United States Patent 8,461,315 (MICRORNAS AND USES THEREOF) - sequence listing, part 8

SEQ ID NO: 190798 - RNA, 64 nt, Homo Sapiens; identical to SEQ ID NO: 88106

SEQ ID NO: 190799 - RNA, 64 nt, Homo Sapiens; identical to SEQ ID NO: 88107

SEQ ID NO: 190800 - RNA, 64 nt, Homo Sapiens; identical to SEQ ID NO: 88108

SEQ ID NO: 190801 - RNA, 64 nt, Homo Sapiens; identical to SEQ ID NO: 88109

SEQ ID NO: 190802 - RNA, 64 nt, Homo Sapiens; identical to SEQ ID NO: 88110

SEQ ID NO: 190803 - RNA, 64 nt, Homo Sapiens; identical to SEQ ID NO: 88111

SEQ ID NO: 190804 - RNA, 64 nt, Homo Sapiens; identical to SEQ ID NO: 88112

SEQ ID NO: 190805 - RNA, 64 nt, Homo Sapiens; identical to SEQ ID NO: 88113

SEQ ID NO: 190806 - RNA, 64 nt, Homo Sapiens; identical to SEQ ID NO: 88114

SEQ ID NO: 190807 - RNA, 64 nt, Homo Sapiens; identical to SEQ ID NO: 88115

SEQ ID NO: 190808 - RNA, 64 nt, Homo Sapiens; identical to SEQ ID NO: 88116

SEQ ID NO: 190809 - RNA, 64 nt, Homo Sapiens; identical to SEQ ID NO: 88117

SEQ ID NO: 190810 - RNA, 64 nt, Homo Sapiens; identical to SEQ ID NO: 88118

SEQ ID NO: 190811 - RNA, 64 nt, Homo Sapiens; identical to SEQ ID NO: 88119

SEQ ID NO: 190812 - RNA, 64 nt, Homo Sapiens; identical to SEQ ID NO: 88120

SEQ ID NO: 190813 - RNA, 64 nt, Homo Sapiens; identical to SEQ ID NO: 88121

SEQ ID NO: 190814 - RNA, 64 nt, Homo Sapiens; identical to SEQ ID NO: 88122

SEQ ID NO: 190815 - RNA, 64 nt, Homo Sapiens; identical to SEQ ID NO: 88123

SEQ ID NO: 190816 - RNA, 64 nt, Homo Sapiens; identical to SEQ ID NO: 88124

SEQ ID NO: 190817 - RNA, 64 nt, Homo Sapiens; identical to SEQ ID NO: 88125

SEQ ID NO: 190818 - RNA, 64 nt, Homo Sapiens; identical to SEQ ID NO: 88126

SEQ ID NO: 190819 - RNA, 64 nt, Homo Sapiens
aauguuuaaaucgcuaaaggaaaauacaguaagugcuugaaagaugaaggaccaaaaggccaaa

SEQ ID NO: 190820 - RNA, 64 nt, Homo Sapiens
uacuggcacuggaagaguuuaguguuucuuguaugcuugaaaauaaaguauguacuguuuugaa

SEQ ID NO: 190821 - RNA, 64 nt, Homo Sapiens
cugggugagucugccaacucacaggugcuuuuaggcuugaaaucuccauccuaucauuuccguu

SEQ ID NO: 190822 - RNA, 64 nt, Homo Sapiens
aguuuuguuugguuuacuuucaaaagaguagaaagcuugaaaagauucugaaaccacaguuuca

SEQ ID NO: 190823 - RNA, 64 nt, Homo Sapiens
uccagcugggccaugucagucucaucgucccaaggcuugaaauccagcaggauggaggacuugg

SEQ ID NO: 190824 - RNA, 64 nt, Homo Sapiens
ccaguguuggugaaucuuuuggccuuuccccaaugcuugaaagaagaucaccacugcuggaggc

SEQ ID NO: 190825 - RNA, 64 nt, Homo Sapiens
agggugauaauaaucuccauaguuauuugaaguggcuugaaaaaggcaagauugacuuuuauga

SEQ ID NO: 190826 - RNA, 64 nt, Homo Sapiens
aucauaacacucucggucacauguuuuuccuucagcuugaaagcuuuuuuuuaaaaggaaaaga

SEQ ID NO: 190827 - RNA, 64 nt, Homo Sapiens
gcccaguuugucuuucagaaggugacuuucaugugcuugaaaaguuuaauauuugaauauugug

SEQ ID NO: 190828 - RNA, 64 nt, Homo Sapiens
guuguuuucuuuaggagucuaccuuuguguaugugcuugaaaguauuuuuguaauccaagaaug

SEQ ID NO: 190829 - RNA, 64 nt, Homo Sapiens
ugugcuaccaguuugcugguggcuaacggcuugugcuugaaagucuucugaagucugaugugaa

SEQ ID NO: 190830 - RNA, 64 nt, Homo Sapiens
ugcaugcauguugaaauuuuuuagcaguacuuuagcuugaaaguacucguacaaauacuguuag

SEQ ID NO: 190831 - RNA, 64 nt, Homo Sapiens
gauuagcauacaucuaauguuuugaaguuugacugcuugaaaaauaguaaauaaaacaguguau

SEQ ID NO: 190832 - RNA, 64 nt, Homo Sapiens
aaaaguucaugaaguaccaaugaaacaaauauuugcuugaaaaaaaacugucagaauuguuaac

SEQ ID NO: 190833 - RNA, 62 nt, Homo Sapiens; identical to SEQ ID NO: 64857

SEQ ID NO: 190834 - RNA, 62 nt, Homo Sapiens; identical to SEQ ID NO: 64858

SEQ ID NO: 190835 - RNA, 62 nt, Homo Sapiens; identical to SEQ ID NO: 64859

SEQ ID NO: 190836 - RNA, 62 nt, Homo Sapiens; identical to SEQ ID NO: 64860

SEQ ID NO: 190837 - RNA, 62 nt, Homo Sapiens; identical to SEQ ID NO: 64861

SEQ ID NO: 190838 - RNA, 62 nt, Homo Sapiens; identical to SEQ ID NO: 64862

SEQ ID NO: 190839 - RNA, 62 nt, Homo Sapiens; identical to SEQ ID NO: 64863

SEQ ID NO: 190840 - RNA, 62 nt, Homo Sapiens; identical to SEQ ID NO: 64864

SEQ ID NO: 190841 - RNA, 62 nt, Homo Sapiens; identical to SEQ ID NO: 64865

SEQ ID NO: 190842 - RNA, 62 nt, Homo Sapiens; identical to SEQ ID NO: 64866

SEQ ID NO: 190843 - RNA, 62 nt, Homo Sapiens; identical to SEQ ID NO: 64867

SEQ ID NO: 190844 - RNA, 62 nt, Homo Sapiens; identical to SEQ ID NO: 64868

SEQ ID NO: 190845 - RNA, 62 nt, Homo Sapiens; identical to SEQ ID NO: 64869

SEQ ID NO: 190846 - RNA, 62 nt, Homo Sapiens; identical to SEQ ID NO: 64870

SEQ ID NO: 190847 - RNA, 62 nt, Homo Sapiens; identical to SEQ ID NO: 64871

SEQ ID NO: 190848 - RNA, 62 nt, Homo Sapiens; identical to SEQ ID NO: 64872

SEQ ID NO: 190849 - RNA, 62 nt, Homo Sapiens; identical to SEQ ID NO: 64873

SEQ ID NO: 190850 - RNA, 62 nt, Homo Sapiens; identical to SEQ ID NO: 64874

SEQ ID NO: 190851 - RNA, 62 nt, Homo Sapiens; identical to SEQ ID NO: 64875

SEQ ID NO: 190852 - RNA, 62 nt, Homo Sapiens; identical to SEQ ID NO: 64876

SEQ ID NO: 190853 - RNA, 62 nt, Homo Sapiens; identical to SEQ ID NO: 64877

SEQ ID NO: 190854 - RNA, 62 nt, Homo Sapiens; identical to SEQ ID NO: 64878

SEQ ID NO: 190855 - RNA, 62 nt, Homo Sapiens; identical to SEQ ID NO: 64879

SEQ ID NO: 190856 - RNA, 62 nt, Homo Sapiens; identical to SEQ ID NO: 64880

SEQ ID NO: 190857 - RNA, 62 nt, Homo Sapiens; identical to SEQ ID NO: 64881

SEQ ID NO: 190858 - RNA, 62 nt, Homo Sapiens; identical to SEQ ID NO: 64882

SEQ ID NO: 190859 - RNA, 62 nt, Homo Sapiens; identical to SEQ ID NO: 64883

SEQ ID NO: 190860 - RNA, 62 nt, Homo Sapiens; identical to SEQ ID NO: 64884

SEQ ID NO: 190861 - RNA, 62 nt, Homo Sapiens; identical to SEQ ID NO: 64885

SEQ ID NO: 190862 - RNA, 62 nt, Homo Sapiens; identical to SEQ ID NO: 64886

SEQ ID NO: 190863 - RNA, 62 nt, Homo Sapiens; identical to SEQ ID NO: 64887

SEQ ID NO: 190864 - RNA, 62 nt, Homo Sapiens; identical to SEQ ID NO: 64888

SEQ ID NO: 190865 - RNA, 62 nt, Homo Sapiens; identical to SEQ ID NO: 64889

SEQ ID NO: 190866 - RNA, 62 nt, Homo Sapiens; identical to SEQ ID NO: 64890

SEQ ID NO: 190867 - RNA, 62 nt, Homo Sapiens; identical to SEQ ID NO: 64891

SEQ ID NO: 190868 - RNA, 62 nt, Homo Sapiens; identical to SEQ ID NO: 64892

SEQ ID NO: 190869 - RNA, 62 nt, Homo Sapiens; identical to SEQ ID NO: 64893

SEQ ID NO: 190870 - RNA, 62 nt, Homo Sapiens; identical to SEQ ID NO: 64894

SEQ ID NO: 190871 - RNA, 62 nt, Homo Sapiens; identical to SEQ ID NO: 64895

SEQ ID NO: 190872 - RNA, 62 nt, Homo Sapiens; identical to SEQ ID NO: 64896

SEQ ID NO: 190873 - RNA, 62 nt, Homo Sapiens; identical to SEQ ID NO: 64897

SEQ ID NO: 190874 - RNA, 62 nt, Homo Sapiens; identical to SEQ ID NO: 64898

SEQ ID NO: 190875 - RNA, 62 nt, Homo Sapiens; identical to SEQ ID NO: 64899

SEQ ID NO: 190876 - RNA, 62 nt, Homo Sapiens; identical to SEQ ID NO: 64900

SEQ ID NO: 190877 - RNA, 62 nt, Homo Sapiens; identical to SEQ ID NO: 64901

SEQ ID NO: 190878 - RNA, 62 nt, Homo Sapiens; identical to SEQ ID NO: 64902

SEQ ID NO: 190879 - RNA, 62 nt, Homo Sapiens; identical to SEQ ID NO: 64903

SEQ ID NO: 190880 - RNA, 62 nt, Homo Sapiens; identical to SEQ ID NO: 64904

SEQ ID NO: 190881 - RNA, 62 nt, Homo Sapiens; identical to SEQ ID NO: 64905

SEQ ID NO: 190882 - RNA, 62 nt, Homo Sapiens; identical to SEQ ID NO: 64906

SEQ ID NO: 190883 - RNA, 62 nt, Homo Sapiens; identical to SEQ ID NO: 64907

SEQ ID NO: 190884 - RNA, 62 nt, Homo Sapiens; identical to SEQ ID NO: 64908

SEQ ID NO: 190885 - RNA, 62 nt, Homo Sapiens; identical to SEQ ID NO: 64909

SEQ ID NO: 190886 - RNA, 62 nt, Homo Sapiens; identical to SEQ ID NO: 64910

SEQ ID NO: 190887 - RNA, 62 nt, Homo Sapiens; identical to SEQ ID NO: 64911

SEQ ID NO: 190888 - RNA, 62 nt, Homo Sapiens; identical to SEQ ID NO: 64912

SEQ ID NO: 190889 - RNA, 62 nt, Homo Sapiens; identical to SEQ ID NO: 64913

SEQ ID NO: 190890 - RNA, 62 nt, Homo Sapiens; identical to SEQ ID NO: 64914

SEQ ID NO: 190891 - RNA, 62 nt, Homo Sapiens; identical to SEQ ID NO: 64915

SEQ ID NO: 190892 - RNA, 62 nt, Homo Sapiens; identical to SEQ ID NO: 64916

SEQ ID NO: 190893 - RNA, 62 nt, Homo Sapiens; identical to SEQ ID NO: 64917

SEQ ID NO: 190894 - RNA, 62 nt, Homo Sapiens; identical to SEQ ID NO: 64918

SEQ ID NO: 190895 - RNA, 62 nt, Homo Sapiens; identical to SEQ ID NO: 64919

SEQ ID NO: 190896 - RNA, 62 nt, Homo Sapiens; identical to SEQ ID NO: 64920

SEQ ID NO: 190897 - RNA, 62 nt, Homo Sapiens; identical to SEQ ID NO: 64921

SEQ ID NO: 190898 - RNA, 62 nt, Homo Sapiens; identical to SEQ ID NO: 64922

SEQ ID NO: 190899 - RNA, 62 nt, Homo Sapiens; identical to SEQ ID NO: 64923

SEQ ID NO: 190900 - RNA, 62 nt, Homo Sapiens; identical to SEQ ID NO: 64924

SEQ ID NO: 190901 - RNA, 62 nt, Homo Sapiens; identical to SEQ ID NO: 64925

SEQ ID NO: 190902 - RNA, 62 nt, Homo Sapiens; identical to SEQ ID NO: 64926

SEQ ID NO: 190903 - RNA, 62 nt, Homo Sapiens; identical to SEQ ID NO: 64927

SEQ ID NO: 190904 - RNA, 62 nt, Homo Sapiens; identical to SEQ ID NO: 64928

SEQ ID NO: 190905 - RNA, 62 nt, Homo Sapiens; identical to SEQ ID NO: 64929

SEQ ID NO: 190906 - RNA, 62 nt, Homo Sapiens; identical to SEQ ID NO: 64930

SEQ ID NO: 190907 - RNA, 62 nt, Homo Sapiens; identical to SEQ ID NO: 64931

SEQ ID NO: 190908 - RNA, 62 nt, Homo Sapiens; identical to SEQ ID NO: 64932

SEQ ID NO: 190909 - RNA, 62 nt, Homo Sapiens; identical to SEQ ID NO: 64933

SEQ ID NO: 190910 - RNA, 62 nt, Homo Sapiens; identical to SEQ ID NO: 64934

SEQ ID NO: 190911 - RNA, 62 nt, Homo Sapiens; identical to SEQ ID NO: 64935

SEQ ID NO: 190912 - RNA, 62 nt, Homo Sapiens; identical to SEQ ID NO: 64936

SEQ ID NO: 190913 - RNA, 62 nt, Homo Sapiens; identical to SEQ ID NO: 64937

SEQ ID NO: 190914 - RNA, 62 nt, Homo Sapiens; identical to SEQ ID NO: 64938

SEQ ID NO: 190915 - RNA, 62 nt, Homo Sapiens; identical to SEQ ID NO: 64939

SEQ ID NO: 190916 - RNA, 62 nt, Homo Sapiens; identical to SEQ ID NO: 64940

SEQ ID NO: 190917 - RNA, 62 nt, Homo Sapiens; identical to SEQ ID NO: 64941

SEQ ID NO: 190918 - RNA, 62 nt, Homo Sapiens; identical to SEQ ID NO: 64942

SEQ ID NO: 190919 - RNA, 62 nt, Homo Sapiens; identical to SEQ ID NO: 64943

SEQ ID NO: 190920 - RNA, 62 nt, Homo Sapiens; identical to SEQ ID NO: 64944

SEQ ID NO: 190921 - RNA, 62 nt, Homo Sapiens; identical to SEQ ID NO: 64945

SEQ ID NO: 190922 - RNA, 62 nt, Homo Sapiens; identical to SEQ ID NO: 64946

SEQ ID NO: 190923 - RNA, 62 nt, Homo Sapiens; identical to SEQ ID NO: 64947

SEQ ID NO: 190924 - RNA, 62 nt, Homo Sapiens; identical to SEQ ID NO: 64948

SEQ ID NO: 190925 - RNA, 62 nt, Homo Sapiens; identical to SEQ ID NO: 64949

SEQ ID NO: 190926 - RNA, 62 nt, Homo Sapiens; identical to SEQ ID NO: 64950

SEQ ID NO: 190927 - RNA, 62 nt, Homo Sapiens; identical to SEQ ID NO: 64951

SEQ ID NO: 190928 - RNA, 62 nt, Homo Sapiens; identical to SEQ ID NO: 64952

SEQ ID NO: 190929 - RNA, 62 nt, Homo Sapiens; identical to SEQ ID NO: 64953

SEQ ID NO: 190930 - RNA, 62 nt, Homo Sapiens; identical to SEQ ID NO: 64954

SEQ ID NO: 190931 - RNA, 62 nt, Homo Sapiens; identical to SEQ ID NO: 64955

SEQ ID NO: 190932 - RNA, 62 nt, Homo Sapiens; identical to SEQ ID NO: 64956

SEQ ID NO: 190933 - RNA, 62 nt, Homo Sapiens; identical to SEQ ID NO: 64957

SEQ ID NO: 190934 - RNA, 62 nt, Homo Sapiens; identical to SEQ ID NO: 64958

SEQ ID NO: 190935 - RNA, 62 nt, Homo Sapiens; identical to SEQ ID NO: 64959

SEQ ID NO: 190936 - RNA, 62 nt, Homo Sapiens; identical to SEQ ID NO: 64960

SEQ ID NO: 190937 - RNA, 62 nt, Homo Sapiens; identical to SEQ ID NO: 64961

SEQ ID NO: 190938 - RNA, 62 nt, Homo Sapiens; identical to SEQ ID NO: 64962

SEQ ID NO: 190939 - RNA, 62 nt, Homo Sapiens; identical to SEQ ID NO: 64963

SEQ ID NO: 190940 - RNA, 62 nt, Homo Sapiens; identical to SEQ ID NO: 64964

SEQ ID NO: 190941 - RNA, 62 nt, Homo Sapiens; identical to SEQ ID NO: 64965

SEQ ID NO: 190942 - RNA, 62 nt, Homo Sapiens; identical to SEQ ID NO: 64966

SEQ ID NO: 190943 - RNA, 62 nt, Homo Sapiens; identical to SEQ ID NO: 64967

SEQ ID NO: 190944 - RNA, 62 nt, Homo Sapiens; identical to SEQ ID NO: 64968

SEQ ID NO: 190945 - RNA, 62 nt, Homo Sapiens; identical to SEQ ID NO: 64969

SEQ ID NO: 190946 - RNA, 62 nt, Homo Sapiens; identical to SEQ ID NO: 64970

SEQ ID NO: 190947 - RNA, 62 nt, Homo Sapiens; identical to SEQ ID NO: 64971

SEQ ID NO: 190948 - RNA, 62 nt, Homo Sapiens; identical to SEQ ID NO: 64972

SEQ ID NO: 190949 - RNA, 62 nt, Homo Sapiens; identical to SEQ ID NO: 64973

SEQ ID NO: 190950 - RNA, 62 nt, Homo Sapiens; identical to SEQ ID NO: 64974

SEQ ID NO: 190951 - RNA, 62 nt, Homo Sapiens; identical to SEQ ID NO: 64975

SEQ ID NO: 190952 - RNA, 62 nt, Homo Sapiens; identical to SEQ ID NO: 64976

SEQ ID NO: 190953 - RNA, 62 nt, Homo Sapiens; identical to SEQ ID NO: 64977

SEQ ID NO: 190954 - RNA, 62 nt, Homo Sapiens; identical to SEQ ID NO: 64978

SEQ ID NO: 190955 - RNA, 62 nt, Homo Sapiens; identical to SEQ ID NO: 64979

SEQ ID NO: 190956 - RNA, 62 nt, Homo Sapiens; identical to SEQ ID NO: 64980

SEQ ID NO: 190957 - RNA, 62 nt, Homo Sapiens; identical to SEQ ID NO: 64981

SEQ ID NO: 190958 - RNA, 62 nt, Homo Sapiens; identical to SEQ ID NO: 64982

SEQ ID NO: 190959 - RNA, 62 nt, Homo Sapiens; identical to SEQ ID NO: 64983

SEQ ID NO: 190960 - RNA, 62 nt, Homo Sapiens; identical to SEQ ID NO: 64984

SEQ ID NO: 190961 - RNA, 62 nt, Homo Sapiens; identical to SEQ ID NO: 64985

SEQ ID NO: 190962 - RNA, 62 nt, Homo Sapiens; identical to SEQ ID NO: 64986

SEQ ID NO: 190963 - RNA, 62 nt, Homo Sapiens; identical to SEQ ID NO: 64987

SEQ ID NO: 190964 - RNA, 62 nt, Homo Sapiens; identical to SEQ ID NO: 64988

SEQ ID NO: 190965 - RNA, 62 nt, Homo Sapiens; identical to SEQ ID NO: 64989

SEQ ID NO: 190966 - RNA, 62 nt, Homo Sapiens; identical to SEQ ID NO: 64990

SEQ ID NO: 190967 - RNA, 62 nt, Homo Sapiens; identical to SEQ ID NO: 64991

SEQ ID NO: 190968 - RNA, 62 nt, Homo Sapiens; identical to SEQ ID NO: 64992

SEQ ID NO: 190969 - RNA, 62 nt, Homo Sapiens; identical to SEQ ID NO: 64993

SEQ ID NO: 190970 - RNA, 62 nt, Homo Sapiens; identical to SEQ ID NO: 64994

SEQ ID NO: 190971 - RNA, 56 nt, Homo Sapiens; identical to SEQ ID NO: 61369

SEQ ID NO: 190972 - RNA, 62 nt, Homo Sapiens; identical to SEQ ID NO: 64996

SEQ ID NO: 190973 - RNA, 62 nt, Homo Sapiens; identical to SEQ ID NO: 64997

SEQ ID NO: 190974 - RNA, 62 nt, Homo Sapiens; identical to SEQ ID NO: 64998

SEQ ID NO: 190975 - RNA, 62 nt, Homo Sapiens; identical to SEQ ID NO: 64999

SEQ ID NO: 190976 - RNA, 62 nt, Homo Sapiens; identical to SEQ ID NO: 65000

SEQ ID NO: 190977 - RNA, 62 nt, Homo Sapiens; identical to SEQ ID NO: 65001

SEQ ID NO: 190978 - RNA, 62 nt, Homo Sapiens; identical to SEQ ID NO: 65002

SEQ ID NO: 190979 - RNA, 62 nt, Homo Sapiens; identical to SEQ ID NO: 65003

SEQ ID NO: 190980 - RNA, 62 nt, Homo Sapiens; identical to SEQ ID NO: 65004

SEQ ID NO: 190981 - RNA, 62 nt, Homo Sapiens; identical to SEQ ID NO: 65005

SEQ ID NO: 190982 - RNA, 62 nt, Homo Sapiens; identical to SEQ ID NO: 65006

SEQ ID NO: 190983 - RNA, 62 nt, Homo Sapiens; identical to SEQ ID NO: 65007

SEQ ID NO: 190984 - RNA, 62 nt, Homo Sapiens; identical to SEQ ID NO: 65008

SEQ ID NO: 190985 - RNA, 62 nt, Homo Sapiens; identical to SEQ ID NO: 65009

SEQ ID NO: 190986 - RNA, 62 nt, Homo Sapiens; identical to SEQ ID NO: 65010

SEQ ID NO: 190987 - RNA, 62 nt, Homo Sapiens; identical to SEQ ID NO: 65011

SEQ ID NO: 190988 - RNA, 62 nt, Homo Sapiens; identical to SEQ ID NO: 65012

SEQ ID NO: 190989 - RNA, 62 nt, Homo Sapiens; identical to SEQ ID NO: 65013

SEQ ID NO: 190990 - RNA, 62 nt, Homo Sapiens; identical to SEQ ID NO: 65014

SEQ ID NO: 190991 - RNA, 62 nt, Homo Sapiens; identical to SEQ ID NO: 65015

SEQ ID NO: 190992 - RNA, 62 nt, Homo Sapiens; identical to SEQ ID NO: 65016

SEQ ID NO: 190993 - RNA, 62 nt, Homo Sapiens; identical to SEQ ID NO: 65017

SEQ ID NO: 190994 - RNA, 62 nt, Homo Sapiens; identical to SEQ ID NO: 65018

SEQ ID NO: 190995 - RNA, 62 nt, Homo Sapiens; identical to SEQ ID NO: 65019

SEQ ID NO: 190996 - RNA, 62 nt, Homo Sapiens; identical to SEQ ID NO: 65020

SEQ ID NO: 190997 - RNA, 62 nt, Homo Sapiens; identical to SEQ ID NO: 65021

SEQ ID NO: 190998 - RNA, 62 nt, Homo Sapiens; identical to SEQ ID NO: 65022

SEQ ID NO: 190999 - RNA, 62 nt, Homo Sapiens; identical to SEQ ID NO: 65023

SEQ ID NO: 191000 - RNA, 62 nt, Homo Sapiens; identical to SEQ ID NO: 65024

SEQ ID NO: 191001 - RNA, 62 nt, Homo Sapiens; identical to SEQ ID NO: 65025

SEQ ID NO: 191002 - RNA, 62 nt, Homo Sapiens; identical to SEQ ID NO: 65026

SEQ ID NO: 191003 - RNA, 62 nt, Homo Sapiens; identical to SEQ ID NO: 65027

SEQ ID NO: 191004 - RNA, 62 nt, Homo Sapiens; identical to SEQ ID NO: 65028

SEQ ID NO: 191005 - RNA, 62 nt, Homo Sapiens; identical to SEQ ID NO: 65029

SEQ ID NO: 191006 - RNA, 62 nt, Homo Sapiens; identical to SEQ ID NO: 65030

SEQ ID NO: 191007 - RNA, 62 nt, Homo Sapiens; identical to SEQ ID NO: 65031

SEQ ID NO: 191008 - RNA, 62 nt, Homo Sapiens; identical to SEQ ID NO: 65032

SEQ ID NO: 191009 - RNA, 62 nt, Homo Sapiens; identical to SEQ ID NO: 65033

SEQ ID NO: 191010 - RNA, 62 nt, Homo Sapiens; identical to SEQ ID NO: 65034

SEQ ID NO: 191011 - RNA, 62 nt, Homo Sapiens; identical to SEQ ID NO: 65035

SEQ ID NO: 191012 - RNA, 62 nt, Homo Sapiens; identical to SEQ ID NO: 65036

SEQ ID NO: 191013 - RNA, 62 nt, Homo Sapiens; identical to SEQ ID NO: 65037

SEQ ID NO: 191014 - RNA, 62 nt, Homo Sapiens; identical to SEQ ID NO: 65038

SEQ ID NO: 191015 - RNA, 62 nt, Homo Sapiens; identical to SEQ ID NO: 65039

SEQ ID NO: 191016 - RNA, 62 nt, Homo Sapiens; identical to SEQ ID NO: 65040

SEQ ID NO: 191017 - RNA, 62 nt, Homo Sapiens; identical to SEQ ID NO: 65041

SEQ ID NO: 191018 - RNA, 62 nt, Homo Sapiens; identical to SEQ ID NO: 65042

SEQ ID NO: 191019 - RNA, 62 nt, Homo Sapiens; identical to SEQ ID NO: 65043

SEQ ID NO: 191020 - RNA, 62 nt, Homo Sapiens; identical to SEQ ID NO: 65044

SEQ ID NO: 191021 - RNA, 62 nt, Homo Sapiens; identical to SEQ ID NO: 65045

SEQ ID NO: 191022 - RNA, 62 nt, Homo Sapiens; identical to SEQ ID NO: 65046

SEQ ID NO: 191023 - RNA, 62 nt, Homo Sapiens; identical to SEQ ID NO: 65047

SEQ ID NO: 191024 - RNA, 62 nt, Homo Sapiens; identical to SEQ ID NO: 65048

SEQ ID NO: 191025 - RNA, 62 nt, Homo Sapiens; identical to SEQ ID NO: 65049

SEQ ID NO: 191026 - RNA, 62 nt, Homo Sapiens; identical to SEQ ID NO: 65050

SEQ ID NO: 191027 - RNA, 62 nt, Homo Sapiens; identical to SEQ ID NO: 65051

SEQ ID NO: 191028 - RNA, 62 nt, Homo Sapiens; identical to SEQ ID NO: 65052

SEQ ID NO: 191029 - RNA, 62 nt, Homo Sapiens; identical to SEQ ID NO: 65053

SEQ ID NO: 191030 - RNA, 62 nt, Homo Sapiens; identical to SEQ ID NO: 65054

SEQ ID NO: 191031 - RNA, 62 nt, Homo Sapiens; identical to SEQ ID NO: 65055

SEQ ID NO: 191032 - RNA, 62 nt, Homo Sapiens; identical to SEQ ID NO: 65056

SEQ ID NO: 191033 - RNA, 62 nt, Homo Sapiens; identical to SEQ ID NO: 65057

SEQ ID NO: 191034 - RNA, 62 nt, Homo Sapiens; identical to SEQ ID NO: 65058

SEQ ID NO: 191035 - RNA, 62 nt, Homo Sapiens; identical to SEQ ID NO: 65059

SEQ ID NO: 191036 - RNA, 62 nt, Homo Sapiens; identical to SEQ ID NO: 65060

SEQ ID NO: 191037 - RNA, 62 nt, Homo Sapiens; identical to SEQ ID NO: 65061

SEQ ID NO: 191038 - RNA, 62 nt, Homo Sapiens; identical to SEQ ID NO: 65062

SEQ ID NO: 191039 - RNA, 62 nt, Homo Sapiens; identical to SEQ ID NO: 65063

SEQ ID NO: 191040 - RNA, 62 nt, Homo Sapiens; identical to SEQ ID NO: 65064

SEQ ID NO: 191041 - RNA, 62 nt, Homo Sapiens; identical to SEQ ID NO: 65065

SEQ ID NO: 191042 - RNA, 62 nt, Homo Sapiens; identical to SEQ ID NO: 65066

SEQ ID NO: 191043 - RNA, 62 nt, Homo Sapiens; identical to SEQ ID NO: 65067

SEQ ID NO: 191044 - RNA, 62 nt, Homo Sapiens; identical to SEQ ID NO: 65068

SEQ ID NO: 191045 - RNA, 62 nt, Homo Sapiens; identical to SEQ ID NO: 65069

SEQ ID NO: 191046 - RNA, 62 nt, Homo Sapiens; identical to SEQ ID NO: 65070

SEQ ID NO: 191047 - RNA, 62 nt, Homo Sapiens; identical to SEQ ID NO: 65071

SEQ ID NO: 191048 - RNA, 62 nt, Homo Sapiens; identical to SEQ ID NO: 65072

SEQ ID NO: 191049 - RNA, 62 nt, Homo Sapiens; identical to SEQ ID NO: 65073

SEQ ID NO: 191050 - RNA, 62 nt, Homo Sapiens; identical to SEQ ID NO: 65074

SEQ ID NO: 191051 - RNA, 62 nt, Homo Sapiens; identical to SEQ ID NO: 65075

SEQ ID NO: 191052 - RNA, 62 nt, Homo Sapiens; identical to SEQ ID NO: 65076

SEQ ID NO: 191053 - RNA, 62 nt, Homo Sapiens; identical to SEQ ID NO: 65077

SEQ ID NO: 191054 - RNA, 62 nt, Homo Sapiens; identical to SEQ ID NO: 65078

SEQ ID NO: 191055 - RNA, 62 nt, Homo Sapiens; identical to SEQ ID NO: 65079

SEQ ID NO: 191056 - RNA, 62 nt, Homo Sapiens; identical to SEQ ID NO: 65080

SEQ ID NO: 191057 - RNA, 62 nt, Homo Sapiens; identical to SEQ ID NO: 65081

SEQ ID NO: 191058 - RNA, 62 nt, Homo Sapiens; identical to SEQ ID NO: 65082

SEQ ID NO: 191059 - RNA, 62 nt, Homo Sapiens; identical to SEQ ID NO: 65083

SEQ ID NO: 191060 - RNA, 62 nt, Homo Sapiens; identical to SEQ ID NO: 65084

SEQ ID NO: 191061 - RNA, 62 nt, Homo Sapiens; identical to SEQ ID NO: 65085

SEQ ID NO: 191062 - RNA, 62 nt, Homo Sapiens; identical to SEQ ID NO: 65086

SEQ ID NO: 191063 - RNA, 60 nt, Homo Sapiens; identical to SEQ ID NO: 65087

SEQ ID NO: 191064 - RNA, 62 nt, Homo Sapiens; identical to SEQ ID NO: 65088

SEQ ID NO: 191065 - RNA, 62 nt, Homo Sapiens; identical to SEQ ID NO: 65089

SEQ ID NO: 191066 - RNA, 62 nt, Homo Sapiens; identical to SEQ ID NO: 65090

SEQ ID NO: 191067 - RNA, 62 nt, Homo Sapiens; identical to SEQ ID NO: 65091

SEQ ID NO: 191068 - RNA, 62 nt, Homo Sapiens; identical to SEQ ID NO: 65092

SEQ ID NO: 191069 - RNA, 62 nt, Homo Sapiens; identical to SEQ ID NO: 65093

SEQ ID NO: 191070 - RNA, 51 nt, Homo Sapiens; identical to SEQ ID NO: 65094

SEQ ID NO: 191071 - RNA, 62 nt, Homo Sapiens; identical to SEQ ID NO: 65095

SEQ ID NO: 191072 - RNA, 62 nt, Homo Sapiens; identical to SEQ ID NO: 65096

SEQ ID NO: 191073 - RNA, 62 nt, Homo Sapiens; identical to SEQ ID NO: 65097

SEQ ID NO: 191074 - RNA, 62 nt, Homo Sapiens; identical to SEQ ID NO: 65098

SEQ ID NO: 191075 - RNA, 62 nt, Homo Sapiens; identical to SEQ ID NO: 65099

SEQ ID NO: 191076 - RNA, 62 nt, Homo Sapiens; identical to SEQ ID NO: 65100

SEQ ID NO: 191077 - RNA, 62 nt, Homo Sapiens; identical to SEQ ID NO: 65101

SEQ ID NO: 191078 - RNA, 62 nt, Homo Sapiens; identical to SEQ ID NO: 65102

SEQ ID NO: 191079 - RNA, 62 nt, Homo Sapiens; identical to SEQ ID NO: 65103

SEQ ID NO: 191080 - RNA, 62 nt, Homo Sapiens; identical to SEQ ID NO: 65104

SEQ ID NO: 191081 - RNA, 62 nt, Homo Sapiens; identical to SEQ ID NO: 65105

SEQ ID NO: 191082 - RNA, 62 nt, Homo Sapiens; identical to SEQ ID NO: 65106

SEQ ID NO: 191083 - RNA, 62 nt, Homo Sapiens; identical to SEQ ID NO: 65107

SEQ ID NO: 191084 - RNA, 62 nt, Homo Sapiens; identical to SEQ ID NO: 65108

SEQ ID NO: 191085 - RNA, 62 nt, Homo Sapiens; identical to SEQ ID NO: 65109

SEQ ID NO: 191086 - RNA, 62 nt, Homo Sapiens; identical to SEQ ID NO: 65110

SEQ ID NO: 191087 - RNA, 62 nt, Homo Sapiens; identical to SEQ ID NO: 65111

SEQ ID NO: 191088 - RNA, 62 nt, Homo Sapiens; identical to SEQ ID NO: 65112

SEQ ID NO: 191089 - RNA, 62 nt, Homo Sapiens; identical to SEQ ID NO: 65113

SEQ ID NO: 191090 - RNA, 62 nt, Homo Sapiens; identical to SEQ ID NO: 65114

SEQ ID NO: 191091 - RNA, 62 nt, Homo Sapiens; identical to SEQ ID NO: 65115

SEQ ID NO: 191092 - RNA, 62 nt, Homo Sapiens; identical to SEQ ID NO: 65116

SEQ ID NO: 191093 - RNA, 62 nt, Homo Sapiens; identical to SEQ ID NO: 65117

SEQ ID NO: 191094 - RNA, 62 nt, Homo Sapiens; identical to SEQ ID NO: 65118

SEQ ID NO: 191095 - RNA, 62 nt, Homo Sapiens; identical to SEQ ID NO: 65119

SEQ ID NO: 191096 - RNA, 62 nt, Homo Sapiens; identical to SEQ ID NO: 65120

SEQ ID NO: 191097 - RNA, 62 nt, Homo Sapiens; identical to SEQ ID NO: 65121

SEQ ID NO: 191098 - RNA, 62 nt, Homo Sapiens; identical to SEQ ID NO: 65122

SEQ ID NO: 191099 - RNA, 62 nt, Homo Sapiens; identical to SEQ ID NO: 65123

SEQ ID NO: 191100 - RNA, 62 nt, Homo Sapiens; identical to SEQ ID NO: 65124

SEQ ID NO: 191101 - RNA, 62 nt, Homo Sapiens; identical to SEQ ID NO: 65125

SEQ ID NO: 191102 - RNA, 62 nt, Homo Sapiens; identical to SEQ ID NO: 65126

SEQ ID NO: 191103 - RNA, 62 nt, Homo Sapiens; identical to SEQ ID NO: 65127

SEQ ID NO: 191104 - RNA, 62 nt, Homo Sapiens; identical to SEQ ID NO: 65128

SEQ ID NO: 191105 - RNA, 62 nt, Homo Sapiens; identical to SEQ ID NO: 65129

SEQ ID NO: 191106 - RNA, 62 nt, Homo Sapiens; identical to SEQ ID NO: 65130

SEQ ID NO: 191107 - RNA, 62 nt, Homo Sapiens; identical to SEQ ID NO: 65131

SEQ ID NO: 191108 - RNA, 62 nt, Homo Sapiens; identical to SEQ ID NO: 65132

SEQ ID NO: 191109 - RNA, 62 nt, Homo Sapiens; identical to SEQ ID NO: 65133

SEQ ID NO: 191110 - RNA, 62 nt, Homo Sapiens; identical to SEQ ID NO: 65134

SEQ ID NO: 191111 - RNA, 62 nt, Homo Sapiens; identical to SEQ ID NO: 65135

SEQ ID NO: 191112 - RNA, 63 nt, Homo Sapiens; identical to SEQ ID NO: 65136

SEQ ID NO: 191113 - RNA, 63 nt, Homo Sapiens; identical to SEQ ID NO: 65137

SEQ ID NO: 191114 - RNA, 63 nt, Homo Sapiens; identical to SEQ ID NO: 65138

SEQ ID NO: 191115 - RNA, 63 nt, Homo Sapiens; identical to SEQ ID NO: 65139

SEQ ID NO: 191116 - RNA, 63 nt, Homo Sapiens; identical to SEQ ID NO: 65140

SEQ ID NO: 191117 - RNA, 63 nt, Homo Sapiens; identical to SEQ ID NO: 65141

SEQ ID NO: 191118 - RNA, 63 nt, Homo Sapiens; identical to SEQ ID NO: 65142

SEQ ID NO: 191119 - RNA, 63 nt, Homo Sapiens; identical to SEQ ID NO: 65143

SEQ ID NO: 191120 - RNA, 63 nt, Homo Sapiens; identical to SEQ ID NO: 65144

SEQ ID NO: 191121 - RNA, 63 nt, Homo Sapiens; identical to SEQ ID NO: 65145

SEQ ID NO: 191122 - RNA, 63 nt, Homo Sapiens; identical to SEQ ID NO: 65146

SEQ ID NO: 191123 - RNA, 63 nt, Homo Sapiens; identical to SEQ ID NO: 65147

SEQ ID NO: 191124 - RNA, 63 nt, Homo Sapiens; identical to SEQ ID NO: 65148

SEQ ID NO: 191125 - RNA, 63 nt, Homo Sapiens; identical to SEQ ID NO: 65149

SEQ ID NO: 191126 - RNA, 63 nt, Homo Sapiens; identical to SEQ ID NO: 65150

SEQ ID NO: 191127 - RNA, 63 nt, Homo Sapiens; identical to SEQ ID NO: 65151

SEQ ID NO: 191128 - RNA, 63 nt, Homo Sapiens; identical to SEQ ID NO: 65152

SEQ ID NO: 191129 - RNA, 63 nt, Homo Sapiens; identical to SEQ ID NO: 65153

SEQ ID NO: 191130 - RNA, 63 nt, Homo Sapiens; identical to SEQ ID NO: 65154

SEQ ID NO: 191131 - RNA, 63 nt, Homo Sapiens; identical to SEQ ID NO: 65155

SEQ ID NO: 191132 - RNA, 63 nt, Homo Sapiens; identical to SEQ ID NO: 65156

SEQ ID NO: 191133 - RNA, 63 nt, Homo Sapiens; identical to SEQ ID NO: 65157

SEQ ID NO: 191134 - RNA, 63 nt, Homo Sapiens; identical to SEQ ID NO: 65158

SEQ ID NO: 191135 - RNA, 63 nt, Homo Sapiens; identical to SEQ ID NO: 65159

SEQ ID NO: 191136 - RNA, 63 nt, Homo Sapiens; identical to SEQ ID NO: 65160

SEQ ID NO: 191137 - RNA, 63 nt, Homo Sapiens; identical to SEQ ID NO: 65161

SEQ ID NO: 191138 - RNA, 63 nt, Homo Sapiens; identical to SEQ ID NO: 65162

SEQ ID NO: 191139 - RNA, 63 nt, Homo Sapiens; identical to SEQ ID NO: 65163

SEQ ID NO: 191140 - RNA, 63 nt, Homo Sapiens; identical to SEQ ID NO: 65164

SEQ ID NO: 191141 - RNA, 63 nt, Homo Sapiens; identical to SEQ ID NO: 65165

SEQ ID NO: 191142 - RNA, 63 nt, Homo Sapiens; identical to SEQ ID NO: 65166

SEQ ID NO: 191143 - RNA, 63 nt, Homo Sapiens; identical to SEQ ID NO: 65167

SEQ ID NO: 191144 - RNA, 63 nt, Homo Sapiens; identical to SEQ ID NO: 65168

SEQ ID NO: 191145 - RNA, 63 nt, Homo Sapiens; identical to SEQ ID NO: 65169

SEQ ID NO: 191146 - RNA, 63 nt, Homo Sapiens; identical to SEQ ID NO: 65170

SEQ ID NO: 191147 - RNA, 63 nt, Homo Sapiens; identical to SEQ ID NO: 65171

SEQ ID NO: 191148 - RNA, 63 nt, Homo Sapiens; identical to SEQ ID NO: 65172

SEQ ID NO: 191149 - RNA, 63 nt, Homo Sapiens; identical to SEQ ID NO: 65173

SEQ ID NO: 191150 - RNA, 63 nt, Homo Sapiens; identical to SEQ ID NO: 65174

SEQ ID NO: 191151 - RNA, 63 nt, Homo Sapiens; identical to SEQ ID NO: 65175

SEQ ID NO: 191152 - RNA, 63 nt, Homo Sapiens; identical to SEQ ID NO: 65176

SEQ ID NO: 191153 - RNA, 63 nt, Homo Sapiens; identical to SEQ ID NO: 65177

SEQ ID NO: 191154 - RNA, 63 nt, Homo Sapiens; identical to SEQ ID NO: 65178

SEQ ID NO: 191155 - RNA, 63 nt, Homo Sapiens; identical to SEQ ID NO: 65179

SEQ ID NO: 191156 - RNA, 63 nt, Homo Sapiens; identical to SEQ ID NO: 65180

SEQ ID NO: 191157 - RNA, 63 nt, Homo Sapiens; identical to SEQ ID NO: 65181

SEQ ID NO: 191158 - RNA, 63 nt, Homo Sapiens; identical to SEQ ID NO: 65182

SEQ ID NO: 191159 - RNA, 63 nt, Homo Sapiens; identical to SEQ ID NO: 65183

SEQ ID NO: 191160 - RNA, 63 nt, Homo Sapiens; identical to SEQ ID NO: 65184

SEQ ID NO: 191161 - RNA, 63 nt, Homo Sapiens; identical to SEQ ID NO: 65185

SEQ ID NO: 191162 - RNA, 63 nt, Homo Sapiens; identical to SEQ ID NO: 65186

SEQ ID NO: 191163 - RNA, 63 nt, Homo Sapiens; identical to SEQ ID NO: 65187

SEQ ID NO: 191164 - RNA, 63 nt, Homo Sapiens; identical to SEQ ID NO: 65188

SEQ ID NO: 191165 - RNA, 63 nt, Homo Sapiens; identical to SEQ ID NO: 65189

SEQ ID NO: 191166 - RNA, 63 nt, Homo Sapiens; identical to SEQ ID NO: 65190

SEQ ID NO: 191167 - RNA, 63 nt, Homo Sapiens; identical to SEQ ID NO: 65191

SEQ ID NO: 191168 - RNA, 63 nt, Homo Sapiens; identical to SEQ ID NO: 65192

SEQ ID NO: 191169 - RNA, 63 nt, Homo Sapiens; identical to SEQ ID NO: 65193

SEQ ID NO: 191170 - RNA, 63 nt, Homo Sapiens; identical to SEQ ID NO: 65194

SEQ ID NO: 191171 - RNA, 63 nt, Homo Sapiens; identical to SEQ ID NO: 65195

SEQ ID NO: 191172 - RNA, 63 nt, Homo Sapiens; identical to SEQ ID NO: 65196

SEQ ID NO: 191173 - RNA, 63 nt, Homo Sapiens; identical to SEQ ID NO: 65197

SEQ ID NO: 191174 - RNA, 63 nt, Homo Sapiens; identical to SEQ ID NO: 65198

SEQ ID NO: 191175 - RNA, 63 nt, Homo Sapiens; identical to SEQ ID NO: 65199

SEQ ID NO: 191176 - RNA, 63 nt, Homo Sapiens; identical to SEQ ID NO: 65200

SEQ ID NO: 191177 - RNA, 63 nt, Homo Sapiens; identical to SEQ ID NO: 65201

SEQ ID NO: 191178 - RNA, 63 nt, Homo Sapiens; identical to SEQ ID NO: 65202

SEQ ID NO: 191179 - RNA, 63 nt, Homo Sapiens; identical to SEQ ID NO: 65203

SEQ ID NO: 191180 - RNA, 63 nt, Homo Sapiens; identical to SEQ ID NO: 65204

SEQ ID NO: 191181 - RNA, 63 nt, Homo Sapiens; identical to SEQ ID NO: 65205

SEQ ID NO: 191182 - RNA, 63 nt, Homo Sapiens; identical to SEQ ID NO: 65206

SEQ ID NO: 191183 - RNA, 63 nt, Homo Sapiens; identical to SEQ ID NO: 65207

SEQ ID NO: 191184 - RNA, 63 nt, Homo Sapiens; identical to SEQ ID NO: 65208

SEQ ID NO: 191185 - RNA, 63 nt, Homo Sapiens; identical to SEQ ID NO: 65209

SEQ ID NO: 191186 - RNA, 63 nt, Homo Sapiens; identical to SEQ ID NO: 65210

SEQ ID NO: 191187 - RNA, 63 nt, Homo Sapiens; identical to SEQ ID NO: 65211

SEQ ID NO: 191188 - RNA, 63 nt, Homo Sapiens; identical to SEQ ID NO: 65212

SEQ ID NO: 191189 - RNA, 63 nt, Homo Sapiens; identical to SEQ ID NO: 65213

SEQ ID NO: 191190 - RNA, 63 nt, Homo Sapiens; identical to SEQ ID NO: 65214

SEQ ID NO: 191191 - RNA, 63 nt, Homo Sapiens; identical to SEQ ID NO: 65215

SEQ ID NO: 191192 - RNA, 63 nt, Homo Sapiens; identical to SEQ ID NO: 65216

SEQ ID NO: 191193 - RNA, 63 nt, Homo Sapiens; identical to SEQ ID NO: 65217

SEQ ID NO: 191194 - RNA, 63 nt, Homo Sapiens; identical to SEQ ID NO: 65218

SEQ ID NO: 191195 - RNA, 63 nt, Homo Sapiens; identical to SEQ ID NO: 65219

SEQ ID NO: 191196 - RNA, 63 nt, Homo Sapiens; identical to SEQ ID NO: 65220

SEQ ID NO: 191197 - RNA, 63 nt, Homo Sapiens; identical to SEQ ID NO: 65221

SEQ ID NO: 191198 - RNA, 63 nt, Homo Sapiens; identical to SEQ ID NO: 65222

SEQ ID NO: 191199 - RNA, 63 nt, Homo Sapiens; identical to SEQ ID NO: 65223

SEQ ID NO: 191200 - RNA, 63 nt, Homo Sapiens; identical to SEQ ID NO: 65224

SEQ ID NO: 191201 - RNA, 63 nt, Homo Sapiens; identical to SEQ ID NO: 65225

SEQ ID NO: 191202 - RNA, 63 nt, Homo Sapiens; identical to SEQ ID NO: 65226

SEQ ID NO: 191203 - RNA, 63 nt, Homo Sapiens; identical to SEQ ID NO: 65227

SEQ ID NO: 191204 - RNA, 63 nt, Homo Sapiens; identical to SEQ ID NO: 65228

SEQ ID NO: 191205 - RNA, 63 nt, Homo Sapiens; identical to SEQ ID NO: 65229

SEQ ID NO: 191206 - RNA, 63 nt, Homo Sapiens; identical to SEQ ID NO: 65230

SEQ ID NO: 191207 - RNA, 63 nt, Homo Sapiens; identical to SEQ ID NO: 65231

SEQ ID NO: 191208 - RNA, 63 nt, Homo Sapiens; identical to SEQ ID NO: 65232

SEQ ID NO: 191209 - RNA, 63 nt, Homo Sapiens; identical to SEQ ID NO: 65233

SEQ ID NO: 191210 - RNA, 63 nt, Homo Sapiens; identical to SEQ ID NO: 65234

SEQ ID NO: 191211 - RNA, 63 nt, Homo Sapiens; identical to SEQ ID NO: 65235

SEQ ID NO: 191212 - RNA, 63 nt, Homo Sapiens; identical to SEQ ID NO: 65236

SEQ ID NO: 191213 - RNA, 63 nt, Homo Sapiens; identical to SEQ ID NO: 65237

SEQ ID NO: 191214 - RNA, 63 nt, Homo Sapiens; identical to SEQ ID NO: 65238

SEQ ID NO: 191215 - RNA, 63 nt, Homo Sapiens; identical to SEQ ID NO: 65239

SEQ ID NO: 191216 - RNA, 63 nt, Homo Sapiens; identical to SEQ ID NO: 65240

SEQ ID NO: 191217 - RNA, 63 nt, Homo Sapiens; identical to SEQ ID NO: 65241

SEQ ID NO: 191218 - RNA, 63 nt, Homo Sapiens; identical to SEQ ID NO: 65242

SEQ ID NO: 191219 - RNA, 63 nt, Homo Sapiens; identical to SEQ ID NO: 65243

SEQ ID NO: 191220 - RNA, 63 nt, Homo Sapiens; identical to SEQ ID NO: 65244

SEQ ID NO: 191221 - RNA, 63 nt, Homo Sapiens; identical to SEQ ID NO: 65245

SEQ ID NO: 191222 - RNA, 63 nt, Homo Sapiens; identical to SEQ ID NO: 65246

SEQ ID NO: 191223 - RNA, 63 nt, Homo Sapiens; identical to SEQ ID NO: 65247

SEQ ID NO: 191224 - RNA, 63 nt, Homo Sapiens; identical to SEQ ID NO: 65248

SEQ ID NO: 191225 - RNA, 63 nt, Homo Sapiens; identical to SEQ ID NO: 65249

SEQ ID NO: 191226 - RNA, 63 nt, Homo Sapiens; identical to SEQ ID NO: 65250

SEQ ID NO: 191227 - RNA, 63 nt, Homo Sapiens; identical to SEQ ID NO: 65251

SEQ ID NO: 191228 - RNA, 63 nt, Homo Sapiens; identical to SEQ ID NO: 65252

SEQ ID NO: 191229 - RNA, 63 nt, Homo Sapiens; identical to SEQ ID NO: 65253

SEQ ID NO: 191230 - RNA, 63 nt, Homo Sapiens; identical to SEQ ID NO: 65254

SEQ ID NO: 191231 - RNA, 63 nt, Homo Sapiens; identical to SEQ ID NO: 65255

SEQ ID NO: 191232 - RNA, 63 nt, Homo Sapiens; identical to SEQ ID NO: 65256

SEQ ID NO: 191233 - RNA, 63 nt, Homo Sapiens; identical to SEQ ID NO: 65257

SEQ ID NO: 191234 - RNA, 63 nt, Homo Sapiens; identical to SEQ ID NO: 65258

SEQ ID NO: 191235 - RNA, 63 nt, Homo Sapiens; identical to SEQ ID NO: 65259

SEQ ID NO: 191236 - RNA, 63 nt, Homo Sapiens; identical to SEQ ID NO: 65260

SEQ ID NO: 191237 - RNA, 63 nt, Homo Sapiens; identical to SEQ ID NO: 65261

SEQ ID NO: 191238 - RNA, 63 nt, Homo Sapiens; identical to SEQ ID NO: 65262

SEQ ID NO: 191239 - RNA, 63 nt, Homo Sapiens; identical to SEQ ID NO: 65263

SEQ ID NO: 191240 - RNA, 63 nt, Homo Sapiens; identical to SEQ ID NO: 65264

SEQ ID NO: 191241 - RNA, 63 nt, Homo Sapiens; identical to SEQ ID NO: 65265

SEQ ID NO: 191242 - RNA, 63 nt, Homo Sapiens; identical to SEQ ID NO: 65266

SEQ ID NO: 191243 - RNA, 63 nt, Homo Sapiens; identical to SEQ ID NO: 65267

SEQ ID NO: 191244 - RNA, 63 nt, Homo Sapiens; identical to SEQ ID NO: 65268

SEQ ID NO: 191245 - RNA, 63 nt, Homo Sapiens; identical to SEQ ID NO: 65269

SEQ ID NO: 191246 - RNA, 63 nt, Homo Sapiens; identical to SEQ ID NO: 65270

SEQ ID NO: 191247 - RNA, 63 nt, Homo Sapiens; identical to SEQ ID NO: 65271

SEQ ID NO: 191248 - RNA, 63 nt, Homo Sapiens; identical to SEQ ID NO: 65272

SEQ ID NO: 191249 - RNA, 63 nt, Homo Sapiens; identical to SEQ ID NO: 65273

SEQ ID NO: 191250 - RNA, 56 nt, Homo Sapiens; identical to SEQ ID NO: 61369

SEQ ID NO: 191251 - RNA, 63 nt, Homo Sapiens; identical to SEQ ID NO: 65275

SEQ ID NO: 191252 - RNA, 63 nt, Homo Sapiens; identical to SEQ ID NO: 65276

SEQ ID NO: 191253 - RNA, 63 nt, Homo Sapiens; identical to SEQ ID NO: 65277

SEQ ID NO: 191254 - RNA, 63 nt, Homo Sapiens; identical to SEQ ID NO: 65278

SEQ ID NO: 191255 - RNA, 63 nt, Homo Sapiens; identical to SEQ ID NO: 65279

SEQ ID NO: 191256 - RNA, 63 nt, Homo Sapiens; identical to SEQ ID NO: 65280

SEQ ID NO: 191257 - RNA, 63 nt, Homo Sapiens; identical to SEQ ID NO: 65281

SEQ ID NO: 191258 - RNA, 63 nt, Homo Sapiens; identical to SEQ ID NO: 65282

SEQ ID NO: 191259 - RNA, 63 nt, Homo Sapiens; identical to SEQ ID NO: 65283

SEQ ID NO: 191260 - RNA, 63 nt, Homo Sapiens; identical to SEQ ID NO: 65284

SEQ ID NO: 191261 - RNA, 63 nt, Homo Sapiens; identical to SEQ ID NO: 65285

SEQ ID NO: 191262 - RNA, 63 nt, Homo Sapiens; identical to SEQ ID NO: 65286

SEQ ID NO: 191263 - RNA, 63 nt, Homo Sapiens; identical to SEQ ID NO: 65287

SEQ ID NO: 191264 - RNA, 63 nt, Homo Sapiens; identical to SEQ ID NO: 65288

SEQ ID NO: 191265 - RNA, 63 nt, Homo Sapiens; identical to SEQ ID NO: 65289

SEQ ID NO: 191266 - RNA, 63 nt, Homo Sapiens; identical to SEQ ID NO: 65290

SEQ ID NO: 191267 - RNA, 63 nt, Homo Sapiens; identical to SEQ ID NO: 65291

SEQ ID NO: 191268 - RNA, 63 nt, Homo Sapiens; identical to SEQ ID NO: 65292

SEQ ID NO: 191269 - RNA, 63 nt, Homo Sapiens; identical to SEQ ID NO: 65293

SEQ ID NO: 191270 - RNA, 63 nt, Homo Sapiens; identical to SEQ ID NO: 65294

SEQ ID NO: 191271 - RNA, 63 nt, Homo Sapiens; identical to SEQ ID NO: 65295

SEQ ID NO: 191272 - RNA, 63 nt, Homo Sapiens; identical to SEQ ID NO: 65296

SEQ ID NO: 191273 - RNA, 63 nt, Homo Sapiens; identical to SEQ ID NO: 65297

SEQ ID NO: 191274 - RNA, 63 nt, Homo Sapiens; identical to SEQ ID NO: 65298

SEQ ID NO: 191275 - RNA, 63 nt, Homo Sapiens; identical to SEQ ID NO: 65299

SEQ ID NO: 191276 - RNA, 63 nt, Homo Sapiens; identical to SEQ ID NO: 65300

SEQ ID NO: 191277 - RNA, 63 nt, Homo Sapiens; identical to SEQ ID NO: 65301

SEQ ID NO: 191278 - RNA, 63 nt, Homo Sapiens; identical to SEQ ID NO: 65302

SEQ ID NO: 191279 - RNA, 63 nt, Homo Sapiens; identical to SEQ ID NO: 65303

SEQ ID NO: 191280 - RNA, 63 nt, Homo Sapiens; identical to SEQ ID NO: 65304

SEQ ID NO: 191281 - RNA, 63 nt, Homo Sapiens; identical to SEQ ID NO: 65305

SEQ ID NO: 191282 - RNA, 63 nt, Homo Sapiens; identical to SEQ ID NO: 65306

SEQ ID NO: 191283 - RNA, 63 nt, Homo Sapiens; identical to SEQ ID NO: 65307

SEQ ID NO: 191284 - RNA, 63 nt, Homo Sapiens; identical to SEQ ID NO: 65308

SEQ ID NO: 191285 - RNA, 63 nt, Homo Sapiens; identical to SEQ ID NO: 65309

SEQ ID NO: 191286 - RNA, 63 nt, Homo Sapiens; identical to SEQ ID NO: 65310

SEQ ID NO: 191287 - RNA, 63 nt, Homo Sapiens; identical to SEQ ID NO: 65311

SEQ ID NO: 191288 - RNA, 63 nt, Homo Sapiens; identical to SEQ ID NO: 65312

SEQ ID NO: 191289 - RNA, 63 nt, Homo Sapiens; identical to SEQ ID NO: 65313

SEQ ID NO: 191290 - RNA, 63 nt, Homo Sapiens; identical to SEQ ID NO: 65314

SEQ ID NO: 191291 - RNA, 63 nt, Homo Sapiens; identical to SEQ ID NO: 65315

SEQ ID NO: 191292 - RNA, 63 nt, Homo Sapiens; identical to SEQ ID NO: 65316

SEQ ID NO: 191293 - RNA, 63 nt, Homo Sapiens; identical to SEQ ID NO: 65317

SEQ ID NO: 191294 - RNA, 63 nt, Homo Sapiens; identical to SEQ ID NO: 65318

SEQ ID NO: 191295 - RNA, 63 nt, Homo Sapiens; identical to SEQ ID NO: 65319

SEQ ID NO: 191296 - RNA, 63 nt, Homo Sapiens; identical to SEQ ID NO: 65320

SEQ ID NO: 191297 - RNA, 63 nt, Homo Sapiens; identical to SEQ ID NO: 65321

SEQ ID NO: 191298 - RNA, 63 nt, Homo Sapiens; identical to SEQ ID NO: 65322

SEQ ID NO: 191299 - RNA, 63 nt, Homo Sapiens; identical to SEQ ID NO: 65323

SEQ ID NO: 191300 - RNA, 63 nt, Homo Sapiens; identical to SEQ ID NO: 65324

SEQ ID NO: 191301 - RNA, 63 nt, Homo Sapiens; identical to SEQ ID NO: 65325

SEQ ID NO: 191302 - RNA, 63 nt, Homo Sapiens; identical to SEQ ID NO: 65326

SEQ ID NO: 191303 - RNA, 63 nt, Homo Sapiens; identical to SEQ ID NO: 65327

SEQ ID NO: 191304 - RNA, 63 nt, Homo Sapiens; identical to SEQ ID NO: 65328

SEQ ID NO: 191305 - RNA, 63 nt, Homo Sapiens; identical to SEQ ID NO: 65329

SEQ ID NO: 191306 - RNA, 63 nt, Homo Sapiens; identical to SEQ ID NO: 65330

SEQ ID NO: 191307 - RNA, 63 nt, Homo Sapiens; identical to SEQ ID NO: 65331

SEQ ID NO: 191308 - RNA, 63 nt, Homo Sapiens; identical to SEQ ID NO: 65332

SEQ ID NO: 191309 - RNA, 63 nt, Homo Sapiens; identical to SEQ ID NO: 65333

SEQ ID NO: 191310 - RNA, 63 nt, Homo Sapiens; identical to SEQ ID NO: 65334

SEQ ID NO: 191311 - RNA, 63 nt, Homo Sapiens; identical to SEQ ID NO: 65335

SEQ ID NO: 191312 - RNA, 63 nt, Homo Sapiens; identical to SEQ ID NO: 65336

SEQ ID NO: 191313 - RNA, 63 nt, Homo Sapiens; identical to SEQ ID NO: 65337

SEQ ID NO: 191314 - RNA, 63 nt, Homo Sapiens; identical to SEQ ID NO: 65338

SEQ ID NO: 191315 - RNA, 63 nt, Homo Sapiens; identical to SEQ ID NO: 65339

SEQ ID NO: 191316 - RNA, 63 nt, Homo Sapiens; identical to SEQ ID NO: 65340

SEQ ID NO: 191317 - RNA, 63 nt, Homo Sapiens; identical to SEQ ID NO: 65341

SEQ ID NO: 191318 - RNA, 63 nt, Homo Sapiens; identical to SEQ ID NO: 65342

SEQ ID NO: 191319 - RNA, 63 nt, Homo Sapiens; identical to SEQ ID NO: 65343

SEQ ID NO: 191320 - RNA, 63 nt, Homo Sapiens; identical to SEQ ID NO: 65344

SEQ ID NO: 191321 - RNA, 63 nt, Homo Sapiens; identical to SEQ ID NO: 65345

SEQ ID NO: 191322 - RNA, 63 nt, Homo Sapiens; identical to SEQ ID NO: 65346

SEQ ID NO: 191323 - RNA, 63 nt, Homo Sapiens; identical to SEQ ID NO: 65347

SEQ ID NO: 191324 - RNA, 63 nt, Homo Sapiens; identical to SEQ ID NO: 65348

SEQ ID NO: 191325 - RNA, 63 nt, Homo Sapiens; identical to SEQ ID NO: 65349

SEQ ID NO: 191326 - RNA, 63 nt, Homo Sapiens; identical to SEQ ID NO: 65350

SEQ ID NO: 191327 - RNA, 63 nt, Homo Sapiens; identical to SEQ ID NO: 65351

SEQ ID NO: 191328 - RNA, 63 nt, Homo Sapiens; identical to SEQ ID NO: 65352

SEQ ID NO: 191329 - RNA, 63 nt, Homo Sapiens; identical to SEQ ID NO: 65353

SEQ ID NO: 191330 - RNA, 63 nt, Homo Sapiens; identical to SEQ ID NO: 65354

SEQ ID NO: 191331 - RNA, 63 nt, Homo Sapiens; identical to SEQ ID NO: 65355

SEQ ID NO: 191332 - RNA, 63 nt, Homo Sapiens; identical to SEQ ID NO: 65356

SEQ ID NO: 191333 - RNA, 63 nt, Homo Sapiens; identical to SEQ ID NO: 65357

SEQ ID NO: 191334 - RNA, 63 nt, Homo Sapiens; identical to SEQ ID NO: 65358

SEQ ID NO: 191335 - RNA, 63 nt, Homo Sapiens; identical to SEQ ID NO: 65359

SEQ ID NO: 191336 - RNA, 63 nt, Homo Sapiens; identical to SEQ ID NO: 65360

SEQ ID NO: 191337 - RNA, 63 nt, Homo Sapiens; identical to SEQ ID NO: 65361

SEQ ID NO: 191338 - RNA, 63 nt, Homo Sapiens; identical to SEQ ID NO: 65362

SEQ ID NO: 191339 - RNA, 63 nt, Homo Sapiens; identical to SEQ ID NO: 65363

SEQ ID NO: 191340 - RNA, 63 nt, Homo Sapiens; identical to SEQ ID NO: 65364

SEQ ID NO: 191341 - RNA, 63 nt, Homo Sapiens; identical to SEQ ID NO: 65365

SEQ ID NO: 191342 - RNA, 60 nt, Homo Sapiens; identical to SEQ ID NO: 65087

SEQ ID NO: 191343 - RNA, 63 nt, Homo Sapiens; identical to SEQ ID NO: 65367

SEQ ID NO: 191344 - RNA, 63 nt, Homo Sapiens; identical to SEQ ID NO: 65368

SEQ ID NO: 191345 - RNA, 63 nt, Homo Sapiens; identical to SEQ ID NO: 65369

SEQ ID NO: 191346 - RNA, 63 nt, Homo Sapiens; identical to SEQ ID NO: 65370

SEQ ID NO: 191347 - RNA, 63 nt, Homo Sapiens; identical to SEQ ID NO: 65371

SEQ ID NO: 191348 - RNA, 63 nt, Homo Sapiens; identical to SEQ ID NO: 65372

SEQ ID NO: 191349 - RNA, 51 nt, Homo Sapiens; identical to SEQ ID NO: 65094

SEQ ID NO: 191350 - RNA, 63 nt, Homo Sapiens; identical to SEQ ID NO: 65374

SEQ ID NO: 191351 - RNA, 63 nt, Homo Sapiens; identical to SEQ ID NO: 65375

SEQ ID NO: 191352 - RNA, 63 nt, Homo Sapiens; identical to SEQ ID NO: 65376

SEQ ID NO: 191353 - RNA, 63 nt, Homo Sapiens; identical to SEQ ID NO: 65377

SEQ ID NO: 191354 - RNA, 63 nt, Homo Sapiens; identical to SEQ ID NO: 65378

SEQ ID NO: 191355 - RNA, 63 nt, Homo Sapiens; identical to SEQ ID NO: 65379

SEQ ID NO: 191356 - RNA, 63 nt, Homo Sapiens; identical to SEQ ID NO: 65380

SEQ ID NO: 191357 - RNA, 63 nt, Homo Sapiens; identical to SEQ ID NO: 65381

SEQ ID NO: 191358 - RNA, 63 nt, Homo Sapiens; identical to SEQ ID NO: 65382

SEQ ID NO: 191359 - RNA, 63 nt, Homo Sapiens; identical to SEQ ID NO: 65383

SEQ ID NO: 191360 - RNA, 63 nt, Homo Sapiens; identical to SEQ ID NO: 65384

SEQ ID NO: 191361 - RNA, 63 nt, Homo Sapiens; identical to SEQ ID NO: 65385

SEQ ID NO: 191362 - RNA, 63 nt, Homo Sapiens; identical to SEQ ID NO: 65386

SEQ ID NO: 191363 - RNA, 63 nt, Homo Sapiens; identical to SEQ ID NO: 65387

SEQ ID NO: 191364 - RNA, 63 nt, Homo Sapiens; identical to SEQ ID NO: 65388

SEQ ID NO: 191365 - RNA, 63 nt, Homo Sapiens; identical to SEQ ID NO: 65389

SEQ ID NO: 191366 - RNA, 63 nt, Homo Sapiens; identical to SEQ ID NO: 65390

SEQ ID NO: 191367 - RNA, 63 nt, Homo Sapiens; identical to SEQ ID NO: 65391

SEQ ID NO: 191368 - RNA, 63 nt, Homo Sapiens; identical to SEQ ID NO: 65392

SEQ ID NO: 191369 - RNA, 63 nt, Homo Sapiens; identical to SEQ ID NO: 65393

SEQ ID NO: 191370 - RNA, 63 nt, Homo Sapiens; identical to SEQ ID NO: 65394

SEQ ID NO: 191371 - RNA, 63 nt, Homo Sapiens; identical to SEQ ID NO: 65395

SEQ ID NO: 191372 - RNA, 63 nt, Homo Sapiens; identical to SEQ ID NO: 65396

SEQ ID NO: 191373 - RNA, 63 nt, Homo Sapiens; identical to SEQ ID NO: 65397

SEQ ID NO: 191374 - RNA, 63 nt, Homo Sapiens; identical to SEQ ID NO: 65398

SEQ ID NO: 191375 - RNA, 63 nt, Homo Sapiens; identical to SEQ ID NO: 65399

SEQ ID NO: 191376 - RNA, 63 nt, Homo Sapiens; identical to SEQ ID NO: 65400

SEQ ID NO: 191377 - RNA, 63 nt, Homo Sapiens; identical to SEQ ID NO: 65401

SEQ ID NO: 191378 - RNA, 63 nt, Homo Sapiens; identical to SEQ ID NO: 65402

SEQ ID NO: 191379 - RNA, 63 nt, Homo Sapiens; identical to SEQ ID NO: 65403

SEQ ID NO: 191380 - RNA, 63 nt, Homo Sapiens; identical to SEQ ID NO: 65404

SEQ ID NO: 191381 - RNA, 63 nt, Homo Sapiens; identical to SEQ ID NO: 65405

SEQ ID NO: 191382 - RNA, 63 nt, Homo Sapiens; identical to SEQ ID NO: 65406

SEQ ID NO: 191383 - RNA, 63 nt, Homo Sapiens; identical to SEQ ID NO: 65407

SEQ ID NO: 191384 - RNA, 63 nt, Homo Sapiens; identical to SEQ ID NO: 65408

SEQ ID NO: 191385 - RNA, 63 nt, Homo Sapiens; identical to SEQ ID NO: 65409

SEQ ID NO: 191386 - RNA, 63 nt, Homo Sapiens; identical to SEQ ID NO: 65410

SEQ ID NO: 191387 - RNA, 63 nt, Homo Sapiens; identical to SEQ ID NO: 65411

SEQ ID NO: 191388 - RNA, 63 nt, Homo Sapiens; identical to SEQ ID NO: 65412

SEQ ID NO: 191389 - RNA, 63 nt, Homo Sapiens; identical to SEQ ID NO: 65413

SEQ ID NO: 191390 - RNA, 63 nt, Homo Sapiens; identical to SEQ ID NO: 65414

SEQ ID NO: 191391 - RNA, 64 nt, Homo Sapiens; identical to SEQ ID NO: 65415

SEQ ID NO: 191392 - RNA, 64 nt, Homo Sapiens; identical to SEQ ID NO: 65416

SEQ ID NO: 191393 - RNA, 64 nt, Homo Sapiens; identical to SEQ ID NO: 65417

SEQ ID NO: 191394 - RNA, 64 nt, Homo Sapiens; identical to SEQ ID NO: 65418

SEQ ID NO: 191395 - RNA, 64 nt, Homo Sapiens; identical to SEQ ID NO: 61352

SEQ ID NO: 191396 - RNA, 64 nt, Homo Sapiens; identical to SEQ ID NO: 61353

SEQ ID NO: 191397 - RNA, 64 nt, Homo Sapiens; identical to SEQ ID NO: 65421

SEQ ID NO: 191398 - RNA, 64 nt, Homo Sapiens; identical to SEQ ID NO: 65422

SEQ ID NO: 191399 - RNA, 64 nt, Homo Sapiens; identical to SEQ ID NO: 65423

SEQ ID NO: 191400 - RNA, 64 nt, Homo Sapiens; identical to SEQ ID NO: 65424

SEQ ID NO: 191401 - RNA, 64 nt, Homo Sapiens; identical to SEQ ID NO: 65425

SEQ ID NO: 191402 - RNA, 64 nt, Homo Sapiens; identical to SEQ ID NO: 65426

SEQ ID NO: 191403 - RNA, 64 nt, Homo Sapiens; identical to SEQ ID NO: 61354

SEQ ID NO: 191404 - RNA, 64 nt, Homo Sapiens; identical to SEQ ID NO: 61355

SEQ ID NO: 191405 - RNA, 64 nt, Homo Sapiens; identical to SEQ ID NO: 65429

SEQ ID NO: 191406 - RNA, 64 nt, Homo Sapiens; identical to SEQ ID NO: 65430

SEQ ID NO: 191407 - RNA, 64 nt, Homo Sapiens; identical to SEQ ID NO: 65431

SEQ ID NO: 191408 - RNA, 64 nt, Homo Sapiens; identical to SEQ ID NO: 65432

SEQ ID NO: 191409 - RNA, 64 nt, Homo Sapiens; identical to SEQ ID NO: 65433

SEQ ID NO: 191410 - RNA, 64 nt, Homo Sapiens; identical to SEQ ID NO: 65434

SEQ ID NO: 191411 - RNA, 64 nt, Homo Sapiens; identical to SEQ ID NO: 65435

SEQ ID NO: 191412 - RNA, 64 nt, Homo Sapiens; identical to SEQ ID NO: 65436

SEQ ID NO: 191413 - RNA, 64 nt, Homo Sapiens; identical to SEQ ID NO: 65437

SEQ ID NO: 191414 - RNA, 64 nt, Homo Sapiens; identical to SEQ ID NO: 65438

SEQ ID NO: 191415 - RNA, 64 nt, Homo Sapiens; identical to SEQ ID NO: 65439

SEQ ID NO: 191416 - RNA, 64 nt, Homo Sapiens; identical to SEQ ID NO: 65440

SEQ ID NO: 191417 - RNA, 64 nt, Homo Sapiens; identical to SEQ ID NO: 61356

SEQ ID NO: 191418 - RNA, 64 nt, Homo Sapiens; identical to SEQ ID NO: 61357

SEQ ID NO: 191419 - RNA, 64 nt, Homo Sapiens; identical to SEQ ID NO: 65443

SEQ ID NO: 191420 - RNA, 64 nt, Homo Sapiens; identical to SEQ ID NO: 65444

SEQ ID NO: 191421 - RNA, 64 nt, Homo Sapiens; identical to SEQ ID NO: 65445

SEQ ID NO: 191422 - RNA, 64 nt, Homo Sapiens; identical to SEQ ID NO: 65446

SEQ ID NO: 191423 - RNA, 64 nt, Homo Sapiens; identical to SEQ ID NO: 65447

SEQ ID NO: 191424 - RNA, 64 nt, Homo Sapiens; identical to SEQ ID NO: 65448

SEQ ID NO: 191425 - RNA, 64 nt, Homo Sapiens; identical to SEQ ID NO: 65449

SEQ ID NO: 191426 - RNA, 64 nt, Homo Sapiens; identical to SEQ ID NO: 65450

SEQ ID NO: 191427 - RNA, 64 nt, Homo Sapiens; identical to SEQ ID NO: 65451

SEQ ID NO: 191428 - RNA, 64 nt, Homo Sapiens; identical to SEQ ID NO: 65452

SEQ ID NO: 191429 - RNA, 64 nt, Homo Sapiens; identical to SEQ ID NO: 65453

SEQ ID NO: 191430 - RNA, 64 nt, Homo Sapiens; identical to SEQ ID NO: 65454

SEQ ID NO: 191431 - RNA, 64 nt, Homo Sapiens; identical to SEQ ID NO: 65455

SEQ ID NO: 191432 - RNA, 64 nt, Homo Sapiens; identical to SEQ ID NO: 65456

SEQ ID NO: 191433 - RNA, 64 nt, Homo Sapiens; identical to SEQ ID NO: 65457

SEQ ID NO: 191434 - RNA, 64 nt, Homo Sapiens; identical to SEQ ID NO: 65458

SEQ ID NO: 191435 - RNA, 64 nt, Homo Sapiens; identical to SEQ ID NO: 65459

SEQ ID NO: 191436 - RNA, 64 nt, Homo Sapiens; identical to SEQ ID NO: 65460

SEQ ID NO: 191437 - RNA, 64 nt, Homo Sapiens; identical to SEQ ID NO: 65461

SEQ ID NO: 191438 - RNA, 64 nt, Homo Sapiens; identical to SEQ ID NO: 65462

SEQ ID NO: 191439 - RNA, 64 nt, Homo Sapiens; identical to SEQ ID NO: 65463

SEQ ID NO: 191440 - RNA, 64 nt, Homo Sapiens; identical to SEQ ID NO: 65464

SEQ ID NO: 191441 - RNA, 64 nt, Homo Sapiens; identical to SEQ ID NO: 61358

SEQ ID NO: 191442 - RNA, 64 nt, Homo Sapiens; identical to SEQ ID NO: 61359

SEQ ID NO: 191443 - RNA, 64 nt, Homo Sapiens; identical to SEQ ID NO: 65467

SEQ ID NO: 191444 - RNA, 64 nt, Homo Sapiens; identical to SEQ ID NO: 65468

SEQ ID NO: 191445 - RNA, 64 nt, Homo Sapiens; identical to SEQ ID NO: 65469

SEQ ID NO: 191446 - RNA, 64 nt, Homo Sapiens; identical to SEQ ID NO: 65470

SEQ ID NO: 191447 - RNA, 64 nt, Homo Sapiens; identical to SEQ ID NO: 65471

SEQ ID NO: 191448 - RNA, 64 nt, Homo Sapiens; identical to SEQ ID NO: 65472

SEQ ID NO: 191449 - RNA, 64 nt, Homo Sapiens; identical to SEQ ID NO: 65473

SEQ ID NO: 191450 - RNA, 64 nt, Homo Sapiens; identical to SEQ ID NO: 65474

SEQ ID NO: 191451 - RNA, 64 nt, Homo Sapiens; identical to SEQ ID NO: 65475

SEQ ID NO: 191452 - RNA, 64 nt, Homo Sapiens; identical to SEQ ID NO: 65476

SEQ ID NO: 191453 - RNA, 64 nt, Homo Sapiens; identical to SEQ ID NO: 65477

SEQ ID NO: 191454 - RNA, 64 nt, Homo Sapiens; identical to SEQ ID NO: 65478

SEQ ID NO: 191455 - RNA, 64 nt, Homo Sapiens; identical to SEQ ID NO: 65479

SEQ ID NO: 191456 - RNA, 64 nt, Homo Sapiens; identical to SEQ ID NO: 65480

SEQ ID NO: 191457 - RNA, 64 nt, Homo Sapiens; identical to SEQ ID NO: 65481

SEQ ID NO: 191458 - RNA, 64 nt, Homo Sapiens; identical to SEQ ID NO: 65482

SEQ ID NO: 191459 - RNA, 64 nt, Homo Sapiens; identical to SEQ ID NO: 65483

SEQ ID NO: 191460 - RNA, 64 nt, Homo Sapiens; identical to SEQ ID NO: 65484

SEQ ID NO: 191461 - RNA, 64 nt, Homo Sapiens; identical to SEQ ID NO: 65485

SEQ ID NO: 191462 - RNA, 64 nt, Homo Sapiens; identical to SEQ ID NO: 65486

SEQ ID NO: 191463 - RNA, 64 nt, Homo Sapiens; identical to SEQ ID NO: 65487

SEQ ID NO: 191464 - RNA, 64 nt, Homo Sapiens; identical to SEQ ID NO: 65488

SEQ ID NO: 191465 - RNA, 64 nt, Homo Sapiens; identical to SEQ ID NO: 65489

SEQ ID NO: 191466 - RNA, 64 nt, Homo Sapiens; identical to SEQ ID NO: 65490

SEQ ID NO: 191467 - RNA, 64 nt, Homo Sapiens; identical to SEQ ID NO: 65491

SEQ ID NO: 191468 - RNA, 64 nt, Homo Sapiens; identical to SEQ ID NO: 65492

SEQ ID NO: 191469 - RNA, 64 nt, Homo Sapiens; identical to SEQ ID NO: 65493

SEQ ID NO: 191470 - RNA, 64 nt, Homo Sapiens; identical to SEQ ID NO: 65494

SEQ ID NO: 191471 - RNA, 64 nt, Homo Sapiens; identical to SEQ ID NO: 65495

SEQ ID NO: 191472 - RNA, 64 nt, Homo Sapiens; identical to SEQ ID NO: 65496

SEQ ID NO: 191473 - RNA, 64 nt, Homo Sapiens; identical to SEQ ID NO: 65497

SEQ ID NO: 191474 - RNA, 64 nt, Homo Sapiens; identical to SEQ ID NO: 65498

SEQ ID NO: 191475 - RNA, 64 nt, Homo Sapiens; identical to SEQ ID NO: 65499

SEQ ID NO: 191476 - RNA, 64 nt, Homo Sapiens; identical to SEQ ID NO: 65500

SEQ ID NO: 191477 - RNA, 64 nt, Homo Sapiens; identical to SEQ ID NO: 65501

SEQ ID NO: 191478 - RNA, 64 nt, Homo Sapiens; identical to SEQ ID NO: 65502

SEQ ID NO: 191479 - RNA, 64 nt, Homo Sapiens; identical to SEQ ID NO: 65503

SEQ ID NO: 191480 - RNA, 64 nt, Homo Sapiens; identical to SEQ ID NO: 65504

SEQ ID NO: 191481 - RNA, 64 nt, Homo Sapiens; identical to SEQ ID NO: 65505

SEQ ID NO: 191482 - RNA, 64 nt, Homo Sapiens; identical to SEQ ID NO: 65506

SEQ ID NO: 191483 - RNA, 64 nt, Homo Sapiens; identical to SEQ ID NO: 65507

SEQ ID NO: 191484 - RNA, 64 nt, Homo Sapiens; identical to SEQ ID NO: 65508

SEQ ID NO: 191485 - RNA, 64 nt, Homo Sapiens; identical to SEQ ID NO: 61360

SEQ ID NO: 191486 - RNA, 64 nt, Homo Sapiens; identical to SEQ ID NO: 61361

SEQ ID NO: 191487 - RNA, 64 nt, Homo Sapiens; identical to SEQ ID NO: 65511

SEQ ID NO: 191488 - RNA, 64 nt, Homo Sapiens; identical to SEQ ID NO: 65512

SEQ ID NO: 191489 - RNA, 64 nt, Homo Sapiens; identical to SEQ ID NO: 65513

SEQ ID NO: 191490 - RNA, 64 nt, Homo Sapiens; identical to SEQ ID NO: 65514

SEQ ID NO: 191491 - RNA, 64 nt, Homo Sapiens; identical to SEQ ID NO: 65515

SEQ ID NO: 191492 - RNA, 64 nt, Homo Sapiens; identical to SEQ ID NO: 65516

SEQ ID NO: 191493 - RNA, 64 nt, Homo Sapiens; identical to SEQ ID NO: 65517

SEQ ID NO: 191494 - RNA, 64 nt, Homo Sapiens; identical to SEQ ID NO: 65518

SEQ ID NO: 191495 - RNA, 64 nt, Homo Sapiens; identical to SEQ ID NO: 65519

SEQ ID NO: 191496 - RNA, 64 nt, Homo Sapiens; identical to SEQ ID NO: 65520

SEQ ID NO: 191497 - RNA, 64 nt, Homo Sapiens; identical to SEQ ID NO: 65521

SEQ ID NO: 191498 - RNA, 64 nt, Homo Sapiens; identical to SEQ ID NO: 65522

SEQ ID NO: 191499 - RNA, 64 nt, Homo Sapiens; identical to SEQ ID NO: 65523

SEQ ID NO: 191500 - RNA, 64 nt, Homo Sapiens; identical to SEQ ID NO: 65524

SEQ ID NO: 191501 - RNA, 64 nt, Homo Sapiens; identical to SEQ ID NO: 65525

SEQ ID NO: 191502 - RNA, 64 nt, Homo Sapiens; identical to SEQ ID NO: 65526

SEQ ID NO: 191503 - RNA, 64 nt, Homo Sapiens; identical to SEQ ID NO: 65527

SEQ ID NO: 191504 - RNA, 64 nt, Homo Sapiens; identical to SEQ ID NO: 65528

SEQ ID NO: 191505 - RNA, 64 nt, Homo Sapiens; identical to SEQ ID NO: 61362

SEQ ID NO: 191506 - RNA, 64 nt, Homo Sapiens; identical to SEQ ID NO: 61363

SEQ ID NO: 191507 - RNA, 64 nt, Homo Sapiens; identical to SEQ ID NO: 61364

SEQ ID NO: 191508 - RNA, 64 nt, Homo Sapiens; identical to SEQ ID NO: 61365

SEQ ID NO: 191509 - RNA, 64 nt, Homo Sapiens; identical to SEQ ID NO: 65533

SEQ ID NO: 191510 - RNA, 64 nt, Homo Sapiens; identical to SEQ ID NO: 65534

SEQ ID NO: 191511 - RNA, 64 nt, Homo Sapiens; identical to SEQ ID NO: 65535

SEQ ID NO: 191512 - RNA, 64 nt, Homo Sapiens; identical to SEQ ID NO: 65536

SEQ ID NO: 191513 - RNA, 64 nt, Homo Sapiens; identical to SEQ ID NO: 65537

SEQ ID NO: 191514 - RNA, 64 nt, Homo Sapiens; identical to SEQ ID NO: 65538

SEQ ID NO: 191515 - RNA, 64 nt, Homo Sapiens; identical to SEQ ID NO: 65539

SEQ ID NO: 191516 - RNA, 64 nt, Homo Sapiens; identical to SEQ ID NO: 65540

SEQ ID NO: 191517 - RNA, 64 nt, Homo Sapiens; identical to SEQ ID NO: 65541

SEQ ID NO: 191518 - RNA, 64 nt, Homo Sapiens; identical to SEQ ID NO: 65542

SEQ ID NO: 191519 - RNA, 64 nt, Homo Sapiens; identical to SEQ ID NO: 65543

SEQ ID NO: 191520 - RNA, 64 nt, Homo Sapiens; identical to SEQ ID NO: 65544

SEQ ID NO: 191521 - RNA, 64 nt, Homo Sapiens; identical to SEQ ID NO: 65545

SEQ ID NO: 191522 - RNA, 64 nt, Homo Sapiens; identical to SEQ ID NO: 65546

SEQ ID NO: 191523 - RNA, 64 nt, Homo Sapiens; identical to SEQ ID NO: 65547

SEQ ID NO: 191524 - RNA, 64 nt, Homo Sapiens; identical to SEQ ID NO: 61366

SEQ ID NO: 191525 - RNA, 64 nt, Homo Sapiens; identical to SEQ ID NO: 61367

SEQ ID NO: 191526 - RNA, 64 nt, Homo Sapiens; identical to SEQ ID NO: 65550

SEQ ID NO: 191527 - RNA, 64 nt, Homo Sapiens; identical to SEQ ID NO: 65551

SEQ ID NO: 191528 - RNA, 64 nt, Homo Sapiens; identical to SEQ ID NO: 61368

SEQ ID NO: 191529 - RNA, 56 nt, Homo Sapiens; identical to SEQ ID NO: 61369

SEQ ID NO: 191530 - RNA, 64 nt, Homo Sapiens; identical to SEQ ID NO: 65554

SEQ ID NO: 191531 - RNA, 64 nt, Homo Sapiens; identical to SEQ ID NO: 65555

SEQ ID NO: 191532 - RNA, 64 nt, Homo Sapiens; identical to SEQ ID NO: 65556

SEQ ID NO: 191533 - RNA, 64 nt, Homo Sapiens; identical to SEQ ID NO: 65557

SEQ ID NO: 191534 - RNA, 64 nt, Homo Sapiens; identical to SEQ ID NO: 65558

SEQ ID NO: 191535 - RNA, 64 nt, Homo Sapiens; identical to SEQ ID NO: 65559

SEQ ID NO: 191536 - RNA, 64 nt, Homo Sapiens; identical to SEQ ID NO: 65560

SEQ ID NO: 191537 - RNA, 64 nt, Homo Sapiens; identical to SEQ ID NO: 65561

SEQ ID NO: 191538 - RNA, 64 nt, Homo Sapiens; identical to SEQ ID NO: 65562

SEQ ID NO: 191539 - RNA, 64 nt, Homo Sapiens; identical to SEQ ID NO: 65563

SEQ ID NO: 191540 - RNA, 64 nt, Homo Sapiens; identical to SEQ ID NO: 65564

SEQ ID NO: 191541 - RNA, 64 nt, Homo Sapiens; identical to SEQ ID NO: 65565

SEQ ID NO: 191542 - RNA, 64 nt, Homo Sapiens; identical to SEQ ID NO: 65566

SEQ ID NO: 191543 - RNA, 64 nt, Homo Sapiens; identical to SEQ ID NO: 65567

SEQ ID NO: 191544 - RNA, 64 nt, Homo Sapiens; identical to SEQ ID NO: 65568

SEQ ID NO: 191545 - RNA, 64 nt, Homo Sapiens; identical to SEQ ID NO: 65569

SEQ ID NO: 191546 - RNA, 64 nt, Homo Sapiens; identical to SEQ ID NO: 65570

SEQ ID NO: 191547 - RNA, 64 nt, Homo Sapiens; identical to SEQ ID NO: 65571

SEQ ID NO: 191548 - RNA, 64 nt, Homo Sapiens; identical to SEQ ID NO: 65572

SEQ ID NO: 191549 - RNA, 64 nt, Homo Sapiens; identical to SEQ ID NO: 65573

SEQ ID NO: 191550 - RNA, 64 nt, Homo Sapiens; identical to SEQ ID NO: 61370

SEQ ID NO: 191551 - RNA, 64 nt, Homo Sapiens; identical to SEQ ID NO: 61371

SEQ ID NO: 191552 - RNA, 64 nt, Homo Sapiens; identical to SEQ ID NO: 65576

SEQ ID NO: 191553 - RNA, 64 nt, Homo Sapiens; identical to SEQ ID NO: 65577

SEQ ID NO: 191554 - RNA, 64 nt, Homo Sapiens; identical to SEQ ID NO: 65578

SEQ ID NO: 191555 - RNA, 64 nt, Homo Sapiens; identical to SEQ ID NO: 65579

SEQ ID NO: 191556 - RNA, 64 nt, Homo Sapiens; identical to SEQ ID NO: 65580

SEQ ID NO: 191557 - RNA, 64 nt, Homo Sapiens; identical to SEQ ID NO: 65581

SEQ ID NO: 191558 - RNA, 64 nt, Homo Sapiens; identical to SEQ ID NO: 65582

SEQ ID NO: 191559 - RNA, 64 nt, Homo Sapiens; identical to SEQ ID NO: 65583

SEQ ID NO: 191560 - RNA, 64 nt, Homo Sapiens; identical to SEQ ID NO: 65584

SEQ ID NO: 191561 - RNA, 64 nt, Homo Sapiens; identical to SEQ ID NO: 65585

SEQ ID NO: 191562 - RNA, 64 nt, Homo Sapiens; identical to SEQ ID NO: 65586

SEQ ID NO: 191563 - RNA, 64 nt, Homo Sapiens; identical to SEQ ID NO: 65587

SEQ ID NO: 191564 - RNA, 64 nt, Homo Sapiens; identical to SEQ ID NO: 65588

SEQ ID NO: 191565 - RNA, 64 nt, Homo Sapiens; identical to SEQ ID NO: 65589

SEQ ID NO: 191566 - RNA, 64 nt, Homo Sapiens; identical to SEQ ID NO: 65590

SEQ ID NO: 191567 - RNA, 64 nt, Homo Sapiens; identical to SEQ ID NO: 65591

SEQ ID NO: 191568 - RNA, 64 nt, Homo Sapiens; identical to SEQ ID NO: 65592

SEQ ID NO: 191569 - RNA, 64 nt, Homo Sapiens; identical to SEQ ID NO: 65593

SEQ ID NO: 191570 - RNA, 64 nt, Homo Sapiens; identical to SEQ ID NO: 65594

SEQ ID NO: 191571 - RNA, 64 nt, Homo Sapiens; identical to SEQ ID NO: 65595

SEQ ID NO: 191572 - RNA, 64 nt, Homo Sapiens; identical to SEQ ID NO: 65596

SEQ ID NO: 191573 - RNA, 64 nt, Homo Sapiens; identical to SEQ ID NO: 65597

SEQ ID NO: 191574 - RNA, 64 nt, Homo Sapiens; identical to SEQ ID NO: 65598

SEQ ID NO: 191575 - RNA, 64 nt, Homo Sapiens; identical to SEQ ID NO: 65599

SEQ ID NO: 191576 - RNA, 64 nt, Homo Sapiens; identical to SEQ ID NO: 65600

SEQ ID NO: 191577 - RNA, 64 nt, Homo Sapiens; identical to SEQ ID NO: 65601

SEQ ID NO: 191578 - RNA, 64 nt, Homo Sapiens; identical to SEQ ID NO: 65602

SEQ ID NO: 191579 - RNA, 64 nt, Homo Sapiens; identical to SEQ ID NO: 65603

SEQ ID NO: 191580 - RNA, 64 nt, Homo Sapiens; identical to SEQ ID NO: 65604

SEQ ID NO: 191581 - RNA, 64 nt, Homo Sapiens; identical to SEQ ID NO: 65605

SEQ ID NO: 191582 - RNA, 64 nt, Homo Sapiens; identical to SEQ ID NO: 65606

SEQ ID NO: 191583 - RNA, 64 nt, Homo Sapiens; identical to SEQ ID NO: 65607

SEQ ID NO: 191584 - RNA, 64 nt, Homo Sapiens; identical to SEQ ID NO: 65608

SEQ ID NO: 191585 - RNA, 64 nt, Homo Sapiens; identical to SEQ ID NO: 65609

SEQ ID NO: 191586 - RNA, 64 nt, Homo Sapiens; identical to SEQ ID NO: 65610

SEQ ID NO: 191587 - RNA, 64 nt, Homo Sapiens; identical to SEQ ID NO: 65611

SEQ ID NO: 191588 - RNA, 64 nt, Homo Sapiens; identical to SEQ ID NO: 61372

SEQ ID NO: 191589 - RNA, 64 nt, Homo Sapiens; identical to SEQ ID NO: 61373

SEQ ID NO: 191590 - RNA, 64 nt, Homo Sapiens; identical to SEQ ID NO: 65614

SEQ ID NO: 191591 - RNA, 64 nt, Homo Sapiens; identical to SEQ ID NO: 65615

SEQ ID NO: 191592 - RNA, 64 nt, Homo Sapiens; identical to SEQ ID NO: 65616

SEQ ID NO: 191593 - RNA, 64 nt, Homo Sapiens; identical to SEQ ID NO: 61374

SEQ ID NO: 191594 - RNA, 64 nt, Homo Sapiens; identical to SEQ ID NO: 61375

SEQ ID NO: 191595 - RNA, 64 nt, Homo Sapiens; identical to SEQ ID NO: 65619

SEQ ID NO: 191596 - RNA, 64 nt, Homo Sapiens; identical to SEQ ID NO: 65620

SEQ ID NO: 191597 - RNA, 64 nt, Homo Sapiens; identical to SEQ ID NO: 65621

SEQ ID NO: 191598 - RNA, 64 nt, Homo Sapiens; identical to SEQ ID NO: 65622

SEQ ID NO: 191599 - RNA, 64 nt, Homo Sapiens; identical to SEQ ID NO: 65623

SEQ ID NO: 191600 - RNA, 64 nt, Homo Sapiens; identical to SEQ ID NO: 65624

SEQ ID NO: 191601 - RNA, 64 nt, Homo Sapiens; identical to SEQ ID NO: 65625

SEQ ID NO: 191602 - RNA, 64 nt, Homo Sapiens; identical to SEQ ID NO: 65626

SEQ ID NO: 191603 - RNA, 64 nt, Homo Sapiens; identical to SEQ ID NO: 65627

SEQ ID NO: 191604 - RNA, 64 nt, Homo Sapiens; identical to SEQ ID NO: 65628

SEQ ID NO: 191605 - RNA, 64 nt, Homo Sapiens; identical to SEQ ID NO: 65629

SEQ ID NO: 191606 - RNA, 64 nt, Homo Sapiens; identical to SEQ ID NO: 65630

SEQ ID NO: 191607 - RNA, 64 nt, Homo Sapiens; identical to SEQ ID NO: 65631

SEQ ID NO: 191608 - RNA, 64 nt, Homo Sapiens; identical to SEQ ID NO: 65632

SEQ ID NO: 191609 - RNA, 64 nt, Homo Sapiens; identical to SEQ ID NO: 65633

SEQ ID NO: 191610 - RNA, 64 nt, Homo Sapiens; identical to SEQ ID NO: 65634

SEQ ID NO: 191611 - RNA, 64 nt, Homo Sapiens; identical to SEQ ID NO: 65635

SEQ ID NO: 191612 - RNA, 64 nt, Homo Sapiens; identical to SEQ ID NO: 65636

SEQ ID NO: 191613 - RNA, 64 nt, Homo Sapiens; identical to SEQ ID NO: 65637

SEQ ID NO: 191614 - RNA, 64 nt, Homo Sapiens; identical to SEQ ID NO: 65638

SEQ ID NO: 191615 - RNA, 64 nt, Homo Sapiens; identical to SEQ ID NO: 65639

SEQ ID NO: 191616 - RNA, 64 nt, Homo Sapiens; identical to SEQ ID NO: 65640

SEQ ID NO: 191617 - RNA, 64 nt, Homo Sapiens; identical to SEQ ID NO: 65641

SEQ ID NO: 191618 - RNA, 64 nt, Homo Sapiens; identical to SEQ ID NO: 65642

SEQ ID NO: 191619 - RNA, 64 nt, Homo Sapiens; identical to SEQ ID NO: 65643

SEQ ID NO: 191620 - RNA, 64 nt, Homo Sapiens; identical to SEQ ID NO: 65644

SEQ ID NO: 191621 - RNA, 60 nt, Homo Sapiens; identical to SEQ ID NO: 65087

SEQ ID NO: 191622 - RNA, 64 nt, Homo Sapiens; identical to SEQ ID NO: 65646

SEQ ID NO: 191623 - RNA, 64 nt, Homo Sapiens; identical to SEQ ID NO: 65647

SEQ ID NO: 191624 - RNA, 64 nt, Homo Sapiens; identical to SEQ ID NO: 65648

SEQ ID NO: 191625 - RNA, 64 nt, Homo Sapiens; identical to SEQ ID NO: 65649

SEQ ID NO: 191626 - RNA, 64 nt, Homo Sapiens; identical to SEQ ID NO: 65650

SEQ ID NO: 191627 - RNA, 64 nt, Homo Sapiens; identical to SEQ ID NO: 65651

SEQ ID NO: 191628 - RNA, 51 nt, Homo Sapiens; identical to SEQ ID NO: 65094

SEQ ID NO: 191629 - RNA, 64 nt, Homo Sapiens; identical to SEQ ID NO: 65653

SEQ ID NO: 191630 - RNA, 64 nt, Homo Sapiens; identical to SEQ ID NO: 65654

SEQ ID NO: 191631 - RNA, 64 nt, Homo Sapiens; identical to SEQ ID NO: 65655

SEQ ID NO: 191632 - RNA, 64 nt, Homo Sapiens; identical to SEQ ID NO: 65656

SEQ ID NO: 191633 - RNA, 64 nt, Homo Sapiens; identical to SEQ ID NO: 65657

SEQ ID NO: 191634 - RNA, 64 nt, Homo Sapiens; identical to SEQ ID NO: 65658

SEQ ID NO: 191635 - RNA, 64 nt, Homo Sapiens; identical to SEQ ID NO: 65659

SEQ ID NO: 191636 - RNA, 64 nt, Homo Sapiens; identical to SEQ ID NO: 65660

SEQ ID NO: 191637 - RNA, 64 nt, Homo Sapiens; identical to SEQ ID NO: 65661

SEQ ID NO: 191638 - RNA, 64 nt, Homo Sapiens; identical to SEQ ID NO: 65662

SEQ ID NO: 191639 - RNA, 64 nt, Homo Sapiens; identical to SEQ ID NO: 65663

SEQ ID NO: 191640 - RNA, 64 nt, Homo Sapiens; identical to SEQ ID NO: 65664

SEQ ID NO: 191641 - RNA, 64 nt, Homo Sapiens; identical to SEQ ID NO: 65665

SEQ ID NO: 191642 - RNA, 64 nt, Homo Sapiens; identical to SEQ ID NO: 65666

SEQ ID NO: 191643 - RNA, 64 nt, Homo Sapiens; identical to SEQ ID NO: 65667

SEQ ID NO: 191644 - RNA, 64 nt, Homo Sapiens; identical to SEQ ID NO: 65668

SEQ ID NO: 191645 - RNA, 64 nt, Homo Sapiens; identical to SEQ ID NO: 65669

SEQ ID NO: 191646 - RNA, 64 nt, Homo Sapiens; identical to SEQ ID NO: 65670

SEQ ID NO: 191647 - RNA, 64 nt, Homo Sapiens; identical to SEQ ID NO: 65671

SEQ ID NO: 191648 - RNA, 64 nt, Homo Sapiens; identical to SEQ ID NO: 65672

SEQ ID NO: 191649 - RNA, 64 nt, Homo Sapiens; identical to SEQ ID NO: 65673

SEQ ID NO: 191650 - RNA, 64 nt, Homo Sapiens; identical to SEQ ID NO: 65674

SEQ ID NO: 191651 - RNA, 64 nt, Homo Sapiens; identical to SEQ ID NO: 65675

SEQ ID NO: 191652 - RNA, 64 nt, Homo Sapiens; identical to SEQ ID NO: 65676

SEQ ID NO: 191653 - RNA, 64 nt, Homo Sapiens; identical to SEQ ID NO: 65677

SEQ ID NO: 191654 - RNA, 64 nt, Homo Sapiens; identical to SEQ ID NO: 65678

SEQ ID NO: 191655 - RNA, 64 nt, Homo Sapiens; identical to SEQ ID NO: 65679

SEQ ID NO: 191656 - RNA, 64 nt, Homo Sapiens; identical to SEQ ID NO: 65680

SEQ ID NO: 191657 - RNA, 64 nt, Homo Sapiens; identical to SEQ ID NO: 65681

SEQ ID NO: 191658 - RNA, 64 nt, Homo Sapiens; identical to SEQ ID NO: 65682

SEQ ID NO: 191659 - RNA, 64 nt, Homo Sapiens; identical to SEQ ID NO: 65683

SEQ ID NO: 191660 - RNA, 64 nt, Homo Sapiens; identical to SEQ ID NO: 65684

SEQ ID NO: 191661 - RNA, 64 nt, Homo Sapiens; identical to SEQ ID NO: 65685

SEQ ID NO: 191662 - RNA, 64 nt, Homo Sapiens; identical to SEQ ID NO: 65686

SEQ ID NO: 191663 - RNA, 64 nt, Homo Sapiens; identical to SEQ ID NO: 65687

SEQ ID NO: 191664 - RNA, 64 nt, Homo Sapiens; identical to SEQ ID NO: 65688

SEQ ID NO: 191665 - RNA, 64 nt, Homo Sapiens; identical to SEQ ID NO: 65689

SEQ ID NO: 191666 - RNA, 64 nt, Homo Sapiens; identical to SEQ ID NO: 65690

SEQ ID NO: 191667 - RNA, 64 nt, Homo Sapiens; identical to SEQ ID NO: 65691

SEQ ID NO: 191668 - RNA, 64 nt, Homo Sapiens; identical to SEQ ID NO: 65692

SEQ ID NO: 191669 - RNA, 64 nt, Homo Sapiens; identical to SEQ ID NO: 65693

SEQ ID NO: 191670 - RNA, 65 nt, Homo Sapiens; identical to SEQ ID NO: 65694

SEQ ID NO: 191671 - RNA, 65 nt, Homo Sapiens; identical to SEQ ID NO: 65695

SEQ ID NO: 191672 - RNA, 65 nt, Homo Sapiens; identical to SEQ ID NO: 65696

SEQ ID NO: 191673 - RNA, 65 nt, Homo Sapiens; identical to SEQ ID NO: 65697

SEQ ID NO: 191674 - RNA, 65 nt, Homo Sapiens; identical to SEQ ID NO: 65698

SEQ ID NO: 191675 - RNA, 65 nt, Homo Sapiens; identical to SEQ ID NO: 65699

SEQ ID NO: 191676 - RNA, 65 nt, Homo Sapiens; identical to SEQ ID NO: 65700

SEQ ID NO: 191677 - RNA, 65 nt, Homo Sapiens; identical to SEQ ID NO: 65701

SEQ ID NO: 191678 - RNA, 65 nt, Homo Sapiens; identical to SEQ ID NO: 65702

SEQ ID NO: 191679 - RNA, 65 nt, Homo Sapiens; identical to SEQ ID NO: 65703

SEQ ID NO: 191680 - RNA, 65 nt, Homo Sapiens; identical to SEQ ID NO: 65704

SEQ ID NO: 191681 - RNA, 65 nt, Homo Sapiens; identical to SEQ ID NO: 65705

SEQ ID NO: 191682 - RNA, 65 nt, Homo Sapiens; identical to SEQ ID NO: 65706

SEQ ID NO: 191683 - RNA, 65 nt, Homo Sapiens; identical to SEQ ID NO: 65707

SEQ ID NO: 191684 - RNA, 65 nt, Homo Sapiens; identical to SEQ ID NO: 65708

SEQ ID NO: 191685 - RNA, 65 nt, Homo Sapiens; identical to SEQ ID NO: 65709

SEQ ID NO: 191686 - RNA, 65 nt, Homo Sapiens; identical to SEQ ID NO: 65710

SEQ ID NO: 191687 - RNA, 65 nt, Homo Sapiens; identical to SEQ ID NO: 65711

SEQ ID NO: 191688 - RNA, 65 nt, Homo Sapiens; identical to SEQ ID NO: 65712

SEQ ID NO: 191689 - RNA, 65 nt, Homo Sapiens; identical to SEQ ID NO: 65713

SEQ ID NO: 191690 - RNA, 65 nt, Homo Sapiens; identical to SEQ ID NO: 65714

SEQ ID NO: 191691 - RNA, 65 nt, Homo Sapiens; identical to SEQ ID NO: 65715

SEQ ID NO: 191692 - RNA, 65 nt, Homo Sapiens; identical to SEQ ID NO: 65716

SEQ ID NO: 191693 - RNA, 65 nt, Homo Sapiens; identical to SEQ ID NO: 65717

SEQ ID NO: 191694 - RNA, 65 nt, Homo Sapiens; identical to SEQ ID NO: 65718

SEQ ID NO: 191695 - RNA, 65 nt, Homo Sapiens; identical to SEQ ID NO: 65719

SEQ ID NO: 191696 - RNA, 65 nt, Homo Sapiens; identical to SEQ ID NO: 65720

SEQ ID NO: 191697 - RNA, 65 nt, Homo Sapiens; identical to SEQ ID NO: 65721

SEQ ID NO: 191698 - RNA, 65 nt, Homo Sapiens; identical to SEQ ID NO: 65722

SEQ ID NO: 191699 - RNA, 65 nt, Homo Sapiens; identical to SEQ ID NO: 65723

SEQ ID NO: 191700 - RNA, 65 nt, Homo Sapiens; identical to SEQ ID NO: 65724

SEQ ID NO: 191701 - RNA, 65 nt, Homo Sapiens; identical to SEQ ID NO: 65725

SEQ ID NO: 191702 - RNA, 65 nt, Homo Sapiens; identical to SEQ ID NO: 65726

SEQ ID NO: 191703 - RNA, 65 nt, Homo Sapiens; identical to SEQ ID NO: 65727

SEQ ID NO: 191704 - RNA, 65 nt, Homo Sapiens; identical to SEQ ID NO: 65728

SEQ ID NO: 191705 - RNA, 65 nt, Homo Sapiens; identical to SEQ ID NO: 65729

SEQ ID NO: 191706 - RNA, 65 nt, Homo Sapiens; identical to SEQ ID NO: 65730

SEQ ID NO: 191707 - RNA, 65 nt, Homo Sapiens; identical to SEQ ID NO: 65731

SEQ ID NO: 191708 - RNA, 65 nt, Homo Sapiens; identical to SEQ ID NO: 65732

SEQ ID NO: 191709 - RNA, 65 nt, Homo Sapiens; identical to SEQ ID NO: 65733

SEQ ID NO: 191710 - RNA, 65 nt, Homo Sapiens; identical to SEQ ID NO: 65734

SEQ ID NO: 191711 - RNA, 65 nt, Homo Sapiens; identical to SEQ ID NO: 65735

SEQ ID NO: 191712 - RNA, 65 nt, Homo Sapiens; identical to SEQ ID NO: 65736

SEQ ID NO: 191713 - RNA, 65 nt, Homo Sapiens; identical to SEQ ID NO: 65737

SEQ ID NO: 191714 - RNA, 65 nt, Homo Sapiens; identical to SEQ ID NO: 65738

SEQ ID NO: 191715 - RNA, 65 nt, Homo Sapiens; identical to SEQ ID NO: 65739

SEQ ID NO: 191716 - RNA, 65 nt, Homo Sapiens; identical to SEQ ID NO: 65740

SEQ ID NO: 191717 - RNA, 65 nt, Homo Sapiens; identical to SEQ ID NO: 65741

SEQ ID NO: 191718 - RNA, 65 nt, Homo Sapiens; identical to SEQ ID NO: 65742

SEQ ID NO: 191719 - RNA, 65 nt, Homo Sapiens; identical to SEQ ID NO: 65743

SEQ ID NO: 191720 - RNA, 65 nt, Homo Sapiens; identical to SEQ ID NO: 65744

SEQ ID NO: 191721 - RNA, 65 nt, Homo Sapiens; identical to SEQ ID NO: 65745

SEQ ID NO: 191722 - RNA, 65 nt, Homo Sapiens; identical to SEQ ID NO: 65746

SEQ ID NO: 191723 - RNA, 65 nt, Homo Sapiens; identical to SEQ ID NO: 65747

SEQ ID NO: 191724 - RNA, 65 nt, Homo Sapiens; identical to SEQ ID NO: 65748

SEQ ID NO: 191725 - RNA, 65 nt, Homo Sapiens; identical to SEQ ID NO: 65749

SEQ ID NO: 191726 - RNA, 65 nt, Homo Sapiens; identical to SEQ ID NO: 65750

SEQ ID NO: 191727 - RNA, 65 nt, Homo Sapiens; identical to SEQ ID NO: 65751

SEQ ID NO: 191728 - RNA, 65 nt, Homo Sapiens; identical to SEQ ID NO: 65752

SEQ ID NO: 191729 - RNA, 65 nt, Homo Sapiens; identical to SEQ ID NO: 65753

SEQ ID NO: 191730 - RNA, 65 nt, Homo Sapiens; identical to SEQ ID NO: 65754

SEQ ID NO: 191731 - RNA, 65 nt, Homo Sapiens; identical to SEQ ID NO: 65755

SEQ ID NO: 191732 - RNA, 65 nt, Homo Sapiens; identical to SEQ ID NO: 65756

SEQ ID NO: 191733 - RNA, 65 nt, Homo Sapiens; identical to SEQ ID NO: 65757

SEQ ID NO: 191734 - RNA, 65 nt, Homo Sapiens; identical to SEQ ID NO: 65758

SEQ ID NO: 191735 - RNA, 65 nt, Homo Sapiens; identical to SEQ ID NO: 65759

SEQ ID NO: 191736 - RNA, 65 nt, Homo Sapiens; identical to SEQ ID NO: 65760

SEQ ID NO: 191737 - RNA, 65 nt, Homo Sapiens; identical to SEQ ID NO: 65761

SEQ ID NO: 191738 - RNA, 65 nt, Homo Sapiens; identical to SEQ ID NO: 65762

SEQ ID NO: 191739 - RNA, 65 nt, Homo Sapiens; identical to SEQ ID NO: 65763

SEQ ID NO: 191740 - RNA, 65 nt, Homo Sapiens; identical to SEQ ID NO: 65764

SEQ ID NO: 191741 - RNA, 65 nt, Homo Sapiens; identical to SEQ ID NO: 65765

SEQ ID NO: 191742 - RNA, 65 nt, Homo Sapiens; identical to SEQ ID NO: 65766

SEQ ID NO: 191743 - RNA, 65 nt, Homo Sapiens; identical to SEQ ID NO: 65767

SEQ ID NO: 191744 - RNA, 65 nt, Homo Sapiens; identical to SEQ ID NO: 65768

SEQ ID NO: 191745 - RNA, 65 nt, Homo Sapiens; identical to SEQ ID NO: 65769

SEQ ID NO: 191746 - RNA, 65 nt, Homo Sapiens; identical to SEQ ID NO: 65770

SEQ ID NO: 191747 - RNA, 65 nt, Homo Sapiens; identical to SEQ ID NO: 65771

SEQ ID NO: 191748 - RNA, 65 nt, Homo Sapiens; identical to SEQ ID NO: 65772

SEQ ID NO: 191749 - RNA, 65 nt, Homo Sapiens; identical to SEQ ID NO: 65773

SEQ ID NO: 191750 - RNA, 65 nt, Homo Sapiens; identical to SEQ ID NO: 65774

SEQ ID NO: 191751 - RNA, 65 nt, Homo Sapiens; identical to SEQ ID NO: 65775

SEQ ID NO: 191752 - RNA, 65 nt, Homo Sapiens; identical to SEQ ID NO: 65776

SEQ ID NO: 191753 - RNA, 65 nt, Homo Sapiens; identical to SEQ ID NO: 65777

SEQ ID NO: 191754 - RNA, 65 nt, Homo Sapiens; identical to SEQ ID NO: 65778

SEQ ID NO: 191755 - RNA, 65 nt, Homo Sapiens; identical to SEQ ID NO: 65779

SEQ ID NO: 191756 - RNA, 65 nt, Homo Sapiens; identical to SEQ ID NO: 65780

SEQ ID NO: 191757 - RNA, 65 nt, Homo Sapiens; identical to SEQ ID NO: 65781

SEQ ID NO: 191758 - RNA, 65 nt, Homo Sapiens; identical to SEQ ID NO: 65782

SEQ ID NO: 191759 - RNA, 65 nt, Homo Sapiens; identical to SEQ ID NO: 65783

SEQ ID NO: 191760 - RNA, 65 nt, Homo Sapiens; identical to SEQ ID NO: 65784

SEQ ID NO: 191761 - RNA, 65 nt, Homo Sapiens; identical to SEQ ID NO: 65785

SEQ ID NO: 191762 - RNA, 65 nt, Homo Sapiens; identical to SEQ ID NO: 65786

SEQ ID NO: 191763 - RNA, 65 nt, Homo Sapiens; identical to SEQ ID NO: 65787

SEQ ID NO: 191764 - RNA, 65 nt, Homo Sapiens; identical to SEQ ID NO: 65788

SEQ ID NO: 191765 - RNA, 65 nt, Homo Sapiens; identical to SEQ ID NO: 65789

SEQ ID NO: 191766 - RNA, 65 nt, Homo Sapiens; identical to SEQ ID NO: 65790

SEQ ID NO: 191767 - RNA, 65 nt, Homo Sapiens; identical to SEQ ID NO: 65791

SEQ ID NO: 191768 - RNA, 65 nt, Homo Sapiens; identical to SEQ ID NO: 65792

SEQ ID NO: 191769 - RNA, 65 nt, Homo Sapiens; identical to SEQ ID NO: 65793

SEQ ID NO: 191770 - RNA, 65 nt, Homo Sapiens; identical to SEQ ID NO: 65794

SEQ ID NO: 191771 - RNA, 65 nt, Homo Sapiens; identical to SEQ ID NO: 65795

SEQ ID NO: 191772 - RNA, 65 nt, Homo Sapiens; identical to SEQ ID NO: 65796

SEQ ID NO: 191773 - RNA, 65 nt, Homo Sapiens; identical to SEQ ID NO: 65797

SEQ ID NO: 191774 - RNA, 65 nt, Homo Sapiens; identical to SEQ ID NO: 65798

SEQ ID NO: 191775 - RNA, 65 nt, Homo Sapiens; identical to SEQ ID NO: 65799

SEQ ID NO: 191776 - RNA, 65 nt, Homo Sapiens; identical to SEQ ID NO: 65800

SEQ ID NO: 191777 - RNA, 65 nt, Homo Sapiens; identical to SEQ ID NO: 65801

SEQ ID NO: 191778 - RNA, 65 nt, Homo Sapiens; identical to SEQ ID NO: 65802

SEQ ID NO: 191779 - RNA, 65 nt, Homo Sapiens; identical to SEQ ID NO: 65803

SEQ ID NO: 191780 - RNA, 65 nt, Homo Sapiens; identical to SEQ ID NO: 65804

SEQ ID NO: 191781 - RNA, 65 nt, Homo Sapiens; identical to SEQ ID NO: 65805

SEQ ID NO: 191782 - RNA, 65 nt, Homo Sapiens; identical to SEQ ID NO: 65806

SEQ ID NO: 191783 - RNA, 65 nt, Homo Sapiens; identical to SEQ ID NO: 65807

SEQ ID NO: 191784 - RNA, 65 nt, Homo Sapiens; identical to SEQ ID NO: 65808

SEQ ID NO: 191785 - RNA, 65 nt, Homo Sapiens; identical to SEQ ID NO: 65809

SEQ ID NO: 191786 - RNA, 65 nt, Homo Sapiens; identical to SEQ ID NO: 65810

SEQ ID NO: 191787 - RNA, 65 nt, Homo Sapiens; identical to SEQ ID NO: 65811

SEQ ID NO: 191788 - RNA, 65 nt, Homo Sapiens; identical to SEQ ID NO: 65812

SEQ ID NO: 191789 - RNA, 65 nt, Homo Sapiens; identical to SEQ ID NO: 65813

SEQ ID NO: 191790 - RNA, 65 nt, Homo Sapiens; identical to SEQ ID NO: 65814

SEQ ID NO: 191791 - RNA, 65 nt, Homo Sapiens; identical to SEQ ID NO: 65815

SEQ ID NO: 191792 - RNA, 65 nt, Homo Sapiens; identical to SEQ ID NO: 65816

SEQ ID NO: 191793 - RNA, 65 nt, Homo Sapiens; identical to SEQ ID NO: 65817

SEQ ID NO: 191794 - RNA, 65 nt, Homo Sapiens; identical to SEQ ID NO: 65818

SEQ ID NO: 191795 - RNA, 65 nt, Homo Sapiens; identical to SEQ ID NO: 65819

SEQ ID NO: 191796 - RNA, 65 nt, Homo Sapiens; identical to SEQ ID NO: 65820

SEQ ID NO: 191797 - RNA, 65 nt, Homo Sapiens; identical to SEQ ID NO: 65821

SEQ ID NO: 191798 - RNA, 65 nt, Homo Sapiens; identical to SEQ ID NO: 65822

SEQ ID NO: 191799 - RNA, 65 nt, Homo Sapiens; identical to SEQ ID NO: 65823

SEQ ID NO: 191800 - RNA, 65 nt, Homo Sapiens; identical to SEQ ID NO: 65824

SEQ ID NO: 191801 - RNA, 65 nt, Homo Sapiens; identical to SEQ ID NO: 65825

SEQ ID NO: 191802 - RNA, 65 nt, Homo Sapiens; identical to SEQ ID NO: 65826

SEQ ID NO: 191803 - RNA, 65 nt, Homo Sapiens; identical to SEQ ID NO: 65827

SEQ ID NO: 191804 - RNA, 65 nt, Homo Sapiens; identical to SEQ ID NO: 65828

SEQ ID NO: 191805 - RNA, 65 nt, Homo Sapiens; identical to SEQ ID NO: 65829

SEQ ID NO: 191806 - RNA, 65 nt, Homo Sapiens; identical to SEQ ID NO: 65830

SEQ ID NO: 191807 - RNA, 65 nt, Homo Sapiens; identical to SEQ ID NO: 65831

SEQ ID NO: 191808 - RNA, 56 nt, Homo Sapiens; identical to SEQ ID NO: 61369

SEQ ID NO: 191809 - RNA, 65 nt, Homo Sapiens; identical to SEQ ID NO: 65833

SEQ ID NO: 191810 - RNA, 65 nt, Homo Sapiens; identical to SEQ ID NO: 65834

SEQ ID NO: 191811 - RNA, 65 nt, Homo Sapiens; identical to SEQ ID NO: 65835

SEQ ID NO: 191812 - RNA, 65 nt, Homo Sapiens; identical to SEQ ID NO: 65836

SEQ ID NO: 191813 - RNA, 65 nt, Homo Sapiens; identical to SEQ ID NO: 65837

SEQ ID NO: 191814 - RNA, 65 nt, Homo Sapiens; identical to SEQ ID NO: 65838

SEQ ID NO: 191815 - RNA, 65 nt, Homo Sapiens; identical to SEQ ID NO: 65839

SEQ ID NO: 191816 - RNA, 65 nt, Homo Sapiens; identical to SEQ ID NO: 65840

SEQ ID NO: 191817 - RNA, 65 nt, Homo Sapiens; identical to SEQ ID NO: 65841

SEQ ID NO: 191818 - RNA, 65 nt, Homo Sapiens; identical to SEQ ID NO: 65842

SEQ ID NO: 191819 - RNA, 65 nt, Homo Sapiens; identical to SEQ ID NO: 65843

SEQ ID NO: 191820 - RNA, 65 nt, Homo Sapiens; identical to SEQ ID NO: 65844

SEQ ID NO: 191821 - RNA, 65 nt, Homo Sapiens; identical to SEQ ID NO: 65845

SEQ ID NO: 191822 - RNA, 65 nt, Homo Sapiens; identical to SEQ ID NO: 65846

SEQ ID NO: 191823 - RNA, 65 nt, Homo Sapiens; identical to SEQ ID NO: 65847

SEQ ID NO: 191824 - RNA, 65 nt, Homo Sapiens; identical to SEQ ID NO: 65848

SEQ ID NO: 191825 - RNA, 65 nt, Homo Sapiens; identical to SEQ ID NO: 65849

SEQ ID NO: 191826 - RNA, 65 nt, Homo Sapiens; identical to SEQ ID NO: 65850

SEQ ID NO: 191827 - RNA, 65 nt, Homo Sapiens; identical to SEQ ID NO: 65851

SEQ ID NO: 191828 - RNA, 65 nt, Homo Sapiens; identical to SEQ ID NO: 65852

SEQ ID NO: 191829 - RNA, 65 nt, Homo Sapiens; identical to SEQ ID NO: 65853

SEQ ID NO: 191830 - RNA, 65 nt, Homo Sapiens; identical to SEQ ID NO: 65854

SEQ ID NO: 191831 - RNA, 65 nt, Homo Sapiens; identical to SEQ ID NO: 65855

SEQ ID NO: 191832 - RNA, 65 nt, Homo Sapiens; identical to SEQ ID NO: 65856

SEQ ID NO: 191833 - RNA, 65 nt, Homo Sapiens; identical to SEQ ID NO: 65857

SEQ ID NO: 191834 - RNA, 65 nt, Homo Sapiens; identical to SEQ ID NO: 65858

SEQ ID NO: 191835 - RNA, 65 nt, Homo Sapiens; identical to SEQ ID NO: 65859

SEQ ID NO: 191836 - RNA, 65 nt, Homo Sapiens; identical to SEQ ID NO: 65860

SEQ ID NO: 191837 - RNA, 65 nt, Homo Sapiens; identical to SEQ ID NO: 65861

SEQ ID NO: 191838 - RNA, 65 nt, Homo Sapiens; identical to SEQ ID NO: 65862

SEQ ID NO: 191839 - RNA, 65 nt, Homo Sapiens; identical to SEQ ID NO: 65863

SEQ ID NO: 191840 - RNA, 65 nt, Homo Sapiens; identical to SEQ ID NO: 65864

SEQ ID NO: 191841 - RNA, 65 nt, Homo Sapiens; identical to SEQ ID NO: 65865

SEQ ID NO: 191842 - RNA, 65 nt, Homo Sapiens; identical to SEQ ID NO: 65866

SEQ ID NO: 191843 - RNA, 65 nt, Homo Sapiens; identical to SEQ ID NO: 65867

SEQ ID NO: 191844 - RNA, 65 nt, Homo Sapiens; identical to SEQ ID NO: 65868

SEQ ID NO: 191845 - RNA, 65 nt, Homo Sapiens; identical to SEQ ID NO: 65869

SEQ ID NO: 191846 - RNA, 65 nt, Homo Sapiens; identical to SEQ ID NO: 65870

SEQ ID NO: 191847 - RNA, 65 nt, Homo Sapiens; identical to SEQ ID NO: 65871

SEQ ID NO: 191848 - RNA, 65 nt, Homo Sapiens; identical to SEQ ID NO: 65872

SEQ ID NO: 191849 - RNA, 65 nt, Homo Sapiens; identical to SEQ ID NO: 65873

SEQ ID NO: 191850 - RNA, 65 nt, Homo Sapiens; identical to SEQ ID NO: 65874

SEQ ID NO: 191851 - RNA, 65 nt, Homo Sapiens; identical to SEQ ID NO: 65875

SEQ ID NO: 191852 - RNA, 65 nt, Homo Sapiens; identical to SEQ ID NO: 65876

SEQ ID NO: 191853 - RNA, 65 nt, Homo Sapiens; identical to SEQ ID NO: 65877

SEQ ID NO: 191854 - RNA, 65 nt, Homo Sapiens; identical to SEQ ID NO: 65878

SEQ ID NO: 191855 - RNA, 65 nt, Homo Sapiens; identical to SEQ ID NO: 65879

SEQ ID NO: 191856 - RNA, 65 nt, Homo Sapiens; identical to SEQ ID NO: 65880

SEQ ID NO: 191857 - RNA, 65 nt, Homo Sapiens; identical to SEQ ID NO: 65881

SEQ ID NO: 191858 - RNA, 65 nt, Homo Sapiens; identical to SEQ ID NO: 65882

SEQ ID NO: 191859 - RNA, 65 nt, Homo Sapiens; identical to SEQ ID NO: 65883

SEQ ID NO: 191860 - RNA, 65 nt, Homo Sapiens; identical to SEQ ID NO: 65884

SEQ ID NO: 191861 - RNA, 65 nt, Homo Sapiens; identical to SEQ ID NO: 65885

SEQ ID NO: 191862 - RNA, 65 nt, Homo Sapiens; identical to SEQ ID NO: 65886

SEQ ID NO: 191863 - RNA, 65 nt, Homo Sapiens; identical to SEQ ID NO: 65887

SEQ ID NO: 191864 - RNA, 65 nt, Homo Sapiens; identical to SEQ ID NO: 65888

SEQ ID NO: 191865 - RNA, 65 nt, Homo Sapiens; identical to SEQ ID NO: 65889

SEQ ID NO: 191866 - RNA, 65 nt, Homo Sapiens; identical to SEQ ID NO: 65890

SEQ ID NO: 191867 - RNA, 65 nt, Homo Sapiens; identical to SEQ ID NO: 65891

SEQ ID NO: 191868 - RNA, 65 nt, Homo Sapiens; identical to SEQ ID NO: 65892

SEQ ID NO: 191869 - RNA, 65 nt, Homo Sapiens; identical to SEQ ID NO: 65893

SEQ ID NO: 191870 - RNA, 65 nt, Homo Sapiens; identical to SEQ ID NO: 65894

SEQ ID NO: 191871 - RNA, 65 nt, Homo Sapiens; identical to SEQ ID NO: 65895

SEQ ID NO: 191872 - RNA, 65 nt, Homo Sapiens; identical to SEQ ID NO: 65896

SEQ ID NO: 191873 - RNA, 65 nt, Homo Sapiens; identical to SEQ ID NO: 65897

SEQ ID NO: 191874 - RNA, 65 nt, Homo Sapiens; identical to SEQ ID NO: 65898

SEQ ID NO: 191875 - RNA, 65 nt, Homo Sapiens; identical to SEQ ID NO: 65899

SEQ ID NO: 191876 - RNA, 65 nt, Homo Sapiens; identical to SEQ ID NO: 65900

SEQ ID NO: 191877 - RNA, 65 nt, Homo Sapiens; identical to SEQ ID NO: 65901

SEQ ID NO: 191878 - RNA, 65 nt, Homo Sapiens; identical to SEQ ID NO: 65902

SEQ ID NO: 191879 - RNA, 65 nt, Homo Sapiens; identical to SEQ ID NO: 65903

SEQ ID NO: 191880 - RNA, 65 nt, Homo Sapiens; identical to SEQ ID NO: 65904

SEQ ID NO: 191881 - RNA, 65 nt, Homo Sapiens; identical to SEQ ID NO: 65905

SEQ ID NO: 191882 - RNA, 65 nt, Homo Sapiens; identical to SEQ ID NO: 65906

SEQ ID NO: 191883 - RNA, 65 nt, Homo Sapiens; identical to SEQ ID NO: 65907

SEQ ID NO: 191884 - RNA, 65 nt, Homo Sapiens; identical to SEQ ID NO: 65908

SEQ ID NO: 191885 - RNA, 65 nt, Homo Sapiens; identical to SEQ ID NO: 65909

SEQ ID NO: 191886 - RNA, 65 nt, Homo Sapiens; identical to SEQ ID NO: 65910

SEQ ID NO: 191887 - RNA, 65 nt, Homo Sapiens; identical to SEQ ID NO: 65911

SEQ ID NO: 191888 - RNA, 65 nt, Homo Sapiens; identical to SEQ ID NO: 65912

SEQ ID NO: 191889 - RNA, 65 nt, Homo Sapiens; identical to SEQ ID NO: 65913

SEQ ID NO: 191890 - RNA, 65 nt, Homo Sapiens; identical to SEQ ID NO: 65914

SEQ ID NO: 191891 - RNA, 65 nt, Homo Sapiens; identical to SEQ ID NO: 65915

SEQ ID NO: 191892 - RNA, 65 nt, Homo Sapiens; identical to SEQ ID NO: 65916

SEQ ID NO: 191893 - RNA, 65 nt, Homo Sapiens; identical to SEQ ID NO: 65917

SEQ ID NO: 191894 - RNA, 65 nt, Homo Sapiens; identical to SEQ ID NO: 65918

SEQ ID NO: 191895 - RNA, 65 nt, Homo Sapiens; identical to SEQ ID NO: 65919

SEQ ID NO: 191896 - RNA, 65 nt, Homo Sapiens; identical to SEQ ID NO: 65920

SEQ ID NO: 191897 - RNA, 65 nt, Homo Sapiens; identical to SEQ ID NO: 65921

SEQ ID NO: 191898 - RNA, 65 nt, Homo Sapiens; identical to SEQ ID NO: 65922

SEQ ID NO: 191899 - RNA, 65 nt, Homo Sapiens; identical to SEQ ID NO: 65923

SEQ ID NO: 191900 - RNA, 60 nt, Homo Sapiens; identical to SEQ ID NO: 65087

SEQ ID NO: 191901 - RNA, 65 nt, Homo Sapiens; identical to SEQ ID NO: 65925

SEQ ID NO: 191902 - RNA, 65 nt, Homo Sapiens; identical to SEQ ID NO: 65926

SEQ ID NO: 191903 - RNA, 65 nt, Homo Sapiens; identical to SEQ ID NO: 65927

SEQ ID NO: 191904 - RNA, 65 nt, Homo Sapiens; identical to SEQ ID NO: 65928

SEQ ID NO: 191905 - RNA, 65 nt, Homo Sapiens; identical to SEQ ID NO: 65929

SEQ ID NO: 191906 - RNA, 65 nt, Homo Sapiens; identical to SEQ ID NO: 65930

SEQ ID NO: 191907 - RNA, 51 nt, Homo Sapiens; identical to SEQ ID NO: 65094

SEQ ID NO: 191908 - RNA, 65 nt, Homo Sapiens; identical to SEQ ID NO: 65932

SEQ ID NO: 191909 - RNA, 65 nt, Homo Sapiens; identical to SEQ ID NO: 65933

SEQ ID NO: 191910 - RNA, 65 nt, Homo Sapiens; identical to SEQ ID NO: 65934

SEQ ID NO: 191911 - RNA, 65 nt, Homo Sapiens; identical to SEQ ID NO: 65935

SEQ ID NO: 191912 - RNA, 65 nt, Homo Sapiens; identical to SEQ ID NO: 65936

SEQ ID NO: 191913 - RNA, 65 nt, Homo Sapiens; identical to SEQ ID NO: 65937

SEQ ID NO: 191914 - RNA, 65 nt, Homo Sapiens; identical to SEQ ID NO: 65938

SEQ ID NO: 191915 - RNA, 65 nt, Homo Sapiens; identical to SEQ ID NO: 65939

SEQ ID NO: 191916 - RNA, 65 nt, Homo Sapiens; identical to SEQ ID NO: 65940

SEQ ID NO: 191917 - RNA, 65 nt, Homo Sapiens; identical to SEQ ID NO: 65941

SEQ ID NO: 191918 - RNA, 65 nt, Homo Sapiens; identical to SEQ ID NO: 65942

SEQ ID NO: 191919 - RNA, 65 nt, Homo Sapiens; identical to SEQ ID NO: 65943

SEQ ID NO: 191920 - RNA, 65 nt, Homo Sapiens; identical to SEQ ID NO: 65944

SEQ ID NO: 191921 - RNA, 65 nt, Homo Sapiens; identical to SEQ ID NO: 65945

SEQ ID NO: 191922 - RNA, 65 nt, Homo Sapiens; identical to SEQ ID NO: 65946

SEQ ID NO: 191923 - RNA, 65 nt, Homo Sapiens; identical to SEQ ID NO: 65947

SEQ ID NO: 191924 - RNA, 65 nt, Homo Sapiens; identical to SEQ ID NO: 65948

SEQ ID NO: 191925 - RNA, 65 nt, Homo Sapiens; identical to SEQ ID NO: 65949

SEQ ID NO: 191926 - RNA, 65 nt, Homo Sapiens; identical to SEQ ID NO: 65950

SEQ ID NO: 191927 - RNA, 65 nt, Homo Sapiens; identical to SEQ ID NO: 65951

SEQ ID NO: 191928 - RNA, 65 nt, Homo Sapiens; identical to SEQ ID NO: 65952

SEQ ID NO: 191929 - RNA, 65 nt, Homo Sapiens; identical to SEQ ID NO: 65953

SEQ ID NO: 191930 - RNA, 65 nt, Homo Sapiens; identical to SEQ ID NO: 65954

SEQ ID NO: 191931 - RNA, 65 nt, Homo Sapiens; identical to SEQ ID NO: 65955

SEQ ID NO: 191932 - RNA, 65 nt, Homo Sapiens; identical to SEQ ID NO: 65956

SEQ ID NO: 191933 - RNA, 65 nt, Homo Sapiens; identical to SEQ ID NO: 65957

SEQ ID NO: 191934 - RNA, 65 nt, Homo Sapiens; identical to SEQ ID NO: 65958

SEQ ID NO: 191935 - RNA, 65 nt, Homo Sapiens; identical to SEQ ID NO: 65959

SEQ ID NO: 191936 - RNA, 65 nt, Homo Sapiens; identical to SEQ ID NO: 65960

SEQ ID NO: 191937 - RNA, 65 nt, Homo Sapiens; identical to SEQ ID NO: 65961

SEQ ID NO: 191938 - RNA, 65 nt, Homo Sapiens; identical to SEQ ID NO: 65962

SEQ ID NO: 191939 - RNA, 65 nt, Homo Sapiens; identical to SEQ ID NO: 65963

SEQ ID NO: 191940 - RNA, 65 nt, Homo Sapiens; identical to SEQ ID NO: 65964

SEQ ID NO: 191941 - RNA, 65 nt, Homo Sapiens; identical to SEQ ID NO: 65965

SEQ ID NO: 191942 - RNA, 65 nt, Homo Sapiens; identical to SEQ ID NO: 65966

SEQ ID NO: 191943 - RNA, 65 nt, Homo Sapiens; identical to SEQ ID NO: 65967

SEQ ID NO: 191944 - RNA, 65 nt, Homo Sapiens; identical to SEQ ID NO: 65968

SEQ ID NO: 191945 - RNA, 65 nt, Homo Sapiens; identical to SEQ ID NO: 65969

SEQ ID NO: 191946 - RNA, 65 nt, Homo Sapiens; identical to SEQ ID NO: 65970

SEQ ID NO: 191947 - RNA, 65 nt, Homo Sapiens; identical to SEQ ID NO: 65971

SEQ ID NO: 191948 - RNA, 65 nt, Homo Sapiens; identical to SEQ ID NO: 65972

SEQ ID NO: 191949 - RNA, 63 nt, Homo Sapiens; identical to SEQ ID NO: 102980

SEQ ID NO: 191950 - RNA, 63 nt, Homo Sapiens; identical to SEQ ID NO: 102981

SEQ ID NO: 191951 - RNA, 63 nt, Homo Sapiens; identical to SEQ ID NO: 102982

SEQ ID NO: 191952 - RNA, 63 nt, Homo Sapiens; identical to SEQ ID NO: 102983

SEQ ID NO: 191953 - RNA, 63 nt, Homo Sapiens; identical to SEQ ID NO: 102984

SEQ ID NO: 191954 - RNA, 63 nt, Homo Sapiens; identical to SEQ ID NO: 102985

SEQ ID NO: 191955 - RNA, 63 nt, Homo Sapiens; identical to SEQ ID NO: 102986

SEQ ID NO: 191956 - RNA, 63 nt, Homo Sapiens; identical to SEQ ID NO: 102987

SEQ ID NO: 191957 - RNA, 63 nt, Homo Sapiens; identical to SEQ ID NO: 102988

SEQ ID NO: 191958 - RNA, 63 nt, Homo Sapiens; identical to SEQ ID NO: 102989

SEQ ID NO: 191959 - RNA, 63 nt, Homo Sapiens; identical to SEQ ID NO: 102990

SEQ ID NO: 191960 - RNA, 58 nt, Homo Sapiens; identical to SEQ ID NO: 102991

SEQ ID NO: 191961 - RNA, 63 nt, Homo Sapiens; identical to SEQ ID NO: 102992

SEQ ID NO: 191962 - RNA, 63 nt, Homo Sapiens; identical to SEQ ID NO: 102993

SEQ ID NO: 191963 - RNA, 63 nt, Homo Sapiens; identical to SEQ ID NO: 102994

SEQ ID NO: 191964 - RNA, 63 nt, Homo Sapiens; identical to SEQ ID NO: 102995

SEQ ID NO: 191965 - RNA, 63 nt, Homo Sapiens; identical to SEQ ID NO: 102996

SEQ ID NO: 191966 - RNA, 63 nt, Homo Sapiens; identical to SEQ ID NO: 102997

SEQ ID NO: 191967 - RNA, 63 nt, Homo Sapiens; identical to SEQ ID NO: 102998

SEQ ID NO: 191968 - RNA, 63 nt, Homo Sapiens; identical to SEQ ID NO: 102999

SEQ ID NO: 191969 - RNA, 63 nt, Homo Sapiens; identical to SEQ ID NO: 103000

SEQ ID NO: 191970 - RNA, 63 nt, Homo Sapiens; identical to SEQ ID NO: 103001

SEQ ID NO: 191971 - RNA, 63 nt, Homo Sapiens; identical to SEQ ID NO: 103002

SEQ ID NO: 191972 - RNA, 63 nt, Homo Sapiens; identical to SEQ ID NO: 103003

SEQ ID NO: 191973 - RNA, 63 nt, Homo Sapiens; identical to SEQ ID NO: 103004

SEQ ID NO: 191974 - RNA, 63 nt, Homo Sapiens; identical to SEQ ID NO: 103005

SEQ ID NO: 191975 - RNA, 63 nt, Homo Sapiens; identical to SEQ ID NO: 103006

SEQ ID NO: 191976 - RNA, 63 nt, Homo Sapiens; identical to SEQ ID NO: 103007

SEQ ID NO: 191977 - RNA, 63 nt, Homo Sapiens; identical to SEQ ID NO: 103008

SEQ ID NO: 191978 - RNA, 63 nt, Homo Sapiens; identical to SEQ ID NO: 103009

SEQ ID NO: 191979 - RNA, 63 nt, Homo Sapiens; identical to SEQ ID NO: 103010

SEQ ID NO: 191980 - RNA, 63 nt, Homo Sapiens; identical to SEQ ID NO: 103011

SEQ ID NO: 191981 - RNA, 63 nt, Homo Sapiens; identical to SEQ ID NO: 103012

SEQ ID NO: 191982 - RNA, 63 nt, Homo Sapiens; identical to SEQ ID NO: 103013

SEQ ID NO: 191983 - RNA, 53 nt, Homo Sapiens; identical to SEQ ID NO: 103014

SEQ ID NO: 191984 - RNA, 63 nt, Homo Sapiens; identical to SEQ ID NO: 103015

SEQ ID NO: 191985 - RNA, 63 nt, Homo Sapiens; identical to SEQ ID NO: 103016

SEQ ID NO: 191986 - RNA, 63 nt, Homo Sapiens; identical to SEQ ID NO: 103017

SEQ ID NO: 191987 - RNA, 63 nt, Homo Sapiens; identical to SEQ ID NO: 103018

SEQ ID NO: 191988 - RNA, 63 nt, Homo Sapiens; identical to SEQ ID NO: 103019

SEQ ID NO: 191989 - RNA, 63 nt, Homo Sapiens; identical to SEQ ID NO: 103020

SEQ ID NO: 191990 - RNA, 63 nt, Homo Sapiens; identical to SEQ ID NO: 103021

SEQ ID NO: 191991 - RNA, 63 nt, Homo Sapiens; identical to SEQ ID NO: 103022

SEQ ID NO: 191992 - RNA, 63 nt, Homo Sapiens; identical to SEQ ID NO: 103023

SEQ ID NO: 191993 - RNA, 63 nt, Homo Sapiens; identical to SEQ ID NO: 103024

SEQ ID NO: 191994 - RNA, 63 nt, Homo Sapiens; identical to SEQ ID NO: 103025

SEQ ID NO: 191995 - RNA, 63 nt, Homo Sapiens; identical to SEQ ID NO: 103026

SEQ ID NO: 191996 - RNA, 63 nt, Homo Sapiens; identical to SEQ ID NO: 103027

SEQ ID NO: 191997 - RNA, 63 nt, Homo Sapiens; identical to SEQ ID NO: 103028

SEQ ID NO: 191998 - RNA, 63 nt, Homo Sapiens; identical to SEQ ID NO: 103029

SEQ ID NO: 191999 - RNA, 63 nt, Homo Sapiens; identical to SEQ ID NO: 103030

SEQ ID NO: 192000 - RNA, 63 nt, Homo Sapiens; identical to SEQ ID NO: 103031

SEQ ID NO: 192001 - RNA, 63 nt, Homo Sapiens; identical to SEQ ID NO: 103032

SEQ ID NO: 192002 - RNA, 63 nt, Homo Sapiens; identical to SEQ ID NO: 103033

SEQ ID NO: 192003 - RNA, 63 nt, Homo Sapiens; identical to SEQ ID NO: 103034

SEQ ID NO: 192004 - RNA, 63 nt, Homo Sapiens; identical to SEQ ID NO: 103035

SEQ ID NO: 192005 - RNA, 63 nt, Homo Sapiens; identical to SEQ ID NO: 103036

SEQ ID NO: 192006 - RNA, 63 nt, Homo Sapiens; identical to SEQ ID NO: 103037

SEQ ID NO: 192007 - RNA, 63 nt, Homo Sapiens; identical to SEQ ID NO: 103038

SEQ ID NO: 192008 - RNA, 63 nt, Homo Sapiens; identical to SEQ ID NO: 103039

SEQ ID NO: 192009 - RNA, 63 nt, Homo Sapiens; identical to SEQ ID NO: 103040

SEQ ID NO: 192010 - RNA, 63 nt, Homo Sapiens; identical to SEQ ID NO: 103041

SEQ ID NO: 192011 - RNA, 63 nt, Homo Sapiens; identical to SEQ ID NO: 103042

SEQ ID NO: 192012 - RNA, 63 nt, Homo Sapiens; identical to SEQ ID NO: 103043

SEQ ID NO: 192013 - RNA, 63 nt, Homo Sapiens; identical to SEQ ID NO: 103044

SEQ ID NO: 192014 - RNA, 63 nt, Homo Sapiens; identical to SEQ ID NO: 103045

SEQ ID NO: 192015 - RNA, 63 nt, Homo Sapiens; identical to SEQ ID NO: 103046

SEQ ID NO: 192016 - RNA, 63 nt, Homo Sapiens; identical to SEQ ID NO: 103047

SEQ ID NO: 192017 - RNA, 63 nt, Homo Sapiens; identical to SEQ ID NO: 103048

SEQ ID NO: 192018 - RNA, 63 nt, Homo Sapiens; identical to SEQ ID NO: 103049

SEQ ID NO: 192019 - RNA, 63 nt, Homo Sapiens; identical to SEQ ID NO: 103050

SEQ ID NO: 192020 - RNA, 63 nt, Homo Sapiens; identical to SEQ ID NO: 103051

SEQ ID NO: 192021 - RNA, 63 nt, Homo Sapiens; identical to SEQ ID NO: 103052

SEQ ID NO: 192022 - RNA, 63 nt, Homo Sapiens; identical to SEQ ID NO: 103053

SEQ ID NO: 192023 - RNA, 63 nt, Homo Sapiens; identical to SEQ ID NO: 103054

SEQ ID NO: 192024 - RNA, 63 nt, Homo Sapiens; identical to SEQ ID NO: 103055

SEQ ID NO: 192025 - RNA, 63 nt, Homo Sapiens; identical to SEQ ID NO: 103056

SEQ ID NO: 192026 - RNA, 63 nt, Homo Sapiens; identical to SEQ ID NO: 103057

SEQ ID NO: 192027 - RNA, 63 nt, Homo Sapiens; identical to SEQ ID NO: 103058

SEQ ID NO: 192028 - RNA, 63 nt, Homo Sapiens; identical to SEQ ID NO: 103059

SEQ ID NO: 192029 - RNA, 63 nt, Homo Sapiens; identical to SEQ ID NO: 103060

SEQ ID NO: 192030 - RNA, 63 nt, Homo Sapiens; identical to SEQ ID NO: 103061

SEQ ID NO: 192031 - RNA, 63 nt, Homo Sapiens; identical to SEQ ID NO: 103062

SEQ ID NO: 192032 - RNA, 63 nt, Homo Sapiens; identical to SEQ ID NO: 103063

SEQ ID NO: 192033 - RNA, 63 nt, Homo Sapiens; identical to SEQ ID NO: 103064

SEQ ID NO: 192034 - RNA, 63 nt, Homo Sapiens; identical to SEQ ID NO: 103065

SEQ ID NO: 192035 - RNA, 63 nt, Homo Sapiens; identical to SEQ ID NO: 103066

SEQ ID NO: 192036 - RNA, 63 nt, Homo Sapiens; identical to SEQ ID NO: 103067

SEQ ID NO: 192037 - RNA, 63 nt, Homo Sapiens; identical to SEQ ID NO: 103068

SEQ ID NO: 192038 - RNA, 63 nt, Homo Sapiens; identical to SEQ ID NO: 103069

SEQ ID NO: 192039 - RNA, 63 nt, Homo Sapiens; identical to SEQ ID NO: 103070

SEQ ID NO: 192040 - RNA, 63 nt, Homo Sapiens; identical to SEQ ID NO: 103071

SEQ ID NO: 192041 - RNA, 63 nt, Homo Sapiens; identical to SEQ ID NO: 103072

SEQ ID NO: 192042 - RNA, 63 nt, Homo Sapiens; identical to SEQ ID NO: 103073

SEQ ID NO: 192043 - RNA, 63 nt, Homo Sapiens; identical to SEQ ID NO: 103074

SEQ ID NO: 192044 - RNA, 63 nt, Homo Sapiens; identical to SEQ ID NO: 103075

SEQ ID NO: 192045 - RNA, 63 nt, Homo Sapiens; identical to SEQ ID NO: 103076

SEQ ID NO: 192046 - RNA, 63 nt, Homo Sapiens; identical to SEQ ID NO: 103077

SEQ ID NO: 192047 - RNA, 63 nt, Homo Sapiens; identical to SEQ ID NO: 103078

SEQ ID NO: 192048 - RNA, 63 nt, Homo Sapiens; identical to SEQ ID NO: 103079

SEQ ID NO: 192049 - RNA, 63 nt, Homo Sapiens; identical to SEQ ID NO: 103080

SEQ ID NO: 192050 - RNA, 63 nt, Homo Sapiens; identical to SEQ ID NO: 103081

SEQ ID NO: 192051 - RNA, 63 nt, Homo Sapiens; identical to SEQ ID NO: 103082

SEQ ID NO: 192052 - RNA, 63 nt, Homo Sapiens; identical to SEQ ID NO: 103083

SEQ ID NO: 192053 - RNA, 63 nt, Homo Sapiens; identical to SEQ ID NO: 103084

SEQ ID NO: 192054 - RNA, 63 nt, Homo Sapiens; identical to SEQ ID NO: 103085

SEQ ID NO: 192055 - RNA, 63 nt, Homo Sapiens; identical to SEQ ID NO: 103086

SEQ ID NO: 192056 - RNA, 63 nt, Homo Sapiens; identical to SEQ ID NO: 103087

SEQ ID NO: 192057 - RNA, 63 nt, Homo Sapiens; identical to SEQ ID NO: 103088

SEQ ID NO: 192058 - RNA, 63 nt, Homo Sapiens; identical to SEQ ID NO: 103089

SEQ ID NO: 192059 - RNA, 63 nt, Homo Sapiens; identical to SEQ ID NO: 103090

SEQ ID NO: 192060 - RNA, 63 nt, Homo Sapiens; identical to SEQ ID NO: 103091

SEQ ID NO: 192061 - RNA, 63 nt, Homo Sapiens; identical to SEQ ID NO: 103092

SEQ ID NO: 192062 - RNA, 63 nt, Homo Sapiens; identical to SEQ ID NO: 103093

SEQ ID NO: 192063 - RNA, 63 nt, Homo Sapiens; identical to SEQ ID NO: 103094

SEQ ID NO: 192064 - RNA, 63 nt, Homo Sapiens; identical to SEQ ID NO: 103095

SEQ ID NO: 192065 - RNA, 63 nt, Homo Sapiens; identical to SEQ ID NO: 103096

SEQ ID NO: 192066 - RNA, 63 nt, Homo Sapiens; identical to SEQ ID NO: 103097

SEQ ID NO: 192067 - RNA, 60 nt, Homo Sapiens; identical to SEQ ID NO: 103098

SEQ ID NO: 192068 - RNA, 63 nt, Homo Sapiens; identical to SEQ ID NO: 103099

SEQ ID NO: 192069 - RNA, 63 nt, Homo Sapiens; identical to SEQ ID NO: 103100

SEQ ID NO: 192070 - RNA, 63 nt, Homo Sapiens; identical to SEQ ID NO: 103101

SEQ ID NO: 192071 - RNA, 63 nt, Homo Sapiens; identical to SEQ ID NO: 103102

SEQ ID NO: 192072 - RNA, 63 nt, Homo Sapiens; identical to SEQ ID NO: 103103

SEQ ID NO: 192073 - RNA, 63 nt, Homo Sapiens; identical to SEQ ID NO: 103104

SEQ ID NO: 192074 - RNA, 63 nt, Homo Sapiens; identical to SEQ ID NO: 103105

SEQ ID NO: 192075 - RNA, 63 nt, Homo Sapiens; identical to SEQ ID NO: 103106

SEQ ID NO: 192076 - RNA, 63 nt, Homo Sapiens; identical to SEQ ID NO: 103107

SEQ ID NO: 192077 - RNA, 63 nt, Homo Sapiens; identical to SEQ ID NO: 103108

SEQ ID NO: 192078 - RNA, 63 nt, Homo Sapiens; identical to SEQ ID NO: 103109

SEQ ID NO: 192079 - RNA, 63 nt, Homo Sapiens; identical to SEQ ID NO: 103110

SEQ ID NO: 192080 - RNA, 63 nt, Homo Sapiens; identical to SEQ ID NO: 103111

SEQ ID NO: 192081 - RNA, 63 nt, Homo Sapiens; identical to SEQ ID NO: 103112

SEQ ID NO: 192082 - RNA, 63 nt, Homo Sapiens; identical to SEQ ID NO: 103113

SEQ ID NO: 192083 - RNA, 63 nt, Homo Sapiens; identical to SEQ ID NO: 103114

SEQ ID NO: 192084 - RNA, 63 nt, Homo Sapiens; identical to SEQ ID NO: 103115

SEQ ID NO: 192085 - RNA, 63 nt, Homo Sapiens; identical to SEQ ID NO: 103116

SEQ ID NO: 192086 - RNA, 63 nt, Homo Sapiens; identical to SEQ ID NO: 103117

SEQ ID NO: 192087 - RNA, 63 nt, Homo Sapiens; identical to SEQ ID NO: 103118

SEQ ID NO: 192088 - RNA, 63 nt, Homo Sapiens; identical to SEQ ID NO: 103119

SEQ ID NO: 192089 - RNA, 63 nt, Homo Sapiens; identical to SEQ ID NO: 103120

SEQ ID NO: 192090 - RNA, 63 nt, Homo Sapiens; identical to SEQ ID NO: 103121

SEQ ID NO: 192091 - RNA, 63 nt, Homo Sapiens; identical to SEQ ID NO: 103122

SEQ ID NO: 192092 - RNA, 63 nt, Homo Sapiens; identical to SEQ ID NO: 103123

SEQ ID NO: 192093 - RNA, 63 nt, Homo Sapiens; identical to SEQ ID NO: 103124

SEQ ID NO: 192094 - RNA, 63 nt, Homo Sapiens; identical to SEQ ID NO: 103125

SEQ ID NO: 192095 - RNA, 63 nt, Homo Sapiens; identical to SEQ ID NO: 103126

SEQ ID NO: 192096 - RNA, 63 nt, Homo Sapiens; identical to SEQ ID NO: 103127

SEQ ID NO: 192097 - RNA, 63 nt, Homo Sapiens; identical to SEQ ID NO: 103128

SEQ ID NO: 192098 - RNA, 63 nt, Homo Sapiens; identical to SEQ ID NO: 103129

SEQ ID NO: 192099 - RNA, 63 nt, Homo Sapiens; identical to SEQ ID NO: 103130

SEQ ID NO: 192100 - RNA, 63 nt, Homo Sapiens; identical to SEQ ID NO: 103131

SEQ ID NO: 192101 - RNA, 63 nt, Homo Sapiens; identical to SEQ ID NO: 103132

SEQ ID NO: 192102 - RNA, 63 nt, Homo Sapiens; identical to SEQ ID NO: 103133

SEQ ID NO: 192103 - RNA, 63 nt, Homo Sapiens; identical to SEQ ID NO: 103134

SEQ ID NO: 192104 - RNA, 63 nt, Homo Sapiens; identical to SEQ ID NO: 103135

SEQ ID NO: 192105 - RNA, 63 nt, Homo Sapiens; identical to SEQ ID NO: 103136

SEQ ID NO: 192106 - RNA, 63 nt, Homo Sapiens; identical to SEQ ID NO: 103137

SEQ ID NO: 192107 - RNA, 63 nt, Homo Sapiens; identical to SEQ ID NO: 103138

SEQ ID NO: 192108 - RNA, 63 nt, Homo Sapiens; identical to SEQ ID NO: 103139

SEQ ID NO: 192109 - RNA, 63 nt, Homo Sapiens; identical to SEQ ID NO: 103140

SEQ ID NO: 192110 - RNA, 63 nt, Homo Sapiens; identical to SEQ ID NO: 103141

SEQ ID NO: 192111 - RNA, 63 nt, Homo Sapiens; identical to SEQ ID NO: 103142

SEQ ID NO: 192112 - RNA, 63 nt, Homo Sapiens; identical to SEQ ID NO: 103143

SEQ ID NO: 192113 - RNA, 63 nt, Homo Sapiens; identical to SEQ ID NO: 103144

SEQ ID NO: 192114 - RNA, 63 nt, Homo Sapiens; identical to SEQ ID NO: 103145

SEQ ID NO: 192115 - RNA, 63 nt, Homo Sapiens; identical to SEQ ID NO: 103146

SEQ ID NO: 192116 - RNA, 63 nt, Homo Sapiens; identical to SEQ ID NO: 103147

SEQ ID NO: 192117 - RNA, 63 nt, Homo Sapiens; identical to SEQ ID NO: 103148

SEQ ID NO: 192118 - RNA, 63 nt, Homo Sapiens; identical to SEQ ID NO: 103149

SEQ ID NO: 192119 - RNA, 63 nt, Homo Sapiens; identical to SEQ ID NO: 103150

SEQ ID NO: 192120 - RNA, 63 nt, Homo Sapiens; identical to SEQ ID NO: 103151

SEQ ID NO: 192121 - RNA, 63 nt, Homo Sapiens; identical to SEQ ID NO: 103152

SEQ ID NO: 192122 - RNA, 63 nt, Homo Sapiens; identical to SEQ ID NO: 103153

SEQ ID NO: 192123 - RNA, 63 nt, Homo Sapiens; identical to SEQ ID NO: 103154

SEQ ID NO: 192124 - RNA, 63 nt, Homo Sapiens; identical to SEQ ID NO: 103155

SEQ ID NO: 192125 - RNA, 63 nt, Homo Sapiens; identical to SEQ ID NO: 103156

SEQ ID NO: 192126 - RNA, 63 nt, Homo Sapiens; identical to SEQ ID NO: 103157

SEQ ID NO: 192127 - RNA, 63 nt, Homo Sapiens; identical to SEQ ID NO: 103158

SEQ ID NO: 192128 - RNA, 63 nt, Homo Sapiens; identical to SEQ ID NO: 103159

SEQ ID NO: 192129 - RNA, 63 nt, Homo Sapiens; identical to SEQ ID NO: 103160

SEQ ID NO: 192130 - RNA, 63 nt, Homo Sapiens; identical to SEQ ID NO: 103161

SEQ ID NO: 192131 - RNA, 63 nt, Homo Sapiens; identical to SEQ ID NO: 103162

SEQ ID NO: 192132 - RNA, 63 nt, Homo Sapiens; identical to SEQ ID NO: 103163

SEQ ID NO: 192133 - RNA, 63 nt, Homo Sapiens; identical to SEQ ID NO: 103164

SEQ ID NO: 192134 - RNA, 63 nt, Homo Sapiens; identical to SEQ ID NO: 103165

SEQ ID NO: 192135 - RNA, 63 nt, Homo Sapiens; identical to SEQ ID NO: 103166

SEQ ID NO: 192136 - RNA, 63 nt, Homo Sapiens; identical to SEQ ID NO: 103167

SEQ ID NO: 192137 - RNA, 63 nt, Homo Sapiens; identical to SEQ ID NO: 103168

SEQ ID NO: 192138 - RNA, 63 nt, Homo Sapiens; identical to SEQ ID NO: 103169

SEQ ID NO: 192139 - RNA, 63 nt, Homo Sapiens; identical to SEQ ID NO: 103170

SEQ ID NO: 192140 - RNA, 63 nt, Homo Sapiens; identical to SEQ ID NO: 103171

SEQ ID NO: 192141 - RNA, 63 nt, Homo Sapiens; identical to SEQ ID NO: 103172

SEQ ID NO: 192142 - RNA, 63 nt, Homo Sapiens; identical to SEQ ID NO: 103173

SEQ ID NO: 192143 - RNA, 63 nt, Homo Sapiens; identical to SEQ ID NO: 103174

SEQ ID NO: 192144 - RNA, 63 nt, Homo Sapiens; identical to SEQ ID NO: 103175

SEQ ID NO: 192145 - RNA, 63 nt, Homo Sapiens; identical to SEQ ID NO: 103176

SEQ ID NO: 192146 - RNA, 63 nt, Homo Sapiens; identical to SEQ ID NO: 103177

SEQ ID NO: 192147 - RNA, 63 nt, Homo Sapiens; identical to SEQ ID NO: 103178

SEQ ID NO: 192148 - RNA, 63 nt, Homo Sapiens; identical to SEQ ID NO: 103179

SEQ ID NO: 192149 - RNA, 63 nt, Homo Sapiens; identical to SEQ ID NO: 103180

SEQ ID NO: 192150 - RNA, 63 nt, Homo Sapiens; identical to SEQ ID NO: 103181

SEQ ID NO: 192151 - RNA, 63 nt, Homo Sapiens; identical to SEQ ID NO: 103182

SEQ ID NO: 192152 - RNA, 63 nt, Homo Sapiens; identical to SEQ ID NO: 103183

SEQ ID NO: 192153 - RNA, 63 nt, Homo Sapiens; identical to SEQ ID NO: 103184

SEQ ID NO: 192154 - RNA, 63 nt, Homo Sapiens; identical to SEQ ID NO: 103185

SEQ ID NO: 192155 - RNA, 63 nt, Homo Sapiens; identical to SEQ ID NO: 103186

SEQ ID NO: 192156 - RNA, 63 nt, Homo Sapiens; identical to SEQ ID NO: 103187

SEQ ID NO: 192157 - RNA, 63 nt, Homo Sapiens; identical to SEQ ID NO: 103188

SEQ ID NO: 192158 - RNA, 63 nt, Homo Sapiens; identical to SEQ ID NO: 103189

SEQ ID NO: 192159 - RNA, 63 nt, Homo Sapiens; identical to SEQ ID NO: 103190

SEQ ID NO: 192160 - RNA, 63 nt, Homo Sapiens; identical to SEQ ID NO: 103191

SEQ ID NO: 192161 - RNA, 63 nt, Homo Sapiens; identical to SEQ ID NO: 103192

SEQ ID NO: 192162 - RNA, 63 nt, Homo Sapiens; identical to SEQ ID NO: 103193

SEQ ID NO: 192163 - RNA, 63 nt, Homo Sapiens; identical to SEQ ID NO: 103194

SEQ ID NO: 192164 - RNA, 63 nt, Homo Sapiens; identical to SEQ ID NO: 103195

SEQ ID NO: 192165 - RNA, 51 nt, Homo Sapiens; identical to SEQ ID NO: 103196

SEQ ID NO: 192166 - RNA, 63 nt, Homo Sapiens; identical to SEQ ID NO: 103197

SEQ ID NO: 192167 - RNA, 63 nt, Homo Sapiens; identical to SEQ ID NO: 103198

SEQ ID NO: 192168 - RNA, 63 nt, Homo Sapiens; identical to SEQ ID NO: 103199

SEQ ID NO: 192169 - RNA, 63 nt, Homo Sapiens; identical to SEQ ID NO: 103200

SEQ ID NO: 192170 - RNA, 63 nt, Homo Sapiens; identical to SEQ ID NO: 103201

SEQ ID NO: 192171 - RNA, 63 nt, Homo Sapiens; identical to SEQ ID NO: 103202

SEQ ID NO: 192172 - RNA, 63 nt, Homo Sapiens; identical to SEQ ID NO: 103203

SEQ ID NO: 192173 - RNA, 63 nt, Homo Sapiens; identical to SEQ ID NO: 103204

SEQ ID NO: 192174 - RNA, 63 nt, Homo Sapiens; identical to SEQ ID NO: 103205

SEQ ID NO: 192175 - RNA, 63 nt, Homo Sapiens; identical to SEQ ID NO: 103206

SEQ ID NO: 192176 - RNA, 63 nt, Homo Sapiens; identical to SEQ ID NO: 103207

SEQ ID NO: 192177 - RNA, 63 nt, Homo Sapiens; identical to SEQ ID NO: 103208

SEQ ID NO: 192178 - RNA, 63 nt, Homo Sapiens; identical to SEQ ID NO: 103209

SEQ ID NO: 192179 - RNA, 63 nt, Homo Sapiens; identical to SEQ ID NO: 103210

SEQ ID NO: 192180 - RNA, 63 nt, Homo Sapiens; identical to SEQ ID NO: 103211

SEQ ID NO: 192181 - RNA, 63 nt, Homo Sapiens; identical to SEQ ID NO: 103212

SEQ ID NO: 192182 - RNA, 63 nt, Homo Sapiens; identical to SEQ ID NO: 103213

SEQ ID NO: 192183 - RNA, 63 nt, Homo Sapiens; identical to SEQ ID NO: 103214

SEQ ID NO: 192184 - RNA, 63 nt, Homo Sapiens; identical to SEQ ID NO: 103215

SEQ ID NO: 192185 - RNA, 63 nt, Homo Sapiens; identical to SEQ ID NO: 103216

SEQ ID NO: 192186 - RNA, 63 nt, Homo Sapiens; identical to SEQ ID NO: 103217

SEQ ID NO: 192187 - RNA, 63 nt, Homo Sapiens; identical to SEQ ID NO: 103218

SEQ ID NO: 192188 - RNA, 63 nt, Homo Sapiens; identical to SEQ ID NO: 103219

SEQ ID NO: 192189 - RNA, 63 nt, Homo Sapiens; identical to SEQ ID NO: 103220

SEQ ID NO: 192190 - RNA, 63 nt, Homo Sapiens; identical to SEQ ID NO: 103221

SEQ ID NO: 192191 - RNA, 63 nt, Homo Sapiens; identical to SEQ ID NO: 103222

SEQ ID NO: 192192 - RNA, 63 nt, Homo Sapiens; identical to SEQ ID NO: 103223

SEQ ID NO: 192193 - RNA, 63 nt, Homo Sapiens; identical to SEQ ID NO: 103224

SEQ ID NO: 192194 - RNA, 63 nt, Homo Sapiens; identical to SEQ ID NO: 103225

SEQ ID NO: 192195 - RNA, 63 nt, Homo Sapiens; identical to SEQ ID NO: 103226

SEQ ID NO: 192196 - RNA, 63 nt, Homo Sapiens; identical to SEQ ID NO: 103227

SEQ ID NO: 192197 - RNA, 63 nt, Homo Sapiens; identical to SEQ ID NO: 103228

SEQ ID NO: 192198 - RNA, 63 nt, Homo Sapiens; identical to SEQ ID NO: 103229

SEQ ID NO: 192199 - RNA, 63 nt, Homo Sapiens; identical to SEQ ID NO: 103230

SEQ ID NO: 192200 - RNA, 63 nt, Homo Sapiens; identical to SEQ ID NO: 103231

SEQ ID NO: 192201 - RNA, 63 nt, Homo Sapiens; identical to SEQ ID NO: 103232

SEQ ID NO: 192202 - RNA, 63 nt, Homo Sapiens; identical to SEQ ID NO: 103233

SEQ ID NO: 192203 - RNA, 63 nt, Homo Sapiens; identical to SEQ ID NO: 103234

SEQ ID NO: 192204 - RNA, 63 nt, Homo Sapiens; identical to SEQ ID NO: 103235

SEQ ID NO: 192205 - RNA, 63 nt, Homo Sapiens; identical to SEQ ID NO: 103236

SEQ ID NO: 192206 - RNA, 63 nt, Homo Sapiens; identical to SEQ ID NO: 103237

SEQ ID NO: 192207 - RNA, 63 nt, Homo Sapiens; identical to SEQ ID NO: 103238

SEQ ID NO: 192208 - RNA, 63 nt, Homo Sapiens; identical to SEQ ID NO: 103239

SEQ ID NO: 192209 - RNA, 63 nt, Homo Sapiens; identical to SEQ ID NO: 103240

SEQ ID NO: 192210 - RNA, 63 nt, Homo Sapiens; identical to SEQ ID NO: 103241

SEQ ID NO: 192211 - RNA, 63 nt, Homo Sapiens; identical to SEQ ID NO: 103242

SEQ ID NO: 192212 - RNA, 63 nt, Homo Sapiens; identical to SEQ ID NO: 103243

SEQ ID NO: 192213 - RNA, 63 nt, Homo Sapiens; identical to SEQ ID NO: 103244

SEQ ID NO: 192214 - RNA, 63 nt, Homo Sapiens; identical to SEQ ID NO: 103245

SEQ ID NO: 192215 - RNA, 63 nt, Homo Sapiens; identical to SEQ ID NO: 103246

SEQ ID NO: 192216 - RNA, 63 nt, Homo Sapiens; identical to SEQ ID NO: 103247

SEQ ID NO: 192217 - RNA, 63 nt, Homo Sapiens; identical to SEQ ID NO: 103248

SEQ ID NO: 192218 - RNA, 63 nt, Homo Sapiens; identical to SEQ ID NO: 103249

SEQ ID NO: 192219 - RNA, 63 nt, Homo Sapiens; identical to SEQ ID NO: 103250

SEQ ID NO: 192220 - RNA, 63 nt, Homo Sapiens; identical to SEQ ID NO: 103251

SEQ ID NO: 192221 - RNA, 63 nt, Homo Sapiens; identical to SEQ ID NO: 103252

SEQ ID NO: 192222 - RNA, 63 nt, Homo Sapiens; identical to SEQ ID NO: 103253

SEQ ID NO: 192223 - RNA, 63 nt, Homo Sapiens; identical to SEQ ID NO: 103254

SEQ ID NO: 192224 - RNA, 63 nt, Homo Sapiens; identical to SEQ ID NO: 103255

SEQ ID NO: 192225 - RNA, 63 nt, Homo Sapiens; identical to SEQ ID NO: 103256

SEQ ID NO: 192226 - RNA, 63 nt, Homo Sapiens; identical to SEQ ID NO: 103257

SEQ ID NO: 192227 - RNA, 63 nt, Homo Sapiens; identical to SEQ ID NO: 103258

SEQ ID NO: 192228 - RNA, 63 nt, Homo Sapiens; identical to SEQ ID NO: 103259

SEQ ID NO: 192229 - RNA, 63 nt, Homo Sapiens; identical to SEQ ID NO: 103260

SEQ ID NO: 192230 - RNA, 63 nt, Homo Sapiens; identical to SEQ ID NO: 103261

SEQ ID NO: 192231 - RNA, 63 nt, Homo Sapiens; identical to SEQ ID NO: 103262

SEQ ID NO: 192232 - RNA, 63 nt, Homo Sapiens; identical to SEQ ID NO: 103263

SEQ ID NO: 192233 - RNA, 63 nt, Homo Sapiens; identical to SEQ ID NO: 103264

SEQ ID NO: 192234 - RNA, 63 nt, Homo Sapiens; identical to SEQ ID NO: 103265

SEQ ID NO: 192235 - RNA, 63 nt, Homo Sapiens; identical to SEQ ID NO: 103266

SEQ ID NO: 192236 - RNA, 63 nt, Homo Sapiens; identical to SEQ ID NO: 103267

SEQ ID NO: 192237 - RNA, 63 nt, Homo Sapiens; identical to SEQ ID NO: 103268

SEQ ID NO: 192238 - RNA, 63 nt, Homo Sapiens; identical to SEQ ID NO: 103269

SEQ ID NO: 192239 - RNA, 63 nt, Homo Sapiens; identical to SEQ ID NO: 103270

SEQ ID NO: 192240 - RNA, 63 nt, Homo Sapiens; identical to SEQ ID NO: 103271

SEQ ID NO: 192241 - RNA, 63 nt, Homo Sapiens; identical to SEQ ID NO: 103272

SEQ ID NO: 192242 - RNA, 63 nt, Homo Sapiens; identical to SEQ ID NO: 103273

SEQ ID NO: 192243 - RNA, 63 nt, Homo Sapiens; identical to SEQ ID NO: 103274

SEQ ID NO: 192244 - RNA, 63 nt, Homo Sapiens; identical to SEQ ID NO: 103275

SEQ ID NO: 192245 - RNA, 63 nt, Homo Sapiens; identical to SEQ ID NO: 103276

SEQ ID NO: 192246 - RNA, 63 nt, Homo Sapiens; identical to SEQ ID NO: 103277

SEQ ID NO: 192247 - RNA, 63 nt, Homo Sapiens; identical to SEQ ID NO: 103278

SEQ ID NO: 192248 - RNA, 63 nt, Homo Sapiens; identical to SEQ ID NO: 103279

SEQ ID NO: 192249 - RNA, 63 nt, Homo Sapiens; identical to SEQ ID NO: 103280

SEQ ID NO: 192250 - RNA, 63 nt, Homo Sapiens; identical to SEQ ID NO: 103281

SEQ ID NO: 192251 - RNA, 63 nt, Homo Sapiens; identical to SEQ ID NO: 103282

SEQ ID NO: 192252 - RNA, 63 nt, Homo Sapiens; identical to SEQ ID NO: 103283

SEQ ID NO: 192253 - RNA, 63 nt, Homo Sapiens; identical to SEQ ID NO: 103284

SEQ ID NO: 192254 - RNA, 63 nt, Homo Sapiens; identical to SEQ ID NO: 103285

SEQ ID NO: 192255 - RNA, 63 nt, Homo Sapiens; identical to SEQ ID NO: 103286

SEQ ID NO: 192256 - RNA, 63 nt, Homo Sapiens; identical to SEQ ID NO: 103287

SEQ ID NO: 192257 - RNA, 63 nt, Homo Sapiens; identical to SEQ ID NO: 103288

SEQ ID NO: 192258 - RNA, 65 nt, Homo Sapiens
uuaaagggaaucggguacuuugcuuguugaauaaugcacuuuaaaacaaggaaccguaucaggcc

SEQ ID NO: 192259 - RNA, 65 nt, Homo Sapiens
ggguaguaaucaucuuguccccuuuuucauguucagcacuuuaauuuuuuugccuuacuuucaug

SEQ ID NO: 192260 - RNA, 65 nt, Homo Sapiens
gggagagacccuuucugaaagaaguauggccaaaagcacuuuaaugcugcugacauuguuguuuu

SEQ ID NO: 192261 - RNA, 65 nt, Homo Sapiens
gcuccccaauucugccugccuccucccucccagcugcacuuuaacccuagaagguggggaccugg

SEQ ID NO: 192262 - RNA, 65 nt, Homo Sapiens
aaggggcagcuccugaccaaagacgauacagcuuggcacuuuaaagcauuaacagcaggugugac

SEQ ID NO: 192263 - RNA, 65 nt, Homo Sapiens
aagaacuagcauugggcagaaugugucuuuuuuaggcacuuuauauucucaacauacaauguuaa

SEQ ID NO: 192264 - RNA, 65 nt, Homo Sapiens
gacuuguugcaacagcagucauacccaaaucauuugcacuuuaaaacuggaagauuaagcuuuug

SEQ ID NO: 192265 - RNA, 65 nt, Homo Sapiens
augauguucuuucuggagguucaacacuacguaccgcacuuuauaauuuaacuggaauugagaug

SEQ ID NO: 192266 - RNA, 65 nt, Homo Sapiens
aaaggacaucugaccuccuuuuuugguacauuaaggcacuuuauaaauggacuuuuauugucuca

SEQ ID NO: 192267 - RNA, 65 nt, Homo Sapiens
cuggcagaugauugaccaguauccuuugaccaucugcacuuuauuuggaaggaagcaggggcugu

SEQ ID NO: 192268 - RNA, 65 nt, Homo Sapiens
ccuuauucugguagauuugacuuguuuauaauucugcacuuuagaagaaaaacaguguuaaucug

SEQ ID NO: 192269 - RNA, 65 nt, Homo Sapiens
aaguccuuggaauugauucuaaggugauguucuuagcacuuuaauuccugucaaauuuuuuguuc

SEQ ID NO: 192270 - RNA, 65 nt, Homo Sapiens
ggcauguuuagucuaccaaaaacaauacuuuucaggcacuuuagaaauauccuuuuagaagcagc

SEQ ID NO: 192271 - RNA, 65 nt, Homo Sapiens
aaauaaaaagucauuaauuuauuaaaacuuguguggcacuuuaacauugcuuucaccuauauuuu

SEQ ID NO: 192272 - RNA, 65 nt, Homo Sapiens
ccuccccuguguccuguccagcugaagcuuuugcagcacuuuaccucucugaaagccccagagga

SEQ ID NO: 192273 - RNA, 65 nt, Homo Sapiens
aucuaggaaaacucugagcuacugcauuuaggcaggcacuuuaauaccaaacuguaacaugucuc

SEQ ID NO: 192274 - RNA, 65 nt, Homo Sapiens
ccccauuaaaauaccagagauaauggagauauuuugcacuuuagccuugaugaaaaguacaagau

SEQ ID NO: 192275 - RNA, 65 nt, Homo Sapiens
accaagggauggaagaaguaaauauagcucagguagcacuuuauacucaggcagaucucagcccu

SEQ ID NO: 192276 - RNA, 65 nt, Homo Sapiens
cuggaaauaaaaaguugggauauuaacuuguuuuugcacuuuagaauagcaugagaaucucacua

SEQ ID NO: 192277 - RNA, 65 nt, Homo Sapiens
aagcugaugcauuccuacagcauggaggaggcaucgcacuuuaccguuccuccuucuccaucccc

SEQ ID NO: 192278 - RNA, 65 nt, Homo Sapiens
agcucaacgcauccacucucgaccggcuccuccaugcacuuuaccaacccaggaaagcaccuaca

SEQ ID NO: 192279 - RNA, 65 nt, Homo Sapiens
gcaaguuaguguuucuagcaguuugcaugaaaacugcacuuuauuagaagaaaacugauggcuaa

SEQ ID NO: 192280 - RNA, 65 nt, Homo Sapiens
uaaauuucuaggugugagcccuuguugaagucugagcacuuuaugcuucucccuccccagggcca

SEQ ID NO: 192281 - RNA, 65 nt, Homo Sapiens
caauuuggauauuggaaugccuuggguagcaaugugcacuuuaaauuuugaaacuguuuuaauug

SEQ ID NO: 192282 - RNA, 65 nt, Homo Sapiens
ugaagauagagacuauguuaauaacaugcaaugaugcacuuuaaccuguguaauuuuaguaaugu

SEQ ID NO: 192283 - RNA, 65 nt, Homo Sapiens
ugacuuaaguggcauuaaacuaugcuuuacaaucugcacuuuaacuauucugggcaccuuccuaa

SEQ ID NO: 192284 - RNA, 65 nt, Homo Sapiens
cacuucuggcucacaggaaagauggucacacaccagcacuuuauacccuuugaccuuccccaaag

SEQ ID NO: 192285 - RNA, 65 nt, Homo Sapiens
uaguuuuuaauuaaucuuaaucuaaggaccuaaaagcacuuuauggcuuauuuauaucauguauc

SEQ ID NO: 192286 - RNA, 65 nt, Homo Sapiens
gauagacuuuaggggcuggcucaaaccucuuaugugcacuuuaaacucagacauagaguuaaaac

SEQ ID NO: 192287 - RNA, 65 nt, Homo Sapiens
aggccgaggcaggcggauugacaccuauaaucccagcacuuuaggcgggccaggcgcuguggcuc

SEQ ID NO: 192288 - RNA, 65 nt, Homo Sapiens
cagcugcagggcgggcaaggccauccucccauccugcacuuuagcagccugcagauaaugcccag

SEQ ID NO: 192289 - RNA, 65 nt, Homo Sapiens
aguccuccuguguacagcugagaugccaauaaagagcacuuuaugggcugaggcacuucuuuuuc

SEQ ID NO: 192290 - RNA, 65 nt, Homo Sapiens
ucacacuguccuauuaaugcgcuuugcuuuaaguugcacuuuaaaucuccuccauuauuacccag

SEQ ID NO: 192291 - RNA, 65 nt, Homo Sapiens
uaucauugaauucucacagccaggcgcugauguaagcacuuuaggauugagugcuugcuguaugc

SEQ ID NO: 192292 - RNA, 65 nt, Homo Sapiens
aauuuaugugguguuauugguucaauuuauaccuagcacuuuauagagcuacuggcccaagauua

SEQ ID NO: 192293 - RNA, 65 nt, Homo Sapiens
gcuuuuuaauuuuguuugaggugcaaucuucuugugcacuuuaagauacucugcacuuuucaauu

SEQ ID NO: 192294 - RNA, 65 nt, Homo Sapiens
uuuuuucaguaauuuccagcaaaaugaaaaccucugcacuuuaauucaucacaauucauggugcu

SEQ ID NO: 192295 - RNA, 65 nt, Homo Sapiens
cagacaccagcuguuugcaaaacaaaauguuccaagcacuuuaggacaggggaccuguuuaagag

SEQ ID NO: 192296 - RNA, 65 nt, Homo Sapiens
uacaacugaaaaaucagauuaaaauaagaaaaggagcacuuuaauugauuaauuuuauuuuacuu

SEQ ID NO: 192297 - RNA, 65 nt, Homo Sapiens
uccaaacuagauuuguugacuucacguucuccaaagcacuuuaacccgggugaaugcgaaugaac

SEQ ID NO: 192298 - RNA, 65 nt, Homo Sapiens
auaaacauaaaacaaauuuuuuacuuaacaugagugcacuuuacuaauccucauggcacaguggc

SEQ ID NO: 192299 - RNA, 65 nt, Homo Sapiens
ugcugacggccgcuggagaggugggcuccccucgugcacuuuauugccugggcaguuuugcuuga

SEQ ID NO: 192300 - RNA, 65 nt, Homo Sapiens
acgcagauuuuaauguuuacuuaaauauaaaccuggcacuuuacaaacaaauaaacauuguuugu

SEQ ID NO: 192301 - RNA, 65 nt, Homo Sapiens
gcccugcccccuggcugacuggccaguugcccagagcacuuuagcagaugugguuucaaaguaaa

SEQ ID NO: 192302 - RNA, 65 nt, Homo Sapiens
gucauugguauauuuuuacuuacuggauucuccuugcacuuuaccuguucuuuuccagagcugac

SEQ ID NO: 192303 - RNA, 65 nt, Homo Sapiens
acccagccccuccugcguaccaggagcuguguuaggcacuuuauauacauuauucuauguggccc

SEQ ID NO: 192304 - RNA, 65 nt, Homo Sapiens
ccuuuuuacaaaaacaaacauagaagaaaauaaaugcacuuuauccacuccccaauuggacugca

SEQ ID NO: 192305 - RNA, 65 nt, Homo Sapiens
cucuggacuguucuguaaaguggcugguaacaacagcacuuuacaguuuguagauguaaccagua

SEQ ID NO: 192306 - RNA, 65 nt, Homo Sapiens
ccucuugucugagaaccuaggccccagguaucacugcacuuuaagaaacuggaggcugcaacagg

SEQ ID NO: 192307 - RNA, 65 nt, Homo Sapiens
gaaaaucuggguaguaaaucuacccaauuaaaauggcacuuuauaaaagggaauagagaagagau

SEQ ID NO: 192308 - RNA, 65 nt, Homo Sapiens
gaucccuguacucacgugccagucuccugacuagagcacuuuacucuguuuccucagcccugcag

SEQ ID NO: 192309 - RNA, 65 nt, Homo Sapiens
gaacucaaaaaaacuuugaaaacuucagcacuguugcacuuuauguuuuaaaaaaugucacucuu

SEQ ID NO: 192310 - RNA, 65 nt, Homo Sapiens
uauuauuagggcauguuaacaguauaccaguaacagcacuuuaucucauuuauaugaacaccuuu

SEQ ID NO: 192311 - RNA, 65 nt, Homo Sapiens
acagcaccuuuaagcucuacccccuacaucaaaaugcacuuuagugccccuucacgguaccucgu

SEQ ID NO: 192312 - RNA, 65 nt, Homo Sapiens
ucaagaguugauaaagauuaccugugcagugcagagcacuuuaaugcaaccagcuuucaagaaaa

SEQ ID NO: 192313 - RNA, 65 nt, Homo Sapiens
acacagcacuuacuaugcuccaaacacuccucuaagcacuuuacacauauuagcucauucagucc

SEQ ID NO: 192314 - RNA, 65 nt, Homo Sapiens
ucauugugcggauuaaaagaaauaauauauguaaagcacuuuaacacagcaccaggcccacggaa

SEQ ID NO: 192315 - RNA, 65 nt, Homo Sapiens
gcaaggggaucuuuggggcuaacuucgggaucccugcacuuuauguaagaauguaaaccuggagu

SEQ ID NO: 192316 - RNA, 65 nt, Homo Sapiens
uuguuauagggaguaguuuuuucccuuaggacucugcacuuuauagaauguuguaaaacagacaa

SEQ ID NO: 192317 - RNA, 65 nt, Homo Sapiens
gggcugauaguuuuguuuaagguuuuggauaaggagcacuuuaaaacaaacugguguguuguuuu

SEQ ID NO: 192318 - RNA, 65 nt, Homo Sapiens
ccuuuuucauuaaggauacaaccuauuuguagcucgcacuuuaaaagaugcuugagauacauuuu

SEQ ID NO: 192319 - RNA, 65 nt, Homo Sapiens
aggcggagguugcagugggccaggaucgugccacugcacuuuauuuagccaggacaacacucugu

SEQ ID NO: 192320 - RNA, 65 nt, Homo Sapiens
aauggagacaccaccacccuugccauggagguuaagcacuuuaacacagugucuggcacuuggga

SEQ ID NO: 192321 - RNA, 65 nt, Homo Sapiens
ccacacaaauaacaagaauacuacuuaugaaaugugcacuuuauccucauuccauaaaugucggu

SEQ ID NO: 192322 - RNA, 65 nt, Homo Sapiens
gugugcgaaacacccuuuuuaucacuuuuaaauuugcacuuuauuuuuuuucuuccaugcuuguu

SEQ ID NO: 192323 - RNA, 65 nt, Homo Sapiens
guuacagaauaggaagaguagcacuuuccgccuaagcacuuuaggaaaucaccuuucuaagcccu

SEQ ID NO: 192324 - RNA, 65 nt, Homo Sapiens
ucuauucagaaucaaaccuuuuuauauuuuauacugcacuuuaguguauuuucugucacuguagg

SEQ ID NO: 192325 - RNA, 65 nt, Homo Sapiens
cuguucacuguacaaaagcuauguauaucccagcggcacuuuauaauauauauguguauaaauau

SEQ ID NO: 192326 - RNA, 65 nt, Homo Sapiens
cugaccaucgguaacggacaguuauauugcgauuggcacuuuaugcagccagccaagagccgggc

SEQ ID NO: 192327 - RNA, 65 nt, Homo Sapiens
auacagccuccuucuguuccuucuaaccuaccuaagcacuuuaaaggaggcauuucaaauucauc

SEQ ID NO: 192328 - RNA, 65 nt, Homo Sapiens
cuggugucuguuuuguuaauuaccuguuuaguguugcacuuuagauccaccgugggaacagagaa

SEQ ID NO: 192329 - RNA, 65 nt, Homo Sapiens
caagccauaguuaguuuuaucaacuuuauaaaauggcacuuuaaguucuggcuaauuaaaaaaga

SEQ ID NO: 192330 - RNA, 65 nt, Homo Sapiens
gucugaaggacagcaacaugcaauaacucaguguagcacuuuaaauuauugaacuguaauucucu

SEQ ID NO: 192331 - RNA, 65 nt, Homo Sapiens
uugggaccaaaacugccuacaggucuuauucuugugcacuuuauccccugcuccuaccuaucaua

SEQ ID NO: 192332 - RNA, 65 nt, Homo Sapiens
aagaauaaaacauucauguauucuucauguuuuaagcacuuuaugggcucuuuauaaagagcuug

SEQ ID NO: 192333 - RNA, 65 nt, Homo Sapiens
uuuauacagaacauucaggagggguuggaaacuuagcacuuuauauccuccuagcccugugggca

SEQ ID NO: 192334 - RNA, 65 nt, Homo Sapiens
acauagucacucuuuuuaguguucagagagauaaagcacuuuaguuuuuauaauguacugaugug

SEQ ID NO: 192335 - RNA, 65 nt, Homo Sapiens
ucaggaaaaucucucagcuugcuauacaugaaggggcacuuuaaaugcuugacugacacuucauu

SEQ ID NO: 192336 - RNA, 65 nt, Homo Sapiens
acuaucacaucuuugaaaacgagucaaauauuggugcacuuuaauaaaauaaagcaagcaaauuu

SEQ ID NO: 192337 - RNA, 65 nt, Homo Sapiens
ugaagaacugcacuuuuuuuguuuaccucauccaugcacuuuaauacucaaaacucuugaaauua

SEQ ID NO: 192338 - RNA, 65 nt, Homo Sapiens
uaugguuuucuuucugugugcagugucaugcuuuggcacuuuagcaaagaggcgcuggcuuucca

SEQ ID NO: 192339 - RNA, 65 nt, Homo Sapiens
ucccuuugagggaaacccugggagucagcaagcgagcacuuuauaggccuugggggcacuggcug

SEQ ID NO: 192340 - RNA, 65 nt, Homo Sapiens
uuaugaaaacauguagcagauuuuaguacaucauagcacuuuauuuacgagaaggcaaugugagg

SEQ ID NO: 192341 - RNA, 65 nt, Homo Sapiens
ugagaagcuaucaguaacagcuacucucaucgaaagcacuuuauuauuuuacggagcugcaaccu

SEQ ID NO: 192342 - RNA, 65 nt, Homo Sapiens
aacuugugggaguaauaccagcuugcaaugggucagcacuuuaccuuuuuucuuuaaggcuccca

SEQ ID NO: 192343 - RNA, 65 nt, Homo Sapiens
gggagcuggggacauuuuaaucaucaauaaacgaagcacuuuauucuguacagauuugggcaggc

SEQ ID NO: 192344 - RNA, 65 nt, Homo Sapiens
guaagguaccaaacuauuuauauugaaagcuauaugcacuuuauuucuuaacugaauugcaucaa

SEQ ID NO: 192345 - RNA, 65 nt, Homo Sapiens
gccaccacagagcacauggcugugucuaggcgcaagcacuuuagcaguaucuguuuacaugcgca

SEQ ID NO: 192346 - RNA, 65 nt, Homo Sapiens
ucuuauucucuagguucugagagugaaugcauugggcacuuuaaguugauauuuucucuucuccg

SEQ ID NO: 192347 - RNA, 65 nt, Homo Sapiens
aaaguguccacaacaguuagggaaaugaugcuagagcacuuuaaaaaucagcaggacaacccuga

SEQ ID NO: 192348 - RNA, 65 nt, Homo Sapiens
guauuuacuaaguuauuggauuuacaugaaaucuggcacuuuaggguguucuuuuucucacagag

SEQ ID NO: 192349 - RNA, 65 nt, Homo Sapiens
caggaagcugaagugugugaaguacaaagcugacagcacuuuauuuuauugcucuccauuauuug

SEQ ID NO: 192350 - RNA, 65 nt, Homo Sapiens
uguuaaaaguauuugggcuaaggaagucaauuaaugcacuuuagagguccuuaggaaaauuccua

SEQ ID NO: 192351 - RNA, 65 nt, Homo Sapiens
ugauuaauccucaauucaugucaacauuuggaauugcacuuuaauccaagccucauuuggaaggc

SEQ ID NO: 192352 - RNA, 65 nt, Homo Sapiens
agcaagguaugcuuucuucccugcuagaggcuacagcacuuuacaaguuugccuggggccuagcc

SEQ ID NO: 192353 - RNA, 65 nt, Homo Sapiens
acaaaugcaugagugguauuuuagacagaacuuuggcacuuuagaggucuagacguguuaauaag

SEQ ID NO: 192354 - RNA, 65 nt, Homo Sapiens
cauaauuaaaagcuuaauguacucugauaggaaaagcacuuuaaauacuacaucuaagaggcuaa

SEQ ID NO: 192355 - RNA, 65 nt, Homo Sapiens
acagauuaaucaagagugggguguaaauaauacuggcacuuuagauggcuaaaaaaaaaaaaaaa

SEQ ID NO: 192356 - RNA, 65 nt, Homo Sapiens
uaucuuauugcuaacccucaccuguuaugcaccaggcacuuuaugcagccaccauuuauucagca

SEQ ID NO: 192357 - RNA, 65 nt, Homo Sapiens
aaauucuuuaccuuuuccuugaaucccugauugcugcacuuuaaagugaaacacauuagucacaa

SEQ ID NO: 192358 - RNA, 65 nt, Homo Sapiens
uaugugcaguuuguuguauguguguaucaaauugugcacuuuaaguuucaugcuguuuaaaagac

SEQ ID NO: 192359 - RNA, 65 nt, Homo Sapiens
uuucuaccugcauauggacuuaacuugcuucuguugcacuuuaguauaagugaguacacucuaau

SEQ ID NO: 192360 - RNA, 65 nt, Homo Sapiens
aaaagugaaagcgacaaauuaugacauuuuauguagcacuuuauaauguuuuuaaauuuggaaau

SEQ ID NO: 192361 - RNA, 65 nt, Homo Sapiens
acucuuuugaacugaaagcauuuuuauauagcuaggcacuuuauuuacaauuugaagucuugugg

SEQ ID NO: 192362 - RNA, 65 nt, Homo Sapiens
aucuuauuuaugccuugcugugguauuguauauaugcacuuuaauguucccaaucuaaacuuuuc

SEQ ID NO: 192363 - RNA, 65 nt, Homo Sapiens
uauaucucauuucauucucacagagucuaggcuaagcacuuuauccuuaauuauuaacaaagugc

SEQ ID NO: 192364 - RNA, 65 nt, Homo Sapiens
gcuauggaaacaugagauucgcagggauaaggggugcacuuuauagcacauuugugaagagguuc

SEQ ID NO: 192365 - RNA, 65 nt, Homo Sapiens
uguaucaugaaaugauuugagaccaccagucagaggcacuuuauuaccauuacccaggucugacu

SEQ ID NO: 192366 - RNA, 65 nt, Homo Sapiens
ccaggcuagacuaggagguuccggugucuggaaaagcacuuuacagaugagauucccucuccucc

SEQ ID NO: 192367 - RNA, 65 nt, Homo Sapiens
auagccaggcauaguggcucacgccuguaaucccagcacuuuaggaggccaaggcggguggauca

SEQ ID NO: 192368 - RNA, 65 nt, Homo Sapiens
gaacaggggcuaccugccacauccccuccacagaugcacuuuaaaaagccacucaugcuuuggcu

SEQ ID NO: 192369 - RNA, 65 nt, Homo Sapiens
cuuaccucacagugauguugugaggacauguggaagcacuuuaaguuuuuucaucauaacauaaa

SEQ ID NO: 192370 - RNA, 65 nt, Homo Sapiens
ugccucuuaaaccauuaacaguacuuuagacauuggcacuuuauuuuucucguagaucuuuagcu

SEQ ID NO: 192371 - RNA, 65 nt, Homo Sapiens
ucucccacucaaaccucucccaucucccaacaacugcacuuuagaauaccagcagugaaauggua

SEQ ID NO: 192372 - RNA, 65 nt, Homo Sapiens
ggaugcuagucuuugugaccgauugcuaaucuucugcacuuuaauuuauuuuauauaaacuuuac

SEQ ID NO: 192373 - RNA, 65 nt, Homo Sapiens
cgacaaucaagaauguuauuaauguguaauacugagcacuuuacuucuuaauaaaaacuugauau

SEQ ID NO: 192374 - RNA, 65 nt, Homo Sapiens
aauucaccagcaguaauccuuuaauaacuggcagagcacuuuauucuucuggugagcucccugaa

SEQ ID NO: 192375 - RNA, 65 nt, Homo Sapiens
uuagaaaacgguccuaagagauucuuugguguuuggcacuuuaaggucaucguugggcagaaguu

SEQ ID NO: 192376 - RNA, 65 nt, Homo Sapiens
gugacugagaaucuagcacuucuccacuuguagcugcacuuuaagucucagcagaagauacgauc

SEQ ID NO: 192377 - RNA, 65 nt, Homo Sapiens
cauagcacauuucuuguguucaggcuuucuuucaugcacuuuacugucuacuucauuuagcugag

SEQ ID NO: 192378 - RNA, 65 nt, Homo Sapiens
uguacacauaaucauauuuagcauagguaaugugugcacuuuaugauguuucuuggcauuguuca

SEQ ID NO: 192379 - RNA, 65 nt, Homo Sapiens
uagaugaaaacuggauuucuacaaugaagaggauagcacuuuaucauguuaguggccauuuugca

SEQ ID NO: 192380 - RNA, 65 nt, Homo Sapiens
aggccaagguagguggaucaacgccuguaaucccagcacuuuagguaggccauggacgguggcuc

SEQ ID NO: 192381 - RNA, 65 nt, Homo Sapiens
aaaagccugaugugggucuuauugcacggguuuuggcacuuuagaucucaccugaaguuaugggg

SEQ ID NO: 192382 - RNA, 65 nt, Homo Sapiens
agucaaaaauguguuuaccucuuugccccggaauagcacuuuaauuuaaacgaaacugagaaaaa

SEQ ID NO: 192383 - RNA, 65 nt, Homo Sapiens
uacaggcgugagucacagcccccggccauaauuuagcacuuuaaaaaauaauagccauguugggc

SEQ ID NO: 192384 - RNA, 65 nt, Homo Sapiens
cacacauauauuauuugcagugcaguauagaauaggcacuuuaaaacacucuuuccccgcacccc

SEQ ID NO: 192385 - RNA, 65 nt, Homo Sapiens
uuuuauaaugucccugcccagggaccuguuagaaagcacuuuauuuuuuauauauuaaauauuua

SEQ ID NO: 192386 - RNA, 65 nt, Homo Sapiens
uggcauuuucuguuccagguuucuuccacccacgagcacuuuauucuccuccgagacccccuuuu

SEQ ID NO: 192387 - RNA, 65 nt, Homo Sapiens
cagagaacugaugcgacuuguuuugcugcuugguagcacuuuaaaaaauuuuuugauuaaugaag

SEQ ID NO: 192388 - RNA, 65 nt, Homo Sapiens
ccaucauaauucagucucuucuuauucuacagugugcacuuuaugccucucgccuuuugauaaua

SEQ ID NO: 192389 - RNA, 65 nt, Homo Sapiens
guuaaauuuguaaacaaucuaauuaaauggcaucagcacuuuaaccaaugacguuugcauagaga

SEQ ID NO: 192390 - RNA, 65 nt, Homo Sapiens
aaagugagauggaacugccacagaaacacuccuuagcacuuuaaguucaaaauuguaucaugaua

SEQ ID NO: 192391 - RNA, 65 nt, Homo Sapiens
gcacuuucaauucuuauaaagaauauagacacaaugcacuuuauucuuuucaaaucuaguaauuu

SEQ ID NO: 192392 - RNA, 65 nt, Homo Sapiens
cuuaaugcagugggcagugucuauauauauagggagcacuuuaaaucuuugcuuacuuuuacugu

SEQ ID NO: 192393 - RNA, 65 nt, Homo Sapiens
auguaggcuaaacuaagcaaucccaucuaugaauagcacuuuauguguuuagcaggcuguuaauu

SEQ ID NO: 192394 - RNA, 65 nt, Homo Sapiens
guaauucagaauaaaauuuagguaauuaucauucagcacuuuauuaaaguacuaaaaaagauuca

SEQ ID NO: 192395 - RNA, 65 nt, Homo Sapiens
acaggcaaugcuacaggaacaaagucccuuuuauagcacuuuagcuuuuuuuuuuggcccccaag

SEQ ID NO: 192396 - RNA, 65 nt, Homo Sapiens
agccaaugaagcaaacacaccuggccauuuaacuagcacuuuauaaagaccuuacaaccacauuu

SEQ ID NO: 192397 - RNA, 65 nt, Homo Sapiens
uucauuuuuaaaauuaggagauguuacguaacuuggcacuuuaguaguguauacacuagcauuag

SEQ ID NO: 192398 - RNA, 65 nt, Homo Sapiens
gcaaaguggugguggggucaagacagaugacaccagcacuuuaaacucuuuguguggguaugcgu

SEQ ID NO: 192399 - RNA, 65 nt, Homo Sapiens
caaucacaaccauaaagcuacaagcacgcacugaagcacuuuacugauacucauucaauuauuca

SEQ ID NO: 192400 - RNA, 65 nt, Homo Sapiens
uaaaauacccuaaucacauuaugaucuugacaggugcacuuuacuggggagaauaaaaaggacca

SEQ ID NO: 192401 - RNA, 65 nt, Homo Sapiens
uagaacaucagagaaggcacauugacuagcaaacagcacuuuaggaaaagucaccguagcccacu

SEQ ID NO: 192402 - RNA, 65 nt, Homo Sapiens
acaccuucccgacacuuuuuuaauguuguagcugagcacuuuaacaaguugagcauuccauguuu

SEQ ID NO: 192403 - RNA, 65 nt, Homo Sapiens
aguuggcucagcugugugcccaguuccuccugugggcacuuuagcaggcuccgagcuuuccuggc

SEQ ID NO: 192404 - RNA, 65 nt, Homo Sapiens
acaccuauuccacagagacugauuuauagggggcagcacuuuauuuuuuucuggaaacccaaguu

SEQ ID NO: 192405 - RNA, 65 nt, Homo Sapiens
cuaaggcuucugcaggauuuauuaucuccugauaugcacuuuaaaauuagucuuuguaguucuau

SEQ ID NO: 192406 - RNA, 65 nt, Homo Sapiens
auguaacaaacuuacaaggacaaagaggcuuguuggcacuuuacauauacaguguauacaugugu

SEQ ID NO: 192407 - RNA, 65 nt, Homo Sapiens
gucaaacgaagacauuccaauacugcuuaauuauagcacuuuauuuuuagcugcugaacugccaa

SEQ ID NO: 192408 - RNA, 65 nt, Homo Sapiens
aaaucaagauaaccucuugaauguaauagcucauagcacuuuaauuuggcaagccauuuuuccug

SEQ ID NO: 192409 - RNA, 65 nt, Homo Sapiens
uagaauacuuugccucgauauauaagcauacagaugcacuuuaaaugaaaacccuugauuauaaa

SEQ ID NO: 192410 - RNA, 65 nt, Homo Sapiens
cccucucccucucacugaucucauuuuuacgagaagcacuuuauuaauguguguauuuauuuugg

SEQ ID NO: 192411 - RNA, 65 nt, Homo Sapiens
acaucugguuggauggcucuaauugcccucagccagcacuuuaggaauggccuucuggacuuguu

SEQ ID NO: 192412 - RNA, 65 nt, Homo Sapiens
cauugcacuugaguuuauuguuguauccauggcuggcacuuuacuuuuuguuuuauuuuuuguuu

SEQ ID NO: 192413 - RNA, 65 nt, Homo Sapiens
uaugguacuaagauaaagacgccuccauucauggugcacuuuauuccucaggcgaguggcuuaua

SEQ ID NO: 192414 - RNA, 65 nt, Homo Sapiens
uuuccuuuuugggugaaaugcuuguacugcuagaagcacuuuauggaaaggccaugccaaccgug

SEQ ID NO: 192415 - RNA, 65 nt, Homo Sapiens
gccggucaggcccuaaaguaccacgguccccgcgugcacuuuaggccaaacugaccaggggacgg

SEQ ID NO: 192416 - RNA, 65 nt, Homo Sapiens
cacaguuaugucuuauaacuacuuuaauuugaaaugcacuuuaugaaauuucucuccugaugggu

SEQ ID NO: 192417 - RNA, 65 nt, Homo Sapiens
uuucucuccugauggguacuaguaccuuauguauugcacuuuaaaagcaacuuugcacuauguaa

SEQ ID NO: 192418 - RNA, 65 nt, Homo Sapiens
uuuacuuaacuuaccauaaaucaagauuauucugugcacuuuaaauuuugccuucuuauguauuu

SEQ ID NO: 192419 - RNA, 65 nt, Homo Sapiens
uuuucaugcugcuuauuguuuggggcuuuuauguagcacuuuacguuuucaaaauuuauguaaug

SEQ ID NO: 192420 - RNA, 65 nt, Homo Sapiens
accaagccucugggauuuuauaaggaaaguuugcugcacuuuauuacuggaguucuuauucaaua

SEQ ID NO: 192421 - RNA, 65 nt, Homo Sapiens
aaggaaaaggcagccuuuacauauaaagcuaauaagcacuuuaaaguaaaaaccauuguuuuugg

SEQ ID NO: 192422 - RNA, 65 nt, Homo Sapiens
uccaguauuuguuuacucaugaggagaaaggcgcugcacuuuaaagggugggaaaaucgaaggga

SEQ ID NO: 192423 - RNA, 65 nt, Homo Sapiens
gugucuuacuacuguuugagacuagugucguuguagcacuuuacuguaauauauaacuuauuuag

SEQ ID NO: 192424 - RNA, 65 nt, Homo Sapiens
ccuucaguucagagccaaaaugggucuagaaucuggcacuuuacucauuuccuuugauaaauugu

SEQ ID NO: 192425 - RNA, 65 nt, Homo Sapiens
ucucucuggacaucaauguagaguccaucuuucaagcacuuuaauuuuuuuagcugccaaagggu

SEQ ID NO: 192426 - RNA, 65 nt, Homo Sapiens
uaccaucgagcuuacccgggcccggcuccugucaagcacuuuaguuagcuguuggugucauguuu

SEQ ID NO: 192427 - RNA, 65 nt, Homo Sapiens
uuuacaaccaugaccccuuggacacuggacugcaugcacuuuacauaucacaaaaugcucucaua

SEQ ID NO: 192428 - RNA, 65 nt, Homo Sapiens
ggggcagacuuugcacuuacugcagugcaacacuugcacuuuaauuuuccuccaacugucuaaaa

SEQ ID NO: 192429 - RNA, 65 nt, Homo Sapiens
uuuaaaagcucuaguuuugcuuagugugaauucuggcacuuuaaaaagauuaagcaagugaaauu

SEQ ID NO: 192430 - RNA, 65 nt, Homo Sapiens
uuuguuuuuuuaaauacagaagucauguuguuucugcacuuuauaauaaagcauggaagaaauua

SEQ ID NO: 192431 - RNA, 65 nt, Homo Sapiens
auaaacgagcuccuaguuuuaaaaucucugccauugcacuuuauagucugauuacaaaacgugca

SEQ ID NO: 192432 - RNA, 65 nt, Homo Sapiens
cccauauuuguguucaguuccagcuuuuguagauggcacuuuagugauugcuuuuauuacauuag

SEQ ID NO: 192433 - RNA, 65 nt, Homo Sapiens
ccagggaagaggagugucgguaguucuugcaguaggcacuuuaucaggaccugaccuguugcugg

SEQ ID NO: 192434 - RNA, 65 nt, Homo Sapiens
uuuuuuauuagaaaguagaaccuuauacugaugaggcacuuuauauacaaacugguaucagaauu

SEQ ID NO: 192435 - RNA, 65 nt, Homo Sapiens
ugagggugggugggaguaauucugccauggacugugcacuuuauuccuguugcauuauucuaugg

SEQ ID NO: 192436 - RNA, 65 nt, Homo Sapiens
auaugccuuguuucauauuucaauuaauuccuucagcacuuuagaguauucguuaucuaauaggg

SEQ ID NO: 192437 - RNA, 65 nt, Homo Sapiens
gacugggggaggggguuuuucucacccaccacgaggcacuuuacaaaacacacgaugcaccuuaa

SEQ ID NO: 192438 - RNA, 65 nt, Homo Sapiens
cuguuguguucuauuuccacacugagggucucaaagcacuuuaaaguauucacguguacuguuua

SEQ ID NO: 192439 - RNA, 65 nt, Homo Sapiens
aaauauaagggagaaaaugaaaaugaguuuuuaaagcacuuuagacucugaaaaauguguagauu

SEQ ID NO: 192440 - RNA, 65 nt, Homo Sapiens
cauacaaaauaaucaaaauaccuaauccagucucagcacuuuauucuggaggcccauucuguauu

SEQ ID NO: 192441 - RNA, 65 nt, Homo Sapiens
ggaagaaaagauauguuucugucauucucuauauggcacuuuaaaguggcucuggguuauaagau

SEQ ID NO: 192442 - RNA, 65 nt, Homo Sapiens
cgcgaagaaguugccggaugaccccggcccccaaugcacuuuacguguuuacagauccggccagg

SEQ ID NO: 192443 - RNA, 65 nt, Homo Sapiens
gauagaugcaaccuuauuuuuaaauuuuauacaaagcacuuuaauaacauuccccuauuuuucuu

SEQ ID NO: 192444 - RNA, 65 nt, Homo Sapiens
aacaggccagccugcuuggggcacugcaugucagagcacuuuaaaucaucacccuuccgacagga

SEQ ID NO: 192445 - RNA, 65 nt, Homo Sapiens
ugaccccauagcacuuuguuucuucgccuugauuugcacuuuacaauguccccagccccucugca

SEQ ID NO: 192446 - RNA, 65 nt, Homo Sapiens
ccuaacacaggcaggcaccagaaauaaaugucucagcacuuuacagaugacuaaaaauguuaauu

SEQ ID NO: 192447 - RNA, 65 nt, Homo Sapiens
uugaacuuuuacaaaaccacuugagaauuucaugagcacuuuaaaaucugaacuuucaaagcuug

SEQ ID NO: 192448 - RNA, 65 nt, Homo Sapiens
uuuucuaauauuaguuuuagauuuucacguauuaggcacuuuaguugaaucuuccagcaaaagcu

SEQ ID NO: 192449 - RNA, 65 nt, Homo Sapiens
cagugaacagauuuugugaagugccuucuguuuuagcacuuuaaguuuaucacauuuuguugacu

SEQ ID NO: 192450 - RNA, 65 nt, Homo Sapiens
ucuuuguuuuuuguuuucauuaaagagccauucuggcacuuuaaugauaaaaucccauuguauuu

SEQ ID NO: 192451 - RNA, 65 nt, Homo Sapiens
uaagauuucaauucuuggauaaucaggcucuguuugcacuuuauauuuuagcagauacagucucu

SEQ ID NO: 192452 - RNA, 65 nt, Homo Sapiens
uggaauaauuagcuuguuacaguuuaguuuguuaugcacuuuaaaaaaaaugccacuuaacagga

SEQ ID NO: 192453 - RNA, 65 nt, Homo Sapiens
gaguguuucugacucuaaacuggaccaucaguuuugcacuuuagaguuuuagcuauuugagaucg

SEQ ID NO: 192454 - RNA, 65 nt, Homo Sapiens
cauuuuugugccauuauauuucuugugauuugguugcacuuuagaaccaguuugcaugauucuuc

SEQ ID NO: 192455 - RNA, 65 nt, Homo Sapiens
cugaaggaugauacuguaacauugguuauaucagagcacuuuaauaggauuucguuugcuguggc

SEQ ID NO: 192456 - RNA, 65 nt, Homo Sapiens
auaauuaaacucuuuugugcauuuagccaagugaugcacuuuauggcugauuuucuuuuuaauau

SEQ ID NO: 192457 - RNA, 65 nt, Homo Sapiens
aaguuguccucaugaauuagccaaguuaauuaagggcacuuuagguauagcuguuuacaaaaucu

SEQ ID NO: 192458 - RNA, 65 nt, Homo Sapiens
aacuuggcuauuuucuugacacuuuuaugggugcugcacuuuauuuuuguucgguuuuugauggg

SEQ ID NO: 192459 - RNA, 65 nt, Homo Sapiens
ccauuugcacuuuucaaaugccuuuggaugacccagcacuuuaaucugaaaccugcaacaagacu

SEQ ID NO: 192460 - RNA, 65 nt, Homo Sapiens
accucuggagccuauggcuuuaagcaagcacuacugcacuuuacagaauuaccccacuggauccu

SEQ ID NO: 192461 - RNA, 65 nt, Homo Sapiens
auaaguugaagauuguggggcuacuuuuucucauagcacuuuauuuugaauguuguuaguuugug

SEQ ID NO: 192462 - RNA, 65 nt, Homo Sapiens
ucaagccuuuauggcugcugggcugagugacacaagcacuuuaauggccuggagggacuuuuaau

SEQ ID NO: 192463 - RNA, 65 nt, Homo Sapiens
uauacuuaaaaacacacaauguuaaaaaaaauaaagcacuuuauccaauuaggccaagauuuaac

SEQ ID NO: 192464 - RNA, 51 nt, Homo Sapiens
auaacuugaauauuaucuauagcacuuuaauaguugcuaaauuuugcuuga

SEQ ID NO: 192465 - RNA, 65 nt, Homo Sapiens
guuuuuuguuacuugaaaacguaaaagacaaaauugcacuuuaaugacagaacuuuuguucagau

SEQ ID NO: 192466 - RNA, 65 nt, Homo Sapiens
uagcauugaaugaucaaauauuuucgauauucaaugcacuuuauguaaaauuggcgcuuguuuua

SEQ ID NO: 192467 - RNA, 65 nt, Homo Sapiens
cucucucaucagggcccaagauaaagaaagauugugcacuuuaacgucuguucccagcaaacacg

SEQ ID NO: 192468 - RNA, 65 nt, Homo Sapiens
cugucuguaaugggaucuauuggcccucauuccaagcacuuuacguugugcucuuuguucaucau

SEQ ID NO: 192469 - RNA, 65 nt, Homo Sapiens
cuucuauagaaaagauaucgcaccucugaacccaggcacuuuaaaagcugugggaaaggaauggg

SEQ ID NO: 192470 - RNA, 65 nt, Homo Sapiens
aacaguacuuuuccuauaauaggcaaauguuucaagcacuuuagagaaaaagagaacagugacgu

SEQ ID NO: 192471 - RNA, 65 nt, Homo Sapiens
uugggcuguaguuauuuuuuuguauuugccccagggcacuuuaauugauucuuaguugauugaua

SEQ ID NO: 192472 - RNA, 65 nt, Homo Sapiens
aaagcugggccucaguggggcuggcucuguaucaggcacuuuauuuaucaccuggguucuguccc

SEQ ID NO: 192473 - RNA, 65 nt, Homo Sapiens
aaggaagcugaccgcacagugccccaccgauacuggcacuuuaaaagcccugagagucccuuccu

SEQ ID NO: 192474 - RNA, 65 nt, Homo Sapiens
uaaucacugauuucaaauauuaagcaaaauguaaagcacuuuaauuuauagcuaugguuauaaac

SEQ ID NO: 192475 - RNA, 65 nt, Homo Sapiens
cugucuguuuuuguaacacuuaaguuauuuuaucagcacuuuaugcacguauuauugacauuaau

SEQ ID NO: 192476 - RNA, 65 nt, Homo Sapiens
gaugguuuuuuggaguaccaagcaaggggaauggagcacuuuaagggcgccuguuaguaacauga

SEQ ID NO: 192477 - RNA, 65 nt, Homo Sapiens
uucaaagcuuuuuucauuuauuuauuuuguuuauugcacuuuaugaaaacugaagcaucaauaaa

SEQ ID NO: 192478 - RNA, 65 nt, Homo Sapiens
cagcuugaaggccuuuugaguucugcuggacaggagcacuuuaucugaagacaaacucauuuaau

SEQ ID NO: 192479 - RNA, 65 nt, Homo Sapiens
cugcuccuagagcagguccauaccaaguaauagaggcacuuuagcuuccacuugguggguaaggc

SEQ ID NO: 192480 - RNA, 65 nt, Homo Sapiens
gcuguguucauacacagaaggggccugagauuucugcacuuuaaacaagcuccuccuaggugagg

SEQ ID NO: 192481 - RNA, 65 nt, Homo Sapiens
cagagacagguaugguccaguuccucuuuuauauagcacuuuaucauucuccacaaguaguuugu

SEQ ID NO: 192482 - RNA, 65 nt, Homo Sapiens
uguacaguguuuucuaaauauuuccuguuuuuucagcacuuuaacagaugccauuccagguuaaa

SEQ ID NO: 192483 - RNA, 65 nt, Homo Sapiens
ucagaggaagguaucccaaugaauaucaauuaagggcacuuuaauauauaaauuauaaacuaagu

SEQ ID NO: 192484 - RNA, 65 nt, Homo Sapiens
gucucaaucuuggauguuucauuuuaugaauggaggcacuuuacuaggucuagaauauuuuuuua

SEQ ID NO: 192485 - RNA, 65 nt, Homo Sapiens
uuuaauugaauacuguuucuucagucaugguuauugcacuuuauccugaauaauaauucagaaau

SEQ ID NO: 192486 - RNA, 65 nt, Homo Sapiens
aaaacaucagcuguggaguggucugauacucaguggcacuuuauuggauguuuucaguuugauca

SEQ ID NO: 192487 - RNA, 65 nt, Homo Sapiens
aaguaaguuuuucuguuacuugagccuaagaucuagcacuuuacauagcagacaccacaugcccu

SEQ ID NO: 192488 - RNA, 65 nt, Homo Sapiens
gaagaaaaucuuuauuuuguuucacugagcaaacagcacuuuacaugcucugugguggcgcauga

SEQ ID NO: 192489 - RNA, 65 nt, Homo Sapiens
aaacgaaauauuuccuaaauaaaucuucaaaagaugcacuuuaggauauugcaguuuuacuaggc

SEQ ID NO: 192490 - RNA, 65 nt, Homo Sapiens
gguaguauuagcuguuuuuaacaaugaaaauggaagcacuuuaguccuugcuaaguaguuuugac

SEQ ID NO: 192491 - RNA, 65 nt, Homo Sapiens
aacacaaauccucacaauacucgaaggcgccugaagcacuuuauauacuuguauguugccuuucu

SEQ ID NO: 192492 - RNA, 65 nt, Homo Sapiens
gcuugggacugauuugggggaagcaaaacugaugugcacuuuaugaguggggacagcaaaaagac

SEQ ID NO: 192493 - RNA, 65 nt, Homo Sapiens
guuugagaagcaaggaccuaagcugauuccuauaagcacuuuagaugcauuuuagcaagaccccc

SEQ ID NO: 192494 - RNA, 65 nt, Homo Sapiens
uaagguagaauggaaaaaacuauuuuuuaauuaaugcacuuuaaaaugauaaagaagugguucau

SEQ ID NO: 192495 - RNA, 65 nt, Homo Sapiens
gcaguaagggcuuggcaucccuggaaacuuacaaugcacuuuagccugggaaaccaaguuugcac

SEQ ID NO: 192496 - RNA, 65 nt, Homo Sapiens
acauuauuuaauuaauggcuucaaaagguggagaugcacuuuauuuaaugucuuucccuagcuaa

SEQ ID NO: 192497 - RNA, 65 nt, Homo Sapiens
uguucaccagaaggaaaaaaaaaaaucaguuuuaugcacuuuauuuuguuuugauuuucauuuuu

SEQ ID NO: 192498 - RNA, 65 nt, Homo Sapiens
ggccagcauggggaagagaugguugcaggcaaaaugcacuuuauagagauuuucuauugcuggga

SEQ ID NO: 192499 - RNA, 65 nt, Homo Sapiens
gaauucuaaucucuggaggcuggcagcuugacuuggcacuuuagggccccuuagcagggugagcu

SEQ ID NO: 192500 - RNA, 65 nt, Homo Sapiens
ucagcugggcgcaguggcucaugcuuguaaucacagcacuuuaggaggcugaggcaggaggacug

SEQ ID NO: 192501 - RNA, 65 nt, Homo Sapiens
aaagauccucucucuagggcagcagagagcuuuuugcacuuuaaaaaaaaaaagaaagaaagaaa

SEQ ID NO: 192502 - RNA, 65 nt, Homo Sapiens
ccugauggcugaugccggcccggcaaauaggcaccgcacuuuacucuugggacucggggacuugg

SEQ ID NO: 192503 - RNA, 65 nt, Homo Sapiens
gggcugagugggaacuuggcaagcagaaguggggagcacuuuaaugcaacccagguaugcuccau

SEQ ID NO: 192504 - RNA, 65 nt, Homo Sapiens
ucugcugaacgguccuaguguuuggacacaauagugcacuuuaaaaccugcuugguuaccaagug

SEQ ID NO: 192505 - RNA, 65 nt, Homo Sapiens
augacuggcgaaaauacuucacaagcucauuuugagcacuuuaggaaguaagugaaaguaccuaa

SEQ ID NO: 192506 - RNA, 65 nt, Homo Sapiens
ggcuuguagcuaugcaucauuuuccuacggcguuagcacuuuaagcacauccccuaggggagggg

SEQ ID NO: 192507 - RNA, 65 nt, Homo Sapiens
uguuucucucccaccugccacuggaacuggagaaugcacuuuauucugggcggggggugaguggg

SEQ ID NO: 192508 - RNA, 65 nt, Homo Sapiens
uaaucugcaugccauugagacuucucacaagugaugcacuuuaaaacagucagaaauuugagaag

SEQ ID NO: 192509 - RNA, 65 nt, Homo Sapiens
ccugcuccauggaggcagagccucccaggcacccagcacuuuaagcuggccgguccugagcccuc

SEQ ID NO: 192510 - RNA, 65 nt, Homo Sapiens
uauucgguucuugcuuuggucccacccccacgguugcacuuuauuggugcccucccucuccuacc

SEQ ID NO: 192511 - RNA, 65 nt, Homo Sapiens
aauggugguuaaauggaaaugaguaauauauaguugcacuuuauacacaccucagauaaaaugca

SEQ ID NO: 192512 - RNA, 65 nt, Homo Sapiens
auaguaaaauggaaagugaaaaaagaauuuuacaugcacuuuaaaaauuaccuaccaaaaaaugg

SEQ ID NO: 192513 - RNA, 65 nt, Homo Sapiens
cccugcauccucgguugagagcucccacgcaaguggcacuuuaagccuggugaacagugagccug

SEQ ID NO: 192514 - RNA, 65 nt, Homo Sapiens
ggccaauuaacugagaauguuuaagaaaauuuccagcacuuuaauuuuaacaaauguuaucauga

SEQ ID NO: 192515 - RNA, 65 nt, Homo Sapiens
gaggaggaagcuagaggaaaauuacucugcuuugugcacuuuaugaagccugugucuauuuucau

SEQ ID NO: 192516 - RNA, 65 nt, Homo Sapiens
guuugcaaagcucuuccauacugcauguguguacugcacuuuacagccccagggccacagcuagc

SEQ ID NO: 192517 - RNA, 65 nt, Homo Sapiens
aaagcaaaagcucuguguaaaagcugggcaugaacgcacuuuauaugcuaugacaugcaagugag

SEQ ID NO: 192518 - RNA, 65 nt, Homo Sapiens
ugaagcuaauaauucuucacgaaggcacaauaugggcacuuuaaaauuguugaaagagauaugua

SEQ ID NO: 192519 - RNA, 65 nt, Homo Sapiens
aacacuguauuguaaguggagaaggaaauaacauugcacuuuauauauggaacauaugcacaggg

SEQ ID NO: 192520 - RNA, 65 nt, Homo Sapiens
ucugagacugcguucauguaugauguguagauuucgcacuuuauuuucuguuaaaagaacuuuau

SEQ ID NO: 192521 - RNA, 65 nt, Homo Sapiens
aaguaaaggggcaagauagggcaguuaacuaaagagcacuuuauuucuuugaagccuuucuaaga

SEQ ID NO: 192522 - RNA, 65 nt, Homo Sapiens
guaguggugcaucauuuuuaacccaaauauugcaagcacuuuaaagauuugaaaccacauuuuua

SEQ ID NO: 192523 - RNA, 65 nt, Homo Sapiens
aaguaacuugccugaggucacucagcucauaaauugcacuuuagggauugugcacucagucacuc

SEQ ID NO: 192524 - RNA, 65 nt, Homo Sapiens
ucaagacauucccagcucuucuuacacaucugcuagcacuuuauguugaaaaauauaggcccaua

SEQ ID NO: 192525 - RNA, 65 nt, Homo Sapiens
auucggggcaguagauaaauguucauuuuacugaugcacuuuaguuuuuggucuguuaccuguuu

SEQ ID NO: 192526 - RNA, 65 nt, Homo Sapiens
gaaagggccccuccccaccugacacccacuggggugcacuuuaauguuccggcagcaagacuggg

SEQ ID NO: 192527 - RNA, 65 nt, Homo Sapiens
gccucagccccagccaccauauaccccugcaguuugcacuuuaauugaugguaguucaguugggg

SEQ ID NO: 192528 - RNA, 65 nt, Homo Sapiens
agagggggcauccugucucucuccagaccaucacugcacuuuaaccagggucuuagguacaaaau

SEQ ID NO: 192529 - RNA, 65 nt, Homo Sapiens
ggcccaguccucugaggcacggcggcucuguucaagcacuuuaugcggcaggggaggccgccugg

SEQ ID NO: 192530 - RNA, 65 nt, Homo Sapiens
uggcugugaguggcaagcugacauucugcacgcuagcacuuuacaaaaauauugugcaagaccua

SEQ ID NO: 192531 - RNA, 65 nt, Homo Sapiens
uccgagauacccacccagcuuugucaaucacccaagcacuuuaugcauauagagacagaaccugg

SEQ ID NO: 192532 - RNA, 53 nt, Homo Sapiens
uguccagccucuuccucaguauugcacuuuauaaccauuuauuaccaauguag

SEQ ID NO: 192533 - RNA, 65 nt, Homo Sapiens
uuauuuugaauccagaaauaaugcaaccuuuggaugcacuuuauacaagaaugagaagaaugacu

SEQ ID NO: 192534 - RNA, 65 nt, Homo Sapiens
aauugugauguagccucgcuauuagcacuaaucuggcacuuuauaaaaaaucaagcugaaugaca

SEQ ID NO: 192535 - RNA, 65 nt, Homo Sapiens
uaaggaaagaucgagaaaucacuugcccuaaucaugcacuuuacuuugagaaaauugacacucag

SEQ ID NO: 192536 - RNA, 65 nt, Homo Sapiens
cagauccagaaaacacucaacucugauaucauugugcacuuuagcaccuuccguaugacguuuua

SEQ ID NO: 192537 - RNA, 65 nt, Homo Sapiens
auaaagggcacaguuuguauacauuacgacugaaugcacuuuagugaaggaauuuaggggcuuaa

SEQ ID NO: 192538 - RNA, 65 nt, Homo Sapiens
accuaccacuuguguugugaauuuccuuguauaaagcacuuuacuccucuccauguguauauagu

SEQ ID NO: 192539 - RNA, 65 nt, Homo Sapiens
cuguugaaauguaagcucugugaaauaccugagaugcacuuuaaaguagaauuacuucuguuauc

SEQ ID NO: 192540 - RNA, 65 nt, Homo Sapiens
aaacuggcacuugacugaacugauagggcagaggugcacuuuaugugccacccuucccccaaagc

SEQ ID NO: 192541 - RNA, 65 nt, Homo Sapiens
uuuuucuaaaaacguguuuuuaaguugguauuugggcacuuuauaggaagccuguaucaccugug

SEQ ID NO: 192542 - RNA, 65 nt, Homo Sapiens
aacaaaacaaaacauuuuucuuacuucuuuugcaugcacuuuaaaugaugaaaaaaaaaaaggcu

SEQ ID NO: 192543 - RNA, 65 nt, Homo Sapiens
aauaucaggauuuuauauaaaaccaccccaggaaugcacuuuaaccaauauuucuauaguauacc

SEQ ID NO: 192544 - RNA, 65 nt, Homo Sapiens
cagaaagcuguaugcaggaugcucacugauguuuugcacuuuaaaacugaaauucaacucuuuau

SEQ ID NO: 192545 - RNA, 65 nt, Homo Sapiens
gcaggaguucuuagcuccucagcgagcaacagagagcacuuuagauggcaccuuucaccacuugg

SEQ ID NO: 192546 - RNA, 65 nt, Homo Sapiens
uauucuauuuauaucuuauuacaauaaaauuaguggcacuuuauucauaaauauucaugagccug

SEQ ID NO: 192547 - RNA, 65 nt, Homo Sapiens
ugaaugcagucucccugcagggcagauuaugccaggcacuuuacauuuguugaucccauuugaca

SEQ ID NO: 192548 - RNA, 65 nt, Homo Sapiens
ccauuuucagugcuuauauuguuagguagaggcuggcacuuuauuagaaugcaagccacaaaaau

SEQ ID NO: 192549 - RNA, 65 nt, Homo Sapiens
gugagcagauauggcuauaaagaccuauagcuuuugcacuuuaugcauauauaaucaauccuuuc

SEQ ID NO: 192550 - RNA, 65 nt, Homo Sapiens
ucuuuauuuaaauuuuuuuuuagagugcacugagugcacuuuacaagugugaagguaguacuuuu

SEQ ID NO: 192551 - RNA, 65 nt, Homo Sapiens
uaaccaaagcuuagcaguuuauacaucauugaacugcacuuuauaggauuugaaugauugggaug

SEQ ID NO: 192552 - RNA, 65 nt, Homo Sapiens
cuccuugaguaaaaaggugggcuggcgcauauuaagcacuuuaagaaggauguggaagagcauua

SEQ ID NO: 192553 - RNA, 65 nt, Homo Sapiens
ucuguuuugaaauuagaacuuuuccccuauuuuuugcacuuuaaagaaaaauauauaaaaguuuu

SEQ ID NO: 192554 - RNA, 65 nt, Homo Sapiens
aauuaaaaaacugaauugccagcugucugaagaaugcacuuuaugcuuaauuagacauuauuuga

SEQ ID NO: 192555 - RNA, 65 nt, Homo Sapiens
aaagguugggguuaaaggaacaagcuaguugaccugcacuuuaucgaguuuagaagugauuaggg

SEQ ID NO: 192556 - RNA, 65 nt, Homo Sapiens
uaucaauccaugcugccugacccaguucccaaacugcacuuuacauccagcccuggcugcagccu

SEQ ID NO: 192557 - RNA, 65 nt, Homo Sapiens
gucuaacuaucaaaaagggcagacuuccugcaacugcacuuuaucuguggucugcugcccagaaa

SEQ ID NO: 192558 - RNA, 65 nt, Homo Sapiens
uucccucuucccugaccucccaacucuaaagccaagcacuuuauauuuuccucuuagauauucac

SEQ ID NO: 192559 - RNA, 65 nt, Homo Sapiens
uggagcagcauauagccgaaaaggagcacaacugagcacuuuaauaguaauuuaaaaguuuucaa

SEQ ID NO: 192560 - RNA, 65 nt, Homo Sapiens
gauagcaucacaucauacagaaugugauaagaauggcacuuuaccucugugguccuccuccccag

SEQ ID NO: 192561 - RNA, 65 nt, Homo Sapiens
uauacuuccugauuugaaaggaaugaaccuuacuugcacuuuaugagccuaggagcacagcgagg

SEQ ID NO: 192562 - RNA, 65 nt, Homo Sapiens
gaaauagaugaacauuucaguacacucauauuugugcacuuuacugucauagccaaaccaaaggg

SEQ ID NO: 192563 - RNA, 65 nt, Homo Sapiens
uaaaaaaaaaagaaguuuucuauuugaauuuaaaagcacuuuauuguuuucuuuagggcaacaua

SEQ ID NO: 192564 - RNA, 65 nt, Homo Sapiens
cuaaugggucacaaaucuuguugcacugaacauaagcacuuuauacccuucugagucugccuuuu

SEQ ID NO: 192565 - RNA, 65 nt, Homo Sapiens
uuagacuugccacucugaaacuccauuuaaaagaggcacuuuacuucugaacaaaugaaacucuu

SEQ ID NO: 192566 - RNA, 65 nt, Homo Sapiens
uucaaauucugccugaugaacuccucagcaauaaagcacuuuauuccgcccugaagcucucuggg

SEQ ID NO: 192567 - RNA, 65 nt, Homo Sapiens
aaaaaguaugaauaaagcaaguuuuaaguaauauugcacuuuauaauuaagguacaugucucucu

SEQ ID NO: 192568 - RNA, 65 nt, Homo Sapiens
gaaaccaugaacacuauauggccagagacaaucuagcacuuuaaaaagcaauagaugauucucaa

SEQ ID NO: 192569 - RNA, 65 nt, Homo Sapiens
gcuuuuguuugcauuuaaaugaauucuguugacccgcacuuuaaaacuguuaagauuagacauuu

SEQ ID NO: 192570 - RNA, 65 nt, Homo Sapiens
uauauugaucucuguacggccagagcguuguaccggcacuuuauauuugggacaaaacuauuuuu

SEQ ID NO: 192571 - RNA, 65 nt, Homo Sapiens
aacauaauggaaaagugcauguacgggaaauaacagcacuuuagguguaguucaggugagcaaga

SEQ ID NO: 192572 - RNA, 65 nt, Homo Sapiens
ccacuucaaaagucuuucauuggcagaucuugguagcacuuuauauguucaccaaugggagguca

SEQ ID NO: 192573 - RNA, 65 nt, Homo Sapiens
cacguagaaugaccacagccacucgcauccguauagcacuuuaaaguuucugcaguccuuugaca

SEQ ID NO: 192574 - RNA, 65 nt, Homo Sapiens
auaaacaaaugcugcuauuuauuagcugcaagaaugcacuuuagaacuauuugacaauucagacu

SEQ ID NO: 192575 - RNA, 65 nt, Homo Sapiens
ccagggaaugaaugguggucuccccacucccggcagcacuuuaggcagcccauaagcuaugcgag

SEQ ID NO: 192576 - RNA, 65 nt, Homo Sapiens
ugauuaauuuuauuuuacuuaaaauaagaaaaggagcacuuuaauuacaacugaaaaaucagauu

SEQ ID NO: 192577 - RNA, 65 nt, Homo Sapiens
ccagucaucucagucguugucguuaggugacaugugcacuuuaaaugcucucaucgguuggcuuc

SEQ ID NO: 192578 - RNA, 65 nt, Homo Sapiens
aauuuaugugguuuuuauacauuuuuuaauaagaugcacuuuaugucauuuuuuaauaaagucug

SEQ ID NO: 192579 - RNA, 65 nt, Homo Sapiens
gcacugauuuuaagauaauggauuuccacaugaaagcacuuuaaguauucugugccuuccaucau

SEQ ID NO: 192580 - RNA, 65 nt, Homo Sapiens
gucugauauuucucgaugugcaauucauuuucagagcacuuuaaauccauauuauuucuuugaau

SEQ ID NO: 192581 - RNA, 65 nt, Homo Sapiens
aaaauacuuccauaucaauuaaacucucacuaugggcacuuuaccgaaaacaggggcugcuuuuu

SEQ ID NO: 192582 - RNA, 65 nt, Homo Sapiens
uuucucaagacucugaaauaauacaugaaaauacugcacuuuaaggacacaauuauuauuugcug

SEQ ID NO: 192583 - RNA, 65 nt, Homo Sapiens
uugguuguguuugcucacgugaaguaaaaagugaagcacuuuauuuuuaguuggucccuauguug

SEQ ID NO: 192584 - RNA, 65 nt, Homo Sapiens
ggggcugugcacagacggaccccccacccccacacgcacuuuaugagggagaccccgacagagga

SEQ ID NO: 192585 - RNA, 65 nt, Homo Sapiens
guuuugggaugauucaagugcauuacauuuauugugcacuuuauuucuauuaugauuacauugua

SEQ ID NO: 192586 - RNA, 65 nt, Homo Sapiens
ugggcugggcaugguggcucacgccuguaacccuagcacuuuaggaaaucgaggcgaguggauca

SEQ ID NO: 192587 - RNA, 65 nt, Homo Sapiens
gugugcaaugucugagugaaccuguauaaguggaggcacuuuagggcuguaaaaugcaugauuuu

SEQ ID NO: 192588 - RNA, 65 nt, Homo Sapiens
uuuauucagugccccaaacacagauuucucuucuagcacuuuagaguugauccuugaagucucuc

SEQ ID NO: 192589 - RNA, 65 nt, Homo Sapiens
augaacuacuauugauaccagcauacaaguguacagcacuuuacacacaagagguuuauugaugu

SEQ ID NO: 192590 - RNA, 65 nt, Homo Sapiens
aaaggcagcgcugacuucguugggcuuuuuuccaagcacuuuaacuucagaaauggucuugacac

SEQ ID NO: 192591 - RNA, 65 nt, Homo Sapiens
agcucugggugaggggacacuuggcuuugguguuugcacuuuacagauccugcgguccacgaggg

SEQ ID NO: 192592 - RNA, 65 nt, Homo Sapiens
gaggcuguguggccaaccagugucugugggcuucagcacuuuaaaagcaggcaggggcaucuguc

SEQ ID NO: 192593 - RNA, 65 nt, Homo Sapiens
cacauucccauguaauacuucaggcaaugugcuaagcacuuuacaagcaguuacuguauaugucc

SEQ ID NO: 192594 - RNA, 65 nt, Homo Sapiens
ggccccuacggccggcgggacuugccgcaccgagugcacuuuaggucucuaugcaacaccccauc

SEQ ID NO: 192595 - RNA, 65 nt, Homo Sapiens
uagagagugugacauagaccuccagccaccccccagcacuuuaugcaccucgucggggggcccag

SEQ ID NO: 192596 - RNA, 65 nt, Homo Sapiens
gcguggagccuaguugccuguugucacggcaucuugcacuuuaggagacuaagaccguccugguu

SEQ ID NO: 192597 - RNA, 65 nt, Homo Sapiens
uccaggggcagggaccauuucuucauuuucugaaagcacuuuaaugauuccccuucccccaaacu

SEQ ID NO: 192598 - RNA, 65 nt, Homo Sapiens
cacaauuagugguuauucuuuucuguguuuguuuugcacuuuaaaaaagagagaacacaugcaaa

SEQ ID NO: 192599 - RNA, 65 nt, Homo Sapiens
cuacccggcccagagaccccuuccuuuccucugcagcacuuuaacccucucuucccuauuauuuc

SEQ ID NO: 192600 - RNA, 65 nt, Homo Sapiens
aauauuaaagcaaggaaaaguguaacugaaacacugcacuuuacuguuuuauacuuuuguacaua

SEQ ID NO: 192601 - RNA, 65 nt, Homo Sapiens
auauacugauugacaaugcauauuagccagguaaugcacuuuagcuacccuggacaaugcuauca

SEQ ID NO: 192602 - RNA, 65 nt, Homo Sapiens
auagcaccacacgcaaaccaaccuuucugacaucagcacuuuaccagaggcauaaacacaacuga

SEQ ID NO: 192603 - RNA, 65 nt, Homo Sapiens
cagugcauagcuuuaagccaagcaggauguaccgagcacuuuauuuauuuucauuccaggugaaa

SEQ ID NO: 192604 - RNA, 65 nt, Homo Sapiens
aaaugguacacugacuaaucauuuuaacuccagaagcacuuuaugcacuuuugacagcuuggcag

SEQ ID NO: 192605 - RNA, 65 nt, Homo Sapiens
aaaacugcaaaaaaauacgucaaaucuuguuucuggcacuuuagaaaaaucacuaaaaauuccca

SEQ ID NO: 192606 - RNA, 65 nt, Homo Sapiens
gguaguuccggugucaacaucacaaaacaaaacuugcacuuuaacagugaaacugcacaaaggaa

SEQ ID NO: 192607 - RNA, 65 nt, Homo Sapiens
aaagagagaacacaugcaaauuccauguuuguuuugcacuuuaaacacaauuaguggugguucuu

SEQ ID NO: 192608 - RNA, 65 nt, Homo Sapiens
gguuaauuuuauaauauuuuauauguaaggaacaugcacuuuauuuuguaaaaggggcaggugua

SEQ ID NO: 192609 - RNA, 65 nt, Homo Sapiens
cauuuaaauuauacaaucauauaagcuauguuguugcacuuuaaaagaggaucugcuuggucuug

SEQ ID NO: 192610 - RNA, 65 nt, Homo Sapiens
cccugcauagggagcagaggccucaggcagccaaagcacuuuaacaccccugcucacuuguuugc

SEQ ID NO: 192611 - RNA, 65 nt, Homo Sapiens
guccuguggcuugugaccucgccaauaaauuucaugcacuuuaaagguauacaugcggcuucauu

SEQ ID NO: 192612 - RNA, 65 nt, Homo Sapiens
cauuucuuuuaaaaggucuauucaugcagagcaaagcacuuuaacuggugccacccucucuggca

SEQ ID NO: 192613 - RNA, 65 nt, Homo Sapiens
aggccgaggcuggcagaucaacgccuguaaucccagcacuuuagggcagccaggugcaguggcuc

SEQ ID NO: 192614 - RNA, 65 nt, Homo Sapiens
aaagagagaacacaugcaaauucuguguuugucuugcacuuuaaacacaauuagugguuguucuu

SEQ ID NO: 192615 - RNA, 65 nt, Homo Sapiens
uacugcugucuuuuuuuuuuuuucauuaaaaagaagcacuuuaugcuguacaucucuuggauuug

SEQ ID NO: 192616 - RNA, 65 nt, Homo Sapiens
ggaagguaagcugaacuucuaaacugaaaccaugugcacuuuaauccuuaguaaguacgugccug

SEQ ID NO: 192617 - RNA, 65 nt, Homo Sapiens
uuauuguccaaagagagucaucuuuguucaguaaugcacuuuauuugauucugguuuugaguuac

SEQ ID NO: 192618 - RNA, 65 nt, Homo Sapiens
auagguuacaggaaagccagccagaggaagugucagcacuuuaaaauucuagaccccaaaaaacu

SEQ ID NO: 192619 - RNA, 65 nt, Homo Sapiens
uuuccacuuguuaaaaaaauuaaauauauuuuaaagcacuuuaagaauaugaaacuuucauauau

SEQ ID NO: 192620 - RNA, 65 nt, Homo Sapiens
uuugauuauaccauuuugagggugaauauggcuaggcacuuuagauaagccuuuuuaaaauucuu

SEQ ID NO: 192621 - RNA, 65 nt, Homo Sapiens
aaccaguuuuuguuguaaaugcaccaauucugaaggcacuuuauguacuacauggaggucauauc

SEQ ID NO: 192622 - RNA, 65 nt, Homo Sapiens
auaagccugagauacaaguucagggacucagcaaugcacuuuaggacugagcuaggaggcaaaua

SEQ ID NO: 192623 - RNA, 65 nt, Homo Sapiens
auuaauggugucuaaaugccaaacuuauauucaaugcacuuuauauauuccuuugaaagggauca

SEQ ID NO: 192624 - RNA, 65 nt, Homo Sapiens
uguauuaauuuauuuuaucucagcaacaagucuaagcacuuuacuagggcauaguuaccuuauac

SEQ ID NO: 192625 - RNA, 65 nt, Homo Sapiens
gagaacuaauaacuuuuuccgucuuuaaaauuuaggcacuuuaagauuuauauggacaaaauuaa

SEQ ID NO: 192626 - RNA, 65 nt, Homo Sapiens
ucucagaauuacucaaaucaggagaaagaaaaugggcacuuuauggaacaaugacauaaaucaag

SEQ ID NO: 192627 - RNA, 65 nt, Homo Sapiens
ccgggcgggcgugggaggagggaggcggccuccaugcacuuuauguggagacuacuggccccgcc

SEQ ID NO: 192628 - RNA, 65 nt, Homo Sapiens
cagguuuuaagucaaaaaugucgauaugucauuaugcacuuuacagaugaggggaggggccgcag

SEQ ID NO: 192629 - RNA, 65 nt, Homo Sapiens
gcugcuucugggccacggggagccccaggaccuaugcacuuuauuucugaccccguggcuucggc

SEQ ID NO: 192630 - RNA, 65 nt, Homo Sapiens
caucaguguuuuguauuuuuguacugaguaucggagcacuuuacagaagcugacuguacauuccu

SEQ ID NO: 192631 - RNA, 65 nt, Homo Sapiens
ggguggcuggggccaagccccgagggccccugcaagcacuuuacuuccuguuccuccccagccuu

SEQ ID NO: 192632 - RNA, 65 nt, Homo Sapiens
aagguuuuguuucaguuuguaagauuucuuuucuggcacuuuaauggcuugagguaucauuauca

SEQ ID NO: 192633 - RNA, 65 nt, Homo Sapiens
uuggcagggcacgguagcucacaccuguaaucccagcacuuuaggaggucaaggugggcagauca

SEQ ID NO: 192634 - RNA, 65 nt, Homo Sapiens
gaggccaggccugguggcucacgccuguaaucccagcacuuuaagaggccaaggcggauggauca

SEQ ID NO: 192635 - RNA, 65 nt, Homo Sapiens
ucaacaauuacauuacuugcuuucacauuuuaaaggcacuuuaaaaaaaucuacuucucuuguag

SEQ ID NO: 192636 - RNA, 65 nt, Homo Sapiens
gagggccccaugccagacagcccuuggggcucguugcacuuuaagaaauaggaucugugguguau

SEQ ID NO: 192637 - RNA, 65 nt, Homo Sapiens
ucacaucucaaucaggaugcuucucuccauugguagcacuuuagaguccaugaaauaugguaaaa

SEQ ID NO: 192638 - RNA, 65 nt, Homo Sapiens
ugcacucucuuccuguacaguauuuauuguuccuggcacuuuauuuaaagauauuugacccucac

SEQ ID NO: 192639 - RNA, 65 nt, Homo Sapiens
cuccuaaccccgccaggcagccucguucugcacaggcacuuuagcccgagccaggcacaccugcg

SEQ ID NO: 192640 - RNA, 65 nt, Homo Sapiens
uaauuuaaguuuuccuuuuuuacaguuuuucuccagcacuuuacucuucuuaagugccuggccuu

SEQ ID NO: 192641 - RNA, 65 nt, Homo Sapiens
uaggcugggcaugguggcucaugccuauaaucccagcacuuuaggagccccagacaggaggauca

SEQ ID NO: 192642 - RNA, 65 nt, Homo Sapiens
aacuuaugacaguuuaauaaguuaucagcaauuuagcacuuuacuuccauuagguuccuuuagcu

SEQ ID NO: 192643 - RNA, 65 nt, Homo Sapiens
uccaauguaccaggugaacugggaaaaacauccaagcacuuuaaucaaaaguuuuuuuaaagugg

SEQ ID NO: 192644 - RNA, 65 nt, Homo Sapiens
uacuaccguagcacuguagcauucaggauacuugagcacuuuauauugucaugacucaugguuac

SEQ ID NO: 192645 - RNA, 65 nt, Homo Sapiens
aucguguccguggccgcgcaccuccucugccuccugcacuuuagcuucacaggccugauggucuc

SEQ ID NO: 192646 - RNA, 65 nt, Homo Sapiens
accauuuagauccuauuaccuaaaguggaaucuaggcacuuuaucguuaucacauuuguaccacu

SEQ ID NO: 192647 - RNA, 65 nt, Homo Sapiens
cuccugggugguuucgaacuccuccccaauuccucgcacuuuauuauggugguuucaugaugccc

SEQ ID NO: 192648 - RNA, 65 nt, Homo Sapiens
cuuuuagggaugauuucuauuaaacaaauaagacagcacuuuauaaaaaauaagauaaaauaaaa

SEQ ID NO: 192649 - RNA, 65 nt, Homo Sapiens
gugaagaugacaccccuccccaccaccucucauaagcacuuuaggaacacacagaggguagggau

SEQ ID NO: 192650 - RNA, 51 nt, Homo Sapiens
cagcugugaugcauuauugaagcacuuuagcugaagcauuggaccacaaac

SEQ ID NO: 192651 - RNA, 65 nt, Homo Sapiens
ccagggucucccauagacagccugggggcaaguuagcacuuuauucccgcagcaguuccugaaug

SEQ ID NO: 192652 - RNA, 65 nt, Homo Sapiens
uagcaaacuuuucacaugcuaaugugcagcugagugcacuuuauuuaaaaagaauggauaaaugc

SEQ ID NO: 192653 - RNA, 65 nt, Homo Sapiens
gacuuggauuuuguaaaucuaauuugugauugaaagcacuuuaguccaggcuuuuggucuuucaa

SEQ ID NO: 192654 - RNA, 65 nt, Homo Sapiens
caguuaacuuggugcaaaacaacgguuccuuaauggcacuuuaaccuauuucauucuagaaugga

SEQ ID NO: 192655 - RNA, 65 nt, Homo Sapiens
agguuuugguuguugguaguagccgaauuuaacuggcacuuuauuuuacuucuaaccuuguuucc

SEQ ID NO: 192656 - RNA, 65 nt, Homo Sapiens
uuuuugaucaauggggaccagccacugccccaggagcacuuuagggcucucaguucaaacugaag

SEQ ID NO: 192657 - RNA, 65 nt, Homo Sapiens
ccagggugaacacacgccacuucccagcuaggagugcacuuuaugggacugugacuggacucuuc

SEQ ID NO: 192658 - RNA, 65 nt, Homo Sapiens
uauugauauaguuugagaaaucuuaaaaaauauaugcacuuuagaaaguuauugagaauaaucuu

SEQ ID NO: 192659 - RNA, 65 nt, Homo Sapiens
cgccgaagacagcccugcaguuguauuccucaguagcacuuuaaaaugaacuuacgugacaauga

SEQ ID NO: 192660 - RNA, 65 nt, Homo Sapiens
uucgucaaguuucaagucuggagaguuuugacagagcacuuuauuuccagcugaaaaccugcugu

SEQ ID NO: 192661 - RNA, 65 nt, Homo Sapiens
aaguuuaauuuuuuguaauucuuuuugugguuuuagcacuuuaagaaauagguuuucauuuaugg

SEQ ID NO: 192662 - RNA, 65 nt, Homo Sapiens
uucacggugguuuuuguuuuuugaagcaaugacaagcacuuuacuaaccauuguguguuuccucu

SEQ ID NO: 192663 - RNA, 65 nt, Homo Sapiens
aggcugaggcaggaggaucaaugccuguaaucccagcacuuuaaggaaguaggggugcauggcuc

SEQ ID NO: 192664 - RNA, 65 nt, Homo Sapiens
ccaggcagggccccugccccgcagccuaggccagagcacuuuacuugcagggcagugaaacccac

SEQ ID NO: 192665 - RNA, 65 nt, Homo Sapiens
ucagugacagccccuuauuuaggcuacuaccuagggcacuuuaagaucucacuuuaugauaggga

SEQ ID NO: 192666 - RNA, 65 nt, Homo Sapiens
cucuccccacucuuuucuuccuuuuccucuuaaaggcacuuuacuaaaaaaaaaaaaaacuucua

SEQ ID NO: 192667 - RNA, 65 nt, Homo Sapiens
uggauggcgcgugggcagugccugucgcucucuaagcacuuuaccucacucacuuugcaccuuuc

SEQ ID NO: 192668 - RNA, 65 nt, Homo Sapiens
aggugggagcugggcagaccuagccacugagaagugcacuuuaagaaccuguuccccucugcuac

SEQ ID NO: 192669 - RNA, 65 nt, Homo Sapiens
guuacaaaguacucuuccaauccuuucugugcacagcacuuuauucauccccauaauggcauuuc

SEQ ID NO: 192670 - RNA, 65 nt, Homo Sapiens
aaucauuuuuaaaauacuaauggaagaacuuucuagcacuuuaccacuacauaaauguucauuga

SEQ ID NO: 192671 - RNA, 65 nt, Homo Sapiens
ucauccaccaaaguuaaauagagcuauuuaaaaaugcacuuuauuuguacucuguguggcuuuug

SEQ ID NO: 192672 - RNA, 65 nt, Homo Sapiens
ccuaguacaucuuacagcuuuccccuuccauguuagcacuuuacugcugaauucucaauuuucuu

SEQ ID NO: 192673 - RNA, 65 nt, Homo Sapiens
cuucagcccuuuuucugccacuagcaaccagaauagcacuuuaccuuuugguuggcuagauaagu

SEQ ID NO: 192674 - RNA, 65 nt, Homo Sapiens
cacuggguaucacuacuuuguguuaaagugccuucgcacuuuaaguacauuacuuaaauguugcu

SEQ ID NO: 192675 - RNA, 65 nt, Homo Sapiens
agaauuugacaacgucauuaacauggauauaagaggcacuuuauuuauuugaauuauuacuuagc

SEQ ID NO: 192676 - RNA, 65 nt, Homo Sapiens
gauaucacccacacacaccuacaacugaagacaaugcacuuuacacccuuacaccuaccccaccu

SEQ ID NO: 192677 - RNA, 65 nt, Homo Sapiens
ggguuuuauccaguuuuagggaucacugucaaguugcacuuuacuccucuuuagaaucugagaga

SEQ ID NO: 192678 - RNA, 65 nt, Homo Sapiens
gacaaaaucaaacccuucucuggcacaucuaccuagcacuuuagguaagccucucaaaauugugu

SEQ ID NO: 192679 - RNA, 65 nt, Homo Sapiens
uagauaauguauuuugacuaagcugcuuuugaaaagcacuuuaauuugggggacucuuauaaugg

SEQ ID NO: 192680 - RNA, 65 nt, Homo Sapiens
accaaacuuaaaaccaaacaacuuaauuuaaguuugcacuuuaauaugaacugcuugaagugaau

SEQ ID NO: 192681 - RNA, 62 nt, Homo Sapiens; identical to SEQ ID NO: 103289

SEQ ID NO: 192682 - RNA, 62 nt, Homo Sapiens; identical to SEQ ID NO: 103290

SEQ ID NO: 192683 - RNA, 62 nt, Homo Sapiens; identical to SEQ ID NO: 103291

SEQ ID NO: 192684 - RNA, 62 nt, Homo Sapiens; identical to SEQ ID NO: 103292

SEQ ID NO: 192685 - RNA, 62 nt, Homo Sapiens; identical to SEQ ID NO: 103293

SEQ ID NO: 192686 - RNA, 62 nt, Homo Sapiens; identical to SEQ ID NO: 103294

SEQ ID NO: 192687 - RNA, 62 nt, Homo Sapiens; identical to SEQ ID NO: 103295

SEQ ID NO: 192688 - RNA, 62 nt, Homo Sapiens; identical to SEQ ID NO: 103296

SEQ ID NO: 192689 - RNA, 62 nt, Homo Sapiens; identical to SEQ ID NO: 103297

SEQ ID NO: 192690 - RNA, 62 nt, Homo Sapiens; identical to SEQ ID NO: 103298

SEQ ID NO: 192691 - RNA, 62 nt, Homo Sapiens; identical to SEQ ID NO: 103299

SEQ ID NO: 192692 - RNA, 57 nt, Homo Sapiens; identical to SEQ ID NO: 103300

SEQ ID NO: 192693 - RNA, 62 nt, Homo Sapiens; identical to SEQ ID NO: 103301

SEQ ID NO: 192694 - RNA, 62 nt, Homo Sapiens; identical to SEQ ID NO: 103302

SEQ ID NO: 192695 - RNA, 62 nt, Homo Sapiens; identical to SEQ ID NO: 103303

SEQ ID NO: 192696 - RNA, 62 nt, Homo Sapiens; identical to SEQ ID NO: 103304

SEQ ID NO: 192697 - RNA, 62 nt, Homo Sapiens; identical to SEQ ID NO: 103305

SEQ ID NO: 192698 - RNA, 62 nt, Homo Sapiens; identical to SEQ ID NO: 103306

SEQ ID NO: 192699 - RNA, 62 nt, Homo Sapiens; identical to SEQ ID NO: 103307

SEQ ID NO: 192700 - RNA, 62 nt, Homo Sapiens; identical to SEQ ID NO: 103308

SEQ ID NO: 192701 - RNA, 62 nt, Homo Sapiens; identical to SEQ ID NO: 103309

SEQ ID NO: 192702 - RNA, 62 nt, Homo Sapiens; identical to SEQ ID NO: 103310

SEQ ID NO: 192703 - RNA, 62 nt, Homo Sapiens; identical to SEQ ID NO: 103311

SEQ ID NO: 192704 - RNA, 62 nt, Homo Sapiens; identical to SEQ ID NO: 103312

SEQ ID NO: 192705 - RNA, 62 nt, Homo Sapiens; identical to SEQ ID NO: 103313

SEQ ID NO: 192706 - RNA, 62 nt, Homo Sapiens; identical to SEQ ID NO: 103314

SEQ ID NO: 192707 - RNA, 62 nt, Homo Sapiens; identical to SEQ ID NO: 103315

SEQ ID NO: 192708 - RNA, 62 nt, Homo Sapiens; identical to SEQ ID NO: 103316

SEQ ID NO: 192709 - RNA, 62 nt, Homo Sapiens; identical to SEQ ID NO: 103317

SEQ ID NO: 192710 - RNA, 62 nt, Homo Sapiens; identical to SEQ ID NO: 103318

SEQ ID NO: 192711 - RNA, 62 nt, Homo Sapiens; identical to SEQ ID NO: 103319

SEQ ID NO: 192712 - RNA, 62 nt, Homo Sapiens; identical to SEQ ID NO: 103320

SEQ ID NO: 192713 - RNA, 62 nt, Homo Sapiens; identical to SEQ ID NO: 103321

SEQ ID NO: 192714 - RNA, 62 nt, Homo Sapiens; identical to SEQ ID NO: 103322

SEQ ID NO: 192715 - RNA, 62 nt, Homo Sapiens; identical to SEQ ID NO: 103323

SEQ ID NO: 192716 - RNA, 62 nt, Homo Sapiens; identical to SEQ ID NO: 103324

SEQ ID NO: 192717 - RNA, 62 nt, Homo Sapiens; identical to SEQ ID NO: 103325

SEQ ID NO: 192718 - RNA, 62 nt, Homo Sapiens; identical to SEQ ID NO: 103326

SEQ ID NO: 192719 - RNA, 62 nt, Homo Sapiens; identical to SEQ ID NO: 103327

SEQ ID NO: 192720 - RNA, 62 nt, Homo Sapiens; identical to SEQ ID NO: 103328

SEQ ID NO: 192721 - RNA, 62 nt, Homo Sapiens; identical to SEQ ID NO: 103329

SEQ ID NO: 192722 - RNA, 62 nt, Homo Sapiens; identical to SEQ ID NO: 103330

SEQ ID NO: 192723 - RNA, 62 nt, Homo Sapiens; identical to SEQ ID NO: 103331

SEQ ID NO: 192724 - RNA, 62 nt, Homo Sapiens; identical to SEQ ID NO: 103332

SEQ ID NO: 192725 - RNA, 62 nt, Homo Sapiens; identical to SEQ ID NO: 103333

SEQ ID NO: 192726 - RNA, 62 nt, Homo Sapiens; identical to SEQ ID NO: 103334

SEQ ID NO: 192727 - RNA, 62 nt, Homo Sapiens; identical to SEQ ID NO: 103335

SEQ ID NO: 192728 - RNA, 62 nt, Homo Sapiens; identical to SEQ ID NO: 103336

SEQ ID NO: 192729 - RNA, 62 nt, Homo Sapiens; identical to SEQ ID NO: 103337

SEQ ID NO: 192730 - RNA, 62 nt, Homo Sapiens; identical to SEQ ID NO: 103338

SEQ ID NO: 192731 - RNA, 62 nt, Homo Sapiens; identical to SEQ ID NO: 103339

SEQ ID NO: 192732 - RNA, 62 nt, Homo Sapiens; identical to SEQ ID NO: 103340

SEQ ID NO: 192733 - RNA, 62 nt, Homo Sapiens; identical to SEQ ID NO: 103341

SEQ ID NO: 192734 - RNA, 62 nt, Homo Sapiens; identical to SEQ ID NO: 103342

SEQ ID NO: 192735 - RNA, 62 nt, Homo Sapiens; identical to SEQ ID NO: 103343

SEQ ID NO: 192736 - RNA, 62 nt, Homo Sapiens; identical to SEQ ID NO: 103344

SEQ ID NO: 192737 - RNA, 62 nt, Homo Sapiens; identical to SEQ ID NO: 103345

SEQ ID NO: 192738 - RNA, 62 nt, Homo Sapiens; identical to SEQ ID NO: 103346

SEQ ID NO: 192739 - RNA, 62 nt, Homo Sapiens; identical to SEQ ID NO: 103347

SEQ ID NO: 192740 - RNA, 62 nt, Homo Sapiens; identical to SEQ ID NO: 103348

SEQ ID NO: 192741 - RNA, 62 nt, Homo Sapiens; identical to SEQ ID NO: 103349

SEQ ID NO: 192742 - RNA, 62 nt, Homo Sapiens; identical to SEQ ID NO: 103350

SEQ ID NO: 192743 - RNA, 62 nt, Homo Sapiens; identical to SEQ ID NO: 103351

SEQ ID NO: 192744 - RNA, 62 nt, Homo Sapiens; identical to SEQ ID NO: 103352

SEQ ID NO: 192745 - RNA, 62 nt, Homo Sapiens; identical to SEQ ID NO: 103353

SEQ ID NO: 192746 - RNA, 62 nt, Homo Sapiens; identical to SEQ ID NO: 103354

SEQ ID NO: 192747 - RNA, 62 nt, Homo Sapiens; identical to SEQ ID NO: 103355

SEQ ID NO: 192748 - RNA, 62 nt, Homo Sapiens; identical to SEQ ID NO: 103356

SEQ ID NO: 192749 - RNA, 62 nt, Homo Sapiens; identical to SEQ ID NO: 103357

SEQ ID NO: 192750 - RNA, 62 nt, Homo Sapiens; identical to SEQ ID NO: 103358

SEQ ID NO: 192751 - RNA, 62 nt, Homo Sapiens; identical to SEQ ID NO: 103359

SEQ ID NO: 192752 - RNA, 62 nt, Homo Sapiens; identical to SEQ ID NO: 103360

SEQ ID NO: 192753 - RNA, 62 nt, Homo Sapiens; identical to SEQ ID NO: 103361

SEQ ID NO: 192754 - RNA, 62 nt, Homo Sapiens; identical to SEQ ID NO: 103362

SEQ ID NO: 192755 - RNA, 62 nt, Homo Sapiens; identical to SEQ ID NO: 103363

SEQ ID NO: 192756 - RNA, 62 nt, Homo Sapiens; identical to SEQ ID NO: 103364

SEQ ID NO: 192757 - RNA, 62 nt, Homo Sapiens; identical to SEQ ID NO: 103365

SEQ ID NO: 192758 - RNA, 62 nt, Homo Sapiens; identical to SEQ ID NO: 103366

SEQ ID NO: 192759 - RNA, 62 nt, Homo Sapiens; identical to SEQ ID NO: 103367

SEQ ID NO: 192760 - RNA, 62 nt, Homo Sapiens; identical to SEQ ID NO: 103368

SEQ ID NO: 192761 - RNA, 62 nt, Homo Sapiens; identical to SEQ ID NO: 103369

SEQ ID NO: 192762 - RNA, 62 nt, Homo Sapiens; identical to SEQ ID NO: 103370

SEQ ID NO: 192763 - RNA, 62 nt, Homo Sapiens; identical to SEQ ID NO: 103371

SEQ ID NO: 192764 - RNA, 59 nt, Homo Sapiens; identical to SEQ ID NO: 103372

SEQ ID NO: 192765 - RNA, 62 nt, Homo Sapiens; identical to SEQ ID NO: 103373

SEQ ID NO: 192766 - RNA, 62 nt, Homo Sapiens; identical to SEQ ID NO: 103374

SEQ ID NO: 192767 - RNA, 62 nt, Homo Sapiens; identical to SEQ ID NO: 103375

SEQ ID NO: 192768 - RNA, 62 nt, Homo Sapiens; identical to SEQ ID NO: 103376

SEQ ID NO: 192769 - RNA, 62 nt, Homo Sapiens; identical to SEQ ID NO: 103377

SEQ ID NO: 192770 - RNA, 62 nt, Homo Sapiens; identical to SEQ ID NO: 103378

SEQ ID NO: 192771 - RNA, 62 nt, Homo Sapiens; identical to SEQ ID NO: 103379

SEQ ID NO: 192772 - RNA, 62 nt, Homo Sapiens; identical to SEQ ID NO: 103380

SEQ ID NO: 192773 - RNA, 62 nt, Homo Sapiens; identical to SEQ ID NO: 103381

SEQ ID NO: 192774 - RNA, 62 nt, Homo Sapiens; identical to SEQ ID NO: 103382

SEQ ID NO: 192775 - RNA, 62 nt, Homo Sapiens; identical to SEQ ID NO: 103383

SEQ ID NO: 192776 - RNA, 62 nt, Homo Sapiens; identical to SEQ ID NO: 103384

SEQ ID NO: 192777 - RNA, 62 nt, Homo Sapiens; identical to SEQ ID NO: 103385

SEQ ID NO: 192778 - RNA, 62 nt, Homo Sapiens; identical to SEQ ID NO: 103386

SEQ ID NO: 192779 - RNA, 62 nt, Homo Sapiens; identical to SEQ ID NO: 103387

SEQ ID NO: 192780 - RNA, 62 nt, Homo Sapiens; identical to SEQ ID NO: 103388

SEQ ID NO: 192781 - RNA, 62 nt, Homo Sapiens; identical to SEQ ID NO: 103389

SEQ ID NO: 192782 - RNA, 62 nt, Homo Sapiens; identical to SEQ ID NO: 103390

SEQ ID NO: 192783 - RNA, 62 nt, Homo Sapiens; identical to SEQ ID NO: 103391

SEQ ID NO: 192784 - RNA, 62 nt, Homo Sapiens; identical to SEQ ID NO: 103392

SEQ ID NO: 192785 - RNA, 60 nt, Homo Sapiens; identical to SEQ ID NO: 103393

SEQ ID NO: 192786 - RNA, 62 nt, Homo Sapiens; identical to SEQ ID NO: 103394

SEQ ID NO: 192787 - RNA, 62 nt, Homo Sapiens; identical to SEQ ID NO: 103395

SEQ ID NO: 192788 - RNA, 62 nt, Homo Sapiens; identical to SEQ ID NO: 103396

SEQ ID NO: 192789 - RNA, 62 nt, Homo Sapiens; identical to SEQ ID NO: 103397

SEQ ID NO: 192790 - RNA, 62 nt, Homo Sapiens; identical to SEQ ID NO: 103398

SEQ ID NO: 192791 - RNA, 62 nt, Homo Sapiens; identical to SEQ ID NO: 103399

SEQ ID NO: 192792 - RNA, 62 nt, Homo Sapiens; identical to SEQ ID NO: 103400

SEQ ID NO: 192793 - RNA, 62 nt, Homo Sapiens; identical to SEQ ID NO: 103401

SEQ ID NO: 192794 - RNA, 62 nt, Homo Sapiens; identical to SEQ ID NO: 103402

SEQ ID NO: 192795 - RNA, 62 nt, Homo Sapiens; identical to SEQ ID NO: 103403

SEQ ID NO: 192796 - RNA, 62 nt, Homo Sapiens; identical to SEQ ID NO: 103404

SEQ ID NO: 192797 - RNA, 62 nt, Homo Sapiens; identical to SEQ ID NO: 103405

SEQ ID NO: 192798 - RNA, 62 nt, Homo Sapiens; identical to SEQ ID NO: 103406

SEQ ID NO: 192799 - RNA, 62 nt, Homo Sapiens; identical to SEQ ID NO: 103407

SEQ ID NO: 192800 - RNA, 62 nt, Homo Sapiens; identical to SEQ ID NO: 103408

SEQ ID NO: 192801 - RNA, 62 nt, Homo Sapiens; identical to SEQ ID NO: 103409

SEQ ID NO: 192802 - RNA, 62 nt, Homo Sapiens; identical to SEQ ID NO: 103410

SEQ ID NO: 192803 - RNA, 62 nt, Homo Sapiens; identical to SEQ ID NO: 103411

SEQ ID NO: 192804 - RNA, 62 nt, Homo Sapiens; identical to SEQ ID NO: 103412

SEQ ID NO: 192805 - RNA, 62 nt, Homo Sapiens; identical to SEQ ID NO: 103413

SEQ ID NO: 192806 - RNA, 62 nt, Homo Sapiens; identical to SEQ ID NO: 103414

SEQ ID NO: 192807 - RNA, 62 nt, Homo Sapiens; identical to SEQ ID NO: 103415

SEQ ID NO: 192808 - RNA, 62 nt, Homo Sapiens; identical to SEQ ID NO: 103416

SEQ ID NO: 192809 - RNA, 62 nt, Homo Sapiens; identical to SEQ ID NO: 103417

SEQ ID NO: 192810 - RNA, 62 nt, Homo Sapiens; identical to SEQ ID NO: 103418

SEQ ID NO: 192811 - RNA, 62 nt, Homo Sapiens; identical to SEQ ID NO: 103419

SEQ ID NO: 192812 - RNA, 62 nt, Homo Sapiens; identical to SEQ ID NO: 103420

SEQ ID NO: 192813 - RNA, 62 nt, Homo Sapiens; identical to SEQ ID NO: 103421

SEQ ID NO: 192814 - RNA, 62 nt, Homo Sapiens; identical to SEQ ID NO: 103422

SEQ ID NO: 192815 - RNA, 62 nt, Homo Sapiens; identical to SEQ ID NO: 103423

SEQ ID NO: 192816 - RNA, 62 nt, Homo Sapiens; identical to SEQ ID NO: 103424

SEQ ID NO: 192817 - RNA, 62 nt, Homo Sapiens; identical to SEQ ID NO: 103425

SEQ ID NO: 192818 - RNA, 62 nt, Homo Sapiens; identical to SEQ ID NO: 103426

SEQ ID NO: 192819 - RNA, 62 nt, Homo Sapiens; identical to SEQ ID NO: 103427

SEQ ID NO: 192820 - RNA, 62 nt, Homo Sapiens; identical to SEQ ID NO: 103428

SEQ ID NO: 192821 - RNA, 62 nt, Homo Sapiens; identical to SEQ ID NO: 103429

SEQ ID NO: 192822 - RNA, 62 nt, Homo Sapiens; identical to SEQ ID NO: 103430

SEQ ID NO: 192823 - RNA, 62 nt, Homo Sapiens; identical to SEQ ID NO: 103431

SEQ ID NO: 192824 - RNA, 62 nt, Homo Sapiens; identical to SEQ ID NO: 103432

SEQ ID NO: 192825 - RNA, 62 nt, Homo Sapiens; identical to SEQ ID NO: 103433

SEQ ID NO: 192826 - RNA, 62 nt, Homo Sapiens; identical to SEQ ID NO: 103434

SEQ ID NO: 192827 - RNA, 62 nt, Homo Sapiens; identical to SEQ ID NO: 103435

SEQ ID NO: 192828 - RNA, 62 nt, Homo Sapiens; identical to SEQ ID NO: 103436

SEQ ID NO: 192829 - RNA, 62 nt, Homo Sapiens; identical to SEQ ID NO: 103437

SEQ ID NO: 192830 - RNA, 62 nt, Homo Sapiens; identical to SEQ ID NO: 103438

SEQ ID NO: 192831 - RNA, 62 nt, Homo Sapiens; identical to SEQ ID NO: 103439

SEQ ID NO: 192832 - RNA, 62 nt, Homo Sapiens; identical to SEQ ID NO: 103440

SEQ ID NO: 192833 - RNA, 62 nt, Homo Sapiens; identical to SEQ ID NO: 103441

SEQ ID NO: 192834 - RNA, 62 nt, Homo Sapiens; identical to SEQ ID NO: 103442

SEQ ID NO: 192835 - RNA, 62 nt, Homo Sapiens; identical to SEQ ID NO: 103443

SEQ ID NO: 192836 - RNA, 62 nt, Homo Sapiens; identical to SEQ ID NO: 103444

SEQ ID NO: 192837 - RNA, 62 nt, Homo Sapiens; identical to SEQ ID NO: 103445

SEQ ID NO: 192838 - RNA, 62 nt, Homo Sapiens; identical to SEQ ID NO: 103446

SEQ ID NO: 192839 - RNA, 62 nt, Homo Sapiens; identical to SEQ ID NO: 103447

SEQ ID NO: 192840 - RNA, 62 nt, Homo Sapiens; identical to SEQ ID NO: 103448

SEQ ID NO: 192841 - RNA, 62 nt, Homo Sapiens; identical to SEQ ID NO: 103449

SEQ ID NO: 192842 - RNA, 62 nt, Homo Sapiens; identical to SEQ ID NO: 103450

SEQ ID NO: 192843 - RNA, 62 nt, Homo Sapiens; identical to SEQ ID NO: 103451

SEQ ID NO: 192844 - RNA, 62 nt, Homo Sapiens; identical to SEQ ID NO: 103452

SEQ ID NO: 192845 - RNA, 62 nt, Homo Sapiens; identical to SEQ ID NO: 103453

SEQ ID NO: 192846 - RNA, 62 nt, Homo Sapiens; identical to SEQ ID NO: 103454

SEQ ID NO: 192847 - RNA, 62 nt, Homo Sapiens; identical to SEQ ID NO: 103455

SEQ ID NO: 192848 - RNA, 62 nt, Homo Sapiens; identical to SEQ ID NO: 103456

SEQ ID NO: 192849 - RNA, 62 nt, Homo Sapiens; identical to SEQ ID NO: 103457

SEQ ID NO: 192850 - RNA, 62 nt, Homo Sapiens; identical to SEQ ID NO: 103458

SEQ ID NO: 192851 - RNA, 62 nt, Homo Sapiens; identical to SEQ ID NO: 103459

SEQ ID NO: 192852 - RNA, 62 nt, Homo Sapiens; identical to SEQ ID NO: 103460

SEQ ID NO: 192853 - RNA, 62 nt, Homo Sapiens; identical to SEQ ID NO: 103461

SEQ ID NO: 192854 - RNA, 62 nt, Homo Sapiens; identical to SEQ ID NO: 103462

SEQ ID NO: 192855 - RNA, 62 nt, Homo Sapiens; identical to SEQ ID NO: 103463

SEQ ID NO: 192856 - RNA, 62 nt, Homo Sapiens; identical to SEQ ID NO: 103464

SEQ ID NO: 192857 - RNA, 62 nt, Homo Sapiens; identical to SEQ ID NO: 103465

SEQ ID NO: 192858 - RNA, 62 nt, Homo Sapiens; identical to SEQ ID NO: 103466

SEQ ID NO: 192859 - RNA, 62 nt, Homo Sapiens; identical to SEQ ID NO: 103467

SEQ ID NO: 192860 - RNA, 62 nt, Homo Sapiens; identical to SEQ ID NO: 103468

SEQ ID NO: 192861 - RNA, 62 nt, Homo Sapiens; identical to SEQ ID NO: 103469

SEQ ID NO: 192862 - RNA, 62 nt, Homo Sapiens; identical to SEQ ID NO: 103470

SEQ ID NO: 192863 - RNA, 62 nt, Homo Sapiens; identical to SEQ ID NO: 103471

SEQ ID NO: 192864 - RNA, 62 nt, Homo Sapiens; identical to SEQ ID NO: 103472

SEQ ID NO: 192865 - RNA, 62 nt, Homo Sapiens; identical to SEQ ID NO: 103473

SEQ ID NO: 192866 - RNA, 62 nt, Homo Sapiens; identical to SEQ ID NO: 103474

SEQ ID NO: 192867 - RNA, 62 nt, Homo Sapiens; identical to SEQ ID NO: 103475

SEQ ID NO: 192868 - RNA, 62 nt, Homo Sapiens; identical to SEQ ID NO: 103476

SEQ ID NO: 192869 - RNA, 62 nt, Homo Sapiens; identical to SEQ ID NO: 103477

SEQ ID NO: 192870 - RNA, 62 nt, Homo Sapiens; identical to SEQ ID NO: 103478

SEQ ID NO: 192871 - RNA, 62 nt, Homo Sapiens; identical to SEQ ID NO: 103479

SEQ ID NO: 192872 - RNA, 62 nt, Homo Sapiens; identical to SEQ ID NO: 103480

SEQ ID NO: 192873 - RNA, 62 nt, Homo Sapiens; identical to SEQ ID NO: 103481

SEQ ID NO: 192874 - RNA, 62 nt, Homo Sapiens; identical to SEQ ID NO: 103482

SEQ ID NO: 192875 - RNA, 62 nt, Homo Sapiens; identical to SEQ ID NO: 103483

SEQ ID NO: 192876 - RNA, 62 nt, Homo Sapiens; identical to SEQ ID NO: 103484

SEQ ID NO: 192877 - RNA, 62 nt, Homo Sapiens; identical to SEQ ID NO: 103485

SEQ ID NO: 192878 - RNA, 62 nt, Homo Sapiens; identical to SEQ ID NO: 103486

SEQ ID NO: 192879 - RNA, 62 nt, Homo Sapiens; identical to SEQ ID NO: 103487

SEQ ID NO: 192880 - RNA, 62 nt, Homo Sapiens; identical to SEQ ID NO: 103488

SEQ ID NO: 192881 - RNA, 62 nt, Homo Sapiens; identical to SEQ ID NO: 103489

SEQ ID NO: 192882 - RNA, 62 nt, Homo Sapiens; identical to SEQ ID NO: 103490

SEQ ID NO: 192883 - RNA, 62 nt, Homo Sapiens; identical to SEQ ID NO: 103491

SEQ ID NO: 192884 - RNA, 62 nt, Homo Sapiens; identical to SEQ ID NO: 103492

SEQ ID NO: 192885 - RNA, 62 nt, Homo Sapiens; identical to SEQ ID NO: 103493

SEQ ID NO: 192886 - RNA, 62 nt, Homo Sapiens; identical to SEQ ID NO: 103494

SEQ ID NO: 192887 - RNA, 62 nt, Homo Sapiens; identical to SEQ ID NO: 103495

SEQ ID NO: 192888 - RNA, 62 nt, Homo Sapiens; identical to SEQ ID NO: 103496

SEQ ID NO: 192889 - RNA, 62 nt, Homo Sapiens; identical to SEQ ID NO: 103497

SEQ ID NO: 192890 - RNA, 62 nt, Homo Sapiens; identical to SEQ ID NO: 103498

SEQ ID NO: 192891 - RNA, 62 nt, Homo Sapiens; identical to SEQ ID NO: 103499

SEQ ID NO: 192892 - RNA, 62 nt, Homo Sapiens; identical to SEQ ID NO: 103500

SEQ ID NO: 192893 - RNA, 62 nt, Homo Sapiens; identical to SEQ ID NO: 103501

SEQ ID NO: 192894 - RNA, 62 nt, Homo Sapiens; identical to SEQ ID NO: 103502

SEQ ID NO: 192895 - RNA, 62 nt, Homo Sapiens; identical to SEQ ID NO: 103503

SEQ ID NO: 192896 - RNA, 62 nt, Homo Sapiens; identical to SEQ ID NO: 103504

SEQ ID NO: 192897 - RNA, 62 nt, Homo Sapiens; identical to SEQ ID NO: 103505

SEQ ID NO: 192898 - RNA, 62 nt, Homo Sapiens; identical to SEQ ID NO: 103506

SEQ ID NO: 192899 - RNA, 62 nt, Homo Sapiens; identical to SEQ ID NO: 103507

SEQ ID NO: 192900 - RNA, 63 nt, Homo Sapiens; identical to SEQ ID NO: 103508

SEQ ID NO: 192901 - RNA, 63 nt, Homo Sapiens; identical to SEQ ID NO: 103509

SEQ ID NO: 192902 - RNA, 63 nt, Homo Sapiens; identical to SEQ ID NO: 103510

SEQ ID NO: 192903 - RNA, 63 nt, Homo Sapiens; identical to SEQ ID NO: 103511

SEQ ID NO: 192904 - RNA, 63 nt, Homo Sapiens; identical to SEQ ID NO: 103512

SEQ ID NO: 192905 - RNA, 63 nt, Homo Sapiens; identical to SEQ ID NO: 103513

SEQ ID NO: 192906 - RNA, 63 nt, Homo Sapiens; identical to SEQ ID NO: 103514

SEQ ID NO: 192907 - RNA, 63 nt, Homo Sapiens; identical to SEQ ID NO: 103515

SEQ ID NO: 192908 - RNA, 63 nt, Homo Sapiens; identical to SEQ ID NO: 103516

SEQ ID NO: 192909 - RNA, 63 nt, Homo Sapiens; identical to SEQ ID NO: 103517

SEQ ID NO: 192910 - RNA, 63 nt, Homo Sapiens; identical to SEQ ID NO: 103518

SEQ ID NO: 192911 - RNA, 57 nt, Homo Sapiens; identical to SEQ ID NO: 103300

SEQ ID NO: 192912 - RNA, 63 nt, Homo Sapiens; identical to SEQ ID NO: 103520

SEQ ID NO: 192913 - RNA, 63 nt, Homo Sapiens; identical to SEQ ID NO: 103521

SEQ ID NO: 192914 - RNA, 63 nt, Homo Sapiens; identical to SEQ ID NO: 103522

SEQ ID NO: 192915 - RNA, 63 nt, Homo Sapiens; identical to SEQ ID NO: 103523

SEQ ID NO: 192916 - RNA, 63 nt, Homo Sapiens; identical to SEQ ID NO: 103524

SEQ ID NO: 192917 - RNA, 63 nt, Homo Sapiens; identical to SEQ ID NO: 103525

SEQ ID NO: 192918 - RNA, 63 nt, Homo Sapiens; identical to SEQ ID NO: 103526

SEQ ID NO: 192919 - RNA, 63 nt, Homo Sapiens; identical to SEQ ID NO: 103527

SEQ ID NO: 192920 - RNA, 63 nt, Homo Sapiens; identical to SEQ ID NO: 103528

SEQ ID NO: 192921 - RNA, 63 nt, Homo Sapiens; identical to SEQ ID NO: 103529

SEQ ID NO: 192922 - RNA, 63 nt, Homo Sapiens; identical to SEQ ID NO: 103530

SEQ ID NO: 192923 - RNA, 63 nt, Homo Sapiens; identical to SEQ ID NO: 103531

SEQ ID NO: 192924 - RNA, 63 nt, Homo Sapiens; identical to SEQ ID NO: 103532

SEQ ID NO: 192925 - RNA, 63 nt, Homo Sapiens; identical to SEQ ID NO: 103533

SEQ ID NO: 192926 - RNA, 63 nt, Homo Sapiens; identical to SEQ ID NO: 103534

SEQ ID NO: 192927 - RNA, 63 nt, Homo Sapiens; identical to SEQ ID NO: 103535

SEQ ID NO: 192928 - RNA, 63 nt, Homo Sapiens; identical to SEQ ID NO: 103536

SEQ ID NO: 192929 - RNA, 63 nt, Homo Sapiens; identical to SEQ ID NO: 103537

SEQ ID NO: 192930 - RNA, 63 nt, Homo Sapiens; identical to SEQ ID NO: 103538

SEQ ID NO: 192931 - RNA, 63 nt, Homo Sapiens; identical to SEQ ID NO: 103539

SEQ ID NO: 192932 - RNA, 63 nt, Homo Sapiens; identical to SEQ ID NO: 103540

SEQ ID NO: 192933 - RNA, 63 nt, Homo Sapiens; identical to SEQ ID NO: 103541

SEQ ID NO: 192934 - RNA, 63 nt, Homo Sapiens; identical to SEQ ID NO: 103542

SEQ ID NO: 192935 - RNA, 63 nt, Homo Sapiens; identical to SEQ ID NO: 103543

SEQ ID NO: 192936 - RNA, 63 nt, Homo Sapiens; identical to SEQ ID NO: 103544

SEQ ID NO: 192937 - RNA, 63 nt, Homo Sapiens; identical to SEQ ID NO: 103545

SEQ ID NO: 192938 - RNA, 63 nt, Homo Sapiens; identical to SEQ ID NO: 103546

SEQ ID NO: 192939 - RNA, 63 nt, Homo Sapiens; identical to SEQ ID NO: 103547

SEQ ID NO: 192940 - RNA, 63 nt, Homo Sapiens; identical to SEQ ID NO: 103548

SEQ ID NO: 192941 - RNA, 63 nt, Homo Sapiens; identical to SEQ ID NO: 103549

SEQ ID NO: 192942 - RNA, 63 nt, Homo Sapiens; identical to SEQ ID NO: 103550

SEQ ID NO: 192943 - RNA, 63 nt, Homo Sapiens; identical to SEQ ID NO: 103551

SEQ ID NO: 192944 - RNA, 63 nt, Homo Sapiens; identical to SEQ ID NO: 103552

SEQ ID NO: 192945 - RNA, 63 nt, Homo Sapiens; identical to SEQ ID NO: 103553

SEQ ID NO: 192946 - RNA, 63 nt, Homo Sapiens; identical to SEQ ID NO: 103554

SEQ ID NO: 192947 - RNA, 63 nt, Homo Sapiens; identical to SEQ ID NO: 103555

SEQ ID NO: 192948 - RNA, 63 nt, Homo Sapiens; identical to SEQ ID NO: 103556

SEQ ID NO: 192949 - RNA, 63 nt, Homo Sapiens; identical to SEQ ID NO: 103557

SEQ ID NO: 192950 - RNA, 63 nt, Homo Sapiens; identical to SEQ ID NO: 103558

SEQ ID NO: 192951 - RNA, 63 nt, Homo Sapiens; identical to SEQ ID NO: 103559

SEQ ID NO: 192952 - RNA, 63 nt, Homo Sapiens; identical to SEQ ID NO: 103560

SEQ ID NO: 192953 - RNA, 63 nt, Homo Sapiens; identical to SEQ ID NO: 103561

SEQ ID NO: 192954 - RNA, 63 nt, Homo Sapiens; identical to SEQ ID NO: 103562

SEQ ID NO: 192955 - RNA, 63 nt, Homo Sapiens; identical to SEQ ID NO: 103563

SEQ ID NO: 192956 - RNA, 63 nt, Homo Sapiens; identical to SEQ ID NO: 103564

SEQ ID NO: 192957 - RNA, 63 nt, Homo Sapiens; identical to SEQ ID NO: 103565

SEQ ID NO: 192958 - RNA, 63 nt, Homo Sapiens; identical to SEQ ID NO: 103566

SEQ ID NO: 192959 - RNA, 63 nt, Homo Sapiens; identical to SEQ ID NO: 103567

SEQ ID NO: 192960 - RNA, 63 nt, Homo Sapiens; identical to SEQ ID NO: 103568

SEQ ID NO: 192961 - RNA, 63 nt, Homo Sapiens; identical to SEQ ID NO: 103569

SEQ ID NO: 192962 - RNA, 63 nt, Homo Sapiens; identical to SEQ ID NO: 103570

SEQ ID NO: 192963 - RNA, 63 nt, Homo Sapiens; identical to SEQ ID NO: 103571

SEQ ID NO: 192964 - RNA, 63 nt, Homo Sapiens; identical to SEQ ID NO: 103572

SEQ ID NO: 192965 - RNA, 63 nt, Homo Sapiens; identical to SEQ ID NO: 103573

SEQ ID NO: 192966 - RNA, 63 nt, Homo Sapiens; identical to SEQ ID NO: 103574

SEQ ID NO: 192967 - RNA, 63 nt, Homo Sapiens; identical to SEQ ID NO: 103575

SEQ ID NO: 192968 - RNA, 63 nt, Homo Sapiens; identical to SEQ ID NO: 103576

SEQ ID NO: 192969 - RNA, 63 nt, Homo Sapiens; identical to SEQ ID NO: 103577

SEQ ID NO: 192970 - RNA, 63 nt, Homo Sapiens; identical to SEQ ID NO: 103578

SEQ ID NO: 192971 - RNA, 63 nt, Homo Sapiens; identical to SEQ ID NO: 103579

SEQ ID NO: 192972 - RNA, 63 nt, Homo Sapiens; identical to SEQ ID NO: 103580

SEQ ID NO: 192973 - RNA, 63 nt, Homo Sapiens; identical to SEQ ID NO: 103581

SEQ ID NO: 192974 - RNA, 63 nt, Homo Sapiens; identical to SEQ ID NO: 103582

SEQ ID NO: 192975 - RNA, 63 nt, Homo Sapiens; identical to SEQ ID NO: 103583

SEQ ID NO: 192976 - RNA, 63 nt, Homo Sapiens; identical to SEQ ID NO: 103584

SEQ ID NO: 192977 - RNA, 63 nt, Homo Sapiens; identical to SEQ ID NO: 103585

SEQ ID NO: 192978 - RNA, 63 nt, Homo Sapiens; identical to SEQ ID NO: 103586

SEQ ID NO: 192979 - RNA, 63 nt, Homo Sapiens; identical to SEQ ID NO: 103587

SEQ ID NO: 192980 - RNA, 63 nt, Homo Sapiens; identical to SEQ ID NO: 103588

SEQ ID NO: 192981 - RNA, 63 nt, Homo Sapiens; identical to SEQ ID NO: 103589

SEQ ID NO: 192982 - RNA, 63 nt, Homo Sapiens; identical to SEQ ID NO: 103590

SEQ ID NO: 192983 - RNA, 59 nt, Homo Sapiens; identical to SEQ ID NO: 103372

SEQ ID NO: 192984 - RNA, 63 nt, Homo Sapiens; identical to SEQ ID NO: 103592

SEQ ID NO: 192985 - RNA, 63 nt, Homo Sapiens; identical to SEQ ID NO: 103593

SEQ ID NO: 192986 - RNA, 63 nt, Homo Sapiens; identical to SEQ ID NO: 103594

SEQ ID NO: 192987 - RNA, 63 nt, Homo Sapiens; identical to SEQ ID NO: 103595

SEQ ID NO: 192988 - RNA, 63 nt, Homo Sapiens; identical to SEQ ID NO: 103596

SEQ ID NO: 192989 - RNA, 63 nt, Homo Sapiens; identical to SEQ ID NO: 103597

SEQ ID NO: 192990 - RNA, 63 nt, Homo Sapiens; identical to SEQ ID NO: 103598

SEQ ID NO: 192991 - RNA, 63 nt, Homo Sapiens; identical to SEQ ID NO: 103599

SEQ ID NO: 192992 - RNA, 63 nt, Homo Sapiens; identical to SEQ ID NO: 103600

SEQ ID NO: 192993 - RNA, 63 nt, Homo Sapiens; identical to SEQ ID NO: 103601

SEQ ID NO: 192994 - RNA, 63 nt, Homo Sapiens; identical to SEQ ID NO: 103602

SEQ ID NO: 192995 - RNA, 63 nt, Homo Sapiens; identical to SEQ ID NO: 103603

SEQ ID NO: 192996 - RNA, 63 nt, Homo Sapiens; identical to SEQ ID NO: 103604

SEQ ID NO: 192997 - RNA, 63 nt, Homo Sapiens; identical to SEQ ID NO: 103605

SEQ ID NO: 192998 - RNA, 63 nt, Homo Sapiens; identical to SEQ ID NO: 103606

SEQ ID NO: 192999 - RNA, 63 nt, Homo Sapiens; identical to SEQ ID NO: 103607

SEQ ID NO: 193000 - RNA, 63 nt, Homo Sapiens; identical to SEQ ID NO: 103608

SEQ ID NO: 193001 - RNA, 63 nt, Homo Sapiens; identical to SEQ ID NO: 103609

SEQ ID NO: 193002 - RNA, 63 nt, Homo Sapiens; identical to SEQ ID NO: 103610

SEQ ID NO: 193003 - RNA, 63 nt, Homo Sapiens; identical to SEQ ID NO: 103611

SEQ ID NO: 193004 - RNA, 61 nt, Homo Sapiens; identical to SEQ ID NO: 103612

SEQ ID NO: 193005 - RNA, 63 nt, Homo Sapiens; identical to SEQ ID NO: 103613

SEQ ID NO: 193006 - RNA, 63 nt, Homo Sapiens; identical to SEQ ID NO: 103614

SEQ ID NO: 193007 - RNA, 63 nt, Homo Sapiens; identical to SEQ ID NO: 103615

SEQ ID NO: 193008 - RNA, 63 nt, Homo Sapiens; identical to SEQ ID NO: 103616

SEQ ID NO: 193009 - RNA, 63 nt, Homo Sapiens; identical to SEQ ID NO: 103617

SEQ ID NO: 193010 - RNA, 63 nt, Homo Sapiens; identical to SEQ ID NO: 103618

SEQ ID NO: 193011 - RNA, 63 nt, Homo Sapiens; identical to SEQ ID NO: 103619

SEQ ID NO: 193012 - RNA, 63 nt, Homo Sapiens; identical to SEQ ID NO: 103620

SEQ ID NO: 193013 - RNA, 63 nt, Homo Sapiens; identical to SEQ ID NO: 103621

SEQ ID NO: 193014 - RNA, 63 nt, Homo Sapiens; identical to SEQ ID NO: 103622

SEQ ID NO: 193015 - RNA, 63 nt, Homo Sapiens; identical to SEQ ID NO: 103623

SEQ ID NO: 193016 - RNA, 63 nt, Homo Sapiens; identical to SEQ ID NO: 103624

SEQ ID NO: 193017 - RNA, 63 nt, Homo Sapiens; identical to SEQ ID NO: 103625

SEQ ID NO: 193018 - RNA, 63 nt, Homo Sapiens; identical to SEQ ID NO: 103626

SEQ ID NO: 193019 - RNA, 63 nt, Homo Sapiens; identical to SEQ ID NO: 103627

SEQ ID NO: 193020 - RNA, 63 nt, Homo Sapiens; identical to SEQ ID NO: 103628

SEQ ID NO: 193021 - RNA, 63 nt, Homo Sapiens; identical to SEQ ID NO: 103629

SEQ ID NO: 193022 - RNA, 63 nt, Homo Sapiens; identical to SEQ ID NO: 103630

SEQ ID NO: 193023 - RNA, 63 nt, Homo Sapiens; identical to SEQ ID NO: 103631

SEQ ID NO: 193024 - RNA, 63 nt, Homo Sapiens; identical to SEQ ID NO: 103632

SEQ ID NO: 193025 - RNA, 63 nt, Homo Sapiens; identical to SEQ ID NO: 103633

SEQ ID NO: 193026 - RNA, 63 nt, Homo Sapiens; identical to SEQ ID NO: 103634

SEQ ID NO: 193027 - RNA, 63 nt, Homo Sapiens; identical to SEQ ID NO: 103635

SEQ ID NO: 193028 - RNA, 63 nt, Homo Sapiens; identical to SEQ ID NO: 103636

SEQ ID NO: 193029 - RNA, 63 nt, Homo Sapiens; identical to SEQ ID NO: 103637

SEQ ID NO: 193030 - RNA, 63 nt, Homo Sapiens; identical to SEQ ID NO: 103638

SEQ ID NO: 193031 - RNA, 63 nt, Homo Sapiens; identical to SEQ ID NO: 103639

SEQ ID NO: 193032 - RNA, 63 nt, Homo Sapiens; identical to SEQ ID NO: 103640

SEQ ID NO: 193033 - RNA, 63 nt, Homo Sapiens; identical to SEQ ID NO: 103641

SEQ ID NO: 193034 - RNA, 63 nt, Homo Sapiens; identical to SEQ ID NO: 103642

SEQ ID NO: 193035 - RNA, 63 nt, Homo Sapiens; identical to SEQ ID NO: 103643

SEQ ID NO: 193036 - RNA, 63 nt, Homo Sapiens; identical to SEQ ID NO: 103644

SEQ ID NO: 193037 - RNA, 63 nt, Homo Sapiens; identical to SEQ ID NO: 103645

SEQ ID NO: 193038 - RNA, 63 nt, Homo Sapiens; identical to SEQ ID NO: 103646

SEQ ID NO: 193039 - RNA, 63 nt, Homo Sapiens; identical to SEQ ID NO: 103647

SEQ ID NO: 193040 - RNA, 63 nt, Homo Sapiens; identical to SEQ ID NO: 103648

SEQ ID NO: 193041 - RNA, 63 nt, Homo Sapiens; identical to SEQ ID NO: 103649

SEQ ID NO: 193042 - RNA, 63 nt, Homo Sapiens; identical to SEQ ID NO: 103650

SEQ ID NO: 193043 - RNA, 63 nt, Homo Sapiens; identical to SEQ ID NO: 103651

SEQ ID NO: 193044 - RNA, 63 nt, Homo Sapiens; identical to SEQ ID NO: 103652

SEQ ID NO: 193045 - RNA, 63 nt, Homo Sapiens; identical to SEQ ID NO: 103653

SEQ ID NO: 193046 - RNA, 63 nt, Homo Sapiens; identical to SEQ ID NO: 103654

SEQ ID NO: 193047 - RNA, 63 nt, Homo Sapiens; identical to SEQ ID NO: 103655

SEQ ID NO: 193048 - RNA, 63 nt, Homo Sapiens; identical to SEQ ID NO: 103656

SEQ ID NO: 193049 - RNA, 63 nt, Homo Sapiens; identical to SEQ ID NO: 103657

SEQ ID NO: 193050 - RNA, 63 nt, Homo Sapiens; identical to SEQ ID NO: 103658

SEQ ID NO: 193051 - RNA, 63 nt, Homo Sapiens; identical to SEQ ID NO: 103659

SEQ ID NO: 193052 - RNA, 63 nt, Homo Sapiens; identical to SEQ ID NO: 103660

SEQ ID NO: 193053 - RNA, 63 nt, Homo Sapiens; identical to SEQ ID NO: 103661

SEQ ID NO: 193054 - RNA, 63 nt, Homo Sapiens; identical to SEQ ID NO: 103662

SEQ ID NO: 193055 - RNA, 63 nt, Homo Sapiens; identical to SEQ ID NO: 103663

SEQ ID NO: 193056 - RNA, 63 nt, Homo Sapiens; identical to SEQ ID NO: 103664

SEQ ID NO: 193057 - RNA, 63 nt, Homo Sapiens; identical to SEQ ID NO: 103665

SEQ ID NO: 193058 - RNA, 63 nt, Homo Sapiens; identical to SEQ ID NO: 103666

SEQ ID NO: 193059 - RNA, 63 nt, Homo Sapiens; identical to SEQ ID NO: 103667

SEQ ID NO: 193060 - RNA, 63 nt, Homo Sapiens; identical to SEQ ID NO: 103668

SEQ ID NO: 193061 - RNA, 63 nt, Homo Sapiens; identical to SEQ ID NO: 103669

SEQ ID NO: 193062 - RNA, 63 nt, Homo Sapiens; identical to SEQ ID NO: 103670

SEQ ID NO: 193063 - RNA, 63 nt, Homo Sapiens; identical to SEQ ID NO: 103671

SEQ ID NO: 193064 - RNA, 63 nt, Homo Sapiens; identical to SEQ ID NO: 103672

SEQ ID NO: 193065 - RNA, 63 nt, Homo Sapiens; identical to SEQ ID NO: 103673

SEQ ID NO: 193066 - RNA, 63 nt, Homo Sapiens; identical to SEQ ID NO: 103674

SEQ ID NO: 193067 - RNA, 63 nt, Homo Sapiens; identical to SEQ ID NO: 103675

SEQ ID NO: 193068 - RNA, 63 nt, Homo Sapiens; identical to SEQ ID NO: 103676

SEQ ID NO: 193069 - RNA, 63 nt, Homo Sapiens; identical to SEQ ID NO: 103677

SEQ ID NO: 193070 - RNA, 63 nt, Homo Sapiens; identical to SEQ ID NO: 103678

SEQ ID NO: 193071 - RNA, 63 nt, Homo Sapiens; identical to SEQ ID NO: 103679

SEQ ID NO: 193072 - RNA, 63 nt, Homo Sapiens; identical to SEQ ID NO: 103680

SEQ ID NO: 193073 - RNA, 63 nt, Homo Sapiens; identical to SEQ ID NO: 103681

SEQ ID NO: 193074 - RNA, 63 nt, Homo Sapiens; identical to SEQ ID NO: 103682

SEQ ID NO: 193075 - RNA, 63 nt, Homo Sapiens; identical to SEQ ID NO: 103683

SEQ ID NO: 193076 - RNA, 63 nt, Homo Sapiens; identical to SEQ ID NO: 103684

SEQ ID NO: 193077 - RNA, 63 nt, Homo Sapiens; identical to SEQ ID NO: 103685

SEQ ID NO: 193078 - RNA, 63 nt, Homo Sapiens; identical to SEQ ID NO: 103686

SEQ ID NO: 193079 - RNA, 63 nt, Homo Sapiens; identical to SEQ ID NO: 103687

SEQ ID NO: 193080 - RNA, 63 nt, Homo Sapiens; identical to SEQ ID NO: 103688

SEQ ID NO: 193081 - RNA, 63 nt, Homo Sapiens; identical to SEQ ID NO: 103689

SEQ ID NO: 193082 - RNA, 63 nt, Homo Sapiens; identical to SEQ ID NO: 103690

SEQ ID NO: 193083 - RNA, 63 nt, Homo Sapiens; identical to SEQ ID NO: 103691

SEQ ID NO: 193084 - RNA, 63 nt, Homo Sapiens; identical to SEQ ID NO: 103692

SEQ ID NO: 193085 - RNA, 63 nt, Homo Sapiens; identical to SEQ ID NO: 103693

SEQ ID NO: 193086 - RNA, 63 nt, Homo Sapiens; identical to SEQ ID NO: 103694

SEQ ID NO: 193087 - RNA, 63 nt, Homo Sapiens; identical to SEQ ID NO: 103695

SEQ ID NO: 193088 - RNA, 63 nt, Homo Sapiens; identical to SEQ ID NO: 103696

SEQ ID NO: 193089 - RNA, 63 nt, Homo Sapiens; identical to SEQ ID NO: 103697

SEQ ID NO: 193090 - RNA, 63 nt, Homo Sapiens; identical to SEQ ID NO: 103698

SEQ ID NO: 193091 - RNA, 63 nt, Homo Sapiens; identical to SEQ ID NO: 103699

SEQ ID NO: 193092 - RNA, 63 nt, Homo Sapiens; identical to SEQ ID NO: 103700

SEQ ID NO: 193093 - RNA, 63 nt, Homo Sapiens; identical to SEQ ID NO: 103701

SEQ ID NO: 193094 - RNA, 63 nt, Homo Sapiens; identical to SEQ ID NO: 103702

SEQ ID NO: 193095 - RNA, 63 nt, Homo Sapiens; identical to SEQ ID NO: 103703

SEQ ID NO: 193096 - RNA, 63 nt, Homo Sapiens; identical to SEQ ID NO: 103704

SEQ ID NO: 193097 - RNA, 63 nt, Homo Sapiens; identical to SEQ ID NO: 103705

SEQ ID NO: 193098 - RNA, 63 nt, Homo Sapiens; identical to SEQ ID NO: 103706

SEQ ID NO: 193099 - RNA, 63 nt, Homo Sapiens; identical to SEQ ID NO: 103707

SEQ ID NO: 193100 - RNA, 63 nt, Homo Sapiens; identical to SEQ ID NO: 103708

SEQ ID NO: 193101 - RNA, 63 nt, Homo Sapiens; identical to SEQ ID NO: 103709

SEQ ID NO: 193102 - RNA, 63 nt, Homo Sapiens; identical to SEQ ID NO: 103710

SEQ ID NO: 193103 - RNA, 63 nt, Homo Sapiens; identical to SEQ ID NO: 103711

SEQ ID NO: 193104 - RNA, 63 nt, Homo Sapiens; identical to SEQ ID NO: 103712

SEQ ID NO: 193105 - RNA, 63 nt, Homo Sapiens; identical to SEQ ID NO: 103713

SEQ ID NO: 193106 - RNA, 63 nt, Homo Sapiens; identical to SEQ ID NO: 103714

SEQ ID NO: 193107 - RNA, 63 nt, Homo Sapiens; identical to SEQ ID NO: 103715

SEQ ID NO: 193108 - RNA, 63 nt, Homo Sapiens; identical to SEQ ID NO: 103716

SEQ ID NO: 193109 - RNA, 63 nt, Homo Sapiens; identical to SEQ ID NO: 103717

SEQ ID NO: 193110 - RNA, 63 nt, Homo Sapiens; identical to SEQ ID NO: 103718

SEQ ID NO: 193111 - RNA, 63 nt, Homo Sapiens; identical to SEQ ID NO: 103719

SEQ ID NO: 193112 - RNA, 63 nt, Homo Sapiens; identical to SEQ ID NO: 103720

SEQ ID NO: 193113 - RNA, 63 nt, Homo Sapiens; identical to SEQ ID NO: 103721

SEQ ID NO: 193114 - RNA, 63 nt, Homo Sapiens; identical to SEQ ID NO: 103722

SEQ ID NO: 193115 - RNA, 63 nt, Homo Sapiens; identical to SEQ ID NO: 103723

SEQ ID NO: 193116 - RNA, 63 nt, Homo Sapiens; identical to SEQ ID NO: 103724

SEQ ID NO: 193117 - RNA, 63 nt, Homo Sapiens; identical to SEQ ID NO: 103725

SEQ ID NO: 193118 - RNA, 63 nt, Homo Sapiens; identical to SEQ ID NO: 103726

SEQ ID NO: 193119 - RNA, 64 nt, Homo Sapiens
auauggauugaaucugguuggucauuuccaccaggaaucagaggcagcuguuaccagguuucgg

SEQ ID NO: 193120 - RNA, 64 nt, Homo Sapiens
ucccuccacuguccaggcugucucaggaggaggugaaucagagcuagucugucaccuuuccaau

SEQ ID NO: 193121 - RNA, 64 nt, Homo Sapiens
uuaauuuuuaaguguuuguauuucuaagugaacagaaucagaagucucaaauguagcauuagua

SEQ ID NO: 193122 - RNA, 64 nt, Homo Sapiens
aaaaguggaagguuugguuuaucacgugcucauugaaucagaaacaugauauuaagcaucuagg

SEQ ID NO: 193123 - RNA, 64 nt, Homo Sapiens
cuaccccaccacgauguggccucugccucaaugugaaucagaccggagaaggaaggagacucac

SEQ ID NO: 193124 - RNA, 64 nt, Homo Sapiens
ucacacugcaagagccuugggaaaacccagagaggaaucagacuaccugcauccguaguucccu

SEQ ID NO: 193125 - RNA, 64 nt, Homo Sapiens
gccuaaaucuuggguuuauuagaugaaguuuacugaaucagaggaaucagacagaggaggauag

SEQ ID NO: 193126 - RNA, 64 nt, Homo Sapiens
uuggguuuauuagaugaaguuuacugaaucagaggaaucagacagaggaggauagcucuuucca

SEQ ID NO: 193127 - RNA, 64 nt, Homo Sapiens
acauauaaaaagucuggauuggauaugugaucgugaaucagaucguguuuacuuucaauuccua

SEQ ID NO: 193128 - RNA, 64 nt, Homo Sapiens
aguuuguuuauucuuuagugcacuuuguggauaugaaucagaagacuaauaauacuuaccaacc

SEQ ID NO: 193129 - RNA, 64 nt, Homo Sapiens
uuucuaccguuccacacccaauaaucucaccacagaaucagaauauuuuguuuucaaaacuaga

SEQ ID NO: 193130 - RNA, 64 nt, Homo Sapiens
caacuucaugguucuccaaagagccaagucugaagaaucagaggugcuccuggaaacccauuua

SEQ ID NO: 193131 - RNA, 64 nt, Homo Sapiens
cgucacuuaauuccugaauguuucagagaaacaggaaucagaaaauagcagauaucauguagga

SEQ ID NO: 193132 - RNA, 64 nt, Homo Sapiens
agaaccccguuggggcagauguuacugaaccugugaaucagacgccaggagugagggcugggga

SEQ ID NO: 193133 - RNA, 64 nt, Homo Sapiens
uuauuagggacucccacccucuucaaguuauaaauauccccagaaccuuggcuacgugcccgga

SEQ ID NO: 193134 - RNA, 64 nt, Homo Sapiens
uaaaauggaauccuggaggguccccuagaggcaguauccccaguggaaagagcgugggccucaa

SEQ ID NO: 193135 - RNA, 64 nt, Homo Sapiens
uauaagcuaaguugaggguucagagggagacaaauauccccaagugaaauauguugcgguagag

SEQ ID NO: 193136 - RNA, 64 nt, Homo Sapiens
caguaggaaacauaaagaaacaauguccccuacauauccccaugacuacauaauccaucaucgu

SEQ ID NO: 193137 - RNA, 64 nt, Homo Sapiens
uuacagaugaggaaacugaaaugagguugguuauuauccccauuuaaucauuauccccaacccu

SEQ ID NO: 193138 - RNA, 64 nt, Homo Sapiens
ccuaugagguugguuauuauucguuuuuaaucauuauccccaacuaaguguuuuucauguauua

SEQ ID NO: 193139 - RNA, 64 nt, Homo Sapiens
ucaugguuuucaguggcaacuggaguuaacuaauuauccccauucauaaaacaacucacauugu

SEQ ID NO: 193140 - RNA, 64 nt, Homo Sapiens
aacagugaucccuuuucuuauccuccuagcccccuauccccaguaaauggacauucuuaccuac

SEQ ID NO: 193141 - RNA, 64 nt, Homo Sapiens
ccuccacccaccccucucccaccucccaccccuguauccccaccaccccucccacaaccccugu

SEQ ID NO: 193142 - RNA, 64 nt, Homo Sapiens
ccguacucccaccccucccaucccccaaccccuguauccccaccgggggcagcugccccauccc

SEQ ID NO: 193143 - RNA, 64 nt, Homo Sapiens
ccccuccuagcuugacuuuagggugggcaguaccuauccccaguaacuucuuucugggggauug

SEQ ID NO: 193144 - RNA, 64 nt, Homo Sapiens
cuccacccacuaccuccuccagccguaucuagcauauccccacccucacaggccccaaacuacc

SEQ ID NO: 193145 - RNA, 64 nt, Homo Sapiens
gaugacucugcacucucauugucaagguuagauauauccccaguugcaaaacagccagacuuga

SEQ ID NO: 193146 - RNA, 64 nt, Homo Sapiens
aaagcaaugaacugcuugcuuagagaagcaucacuauccccauugagaaaaauguguggcaaga

SEQ ID NO: 193147 - RNA, 64 nt, Homo Sapiens
gagauugccucugacuuccugggaugaacggguagacaaggacuucgaacccagagauuuuuga

SEQ ID NO: 193148 - RNA, 64 nt, Homo Sapiens
gcuaucugggacauuauuggagggaugagauacagacaaggauagccugacaaugguaccuauu

SEQ ID NO: 193149 - RNA, 64 nt, Homo Sapiens
ggacgugguuuuagagucuaccuaauauguuaaggacaaggaaaccucugagucuaccuaauau

SEQ ID NO: 193150 - RNA, 64 nt, Homo Sapiens
caaggaaaccucugagucuaccuaauauguuaaggacaaggaaaccucuggacagugguauauu

SEQ ID NO: 193151 - RNA, 64 nt, Homo Sapiens
ugagacaguggugauggccaacaaucagaaaaaggacaaggacaucccugaacuuaagauagcc

SEQ ID NO: 193152 - RNA, 64 nt, Homo Sapiens
aagcagggcagaaugaugccagugggucaggcaggacaaggagagaccguuccuaggaugggac

SEQ ID NO: 193153 - RNA, 64 nt, Homo Sapiens
cuguggggucuggguccccacgggugguggagaugacaaggacaaaggagcagggcuuggagcu

SEQ ID NO: 193154 - RNA, 64 nt, Homo Sapiens
gcaccccauauuauuuccaaaaauaucuuggacagacaaggaccaaaaugccaaaaucucagcg

SEQ ID NO: 193155 - RNA, 64 nt, Homo Sapiens
cccaggaaacagcaugugguucagagaaaagagcgacaaggaaaaguuaggacuccugaggucc

SEQ ID NO: 193156 - RNA, 64 nt, Homo Sapiens
ugagcgggagcgcagagagcggagccgggagcgagacaaggagcgagaacggcgacgcucccgc

SEQ ID NO: 193157 - RNA, 64 nt, Homo Sapiens
cucccgggaccggcggaggcgcucacggagucgcgacaaggaggagcggaggcgcuccagggag

SEQ ID NO: 193158 - RNA, 64 nt, Homo Sapiens
ggaggagcggaggcgcuccagggagcggagcaaggacaaggaccgggaccggaagcggcgaagc

SEQ ID NO: 193159 - RNA, 64 nt, Homo Sapiens
ccuggccucgaagcccugggugcaugucugcugggacaaggauuacaggagaccguugcuccag

SEQ ID NO: 193160 - RNA, 64 nt, Homo Sapiens
ucaagacccagcuugggggaauuuccauuuuacagacaaggaaagccuuugggaccauuagucc

SEQ ID NO: 193161 - RNA, 64 nt, Homo Sapiens
ucugugcugguugcaaagaaguuuggauuugauagccaauuaguccaaacuuaaccuugguggg

SEQ ID NO: 193162 - RNA, 64 nt, Homo Sapiens
guuuaccgaguauaauguugaaacuuauuuuguugccaauuauuacugguuugggcagaauauu

SEQ ID NO: 193163 - RNA, 64 nt, Homo Sapiens
auaggcagucuucauuuugcuuuucauguucucugccaauuacuucucuuuaccuccuuggcca

SEQ ID NO: 193164 - RNA, 64 nt, Homo Sapiens
gaaaccaaccggugucaguacaaauguaauuuuugccaauuagaaguaauuuuuuuuuaaauug

SEQ ID NO: 193165 - RNA, 64 nt, Homo Sapiens
uuuucauaguaagugcgaagacugagccagauuggccaauuaaaaacgaaaaccugacuagguu

SEQ ID NO: 193166 - RNA, 64 nt, Homo Sapiens
aauuaaaaacgaaaaccugacuagguucuguagagccaauuagacuugaaauacguuuguguuu

SEQ ID NO: 193167 - RNA, 64 nt, Homo Sapiens
caccuccggugucaaaaggcugucaugggguugugccaauuaauuaccaaacauugagccugca

SEQ ID NO: 193168 - RNA, 64 nt, Homo Sapiens
gagugggaguguugcccccaggagccuuaucucagccaauuaccuuucuugacaguaggagcgg

SEQ ID NO: 193169 - RNA, 64 nt, Homo Sapiens
ccucuuuucuuauaaauuaccuggagaacugugagccaauuauaagugcuaugcuuccuauagc

SEQ ID NO: 193170 - RNA, 64 nt, Homo Sapiens
uaucaccauaaaaguaauaaacuacuccuuuacugccaauuaacuuguaguuguccuuuacgua

SEQ ID NO: 193171 - RNA, 64 nt, Homo Sapiens
ucuucuuuuguuuagccaagaaaacauucuuaguuggaaacaggugguaaaguaguuuggccug

SEQ ID NO: 193172 - RNA, 64 nt, Homo Sapiens
ucauagaaacaaagucucagauauuuuaguucuuuggaaacaaaugcuguaauucaaaagcauu

SEQ ID NO: 193173 - RNA, 64 nt, Homo Sapiens
uuuuaguuuauugcuuuggauuaccuccccgucuuggaaacaaguauuguuuuauaagccugcu

SEQ ID NO: 193174 - RNA, 64 nt, Homo Sapiens
ugggccacuuggcuuucuuugauggcaaacacacuggaaacaaugaaaguaacaaccaugcuaa

SEQ ID NO: 193175 - RNA, 64 nt, Homo Sapiens
ucuucuguuauuuacaaaauggcaccuuacuuuuuggaaacaaaucaauuauauacuucugaau

SEQ ID NO: 193176 - RNA, 64 nt, Homo Sapiens
uucagauugggaaaaacaauaauacauacauguauggaaacauaauuggaaaauagaaauugca

SEQ ID NO: 193177 - RNA, 64 nt, Homo Sapiens
gguacaagaugugguuagaaacauuucuuuguucuggaaacaaaguacuguugaaaccagcuug

SEQ ID NO: 193178 - RNA, 64 nt, Homo Sapiens
gaaaaguuuucuuaucuucugugcuuuuggucccuggaaacaaauccgccuauguaugaagcua

SEQ ID NO: 193179 - RNA, 64 nt, Homo Sapiens
aguuugauggaaugaaucaccuggguggggaccuuggaaacaaguuuguccguccacucuacaa

SEQ ID NO: 193180 - RNA, 64 nt, Homo Sapiens
auggaaaucuaugaauuauugcaaauuguaaugcuggaaacaaaaaauaaauccuugguuaaag

SEQ ID NO: 193181 - RNA, 64 nt, Homo Sapiens
uucaucauuauuauucagccacaugaauagaccauggaaacauuugguuguuauugugcuguug

SEQ ID NO: 193182 - RNA, 64 nt, Homo Sapiens
gcaagaucaaugaaggcuaacuguggccuuuuuauggaaacagaccucccauuuuaacuaucua

SEQ ID NO: 193183 - RNA, 64 nt, Homo Sapiens
aacaugaaggacuccaacuacauuuucucugaguuggaaacaaaaagaguaucuucauuauucu

SEQ ID NO: 193184 - RNA, 64 nt, Homo Sapiens
ucaauauaauuacaguguuuuuucagauuauuucuggaaacauauuuacuuuuuuuguacacuu

SEQ ID NO: 193185 - RNA, 64 nt, Homo Sapiens
uaaggguugggggaaagcauggacaaaacaucacuggaaacaaaggcuguaaccacagcaacag

SEQ ID NO: 193186 - RNA, 64 nt, Homo Sapiens
caacuuuuuauuuagaacugugagaccgguauuuuggaaacauuucaaaggaaacauaugaauu

SEQ ID NO: 193187 - RNA, 64 nt, Homo Sapiens
cggcccacgcgugcugcagaagauguggggagucuggaaacaccacccggcccacgcgugcugc

SEQ ID NO: 193188 - RNA, 64 nt, Homo Sapiens
cggcccacgcgugcugcagaagauguggggagccuggaaacaccacccggcccacgcgugcugc

SEQ ID NO: 193189 - RNA, 64 nt, Homo Sapiens; identical to SEQ ID NO: 193188

SEQ ID NO: 193190 - RNA, 64 nt, Homo Sapiens
cggcccacgcgugcugcagaugacguggggagccuggaaacacccgaggcagaguuaagaccug

SEQ ID NO: 193191 - RNA, 64 nt, Homo Sapiens
uggagcaucagguagaauucgaguggaaacagaguggaaacacaguuuauguucucagcagcca

SEQ ID NO: 193192 - RNA, 64 nt, Homo Sapiens
guggaaacacauggagcauccucagcagccagaguggaaacagaggcugggaauaguuuauguu

SEQ ID NO: 193193 - RNA, 64 nt, Homo Sapiens
ucugugugugaaggugaggagugcuggccugggcuggaaacagcugcaggccuucugcaaauca

SEQ ID NO: 193194 - RNA, 64 nt, Homo Sapiens
auaccucuucccccuuauccccccuugguuuccuuggaaacaaccagccguaggggaccccaga

SEQ ID NO: 193195 - RNA, 64 nt, Homo Sapiens
aacugugccuggacccucccucuuggugggucuguggaaacauaagcgguuuuuuuaaugggcc

SEQ ID NO: 193196 - RNA, 64 nt, Homo Sapiens
cuaggaaacgguucaugugucacuuuucaggauguggaaacacugagccauacacccuccauug

SEQ ID NO: 193197 - RNA, 64 nt, Homo Sapiens
cugucccuguccccaggcccuccggcucucaccauggaaacaaaggugacccaacauccaguuc

SEQ ID NO: 193198 - RNA, 64 nt, Homo Sapiens
ccaacugcccccguggucgccuccugagaccacuuggaaacagacuccugaagacuggccacgc

SEQ ID NO: 193199 - RNA, 64 nt, Homo Sapiens
uaauguggucugcuuuauaaucuacagguauauauggaaacaaauauuugaggggagagaaaua

SEQ ID NO: 193200 - RNA, 64 nt, Homo Sapiens
uagaagccaucaccuggcccacacauuagccuucuggaaacaaguuacuaagaaaggguguagg

SEQ ID NO: 193201 - RNA, 64 nt, Homo Sapiens
aaaaaaggaaauaaaaugcagcuaucuaaugcagugauaccaaauucagcauuguacuggaagu

SEQ ID NO: 193202 - RNA, 64 nt, Homo Sapiens
ucuguacugucucuuucagaacuuaagguagaaaugauaccaagugaugugcauuuuucgagau

SEQ ID NO: 193203 - RNA, 64 nt, Homo Sapiens
uauuuguuuguuuaaaaugguauaaaacuuuaaaugauaccacauucaguuacucuuaauucuu

SEQ ID NO: 193204 - RNA, 64 nt, Homo Sapiens
cucugggagauacucugcaaggagugaagacacuugauaccagaggaaaaaagugaugugacag

SEQ ID NO: 193205 - RNA, 64 nt, Homo Sapiens
cagaccuuggguggggagaguuauucuugaguuuugauaccacguggugguuuggcuucuguuc

SEQ ID NO: 193206 - RNA, 64 nt, Homo Sapiens
ggguuaaggggcagauuggccuuuuaagaugcucugauaccauuaucagagucuagugguugug

SEQ ID NO: 193207 - RNA, 64 nt, Homo Sapiens
ccugcacuccuggguccugccaaaggggcaacagugauaccaucagugggaaaugggucauuuu

SEQ ID NO: 193208 - RNA, 64 nt, Homo Sapiens
accaccugccuacccaugggugcccagugguugaugauaccaccaagugcugcauaugccccug

SEQ ID NO: 193209 - RNA, 64 nt, Homo Sapiens
gugcacaagcaccucuccugugaguucauccccugugaaucagauuguaugucuuuugagaucc

SEQ ID NO: 193210 - RNA, 64 nt, Homo Sapiens
cauaacgcacacacacgccauuuuuuaccaccuggugaaucagcagaggagauuaaccucuugu

SEQ ID NO: 193211 - RNA, 64 nt, Homo Sapiens; identical to SEQ ID NO: 101915

SEQ ID NO: 193212 - RNA, 64 nt, Homo Sapiens; identical to SEQ ID NO: 101916

SEQ ID NO: 193213 - RNA, 64 nt, Homo Sapiens; identical to SEQ ID NO: 101917

SEQ ID NO: 193214 - RNA, 64 nt, Homo Sapiens; identical to SEQ ID NO: 101918

SEQ ID NO: 193215 - RNA, 64 nt, Homo Sapiens; identical to SEQ ID NO: 101919

SEQ ID NO: 193216 - RNA, 64 nt, Homo Sapiens; identical to SEQ ID NO: 101920

SEQ ID NO: 193217 - RNA, 64 nt, Homo Sapiens; identical to SEQ ID NO: 101921

SEQ ID NO: 193218 - RNA, 64 nt, Homo Sapiens; identical to SEQ ID NO: 101922

SEQ ID NO: 193219 - RNA, 64 nt, Homo Sapiens; identical to SEQ ID NO: 101923

SEQ ID NO: 193220 - RNA, 64 nt, Homo Sapiens; identical to SEQ ID NO: 101924

SEQ ID NO: 193221 - RNA, 51 nt, Homo Sapiens; identical to SEQ ID NO: 101925

SEQ ID NO: 193222 - RNA, 64 nt, Homo Sapiens; identical to SEQ ID NO: 101926

SEQ ID NO: 193223 - RNA, 64 nt, Homo Sapiens; identical to SEQ ID NO: 101927

SEQ ID NO: 193224 - RNA, 64 nt, Homo Sapiens; identical to SEQ ID NO: 101928

SEQ ID NO: 193225 - RNA, 64 nt, Homo Sapiens; identical to SEQ ID NO: 161097

SEQ ID NO: 193226 - RNA, 64 nt, Homo Sapiens; identical to SEQ ID NO: 161098

SEQ ID NO: 193227 - RNA, 64 nt, Homo Sapiens; identical to SEQ ID NO: 161099

SEQ ID NO: 193228 - RNA, 64 nt, Homo Sapiens; identical to SEQ ID NO: 161100

SEQ ID NO: 193229 - RNA, 64 nt, Homo Sapiens; identical to SEQ ID NO: 161101

SEQ ID NO: 193230 - RNA, 64 nt, Homo Sapiens; identical to SEQ ID NO: 161102

SEQ ID NO: 193231 - RNA, 64 nt, Homo Sapiens; identical to SEQ ID NO: 161103

SEQ ID NO: 193232 - RNA, 64 nt, Homo Sapiens; identical to SEQ ID NO: 161104

SEQ ID NO: 193233 - RNA, 64 nt, Homo Sapiens; identical to SEQ ID NO: 161105

SEQ ID NO: 193234 - RNA, 64 nt, Homo Sapiens; identical to SEQ ID NO: 161106

SEQ ID NO: 193235 - RNA, 64 nt, Homo Sapiens; identical to SEQ ID NO: 161107

SEQ ID NO: 193236 - RNA, 64 nt, Homo Sapiens; identical to SEQ ID NO: 161108

SEQ ID NO: 193237 - RNA, 64 nt, Homo Sapiens; identical to SEQ ID NO: 161109

SEQ ID NO: 193238 - RNA, 64 nt, Homo Sapiens; identical to SEQ ID NO: 161110

SEQ ID NO: 193239 - RNA, 64 nt, Homo Sapiens; identical to SEQ ID NO: 161111

SEQ ID NO: 193240 - RNA, 64 nt, Homo Sapiens; identical to SEQ ID NO: 161112

SEQ ID NO: 193241 - RNA, 64 nt, Homo Sapiens; identical to SEQ ID NO: 161113

SEQ ID NO: 193242 - RNA, 64 nt, Homo Sapiens; identical to SEQ ID NO: 161114

SEQ ID NO: 193243 - RNA, 64 nt, Homo Sapiens; identical to SEQ ID NO: 161115

SEQ ID NO: 193244 - RNA, 64 nt, Homo Sapiens; identical to SEQ ID NO: 161116

SEQ ID NO: 193245 - RNA, 64 nt, Homo Sapiens; identical to SEQ ID NO: 161117

SEQ ID NO: 193246 - RNA, 64 nt, Homo Sapiens; identical to SEQ ID NO: 161118

SEQ ID NO: 193247 - RNA, 64 nt, Homo Sapiens; identical to SEQ ID NO: 161119

SEQ ID NO: 193248 - RNA, 64 nt, Homo Sapiens; identical to SEQ ID NO: 161120

SEQ ID NO: 193249 - RNA, 64 nt, Homo Sapiens; identical to SEQ ID NO: 161121

SEQ ID NO: 193250 - RNA, 64 nt, Homo Sapiens; identical to SEQ ID NO: 161122

SEQ ID NO: 193251 - RNA, 64 nt, Homo Sapiens; identical to SEQ ID NO: 161123

SEQ ID NO: 193252 - RNA, 64 nt, Homo Sapiens; identical to SEQ ID NO: 161124

SEQ ID NO: 193253 - RNA, 64 nt, Homo Sapiens; identical to SEQ ID NO: 161125

SEQ ID NO: 193254 - RNA, 64 nt, Homo Sapiens; identical to SEQ ID NO: 161126

SEQ ID NO: 193255 - RNA, 64 nt, Homo Sapiens; identical to SEQ ID NO: 161127

SEQ ID NO: 193256 - RNA, 64 nt, Homo Sapiens; identical to SEQ ID NO: 161128

SEQ ID NO: 193257 - RNA, 64 nt, Homo Sapiens; identical to SEQ ID NO: 161129

SEQ ID NO: 193258 - RNA, 64 nt, Homo Sapiens; identical to SEQ ID NO: 161130

SEQ ID NO: 193259 - RNA, 64 nt, Homo Sapiens; identical to SEQ ID NO: 161131

SEQ ID NO: 193260 - RNA, 64 nt, Homo Sapiens; identical to SEQ ID NO: 161132

SEQ ID NO: 193261 - RNA, 64 nt, Homo Sapiens; identical to SEQ ID NO: 161133

SEQ ID NO: 193262 - RNA, 64 nt, Homo Sapiens; identical to SEQ ID NO: 161134

SEQ ID NO: 193263 - RNA, 64 nt, Homo Sapiens; identical to SEQ ID NO: 161135

SEQ ID NO: 193264 - RNA, 64 nt, Homo Sapiens; identical to SEQ ID NO: 161136

SEQ ID NO: 193265 - RNA, 64 nt, Homo Sapiens; identical to SEQ ID NO: 161137

SEQ ID NO: 193266 - RNA, 64 nt, Homo Sapiens; identical to SEQ ID NO: 161138

SEQ ID NO: 193267 - RNA, 64 nt, Homo Sapiens; identical to SEQ ID NO: 161139

SEQ ID NO: 193268 - RNA, 64 nt, Homo Sapiens; identical to SEQ ID NO: 161140

SEQ ID NO: 193269 - RNA, 64 nt, Homo Sapiens; identical to SEQ ID NO: 161141

SEQ ID NO: 193270 - RNA, 64 nt, Homo Sapiens; identical to SEQ ID NO: 161142

SEQ ID NO: 193271 - RNA, 64 nt, Homo Sapiens; identical to SEQ ID NO: 161143

SEQ ID NO: 193272 - RNA, 64 nt, Homo Sapiens
agaaguccacgugaaggcugggcuaaugcuccuggauauucauuuacgaccuuccucuauggcc

SEQ ID NO: 193273 - RNA, 64 nt, Homo Sapiens
gucagaauaaagggagaucauagugaguuaauuugauauucauauccuggaaguauacauauuu

SEQ ID NO: 193274 - RNA, 64 nt, Homo Sapiens
uccccucaguugcagugaauauuuauugcauaaugauauucacaucagccaacuguggcucuua

SEQ ID NO: 193275 - RNA, 64 nt, Homo Sapiens
acucagaagcaucagcaaugcauggacguuaagagauauucaaacauuacuuguucguuauaga

SEQ ID NO: 193276 - RNA, 64 nt, Homo Sapiens
uuacuaacuuaucugucucuuauuugcacucauggauauucacaguaagcauuguuugacauau

SEQ ID NO: 193277 - RNA, 64 nt, Homo Sapiens
ggcuauuuacacuguaaugaauuauaccauauaugauauucacucaguaauguuaauaaugaac

SEQ ID NO: 193278 - RNA, 64 nt, Homo Sapiens
ugcuaacugaauaucauugcagcaacuagacuaagauauucaagaucucuuuauuggggauggg

SEQ ID NO: 193279 - RNA, 64 nt, Homo Sapiens
uaccccccuucuugacuuuuucugauaauuagcugauauucaugguuguuuagcacacaguuca

SEQ ID NO: 193280 - RNA, 64 nt, Homo Sapiens
uugcagccauaguaccuuuuugcguaauguuugggauauucaguagcccaggauugcuacaaaa

SEQ ID NO: 193281 - RNA, 64 nt, Homo Sapiens
uuuuaaacauuacacuugagaucagucaugacuugauauucagguaaauuuucuuuuccaagaa

SEQ ID NO: 193282 - RNA, 64 nt, Homo Sapiens
uucuguuacgaacucuaagagggcugaaacuucugauauucagguggaucaccugaauucucuc

SEQ ID NO: 193283 - RNA, 64 nt, Homo Sapiens
ugaaccuucuauuucacuaccgcucccuguuuuagauauucagauuuaaaagguuuucaaagaa

SEQ ID NO: 193284 - RNA, 64 nt, Homo Sapiens
uagucaaagcuauguucuuacaaaaaccccagacagcucagagcucagaaaauccuguggagug

SEQ ID NO: 193285 - RNA, 64 nt, Homo Sapiens
agcuauguucuuacaaaaaccccagacagcucagagcucagaaaauccuguggaguggcugcuc

SEQ ID NO: 193286 - RNA, 64 nt, Homo Sapiens
auauacugaauggaauguauuccugcugcuucccagcucagaacauaggaaaggggcccuauuu

SEQ ID NO: 193287 - RNA, 64 nt, Homo Sapiens
agcuccgugggccuguuuccaucucauggggaugagcucagagauuuaguuucuguauguuuua

SEQ ID NO: 193288 - RNA, 64 nt, Homo Sapiens
agccuucuggagaggacaguggggucuccugcucagcucagaaguggggcucggcuguggcccu

SEQ ID NO: 193289 - RNA, 64 nt, Homo Sapiens
gugucuagguuggggcucggccagccaagguuggagcucagaccuacccgcccuugaaguauag

SEQ ID NO: 193290 - RNA, 64 nt, Homo Sapiens
cuggcagugagagcccagaaggggagauggaucaagcucagagauucccuuugggcuucggcuu

SEQ ID NO: 193291 - RNA, 64 nt, Homo Sapiens
cuaagaauaagccuuugaaagcaauucauucagaagcucagaaggcucccuggaugaauagaau

SEQ ID NO: 193292 - RNA, 64 nt, Homo Sapiens
cuuuauuuuuuccauuuugagaugccucuauugcagcucagaggccuggacaccacccugacgu

SEQ ID NO: 193293 - RNA, 64 nt, Homo Sapiens
guuauauucaucccucuuaggacaauuuaguugaagcucagaaauguugccaccaguuauacuu

SEQ ID NO: 193294 - RNA, 64 nt, Homo Sapiens
gcccuuuuaagggggcuccagacguuaggcagagagcucagaugggaaucuauguagacaaugg

SEQ ID NO: 193295 - RNA, 64 nt, Homo Sapiens
gagagaugacacaaugccuccugccucuaggaugagcucagagcuccuuugagcauguaugugu

SEQ ID NO: 193296 - RNA, 64 nt, Homo Sapiens
aagggagcggcagcuagaggcuuucagacuguagagcucagagagccagugcugcugacagaug

SEQ ID NO: 193297 - RNA, 64 nt, Homo Sapiens
cugaucucuuucuaaugggcauagaaacaucuacagcucagauaaaaaagaaauuugauugaaa

SEQ ID NO: 193298 - RNA, 64 nt, Homo Sapiens
ucuggaguuguggugaggccaccaggcugaagucagcucagacccagaccucccugcuuaggcc

SEQ ID NO: 193299 - RNA, 64 nt, Homo Sapiens
gacaaagggagccgagacccuggauggggcuuccagcucagaacccaucccucugguggguacc

SEQ ID NO: 193300 - RNA, 64 nt, Homo Sapiens
cccaggugcagauaguucuggggaguggaggaagagcucagaggguccccagaauggcuccacu

SEQ ID NO: 193301 - RNA, 64 nt, Homo Sapiens
uauggcagcuaagaacacagucauguucccaggaagcucagaagcccauagucgccagacuuuc

SEQ ID NO: 193302 - RNA, 64 nt, Homo Sapiens
ccuggcuggcaggguagcuagaccucucacaugcagcucagagcucccaagagcucaaaagcag

SEQ ID NO: 193303 - RNA, 64 nt, Homo Sapiens
uaugcccucuacuuacuaaacaagucacaagcccagcucagauucaagaaaagggugugaagua

SEQ ID NO: 193304 - RNA, 64 nt, Homo Sapiens
caaaaaaccacccuguacgaaggccacaaagaacagcucagaugcacaaagauucacaccauac

SEQ ID NO: 193305 - RNA, 64 nt, Homo Sapiens
ggggcugggaggggcugugaggggcuggcaccucagcucagaaaagguagcagcaaucccaaag

SEQ ID NO: 193306 - RNA, 64 nt, Homo Sapiens
ggcccaggaagaggcccugguuuggggcugugccagcucagagcccuugaaccagaaccaacug

SEQ ID NO: 193307 - RNA, 64 nt, Homo Sapiens
auauuucacaugugaagcggggacaaaaccaugcagcucagaggucccugugggggcuggggga

SEQ ID NO: 193308 - RNA, 64 nt, Homo Sapiens
gaauuauauauccauauauauucuucucagucccagcucagaucuuugaguugcaauugcuauu

SEQ ID NO: 193309 - RNA, 64 nt, Homo Sapiens
cacgggggucugugccggcacccugccgggguccagcucagaacugccacccacgggggcuccu

SEQ ID NO: 193310 - RNA, 64 nt, Homo Sapiens
cagagcagggaguguggagaagguggaagagcugagcucagaggcagagaagcuccuugcaggg

SEQ ID NO: 193311 - RNA, 64 nt, Homo Sapiens
guaaagcccgucugcugucuucccccaaauccucagcucagagccuuccgcuuccagggccaac

SEQ ID NO: 193312 - RNA, 64 nt, Homo Sapiens
agggucggaucugagagaauagccuuacgggugaagcucagagaacaauguuacaaguggaaua

SEQ ID NO: 193313 - RNA, 64 nt, Homo Sapiens
agcagcucacaucugaggccgaaggggcugggguagcucagagucucuggguaaaggucuguaa

SEQ ID NO: 193314 - RNA, 64 nt, Homo Sapiens
acugaauguuuuuaauuugcgugguguucugucuagaggauacaguaaguguacauguaguggu

SEQ ID NO: 193315 - RNA, 64 nt, Homo Sapiens
cagaagcuguuugcucaugucgaauuuguggcugagaggauaaauaggaaaauauaccuaaaag

SEQ ID NO: 193316 - RNA, 64 nt, Homo Sapiens
agaucagugaucuugggucauugaucccuggcucagaggauagcgguuuccaucauaaaccaag

SEQ ID NO: 193317 - RNA, 64 nt, Homo Sapiens
cuggcauucgagacuuccuccuguucccugggucagaggauagcgguuuccaucauaaaccaag

SEQ ID NO: 193318 - RNA, 64 nt, Homo Sapiens
ggacagaacuuacuguaaagaaagaaaucugccuagaggauauauguaaggaagauuccacauc

SEQ ID NO: 193319 - RNA, 64 nt, Homo Sapiens
uuuaagccguuuucuuagugauucuguaucaaguagaggauaaguguaguuuaacuuaguuuuu

SEQ ID NO: 193320 - RNA, 64 nt, Homo Sapiens
gaccuuuuuaacuuuauagucucugaaauaagggagaggauauagguaauuuuccacacaaucc

SEQ ID NO: 193321 - RNA, 64 nt, Homo Sapiens
cuggagcagaaauaagccuugaauaagaggcuuaagaggauaaagacucauacagggcucaacu

SEQ ID NO: 193322 - RNA, 64 nt, Homo Sapiens
aacuguaugcuacugggacaauacaauggaaaauagaggauaccuccugaauggaaaauagagg

SEQ ID NO: 193323 - RNA, 59 nt, Homo Sapiens
auggaaaauagaggauaccaauggaaaauagaggauacaggacaauugugcuauccuga

SEQ ID NO: 193324 - RNA, 64 nt, Homo Sapiens
uuaggaaggagaggaaacuugccuuuuuuauggcagaggauaguaaugaaaaugucucaguauu

SEQ ID NO: 193325 - RNA, 64 nt, Homo Sapiens
uacagaagaggcaacaauuugguucuugacagugagaggauauugagggcuucagcugcugcua

SEQ ID NO: 193326 - RNA, 64 nt, Homo Sapiens; identical to SEQ ID NO: 129417

SEQ ID NO: 193327 - RNA, 64 nt, Homo Sapiens; identical to SEQ ID NO: 129418

SEQ ID NO: 193328 - RNA, 64 nt, Homo Sapiens; identical to SEQ ID NO: 129419

SEQ ID NO: 193329 - RNA, 64 nt, Homo Sapiens; identical to SEQ ID NO: 129420

SEQ ID NO: 193330 - RNA, 64 nt, Homo Sapiens; identical to SEQ ID NO: 129421

SEQ ID NO: 193331 - RNA, 64 nt, Homo Sapiens; identical to SEQ ID NO: 129422

SEQ ID NO: 193332 - RNA, 64 nt, Homo Sapiens; identical to SEQ ID NO: 129423

SEQ ID NO: 193333 - RNA, 64 nt, Homo Sapiens; identical to SEQ ID NO: 129424

SEQ ID NO: 193334 - RNA, 64 nt, Homo Sapiens; identical to SEQ ID NO: 129425

SEQ ID NO: 193335 - RNA, 64 nt, Homo Sapiens; identical to SEQ ID NO: 129426

SEQ ID NO: 193336 - RNA, 64 nt, Homo Sapiens; identical to SEQ ID NO: 129427

SEQ ID NO: 193337 - RNA, 64 nt, Homo Sapiens; identical to SEQ ID NO: 129428

SEQ ID NO: 193338 - RNA, 64 nt, Homo Sapiens; identical to SEQ ID NO: 129429

SEQ ID NO: 193339 - RNA, 64 nt, Homo Sapiens; identical to SEQ ID NO: 129430

SEQ ID NO: 193340 - RNA, 64 nt, Homo Sapiens; identical to SEQ ID NO: 129431

SEQ ID NO: 193341 - RNA, 64 nt, Homo Sapiens; identical to SEQ ID NO: 129432

SEQ ID NO: 193342 - RNA, 64 nt, Homo Sapiens; identical to SEQ ID NO: 129433

SEQ ID NO: 193343 - RNA, 64 nt, Homo Sapiens; identical to SEQ ID NO: 129434

SEQ ID NO: 193344 - RNA, 64 nt, Homo Sapiens; identical to SEQ ID NO: 129435

SEQ ID NO: 193345 - RNA, 64 nt, Homo Sapiens; identical to SEQ ID NO: 129436

SEQ ID NO: 193346 - RNA, 64 nt, Homo Sapiens; identical to SEQ ID NO: 129437

SEQ ID NO: 193347 - RNA, 64 nt, Homo Sapiens; identical to SEQ ID NO: 129438

SEQ ID NO: 193348 - RNA, 64 nt, Homo Sapiens; identical to SEQ ID NO: 129439

SEQ ID NO: 193349 - RNA, 64 nt, Homo Sapiens; identical to SEQ ID NO: 129440

SEQ ID NO: 193350 - RNA, 64 nt, Homo Sapiens; identical to SEQ ID NO: 129441

SEQ ID NO: 193351 - RNA, 64 nt, Homo Sapiens; identical to SEQ ID NO: 129442

SEQ ID NO: 193352 - RNA, 64 nt, Homo Sapiens; identical to SEQ ID NO: 129443

SEQ ID NO: 193353 - RNA, 64 nt, Homo Sapiens; identical to SEQ ID NO: 129444

SEQ ID NO: 193354 - RNA, 64 nt, Homo Sapiens; identical to SEQ ID NO: 129445

SEQ ID NO: 193355 - RNA, 64 nt, Homo Sapiens; identical to SEQ ID NO: 129446

SEQ ID NO: 193356 - RNA, 64 nt, Homo Sapiens; identical to SEQ ID NO: 129447

SEQ ID NO: 193357 - RNA, 64 nt, Homo Sapiens; identical to SEQ ID NO: 129448

SEQ ID NO: 193358 - RNA, 64 nt, Homo Sapiens; identical to SEQ ID NO: 129449

SEQ ID NO: 193359 - RNA, 64 nt, Homo Sapiens; identical to SEQ ID NO: 129450

SEQ ID NO: 193360 - RNA, 64 nt, Homo Sapiens; identical to SEQ ID NO: 129451

SEQ ID NO: 193361 - RNA, 64 nt, Homo Sapiens; identical to SEQ ID NO: 129452

SEQ ID NO: 193362 - RNA, 64 nt, Homo Sapiens; identical to SEQ ID NO: 129453

SEQ ID NO: 193363 - RNA, 64 nt, Homo Sapiens; identical to SEQ ID NO: 129454

SEQ ID NO: 193364 - RNA, 64 nt, Homo Sapiens; identical to SEQ ID NO: 129455

SEQ ID NO: 193365 - RNA, 64 nt, Homo Sapiens; identical to SEQ ID NO: 129456

SEQ ID NO: 193366 - RNA, 64 nt, Homo Sapiens; identical to SEQ ID NO: 129457

SEQ ID NO: 193367 - RNA, 64 nt, Homo Sapiens; identical to SEQ ID NO: 129458

SEQ ID NO: 193368 - RNA, 64 nt, Homo Sapiens
uuacucuggacuuuauuguccuguuucuaucaaauuggacuaacaaaaauugauauaauacauu

SEQ ID NO: 193369 - RNA, 64 nt, Homo Sapiens
caucuauugcagaauguauaauuaucuauuuguuuuggacuauauguuacaaaaauuuaaaaca

SEQ ID NO: 193370 - RNA, 64 nt, Homo Sapiens
uauaaaucuaggaaagggaucuucuaguuucuguguuguuuagacucaaagaaucacaaauuug

SEQ ID NO: 193371 - RNA, 64 nt, Homo Sapiens
acucaaagaaucacaaauuugucaguaacauguaguuguuuaguuauaauucagaguguacaga

SEQ ID NO: 193372 - RNA, 64 nt, Homo Sapiens
gacaaaauuuucaugaucuucucuaacaaaaaaaguuguuuauuaacuguacagacuguuuacu

SEQ ID NO: 193373 - RNA, 64 nt, Homo Sapiens
uuuuguuuuuguuuuucucagucuuaccugugauguuguuuaggaucaggccccucuccugggc

SEQ ID NO: 193374 - RNA, 64 nt, Homo Sapiens
uacauuaggcuuugcuauauuaauuggggguuuuguuguuuaguagcuuccugacgacaugaaa

SEQ ID NO: 193375 - RNA, 64 nt, Homo Sapiens
uaugagucgggaccaaagagauuauuuauagguaguuguuuacaaaccuuacaaguauaugagu

SEQ ID NO: 193376 - RNA, 64 nt, Homo Sapiens
ggccaaaggaaagcuuucugggcuuuggaaaguaguuguuuaacuuuguuuuaagccguuuucu

SEQ ID NO: 193377 - RNA, 64 nt, Homo Sapiens
uaagcacaguuugccugaauuucugcuugguuguguuguuuaccguaaguacugaggguaguuu

SEQ ID NO: 193378 - RNA, 64 nt, Homo Sapiens
agagccuggaacuuccuccuuuaugcaagagcugguuguuuaaaugaguucucacucugguugu

SEQ ID NO: 193379 - RNA, 64 nt, Homo Sapiens
caagagcugguuguuuaaaagaguucucacucugguuguuuaugccauccccauaguaaugagu

SEQ ID NO: 193380 - RNA, 64 nt, Homo Sapiens
ccuauaaauggcagcucuccuguuguauucagguguuguuuacagacuaacaaauguguuggca

SEQ ID NO: 193381 - RNA, 64 nt, Homo Sapiens
ugaaaaccuuggaguuuuuuuuuuuccugauaggguuguuuauacuucuugauugguuucuugc

SEQ ID NO: 193382 - RNA, 64 nt, Homo Sapiens
aaugaaugccucaguucucuuuauauucugugauguuguuuauaccacaaaauaugaucuucgu

SEQ ID NO: 193383 - RNA, 64 nt, Homo Sapiens
gauuuagucaucaaggacaggucuggacacugacguuguuuaggcaaaaaauauguaauucaug

SEQ ID NO: 193384 - RNA, 64 nt, Homo Sapiens
uguguucuuuuuuauuguuccucuguuauuugggguuguuuacuagucuuccuauagguuacuu

SEQ ID NO: 193385 - RNA, 64 nt, Homo Sapiens
gcagugaguuuucauuuugguuuuguauuuuccaguuguuuaauuuccauuggguggguucuuu

SEQ ID NO: 193386 - RNA, 64 nt, Homo Sapiens
gccucccuuaaggcauuuuacaucucuucuuugaguuguuuauggaagccaguucaguccacac

SEQ ID NO: 193387 - RNA, 64 nt, Homo Sapiens
ggcuaggugaagaaaguuucuaucugauaaucauguuguuuaaggaguaauguaauugacaaaa

SEQ ID NO: 193388 - RNA, 64 nt, Homo Sapiens
cuaaugaagcauucaaaaugagcaaugcuaauggguuguuuagcuuuuuguuuucuuuguacuc

SEQ ID NO: 193389 - RNA, 64 nt, Homo Sapiens
aaccaggcauuuuucccaaauuaauuacaaucugguuguuuagccuaugcuaauuaagcccucu

SEQ ID NO: 193390 - RNA, 64 nt, Homo Sapiens
aaaaccccuaaaaacaaaaccuuuauaaaaaaaaguuguuuauaagauuguaaacuaaagugug

SEQ ID NO: 193391 - RNA, 64 nt, Homo Sapiens
aauuuauaacaguuauaaagggaacgcauuuuggguuguuuaaaaacuugccauuucuuuauau

SEQ ID NO: 193392 - RNA, 64 nt, Homo Sapiens
cauaauuuaagaaaaaaaauuguuuuuuauuauuguuguuuaagccaaaauauacaugcagacu

SEQ ID NO: 193393 - RNA, 64 nt, Homo Sapiens
agugugcuagaugaaaagcgcaaaaagaguaauaguuguuuacuauuugucaguguauccuuuc

SEQ ID NO: 193394 - RNA, 64 nt, Homo Sapiens
aauaaguaaaaggcuuuuuguauaucacaucaauaaucaauaaauaacaaucucggaaggaaaa

SEQ ID NO: 193395 - RNA, 64 nt, Homo Sapiens
aguggaaguacugucuauguggauuguuugacuuaaucaauauugauagugaccgagacuaaga

SEQ ID NO: 193396 - RNA, 64 nt, Homo Sapiens
uuucaauagaaguauuagagucauguuguuauguaaucaauauugagcguuagccaaguuauuu

SEQ ID NO: 193397 - RNA, 64 nt, Homo Sapiens
uuuaaccauuguuaaaaugccccaugaguaugcaaaucaauagucuaggcauagcuguuuuucu

SEQ ID NO: 193398 - RNA, 64 nt, Homo Sapiens
auccuuuccucaguguguauaugacagccaguauaaucaauacccuagguuaugcgucuauaug

SEQ ID NO: 193399 - RNA, 64 nt, Homo Sapiens
guacuuuucucauacaccaaaaacacaccaaaaaaaucaauaaaauaagcaaucuucuauucuc

SEQ ID NO: 193400 - RNA, 64 nt, Homo Sapiens
ugauaaacaacuucagcuaacuuucaggagacaaaaucaauauacaaaauaugguagcauuuuu

SEQ ID NO: 193401 - RNA, 64 nt, Homo Sapiens
aauggaaaaacauuccauacuuauggauaggaagaaucaauauuguuaaaauggccauacuacc

SEQ ID NO: 193402 - RNA, 64 nt, Homo Sapiens
auagaccaauaacagccucugggguugaggugauaaucaauagcuuaccaaccaaaaagagucc

SEQ ID NO: 193403 - RNA, 64 nt, Homo Sapiens
aucccugggaugcaaggcugguucaacauacgcaaaucaauaaauguaauccagcauauaaaca

SEQ ID NO: 193404 - RNA, 64 nt, Homo Sapiens
aauggaagagcauuccaugcucauggguaggaagaaucaauaucaugaaaauggcccauacugc

SEQ ID NO: 193405 - RNA, 64 nt, Homo Sapiens
uuuuugaaccuuuuaaguacaagaaaaauaacucaaucaauauaucaauauaauuuauuuaugu

SEQ ID NO: 193406 - RNA, 64 nt, Homo Sapiens
auuuauuuauguaagaaaaauguuaaauccuaaaaaucaauauagcagaaaggguuuuuucagc

SEQ ID NO: 193407 - RNA, 64 nt, Homo Sapiens
cuuuuuauaaaaauucauguuuuuuauagcaagaaaucaauaucgucugacaccuuucagucuc

SEQ ID NO: 193408 - RNA, 64 nt, Homo Sapiens
caauugauaauaguuuggagcugaggcaauuuggaaucaauaagauuccuggucaaucucucca

SEQ ID NO: 193409 - RNA, 64 nt, Homo Sapiens; identical to SEQ ID NO: 72602

SEQ ID NO: 193410 - RNA, 64 nt, Homo Sapiens; identical to SEQ ID NO: 72603

SEQ ID NO: 193411 - RNA, 64 nt, Homo Sapiens; identical to SEQ ID NO: 72604

SEQ ID NO: 193412 - RNA, 64 nt, Homo Sapiens; identical to SEQ ID NO: 72605

SEQ ID NO: 193413 - RNA, 64 nt, Homo Sapiens; identical to SEQ ID NO: 72606

SEQ ID NO: 193414 - RNA, 64 nt, Homo Sapiens; identical to SEQ ID NO: 72607

SEQ ID NO: 193415 - RNA, 64 nt, Homo Sapiens; identical to SEQ ID NO: 72608

SEQ ID NO: 193416 - RNA, 64 nt, Homo Sapiens; identical to SEQ ID NO: 72609

SEQ ID NO: 193417 - RNA, 64 nt, Homo Sapiens; identical to SEQ ID NO: 72610

SEQ ID NO: 193418 - RNA, 64 nt, Homo Sapiens; identical to SEQ ID NO: 72611

SEQ ID NO: 193419 - RNA, 64 nt, Homo Sapiens; identical to SEQ ID NO: 72612

SEQ ID NO: 193420 - RNA, 64 nt, Homo Sapiens; identical to SEQ ID NO: 72613

SEQ ID NO: 193421 - RNA, 64 nt, Homo Sapiens; identical to SEQ ID NO: 72614

SEQ ID NO: 193422 - RNA, 64 nt, Homo Sapiens; identical to SEQ ID NO: 72615

SEQ ID NO: 193423 - RNA, 64 nt, Homo Sapiens; identical to SEQ ID NO: 72616

SEQ ID NO: 193424 - RNA, 64 nt, Homo Sapiens; identical to SEQ ID NO: 72617

SEQ ID NO: 193425 - RNA, 64 nt, Homo Sapiens; identical to SEQ ID NO: 72618

SEQ ID NO: 193426 - RNA, 64 nt, Homo Sapiens; identical to SEQ ID NO: 72619

SEQ ID NO: 193427 - RNA, 64 nt, Homo Sapiens; identical to SEQ ID NO: 72620

SEQ ID NO: 193428 - RNA, 64 nt, Homo Sapiens; identical to SEQ ID NO: 72621

SEQ ID NO: 193429 - RNA, 64 nt, Homo Sapiens; identical to SEQ ID NO: 72622

SEQ ID NO: 193430 - RNA, 64 nt, Homo Sapiens; identical to SEQ ID NO: 72623

SEQ ID NO: 193431 - RNA, 64 nt, Homo Sapiens; identical to SEQ ID NO: 72624

SEQ ID NO: 193432 - RNA, 64 nt, Homo Sapiens; identical to SEQ ID NO: 72625

SEQ ID NO: 193433 - RNA, 64 nt, Homo Sapiens; identical to SEQ ID NO: 72626

SEQ ID NO: 193434 - RNA, 64 nt, Homo Sapiens; identical to SEQ ID NO: 72627

SEQ ID NO: 193435 - RNA, 64 nt, Homo Sapiens; identical to SEQ ID NO: 72628

SEQ ID NO: 193436 - RNA, 64 nt, Homo Sapiens; identical to SEQ ID NO: 72629

SEQ ID NO: 193437 - RNA, 64 nt, Homo Sapiens; identical to SEQ ID NO: 72630

SEQ ID NO: 193438 - RNA, 64 nt, Homo Sapiens; identical to SEQ ID NO: 72631

SEQ ID NO: 193439 - RNA, 64 nt, Homo Sapiens; identical to SEQ ID NO: 72632

SEQ ID NO: 193440 - RNA, 64 nt, Homo Sapiens; identical to SEQ ID NO: 72633

SEQ ID NO: 193441 - RNA, 64 nt, Homo Sapiens; identical to SEQ ID NO: 72634

SEQ ID NO: 193442 - RNA, 64 nt, Homo Sapiens; identical to SEQ ID NO: 72635

SEQ ID NO: 193443 - RNA, 64 nt, Homo Sapiens; identical to SEQ ID NO: 72636

SEQ ID NO: 193444 - RNA, 64 nt, Homo Sapiens; identical to SEQ ID NO: 72637

SEQ ID NO: 193445 - RNA, 64 nt, Homo Sapiens; identical to SEQ ID NO: 72638

SEQ ID NO: 193446 - RNA, 64 nt, Homo Sapiens; identical to SEQ ID NO: 72639

SEQ ID NO: 193447 - RNA, 64 nt, Homo Sapiens; identical to SEQ ID NO: 72640

SEQ ID NO: 193448 - RNA, 64 nt, Homo Sapiens; identical to SEQ ID NO: 72641

SEQ ID NO: 193449 - RNA, 64 nt, Homo Sapiens; identical to SEQ ID NO: 72642

SEQ ID NO: 193450 - RNA, 64 nt, Homo Sapiens; identical to SEQ ID NO: 72643

SEQ ID NO: 193451 - RNA, 64 nt, Homo Sapiens; identical to SEQ ID NO: 72644

SEQ ID NO: 193452 - RNA, 64 nt, Homo Sapiens; identical to SEQ ID NO: 72645

SEQ ID NO: 193453 - RNA, 64 nt, Homo Sapiens
uuuuugauaacuguguacuucuggugacuguacaguuugaaauacuauuuuuuaucaaguuuua

SEQ ID NO: 193454 - RNA, 64 nt, Homo Sapiens
cuuucugauuuuugguaguccauugaagaagggaguuugaaaguuguuguauacuguuaacgau

SEQ ID NO: 193455 - RNA, 64 nt, Homo Sapiens
uggguuaccuuaaaaaguugauuuccuugaagcaguuugaaaauuugaauugagucuuaacuuu

SEQ ID NO: 193456 - RNA, 64 nt, Homo Sapiens
gcaggcaguaucgauuuuaugaagagaaagugaaguuugaaaacuuuucaaacuuuucuaguua

SEQ ID NO: 193457 - RNA, 64 nt, Homo Sapiens
ugucuuuguuaguggagaccgcuaaacuaaugauguuugaaaacaguuccucuguuuuagauug

SEQ ID NO: 193458 - RNA, 64 nt, Homo Sapiens
agcagugauauuauuuccauaacuuaaaaagugaguuugaaaaagaaaaucuccagcaagcauc

SEQ ID NO: 193459 - RNA, 64 nt, Homo Sapiens
ucuauuacuuucuguucccaauguccuucuagugguuugaaaauguuaaaacaucccuaaaauc

SEQ ID NO: 193460 - RNA, 64 nt, Homo Sapiens
auuguacagcuucuaauucacuuuucagaucaguguuugaaauggcaauuaucaguguuggauu

SEQ ID NO: 193461 - RNA, 64 nt, Homo Sapiens
cuauuucuuuucuaaacuaucaaaaacucuagcaguuugaaaagccuaauauuuauuuguaugu

SEQ ID NO: 193462 - RNA, 64 nt, Homo Sapiens
guucuuugaaagaaucucuaaaaggcuuauaaauguuugaaauaucacacaaaggcugauuucu

SEQ ID NO: 193463 - RNA, 64 nt, Homo Sapiens
uauaauagcacuggagauuuugcaaacaaguaauguuugaaauagucucaguguuugguuauua

SEQ ID NO: 193464 - RNA, 64 nt, Homo Sapiens
ugugauaguaccugguugugccagccacugugauguuugaaauacuguuccugcccuguugcuu

SEQ ID NO: 193465 - RNA, 64 nt, Homo Sapiens
gcuugugggucuguucagacugucuccucucaugguuugaaacugcaucugaaugccugccuuc

SEQ ID NO: 193466 - RNA, 64 nt, Homo Sapiens
uuaaacuguaguuguagauccuugucauuuugcuguuugaaaauaaccaauguguuuucuaaaa

SEQ ID NO: 193467 - RNA, 64 nt, Homo Sapiens
ugaagauaacuuuuacuuaaauaugaaaauuauaguuugaaaauuaggcucaagcaaauaucaa

SEQ ID NO: 193468 - RNA, 64 nt, Homo Sapiens
auacaccaggauaaaucuuauuuaaaggaagccuguuugaaaaucaccaacuuuaacuuauugc

SEQ ID NO: 193469 - RNA, 64 nt, Homo Sapiens
aaaaaacauucuauauuuguagcagaaaucagugguuugaaaagucauacuuugcagauaugaa

SEQ ID NO: 193470 - RNA, 64 nt, Homo Sapiens
ccuucuuagguuuaaauguuauaccaaugcauguguuugaaauauccauuaagaugauuuaaaa

SEQ ID NO: 193471 - RNA, 64 nt, Homo Sapiens
auaaaugugugucuauaugcuuuccuuuaaauauguuugaaaagauguuugaaacuugauuaua

SEQ ID NO: 193472 - RNA, 64 nt, Homo Sapiens
cuauaugcuuuccuuuaaauauguuugaaaagauguuugaaacuugauuauacuauuuauaauu

SEQ ID NO: 193473 - RNA, 64 nt, Homo Sapiens
gucucaaagcaguaaccuuauacacuacuuauaaguuugaaaggggaaagguuaccuuuacaau

SEQ ID NO: 193474 - RNA, 64 nt, Homo Sapiens
uguucauuguacuaucaauguggcuuugcuguggguuugaaauuuugcaaacuaagaguugggu

SEQ ID NO: 193475 - RNA, 64 nt, Homo Sapiens
auauuugucgaaaaaaagaguuuggguucuuucuguuugaaaggcaggcauuuugaggugucuc

SEQ ID NO: 193476 - RNA, 64 nt, Homo Sapiens
cauuguuuccuugugguaaggauguauagaaguaguuugaaacuuuuuauccauguacucuuuu

SEQ ID NO: 193477 - RNA, 64 nt, Homo Sapiens
uacuuaucagaaguguguuuaccaacuuauuuuuguuugaaagugugauuuuuuuuuuccuucc

SEQ ID NO: 193478 - RNA, 64 nt, Homo Sapiens
ugugccaucaugauuaaugaaaacuaucuuuugaguuugaaaagaaauuaauuugcaguguuug

SEQ ID NO: 193479 - RNA, 64 nt, Homo Sapiens
uuggaaaaucaaugauuuuaaugcauagcaguauguuugaaaaauagaccauucuaaaaagccc

SEQ ID NO: 193480 - RNA, 64 nt, Homo Sapiens
aaguuucaguucuauaugaaguauuugauguuuuguuugaaacaauacagcauuaaagaaccaa

SEQ ID NO: 193481 - RNA, 64 nt, Homo Sapiens
auguauuaaguacuuuguauugaaaugcaaacagguuugaaaauacaaaaacgcuaacuuuguu

SEQ ID NO: 193482 - RNA, 64 nt, Homo Sapiens
caaacagguuugaaaauaugaaaacgcuaacuuuguuugaaaugguuaucaaauuugauuuaca

SEQ ID NO: 193483 - RNA, 64 nt, Homo Sapiens
uuuaagcauccugguaaauacgcccggccgaaguguuugaaaucauuacaggcgugagccacug

SEQ ID NO: 193484 - RNA, 64 nt, Homo Sapiens
uuuuuuuguugguuuguuugaauuagguugaaguguuugaaaucuagauuuccagguauggaau

SEQ ID NO: 193485 - RNA, 64 nt, Homo Sapiens
gcugcauucucguguucagugaugcccucuucuuguuugaaacaaaagaaaauaaugcauugug

SEQ ID NO: 193486 - RNA, 64 nt, Homo Sapiens
aacuuguuuaccuuaaaauuaucagaaucucaguguuugaaaguacugaagcacaaacauauau

SEQ ID NO: 193487 - RNA, 64 nt, Homo Sapiens
uucaagcucacaauaagcuuugaaauauagaaguguuugaaaugaaaagcuacagagaggagag

SEQ ID NO: 193488 - RNA, 64 nt, Homo Sapiens
auaaucaacaaaagauacaaaauccuguaacuggguuugaaaaaaucaacuggaauaauauagu

SEQ ID NO: 193489 - RNA, 64 nt, Homo Sapiens
uuuauuugguuaucaacugcugcaguguagcccaguuugaaauacuuguuauuguuuacacacu

SEQ ID NO: 193490 - RNA, 64 nt, Homo Sapiens
ucuuagcugucacuuuggaauaaauguaguguguguuugaaacuuagagaaguugauugucccu

SEQ ID NO: 193491 - RNA, 64 nt, Homo Sapiens
uugaauugaagcuuuacuuuagaauuuagcccugguuugaaauuuuccauuacaugaucuuggu

SEQ ID NO: 193492 - RNA, 64 nt, Homo Sapiens
gacuuucuauuaauauuuauguguuuuaauaaacguuugaaauuauuuaugacuacuuaaaaug

SEQ ID NO: 193493 - RNA, 64 nt, Homo Sapiens
cugaauguaauacuugaguagauuuuuuuuucuaguuugaaauuuagucugucuuuuugaccuu

SEQ ID NO: 193494 - RNA, 64 nt, Homo Sapiens
guuuuaugacaugguauacuacuauauuuacucaguuugaaacuauucauuucuacacacuauu

SEQ ID NO: 193495 - RNA, 64 nt, Homo Sapiens
ggaauguuuaauaaaggcuuagguuugaaaggcuguuugaaagaccaagucuggggagggguau

SEQ ID NO: 193496 - RNA, 64 nt, Homo Sapiens
cuguuugaaagaggaauguuggggagggguauagguuugaaaggcucuggcaguucccaagucu

SEQ ID NO: 193497 - RNA, 64 nt, Homo Sapiens
aaguuucguuuuaauuuuggaccaggauucuacuguuugaaaagauugacaguaaaaacaacaa

SEQ ID NO: 193498 - RNA, 64 nt, Homo Sapiens
cgaagguaauuuaauguuacuuagaaaaaguaauguuugaaauaugauuaacuucugguuuggu

SEQ ID NO: 193499 - RNA, 64 nt, Homo Sapiens
agauucacgcuucugcauccucugaucuuaaguuguuugaaaaauuaagaaucccuuuucaugg

SEQ ID NO: 193500 - RNA, 64 nt, Homo Sapiens
aguuauuuggugacuagaaagcuccccuuuucuuguuugaaaacguaccacaauuaaagauuau

SEQ ID NO: 193501 - RNA, 64 nt, Homo Sapiens
gcugugauaaggaccagcugaagugaacguacagguuugaaauggaggcaggagccaaggccaa

SEQ ID NO: 193502 - RNA, 64 nt, Homo Sapiens
cuuauuuaagccacacguacggaagaagucuucuguuugaaaggagcagugaaucuaaaacucu

SEQ ID NO: 193503 - RNA, 63 nt, Homo Sapiens
aaaaaaaaaaguguggcaauuaaagcuggauacaguuugaaaguuuauggaaaguaucuuuaa

SEQ ID NO: 193504 - RNA, 64 nt, Homo Sapiens
uguauacuguuaaugacugucauugaagaagagaguuugaaagugcggcugauuuuugguaguc

SEQ ID NO: 193505 - RNA, 64 nt, Homo Sapiens
uucuuuaucaaguuuuauaacuggugacuguacaguuugaaauacauuuuuuauaacuguacuu

SEQ ID NO: 193506 - RNA, 57 nt, Homo Sapiens
uaacuguguacuucuggugacuguacaguuugaaauacuauuuuuuaaucaaguuuu

SEQ ID NO: 193507 - RNA, 64 nt, Homo Sapiens; identical to SEQ ID NO: 193454

SEQ ID NO: 193508 - RNA, 64 nt, Homo Sapiens
aagaauagguggaaggucauagccuggaacccaaguuugaaaacauuucauuguguucaguagu

SEQ ID NO: 193509 - RNA, 64 nt, Homo Sapiens
gcucucgggucccuuuauugcuuuuuaaaauaggguuugaaacaugccacaggaagguugcucu

SEQ ID NO: 193510 - RNA, 64 nt, Homo Sapiens
uuuugugagggcaaaggggaggaaaugggguucuguuugaaaaaaaugaggggaucuuagaugc

SEQ ID NO: 193511 - RNA, 64 nt, Homo Sapiens
ccucaugugcuucuucugaauacugaaugugacuguuugaaagcugguagaauucaucccucuu

SEQ ID NO: 193512 - RNA, 64 nt, Homo Sapiens
cucaguugagugagcaaggauacgaaaacaguguguuugaaaacaaauuagguuuggguucaau

SEQ ID NO: 193513 - RNA, 64 nt, Homo Sapiens
uuuuuaauguguacaccugcucuagggacgauucguuugaaagagaguaagaugcauuaacaga

SEQ ID NO: 193514 - RNA, 64 nt, Homo Sapiens
ccacguuuguuccccacguuuguuccccuuuucuguuugaaaaaccuguucugguagcuccaca

SEQ ID NO: 193515 - RNA, 64 nt, Homo Sapiens
cuuagugacuuaguucuuagaagcucacgccuuaguuugaaacagauucuccacgguggucccc

SEQ ID NO: 193516 - RNA, 64 nt, Homo Sapiens
caucagccuccagguugacuaagggucaggucauguuugaaaccaugcuuggcuggaccgggac

SEQ ID NO: 193517 - RNA, 64 nt, Homo Sapiens
uuggcaacagacucaugacaaaggauucaagauuguuugaaaaaaaaaaaaggggagcagggag

SEQ ID NO: 193518 - RNA, 64 nt, Homo Sapiens
ggcgugagccaccuugcccagcccacaucauacaguuugaaaugaaacuuugccacaaccagcc

SEQ ID NO: 193519 - RNA, 64 nt, Homo Sapiens
cuuugcuguagcacacacauauaucacugaaccuguuugaaauaaaguuuuuuuucuuuuucau

SEQ ID NO: 193520 - RNA, 64 nt, Homo Sapiens
uuuuucaaaagcucaguauaugaaucaucauacuguuugaaauugcuaaugacagaguaaguaa

SEQ ID NO: 193521 - RNA, 64 nt, Homo Sapiens
guaacuauaaauuuugugaaugcauuuuccugguguuugaaaaagaagggggggagaauuccag

SEQ ID NO: 193522 - RNA, 64 nt, Homo Sapiens
guuuaacuugguuagaugcaaacacguuggaugaguuugaaaggacuaugcugcccuuuugaca

SEQ ID NO: 193523 - RNA, 64 nt, Homo Sapiens
aaugaaguuuaaucagcgugccauuuuuguuguuguuugaaagauuuuaauuuuuggaaugcac

SEQ ID NO: 193524 - RNA, 64 nt, Homo Sapiens
caauauacuuguuuagaaaaacuucaagacauucaaaaacuaggaaggaguauguuuaauagua

SEQ ID NO: 193525 - RNA, 64 nt, Homo Sapiens
guuuuuuuauuuuguuucuguuuuguguagagguaaaaacuauaguuuuauuacagcauaauuc

SEQ ID NO: 193526 - RNA, 64 nt, Homo Sapiens
auuuugauaaauuuauaaauauauaaaauuauguaaaaacuacacuauauuuugauuuagauuu

SEQ ID NO: 193527 - RNA, 64 nt, Homo Sapiens
ugaugaaaaaaacgaauuguaugauuuaggaaucaaaaacuaaaauaaguggaauuauguaucu

SEQ ID NO: 193528 - RNA, 64 nt, Homo Sapiens
caacaauguacccaaaagaggguagaauucugagaaaaacuauuagcuuagaauuugcaacaag

SEQ ID NO: 193529 - RNA, 64 nt, Homo Sapiens
agggaaaugauucuaaaaggauuaucugaaauugaaaaacuaguaagcaaauaaaugauaaaca

SEQ ID NO: 193530 - RNA, 64 nt, Homo Sapiens
aauaacacucuuuucuuugauaauuuggacaacaaaaaacuagauuaauccguugaaacucuug

SEQ ID NO: 193531 - RNA, 64 nt, Homo Sapiens
aguuaagccuucagguacguaguaguuuucugucaaaaacuaggaauagaguagaagagauaaa

SEQ ID NO: 193532 - RNA, 64 nt, Homo Sapiens
uggugcuuuauauuuagauuuuuuuuucauugccaaaaacuaaaaaaaaaccaauguuuugcag

SEQ ID NO: 193533 - RNA, 64 nt, Homo Sapiens
aaaaaaaaaacuuugccagcgaggagcauuuuuuaaaaacuaaaaaauugaacacaaucucauu

SEQ ID NO: 193534 - RNA, 64 nt, Homo Sapiens
aacauauaauauauaugcugugcucccuggccuuaaaaacuaccauaugcucaucacugauaaa

SEQ ID NO: 193535 - RNA, 64 nt, Homo Sapiens
aaaagaagcguaaaaagugauuugaaaaacuaauaaaaacuaauauucuguuauuucugauacu

SEQ ID NO: 193536 - RNA, 64 nt, Homo Sapiens
aaaaacuaauaaaagaagcguucugauacuuuugaaaaacuaauuucucccaacauucuguuau

SEQ ID NO: 193537 - RNA, 64 nt, Homo Sapiens
uagacuucugcccuccaacauugcaaguguauacaaaaacuaaauuauacugaguaaugcacuc

SEQ ID NO: 193538 - RNA, 64 nt, Homo Sapiens
aaauaacaaaggugcauaaugcuuagguaaucccaaaaacuaacuugcaauuaaaaugugauug

SEQ ID NO: 193539 - RNA, 64 nt, Homo Sapiens
cuaugaauguaauucauaauuuaaaaggaaaacuaaaaacuauuuugauuugggaaaaugagcc

SEQ ID NO: 193540 - RNA, 64 nt, Homo Sapiens
cuuuauauucagcuacucuugucauuucucguugaaaaacuaaaaucugacuagguuaguuuac

SEQ ID NO: 193541 - RNA, 64 nt, Homo Sapiens
uuguuguuucuuaaauaagaaacuuuuuuauuuaaaaaacuaaaaacuagaggugagaaauuua

SEQ ID NO: 193542 - RNA, 64 nt, Homo Sapiens
uucuuaaauaagaaacuuuuuuauuuaaaaaacuaaaaacuagaggugagaaauuuaaacuaua

SEQ ID NO: 193543 - RNA, 64 nt, Homo Sapiens
ucuguguucuaagaacucaggcaauuuuaaggauaaaaacuaacauuggccaggcacgguggcu

SEQ ID NO: 193544 - RNA, 64 nt, Homo Sapiens
caacauggugaaacuucaucucuacuaaaaauacaaaaacuagccaggugugguucuccaugcc

SEQ ID NO: 193545 - RNA, 64 nt, Homo Sapiens
agaaugaaaaguauuugccuuaacuaacggaaggaaaaacuaaguuuggaaaaacccaugaagg

SEQ ID NO: 193546 - RNA, 64 nt, Homo Sapiens
aaaaaacaauaauuuggaaauaugcauucacuugaaaaacuaaauaaaauuuuauguauuaaua

SEQ ID NO: 193547 - RNA, 64 nt, Homo Sapiens
ugagccugugccuggcuagauuggcuagaguuugaaaaacuaauuucccaaaugaaauacugcc

SEQ ID NO: 193548 - RNA, 64 nt, Homo Sapiens
aauacugucuuaucugcuaucucucaauucccugaaaaacuaguacacacagaguaaccuguaa

SEQ ID NO: 193549 - RNA, 64 nt, Homo Sapiens
acuguaucagaaugaagaaacuaauauuuuacauaaaaacuaauacuuucaauuuuuuauauag

SEQ ID NO: 193550 - RNA, 64 nt, Homo Sapiens
auugaucacuuguguacgaaaaauaaaucuccuuaaaaacuaaauaaaaugcacuguauucuua

SEQ ID NO: 193551 - RNA, 64 nt, Homo Sapiens
cuugacaugauuguucauuuaacugcauuugcauaaaaacuacuagugccagcagaguagggaa

SEQ ID NO: 193552 - RNA, 64 nt, Homo Sapiens
uaucaaagcagcagaagguuaagaugcauggccaaaaaacuaagaucaaacuuacauuccugcc

SEQ ID NO: 193553 - RNA, 64 nt, Homo Sapiens
cuuucugaacuuaucuaccuuuacaugcauuuuuaaaaacuauucugauuauuguauaugcaaa

SEQ ID NO: 193554 - RNA, 64 nt, Homo Sapiens
ggcggauaguauaagacuauuaauaauugugccuaaaaacuauguuugccccuaggagaaaacu

SEQ ID NO: 193555 - RNA, 64 nt, Homo Sapiens
gguagaaaacauaagaacuauacgcagaagaaauaaaaacuacgaauaaguaucacaaaucuuu

SEQ ID NO: 193556 - RNA, 64 nt, Homo Sapiens
uuugaacauuggucuuucuuguagauuuuauuuaaaaaacuauauuaauaaauuaucuguuaau

SEQ ID NO: 193557 - RNA, 64 nt, Homo Sapiens
uucaguaaaagccugcucaaugaaauguauuuuuaaaaacuauauaacugaaaagacuauguag

SEQ ID NO: 193558 - RNA, 64 nt, Homo Sapiens
guaacuucucagaaagauaucucacuguggaaauaaaaacuaagaacacagucuuuaauuuuca

SEQ ID NO: 193559 - RNA, 64 nt, Homo Sapiens
uuuagaaguuugaagacuuuguaaauguguugauaaaaacuaauauaaauuaaguugacaugag

SEQ ID NO: 193560 - RNA, 64 nt, Homo Sapiens
uaaugaaaguagcaggugcuuucuuuauguggucaaaaacuagaacugaaccacugcccuaagu

SEQ ID NO: 193561 - RNA, 64 nt, Homo Sapiens
aaauugcacucugugucaacuaaguccacugaauaaaaacuauguugggaugguuucuuggcuu

SEQ ID NO: 193562 - RNA, 64 nt, Homo Sapiens
aaugccgagugguagaaacuucugcaaugcauauaaaaacuauaaucacuuaauuccccaugcu

SEQ ID NO: 193563 - RNA, 64 nt, Homo Sapiens
uaugauucaguagucaacuugagggaaauuuuuaaaaaacuauucucaauuauauacgagguga

SEQ ID NO: 193564 - RNA, 64 nt, Homo Sapiens
cacacuuaggcaauaguccuuuccaaaccaugacaaaaacuacaaguuuauuuauaauuuaaca

SEQ ID NO: 193565 - RNA, 64 nt, Homo Sapiens
aucaaguccacucuucugccugcaacauuuguucaaaaacuaaccaagguaaaauauuuauuug

SEQ ID NO: 193566 - RNA, 64 nt, Homo Sapiens
cauagcauuuuuacuaccagcaguauguuacuuaaaaaacuacauggcuuuccuugaauuuauu

SEQ ID NO: 193567 - RNA, 64 nt, Homo Sapiens
agaugucacacaguugccauccacugcuuugggaaaaaacuagcaugcuccccugcucccuguu

SEQ ID NO: 193568 - RNA, 64 nt, Homo Sapiens
ccaaucagaaagaaauccucuguggggucacuuuaaaaacuacuagcuucaacuaccacuuaca

SEQ ID NO: 193569 - RNA, 64 nt, Homo Sapiens
aacaaaaaaaaaagcuuggaacuccaucacguggaaaaacuagauccuguugguuauagcauuu

SEQ ID NO: 193570 - RNA, 64 nt, Homo Sapiens
uacaaugcaaucauuucauacuuuaaacuggucaaaaaacuaauugugauuucuagucuugcaa

SEQ ID NO: 193571 - RNA, 64 nt, Homo Sapiens
aauauuugagaauguaugauacauguaaaauuaaaaaaacuauuagaacuguaccauaauuaug

SEQ ID NO: 193572 - RNA, 64 nt, Homo Sapiens
gaaaagaaugacauuucaaaaaaaugguucaaugaaaaacuauagcuaaaauauguaaaccuuu

SEQ ID NO: 193573 - RNA, 64 nt, Homo Sapiens
uuugagugucuuuagauagaagggaugggcagggaaaaacuagucauaaaguugcaguuaggaa

SEQ ID NO: 193574 - RNA, 64 nt, Homo Sapiens
gugaaguuuacaguuagaagacuaacugggaaaaaaaaacuaguaaaauuuucuaaauauuaau

SEQ ID NO: 193575 - RNA, 64 nt, Homo Sapiens
gccaaauuucacagucuuaauaacuuuuuuuaaaaaaaacuaaaaggcgcuucauguccagugu

SEQ ID NO: 193576 - RNA, 64 nt, Homo Sapiens
guuccuuuuucacuaugggcaguucacacaaggcaaaaacuauugaacaguugguuuuagugug

SEQ ID NO: 193577 - RNA, 64 nt, Homo Sapiens
aaagugauauacagagagaaugaagaguaagaauaaaaacuaccgaagaaaaaaucaaugaacu

SEQ ID NO: 193578 - RNA, 64 nt, Homo Sapiens
guguuaugcaaagaagcaauuguccggcauccaaaaaaacuaauaagcuacucuggaccuacag

SEQ ID NO: 193579 - RNA, 64 nt, Homo Sapiens
uuaaaaauuccuguaguuguauuucauaaaauuaaaaaacuauuaguuauuuucuucagcuuua

SEQ ID NO: 193580 - RNA, 64 nt, Homo Sapiens
augcuagauaauccagugucugccuuccugauguaaaaacuaacuugggcccaacacuugcagu

SEQ ID NO: 193581 - RNA, 64 nt, Homo Sapiens
uaacuaaauaccuaaugguaacuuacauaggcuaaaaaacuauggacuauucacagcccuauuu

SEQ ID NO: 193582 - RNA, 64 nt, Homo Sapiens
acuaagaauucucaaaaaaauguguaagcuaaacaaaaacuaaaaugcuucucaaaauuuucag

SEQ ID NO: 193583 - RNA, 64 nt, Homo Sapiens
uuuagcucuuguuugggagaacacguaacuguugaaaaacuaccugggaggagugaguuccucc

SEQ ID NO: 193584 - RNA, 64 nt, Homo Sapiens
acuagauauuaguuuuagaggaaggaaauagcugaaaaacuaaauuugcuuuggugaaaugucc

SEQ ID NO: 193585 - RNA, 64 nt, Homo Sapiens
uauaaaaauuacauaauucaaaauuauccaugguaaaaacuaguucuaguguucagaauucaug

SEQ ID NO: 193586 - RNA, 64 nt, Homo Sapiens
guuaacacugcuaaugaaagaccgauggggaaaaaaaaacuacugaauagaaacuuuuaguauu

SEQ ID NO: 193587 - RNA, 64 nt, Homo Sapiens
uuuucccuuagcucuucugacuggauuuuucuacaaaaacuauggaaaauaucuuuguucuugu

SEQ ID NO: 193588 - RNA, 64 nt, Homo Sapiens
ucguuaaauagguuuucuuuaaacuuaauuaaagaaaaacuauuuaaagguaaaggauauuuug

SEQ ID NO: 193589 - RNA, 64 nt, Homo Sapiens
cccagauugcaccacugcucucuagccugggcaaaaaaacuaguuccaaaaaagacacuuguac

SEQ ID NO: 193590 - RNA, 64 nt, Homo Sapiens
ccuuauccuuguaaccaaaagccaucugcuccccaaaaacuauugaaauaaaauaaaauauaaa

SEQ ID NO: 193591 - RNA, 64 nt, Homo Sapiens
uguacauauauuucuggguucccacgaugaugugaaaaacuaccagacuguuuuuugucuucuc

SEQ ID NO: 193592 - RNA, 64 nt, Homo Sapiens
aucuaguccuuucugugguucucagccaagacauaaaaacuaggacucagagcacauacaaaac

SEQ ID NO: 193593 - RNA, 64 nt, Homo Sapiens
uggaguugacuuucuucuguccaaacaaacaaacaaaaacuaaacacacacacaaacccccaga

SEQ ID NO: 193594 - RNA, 64 nt, Homo Sapiens
acccccagaaacccacaauauguacacgcuaaggaaaaacuagcacccuucuguccacucagca

SEQ ID NO: 193595 - RNA, 64 nt, Homo Sapiens
uagcaagcuaauggaaacaugauuuucggggaagaaaaacuacagaaaauguagaaauuuauua

SEQ ID NO: 193596 - RNA, 64 nt, Homo Sapiens
uauuuaauuguguuggagcuucuuuuuccaaaagaaaaacuaguugcagucagggagccagcga

SEQ ID NO: 193597 - RNA, 64 nt, Homo Sapiens
aggaaagaaaggagaguagaacauuuuuccucauuuuaucaaauccucucuugcccucccucaa

SEQ ID NO: 193598 - RNA, 64 nt, Homo Sapiens
aacauuccugaagcuguucccacucccagaugguuuuaucaauagccuagagguaaagaacugu

SEQ ID NO: 193599 - RNA, 64 nt, Homo Sapiens
aaauuuaaauugggggaucacaaacaacgcugaguuuaucaagauguuuucuugucacugaaaa

SEQ ID NO: 193600 - RNA, 64 nt, Homo Sapiens
uggcuucaugauccucacuucuguuuuaugaagcuuuaucaacuuggauaguuccuuuuuagua

SEQ ID NO: 193601 - RNA, 64 nt, Homo Sapiens
ccaaauagcaugaaugcuucgugccacuccaauauuuaucaaauugcuuaauuuauuuuuuacu

SEQ ID NO: 193602 - RNA, 64 nt, Homo Sapiens
aaguuugaaguuuuucuauuaucauaagcuccuuuuuaucaaugcaccaagguuaaagugggua

SEQ ID NO: 193603 - RNA, 64 nt, Homo Sapiens
uaaaucugcaaaaggcaaugaaaaugccuuaaauuuuaucaauaacagaauuauuguauuuaaa

SEQ ID NO: 193604 - RNA, 64 nt, Homo Sapiens
uggaucauucuaguaggaaaggacaauaagauuuuuuaucaaaaugugucaugccaguaagaga

SEQ ID NO: 193605 - RNA, 64 nt, Homo Sapiens
uggguuuuuguacugaaguuuaagauuuugcagauuuaucaauuuaucaauggauuaagaaguu

SEQ ID NO: 193606 - RNA, 64 nt, Homo Sapiens
gauuaagaaguuuaagauuugcuacuccuuaauauuuaucaauguuuacgguguuugaagacca

SEQ ID NO: 193607 - RNA, 64 nt, Homo Sapiens
gaagaguccauuuaacagcagaccauugaaagccuuuaucaacuagaccacaagugggugguga

SEQ ID NO: 193608 - RNA, 64 nt, Homo Sapiens
aauuaaaauaaaucuacauacaacuacccuuucuuuuaucaaguuugggauggaaaaugcuaau

SEQ ID NO: 193609 - RNA, 64 nt, Homo Sapiens
auacaccacuugaggacaauaucaugacucacgguuuaucaaguuuauguucuggacugguagc

SEQ ID NO: 193610 - RNA, 64 nt, Homo Sapiens
gcuuaagaaauacauuuaaccuguuaugucaguauuuaucaaugaaguuugauaauucacuuuu

SEQ ID NO: 193611 - RNA, 64 nt, Homo Sapiens
ucuuuccuucuucuauuaaauuuaagaauguuuauuuaucaaaguuauaaaaaacaauuguauu

SEQ ID NO: 193612 - RNA, 64 nt, Homo Sapiens
aacaacuguagcuguuauuugguuucucauuauguuuaucaaaaaaauaaaugcauugcuuaau

SEQ ID NO: 193613 - RNA, 64 nt, Homo Sapiens
acuaagugcacucuuucaaaacuuauucuauaacuuuaucaauucaugugaauuuuagcucaau

SEQ ID NO: 193614 - RNA, 64 nt, Homo Sapiens
gguuguuuuccuguaauauaaaagaaaaaguuaauuuaucaauugauugaauacaguuuuuacu

SEQ ID NO: 193615 - RNA, 64 nt, Homo Sapiens
uaucaauugauugaauacaguuuuuacuaauuaguuuaucaaaccaaauacugugaacguacca

SEQ ID NO: 193616 - RNA, 64 nt, Homo Sapiens
ccaauguaaagaauguguaucuguauauaaauaauuuaucaaauaguuuucucuuugugucugu

SEQ ID NO: 193617 - RNA, 64 nt, Homo Sapiens
augaagacucaguugcauuuuuaucgaauacauuuuuaucaacaguuaaagacuauggugguuu

SEQ ID NO: 193618 - RNA, 64 nt, Homo Sapiens
aauuguccagauuccacguguagcagccuuaaaguuuaucaaaacacaguuucuguaaauuauu

SEQ ID NO: 193619 - RNA, 64 nt, Homo Sapiens
gccaccuagcagucaucuguagauuguauuuuauuuuaucaaaaagccuuaagagccucaguga

SEQ ID NO: 193620 - RNA, 64 nt, Homo Sapiens
agcucaauauuacuuuguuugggcugaccuuuauuuuaucaauaccuuauucccacacacucuu

SEQ ID NO: 193621 - RNA, 64 nt, Homo Sapiens
guugggguuaaaggaagguguaguugaccugcacuuuaucaaaguagaagugauuagggcaagc

SEQ ID NO: 193622 - RNA, 64 nt, Homo Sapiens
cuguuaaugcuuguccuugguagucaguuuggguuuuaucaaucuuauauugugagaacacauu

SEQ ID NO: 193623 - RNA, 64 nt, Homo Sapiens
caguuaugaucaucguuuucaugucuaggauccuuuuaucaaggauuuuugcgcagacuuauac

SEQ ID NO: 193624 - RNA, 64 nt, Homo Sapiens
aauccuaucugcugcuuguuuuuguaaauagaguuuuaucaaaccacagccaugcuuacuuguu

SEQ ID NO: 193625 - RNA, 64 nt, Homo Sapiens
ucagaaacaagaaaacaaaugauaaaggaacucauuuaucaauagaggugaaaggaaauuauua

SEQ ID NO: 193626 - RNA, 64 nt, Homo Sapiens
guggaauagaugaauaagugggauauaacaaauuuuuaucaauugguuuguauugcccaaaauu

SEQ ID NO: 193627 - RNA, 64 nt, Homo Sapiens
uauaaaauauguugaaaggccaaugaguuaggucuuuaucaaguaaaccuaagaauaaacacaa

SEQ ID NO: 193628 - RNA, 61 nt, Homo Sapiens
uaguggugaagcuacccuaaagcuaucuaucuuuaucaaauggaaugaaacuagauaauuu

SEQ ID NO: 193629 - RNA, 64 nt, Homo Sapiens
uaaauucagauccuuucuccacacagcaaugacauuuaucaaucugacucagguguggcuguug

SEQ ID NO: 193630 - RNA, 64 nt, Homo Sapiens
aagacauuuucuacccuagauccaauugcauuuauuuaucaauaagugccauuaaauugaaauu

SEQ ID NO: 193631 - RNA, 64 nt, Homo Sapiens
uaucuagcauagcacaaacguuuuuccagucuucuuuaucaacacuaaugccucuuaauugcau

SEQ ID NO: 193632 - RNA, 64 nt, Homo Sapiens; identical to SEQ ID NO: 193524

SEQ ID NO: 193633 - RNA, 64 nt, Homo Sapiens; identical to SEQ ID NO: 193525

SEQ ID NO: 193634 - RNA, 64 nt, Homo Sapiens; identical to SEQ ID NO: 193526

SEQ ID NO: 193635 - RNA, 64 nt, Homo Sapiens; identical to SEQ ID NO: 193527

SEQ ID NO: 193636 - RNA, 64 nt, Homo Sapiens; identical to SEQ ID NO: 193528

SEQ ID NO: 193637 - RNA, 64 nt, Homo Sapiens; identical to SEQ ID NO: 193529

SEQ ID NO: 193638 - RNA, 64 nt, Homo Sapiens; identical to SEQ ID NO: 193530

SEQ ID NO: 193639 - RNA, 64 nt, Homo Sapiens; identical to SEQ ID NO: 193531

SEQ ID NO: 193640 - RNA, 64 nt, Homo Sapiens; identical to SEQ ID NO: 193532

SEQ ID NO: 193641 - RNA, 64 nt, Homo Sapiens; identical to SEQ ID NO: 193533

SEQ ID NO: 193642 - RNA, 64 nt, Homo Sapiens; identical to SEQ ID NO: 193534

SEQ ID NO: 193643 - RNA, 64 nt, Homo Sapiens; identical to SEQ ID NO: 193535

SEQ ID NO: 193644 - RNA, 64 nt, Homo Sapiens; identical to SEQ ID NO: 193536

SEQ ID NO: 193645 - RNA, 64 nt, Homo Sapiens; identical to SEQ ID NO: 193537

SEQ ID NO: 193646 - RNA, 64 nt, Homo Sapiens; identical to SEQ ID NO: 193538

SEQ ID NO: 193647 - RNA, 64 nt, Homo Sapiens; identical to SEQ ID NO: 193539

SEQ ID NO: 193648 - RNA, 64 nt, Homo Sapiens; identical to SEQ ID NO: 193540

SEQ ID NO: 193649 - RNA, 64 nt, Homo Sapiens; identical to SEQ ID NO: 193541

SEQ ID NO: 193650 - RNA, 64 nt, Homo Sapiens; identical to SEQ ID NO: 193542

SEQ ID NO: 193651 - RNA, 64 nt, Homo Sapiens; identical to SEQ ID NO: 193543

SEQ ID NO: 193652 - RNA, 64 nt, Homo Sapiens; identical to SEQ ID NO: 193544

SEQ ID NO: 193653 - RNA, 64 nt, Homo Sapiens; identical to SEQ ID NO: 193545

SEQ ID NO: 193654 - RNA, 64 nt, Homo Sapiens; identical to SEQ ID NO: 193546

SEQ ID NO: 193655 - RNA, 64 nt, Homo Sapiens; identical to SEQ ID NO: 193547

SEQ ID NO: 193656 - RNA, 64 nt, Homo Sapiens; identical to SEQ ID NO: 193548

SEQ ID NO: 193657 - RNA, 64 nt, Homo Sapiens; identical to SEQ ID NO: 193549

SEQ ID NO: 193658 - RNA, 64 nt, Homo Sapiens; identical to SEQ ID NO: 193550

SEQ ID NO: 193659 - RNA, 64 nt, Homo Sapiens; identical to SEQ ID NO: 193551

SEQ ID NO: 193660 - RNA, 64 nt, Homo Sapiens; identical to SEQ ID NO: 193552

SEQ ID NO: 193661 - RNA, 64 nt, Homo Sapiens; identical to SEQ ID NO: 193553

SEQ ID NO: 193662 - RNA, 64 nt, Homo Sapiens; identical to SEQ ID NO: 193554

SEQ ID NO: 193663 - RNA, 64 nt, Homo Sapiens; identical to SEQ ID NO: 193555

SEQ ID NO: 193664 - RNA, 64 nt, Homo Sapiens; identical to SEQ ID NO: 193556

SEQ ID NO: 193665 - RNA, 64 nt, Homo Sapiens; identical to SEQ ID NO: 193557

SEQ ID NO: 193666 - RNA, 64 nt, Homo Sapiens; identical to SEQ ID NO: 193558

SEQ ID NO: 193667 - RNA, 64 nt, Homo Sapiens; identical to SEQ ID NO: 193559

SEQ ID NO: 193668 - RNA, 64 nt, Homo Sapiens; identical to SEQ ID NO: 193560

SEQ ID NO: 193669 - RNA, 64 nt, Homo Sapiens; identical to SEQ ID NO: 193561

SEQ ID NO: 193670 - RNA, 64 nt, Homo Sapiens; identical to SEQ ID NO: 193562

SEQ ID NO: 193671 - RNA, 64 nt, Homo Sapiens; identical to SEQ ID NO: 193563

SEQ ID NO: 193672 - RNA, 64 nt, Homo Sapiens; identical to SEQ ID NO: 193564

SEQ ID NO: 193673 - RNA, 64 nt, Homo Sapiens; identical to SEQ ID NO: 193565

SEQ ID NO: 193674 - RNA, 64 nt, Homo Sapiens; identical to SEQ ID NO: 193566

SEQ ID NO: 193675 - RNA, 64 nt, Homo Sapiens; identical to SEQ ID NO: 193567

SEQ ID NO: 193676 - RNA, 64 nt, Homo Sapiens; identical to SEQ ID NO: 193568

SEQ ID NO: 193677 - RNA, 64 nt, Homo Sapiens; identical to SEQ ID NO: 193569

SEQ ID NO: 193678 - RNA, 64 nt, Homo Sapiens; identical to SEQ ID NO: 193570

SEQ ID NO: 193679 - RNA, 64 nt, Homo Sapiens; identical to SEQ ID NO: 193571

SEQ ID NO: 193680 - RNA, 64 nt, Homo Sapiens; identical to SEQ ID NO: 193572

SEQ ID NO: 193681 - RNA, 64 nt, Homo Sapiens; identical to SEQ ID NO: 193573

SEQ ID NO: 193682 - RNA, 64 nt, Homo Sapiens; identical to SEQ ID NO: 193574

SEQ ID NO: 193683 - RNA, 64 nt, Homo Sapiens; identical to SEQ ID NO: 193575

SEQ ID NO: 193684 - RNA, 64 nt, Homo Sapiens; identical to SEQ ID NO: 193576

SEQ ID NO: 193685 - RNA, 64 nt, Homo Sapiens; identical to SEQ ID NO: 193577

SEQ ID NO: 193686 - RNA, 64 nt, Homo Sapiens; identical to SEQ ID NO: 193578

SEQ ID NO: 193687 - RNA, 64 nt, Homo Sapiens; identical to SEQ ID NO: 193579

SEQ ID NO: 193688 - RNA, 64 nt, Homo Sapiens; identical to SEQ ID NO: 193580

SEQ ID NO: 193689 - RNA, 64 nt, Homo Sapiens; identical to SEQ ID NO: 193581

SEQ ID NO: 193690 - RNA, 64 nt, Homo Sapiens; identical to SEQ ID NO: 193582

SEQ ID NO: 193691 - RNA, 64 nt, Homo Sapiens; identical to SEQ ID NO: 193583

SEQ ID NO: 193692 - RNA, 64 nt, Homo Sapiens; identical to SEQ ID NO: 193584

SEQ ID NO: 193693 - RNA, 64 nt, Homo Sapiens; identical to SEQ ID NO: 193585

SEQ ID NO: 193694 - RNA, 64 nt, Homo Sapiens; identical to SEQ ID NO: 193586

SEQ ID NO: 193695 - RNA, 64 nt, Homo Sapiens; identical to SEQ ID NO: 193587

SEQ ID NO: 193696 - RNA, 64 nt, Homo Sapiens; identical to SEQ ID NO: 193588

SEQ ID NO: 193697 - RNA, 64 nt, Homo Sapiens; identical to SEQ ID NO: 193589

SEQ ID NO: 193698 - RNA, 64 nt, Homo Sapiens; identical to SEQ ID NO: 193590

SEQ ID NO: 193699 - RNA, 64 nt, Homo Sapiens; identical to SEQ ID NO: 193591

SEQ ID NO: 193700 - RNA, 64 nt, Homo Sapiens; identical to SEQ ID NO: 193592

SEQ ID NO: 193701 - RNA, 64 nt, Homo Sapiens; identical to SEQ ID NO: 193593

SEQ ID NO: 193702 - RNA, 64 nt, Homo Sapiens; identical to SEQ ID NO: 193594

SEQ ID NO: 193703 - RNA, 64 nt, Homo Sapiens; identical to SEQ ID NO: 193595

SEQ ID NO: 193704 - RNA, 64 nt, Homo Sapiens; identical to SEQ ID NO: 193596

SEQ ID NO: 193705 - RNA, 64 nt, Homo Sapiens; identical to SEQ ID NO: 193597

SEQ ID NO: 193706 - RNA, 64 nt, Homo Sapiens; identical to SEQ ID NO: 193598

SEQ ID NO: 193707 - RNA, 64 nt, Homo Sapiens; identical to SEQ ID NO: 193599

SEQ ID NO: 193708 - RNA, 64 nt, Homo Sapiens; identical to SEQ ID NO: 193600

SEQ ID NO: 193709 - RNA, 64 nt, Homo Sapiens; identical to SEQ ID NO: 193601

SEQ ID NO: 193710 - RNA, 64 nt, Homo Sapiens; identical to SEQ ID NO: 193602

SEQ ID NO: 193711 - RNA, 64 nt, Homo Sapiens; identical to SEQ ID NO: 193603

SEQ ID NO: 193712 - RNA, 64 nt, Homo Sapiens; identical to SEQ ID NO: 193604

SEQ ID NO: 193713 - RNA, 64 nt, Homo Sapiens; identical to SEQ ID NO: 193605

SEQ ID NO: 193714 - RNA, 64 nt, Homo Sapiens; identical to SEQ ID NO: 193606

SEQ ID NO: 193715 - RNA, 64 nt, Homo Sapiens; identical to SEQ ID NO: 193607

SEQ ID NO: 193716 - RNA, 64 nt, Homo Sapiens; identical to SEQ ID NO: 193608

SEQ ID NO: 193717 - RNA, 64 nt, Homo Sapiens; identical to SEQ ID NO: 193609

SEQ ID NO: 193718 - RNA, 64 nt, Homo Sapiens; identical to SEQ ID NO: 193610

SEQ ID NO: 193719 - RNA, 64 nt, Homo Sapiens; identical to SEQ ID NO: 193611

SEQ ID NO: 193720 - RNA, 64 nt, Homo Sapiens; identical to SEQ ID NO: 193612

SEQ ID NO: 193721 - RNA, 64 nt, Homo Sapiens; identical to SEQ ID NO: 193613

SEQ ID NO: 193722 - RNA, 64 nt, Homo Sapiens; identical to SEQ ID NO: 193614

SEQ ID NO: 193723 - RNA, 64 nt, Homo Sapiens; identical to SEQ ID NO: 193615

SEQ ID NO: 193724 - RNA, 64 nt, Homo Sapiens; identical to SEQ ID NO: 193616

SEQ ID NO: 193725 - RNA, 64 nt, Homo Sapiens; identical to SEQ ID NO: 193617

SEQ ID NO: 193726 - RNA, 64 nt, Homo Sapiens; identical to SEQ ID NO: 193618

SEQ ID NO: 193727 - RNA, 64 nt, Homo Sapiens; identical to SEQ ID NO: 193619

SEQ ID NO: 193728 - RNA, 64 nt, Homo Sapiens; identical to SEQ ID NO: 193620

SEQ ID NO: 193729 - RNA, 64 nt, Homo Sapiens; identical to SEQ ID NO: 193621

SEQ ID NO: 193730 - RNA, 64 nt, Homo Sapiens; identical to SEQ ID NO: 193622

SEQ ID NO: 193731 - RNA, 64 nt, Homo Sapiens; identical to SEQ ID NO: 193623

SEQ ID NO: 193732 - RNA, 64 nt, Homo Sapiens; identical to SEQ ID NO: 193624

SEQ ID NO: 193733 - RNA, 64 nt, Homo Sapiens; identical to SEQ ID NO: 193625

SEQ ID NO: 193734 - RNA, 64 nt, Homo Sapiens; identical to SEQ ID NO: 193626

SEQ ID NO: 193735 - RNA, 64 nt, Homo Sapiens; identical to SEQ ID NO: 193627

SEQ ID NO: 193736 - RNA, 61 nt, Homo Sapiens; identical to SEQ ID NO: 193628

SEQ ID NO: 193737 - RNA, 64 nt, Homo Sapiens; identical to SEQ ID NO: 193629

SEQ ID NO: 193738 - RNA, 64 nt, Homo Sapiens; identical to SEQ ID NO: 193630

SEQ ID NO: 193739 - RNA, 64 nt, Homo Sapiens; identical to SEQ ID NO: 193631

SEQ ID NO: 193740 - RNA, 64 nt, Homo Sapiens
ugguuuugguugcuccucccccagcugccaccccccaccuuacccuuauuccucucuguccaca

SEQ ID NO: 193741 - RNA, 64 nt, Homo Sapiens
uuacccuuauuccucucuguccacauuuucugccccaccuuacuucuccucccugacagacauc

SEQ ID NO: 193742 - RNA, 64 nt, Homo Sapiens
guagugaauguaaggaaagcuuaauggaucucucccaccuuaauaaaugggagagcaucccuaa

SEQ ID NO: 193743 - RNA, 64 nt, Homo Sapiens
guagcaguugugaaagagucuucagucguaguguccaccuuacucaacaucagaaaauucacaa

SEQ ID NO: 193744 - RNA, 64 nt, Homo Sapiens
aaugcaauccaugccauaagcaggaguugauacaccaccuuauuagcuaaaaauauauauaaca

SEQ ID NO: 193745 - RNA, 64 nt, Homo Sapiens
uccuguccccuccuuccagccugagauguaggcuccaccuuaacugugcucagauacacaagug

SEQ ID NO: 193746 - RNA, 60 nt, Homo Sapiens
uucuucugauuuuuaugugaccauagcuaugauguaaagacaauacuguccuucagagaa

SEQ ID NO: 193747 - RNA, 64 nt, Homo Sapiens
uuuauuaauaguauuagaacucauucccugaacugauguaaaucuucauagugucagacauacu

SEQ ID NO: 193748 - RNA, 64 nt, Homo Sapiens
cuuuauuugaaaucuccuaauaguaaacaugagcgauguaaaaagacagcucagauugucgagu

SEQ ID NO: 193749 - RNA, 64 nt, Homo Sapiens
uguuuuguaguguugcuuagaggucuucaguguugauguaaauguuguuggauuucauuucccc

SEQ ID NO: 193750 - RNA, 64 nt, Homo Sapiens
aaauugaguucucauuuaacaauggaaauaaauagauguaaauaccugaagaugugauacacug

SEQ ID NO: 193751 - RNA, 64 nt, Homo Sapiens
auauuaaagauaucaauacuuaacaaugucucaugauguaaaaaauaacaaucagguaagauca

SEQ ID NO: 193752 - RNA, 64 nt, Homo Sapiens
uuauauauuuaaagugcucauuaauagaaugauggauguaaauuggauguaaauauucaguuua

SEQ ID NO: 193753 - RNA, 64 nt, Homo Sapiens
aagugcucauuaauagaaugauggauguaaauuggauguaaauauucaguuuauauaauuauau

SEQ ID NO: 193754 - RNA, 64 nt, Homo Sapiens
uuucuauguaaaaaauucugauguauaugguacagauguaaaguaauuuuuucagauggacaaa

SEQ ID NO: 193755 - RNA, 64 nt, Homo Sapiens
uugaacuucuacaagaaguacccaaagaacuauagauguaaagaagguguggaagugaaacuua

SEQ ID NO: 193756 - RNA, 64 nt, Homo Sapiens
gaguuuguauuauuacaaaugguacagacauggagauguaaaauuggaaggaaauaaacauuac

SEQ ID NO: 193757 - RNA, 64 nt, Homo Sapiens
ugcuuccacugcaagucugucgggagccaguggugauguaaaaaagaacuaacuuuggucucag

SEQ ID NO: 193758 - RNA, 64 nt, Homo Sapiens
caaaauaaagguuaaagagguguaacguguuauagauguaaagaauggauauguaaacaaugac

SEQ ID NO: 193759 - RNA, 64 nt, Homo Sapiens
ugaauaaagcauuauuucugaguauaugaugaaagauguaaagcugcaaguuuuuuggugcugu

SEQ ID NO: 193760 - RNA, 64 nt, Homo Sapiens
ccauucuuaguuugugggccagaaaaagaaaaaagauguaaaaagagcaagacucccucucaaa

SEQ ID NO: 193761 - RNA, 64 nt, Homo Sapiens
ccggccgggcgcgguggcuccccccuucuuuaaagauguaaaacagccacugugcccaggcaga

SEQ ID NO: 193762 - RNA, 64 nt, Homo Sapiens
auaguuuuguuuguuagaaaaguugcucuuaaaagauguaaauagaugacaaacgauguaaaua

SEQ ID NO: 193763 - RNA, 64 nt, Homo Sapiens
aguugcucuuaaaagauguaaauagaugacaaacgauguaaauaauuuuguaagaggcuucaaa

SEQ ID NO: 193764 - RNA, 64 nt, Homo Sapiens
aacugaacagugaaguggcuaguauucauuucaugauguaaagaaauuugggagguuaauacca

SEQ ID NO: 193765 - RNA, 64 nt, Homo Sapiens; identical to SEQ ID NO: 193764

SEQ ID NO: 193766 - RNA, 64 nt, Homo Sapiens
uuuacaugggaugcauuagaugaggaauaaaauggauguaaacaugauaagucuuagaggcgag

SEQ ID NO: 193767 - RNA, 64 nt, Homo Sapiens
aaaaaauuuaaaguuaaaugagacauauuuuugagauguaaaaaaaugaagcucuaauuauugc

SEQ ID NO: 193768 - RNA, 64 nt, Homo Sapiens
agaagaauacccuagaaugaccucaugaaaaauugauguaaaucucuuaaaaugggacaaucag

SEQ ID NO: 193769 - RNA, 64 nt, Homo Sapiens
ucugcgguucugggagccaagaagaauguacccugauguaaaucuuuuuaaggauugcacuaca

SEQ ID NO: 193770 - RNA, 64 nt, Homo Sapiens
ccuuuuuaauaacuuauuuuauacauauugugcagauguaaaucuuguaauuaauggucaaacu

SEQ ID NO: 193771 - RNA, 64 nt, Homo Sapiens
uacuuuaaaaaaaauccaguuucuccuauaacaugauguaaauuaaauauucaggaauauuuca

SEQ ID NO: 193772 - RNA, 64 nt, Homo Sapiens
uucuuauuuaagaaaccuagaucaaguuuuuacagauguaaauaaaaguugaauaguuuaccuu

SEQ ID NO: 193773 - RNA, 64 nt, Homo Sapiens
uaauaaugcacaguaaauaugugaauuuuuccuagauguaaaaaaaaaaaucuuucauauaaag

SEQ ID NO: 193774 - RNA, 64 nt, Homo Sapiens
uccuuguagccuuuugacuuucauuggaaauuaggauguaaaucugcucaggagaccuggagga

SEQ ID NO: 193775 - RNA, 64 nt, Homo Sapiens
uucucugaggaagcugggguucaugacaauggcagauguaaaguuauucuugaagucagauuga

SEQ ID NO: 193776 - RNA, 64 nt, Homo Sapiens
cugggaagggagcggcagcccagccaggccuggcccauaaaaggcucccaugcugagcagccca

SEQ ID NO: 193777 - RNA, 64 nt, Homo Sapiens
aaugaaauugaacuauugacugggccccagaaauccauaaaauggcugcagacaguuguuucug

SEQ ID NO: 193778 - RNA, 64 nt, Homo Sapiens
auucagaccuuaguacagcaagacacucuggccaccauaaaaaacgcagaaaagaaaaaaaggu

SEQ ID NO: 193779 - RNA, 64 nt, Homo Sapiens
caaauauuaaagagacugguagcucaucauccuaccauaaaagagaaaaaaauucggaaaguga

SEQ ID NO: 193780 - RNA, 64 nt, Homo Sapiens
ucaaaagagaaaaaaguuucugaaaacaaugaaaccauaaaagauaauauucuaaaaacugaga

SEQ ID NO: 193781 - RNA, 64 nt, Homo Sapiens
acaguugguuuucuuauccuuugauaaaagcaucccauaaaauauaaaguaguaaguuaacaua

SEQ ID NO: 193782 - RNA, 64 nt, Homo Sapiens
ccucuguuagucauuuguaaauucuaaauggucaccauaaaauguauuagguaggagaagauac

SEQ ID NO: 193783 - RNA, 64 nt, Homo Sapiens
aaauaaaauaaaauuuagauuagagggagcauggccauaaaauauauuuaaaauuuagauuuau

SEQ ID NO: 193784 - RNA, 64 nt, Homo Sapiens
cuuuagaaucagcuagucaaagcccuuuacauuuccauaaaacaaggcaacuccagaagaaaga

SEQ ID NO: 193785 - RNA, 64 nt, Homo Sapiens
cucaguuuuauugagguagaaagucuucugguucccauaaaagauccugguucccauuagucuu

SEQ ID NO: 193786 - RNA, 64 nt, Homo Sapiens
gagcuagucauggauaacagguacuguaugaaggccauaaaauaauugagcagugcugcaacau

SEQ ID NO: 193787 - RNA, 64 nt, Homo Sapiens
ugccgucuuuugaggaaaucuagugaagaggucgccauaaaauauuagagucaacaaccaaaau

SEQ ID NO: 193788 - RNA, 64 nt, Homo Sapiens
uuuugaacuucuuggaucuguggguuuauuguuuccauaaaauuuggaaauuuuuacaaucuuc

SEQ ID NO: 193789 - RNA, 64 nt, Homo Sapiens
aucguuuuugaguuuggcaauaaaggcuaaucuaccauaaaacucuugaagcuuaagcuuuagg

SEQ ID NO: 193790 - RNA, 64 nt, Homo Sapiens
auagucauaagaagagacaaucaaaaauaaucagccauaaaauauuaaaaagguauuauaaagg

SEQ ID NO: 193791 - RNA, 64 nt, Homo Sapiens
aaacuugaccuugaccaugucacuuuacguuugaauuucugagcuaaagagucagagagauuag

SEQ ID NO: 193792 - RNA, 64 nt, Homo Sapiens
gccauaccaggguaucccuugucccuucacccccauuucugaccucaguuccuggaggggggaa

SEQ ID NO: 193793 - RNA, 64 nt, Homo Sapiens
uuaauuguguggguccauagacuuuuuaaugaagauuucugacuuugccacuguaaaugccuuu

SEQ ID NO: 193794 - RNA, 64 nt, Homo Sapiens
uuaucagcuauuucuuauauaucauaaucuggcaauuucugaaaccagucagaaaagacauaua

SEQ ID NO: 193795 - RNA, 64 nt, Homo Sapiens
caugcccccuuuaauguuaacaugacuuggaguaauuucugagguuuacugacaaacauaaaaa

SEQ ID NO: 193796 - RNA, 64 nt, Homo Sapiens
augaugcucuggacauuuuaggaagcuuaaguaaauuucugauuuuccuuuauugauuauguaa

SEQ ID NO: 193797 - RNA, 64 nt, Homo Sapiens
uuuacccuaacaguuuuaccaccuaguaacagucauuucugaaaauauguuggauagaaaguca

SEQ ID NO: 193798 - RNA, 64 nt, Homo Sapiens
ugcagcaugcaauauaugcuuauauuucauuuuaauuucugauauauaaugaacuucuugggag

SEQ ID NO: 193799 - RNA, 64 nt, Homo Sapiens
uauuucuuuaauuuaugcuugaaucugaaaaauuauuucugacuuacuccauggccuccuuaua

SEQ ID NO: 193800 - RNA, 64 nt, Homo Sapiens
caacuucaagugauuuagauaucuaucuaucuagauuucugaaccaagauauauuuauaguuca

SEQ ID NO: 193801 - RNA, 64 nt, Homo Sapiens
gauagccagaguaaguaagcgauaaggcagcuaaauuucugaaauguuaguuaaaugagcuaua

SEQ ID NO: 193802 - RNA, 64 nt, Homo Sapiens
aguaauauuuuuaaacuauaugcuugggcuccaaauuucugaagggaggaaucucuguaauucc

SEQ ID NO: 193803 - RNA, 64 nt, Homo Sapiens
guaucagucuucugaauucuacucaagcaaaggaauuucugaaaucugagcaaaaaucugggaa

SEQ ID NO: 193804 - RNA, 64 nt, Homo Sapiens
aaaaaucugggaaacucaagaauaaauaguagcaauuucugagcgaauuuuuuaaaacauuuau

SEQ ID NO: 193805 - RNA, 64 nt, Homo Sapiens
uucaaauaaaacuuauuaugggaacauggacaccauuucugaccgauccaggaaaaauaaaaug

SEQ ID NO: 193806 - RNA, 64 nt, Homo Sapiens
uuucaguaaagaaauacacaauuuugcaacacucauuucugaauaguucugaucaaauccuuac

SEQ ID NO: 193807 - RNA, 64 nt, Homo Sapiens
cacuuuaggaaacaauagauuauuuuauauuauuauuucugauggugacaaguuugucuugagg

SEQ ID NO: 193808 - RNA, 64 nt, Homo Sapiens
ccaucucuuggucuucuccuuugaagcacagccuauuucugagccaaggguuggggaagccugu

SEQ ID NO: 193809 - RNA, 64 nt, Homo Sapiens
cugguucuggaacuucaugaguagucucaucuucauuucugauuugcgguuuuggcucgucuug

SEQ ID NO: 193810 - RNA, 64 nt, Homo Sapiens
aauaaagagaaaagguguuuauccauguuaggacauuucugaauacaauuauuaaaacaaacag

SEQ ID NO: 193811 - RNA, 64 nt, Homo Sapiens
uacacugauauuuuuuuuuguggauuuuccuaagauuucugauuaaauuacuuuuuaaagauac

SEQ ID NO: 193812 - RNA, 64 nt, Homo Sapiens
uuaacuccaaauuucuuuaucaagccauauuuaaauuucugaagauuccccaauaucaucuaau

SEQ ID NO: 193813 - RNA, 64 nt, Homo Sapiens
guuucucuuguccucguaauaccauuuggauuuuauuucugaauuuaaauaguaaaauauuuau

SEQ ID NO: 193814 - RNA, 64 nt, Homo Sapiens
agcagauacaaugaucugcuuuagugagaggacaauuucugauugauuguuuucucuucaggcc

SEQ ID NO: 193815 - RNA, 64 nt, Homo Sapiens
acguuagauuugguuugaaaaacuaaaauuucagauuucugaggauauacugucuuagacuuau

SEQ ID NO: 193816 - RNA, 64 nt, Homo Sapiens
gagauuauaucauuucuuuuucaauuauacuauuauuucugagaaugaaauggacgauuacacu

SEQ ID NO: 193817 - RNA, 64 nt, Homo Sapiens
auaagcucuuuaaaggcaaaucaagacgaagcuuauuucugaggguguuuuguaguucaacaac

SEQ ID NO: 193818 - RNA, 64 nt, Homo Sapiens
caagggcguggaucccucaaccuucuguggugucauuucugaaacaugcuccuggagcucacag

SEQ ID NO: 193819 - RNA, 64 nt, Homo Sapiens
cuccauuauaacauauguaaaauucccuugucauauuucugaaagaagagacacuuaagcuaaa

SEQ ID NO: 193820 - RNA, 64 nt, Homo Sapiens
gaucaaaaaggccuagucugcuguaguacugagcauuucugacuuauagagaugagguccgcuu

SEQ ID NO: 193821 - RNA, 64 nt, Homo Sapiens
uuaacugcuaguaguggaauacuggaaaagcuucauuucugaagaugaauuuuauuuuuaaaaa

SEQ ID NO: 193822 - RNA, 64 nt, Homo Sapiens
cucaaaacuuuuagcuuugaucacaaguggacaaauuucugaaaccaaaggcaacuaaguugcu

SEQ ID NO: 193823 - RNA, 64 nt, Homo Sapiens
caaauaggcaucucagcuccucacacuuauggcuauuucugacguauagccaguuuucuucccu

SEQ ID NO: 193824 - RNA, 64 nt, Homo Sapiens
cuugcuauacagaaacuauguauguauuuaggcuauuucugaagggcacagggaagggggaaca

SEQ ID NO: 193825 - RNA, 64 nt, Homo Sapiens
aaaugaggcagagcauggaaaucaaaugccuucaauuucugagaacccaaacaaaaaaauaaua

SEQ ID NO: 193826 - RNA, 64 nt, Homo Sapiens
ucaggaugcuuguauagugggagcucgguuucucauuucugagagaccauaacccaggaaucca

SEQ ID NO: 193827 - RNA, 64 nt, Homo Sapiens
guguagagacuacuacaaaauguuuaacagcagaauuucugaauaagaaauauuuuauaaaucc

SEQ ID NO: 193828 - RNA, 64 nt, Homo Sapiens
uucauuuuauuuggguacaugugacaguauuuuuauuucugacaccaauaaggggugcuucuuu

SEQ ID NO: 193829 - RNA, 64 nt, Homo Sapiens
ccuuuguuguauuuaacaaaauccaggugcaucaauuucugaugcuuuuuacuauuguguauua

SEQ ID NO: 193830 - RNA, 64 nt, Homo Sapiens
acuacaugacagaaaugaccuaucacuacuuauuauuucugaagccuaacugcaagacugauuu

SEQ ID NO: 193831 - RNA, 64 nt, Homo Sapiens
uacuuauuauuucugaagccuaacugcaagacugauuucugagaacaaguaaagaacuggaaua

SEQ ID NO: 193832 - RNA, 64 nt, Homo Sapiens
cagaaaguugccaaacccuucucuauccucucguauuucugaguuuuuguccuucccgagggag

SEQ ID NO: 193833 - RNA, 64 nt, Homo Sapiens
ggugggcauuugguauguccuuucucuuggggugauuucugauguuuuuacucuauauagugaa

SEQ ID NO: 193834 - RNA, 64 nt, Homo Sapiens
gucucuauugucacacaugguuauauuuaaaguaauuucugaacuguguaaugugucuagagua

SEQ ID NO: 193835 - RNA, 64 nt, Homo Sapiens
cacgacguguuccuaaaacauguuugaaaggugaauuucugaaagucuacaauaaauguaggug

SEQ ID NO: 193836 - RNA, 64 nt, Homo Sapiens
aaacagacagcucccacuaagaucacguucugguauuucugagguuaacacuugauuuagcccc

SEQ ID NO: 193837 - RNA, 64 nt, Homo Sapiens
uuuagccccuacauaucuuuccauauauccuauuauuucugaauauauguccucaaaaucccca

SEQ ID NO: 193838 - RNA, 64 nt, Homo Sapiens
aaaagcaaaugcauuaguauucuuuauaaguaugauuucugaaguugggacagauuuuauguaa

SEQ ID NO: 193839 - RNA, 64 nt, Homo Sapiens
uuuaaccuuuucagaaugcauuuaccuuuaaauaauuucugaaaccuuauggcugccacucuua

SEQ ID NO: 193840 - RNA, 64 nt, Homo Sapiens
uggcagaugaaaugugcuggaggaaaaaaaugacauuucugaccuucccgggacacauucuucu

SEQ ID NO: 193841 - RNA, 64 nt, Homo Sapiens
agccuuguuauuuuuaaguccuauuuugauauuaauuucugauuaguuaguaaauaacaccugg

SEQ ID NO: 193842 - RNA, 64 nt, Homo Sapiens
aaacacuccauguuauauuccccucuauuuuaagauuucugaaauuacaaacaaaaagccuaau

SEQ ID NO: 193843 - RNA, 64 nt, Homo Sapiens
uuugaagaaaacguauaaauugagggacccucucauuucugacauaggggggauauugcugucc

SEQ ID NO: 193844 - RNA, 64 nt, Homo Sapiens
aaaauaaaguuguuucucccuauaaacauuacuaauuucugaugcaaacuacuauaaacaaauu

SEQ ID NO: 193845 - RNA, 64 nt, Homo Sapiens
auaauuuacaaacuacuauauuauagacauuacuauuucugauaugucucuuaaaguaaguggu

SEQ ID NO: 193846 - RNA, 64 nt, Homo Sapiens
ggggcaagaaagagggagggaaaucuuucaacuuauuucugaaaaagagaaaaaaauauaaaau

SEQ ID NO: 193847 - RNA, 64 nt, Homo Sapiens
uaauugccauagaaaguauaauuucagugcaguaauuucugagagcuaguaccuauaugcuacc

SEQ ID NO: 193848 - RNA, 64 nt, Homo Sapiens
gacaauauuaauacuguuuauagcuagaaguuugauuucugaauucuuugagauuuuagcaaaa

SEQ ID NO: 193849 - RNA, 64 nt, Homo Sapiens
uugcaaggacucuggaaacugccgccaaugaccaauuucugacuaaccagccaccuuuucucuc

SEQ ID NO: 193850 - RNA, 64 nt, Homo Sapiens
aauguaaaacacucaaaagcgaccucuaucagggauuucugaauuuaauuuaagccaccuaaau

SEQ ID NO: 193851 - RNA, 64 nt, Homo Sapiens
uacugaaugguaaauuuuuauuugaaucuaacccauuucugauaccaacuacaguuuuuccuca

SEQ ID NO: 193852 - RNA, 64 nt, Homo Sapiens
agcaaaacuaaagaacugcagucuucugaucuuuauuucugaagagcuagccuuuaacauauau

SEQ ID NO: 193853 - RNA, 64 nt, Homo Sapiens
aaaucaucuguaacuucuuaauuacaguuuaccuauuucugacaugcagcacugccaucucuuc

SEQ ID NO: 193854 - RNA, 64 nt, Homo Sapiens
agaaaauauuuaaaguggcucauagguaaugaauauuucugacuuagauguaaauccaucugga

SEQ ID NO: 193855 - RNA, 64 nt, Homo Sapiens
cuagaaaaugauggauaaaagggcugauaagaaaauuucugacugucaguagaagugagauaag

SEQ ID NO: 193856 - RNA, 64 nt, Homo Sapiens
auuuuauguuuuuccugcuuuguggaugaaaaauauuucugagugguaguuuuuugacagguag

SEQ ID NO: 193857 - RNA, 64 nt, Homo Sapiens
gguagaccaugucuuaucuuguuucaaaauaaguauuucugauuuuguaaaaugaaauauaaaa

SEQ ID NO: 193858 - RNA, 64 nt, Homo Sapiens; identical to SEQ ID NO: 87004

SEQ ID NO: 193859 - RNA, 64 nt, Homo Sapiens; identical to SEQ ID NO: 87005

SEQ ID NO: 193860 - RNA, 64 nt, Homo Sapiens; identical to SEQ ID NO: 87006

SEQ ID NO: 193861 - RNA, 64 nt, Homo Sapiens; identical to SEQ ID NO: 87007

SEQ ID NO: 193862 - RNA, 64 nt, Homo Sapiens; identical to SEQ ID NO: 87008

SEQ ID NO: 193863 - RNA, 64 nt, Homo Sapiens; identical to SEQ ID NO: 87009

SEQ ID NO: 193864 - RNA, 64 nt, Homo Sapiens; identical to SEQ ID NO: 87010

SEQ ID NO: 193865 - RNA, 64 nt, Homo Sapiens; identical to SEQ ID NO: 87011

SEQ ID NO: 193866 - RNA, 64 nt, Homo Sapiens; identical to SEQ ID NO: 87012

SEQ ID NO: 193867 - RNA, 64 nt, Homo Sapiens; identical to SEQ ID NO: 87013

SEQ ID NO: 193868 - RNA, 64 nt, Homo Sapiens; identical to SEQ ID NO: 87014

SEQ ID NO: 193869 - RNA, 64 nt, Homo Sapiens; identical to SEQ ID NO: 87015

SEQ ID NO: 193870 - RNA, 64 nt, Homo Sapiens; identical to SEQ ID NO: 87016

SEQ ID NO: 193871 - RNA, 64 nt, Homo Sapiens; identical to SEQ ID NO: 87017

SEQ ID NO: 193872 - RNA, 64 nt, Homo Sapiens; identical to SEQ ID NO: 87018

SEQ ID NO: 193873 - RNA, 64 nt, Homo Sapiens; identical to SEQ ID NO: 87019

SEQ ID NO: 193874 - RNA, 64 nt, Homo Sapiens; identical to SEQ ID NO: 87020

SEQ ID NO: 193875 - RNA, 64 nt, Homo Sapiens; identical to SEQ ID NO: 87021

SEQ ID NO: 193876 - RNA, 64 nt, Homo Sapiens; identical to SEQ ID NO: 87022

SEQ ID NO: 193877 - RNA, 64 nt, Homo Sapiens; identical to SEQ ID NO: 87023

SEQ ID NO: 193878 - RNA, 64 nt, Homo Sapiens; identical to SEQ ID NO: 87024

SEQ ID NO: 193879 - RNA, 64 nt, Homo Sapiens; identical to SEQ ID NO: 87025

SEQ ID NO: 193880 - RNA, 64 nt, Homo Sapiens; identical to SEQ ID NO: 87026

SEQ ID NO: 193881 - RNA, 64 nt, Homo Sapiens; identical to SEQ ID NO: 87027

SEQ ID NO: 193882 - RNA, 64 nt, Homo Sapiens; identical to SEQ ID NO: 87028

SEQ ID NO: 193883 - RNA, 64 nt, Homo Sapiens; identical to SEQ ID NO: 87029

SEQ ID NO: 193884 - RNA, 64 nt, Homo Sapiens; identical to SEQ ID NO: 87030

SEQ ID NO: 193885 - RNA, 64 nt, Homo Sapiens; identical to SEQ ID NO: 87031

SEQ ID NO: 193886 - RNA, 64 nt, Homo Sapiens; identical to SEQ ID NO: 87032

SEQ ID NO: 193887 - RNA, 64 nt, Homo Sapiens; identical to SEQ ID NO: 87033

SEQ ID NO: 193888 - RNA, 64 nt, Homo Sapiens; identical to SEQ ID NO: 87034

SEQ ID NO: 193889 - RNA, 64 nt, Homo Sapiens; identical to SEQ ID NO: 87035

SEQ ID NO: 193890 - RNA, 64 nt, Homo Sapiens; identical to SEQ ID NO: 87036

SEQ ID NO: 193891 - RNA, 64 nt, Homo Sapiens; identical to SEQ ID NO: 87037

SEQ ID NO: 193892 - RNA, 64 nt, Homo Sapiens; identical to SEQ ID NO: 87038

SEQ ID NO: 193893 - RNA, 51 nt, Homo Sapiens; identical to SEQ ID NO: 87039

SEQ ID NO: 193894 - RNA, 64 nt, Homo Sapiens; identical to SEQ ID NO: 87040

SEQ ID NO: 193895 - RNA, 64 nt, Homo Sapiens; identical to SEQ ID NO: 87041

SEQ ID NO: 193896 - RNA, 64 nt, Homo Sapiens; identical to SEQ ID NO: 87042

SEQ ID NO: 193897 - RNA, 64 nt, Homo Sapiens; identical to SEQ ID NO: 87043

SEQ ID NO: 193898 - RNA, 64 nt, Homo Sapiens
ucaagagcggugugcuuugcccgacugcucccaucaggaauaggagaguagacagagaucuucc

SEQ ID NO: 193899 - RNA, 64 nt, Homo Sapiens
ugacaucugugagccaaagacugagccuuuuuggcaggaauaauaagcaauacuacacaacuug

SEQ ID NO: 193900 - RNA, 64 nt, Homo Sapiens
uccugcccacgggaggacaagcaauaacucucuacaggaauauauuuuuuaaacgaagagacag

SEQ ID NO: 193901 - RNA, 64 nt, Homo Sapiens
cccccacucccccuucccuuggagggagagguggcaggaauacuucaccuuuccucucccucag

SEQ ID NO: 193902 - RNA, 64 nt, Homo Sapiens
aaguuuguaaaaauauacugauuuugaaaaguaucaggaauauaaauauuugguaauucugugu

SEQ ID NO: 193903 - RNA, 64 nt, Homo Sapiens
uuaguuaguaaaaauccuauuaaugugaaccagccaggaauaacaguguuauuucuauuggaua

SEQ ID NO: 193904 - RNA, 64 nt, Homo Sapiens
aauguguauuuuggcuacagauccacaguagcaucaggaauagaggcuuaaacuaaaccuugac

SEQ ID NO: 193905 - RNA, 64 nt, Homo Sapiens
auuucuuugaaagcugaaaucuaacaaggaagaucaggaauaaucaaacuaaguuacuuuuuua

SEQ ID NO: 193906 - RNA, 64 nt, Homo Sapiens
augguuccagugaauuagagaaucagcugcucuacaggaauagcugaagguacuaugaccaaag

SEQ ID NO: 193907 - RNA, 64 nt, Homo Sapiens
uuuuucuuacucuacauauggauauccuuccauccaggaauagaaauccaucaucucuaucguu

SEQ ID NO: 193908 - RNA, 64 nt, Homo Sapiens
gcucguuauaaacacuacuagaaauauuuagcuucaggaauacuuucucagaaaucaguuugua

SEQ ID NO: 193909 - RNA, 64 nt, Homo Sapiens
uuuuucauaaagcagaauugcgugaguuguuccucaggaauagacagaaauaucuucagaagua

SEQ ID NO: 193910 - RNA, 64 nt, Homo Sapiens
ugggcuuuauugauaccaaaaaggcaucacugaccaggaauauccaaaggaaacaggaauaaua

SEQ ID NO: 193911 - RNA, 64 nt, Homo Sapiens
aaaggcaucacugaccaggagaguacaaaggaaacaggaauaauuuaaacccagugaagcaacu

SEQ ID NO: 193912 - RNA, 64 nt, Homo Sapiens
ggugcuguggugcuugcauguagucccagcuauucaggaauauugcuugaguccagcuugggca

SEQ ID NO: 193913 - RNA, 64 nt, Homo Sapiens
guggggaaaaaaaucagaauugcgucugugggaacaggaauaaaggagaaaccacuauugacug

SEQ ID NO: 193914 - RNA, 64 nt, Homo Sapiens
uagccuguauugggaaggugggaauacauauaagcaggaauacuacgggccuuuuaaucuuuca

SEQ ID NO: 193915 - RNA, 64 nt, Homo Sapiens
uauaagcaggaauacuuagcgccuuuuaaucuuucaggaauacauugguaugaaugggugacgg

SEQ ID NO: 193916 - RNA, 64 nt, Homo Sapiens
gaagcuuccuguguccuuuauuccuguaagcacucaggaauaaugggccuguucccagcacauu

SEQ ID NO: 193917 - RNA, 64 nt, Homo Sapiens
uccuuaaggcacaaaucacucuuguuaucugcaacaggaauaugaagaaagggacaggcucugg

SEQ ID NO: 193918 - RNA, 64 nt, Homo Sapiens
auuauguaaugaaaaccuaugaaaucuugaaccccaggaauagucuuggagggacguguuuaau

SEQ ID NO: 193919 - RNA, 64 nt, Homo Sapiens
uaugaaagauugugauggugcaaaagaauucuuacaggaauauugaugauaucucaauugguau

SEQ ID NO: 193920 - RNA, 64 nt, Homo Sapiens
ggggcuuuagugaugcuccuaucuuccucagcccagaaagcaauccuaauaccucauauucccc

SEQ ID NO: 193921 - RNA, 64 nt, Homo Sapiens
aggacaguggagguguguggguaucugguaggggagaaagcagcacagagcagcccuuggguuu

SEQ ID NO: 193922 - RNA, 64 nt, Homo Sapiens
ugcaugugaacaccaucaugccccagggcucuucagaaagcaucaggggcaaggcugcccccug

SEQ ID NO: 193923 - RNA, 64 nt, Homo Sapiens
cccaguaguuccauucuugcaauuggcugaguugagaaagcagcaaugggccaaacacaccuca

SEQ ID NO: 193924 - RNA, 64 nt, Homo Sapiens
ugccuucucuguuccugcaccaaaaaugaucaggagaaagcauauuaccaggcugaacugucac

SEQ ID NO: 193925 - RNA, 64 nt, Homo Sapiens
uuuagaaauauacauauuuuauacaaaauuauaaagaaagcauagagagguaagcauuaguggc

SEQ ID NO: 193926 - RNA, 64 nt, Homo Sapiens
augaauuaauggaaaagaacaaugagggauaaauagaaagcagaguauauauguuagaguuuug

SEQ ID NO: 193927 - RNA, 64 nt, Homo Sapiens
gugggucccagacauugaaguucggccuuucuugagaaagcaaaugucacgcaguugacugguu

SEQ ID NO: 193928 - RNA, 64 nt, Homo Sapiens
uuaaagaccaucagaaggaaaagaucucauuugcagaaagcagaaaagauuaaauccuugacau

SEQ ID NO: 193929 - RNA, 64 nt, Homo Sapiens
cccuuagagaugaggauaaacuccggcuggaaauagaaagcauuauuugcauuucauguuuaac

SEQ ID NO: 193930 - RNA, 64 nt, Homo Sapiens
ucccauucugguagagggagacagucuacaaaccagaaagcaucagggaugcuaagugcaguga

SEQ ID NO: 193931 - RNA, 64 nt, Homo Sapiens
cuggcuaggggccacagcguuagacagugcagagagaaagcacuuccaucgcugaggaaaguuc

SEQ ID NO: 193932 - RNA, 64 nt, Homo Sapiens
aaagauugagaagccauguaauuugugaacuggaagaaagcaacaaggagagcaagaaggaaag

SEQ ID NO: 193933 - RNA, 64 nt, Homo Sapiens
agcaagggaccuucaugcccguaucuggguaagaagaaagcaaacaaacagaguauguccgaug

SEQ ID NO: 193934 - RNA, 64 nt, Homo Sapiens
guuuuaauugagaggggcagaaagaaaagaaaaaagaaagcauugcaagacuccgucucaaaaa

SEQ ID NO: 193935 - RNA, 64 nt, Homo Sapiens
guuuuaguccaggcacaguggcagaaugcgcuuuagaaagcauuccucacaggcacaucaggcu

SEQ ID NO: 193936 - RNA, 64 nt, Homo Sapiens
uccaaagcauaguuuaccuggugauuuuggugaaagaaagcacaauuuguggcuccugaguuga

SEQ ID NO: 193937 - RNA, 64 nt, Homo Sapiens
acauacuaagcgugagguauagugguggcuguucagaaagcagaacagaggccacuggguuccc

SEQ ID NO: 193938 - RNA, 64 nt, Homo Sapiens
uuccaaggauauguuucaugagacgaagggagagagaaagcagugaagagggagggagagagaa

SEQ ID NO: 193939 - RNA, 64 nt, Homo Sapiens
auuuucuccuguaucugaauuuaacacacaagaaagaaagcagguuauugaaaauugccuucca

SEQ ID NO: 193940 - RNA, 64 nt, Homo Sapiens
ucuuuuggaacuuguuucaagccaaaaacucucaagaaagcaaauugcaccucagcuggauuga

SEQ ID NO: 193941 - RNA, 64 nt, Homo Sapiens
aacugugacuuuuccccaaacgucaaucuuuauuagaaagcauuuucuagguguguuuagugua

SEQ ID NO: 193942 - RNA, 64 nt, Homo Sapiens
agcuaauuugaaauaaaaauuauuuguauaauuaagaaagcagauuagaugcacauggucaaca

SEQ ID NO: 193943 - RNA, 64 nt, Homo Sapiens
uguucuuaugcuagugcuugcugagugcauacuaagaaagcaauuccaaauagauguauacauc

SEQ ID NO: 193944 - RNA, 64 nt, Homo Sapiens
gggaacugugauuggauuugccacuguacaguguagaaagcaguuuaaaacucaguagugucag

SEQ ID NO: 193945 - RNA, 64 nt, Homo Sapiens
ugucucagacugcauguaccgcugauguuggaagagaaagcacgggucucauuuagaacuugca

SEQ ID NO: 193946 - RNA, 64 nt, Homo Sapiens
agauuuaaaugaauuagugaauguaagauacuuuagaaagcauguaaaguacuagaaacaauga

SEQ ID NO: 193947 - RNA, 64 nt, Homo Sapiens
accugcugaggaaaucguuuggugaaaugaauccagaaagcagagaaaaugcuucauuacuuua

SEQ ID NO: 193948 - RNA, 64 nt, Homo Sapiens
auucacauccucagugucucagucuuuuuugccgagaaagcacaguagucugggacugggcauu

SEQ ID NO: 193949 - RNA, 64 nt, Homo Sapiens
uggggguuuucuuugaaaguuuccagcccuauucagaaagcaacucuuggcugugugcauuuuu

SEQ ID NO: 193950 - RNA, 64 nt, Homo Sapiens
caccauaacuagguaacaguuugauaacuagggaagaaagcagaacaguuaagcagccgccaca

SEQ ID NO: 193951 - RNA, 64 nt, Homo Sapiens
ggcagcugaacaguguuggcuuucaugaggaggcagaaagcagaggcuggccucagacucauac

SEQ ID NO: 193952 - RNA, 64 nt, Homo Sapiens
gacaugcggccugcauggugucuacaguacugacagaaagcaaguggaggcucucucugccuag

SEQ ID NO: 193953 - RNA, 64 nt, Homo Sapiens
gacugcccuucauucagccuggugccagucuuccagaaagcaagaggguucacauaggcucuca

SEQ ID NO: 193954 - RNA, 64 nt, Homo Sapiens
ggagguggggguugcuguugaaaccaaaccaaacagaaagcaguuagcccaaaaucccaaacuc

SEQ ID NO: 193955 - RNA, 64 nt, Homo Sapiens
caaagaaaaaagagcuagccgaggaagggaaaacagaaagcagacugagcguacauagggaagg

SEQ ID NO: 193956 - RNA, 64 nt, Homo Sapiens
aauauaaguaaccaugacuuguaaaaaaaaaaaaagaaagcaguuacucuuggagcuuaugccu

SEQ ID NO: 193957 - RNA, 64 nt, Homo Sapiens
gacgaugcauuucuuggccaaaguggcuuccucaagaaagcagcacuuaccuuugaaaaaugcu

SEQ ID NO: 193958 - RNA, 64 nt, Homo Sapiens
uucuaaauuauguauuauaaauucguagagcuauagaaagcaaugaguguguaauuuggaguga

SEQ ID NO: 193959 - RNA, 64 nt, Homo Sapiens
aauugacuuaaguaucuugaaaaagaaacuuuagagaaagcaucagggguguguacucaguauu

SEQ ID NO: 193960 - RNA, 64 nt, Homo Sapiens
cagcaagggcuugcagccuagagacggucaugcaagaaagcagagccaaaccuuuccuguaaca

SEQ ID NO: 193961 - RNA, 54 nt, Homo Sapiens
caaaccuuuccuguaacagagauuagaaagcagcaguucuuugaacaugaguga

SEQ ID NO: 193962 - RNA, 64 nt, Homo Sapiens
aaggcagagaaguaggccagagcuggguucuugcagaaagcaucagugccuacaaauggagcuc

SEQ ID NO: 193963 - RNA, 64 nt, Homo Sapiens
ugcaugagcuacucuuggcuuccuuaaagggucaagaaagcaauuuuucugcuuacuagauuca

SEQ ID NO: 193964 - RNA, 64 nt, Homo Sapiens
ggcauagaaaaguacauuuuaguuccaaaaauguagaaagcacaggccucuguggauuuguauc

SEQ ID NO: 193965 - RNA, 64 nt, Homo Sapiens
gauugcauaguuauguacacuagacacuucugugagaaagcaggaugaucuguugaaugaaucc

SEQ ID NO: 193966 - RNA, 64 nt, Homo Sapiens
cuaggaagugauuuuuuaaaauuaggacuccuuaagaauaaacuuuuccagaagcacgagguag

SEQ ID NO: 193967 - RNA, 64 nt, Homo Sapiens
uuauuugaaagugacaggaaucuccucagaaugaagaauaaagccuacuaggucucuaacuguu

SEQ ID NO: 193968 - RNA, 64 nt, Homo Sapiens
uaaacaugcccucuaaaaguaggugguuuugaagagaauaaauucaucagauaaccucaaguca

SEQ ID NO: 193969 - RNA, 64 nt, Homo Sapiens
gaggaagauaugauuggaaaaucaagaguguagaagaauaaauacuguuuuacuguccaaagac

SEQ ID NO: 193970 - RNA, 64 nt, Homo Sapiens
aguuauuaaucgaaagacagucauuugcuuuuccagaauaaagauguuuauaugaauaugacuu

SEQ ID NO: 193971 - RNA, 64 nt, Homo Sapiens
cuccuaccccaacuuccggugaggaucugccaaaagaauaaagcgcaauaucuauaaugacuga

SEQ ID NO: 193972 - RNA, 64 nt, Homo Sapiens
cauguacuucacagcuagcauauguccuauggaaagaauaaaagcugugaucauuauuuggaaa

SEQ ID NO: 193973 - RNA, 64 nt, Homo Sapiens
auuccuuucauaucguuauuagcuguguauagguagaauaaaaagaaguuauaccuuuauuuug

SEQ ID NO: 193974 - RNA, 64 nt, Homo Sapiens
cauggguucuuagucuuuagcaaguauugaaaguagaauaaaaauuguuuuauccacaacuuuu

SEQ ID NO: 193975 - RNA, 64 nt, Homo Sapiens
aaccaauacuccacugcucauaacugagccaaccagaauaaaaucagggccuuuauuuggcaaa

SEQ ID NO: 193976 - RNA, 64 nt, Homo Sapiens
agguuuuuuucaauuaaaaaacuugcaaaugagcagaauaaaugucuugccaguuaaaauuaua

SEQ ID NO: 193977 - RNA, 64 nt, Homo Sapiens
gagaccauuaaucuaauauaaguaagauuuugucagaauaaauuucuaaaugacuaaacuucaa

SEQ ID NO: 193978 - RNA, 64 nt, Homo Sapiens
gcaaucauuucaaaucuauucugcaaauuguauaagaauaaaguuagaauuaacaauuuuauuu

SEQ ID NO: 193979 - RNA, 64 nt, Homo Sapiens
uuucuaauuagguguauagccuauucacuuuccuagaauaaaucucuuaaccuaaauuugagua

SEQ ID NO: 193980 - RNA, 64 nt, Homo Sapiens
gaaauuguucuuuuaaaauaauuacuagaaugaaagaauaaaaaauguucuaaguagugauaau

SEQ ID NO: 193981 - RNA, 64 nt, Homo Sapiens
ugaaauugaacuauuuucaguagcaauaaauauuagaauaaauaagaagcauuccuuacauuag

SEQ ID NO: 193982 - RNA, 64 nt, Homo Sapiens
aauugggcaaaacuaccuaggaaaaucacauuucagaauaaaacaugaaauuuugguaaaaucu

SEQ ID NO: 193983 - RNA, 64 nt, Homo Sapiens
gguuugagaugaaaagaacccgaguaaguagacaagaauaaaguacaaacuaucaugcaaauaa

SEQ ID NO: 193984 - RNA, 64 nt, Homo Sapiens
auuuucuauaaaagucuaaccuuaaaaauuaaaaagaauaaaagaaacuguauaagcaauugcc

SEQ ID NO: 193985 - RNA, 64 nt, Homo Sapiens
uggacccgguuucugauuauuuuuuguuuuuauaagaauaaauuguaccuuccauguuauauua

SEQ ID NO: 193986 - RNA, 64 nt, Homo Sapiens
auaauggauaaaaaucguuuacgaaguauuguagagaauaaaucgcaaaucauugaacacuuua

SEQ ID NO: 193987 - RNA, 64 nt, Homo Sapiens
ucuuguuaaaaacguggcaaauuuccugcugcugagaauaaauggauggaggggucguuucgug

SEQ ID NO: 193988 - RNA, 64 nt, Homo Sapiens
aauaaacuuguaucgaggaaaaacuuguauauggagaauaaacuugcugcuauucugggagaau

SEQ ID NO: 193989 - RNA, 64 nt, Homo Sapiens
uguauauggagaauaaacuagcugcuauucugggagaauaaacuauccaauucaaguuuuauuu

SEQ ID NO: 193990 - RNA, 64 nt, Homo Sapiens
ugggccaucccagcacuuauagcuccuaaacaagagaauaaaaagaauaaaacaaucucagagc

SEQ ID NO: 193991 - RNA, 64 nt, Homo Sapiens
uucacaguuucaccuccauuuaaauuuauggggaagaauaaauguuuccugacucagaaacaau

SEQ ID NO: 193992 - RNA, 64 nt, Homo Sapiens
uacuuacaacugcaauuucacuuucauuuagaaaagaauaaauguuucuuaauugaacaacuau

SEQ ID NO: 193993 - RNA, 64 nt, Homo Sapiens
uuuaagcuacaaauugagaaaaccguuauaaauaagaauaaaauaggccaggcacaguggcuca

SEQ ID NO: 193994 - RNA, 64 nt, Homo Sapiens
cgagacccugucuccaaaggaaaaacaaaaaagaagaauaaaauaauuuggaugaaaaucaugu

SEQ ID NO: 193995 - RNA, 64 nt, Homo Sapiens
guacagauaugaacacuuauuagacauacggagcagaauaaagaguguguuacugguuuaagga

SEQ ID NO: 193996 - RNA, 64 nt, Homo Sapiens
aggaaucaacuuaacaaaacuaauaccaucagaaagaauaaaauaaguuaaauaauuccauuua

SEQ ID NO: 193997 - RNA, 64 nt, Homo Sapiens
gcaauaacgagccagcauuuaugagagaagggagagaauaaaauagucuuaagaagaugaaugg

SEQ ID NO: 193998 - RNA, 64 nt, Homo Sapiens
uaauauuuauacuuguuuccaaguaucuggacucagaauaaaugcugcacuucuacaguuuaga

SEQ ID NO: 193999 - RNA, 64 nt, Homo Sapiens
ucuucaaauauuuuacagagcucauauuuggcucagaauaaaucugugucacgggccauggcca

SEQ ID NO: 194000 - RNA, 64 nt, Homo Sapiens
auccucagcccugaugccucgcaccacagccuggagaauaaaaugcaaagcacccucaaaagcu

SEQ ID NO: 194001 - RNA, 64 nt, Homo Sapiens
aaccaauuuccugauggacuauuaaauucaucuuagaauaaauuagugaagaauuuaauuuuag

SEQ ID NO: 194002 - RNA, 64 nt, Homo Sapiens
caucuuagaauaaauuagugaagaauuuaauuuuagaauaaauaauccaaucugaaauaauuau

SEQ ID NO: 194003 - RNA, 64 nt, Homo Sapiens
uuuuggccucucauaguuuucucucucuuuaaagagaauaaauagagggccaggugugguggcu

SEQ ID NO: 194004 - RNA, 64 nt, Homo Sapiens
aaaaaaaaaaaaaaaaaaaaaaaaagagagagagagaauaaauagaaaagaauguggcugggaa

SEQ ID NO: 194005 - RNA, 64 nt, Homo Sapiens
ugaaaucugcauucaugccauugucucaagaacaagaauaaaauucauaaaauagacaauguuu

SEQ ID NO: 194006 - RNA, 64 nt, Homo Sapiens
gguaaaacuacauuuagacuuauuucuaaaaauaagaauaaaaagaauggcguacaaaucuuau

SEQ ID NO: 194007 - RNA, 64 nt, Homo Sapiens
acuuuacuaaaauauuguauuaaaguaguaauaaagaauaaaauauuuaaggauaaauaaaaaa

SEQ ID NO: 194008 - RNA, 64 nt, Homo Sapiens
uaggcuucaaucauuauaauugucucuuuuguuaagaauaaauuucaguuaauaguuuuaaaaa

SEQ ID NO: 194009 - RNA, 64 nt, Homo Sapiens
agguaaauauuuuaaguuaugauguccuuguaaaagaauaaaaacaaccagaagguaaaacuua

SEQ ID NO: 194010 - RNA, 64 nt, Homo Sapiens
gucacuguaagaucacaagcguguucagaugcuuagaauaaaaucccuggagaauguccaccuu

SEQ ID NO: 194011 - RNA, 64 nt, Homo Sapiens
uaauuauauucuggucuucaaaauauguuagaccagaauaaaauaaagcaauguaaaucagaau

SEQ ID NO: 194012 - RNA, 64 nt, Homo Sapiens
uguuagaccagaauaaaauuaagcaauguaaaucagaauaaauaucuguaauuauguuacauaa

SEQ ID NO: 194013 - RNA, 64 nt, Homo Sapiens
aaaaucuuucaacaaacugauaucaauuucuuguagaauaaaaauucuuuaacaggauugcacc

SEQ ID NO: 194014 - RNA, 64 nt, Homo Sapiens
auggaaagcaacuugauauauauauuuuuaaaguagaauaaauaauuugaacaucauaguugua

SEQ ID NO: 194015 - RNA, 64 nt, Homo Sapiens
cuugggagucauuaccacgcagccgcaggaaggcagaauaaaucaaaugaagaaagggaggccc

SEQ ID NO: 194016 - RNA, 64 nt, Homo Sapiens
aagaaagggaggcccagccguggcaucuccauguagaauaaaugugguggguaacuuagaagga

SEQ ID NO: 194017 - RNA, 64 nt, Homo Sapiens
ugcagaaagguuuucucauugcauccauacugugagaauaaacugcagacugaaagaaacaugc

SEQ ID NO: 194018 - RNA, 64 nt, Homo Sapiens
aauaauuccgaggaacauuggggguuaaauaccaagaauaaaaauugguucuucuuugacuuca

SEQ ID NO: 194019 - RNA, 64 nt, Homo Sapiens
cuguggaaugaagcuuuuuaguuuauguucuuauagaauaaaagugugcguggaaaaagacgau

SEQ ID NO: 194020 - RNA, 64 nt, Homo Sapiens
aauauuguauugcugcugugucuaaucuuaaaucagaauaaauuuaguucuagcucuauuuacu

SEQ ID NO: 194021 - RNA, 64 nt, Homo Sapiens
ucugugaagagauccuacuaggaacagaaucaaaagaauaaaaaaggugaaaagccaaauuuua

SEQ ID NO: 194022 - RNA, 64 nt, Homo Sapiens
uugggguuuucaaggaucgcccagcugucuuucaagaauaaaagacuggcuuuugccaguuaau

SEQ ID NO: 194023 - RNA, 64 nt, Homo Sapiens
ggauaugaugacaagguugagaauaaaagggugaagaauaaaaggggacugucauaccagugaa

SEQ ID NO: 194024 - RNA, 64 nt, Homo Sapiens
ggugaagaauaaaagggauaugucauaccagugaagaauaaaagggcuaagaugguauagggac

SEQ ID NO: 194025 - RNA, 64 nt, Homo Sapiens
augucugugcugucuaguuuguguucaaaaugucagaauaaacacagaauaaauguucccacgg

SEQ ID NO: 194026 - RNA, 64 nt, Homo Sapiens
gucuaguuuguguucaaaaugucagaauaaacacagaauaaauguucccacggccacacagucg

SEQ ID NO: 194027 - RNA, 64 nt, Homo Sapiens
ucaagggauggcauaacuguaagaggucagugcuagaauaaaguccuguagguuuauuuuggaa

SEQ ID NO: 194028 - RNA, 64 nt, Homo Sapiens
aaagaacacuggauuaauaaucuuuugggaggguagaauaaaauaauugauuacuauugcugca

SEQ ID NO: 194029 - RNA, 64 nt, Homo Sapiens
uuuuuucucuuuugcagcuacauuugaaagugauagaauaaagagauuuuaaugaguuaucacu

SEQ ID NO: 194030 - RNA, 64 nt, Homo Sapiens
ucuuuauaugucaaacugguugaacacuguaaugagaauaaacugcacagaguuuauucugacu

SEQ ID NO: 194031 - RNA, 64 nt, Homo Sapiens
auucacaugaaaaggagacaauaaucaagucaaaagaauaaaugcuuacuaaucaucagaaaau

SEQ ID NO: 194032 - RNA, 64 nt, Homo Sapiens
gccagauaaacacuuucuccuuacucaucaaucaagaauaaaauuuucuacaucaaaguaagac

SEQ ID NO: 194033 - RNA, 64 nt, Homo Sapiens
aaagaguaacugguagauuuuguuaacaaauuaaagaauaaaguuagacaagcaacugguugac

SEQ ID NO: 194034 - RNA, 64 nt, Homo Sapiens
uaaaauacaauuuuguuucuccaaauuugacagcagaauaaaaacccuacccuuucacugugua

SEQ ID NO: 194035 - RNA, 64 nt, Homo Sapiens
uaugaagagagacugguuguacauguuuggaaagagaauaaauaagauauagcaggagaccaaa

SEQ ID NO: 194036 - RNA, 64 nt, Homo Sapiens
uccagaacuuagugggaagaggcaccauuauguuagaauaaauuuacaguucuuuguacagaaa

SEQ ID NO: 194037 - RNA, 64 nt, Homo Sapiens
cuguauucauggauuggauguugaaguacaaaguagaauaaauuauggaugucauccugugacu

SEQ ID NO: 194038 - RNA, 64 nt, Homo Sapiens
caauuccuccugucaguugcuuaucauuaaugcaagaauaaagaggccaucuuguagauuacau

SEQ ID NO: 194039 - RNA, 64 nt, Homo Sapiens
aguuaaauuuccuuauuuuuuaaaugaaguguuuagaauaaaauggccacaguugccuuauaug

SEQ ID NO: 194040 - RNA, 64 nt, Homo Sapiens
auguucagcuuaauuuuagucauguccaagaaaaagaauaaauuggauguuuuauuucucacau

SEQ ID NO: 194041 - RNA, 64 nt, Homo Sapiens
aagaacauguauaacaaaaaauuucaacaauaagagaauaaaauucacuugagaacagaauagg

SEQ ID NO: 194042 - RNA, 64 nt, Homo Sapiens
uacuucuauuauucuuuuauuguaaaaaaauuaaagaauaaaaagaaaauugaaaaaauuaaaa

SEQ ID NO: 194043 - RNA, 64 nt, Homo Sapiens
uguucuccuucuaaaaguuucaaguucuauuuuuagaauaaaauuuuugguauuucauuguuac

SEQ ID NO: 194044 - RNA, 64 nt, Homo Sapiens
cuuagaaaguuuugagaggacaccaaaauauuuuagaauaaauucauuuuuauacuaaaacaaa

SEQ ID NO: 194045 - RNA, 64 nt, Homo Sapiens
uaccugugugcuuuugugggcaccuuguuuaugaagaauaaaaaaugauuuguuaucugaagag

SEQ ID NO: 194046 - RNA, 64 nt, Homo Sapiens
uuaugaagaauaaaaaaugauuuguuaucugaagagaauaaauuuuaaauucucaguuuauguc

SEQ ID NO: 194047 - RNA, 64 nt, Homo Sapiens
auuaguagaaaagaggagcuauuuccgaaucuauagaauaaaguaccaccuaaaacugaauuuu

SEQ ID NO: 194048 - RNA, 64 nt, Homo Sapiens
uuuuuuaguuguuuaaauaaguaauauuuucaaaagaauaaaauaaccaaugauaucucuugga

SEQ ID NO: 194049 - RNA, 64 nt, Homo Sapiens
uuacugucauucccauuccuuuucguuuagaaucagaauaaaguuguauuucaaauaucuaagc

SEQ ID NO: 194050 - RNA, 64 nt, Homo Sapiens
uagggaagcacuugcucaaaaucugugaccugucagaauaaaaaugugguuuguacauaucaaa

SEQ ID NO: 194051 - RNA, 64 nt, Homo Sapiens
gauuuccaccaucaggauucauaaccuguguaugagaauaaaaucucuuccuaauugugcugua

SEQ ID NO: 194052 - RNA, 64 nt, Homo Sapiens
uaauuuacaucacagcagugaaaugaccugaaguagaauaaacacccacauauucaagaagcuc

SEQ ID NO: 194053 - RNA, 64 nt, Homo Sapiens
cuaccaaagugauauacagagaacuugaagaguaagaauaaaaaaaaaagaagaaaaaaucaau

SEQ ID NO: 194054 - RNA, 64 nt, Homo Sapiens
uccugucauuccucuaaaaauuucaugcaauauuagaauaaaguucauuucuacuucaaaaaca

SEQ ID NO: 194055 - RNA, 64 nt, Homo Sapiens
aggaaaagguccuugccuccaaguuuuccugauaagaauaaacguguccuucuaccuugaauag

SEQ ID NO: 194056 - RNA, 64 nt, Homo Sapiens
guuacuaaugcuguuguauucuuuuaucacuuugagaauaaaaauguaaaguauauguuaaaug

SEQ ID NO: 194057 - RNA, 64 nt, Homo Sapiens
aaaaggugauuuucuacauaggauggccuucuuaagaauaaagccuuagaucuacuuuuaaaac

SEQ ID NO: 194058 - RNA, 64 nt, Homo Sapiens
cuaagaauuaaaaguuugauuguuuucauuuaccagaauaaaaaaauucuuuuugauuauuuuu

SEQ ID NO: 194059 - RNA, 64 nt, Homo Sapiens
aauuaauguuuuacuuaauuucugauaauagugcagaauaaauguacggaaaaauuagaaaaau

SEQ ID NO: 194060 - RNA, 64 nt, Homo Sapiens
auuucauagccuguaucuauaagcugcuacaaauagaauaaagaguguuuggcugcaccugcau

SEQ ID NO: 194061 - RNA, 64 nt, Homo Sapiens
acuugaaaggaaacaagacugacuguuccauagcagaauaaagcaagcuuuacaucuucauuuu

SEQ ID NO: 194062 - RNA, 64 nt, Homo Sapiens
caagaaugcaauccuauucacaauugccacaaaaagaauaaaauaccuaggaauacagcuaacc

SEQ ID NO: 194063 - RNA, 64 nt, Homo Sapiens
auccuacacccacagaacccggcuuuguccccaaagaauaaaaacaccucucuaaaagcugcuc

SEQ ID NO: 194064 - RNA, 64 nt, Homo Sapiens
uucuaaaauuacauguuucaaaauuuuuuuauugagaauaaauuuauuaaccauuauugagaau

SEQ ID NO: 194065 - RNA, 64 nt, Homo Sapiens
uuuuuauugagaauaaauuuauuaaccauuauugagaauaaauuugcuguuucugaguuauugu

SEQ ID NO: 194066 - RNA, 64 nt, Homo Sapiens
ugcagaacauuguaucacauuuuaguccagagauagaauaaaguugaauaaccuugacuuacac

SEQ ID NO: 194067 - RNA, 64 nt, Homo Sapiens
aauuuuaugugcuuucaucacaaauccaaaggaaagaauaaaaauuucuuaacacaacccagcg

SEQ ID NO: 194068 - RNA, 64 nt, Homo Sapiens
uuaaaaacuauugcagaaaaaucuuuuuuaaaccagaauaaacaagaaagaaaagaaaaagaaa

SEQ ID NO: 194069 - RNA, 64 nt, Homo Sapiens
caaucuaaauccagaaaaugaauauaaauaugugagaauaaaaaauguaaaauauuaaagcauu

SEQ ID NO: 194070 - RNA, 64 nt, Homo Sapiens
caguguuuccugaguagcaguuugaugauuaaaaagaauaaacaucuugcccaaagucauugau

SEQ ID NO: 194071 - RNA, 64 nt, Homo Sapiens
acucuuaaguugaucuaaugaccgcgcccagccaagaauaaaauugggauuacaggugugagcc

SEQ ID NO: 194072 - RNA, 64 nt, Homo Sapiens
ucucuaaggaaggcagagaccuggguugagccucagaauaaaagaucuucuuccaagaaaugca

SEQ ID NO: 194073 - RNA, 64 nt, Homo Sapiens
cauuacuuugaaucaaaaauuuauuuauauuucaagaauaaaguacuaagauugugcucaauac

SEQ ID NO: 194074 - RNA, 64 nt, Homo Sapiens
caucagccauucccuucuggagccucucacccucagaauaaagaucaaggguccacagggugcc

SEQ ID NO: 194075 - RNA, 64 nt, Homo Sapiens
acugcucaacaaaggguguuaggcugugagggccagaauaaacagggccuuuguggacuagcca

SEQ ID NO: 194076 - RNA, 64 nt, Homo Sapiens
caagugaaauuuucaccuaccaauuuugucuaucagaauaaacaguugcuucucaucuaaaaua

SEQ ID NO: 194077 - RNA, 64 nt, Homo Sapiens
uugaaaugguguuaaucugaaauagaguugccuaagaauaaaaacuguuucacuggaaaguguc

SEQ ID NO: 194078 - RNA, 64 nt, Homo Sapiens
guacuguauacuuuuccucauugucucauauuucagaauaaaaucaacugcauguuggauuaga

SEQ ID NO: 194079 - RNA, 64 nt, Homo Sapiens
aaccaaaucaugaaaauuauaauuugcuuuagccagaauaaagaaccgaaucugaaacuuuggg

SEQ ID NO: 194080 - RNA, 64 nt, Homo Sapiens
gauaaugccgggcaggccgggcacaguggcucacgccuguaauccaagcacuuggggaggccga

SEQ ID NO: 194081 - RNA, 64 nt, Homo Sapiens
aaaaauacaaaauuagucggguaugguggcacaugccuguaauuccagcugcuugggagccuga

SEQ ID NO: 194082 - RNA, 64 nt, Homo Sapiens
cucuugaaagauucaaccgggugugguggcucacgccuguaaucccagcacauugggaggccaa

SEQ ID NO: 194083 - RNA, 64 nt, Homo Sapiens
gaaaauagaaaauaggcuaggcacaguggcucacgccuguaaucucaacacuuugggaggccaa

SEQ ID NO: 194084 - RNA, 64 nt, Homo Sapiens
aaagucugaagcucggccaggugcgguggcucacgccuguaaucccaaaacuuuggaaggcuga

SEQ ID NO: 194085 - RNA, 64 nt, Homo Sapiens
cucuauaaaaguacaaaagggcaugauggcaggugccuguaaucucagcuacucaguaggcugg

SEQ ID NO: 194086 - RNA, 64 nt, Homo Sapiens
aaucugggaaggcaguagaauggccagcauuccugccuguaagucuucccaagacagaggcccg

SEQ ID NO: 194087 - RNA, 64 nt, Homo Sapiens
auaauacaaaaauuagcugggcgugguggcacaugccuguaaucccagcuacuugggaggcuga

SEQ ID NO: 194088 - RNA, 64 nt, Homo Sapiens
gaaaaaggaaacuaggccaggcgugguggcucacgccuguaaucccaacacuuugggaggccga

SEQ ID NO: 194089 - RNA, 64 nt, Homo Sapiens
aaauacaaaaaauuggccgggcgcagcggcucacgccuguaaucccagcacuuucggaggcaga

SEQ ID NO: 194090 - RNA, 64 nt, Homo Sapiens
aaauacaaaaaauuagccgggcgugguggcaccugccuguaaucccagcuacuugggaggcuga

SEQ ID NO: 194091 - RNA, 64 nt, Homo Sapiens
aauaugccuuaaaaggccgggcgcgguggcucacgccuguaaucccagcacuuugggaggccaa

SEQ ID NO: 194092 - RNA, 64 nt, Homo Sapiens
aaaaauacaaaauuagccaggcaugauggcacaugccuguaaucccagauacuugggaggcuga

SEQ ID NO: 194093 - RNA, 64 nt, Homo Sapiens
aagagauuugcuuuuucugggugcgguggcucaugccuguaaucccagcacuuugggaggccga

SEQ ID NO: 194094 - RNA, 64 nt, Homo Sapiens
aaguacaaaaaauuagccagucaugguggcacacgccuguaaucucagcuacucaggaggcuga

SEQ ID NO: 194095 - RNA, 64 nt, Homo Sapiens
uuaaagauuuuugaggccgggcacagugacucacgccuguaaccccagcacuuugggaggccga

SEQ ID NO: 194096 - RNA, 64 nt, Homo Sapiens
acuaaaaauacagaauuagccgggcauggugcaugccuguaaucccagcugcuugggaggcuga

SEQ ID NO: 194097 - RNA, 64 nt, Homo Sapiens
gauaagaugcucccggccgggcgcgguggcucacgccuguaaucccagcacuuugggaggccga

SEQ ID NO: 194098 - RNA, 64 nt, Homo Sapiens
aaagucaucuugccagccaggcgugguggaucacgccuguaaucccagcacucugggaggccaa

SEQ ID NO: 194099 - RNA, 64 nt, Homo Sapiens
uaaguacaaguuuaggcugggcgugguggcucacgccuguaaucccagcacuuugggaggccga

SEQ ID NO: 194100 - RNA, 64 nt, Homo Sapiens
gaaauacaaaaauuagcuggauauggugguaugugccuguaaucccagcuacuugggaggcuga

SEQ ID NO: 194101 - RNA, 64 nt, Homo Sapiens
uuauaagaccuuaaggcugggugcaguggcucacgccuguaaucccagcacuuugggaggcuga

SEQ ID NO: 194102 - RNA, 64 nt, Homo Sapiens
aaaauagaaaaauuagcugggcaugguggcaggagccuguaaucccagcuauucuggaggugga

SEQ ID NO: 194103 - RNA, 64 nt, Homo Sapiens
ccagcuacuugggaggcugaccaugguggcgggcgccuguaaucauacaaaaaaaauuagccag

SEQ ID NO: 194104 - RNA, 64 nt, Homo Sapiens
ccagcacugggaggccgagggcgcaguggcucacgccuguaaucaauuggcagugauuggccag

SEQ ID NO: 194105 - RNA, 64 nt, Homo Sapiens
ccagcacuuugggaggccaagcgcgguggcucacgccuguaaucaaaagcccauggcaggcugg

SEQ ID NO: 194106 - RNA, 64 nt, Homo Sapiens
ccagcuauucaggaggcugagcaucguggugggugccuguaaucaaaauacaaaaauuagccag

SEQ ID NO: 194107 - RNA, 64 nt, Homo Sapiens
ccaacacuuaggguggcugagcaugguggcucaugccuguaaucaaagauaaagucuaggccag

SEQ ID NO: 194108 - RNA, 64 nt, Homo Sapiens
aauacaacgauggauuuuaaguaaucuaggcuuugccuguaaaguuuuuucaauuucgguuuua

SEQ ID NO: 194109 - RNA, 64 nt, Homo Sapiens
ucagcuacucaggaggcugagcaugguggcacaugccuguaaucaaaauacaaaaauuauccgg

SEQ ID NO: 194110 - RNA, 64 nt, Homo Sapiens
ccggcuauucagaaggccgagcaugguggcaggugccuguaaucaaaauacaaaaauuagccag

SEQ ID NO: 194111 - RNA, 64 nt, Homo Sapiens
ccaguaguuugggaggccaagcgagguggcucacgccuguaaucaacaccuucauccaggcugg

SEQ ID NO: 194112 - RNA, 64 nt, Homo Sapiens
ccagcuacuagggaggcugagcaugguggccggcgccuguaaucaaacaaaaacaauuagcugg

SEQ ID NO: 194113 - RNA, 64 nt, Homo Sapiens
ccaccacuuuggaaagcugaacacaguggcucacgccuguaaucacauacaggaaacaggcggg

SEQ ID NO: 194114 - RNA, 64 nt, Homo Sapiens
ccagcacucugggaggccaacgggcacaccucaugccuguaaucaaaauuaugugaaaucugcc

SEQ ID NO: 194115 - RNA, 64 nt, Homo Sapiens
ucagcuacuugggaggcugagcgugguggcacucgccuguaaucaaaauacaaaaauuggcugg

SEQ ID NO: 194116 - RNA, 64 nt, Homo Sapiens
ggugucauugaggcagauauaaaaucuaguuacugccuguaaauagagaaaauugagaugugua

SEQ ID NO: 194117 - RNA, 64 nt, Homo Sapiens
ccagcacuuugggaggccgagccugguggcucacgccuguaaucaaacauuauuuuuaaaauua

SEQ ID NO: 194118 - RNA, 64 nt, Homo Sapiens
ccagcacuuugggaggcccagcaugguggcucacgccuguaaucgauuaacaaaauuaggccgg

SEQ ID NO: 194119 - RNA, 64 nt, Homo Sapiens
ccagcuacuugggaggcugagcgugguggcacacgccuguaaacaauacguaaaaauuagccag

SEQ ID NO: 194120 - RNA, 64 nt, Homo Sapiens
ccagcacuuugggagggcaagcgcuguggcucacgccuguaauccuuagcaccccgcaggcugg

SEQ ID NO: 194121 - RNA, 64 nt, Homo Sapiens
ccaacacuuugggaggcugaguguaguggcucaugccuguaaucaagaggauucaaaacgccac

SEQ ID NO: 194122 - RNA, 64 nt, Homo Sapiens
ccagcuacuugggaggcugagcacgguggugcaugccuguaaucaaauacaaaaaauuagccga

SEQ ID NO: 194123 - RNA, 64 nt, Homo Sapiens
ccaguacuugggaggccaaggcacgguggcucacgccuguaaucaaaauauaguuugaggccgg

SEQ ID NO: 194124 - RNA, 64 nt, Homo Sapiens
ccaacacuuugggaggccaagggugguggcucacgccuguaaucagauaaacggaagccggcug

SEQ ID NO: 194125 - RNA, 64 nt, Homo Sapiens
aaagcaggaaaccuucugcuacugccacaucucagccuguaagccucuuacugggagauugcaa

SEQ ID NO: 194126 - RNA, 64 nt, Homo Sapiens
ccagcuacacuggaggcugagcgugguaguacaugccuguaaucaaaagacaaaaauuagcugg

SEQ ID NO: 194127 - RNA, 64 nt, Homo Sapiens
ccagcacuuugggaggccaagcguggugggucacgccuguaaucuauaucaguuggugagccgg

SEQ ID NO: 194128 - RNA, 64 nt, Homo Sapiens
caagauacucaggaggcugagcgugguggugcaugccuguaaucagauacaaaaaauuagccgg

SEQ ID NO: 194129 - RNA, 64 nt, Homo Sapiens
ucagcacuuugggaggcugagcaugguggcucacgccuguaaucaaaaaaaaaaaagaggccag

SEQ ID NO: 194130 - RNA, 64 nt, Homo Sapiens
uaaauagcuaauacgaccggguacagugguucaugccuguaaucccagaacuucgggaggccga

SEQ ID NO: 194131 - RNA, 64 nt, Homo Sapiens
auauaaauaauuguggccgggugcaauggcucaugccuguaaucccagcacuuugggaggcuga

SEQ ID NO: 194132 - RNA, 64 nt, Homo Sapiens
aaaaguaaacaugcggcugggcgugguggcucaugccuguaaucccagcacuuugggaggcuga

SEQ ID NO: 194133 - RNA, 64 nt, Homo Sapiens
aaaaauacaaaacuagccggguauggugguacaugccuguaaucccagcuacucaggaggcuga

SEQ ID NO: 194134 - RNA, 64 nt, Homo Sapiens
ggaagagcaaauggggcugagugcaguggcucaugccuguaaucccagcacuuagggugccaau

SEQ ID NO: 194135 - RNA, 64 nt, Homo Sapiens
agauuuuaauaauuaguugggcguaguggugcaugccuguaaucccagcuacucuggagacagg

SEQ ID NO: 194136 - RNA, 64 nt, Homo Sapiens
auuaaauguugaccuagccagcgcaguggcucaugccuguaaucccagcacuuugggaggcuga

SEQ ID NO: 194137 - RNA, 64 nt, Homo Sapiens
aaaaauacaaaauuagcugggcaugguggugcaugccuguaauuccagcuacucgggaggcuga

SEQ ID NO: 194138 - RNA, 64 nt, Homo Sapiens
uaugacuuguaguaagccgggcgcgguggcucacgccuguaaucccaacacuuugggaggccaa

SEQ ID NO: 194139 - RNA, 64 nt, Homo Sapiens
aaaauguuaacgugggcugggcaugguggcucaugccuguaaucccagcacucugggaggcuga

SEQ ID NO: 194140 - RNA, 64 nt, Homo Sapiens
aauuucucauuuggagccgggcgcaguggcucacgccuguaaucccagcacuuugggaggccaa

SEQ ID NO: 194141 - RNA, 64 nt, Homo Sapiens
aaaauacaaaaauuagccaggcgugguggcuggcgccuguaaucccagcuacucaggagguuga

SEQ ID NO: 194142 - RNA, 64 nt, Homo Sapiens
uuuuaaauguuuuuggccgggcgugguggcucaugccuguaaucucaguacauugggaggccaa

SEQ ID NO: 194143 - RNA, 64 nt, Homo Sapiens
aaauacaaaaaauuggccgggcgugauggugggcgccuguaaucccagccacuccagaggcuga

SEQ ID NO: 194144 - RNA, 64 nt, Homo Sapiens
ccagcuacuugggaggcugagcaugauggugguggccuguaaucaauauacaaaaauuagccgg

SEQ ID NO: 194145 - RNA, 64 nt, Homo Sapiens
cuagcacuuugggaggccaagcaugguggcuuacgccuguaaucuaaauacaucaucuggccag

SEQ ID NO: 194146 - RNA, 64 nt, Homo Sapiens
cacaugcagugagaggccucgcccucauccuuaugccuguaacaagcaagucacaccugccagu

SEQ ID NO: 194147 - RNA, 64 nt, Homo Sapiens
accugugcagccuuuugugggaccuuccuacuuggccuguaaucagaugccugggugugccaca

SEQ ID NO: 194148 - RNA, 64 nt, Homo Sapiens
caacuacccaggaggcugagacgugguggugggugccuguaaucaaaauacaaaaauuagccag

SEQ ID NO: 194149 - RNA, 64 nt, Homo Sapiens
ccagcauuuugggaggcugagugccguggcucacgccuguaaucaguggcuuuuugggggcugg

SEQ ID NO: 194150 - RNA, 64 nt, Homo Sapiens
ccagcuacuugggaggcugagcgugguagugcgugccuguaaucaaaaacacaaaauuagcugg

SEQ ID NO: 194151 - RNA, 64 nt, Homo Sapiens
ccaacacuuugggaggccgagcgcgguggcucacgccuguaaucugaagguguuuccaggccag

SEQ ID NO: 194152 - RNA, 64 nt, Homo Sapiens
ucagcacuuugggaggcugagcuuaguggcucacgccuguaaucuuuaaaaacuagagggcuag

SEQ ID NO: 194153 - RNA, 64 nt, Homo Sapiens
ccagcuacucaggaggcugagugugguggcgggugccuguaaucaaauacaaaaaauuaguugg

SEQ ID NO: 194154 - RNA, 64 nt, Homo Sapiens
ccaguacuuugggaggccgagcaugguggcucacgccuguaaucuauaaaaugguguaggccgg

SEQ ID NO: 194155 - RNA, 64 nt, Homo Sapiens
ccagcuacucaggaggcugaguguggagguacaugccuguaaucaaaauacaaaaauuagccag

SEQ ID NO: 194156 - RNA, 64 nt, Homo Sapiens
ccagcacuuugggaggccaugcaugguggcucacgccuguaaucaaugcuaaaacuuuggcugg

SEQ ID NO: 194157 - RNA, 64 nt, Homo Sapiens
uauuauagacaauagauugcaugacucgggaauugccuguaaauuauacuuaauauuaccucca

SEQ ID NO: 194158 - RNA, 64 nt, Homo Sapiens
uuuuuuucugaguuucuucuaagcaugagguggggccuguaauaauuggccucuuagaugauau

SEQ ID NO: 194159 - RNA, 64 nt, Homo Sapiens
agaaaugaaagcggggccaggcgcgguggcucgugccuguaaucccagcacuuugggaggcuga

SEQ ID NO: 194160 - RNA, 64 nt, Homo Sapiens
aaaacacaaaaauuagccaggcaugguggcgcaugccuguaaucccagcuacuagagaggcuga

SEQ ID NO: 194161 - RNA, 64 nt, Homo Sapiens
uaauuaaaagugugggcugggcgugggggcucaugccuguaaucccagcacuuugggaggccga

SEQ ID NO: 194162 - RNA, 64 nt, Homo Sapiens
aaaauacaaaaauuagccaggcgugauggcaggugccuguaauccuagcuacuuggcaggcuaa

SEQ ID NO: 194163 - RNA, 64 nt, Homo Sapiens
aaauugagcaucugggccgggcaugguggcucacgccuguaaucccagcacucugggaggucga

SEQ ID NO: 194164 - RNA, 64 nt, Homo Sapiens
aaauacagaaaauuagcugggcaugguggugugugccuguaauuccagcuacucgggaggcuga

SEQ ID NO: 194165 - RNA, 64 nt, Homo Sapiens
ccagcuacucuggcugcugagagugguggcauaggccuguaauuaauacaaaaaaauuagcugg

SEQ ID NO: 194166 - RNA, 64 nt, Homo Sapiens
cuagcaccuugggggucaaggcacgguggcucacgccuguaaucugaaaguggaucucagcugg

SEQ ID NO: 194167 - RNA, 64 nt, Homo Sapiens
ccagcacuguaggcggccgagugcgguggcucaugccuguaaucguaguugaaauucuaggccg

SEQ ID NO: 194168 - RNA, 64 nt, Homo Sapiens
ccagcacuaugggaggccaggugcgguggcucaugccuguaaucaaaaucaagcuuugggccag

SEQ ID NO: 194169 - RNA, 64 nt, Homo Sapiens
cuagcuacucaggaggcugaaccugguggcgcaugccuguaaucuacaaaaaaaaauuagcugg

SEQ ID NO: 194170 - RNA, 64 nt, Homo Sapiens
ccaccacuuugggagggugagcaugguggcucaugccuguaaucauuccaugaaucuuggccag

SEQ ID NO: 194171 - RNA, 64 nt, Homo Sapiens
ccagcuacuugggacacugagugcgguggcaggugccuguaaucaaaauacaaaaauuagcugg

SEQ ID NO: 194172 - RNA, 64 nt, Homo Sapiens
ucagcacuuugggaggcugaaacuuacagcucacgccuguaauccccugcugggauuuuaauag

SEQ ID NO: 194173 - RNA, 64 nt, Homo Sapiens
aaaaaaaugucaauagccaggcauaguggcucacgccuguaaucccagcacuuuaggaggccaa

SEQ ID NO: 194174 - RNA, 64 nt, Homo Sapiens
aaaacacaaaaauuagucaggcgugguagugggugccuguaaucccagcuacucgggaggcuaa

SEQ ID NO: 194175 - RNA, 64 nt, Homo Sapiens
uuuuguuuauaauuggccuggugugguggcccacgccuguaaucccagcacuuugggaggccga

SEQ ID NO: 194176 - RNA, 64 nt, Homo Sapiens
aaaauacaaaaauuagcugggugugguggcgugugccuguaaucccagcuacuugggaggcuga

SEQ ID NO: 194177 - RNA, 64 nt, Homo Sapiens
aaaaauugcuuguaggcugagcgcgguggcucacgccuguaaucccagcacuuugggaggccaa

SEQ ID NO: 194178 - RNA, 64 nt, Homo Sapiens
aaaauacaaaaauuagccggacgcaguggcacgcgccuguaaucccagcuacucaagaggcuga

SEQ ID NO: 194179 - RNA, 64 nt, Homo Sapiens
aguaagaaguuacuggccaggagcggcggcucaugccuguaaucccaggacuuugguaggccaa

SEQ ID NO: 194180 - RNA, 64 nt, Homo Sapiens
aaaauacaaaaauuagcugggcaugguggcaggcgccuguaaucccagcuacucaggaggcuga

SEQ ID NO: 194181 - RNA, 64 nt, Homo Sapiens
ggcuuaaauuccauuuuauuaaaaaaaaaaaauugccuguaaucccagcacuucaggaggccga

SEQ ID NO: 194182 - RNA, 64 nt, Homo Sapiens
gacaaugauuuuuaaagcauuggaaaaauauuuugccuguaaaaguuaguaacuaggugguuca

SEQ ID NO: 194183 - RNA, 64 nt, Homo Sapiens
ccagcacuuugggaggcucagugugguggcucacgccuguaaucauaagaaaauuugaggccgg

SEQ ID NO: 194184 - RNA, 64 nt, Homo Sapiens
caccugggaaguuccacugguucuacgcccccuugccuguaaaaaaaccaucacauuuuuuucu

SEQ ID NO: 194185 - RNA, 64 nt, Homo Sapiens
cuagcuacuugggagucugagcgugguggcgcaugccuguaaucaauacaaaaaaauuagcugg

SEQ ID NO: 194186 - RNA, 64 nt, Homo Sapiens
ccaguacuuugggaggccgagugugguggcuuaugccuguaaucaagauaaaaaucagggcagg

SEQ ID NO: 194187 - RNA, 64 nt, Homo Sapiens
acauaaaaauugauggccaggcaugguggcucacgccuguaaucccagaacuaugugaggcuga

SEQ ID NO: 194188 - RNA, 64 nt, Homo Sapiens
aaaauacaaaaauuagccgggcauggugguaggggccuguaacccagcuacucgugaggccaag

SEQ ID NO: 194189 - RNA, 64 nt, Homo Sapiens
aaauuauguaacucggccggguacaauggcucacgccuguaauccuaacacuuugggaggccga

SEQ ID NO: 194190 - RNA, 64 nt, Homo Sapiens
uuacaaaaaaaauuauccaggcgugguggugcacgccuguaaucccagcuacucaggaggcuaa

SEQ ID NO: 194191 - RNA, 64 nt, Homo Sapiens
auaaaaucaagauaguccggacgcgguggcacaugccuguaaucccagcacuuugggaggcuga

SEQ ID NO: 194192 - RNA, 64 nt, Homo Sapiens
aaaacacaaaaauuagccaggcuugguggcuggcgccuguaauuccagcuacucagaaggcuga

SEQ ID NO: 194193 - RNA, 64 nt, Homo Sapiens
ugaguuaauguccgggcuggucacagugguucaugccuguaaucccagcacuuugggaguccaa

SEQ ID NO: 194194 - RNA, 64 nt, Homo Sapiens
aaaauacaaaaaugagcccgguauguuggcauaugccuguaaucccagcuacucgagaggcuga

SEQ ID NO: 194195 - RNA, 64 nt, Homo Sapiens
ccagcuacucaggaggcugaacaugguggcacgugccuguaaucaaaauacaaaaauuagcugg

SEQ ID NO: 194196 - RNA, 64 nt, Homo Sapiens
ccagcauuuugggaggccgagcacgguggcucacgccuguaaucaaucgcacaaagcaggccag

SEQ ID NO: 194197 - RNA, 64 nt, Homo Sapiens
ccagauacucaggaggcugagcguggugacgggcgccuguaaucaaauacaaaaaauuagcugg

SEQ ID NO: 194198 - RNA, 64 nt, Homo Sapiens
ccagcacuuuggggggcugagcacgguggcucaugccuguaaucgaaaaaugcgaagcggccgg

SEQ ID NO: 194199 - RNA, 64 nt, Homo Sapiens
ccagcuacucaggaggcugagcgugguggcacaugccuguaaucaaacacaaaaaauuagccgg

SEQ ID NO: 194200 - RNA, 64 nt, Homo Sapiens
ccagcacuuugggagguggggcacgguggcucacgccuguaaucuauaaaaauaccccggccag

SEQ ID NO: 194201 - RNA, 64 nt, Homo Sapiens
aaugguuugggauaggcugggugccgugggucacgccuguaaucccagcacuuugggaggcuga

SEQ ID NO: 194202 - RNA, 64 nt, Homo Sapiens
aaaauacagaaauuagcugggugugguugcacacgccuguaaucccagcuacucaggaggcuga

SEQ ID NO: 194203 - RNA, 64 nt, Homo Sapiens
auuaaaagggauagggccaggcacaguggcuuaugccuguaauugcagcacuuuuagaggccga

SEQ ID NO: 194204 - RNA, 64 nt, Homo Sapiens
aaaacuuucaucuaggccacgugcgguggcucaugccuguaaucccggcacuuugggaggccug

SEQ ID NO: 194205 - RNA, 64 nt, Homo Sapiens
aauauacaaaaauuaguuggguguuauggugcaugccuguaaucccagcuacucgggaggcuga

SEQ ID NO: 194206 - RNA, 64 nt, Homo Sapiens
uagaaagcaacugaggccaggugcgguggcucacgccuguaaucccagcacuuugggaggccga

SEQ ID NO: 194207 - RNA, 64 nt, Homo Sapiens
gggagcucaaucuuggccgggcgccguggcucacgccuguaaucgcagcacuuugggaggccga

SEQ ID NO: 194208 - RNA, 64 nt, Homo Sapiens
cuuugaaaagaccgugcugggcgcgguggcucuugccuguaaucccagcacuuugggaggcuga

SEQ ID NO: 194209 - RNA, 64 nt, Homo Sapiens
aagaacacaaaauuagcugggcaugguggugcaugccuguaaucccagcuacuugggaggccga

SEQ ID NO: 194210 - RNA, 64 nt, Homo Sapiens
gcaaggccuguuuaggccgguugcgguggcucaugccuguaauccuagcacuuugggaggcuga

SEQ ID NO: 194211 - RNA, 64 nt, Homo Sapiens
aaaauacaaaaguuagcugggugugguggcagaggccuguaaucccagcuccuugggaggcuga

SEQ ID NO: 194212 - RNA, 64 nt, Homo Sapiens
uuagcuaugguuugcauuuaguacauggcagauugccuguaagucuguucauuuuaacaacaua

SEQ ID NO: 194213 - RNA, 64 nt, Homo Sapiens
uuaacaacauacagggcugggcacgguggcucacgccuguaaucccagcacuuugggagguugc

SEQ ID NO: 194214 - RNA, 64 nt, Homo Sapiens
ccagcacuuugggggccaaggugugguggcucaugccuguaauccaaaaacugaaguuagcugg

SEQ ID NO: 194215 - RNA, 64 nt, Homo Sapiens
ccagcuacccaggaaggcuggcguggugaugcgugccuguaaucaaaaauacaaaaguagccgg

SEQ ID NO: 194216 - RNA, 64 nt, Homo Sapiens
ccagcacuuugggaggcugagcaugguggcucaugccuguaaucgaaacaagguuaauagccag

SEQ ID NO: 194217 - RNA, 64 nt, Homo Sapiens
ccagaacuuugggaggccaagcacaguggcgcaugccuguaaucaagauucucugcccagccgg

SEQ ID NO: 194218 - RNA, 64 nt, Homo Sapiens
ccagcacuuugagaggcugagcacaguggcucacgccuguaaucaauuaccaagggguggccgg

SEQ ID NO: 194219 - RNA, 64 nt, Homo Sapiens
ccagcuacuugggaggcugagcuuggugguguaugccuguaaucaaaauacaaaaauuaaccag

SEQ ID NO: 194220 - RNA, 64 nt, Homo Sapiens
ccagcacuuugggaggugaggcaugguggcucaugccuguaaucaaguuccacaaccaggccgg

SEQ ID NO: 194221 - RNA, 64 nt, Homo Sapiens
ucacuacacaggaggcugagggcaugguggacucgccuguaaucaaaaauacacaaauuagcua

SEQ ID NO: 194222 - RNA, 64 nt, Homo Sapiens
cuagcaguuugggaggcugagcacaguggcucacgccuguaaucauuaugccuuuuuugaucag

SEQ ID NO: 194223 - RNA, 64 nt, Homo Sapiens
ccagcacuuugggaggccgagcgugguggcucacgccuguaaucaauuugaagugccuggcugg

SEQ ID NO: 194224 - RNA, 64 nt, Homo Sapiens
ccagcuacucagguggcugaguguguuggcacacgccuguaauaaaaauacaaaaauucacagg

SEQ ID NO: 194225 - RNA, 64 nt, Homo Sapiens
ccagcuacuugggaggcugaguguggugccgcgugccuguaaucaaaauagaaaaaucagcugg

SEQ ID NO: 194226 - RNA, 64 nt, Homo Sapiens
cagcuacucgggaggcugaggugugguggcaggcgccuguaaucaaaauacaaaauuuagcuga

SEQ ID NO: 194227 - RNA, 64 nt, Homo Sapiens
ccugcacuuugggaagccaagugugguggcuuaugccuguaaucaaagagaccucuggggccga

SEQ ID NO: 194228 - RNA, 64 nt, Homo Sapiens
ccagcacuuugggaggccgagcgcgguggcuuaugccuguaaucugaaagaauuuuggggccgg

SEQ ID NO: 194229 - RNA, 64 nt, Homo Sapiens
ccagcuacuuggaaggcugagagugguggugcaugccuguaaucaaaaauacaaaauuugcugg

SEQ ID NO: 194230 - RNA, 64 nt, Homo Sapiens
ccagcacuuugggaggccgagcacgguggcucacgccuguaaucauaugcacagucuaggccgg

SEQ ID NO: 194231 - RNA, 64 nt, Homo Sapiens
ccagcacuuugggaggcugaacgcgguggcucacgccuguaaucaaauguacauguauggcugg

SEQ ID NO: 194232 - RNA, 64 nt, Homo Sapiens
ccagcuacucgggaggcugggcaugguggugcgugccuguaaucaaaauacaaaaauuagcuug

SEQ ID NO: 194233 - RNA, 64 nt, Homo Sapiens
ccagcacuuugcaaggccgaucgugguggcucaugccuguaaucaagaagccccuucaggccag

SEQ ID NO: 194234 - RNA, 64 nt, Homo Sapiens
ucagcacuuugggaggccaagugagguggcucccgccuguaauccaggagucaagagaauuuau

SEQ ID NO: 194235 - RNA, 64 nt, Homo Sapiens
ccagcauuuugggaggcugagugcaguggcucacgccuguaaucaaaaaaaucuaugcagcugg

SEQ ID NO: 194236 - RNA, 64 nt, Homo Sapiens
ccugcuacuugggagccugagcgugguggcaggcgccuguaaugaaauacagaaaauuagcugg

SEQ ID NO: 194237 - RNA, 64 nt, Homo Sapiens
ccagcacuuugggaggcugagcacaguggcucaugccuguaaucgaaaauagaagguaggccgg

SEQ ID NO: 194238 - RNA, 64 nt, Homo Sapiens
cuguauuaaaagucugccgggcacaguggcucacgccuguaaucccaacacuuugggaggccaa

SEQ ID NO: 194239 - RNA, 64 nt, Homo Sapiens
aaguacaaaaaauuagcugggcgugguggcucaugccuguaaucccagcuacucaggaggcuga

SEQ ID NO: 194240 - RNA, 64 nt, Homo Sapiens
aaaauacaaaaauuagcugggcaugguggugcaugccuguaaucccagcuacucgggaggcuga

SEQ ID NO: 194241 - RNA, 64 nt, Homo Sapiens
gcuaauacccaucaggcugggugugguggcucacgccuguaauccuagcacuuugggaggccga

SEQ ID NO: 194242 - RNA, 64 nt, Homo Sapiens
aaaauaagguccagggccggacacaguggcccaugccuguaaucccagcacuuuggggggccaa

SEQ ID NO: 194243 - RNA, 64 nt, Homo Sapiens
aaaauacaaaaauuagccgggcaugguggugggcgccuguaaucccagcuacucagaaggcuga

SEQ ID NO: 194244 - RNA, 64 nt, Homo Sapiens
uaaucaguaaggccagcuagacccaauggcucaugccuguaaucccaacacuuugggaggccaa

SEQ ID NO: 194245 - RNA, 64 nt, Homo Sapiens
aaaauacaaaaauuagcugggcgugguggugcaugccuguaaucccagcuacucgggaggcuga

SEQ ID NO: 194246 - RNA, 64 nt, Homo Sapiens
ccagcauguugggaggccgagcgcaguggcucacgccuguaauuuuugaaaccagucucaccag

SEQ ID NO: 194247 - RNA, 64 nt, Homo Sapiens
ccagcacucugggaggcugaacgcaguggcucaugccuguaaucauaggggaagacugggccag

SEQ ID NO: 194248 - RNA, 64 nt, Homo Sapiens
ccagcuacucgggaggcugagcaugguggcacgugccuguaaucaaaauacaaaaauuagccag

SEQ ID NO: 194249 - RNA, 64 nt, Homo Sapiens
ccagcacuuuugggaggcuggugcaguggcucacgccuguaaucaaguuaugaaaaaaggccag

SEQ ID NO: 194250 - RNA, 64 nt, Homo Sapiens
ccagcugcucaggaggcugagcgugguggcacaugccuguaaucaauacagaaaaguuagccag

SEQ ID NO: 194251 - RNA, 64 nt, Homo Sapiens
ccagcacuuugggaggccgagcgugguggcuccugccuguaaucaaaaauggcuuccuggccgg

SEQ ID NO: 194252 - RNA, 64 nt, Homo Sapiens
aaaauggccauuaaggccgggugggguggcacaugccuguaaucccagcacuuugggaggccaa

SEQ ID NO: 194253 - RNA, 64 nt, Homo Sapiens
aaagaaagugugauggcugggugcaguggcucacgccuguaaucccagcacuuugggaggcuua

SEQ ID NO: 194254 - RNA, 64 nt, Homo Sapiens
aaagaacauuucuuggcugggcgcugcggcuugcgccuguaaucucagcacuuugggaggcuga

SEQ ID NO: 194255 - RNA, 64 nt, Homo Sapiens
aaaaaaaaaaauaaagccgggcgugguggcucacgccuguaaucccggcacuuugggaggcuga

SEQ ID NO: 194256 - RNA, 64 nt, Homo Sapiens
cuacaaaaaaaauuagccaggcgugguggcgggcgccuguaaucccagcuacucaggaggcuga

SEQ ID NO: 194257 - RNA, 64 nt, Homo Sapiens
guaccccauuuucaggccgggugugguggcucaugccuguaaucccagcacuuugggaggcgag

SEQ ID NO: 194258 - RNA, 64 nt, Homo Sapiens
aaaauacaaaaauuagccgggugguguggugggcgccuguaaucccagcuccucaggaggcuga

SEQ ID NO: 194259 - RNA, 64 nt, Homo Sapiens
ccaucaucuacucaggaggcgcgugguggugcaugccuguaaucaaaaauacaaaauuaccugg

SEQ ID NO: 194260 - RNA, 64 nt, Homo Sapiens
ccagcacuuugggaggccgagcacggcggcucacgccuguaaucgaaucucaagucaaggccag

SEQ ID NO: 194261 - RNA, 64 nt, Homo Sapiens
aauuguuugggcucuaaaagaugauggauuaaaagccuguaaaguaagggaauuaaguuuuggg

SEQ ID NO: 194262 - RNA, 64 nt, Homo Sapiens
ccagcacuuugggaagccaagugcaguagcucacgccuguaaucuaaaacauaaaguagaccag

SEQ ID NO: 194263 - RNA, 64 nt, Homo Sapiens
gaaacagcuuugggggccgggcgugguggcucacgccuguaaucccagcacuuugggaggccga

SEQ ID NO: 194264 - RNA, 64 nt, Homo Sapiens
auacaaaaaaaauuagcugagcgugguggcgggcgccuguaaucccagcuacuugggaggcuga

SEQ ID NO: 194265 - RNA, 64 nt, Homo Sapiens
uguguuauuugauaggccgggcaugguggcucaugccuguaaucccagcacuuugggaggccag

SEQ ID NO: 194266 - RNA, 64 nt, Homo Sapiens
auuauccaaagucaggcugggcgcaguggcucacgccuguaaucccagcacuuugggagggaua

SEQ ID NO: 194267 - RNA, 64 nt, Homo Sapiens
gguuaagauuguggggccgggcgagguggcucacgccuguaaucccagcacuuugggaggcuga

SEQ ID NO: 194268 - RNA, 64 nt, Homo Sapiens
ggaguacaaaaauuagccggccauaguggcucgugccuguaaucucagcuauuugggaggcuga

SEQ ID NO: 194269 - RNA, 64 nt, Homo Sapiens
aaugccaugaaucaagccagggccguuggcuuaugccuguaaucccagcacuuugcaggccgag

SEQ ID NO: 194270 - RNA, 64 nt, Homo Sapiens
aauauaaaaauguuggcugugcacgguagcuuaugccuguaaucucagcacuuugggaggccaa

SEQ ID NO: 194271 - RNA, 64 nt, Homo Sapiens
ccaacacuuuugggagguccaugcaguggcucaugccuguaaucgaaaauuagaagcaagcugg

SEQ ID NO: 194272 - RNA, 64 nt, Homo Sapiens
ccagcuacccaggaggcugagcgugguggcacgcgccuguaaucuaaaauuccacucaugccgg

SEQ ID NO: 194273 - RNA, 64 nt, Homo Sapiens
ccagcuacuugggaggcugagcgugguggcgggcgccuguaaucaaaauacaaaaauuagccgg

SEQ ID NO: 194274 - RNA, 64 nt, Homo Sapiens
ccagcacuuugagaggcugcgugcgguggcucaugccuguaaucgaaagacgggccugggcugg

SEQ ID NO: 194275 - RNA, 64 nt, Homo Sapiens
ccagcuacucgggaggcugagcaugguggcauuugccuguaaucaaaauacaaaaauuagccag

SEQ ID NO: 194276 - RNA, 64 nt, Homo Sapiens
ccagcacuuuggcaggccgauugcaguggcucacgccuguaaucaaaauauguacucuggccgg

SEQ ID NO: 194277 - RNA, 64 nt, Homo Sapiens
ccagcuauuugggaggcugagcgugguggcgugugccuguaaucaaaauacaagaauuagcugg

SEQ ID NO: 194278 - RNA, 64 nt, Homo Sapiens
ccagcacuuugggaggccaagcacaguggcucacgccuguaaucaagugacaauuguaggccag

SEQ ID NO: 194279 - RNA, 64 nt, Homo Sapiens
agaaauauggauggggccggccacaguggcucacgccuguaaucccagaacucuggaaggcuga

SEQ ID NO: 194280 - RNA, 64 nt, Homo Sapiens
aaaaauacaaaauuagccaggcgugguggcguacgccuguaaucccagcuacucaggaggcagg

SEQ ID NO: 194281 - RNA, 64 nt, Homo Sapiens
aaaaucaguaauuggaccaggcgcgguggcucuugccuguaaucccagcacuuugggaggccga

SEQ ID NO: 194282 - RNA, 64 nt, Homo Sapiens
aaaauacaaaaauuagccggggguggugacaugugccuguaaucccagcuacucaggaggcuaa

SEQ ID NO: 194283 - RNA, 64 nt, Homo Sapiens
aaaauggucaaaggggcugggcaugguggcucacgccuguaaucucagcacuuugggaggccga

SEQ ID NO: 194284 - RNA, 64 nt, Homo Sapiens
aaauaugaaacauuagccaggugugguggcacgcgccuguaaucccagcuacucgggaggcuga

SEQ ID NO: 194285 - RNA, 64 nt, Homo Sapiens
uuuaaaaaaaaaaagguugggcguuguggcucaugccuguaaucccagcacuuugggaggcuga

SEQ ID NO: 194286 - RNA, 64 nt, Homo Sapiens
aaaauacaaaaauuagcugagcaugguggcgugugccuguaaucucagcuacucaggaggcuga

SEQ ID NO: 194287 - RNA, 64 nt, Homo Sapiens
uuuacacaaagggaagucgggcaugguggcucaugccuguaaucucagcacuuugggaggcuga

SEQ ID NO: 194288 - RNA, 64 nt, Homo Sapiens
aaaaaaaacuuuagaacugggugcaguggcucaugccuguaaucccagccagcacuuugggagg

SEQ ID NO: 194289 - RNA, 64 nt, Homo Sapiens
aaaaaaaaaaauugggccaggcacgguggcucacgccuguaaucccagcacuuugggaggccaa

SEQ ID NO: 194290 - RNA, 64 nt, Homo Sapiens
aauaauacaaaauuagccaggcgugguggcgcaugccuguaaucccagcuacucgggaggcuga

SEQ ID NO: 194291 - RNA, 64 nt, Homo Sapiens
ccagcuacuugggaagcugagcgugguggcgggcgccuguaaucaaaaugcaaaaauuagccgg

SEQ ID NO: 194292 - RNA, 64 nt, Homo Sapiens
ccagcacuuugggaggccuaaugcgguggcucacgccuguaaucaugcacguagcugaggccgg

SEQ ID NO: 194293 - RNA, 64 nt, Homo Sapiens
ccagcuacucgggaggcugagcgugguggcacgugccuguaaucaaaauacaaaaauuagcugg

SEQ ID NO: 194294 - RNA, 64 nt, Homo Sapiens
ugagcacuuugggaagcugagcgcaguggcucaugccuguaaucauuuaucuuaguacugcugg

SEQ ID NO: 194295 - RNA, 64 nt, Homo Sapiens
ccagcuacucaggaggcugaggggugguggcagggccuguaauuaauagacaaaaauuagcggg

SEQ ID NO: 194296 - RNA, 64 nt, Homo Sapiens
cugacacuuugggagucugaguacgguggcuaacgccuguaaucaaaaacugggagcaggccag

SEQ ID NO: 194297 - RNA, 64 nt, Homo Sapiens
ccagcuacucaggaggcugagcaugguggcgcaagccuguaaucaaaaaaaaaaaaauagccgg

SEQ ID NO: 194298 - RNA, 64 nt, Homo Sapiens
ccagcaguuugggaggucgagcgcgguggcucacgccuguaaucagugggccaggacaggcccg

SEQ ID NO: 194299 - RNA, 64 nt, Homo Sapiens
ccagcuacucaggagguugggcaugguggccugugccuguaaacaaaauacaaaaauuagccga

SEQ ID NO: 194300 - RNA, 64 nt, Homo Sapiens
ccagcacuuugggaggccgagugcaguggcucacgccuguaauccucccagccuuugaggccgg

SEQ ID NO: 194301 - RNA, 64 nt, Homo Sapiens
ccagcacuuugggaggcugagcacgguggcucaugccuguaaucauuuagaaagcagcagucag

SEQ ID NO: 194302 - RNA, 64 nt, Homo Sapiens
ccagcuacuggggaggcugagcgugguggugcaugccuguaaucaaaaaaaaaaaauuagucgg

SEQ ID NO: 194303 - RNA, 64 nt, Homo Sapiens
ccagcauuuugggaggccaagcaugguggcucaugccuguaaucuaaagguugguguuggccag

SEQ ID NO: 194304 - RNA, 64 nt, Homo Sapiens
ccaucuucuugggaggcugagcaugguagcgcacgccuguaaucaaaaauauagaauuagccag

SEQ ID NO: 194305 - RNA, 64 nt, Homo Sapiens
ccagcacuuugggaggcugagcaccguggcucacgccuguaaucaauaagcacaugauggcugg

SEQ ID NO: 194306 - RNA, 64 nt, Homo Sapiens
ccagcacuuugggaggccgagcgcgguggcaaaugccuguaaucucaaaaaaaaaaauugccgg

SEQ ID NO: 194307 - RNA, 64 nt, Homo Sapiens
cagcuacuugggaggcugaggcgugguggugcaugccuguaaucaaaaauacaaaauuagccag

SEQ ID NO: 194308 - RNA, 64 nt, Homo Sapiens
ccagcacuuugggaggccaagcaugguggcucaugccuguaauuaaaaucaagcucuuggccag

SEQ ID NO: 194309 - RNA, 64 nt, Homo Sapiens
agcgaaguaaaagaggccgggugcgguggcucacgccuguaaucccaacacuuuaggaguccaa

SEQ ID NO: 194310 - RNA, 64 nt, Homo Sapiens
uaacaauaauauauggccaggcgggauggcucacgccuguaaucccagcacuuugggaggcuga

SEQ ID NO: 194311 - RNA, 64 nt, Homo Sapiens
aaaauacauaaaauuagccgggugcaguggugaggccuguaaucccagcuacucaggaggcuga

SEQ ID NO: 194312 - RNA, 64 nt, Homo Sapiens
aaaauacaaaaauuagccgggcgugguggcuuacgccuguaaucccagcacuuugggaggccaa

SEQ ID NO: 194313 - RNA, 64 nt, Homo Sapiens
agcaaaaaaaauuuagccaggcuuggucaugcaugccuguaauccuagcuacugggaaggcuga

SEQ ID NO: 194314 - RNA, 64 nt, Homo Sapiens
aaacugcuaugcaaggcugggugcuguggcucaugccuguaaucccagcacuuugggaggccaa

SEQ ID NO: 194315 - RNA, 64 nt, Homo Sapiens
auaauacaaaaauuagcugggcaugguggcgcaugccuguaaucccagcuacugggaaggcuga

SEQ ID NO: 194316 - RNA, 64 nt, Homo Sapiens
caaagaacuuuacagaaaucaagcgaauuagaaggccuguaagaguaagguuugcuaaaacgug

SEQ ID NO: 194317 - RNA, 64 nt, Homo Sapiens
gaaugggaccaggggaccuuuuggugcagugggugccuguaacucauuagacguacugaggcag

SEQ ID NO: 194318 - RNA, 64 nt, Homo Sapiens
cuagcaacucggggcugaggguguaguggcucaugccuguaaucuacaaguugacaguugcugg

SEQ ID NO: 194319 - RNA, 64 nt, Homo Sapiens
ccagcuacccaggaggcugagcgugguggcaugcgccuguaaucaaaauacaaaaauuagcugg

SEQ ID NO: 194320 - RNA, 64 nt, Homo Sapiens
cuagcacuuugggaggccgagcgcgguggcucacgccuguaaucaagaaaaaaaugcaggcugg

SEQ ID NO: 194321 - RNA, 64 nt, Homo Sapiens
ccagcuacuugggaggcugaguguaacggcggaugccuguaaucaaauacaaaaacuuagcugg

SEQ ID NO: 194322 - RNA, 64 nt, Homo Sapiens
cuagcauuuugggaggacgagugcgguggcucaugccuguaaucuaaaaaaguuugccggcuag

SEQ ID NO: 194323 - RNA, 64 nt, Homo Sapiens
uggauuguaauuuccuauaaaaugaaccuuugaggccuguaaagccaugggcuuugggccacag

SEQ ID NO: 194324 - RNA, 64 nt, Homo Sapiens
uuaggcgaaauggaagcagaacuucauauacaaagccuguaauuuuuuuugagaaguaaaauug

SEQ ID NO: 194325 - RNA, 64 nt, Homo Sapiens
uaaaagaauaaacaagcuaggugugguggcucaugccuguaauccuagcacuuugggaagccaa

SEQ ID NO: 194326 - RNA, 64 nt, Homo Sapiens
aauacaaaaaaacuagccggauaugguggcgggugccuguaaucucagcuacuugagaggcuga

SEQ ID NO: 194327 - RNA, 64 nt, Homo Sapiens
gguauuauuaagggauuuaaaguuuggguugcaugccuguaaucccagcauuuugggaggccga

SEQ ID NO: 194328 - RNA, 64 nt, Homo Sapiens
aaauacgaaaaauuagccaggcgugguggcgggcgccuguaaucccagcuacucgggaagcuga

SEQ ID NO: 194329 - RNA, 64 nt, Homo Sapiens
uuaaaaagauugacagccgggccugaugucucaagccuguaauccuagcacuuugggaggcaga

SEQ ID NO: 194330 - RNA, 64 nt, Homo Sapiens
aaaauacaaaaauuagcugggcgugguggcacacgccuguaaucccagcuacucaggaggcuga

SEQ ID NO: 194331 - RNA, 64 nt, Homo Sapiens
ccagcuacucaggaagcugaacgugguggcaugcgccuguaaucaaaaaagaaaaauuagccag

SEQ ID NO: 194332 - RNA, 64 nt, Homo Sapiens
ccagcacuuugggaggcugagugcaguggcucacgccuguaaucaauuagccugguaaggccgg

SEQ ID NO: 194333 - RNA, 64 nt, Homo Sapiens
ccagcuacucgcaaggcugagcaugguggcacgugccuguaaucaauacaaaaaaauuagccag

SEQ ID NO: 194334 - RNA, 64 nt, Homo Sapiens
ccagcgcuuugggaggcagagcgcgguggcucacgccuguaaucacaaaguuuguucugacagg

SEQ ID NO: 194335 - RNA, 64 nt, Homo Sapiens
aaaguuccuuucugggccgggcacaguggcucacgccuguaaucccagcacuuuggaaggccga

SEQ ID NO: 194336 - RNA, 64 nt, Homo Sapiens
uacaaaaaaaaauuagcugggcauaguggugggugccuguaaucccagcuacuugggaggcuga

SEQ ID NO: 194337 - RNA, 64 nt, Homo Sapiens
agaaauggguucugggccaggugugguggcucaagccuguaaucccagcacuuugggaggccga

SEQ ID NO: 194338 - RNA, 64 nt, Homo Sapiens
aaaauaaaaaaauuagcugggcgugguggugggcgccuguaaucccagcuacucgggagguuua

SEQ ID NO: 194339 - RNA, 64 nt, Homo Sapiens
uaaaagaggaagucagccaggcgcgguggcucaugccuguaaucccagcacuuugggaggccaa

SEQ ID NO: 194340 - RNA, 64 nt, Homo Sapiens
aauacaaaauuagccgggcauugugguggugcaugccuguaaucccagcuacucgggaagcuga

SEQ ID NO: 194341 - RNA, 64 nt, Homo Sapiens
caaagcuagaucucagcugggugcgauggcucacgccuguaaucccggcacuuugggaggccaa

SEQ ID NO: 194342 - RNA, 64 nt, Homo Sapiens
aaaauacaaaaacuagccaggaaugguggcgcgcgccuguaaucccaguuacuuaggaggcuga

SEQ ID NO: 194343 - RNA, 64 nt, Homo Sapiens
ccagcugcucaggaggcugacgggcguggugggcgccuguaauccuacuaaaaauacaaaaagc

SEQ ID NO: 194344 - RNA, 64 nt, Homo Sapiens
ccagcacuuugggaggcugagcgugguggcucacgccuguaaucaaaacucagaacguggccgg

SEQ ID NO: 194345 - RNA, 64 nt, Homo Sapiens
ccagcuacucaggaggaugagcaugguggugugugccuguaaucauaaaaaaauuauuagcugg

SEQ ID NO: 194346 - RNA, 64 nt, Homo Sapiens
ccagcacuuugagaggccuggucugguggcucaugccuguaaucaaaugccuaacacaggccgg

SEQ ID NO: 194347 - RNA, 64 nt, Homo Sapiens
guaagcuuacccagcccggcgcacagugacucacgccuguaaucccagcacuuugggagggcga

SEQ ID NO: 194348 - RNA, 64 nt, Homo Sapiens
aaaauacaaaaauuaacugggugugguggcgggcgccuguaaucccagcuacugagggggcuga

SEQ ID NO: 194349 - RNA, 64 nt, Homo Sapiens
aaaaaucucaaagcgauuggaccuagcagcucaugccuguaaucuccagcacuuugggaggcgg

SEQ ID NO: 194350 - RNA, 64 nt, Homo Sapiens
aaaauggaauuggaggccgggcgcaguggcucacgccuguaaucccagcacuuugggaggccaa

SEQ ID NO: 194351 - RNA, 64 nt, Homo Sapiens
aaaauacaaaaauuagccaggugugauggugcaugccuguaaucccagcuccucaguaggcuga

SEQ ID NO: 194352 - RNA, 64 nt, Homo Sapiens
ucucuacaaaaaauauacaggcguguuagcaugugccuguaaucccagcuucuugggaagcuga

SEQ ID NO: 194353 - RNA, 64 nt, Homo Sapiens
gagaaggaagucugggcugggcaugguggcucacgccuguaacccuagcacuuuaggaaaucga

SEQ ID NO: 194354 - RNA, 64 nt, Homo Sapiens
uaauauuccuucuuggcugggugcaguaguuuacgccuguaaucccagcacugugggaggccga

SEQ ID NO: 194355 - RNA, 64 nt, Homo Sapiens
aaaaauacaaaauuagccaggugugguggugcaugccuguaaucccagcuacucgggaggcuga

SEQ ID NO: 194356 - RNA, 64 nt, Homo Sapiens
ccagcuacucgggaggccaagcaugguggcaggcgccuguaaucaaaauacaaaaauuagccag

SEQ ID NO: 194357 - RNA, 64 nt, Homo Sapiens
ccagcauuuugggaggcugagcgcaguggcucaugccuguaaucucuuuaaaacucucggcugg

SEQ ID NO: 194358 - RNA, 64 nt, Homo Sapiens
ccaacacuuugggaggcuaagcaugguggcucaugccuguaaucauagaagaagaaaaggccgg

SEQ ID NO: 194359 - RNA, 64 nt, Homo Sapiens
ucagcacuuugggaggccaagcaugguggcucacgccuguaaucauaaaaaucuugagggccgg

SEQ ID NO: 194360 - RNA, 64 nt, Homo Sapiens
ccaccuacucgagaggcugagcaugguggaaugugccuguaaucaaaauacaaaaauuagccgg

SEQ ID NO: 194361 - RNA, 64 nt, Homo Sapiens
ccagcuacucgggaggcuaagcgugguggugcaggccuguaaucaaaaauacaaauuuagccgg

SEQ ID NO: 194362 - RNA, 64 nt, Homo Sapiens
ccagcacuuugggaggccgagcgcgguggcucacgccuguaaucguagaauaccuucaggccag

SEQ ID NO: 194363 - RNA, 64 nt, Homo Sapiens
aagaaaugugacuuggccgggcgcgguggcucacgccuguaaucccagcacuuugggaggccaa

SEQ ID NO: 194364 - RNA, 64 nt, Homo Sapiens
aaaaauacaaaauuagccagguguggugguacaugccuguaaucccagcuacuagggaggcuga

SEQ ID NO: 194365 - RNA, 64 nt, Homo Sapiens
aagaacaaaaagaaagccgggcaugacggcucaugccuguaaucccagcacuuugggaggcuga

SEQ ID NO: 194366 - RNA, 64 nt, Homo Sapiens
caauuagccagguguggcggcguaaucccagcuggccuguaaucccagcuacuugggaggcuga

SEQ ID NO: 194367 - RNA, 64 nt, Homo Sapiens
uauuaaaggaaucaggccaggcacaguggcucacgccuguaaucucagcacauugggaggcuga

SEQ ID NO: 194368 - RNA, 64 nt, Homo Sapiens
aaaauacaaaaauuagcuaggcgggguagugcaugccuguaaucccagcuacucaggaggcuga

SEQ ID NO: 194369 - RNA, 64 nt, Homo Sapiens
uaaaaaaaaaauuguagcacugggcguggugcaugccuguaaucccagccacucaggaggcuga

SEQ ID NO: 194370 - RNA, 64 nt, Homo Sapiens
aagauaaaaaaauuagcugaguguguuggugggugccuguaauccagcuacuugggagacugag

SEQ ID NO: 194371 - RNA, 64 nt, Homo Sapiens
aauuaaaagaauuuggccgggugcggcagcucaugccuguaaucccaacacuuugggaggcuga

SEQ ID NO: 194372 - RNA, 64 nt, Homo Sapiens
aggaucuuggggagguggccgggugcaguggcucgccuguaaucccagcacuuugggaggccga

SEQ ID NO: 194373 - RNA, 64 nt, Homo Sapiens
aaaagaaaaaaaauagccgggcgugguggcaggcgccuguaaucccagcuacuggggaggcuga

SEQ ID NO: 194374 - RNA, 64 nt, Homo Sapiens
guaaauaguauauaaaauagcucugguggcucaugccuguaauccagcacuuugggaggccaag

SEQ ID NO: 194375 - RNA, 64 nt, Homo Sapiens
uaaaaauacaaaaauuagccaggugguggcacacgccuguaaucccagcuacucaggaggcuga

SEQ ID NO: 194376 - RNA, 64 nt, Homo Sapiens
ccagcacuuugggaggccgagugcgguggcucaagccuguaaucaaaaaaaaauaagaggccgg

SEQ ID NO: 194377 - RNA, 64 nt, Homo Sapiens
ccagcacuuugggaggcuaaguaugguggcucacgccuguaaucaaagagguuuugcuggccag

SEQ ID NO: 194378 - RNA, 64 nt, Homo Sapiens
ccagcuacucaggaggcugagcgugguggcgcaugccuguaauccuacuaaaaauacaagccgg

SEQ ID NO: 194379 - RNA, 64 nt, Homo Sapiens
ccagcacuuugggaagcccagcauguuggcucccgccuguaaucuaaagcccauucuuggccgg

SEQ ID NO: 194380 - RNA, 64 nt, Homo Sapiens
ccagcuacucgggaggcuaagcgugguggcccacgccuguaaucaaaauacaaaaauuagccgg

SEQ ID NO: 194381 - RNA, 64 nt, Homo Sapiens
ccagcacuuugggaggccaaacgugguggcucacgccuguaaucaaaaaccuuccccaggcugg

SEQ ID NO: 194382 - RNA, 64 nt, Homo Sapiens
ccagcuacuccagaggcugacaugaugggggucugccuguaaugaaguacgaaacuuagccagg

SEQ ID NO: 194383 - RNA, 64 nt, Homo Sapiens
ccagcacuuugggaggcugagugugguggcucaugccuguaaucaaaacccaagagcuggccag

SEQ ID NO: 194384 - RNA, 64 nt, Homo Sapiens
ccagcuacuuuggaggcugagcaugguugcgcaugccuguaaucaaauuacaaaaauuagcugg

SEQ ID NO: 194385 - RNA, 64 nt, Homo Sapiens
ccagcacuuugggaggccgagcuugguggcuuaugccuguaaccaauagaagaaggucggccgg

SEQ ID NO: 194386 - RNA, 64 nt, Homo Sapiens
uuuuucuccacccaaacccccccuguggugaugugccuguaaucucuucucuccacuucugguc

SEQ ID NO: 194387 - RNA, 64 nt, Homo Sapiens
ccagcacuuugggaggccaagcgcgguggcucacgccuguaaucagaaagcccaccugggcugg

SEQ ID NO: 194388 - RNA, 64 nt, Homo Sapiens
uuaagaaaaggcugggccaggcacgauggcucacgccuguaaucccagacuuugggaggccgag

SEQ ID NO: 194389 - RNA, 64 nt, Homo Sapiens
aaaauacaaaaauuagccaggcgugguggcaggugccuguaaucccagcuacuugggaggcuga

SEQ ID NO: 194390 - RNA, 64 nt, Homo Sapiens
aaaaauaaaaaauaaucagggcacaguggcucaugccuguaaucccagcacucugggaggcuga

SEQ ID NO: 194391 - RNA, 64 nt, Homo Sapiens
aaaauacaaaaauuagccgggcaugguggugcaugccuguaaucccagcuacucgggaggcuga

SEQ ID NO: 194392 - RNA, 64 nt, Homo Sapiens
aacaugcacggugaggccgggcgcaguggcucacgccuguaaucccagcacuuugggaggccga

SEQ ID NO: 194393 - RNA, 64 nt, Homo Sapiens
aaaaaaugaauuuggccagacacaggugccucacgccuguaaucccagcacuuugggaggcuga

SEQ ID NO: 194394 - RNA, 64 nt, Homo Sapiens
auaagauaaggagaggccaggccugguggcucacgccuguaaucccagcacuuuaagaggccaa

SEQ ID NO: 194395 - RNA, 64 nt, Homo Sapiens
aaaauacaaaaauuagcugggcuugguggcuggcgccuguaaucccagcuacucaggagacuga

SEQ ID NO: 194396 - RNA, 64 nt, Homo Sapiens
uaauuaaacucgcaggccaggcacgguggcucaugccuguaaucccagcacuuugggaggccaa

SEQ ID NO: 194397 - RNA, 64 nt, Homo Sapiens
aaaauacaaaaauuagccgggcgugguggcggccgccuguaaucccagcuacuugggaggcuga

SEQ ID NO: 194398 - RNA, 64 nt, Homo Sapiens
aaaacugaccaucgggccgggggcgguggcucacgccuguaaucccaacacuuugggagcccga

SEQ ID NO: 194399 - RNA, 64 nt, Homo Sapiens
aguggagauguuggggccaggcacaguggcccaggccuguaaucccaucacuuugggaggugca

SEQ ID NO: 194400 - RNA, 64 nt, Homo Sapiens
uuuuuaaaacugguggcugggcgugguggcucacgccuguaaucccagcacuuugggaggccga

SEQ ID NO: 194401 - RNA, 64 nt, Homo Sapiens
aaaacuuaaaaguuagccaggccugguggcacaugccuguaauccgagugcuuugggaggcuga

SEQ ID NO: 194402 - RNA, 64 nt, Homo Sapiens
caaaccuugagauaggcugggugcgguggcucacgccuguaaucccaacacuuugggaggccga

SEQ ID NO: 194403 - RNA, 64 nt, Homo Sapiens
aaaaauacaaaauuagccgggugugguggcacaugccuguaaucccagcuacuccggaagcuga

SEQ ID NO: 194404 - RNA, 64 nt, Homo Sapiens
aaaaaagaaaauuaggcugagagcaguggcucacgccuguaaucccagaacuuugggaggcuaa

SEQ ID NO: 194405 - RNA, 64 nt, Homo Sapiens
aaauacaaaaaauuaacugggcaugguagugggugccuguaaucccagcuacuugggaggcuga

SEQ ID NO: 194406 - RNA, 64 nt, Homo Sapiens
uauaagaaauuuagggcagggcacgguggcucacgccuguaauuccagcacuuugggaggccga

SEQ ID NO: 194407 - RNA, 64 nt, Homo Sapiens
aaaaauacaaaaauuagcuggaugugguggcagugccuguaaucccagcuauuugggaggcuga

SEQ ID NO: 194408 - RNA, 64 nt, Homo Sapiens
cagcuacucaggaggcugagacgugguggugccugccuguaaucaaaauacaaaaauuagccgg

SEQ ID NO: 194409 - RNA, 64 nt, Homo Sapiens
ccagcacuuugggaggccaagcgugguggcucucgccuguaaucacucacgaagcagaggcugg

SEQ ID NO: 194410 - RNA, 64 nt, Homo Sapiens
ccagcuacucaggaggcugaaugugauggcacaugccuguaaucuuugguacaaaauuacccgg

SEQ ID NO: 194411 - RNA, 64 nt, Homo Sapiens
ccagcacuuagggugggcaagcacaguggcucacgccuguaaucuuaaaaguacaugaggcugg

SEQ ID NO: 194412 - RNA, 64 nt, Homo Sapiens
ccagcuacuugggaggcugagcaugguggcaccugccuguaauccuaaaacaaaaauuagccag

SEQ ID NO: 194413 - RNA, 64 nt, Homo Sapiens
ucagcacuuugggaggcugagcgugguggcucaugccuguaaucaagagucaguuuggggccag

SEQ ID NO: 194414 - RNA, 64 nt, Homo Sapiens
ccagcuacuggggaggcugagcaugguggcgggugccuguaaucaaaauacaaaaauuggcugg

SEQ ID NO: 194415 - RNA, 64 nt, Homo Sapiens
ccgguacuuugggaggcugagcauaguggcuuaugccuguaaucgaaaagaagggcugggcaag

SEQ ID NO: 194416 - RNA, 64 nt, Homo Sapiens
ccagcuacuugggaggcuaagcaugguggugcaugccuguaaucaaagauacaaaauuagccag

SEQ ID NO: 194417 - RNA, 64 nt, Homo Sapiens
ccagcacuuugggaggccaugugcgguggcucaugccuguaaucaagaacagccaaguggccag

SEQ ID NO: 194418 - RNA, 64 nt, Homo Sapiens
ccagcuacucgggcagcugagcguggucacaugcgccuguaaucaaaauacaaaaauuagccag

SEQ ID NO: 194419 - RNA, 64 nt, Homo Sapiens
ccagcacuuugggaggccgggcccgguggcucaugccuguaaucuaaaaaaaauuucuggcugg

SEQ ID NO: 194420 - RNA, 64 nt, Homo Sapiens
cuagcuacuugggaggcugagcgugguggugggugccuguaaucuaaaaccaaaaguuaaccgg

SEQ ID NO: 194421 - RNA, 64 nt, Homo Sapiens
cuagcaccuugggaggccgagagcgguggcucacgccuguaaucgaaaaaaacggugcggcugg

SEQ ID NO: 194422 - RNA, 64 nt, Homo Sapiens
guccagcuucuaauuucaaauugaagagaccaaagccuguaacucccaggggugaauuggauuc

SEQ ID NO: 194423 - RNA, 64 nt, Homo Sapiens
ccagcuacucaggaggcugagcgugguggcgcgcgccuguaaucucucuacaaaaauuagcugg

SEQ ID NO: 194424 - RNA, 64 nt, Homo Sapiens
ccagcacuuugggaggcugagcacgguggcucacgccuguaaucaaaacuuggcuguuggccgg

SEQ ID NO: 194425 - RNA, 64 nt, Homo Sapiens
ccagcacuuugggaggccgagcgcgguggcucaugccuguaaccaaaaaggcagaaaaggccgg

SEQ ID NO: 194426 - RNA, 64 nt, Homo Sapiens
ucagcacucugggagaccgagcgaaguggcccaugccuguaaucgagcaggggauagaagccgg

SEQ ID NO: 194427 - RNA, 64 nt, Homo Sapiens
ccagcuauucaggagggugagugugguggcgagugccuguaaucaaaauauagaaauuagccug

SEQ ID NO: 194428 - RNA, 64 nt, Homo Sapiens
ccagcacuuugggaggccaagugcucuggcucaugccuguaaucaaaaaaaaaaaauagaccag

SEQ ID NO: 194429 - RNA, 64 nt, Homo Sapiens
ccauaauuuucagaggcugaaugcuguggcucaggccuguaauccaaauuugcgaugagaccag

SEQ ID NO: 194430 - RNA, 64 nt, Homo Sapiens
ccagcuauauaggaggcugagccugguggcgugcgccuguaaucaaaaguacacaauuagcuag

SEQ ID NO: 194431 - RNA, 64 nt, Homo Sapiens
ccaacacuuugggaguccgagugcaguggcucaugccuguaaucaaaaugcaaugacuggcugg

SEQ ID NO: 194432 - RNA, 64 nt, Homo Sapiens
ccagcacuuugggaggccaagcacaguggcucacgccuguaaugagaaauucucuacuggccgg

SEQ ID NO: 194433 - RNA, 64 nt, Homo Sapiens
ccagcuacucgggaggcugagugugguggugcacgccuguaaucaaaauacaaaaauuagcugg

SEQ ID NO: 194434 - RNA, 64 nt, Homo Sapiens
ccagcacuuugggaggccgagcgugguggcucacgccuguaaucaaccuuacaaaggacgccgg

SEQ ID NO: 194435 - RNA, 64 nt, Homo Sapiens
ccagcacuuugggaggccgaguggggugacucacgccuguaaucaaacacuugaugcuggcugg

SEQ ID NO: 194436 - RNA, 64 nt, Homo Sapiens
ccagcacuuugggaggcggagcgcgguggcucaugccuguaauaaaaaaagaaguuauggccgg

SEQ ID NO: 194437 - RNA, 64 nt, Homo Sapiens
ccagcuacuugggaagcugagcauaguagugugugccuguaaucaaauacaggaaauuaucugg

SEQ ID NO: 194438 - RNA, 64 nt, Homo Sapiens
cuagcacuuugggaggccgaaugugguggcucacgccuguaaucgacugaaacaagcaggccag

SEQ ID NO: 194439 - RNA, 64 nt, Homo Sapiens
cuguuuuaaggaggggcugggcucgguggcucacgccuguaaucccagacuuugagaggccaag

SEQ ID NO: 194440 - RNA, 64 nt, Homo Sapiens
uacaaaaaauacaaaaauuagccgggugggacacgccuguaaucccagcuacucaagaggcuga

SEQ ID NO: 194441 - RNA, 64 nt, Homo Sapiens
ccaguuacucgagaggcugagcguaguggugcaugccuguaaucaaaaauacaaaauuagucgg

SEQ ID NO: 194442 - RNA, 64 nt, Homo Sapiens
ccagcacuuugggaggcugagcacaguggcuuacgccuguaaucuaagaauacgugcauggcug

SEQ ID NO: 194443 - RNA, 64 nt, Homo Sapiens
ccagcuacuugggaggcugagugugguggcgcaugccuguaaucaaaaauacaaaauuagccgg

SEQ ID NO: 194444 - RNA, 64 nt, Homo Sapiens
ccaggacuuugggaggccaagcgcuguggcucacgccuguaaucaauacuaauaguccggccag

SEQ ID NO: 194445 - RNA, 64 nt, Homo Sapiens
ccagcuauucaggaggcugaguguggcggugcgugccuguaaucaacauaaaaaaauuagucag

SEQ ID NO: 194446 - RNA, 64 nt, Homo Sapiens
ccagcacuuugggaggccgacuuugccccggcuugccuguaaucuaucagugaugaaaauuugc

SEQ ID NO: 194447 - RNA, 64 nt, Homo Sapiens
gaaacauacuucuuugcugggcauggugacucacgccuguaaucccagcacuuuggaaggguga

SEQ ID NO: 194448 - RNA, 64 nt, Homo Sapiens
aaaaaacaauucucggcugggcgcgguggcgcaugccuguaaucccagcacuuugggaggccaa

SEQ ID NO: 194449 - RNA, 64 nt, Homo Sapiens
ggugggcucucucuggcccagcguggugguucaugccuguaauaccagcguuuugggaggcuga

SEQ ID NO: 194450 - RNA, 64 nt, Homo Sapiens
uaagcagcccacacaacugggcauagugguucaugccuguaaucccagcacuuugggaggcuga

SEQ ID NO: 194451 - RNA, 64 nt, Homo Sapiens
aaaaaaggaaaaauaggccgggcugguggcucacgccuguaaucccagcacuuuggcaggcuga

SEQ ID NO: 194452 - RNA, 64 nt, Homo Sapiens
aaaauaaaaaauuagcgaggcguggugggcgggcgccuguaaucccagcuacuugggaggcuga

SEQ ID NO: 194453 - RNA, 64 nt, Homo Sapiens
agauccagacaucagggcugggcacagcgguuccgccuguaaucccagcacuuugggaggucca

SEQ ID NO: 194454 - RNA, 64 nt, Homo Sapiens
aaaauacaaaaaugagcugggugugaugauacaugccuguaauccuggcuacuugggaggcuga

SEQ ID NO: 194455 - RNA, 64 nt, Homo Sapiens
aaaaaaugauuucuggccgggcgugguggcucaagccuguaaucccagcacuuugggaggccga

SEQ ID NO: 194456 - RNA, 64 nt, Homo Sapiens
uuagcuacucaggaggcuaagcaugguggcgagugccuguaaucaaaauacgaaaauuagccgg

SEQ ID NO: 194457 - RNA, 64 nt, Homo Sapiens
ccagcacuuugggaggccaagugcgguggcucacgccuguaaucgaaaaccaaacuggggccgg

SEQ ID NO: 194458 - RNA, 64 nt, Homo Sapiens
ucagcuacuagggaugcugaucuuguuggcgcacgccuguaaucaaaauacacaacuuagccag

SEQ ID NO: 194459 - RNA, 64 nt, Homo Sapiens
ccagcacuuugggaggccgagcgcgguggcucacgccuguaaucgguaaauguuucccggcugg

SEQ ID NO: 194460 - RNA, 64 nt, Homo Sapiens
uaaauaaaaaaccaggccaggcgugguggcucacgccuguaaucccagcacuuugggaggccga

SEQ ID NO: 194461 - RNA, 64 nt, Homo Sapiens
aaaauacaaaaauuagccaggugugguagcaggugccuguaaucacagcuacucgggaggcuga

SEQ ID NO: 194462 - RNA, 64 nt, Homo Sapiens
aaaauggaaauauuggccgggcgcgguggcucacgccuguaaucccagcacuuugggaggccga

SEQ ID NO: 194463 - RNA, 64 nt, Homo Sapiens
aaaaaugaaaaauuagccaggcagguuggcgggggccuguaauccuagcuacuuggggugcuga

SEQ ID NO: 194464 - RNA, 64 nt, Homo Sapiens
agcauggcaaauuuaaaaaauaacacaauuucuugccuguaacccuagcacuuugggaggccga

SEQ ID NO: 194465 - RNA, 64 nt, Homo Sapiens
aaaauacaaaaauuagcugggcgugguagugcaugccuguaaucccagcuacuugggaggcuga

SEQ ID NO: 194466 - RNA, 64 nt, Homo Sapiens
cuuuuaacagucugggcuggguccgguggcucacgccuguaaucccagcaauuugggaguccga

SEQ ID NO: 194467 - RNA, 64 nt, Homo Sapiens
aaacuacaaaaauuaacugggugugguggcgcgugccuguaaucccagcuacucgggaagcuga

SEQ ID NO: 194468 - RNA, 64 nt, Homo Sapiens
ccaucuacucgggaggcugagcguaguggcgcgugccuguaauuaaaauacaaaaauuagcugg

SEQ ID NO: 194469 - RNA, 64 nt, Homo Sapiens
cuagcacuuugggaggcugagcgcgguggcucaugccuguaaccaauucuuaguucagggcugg

SEQ ID NO: 194470 - RNA, 64 nt, Homo Sapiens
ccagcuacacaggaggcugagugugguggcaggagccuguaaucaaaauauaaaaauuagcugg

SEQ ID NO: 194471 - RNA, 64 nt, Homo Sapiens
ucagcacuuugggaggccaagcgcagugacuuacgccuguaaucgaaaaggacucccuggccag

SEQ ID NO: 194472 - RNA, 64 nt, Homo Sapiens
ccaguuacucgggaggcugagcgugguggugggcgccuguaaucaaauacaaaaaauuagcugg

SEQ ID NO: 194473 - RNA, 64 nt, Homo Sapiens
ccagcacuuugggaggccgagcguggcggcucacgccuguaaucauaacuugcaucuaggcugg

SEQ ID NO: 194474 - RNA, 64 nt, Homo Sapiens
ccagcuacucgggaggcugaaugcgguggcacccgccuguaaucaaauacaagaaacuagccag

SEQ ID NO: 194475 - RNA, 64 nt, Homo Sapiens
ccagcuucuggaggcugagggacugauggcaugugccuguaaucaaaauacaaaaauuagccag

SEQ ID NO: 194476 - RNA, 64 nt, Homo Sapiens
uucuguucuccuucuguuauuauacuuaaucuucuaaacuaaacuaaugugaacaguagggaag

SEQ ID NO: 194477 - RNA, 64 nt, Homo Sapiens
uucuccuucuguuauuauacuuaaucuucuaaacuaaacuaaugugaacaguagggaagcaagg

SEQ ID NO: 194478 - RNA, 64 nt, Homo Sapiens
aagccguuagacacacaggaaaaauccagaaggguaaacuaaacuaaagcuacaauuaauaugg

SEQ ID NO: 194479 - RNA, 64 nt, Homo Sapiens
guuagacacacaggaaaaauccagaaggguaaacuaaacuaaagcuacaauuaauaugggaauu

SEQ ID NO: 194480 - RNA, 64 nt, Homo Sapiens
aauuugauuagauuauucagaaacaauaggaugcuaaacuaauucauuguaucuuuuuuuuaca

SEQ ID NO: 194481 - RNA, 64 nt, Homo Sapiens
aaacuuauuuuuuaaaucguuguacauuucuuauuaaacuaagugcuuaauuuuaaaguauuau

SEQ ID NO: 194482 - RNA, 64 nt, Homo Sapiens
aaguacucauuucuucauuuuaaaggcauuaaaauaaacuaaaauguaaaagucaccaaaaacu

SEQ ID NO: 194483 - RNA, 64 nt, Homo Sapiens
auuuuauuauauauaaaaauauuuugauuguugguaaacuaaucuguggcuuugggaucuuuuu

SEQ ID NO: 194484 - RNA, 64 nt, Homo Sapiens
uuugcuuguuuucuacucuguagucacuguuguauaaacuaaucuguuuucccucugauguaua

SEQ ID NO: 194485 - RNA, 64 nt, Homo Sapiens
uuagguuugcagaaaguauuaauauuaaccuuucuaaacuaaauauaugccauaguuuagaaag

SEQ ID NO: 194486 - RNA, 64 nt, Homo Sapiens
gagcaucacaagcuuuugagcgcauggaacuccauaaacuaacaaauuacauaaacuaaagggg

SEQ ID NO: 194487 - RNA, 64 nt, Homo Sapiens
gagcgcauggaacuccauaaacuaacaaauuacauaaacuaaagggggauuuucuuucuucuuu

SEQ ID NO: 194488 - RNA, 64 nt, Homo Sapiens
aaauggaauguuaacugaauuucccccaauuuuuuaaacuaacauaaagcauaucuauuaauaa

SEQ ID NO: 194489 - RNA, 64 nt, Homo Sapiens
ucuuuugaguucauaaaucauacauguuuuaggauaaacuaauugcaaagacugaauugaaggu

SEQ ID NO: 194490 - RNA, 64 nt, Homo Sapiens
guguauguauugauguuugguuugucugugauuuuaaacuaacuacuuuuacccucaaguccga

SEQ ID NO: 194491 - RNA, 64 nt, Homo Sapiens
uuucaaaaaccuuagugaaaaugguaucauauguuaaacuaagcaaagucagccuaaagaaguu

SEQ ID NO: 194492 - RNA, 64 nt, Homo Sapiens
uucacugguuccagggauuacacauuuugccauguaaacuaacauauuaaacacaucugcagga

SEQ ID NO: 194493 - RNA, 64 nt, Homo Sapiens
ccacuuccagcuuguagagguuucuugcugacuguaaacuaaggggcagggccaagguccccac

SEQ ID NO: 194494 - RNA, 64 nt, Homo Sapiens
ggaaaugcugcuuuugauccuacagcacuguacauaaacuaacaagggaaacaaaugccuaaac

SEQ ID NO: 194495 - RNA, 64 nt, Homo Sapiens
cagaauaaaaaguauccuuugcuucuugucaccuuaaacuaaagcaaauguaaucacuuaaaua

SEQ ID NO: 194496 - RNA, 64 nt, Homo Sapiens
auuguucuaugucuuuguuggcugguguauuuuauaaacuaaagcugccuauguuucuuuuuaa

SEQ ID NO: 194497 - RNA, 64 nt, Homo Sapiens
uaauacauauuauuuaccccacuguaacaucauguaaacuaaguauguuuuuaaacaauuuuua

SEQ ID NO: 194498 - RNA, 64 nt, Homo Sapiens
uaguuauccauuggggggugagggauagaaaaucuaaacuaauuuucccaaugcauugauguga

SEQ ID NO: 194499 - RNA, 64 nt, Homo Sapiens
aauuugugcugucacagaaagauuuaaaaauuuuuaaacuaaauguuauuaaugaaagaauaug

SEQ ID NO: 194500 - RNA, 64 nt, Homo Sapiens
acugguacauggaggcuauuuuaauccuucuaacuaaacuaaaauagauuaaaggaauuaaacu

SEQ ID NO: 194501 - RNA, 64 nt, Homo Sapiens
uccuucuaacuaaacuaaaauagauuaaaggaauuaaacuaaaauacaaguaaagcuagacaaa

SEQ ID NO: 194502 - RNA, 64 nt, Homo Sapiens
uguaacaaagaccacaacugagguaaagaaaagauaaacuaacuuagaagcuauuuuacuacau

SEQ ID NO: 194503 - RNA, 64 nt, Homo Sapiens
gccaugaaaaucacuuggccauuuuacagaauaguaaacuaagagccuacgagguuuuugcccc

SEQ ID NO: 194504 - RNA, 64 nt, Homo Sapiens
aaaaauggugagcgaucauuuauuucaugauucaaccugauacauuuacauagugcaaaacugu

SEQ ID NO: 194505 - RNA, 64 nt, Homo Sapiens
agucaaauggauucaucaccugucaugcauugacaccugauacccagacuuaauugguauuugu

SEQ ID NO: 194506 - RNA, 64 nt, Homo Sapiens
aagcauuuuaucuuuagaagagaaacugaugggcaccugauacucugucuaaauacguuuguua

SEQ ID NO: 194507 - RNA, 64 nt, Homo Sapiens
uagaguguagacccuuucauguacuguacuguacaccugauacuguaaacauacuguaauaaua

SEQ ID NO: 194508 - RNA, 64 nt, Homo Sapiens
ccugcccucccuuuauuuuuccaguucuuauuucaccugauaauauuccguccaauuggcaaug

SEQ ID NO: 194509 - RNA, 64 nt, Homo Sapiens
uguugguuauauugcacaauugguuauauuuaugaccugauauucaaagacucuggcauugaua

SEQ ID NO: 194510 - RNA, 64 nt, Homo Sapiens
uuuucuugcccuuggagaaaaagaaucauucucaaccugauaaucuguuaagaaaaaucccaua

SEQ ID NO: 194511 - RNA, 64 nt, Homo Sapiens
aaugcaggaguuuuaaauucuugcaccuugcuaaaccugauacgcuuaugucaagguugcuucu

SEQ ID NO: 194512 - RNA, 64 nt, Homo Sapiens
ugggguguugagaccagcuucagagcacaugcugaccugauaaccucuaaguagaaaaaucacc

SEQ ID NO: 194513 - RNA, 64 nt, Homo Sapiens
agucuuuaauuuagggcacucucaaccaguuguuaccugauaggcaaauguagauuugagaaau

SEQ ID NO: 194514 - RNA, 64 nt, Homo Sapiens
aagaagacaacuugagccacgcgucuccuaauaaaccugauaccuaaauaugucgguggacggg

SEQ ID NO: 194515 - RNA, 64 nt, Homo Sapiens
uguuaaaauuagagguaguaagauguucugaaguaccugauacauugagaugucuguuucuucu

SEQ ID NO: 194516 - RNA, 64 nt, Homo Sapiens
gccuauuuuguggcauaugccacauaaaaaaugaaccugauauagacaaguacuaccuuuucaa

SEQ ID NO: 194517 - RNA, 64 nt, Homo Sapiens
uauuuaugcuguagaaaacgaaaaugguuuugcuaccugauaagcuucagauuagauauagccc

SEQ ID NO: 194518 - RNA, 64 nt, Homo Sapiens
uuuagucaccuuucuccuguccaacuucaccaccaccugauaauggguauauaacaggaagcug

SEQ ID NO: 194519 - RNA, 64 nt, Homo Sapiens
uguggacaguugacagcuuuuuuuuuuuccauauaccugauagucuguguacagcauuguuuug

SEQ ID NO: 194520 - RNA, 64 nt, Homo Sapiens
ucaaaagugaauguauaauaagugaauuaaguucaccugauaacugucucugugauuguucugg

SEQ ID NO: 194521 - RNA, 64 nt, Homo Sapiens
uugaaaagcuucuaugugucuuuuuuuuuuugcaaccugauacccucugauacuuuuuuuuuuu

SEQ ID NO: 194522 - RNA, 64 nt, Homo Sapiens
aaacugagcagaaaaaauaagcuguugauuuucuaccugauacuuaagccaguggccuacuuua

SEQ ID NO: 194523 - RNA, 64 nt, Homo Sapiens
guuugccuuacucccuugggcuggggcuagcccuaccugauacccugugucaaugaguguaccu

SEQ ID NO: 194524 - RNA, 64 nt, Homo Sapiens
cuucauuucuugaugcucuucccaauccuugucuaccugauaauaaauucuuacuuguccuuca

SEQ ID NO: 194525 - RNA, 64 nt, Homo Sapiens
ugguucuaaguccuuuuuaaagccauggaacaaaaccugauacaucacccuaacagagcauuaa

SEQ ID NO: 194526 - RNA, 64 nt, Homo Sapiens
agaauaaauugguguuucccgccuuuuuauaaagaccugauagcgcccuuccuccacagguguu

SEQ ID NO: 194527 - RNA, 64 nt, Homo Sapiens
aaguacuuuuguugaagugauuuucucuaaugucaccugauauaacagcaaaggcuuuacuucu

SEQ ID NO: 194528 - RNA, 64 nt, Homo Sapiens
guaguaauaaguuguauucaugaaagcuguuuuuaccugauaauuaacuuucuaugcaugcauu

SEQ ID NO: 194529 - RNA, 64 nt, Homo Sapiens
uaaauuuuugaggugcuuugcuauuucuugugugaccugauagcucccuggaacuuugggucug

SEQ ID NO: 194530 - RNA, 64 nt, Homo Sapiens
augauuaguuauaucugagauuugaagcuggaaaaccugauaggugagacuacuucaguuuauu

SEQ ID NO: 194531 - RNA, 64 nt, Homo Sapiens
uuuauuauccugaguuagcuguuacuuuuacaguaccugauacuccuaaaacuuuuaacuuaua

SEQ ID NO: 194532 - RNA, 64 nt, Homo Sapiens
cuaauauaguauuuccacuauuuacuguuauuuuaccugauaaguuauugaacccuuuggcaau

SEQ ID NO: 194533 - RNA, 64 nt, Homo Sapiens
auagauagaggaagacagcucuuucgggauaaccaccugauaccugcagaaacccccaguccug

SEQ ID NO: 194534 - RNA, 64 nt, Homo Sapiens
gacaguagcuucuugaaaacccaucaaggaaucuaccugauaguaaaagaaauacagucuuaca

SEQ ID NO: 194535 - RNA, 64 nt, Homo Sapiens
agcccacgccucaucuuccccugugcacauguuuaccugauacagcagugcugcguguuguaca

SEQ ID NO: 194536 - RNA, 64 nt, Homo Sapiens
uaggauuuuucacugauucuauaagcccagcauuaccugauaccaaaaccaggcaaagaaaaca

SEQ ID NO: 194537 - RNA, 64 nt, Homo Sapiens
uauagguauuuaaaugcuuugaacuuagaauuguaccugauauuuagaaauauuuuuugauuca

SEQ ID NO: 194538 - RNA, 64 nt, Homo Sapiens
caauuaugaccagaaaauauauuagcaugaaugaaccugauacaaaaucuggaaucccuuucuc

SEQ ID NO: 194539 - RNA, 64 nt, Homo Sapiens
uaaaauacuguuauuggcaagagggaauggugagaccugauaacauccaaaggcucaacaacca

SEQ ID NO: 194540 - RNA, 64 nt, Homo Sapiens
uggguugauguggauuaccuggcugggcucaagaaccugauaccuguguucgcacuuagccaug

SEQ ID NO: 194541 - RNA, 64 nt, Homo Sapiens
auugccugcuuagaugauaacuugcccuacucagaccugauagggcauguaagaaacacaaugc

SEQ ID NO: 194542 - RNA, 64 nt, Homo Sapiens
aguugcaggccgcugauugccauguugauuuuuaaccugauauucuuuuuaauuguuuuaaauu

SEQ ID NO: 194543 - RNA, 64 nt, Homo Sapiens
acagggggcgugaugcugcuggcacugguuggguaccugauacgggacuggcgauggcuucugc

SEQ ID NO: 194544 - RNA, 64 nt, Homo Sapiens
ggcuaggagcugggucugaccguuguaugguuugaccugauauacuccauucuccccugcgccu

SEQ ID NO: 194545 - RNA, 64 nt, Homo Sapiens
ugaucaucuuugggggaagcccugcuuccugaaaaccugauauugcacugggauuugaaugugu

SEQ ID NO: 194546 - RNA, 64 nt, Homo Sapiens
aauaccaguuucucauuuauauuuaacguauuggaccugauauuuuuagugggugcauucuucc

SEQ ID NO: 194547 - RNA, 64 nt, Homo Sapiens
ugccuauuccugucugguugguguuucccuccaaaccugauagcucgugaaggcgaucucaaga

SEQ ID NO: 194548 - RNA, 64 nt, Homo Sapiens
ucaccuguucccaccuccuucaaagaucuaacagaccugauaaauuuuauaaacuuacaguaau

SEQ ID NO: 194549 - RNA, 64 nt, Homo Sapiens
ggaucccuuagccacuuuaguuucaacacagcagaccugauauguugguaaaagggcaguuugg

SEQ ID NO: 194550 - RNA, 64 nt, Homo Sapiens
cuuugccaguaacuuguuuuauaguggucauaugaccugauacuggguaaacaaaacaaagaug

SEQ ID NO: 194551 - RNA, 64 nt, Homo Sapiens
aacauuguaugugagagaaauauaaauauuuacaaccugauauucguuguuguuuuauuguuaa

SEQ ID NO: 194552 - RNA, 64 nt, Homo Sapiens
guacagagucuuacuguagcuacgcuaaugguuaaccugauagaauuaacucguauuuuucuau

SEQ ID NO: 194553 - RNA, 64 nt, Homo Sapiens
uaagccuauuugaacaaagugcuuuccagugauuaccugauacguguauguuaauguaaguuuu

SEQ ID NO: 194554 - RNA, 64 nt, Homo Sapiens
uauguaucuaguucuacaaguuacauauuuauuuaccugauaaauugaucuaauuacuaaauaa

SEQ ID NO: 194555 - RNA, 64 nt, Homo Sapiens
aauaagccaccuguugacauaauaucaauaaaccaccugauaucugaaaggggcguggaguuuc

SEQ ID NO: 194556 - RNA, 64 nt, Homo Sapiens
aaaauguuagaaaaggcaaaaaaaaauuguuuucaccugauauguaaauacaaucacccauaug

SEQ ID NO: 194557 - RNA, 64 nt, Homo Sapiens
gcuguauguauuguacauaguggaguaguuaguuaccugauaacagucuuguuauuugggucuc

SEQ ID NO: 194558 - RNA, 64 nt, Homo Sapiens
cacccccaaauccuguuccaaugaaaaaauuaaaaccugauacgaaaaaaaaaaaauuccaguu

SEQ ID NO: 194559 - RNA, 64 nt, Homo Sapiens
cuaaauuaucaggauauuuguuaucugucuuucuaccugauaauccaacauauccacaagcaag

SEQ ID NO: 194560 - RNA, 64 nt, Homo Sapiens
cagaucugaaccuguggucuugggagccagggugaccugauaugacaucuaaagaagcuucugg

SEQ ID NO: 194561 - RNA, 64 nt, Homo Sapiens
gucuaugacaguguaacucuacagucucaaaaugaccugauaaauugauaagacaaagaugaga

SEQ ID NO: 194562 - RNA, 64 nt, Homo Sapiens
cgucuccagacucucacaugcaguaugugcaggcaccugauacuucuguugcccuugugcucca

SEQ ID NO: 194563 - RNA, 64 nt, Homo Sapiens
agggucaaagacagaaugguggaguguagccuccaccugauauucaggcuacucauucaguccc

SEQ ID NO: 194564 - RNA, 64 nt, Homo Sapiens
caaggucagucuaaaguggcagguccuaggugugaccugauaccaccacccuuuguggcagcac

SEQ ID NO: 194565 - RNA, 64 nt, Homo Sapiens
aagggaaacuaaagaaaaugcuuuccuaaugacaaccugauauuguuuaaauaacuuguggaau

SEQ ID NO: 194566 - RNA, 64 nt, Homo Sapiens
acugguucugucuacaauaaagcaccacuggucuaccugauauguaggaguaucagugucuuca

SEQ ID NO: 194567 - RNA, 64 nt, Homo Sapiens
gcuccccaguacaccccacccaucaggacccuggaccugauacgcuguccccuugaaggagaau

SEQ ID NO: 194568 - RNA, 64 nt, Homo Sapiens
gggcuuugcaugaaccuaaaaaauugauaguaccaccugauacagacauccuuucaauguaaug

SEQ ID NO: 194569 - RNA, 64 nt, Homo Sapiens
ucacuuauacugcauaacaaagcauaggguaaaaaccugauauuuaauuuuaaugauuaaaaag

SEQ ID NO: 194570 - RNA, 64 nt, Homo Sapiens
ugugcagaaagugagagcagcugcuaugagcuggaccugauagcuggauggauaaauagaagaa

SEQ ID NO: 194571 - RNA, 64 nt, Homo Sapiens
uauacacacacauacauaaauauaccacauauacaccugauagucaaauaagguacagaaauuu

SEQ ID NO: 194572 - RNA, 64 nt, Homo Sapiens
ugugucaagagagguuacaugguguuaaaucgguaccugauaauguacccaaauacuauggcca

SEQ ID NO: 194573 - RNA, 64 nt, Homo Sapiens
acuccaaggaguggaaauuauguggaagaagcaaaccugauacaauuugcccaagguaaacagu

SEQ ID NO: 194574 - RNA, 64 nt, Homo Sapiens
aaaccuaggagcauuaagacuugucacacaguaaaccugauacaucagaggugaauaccagcac

SEQ ID NO: 194575 - RNA, 64 nt, Homo Sapiens
uauauucaugagugaaauugccugcaauuccuggaccugauaguagacuaaaaugcaagcaaac

SEQ ID NO: 194576 - RNA, 64 nt, Homo Sapiens
uaagcgcuggucauuuuucugauguuuaagaaggaccugauauguuaacuuugaaaaguuguuu

SEQ ID NO: 194577 - RNA, 64 nt, Homo Sapiens
uccugucaucguguuaguuuggagcagaguggugaccugauagcagggcuggcaucagguagag

SEQ ID NO: 194578 - RNA, 64 nt, Homo Sapiens
ucccagcacuuugggaggcugaggcaggcagaucaccugauaucaagaguuugaggccagccug

SEQ ID NO: 194579 - RNA, 64 nt, Homo Sapiens
ggagagggaaauacaaggagcuaaguguggaauuaccugauaaggcuuccagguaugggaccug

SEQ ID NO: 194580 - RNA, 64 nt, Homo Sapiens
cagugcuuuugacuaucuuacccucccaccucccaccugauauggucccagguuggagucccua

SEQ ID NO: 194581 - RNA, 64 nt, Homo Sapiens
ugagguacaagacgauggcucaugucacaggccuaccugauacggugucagagaaagugguggg

SEQ ID NO: 194582 - RNA, 64 nt, Homo Sapiens
cugguuagaaacagguccucaggaguauucucuaaccugauauuuucuaaaaagauauguugau

SEQ ID NO: 194583 - RNA, 64 nt, Homo Sapiens
uuuccuccuucugggugcccagcccccuuuccucaccugauacccaagcccaccacuuuuauuu

SEQ ID NO: 194584 - RNA, 64 nt, Homo Sapiens
acuguaugacuugcaaucguagguauaguuuauaaccugauagcaaaaaacuugaaauauugca

SEQ ID NO: 194585 - RNA, 64 nt, Homo Sapiens
cugaauuuucacaacugguauuaugucacuagcuaccugauacggcuauuucccuuauaacuca

SEQ ID NO: 194586 - RNA, 64 nt, Homo Sapiens
accucuccaaagcccucccuaccuaccaagauauaccugauauauuccaccaggauauccuccc

SEQ ID NO: 194587 - RNA, 64 nt, Homo Sapiens
aaggugcaaagguccaaaccggugcagccgcuggaccugauaguauuaaguuacaaggcugaau

SEQ ID NO: 194588 - RNA, 64 nt, Homo Sapiens
ucauuuuggauaggccuuuccaagugucuucccaaccugauaauuacagggauuuauaguaaaa

SEQ ID NO: 194589 - RNA, 64 nt, Homo Sapiens
uuccuuagcagaauuaccuacaaacaaugucucaaccugauaaucaauacagaaaaggaguauc

SEQ ID NO: 194590 - RNA, 64 nt, Homo Sapiens
aacagggacagcugccaauaccuuccuaucaaucaccugauagccguggucccuagcuagaucc

SEQ ID NO: 194591 - RNA, 64 nt, Homo Sapiens
agcccagauucuacuguauuuggggaaauauuccaccugauaauagugcuguaaggcuuguaac

SEQ ID NO: 194592 - RNA, 64 nt, Homo Sapiens
gaacugagagagggguucaaagaagagaggcaaaaccugauauuagcuuggagccucuagguug

SEQ ID NO: 194593 - RNA, 64 nt, Homo Sapiens
cucuagggacacuggcagcuccccugaccaauucaccugauaaacaggcucgagggagacugau

SEQ ID NO: 194594 - RNA, 64 nt, Homo Sapiens
cacuuucaugaugggagaaauuauagagaaaccaaccugauacauaguucagcuauaauuccuu

SEQ ID NO: 194595 - RNA, 64 nt, Homo Sapiens
uguucagaaaaugcaaauuacacuauaauauaaaaccugauauauacacauuagaaauauucca

SEQ ID NO: 194596 - RNA, 51 nt, Homo Sapiens
uccuagguauguuucuauaaaaccugauaaccgaaaauuggccaacggaac

SEQ ID NO: 194597 - RNA, 64 nt, Homo Sapiens
ucauguucuagagaguaggacuuuuauuccguguaccugauauauauacaauuaaaauaucugu

SEQ ID NO: 194598 - RNA, 64 nt, Homo Sapiens
cuuuguagcuacuuguguuuuauugguauuauaaaccugauaauuauuuacauguuuauuacug

SEQ ID NO: 194599 - RNA, 64 nt, Homo Sapiens
ugcuucauuuaaucaggaauuauuguugaucuaaaccugauacauaacuugcuuuguagguuug

SEQ ID NO: 194600 - RNA, 64 nt, Homo Sapiens
uuccaucguaucaaacuuucgcacccacccucuuaccugauaaggagacggcaucucguucaca

SEQ ID NO: 194601 - RNA, 64 nt, Homo Sapiens
uucgguaauacuaucaagagucggccagcgguuuaccugauagaaauuccugcagacauccuac

SEQ ID NO: 194602 - RNA, 64 nt, Homo Sapiens
gccaaugcuguuguagucgugaagaaggaagaaaaccugauauaaacguuuuuccagguggcug

SEQ ID NO: 194603 - RNA, 64 nt, Homo Sapiens
aagggacagauuuuuaaugaccggucgcuguugcaccugauaguuacuguguaaggugauguuc

SEQ ID NO: 194604 - RNA, 64 nt, Homo Sapiens
aagcaacguaugguaaauauacugcuuucagucgaccugauaaacauagaugaaaaauguguuu

SEQ ID NO: 194605 - RNA, 64 nt, Homo Sapiens
aaucugaaaugugacaguaggaguacucauuagcaccugauagauuguugggguauaacaugau

SEQ ID NO: 194606 - RNA, 64 nt, Homo Sapiens
cacauuccucucugccaccuucucucuuguccauaccugauagaugaagagcacauuucuuuca

SEQ ID NO: 194607 - RNA, 64 nt, Homo Sapiens
gugguacauuaacucuccauuuuagccagaagauaccugauaagagaagguguaagguuuuuau

SEQ ID NO: 194608 - RNA, 64 nt, Homo Sapiens
auauuuugcgaagagaggugaaacaagucuuuacaccugauaaaacgguucuucccuagaagaa

SEQ ID NO: 194609 - RNA, 64 nt, Homo Sapiens
uugcugagcgggagcucaguaugacuugccacccaccugauaccucagggcaaggcccuuuuuc

SEQ ID NO: 194610 - RNA, 64 nt, Homo Sapiens
gccuucuggcuguauggcuuacauccuggaaauuaccugauaauaaagcaaguaaagguguaag

SEQ ID NO: 194611 - RNA, 64 nt, Homo Sapiens
gagccccagcugcuggcggcugcuggaauauccuaccugauaggauuaaaaggccuaguggagc

SEQ ID NO: 194612 - RNA, 64 nt, Homo Sapiens
uggagguaggaacaaaauugcgccgcuccuggagaccugauaacuuaggcuugaaauaauugac

SEQ ID NO: 194613 - RNA, 64 nt, Homo Sapiens
uaguaaacucacaauaaauaguaccuagcacuguaccugauacaaauuaugucuccaauuguga

SEQ ID NO: 194614 - RNA, 64 nt, Homo Sapiens
acucaggcugcaauuccaucgcgucucaccuggaaccugauauauaucccaggugagguggaaa

SEQ ID NO: 194615 - RNA, 64 nt, Homo Sapiens
uggagauguaaauauugcucuaauagggauugugaccugauauuaucauucuaacuucaacgua

SEQ ID NO: 194616 - RNA, 64 nt, Homo Sapiens
gauguaagugauuuaauucauggguacuuuuagaaccugauagauaaucccauugccuuuauuu

SEQ ID NO: 194617 - RNA, 64 nt, Homo Sapiens
uggggugucgggaugggggugcugggagacacagaccugauacaguaugucuuucugcaccacc

SEQ ID NO: 194618 - RNA, 64 nt, Homo Sapiens
aaguacauaucuuaauuuugaaaaaggucuuacuaccugauaucuucauaugacuguucucuga

SEQ ID NO: 194619 - RNA, 64 nt, Homo Sapiens
gcacaugugaaauggaaauguuuaucuaccaucaaccugauaagagaaguagcacguaauggcu

SEQ ID NO: 194620 - RNA, 64 nt, Homo Sapiens
cuugucugucucuggguccugggccagccaggauaccugauaauaaaagaucauugggugaaca

SEQ ID NO: 194621 - RNA, 64 nt, Homo Sapiens
gucgccacacucaccucugaggucuguggaagucaccugauauucuggccccaggggugggagg

SEQ ID NO: 194622 - RNA, 64 nt, Homo Sapiens
caugcccaggguucucauccacagcagcugggucaccugauagggccgcccuggacuugggguc

SEQ ID NO: 194623 - RNA, 64 nt, Homo Sapiens
ggagccucuugucaccuucuuggacuuauuccccaccugauaccuuauagagaaaagugugaau

SEQ ID NO: 194624 - RNA, 64 nt, Homo Sapiens
cagaccagacuacccaccuaacuugucgguugucaccugauaaucugggauucccaacaggugg

SEQ ID NO: 194625 - RNA, 64 nt, Homo Sapiens
ugaacccaggacaggcacaguggggguggugaggaccugauagaguuggaucagugacuaagag

SEQ ID NO: 194626 - RNA, 64 nt, Homo Sapiens
uucacauguaauuaaauuccguguccaugugccuaccugauacuugugugugcacacaugguac

SEQ ID NO: 194627 - RNA, 64 nt, Homo Sapiens
ugccugggacagccacuggacaggugugggccgaaccugauacccugcccagaguaugggcacu

SEQ ID NO: 194628 - RNA, 64 nt, Homo Sapiens
gauuugcucacucuauccuggauagguauuuagaaccugauagucuuuaagccauuccagucau

SEQ ID NO: 194629 - RNA, 64 nt, Homo Sapiens
cauuuguaaacuaaccccugggaaauuugaaauuaccugauaacuuaagacucugugaucucug

SEQ ID NO: 194630 - RNA, 64 nt, Homo Sapiens
cuuuuaagugaaaaaaauagguaacaaaacaaccaccugauaguaaguuuucugauaagacuau

SEQ ID NO: 194631 - RNA, 64 nt, Homo Sapiens
agauauugaaacccauuuccuuauaaacauggauaccugauaaucaugucuuugggaaacacau

SEQ ID NO: 194632 - RNA, 64 nt, Homo Sapiens
ccaugaugaucccaugguaguuacucaucuucuuaccugauaucaacuuuuguaguuuuguaug

SEQ ID NO: 194633 - RNA, 64 nt, Homo Sapiens
cacugagaaccugcugagcaggucaucauucuagaccugauaacauaaaguccauaaugcauau

SEQ ID NO: 194634 - RNA, 64 nt, Homo Sapiens
uggcugggcgccguggcucaaauaaauaauaaaaaccugauauuaucucaaaacaaacaauaau

SEQ ID NO: 194635 - RNA, 55 nt, Homo Sapiens
ggccccgccggcaccucugauguacagccagcagggcccaggcagccaccaagcc

SEQ ID NO: 194636 - RNA, 58 nt, Homo Sapiens
gcugcccagcccugcccccccuccccauagccagcacagcuaucccgcggggacacca

SEQ ID NO: 194637 - RNA, 58 nt, Homo Sapiens
gcacagacagcugcgaccagaggacgucagccagcacucugcacagacagcugcgacc

SEQ ID NO: 194638 - RNA, 58 nt, Homo Sapiens
gcacagacagcugcgaccaguggacaucagccagcacucugugaggccgugguuagcg

SEQ ID NO: 194639 - RNA, 58 nt, Homo Sapiens
cugggccuuguacugucuguguuucaccagccagcaacaggagggacgagggacaggg

SEQ ID NO: 194640 - RNA, 58 nt, Homo Sapiens
auggacagcuggaccccugaccuccucuagccagcagugaccucucccggaucugucu

SEQ ID NO: 194641 - RNA, 58 nt, Homo Sapiens
ugccuccccuucacucccaccaaucaguagccagcaucuccacucugagucccagagc

SEQ ID NO: 194642 - RNA, 58 nt, Homo Sapiens
cuggcucucccagccagguugcacacugagccagcagcaagcaggcgugaccugccag

SEQ ID NO: 194643 - RNA, 58 nt, Homo Sapiens
ucaccugccaggcuuccuuuggugguggagccagcaucgacaagcagggcuugaugcu

SEQ ID NO: 194644 - RNA, 58 nt, Homo Sapiens
uggcccuccaccaucuucacacccugccagccagcagcgcaggauacccuggcgggcc

SEQ ID NO: 194645 - RNA, 58 nt, Homo Sapiens
cauuguaaguucccucuuugcccugggcagccagcauuccagauacacucaugggcug

SEQ ID NO: 194646 - RNA, 58 nt, Homo Sapiens
uagaggaaaagacacacauaccagccacagccagcagacuuugggauagguugcagua

SEQ ID NO: 194647 - RNA, 58 nt, Homo Sapiens
ugagaacauagcacaggccccucuuaaaagccagcagccccucccugccucuuuggug

SEQ ID NO: 194648 - RNA, 58 nt, Homo Sapiens
ugugcaguuucuagugcugggaagucuuagccagcaccagagcgccaggccucucccu

SEQ ID NO: 194649 - RNA, 58 nt, Homo Sapiens
ccaggcuucagcaacacuccucuuucccagccagcaaaggcugugaauuugaauucuu

SEQ ID NO: 194650 - RNA, 58 nt, Homo Sapiens
acagcugggagaggggagccagcuguccagccagcauguuccuguuguacagcccggu

SEQ ID NO: 194651 - RNA, 58 nt, Homo Sapiens
ggccccauccuugagggccuucccagccagccagcaggagaggcaagaacugggggaa

SEQ ID NO: 194652 - RNA, 58 nt, Homo Sapiens
gcuccuccucuggcucuucaccugggccagccagcaggucccucccuccuugccccau

SEQ ID NO: 194653 - RNA, 58 nt, Homo Sapiens
caggucuuguugccaauuuacucagggcagccagcagggugggagcagacccgugggc

SEQ ID NO: 194654 - RNA, 58 nt, Homo Sapiens
uucucuccugugagcuccccccuggcccagccagcaggccggcccugccccacacagg

SEQ ID NO: 194655 - RNA, 58 nt, Homo Sapiens
gcgggccaggagaaagaaggaagucaggagccagcaggcuuguuugccuuuaggcagg

SEQ ID NO: 194656 - RNA, 58 nt, Homo Sapiens
gaggggugggaccaggcugggaggacagagccagcagcugccaugcccuccugcuccc

SEQ ID NO: 194657 - RNA, 58 nt, Homo Sapiens
cuggccaaggucaggaggagcaaaaaugagccagcaccagcgccuuggcuuuguguua

SEQ ID NO: 194658 - RNA, 58 nt, Homo Sapiens
ugccagggagccacccgcccaagcacugagccagcaggcaccucucauugcaagcccc

SEQ ID NO: 194659 - RNA, 58 nt, Homo Sapiens
gcugcucccuggagcccggguuccccuaagccagcacuagcccugcacagcggucucc

SEQ ID NO: 194660 - RNA, 58 nt, Homo Sapiens
gguucuggagaaagaaacuguaugggagagccagcaggcucugcuccacccacuuggc

SEQ ID NO: 194661 - RNA, 58 nt, Homo Sapiens
uccuccggaucacugugguuagccaugcagccagcaggucuccucccagcaucacacc

SEQ ID NO: 194662 - RNA, 58 nt, Homo Sapiens
gaggggcggaggcacagcugcuuccagcagccagcauucaguggccuugucaccaagc

SEQ ID NO: 194663 - RNA, 58 nt, Homo Sapiens
uguggcaggacuggcccagggaggaggaagccagcagcacaccuggggaauggggucc

SEQ ID NO: 194664 - RNA, 58 nt, Homo Sapiens
gcccugcuuagcucaucuuagagcaaagagccagcacccugaugucccugggguggcu

SEQ ID NO: 194665 - RNA, 58 nt, Homo Sapiens
ugcugcccgcucugcagacugcugcuagagccagcaacuccacuaagguggauuuuca

SEQ ID NO: 194666 - RNA, 58 nt, Homo Sapiens
aaggaaaaggcaugaaguucuauaccucagccagcagcugccuucguuuggaacugaa

SEQ ID NO: 194667 - RNA, 58 nt, Homo Sapiens
cagcugccuucguuuggaacugaaguccagccagcagacucucuagcuccaucucccc

SEQ ID NO: 194668 - RNA, 58 nt, Homo Sapiens
acagucucuauggugcugagagcagcccagccagcagcccccaagguugccccgggcc

SEQ ID NO: 194669 - RNA, 58 nt, Homo Sapiens
guggaugcaaggggccucuagacaggagagccagcaggaggacaugguggagaccagg

SEQ ID NO: 194670 - RNA, 58 nt, Homo Sapiens
ccgggccaagugaagaaucuuagaugugagccagcacacucccagaaugcuggguuua

SEQ ID NO: 194671 - RNA, 58 nt, Homo Sapiens
acguggcuucagaggccuggcuuucuagagccagcaguacuuucugaaguagccugau

SEQ ID NO: 194672 - RNA, 58 nt, Homo Sapiens
caucauuucuauuauaccuuccaugccuagccagcaaggggauuacaggcaugagcca

SEQ ID NO: 194673 - RNA, 58 nt, Homo Sapiens
aucucuuuggggaccacuccccugucccagccagcaucucucaccuccaccaccccuc

SEQ ID NO: 194674 - RNA, 58 nt, Homo Sapiens
ucucaugccccuggcugggacguggcucagccagcacuuguccagcugagcgccagga

SEQ ID NO: 194675 - RNA, 58 nt, Homo Sapiens
aggcugaggcuggcacaggacaugcgguagccagcacacagggcagugagggagggcu

SEQ ID NO: 194676 - RNA, 64 nt, Homo Sapiens
uguucugcugauaucaacagacgguuuuuuucuuuggcugcagggauuggcugguuaaugggaa

SEQ ID NO: 194677 - RNA, 64 nt, Homo Sapiens
aagaaacuuuuuuauuuuuugauggacuugugauuggcugcaggguuuauaauuggcuuaaagg

SEQ ID NO: 194678 - RNA, 64 nt, Homo Sapiens
gagauggaaaagaagagccccaguguuucugcaguggcugcaggagggccagaagguuguccag

SEQ ID NO: 194679 - RNA, 64 nt, Homo Sapiens
uaagggucuguuucucagcaugugugaugcaguguggcugcacuuugugugaggcugacacguc

SEQ ID NO: 194680 - RNA, 64 nt, Homo Sapiens
ccaguuuuaugauucugcuuggguacugugaugauggcugcaguagacccccaagcauagacuc

SEQ ID NO: 194681 - RNA, 64 nt, Homo Sapiens
ccaguuuugugaugcugcuuuggugccguggugauggcugcagugaagagcccaagcauagacu

SEQ ID NO: 194682 - RNA, 64 nt, Homo Sapiens
ucauagugagugucuucacucaagggugguuuccuggcugcacggcaccuguuccaacaccuac

SEQ ID NO: 194683 - RNA, 64 nt, Homo Sapiens
gagagauggccuggguuaucauugcugauagcuuuggcugcaugaguugggcuuccccuuaccc

SEQ ID NO: 194684 - RNA, 64 nt, Homo Sapiens
agccaggugugagggucaccggcaggugggcugguggcugcagccucagagcccucccagguug

SEQ ID NO: 194685 - RNA, 64 nt, Homo Sapiens
aaaagaagcaucauauauaagcaaauaucacuuuuggcugcauucgauuaugguucugagaaaa

SEQ ID NO: 194686 - RNA, 64 nt, Homo Sapiens
gucaggcccugccccauggcccucugccagccucuggcugcacgucugcccacccuuccccagg

SEQ ID NO: 194687 - RNA, 64 nt, Homo Sapiens
ccuuugaaaaguggaggaaauuguagucacagaguggcugcaggaaaggucggaggacuggcuc

SEQ ID NO: 194688 - RNA, 64 nt, Homo Sapiens
cugacaucauuuauuuuugcgggaugcuggaguuuggcugcaggcagugggucagcugcggugu

SEQ ID NO: 194689 - RNA, 64 nt, Homo Sapiens
cacucagugcugggaguagugacaucguucucccuggcugcauccacuaacccacacacugcag

SEQ ID NO: 194690 - RNA, 64 nt, Homo Sapiens
acuguaccuuaucauucugaugcuauugcagacauggcugcaguaaaaaaaaguaaaauugaag

SEQ ID NO: 194691 - RNA, 64 nt, Homo Sapiens
agcggcguagccgugcgugugugugaugguuccguggcugcaaggaagggaaacagucuauuau

SEQ ID NO: 194692 - RNA, 64 nt, Homo Sapiens
uuuuugguugauugcuggugagaauggccggcgguggcugcagugguagccugaggaaggccaa

SEQ ID NO: 194693 - RNA, 64 nt, Homo Sapiens
caagccuccuccaucucccaucagugcugugggcuggcugcaagccucgaaacaguucuccugg

SEQ ID NO: 194694 - RNA, 64 nt, Homo Sapiens
uugaaaaacaaccaaagaaagggagugaggacuauggcugcauguccucugcuugcccggcugc

SEQ ID NO: 194695 - RNA, 64 nt, Homo Sapiens
ucuucagcuccuuccugugguuugccauccgcuguggcugcagcuuggaccgcaagggcaaaua

SEQ ID NO: 194696 - RNA, 64 nt, Homo Sapiens
uauugguccaagaggaugcucggguagucuucgguggcugcaggagagcgaugcugcgccucug

SEQ ID NO: 194697 - RNA, 64 nt, Homo Sapiens
ggugcuuggaccaagucucaggugugucugccuguggcugcacaggcucucuaaccgaaaccuc

SEQ ID NO: 194698 - RNA, 64 nt, Homo Sapiens
uaacacugcauucucacuauaacgugcccuauaauggcugcaucccuuuugagcaaccuccaaa

SEQ ID NO: 194699 - RNA, 64 nt, Homo Sapiens
accaccaccuggcguguagaaucuccaggaagccuggcugcagcuucccauuugguuacgaggu

SEQ ID NO: 194700 - RNA, 64 nt, Homo Sapiens
ucaguauuucaaggaaaauuauggaugccagucuuggcugcacaagauauccauuacguacuua

SEQ ID NO: 194701 - RNA, 64 nt, Homo Sapiens
cagggaauggaugcuucacuugaucuccggaccuuggcugcagaggccaucgcagcuuuugaaa

SEQ ID NO: 194702 - RNA, 64 nt, Homo Sapiens
uggagaugguaucaucaagcucaacguucuggaguggcugcagcucaccauguaugccugaacc

SEQ ID NO: 194703 - RNA, 64 nt, Homo Sapiens
ggcugguuacuuugggcuguccaacucauaaguuuggcugcauuuugaaaaaagcugaucuaaa

SEQ ID NO: 194704 - RNA, 64 nt, Homo Sapiens
ugagcugguuuuuagcggagacggagucccaccuuggcugcagggaguccgaaagggacuugga

SEQ ID NO: 194705 - RNA, 64 nt, Homo Sapiens
cuuugcagacaggcaagcaccuccugccucgaacuggcugcaaaggguaucaggugcugccauc

SEQ ID NO: 194706 - RNA, 60 nt, Homo Sapiens
uccucgagaucaaacacuaaggcacggggcuggcugcagagcagccuuaggacccuggga

SEQ ID NO: 194707 - RNA, 64 nt, Homo Sapiens
aacacaacucccaucccagucaguuuccuucccauggcugcaucuuaagauggaugcacggaga

SEQ ID NO: 194708 - RNA, 64 nt, Homo Sapiens
ugaguauuuuaucuguaaaauguuaucugcccuuuggcugcauuggaauuucagagaaggcugc

SEQ ID NO: 194709 - RNA, 64 nt, Homo Sapiens
ccuuccgccacuggggcucagagccggggugggguggcugcagccucaggacugggagccccca

SEQ ID NO: 194710 - RNA, 64 nt, Homo Sapiens
guggcagcucggccucucuacgaccccaucuugguggcugcacacucuuccuggcccgcacccc

SEQ ID NO: 194711 - RNA, 64 nt, Homo Sapiens
cuccgggguucagccuccugcacugccuccucccuggcugcagcgaugggcuccccaggaagcc

SEQ ID NO: 194712 - RNA, 64 nt, Homo Sapiens
cccaccucggcccucccugccuggcccuggcggguggcugcaagagggcagccccugcagacgu

SEQ ID NO: 194713 - RNA, 64 nt, Homo Sapiens
cguguccacaugggccuugccgugaaagcauguguggcugcagaguguacguucccaugugccc

SEQ ID NO: 194714 - RNA, 64 nt, Homo Sapiens
ggugugcacgcauuacccuucgcucaugcacaccuggcugcacaucaccuggccugugcagaaa

SEQ ID NO: 194715 - RNA, 64 nt, Homo Sapiens
uaucucaaugaaaagggaguuucguaagcaaaauagaggacagaaaugcaguucaugaacuugc

SEQ ID NO: 194716 - RNA, 64 nt, Homo Sapiens
cugcaggugucuagggucucagcuuuucauuugcagaggacauguucaacuuccucucuguuca

SEQ ID NO: 194717 - RNA, 64 nt, Homo Sapiens
uuuguaucucaagcuaaugcgggauggaaagucuagaggacaccauagauaugaugccagcaaa

SEQ ID NO: 194718 - RNA, 64 nt, Homo Sapiens
agaaagguaaaacaaagacuugaugaaguucaugagaggacagaggaguuucccauaucauugu

SEQ ID NO: 194719 - RNA, 64 nt, Homo Sapiens
uguaauaaaucaaaauugacugaggaaagggaggagaggacaagaauauaaaaaauguuauuac

SEQ ID NO: 194720 - RNA, 64 nt, Homo Sapiens
ccacugccaugucagggguuuuaucaaguguuacagaggacauauuuuagugguucugugccuc

SEQ ID NO: 194721 - RNA, 64 nt, Homo Sapiens
agacugguacuuuuuuguuuugaaaaauaauuuaagaggacagaucuuuguaauauaaucagaa

SEQ ID NO: 194722 - RNA, 64 nt, Homo Sapiens
uaauauucuacaugcuguaaacuuuaguuaaaaaagaggacauuccaugcuucuucauuuuuuu

SEQ ID NO: 194723 - RNA, 64 nt, Homo Sapiens
ggccacgcccccaugcaucccaugacuucuggacagaggacaugagagaugccaaaaaugggga

SEQ ID NO: 194724 - RNA, 64 nt, Homo Sapiens
ccccaauacaggagaagcacggacgcaggcuuccagaggacaaacucacaaggcgacuugaaga

SEQ ID NO: 194725 - RNA, 64 nt, Homo Sapiens
cagcucuggauuucuaccccaaugcccucucuccagaggacacaacauguggauauccagccag

SEQ ID NO: 194726 - RNA, 64 nt, Homo Sapiens
uggauauccagccagaaugcgggcugaggggcgaagaggacauguugaccugccuuggggagca

SEQ ID NO: 194727 - RNA, 64 nt, Homo Sapiens
uccugcaguugcuggauggauagggacaccaggaagaggacaaacugcauggacucaagcgagc

SEQ ID NO: 194728 - RNA, 64 nt, Homo Sapiens
caguggggucacguaaaggaauugcaggucggugagaggacaagagggacucccauguucuaag

SEQ ID NO: 194729 - RNA, 64 nt, Homo Sapiens
cugauuugcucucagaaacauuggcuuuuuacuuagaggacauuuuuuuuuucuaauuucagac

SEQ ID NO: 194730 - RNA, 64 nt, Homo Sapiens
acuugacauaguaacauuagacuggaugacucucagaggacauguguggguuucuuuugcccuu

SEQ ID NO: 194731 - RNA, 64 nt, Homo Sapiens
auggcaauguccuucaaaaugaaguacauauugaagaggacaauuacucucauaacagcugaca

SEQ ID NO: 194732 - RNA, 64 nt, Homo Sapiens
augaaaaauacguggaguugcugagaaagcagcaagaggacaugaaugaagaagaacaaagagc

SEQ ID NO: 194733 - RNA, 64 nt, Homo Sapiens
gaaccugccuuccaccugccauuaguggaaaaaaagaggacaguacagccaccaccauauugcc

SEQ ID NO: 194734 - RNA, 64 nt, Homo Sapiens
cucaguggaaagaguuugaugagaacauggguccagaggacauuggccggccaagccauucaga

SEQ ID NO: 194735 - RNA, 64 nt, Homo Sapiens
cagcaaaaauaaguagcuacgcaugcagaaaagcagaggacacuguggaagaaaagauugugga

SEQ ID NO: 194736 - RNA, 64 nt, Homo Sapiens
uggccuggccagcccacaacugaugaaaucaggaagaggacaaggcugaaagcuuugguuuugc

SEQ ID NO: 194737 - RNA, 64 nt, Homo Sapiens
acagaaaggagaaucuccacugaggccuuugagaagaggacaucgagcuacaagauggcugcuc

SEQ ID NO: 194738 - RNA, 64 nt, Homo Sapiens
caggggagacgccccagucuccuccucauucaccagaggacacaggcuuuagccggaagucagu

SEQ ID NO: 194739 - RNA, 64 nt, Homo Sapiens
cacaggggagaagccuuaugccuccucagucaccagaggacacaggcuuuagccggaagucaga

SEQ ID NO: 194740 - RNA, 64 nt, Homo Sapiens
augggggaggggcuucggaccuaucaacugccugagaggacacauauuuuaaauggaauuuauu

SEQ ID NO: 194741 - RNA, 64 nt, Homo Sapiens
uaaauacacagcgguggugccuccguagguguacagaggacaugugugucuggccgggcccccu

SEQ ID NO: 194742 - RNA, 64 nt, Homo Sapiens
guauuaagccagcgguugugacucauugaacaucagaggacauauccuggagaaaagcccuacg

SEQ ID NO: 194743 - RNA, 64 nt, Homo Sapiens
gccuucaaugaucgcucaacccuuaguaaacacgagaggacacacacuggaggcaaacccuaug

SEQ ID NO: 194744 - RNA, 64 nt, Homo Sapiens
ucuguaagauuaugguacuguggaacaugagggcagaggacaccgggaggcuguuaggggguca

SEQ ID NO: 194745 - RNA, 64 nt, Homo Sapiens
caacugaaauagcuauguggcggauacggaaaacagaggacaauuugaggaucuugcuggaaua

SEQ ID NO: 194746 - RNA, 64 nt, Homo Sapiens
guauccccucuggccagagucuuggucauuuggaagaggacacggcacagccccugcagagcau

SEQ ID NO: 194747 - RNA, 64 nt, Homo Sapiens
uccugggcugggcccagguagccccuccagauggagaggacaucauuccagccucuuugagcug

SEQ ID NO: 194748 - RNA, 64 nt, Homo Sapiens; identical to SEQ ID NO: 68448

SEQ ID NO: 194749 - RNA, 64 nt, Homo Sapiens; identical to SEQ ID NO: 68449

SEQ ID NO: 194750 - RNA, 64 nt, Homo Sapiens; identical to SEQ ID NO: 68450

SEQ ID NO: 194751 - RNA, 64 nt, Homo Sapiens; identical to SEQ ID NO: 68451

SEQ ID NO: 194752 - RNA, 64 nt, Homo Sapiens; identical to SEQ ID NO: 68452

SEQ ID NO: 194753 - RNA, 64 nt, Homo Sapiens; identical to SEQ ID NO: 68453

SEQ ID NO: 194754 - RNA, 64 nt, Homo Sapiens; identical to SEQ ID NO: 68454

SEQ ID NO: 194755 - RNA, 64 nt, Homo Sapiens; identical to SEQ ID NO: 68455

SEQ ID NO: 194756 - RNA, 64 nt, Homo Sapiens; identical to SEQ ID NO: 68456

SEQ ID NO: 194757 - RNA, 64 nt, Homo Sapiens; identical to SEQ ID NO: 68457

SEQ ID NO: 194758 - RNA, 64 nt, Homo Sapiens; identical to SEQ ID NO: 68458

SEQ ID NO: 194759 - RNA, 64 nt, Homo Sapiens; identical to SEQ ID NO: 68459

SEQ ID NO: 194760 - RNA, 64 nt, Homo Sapiens; identical to SEQ ID NO: 68460

SEQ ID NO: 194761 - RNA, 64 nt, Homo Sapiens; identical to SEQ ID NO: 68461

SEQ ID NO: 194762 - RNA, 64 nt, Homo Sapiens; identical to SEQ ID NO: 68462

SEQ ID NO: 194763 - RNA, 64 nt, Homo Sapiens; identical to SEQ ID NO: 68463

SEQ ID NO: 194764 - RNA, 64 nt, Homo Sapiens; identical to SEQ ID NO: 68464

SEQ ID NO: 194765 - RNA, 54 nt, Homo Sapiens; identical to SEQ ID NO: 67612

SEQ ID NO: 194766 - RNA, 64 nt, Homo Sapiens; identical to SEQ ID NO: 68466

SEQ ID NO: 194767 - RNA, 64 nt, Homo Sapiens; identical to SEQ ID NO: 68467

SEQ ID NO: 194768 - RNA, 64 nt, Homo Sapiens; identical to SEQ ID NO: 68468

SEQ ID NO: 194769 - RNA, 64 nt, Homo Sapiens; identical to SEQ ID NO: 68469

SEQ ID NO: 194770 - RNA, 64 nt, Homo Sapiens; identical to SEQ ID NO: 68470

SEQ ID NO: 194771 - RNA, 64 nt, Homo Sapiens; identical to SEQ ID NO: 68471

SEQ ID NO: 194772 - RNA, 64 nt, Homo Sapiens; identical to SEQ ID NO: 68472

SEQ ID NO: 194773 - RNA, 64 nt, Homo Sapiens; identical to SEQ ID NO: 68473

SEQ ID NO: 194774 - RNA, 64 nt, Homo Sapiens; identical to SEQ ID NO: 68474

SEQ ID NO: 194775 - RNA, 64 nt, Homo Sapiens; identical to SEQ ID NO: 68475

SEQ ID NO: 194776 - RNA, 64 nt, Homo Sapiens; identical to SEQ ID NO: 68476

SEQ ID NO: 194777 - RNA, 64 nt, Homo Sapiens; identical to SEQ ID NO: 68477

SEQ ID NO: 194778 - RNA, 64 nt, Homo Sapiens; identical to SEQ ID NO: 68478

SEQ ID NO: 194779 - RNA, 64 nt, Homo Sapiens; identical to SEQ ID NO: 68479

SEQ ID NO: 194780 - RNA, 64 nt, Homo Sapiens; identical to SEQ ID NO: 68480

SEQ ID NO: 194781 - RNA, 64 nt, Homo Sapiens; identical to SEQ ID NO: 68481

SEQ ID NO: 194782 - RNA, 64 nt, Homo Sapiens; identical to SEQ ID NO: 68482

SEQ ID NO: 194783 - RNA, 64 nt, Homo Sapiens; identical to SEQ ID NO: 68483

SEQ ID NO: 194784 - RNA, 64 nt, Homo Sapiens; identical to SEQ ID NO: 68484

SEQ ID NO: 194785 - RNA, 64 nt, Homo Sapiens; identical to SEQ ID NO: 68485

SEQ ID NO: 194786 - RNA, 64 nt, Homo Sapiens; identical to SEQ ID NO: 68486

SEQ ID NO: 194787 - RNA, 64 nt, Homo Sapiens; identical to SEQ ID NO: 68487

SEQ ID NO: 194788 - RNA, 64 nt, Homo Sapiens; identical to SEQ ID NO: 68488

SEQ ID NO: 194789 - RNA, 64 nt, Homo Sapiens; identical to SEQ ID NO: 68489

SEQ ID NO: 194790 - RNA, 64 nt, Homo Sapiens; identical to SEQ ID NO: 68490

SEQ ID NO: 194791 - RNA, 64 nt, Homo Sapiens; identical to SEQ ID NO: 68491

SEQ ID NO: 194792 - RNA, 64 nt, Homo Sapiens; identical to SEQ ID NO: 68492

SEQ ID NO: 194793 - RNA, 64 nt, Homo Sapiens; identical to SEQ ID NO: 68493

SEQ ID NO: 194794 - RNA, 64 nt, Homo Sapiens; identical to SEQ ID NO: 68494

SEQ ID NO: 194795 - RNA, 64 nt, Homo Sapiens; identical to SEQ ID NO: 68495

SEQ ID NO: 194796 - RNA, 64 nt, Homo Sapiens; identical to SEQ ID NO: 68496

SEQ ID NO: 194797 - RNA, 64 nt, Homo Sapiens; identical to SEQ ID NO: 68497

SEQ ID NO: 194798 - RNA, 64 nt, Homo Sapiens; identical to SEQ ID NO: 68498

SEQ ID NO: 194799 - RNA, 64 nt, Homo Sapiens; identical to SEQ ID NO: 68499

SEQ ID NO: 194800 - RNA, 64 nt, Homo Sapiens; identical to SEQ ID NO: 68500

SEQ ID NO: 194801 - RNA, 64 nt, Homo Sapiens; identical to SEQ ID NO: 68501

SEQ ID NO: 194802 - RNA, 64 nt, Homo Sapiens; identical to SEQ ID NO: 68502

SEQ ID NO: 194803 - RNA, 64 nt, Homo Sapiens; identical to SEQ ID NO: 68503

SEQ ID NO: 194804 - RNA, 64 nt, Homo Sapiens; identical to SEQ ID NO: 68504

SEQ ID NO: 194805 - RNA, 64 nt, Homo Sapiens; identical to SEQ ID NO: 68505

SEQ ID NO: 194806 - RNA, 64 nt, Homo Sapiens; identical to SEQ ID NO: 68506

SEQ ID NO: 194807 - RNA, 64 nt, Homo Sapiens; identical to SEQ ID NO: 68507

SEQ ID NO: 194808 - RNA, 64 nt, Homo Sapiens; identical to SEQ ID NO: 68508

SEQ ID NO: 194809 - RNA, 64 nt, Homo Sapiens; identical to SEQ ID NO: 68509

SEQ ID NO: 194810 - RNA, 64 nt, Homo Sapiens; identical to SEQ ID NO: 68510

SEQ ID NO: 194811 - RNA, 64 nt, Homo Sapiens; identical to SEQ ID NO: 68511

SEQ ID NO: 194812 - RNA, 64 nt, Homo Sapiens; identical to SEQ ID NO: 68512

SEQ ID NO: 194813 - RNA, 64 nt, Homo Sapiens; identical to SEQ ID NO: 68513

SEQ ID NO: 194814 - RNA, 64 nt, Homo Sapiens; identical to SEQ ID NO: 68514

SEQ ID NO: 194815 - RNA, 64 nt, Homo Sapiens; identical to SEQ ID NO: 68515

SEQ ID NO: 194816 - RNA, 64 nt, Homo Sapiens; identical to SEQ ID NO: 68516

SEQ ID NO: 194817 - RNA, 64 nt, Homo Sapiens; identical to SEQ ID NO: 68517

SEQ ID NO: 194818 - RNA, 64 nt, Homo Sapiens; identical to SEQ ID NO: 68518

SEQ ID NO: 194819 - RNA, 64 nt, Homo Sapiens; identical to SEQ ID NO: 68519

SEQ ID NO: 194820 - RNA, 64 nt, Homo Sapiens
auacucuuaaguguaaauaauauaaaauguuucaagcgcuuaacucccccucauucacaaagua

SEQ ID NO: 194821 - RNA, 64 nt, Homo Sapiens
acauucccaauucagugagauuuaugguuugaccagcgcuuaucaugacaguaaauaucagaau

SEQ ID NO: 194822 - RNA, 64 nt, Homo Sapiens
cugaaguauuagauuaaagcggauauucacuuucagcgcuuauaauguuuuuauaaaagcaaaa

SEQ ID NO: 194823 - RNA, 64 nt, Homo Sapiens
guaauuaaaugggggcucuuacugacuuuaaauuagcgcuuauaaaauaaaaauguuuaguuca

SEQ ID NO: 194824 - RNA, 64 nt, Homo Sapiens
uuccuagcgaagugccguaaacacuucaaagagcagcgcuuaaauagaguauaaagcagcuguc

SEQ ID NO: 194825 - RNA, 64 nt, Homo Sapiens
aacauguuccuguuccucggaccuccaaucccccagcgcuuagaagcagucugaaggauucccc

SEQ ID NO: 194826 - RNA, 50 nt, Homo Sapiens; identical to SEQ ID NO: 57621

SEQ ID NO: 194827 - RNA, 64 nt, Homo Sapiens
acuaugugaaguacuguguugcagaaguggcaaaagcgcuuauuuuuaaaaaugcaaaauauuu

SEQ ID NO: 194828 - RNA, 64 nt, Homo Sapiens
augcccccacgugugaacaugauuuggagcugguagcgcuuacgcccaaguucccaucacguca

SEQ ID NO: 194829 - RNA, 64 nt, Homo Sapiens
ccuuacccaggaaauauccuacgguaccaagaguagcgcuuagccuggugagggucagaagggg

SEQ ID NO: 194830 - RNA, 64 nt, Homo Sapiens
uuguuccucuguuaucaugcccuuugggguuuagagcgcuuaagauggaggcaagaaagcauuu

SEQ ID NO: 194831 - RNA, 64 nt, Homo Sapiens
guauauuuaaauacuaccaucugaagcacuauuaagcgcuuaacuagaguaaaagucuaccccu

SEQ ID NO: 194832 - RNA, 64 nt, Homo Sapiens
aaaacaaauuggacagcuacuggucccaaugcucagcgcuuaaaauucauuuguggcaauuaag

SEQ ID NO: 194833 - RNA, 64 nt, Homo Sapiens
gcacgcugucaucauggacagguugguuggacacagcgcuuaguggcuaaaaugccagguaaag

SEQ ID NO: 194834 - RNA, 64 nt, Homo Sapiens
uccaagacuauuuuuuauugucuuuagguauaucagcgcuuaaaacacuuaagccuagaauuuc

SEQ ID NO: 194835 - RNA, 64 nt, Homo Sapiens
ccuuuuucuauuuuagucggcaucccuucucgugagcgcuuagauuugagcauuguauuucucg

SEQ ID NO: 194836 - RNA, 64 nt, Homo Sapiens
gacacgcgggccuuuggugggugcugcuguaguuagcgcuuagugugcacugcucgagacacaa

SEQ ID NO: 194837 - RNA, 64 nt, Homo Sapiens
guauguuuuucuugaauagguauugauaaauggaagcgcuuaccagcccagcuuugccagcccu

SEQ ID NO: 194838 - RNA, 64 nt, Homo Sapiens
aaauccggaaaaaugggguuuuuucuuauuuuagagcgcuuaaaugcuggcuugcacuuucuua

SEQ ID NO: 194839 - RNA, 64 nt, Homo Sapiens
aauugggcuguggcuggggcaggagcuauagggaguuaaggaaugaugauacggaaguuggagc

SEQ ID NO: 194840 - RNA, 64 nt, Homo Sapiens
cgucugcucuacugaguacuuucugcaggggccuguuaaggacgaggccuccccagcccugccc

SEQ ID NO: 194841 - RNA, 64 nt, Homo Sapiens
uacuugcaaauuacauccuugcugaauucaggagguuaaggaaacgauccaugcaagagaggcc

SEQ ID NO: 194842 - RNA, 64 nt, Homo Sapiens
cuggcacauaguacaugcaauauguuugaaacuaguuaaggaauuauaaaaacaaaugaguucu

SEQ ID NO: 194843 - RNA, 64 nt, Homo Sapiens
acccagggacgugguuuuagagucuaccuaauauguuaaggacaaggaaaccucugagucuacc

SEQ ID NO: 194844 - RNA, 64 nt, Homo Sapiens
uaaggacaaggaaaccucugagucuaccuaauauguuaaggacaaggaaaccucuggacagugg

SEQ ID NO: 194845 - RNA, 64 nt, Homo Sapiens
cucuaauucauuggucacugguagguaagcaugaguuaaggaaagucaaaaaugaaaauauauu

SEQ ID NO: 194846 - RNA, 64 nt, Homo Sapiens
aaauuggaaaaaauuaaaacugaccuauaagaguguuaaggaccuaauagagugacauauauaa

SEQ ID NO: 194847 - RNA, 64 nt, Homo Sapiens
uucauauuagaauugugucagcaagcuuaauguaguuaaggaucaaauaaagaucuuaauaaaa

SEQ ID NO: 194848 - RNA, 64 nt, Homo Sapiens
uuaguccauaaaauuggcaauaauuguaggguuaguuaaggaaaaaagacagguaaauguuaua

SEQ ID NO: 194849 - RNA, 64 nt, Homo Sapiens
aauagcaaaagauauuaaauuuaaggauuaacuaguuaaggauuguuaaggauuaacuagcccu

SEQ ID NO: 194850 - RNA, 64 nt, Homo Sapiens
aacuagcccuuuaaggauuaaaaugaagggacuaguuaaggauuauacuggaagauaaugcaca

SEQ ID NO: 194851 - RNA, 64 nt, Homo Sapiens
aagcugaguaucaacuugccaaggucugaacacuguuaaggagauuucuugaauugcuuucgua

SEQ ID NO: 194852 - RNA, 64 nt, Homo Sapiens
acccuuggacucuggggcauaugucagacccuuuguuaaggauaugcacauuuaggaagguuac

SEQ ID NO: 194853 - RNA, 64 nt, Homo Sapiens
uuguuguuuuugccaccguggagagcaacuauuuggagugcacagccuauugaacuaccucauu

SEQ ID NO: 194854 - RNA, 64 nt, Homo Sapiens
uuuuaaaauggagucucacugugucacccaggcuggagugcagugagcugagaucgcaccacug

SEQ ID NO: 194855 - RNA, 64 nt, Homo Sapiens
ggugcgaucaaggcccacuguuaucacccaggcaggagugcaguuuugagacagagucucacuc

SEQ ID NO: 194856 - RNA, 64 nt, Homo Sapiens
gguauagucauagcucacugcugucacccaggcuggagugcaguuguggcgacaaggucuugcu

SEQ ID NO: 194857 - RNA, 64 nt, Homo Sapiens
ugcacaccgccaugccuggccucccgaguagcugggagugcaggagcaauucuccugccucagc

SEQ ID NO: 194858 - RNA, 64 nt, Homo Sapiens
ggcacgaucucggcucacugcuguugcccaggcuggagugcaguuuuugagauggagucuugcc

SEQ ID NO: 194859 - RNA, 64 nt, Homo Sapiens
uuuugagauggacucuagcucugucacccaggcuggagugcaguggugcgaucucggcucacug

SEQ ID NO: 194860 - RNA, 64 nt, Homo Sapiens
ucggagacggaguuucacucuugcugcccaggcuggagugcaauggugcaaugaccucggcuca

SEQ ID NO: 194861 - RNA, 64 nt, Homo Sapiens
uuuuagauggaguuuggcucuugucacccaggcuggagugcaauggcgcaaucucagcucacug

SEQ ID NO: 194862 - RNA, 64 nt, Homo Sapiens
uuugagacagaguuuugcucuuauugcccaggcuggagugcaguggcgugaucuuggcucacug

SEQ ID NO: 194863 - RNA, 64 nt, Homo Sapiens
uuuugagacugagucucgcacugucacccaggguggagugcaguggcgggaucucagcucagug

SEQ ID NO: 194864 - RNA, 64 nt, Homo Sapiens
accugccacagccucccaaagugcuaggaauacaggagugcaccaucgcacccggcuggguuau

SEQ ID NO: 194865 - RNA, 64 nt, Homo Sapiens
uguuuuuuguagacagcacucugucacccaggcuggagugcaguggcaccaucuuggcucacug

SEQ ID NO: 194866 - RNA, 64 nt, Homo Sapiens
uuuuugagacggagucugcucugucgcucgcgcuggagugcaguggcaugaucucggcucacug

SEQ ID NO: 194867 - RNA, 64 nt, Homo Sapiens
uuuugagacagggucucacugugucccccaggcuggagugcaguggcacaaugacgacucacug

SEQ ID NO: 194868 - RNA, 64 nt, Homo Sapiens
ggcaggaucacagcuuacugggguugcccaggguggagugcagucuuuuuuauuuuuugagaca

SEQ ID NO: 194869 - RNA, 64 nt, Homo Sapiens
gagccagcuggaagggaagggaagccccugggauggagugcaggugacugguguccucaggaag

SEQ ID NO: 194870 - RNA, 64 nt, Homo Sapiens
ggcaugaucucagcucacugcugucacccaggcuggagugcagucguugagauacaguuucacu

SEQ ID NO: 194871 - RNA, 64 nt, Homo Sapiens
ggcaugaucucaguuuaugccugucacccaggcuggagugcaguuuuuuggagacagagucuca

SEQ ID NO: 194872 - RNA, 64 nt, Homo Sapiens
ggggggauggaguuucgcuguuguugcccaggcuggagugcaauagcacgaucuuggcucaccg

SEQ ID NO: 194873 - RNA, 64 nt, Homo Sapiens
uuuugaaacagggucucacucuauugcccaggcuggagugcacuggcgugaucucggcucacug

SEQ ID NO: 194874 - RNA, 64 nt, Homo Sapiens
ggcacgaucucggcucacuauugucacccaggcuggagugcagucuugagacggagucuugguc

SEQ ID NO: 194875 - RNA, 64 nt, Homo Sapiens
agcgcagucucggcucacuguuguugcccaggcuggagugcaguuuugagacagaguuucacuc

SEQ ID NO: 194876 - RNA, 64 nt, Homo Sapiens
ggcacgaucucggcucacggcuguugcccaggcuggagugcaguuucugagacagagucucgcu

SEQ ID NO: 194877 - RNA, 64 nt, Homo Sapiens
ggcgcgaucucggcucacugcugucgcccaggcuggagugcaguuuuugagacggagucucgcu

SEQ ID NO: 194878 - RNA, 64 nt, Homo Sapiens
ggcgugaucgcugcucaccguuguugcccaggcuggagugcaauuuuuugagauaauuucacuc

SEQ ID NO: 194879 - RNA, 64 nt, Homo Sapiens
ggugcgaucucggcuggcuggugucgccaaggcuggagugcaguuuuugagacauggucacgcu

SEQ ID NO: 194880 - RNA, 64 nt, Homo Sapiens
ggcacaaucucggcccgcugucucccaggcugcuggagugcaguuuugaaacagucuuacucug

SEQ ID NO: 194881 - RNA, 64 nt, Homo Sapiens
ggcacaaucauggcucacugcugucucccaggcuggagugcaguucuuaagacagagucuugcu

SEQ ID NO: 194882 - RNA, 64 nt, Homo Sapiens
uuuugagacauggucuugcucuauugcccaggcuggagugcagugguacaaucuuagcucacug

SEQ ID NO: 194883 - RNA, 64 nt, Homo Sapiens
ucucaggaacucauggcagugguuuaccuugucaggagugcauggacgggcugccccucccauu

SEQ ID NO: 194884 - RNA, 64 nt, Homo Sapiens
cuucuccauaucuccauggccuuccauacacagaggagugcagcccgccauggugucccgguac

SEQ ID NO: 194885 - RNA, 64 nt, Homo Sapiens
ggcaugaucauagcucacugcugucccccaggcuggagugcaguuuaugagacagggucuugcu

SEQ ID NO: 194886 - RNA, 64 nt, Homo Sapiens
gguacgaucuuggcucagugcucucgcccaggcuggagugcaacuuuugagacagaaucucacu

SEQ ID NO: 194887 - RNA, 64 nt, Homo Sapiens
ggugcaaucuuggcucacuacugucucccaggcuggagugcaauggggugcggggcaguucacu

SEQ ID NO: 194888 - RNA, 64 nt, Homo Sapiens
ggcgcaaucucaccucacugcugucaccuaggcuggagugcaguuuuugagacagagucucgcu

SEQ ID NO: 194889 - RNA, 64 nt, Homo Sapiens
ggugcaaucucggcucacugcugucacccaggcuggagugcaauuuuuuuuuuuucgagacacu

SEQ ID NO: 194890 - RNA, 64 nt, Homo Sapiens
ggcgcgaucuuggcccaccacugucccccaggcuggagugcaguuuuugagacagagucucacu

SEQ ID NO: 194891 - RNA, 64 nt, Homo Sapiens
ggcgcaauuucagcucacugcugucacugaggcuggagugcaguuuuuuuuuuugagucuugcu

SEQ ID NO: 194892 - RNA, 64 nt, Homo Sapiens
ggcgcgaucucggcucacugcugucacccagacuggagugcaguuuuugagacagagucucacu

SEQ ID NO: 194893 - RNA, 64 nt, Homo Sapiens
uuuagugacagagucucauucuguugcccaugcuggagugcaguggcgugaucauagcucacug

SEQ ID NO: 194894 - RNA, 64 nt, Homo Sapiens
uuuugagacggagucuugcucuguugcccaggcuggagugcaguggcacaaucucagcucacug

SEQ ID NO: 194895 - RNA, 64 nt, Homo Sapiens
uuuuuuuuuugagacucgcuuugucacccaggcuggagugcaauggcacaaucucaacucaccg

SEQ ID NO: 194896 - RNA, 64 nt, Homo Sapiens
uuuugagacagcaucucacacugucgcccaggcuggagugcaguggugcaaucucagcuuacug

SEQ ID NO: 194897 - RNA, 64 nt, Homo Sapiens
uuuuggagacagagucuugcuuuguugccaggcuggagugcaguggcgcgaucucggcucacca

SEQ ID NO: 194898 - RNA, 64 nt, Homo Sapiens
aauggagacagggucuugcacuaucacccaggcuggagugcaguggcauaaucauaccucauug

SEQ ID NO: 194899 - RNA, 64 nt, Homo Sapiens
ggcacgaucucggcucaccguuguugcccaggcuggagugcaacuuugagacagaguuucgcuc

SEQ ID NO: 194900 - RNA, 64 nt, Homo Sapiens
ggcacaaucucgacucacuguuguuacccaggcuggagugcaguuuuugagauagggucucacu

SEQ ID NO: 194901 - RNA, 64 nt, Homo Sapiens
ggcgugaucucggcucacuguugucacccgggcuggagugcaguuuugagaugaagucucgcgg

SEQ ID NO: 194902 - RNA, 64 nt, Homo Sapiens
ggcaugaucucagcucacugaugucacccaggcuggagugcaauaguggggacagagucucacu

SEQ ID NO: 194903 - RNA, 64 nt, Homo Sapiens
caggaugccccaaaugucgugucagaauguuaaaggagugcaugaucuguuaagagagucacua

SEQ ID NO: 194904 - RNA, 64 nt, Homo Sapiens
ggugcgaucucagcucacuguugucauccaggcuggagugcaguuuuugagacggagucucgcu

SEQ ID NO: 194905 - RNA, 64 nt, Homo Sapiens
cuuaauuuuuuuuugagacagagucacccaggcuggagugcaguggugagauuuuggcucacua

SEQ ID NO: 194906 - RNA, 64 nt, Homo Sapiens
uuugagauggaguuuugcucuuguugcccagacuggagugcaauggcacacgaucucggcucac

SEQ ID NO: 194907 - RNA, 64 nt, Homo Sapiens
uuuugagacagagucuugcucugucacccaggcuggagugcaguggugcgaucgcucacugcaa

SEQ ID NO: 194908 - RNA, 64 nt, Homo Sapiens
uuuugagauggagucucacucugucacccaggcuggagugcaguggcgugaucuuggcucacug

SEQ ID NO: 194909 - RNA, 64 nt, Homo Sapiens
gucugagacagaaucucagucugucacccagguuggagugcaguggcgugaucucagcucacug

SEQ ID NO: 194910 - RNA, 64 nt, Homo Sapiens
uuuuugagacagagucuuacucuguugccaggcuggagugcaguggcgcgaucucagcucacua

SEQ ID NO: 194911 - RNA, 64 nt, Homo Sapiens
uuuugagacagagucuuccucugucuccuaagcuggagugcaguggcaucaucucagcucacug

SEQ ID NO: 194912 - RNA, 64 nt, Homo Sapiens
uuuugagauggcaucuugcucugucgcccaggauggagugcaguggcgcgaucuuagcucacug

SEQ ID NO: 194913 - RNA, 64 nt, Homo Sapiens
gcagccguguggagccugggacuuugagcagcagggagugcauuugcuggggugucggggaccc

SEQ ID NO: 194914 - RNA, 64 nt, Homo Sapiens
uuugagauggaguuucgcucuugucacccacgcuggagugcaaugguguggucuuggcuuauug

SEQ ID NO: 194915 - RNA, 64 nt, Homo Sapiens
uuuuauggcagggucucacucugucgcccaggcuggagugcaguggcgugaucucggcucacua

SEQ ID NO: 194916 - RNA, 64 nt, Homo Sapiens
ggugcaaucuuggcucgcaauugucacccaggcuggagugcaguuuugagacaaaguuuugcuc

SEQ ID NO: 194917 - RNA, 64 nt, Homo Sapiens
ggcacgaucucagcucacugcuguggcccaggcuggagugcaguuuuugagaccaaaucuugcu

SEQ ID NO: 194918 - RNA, 64 nt, Homo Sapiens
ggugccaucaugacucacugcugucacccaggcuggagugcaguguuuuugagacgaggucuca

SEQ ID NO: 194919 - RNA, 64 nt, Homo Sapiens
ggcgugaucuuggcucacugcugucucccaggcuggagugcaguguuugagauggagucucacu

SEQ ID NO: 194920 - RNA, 64 nt, Homo Sapiens
uuuugagacagauucuugcucugucacccaggcuggagugcaguagcaugaucagggaucacug

SEQ ID NO: 194921 - RNA, 64 nt, Homo Sapiens
uuugagaugggggucuugcucuguugcccacgcaggagugcaguggcaugcucucagcucacug

SEQ ID NO: 194922 - RNA, 64 nt, Homo Sapiens
uuuugagauggagucucgcucugucgcccaggcuggagugcaguggcgcaaucucagcucacug

SEQ ID NO: 194923 - RNA, 64 nt, Homo Sapiens
uuuaaggacagagucucucucugucacccaggcuggagugcaauggcgcgaucuuggcucacug

SEQ ID NO: 194924 - RNA, 64 nt, Homo Sapiens
uuuugagauggagucucgcucugucgcccagguuggagugcaguggcgcaaucucggcucacug

SEQ ID NO: 194925 - RNA, 64 nt, Homo Sapiens
uuuuuugagacagucuccuggugucacccaggcuggagugcaguggugugaucuuggcucacug

SEQ ID NO: 194926 - RNA, 64 nt, Homo Sapiens
ggugcgaucucagcucacugcugucgcccaggcuggagugcaguuuuugagacggagucucacu

SEQ ID NO: 194927 - RNA, 64 nt, Homo Sapiens
ggcacaaucucagcucacaguuguuguccagucuggagugcaauuuugagacagaguuucacuc

SEQ ID NO: 194928 - RNA, 64 nt, Homo Sapiens
ggcacaaucuuggcucacugacuguugccaggcuggagugcaguuuuuuuugagauggauucuc

SEQ ID NO: 194929 - RNA, 64 nt, Homo Sapiens
ggcgcgaucucagcucacuguccuugcccaggcuggagugcaguuuuuuuuuuuugagacggag

SEQ ID NO: 194930 - RNA, 64 nt, Homo Sapiens
ggugugauccuggcucacuguguugccccaggcuggagugcagucccaagauggugucucacuc

SEQ ID NO: 194931 - RNA, 64 nt, Homo Sapiens
ggugcgaucgcggcucaccguuguugcccaggcuggagugcaguguugagauguaauuuugcuc

SEQ ID NO: 194932 - RNA, 64 nt, Homo Sapiens
ggugcaaugugggcucacuguuguugcccaagcuggagugcaguuuugagacagagucucacuc

SEQ ID NO: 194933 - RNA, 64 nt, Homo Sapiens
ggcacgaucucggcucacugcugucacccaggcuggagugcaguuuuugagagguagucuugcu

SEQ ID NO: 194934 - RNA, 64 nt, Homo Sapiens
ggugucaucucagaucacugucugucaccaggccggagugcaguauuuugagauagagccuugc

SEQ ID NO: 194935 - RNA, 64 nt, Homo Sapiens
ggcgcagucuuggcucaccuuuguugccuaggcuggagugcaguuuuuagacagaguuuugcuc

SEQ ID NO: 194936 - RNA, 64 nt, Homo Sapiens
ggugugaucucagcucacugcugucaucuaggcuggagugcaguuuuugagauggagucucgcu

SEQ ID NO: 194937 - RNA, 64 nt, Homo Sapiens
ggugcgaucucagcucacugcuguuacccaggcuggagugcaguuucaagacagggucucaacu

SEQ ID NO: 194938 - RNA, 64 nt, Homo Sapiens
ggcgugaucuuggcucacaguuguugcccaggcuggagugcaauuuugagacagaauuuugcuc

SEQ ID NO: 194939 - RNA, 64 nt, Homo Sapiens
guugcaguccggcucacugccugucacccaggcuggagugcaguuuuugagacagggucucaca

SEQ ID NO: 194940 - RNA, 64 nt, Homo Sapiens
ggugcaaucacuguuuauugcugucacccaggcuggagugcaguggagggggcaggguuucacu

SEQ ID NO: 194941 - RNA, 64 nt, Homo Sapiens
ggcggccuuggguguggagagcgcccuccugcugggagugcagguuuucgggccgccggugcgg

SEQ ID NO: 194942 - RNA, 64 nt, Homo Sapiens
uuuuagauggaguuuuacucuuguugcccaggcuggagugcaacggcaugauuuuggcucacug

SEQ ID NO: 194943 - RNA, 64 nt, Homo Sapiens
uuuugaggcagagucucauucuguugcccaggcuggagugcaguggcgugaucuuggcucacua

SEQ ID NO: 194944 - RNA, 64 nt, Homo Sapiens
gaagaugaaccuuccaccgucuucacugcauccuggagugcaaaaauaaaauccacucaagagu

SEQ ID NO: 194945 - RNA, 64 nt, Homo Sapiens
uuuugagacagggucucacucugucacccaggcuggagugcaguggcacauucucggcucacug

SEQ ID NO: 194946 - RNA, 51 nt, Homo Sapiens
ucccagccgacgacgucugauggagugcauugugcacaugaaguauuuauc

SEQ ID NO: 194947 - RNA, 64 nt, Homo Sapiens
uuuugagacagggucuugcuuuguugcccaggcuggagugcagugacguggucauagcucacug

SEQ ID NO: 194948 - RNA, 64 nt, Homo Sapiens
ggcaguuguuucaccguaaccuguuguccaggcuggagugcaauuuuugagauggaguuucgcu

SEQ ID NO: 194949 - RNA, 64 nt, Homo Sapiens
ggcacagucuuggcucacugcuguugugcaggcuggagugcaguuuugagauggagucuugcuc

SEQ ID NO: 194950 - RNA, 64 nt, Homo Sapiens
ggcgcaaucuuggcucacugucuguugccaggcuggagugcaguuuucugauacagagucucac

SEQ ID NO: 194951 - RNA, 64 nt, Homo Sapiens; identical to SEQ ID NO: 93186

SEQ ID NO: 194952 - RNA, 64 nt, Homo Sapiens; identical to SEQ ID NO: 93187

SEQ ID NO: 194953 - RNA, 64 nt, Homo Sapiens; identical to SEQ ID NO: 93188

SEQ ID NO: 194954 - RNA, 64 nt, Homo Sapiens; identical to SEQ ID NO: 93189

SEQ ID NO: 194955 - RNA, 64 nt, Homo Sapiens; identical to SEQ ID NO: 93190

SEQ ID NO: 194956 - RNA, 64 nt, Homo Sapiens; identical to SEQ ID NO: 93191

SEQ ID NO: 194957 - RNA, 64 nt, Homo Sapiens; identical to SEQ ID NO: 93192

SEQ ID NO: 194958 - RNA, 64 nt, Homo Sapiens; identical to SEQ ID NO: 93193

SEQ ID NO: 194959 - RNA, 64 nt, Homo Sapiens; identical to SEQ ID NO: 93194

SEQ ID NO: 194960 - RNA, 64 nt, Homo Sapiens; identical to SEQ ID NO: 93195

SEQ ID NO: 194961 - RNA, 64 nt, Homo Sapiens; identical to SEQ ID NO: 93196

SEQ ID NO: 194962 - RNA, 64 nt, Homo Sapiens; identical to SEQ ID NO: 93197

SEQ ID NO: 194963 - RNA, 64 nt, Homo Sapiens; identical to SEQ ID NO: 93198

SEQ ID NO: 194964 - RNA, 64 nt, Homo Sapiens; identical to SEQ ID NO: 93199

SEQ ID NO: 194965 - RNA, 64 nt, Homo Sapiens
gacuguggaguuccauucuuggcaucuacucuggaccaaggagcaucccuaauucuucauaggg

SEQ ID NO: 194966 - RNA, 64 nt, Homo Sapiens
caaaugcuuguugauagccuuuuucuaucaagaaaccaaggagcuaauuauuaauaacaaucau

SEQ ID NO: 194967 - RNA, 64 nt, Homo Sapiens
gagaucggaguuuugcagccacaagcuaagaaacaccaaggauuguggcaaccaucagaagcuu

SEQ ID NO: 194968 - RNA, 64 nt, Homo Sapiens
acgaagaaagaauaaauuucggcuguuuuaagccaccaaggauaauugguuacagcagcucuag

SEQ ID NO: 194969 - RNA, 64 nt, Homo Sapiens
gaagaagcagauccccuguguggucuccaugcucaccaaggaacucuacuucagucaauagcca

SEQ ID NO: 194970 - RNA, 64 nt, Homo Sapiens
accuuacugcccaggccuaucuggaagccaccucaccaaggaccuuggaagagcaagggacagu

SEQ ID NO: 194971 - RNA, 64 nt, Homo Sapiens
cuggauaccugugugucuccauaaaaguccugucaccaaggacguuaaaggcauuuuauuccag

SEQ ID NO: 194972 - RNA, 64 nt, Homo Sapiens
accggccuugugacauucacucagagaagaccacaccaaggaggcggccgcuggcccaggagag

SEQ ID NO: 194973 - RNA, 64 nt, Homo Sapiens
ggcggccggagggcggguacugagguccauccugaccaaggagcuggcggaagccccacggcgg

SEQ ID NO: 194974 - RNA, 64 nt, Homo Sapiens
uaaggguggaggaggugaggaauuccccuuuaagaccaaggagacgucaaugacaaugcccccg

SEQ ID NO: 194975 - RNA, 64 nt, Homo Sapiens
aucuaauuauuuccacuugcccuguucucuucacaccaaggaagcuccagauccaguaucuugu

SEQ ID NO: 194976 - RNA, 64 nt, Homo Sapiens
cuugggaucagaucaagaguuuuggagaucagguaccaaggaaauaaggacagucuagcugccu

SEQ ID NO: 194977 - RNA, 64 nt, Homo Sapiens
ugaacaugcuuccagugauuaugccucuucaaacaccaaggaguaagggcucuauguuuguguc

SEQ ID NO: 194978 - RNA, 64 nt, Homo Sapiens
gaugcagagacuauauuuagagaugaaugaaagaaccaaggagacuuuuuuaaagaacagaaaa

SEQ ID NO: 194979 - RNA, 64 nt, Homo Sapiens
acaguuuuaggcuuccaaagguagagauaggaugaccaaggacauuaaaaaauacaauaaauuu

SEQ ID NO: 194980 - RNA, 64 nt, Homo Sapiens
uugugguacgaccccuccccaggucccuauauugaccaaggagugcuggggcgcacggagaagc

SEQ ID NO: 194981 - RNA, 64 nt, Homo Sapiens
ugauaaaguuuaaauaauuuuauuaaggucauguaccaaggauuauuuaacaaauacuuaauug

SEQ ID NO: 194982 - RNA, 64 nt, Homo Sapiens
gauggugcagucccuguguccaggcaccaugcaaaccaaggaugcaguaauacaggaagcaugg

SEQ ID NO: 194983 - RNA, 64 nt, Homo Sapiens; identical to SEQ ID NO: 73420

SEQ ID NO: 194984 - RNA, 64 nt, Homo Sapiens; identical to SEQ ID NO: 73421

SEQ ID NO: 194985 - RNA, 64 nt, Homo Sapiens
gggccgcagcagugcuggguguucucagaccugacugaggaaguuagcugcgggcugcccugug

SEQ ID NO: 194986 - RNA, 64 nt, Homo Sapiens
gcuuuucuuucugcuucaaacacacaguucgucucugaggaaaguaaaauaaauggaauaagag

SEQ ID NO: 194987 - RNA, 64 nt, Homo Sapiens
uuuccaucccacuccacuauguugucuauuuuuucugaggaauuaaggguuaccccacccugcc

SEQ ID NO: 194988 - RNA, 64 nt, Homo Sapiens
agaccuagauaggucaugcaagugagaaagacaucugaggaaaauggaagaccuaaggcagaca

SEQ ID NO: 194989 - RNA, 64 nt, Homo Sapiens
cugauuucaauuaggcagcacuucccaaagugcacugaggaagguggccccaagagaagcucuc

SEQ ID NO: 194990 - RNA, 64 nt, Homo Sapiens
cccauagaucuaguauuguacagcacugcauucucugaggaagucccaguccaaacucugauuu

SEQ ID NO: 194991 - RNA, 64 nt, Homo Sapiens
uaauccuugugccauagaaguuacaagguugaaucugaggaaaaucagaaagcaaacaacacaa

SEQ ID NO: 194992 - RNA, 64 nt, Homo Sapiens
uguguuccuaugggaacuaucaaaggugugagagcugaggaauauugcccaucuccugugucuu

SEQ ID NO: 194993 - RNA, 64 nt, Homo Sapiens
ccucucccgugccuuuagaggaaggagaggauugcugaggaaugcagggacgccuguuucuguc

SEQ ID NO: 194994 - RNA, 64 nt, Homo Sapiens
ccuuguuuucagugcugcgguaucagucagugaucugaggaaauccuguaggggaaggcaggcu

SEQ ID NO: 194995 - RNA, 64 nt, Homo Sapiens
gacagccaggaggcugcagcuaccacgagggccucugaggaaccuccuuccaggccugggauga

SEQ ID NO: 194996 - RNA, 64 nt, Homo Sapiens
ugccuuaggcacuucucgggaauuugaggccagccugaggaacugcaggacucaggugcaaugu

SEQ ID NO: 194997 - RNA, 64 nt, Homo Sapiens
ugauggucucucccuccuggccucaggcccauuccugaggaagggccuuggcgagcuuguggau

SEQ ID NO: 194998 - RNA, 64 nt, Homo Sapiens
cuuucugcccagaaaaaugugcagcuugacucugcugaggaaaagguccaagccaagaggacug

SEQ ID NO: 194999 - RNA, 64 nt, Homo Sapiens
cuagguaguuuuccuuuuggauccugacuuuuaucugaggaaguuccuguuuuaauuccuaaag

SEQ ID NO: 195000 - RNA, 64 nt, Homo Sapiens
gcuaacuuccacagcauuguuuugugaauuacuucugaggaaauuagauaaggauaaaaauaua

SEQ ID NO: 195001 - RNA, 64 nt, Homo Sapiens
ggaggagaggacaaguguaaaaaaaauguuauuacugaggaaagaaaauacauuauuagaauau

SEQ ID NO: 195002 - RNA, 64 nt, Homo Sapiens
gagggaaaguuccagcaguuguuacucagaugaccugaggaaagaaggggauggcccauuaaga

SEQ ID NO: 195003 - RNA, 64 nt, Homo Sapiens
gcacugagccacugcgcccagccaacaauccgcucugaggaaagcguaagcaggaagaccucuu

SEQ ID NO: 195004 - RNA, 64 nt, Homo Sapiens
ccuaguuguguuuggaaagggagagaagagaugucugaggaaggucauguucuuucagcuuaug

SEQ ID NO: 195005 - RNA, 64 nt, Homo Sapiens
uucugguugcaggugcaaaguuaugguuggaaaacugaggaaucaaaguaguagucagaaugaa

SEQ ID NO: 195006 - RNA, 64 nt, Homo Sapiens
auugauacccaguuaauuuuuuugccuuugaaggcugaggaaaggaaagaggaaguggagucau

SEQ ID NO: 195007 - RNA, 64 nt, Homo Sapiens
aagcugagcaccaggggaugaguggagguuaaggcugaggaaaggccagcuggcagcagagugu

SEQ ID NO: 195008 - RNA, 64 nt, Homo Sapiens
ugacucuaggugcccuuggaggccagccagugaccugaggaagcgugaaggccgagaagcaaga

SEQ ID NO: 195009 - RNA, 64 nt, Homo Sapiens
uuuuaucuccauuuuccaguuagguagagccaagcugaggaauccuuuuaagauuauuagaaaa

SEQ ID NO: 195010 - RNA, 64 nt, Homo Sapiens
uucuaugauaauuuaaaauacauagguagggcuacugaggaaauuuggagagccacauucugug

SEQ ID NO: 195011 - RNA, 64 nt, Homo Sapiens
aagggacacggaacagggucgcuuucuccagcagcugaggaaaggcucccucucccgugccucu

SEQ ID NO: 195012 - RNA, 64 nt, Homo Sapiens
cuaaguccaguuuuccuucuaggaaccucaugcucugaggaaguucuguucauucuucacaggc

SEQ ID NO: 195013 - RNA, 64 nt, Homo Sapiens
acccaaaugagugccaccaagcugaacaaggaaacugaggaaucaaggaaacagauaucauaga

SEQ ID NO: 195014 - RNA, 64 nt, Homo Sapiens
uauauucaacugugaagaagaguuucagccagcgcugaggaaaaggaggccccaguccccagac

SEQ ID NO: 195015 - RNA, 64 nt, Homo Sapiens
ucaucagagaagcauggaagcaguugucucagugcugaggaaccugugcaaaguuaggucuucc

SEQ ID NO: 195016 - RNA, 64 nt, Homo Sapiens
gaaggaagggaauaaucuuuacauguggacucaccugaggaagguggauugucuccugaugagu

SEQ ID NO: 195017 - RNA, 64 nt, Homo Sapiens
ccaucuguugacaaugucuuguggagcauuuuugcugaggaaaaggucacuuguaaacagagga

SEQ ID NO: 195018 - RNA, 64 nt, Homo Sapiens
cuuuguuucuuuuuaauuaaaauacaagaagcagcugaggaaagggagacaagguauuuuauuu

SEQ ID NO: 195019 - RNA, 64 nt, Homo Sapiens
caaaaccuguuuucuacuugacguucauuaaucucugaggaaaaggcagggcgggggaggggga

SEQ ID NO: 195020 - RNA, 64 nt, Homo Sapiens
aaacuuuuuuuuuuuuuuuuuucaaaguauguuacugaggaaguuggagucacuuuuuuccccc

SEQ ID NO: 195021 - RNA, 64 nt, Homo Sapiens
ggcaucacuugaaccaggagaacacuuugggaggcugaggaaggguggcucagccuacaauccc

SEQ ID NO: 195022 - RNA, 64 nt, Homo Sapiens
cucaacuggggcuggagccacaaggccacuucgucugaggaaggguugcaguuaagacaucagc

SEQ ID NO: 195023 - RNA, 64 nt, Homo Sapiens
uggaaagcucagguggcagcggacucugacuccacugaggaacugccucagaagcugcgaucac

SEQ ID NO: 195024 - RNA, 64 nt, Homo Sapiens
ggcugggggaugacagugugggagcugugggguacugaggaagacaccauuccuugacgguguc

SEQ ID NO: 195025 - RNA, 64 nt, Homo Sapiens
aagggugcagccugccacaggcuccucauccggacugaggaagacgaggacagggaggaggaaa

SEQ ID NO: 195026 - RNA, 64 nt, Homo Sapiens
ggggauaaagaggggcccgacuuuugccacccuccugaggaagccccuagguccacacagugau

SEQ ID NO: 195027 - RNA, 64 nt, Homo Sapiens
cacuauacaagaguggcuauaggaaaaaagaaaguguaucuauccuuuuguauucaaaugaagu

SEQ ID NO: 195028 - RNA, 64 nt, Homo Sapiens
uauugccaauuuguguuaccagacaaucuguuaauguaucuaauucgaaucagcaaagacugac

SEQ ID NO: 195029 - RNA, 64 nt, Homo Sapiens
auguacccuaguagucgaacuuugaugucuaaucuguaucuauaaauuuguaguauuuucuugu

SEQ ID NO: 195030 - RNA, 64 nt, Homo Sapiens
uuucacauguggaaacuuucauuuuguucacuguuguaucuauaauguacaugggaggccacau

SEQ ID NO: 195031 - RNA, 64 nt, Homo Sapiens
cccugcccuggaguccguuucuggagacuagaaauguaucuaaauugggggaacagaaugaaug

SEQ ID NO: 195032 - RNA, 64 nt, Homo Sapiens
aguagucauuuguucuaaaucuauacauauuacuuguaucuagugcagaauaagcuauaacauc

SEQ ID NO: 195033 - RNA, 64 nt, Homo Sapiens
cguguauuuuguagcugucaaucuacacgcauccuguaucuacaagagauguucagcauccugu

SEQ ID NO: 195034 - RNA, 64 nt, Homo Sapiens
cgcauccuguaucuacacgugauguucagcauccuguaucuacaccuuggaaagacaacccaga

SEQ ID NO: 195035 - RNA, 64 nt, Homo Sapiens
cacuaccuuaucaggcaaauuggggaggggaggguguaucuagcucuaguucaaauuauuugga

SEQ ID NO: 195036 - RNA, 64 nt, Homo Sapiens
guuugagaccagccuggccaacauggugaaacccuguaucuacuaaaaauacaaaaauuagccg

SEQ ID NO: 195037 - RNA, 64 nt, Homo Sapiens
uacacuucuguaaaucucuugcauuauucauauguguaucuauaucugcauaauguuuguuaau

SEQ ID NO: 195038 - RNA, 64 nt, Homo Sapiens
auaguuuuauuugauuaggauugaacaguucaguuguaucuaugccccacagugaccaguaaag

SEQ ID NO: 195039 - RNA, 64 nt, Homo Sapiens
caauguauuugucaaugcauauguaggcaauacauguaucuaaaaccaucuaaucuaugcaugu

SEQ ID NO: 195040 - RNA, 64 nt, Homo Sapiens
aucuaaucuaugcauguauguuuauuuacaucuauguaucuaccauagacaauuugcccuauca

SEQ ID NO: 195041 - RNA, 64 nt, Homo Sapiens
agcuaagggauuguaaauacaccgaugggcacucuguaucuagcucaagguuuguaaacacacc

SEQ ID NO: 195042 - RNA, 64 nt, Homo Sapiens
gguggggacuuggagaaccuuuguguccacacucuguaucuagcuaaucuaguggggaugugga

SEQ ID NO: 195043 - RNA, 64 nt, Homo Sapiens
cauauggcucuugaggacuuauuaaaaaacauuguguaucuauaugaucucuguuuuaaagauu

SEQ ID NO: 195044 - RNA, 64 nt, Homo Sapiens
uaaauagcacaguuuggaaagagaauuucucaauuguaucuaguacuauauaaaauuuucauuu

SEQ ID NO: 195045 - RNA, 64 nt, Homo Sapiens
guauaauaaaacugaaacaaaaaugagacuuuuuauauguuaauauuccuuuagaugucucaua

SEQ ID NO: 195046 - RNA, 64 nt, Homo Sapiens
uauacuugcaaugugacauguggacuuuacaaguauauguuauaugaaauauagaugggaaaug

SEQ ID NO: 195047 - RNA, 64 nt, Homo Sapiens
ccaucagugaggcagcaguuacuucaaggauaugauauguuaaugaauccaaagaagaugggag

SEQ ID NO: 195048 - RNA, 64 nt, Homo Sapiens
gacuaaauggcuauucacaggaaacugauaagauauauguuauuuuuuuaaaugagcuagggca

SEQ ID NO: 195049 - RNA, 64 nt, Homo Sapiens
cuaaggguguaaguaauuauagacagugaucuccauauguuacauaccacagugucuguaucgg

SEQ ID NO: 195050 - RNA, 64 nt, Homo Sapiens
cucagugucauuuaugaaaaggaauaaggccuuaauauguuaacagguucaacuguugauugca

SEQ ID NO: 195051 - RNA, 64 nt, Homo Sapiens
aaauauguucauuaaagcucuucucagauuauacauauguuauaagucuauggaguauuuucaa

SEQ ID NO: 195052 - RNA, 64 nt, Homo Sapiens
ugaaacaagccaggaacagauggaauuggagggcauauguuaaggucauucaggacaacaugga

SEQ ID NO: 195053 - RNA, 64 nt, Homo Sapiens
gguauguaucagacauauuuccauacuuuguuauauauguuaguuucucucugugaaauaaaug

SEQ ID NO: 195054 - RNA, 64 nt, Homo Sapiens
gccaaguagguuaacuggugaaagggaauuuagaauauguuaagaaacauugaugugauucuug

SEQ ID NO: 195055 - RNA, 64 nt, Homo Sapiens
gagcacccagggacgugguuuuagagucuaccuaauauguuaaggacaaggaaaccucugaguc

SEQ ID NO: 195056 - RNA, 64 nt, Homo Sapiens
auguuaaggacaaggaaaccucugagucuaccuaauauguuaaggacaaggaaaccucuggaca

SEQ ID NO: 195057 - RNA, 64 nt, Homo Sapiens
acaaucucuuaccuagagcacugaaagacaaaauauauguuaauauuaaguugaauuugaaugg

SEQ ID NO: 195058 - RNA, 64 nt, Homo Sapiens
auuauuuuugauuccuggcuugugugcucuauuaauauguuaccgucugagccacagccaauug

SEQ ID NO: 195059 - RNA, 64 nt, Homo Sapiens
cccuuugaaaaaauaguccuaauaauuugaacaaauauguuaguaaugauggaacagaucaaug

SEQ ID NO: 195060 - RNA, 64 nt, Homo Sapiens
agauauucaaaaguaugcauguagaauuuaaagaauauguuaaaaauuauuaauuuuaauauuu

SEQ ID NO: 195061 - RNA, 64 nt, Homo Sapiens
acuaaauuauaaacagaguuaacuugaaccuuuuauauguuaugcauugauucuaacaaacugu

SEQ ID NO: 195062 - RNA, 64 nt, Homo Sapiens
guguguuuuuccaugaaugaauauaccgugguucauauguuagcauggcagcauuuucagauag

SEQ ID NO: 195063 - RNA, 64 nt, Homo Sapiens
acugacauaauuugauuacauacuaaauaagaggauauguuaauaugaggaaauguaaauuaaa

SEQ ID NO: 195064 - RNA, 64 nt, Homo Sapiens
aaauauagauugagcuauguuaguuugcaauaauauauguuaacuuuaguaauuaaagacuggu

SEQ ID NO: 195065 - RNA, 64 nt, Homo Sapiens
agccugagcuuagaaguauuugugcauuauauuuauauguuaaguuuuugcaguauauuuauuu

SEQ ID NO: 195066 - RNA, 64 nt, Homo Sapiens
gguuaucaucauuauuuguagagacacaagagcuauauguuagaaagcacuuagaauagugucu

SEQ ID NO: 195067 - RNA, 64 nt, Homo Sapiens
aaauaaaauuauuuugcugaauguauauguuaccauauguuagggcaaggggagcacauauugg

SEQ ID NO: 195068 - RNA, 64 nt, Homo Sapiens
auauguuaggaaauaaaauucacauauuggauguauauguuaccgaauagaugugcaaggggag

SEQ ID NO: 195069 - RNA, 64 nt, Homo Sapiens
uaaucgccaaaaacacacuggccaguguaccauaauauguuaccagaagaguuauuaucuauuu

SEQ ID NO: 195070 - RNA, 64 nt, Homo Sapiens
uuuaaaugacaucugccugggauguaccacaaccauauguuaccuguaucuuaggggaauggau

SEQ ID NO: 195071 - RNA, 64 nt, Homo Sapiens
gugcucucaaugcauuuacccauucguuauauaaauauguuacaucaggacaacuuugagaaaa

SEQ ID NO: 195072 - RNA, 64 nt, Homo Sapiens
ggcauggaauuuuauaugcuagugagucauaaugauauguuaguguuaauuaguuuuuucuucc

SEQ ID NO: 195073 - RNA, 64 nt, Homo Sapiens
accauuuuccagauuggaaaaggcaaaacaacucauauguuaagagauugauguucuucaaacu

SEQ ID NO: 195074 - RNA, 64 nt, Homo Sapiens
ucuagguaacucccuuugugaacacaaagcuauuauauguuauugaaaaaaucuuacauguaau

SEQ ID NO: 195075 - RNA, 64 nt, Homo Sapiens
agauuaaauuuauuaaaauuguauuauucuuuugauauguuauuaaaaaaacucuagucauuug

SEQ ID NO: 195076 - RNA, 64 nt, Homo Sapiens
ccaaccuuucauuccugaaaacauugauggcacgauauguuaaagucuguuaauaugguacauu

SEQ ID NO: 195077 - RNA, 64 nt, Homo Sapiens
uucacuuggaggcuaaaaaucagaugcauaggcaauauguuaagucuaaaagucuauaaagaau

SEQ ID NO: 195078 - RNA, 64 nt, Homo Sapiens
ugaaauguuaaauuuaauauaauguuugcuauauauauguuacucaugaaagaguauuuggcug

SEQ ID NO: 195079 - RNA, 64 nt, Homo Sapiens
ugcuuuuaucacuuugagaauuauacuguaaaguauauguuaaaaugcauaguacuuaauuugu

SEQ ID NO: 195080 - RNA, 64 nt, Homo Sapiens
auguauguggcacuugaggcuacauucuuuugugauauguuauucuguaaucugcuaaaccaua

SEQ ID NO: 195081 - RNA, 64 nt, Homo Sapiens
auauccaagaaguacuaauaaggaaacaaaaccuauauguuauauuaaacaguuuacagucuaa

SEQ ID NO: 195082 - RNA, 64 nt, Homo Sapiens
cuaucaagcacuacuuagaaacuggaaaacauauauauguuagcaucaaagggggcagaagcaa

SEQ ID NO: 195083 - RNA, 64 nt, Homo Sapiens
ggcuuaccccuagcuuuugaccuuugcauuucauauauguuagaugucucagcaagaauaucug

SEQ ID NO: 195084 - RNA, 64 nt, Homo Sapiens
guuucucuuccauuguacauguggguuauauaccauauguuaaauaugcaauaaaguguuuaca

SEQ ID NO: 195085 - RNA, 64 nt, Homo Sapiens
agaaauaaaagaacacuuuuaguauuuauacaauauauguuacuuggaagugcauauaaaauag

SEQ ID NO: 195086 - RNA, 64 nt, Homo Sapiens
auaaauuacauguacuuuauauguauauaguaaaauauguuacugagaauaugauuuuuuccau

SEQ ID NO: 195087 - RNA, 64 nt, Homo Sapiens
guaccccaccuguaaguuauuuaguggguaagggauauguuacagauucaaaugguuuacauau

SEQ ID NO: 195088 - RNA, 64 nt, Homo Sapiens
cacuagacauccugguuaucagcaagaguuugaaauauguuaaagacaguauuugacuacauau

SEQ ID NO: 195089 - RNA, 64 nt, Homo Sapiens
aaagcuuaacacauggggcuucaucgcucauagaauauguuauuuucaaagaaguucaagaauu

SEQ ID NO: 195090 - RNA, 64 nt, Homo Sapiens
guauuuacaaagaaagguacuuucuuaagagcauauauguuauuaauauuugauaugauuuuaa

SEQ ID NO: 195091 - RNA, 64 nt, Homo Sapiens
gaaccaguucauuauaccuuaugcauuaaauuaaauauguuauaagguggcuuuacuugucuuu

SEQ ID NO: 195092 - RNA, 64 nt, Homo Sapiens
gguugaagcacacauauuugcucaaagugacagaauauguuauauucucugucaauaugacaag

SEQ ID NO: 195093 - RNA, 64 nt, Homo Sapiens
guauugcaaaaucuguuaagcuuuaaaaguagcuauauguuacuaagaagcauuagaaaaauua

SEQ ID NO: 195094 - RNA, 64 nt, Homo Sapiens
ggucugacccuuggacucuggguugcccacuucacagguccauguauggacaguucccggaaac

SEQ ID NO: 195095 - RNA, 64 nt, Homo Sapiens
cgaagugcuacccccaguuuuuucuggagucugccagguccacauaauaccauguaaagcuggc

SEQ ID NO: 195096 - RNA, 64 nt, Homo Sapiens
cagccaggaggggagcgggcccaggagccaggcucagguccagcugguuccucucuggcgccuu

SEQ ID NO: 195097 - RNA, 64 nt, Homo Sapiens
gguuccucucuggcgccuucugaacccgucucagcagguccacagcaccugggcagaggucaga

SEQ ID NO: 195098 - RNA, 64 nt, Homo Sapiens
cagcauggguggcaggguuuccccgucuccauggcagguccauaugggugggcagggcuuggac

SEQ ID NO: 195099 - RNA, 64 nt, Homo Sapiens
cggugugggugggcagggcuccuguccucuguggcagguccacaggaagccaacccugagcgag

SEQ ID NO: 195100 - RNA, 64 nt, Homo Sapiens
gauguuuugguggaaggacacuucuuucuaucacccucuucagucaccucuauacacucuacau

SEQ ID NO: 195101 - RNA, 64 nt, Homo Sapiens
uucuugugcugcuuggacagguaccuacugcuggccucuucaguggccacaauccucaguccuc

SEQ ID NO: 195102 - RNA, 64 nt, Homo Sapiens
uguauuuauuuuauugagguucuuuauauuccugccucuucauagucaaggcucuuaguacagg

SEQ ID NO: 195103 - RNA, 64 nt, Homo Sapiens
uuauauaauuucauguucuaugaggaauuuaguaccucuucacugugaaauucgaaauaaugau

SEQ ID NO: 195104 - RNA, 64 nt, Homo Sapiens
uccuuuuuauccucucaaaaauuuaaacacuguaccucuucaguggucagaagaaaguuggaaa

SEQ ID NO: 195105 - RNA, 64 nt, Homo Sapiens
ugagaugaucauucaguuacuugucaggauuucuccucuucagagagauuuuuuuuuauagcac

SEQ ID NO: 195106 - RNA, 64 nt, Homo Sapiens
cugaaacaucacaugccuuugcacaggccaccccccucuucaggcugcugcaggaggccaggcc

SEQ ID NO: 195107 - RNA, 64 nt, Homo Sapiens
ccagccccucaagacaccgcuggcugcuggacacccucuucacuuguguguguguguguagcgg

SEQ ID NO: 195108 - RNA, 64 nt, Homo Sapiens
ugaugccgugcacugugugagauacaaguucuuuccucuucauuuacagaaagccaggcuuugg

SEQ ID NO: 195109 - RNA, 64 nt, Homo Sapiens
acaacaguuccaauuccaagaaacagaggcuugcccucuucaggagcccuggauucagaguguu

SEQ ID NO: 195110 - RNA, 64 nt, Homo Sapiens
ccacacccauguguacacuccuucagcaugccccccucuucaccuauacccugguaggcuuccu

SEQ ID NO: 195111 - RNA, 64 nt, Homo Sapiens
augccccccucuucaccccaacccugguaggcuuccucuucagcgcaagcuaaagccccucuau

SEQ ID NO: 195112 - RNA, 64 nt, Homo Sapiens
gaauuuuauuugagaaguagccacuacaccuggcccucuucaucgcugggauuacaggcguaag

SEQ ID NO: 195113 - RNA, 64 nt, Homo Sapiens
gucuacugaguaaggggacagguggagagaggggccucuucagucugugccuggcuuggcgucu

SEQ ID NO: 195114 - RNA, 64 nt, Homo Sapiens
augauguugcuaggauuagagccucucagucuggccucuucacccaagugcaagaacucagucu

SEQ ID NO: 195115 - RNA, 64 nt, Homo Sapiens
auaaggauuucguaauuccccuaacugcaaauguccucuucauuuguucuuuaugagaaaaccc

SEQ ID NO: 195116 - RNA, 64 nt, Homo Sapiens
caugacuguccuccucguggguggggccgagggcccucuucagcucucuggagacaggggccga

SEQ ID NO: 195117 - RNA, 64 nt, Homo Sapiens
acaggcuggcccugcaauggggcccugagcccucccucuucaucccccaaggccucaacuagag

SEQ ID NO: 195118 - RNA, 64 nt, Homo Sapiens
uucccaaaaacagcccacucauccuuuccccagcccucuucagcccuccccaguccuccccagc

SEQ ID NO: 195119 - RNA, 64 nt, Homo Sapiens
uguucucgaauguuuauauuucaauaaaccucuaccucuucacacaagcaggucucucucaguu

SEQ ID NO: 195120 - RNA, 64 nt, Homo Sapiens; identical to SEQ ID NO: 147094

SEQ ID NO: 195121 - RNA, 64 nt, Homo Sapiens; identical to SEQ ID NO: 147095

SEQ ID NO: 195122 - RNA, 64 nt, Homo Sapiens; identical to SEQ ID NO: 147096

SEQ ID NO: 195123 - RNA, 64 nt, Homo Sapiens; identical to SEQ ID NO: 147097

SEQ ID NO: 195124 - RNA, 64 nt, Homo Sapiens; identical to SEQ ID NO: 147098

SEQ ID NO: 195125 - RNA, 64 nt, Homo Sapiens; identical to SEQ ID NO: 147099

SEQ ID NO: 195126 - RNA, 64 nt, Homo Sapiens; identical to SEQ ID NO: 147100

SEQ ID NO: 195127 - RNA, 64 nt, Homo Sapiens; identical to SEQ ID NO: 147101

SEQ ID NO: 195128 - RNA, 64 nt, Homo Sapiens; identical to SEQ ID NO: 147102

SEQ ID NO: 195129 - RNA, 64 nt, Homo Sapiens; identical to SEQ ID NO: 147103

SEQ ID NO: 195130 - RNA, 64 nt, Homo Sapiens; identical to SEQ ID NO: 147104

SEQ ID NO: 195131 - RNA, 64 nt, Homo Sapiens; identical to SEQ ID NO: 147105

SEQ ID NO: 195132 - RNA, 64 nt, Homo Sapiens; identical to SEQ ID NO: 147106

SEQ ID NO: 195133 - RNA, 64 nt, Homo Sapiens; identical to SEQ ID NO: 147107

SEQ ID NO: 195134 - RNA, 64 nt, Homo Sapiens; identical to SEQ ID NO: 147108

SEQ ID NO: 195135 - RNA, 64 nt, Homo Sapiens; identical to SEQ ID NO: 147109

SEQ ID NO: 195136 - RNA, 64 nt, Homo Sapiens; identical to SEQ ID NO: 147110

SEQ ID NO: 195137 - RNA, 64 nt, Homo Sapiens; identical to SEQ ID NO: 147111

SEQ ID NO: 195138 - RNA, 64 nt, Homo Sapiens; identical to SEQ ID NO: 147112

SEQ ID NO: 195139 - RNA, 64 nt, Homo Sapiens; identical to SEQ ID NO: 147113

SEQ ID NO: 195140 - RNA, 64 nt, Homo Sapiens; identical to SEQ ID NO: 147114

SEQ ID NO: 195141 - RNA, 64 nt, Homo Sapiens; identical to SEQ ID NO: 147115

SEQ ID NO: 195142 - RNA, 64 nt, Homo Sapiens; identical to SEQ ID NO: 147116

SEQ ID NO: 195143 - RNA, 64 nt, Homo Sapiens; identical to SEQ ID NO: 147117

SEQ ID NO: 195144 - RNA, 64 nt, Homo Sapiens; identical to SEQ ID NO: 147118

SEQ ID NO: 195145 - RNA, 64 nt, Homo Sapiens; identical to SEQ ID NO: 147119

SEQ ID NO: 195146 - RNA, 64 nt, Homo Sapiens; identical to SEQ ID NO: 147120

SEQ ID NO: 195147 - RNA, 64 nt, Homo Sapiens; identical to SEQ ID NO: 147121

SEQ ID NO: 195148 - RNA, 64 nt, Homo Sapiens; identical to SEQ ID NO: 147122

SEQ ID NO: 195149 - RNA, 64 nt, Homo Sapiens
guauauuuuuaucauggaaaaauuucaacuccucaagccguaauguugaacagaauuggaguau

SEQ ID NO: 195150 - RNA, 64 nt, Homo Sapiens
ccagucagacaaauucaccuuuuuuuucuuauaaaagccguaacauuacagauucgucuuuuuu

SEQ ID NO: 195151 - RNA, 64 nt, Homo Sapiens
caggaauauugacuaccaaaucacaaugcaauugaagccguacugcuuuuuugagcaguuauuc

SEQ ID NO: 195152 - RNA, 64 nt, Homo Sapiens
aagaaauggaucauauauauuuuugggaggaaaaaagccguaguaaauugguugaaaggucuag

SEQ ID NO: 195153 - RNA, 64 nt, Homo Sapiens
uguacgcacaacauuaaaucgauuuccuuagcagaagccguauuaacaaagaaauaacaguaau

SEQ ID NO: 195154 - RNA, 64 nt, Homo Sapiens
auaauuuauaugcuugguggcugugcugcugauuaagccguaauuaaaauucuucucaucccau

SEQ ID NO: 195155 - RNA, 64 nt, Homo Sapiens
gaucaguuaguugacaacggaucaccauuauugaaagccguacuugguguuuaccuacuuguuc

SEQ ID NO: 195156 - RNA, 64 nt, Homo Sapiens
accuuuguugcuuuaauugaguucuuccaacugaaagccguaaacugcugucacagucucauuu

SEQ ID NO: 195157 - RNA, 64 nt, Homo Sapiens
cgaagccaggcccgcagccgccccgcugggaccgaagccguaacccaaugccaaugccuucaga

SEQ ID NO: 195158 - RNA, 64 nt, Homo Sapiens
uauaacaauguuuaagauucccuauguugaagcuaagccguauuacaaacaggaauguaccaga

SEQ ID NO: 195159 - RNA, 64 nt, Homo Sapiens
aaaaaaaaaaaaaaaaaggaaaaaaaagugauggaagccguaagugcuucuuugucaucgacgu

SEQ ID NO: 195160 - RNA, 64 nt, Homo Sapiens
aucaguguuaagagcaugaugaaaggugucaauaaagccguaggaucgcgcaacccuuugugug

SEQ ID NO: 195161 - RNA, 64 nt, Homo Sapiens
ugggccagcuucucagguggcuuuagaccucaacaagccguaucuucaccaguguucuaucuug

SEQ ID NO: 195162 - RNA, 64 nt, Homo Sapiens
ccaugcaugcugcucacccuagacaaugacauauaagccguauauagaucaauguccacauaua

SEQ ID NO: 195163 - RNA, 64 nt, Homo Sapiens
uuccaugcaccacgcuccguagaagccccggcggaagccguagcuuucccugccaccuggaggu

SEQ ID NO: 195164 - RNA, 64 nt, Homo Sapiens
ugucauuuauuuuauuuccacaacaugaaaguggaagccguauccccaaggguauaaacaaaag

SEQ ID NO: 195165 - RNA, 64 nt, Homo Sapiens
guguauguagaccacuuaauauauuuggaagaaaaagccguaagaauaggcuuucuuauauuug

SEQ ID NO: 195166 - RNA, 64 nt, Homo Sapiens
ucauuucucuuacguugaauccccaaucauaauuaagccguauacacagauuaaauuaacagaa

SEQ ID NO: 195167 - RNA, 64 nt, Homo Sapiens
ggagugggacugagcguccgcagaggugaccgaaaagccguaugaugauguucccgauuucucu

SEQ ID NO: 195168 - RNA, 64 nt, Homo Sapiens
cagcaccugaaagcuuccucgacaucuguuaauaaagccguaggcccuugucuaagugcaaccg

SEQ ID NO: 195169 - RNA, 64 nt, Homo Sapiens
acccaguuuccuuucuuagcggguuggaaaguccaagccguagguuugucuugcgggucuguca

SEQ ID NO: 195170 - RNA, 64 nt, Homo Sapiens
cagcugucuuuguaguuaggaaauagauccaauaaagccguauuuuuuugcuggacaggcguag

SEQ ID NO: 195171 - RNA, 64 nt, Homo Sapiens
gcuccucagcuucgugucccugcuggagaccaacaagccguaccuggugaacugcguccgcauc

SEQ ID NO: 195172 - RNA, 64 nt, Homo Sapiens
uugccguuuaugucacugacaguuucugaggcagaagccguaucaugucuaccaccugugaggu

SEQ ID NO: 195173 - RNA, 64 nt, Homo Sapiens
aauguaaggaaugcaggaaauucacacuggagagaagccguaugcuuaaagcaacaugaaagga

SEQ ID NO: 195174 - RNA, 64 nt, Homo Sapiens
ggccgacccaggcaucuugguugcgacacucccaaagccguaagucucuggcgcccccaugugg

SEQ ID NO: 195175 - RNA, 64 nt, Homo Sapiens
aucgaguccuuacagccauaaguuaggaauacacaagccguaaacaggugacaggccuagcuau

SEQ ID NO: 195176 - RNA, 64 nt, Homo Sapiens
uaaaaguuaauauuuucacaagaguaguuuacaaaagccguauugcccagauaaaauuuucaug

SEQ ID NO: 195177 - RNA, 64 nt, Homo Sapiens; identical to SEQ ID NO: 160682

SEQ ID NO: 195178 - RNA, 64 nt, Homo Sapiens; identical to SEQ ID NO: 160683

SEQ ID NO: 195179 - RNA, 64 nt, Homo Sapiens; identical to SEQ ID NO: 160684

SEQ ID NO: 195180 - RNA, 64 nt, Homo Sapiens; identical to SEQ ID NO: 160685

SEQ ID NO: 195181 - RNA, 64 nt, Homo Sapiens; identical to SEQ ID NO: 160686

SEQ ID NO: 195182 - RNA, 64 nt, Homo Sapiens; identical to SEQ ID NO: 160687

SEQ ID NO: 195183 - RNA, 64 nt, Homo Sapiens; identical to SEQ ID NO: 160688

SEQ ID NO: 195184 - RNA, 64 nt, Homo Sapiens; identical to SEQ ID NO: 160689

SEQ ID NO: 195185 - RNA, 64 nt, Homo Sapiens; identical to SEQ ID NO: 160690

SEQ ID NO: 195186 - RNA, 64 nt, Homo Sapiens; identical to SEQ ID NO: 160691

SEQ ID NO: 195187 - RNA, 64 nt, Homo Sapiens; identical to SEQ ID NO: 160692

SEQ ID NO: 195188 - RNA, 64 nt, Homo Sapiens; identical to SEQ ID NO: 160693

SEQ ID NO: 195189 - RNA, 64 nt, Homo Sapiens; identical to SEQ ID NO: 160694

SEQ ID NO: 195190 - RNA, 64 nt, Homo Sapiens; identical to SEQ ID NO: 160695

SEQ ID NO: 195191 - RNA, 64 nt, Homo Sapiens; identical to SEQ ID NO: 160696

SEQ ID NO: 195192 - RNA, 64 nt, Homo Sapiens; identical to SEQ ID NO: 160697

SEQ ID NO: 195193 - RNA, 64 nt, Homo Sapiens; identical to SEQ ID NO: 160698

SEQ ID NO: 195194 - RNA, 64 nt, Homo Sapiens; identical to SEQ ID NO: 160699

SEQ ID NO: 195195 - RNA, 64 nt, Homo Sapiens; identical to SEQ ID NO: 160700

SEQ ID NO: 195196 - RNA, 64 nt, Homo Sapiens; identical to SEQ ID NO: 160701

SEQ ID NO: 195197 - RNA, 64 nt, Homo Sapiens; identical to SEQ ID NO: 160702

SEQ ID NO: 195198 - RNA, 64 nt, Homo Sapiens; identical to SEQ ID NO: 160703

SEQ ID NO: 195199 - RNA, 64 nt, Homo Sapiens; identical to SEQ ID NO: 160704

SEQ ID NO: 195200 - RNA, 64 nt, Homo Sapiens; identical to SEQ ID NO: 160705

SEQ ID NO: 195201 - RNA, 64 nt, Homo Sapiens; identical to SEQ ID NO: 160706

SEQ ID NO: 195202 - RNA, 64 nt, Homo Sapiens; identical to SEQ ID NO: 160707

SEQ ID NO: 195203 - RNA, 64 nt, Homo Sapiens; identical to SEQ ID NO: 160708

SEQ ID NO: 195204 - RNA, 64 nt, Homo Sapiens; identical to SEQ ID NO: 160709

SEQ ID NO: 195205 - RNA, 64 nt, Homo Sapiens; identical to SEQ ID NO: 160710

SEQ ID NO: 195206 - RNA, 64 nt, Homo Sapiens; identical to SEQ ID NO: 160711

SEQ ID NO: 195207 - RNA, 64 nt, Homo Sapiens; identical to SEQ ID NO: 160712

SEQ ID NO: 195208 - RNA, 64 nt, Homo Sapiens; identical to SEQ ID NO: 160713

SEQ ID NO: 195209 - RNA, 64 nt, Homo Sapiens; identical to SEQ ID NO: 160714

SEQ ID NO: 195210 - RNA, 64 nt, Homo Sapiens; identical to SEQ ID NO: 160715

SEQ ID NO: 195211 - RNA, 64 nt, Homo Sapiens; identical to SEQ ID NO: 160716

SEQ ID NO: 195212 - RNA, 51 nt, Homo Sapiens; identical to SEQ ID NO: 160717

SEQ ID NO: 195213 - RNA, 64 nt, Homo Sapiens; identical to SEQ ID NO: 160718

SEQ ID NO: 195214 - RNA, 64 nt, Homo Sapiens; identical to SEQ ID NO: 160719

SEQ ID NO: 195215 - RNA, 64 nt, Homo Sapiens; identical to SEQ ID NO: 160720

SEQ ID NO: 195216 - RNA, 52 nt, Homo Sapiens; identical to SEQ ID NO: 160721

SEQ ID NO: 195217 - RNA, 64 nt, Homo Sapiens; identical to SEQ ID NO: 160722

SEQ ID NO: 195218 - RNA, 64 nt, Homo Sapiens; identical to SEQ ID NO: 160723

SEQ ID NO: 195219 - RNA, 64 nt, Homo Sapiens; identical to SEQ ID NO: 160724

SEQ ID NO: 195220 - RNA, 64 nt, Homo Sapiens; identical to SEQ ID NO: 160725

SEQ ID NO: 195221 - RNA, 64 nt, Homo Sapiens; identical to SEQ ID NO: 160726

SEQ ID NO: 195222 - RNA, 64 nt, Homo Sapiens; identical to SEQ ID NO: 160727

SEQ ID NO: 195223 - RNA, 64 nt, Homo Sapiens; identical to SEQ ID NO: 160728

SEQ ID NO: 195224 - RNA, 64 nt, Homo Sapiens; identical to SEQ ID NO: 160729

SEQ ID NO: 195225 - RNA, 64 nt, Homo Sapiens; identical to SEQ ID NO: 160730

SEQ ID NO: 195226 - RNA, 64 nt, Homo Sapiens; identical to SEQ ID NO: 160731

SEQ ID NO: 195227 - RNA, 64 nt, Homo Sapiens; identical to SEQ ID NO: 160732

SEQ ID NO: 195228 - RNA, 64 nt, Homo Sapiens; identical to SEQ ID NO: 160733

SEQ ID NO: 195229 - RNA, 64 nt, Homo Sapiens; identical to SEQ ID NO: 160734

SEQ ID NO: 195230 - RNA, 64 nt, Homo Sapiens; identical to SEQ ID NO: 160735

SEQ ID NO: 195231 - RNA, 64 nt, Homo Sapiens; identical to SEQ ID NO: 160736

SEQ ID NO: 195232 - RNA, 64 nt, Homo Sapiens; identical to SEQ ID NO: 160737

SEQ ID NO: 195233 - RNA, 64 nt, Homo Sapiens; identical to SEQ ID NO: 160738

SEQ ID NO: 195234 - RNA, 64 nt, Homo Sapiens; identical to SEQ ID NO: 160739

SEQ ID NO: 195235 - RNA, 64 nt, Homo Sapiens; identical to SEQ ID NO: 160740

SEQ ID NO: 195236 - RNA, 64 nt, Homo Sapiens; identical to SEQ ID NO: 160741

SEQ ID NO: 195237 - RNA, 64 nt, Homo Sapiens; identical to SEQ ID NO: 160742

SEQ ID NO: 195238 - RNA, 64 nt, Homo Sapiens; identical to SEQ ID NO: 160743

SEQ ID NO: 195239 - RNA, 64 nt, Homo Sapiens; identical to SEQ ID NO: 160744

SEQ ID NO: 195240 - RNA, 64 nt, Homo Sapiens; identical to SEQ ID NO: 160745

SEQ ID NO: 195241 - RNA, 64 nt, Homo Sapiens; identical to SEQ ID NO: 160746

SEQ ID NO: 195242 - RNA, 64 nt, Homo Sapiens; identical to SEQ ID NO: 160747

SEQ ID NO: 195243 - RNA, 62 nt, Homo Sapiens
gacuaguugaucuggaugaguucccaaaaaucagugucuaggucaguaauucucuuacaucc

SEQ ID NO: 195244 - RNA, 62 nt, Homo Sapiens
gacugguugaucuagaugaguucccaaaaaucagugucuaggcaguaauucucuaaaaaucc

SEQ ID NO: 195245 - RNA, 56 nt, Homo Sapiens
agcggccccgcgggacuggggacugagcccaggagguuugcacaagccgggcgauu

SEQ ID NO: 195246 - RNA, 56 nt, Homo Sapiens
acagauggcugaggcugcagacucaggcccaggacacucaaccccaggaggggagc

SEQ ID NO: 195247 - RNA, 56 nt, Homo Sapiens
ccgcucggcgaaugagcugggugggugcccaggagccggcccgcagcaccugcaca

SEQ ID NO: 195248 - RNA, 56 nt, Homo Sapiens
ucaaggcugcagugagccaaacuugagcccaggagggaggcugagguugcaggauc

SEQ ID NO: 195249 - RNA, 56 nt, Homo Sapiens
uugagguuguaguaagcuacacuugagcccaggaauaaggcugaggcagaaggauc

SEQ ID NO: 195250 - RNA, 56 nt, Homo Sapiens
uugagaaugcagugagcuugacaagagcccaggaggaugucuaagacaggaggauc

SEQ ID NO: 195251 - RNA, 56 nt, Homo Sapiens
ucaagaccagccuggacaacucuugagcccaggaguaggcugaaguaggaggaucg

SEQ ID NO: 195252 - RNA, 56 nt, Homo Sapiens
uggggaagaguagguucucgucuggggcccaggaagaggccauccucuuauuccgu

SEQ ID NO: 195253 - RNA, 56 nt, Homo Sapiens
ggugggggguccagggcaccuccucagcccaggaguaacggcaucaugugacacgc

SEQ ID NO: 195254 - RNA, 56 nt, Homo Sapiens
aucaacacuguucucucuguuuuguggcccaggauagaacuacccagggcagcccc

SEQ ID NO: 195255 - RNA, 56 nt, Homo Sapiens
auggcacccuuagagugcaggagguggcccaggaccgaugaacacuggagugggca

SEQ ID NO: 195256 - RNA, 56 nt, Homo Sapiens
acaaaguguggaggccucggggcagggcccaggagaguucugugcugucucuugga

SEQ ID NO: 195257 - RNA, 56 nt, Homo Sapiens
ugggagaaggucacagagccgcucaggcccaggagguccaccuccuuccaagucca

SEQ ID NO: 195258 - RNA, 56 nt, Homo Sapiens
auugcuuuucugugaauucauucuuggcccaggagcgcuggccaagagccaacaca

SEQ ID NO: 195259 - RNA, 56 nt, Homo Sapiens
ccuuggccucggcgggcuuuucuggggcccaggaagcccacacuaugcacagagcc

SEQ ID NO: 195260 - RNA, 56 nt, Homo Sapiens
cagacagaugucagcuucccagccaugcccaggacguccuaucucccccaacccac

SEQ ID NO: 195261 - RNA, 56 nt, Homo Sapiens
uuagggugccaauguggauuaccugagcccaggaguuugagaccagccuggguaac

SEQ ID NO: 195262 - RNA, 56 nt, Homo Sapiens
uaggcagugaacaagucuucauccuggcccaggaaauagccuauuaaaaaaugcug

SEQ ID NO: 195263 - RNA, 56 nt, Homo Sapiens
gaugacaagccgcugcccaccuccaagcccaggaaacaguacaagauggcuaagga

SEQ ID NO: 195264 - RNA, 56 nt, Homo Sapiens
ggguuuaucucaaggcagcagccugagcccaggagcagaggacccaguuguuauaa

SEQ ID NO: 195265 - RNA, 56 nt, Homo Sapiens
gagcuacggcagggugugugcaccuagcccaggagagcaugugacacccacaaucc

SEQ ID NO: 195266 - RNA, 56 nt, Homo Sapiens
cagagguugcagugagccgaacugcagcccaggagguacuugaacgcaggagaauc

SEQ ID NO: 195267 - RNA, 56 nt, Homo Sapiens
aaauuuuuuuucaugcuuuaucaauagcccaggauauauuuuauuuuuagaauuuu

SEQ ID NO: 195268 - RNA, 56 nt, Homo Sapiens
aauuucugcagguggcaggugagcaagcccaggagaaugcugcaaucuugggggug

SEQ ID NO: 195269 - RNA, 56 nt, Homo Sapiens
uugaggcuggagugagccauacuugagcccaggagggaggcugaggcaggaggauc

SEQ ID NO: 195270 - RNA, 56 nt, Homo Sapiens
ucgagaccagccugggcaacaguugagcccaggaguggaggcugaugugggcggau

SEQ ID NO: 195271 - RNA, 56 nt, Homo Sapiens
ucgaggcugcagugugcuguacuugagcccaggagggaggcugaggugggaaaauc

SEQ ID NO: 195272 - RNA, 56 nt, Homo Sapiens
uugagaacaggauuuugagaguuugagcccaggaaugaggcugaggcaagcagguu

SEQ ID NO: 195273 - RNA, 56 nt, Homo Sapiens
gugccugcacaugagaggagcuuccugcccaggaagcugcaguucugcuaggucug

SEQ ID NO: 195274 - RNA, 56 nt, Homo Sapiens
agccagcaagagcaaggcaucagcuggcccaggaaguggugccugcauaccucugg

SEQ ID NO: 195275 - RNA, 56 nt, Homo Sapiens
gacguggucuuccagcccauugaggagcccaggaacuaccacguuccacggaggag

SEQ ID NO: 195276 - RNA, 56 nt, Homo Sapiens
guggucugccauugcaaugcacuccagcccaggacuaagauuggcuuggcaucugc

SEQ ID NO: 195277 - RNA, 56 nt, Homo Sapiens
uggagccacagagcuggugccaguuggcccaggaacggcacgugcagcguccuugg

SEQ ID NO: 195278 - RNA, 56 nt, Homo Sapiens
gaggccgaggagagaggaucacuuaagcccaggagucugagaccagccugggcaac

SEQ ID NO: 195279 - RNA, 56 nt, Homo Sapiens
gaggcugaggugggaggaucacuugagcccaggaaguccagaacguagugagccuu

SEQ ID NO: 195280 - RNA, 56 nt, Homo Sapiens
gcccucgaaugccauucacaggaacagcccaggaacccagggacuucagaagggcu

SEQ ID NO: 195281 - RNA, 56 nt, Homo Sapiens
gcucuggaagcugaaggauagcuugagcccaggaguucgaggcugcagugagcuau

SEQ ID NO: 195282 - RNA, 56 nt, Homo Sapiens
cagagguugcagugagccaagcuugagcccaggagggaggcugaggugggaggauu

SEQ ID NO: 195283 - RNA, 56 nt, Homo Sapiens
ucaagaccagccugggcaacacuugagcccaggaaugaggcugagguggguagauu

SEQ ID NO: 195284 - RNA, 56 nt, Homo Sapiens
ucgaggcugcagugagccauacuugagcccaggagggaggcuggggugggaagauc

SEQ ID NO: 195285 - RNA, 56 nt, Homo Sapiens
uugagaccagcuaaggcaaugcgugagcccaggagugaggcugagucgggaggaua

SEQ ID NO: 195286 - RNA, 56 nt, Homo Sapiens
guaccagcaaguagacuaggaacugagcccaggaaagggggauguuuuccuggugu

SEQ ID NO: 195287 - RNA, 56 nt, Homo Sapiens
ccaagucauggcaacaggcuggagcagcccaggagaugggccuaaaauguucugga

SEQ ID NO: 195288 - RNA, 56 nt, Homo Sapiens
ucgucccacccccacccaggcaggaagcccaggaggagugcgggcagggccugacc

SEQ ID NO: 195289 - RNA, 56 nt, Homo Sapiens
gucccccauuguuuugcuuccccagcgcccaggaugagcgguuuaccaucgagcuu

SEQ ID NO: 195290 - RNA, 56 nt, Homo Sapiens
gaugcucucauaagcaccuucauaaggcccaggaaggggcccaggaaggaugcucu

SEQ ID NO: 195291 - RNA, 56 nt, Homo Sapiens
gaugcucucauaaggcccagagaagggcccaggaagccacggccuuuucuggcaag

SEQ ID NO: 195292 - RNA, 56 nt, Homo Sapiens
ucagguucauuuuguuacauggcugggcccaggaggcaaacagugauuguacagca

SEQ ID NO: 195293 - RNA, 56 nt, Homo Sapiens
uuucuuuucuggguaucuugcuggaggcccaggauaaggaauuggagcagcuuuuc

SEQ ID NO: 195294 - RNA, 56 nt, Homo Sapiens
uugaggcugcagugagcagaacuugagcccaggagggcucugauaagaggaggcuc

SEQ ID NO: 195295 - RNA, 56 nt, Homo Sapiens
uggagguugcagugagcugagcuugagcccaggaggguggcuaggguggauggauc

SEQ ID NO: 195296 - RNA, 56 nt, Homo Sapiens
gaggucgaggcaagcugaucgcuugagcccaggaguuuaagaccggccugaguagc

SEQ ID NO: 195297 - RNA, 56 nt, Homo Sapiens
ggugcugaggugggaggaucgcuugagcccaggagagugaggcugcagugagcuga

SEQ ID NO: 195298 - RNA, 56 nt, Homo Sapiens
aggaaucauguucaauauugaauucugcccaggagcaugaacugauccaugaaugc

SEQ ID NO: 195299 - RNA, 56 nt, Homo Sapiens
gguggaagaauggaagaaucacuugagcccaggaguuugaggcugcagugagcuau

SEQ ID NO: 195300 - RNA, 56 nt, Homo Sapiens
caccugcccugcacucugcccucuuugcccaggauacugaggagggcuggagcucg

SEQ ID NO: 195301 - RNA, 56 nt, Homo Sapiens
ccacugccugggacccagcagacacugcccaggacucuuuagugcacucacucuug

SEQ ID NO: 195302 - RNA, 56 nt, Homo Sapiens
aauaaccauacacugaccucauacuugcccaggacccauuaaaguugcgguauuua

SEQ ID NO: 195303 - RNA, 56 nt, Homo Sapiens
guugggacacaguuggucugcagucggcccaggacggucuacucagcacaacugac

SEQ ID NO: 195304 - RNA, 56 nt, Homo Sapiens
ucgaggcugcagucagucaugcuugagcccaggagugaggcugaggcaggaggauu

SEQ ID NO: 195305 - RNA, 56 nt, Homo Sapiens
cauccguugugcuugccugcauggucgcccaggagaagugaaaucaaaggugcuaa

SEQ ID NO: 195306 - RNA, 56 nt, Homo Sapiens
uugaggcugcagugagccauacuugagcccaggagaucuggaggcccuugaggauc

SEQ ID NO: 195307 - RNA, 56 nt, Homo Sapiens
ucgacaccagccuggccaacgcuugagcccaggagugcacuuugaggugggcaaug

SEQ ID NO: 195308 - RNA, 56 nt, Homo Sapiens
uccuguaaugucucccggucagggcagcccaggacugcccagccuggugggcuggg

SEQ ID NO: 195309 - RNA, 56 nt, Homo Sapiens
uagaaagacaaacggccaccuugggugcccaggauacuggugccuggccccacgua

SEQ ID NO: 195310 - RNA, 56 nt, Homo Sapiens
gaggcugaggcaggaggacuguuugagcccaggaguuugagaccaaccugaguaag

SEQ ID NO: 195311 - RNA, 56 nt, Homo Sapiens
ggugcugaggcgggaggauuacuugagcccaggaggauuacuucaaccugggaggu

SEQ ID NO: 195312 - RNA, 56 nt, Homo Sapiens
gaggccaaggcaggaggacugcuugagcccaggaguuugagaccagccugggcaau

SEQ ID NO: 195313 - RNA, 56 nt, Homo Sapiens
gaggccgaggcaggaagacugcuugagcccaggaguucaagaccagccugggcaac

SEQ ID NO: 195314 - RNA, 56 nt, Homo Sapiens
gagguugaggugggaagauugcuugagcccaggaguuugagguugcagugagcuga

SEQ ID NO: 195315 - RNA, 56 nt, Homo Sapiens
gaggccauagcaggaggauugcuugagcccaggaguucgagaccagccagagcaac

SEQ ID NO: 195316 - RNA, 56 nt, Homo Sapiens
gagguugaggugggaggauugcuugagcccaggauuucaaggcugcagugagccau

SEQ ID NO: 195317 - RNA, 56 nt, Homo Sapiens
uucauaucuuuaaaagcugcgguaaggcccaggacagcuagcucagacaccaaagg

SEQ ID NO: 195318 - RNA, 56 nt, Homo Sapiens
cugaggaaauacccagucagaaacaggcccaggagcccagagcuggagugaggauc

SEQ ID NO: 195319 - RNA, 56 nt, Homo Sapiens
auuugucugagacauuuccaggccaagcccaggagggcugugccagggugagggag

SEQ ID NO: 195320 - RNA, 56 nt, Homo Sapiens
ccuuucucugccgccugcugauuacagcccaggacacccagaacucuggucuccaa

SEQ ID NO: 195321 - RNA, 56 nt, Homo Sapiens
agcaaugucucuucacgggcacuggggcccaggaaauuuuuccucugcccugauca

SEQ ID NO: 195322 - RNA, 56 nt, Homo Sapiens
ccauguugggcccucguuucgcccuggcccaggagggcaggcaaagcuggacaugu

SEQ ID NO: 195323 - RNA, 56 nt, Homo Sapiens
agccacuguaaauaacccucgucccugcccaggaacccagacuggacuucagucuc

SEQ ID NO: 195324 - RNA, 56 nt, Homo Sapiens
gucauuuccaaacccauccuggaagggcccaggauccaaaggucaucaguccugcu

SEQ ID NO: 195325 - RNA, 56 nt, Homo Sapiens
gaggccaagacaggcagaucacuugagcccaggaguuugaggccagccugggcaac

SEQ ID NO: 195326 - RNA, 56 nt, Homo Sapiens
gaggcaaagaugggaggauuacuugagcccaggaggucaaggcuacagugagccau

SEQ ID NO: 195327 - RNA, 56 nt, Homo Sapiens
agugaccaagcagcaccagcaggccugcccaggaugcugaaagcagauuucuucuu

SEQ ID NO: 195328 - RNA, 56 nt, Homo Sapiens
aaaauaggggugauggagggggagaagcccaggacugggagaaucgcacaugcccc

SEQ ID NO: 195329 - RNA, 56 nt, Homo Sapiens
ugggcccugccacccaggccccugccgcccaggagcaggaagcccaggagcugggu

SEQ ID NO: 195330 - RNA, 56 nt, Homo Sapiens
uggguccugccgcccaggaggaggaagcccaggagccccaagggcggacccagcag

SEQ ID NO: 195331 - RNA, 56 nt, Homo Sapiens
uugggugugcugacgagcagccaguagcccaggagcaugagcccacucuaggagcc

SEQ ID NO: 195332 - RNA, 56 nt, Homo Sapiens
ugagguccugagaaggggauagcacugcccaggacgugugucccuagccuggaaug

SEQ ID NO: 195333 - RNA, 56 nt, Homo Sapiens
gcccucuacgaucaggugcaggggcugcccaggacaaagcgggggcaggggaaaga

SEQ ID NO: 195334 - RNA, 56 nt, Homo Sapiens
gaggcccaggcagaaggaucgcugcagcccaggaguucgagacuagccugggcaac

SEQ ID NO: 195335 - RNA, 56 nt, Homo Sapiens
gaggccaaggcaggaggauugcuugagcccaggaguuugagaccagccugggcaac

SEQ ID NO: 195336 - RNA, 56 nt, Homo Sapiens
acugcuauccuuccccucaccccucagcccaggagggaaagggcauuuucuuuuuc

SEQ ID NO: 195337 - RNA, 56 nt, Homo Sapiens
cugacucacgggcaugcuucauugaggcccaggaagaggcccugguuuggggcugu

SEQ ID NO: 195338 - RNA, 56 nt, Homo Sapiens
uugaggcugcagugagguguccuugagcccaggaggggaggcugaggcuagaggau

SEQ ID NO: 195339 - RNA, 56 nt, Homo Sapiens
ucaagacuagccuaggcaacacuugagcccaggagugaggcugaggcaggaggauc

SEQ ID NO: 195340 - RNA, 56 nt, Homo Sapiens
gcucgggacagcugugugcugagagggcccaggagggcuuagguuguggaguggcu

SEQ ID NO: 195341 - RNA, 56 nt, Homo Sapiens
uuaagugacuuggcuaaaguaaacaggcccaggagacucucuugcuacaaauaagg

SEQ ID NO: 195342 - RNA, 56 nt, Homo Sapiens
uucccugccccuuacucacccucugagcccaggacacaccccugcagggucucggg

SEQ ID NO: 195343 - RNA, 56 nt, Homo Sapiens
ucggacugcugguccuggaggcggcggcccaggagcccacuggcuaccccuacugc

SEQ ID NO: 195344 - RNA, 56 nt, Homo Sapiens
ucccaccucaggaagcuaguauucaugcccaggaucggugaguucaggggauccau

SEQ ID NO: 195345 - RNA, 56 nt, Homo Sapiens
acaccccagggggaugagcucuccaagcccaggauucuggcaagagaggugaagaa

SEQ ID NO: 195346 - RNA, 56 nt, Homo Sapiens
gugucggacugcucagaguccgcauggcccaggagcagguggucggaggccccugg

SEQ ID NO: 195347 - RNA, 56 nt, Homo Sapiens
ggcgaaaggggcccagucguucuugggcccaggauggggccucuagacuugcaagg

SEQ ID NO: 195348 - RNA, 56 nt, Homo Sapiens
gccugggcagagacccuguaggaggggcccaggaagaggccccuggcagugcuccc

SEQ ID NO: 195349 - RNA, 56 nt, Homo Sapiens
cagucucuggcuguggcuccaggagagcccaggagcgggcuggcaccgagaguuca

SEQ ID NO: 195350 - RNA, 56 nt, Homo Sapiens
ugcgccauccuuuaggccgauuuccugcccaggaccaugugauaaaggaaaaauuc

SEQ ID NO: 195351 - RNA, 56 nt, Homo Sapiens
ggagggaggcaagccagucgcgcuaggcccaggagaaccauugccauuucuggccu

SEQ ID NO: 195352 - RNA, 56 nt, Homo Sapiens
uccccgugguguccccuggcgagaaagcccaggaaggccagagcaccggccuccca

SEQ ID NO: 195353 - RNA, 56 nt, Homo Sapiens
cucaccgugucacagcugugccaucagcccaggauaagccaucccggcuggguuug

SEQ ID NO: 195354 - RNA, 56 nt, Homo Sapiens
agaaucgcugccuccucuccacgagggcccaggaccucaagcccaggaggcugaaa

SEQ ID NO: 195355 - RNA, 56 nt, Homo Sapiens
cugaaaacgagggcccaggaauucaagcccaggaggccagccccagcugccaucag

SEQ ID NO: 195356 - RNA, 56 nt, Homo Sapiens
gaggccaaggcggauggaucacuugagcccaggaguucaacaccagccugagcaac

SEQ ID NO: 195357 - RNA, 56 nt, Homo Sapiens
cuggcauguggcacuuugucagggcagcccaggaaucugaaacaggaucaaacucu

SEQ ID NO: 195358 - RNA, 56 nt, Homo Sapiens
ucccuggagacucacugcaaguuccugcccaggaggcugagggcaccccauccuca

SEQ ID NO: 195359 - RNA, 56 nt, Homo Sapiens
agacaccacccccuccagcuucuggggcccaggagccucucccugcuacagggggu

SEQ ID NO: 195360 - RNA, 56 nt, Homo Sapiens
gaggcugaggcaggaggaucacuugagcccaggagauugaggcugcagugagcaug

SEQ ID NO: 195361 - RNA, 56 nt, Homo Sapiens
gcccacucaugggcccuucaccaccugcccaggaucucacccaguacugacagcuc

SEQ ID NO: 195362 - RNA, 56 nt, Homo Sapiens
ggggucgacagguugaacgucuucaggcccaggaccccaagcuccucagccuggcc

SEQ ID NO: 195363 - RNA, 56 nt, Homo Sapiens
ggggccgacccuccucgggacacucugcccaggagacuccacgagagcagccccuc

SEQ ID NO: 195364 - RNA, 56 nt, Homo Sapiens
ugaggagcuggaguggaagcagaugugcccaggauggugggaaucccccacuucca

SEQ ID NO: 195365 - RNA, 56 nt, Homo Sapiens
ccccgggccucgggcccggcgcgcucgcccaggacugcguccucgggcgccaccgg

SEQ ID NO: 195366 - RNA, 56 nt, Homo Sapiens
gagaggcgggucccaggcccccgcucgcccaggaugacggggggccacagcagcgg

SEQ ID NO: 195367 - RNA, 56 nt, Homo Sapiens
cgacaagcuggacccccugcgagggugcccaggacucccggggauucccccccccc

SEQ ID NO: 195368 - RNA, 56 nt, Homo Sapiens
ucagagagggcgcggcccccgagugugcccaggaacccuggggacccccccucccc

SEQ ID NO: 195369 - RNA, 56 nt, Homo Sapiens
caccgggaaagcagccagcacaaagggcccaggaagccagcccccgagagcugagc

SEQ ID NO: 195370 - RNA, 56 nt, Homo Sapiens
gcagcauggagccaaggucuguccccgcccaggagggugccuuccucggggguagg

SEQ ID NO: 195371 - RNA, 56 nt, Homo Sapiens
cguccagaccucacccuguggcauuugcccaggaccccauggggacagaagcucca

SEQ ID NO: 195372 - RNA, 56 nt, Homo Sapiens
acgggagcuucugaagagcuuaaaaggcccaggaacccuauccaaugacgucucca

SEQ ID NO: 195373 - RNA, 56 nt, Homo Sapiens
ggagccauggcauaugacaagcaucugcccaggacaaggccaugagaaccugaggg

SEQ ID NO: 195374 - RNA, 56 nt, Homo Sapiens
cccauccuugcuucaucucaccuggagcccaggaacugcagagagcacagcccuug

SEQ ID NO: 195375 - RNA, 56 nt, Homo Sapiens
uuucuccaccuguguuuaugugagaagcccaggaaagggaagaugcaaggaaguaa

SEQ ID NO: 195376 - RNA, 56 nt, Homo Sapiens
uugaacauuuuccuuuacccaccagugcccaggaauaggcuuggaugagauggggc

SEQ ID NO: 195377 - RNA, 56 nt, Homo Sapiens
ggcugccugcagaggacaggcagcuggcccaggaaacuggauccccacgugagcaa

SEQ ID NO: 195378 - RNA, 56 nt, Homo Sapiens
aacacuuacauucuggugccuuuugggcccaggagaacgguacccaggagaaggga

SEQ ID NO: 195379 - RNA, 56 nt, Homo Sapiens
auuucacaauccaaaaauggcccacagcccaggaagcuacccugaacaugccaguu

SEQ ID NO: 195380 - RNA, 56 nt, Homo Sapiens
ugcaaaaguggcugcuuuggaugccagcccaggaugaguaguuccuguucucaggg

SEQ ID NO: 195381 - RNA, 56 nt, Homo Sapiens
gaggcagaggugagagaaucgcuugagcccaggaauucgagaccagccugggccac

SEQ ID NO: 195382 - RNA, 56 nt, Homo Sapiens
uucauguccuacgcagcuaaaacagagcccaggagccagggaggaaaagcagucag

SEQ ID NO: 195383 - RNA, 56 nt, Homo Sapiens
aucaggcugggcucuggcagggaccugcccaggauggagaugagagagggugagag

SEQ ID NO: 195384 - RNA, 56 nt, Homo Sapiens
cuccuccccaucaagcacaagagagggcccaggaaaaaagguuucacauaagugua

SEQ ID NO: 195385 - RNA, 56 nt, Homo Sapiens
ucccaggcaggggugaggguggccuggcccaggaggccaggaaggagggcccuguc

SEQ ID NO: 195386 - RNA, 56 nt, Homo Sapiens
cugugaguaaaacugggggcucaaaugcccaggaugaggggaucagugacugucua

SEQ ID NO: 195387 - RNA, 56 nt, Homo Sapiens
gaggccgaggugggaggaucacuugagcccaggaguucgagaccagccuaggcaac

SEQ ID NO: 195388 - RNA, 56 nt, Homo Sapiens
aaacccagaacucagcauucaaggaugcccaggagagcugucccuguuuuaaagag

SEQ ID NO: 195389 - RNA, 56 nt, Homo Sapiens
acccaugcacagcagcugugcagguggcccaggagucaucuccauugccuuaaugc

SEQ ID NO: 195390 - RNA, 56 nt, Homo Sapiens
uuacaacacagcaaguagcaguuccugcccaggaucuaucuugauggagaagaggg

SEQ ID NO: 195391 - RNA, 56 nt, Homo Sapiens
gaccuguguguaagucccaagucgcugcccaggauucagaucucuagagcuguccu

SEQ ID NO: 195392 - RNA, 56 nt, Homo Sapiens
gagugcaguggcucaaucucucuaucgcccaggauguuuuugagauggagucucgc

SEQ ID NO: 195393 - RNA, 56 nt, Homo Sapiens
cugguagaaggccuuuaaugaucugggcccaggaugauuuccugcccuuuuaucau

SEQ ID NO: 195394 - RNA, 56 nt, Homo Sapiens
ucuuccuuccugcuguaccacagauggcccaggagaggcacuugucuuuuauuaua

SEQ ID NO: 195395 - RNA, 63 nt, Homo Sapiens
ucugcagcuggagagacagcauaccugaaaccugcaaggaaccgguuuauaaaacaacagaac

SEQ ID NO: 195396 - RNA, 63 nt, Homo Sapiens
cucucaguucuugagggccuccccaccgcagcagcaaggaaagcucacgaaccccaaaccugg

SEQ ID NO: 195397 - RNA, 63 nt, Homo Sapiens
gcccucuugcuagggaacccugccagggugaaggcaaggaacaaccaccuggccuccauucuc

SEQ ID NO: 195398 - RNA, 63 nt, Homo Sapiens
caacaggaaccugccugaggacacccuucuagagcaaggaauugacuuuuaggagccguucuc

SEQ ID NO: 195399 - RNA, 63 nt, Homo Sapiens
aagcaguucuccacguucucaccuaagcccagagcaaggaacagguauaauaaguggaaaauc

SEQ ID NO: 195400 - RNA, 63 nt, Homo Sapiens
aaggaagagaugauguuuaauucaaguccgaaggcaaggaaaaagcugaugguccuguccaaa

SEQ ID NO: 195401 - RNA, 63 nt, Homo Sapiens
gccuagucagggcacagcugcccugcugccacagcaaggaaauguccugcauggggcagaggc

SEQ ID NO: 195402 - RNA, 63 nt, Homo Sapiens
gccaaggacucccagcccaggacucucuuuagagcaaggaagccucguucucuuucuucucaa

SEQ ID NO: 195403 - RNA, 63 nt, Homo Sapiens
ugcucaugucugggguauucacuuggcuccucagcaaggaagcaaacgccuuggaggagaagc

SEQ ID NO: 195404 - RNA, 63 nt, Homo Sapiens
cagccaccucuguccagggcaguaagaagggcugcaaggaaggggaggauggggacaaggaaa

SEQ ID NO: 195405 - RNA, 63 nt, Homo Sapiens
caggacuguaaccuggggaggacgcgggucccugcaaggaagaguagauuuggagaggaagga

SEQ ID NO: 195406 - RNA, 63 nt, Homo Sapiens
auuucauugcacuggaauuuugcuuuaucagaagcaaggaaguaagggagucauugccuuggg

SEQ ID NO: 195407 - RNA, 63 nt, Homo Sapiens
uccagauggucuccuuagcaucucagcucuucugcaaggaagagcuuggguguuaggccucag

SEQ ID NO: 195408 - RNA, 63 nt, Homo Sapiens
uucuuuuguuuuuuggaaaauggaaagaacaaggcaaggaaggaaaauuaauggggaagcuga

SEQ ID NO: 195409 - RNA, 63 nt, Homo Sapiens
uccauacacaggugugcuucuagucaguguguagcaaggaaagccccguucacugcuccugug

SEQ ID NO: 195410 - RNA, 63 nt, Homo Sapiens
accaugugcuuauuagaugguuccacucaggaagcaaggaagcuaaaacucaaguuaaugguc

SEQ ID NO: 195411 - RNA, 63 nt, Homo Sapiens
aaaucugaggcugaagaauuaaguuuuccccaagcaaggaaggcagguggucagagagaucaa

SEQ ID NO: 195412 - RNA, 63 nt, Homo Sapiens
aguggaauagaaagaaguucaugaguaagggcugcaaggaauucuuauccuggccacaugucc

SEQ ID NO: 195413 - RNA, 63 nt, Homo Sapiens
acaauauugacuauauauuuuuauaaacuacuggcaaggaacuuacccagcuguuauacaugu

SEQ ID NO: 195414 - RNA, 63 nt, Homo Sapiens
uguugcauuaugcuagagcaccagggucagggugcaaggaagaggcuuaaguauguucauuuu

SEQ ID NO: 195415 - RNA, 63 nt, Homo Sapiens
aaugaaacugucaccacagguaaauccuuguuagcaaggaaucugucugcuccagucuacucc

SEQ ID NO: 195416 - RNA, 63 nt, Homo Sapiens
uggaugcaagauagauacuaaagucaguguacugcaaggaagcaccuuuuguauuuaauuuua

SEQ ID NO: 195417 - RNA, 63 nt, Homo Sapiens
augagucauccgcuaucacauucuugaaaagaagcaaggaaauucaauagggcuguugggacu

SEQ ID NO: 195418 - RNA, 63 nt, Homo Sapiens
augucucauguuuugacuucucuccugcaaugagcaaggaauuaaggagggggcaccugcaug

SEQ ID NO: 195419 - RNA, 63 nt, Homo Sapiens
cacagcccacacgugagcucgccuggcuggacagcaaggaaucauggccacucccugccccca

SEQ ID NO: 195420 - RNA, 63 nt, Homo Sapiens
ccucccaucugguacuaaaacucaagauuacgugcaaggaaucccugcugaagcagguggaug

SEQ ID NO: 195421 - RNA, 63 nt, Homo Sapiens
uaagaagacauggcacguguaagaaagaaaggggcaaggaaaguccucagguguaauauuguu

SEQ ID NO: 195422 - RNA, 63 nt, Homo Sapiens
cuuaacuaggccucuguuuaguucaccacuaaggcaaggaauuauugucuguguuuaguccuu

SEQ ID NO: 195423 - RNA, 63 nt, Homo Sapiens
cauccugagcccacagcuuuucagagggacagagcaaggaauggagcauggucagggcauugg

SEQ ID NO: 195424 - RNA, 63 nt, Homo Sapiens
aguaggggaaucuccagcucggcuuuagcaggggcaaggaaauccagaucucucucuccugga

SEQ ID NO: 195425 - RNA, 63 nt, Homo Sapiens
gaauucccacagcccuccaguuccccaucaugggcaaggaagggggcccugcacuugcugagg

SEQ ID NO: 195426 - RNA, 63 nt, Homo Sapiens
auuugggcacccuacccuuuuccucccagcucagcaaggaaguuacauuuucugccucugccu

SEQ ID NO: 195427 - RNA, 63 nt, Homo Sapiens
cugcuucccuggaaguguaucagggcgggcaaggcaaggaaaguccugcacuuuagccagcug

SEQ ID NO: 195428 - RNA, 63 nt, Homo Sapiens
aaugggcucagaaaaaggagggcagauagcucagcaaggaaaggggugggaaagggagcaagg

SEQ ID NO: 195429 - RNA, 63 nt, Homo Sapiens
auaagauauccuaaaaucacgcuggaaccuugggcaaggaagaaugugagcaagaguagagag

SEQ ID NO: 195430 - RNA, 63 nt, Homo Sapiens
ccucagccucuucucuuuaggcccagcugcugggcaaggaauuccagugccuccuacgggggc

SEQ ID NO: 195431 - RNA, 63 nt, Homo Sapiens
cugauuauuccuuggccuuucccuuguauuuaugcaaggaaggauauacugagcugauacucu

SEQ ID NO: 195432 - RNA, 63 nt, Homo Sapiens
aggcuuuucaaaaaaauuuuuauucaaggcaaagcaaggaacaucuugagauaugucucaaga

SEQ ID NO: 195433 - RNA, 63 nt, Homo Sapiens
uggugggugggagguggggcaugugcaaagcaagcaaggaacauuugggguaagaaaacaaac

SEQ ID NO: 195434 - RNA, 63 nt, Homo Sapiens
uuaacuaguuguuucaguuaugcucuuuuaguugcaaggaaucucaagugggacaaacauaaa

SEQ ID NO: 195435 - RNA, 63 nt, Homo Sapiens
agaugauuuuuaaguacaaaaaaguuuaagauugcaaggaaggaaacaauggucacaaggucu

SEQ ID NO: 195436 - RNA, 63 nt, Homo Sapiens
aggcuuuaaguuucuugguugcccaagggcagagcaaggaauaucugguguuucuugugauga

SEQ ID NO: 195437 - RNA, 63 nt, Homo Sapiens
auaaaaauagauaauuaaaaagaugguugccaagcaaggaaaacuuauuuuauauuuucccuu

SEQ ID NO: 195438 - RNA, 63 nt, Homo Sapiens
gagggggugcugggguacccgggggcuggggaagcaaggaaauaagucaucuguaugcugacu

SEQ ID NO: 195439 - RNA, 63 nt, Homo Sapiens
uaacagugacuuuuuaaaauggugacaguguuggcaaggaaacagcaacacaggcugcgcugu

SEQ ID NO: 195440 - RNA, 63 nt, Homo Sapiens
auuauuaauucugagaacagaaauuggugccuugcaaggaaguuuacuagcucuaucaacaag

SEQ ID NO: 195441 - RNA, 63 nt, Homo Sapiens
aaauuucauggauuaaaccauggguuuaaugcagcaaggaaacuuacaaugucccuuuauaua

SEQ ID NO: 195442 - RNA, 63 nt, Homo Sapiens
gaggcuguuugccaauucaggguucugcugggcgcaaggaacgcacuguucaaacgcacuguu

SEQ ID NO: 195443 - RNA, 63 nt, Homo Sapiens
uggggcuuuuacaccaguuccuuucaaugguuugcaaggaagccacagcuggugguaucugag

SEQ ID NO: 195444 - RNA, 63 nt, Homo Sapiens
uaggccaucugggugcugggcauggauuucucagcaaggaagacucauuaccuucccucccug

SEQ ID NO: 195445 - RNA, 63 nt, Homo Sapiens
ugaaaauaacuacucacaacauucacuauguuugcaaggaauuaacacaaauaaaagaugccu

SEQ ID NO: 195446 - RNA, 63 nt, Homo Sapiens
ggagagacgcagcccugggggccagcuggugcugcaaggaagggugggaagcuugcuggcuuc

SEQ ID NO: 195447 - RNA, 63 nt, Homo Sapiens
caaaaaugauuaagacuucuugcuagguccugugcaaggaauaaacauugaguaccaauuauu

SEQ ID NO: 195448 - RNA, 63 nt, Homo Sapiens
cccauacagaagaaacaacaagcccccuaucuggcaaggaaacacucaagcuauugcaugauu

SEQ ID NO: 195449 - RNA, 63 nt, Homo Sapiens
uuguucaguucguauacuucucaccuuugcuacgcaaggaaaucagcacauuaucuucauaug

SEQ ID NO: 195450 - RNA, 63 nt, Homo Sapiens
ugucaagagaucaugguucaacuugccacuuaagcaaggaacugaaguccagcuucaaaaguu

SEQ ID NO: 195451 - RNA, 63 nt, Homo Sapiens
cagggacccuuguugccuggggagccuguggcugcaaggaacccguggccagcccuggauuuu

SEQ ID NO: 195452 - RNA, 63 nt, Homo Sapiens
ccuggcaauggacagcaggacaggugucagggugcaaggaagagcugccagagcgccucagca

SEQ ID NO: 195453 - RNA, 63 nt, Homo Sapiens
guuauauacagccaaaguggauguuucuauuuggcaaggaagguaggauuucugaaacucagg

SEQ ID NO: 195454 - RNA, 63 nt, Homo Sapiens
gcuuuguuuuguuagucauuucuuuuucuaacggcaaggaagauaugugcccuuuugagaauu

SEQ ID NO: 195455 - RNA, 63 nt, Homo Sapiens
ggcccuucugugucugagaaaauuaauuauauagcaaggaaugaaauuugauaaagcaaauau

SEQ ID NO: 195456 - RNA, 63 nt, Homo Sapiens
guguuuuauuguacuccuuccuuggagcugaaugcaaggaaugugaauucugaggaauuaagg

SEQ ID NO: 195457 - RNA, 63 nt, Homo Sapiens
accaagucuacaaugaaaguuugaaauuuaacugcaaggaauuagaagcauauuugcaaucau

SEQ ID NO: 195458 - RNA, 63 nt, Homo Sapiens
ucugauuuagaauuacugguagcuuauuuuaaagcaaggaaaagcagcugagcucaaguuugc

SEQ ID NO: 195459 - RNA, 63 nt, Homo Sapiens
aaugaaauaucugguuuuugacgaaaauacaaagcaaggaaaacacaugaggucaaaggagug

SEQ ID NO: 195460 - RNA, 63 nt, Homo Sapiens
aguuccagggagagucagguugaguccuccauggcaaggaagcagaggcccucugagaucaug

SEQ ID NO: 195461 - RNA, 61 nt, Homo Sapiens
gucuuucugguucaauagacggccauccagggcaaggaacuggauggaaaaagacaucuga

SEQ ID NO: 195462 - RNA, 63 nt, Homo Sapiens
aaacucaaacaaaagugcguuuuuuuucagaaagcaaggaagucuagugucuaaauaccuaug

SEQ ID NO: 195463 - RNA, 63 nt, Homo Sapiens
uaucuucaggugaagaagaggagcucaucucuagcaaggaauugccuaggaggcuguaugcca

SEQ ID NO: 195464 - RNA, 63 nt, Homo Sapiens
uguaaggaaaaacucgcacacuucuucuacugugcaaggaagacugaucuaaacgguuccuuc

SEQ ID NO: 195465 - RNA, 56 nt, Homo Sapiens
ggccaguuaaguagugucuuacuccagcaaggaaauacaaaagggaaucggaauaa

SEQ ID NO: 195466 - RNA, 63 nt, Homo Sapiens
aaggaaggaauccccuucuugggaguauucuaggcaaggaacugugagggagaauaaggguaa

SEQ ID NO: 195467 - RNA, 63 nt, Homo Sapiens
gucaggagaccgcugcuucugggcauaaguccugcaaggaaagcaacauggaaaacagcccca

SEQ ID NO: 195468 - RNA, 63 nt, Homo Sapiens
ggcacacacacacguuugcaagaaaucuaccgagcaaggaaaaguccacguaacuggcugcag

SEQ ID NO: 195469 - RNA, 63 nt, Homo Sapiens
gaagcggaaagcaucugaggugugacacaacgugcaaggaaauaaaaucagguuucaauagaa

SEQ ID NO: 195470 - RNA, 63 nt, Homo Sapiens
gagggguagugucuggggcacauuucugaaaaggcaaggaaggguuucucucuugcucugaaa

SEQ ID NO: 195471 - RNA, 63 nt, Homo Sapiens
gaaggauauauuaugaguuuauauggucaggaagcaaggaagcaauguauaugaaugcuccua

SEQ ID NO: 195472 - RNA, 53 nt, Homo Sapiens
uaucagaaaaauguauauaauaggcaaggaaagaaauacaguacuguuucugg

SEQ ID NO: 195473 - RNA, 63 nt, Homo Sapiens
auagaauuggccccauggcuugaugugaagacagcaaggaaagaagcaccagucaaguuguga

SEQ ID NO: 195474 - RNA, 63 nt, Homo Sapiens
uuauggguuucuugguaaagagccuuuaccacagcaaggaaugggaacauuuccccaucagca

SEQ ID NO: 195475 - RNA, 63 nt, Homo Sapiens
auggaccucaggcuucguggcuggaaauaaagagcaaggaaaaagggcugggaaguucagugc

SEQ ID NO: 195476 - RNA, 63 nt, Homo Sapiens
gggguggcacacgggacacccgugggcaugcacgcaaggaauuggggugccugggcggccuuu

SEQ ID NO: 195477 - RNA, 63 nt, Homo Sapiens
ggcucuuuauuacuuaaaagggaaaaaagaaaagcaaggaaaaaaaaaagaaaagaaaaaaag

SEQ ID NO: 195478 - RNA, 63 nt, Homo Sapiens
agucucuuuggucaguaacaaucuaaaauaagugcaaggaagcugaaggcacaaacucucaau

SEQ ID NO: 195479 - RNA, 63 nt, Homo Sapiens
gggggaaacaucagaauuucccaggcaguuguugcaaggaauugguacuaaccgugacuacaa

SEQ ID NO: 195480 - RNA, 63 nt, Homo Sapiens
gccuuacccagcugugcuacugucauuugcaaagcaaggaaauacuacuacugguaauaaaac

SEQ ID NO: 195481 - RNA, 63 nt, Homo Sapiens
ccccaguuaaccaccauucugcggccugguucugcaaggaaccagggcugccccaccgcccgc

SEQ ID NO: 195482 - RNA, 63 nt, Homo Sapiens
uucuccugugccccucagagaggcaugugaugugcaaggaaaauaauaggauauaaaacacau

SEQ ID NO: 195483 - RNA, 63 nt, Homo Sapiens
aauggacgcuuuguauucagagauggcuuccaggcaaggaaguucuaucuugugauacggaaa

SEQ ID NO: 195484 - RNA, 63 nt, Homo Sapiens
uucaaccuauacaaaggggacccuggauaggcugcaaggaaagaggccaagggccaagcugcu

SEQ ID NO: 195485 - RNA, 63 nt, Homo Sapiens
uugucuuccauuccagccuaacauccaaugcaggcaaggaaaauaaaagauuuccagugacag

SEQ ID NO: 195486 - RNA, 63 nt, Homo Sapiens
uggucucugauagguagcauuuuccagcacuuugcaaggaauguuuuguagcucuaggguaua

SEQ ID NO: 195487 - RNA, 63 nt, Homo Sapiens
gccccacaaaauuccuguuaacaugaaggagaggcaaggaaaagaaaugagugugucauuucc

SEQ ID NO: 195488 - RNA, 63 nt, Homo Sapiens
uaguuuuuaaucucuccacccccaggcuauucggcaaggaagucaaaaacaugcuuuuccaaa

SEQ ID NO: 195489 - RNA, 63 nt, Homo Sapiens
uugcaaauauuagcuuauuuaugcauacucugugcaaggaaauauuaaucuaccauuuauuga

SEQ ID NO: 195490 - RNA, 63 nt, Homo Sapiens
gugggguauggaagucaucuccacuucucaccagcaaggaagacagccacugaacuccaaggu

SEQ ID NO: 195491 - RNA, 63 nt, Homo Sapiens
cucugggagcuucuuccguuuccacagcaaagggcaaggaauccccauggacaacacuaauug

SEQ ID NO: 195492 - RNA, 63 nt, Homo Sapiens
guguuugcacaguacaguaaaagugagugaacagcaaggaagaacgccuuuuaggaaaaagaa

SEQ ID NO: 195493 - RNA, 63 nt, Homo Sapiens
acagcagugaugacacugucaccccuugcccaggcaaggaaagguuaccuucacaauggugcu

SEQ ID NO: 195494 - RNA, 63 nt, Homo Sapiens
uagaaggucuguucuugcucguuguaggaaauugcaaggaaaaagaacauacucuccuaagug

SEQ ID NO: 195495 - RNA, 63 nt, Homo Sapiens
gguuggaagugggaaagggguuccaggcuuccugcaaggaaacucaugugccagggcauccca

SEQ ID NO: 195496 - RNA, 63 nt, Homo Sapiens
ggugguauuauggaccgaacucacauuauaguagcaaggaauuacucagaggugagaauuuuu

SEQ ID NO: 195497 - RNA, 63 nt, Homo Sapiens
gaguugagugucuggagucaaaagaaacagacugcaaggaacaacuaaucaccaccauagaag

SEQ ID NO: 195498 - RNA, 63 nt, Homo Sapiens
ccagaggccacuccacaaccccagcgccagucagcaaggaagccgggugucgcucacacaacc

SEQ ID NO: 195499 - RNA, 63 nt, Homo Sapiens
auguagcauucaugguaaacuuuuaagugcuaagcaaggaauuauuuacugauugguuuuaaa

SEQ ID NO: 195500 - RNA, 63 nt, Homo Sapiens
accuggagagagaguuuaggcaaauaacaaucagcaaggaaaccuucaccagugagaagaaca

SEQ ID NO: 195501 - RNA, 63 nt, Homo Sapiens
uggccugguggaugaauuuggccgaaucuucaugcaaggaaauaacagauacgggcagcuagg

SEQ ID NO: 195502 - RNA, 63 nt, Homo Sapiens
uuagugucugcagguguuaguggugugcuaaaagcaaggaaagcgaguuagucuuuucagugu

SEQ ID NO: 195503 - RNA, 63 nt, Homo Sapiens
cauccugaaaguggguucgggaggucucuaugagcaaggaauacaagacaaaacuuccucaau

SEQ ID NO: 195504 - RNA, 63 nt, Homo Sapiens
auagguccagcaacugaaccugccauuaccugggcaaggaaagaucccuuugcucuaggaaag

SEQ ID NO: 195505 - RNA, 63 nt, Homo Sapiens
gugauugagucuucaaaaccaccgauucugagagcaaggaagauuuuggaagaaaaucugacu

SEQ ID NO: 195506 - RNA, 63 nt, Homo Sapiens
cucuaguuuuaagaguaagugaagaaaaccagcgcaaggaaucuaagauuaauuucauuagag

SEQ ID NO: 195507 - RNA, 63 nt, Homo Sapiens
ccagaugggcuuagcauuggcauagaaaagcaugcaaggaagagauuugacuuaccaccagag

SEQ ID NO: 195508 - RNA, 63 nt, Homo Sapiens
gcugugccugaggcugcucuugcaugagggcaagcaaggaaugagugugugaagcucugugcu

SEQ ID NO: 195509 - RNA, 63 nt, Homo Sapiens
agcacagaacacgagguggugggaaagggacaugcaaggaaacccacccccuaggguccccau

SEQ ID NO: 195510 - RNA, 63 nt, Homo Sapiens
agauucuccauuagagucccaaagauugaaaaggcaaggaaacaaugaagggggccuguaaaa

SEQ ID NO: 195511 - RNA, 58 nt, Homo Sapiens
aauauaugugauuaucacugaaaagguugcaaggaacgacaaacgaagaucaaaauga

SEQ ID NO: 195512 - RNA, 63 nt, Homo Sapiens
guacaauuuuaucuucuggcgaaccaagaaauagcaaggaaaucuuaagaaauuaucaaguug

SEQ ID NO: 195513 - RNA, 63 nt, Homo Sapiens
gcucugggugcguaugcggcaacugacgcuccugcaaggaaaacccagggcacugcgccccgc

SEQ ID NO: 195514 - RNA, 63 nt, Homo Sapiens
ggguaaggggaaaacuucccggaaggcaauggggcaaggaaaaagaaagccuaugggaaaugg

SEQ ID NO: 195515 - RNA, 63 nt, Homo Sapiens
uuuccagaugcaccagcuccuauuaauaaguuagcaaggaaaguguaugucacgugcaggaac

SEQ ID NO: 195516 - RNA, 63 nt, Homo Sapiens
uuuuaaucacuuuuuaaaauauaaggaccgaaugcaaggaaaccaaaguuuauuaauaauuuu

SEQ ID NO: 195517 - RNA, 60 nt, Homo Sapiens
agaccgugcgcuugcucugaagccuugugagcaaggaaggcucccugcauguccugcuug

SEQ ID NO: 195518 - RNA, 63 nt, Homo Sapiens
auugaaaaccaccugugucuucaucaacaugaggcaaggaaucggguucugaauucuacagac

SEQ ID NO: 195519 - RNA, 63 nt, Homo Sapiens
gguaagacuuuucagaauuaaugcuuuccagcugcaaggaaaauuugucuuagcauuauuagc

SEQ ID NO: 195520 - RNA, 63 nt, Homo Sapiens
guaucuucauuauucucauuuuaagaaaaacgagcaaggaagauauauuaucuuuauguacuc

SEQ ID NO: 195521 - RNA, 63 nt, Homo Sapiens
guaauuuggauuauaaaauuaauugauaacugagcaaggaaacaguucuguuuuaaguaacag

SEQ ID NO: 195522 - RNA, 63 nt, Homo Sapiens
uuuuucuuauuuaauuacaaauacuauaaaugagcaaggaaaaggaauagacuuucuuaauau

SEQ ID NO: 195523 - RNA, 63 nt, Homo Sapiens
uauuguuuucugacaguuuuucuguuuuguuuggcaaggaaaggggagaagggaauccuccuc

SEQ ID NO: 195524 - RNA, 63 nt, Homo Sapiens
acagcaaagacagcacuguuccugggcugggacgcaaggaaugagguccuuuaugaaagaaag

SEQ ID NO: 195525 - RNA, 63 nt, Homo Sapiens
cuuucucugugggugccaguuaaauauuggagagcaaggaauguggacuuguauggcuuugaa

SEQ ID NO: 195526 - RNA, 63 nt, Homo Sapiens
ugcauucccugaaucugugccugcacugagagggcaaggaagugggguguucuucuugggacc

SEQ ID NO: 195527 - RNA, 63 nt, Homo Sapiens
guagccgugcgugugugugaugguuccguggcugcaaggaagggaaacagucuauuauacaua

SEQ ID NO: 195528 - RNA, 63 nt, Homo Sapiens
cugcuccaggagaagggccuccugcuggccagagcaaggaaggcugagcagcuugguucuccc

SEQ ID NO: 195529 - RNA, 63 nt, Homo Sapiens
auguucacuuuaaaguuugacaacagauugcaagcaaggaaguuguaggcagaagagauccau

SEQ ID NO: 195530 - RNA, 63 nt, Homo Sapiens
cccggcuuugcccucacaagggcaucuggcugugcaaggaagaucaucgcgcucugaucuggu

SEQ ID NO: 195531 - RNA, 63 nt, Homo Sapiens
ugaacauuuuguauuuaaguaaauuucuuaccugcaaggaaaguugacauggaaaugucagug

SEQ ID NO: 195532 - RNA, 63 nt, Homo Sapiens
uaaauuauucuagccaauuugucauaggcauaggcaaggaaagcuggccuugcuaacuauaua

SEQ ID NO: 195533 - RNA, 63 nt, Homo Sapiens
acuagacacuuuccuacuaagaucaggaacauggcaaggaacaccacaccacugcuuuucagc

SEQ ID NO: 195534 - RNA, 63 nt, Homo Sapiens
cucaacggaauuuacaguucagaguccaaaauagcaaggaaguggugggaagaaggugagaga

SEQ ID NO: 195535 - RNA, 63 nt, Homo Sapiens
ucaaaaugaauguuuacuugugaacucgauagagcaaggaaaccagaaagguguaauauuuau

SEQ ID NO: 195536 - RNA, 63 nt, Homo Sapiens
gcuuggaguuuuaguuuaaagaaucuauauguagcaaggaaaaggugcuuuuuaauuuuaauc

SEQ ID NO: 195537 - RNA, 63 nt, Homo Sapiens
cuuacccuaggugggugugaaagagcacccguagcaaggaaaauuuucucuauuaguguguuc

SEQ ID NO: 195538 - RNA, 63 nt, Homo Sapiens
cuguaguuuuauuuuauguuuagauagggcugggcaaggaaaaagaaaauaaagacaaccaua

SEQ ID NO: 195539 - RNA, 63 nt, Homo Sapiens
uaaaaaauucauaccaaaucaaugagaauacuggcaaggaauacauagggacuuucugcuaua

SEQ ID NO: 195540 - RNA, 63 nt, Homo Sapiens
gggcuccaggagcaagcucaacugagaagaggugcaaggaagccucugcuuuagcuaaagacg

SEQ ID NO: 195541 - RNA, 63 nt, Homo Sapiens
aaagaaagaaggaagugaagauucaauguuuaugcaaggaaggcaccaaaaagggauccguac

SEQ ID NO: 195542 - RNA, 63 nt, Homo Sapiens
agaggcaaaaauucuaaagagcccacuggaguugcaaggaaugaaaacuggaucaagauucua

SEQ ID NO: 195543 - RNA, 63 nt, Homo Sapiens
uucuuuuaaauucugaacugagacauucuuucugcaaggaaauauuaagaggggccaagagga

SEQ ID NO: 195544 - RNA, 63 nt, Homo Sapiens
ccacugcuuuucagcauugugaucaggaacauggcaaggaacaacuaaaugcuuuccuacuaa

SEQ ID NO: 195545 - RNA, 63 nt, Homo Sapiens
uauguaacauguaggaaguacaaggaagucaaagcaaggaaacuuaaugaagaaaguggaaaa

SEQ ID NO: 195546 - RNA, 63 nt, Homo Sapiens
gcacaagugcaugaguucuuugaaaagacaguggcaaggaaaauggcuggauguucucuuuac

SEQ ID NO: 195547 - RNA, 63 nt, Homo Sapiens
guugaggaaggauggcugaugcuuucauguugggcaaggaaaaccuucccucucaauccacua

SEQ ID NO: 195548 - RNA, 63 nt, Homo Sapiens
gaacucaggauucagagaucugaagggaaucaggcaaggaaaucaggagauaaaaauggagcc

SEQ ID NO: 195549 - RNA, 63 nt, Homo Sapiens
aauuaugcuuguauucauaauuauuuguagaaggcaaggaaccuuuuaucauuuucaagaugg

SEQ ID NO: 195550 - RNA, 63 nt, Homo Sapiens
agauuccagcagaguugguucuuucugaggucugcaaggaagggcucuguuccaugccucucu

SEQ ID NO: 195551 - RNA, 63 nt, Homo Sapiens
cccaguuuuuacucaguuugauuuauauucugggcaaggaagcuuugccuacuuuauuggcac

SEQ ID NO: 195552 - RNA, 63 nt, Homo Sapiens
aaauaacugugccccaagaagugcuccagauuugcaaggaauagccccaagagaauaccaaga

SEQ ID NO: 195553 - RNA, 63 nt, Homo Sapiens
aagacaugacuauccaacuuuuuaugacaaacugcaaggaauaaaggaagaauaaguccaugu

SEQ ID NO: 195554 - RNA, 63 nt, Homo Sapiens
guccagagguccagucuggcugcuguuguggaggcaaggaaggcaacucaucccagaaggcau

SEQ ID NO: 195555 - RNA, 63 nt, Homo Sapiens
guggcuuugcccagccugcugcaauccaagagagcaaggaagagaaauuccaugggugacuuu

SEQ ID NO: 195556 - RNA, 63 nt, Homo Sapiens
ggaugaacaaccucagagaagaggugguuuagagcaaggaaaaaaaugaaaccagugaccaaa

SEQ ID NO: 195557 - RNA, 63 nt, Homo Sapiens
cagguuccccucuggugucaugucaggcauuuugcaaggaaaagccacuuggggaaagaugga

SEQ ID NO: 195558 - RNA, 61 nt, Homo Sapiens
uuccauuggcccucgggugagcugaggguuuuugcaaggaaguugugguggccaagugugg

SEQ ID NO: 195559 - RNA, 63 nt, Homo Sapiens
uucccagagucaucugauuggacaggcaugggugcaaggaaaauuaggguacucaaccuaagu

SEQ ID NO: 195560 - RNA, 63 nt, Homo Sapiens
ggcagaaaguaaaagaaaauucccuaaauuauagcaaggaacaugaauucucagacauuguga

SEQ ID NO: 195561 - RNA, 63 nt, Homo Sapiens
aacaaaugauguauggggagaggagaaggaagggcaaggaaggaauugacagauaagaagcaa

SEQ ID NO: 195562 - RNA, 63 nt, Homo Sapiens
uauaaauaaaaagaaauacagucuagacaugcugcaaggaaagaagauucuaaaguccguuua

SEQ ID NO: 195563 - RNA, 63 nt, Homo Sapiens
aaggaagggcugcuggagccaggaaggacggaagcaaggaaggugcagacggaaggaggagga

SEQ ID NO: 195564 - RNA, 63 nt, Homo Sapiens
uacugaggcagccacuugaucuuccugggacaagcaaggaaagacucugcuaugugaugggga

SEQ ID NO: 195565 - RNA, 63 nt, Homo Sapiens
ccugaugaguagauaaguggaugagcuaggggugcaaggaacauggauuguccccuugggggg

SEQ ID NO: 195566 - RNA, 63 nt, Homo Sapiens
auuaaugcuuagaauucugaaagaauuauaacagcaaggaaacggcaguugaaccugaugagc

SEQ ID NO: 195567 - RNA, 63 nt, Homo Sapiens
aauauacuucuguuuacuuaugaggauggguaugcaaggaaaaggaaacuguguguugacauu

SEQ ID NO: 195568 - RNA, 63 nt, Homo Sapiens
uucaaaacauugauaauucauuuaccagagagagcaaggaagcucuaguaccuuuggaguagg

SEQ ID NO: 195569 - RNA, 63 nt, Homo Sapiens
ggaacaguggcugucugcgacguccugcugcuggcaaggaaugaggugggguagagcacucuc

SEQ ID NO: 195570 - RNA, 63 nt, Homo Sapiens
ccuaaucauguuacaaucacacagccgccaucugcaaggaaggaaccccacuccccguucagc

SEQ ID NO: 195571 - RNA, 63 nt, Homo Sapiens
cggggcggggggacuuuuuucuauagcccggcagcaaggaaguaugcaugcuuuaauauuugc

SEQ ID NO: 195572 - RNA, 63 nt, Homo Sapiens
augauugacaacagucaagcuaccacuccaaaggcaaggaacccauucucuguaccuuuauag

SEQ ID NO: 195573 - RNA, 63 nt, Homo Sapiens
ggaccgauaucaucugucuggucucugugaacagcaaggaaucuucuugaccguucuugggca

SEQ ID NO: 195574 - RNA, 63 nt, Homo Sapiens
uucuuuagagcuguauaacuauaguuugaacuagcaaggaaguuauuguuuugacaaccagaa

SEQ ID NO: 195575 - RNA, 63 nt, Homo Sapiens
uucuccaagaggaggaauacauaguaugguaaggcaaggaacuggguggaaugucagguugcc

SEQ ID NO: 195576 - RNA, 63 nt, Homo Sapiens
agaagacaaaacccugaagaguuaagaacaaacgcaaggaaauaauuuuuauuguuuaaagcc

SEQ ID NO: 195577 - RNA, 63 nt, Homo Sapiens
ccuuguuuaucagauacaucacugcuugaugaagcaaggaagauauacaugaaaauuuuaaaa

SEQ ID NO: 195578 - RNA, 63 nt, Homo Sapiens
gaaaccaaaucacaaaggagaugguguggcuuagcaaggaaacagugcaggaaauguagguua

SEQ ID NO: 195579 - RNA, 63 nt, Homo Sapiens
agauguaauuauguuuucaacucaggaacuauggcaaggaacuuuccccagaucaaauucuau

SEQ ID NO: 195580 - RNA, 63 nt, Homo Sapiens
aaggaagacaaauguaaagaaauaaggaaaaaagcaaggaauauccccucccccucccccucc

SEQ ID NO: 195581 - RNA, 63 nt, Homo Sapiens
uauagcuauaccuucaggucuuuuguuacuuaggcaaggaaaaccacaugucugaccugguuc

SEQ ID NO: 195582 - RNA, 63 nt, Homo Sapiens
aaagagugugugcucuacuuugauggaaacauggcaaggaauuuaaagacaggaauguauuaa

SEQ ID NO: 195583 - RNA, 63 nt, Homo Sapiens
aggcggugacagacgggcugaucuuuggagaaggcaaggaaggggccucaaguccaaggcuuu

SEQ ID NO: 195584 - RNA, 63 nt, Homo Sapiens
uggugacgacaaggugcagcgccuauggcaagugcaaggaauuuucucaaacagauccaggaa

SEQ ID NO: 195585 - RNA, 63 nt, Homo Sapiens
ugugcuuuauccaacaaaauauggggaagcauugcaaggaaauacaauauuugggagagaagg

SEQ ID NO: 195586 - RNA, 63 nt, Homo Sapiens
uacauuuguuugccugucuuuuauagaaauagugcaaggaaagaugccacauccuauauggug

SEQ ID NO: 195587 - RNA, 63 nt, Homo Sapiens
aggccggucaccagaagccaagaaaccggccaggcaaggaaagcucccaucuuggccucuucc

SEQ ID NO: 195588 - RNA, 63 nt, Homo Sapiens
aggaaacuuuaguuauuuaugguuacuuauaaugcaaggaaucaauauggguguugaaaacua

SEQ ID NO: 195589 - RNA, 63 nt, Homo Sapiens
aagacugccuuggcaauuguuuaucuuaaaaaugcaaggaaaaugaucaggaaauuuaagaau

SEQ ID NO: 195590 - RNA, 63 nt, Homo Sapiens
cuauaaauaacccauucauagaguugcugagaugcaaggaauuggugcaacaucagggcgcuu

SEQ ID NO: 195591 - RNA, 63 nt, Homo Sapiens
cucuguuaauuuauagcugucucagguaagaaggcaaggaaggcuucugugagaguuaaaaau

SEQ ID NO: 195592 - RNA, 63 nt, Homo Sapiens
acuuacccaguauuacugcuucagauguuuuacgcaaggaagggauaccuucaaugaauuaau

SEQ ID NO: 195593 - RNA, 63 nt, Homo Sapiens
cauucuguuuuaaguaacagaauugauaacugagcaaggaaacaugguuuggauuauaaaauu

SEQ ID NO: 195594 - RNA, 63 nt, Homo Sapiens
gauuguuucuuuuaaacucacuuuaaaauuuuggcaaggaauucaugcauaacugagacuugg

SEQ ID NO: 195595 - RNA, 63 nt, Homo Sapiens
aaugacuccauuuaaaaauaucacagggugggggcaaggaaauuagcugagauucaucucagg

SEQ ID NO: 195596 - RNA, 63 nt, Homo Sapiens
acauucaguucuguaagaaaaauugcauuuccagcaaggaaugugagagaaauaagucauuuu

SEQ ID NO: 195597 - RNA, 63 nt, Homo Sapiens
aauaauuacuccuccuuaaagaucugggauaaagcaaggaaauauucaaaaacugagagugga

SEQ ID NO: 195598 - RNA, 63 nt, Homo Sapiens
aggcuccaagaggcugaggaccacauuuuacaggcaaggaaacagcaggguagcuauuacugu

SEQ ID NO: 195599 - RNA, 63 nt, Homo Sapiens
aucucuuuucuaagucuuggaacaauuuuagaagcaaggaacauuuccuacagaggaaaauag

SEQ ID NO: 195600 - RNA, 63 nt, Homo Sapiens
uaauuuucaaaguacauuugaugcuggguauaggcaaggaaagucauuagaugacauucacgc

SEQ ID NO: 195601 - RNA, 63 nt, Homo Sapiens
auuuuccagaaugacacccgggagcaaggaacagcaaggaauuaggcaagcugugaucugaaa

SEQ ID NO: 195602 - RNA, 63 nt, Homo Sapiens
gcaaggaauuauuuuccagaugaucugaaaggagcaaggaacagggucugaccaggcaagcug

SEQ ID NO: 195603 - RNA, 63 nt, Homo Sapiens
agguucccaaugggcucagggacgaagcuuguggcaaggaaacuccagcuggcuaugccggcc

SEQ ID NO: 195604 - RNA, 63 nt, Homo Sapiens
cacaaaaugcccaaggcacucacuggggaggaagcaaggaagcaaacagucugagaaaaugau

SEQ ID NO: 195605 - RNA, 63 nt, Homo Sapiens
uggugacaggcagacacaugcuguuggccucaagcaaggaagcagagcacuguguaaccagca

SEQ ID NO: 195606 - RNA, 63 nt, Homo Sapiens
aguacccaccgagagcuguggggagcagcaugggcaaggaagacacagacucgcauuacccuu

SEQ ID NO: 195607 - RNA, 63 nt, Homo Sapiens
gacucuuuguaaacgauagcugaucgugugcacgcaaggaaagaaccaggagggagagugcag

SEQ ID NO: 195608 - RNA, 63 nt, Homo Sapiens
acaauaguccucuuuccaagguuuuugucaugugcaaggaaggcuagggguuugguucauuug

SEQ ID NO: 195609 - RNA, 63 nt, Homo Sapiens
aacugagccuucuccagcagcccccagggaacagcaaggaaggggggccgugcugucccuggu

SEQ ID NO: 195610 - RNA, 63 nt, Homo Sapiens
agggacagggaaagauaauuagaugaugggaaggcaaggaagaccagcccccaggucuuugcc

SEQ ID NO: 195611 - RNA, 63 nt, Homo Sapiens
uaagaacugaauccauauuuaaguuauauaaaggcaaggaaauagagagcuuauuguuuuaaa

SEQ ID NO: 195612 - RNA, 63 nt, Homo Sapiens
cguccccagaccaguagugaccaaucgggaguagcaaggaaggacacugcccaguguaucuug

SEQ ID NO: 195613 - RNA, 63 nt, Homo Sapiens
agaugggugcugggagaggguugggggcagggggcaaggaaaauugcuaccugauuuguugaa

SEQ ID NO: 195614 - RNA, 63 nt, Homo Sapiens
ccugggaaaggccuggaaaggaugagggaacaggcaaggaacaaaggcaaccuuugcacacuc

SEQ ID NO: 195615 - RNA, 63 nt, Homo Sapiens
cauucaaaauagucacuugagcucacaaaaaaagcaaggaagaauucucauguccuuugucuu

SEQ ID NO: 195616 - RNA, 63 nt, Homo Sapiens
acuaguuuauauuuuccaauucaucuguuaaaagcaaggaauaacacaaaacuugucaagaac

SEQ ID NO: 195617 - RNA, 63 nt, Homo Sapiens
uauuuaacauggugcugagcuuuaagggagauugcaaggaagcuugcucuggggauggguuua

SEQ ID NO: 195618 - RNA, 63 nt, Homo Sapiens
gagcgaaacugggucucaaguuaaaaaaagaaagcaaggaaagaguaauuuacaacgaaggaa

SEQ ID NO: 195619 - RNA, 63 nt, Homo Sapiens
gcagaaugagccagaguucaccaagcaggcaaggcaaggaaggguguugcagagagggaacag

SEQ ID NO: 195620 - RNA, 63 nt, Homo Sapiens
aggcuugcuggaaaagugacuaaugagucaggagcaaggaacguccagggagugggagcagca

SEQ ID NO: 195621 - RNA, 63 nt, Homo Sapiens
ucgaauaaaggaugggaccaggcuaggguaggggcaaggaaaccuggccaacgucagggucgg

SEQ ID NO: 195622 - RNA, 63 nt, Homo Sapiens
agaugcugaggcagucuuccugccacggccccugcaaggaaaugguucuggaacuuuucuuca

SEQ ID NO: 195623 - RNA, 63 nt, Homo Sapiens
aacucauagaaaagauaaauaauugaaauucaugcaaggaaacacuguuuaagaucuccaugu

SEQ ID NO: 195624 - RNA, 63 nt, Homo Sapiens
gauucaggauguuguuggagaaugugugauggugcaaggaaugaacacuucugaugcaugaaa

SEQ ID NO: 195625 - RNA, 63 nt, Homo Sapiens
uggcacuuggcagguacuccuggauguugaugagcaaggaagagcaacggcccugucagcugg

SEQ ID NO: 195626 - RNA, 63 nt, Homo Sapiens
ccccagcccuugaauagguugguccucaucauugcaaggaaugagaaagggaggauuuugcac

SEQ ID NO: 195627 - RNA, 63 nt, Homo Sapiens
guagagccacaauauguaucuuugcuguaaagugcaaggaaauuuuaaauucugggacacuga

SEQ ID NO: 195628 - RNA, 63 nt, Homo Sapiens
uuucaaaagcagaaaaagacaacaaauauuaaagcaaggaaaaguguaacugaaacacugcac

SEQ ID NO: 195629 - RNA, 63 nt, Homo Sapiens
ugaucuguuuuaaaggucauauuuggagaaagggcaaggaauugggucugcuuuauuuuuggg

SEQ ID NO: 195630 - RNA, 63 nt, Homo Sapiens
cagaaucugaugcuuucugaucaacaaaacugagcaaggaagaucccaacacugaagggguag

SEQ ID NO: 195631 - RNA, 63 nt, Homo Sapiens
uagggauagaugugcuagucuucuagcauaggagcaaggaaucagaggugggguuaaaggcau

SEQ ID NO: 195632 - RNA, 63 nt, Homo Sapiens
uaauggcuaauauuuccugagcaucuacuaaaugcaaggaauugugcuuggugugucaugugg

SEQ ID NO: 195633 - RNA, 63 nt, Homo Sapiens
uagccgagagguugugugggugacuccagcagggcaaggaaugcacaguggauguguuuuccc

SEQ ID NO: 195634 - RNA, 63 nt, Homo Sapiens
gaaaccaucagggcugggcugagcugugucccagcaaggaaggaguuucucaacugcuggaag

SEQ ID NO: 195635 - RNA, 63 nt, Homo Sapiens
ggcugugguaacacugauccaggacgguguaaugcaaggaaauuucucauagacguccugaga

SEQ ID NO: 195636 - RNA, 63 nt, Homo Sapiens
caucuaaacccauaaccauauauucauuuuauggcaaggaaaugcugauuacuguugauagaa

SEQ ID NO: 195637 - RNA, 63 nt, Homo Sapiens
cccugagcaggaccguggauccagccccggucagcaaggaagauggccaccagaagagcaggg

SEQ ID NO: 195638 - RNA, 63 nt, Homo Sapiens
uauggguaugugagccauaaggaauucagcaccgcaaggaaaugucucuaauaauccccacuu

SEQ ID NO: 195639 - RNA, 63 nt, Homo Sapiens
gucaccagccgcacgcguggucagcgucagacagcaaggaacuccuagagccgggcacagccc

SEQ ID NO: 195640 - RNA, 63 nt, Homo Sapiens
uuguccugaccaguaacccaagccuauuucacagcaaggaaauucaccuucaaaagcacugau

SEQ ID NO: 195641 - RNA, 63 nt, Homo Sapiens
uuuauuaguucaaaagugugacaccuuuucugggcaaggaacagccccuuuaaggagcaaauc

SEQ ID NO: 195642 - RNA, 63 nt, Homo Sapiens
aaccuuuguauauuggagacuucagaguaaccagcaaggaagagaaaucuuaaucuucaaguu

SEQ ID NO: 195643 - RNA, 63 nt, Homo Sapiens
agauguguuggagagcacgucgugaccuugggggcaaggaauccagaaagguaggaagauaug

SEQ ID NO: 195644 - RNA, 63 nt, Homo Sapiens
ccuacugcugaauagcuguuuuccaucugaggagcaaggaaauuguauuuaauuuuucuuucc

SEQ ID NO: 195645 - RNA, 63 nt, Homo Sapiens
cauggcguggcucagcugucuguugaaguuguugcaaggaaaagaggaaacaucucgggccua

SEQ ID NO: 195646 - RNA, 63 nt, Homo Sapiens
ucugccuggauggaacugaggaccaaucaugcugcaaggaacacuuccacgccccgugaggcc

SEQ ID NO: 195647 - RNA, 63 nt, Homo Sapiens
aagcacucccagccccguuuaucagaaacacaggcaaggaaauuggaacugccacccagccca

SEQ ID NO: 195648 - RNA, 63 nt, Homo Sapiens
acuccauggccuccuguccuggaccccacgucugcaaggaaacccuaggaccauggauaccuc

SEQ ID NO: 195649 - RNA, 63 nt, Homo Sapiens
cccuguccccuuccuucaugaaggcaucuccaggcaaggaaaacugaagucauuggcccgaua

SEQ ID NO: 195650 - RNA, 63 nt, Homo Sapiens
cgccagucagccccaaggagguggccacccugagcaaggaacuccugcaauucacggcaucca

SEQ ID NO: 195651 - RNA, 63 nt, Homo Sapiens
ccacaggcagcccugggacauaggaagcugggagcaaggaaagggucuuagucacugccuccc

SEQ ID NO: 195652 - RNA, 63 nt, Homo Sapiens
guugcuagugucugauuauaugguagaaauaaugcaaggaaaaagguagccaccuucuccauu

SEQ ID NO: 195653 - RNA, 63 nt, Homo Sapiens
ccucugagcuaaaggagcauguucuaacccaaugcaaggaagcuaagaaccuugaaaaaaggu

SEQ ID NO: 195654 - RNA, 63 nt, Homo Sapiens
augaugacgugucuccucaccagauguaauacugcaaggaaaagaucaucacggcacgguuuc

SEQ ID NO: 195655 - RNA, 63 nt, Homo Sapiens
aaaaagaaaaaaaucaaaaauggagcuucugcugcaaggaacaguguuguuauuaaacgucug

SEQ ID NO: 195656 - RNA, 63 nt, Homo Sapiens
ugggaaagccuucaguuaccaaacccuacaaaugcaaggaaugaaaagacucauacuggagag

SEQ ID NO: 195657 - RNA, 63 nt, Homo Sapiens
aaauuuaagacucucgcauccuggcccaaagaagcaaggaaccucaguggggcucucugaguc

SEQ ID NO: 195658 - RNA, 63 nt, Homo Sapiens
ugaaugggccuguggcccacgaagcgggggcuugcaaggaaagaaggccucucaucaccacag

SEQ ID NO: 195659 - RNA, 63 nt, Homo Sapiens
agcaaagacauuuaccagagcccacugccagcugcaaggaaccgggccugggcuggggucccc

SEQ ID NO: 195660 - RNA, 63 nt, Homo Sapiens
aaaagauuguguggucaaauauucaauuuaagagcaaggaaauucuuauaaauauaacaauag

SEQ ID NO: 195661 - RNA, 63 nt, Homo Sapiens
gacauugaugaacgagucuuguuucucuccccugcaaggaagguccaagcaggcccuuaggga

SEQ ID NO: 195662 - RNA, 63 nt, Homo Sapiens
ucuagacucuucuguaagacucacagaacaaaagcaaggaauugcugauuuggggggugccug

SEQ ID NO: 195663 - RNA, 63 nt, Homo Sapiens
ggaaaaauggccuuuguaggcaguggaaaacuugcaaggaaagcugccgucucuuuggcaguc

SEQ ID NO: 195664 - RNA, 63 nt, Homo Sapiens
agggagggaggggcagagugacauggacccugagcaaggaaggccaacaauggccugcuguuc

SEQ ID NO: 195665 - RNA, 63 nt, Homo Sapiens
aaugagaagcccaggaaauuguuuggggaagaugcaaggaaguaccucauagaugugggcucu

SEQ ID NO: 195666 - RNA, 63 nt, Homo Sapiens
uaccuacuauaauagaaauuaauuccugcugcagcaaggaaagaugcccaguucagacugaau

SEQ ID NO: 195667 - RNA, 63 nt, Homo Sapiens
cuacaguuguguaaaguuguauaugaggaaucugcaaggaacagauuguacuguacauaaaac

SEQ ID NO: 195668 - RNA, 63 nt, Homo Sapiens
ugugguguguccccugggaaagacucauguccagcaaggaacgcagcaggagggacugaggcc

SEQ ID NO: 195669 - RNA, 63 nt, Homo Sapiens
ucugcugucccugggaagucccuugggaccagugcaaggaaguaggguggccaagaggggcuu

SEQ ID NO: 195670 - RNA, 63 nt, Homo Sapiens
cccugcucccugcgucugggagagcgaggccgagcaaggaaagcauuucgaaccuuccagucc

SEQ ID NO: 195671 - RNA, 63 nt, Homo Sapiens
uauccaacauauauuuuggaauaucuacuaugugcaaggaauuuuucuuaaacucuaagguua

SEQ ID NO: 195672 - RNA, 63 nt, Homo Sapiens
uugcuucccccucaaucuggggucuagaguugugcaaggaauucagcuccaguaaggccugga

SEQ ID NO: 195673 - RNA, 63 nt, Homo Sapiens
ugugaagccagauaugcaauguguaucugaaaagcaaggaauuugcagccguuuuacaaauau

SEQ ID NO: 195674 - RNA, 63 nt, Homo Sapiens
ucaagauucuugaaguugaaaaaaagccuucuagcaaggaaaucuaaaaggaaucuuugagga

SEQ ID NO: 195675 - RNA, 63 nt, Homo Sapiens
uaagauuucaaauaaaauuucauuuuugucuaagcaaggaauaugacugguguuuugucuuca

SEQ ID NO: 195676 - RNA, 63 nt, Homo Sapiens
ucgccgggcccggccacccugccccaagggcaagcaaggaauacguucccccagccccagggg

SEQ ID NO: 195677 - RNA, 63 nt, Homo Sapiens
agguuaaguagcagguuggguuuuuaugauagugcaaggaaugacucaugccucugagcuucu

SEQ ID NO: 195678 - RNA, 63 nt, Homo Sapiens
ccauggaggaugagagacugaggcucagggagggcaaggaauaggcccaagaucacuuggcaa

SEQ ID NO: 195679 - RNA, 63 nt, Homo Sapiens
uggccgccucugccccacugccagccugagugggcaaggaagcagguggaucccccagaagga

SEQ ID NO: 195680 - RNA, 63 nt, Homo Sapiens
gcuuuuugucuggagcugcccacaagaaagagggcaaggaaaaaaggcuggacuccaugacua

SEQ ID NO: 195681 - RNA, 63 nt, Homo Sapiens
uggcugaaggauucuagagaaccuuuuguucuugcaaggaaaacaagaauccaaaaccaguga

SEQ ID NO: 195682 - RNA, 63 nt, Homo Sapiens
uuuggaagcagcaaggugggggcccagcccugggcaaggaagcguguggggggugccccacaa

SEQ ID NO: 195683 - RNA, 63 nt, Homo Sapiens
ucccugagaaagagaaugcaauucuuuuucucagcaaggaacaaaugggagaaauaucgcuga

SEQ ID NO: 195684 - RNA, 63 nt, Homo Sapiens
gaggcccucugggaggagggccucugccccugggcaaggaagcggccugggcuaggugagcug

SEQ ID NO: 195685 - RNA, 63 nt, Homo Sapiens
agcucagaggguggggagaaugguccuggggcagcaaggaagacacauuaccuacccugugca

SEQ ID NO: 195686 - RNA, 63 nt, Homo Sapiens
agggcagacacacaaccuccuccuccucuuccagcaaggaacgcaccgaaaagucacaugaug

SEQ ID NO: 195687 - RNA, 63 nt, Homo Sapiens
aaaagguauuacauauucuuuugagcuggagcugcaaggaaauacaaaaauuuuuaaaaagaa

SEQ ID NO: 195688 - RNA, 63 nt, Homo Sapiens
uuuaaguaucuagcacauuggauugguuauaaagcaaggaauguucacacaguaggauauuau

SEQ ID NO: 195689 - RNA, 63 nt, Homo Sapiens
uuccucuccucuaaucuguguacacaucuccaagcaaggaagaaaaaacaaacucugcucaga

SEQ ID NO: 195690 - RNA, 59 nt, Homo Sapiens
ccccauugagccugccccccgacacaauagcaaggaaaucaacaauaacugggugguga

SEQ ID NO: 195691 - RNA, 63 nt, Homo Sapiens
gaagugaggaugagacccagcugcucugcccaggcaaggaacaccuuccccaugaacccugcc

SEQ ID NO: 195692 - RNA, 63 nt, Homo Sapiens
cuuuacuggaucugagacccacaaugaaacccugcaaggaaaauugacauugacagcucugag

SEQ ID NO: 195693 - RNA, 63 nt, Homo Sapiens
gaacaucaaauuaaguaaguuccggucccacaugcaaggaaguuuuuacaucuuuagauaugu

SEQ ID NO: 195694 - RNA, 63 nt, Homo Sapiens
uaaaaaguuaacaggcaaacgcugagaccaagagcaaggaaggguguuuauucaaacugaaaa

SEQ ID NO: 195695 - RNA, 63 nt, Homo Sapiens
cuggcaucauccagugaggaccagcaucugggggcaaggaaggaguggaacccugccuccaug

SEQ ID NO: 195696 - RNA, 63 nt, Homo Sapiens
acaggucuucaucgaaucuagaaguccaauguggcaaggaaaacccaauccaaauggcgucug

SEQ ID NO: 195697 - RNA, 64 nt, Homo Sapiens
auugugagucaucagaguuugaaugcugaccuuucauauggauucacaaaagugucacauauua

SEQ ID NO: 195698 - RNA, 64 nt, Homo Sapiens
aacuguaagaaaugaaauaauuccaaggaaauggcauauggauuaauaaaugagguuuuuugca

SEQ ID NO: 195699 - RNA, 64 nt, Homo Sapiens
ugauuccagucaaaaauaaaucacaauuucccuucauauggauacaaaagaguaaaggauacuu

SEQ ID NO: 195700 - RNA, 64 nt, Homo Sapiens
cagggacaucuccaucauuacgccugucagugugcauauggaaagcauuuccuaggcagcuccu

SEQ ID NO: 195701 - RNA, 64 nt, Homo Sapiens
uccuuucaguucucugaccacauugugcuguagccauauggaacucucuccgucuucccgccau

SEQ ID NO: 195702 - RNA, 64 nt, Homo Sapiens
uuaguaacaucuugcuuaguguauguuacugacccauauggauuauaauuucaucagguuuuuu

SEQ ID NO: 195703 - RNA, 64 nt, Homo Sapiens
acauuuauauauuauguaaaauguuaacuaucaucauauggacucuauguaacacaaauucaaa

SEQ ID NO: 195704 - RNA, 64 nt, Homo Sapiens
caaaauacaagagacaugggacuguuugcaauaccauauggaaaucuuuuaauaaauauaugua

SEQ ID NO: 195705 - RNA, 64 nt, Homo Sapiens
ucuagaauuuuauaugugcuagucauucucaauucauauggaaucuagauggauauuucaugca

SEQ ID NO: 195706 - RNA, 64 nt, Homo Sapiens
aaacagcuuauucugauacaagaaugcuugggugcauauggaaagauugugaaagagugugucu

SEQ ID NO: 195707 - RNA, 64 nt, Homo Sapiens
uguaaacaaugacuguaacgacagccuagucaggcauauggauauuucugcccuagaguuguuc

SEQ ID NO: 195708 - RNA, 64 nt, Homo Sapiens
gcauuuaaaacuuugaaugagucuaaaaauguggcauauggaugauuauuaagcuucuguguuu

SEQ ID NO: 195709 - RNA, 64 nt, Homo Sapiens
uauuaagccaagaauaagcagcagaacccuguuccauauggaaaaaagaaaaacaauuuuuugu

SEQ ID NO: 195710 - RNA, 64 nt, Homo Sapiens
ccaaaugcuaucuuaaauuuugguccaaacugaacauauggaaauagauuuauuguaaguauuu

SEQ ID NO: 195711 - RNA, 64 nt, Homo Sapiens; identical to SEQ ID NO: 78073

SEQ ID NO: 195712 - RNA, 64 nt, Homo Sapiens; identical to SEQ ID NO: 78074

SEQ ID NO: 195713 - RNA, 64 nt, Homo Sapiens; identical to SEQ ID NO: 78075

SEQ ID NO: 195714 - RNA, 64 nt, Homo Sapiens; identical to SEQ ID NO: 78076

SEQ ID NO: 195715 - RNA, 64 nt, Homo Sapiens; identical to SEQ ID NO: 78077

SEQ ID NO: 195716 - RNA, 64 nt, Homo Sapiens; identical to SEQ ID NO: 78078

SEQ ID NO: 195717 - RNA, 64 nt, Homo Sapiens; identical to SEQ ID NO: 78079

SEQ ID NO: 195718 - RNA, 64 nt, Homo Sapiens; identical to SEQ ID NO: 78080

SEQ ID NO: 195719 - RNA, 64 nt, Homo Sapiens; identical to SEQ ID NO: 78081

SEQ ID NO: 195720 - RNA, 64 nt, Homo Sapiens; identical to SEQ ID NO: 78082

SEQ ID NO: 195721 - RNA, 64 nt, Homo Sapiens; identical to SEQ ID NO: 78083

SEQ ID NO: 195722 - RNA, 64 nt, Homo Sapiens; identical to SEQ ID NO: 78084

SEQ ID NO: 195723 - RNA, 64 nt, Homo Sapiens; identical to SEQ ID NO: 78085

SEQ ID NO: 195724 - RNA, 64 nt, Homo Sapiens; identical to SEQ ID NO: 78086

SEQ ID NO: 195725 - RNA, 64 nt, Homo Sapiens; identical to SEQ ID NO: 78087

SEQ ID NO: 195726 - RNA, 64 nt, Homo Sapiens; identical to SEQ ID NO: 78088

SEQ ID NO: 195727 - RNA, 64 nt, Homo Sapiens; identical to SEQ ID NO: 78089

SEQ ID NO: 195728 - RNA, 64 nt, Homo Sapiens; identical to SEQ ID NO: 78090

SEQ ID NO: 195729 - RNA, 64 nt, Homo Sapiens; identical to SEQ ID NO: 78091

SEQ ID NO: 195730 - RNA, 64 nt, Homo Sapiens; identical to SEQ ID NO: 78092

SEQ ID NO: 195731 - RNA, 64 nt, Homo Sapiens; identical to SEQ ID NO: 78093

SEQ ID NO: 195732 - RNA, 64 nt, Homo Sapiens; identical to SEQ ID NO: 78094

SEQ ID NO: 195733 - RNA, 64 nt, Homo Sapiens; identical to SEQ ID NO: 78095

SEQ ID NO: 195734 - RNA, 64 nt, Homo Sapiens; identical to SEQ ID NO: 78096

SEQ ID NO: 195735 - RNA, 64 nt, Homo Sapiens; identical to SEQ ID NO: 78097

SEQ ID NO: 195736 - RNA, 64 nt, Homo Sapiens; identical to SEQ ID NO: 78098

SEQ ID NO: 195737 - RNA, 64 nt, Homo Sapiens; identical to SEQ ID NO: 78099

SEQ ID NO: 195738 - RNA, 64 nt, Homo Sapiens; identical to SEQ ID NO: 78100

SEQ ID NO: 195739 - RNA, 64 nt, Homo Sapiens
caucgggaaaugaucucccaagucgcugccagacaccacccacugcuucgccggacaaugucga

SEQ ID NO: 195740 - RNA, 64 nt, Homo Sapiens
cacccaagccugucaccucugcucauccuccaagaccacccagcuuucucccagccacagccaa

SEQ ID NO: 195741 - RNA, 64 nt, Homo Sapiens
gagucaaaaauauauauauaccacacuugagaaaaccacccaauuuaaggauauuuucuaaaac

SEQ ID NO: 195742 - RNA, 64 nt, Homo Sapiens
ucagaguaguguuuaaguacgucugaucauauaaaccacccauuuuuugaaguuugugguaauc

SEQ ID NO: 195743 - RNA, 64 nt, Homo Sapiens
caaagaaccaucucuacuugccagaguauguuccaccacccaagcagggucucccuacuuuuuc

SEQ ID NO: 195744 - RNA, 64 nt, Homo Sapiens
guaagacuuagucaguguugguagacaaagucauaccacccagggcagccugcaugcagcgagu

SEQ ID NO: 195745 - RNA, 64 nt, Homo Sapiens
gcuacugaagccaaggugggaggcagcugacaacaccacccacggcccaugcagaggugguaga

SEQ ID NO: 195746 - RNA, 64 nt, Homo Sapiens
ucagcaggaacaccaaaucccggaccaggcagaaaccacccaagacugaggggcucgugccaga

SEQ ID NO: 195747 - RNA, 64 nt, Homo Sapiens
aacuacacaaaauuuuauuuaaagagaacacuuagcagccuaugauaguuuucaauaaaauguu

SEQ ID NO: 195748 - RNA, 64 nt, Homo Sapiens
uuugggucgcguaguugcugaaaccuaaguaccugcagccuacaggauaaggaaguucacagcc

SEQ ID NO: 195749 - RNA, 64 nt, Homo Sapiens
agggguuggccaguuggagccugggucagccucagcagccuauccccauguccucuaugccccu

SEQ ID NO: 195750 - RNA, 64 nt, Homo Sapiens
aggccccucgggggauuggggggacuggggaggcgcagccuagacccaauugcuugcccccaug

SEQ ID NO: 195751 - RNA, 64 nt, Homo Sapiens
gaaggcuuucccaggaugcacguccucagagggagcagccuaucucccccaagcuggaggcggc

SEQ ID NO: 195752 - RNA, 64 nt, Homo Sapiens
uauuuuuaagugugugaggagaugcucaguagcagcagccuauggcaagagcuuauaaaugauu

SEQ ID NO: 195753 - RNA, 64 nt, Homo Sapiens
ugcuggugcacagccacuccccggcaugagacucagugcagauggagagacagcuacacagagc

SEQ ID NO: 195754 - RNA, 64 nt, Homo Sapiens
gcagcaccgaggggccuuuguucuggggggacccagugcagaauguaagugggcccacccggug

SEQ ID NO: 195755 - RNA, 64 nt, Homo Sapiens
ccguccuuuuguacuuggggagaccuugguccuuagugcagagcagcuuuccaagugccuggcc

SEQ ID NO: 195756 - RNA, 64 nt, Homo Sapiens
uucuuccccaagcccagagaauauucaggaaagaagugcagaaugcaguaucugacugcaaauc

SEQ ID NO: 195757 - RNA, 64 nt, Homo Sapiens
aagugaacuuuuuuguuuugcgcugguucuucugagugcagaaucuuuugaagugcagauuccu

SEQ ID NO: 195758 - RNA, 64 nt, Homo Sapiens
ccucgcugguucuucugaguucacuuccuuuugaagugcagauuuucaccuaauguuuucaguu

SEQ ID NO: 195759 - RNA, 64 nt, Homo Sapiens
cacagaaucucugcagcggaccgaugcauaccucagugcagaacgguccuccccguccccugcu

SEQ ID NO: 195760 - RNA, 64 nt, Homo Sapiens
uucucucugggccacgaagccuuccuaaacagccagugcagacggucuuucaaacacccugagc

SEQ ID NO: 195761 - RNA, 64 nt, Homo Sapiens
ccagagucagaugcccgaggguucucuugaugccagugcagagagccuuaaaccaccgagcagc

SEQ ID NO: 195762 - RNA, 64 nt, Homo Sapiens
ugcgcuuuguguguugucuaaagauaaggacagaagugcagagcgguguggaugucacugugug

SEQ ID NO: 195763 - RNA, 64 nt, Homo Sapiens; identical to SEQ ID NO: 138909

SEQ ID NO: 195764 - RNA, 64 nt, Homo Sapiens; identical to SEQ ID NO: 138910

SEQ ID NO: 195765 - RNA, 64 nt, Homo Sapiens; identical to SEQ ID NO: 138911

SEQ ID NO: 195766 - RNA, 64 nt, Homo Sapiens; identical to SEQ ID NO: 138912

SEQ ID NO: 195767 - RNA, 64 nt, Homo Sapiens; identical to SEQ ID NO: 138913

SEQ ID NO: 195768 - RNA, 64 nt, Homo Sapiens; identical to SEQ ID NO: 138914

SEQ ID NO: 195769 - RNA, 64 nt, Homo Sapiens; identical to SEQ ID NO: 138915

SEQ ID NO: 195770 - RNA, 64 nt, Homo Sapiens; identical to SEQ ID NO: 138916

SEQ ID NO: 195771 - RNA, 64 nt, Homo Sapiens; identical to SEQ ID NO: 138917

SEQ ID NO: 195772 - RNA, 64 nt, Homo Sapiens; identical to SEQ ID NO: 138918

SEQ ID NO: 195773 - RNA, 64 nt, Homo Sapiens; identical to SEQ ID NO: 138919

SEQ ID NO: 195774 - RNA, 64 nt, Homo Sapiens; identical to SEQ ID NO: 138920

SEQ ID NO: 195775 - RNA, 64 nt, Homo Sapiens; identical to SEQ ID NO: 138921

SEQ ID NO: 195776 - RNA, 64 nt, Homo Sapiens; identical to SEQ ID NO: 138922

SEQ ID NO: 195777 - RNA, 64 nt, Homo Sapiens; identical to SEQ ID NO: 138923

SEQ ID NO: 195778 - RNA, 64 nt, Homo Sapiens; identical to SEQ ID NO: 138924

SEQ ID NO: 195779 - RNA, 64 nt, Homo Sapiens; identical to SEQ ID NO: 138925

SEQ ID NO: 195780 - RNA, 64 nt, Homo Sapiens; identical to SEQ ID NO: 138926

SEQ ID NO: 195781 - RNA, 64 nt, Homo Sapiens; identical to SEQ ID NO: 138927

SEQ ID NO: 195782 - RNA, 64 nt, Homo Sapiens; identical to SEQ ID NO: 138928

SEQ ID NO: 195783 - RNA, 64 nt, Homo Sapiens; identical to SEQ ID NO: 138929

SEQ ID NO: 195784 - RNA, 64 nt, Homo Sapiens; identical to SEQ ID NO: 138930

SEQ ID NO: 195785 - RNA, 64 nt, Homo Sapiens; identical to SEQ ID NO: 138931

SEQ ID NO: 195786 - RNA, 64 nt, Homo Sapiens; identical to SEQ ID NO: 138932

SEQ ID NO: 195787 - RNA, 64 nt, Homo Sapiens; identical to SEQ ID NO: 138933

SEQ ID NO: 195788 - RNA, 64 nt, Homo Sapiens; identical to SEQ ID NO: 138934

SEQ ID NO: 195789 - RNA, 64 nt, Homo Sapiens; identical to SEQ ID NO: 138935

SEQ ID NO: 195790 - RNA, 64 nt, Homo Sapiens; identical to SEQ ID NO: 138936

SEQ ID NO: 195791 - RNA, 64 nt, Homo Sapiens; identical to SEQ ID NO: 138937

SEQ ID NO: 195792 - RNA, 64 nt, Homo Sapiens; identical to SEQ ID NO: 138938

SEQ ID NO: 195793 - RNA, 64 nt, Homo Sapiens; identical to SEQ ID NO: 138939

SEQ ID NO: 195794 - RNA, 64 nt, Homo Sapiens; identical to SEQ ID NO: 138940

SEQ ID NO: 195795 - RNA, 64 nt, Homo Sapiens
ggcggugcuagcuugacacagucagcaugcuucccagagggagcaggccggaaccacagggcca

SEQ ID NO: 195796 - RNA, 64 nt, Homo Sapiens
gcuucccagagggagcaggccggaaccacagggccagagggagcuggaacccgaggggccgggg

SEQ ID NO: 195797 - RNA, 64 nt, Homo Sapiens
acuuuauuguuguuauuuuuuuauuuuuaugaaacagagggaaguagggggaggguuggaaaau

SEQ ID NO: 195798 - RNA, 64 nt, Homo Sapiens
cugagaaucauccagucuuaccagaauggaaagccagagggaacagagccuccacucugggaug

SEQ ID NO: 195799 - RNA, 64 nt, Homo Sapiens
gugugucuccuuccugaaggcuggugugagcagccagagggagagaugcucagggagggauaug

SEQ ID NO: 195800 - RNA, 64 nt, Homo Sapiens
aggcagagggugggggaccuacccccagagccaacagagggagcggguggggaggugcaguggc

SEQ ID NO: 195801 - RNA, 64 nt, Homo Sapiens
gguggaccuguuucucuuucccuggugggcccuucagagggaggcccucccacccuuguccaga

SEQ ID NO: 195802 - RNA, 64 nt, Homo Sapiens
aggaggguggggcccuggaugaggcaguagggcacagagggaagccugccccugucugccagca

SEQ ID NO: 195803 - RNA, 64 nt, Homo Sapiens
cagggagcuuuuggacaauuggcuugagcuggcucagagggagggcaucaugggucauuacggg

SEQ ID NO: 195804 - RNA, 64 nt, Homo Sapiens
gcuggauugggagaucagucgaaucagagaagagcagagggaguauguguguaguggacaaagu

SEQ ID NO: 195805 - RNA, 64 nt, Homo Sapiens
ggguccuuauguacacaccacguucacacacacacagagggaccacgugugcacgcaugaccgu

SEQ ID NO: 195806 - RNA, 64 nt, Homo Sapiens
guguuuuccugugaggccucccccaucaguggaccagagggagaagcccgaugccccaucccgg

SEQ ID NO: 195807 - RNA, 64 nt, Homo Sapiens
uggggaaaaccagcagggagcacuuggcuccuggcagagggagaggacaggaggaggagccuuc

SEQ ID NO: 195808 - RNA, 64 nt, Homo Sapiens
gccuuccccugcaaggugcccaccugcccggagacagagggagcagcugaggccucucuccacu

SEQ ID NO: 195809 - RNA, 64 nt, Homo Sapiens
aaggaucuuuuuuuuaaagaagugaagacagaaccagagggaauccauaguguucuccaucucu

SEQ ID NO: 195810 - RNA, 64 nt, Homo Sapiens
cuccaucucaaaaaaaaaaauccagccugggcaacagagggagaccgaaaucacgccacuacac

SEQ ID NO: 195811 - RNA, 64 nt, Homo Sapiens
auguuggccugaggccugagagugucaccaaagacagagggagcuucacugagacucagaggga

SEQ ID NO: 195812 - RNA, 64 nt, Homo Sapiens
ugucaccaaagacagagggagcuucacugagacucagagggaaaaggaaaagagccucaaacau

SEQ ID NO: 195813 - RNA, 64 nt, Homo Sapiens
gacccucgggccgcuccccugagggaaagaccuacagagggaaaaucuucuggauguuccuaca

SEQ ID NO: 195814 - RNA, 64 nt, Homo Sapiens
gaccuacagagggaaagaccucuggauguuccuacagagggaaaugugcuugcuuccagaaucu

SEQ ID NO: 195815 - RNA, 64 nt, Homo Sapiens
ugucuuucuacuguggcaggcgcacuggcgaagccagagggauccagcugcugucuaaagcaug

SEQ ID NO: 195816 - RNA, 64 nt, Homo Sapiens
ccuugguggcacugguggaccuggacccgcuggccagagggacaguggugugagucugcaggcc

SEQ ID NO: 195817 - RNA, 64 nt, Homo Sapiens
agacacugggaggucagcauguuccacagguguucagagggagucugcuacaaacuaucagggc

SEQ ID NO: 195818 - RNA, 64 nt, Homo Sapiens
auuaccuggaagggagcugccaucugucccucugcagagggauaccuuccaauaguaaauuauc

SEQ ID NO: 195819 - RNA, 64 nt, Homo Sapiens
agcuagccuguagaggggaaggggaaugaccacccagagggaugccucgcucucaacgugaccc

SEQ ID NO: 195820 - RNA, 64 nt, Homo Sapiens
ccccuugcccuguuuggccaggacaaugcccaagcagagggagccccucucacugaccaggggu

SEQ ID NO: 195821 - RNA, 64 nt, Homo Sapiens
aaggcaugguuuguccugcuuagguugcccuucccagagggaugguuugaggggagcugaugag

SEQ ID NO: 195822 - RNA, 64 nt, Homo Sapiens
gaagcuucggggagacaaguuuugagagaagccccagagggagcuauuuccuugcaccccccag

SEQ ID NO: 195823 - RNA, 64 nt, Homo Sapiens
uggaggauauccacagucugcuaacccucauugucagagggaauuaacugcuaggcaccucucu

SEQ ID NO: 195824 - RNA, 64 nt, Homo Sapiens
ugcuguuaucucguaccuccucuguagaaguuuccagagggaggaauagaaaacaaaacugacu

SEQ ID NO: 195825 - RNA, 64 nt, Homo Sapiens
aucccuacgcuaaacagguaacaucucauccaaacagagggaacaauuccaguucaugcugccc

SEQ ID NO: 195826 - RNA, 64 nt, Homo Sapiens
aggagggaagggaauuagaaaaugaucaaggccucagagggagggaggaaguuggauauccagu

SEQ ID NO: 195827 - RNA, 64 nt, Homo Sapiens
gucaucuaaaccaggggaaccuaccuugagcucacagagggacucaagggaaugaacaagaaga

SEQ ID NO: 195828 - RNA, 64 nt, Homo Sapiens
cggugagcauuuccuuaguuugugugagcgugcacagagggagucuccaggagacacgucccca

SEQ ID NO: 195829 - RNA, 64 nt, Homo Sapiens
uggaugccucucccucgccucugcugaacuggugcagagggacgggauaagguagagcucccac

SEQ ID NO: 195830 - RNA, 64 nt, Homo Sapiens
cgagacucggaaagugauaguaaaguuucacccccagagggagccccaguacugacagccuccu

SEQ ID NO: 195831 - RNA, 64 nt, Homo Sapiens
ccugugccguaggaaagugacuggaaguggacuccagagggacaggugugguggcacaguccug

SEQ ID NO: 195832 - RNA, 64 nt, Homo Sapiens
cauggaagagcagcuggaggguggauggggaggccagagggagcaaugagggguggucccagcu

SEQ ID NO: 195833 - RNA, 64 nt, Homo Sapiens
uccuacacacacuuuuucccucuuuucaaaauggcagagggaguggaacugcuuuuagcuccug

SEQ ID NO: 195834 - RNA, 64 nt, Homo Sapiens
ccuaacgugcccagcauguaaaggcgccccuccccagagggauccacaccaacaaggcaagcca

SEQ ID NO: 195835 - RNA, 64 nt, Homo Sapiens
ugcucaccugagcacccuugguuuggccuuagcccagagggagcuggacuucaacccuccuguu

SEQ ID NO: 195836 - RNA, 64 nt, Homo Sapiens
acccaagccccugaugccuauuagcucugaagggcagagggaauaccaaaaaaauaauaauaag

SEQ ID NO: 195837 - RNA, 64 nt, Homo Sapiens; identical to SEQ ID NO: 120942

SEQ ID NO: 195838 - RNA, 64 nt, Homo Sapiens; identical to SEQ ID NO: 120943

SEQ ID NO: 195839 - RNA, 64 nt, Homo Sapiens; identical to SEQ ID NO: 120944

SEQ ID NO: 195840 - RNA, 64 nt, Homo Sapiens; identical to SEQ ID NO: 120945

SEQ ID NO: 195841 - RNA, 64 nt, Homo Sapiens; identical to SEQ ID NO: 120946

SEQ ID NO: 195842 - RNA, 64 nt, Homo Sapiens; identical to SEQ ID NO: 120947

SEQ ID NO: 195843 - RNA, 64 nt, Homo Sapiens; identical to SEQ ID NO: 120948

SEQ ID NO: 195844 - RNA, 64 nt, Homo Sapiens; identical to SEQ ID NO: 120949

SEQ ID NO: 195845 - RNA, 64 nt, Homo Sapiens; identical to SEQ ID NO: 120950

SEQ ID NO: 195846 - RNA, 64 nt, Homo Sapiens; identical to SEQ ID NO: 120951

SEQ ID NO: 195847 - RNA, 64 nt, Homo Sapiens; identical to SEQ ID NO: 120952

SEQ ID NO: 195848 - RNA, 64 nt, Homo Sapiens; identical to SEQ ID NO: 120953

SEQ ID NO: 195849 - RNA, 64 nt, Homo Sapiens; identical to SEQ ID NO: 120954

SEQ ID NO: 195850 - RNA, 64 nt, Homo Sapiens; identical to SEQ ID NO: 120955

SEQ ID NO: 195851 - RNA, 64 nt, Homo Sapiens; identical to SEQ ID NO: 120956

SEQ ID NO: 195852 - RNA, 64 nt, Homo Sapiens; identical to SEQ ID NO: 120957

SEQ ID NO: 195853 - RNA, 64 nt, Homo Sapiens; identical to SEQ ID NO: 120958

SEQ ID NO: 195854 - RNA, 64 nt, Homo Sapiens; identical to SEQ ID NO: 120959

SEQ ID NO: 195855 - RNA, 64 nt, Homo Sapiens; identical to SEQ ID NO: 120960

SEQ ID NO: 195856 - RNA, 64 nt, Homo Sapiens; identical to SEQ ID NO: 120961

SEQ ID NO: 195857 - RNA, 64 nt, Homo Sapiens; identical to SEQ ID NO: 120962

SEQ ID NO: 195858 - RNA, 64 nt, Homo Sapiens; identical to SEQ ID NO: 120963

SEQ ID NO: 195859 - RNA, 64 nt, Homo Sapiens; identical to SEQ ID NO: 120964

SEQ ID NO: 195860 - RNA, 62 nt, Homo Sapiens; identical to SEQ ID NO: 120965

SEQ ID NO: 195861 - RNA, 64 nt, Homo Sapiens; identical to SEQ ID NO: 120966

SEQ ID NO: 195862 - RNA, 64 nt, Homo Sapiens; identical to SEQ ID NO: 120967

SEQ ID NO: 195863 - RNA, 64 nt, Homo Sapiens; identical to SEQ ID NO: 120968

SEQ ID NO: 195864 - RNA, 64 nt, Homo Sapiens; identical to SEQ ID NO: 120969

SEQ ID NO: 195865 - RNA, 64 nt, Homo Sapiens; identical to SEQ ID NO: 120970

SEQ ID NO: 195866 - RNA, 64 nt, Homo Sapiens; identical to SEQ ID NO: 120971

SEQ ID NO: 195867 - RNA, 64 nt, Homo Sapiens; identical to SEQ ID NO: 89071

SEQ ID NO: 195868 - RNA, 64 nt, Homo Sapiens; identical to SEQ ID NO: 89072

SEQ ID NO: 195869 - RNA, 64 nt, Homo Sapiens; identical to SEQ ID NO: 89073

SEQ ID NO: 195870 - RNA, 64 nt, Homo Sapiens; identical to SEQ ID NO: 89074

SEQ ID NO: 195871 - RNA, 64 nt, Homo Sapiens; identical to SEQ ID NO: 89075

SEQ ID NO: 195872 - RNA, 64 nt, Homo Sapiens; identical to SEQ ID NO: 89076

SEQ ID NO: 195873 - RNA, 64 nt, Homo Sapiens; identical to SEQ ID NO: 89077

SEQ ID NO: 195874 - RNA, 64 nt, Homo Sapiens; identical to SEQ ID NO: 89078

SEQ ID NO: 195875 - RNA, 64 nt, Homo Sapiens; identical to SEQ ID NO: 89079

SEQ ID NO: 195876 - RNA, 64 nt, Homo Sapiens; identical to SEQ ID NO: 89080

SEQ ID NO: 195877 - RNA, 64 nt, Homo Sapiens; identical to SEQ ID NO: 89081

SEQ ID NO: 195878 - RNA, 64 nt, Homo Sapiens; identical to SEQ ID NO: 89082

SEQ ID NO: 195879 - RNA, 64 nt, Homo Sapiens; identical to SEQ ID NO: 89083

SEQ ID NO: 195880 - RNA, 64 nt, Homo Sapiens; identical to SEQ ID NO: 89084

SEQ ID NO: 195881 - RNA, 64 nt, Homo Sapiens; identical to SEQ ID NO: 89085

SEQ ID NO: 195882 - RNA, 64 nt, Homo Sapiens; identical to SEQ ID NO: 89086

SEQ ID NO: 195883 - RNA, 64 nt, Homo Sapiens; identical to SEQ ID NO: 89087

SEQ ID NO: 195884 - RNA, 64 nt, Homo Sapiens; identical to SEQ ID NO: 89088

SEQ ID NO: 195885 - RNA, 64 nt, Homo Sapiens; identical to SEQ ID NO: 89089

SEQ ID NO: 195886 - RNA, 64 nt, Homo Sapiens; identical to SEQ ID NO: 89090

SEQ ID NO: 195887 - RNA, 64 nt, Homo Sapiens; identical to SEQ ID NO: 89091

SEQ ID NO: 195888 - RNA, 64 nt, Homo Sapiens; identical to SEQ ID NO: 89092

SEQ ID NO: 195889 - RNA, 64 nt, Homo Sapiens; identical to SEQ ID NO: 89093

SEQ ID NO: 195890 - RNA, 64 nt, Homo Sapiens; identical to SEQ ID NO: 89094

SEQ ID NO: 195891 - RNA, 64 nt, Homo Sapiens; identical to SEQ ID NO: 89041

SEQ ID NO: 195892 - RNA, 64 nt, Homo Sapiens; identical to SEQ ID NO: 89042

SEQ ID NO: 195893 - RNA, 64 nt, Homo Sapiens; identical to SEQ ID NO: 89043

SEQ ID NO: 195894 - RNA, 64 nt, Homo Sapiens; identical to SEQ ID NO: 89044

SEQ ID NO: 195895 - RNA, 64 nt, Homo Sapiens; identical to SEQ ID NO: 89045

SEQ ID NO: 195896 - RNA, 64 nt, Homo Sapiens; identical to SEQ ID NO: 89046

SEQ ID NO: 195897 - RNA, 64 nt, Homo Sapiens; identical to SEQ ID NO: 89047

SEQ ID NO: 195898 - RNA, 64 nt, Homo Sapiens; identical to SEQ ID NO: 89048

SEQ ID NO: 195899 - RNA, 64 nt, Homo Sapiens; identical to SEQ ID NO: 89049

SEQ ID NO: 195900 - RNA, 64 nt, Homo Sapiens; identical to SEQ ID NO: 89050

SEQ ID NO: 195901 - RNA, 64 nt, Homo Sapiens; identical to SEQ ID NO: 89051

SEQ ID NO: 195902 - RNA, 64 nt, Homo Sapiens; identical to SEQ ID NO: 89052

SEQ ID NO: 195903 - RNA, 64 nt, Homo Sapiens; identical to SEQ ID NO: 89053

SEQ ID NO: 195904 - RNA, 64 nt, Homo Sapiens; identical to SEQ ID NO: 89054

SEQ ID NO: 195905 - RNA, 64 nt, Homo Sapiens; identical to SEQ ID NO: 89055

SEQ ID NO: 195906 - RNA, 64 nt, Homo Sapiens; identical to SEQ ID NO: 89056

SEQ ID NO: 195907 - RNA, 64 nt, Homo Sapiens; identical to SEQ ID NO: 89057

SEQ ID NO: 195908 - RNA, 64 nt, Homo Sapiens; identical to SEQ ID NO: 89058

SEQ ID NO: 195909 - RNA, 64 nt, Homo Sapiens; identical to SEQ ID NO: 89059

SEQ ID NO: 195910 - RNA, 64 nt, Homo Sapiens; identical to SEQ ID NO: 89060

SEQ ID NO: 195911 - RNA, 64 nt, Homo Sapiens; identical to SEQ ID NO: 89061

SEQ ID NO: 195912 - RNA, 64 nt, Homo Sapiens; identical to SEQ ID NO: 89062

SEQ ID NO: 195913 - RNA, 64 nt, Homo Sapiens; identical to SEQ ID NO: 89063

SEQ ID NO: 195914 - RNA, 64 nt, Homo Sapiens; identical to SEQ ID NO: 89064

SEQ ID NO: 195915 - RNA, 64 nt, Homo Sapiens; identical to SEQ ID NO: 89065

SEQ ID NO: 195916 - RNA, 64 nt, Homo Sapiens; identical to SEQ ID NO: 89066

SEQ ID NO: 195917 - RNA, 64 nt, Homo Sapiens; identical to SEQ ID NO: 89067

SEQ ID NO: 195918 - RNA, 64 nt, Homo Sapiens; identical to SEQ ID NO: 89068

SEQ ID NO: 195919 - RNA, 64 nt, Homo Sapiens; identical to SEQ ID NO: 89069

SEQ ID NO: 195920 - RNA, 64 nt, Homo Sapiens; identical to SEQ ID NO: 89070

SEQ ID NO: 195921 - RNA, 64 nt, Homo Sapiens
uauguuaaauaugugguugcaauguauuaaccuaacagaugaaagacugacuuuuagcugucau

SEQ ID NO: 195922 - RNA, 64 nt, Homo Sapiens
acauuuuccaaaacuuaguguaauuugcaugaacacagaugacuuuaaaaauauguaaaauuaa

SEQ ID NO: 195923 - RNA, 64 nt, Homo Sapiens
ucuuaccguacuuuggaacuugcuguuuaaaaagacagaugaaauaaguugaagaaaccucaug

SEQ ID NO: 195924 - RNA, 64 nt, Homo Sapiens
ccuuuauauagcagacaugucacccugcuucuacacagaugauggaugaaagcuuggagcaaug

SEQ ID NO: 195925 - RNA, 64 nt, Homo Sapiens
aacaaaugggauacgcaguacaucuuggaucuuuacagaugacaagaacagaugaaaauccugc

SEQ ID NO: 195926 - RNA, 64 nt, Homo Sapiens
auccugccaucuuggaucuucagcagggaccagaacagaugaaaugguguguuugccagagacc

SEQ ID NO: 195927 - RNA, 64 nt, Homo Sapiens
uuuuuucaauuuaugcugcucauccaaaguugccacagaugauacuuccaagugauaauuuuau

SEQ ID NO: 195928 - RNA, 64 nt, Homo Sapiens
uaaaguaagacaucucaggauuucaccagaaguuacagaugaggcacuggaagccaccaaauua

SEQ ID NO: 195929 - RNA, 64 nt, Homo Sapiens
aaauuuaauaaugaaccaauuuauuuuuugaaccacagaugaguauaaaauacuuaaauuugug

SEQ ID NO: 195930 - RNA, 64 nt, Homo Sapiens
auugaauuuuuaauugauuuauaauuugaggauaacagaugacaaauuacauuaguugaucucg

SEQ ID NO: 195931 - RNA, 64 nt, Homo Sapiens
cuuugguguuggucuuuuugacagcauggaggacacagaugacucccucaggucugcugcaaac

SEQ ID NO: 195932 - RNA, 64 nt, Homo Sapiens
acuggcaaggacuagagagcauggccucuuggagacagaugaugcaaucaaaggcugcaacccu

SEQ ID NO: 195933 - RNA, 64 nt, Homo Sapiens
guuuaauugugugacuaucugacuguugauggccacagaugauggucuccuaugguauaguuca

SEQ ID NO: 195934 - RNA, 64 nt, Homo Sapiens
uugaaauuacucuaaguaauccauguguuagaauacagaugaaccuccguuugauuucacagcc

SEQ ID NO: 195935 - RNA, 59 nt, Homo Sapiens
ggacaaccucuacuaggcgauggcucugcucugucuacauuuauuuguacccacacgug

SEQ ID NO: 195936 - RNA, 59 nt, Homo Sapiens
guguguguguguguguuugugugugugugucugucuauuuuguauccuggaccacaagu

SEQ ID NO: 195937 - RNA, 59 nt, Homo Sapiens
cuggccgagucuccgacugugucucugggucugucuacagcucugucuacacuggccga

SEQ ID NO: 195938 - RNA, 59 nt, Homo Sapiens
cuggccgagucucugggucucagccuggcucugucuacagccagcgucgccgggcugcc

SEQ ID NO: 195939 - RNA, 59 nt, Homo Sapiens
uuaagcuuucuuuauaucagauuucagggucugucuaucgaauuucaggagcacaguaa

SEQ ID NO: 195940 - RNA, 59 nt, Homo Sapiens
gguuuaugggcuauuacuuugugcugguuucugucuauaguccuugucuccuugacaua

SEQ ID NO: 195941 - RNA, 59 nt, Homo Sapiens
ucaucuuugcuuccuguuacgggcagaagucugucuaauccaauuagucaacucuuuua

SEQ ID NO: 195942 - RNA, 59 nt, Homo Sapiens
ucuagagcccauguucuuuaaaaugcaagucugucuaaaaaguucuaguauuuggaguc

SEQ ID NO: 195943 - RNA, 59 nt, Homo Sapiens
aacacagaggagaauuuauuuaccgagugucugucuaagacuaggcauagcaccguugc

SEQ ID NO: 195944 - RNA, 59 nt, Homo Sapiens
uugaauuggguaagggucuccaaaagacgucugucuacacaaagcagcggauacaaccu

SEQ ID NO: 195945 - RNA, 59 nt, Homo Sapiens
caguucccuugagaacuuccguuuguaccucugucuaaauggaagucugaauuggagau

SEQ ID NO: 195946 - RNA, 59 nt, Homo Sapiens
uacaaaggucagaaaucuuauucuccagaucugucuagauagcuaguagcaaccguguu

SEQ ID NO: 195947 - RNA, 64 nt, Homo Sapiens
uccaagggcugugcuaagcauugcucugcaacucacccugcaucuggagcagaaggacuuacug

SEQ ID NO: 195948 - RNA, 64 nt, Homo Sapiens
ucaaguauccuaaggacagggaaagauuauugccacccugcacacaucugggaacuuguaagug

SEQ ID NO: 195949 - RNA, 64 nt, Homo Sapiens
gaaccucuggcaagccgcccgacugcaacugcugacccugcagagcuggcugcuggacgcaccg

SEQ ID NO: 195950 - RNA, 64 nt, Homo Sapiens
gcccguggcuugguuucacgcgcagcggcgccagacccugcaggagggcggcgugguggucuug

SEQ ID NO: 195951 - RNA, 64 nt, Homo Sapiens
caaguguaacagcauucuguguggcaugggcccaacccugcauuguaaaauaggcaguagaguu

SEQ ID NO: 195952 - RNA, 64 nt, Homo Sapiens
uaggugguauuauccaaguucaauucucaccacaacccugcaaggcauugcauguuuauauccc

SEQ ID NO: 195953 - RNA, 64 nt, Homo Sapiens
agcagugaccgggcagagccuagaccuuguauauacccugcaccagucaggccugugagggccg

SEQ ID NO: 195954 - RNA, 64 nt, Homo Sapiens
gccagaacugccuuuggcccuuccuaacccagggacccugcacaugaccccagccucuguccac

SEQ ID NO: 195955 - RNA, 64 nt, Homo Sapiens
gaagcagccacuucagcccauuaaacaagguccaacccugcaauggaaaugucaaaucugguuu

SEQ ID NO: 195956 - RNA, 64 nt, Homo Sapiens
uccuggcagcuuuggcccugccagggcugccuccacccugcaaccaccgagguccaaguaugag

SEQ ID NO: 195957 - RNA, 64 nt, Homo Sapiens
gcuugcacaacauccucagaguuuccucagccucacccugcauaacauuccaaacagaguccug

SEQ ID NO: 195958 - RNA, 64 nt, Homo Sapiens
aggccaucagcaccacgugccuggccaccauggcacccugcaccauaccaaagcugcugcacag

SEQ ID NO: 195959 - RNA, 64 nt, Homo Sapiens
uuaaaugguauggucuggaucacauuggagagaaacccugcaauuuaauguguguaugugaacu

SEQ ID NO: 195960 - RNA, 64 nt, Homo Sapiens
agggaauguggaaaugacuuucacaguggagaagacccugcauccuuaaugaacacauaugaau

SEQ ID NO: 195961 - RNA, 64 nt, Homo Sapiens
uauuuugcccauagugccauuuagagaugaaaaccagcuuuaacuuugcaaagugaacauguac

SEQ ID NO: 195962 - RNA, 64 nt, Homo Sapiens
gcacccaaauccuugucgccaaucuccugaaguacagcuuuaccauauuaguggucauuauuua

SEQ ID NO: 195963 - RNA, 64 nt, Homo Sapiens
ugucagaauaacuuacagaaaaauagaaaaugcacagcuuuaaaaugggcagaguuaaaaucua

SEQ ID NO: 195964 - RNA, 64 nt, Homo Sapiens
cagcuuuaaaaugggcagaguuaaaaucuauucccagcuuuaucacuuauuuagccaugcuagc

SEQ ID NO: 195965 - RNA, 64 nt, Homo Sapiens
agaaauggucuggguauaagcuauuucauaaaagcagcuuuaaauugucaguauuaagguuuuc

SEQ ID NO: 195966 - RNA, 64 nt, Homo Sapiens
aaguuuaugaaaacauucauuugaaaguuccaugcagcuuuagcacagaguugaccaaacacug

SEQ ID NO: 195967 - RNA, 64 nt, Homo Sapiens
uauagagagugaauuaugggauagccaagaauuacagcuuuauuacaccaaggucugcugucuu

SEQ ID NO: 195968 - RNA, 64 nt, Homo Sapiens
ucucaagagucguauguaacuagcgugcuacagucagcuuuagcagugagcagcgcaccagaug

SEQ ID NO: 195969 - RNA, 64 nt, Homo Sapiens
ggaaaaggaaagcguuuuuguagcccaccaucuacagcuuuacuguaaaaccuugucuuauucg

SEQ ID NO: 195970 - RNA, 64 nt, Homo Sapiens
aaaagaguauuuauacaucccaccaaucaaaacacagcuuuauuaccucaugcgaacucauaca

SEQ ID NO: 195971 - RNA, 64 nt, Homo Sapiens
ggaacuucuaaacacuucauucuuuauauauggacagcuuuauuuuaaaugugguuuuugaugc

SEQ ID NO: 195972 - RNA, 64 nt, Homo Sapiens
gccauuuacuuugcaagugagauagcuuccccaccagcuuuauuuuuuaacaugaaagcugaug

SEQ ID NO: 195973 - RNA, 64 nt, Homo Sapiens
cccugugggcaccuggugccugcccccugccgggcagcuuuaaggacagacccccaggggcagu

SEQ ID NO: 195974 - RNA, 64 nt, Homo Sapiens
uggggccuuugaggcagggucgcagggacaagcucagcuuuaggcaccaucuguucccaucgcg

SEQ ID NO: 195975 - RNA, 64 nt, Homo Sapiens
cacagaugaccacaucuaauccugcuucuacucucagcuuuaggacaaaagcucugucagaggc

SEQ ID NO: 195976 - RNA, 64 nt, Homo Sapiens
ccuuacgaauaaaaaacuggauucugguuuacagcagcuuuacagugauaguuaaauuaacugg

SEQ ID NO: 195977 - RNA, 64 nt, Homo Sapiens
cagcaguggcuucuaggaaacugggaguuuagaucagcuuuacagauacaucgaucagaggcua

SEQ ID NO: 195978 - RNA, 64 nt, Homo Sapiens
guugccgauuagugauauggauuuggcaacaugucagcuuuauagcagugggaacugugauugg

SEQ ID NO: 195979 - RNA, 64 nt, Homo Sapiens
caaauucauauucugucuggcuucauaaaugaagcagcuuuaaacugguaacaguucauguuug

SEQ ID NO: 195980 - RNA, 64 nt, Homo Sapiens
gucccuuaacagugccgcaucucagccuggaagucagcuuuaagucauucaagagaaccucagg

SEQ ID NO: 195981 - RNA, 64 nt, Homo Sapiens
aacccuacagauuagcccaguucucucuuauuuucagcuuuacagacaagaacaauuuaaaucu

SEQ ID NO: 195982 - RNA, 64 nt, Homo Sapiens
auuagauguaauugagcuuuguguaauauuaugucagcuuuaacauauaauauuuugaauauuu

SEQ ID NO: 195983 - RNA, 64 nt, Homo Sapiens
auguaaucagucauuacacuagggagaaauuuaucagcuuuaguucuaaauaugcucaugaggu

SEQ ID NO: 195984 - RNA, 64 nt, Homo Sapiens
cuuguuucucuuccuuucuuuuuuuaaaaaauagcagcuuuagccaagugcagggccuguaauc

SEQ ID NO: 195985 - RNA, 64 nt, Homo Sapiens
aaaaaaaaaaccauauauauacauauauauauagcagcuuuauggagauauaauucuuaugcca

SEQ ID NO: 195986 - RNA, 64 nt, Homo Sapiens
cccaugugcaagaaaaugagagaaucugacaggacagcuuuaagacaccugcggaaggagcugg

SEQ ID NO: 195987 - RNA, 64 nt, Homo Sapiens
cccaaguggaagaaaaugagagaaucuggcaggacagcuuuaagacaccugcggaaggagcugg

SEQ ID NO: 195988 - RNA, 64 nt, Homo Sapiens; identical to SEQ ID NO: 156555

SEQ ID NO: 195989 - RNA, 64 nt, Homo Sapiens; identical to SEQ ID NO: 156556

SEQ ID NO: 195990 - RNA, 64 nt, Homo Sapiens; identical to SEQ ID NO: 156557

SEQ ID NO: 195991 - RNA, 64 nt, Homo Sapiens; identical to SEQ ID NO: 156558

SEQ ID NO: 195992 - RNA, 64 nt, Homo Sapiens; identical to SEQ ID NO: 156559

SEQ ID NO: 195993 - RNA, 64 nt, Homo Sapiens; identical to SEQ ID NO: 156560

SEQ ID NO: 195994 - RNA, 64 nt, Homo Sapiens; identical to SEQ ID NO: 156561

SEQ ID NO: 195995 - RNA, 64 nt, Homo Sapiens; identical to SEQ ID NO: 156562

SEQ ID NO: 195996 - RNA, 64 nt, Homo Sapiens; identical to SEQ ID NO: 156563

SEQ ID NO: 195997 - RNA, 64 nt, Homo Sapiens; identical to SEQ ID NO: 156564

SEQ ID NO: 195998 - RNA, 64 nt, Homo Sapiens; identical to SEQ ID NO: 156565

SEQ ID NO: 195999 - RNA, 64 nt, Homo Sapiens; identical to SEQ ID NO: 156566

SEQ ID NO: 196000 - RNA, 64 nt, Homo Sapiens
cccgcuuaggggcuuagaaggagaagccagugagcaggcucacacuaaguuguaaacauaggag

SEQ ID NO: 196001 - RNA, 64 nt, Homo Sapiens
agugaguuccaccugaccagucuugagcagccaacaggcucaauuaagcccgccugguuuuucc

SEQ ID NO: 196002 - RNA, 64 nt, Homo Sapiens
agcgugcugauggaaguggaaacccaccaugccccaggcucagcaagaaggggaagaagaucaa

SEQ ID NO: 196003 - RNA, 64 nt, Homo Sapiens
agggagcugcuggagguaguggcccaccgugccccaggcucagcaagaagaggaagaagaccaa

SEQ ID NO: 196004 - RNA, 64 nt, Homo Sapiens
agggagcugcuggcugagaagacccaucaugccccaggcucagcaagaaguggaagaagaccaa

SEQ ID NO: 196005 - RNA, 64 nt, Homo Sapiens
auuucccaucuggaccugguacaaaugcacgucacaggcucagcuccuccccacuagcauuuuc

SEQ ID NO: 196006 - RNA, 64 nt, Homo Sapiens
cuacugcacagagucaggaucucacauuucaccccaggcucaacugaggauguggcuuauuaaa

SEQ ID NO: 196007 - RNA, 64 nt, Homo Sapiens
guucccauaggaaggagucugccucuucuguccccaggcucacucagccuggcggccauggggc

SEQ ID NO: 196008 - RNA, 64 nt, Homo Sapiens
caggccugggugguguaccuccuggacuucuccccaggcucacucagugcgcacuuaggggugg

SEQ ID NO: 196009 - RNA, 64 nt, Homo Sapiens
uuuggguguuuucuggggauguuaacaugggauucaggcucaacucacaagaaacuuuuccauc

SEQ ID NO: 196010 - RNA, 64 nt, Homo Sapiens
caccuacauguagaaugugaugucagaacucaaacaggcucaccaggcagugugcuuccuuccu

SEQ ID NO: 196011 - RNA, 64 nt, Homo Sapiens
ugaauccucagcaguggccguuuuuccucuuguccaggcucacgaguuaguccagggauuccau

SEQ ID NO: 196012 - RNA, 64 nt, Homo Sapiens
ugguaaaugacuguuugccucauuuaauaguauacaggcucagcccauagacuacaguucuuca

SEQ ID NO: 196013 - RNA, 64 nt, Homo Sapiens
agccugugccugacccuucugaccucgaucaugacaggcucaucccaaugccacaggguuccgg

SEQ ID NO: 196014 - RNA, 64 nt, Homo Sapiens
guuucaugacuuguugaaaguauuggugagaaaacaggcucagguagggacacugguccccauu

SEQ ID NO: 196015 - RNA, 64 nt, Homo Sapiens
ugauccucacaccuuagccuugacuucccaggcucaggcucaggaucucggcucacugcagccu

SEQ ID NO: 196016 - RNA, 64 nt, Homo Sapiens
cucaggugauccucacaccucagccuugacuucccaggcucaggacaaaaaucucggcucacug

SEQ ID NO: 196017 - RNA, 64 nt, Homo Sapiens
uagagaucaugaacccauuuaacagacgaggagacaggcucagagaggcaccgucccuugccua

SEQ ID NO: 196018 - RNA, 64 nt, Homo Sapiens
uacagaugaggacauugaggagaagagacuuacccaggcucacacagcagcucagccuguucca

SEQ ID NO: 196019 - RNA, 64 nt, Homo Sapiens
caggggccuccaugggccccagcucccaggaccacaggcucaggagcaucucuaccuucucccc

SEQ ID NO: 196020 - RNA, 64 nt, Homo Sapiens
caaugacaaagcagauucagucucaugccaguaacaggcucaaauacccccucccccaccguug

SEQ ID NO: 196021 - RNA, 64 nt, Homo Sapiens
gcgccugaagacgcagccgaggugggagcacgggcaggcucaggcgggaagaaggaggcaucgu

SEQ ID NO: 196022 - RNA, 64 nt, Homo Sapiens
gaggcagagccgggaggcugcgugggcuucugggcaggcucacgcagacgccggccacaccauc

SEQ ID NO: 196023 - RNA, 64 nt, Homo Sapiens
ugcgucccaagcagccgcagcagagaugcaugcgcaggcucauagccagugagggcugggccca

SEQ ID NO: 196024 - RNA, 64 nt, Homo Sapiens
cucugggucccucggagcugcgggugccucagagcaggcucagagcuggcccagccaacugccc

SEQ ID NO: 196025 - RNA, 64 nt, Homo Sapiens
gaugacuggcuuugagaaggaagggaagauggaacaggcucagaucucaugggauagcacgugg

SEQ ID NO: 196026 - RNA, 64 nt, Homo Sapiens
cgcucauacaggaaugaagccuuagccaggaggccaggcucagcccugugccacucaccgaagc

SEQ ID NO: 196027 - RNA, 64 nt, Homo Sapiens
caggccuggcccagagucaccucccaaaggagcccaggcucagguugccgcaucuacuucuaga

SEQ ID NO: 196028 - RNA, 64 nt, Homo Sapiens
agacgaugcggggcugugugcgcgaugcagcaggcaggcucagagggccagggauugacccaag

SEQ ID NO: 196029 - RNA, 64 nt, Homo Sapiens
ugugguucaccuguagacagagccugcuggucagcaggcucaucgcaugagagcacaguagccc

SEQ ID NO: 196030 - RNA, 64 nt, Homo Sapiens
aaagaaaaaaaaaagaacacuccagccugggcgacaggcucaaagcagugagcugagauugcac

SEQ ID NO: 196031 - RNA, 64 nt, Homo Sapiens
caggcucugcucaggcugggcugguuuccucucccaggcucaccaccccccuugcggcucagcu

SEQ ID NO: 196032 - RNA, 64 nt, Homo Sapiens
uucagccuccaucacuuaccuggagcauauagaucuggcucaaauuuccccaggagagugauga

SEQ ID NO: 196033 - RNA, 64 nt, Homo Sapiens
ccuugccagaucccucucucacaguggauggagacuggcucauaaugggccuccuggaaucccu

SEQ ID NO: 196034 - RNA, 64 nt, Homo Sapiens
aucucuagucccagugccuggcagcucuuuggagcuggcucacauuuucccaaaaaaaguugau

SEQ ID NO: 196035 - RNA, 64 nt, Homo Sapiens
agcccuguggccacaguucugggagccuucaacccuggcucaugcugccauagucuccacggug

SEQ ID NO: 196036 - RNA, 64 nt, Homo Sapiens
gcccaguguuuugccacucaguggggacugucugcuggcucagggggucacggcccacagcuag

SEQ ID NO: 196037 - RNA, 64 nt, Homo Sapiens
gccuuaucaggaccucugagcaucucccuggggucuggcucacugcccccgcagcacucacaga

SEQ ID NO: 196038 - RNA, 64 nt, Homo Sapiens
cuuguaacugccugcuagcccuuagccugggcaccuggcucaaugucucccugucucuagaagc

SEQ ID NO: 196039 - RNA, 64 nt, Homo Sapiens
cugaggauggcccaaaguccggaggggcuguuugcuggcucagguuuuuuuuuuugucuccagg

SEQ ID NO: 196040 - RNA, 64 nt, Homo Sapiens
ggcugaguuaagugaaaggaugcagcuuccuucucuggcucaaggcaaaauccaauagaaguau

SEQ ID NO: 196041 - RNA, 64 nt, Homo Sapiens
gauucauauguggcuuugggagcaccuccucagccuggcucaguucaagaaggagaauccauuu

SEQ ID NO: 196042 - RNA, 64 nt, Homo Sapiens
agaacugucuacuugaucuggagggcauugacaccuggcucagcuggaacaguggggacaggag

SEQ ID NO: 196043 - RNA, 64 nt, Homo Sapiens
gguugaacugagcucuugucauuuuccaugcucucuggcucauugugucauuucaaaauguauu

SEQ ID NO: 196044 - RNA, 64 nt, Homo Sapiens
ugugggugggaggggcccaccugcagucuucucucuggcucaggguuggcuuuggaugucuuug

SEQ ID NO: 196045 - RNA, 64 nt, Homo Sapiens
gcagccuccgccucccggguugaagugguacaaucuggcucacucucuguugcccaagcuggag

SEQ ID NO: 196046 - RNA, 64 nt, Homo Sapiens
uucucaguuuuguuuguuuguuuguuuccuuaaucuggcucauuugaaauuucuucucccucuc

SEQ ID NO: 196047 - RNA, 64 nt, Homo Sapiens
ccagcuaacaagagcucccuggggcuggucacagcuggcucaugaugcugaacuugaaaguuuu

SEQ ID NO: 196048 - RNA, 64 nt, Homo Sapiens
ccaagccucuagcauagagcacugcagacaggcccuggcucagaaucagagcccagaaaguggc

SEQ ID NO: 196049 - RNA, 64 nt, Homo Sapiens
gcuggucucaaacuccugggcucaagcgauccuccuggcucagccucccaaagugcugggauua

SEQ ID NO: 196050 - RNA, 64 nt, Homo Sapiens
caagaggagacaccucagucagcagaaaggccaccuggcucacuggcucauuccaggaguggga

SEQ ID NO: 196051 - RNA, 64 nt, Homo Sapiens
gacaccucagucagcagaaaggccaccuggcucacuggcucauuccaggagugggagagacggc

SEQ ID NO: 196052 - RNA, 64 nt, Homo Sapiens
uccgucuguucaucaccuuccccaggaggugucucuggcucacccccgccuccuggccgacuug

SEQ ID NO: 196053 - RNA, 64 nt, Homo Sapiens
guucaguccagcagccuggcgugauucuggccuucuggcucaugcgggcuggagcugucuugca

SEQ ID NO: 196054 - RNA, 64 nt, Homo Sapiens
caugacuccuggccuugggaugcccaagggauuucuggcucaggcuguaaaaguagcugagcca

SEQ ID NO: 196055 - RNA, 64 nt, Homo Sapiens
guguggcaucugggagccacagugacccagccaccuggcucaggcuaguuccaaauuccaaaag

SEQ ID NO: 196056 - RNA, 64 nt, Homo Sapiens; identical to SEQ ID NO: 51593

SEQ ID NO: 196057 - RNA, 64 nt, Homo Sapiens; identical to SEQ ID NO: 51594

SEQ ID NO: 196058 - RNA, 64 nt, Homo Sapiens
cucaacauggucaucauguuuucuauaugguuuuuccagcuagcaguacucccuuccauaccug

SEQ ID NO: 196059 - RNA, 64 nt, Homo Sapiens
aucuucacucccaucaucaucuauuuucacacuauccagcuaagcaaagauuccuggaggcuga

SEQ ID NO: 196060 - RNA, 64 nt, Homo Sapiens
gguaguagggagugggagggcuuauauugguuuuuccagcuauuaaggggacauauugugucgu

SEQ ID NO: 196061 - RNA, 64 nt, Homo Sapiens
acaaaaauuaggcaugguggugcaugccuguaguuccagcuacuugggaggcugagacaggcga

SEQ ID NO: 196062 - RNA, 64 nt, Homo Sapiens
aauuuucugugccauuuuaaauuuaacuuugacauccagcuauagacagaaauaauaagccacc

SEQ ID NO: 196063 - RNA, 64 nt, Homo Sapiens
ccggggccuggggccuccuugccuggcuucuuccuccagcuauccucagggaagcuggagauuc

SEQ ID NO: 196064 - RNA, 64 nt, Homo Sapiens
uguccuggacuaagccaaugacaccuuccaucuuuccagcuauggugacuggguuagguaugau

SEQ ID NO: 196065 - RNA, 64 nt, Homo Sapiens
cagccauggucacgagucauuucugccugacugcuccagcuaacuuccagggucucagcaaacu

SEQ ID NO: 196066 - RNA, 64 nt, Homo Sapiens
aaauuagccaggcaugguggugggugccuguaguuccagcuacuugggaggcugaggugggaaa

SEQ ID NO: 196067 - RNA, 64 nt, Homo Sapiens
ggcuaccugaaccaaggcgucucuuuaaguggggcgcccgaagucauuuuggacggccaccuga

SEQ ID NO: 196068 - RNA, 55 nt, Homo Sapiens
aacuaccccaugaggccugaggagccgcccgaaggucgcggugaccuggugccuu

SEQ ID NO: 196069 - RNA, 64 nt, Homo Sapiens
agccugcuuugguacuaugggccgagacucuggccgcccgaagggcaccaaacagcccaggacu

SEQ ID NO: 196070 - RNA, 64 nt, Homo Sapiens
cagcaccugggagccgagauuacguggugucgcgcgcccgaauuaccugcugccacuucucauc

SEQ ID NO: 196071 - RNA, 64 nt, Homo Sapiens
gacugcugacaguaaaccaauauuggcaaaaugccgcccgaacauuucccuuaggauagggcua

SEQ ID NO: 196072 - RNA, 54 nt, Homo Sapiens
ccgaggaggggggcagcuagcgagcgcccgaacuggccaggacccccgcgcccg

SEQ ID NO: 196073 - RNA, 55 nt, Homo Sapiens
gcucccagaccguuaccuagcccagcgcccgaaagccgucucuucuaugcaauaa

SEQ ID NO: 196074 - RNA, 64 nt, Homo Sapiens
aaaauggccuucuccaaaaucuauguaauuaaaacgcccgaagugcauugcuuucuggccucag

SEQ ID NO: 196075 - RNA, 64 nt, Homo Sapiens
accaagugaggccauagcaaaauuaagaaaaagucgcccgaaacgccccucacccccagcugga

SEQ ID NO: 196076 - RNA, 64 nt, Homo Sapiens
ccuggcugcuguuguaaucuacuuguucugcugacgcccgaacugacuucuuucccggucucuc

SEQ ID NO: 196077 - RNA, 64 nt, Homo Sapiens
gccucccaagccagcgcggcaccgaggcgucggccgcccgaagacugacgggagucgcggcccc

SEQ ID NO: 196078 - RNA, 64 nt, Homo Sapiens
ugaagaaaaaugaccugaccggaauuccuuuucccgcccgaacauugccuuagaaaaggagaaa

SEQ ID NO: 196079 - RNA, 64 nt, Homo Sapiens
auaaaauucaacgugaggaagcaagugacaaggacgcccgaagcacaguggacggucaugaagg

SEQ ID NO: 196080 - RNA, 64 nt, Homo Sapiens
cugugugacccucagucuuggccagccaugcaugcgcccgaagcucgugcaguuuguacgugag

SEQ ID NO: 196081 - RNA, 64 nt, Homo Sapiens
guuccuuccucugaaucgaauggaugugggugaccgcccgaaggccuucacaggauggaaguag

SEQ ID NO: 196082 - RNA, 64 nt, Homo Sapiens
uuggagagacugucauggaagaggguggagccgccgcccgaagcgccgaggaggcugagccacu

SEQ ID NO: 196083 - RNA, 64 nt, Homo Sapiens
gcccauccucgugguaggcacaggccggcgggcgcgcccgaagcucucaucuccauucggcccc

SEQ ID NO: 196084 - RNA, 64 nt, Homo Sapiens
acccucugcuacccacuagccccugagcaaacaacgcccgaaauccauuuuacccauuuccugu

SEQ ID NO: 196085 - RNA, 64 nt, Homo Sapiens
agcccggaucugagggcccuagagccgccgccgccgcccgaaccacguugcacacgcagucugc

SEQ ID NO: 196086 - RNA, 64 nt, Homo Sapiens; identical to SEQ ID NO: 196058

SEQ ID NO: 196087 - RNA, 64 nt, Homo Sapiens; identical to SEQ ID NO: 196059

SEQ ID NO: 196088 - RNA, 64 nt, Homo Sapiens; identical to SEQ ID NO: 196060

SEQ ID NO: 196089 - RNA, 64 nt, Homo Sapiens; identical to SEQ ID NO: 196061

SEQ ID NO: 196090 - RNA, 64 nt, Homo Sapiens; identical to SEQ ID NO: 196062

SEQ ID NO: 196091 - RNA, 64 nt, Homo Sapiens; identical to SEQ ID NO: 196063

SEQ ID NO: 196092 - RNA, 64 nt, Homo Sapiens; identical to SEQ ID NO: 196064

SEQ ID NO: 196093 - RNA, 64 nt, Homo Sapiens; identical to SEQ ID NO: 196065

SEQ ID NO: 196094 - RNA, 64 nt, Homo Sapiens; identical to SEQ ID NO: 196066

SEQ ID NO: 196095 - RNA, 64 nt, Homo Sapiens; identical to SEQ ID NO: 196067

SEQ ID NO: 196096 - RNA, 55 nt, Homo Sapiens; identical to SEQ ID NO: 196068

SEQ ID NO: 196097 - RNA, 64 nt, Homo Sapiens; identical to SEQ ID NO: 196069

SEQ ID NO: 196098 - RNA, 64 nt, Homo Sapiens; identical to SEQ ID NO: 196070

SEQ ID NO: 196099 - RNA, 64 nt, Homo Sapiens; identical to SEQ ID NO: 196071

SEQ ID NO: 196100 - RNA, 54 nt, Homo Sapiens; identical to SEQ ID NO: 196072

SEQ ID NO: 196101 - RNA, 55 nt, Homo Sapiens; identical to SEQ ID NO: 196073

SEQ ID NO: 196102 - RNA, 64 nt, Homo Sapiens; identical to SEQ ID NO: 196074

SEQ ID NO: 196103 - RNA, 64 nt, Homo Sapiens; identical to SEQ ID NO: 196075

SEQ ID NO: 196104 - RNA, 64 nt, Homo Sapiens; identical to SEQ ID NO: 196076

SEQ ID NO: 196105 - RNA, 64 nt, Homo Sapiens; identical to SEQ ID NO: 196077

SEQ ID NO: 196106 - RNA, 64 nt, Homo Sapiens; identical to SEQ ID NO: 196078

SEQ ID NO: 196107 - RNA, 64 nt, Homo Sapiens; identical to SEQ ID NO: 196079

SEQ ID NO: 196108 - RNA, 64 nt, Homo Sapiens; identical to SEQ ID NO: 196080

SEQ ID NO: 196109 - RNA, 64 nt, Homo Sapiens; identical to SEQ ID NO: 196081

SEQ ID NO: 196110 - RNA, 64 nt, Homo Sapiens; identical to SEQ ID NO: 196082

SEQ ID NO: 196111 - RNA, 64 nt, Homo Sapiens; identical to SEQ ID NO: 196083

SEQ ID NO: 196112 - RNA, 64 nt, Homo Sapiens; identical to SEQ ID NO: 196084

SEQ ID NO: 196113 - RNA, 64 nt, Homo Sapiens; identical to SEQ ID NO: 196085

SEQ ID NO: 196114 - RNA, 64 nt, Homo Sapiens; identical to SEQ ID NO: 71314

SEQ ID NO: 196115 - RNA, 64 nt, Homo Sapiens; identical to SEQ ID NO: 71315

SEQ ID NO: 196116 - RNA, 64 nt, Homo Sapiens; identical to SEQ ID NO: 71316

SEQ ID NO: 196117 - RNA, 64 nt, Homo Sapiens; identical to SEQ ID NO: 71317

SEQ ID NO: 196118 - RNA, 64 nt, Homo Sapiens
ugaguguaugaauuugucaccugauuugaucuuuacaaauuauaugacagauaucccaacuacg

SEQ ID NO: 196119 - RNA, 64 nt, Homo Sapiens
caugccccaaguguuaaaacguacaauaccaccuacaaauuaucagaggucuccugauggaagu

SEQ ID NO: 196120 - RNA, 64 nt, Homo Sapiens
aaagauuuaaaauaauuccugguuugaagaaauaacaaauuaaaagcuauauauaaacgguuaa

SEQ ID NO: 196121 - RNA, 64 nt, Homo Sapiens
uggugaaacauacgacagaccacuguaagugagaacaaauuacuggcccagcccaacccacacc

SEQ ID NO: 196122 - RNA, 64 nt, Homo Sapiens
auaaugcaucucuaucuucacaaauuaaggguguacaaauuauaaauauauuuucaauugugua

SEQ ID NO: 196123 - RNA, 64 nt, Homo Sapiens
gguguacaaauuauaauaauauuuucaauuguguacaaauuaagguaaaauuucacauaaauau

SEQ ID NO: 196124 - RNA, 64 nt, Homo Sapiens
uucaaaaaagcucucuugaaucuagguagcaugaacaaauuauaaaauuuguuuaaaaaagcaa

SEQ ID NO: 196125 - RNA, 64 nt, Homo Sapiens
auugaagagccuuuucauguauuaaauaaugaacacaaauuauauaauuaaaauaauuggagau

SEQ ID NO: 196126 - RNA, 64 nt, Homo Sapiens
acaguaccugauacuccuaaaacuuuuaacuuauacaaauuagucaauaaugaccccaauuuuu

SEQ ID NO: 196127 - RNA, 64 nt, Homo Sapiens
uuugguggugguuuuguuucuaugcaaacuggacacaaauuacaacaguaaauuuuuuuauaag

SEQ ID NO: 196128 - RNA, 64 nt, Homo Sapiens
cuauuugaaaauguucauauuaccaauaauguggacaaauuacuuugcagguuuaaauaugccu

SEQ ID NO: 196129 - RNA, 64 nt, Homo Sapiens
agucaaaagguauucugaauauaauaaaagccucacaaauuauuuguaaaauuuaguaguucau

SEQ ID NO: 196130 - RNA, 64 nt, Homo Sapiens
aauuguaugaagcaaugugauuauaugaagagacacaaauuaaaaagacaaauuaaaccugaaa

SEQ ID NO: 196131 - RNA, 64 nt, Homo Sapiens
aaugugauuauaugaagagacacaaauuaaaaagacaaauuaaaccugaaauuauauuuaaaau

SEQ ID NO: 196132 - RNA, 64 nt, Homo Sapiens
uaggcaugguggacucgccuucuacuaaaaauacacaaauuagcuacaugguugaaaccccauc

SEQ ID NO: 196133 - RNA, 64 nt, Homo Sapiens
aaugaaaauaagaauuauuucaauaauuuccuccacaaauuauuauaagagaaucaacauuucu

SEQ ID NO: 196134 - RNA, 64 nt, Homo Sapiens
cuugagaauguuuguuguaaaugguuucaaaaauacaaauuauagccaaucaaaacauugcuuu

SEQ ID NO: 196135 - RNA, 64 nt, Homo Sapiens
auaauuauauggucauucugaccccagcucuuauacaaauuauacauguauuuuuguguauguu

SEQ ID NO: 196136 - RNA, 64 nt, Homo Sapiens
ccagguggaccaagaauucaaaaacaaauuaaaaacaaauuauuuuagugggacuauuacacac

SEQ ID NO: 196137 - RNA, 64 nt, Homo Sapiens
aacaaauuauuccagguggacuauuacacacaaaacaaauuaaacuaacaacuacuuaguggga

SEQ ID NO: 196138 - RNA, 64 nt, Homo Sapiens
ugcugguucuuuggauaauggaguucuuguguuaacaaauuacgugcuauaugauuuuuuguua

SEQ ID NO: 196139 - RNA, 64 nt, Homo Sapiens
ggaugaaaacuucagggcuucuuuucuguauauaacaaauuaagucuguacauauuuuuguacc

SEQ ID NO: 196140 - RNA, 64 nt, Homo Sapiens
aguagaaaaaaaguauaguuaaaacauuuguucuacaaauuaaccuuuaaaaauauaauuacug

SEQ ID NO: 196141 - RNA, 64 nt, Homo Sapiens
gccauaaauacagcugaacugaauauaaauguucacaaauuaaugcugucaaaggaaugaguaa

SEQ ID NO: 196142 - RNA, 64 nt, Homo Sapiens
uuuagaagcagcacugcauccaugccugccccccacaaauuauggcacuucugaacuuggguuu

SEQ ID NO: 196143 - RNA, 64 nt, Homo Sapiens
auuuuugaugccaaaauuaguaugauucugaucuacaaauuaacgaauauggaguuaguagauu

SEQ ID NO: 196144 - RNA, 64 nt, Homo Sapiens
ucugaauccuugguucucuuuauacucaccagguacaaauuacugguauguuuuauaagccgca

SEQ ID NO: 196145 - RNA, 64 nt, Homo Sapiens
cugaaaacguaagaaguuuuaaacagcuuuucacacaaauuagaugcaacuguucccaugucug

SEQ ID NO: 196146 - RNA, 64 nt, Homo Sapiens
uuucacuguacaagcaacuuagauuuuuauuuguacaaauuacuucuuuguuuuucuuaaugau

SEQ ID NO: 196147 - RNA, 64 nt, Homo Sapiens
aguaaaucugucuaaauuuauauuuuaaauuauuacaaauuacacaucuuugaggaaagaguau

SEQ ID NO: 196148 - RNA, 64 nt, Homo Sapiens
ccuauuuuccucuuaauaauacguuugggugaagacaaauuaguguuuaguaauugcaucaucu

SEQ ID NO: 196149 - RNA, 64 nt, Homo Sapiens
uggauuuacuuuuacagaauauugaaaagauaagacaaauuauaaauaaguucuaaaacauaaa

SEQ ID NO: 196150 - RNA, 64 nt, Homo Sapiens
acuuggaaggauauauuaugccuaacccugcccaacaaauuaagguuugugccuaaaauguuag

SEQ ID NO: 196151 - RNA, 64 nt, Homo Sapiens
guuucccaguggcauucacuagugagaguuuuagacaaauuauguuacgaguaaaguuuggcug

SEQ ID NO: 196152 - RNA, 64 nt, Homo Sapiens
acacacacacacacacacacacaaauauuauuagacaaauuagaugacaaaaaucauuaagaag

SEQ ID NO: 196153 - RNA, 64 nt, Homo Sapiens
cucacaguugaccaugauucugacuucuaacauuacaaauuaguuuuuacuauuauaaaccuuu

SEQ ID NO: 196154 - RNA, 64 nt, Homo Sapiens
agugagcaaggauacgaaaacaguguguuugaaaacaaauuagguuuggguucaauuccuucaa

SEQ ID NO: 196155 - RNA, 64 nt, Homo Sapiens
gauugacauaaacucuuugugccuugaaaaugaaacaaauuauaaaaauguuuaaauggaacca

SEQ ID NO: 196156 - RNA, 64 nt, Homo Sapiens
cucaauuaucaucauacuuacuuaccuuauauuaacaaauuaagaugaugcugccaaaacaagu

SEQ ID NO: 196157 - RNA, 64 nt, Homo Sapiens
cuaauugcauccaucaucuccuuuggcugcuguaacaaauuaccaccaauaauaugauggcuua

SEQ ID NO: 196158 - RNA, 64 nt, Homo Sapiens
gaugauggggcagggguuucagaagaucuguaaaacaaauuaaggugcgaacaaguuaauuuga

SEQ ID NO: 196159 - RNA, 64 nt, Homo Sapiens
aaauagccaugcagacaagucucucaucugaagaacaaauuagauuuagcuaauuagaauuaau

SEQ ID NO: 196160 - RNA, 64 nt, Homo Sapiens
acuuuacuaucauaugaauguguuauguuauaugacaaauuaaugcagcaguuuuacuuaccuu

SEQ ID NO: 196161 - RNA, 64 nt, Homo Sapiens
auaugguaucacaaugccuauuaagaggcuuuuuacaaauuacuuacuuaguaauaucuguuaa

SEQ ID NO: 196162 - RNA, 64 nt, Homo Sapiens
gucgugccuggggaggagcacggugauggagccccggggggacaagcagacgcuccgccccacc

SEQ ID NO: 196163 - RNA, 64 nt, Homo Sapiens
cuguggcccacagagcugccagaugcagugggugcggggggaucggcaggcacccugggcagag

SEQ ID NO: 196164 - RNA, 64 nt, Homo Sapiens; identical to SEQ ID NO: 83612

SEQ ID NO: 196165 - RNA, 64 nt, Homo Sapiens; identical to SEQ ID NO: 83613

SEQ ID NO: 196166 - RNA, 64 nt, Homo Sapiens; identical to SEQ ID NO: 83614

SEQ ID NO: 196167 - RNA, 64 nt, Homo Sapiens; identical to SEQ ID NO: 83615

SEQ ID NO: 196168 - RNA, 64 nt, Homo Sapiens; identical to SEQ ID NO: 83616

SEQ ID NO: 196169 - RNA, 64 nt, Homo Sapiens; identical to SEQ ID NO: 83617

SEQ ID NO: 196170 - RNA, 64 nt, Homo Sapiens; identical to SEQ ID NO: 83618

SEQ ID NO: 196171 - RNA, 64 nt, Homo Sapiens; identical to SEQ ID NO: 83619

SEQ ID NO: 196172 - RNA, 64 nt, Homo Sapiens; identical to SEQ ID NO: 83620

SEQ ID NO: 196173 - RNA, 64 nt, Homo Sapiens; identical to SEQ ID NO: 83621

SEQ ID NO: 196174 - RNA, 64 nt, Homo Sapiens; identical to SEQ ID NO: 83622

SEQ ID NO: 196175 - RNA, 64 nt, Homo Sapiens; identical to SEQ ID NO: 83623

SEQ ID NO: 196176 - RNA, 64 nt, Homo Sapiens; identical to SEQ ID NO: 83624

SEQ ID NO: 196177 - RNA, 64 nt, Homo Sapiens; identical to SEQ ID NO: 83625

SEQ ID NO: 196178 - RNA, 64 nt, Homo Sapiens; identical to SEQ ID NO: 83626

SEQ ID NO: 196179 - RNA, 64 nt, Homo Sapiens; identical to SEQ ID NO: 83627

SEQ ID NO: 196180 - RNA, 64 nt, Homo Sapiens; identical to SEQ ID NO: 83628

SEQ ID NO: 196181 - RNA, 64 nt, Homo Sapiens; identical to SEQ ID NO: 83629

SEQ ID NO: 196182 - RNA, 64 nt, Homo Sapiens; identical to SEQ ID NO: 83630

SEQ ID NO: 196183 - RNA, 64 nt, Homo Sapiens; identical to SEQ ID NO: 83631

SEQ ID NO: 196184 - RNA, 64 nt, Homo Sapiens; identical to SEQ ID NO: 83632

SEQ ID NO: 196185 - RNA, 60 nt, Homo Sapiens; identical to SEQ ID NO: 83633

SEQ ID NO: 196186 - RNA, 64 nt, Homo Sapiens; identical to SEQ ID NO: 83634

SEQ ID NO: 196187 - RNA, 64 nt, Homo Sapiens; identical to SEQ ID NO: 83635

SEQ ID NO: 196188 - RNA, 64 nt, Homo Sapiens; identical to SEQ ID NO: 83636

SEQ ID NO: 196189 - RNA, 64 nt, Homo Sapiens; identical to SEQ ID NO: 83637

SEQ ID NO: 196190 - RNA, 64 nt, Homo Sapiens; identical to SEQ ID NO: 83638

SEQ ID NO: 196191 - RNA, 64 nt, Homo Sapiens; identical to SEQ ID NO: 83639

SEQ ID NO: 196192 - RNA, 64 nt, Homo Sapiens; identical to SEQ ID NO: 83640

SEQ ID NO: 196193 - RNA, 64 nt, Homo Sapiens; identical to SEQ ID NO: 83641

SEQ ID NO: 196194 - RNA, 64 nt, Homo Sapiens; identical to SEQ ID NO: 83642

SEQ ID NO: 196195 - RNA, 64 nt, Homo Sapiens; identical to SEQ ID NO: 83643

SEQ ID NO: 196196 - RNA, 64 nt, Homo Sapiens; identical to SEQ ID NO: 83644

SEQ ID NO: 196197 - RNA, 64 nt, Homo Sapiens; identical to SEQ ID NO: 83645

SEQ ID NO: 196198 - RNA, 64 nt, Homo Sapiens; identical to SEQ ID NO: 83646

SEQ ID NO: 196199 - RNA, 64 nt, Homo Sapiens; identical to SEQ ID NO: 83647

SEQ ID NO: 196200 - RNA, 64 nt, Homo Sapiens; identical to SEQ ID NO: 83648

SEQ ID NO: 196201 - RNA, 64 nt, Homo Sapiens; identical to SEQ ID NO: 83649

SEQ ID NO: 196202 - RNA, 64 nt, Homo Sapiens; identical to SEQ ID NO: 83650

SEQ ID NO: 196203 - RNA, 54 nt, Homo Sapiens; identical to SEQ ID NO: 83651

SEQ ID NO: 196204 - RNA, 64 nt, Homo Sapiens; identical to SEQ ID NO: 83652

SEQ ID NO: 196205 - RNA, 64 nt, Homo Sapiens; identical to SEQ ID NO: 83653

SEQ ID NO: 196206 - RNA, 64 nt, Homo Sapiens; identical to SEQ ID NO: 83654

SEQ ID NO: 196207 - RNA, 64 nt, Homo Sapiens; identical to SEQ ID NO: 83655

SEQ ID NO: 196208 - RNA, 64 nt, Homo Sapiens; identical to SEQ ID NO: 83656

SEQ ID NO: 196209 - RNA, 64 nt, Homo Sapiens; identical to SEQ ID NO: 83657

SEQ ID NO: 196210 - RNA, 59 nt, Homo Sapiens; identical to SEQ ID NO: 83658

SEQ ID NO: 196211 - RNA, 64 nt, Homo Sapiens; identical to SEQ ID NO: 83659

SEQ ID NO: 196212 - RNA, 64 nt, Homo Sapiens; identical to SEQ ID NO: 83660

SEQ ID NO: 196213 - RNA, 64 nt, Homo Sapiens; identical to SEQ ID NO: 83661

SEQ ID NO: 196214 - RNA, 64 nt, Homo Sapiens; identical to SEQ ID NO: 83662

SEQ ID NO: 196215 - RNA, 64 nt, Homo Sapiens; identical to SEQ ID NO: 83663

SEQ ID NO: 196216 - RNA, 64 nt, Homo Sapiens; identical to SEQ ID NO: 83664

SEQ ID NO: 196217 - RNA, 64 nt, Homo Sapiens; identical to SEQ ID NO: 83665

SEQ ID NO: 196218 - RNA, 64 nt, Homo Sapiens; identical to SEQ ID NO: 83666

SEQ ID NO: 196219 - RNA, 64 nt, Homo Sapiens; identical to SEQ ID NO: 83667

SEQ ID NO: 196220 - RNA, 64 nt, Homo Sapiens; identical to SEQ ID NO: 83668

SEQ ID NO: 196221 - RNA, 64 nt, Homo Sapiens
cccacucugccgugcucacacagacacacccagcugcacacaugaggcaucccacaugacacgg

SEQ ID NO: 196222 - RNA, 64 nt, Homo Sapiens
ccccuucccacggcgugucccacggccagacacaugcacacacaucacacccucaaacacccag

SEQ ID NO: 196223 - RNA, 64 nt, Homo Sapiens
aagccauauggagcaucuacccagacucccacucugcacacacucacucccaccucucaagccu

SEQ ID NO: 196224 - RNA, 64 nt, Homo Sapiens
gcaaggaauucuuauccuggccacauguccuccgugcacacacccaauggaguuaaccuuggaa

SEQ ID NO: 196225 - RNA, 64 nt, Homo Sapiens
uccuaugacuggcuccuacugugugcacacacaaugcacacaacguauguacacacacacacac

SEQ ID NO: 196226 - RNA, 64 nt, Homo Sapiens
augcacacaacuccuaugaccacacacacacgugugcacacacaaauguguguauguauguaca

SEQ ID NO: 196227 - RNA, 64 nt, Homo Sapiens
ugucauuucaguguuacuggaguuuucuucauugugcacacaggacaaaucugaucucuuuggg

SEQ ID NO: 196228 - RNA, 64 nt, Homo Sapiens
agugaggaguucugauauuaagcacacacacacaugcacacaaauggacuucucugaagcugug

SEQ ID NO: 196229 - RNA, 64 nt, Homo Sapiens
uaccuacguacacauauacaaaccugccgcaugcugcacacaucuauaacuggaggaccuggca

SEQ ID NO: 196230 - RNA, 64 nt, Homo Sapiens
cauaaacacacacacagugccacaggcacacacaugcacacaccuugauguccccaaaugcaaa

SEQ ID NO: 196231 - RNA, 64 nt, Homo Sapiens
cacacacacacacacgaaaucucacucucacacuugcacacauaugcuugcacacaugcacccc

SEQ ID NO: 196232 - RNA, 64 nt, Homo Sapiens
cacccccucacucucacacugaaugaaggaugcuugcacacaugcguuggucuucucuugucag

SEQ ID NO: 196233 - RNA, 64 nt, Homo Sapiens
acucucugguuuacuucaaaaagcaaaaugcuucugcacacaaauguggugauggcccuaaguu

SEQ ID NO: 196234 - RNA, 64 nt, Homo Sapiens
cacacacacacacgaguucaugugcacgcgcgcgugcacacacacccacagaaggacacuagcc

SEQ ID NO: 196235 - RNA, 64 nt, Homo Sapiens
acacacagacacacacacugccuggaugcauguaugcacacacaugcgcgcacacgugcucccu

SEQ ID NO: 196236 - RNA, 64 nt, Homo Sapiens
acacacacaugugcacagauaugcugucuggacaugcacacacgugcagauaugcuguccggau

SEQ ID NO: 196237 - RNA, 64 nt, Homo Sapiens
auaugcugccugggcacacacuuccggacacacaugcacacacaggugcagauaugcugccugg

SEQ ID NO: 196238 - RNA, 64 nt, Homo Sapiens
gaaaugacauggaaauagaugcacacacgugcagugcacacaaagucuccaagccaugugcaca

SEQ ID NO: 196239 - RNA, 64 nt, Homo Sapiens
acauacacacacacgcacagcacacacacacacaugcacacaacuaccccaucccccaccccca

SEQ ID NO: 196240 - RNA, 64 nt, Homo Sapiens
ucuccuguucucugagaguacuuuuucuaaggcaugcacacauacuuccuuaccuacucaaggg

SEQ ID NO: 196241 - RNA, 64 nt, Homo Sapiens
cccauaccucucagaaaaagguaugugugugccuugcacacacacaugcauguacagaaagacu

SEQ ID NO: 196242 - RNA, 64 nt, Homo Sapiens
aaaauuauuuuaaauuucuaaguuauaauaaauuugcacacagauaacaugcaugcuauuuaug

SEQ ID NO: 196243 - RNA, 64 nt, Homo Sapiens
caccacaccugauggaaaaauguaauugcuuaccugcacacaguuuuuuuuccuuuucuaaauu

SEQ ID NO: 196244 - RNA, 64 nt, Homo Sapiens
agcaaaaaggcauuuucuucaguuaauuuccaauugcacacauaagaauaccuccuuauaggaa

SEQ ID NO: 196245 - RNA, 64 nt, Homo Sapiens
augcuuaugugucauuucacucucuuugccuguaugcacacaguagcuuuuugccucccucucu

SEQ ID NO: 196246 - RNA, 64 nt, Homo Sapiens
cagcuuuguucucaccucuaucagcacacacaucugcacacacggccguccccauccccugccc

SEQ ID NO: 196247 - RNA, 64 nt, Homo Sapiens
agccuuccgggcuggaaggcuggggucaagagccugcacacauggcugggguaagggcaagcac

SEQ ID NO: 196248 - RNA, 64 nt, Homo Sapiens
gaguuccacaugggguacugacaagugacacgcaugcacacaugaagcugugagauccacaguu

SEQ ID NO: 196249 - RNA, 64 nt, Homo Sapiens
gacagcaacuuuuguacagaaaaaugcaauagaaugcacacaaacccucccccaaaaaacuuau

SEQ ID NO: 196250 - RNA, 64 nt, Homo Sapiens
gaaagcagccccuccucacacauacaugugcacaugcacacacaugcaugcacacacaugcaca

SEQ ID NO: 196251 - RNA, 64 nt, Homo Sapiens
cucacacauacaugugcacaugcacacacaugcaugcacacacaugcacacauacacgcacaug

SEQ ID NO: 196252 - RNA, 64 nt, Homo Sapiens
caugugcacaugcacacacaugcaugcacacacaugcacacauacacgcacaugcacacauaca

SEQ ID NO: 196253 - RNA, 64 nt, Homo Sapiens
caugcaugcacacacaugcacacauacacgcacaugcacacauacacaugcaugcacacauaca

SEQ ID NO: 196254 - RNA, 64 nt, Homo Sapiens
cacacauacacgcacaugcacacauacacaugcaugcacacauacacaggcauacaugcaugca

SEQ ID NO: 196255 - RNA, 64 nt, Homo Sapiens
cacaugcaugcacacauacacaggcauacaugcaugcacacacacaugcacgcacacacacaug

SEQ ID NO: 196256 - RNA, 64 nt, Homo Sapiens
caugcaugcacacacacaugcacgcacacacacaugcacacauacacgugcacacauacacagg

SEQ ID NO: 196257 - RNA, 64 nt, Homo Sapiens
cacaugcacgcacacacacaugcacacauacacgugcacacauacacaggcacacaugcaugca

SEQ ID NO: 196258 - RNA, 64 nt, Homo Sapiens
cauacacgugcacacauacacaggcacacaugcaugcacacauacacaugcacacacacaugca

SEQ ID NO: 196259 - RNA, 64 nt, Homo Sapiens
cauacacaggcacacaugcaugcacacauacacaugcacacacacaugcacacauauaugcaca

SEQ ID NO: 196260 - RNA, 64 nt, Homo Sapiens
cacaugcaugcacacauacacaugcacacacacaugcacacauauaugcacaggcacacacaug

SEQ ID NO: 196261 - RNA, 64 nt, Homo Sapiens
acaggcacacacauguacgcacacacacaugcacugcacacauauccaugcacacaaacacaua

SEQ ID NO: 196262 - RNA, 64 nt, Homo Sapiens
guacgcacacacacaugcacugcacacauauccaugcacacaaacacauauauacacaugcaca

SEQ ID NO: 196263 - RNA, 64 nt, Homo Sapiens
acaguggggccacgaggcugacauucucuggccuugcacacagugcccccugagaaguucaaca

SEQ ID NO: 196264 - RNA, 64 nt, Homo Sapiens
cucugucaucacuccuuggcacccaccaacuuccugcacacacuggcagagaggggcgcuggga

SEQ ID NO: 196265 - RNA, 64 nt, Homo Sapiens
ccucugggcugacggcaugaggccaccgcagcggugcacacauuggaggagagcuggaccugag

SEQ ID NO: 196266 - RNA, 64 nt, Homo Sapiens
aggagagcuggaccugagggcacacacucugccaugcacacagggacacccaaccccugaaccc

SEQ ID NO: 196267 - RNA, 64 nt, Homo Sapiens
cccgccucugguccuuuacaugugcauaaccacaugcacacacacucacgcaugagcaaacgug

SEQ ID NO: 196268 - RNA, 64 nt, Homo Sapiens
gcugucuacccgugcacaggcacacgugcuggucugcacacaccugcacacaccugcacacucg

SEQ ID NO: 196269 - RNA, 64 nt, Homo Sapiens
cgugcacaggcacacgugcuggucugcacacaccugcacacaccugcacacucgcuaugccagg

SEQ ID NO: 196270 - RNA, 64 nt, Homo Sapiens
uauauagauaucuguauauacacacacacauaugugcacacacacacucucucuccauuaucga

SEQ ID NO: 196271 - RNA, 64 nt, Homo Sapiens
aaagaaauauguuuuuguaagugguaggaacaugugcacacaauagaacaugaaauaaguuuuu

SEQ ID NO: 196272 - RNA, 64 nt, Homo Sapiens
ccuucauacacacacgcacgcacgcacacaaacaugcacacacgcaugcacacacacaaagccu

SEQ ID NO: 196273 - RNA, 64 nt, Homo Sapiens
cacgcacgcacgcacacaaacaugcacacacgcaugcacacacacaaagccuuaagcagaagaa

SEQ ID NO: 196274 - RNA, 64 nt, Homo Sapiens
cacucacacucacacucccuugauacacagccacugcacacacacuccuagcccugguugcuuc

SEQ ID NO: 196275 - RNA, 64 nt, Homo Sapiens
cacucacacacaugcauacacaaauacacacucaugcacacacacuuacucccucguacaugca

SEQ ID NO: 196276 - RNA, 64 nt, Homo Sapiens
cacgcucacucauagccauguccacaugggggcuugcacacaggaucacucacauauguacaug

SEQ ID NO: 196277 - RNA, 64 nt, Homo Sapiens
auguacauguacccaccacaaacgugcaagcuccugcacacaugcaugcacacaaacguguaca

SEQ ID NO: 196278 - RNA, 64 nt, Homo Sapiens
ccaccacaaacgugcaagcuccugcacacaugcaugcacacaaacguguacacaagugugagcu

SEQ ID NO: 196279 - RNA, 64 nt, Homo Sapiens
uguaugcacagcagagagacguaugagcuucuacugcacacaugcacacacacacgcacacgua

SEQ ID NO: 196280 - RNA, 64 nt, Homo Sapiens
cagcagagagacguaugagcuucuacugcacacaugcacacacacacgcacacguacauucacu

SEQ ID NO: 196281 - RNA, 64 nt, Homo Sapiens
accacaaaugaguucccagacguguaaacacacgugcacacaucguacacaugugagcucccac

SEQ ID NO: 196282 - RNA, 64 nt, Homo Sapiens
acacaccccaaacacgcacaggcuccuacacacaugcacacacguguacaccacaaacgagcuc

SEQ ID NO: 196283 - RNA, 64 nt, Homo Sapiens
caugcgcaggcuccugcaggcgugaauacacacaugcacacacauauacacacaugugccacaa

SEQ ID NO: 196284 - RNA, 64 nt, Homo Sapiens
ugcuggagacaguagaggcaugaacacacauggaugcacacacacacacgccaaugcacacaca

SEQ ID NO: 196285 - RNA, 64 nt, Homo Sapiens
ugaacacacauggaugcacacacacacacgccaaugcacacacacagagauaugcacacacacg

SEQ ID NO: 196286 - RNA, 64 nt, Homo Sapiens
cacacacacacgccaaugcacacacacagagauaugcacacacacggaugcacacacagauggu

SEQ ID NO: 196287 - RNA, 64 nt, Homo Sapiens
aaugcacacacacagagauaugcacacacacggaugcacacacagauggucacacagagauacg

SEQ ID NO: 196288 - RNA, 64 nt, Homo Sapiens
cgcaaacacaccgaugcacacgcacauagagauaugcacacacagaugcacacacagauauaca

SEQ ID NO: 196289 - RNA, 64 nt, Homo Sapiens
gaugcacacgcacauagagauaugcacacacagaugcacacacagauauacacauggaugcacg

SEQ ID NO: 196290 - RNA, 64 nt, Homo Sapiens
cgcacacaucagugcacacggaugcacagagauaugcacacaccgaugugcgcacacacagaua

SEQ ID NO: 196291 - RNA, 64 nt, Homo Sapiens
gauaugcacacaccgaugugcgcacacacagauaugcacacacauggaugagcacacacacacc

SEQ ID NO: 196292 - RNA, 64 nt, Homo Sapiens
ccaaugcgcacacacaccgauguacacacacagaugcacacacagaugcacacacaccgaugcu

SEQ ID NO: 196293 - RNA, 64 nt, Homo Sapiens
cacaccgauguacacacacagaugcacacacagaugcacacacaccgaugcugacuccaugugu

SEQ ID NO: 196294 - RNA, 64 nt, Homo Sapiens
acauuuuauaaacuaugcacaugcauuacacacaugcacacacauaugcacacacaugugcaaa

SEQ ID NO: 196295 - RNA, 64 nt, Homo Sapiens
cuaugcacaugcauuacacacaugcacacacauaugcacacacaugugcaaacauagccacuuu

SEQ ID NO: 196296 - RNA, 64 nt, Homo Sapiens
cauauguguaugcauguauacgcccauacagacaugcacacacagacuccuacuccauuagcua

SEQ ID NO: 196297 - RNA, 64 nt, Homo Sapiens
ggaaagcaaucauugguguguauguguaugugcaugcacacacgugcauauacacauuugugua

SEQ ID NO: 196298 - RNA, 64 nt, Homo Sapiens
cgacucccuggcuuuggcauucagugagacgcccugcacacacagaaagccaaagcgaucggug

SEQ ID NO: 196299 - RNA, 64 nt, Homo Sapiens
gcgagaacccucugggaccuuccgcggcccucucugcacacauccucaagugaccccgcacggc

SEQ ID NO: 196300 - RNA, 64 nt, Homo Sapiens
auccuuccacacuguguaugacacaccaccuacgugcacacagcucaugcacacaacccagugu

SEQ ID NO: 196301 - RNA, 64 nt, Homo Sapiens
ccaguguacacaccaccuaccacacagugucucaugcacacaacuguguugugugcucacgugc

SEQ ID NO: 196302 - RNA, 64 nt, Homo Sapiens
cccacagcacagcucccugcccaagagaaaggccugcacacaagcacacacauccaccccaggg

SEQ ID NO: 196303 - RNA, 64 nt, Homo Sapiens
cgcgcgcgcacacacacacacacacacacacacaugcacacacagacacccgugagcgccugug

SEQ ID NO: 196304 - RNA, 64 nt, Homo Sapiens
cacacaugcacacacacgcgcccgugagcgccugugcacacacacaccuaccacucacaugaca

SEQ ID NO: 196305 - RNA, 64 nt, Homo Sapiens
ccuuccacaguuggcacugcgcaacuguggggccugcacacagcgcuggcccggaacagccccu

SEQ ID NO: 196306 - RNA, 64 nt, Homo Sapiens
gaaguguuccaguuuccacuguggaccaaaacacugcacacaguaaaaaagcagcuaaaaaaga

SEQ ID NO: 196307 - RNA, 64 nt, Homo Sapiens
uuagguucuggugaagggagacaaucagugcacaugcacacaccccacacgcauacacacauga

SEQ ID NO: 196308 - RNA, 64 nt, Homo Sapiens
cccacacgcauacacacaugaacacaugcacaugugcacacacaaguaagauggcuucagagag

SEQ ID NO: 196309 - RNA, 64 nt, Homo Sapiens
ugcacaccgucccucucccccaccugcacaccccugcacacaccuuugccucugcacgugcaca

SEQ ID NO: 196310 - RNA, 64 nt, Homo Sapiens
ugcacaccccugcacacaccuuugccucugcacgugcacacacccaggcuuccugcccuagcag

SEQ ID NO: 196311 - RNA, 64 nt, Homo Sapiens
cgucugagcagggcaggugcccucccaugccuccugcacacagcggacacgcugggggagggcu

SEQ ID NO: 196312 - RNA, 64 nt, Homo Sapiens
cacgcgugcaugcacacuccgcacacugcacacaugcacacacaagcacacacaagugcacaga

SEQ ID NO: 196313 - RNA, 64 nt, Homo Sapiens
cacacacacacgcgugcaugugcacagagcacacugcacacauggaccacacagcacacacaag

SEQ ID NO: 196314 - RNA, 64 nt, Homo Sapiens
ugcacagaccacacagcacaggccacacagcacaugcacacaggaugcacacacaaagugcaua

SEQ ID NO: 196315 - RNA, 64 nt, Homo Sapiens
aagugcauaggccacacagcacagcacuaacacaugcacacacacacaagugcacagaccacac

SEQ ID NO: 196316 - RNA, 64 nt, Homo Sapiens
uguagcucacacacaguauaacagaucacacacaugcacacacgacgcuuacauguacacgugc

SEQ ID NO: 196317 - RNA, 64 nt, Homo Sapiens
ccacauagcacacaugugcacacgcuugcacacaugcacacagacgcauacaggcguacacaug

SEQ ID NO: 196318 - RNA, 64 nt, Homo Sapiens
cacacagaccacauagcacauacacaugcacgcuugcacacauguacauguccgcauacaggcg

SEQ ID NO: 196319 - RNA, 64 nt, Homo Sapiens
cggauagauugcuagguagauagacacacacacaugcacacacacacaucuggagauggcaaaa

SEQ ID NO: 196320 - RNA, 64 nt, Homo Sapiens
ccagugcagggucugugcaccuucccugcuggccugcacacagcugcucagcaccacuuucauu

SEQ ID NO: 196321 - RNA, 64 nt, Homo Sapiens
aguccuauccgaucugaaaacacacauacacaaaugcacacacaugcacacacacauuuaaggg

SEQ ID NO: 196322 - RNA, 64 nt, Homo Sapiens
gaucugaaaacacacauacacaaaugcacacacaugcacacacacauuuaagggacauagcagu

SEQ ID NO: 196323 - RNA, 64 nt, Homo Sapiens
gccagcucugagcagacaggacuccuguuuucacaccuuacaaaccgggucgugucuuuuaaaa

SEQ ID NO: 196324 - RNA, 64 nt, Homo Sapiens
gcuuuagagaagccauaacgcauugaccuucaugaccuuacauacgggccagggcguggcuugg

SEQ ID NO: 196325 - RNA, 64 nt, Homo Sapiens
uugcaugucaucauagacuucauacuggagagaaaccuuacaaaugugaagcaugugacaaagu

SEQ ID NO: 196326 - RNA, 64 nt, Homo Sapiens
uuaaaagacauaggagaauucauacuggagagaaaccuuacaaguguaaugaguguggcaaagc

SEQ ID NO: 196327 - RNA, 64 nt, Homo Sapiens
uugcaguucaucagugaacucauacuggagagaaaccuuacaaaugucaugacuguggcaaggu

SEQ ID NO: 196328 - RNA, 64 nt, Homo Sapiens
ugucaugacugugccaaggucauacuggagagaaaccuuacaaauugcaggucaucggugaacu

SEQ ID NO: 196329 - RNA, 64 nt, Homo Sapiens
uguaaugaguguggcaaagccacacuggagagaaaccuuacaaguggaacaacauacuggacuu

SEQ ID NO: 196330 - RNA, 64 nt, Homo Sapiens
ugcaaugaguguggcaaagccacacuggagagaaaccuuacaaguggcacaccauacuagaauu

SEQ ID NO: 196331 - RNA, 64 nt, Homo Sapiens
ugugaugaguguggcaacaccaaacuggagagaaaccuuacaaauggcaaaacauauuagaauu

SEQ ID NO: 196332 - RNA, 64 nt, Homo Sapiens
ugcaaugaguguggcaaacccacacuggagagaaaccuuacaaguggcaccccauacuagaauu

SEQ ID NO: 196333 - RNA, 64 nt, Homo Sapiens
cacaaugaaugugacauggucauaguggagagaaaccuuacaagaaaauucacaccuuguaauu

SEQ ID NO: 196334 - RNA, 64 nt, Homo Sapiens
ugggaggaaugugacaaaagcauacuggagagaaaccuuacaaauugcacaucaccauagacuu

SEQ ID NO: 196335 - RNA, 64 nt, Homo Sapiens
cauaaugaauguggcaaggucauacuggagagaaaccuuacaagcuguaagucauaaggcaauu

SEQ ID NO: 196336 - RNA, 64 nt, Homo Sapiens
ggagugcggccaguuuuucaaaaaaaaaaaaguaaccuuacaaacuccaucuccaaaaaaaaaa

SEQ ID NO: 196337 - RNA, 52 nt, Homo Sapiens
ggacgccgggcgugguggcuaaaccuuacaaagaagaauucauaguggauag

SEQ ID NO: 196338 - RNA, 64 nt, Homo Sapiens; identical to SEQ ID NO: 21289

SEQ ID NO: 196339 - RNA, 64 nt, Homo Sapiens; identical to SEQ ID NO: 21290

SEQ ID NO: 196340 - RNA, 64 nt, Homo Sapiens; identical to SEQ ID NO: 21291

SEQ ID NO: 196341 - RNA, 64 nt, Homo Sapiens; identical to SEQ ID NO: 21292

SEQ ID NO: 196342 - RNA, 64 nt, Homo Sapiens; identical to SEQ ID NO: 21293

SEQ ID NO: 196343 - RNA, 64 nt, Homo Sapiens; identical to SEQ ID NO: 21294

SEQ ID NO: 196344 - RNA, 64 nt, Homo Sapiens; identical to SEQ ID NO: 21295

SEQ ID NO: 196345 - RNA, 64 nt, Homo Sapiens; identical to SEQ ID NO: 21296

SEQ ID NO: 196346 - RNA, 64 nt, Homo Sapiens; identical to SEQ ID NO: 21297

SEQ ID NO: 196347 - RNA, 64 nt, Homo Sapiens; identical to SEQ ID NO: 21298

SEQ ID NO: 196348 - RNA, 64 nt, Homo Sapiens; identical to SEQ ID NO: 21299

SEQ ID NO: 196349 - RNA, 64 nt, Homo Sapiens; identical to SEQ ID NO: 21300

SEQ ID NO: 196350 - RNA, 64 nt, Homo Sapiens; identical to SEQ ID NO: 21301

SEQ ID NO: 196351 - RNA, 64 nt, Homo Sapiens; identical to SEQ ID NO: 21302

SEQ ID NO: 196352 - RNA, 64 nt, Homo Sapiens; identical to SEQ ID NO: 21303

SEQ ID NO: 196353 - RNA, 64 nt, Homo Sapiens; identical to SEQ ID NO: 85822

SEQ ID NO: 196354 - RNA, 64 nt, Homo Sapiens; identical to SEQ ID NO: 85823

SEQ ID NO: 196355 - RNA, 64 nt, Homo Sapiens; identical to SEQ ID NO: 85824

SEQ ID NO: 196356 - RNA, 64 nt, Homo Sapiens; identical to SEQ ID NO: 85825

SEQ ID NO: 196357 - RNA, 64 nt, Homo Sapiens; identical to SEQ ID NO: 85826

SEQ ID NO: 196358 - RNA, 64 nt, Homo Sapiens; identical to SEQ ID NO: 85827

SEQ ID NO: 196359 - RNA, 64 nt, Homo Sapiens; identical to SEQ ID NO: 85828

SEQ ID NO: 196360 - RNA, 64 nt, Homo Sapiens; identical to SEQ ID NO: 85829

SEQ ID NO: 196361 - RNA, 64 nt, Homo Sapiens; identical to SEQ ID NO: 85830

SEQ ID NO: 196362 - RNA, 64 nt, Homo Sapiens; identical to SEQ ID NO: 85831

SEQ ID NO: 196363 - RNA, 64 nt, Homo Sapiens; identical to SEQ ID NO: 85832

SEQ ID NO: 196364 - RNA, 64 nt, Homo Sapiens; identical to SEQ ID NO: 85833

SEQ ID NO: 196365 - RNA, 64 nt, Homo Sapiens; identical to SEQ ID NO: 85834

SEQ ID NO: 196366 - RNA, 64 nt, Homo Sapiens; identical to SEQ ID NO: 85835

SEQ ID NO: 196367 - RNA, 64 nt, Homo Sapiens; identical to SEQ ID NO: 85836

SEQ ID NO: 196368 - RNA, 64 nt, Homo Sapiens; identical to SEQ ID NO: 85837

SEQ ID NO: 196369 - RNA, 64 nt, Homo Sapiens; identical to SEQ ID NO: 85838

SEQ ID NO: 196370 - RNA, 64 nt, Homo Sapiens; identical to SEQ ID NO: 85839

SEQ ID NO: 196371 - RNA, 64 nt, Homo Sapiens; identical to SEQ ID NO: 85840

SEQ ID NO: 196372 - RNA, 64 nt, Homo Sapiens; identical to SEQ ID NO: 85841

SEQ ID NO: 196373 - RNA, 64 nt, Homo Sapiens; identical to SEQ ID NO: 85842

SEQ ID NO: 196374 - RNA, 64 nt, Homo Sapiens; identical to SEQ ID NO: 85843

SEQ ID NO: 196375 - RNA, 64 nt, Homo Sapiens; identical to SEQ ID NO: 85844

SEQ ID NO: 196376 - RNA, 64 nt, Homo Sapiens; identical to SEQ ID NO: 85845

SEQ ID NO: 196377 - RNA, 64 nt, Homo Sapiens; identical to SEQ ID NO: 85846

SEQ ID NO: 196378 - RNA, 64 nt, Homo Sapiens; identical to SEQ ID NO: 85847

SEQ ID NO: 196379 - RNA, 64 nt, Homo Sapiens; identical to SEQ ID NO: 85848

SEQ ID NO: 196380 - RNA, 64 nt, Homo Sapiens; identical to SEQ ID NO: 85849

SEQ ID NO: 196381 - RNA, 64 nt, Homo Sapiens; identical to SEQ ID NO: 85850

SEQ ID NO: 196382 - RNA, 64 nt, Homo Sapiens; identical to SEQ ID NO: 85851

SEQ ID NO: 196383 - RNA, 64 nt, Homo Sapiens; identical to SEQ ID NO: 85852

SEQ ID NO: 196384 - RNA, 64 nt, Homo Sapiens; identical to SEQ ID NO: 85853

SEQ ID NO: 196385 - RNA, 64 nt, Homo Sapiens; identical to SEQ ID NO: 85854

SEQ ID NO: 196386 - RNA, 64 nt, Homo Sapiens; identical to SEQ ID NO: 85855

SEQ ID NO: 196387 - RNA, 64 nt, Homo Sapiens; identical to SEQ ID NO: 85856

SEQ ID NO: 196388 - RNA, 64 nt, Homo Sapiens; identical to SEQ ID NO: 85857

SEQ ID NO: 196389 - RNA, 64 nt, Homo Sapiens; identical to SEQ ID NO: 85858

SEQ ID NO: 196390 - RNA, 64 nt, Homo Sapiens; identical to SEQ ID NO: 106200

SEQ ID NO: 196391 - RNA, 64 nt, Homo Sapiens; identical to SEQ ID NO: 106201

SEQ ID NO: 196392 - RNA, 64 nt, Homo Sapiens; identical to SEQ ID NO: 106202

SEQ ID NO: 196393 - RNA, 64 nt, Homo Sapiens; identical to SEQ ID NO: 106203

SEQ ID NO: 196394 - RNA, 64 nt, Homo Sapiens; identical to SEQ ID NO: 106204

SEQ ID NO: 196395 - RNA, 64 nt, Homo Sapiens; identical to SEQ ID NO: 106205

SEQ ID NO: 196396 - RNA, 64 nt, Homo Sapiens; identical to SEQ ID NO: 106206

SEQ ID NO: 196397 - RNA, 64 nt, Homo Sapiens; identical to SEQ ID NO: 106207

SEQ ID NO: 196398 - RNA, 64 nt, Homo Sapiens
gcucagagaaggguuuuucuuuuuugaccuuucuucucucaacaggaaccugccugaggacacc

SEQ ID NO: 196399 - RNA, 64 nt, Homo Sapiens
gaucucagccccaggcugguuguuucuacaaaucucucucaaauguauuauuuuggugacaaaa

SEQ ID NO: 196400 - RNA, 64 nt, Homo Sapiens
auuauuaaauuuauaucccuaaaauuuuuagaaaucucucaaaaucuuuccaaauguucuggua

SEQ ID NO: 196401 - RNA, 64 nt, Homo Sapiens
guguacauuaaaucuagaaaccauuaguuugagaucucucaaaaauaaaaauaaaaauugcuuu

SEQ ID NO: 196402 - RNA, 64 nt, Homo Sapiens
uaauauggauuuguuacagccaagugccaaaugcucucucaaauugucagcaauuuaacuagac

SEQ ID NO: 196403 - RNA, 64 nt, Homo Sapiens
augaaauccuuuuccuguucauacacuaaccaaaucucucaaaucuguuaucccaaucauuguu

SEQ ID NO: 196404 - RNA, 64 nt, Homo Sapiens
gaguguuaagugucaaggugagaaagccucacauucucucaagacaguugcucuaggagcugag

SEQ ID NO: 196405 - RNA, 64 nt, Homo Sapiens
cugguuuggaaguguggagauugcauuucuggcuucucucaauggcuuguguugaggacucugg

SEQ ID NO: 196406 - RNA, 64 nt, Homo Sapiens
ccagcacuccagccugggugacagagcaagacucucucucaaaaaaaaaaaaaaaaaaaaauuc

SEQ ID NO: 196407 - RNA, 64 nt, Homo Sapiens
cugauguuuacagaacccaaaugaugucuuccucucucucaaaauaaacuaaccuauucauauu

SEQ ID NO: 196408 - RNA, 64 nt, Homo Sapiens
ccuuccuauuucucaauaguaugaaacccaauaaucucucaauaggcuacuuaagucugcucug

SEQ ID NO: 196409 - RNA, 64 nt, Homo Sapiens
ccuuccuauuucucaauagucugaugaaacccagucucucaauaccagguuacuuaaguccgcu

SEQ ID NO: 196410 - RNA, 64 nt, Homo Sapiens
uuaaucuaaaacacuacaagagaauuuaacaccaucucucaaaugcuuuuuuggagagcuuaau

SEQ ID NO: 196411 - RNA, 64 nt, Homo Sapiens
uccgccccgaucucacgucagugagggucuccugucucucaaguguguuuccuuuggcuguucc

SEQ ID NO: 196412 - RNA, 64 nt, Homo Sapiens; identical to SEQ ID NO: 193394

SEQ ID NO: 196413 - RNA, 64 nt, Homo Sapiens; identical to SEQ ID NO: 193395

SEQ ID NO: 196414 - RNA, 64 nt, Homo Sapiens; identical to SEQ ID NO: 193396

SEQ ID NO: 196415 - RNA, 64 nt, Homo Sapiens; identical to SEQ ID NO: 193397

SEQ ID NO: 196416 - RNA, 64 nt, Homo Sapiens; identical to SEQ ID NO: 193398

SEQ ID NO: 196417 - RNA, 64 nt, Homo Sapiens; identical to SEQ ID NO: 193399

SEQ ID NO: 196418 - RNA, 64 nt, Homo Sapiens; identical to SEQ ID NO: 193400

SEQ ID NO: 196419 - RNA, 64 nt, Homo Sapiens; identical to SEQ ID NO: 193401

SEQ ID NO: 196420 - RNA, 64 nt, Homo Sapiens; identical to SEQ ID NO: 193402

SEQ ID NO: 196421 - RNA, 64 nt, Homo Sapiens; identical to SEQ ID NO: 193403

SEQ ID NO: 196422 - RNA, 64 nt, Homo Sapiens; identical to SEQ ID NO: 193404

SEQ ID NO: 196423 - RNA, 64 nt, Homo Sapiens; identical to SEQ ID NO: 193405

SEQ ID NO: 196424 - RNA, 64 nt, Homo Sapiens; identical to SEQ ID NO: 193406

SEQ ID NO: 196425 - RNA, 64 nt, Homo Sapiens; identical to SEQ ID NO: 193407

SEQ ID NO: 196426 - RNA, 64 nt, Homo Sapiens; identical to SEQ ID NO: 193408

SEQ ID NO: 196427 - RNA, 64 nt, Homo Sapiens
aucuauauuuuaaacuagaaauuauauuagaacucaaauucaauguuauacauacuugguaaac

SEQ ID NO: 196428 - RNA, 64 nt, Homo Sapiens
uaagcauuuuaagaaacauuuuuaaagugugcuacaaauucauuugguguacuaacaucaaaau

SEQ ID NO: 196429 - RNA, 64 nt, Homo Sapiens
aagcuuaaucuccaauaaacaucuauguuaaauccaaauucagcauuugcuguuagcuauucag

SEQ ID NO: 196430 - RNA, 64 nt, Homo Sapiens
caacuaacaacugacaaaucagaguuugccaguucaaauucagcauggcugcagcugauuaaga

SEQ ID NO: 196431 - RNA, 64 nt, Homo Sapiens
uaugaauaaacuugauaaugguauuuauuaauaucaaauucacuguugugaaugaugcuuuuuu

SEQ ID NO: 196432 - RNA, 64 nt, Homo Sapiens
aagaagcaguauuaacaucauaugauaguuauuccaaauucaagcucagucugcauguaacuuu

SEQ ID NO: 196433 - RNA, 64 nt, Homo Sapiens
aaugcaguauccgcgagccuccugugaaucaaaacaaauucaaggcuuuuuaaaaucauauuua

SEQ ID NO: 196434 - RNA, 64 nt, Homo Sapiens
caaaguccuuucccgaugcgaauggaggaaaccacaaauucauguuuagcugugcagaagguga

SEQ ID NO: 196435 - RNA, 64 nt, Homo Sapiens
cucaugaauguaaugaagaugggaagauauuuaucaaauucaggcuucauucagcaucugagag

SEQ ID NO: 196436 - RNA, 64 nt, Homo Sapiens
agccaucagucaaagaaacuaccuuguuuaguaucaaauucacgccaugcaaaaagauuauaaa

SEQ ID NO: 196437 - RNA, 64 nt, Homo Sapiens
auggcugcgauuguuagcacuucaucuacacagucaaauucacaggacgcuaagauagacuucg

SEQ ID NO: 196438 - RNA, 64 nt, Homo Sapiens
uguggaucaagaggaaacucugacaugaugauuccaaauucagaaagauuuccaucauuaucca

SEQ ID NO: 196439 - RNA, 64 nt, Homo Sapiens
aaguuauuaaaucugacauguggaguuaaauaaacaaauucagcauggacauggucuuaaucaa

SEQ ID NO: 196440 - RNA, 64 nt, Homo Sapiens
uucugucuggagugacagacgaagcagcuuuaaacaaauucauauucauguuugcuucauaaau

SEQ ID NO: 196441 - RNA, 64 nt, Homo Sapiens
augacagacugcaaaguaacaugucaagugaacacaaauucaggcugaaacuaauaauuaggca

SEQ ID NO: 196442 - RNA, 57 nt, Homo Sapiens
guacuugauaauaucaacugacacagucaaauucagucuggagccagaacgugguga

SEQ ID NO: 196443 - RNA, 64 nt, Homo Sapiens
agcugcagguggagcuggagcaagaauaccaagacaaauucaaaagacugccccucgagauuuu

SEQ ID NO: 196444 - RNA, 64 nt, Homo Sapiens
cauguaugugagauuuuuguuuucuuuccaauagcaaauucaaagcaagcaacuugcaggcucc

SEQ ID NO: 196445 - RNA, 64 nt, Homo Sapiens
caaugacccaaaucucuuccacaagacuuaaaaccaaauucagggacaaauggauagagaagaa

SEQ ID NO: 196446 - RNA, 64 nt, Homo Sapiens
ucaacaacaucaaaacuucaaaaaggaaacugagcaaauucauuguugaaaugcuggucaccaa

SEQ ID NO: 196447 - RNA, 64 nt, Homo Sapiens
auccuguuaagugucauauucaaauuuacauucacaaauucaguguaacugccauauuauauaa

SEQ ID NO: 196448 - RNA, 64 nt, Homo Sapiens
auauuccagaggugggaggugggaggggaagggagaaauccaaaacaaaguguucuugcucuga

SEQ ID NO: 196449 - RNA, 64 nt, Homo Sapiens
cuucuauugcuacacaucuccuucuggcucaggugaaauccaugcccuucugcuuauagaccua

SEQ ID NO: 196450 - RNA, 64 nt, Homo Sapiens
ugcuuuccagacuccaaaggggcuccucucccaagaaauccaggcuccucucccaagaaaucca

SEQ ID NO: 196451 - RNA, 64 nt, Homo Sapiens
cuccucucccaagaaauccacccuccucucccaagaaauccaggacugauuggggcuuccacag

SEQ ID NO: 196452 - RNA, 64 nt, Homo Sapiens
acacuucuggucccuagcaugauauuccaaaccugaaauccaaaggucccguuguguauaugca

SEQ ID NO: 196453 - RNA, 64 nt, Homo Sapiens
agcuucaaaaucugaaucuuuaauucaaaaaucugaaauccagauacuacaaguugagcaucuc

SEQ ID NO: 196454 - RNA, 64 nt, Homo Sapiens
uauaucucaaaucuggcuacaaguuaaccuuuuagaaauccacaauuagaucucauaauuugac

SEQ ID NO: 196455 - RNA, 64 nt, Homo Sapiens
gacaaugguacuggcauacagaacuuccagagaggaaauccaauccaaagacuauugcagggag

SEQ ID NO: 196456 - RNA, 64 nt, Homo Sapiens
accaaucccgaucggcucuuacaccugugcuuuggaaauccaccuuagcuccccgcuccacaag

SEQ ID NO: 196457 - RNA, 64 nt, Homo Sapiens
accaaucccgaucggcucuuuccacggggaucuggaaauccacgaggaaagaacuucagcugac

SEQ ID NO: 196458 - RNA, 64 nt, Homo Sapiens
ggaagggaaaaaagaaagugaggaacaaacuguugaaauccauuuugagaacugugaaauguuu

SEQ ID NO: 196459 - RNA, 64 nt, Homo Sapiens
ccaaaggaaagguaaacugaagucagaacuucaugaaauccacaauauuuagauuaauuuuuuu

SEQ ID NO: 196460 - RNA, 64 nt, Homo Sapiens
uucucagccucauuuggacuaaaaaaagaaagcagaaauccaugaacacauugcuucucggccu

SEQ ID NO: 196461 - RNA, 64 nt, Homo Sapiens
uugcuucucggccuuuuggcuaagaucaaguguagaaauccaugaacacuaaaggacuucauug

SEQ ID NO: 196462 - RNA, 64 nt, Homo Sapiens
uagacuagccaaaaaugccguggcaaagagcucagaaauccaauuuggauaccaaagguuucuc

SEQ ID NO: 196463 - RNA, 64 nt, Homo Sapiens
agguggggaaggaggugaugaaacauuaguuugugaaauccaaggcccuggcuugcuuucuuuc

SEQ ID NO: 196464 - RNA, 64 nt, Homo Sapiens
ucucggguccgauuaauuuaaaucuugacacggugaaauccaggaagaaaaaaaaagcauuccc

SEQ ID NO: 196465 - RNA, 64 nt, Homo Sapiens
acacccccaccccaacacccgacgcaagggagaagaaauccauauggggagacgguguugcaga

SEQ ID NO: 196466 - RNA, 64 nt, Homo Sapiens
gauggagaaaaaucugggacagugucuucucagaaaccaccagccuugacgguaaugaaacacu

SEQ ID NO: 196467 - RNA, 64 nt, Homo Sapiens
gauggagaaauaucuaggaaagugucuucucagaaaccaccaaccuugaagguaaugaaacucc

SEQ ID NO: 196468 - RNA, 64 nt, Homo Sapiens
ucagaaaccaccaaccuugaagugucuucugagaaaccaccaggcuugaagguaaugaaacugu

SEQ ID NO: 196469 - RNA, 64 nt, Homo Sapiens
gauggagaaauaucuaggaaagugucuucucagaaaccaccagccuugaagguaaugaaacucc

SEQ ID NO: 196470 - RNA, 64 nt, Homo Sapiens
gauggagaaaaaucuaggacagugucuucugagaaaccaccaggcuugaagguaaugaaacugu

SEQ ID NO: 196471 - RNA, 64 nt, Homo Sapiens
ugaguaguaaucucacacuucauccuauagagucaaccaccacagauaggaauuccuuauucuu

SEQ ID NO: 196472 - RNA, 64 nt, Homo Sapiens
cuuggccucccaaagugcugggauuacagacaugaaccaccacgccuggcuggaauacuuacuc

SEQ ID NO: 196473 - RNA, 64 nt, Homo Sapiens
cugcuuucugucucuauggacuccagcccccagcaaccaccaauuacucuccauuccuuccuuc

SEQ ID NO: 196474 - RNA, 64 nt, Homo Sapiens
uuuauuuaaaguuccaaaaauaacaauguugcauaaccaccaccucagugccacuuaguauugu

SEQ ID NO: 196475 - RNA, 64 nt, Homo Sapiens
uguacaagguuuugaaaaaucuauacaccuguguaaccaccaccaccuguguaaccaccaccgc

SEQ ID NO: 196476 - RNA, 64 nt, Homo Sapiens
aucuauacaccuguguaaccaccaccaccuguguaaccaccaccgccagaaccaaaaacguuuc

SEQ ID NO: 196477 - RNA, 64 nt, Homo Sapiens
ccuacuuguuugcuugcuacaucccagagauucuaaccaccauggcuauccgcaagcucaagag

SEQ ID NO: 196478 - RNA, 64 nt, Homo Sapiens
ccaaucuacaggcacucauuccaugggauuugggaaccaccaugacagauggauucucuccagg

SEQ ID NO: 196479 - RNA, 64 nt, Homo Sapiens
uccuaucaacccauggggcuagagacugccaugcaaccaccaccacgacagcccuuccuccauc

SEQ ID NO: 196480 - RNA, 64 nt, Homo Sapiens
accuugggaagaggcaucagccaucuugcuugagaaccaccaagccaaaagcaaaagcuuuuau

SEQ ID NO: 196481 - RNA, 64 nt, Homo Sapiens
accaccaccaccccuacuacagagacccugucucaaccaccaccugcacuccagccugggcaac

SEQ ID NO: 196482 - RNA, 64 nt, Homo Sapiens
cuccagccugggcaacguagacaaggaauauaaaaaccaccaccauaucacagacaccccucac

SEQ ID NO: 196483 - RNA, 64 nt, Homo Sapiens
uccccacaccgccgcccgguaacaaccaaccgguaaccaccacuuucccagaaauucacgcuua

SEQ ID NO: 196484 - RNA, 64 nt, Homo Sapiens
gcuggguaaccaccgaucagccugagguauuugcaaccaccauguucugguugcuguuaguuuc

SEQ ID NO: 196485 - RNA, 64 nt, Homo Sapiens
cccacuggaggcgccgccccacccggcccacuggcagacacagacccaggcagcaccaggcccc

SEQ ID NO: 196486 - RNA, 64 nt, Homo Sapiens
aggucccaggagcagacccugcccccagcccccacagacacaccccaaucugaaagccaugcgu

SEQ ID NO: 196487 - RNA, 64 nt, Homo Sapiens
ugugcugugagccccccacucugccgugcucacacagacacacccagcugcacacaugaggcau

SEQ ID NO: 196488 - RNA, 64 nt, Homo Sapiens
uauccccaccccuucccacggcgugucccacggccagacacaugcacacacaucacacccucaa

SEQ ID NO: 196489 - RNA, 64 nt, Homo Sapiens
auacaucuuugaugugcgaaagugaguucaucuucagacacauuugguacauccagaaauagau

SEQ ID NO: 196490 - RNA, 64 nt, Homo Sapiens
ccccacguguaucugaacauuaagcagauuggcucagacacaaugaaaaggauaauccaaugua

SEQ ID NO: 196491 - RNA, 64 nt, Homo Sapiens
cacacucucaucucuuuccuggagagggccaauccagacacacugcaccccccugggccuggag

SEQ ID NO: 196492 - RNA, 64 nt, Homo Sapiens
ggaggcugacagaggcaggagcguccauuuccagcagacacaauuggccagaggaaagugagag

SEQ ID NO: 196493 - RNA, 64 nt, Homo Sapiens
aauauacagacaaucaaaacauguaugacuugcacagacacaaacacaaggcuggcagagauuu

SEQ ID NO: 196494 - RNA, 64 nt, Homo Sapiens
gaugcucaccagccuggcuugucagucagcaucacagacacauauauuagguaugucuugugcg

SEQ ID NO: 196495 - RNA, 64 nt, Homo Sapiens
gugcucaggagggacccagaugggggcagaaguucagacacaccguguauauuggguucagacu

SEQ ID NO: 196496 - RNA, 64 nt, Homo Sapiens
gacacgcggaagccaagcacacgccggcgacgcgcagacacacgucacagggaacacgggacag

SEQ ID NO: 196497 - RNA, 64 nt, Homo Sapiens
cuugugggcacaugggcacauacagacucacauacagacacacacauauauguacagacaugua

SEQ ID NO: 196498 - RNA, 64 nt, Homo Sapiens
agagagcugcuuaaacucacacaacaaugaacugcagacacagcuguucucucccucucuccuu

SEQ ID NO: 196499 - RNA, 64 nt, Homo Sapiens
ugcaguaccagugagccaagccugaugggcagcacagacacagacacacaccgcagggcccgac

SEQ ID NO: 196500 - RNA, 64 nt, Homo Sapiens
accagugagccaagccugaugggcagcacagacacagacacacaccgcagggcccgacccuccu

SEQ ID NO: 196501 - RNA, 64 nt, Homo Sapiens
gacaugggaguggggagcggcuccagcuccucuccagacacagaggaggaguuuucuguguggu

SEQ ID NO: 196502 - RNA, 64 nt, Homo Sapiens
ccgugggacccaggcucccaucacacacggaggccagacacaggcaagcacacacacacagucc

SEQ ID NO: 196503 - RNA, 64 nt, Homo Sapiens
uaagccuguggcacugggacuuggccagaauccacagacacaccguugacauauggccauccca

SEQ ID NO: 196504 - RNA, 64 nt, Homo Sapiens
uccacaccacagcacuaccgccggcauggccacucagacacaaguguggucugaaggaccccga

SEQ ID NO: 196505 - RNA, 64 nt, Homo Sapiens
ugugugugaggcauagccccuggacacacacacacagacacacacacugccuggaugcauguau

SEQ ID NO: 196506 - RNA, 64 nt, Homo Sapiens
acacaugcagauaugcugccuggacacacacuuccagacacacgugcacaggcgcagauaugcu

SEQ ID NO: 196507 - RNA, 64 nt, Homo Sapiens
cauuguaaggccgcuuguggucugccaaacugcacagacacacguaaucccccgaccccccgca

SEQ ID NO: 196508 - RNA, 64 nt, Homo Sapiens
cugccagucccuccagccucugucccugccccagcagacacagggagcagcaggcucccuggug

SEQ ID NO: 196509 - RNA, 64 nt, Homo Sapiens
uagagaagccuuuuccauaauacagaaagcaaaucagacacaaucuucuuccaaugaugcuuac

SEQ ID NO: 196510 - RNA, 64 nt, Homo Sapiens
acaucaagaaaacagcaaggcacacacacaaaugcagacacacacacacacacgcagacacaca

SEQ ID NO: 196511 - RNA, 64 nt, Homo Sapiens
cacacacacaaaugcagacaaacacacacacacgcagacacacauucaggagaugaugugaugg

SEQ ID NO: 196512 - RNA, 64 nt, Homo Sapiens
cauguguccgcccccgauggaggacuccaggcagcagacacaugccagggccaugucagacaca

SEQ ID NO: 196513 - RNA, 64 nt, Homo Sapiens
gacuccaggcagcagacacaugccagggccaugucagacacagauuggccagaaaccuuccugc

SEQ ID NO: 196514 - RNA, 64 nt, Homo Sapiens
aagacccugcuuaaagggccccacaccacagacccagacacagccaagggagagugcucccgac

SEQ ID NO: 196515 - RNA, 64 nt, Homo Sapiens
aaggaaaacuacagguccauaucccucauuaacacagacacaaaaauucuaaauaaaauuuuaa

SEQ ID NO: 196516 - RNA, 64 nt, Homo Sapiens
agccauggugacacacagcagcacugcagauagccagacacauggcuauccuagagaggcuggc

SEQ ID NO: 196517 - RNA, 64 nt, Homo Sapiens
uuaaauggugggaacccuccccaaaaccuuuccccagacacauucuccugugccccucagagag

SEQ ID NO: 196518 - RNA, 64 nt, Homo Sapiens
caaaaggugacuuaauuaauaaagggcauuugggcagacacacuguguuggaccaacaaaguag

SEQ ID NO: 196519 - RNA, 64 nt, Homo Sapiens
gccugaaaagaggggcugcccuccugcgccaaggcagacacaagcugcgggcugugcgguccua

SEQ ID NO: 196520 - RNA, 64 nt, Homo Sapiens
agcugcagcucggaugguggauuuucagugccaacagacacaucugccgugaacucgcagaugc

SEQ ID NO: 196521 - RNA, 64 nt, Homo Sapiens
caggauuugcucgaucucagcccagcaggccaggcagacacaccccgcugugccuuaggaaggu

SEQ ID NO: 196522 - RNA, 64 nt, Homo Sapiens
ugaccauaacccaggaauccagacacacauggcacagacacagcgccccuguauucugcuggcc

SEQ ID NO: 196523 - RNA, 64 nt, Homo Sapiens
uggcacagacacagcugaccuguauucugcuggccagacacacagaagagcagcccugagcccc

SEQ ID NO: 196524 - RNA, 64 nt, Homo Sapiens
cagaaagacacacacagacacaccauuacauacacagacacacacccuccccgccacagagaca

SEQ ID NO: 196525 - RNA, 64 nt, Homo Sapiens
aucacacgcagccccucccccagaaagacacacacagacacacacaccauuacacacacauaca

SEQ ID NO: 196526 - RNA, 64 nt, Homo Sapiens
aucacacacacacccucccccacacagaaagacacagacacaaacaccauuacauacacagaca

SEQ ID NO: 196527 - RNA, 64 nt, Homo Sapiens
cagaaagacacagacacaaacaccauuacauacacagacacacacacccuccccgccacagaga

SEQ ID NO: 196528 - RNA, 64 nt, Homo Sapiens
aucacacacacacccucccccagaaagacacacacagacacaaaauuacauacacagacacaca

SEQ ID NO: 196529 - RNA, 64 nt, Homo Sapiens
cagaaagacacacacagacacaccauuacauacacagacacacacccccuccccaccacagaga

SEQ ID NO: 196530 - RNA, 64 nt, Homo Sapiens
uacacccaugaugugagcaaccugaacacacacacagacacacaaacacacacacauacacacc

SEQ ID NO: 196531 - RNA, 64 nt, Homo Sapiens
acacacacacauacacacccccugaaaacacacacagacacacaggcccucuccacaugcacac

SEQ ID NO: 196532 - RNA, 64 nt, Homo Sapiens
cacacacacacacacacacaccacccuacauacacagacacacaauaugaaaaucucuuaacac

SEQ ID NO: 196533 - RNA, 64 nt, Homo Sapiens
aguccacugaugcaaauugguccaagaggaacuucagacacaaaaaguccccccaguuaugccu

SEQ ID NO: 196534 - RNA, 64 nt, Homo Sapiens
cacccaucuuggcacccugacuugcccaucuucacagacacauaagcuccuugcagauguagcc

SEQ ID NO: 196535 - RNA, 64 nt, Homo Sapiens
cauugauccuccuccucagcccucccaauccccacagacacacacuuccagcagaguccugccu

SEQ ID NO: 196536 - RNA, 64 nt, Homo Sapiens
cauauauacauacgcaauugcacagacacacaagcagacacacaaguuuuuauaccuguacaca

SEQ ID NO: 196537 - RNA, 64 nt, Homo Sapiens
agcagacacacacauauauauaccuguacacacacagacacacacucugccugucaaguuuuua

SEQ ID NO: 196538 - RNA, 64 nt, Homo Sapiens
uuauguuccugcuguauuucaaauaucgcugaugcagacacagaauuucuggcugggucaccag

SEQ ID NO: 196539 - RNA, 64 nt, Homo Sapiens
agcguggcuuagauugugcccaccaauaauggggcagacacaacuacaaauacugcagaaauga

SEQ ID NO: 196540 - RNA, 64 nt, Homo Sapiens
guuggcuucuuuggaccugcacuggaggauuucucagacacaugcaccagauucuggcucgaag

SEQ ID NO: 196541 - RNA, 64 nt, Homo Sapiens
accaaguaauuacuggugucauuuuguuuuaugacagacacacguaucuaacaaacaaacaaac

SEQ ID NO: 196542 - RNA, 64 nt, Homo Sapiens
gcggccaggcacccauguggagagacaagaaaggcagacacaccuccuucagucuucuagaaac

SEQ ID NO: 196543 - RNA, 64 nt, Homo Sapiens
ggcuugugacauucgugaaagccggacagcugcccagacacauguaccacagacuugcacugaa

SEQ ID NO: 196544 - RNA, 64 nt, Homo Sapiens
gggccugacugaggcccacgcaggaaccgacacucagacacaaggcaaagagggccacaggacc

SEQ ID NO: 196545 - RNA, 64 nt, Homo Sapiens
aaauacacacagagccaggagcagaagcaaagagcagacacacauacagccugaaacagaccug

SEQ ID NO: 196546 - RNA, 64 nt, Homo Sapiens
gacacacauacagccugaaacagaccuggacagacagacacagccugaaacagacccggacaga

SEQ ID NO: 196547 - RNA, 64 nt, Homo Sapiens
cagacagacacagccugaaacagacccggacagacagacacagccugaaacagacccagacaaa

SEQ ID NO: 196548 - RNA, 64 nt, Homo Sapiens
cacagccugaaacagacccagacaaacagacagacagacacagccugaaacagacccagacaga

SEQ ID NO: 196549 - RNA, 64 nt, Homo Sapiens
cccagacagacagacagacagccugaaacagacccagacacagccugaaacagauccggacaga

SEQ ID NO: 196550 - RNA, 64 nt, Homo Sapiens
cagaaacagccugaaacagacccagacagacagacagacacagccugaaacagacccggacaga

SEQ ID NO: 196551 - RNA, 64 nt, Homo Sapiens
cagacacagccugaaacagacccggacagacagacagacacagccugaaacagacccggacaga

SEQ ID NO: 196552 - RNA, 64 nt, Homo Sapiens; identical to SEQ ID NO: 196551

SEQ ID NO: 196553 - RNA, 64 nt, Homo Sapiens
cagacacagccugaaacagacccggacagacagacagacacagccugaaacagaccuagacaga

SEQ ID NO: 196554 - RNA, 64 nt, Homo Sapiens
cagacagacacagccugaaacagaccuagacagacagacacagauugaaacagacccagacaaa

SEQ ID NO: 196555 - RNA, 64 nt, Homo Sapiens
cagacacagauugaaacagacccagacaaacagacagacacagccugaaacagacccagacaca

SEQ ID NO: 196556 - RNA, 64 nt, Homo Sapiens
cagacaaacagacagacacagccugaaacagacccagacacagccugaaacagacccggacaga

SEQ ID NO: 196557 - RNA, 64 nt, Homo Sapiens
cagacacagccugaaacagacccggacagacagacagacacagccugaaacagacccagacaga

SEQ ID NO: 196558 - RNA, 64 nt, Homo Sapiens
cagacacagccugaaacagacccagacagacagacagacacagccugaaacagacccagacaga

SEQ ID NO: 196559 - RNA, 64 nt, Homo Sapiens
cgcagccugaaagagacccagacagagagacaggcagacacagccuaaaacagaccuggacaga

SEQ ID NO: 196560 - RNA, 64 nt, Homo Sapiens
ccucugaagacgaugggcagaggagugacagccgcagacacacgacagccggcagcaacuggaa

SEQ ID NO: 196561 - RNA, 64 nt, Homo Sapiens
cgcacacagcccacacagacaacacgcacccacacagacacagagggaagggguugggaugggg

SEQ ID NO: 196562 - RNA, 64 nt, Homo Sapiens
accacacacacacacacacacacacacacacacacagacacacagacacauacgcacacacgug

SEQ ID NO: 196563 - RNA, 64 nt, Homo Sapiens
cacacacacacacacacacacacacacagacacacagacacauacgcacacacgugcacacaug

SEQ ID NO: 196564 - RNA, 64 nt, Homo Sapiens
aaaugucacaauccuguccccuggaaaagucacacagacacacaucgcacagauuacuucaggg

SEQ ID NO: 196565 - RNA, 64 nt, Homo Sapiens
ccccagucgagcccugcagcccccaccuccgccccagacacaccgccccgguccuggccccagc

SEQ ID NO: 196566 - RNA, 64 nt, Homo Sapiens
aaguaccaguauaagcaucugacacacacacacacagacacacccacacaaacacacacacaca

SEQ ID NO: 196567 - RNA, 64 nt, Homo Sapiens
cacacacagacacaccaagucaaacacacacacacagacacacagcauuuacacaccagacaca

SEQ ID NO: 196568 - RNA, 64 nt, Homo Sapiens
aacacacacacacagacacacugcauuuacacaccagacacacauuaauuuccgauuuuccccu

SEQ ID NO: 196569 - RNA, 64 nt, Homo Sapiens
gaccaggaaaaaaccuaugaucccugugagcuagcagacacaauggucaccuauacaguguguu

SEQ ID NO: 196570 - RNA, 64 nt, Homo Sapiens
augaguagucauccugucucgugggaaacaccugcagacacaaaugggugagccuuggagacau

SEQ ID NO: 196571 - RNA, 64 nt, Homo Sapiens
gcaggaggacacguggagaccagaagaggagacacagacacagaacagguguccuuccaagaga

SEQ ID NO: 196572 - RNA, 64 nt, Homo Sapiens
gcaggaggccacauaaagaccggaagaggagacacagacacaaauccagugucccuaugagaga

SEQ ID NO: 196573 - RNA, 64 nt, Homo Sapiens
uauuuacugucugguuuuugaugguaaagccuacaaagccuaauaaugaguaguugcaauagag

SEQ ID NO: 196574 - RNA, 64 nt, Homo Sapiens
aagccuaauuauuuacugucgcaauagagaugguaaagccuacacugcuuugaaaugaguaguu

SEQ ID NO: 196575 - RNA, 64 nt, Homo Sapiens
uugaccaauaaauaaaaauaccacuuucuuuaaaaaagccuagggaauugaagcucuguacaua

SEQ ID NO: 196576 - RNA, 64 nt, Homo Sapiens
acucugacaaaggcuuuuccuuauagaauaacccaaagccuaggugaggguugauauauaaugu

SEQ ID NO: 196577 - RNA, 64 nt, Homo Sapiens; identical to SEQ ID NO: 161670

SEQ ID NO: 196578 - RNA, 64 nt, Homo Sapiens; identical to SEQ ID NO: 161671

SEQ ID NO: 196579 - RNA, 64 nt, Homo Sapiens; identical to SEQ ID NO: 161672

SEQ ID NO: 196580 - RNA, 64 nt, Homo Sapiens; identical to SEQ ID NO: 161673

SEQ ID NO: 196581 - RNA, 64 nt, Homo Sapiens; identical to SEQ ID NO: 161674

SEQ ID NO: 196582 - RNA, 64 nt, Homo Sapiens; identical to SEQ ID NO: 161675

SEQ ID NO: 196583 - RNA, 64 nt, Homo Sapiens; identical to SEQ ID NO: 161676

SEQ ID NO: 196584 - RNA, 64 nt, Homo Sapiens; identical to SEQ ID NO: 161677

SEQ ID NO: 196585 - RNA, 64 nt, Homo Sapiens; identical to SEQ ID NO: 161678

SEQ ID NO: 196586 - RNA, 64 nt, Homo Sapiens; identical to SEQ ID NO: 161679

SEQ ID NO: 196587 - RNA, 64 nt, Homo Sapiens; identical to SEQ ID NO: 161680

SEQ ID NO: 196588 - RNA, 64 nt, Homo Sapiens; identical to SEQ ID NO: 161681

SEQ ID NO: 196589 - RNA, 64 nt, Homo Sapiens; identical to SEQ ID NO: 161682

SEQ ID NO: 196590 - RNA, 64 nt, Homo Sapiens; identical to SEQ ID NO: 161683

SEQ ID NO: 196591 - RNA, 64 nt, Homo Sapiens; identical to SEQ ID NO: 161684

SEQ ID NO: 196592 - RNA, 64 nt, Homo Sapiens; identical to SEQ ID NO: 161685

SEQ ID NO: 196593 - RNA, 64 nt, Homo Sapiens; identical to SEQ ID NO: 161686

SEQ ID NO: 196594 - RNA, 64 nt, Homo Sapiens; identical to SEQ ID NO: 161687

SEQ ID NO: 196595 - RNA, 64 nt, Homo Sapiens; identical to SEQ ID NO: 161688

SEQ ID NO: 196596 - RNA, 64 nt, Homo Sapiens; identical to SEQ ID NO: 161689

SEQ ID NO: 196597 - RNA, 64 nt, Homo Sapiens; identical to SEQ ID NO: 161690

SEQ ID NO: 196598 - RNA, 64 nt, Homo Sapiens; identical to SEQ ID NO: 161691

SEQ ID NO: 196599 - RNA, 64 nt, Homo Sapiens; identical to SEQ ID NO: 161692

SEQ ID NO: 196600 - RNA, 64 nt, Homo Sapiens; identical to SEQ ID NO: 161693

SEQ ID NO: 196601 - RNA, 64 nt, Homo Sapiens; identical to SEQ ID NO: 161694

SEQ ID NO: 196602 - RNA, 64 nt, Homo Sapiens; identical to SEQ ID NO: 161695

SEQ ID NO: 196603 - RNA, 64 nt, Homo Sapiens; identical to SEQ ID NO: 161696

SEQ ID NO: 196604 - RNA, 64 nt, Homo Sapiens; identical to SEQ ID NO: 161697

SEQ ID NO: 196605 - RNA, 64 nt, Homo Sapiens; identical to SEQ ID NO: 161698

SEQ ID NO: 196606 - RNA, 64 nt, Homo Sapiens; identical to SEQ ID NO: 161699

SEQ ID NO: 196607 - RNA, 64 nt, Homo Sapiens; identical to SEQ ID NO: 161700

SEQ ID NO: 196608 - RNA, 64 nt, Homo Sapiens; identical to SEQ ID NO: 161701

SEQ ID NO: 196609 - RNA, 64 nt, Homo Sapiens; identical to SEQ ID NO: 161702

SEQ ID NO: 196610 - RNA, 64 nt, Homo Sapiens; identical to SEQ ID NO: 161703

SEQ ID NO: 196611 - RNA, 64 nt, Homo Sapiens; identical to SEQ ID NO: 161704

SEQ ID NO: 196612 - RNA, 64 nt, Homo Sapiens; identical to SEQ ID NO: 161705

SEQ ID NO: 196613 - RNA, 64 nt, Homo Sapiens; identical to SEQ ID NO: 161706

SEQ ID NO: 196614 - RNA, 64 nt, Homo Sapiens; identical to SEQ ID NO: 161707

SEQ ID NO: 196615 - RNA, 64 nt, Homo Sapiens; identical to SEQ ID NO: 161708

SEQ ID NO: 196616 - RNA, 64 nt, Homo Sapiens; identical to SEQ ID NO: 161709

SEQ ID NO: 196617 - RNA, 64 nt, Homo Sapiens; identical to SEQ ID NO: 87177

SEQ ID NO: 196618 - RNA, 64 nt, Homo Sapiens; identical to SEQ ID NO: 87178

SEQ ID NO: 196619 - RNA, 64 nt, Homo Sapiens; identical to SEQ ID NO: 87179

SEQ ID NO: 196620 - RNA, 64 nt, Homo Sapiens; identical to SEQ ID NO: 87180

SEQ ID NO: 196621 - RNA, 64 nt, Homo Sapiens; identical to SEQ ID NO: 87181

SEQ ID NO: 196622 - RNA, 64 nt, Homo Sapiens; identical to SEQ ID NO: 87182

SEQ ID NO: 196623 - RNA, 64 nt, Homo Sapiens; identical to SEQ ID NO: 87183

SEQ ID NO: 196624 - RNA, 64 nt, Homo Sapiens; identical to SEQ ID NO: 87184

SEQ ID NO: 196625 - RNA, 64 nt, Homo Sapiens; identical to SEQ ID NO: 87185

SEQ ID NO: 196626 - RNA, 64 nt, Homo Sapiens; identical to SEQ ID NO: 87186

SEQ ID NO: 196627 - RNA, 64 nt, Homo Sapiens; identical to SEQ ID NO: 87187

SEQ ID NO: 196628 - RNA, 64 nt, Homo Sapiens; identical to SEQ ID NO: 87188

SEQ ID NO: 196629 - RNA, 64 nt, Homo Sapiens; identical to SEQ ID NO: 87189

SEQ ID NO: 196630 - RNA, 64 nt, Homo Sapiens; identical to SEQ ID NO: 87190

SEQ ID NO: 196631 - RNA, 64 nt, Homo Sapiens; identical to SEQ ID NO: 87191

SEQ ID NO: 196632 - RNA, 64 nt, Homo Sapiens; identical to SEQ ID NO: 87192

SEQ ID NO: 196633 - RNA, 64 nt, Homo Sapiens; identical to SEQ ID NO: 87193

SEQ ID NO: 196634 - RNA, 64 nt, Homo Sapiens; identical to SEQ ID NO: 87194

SEQ ID NO: 196635 - RNA, 64 nt, Homo Sapiens; identical to SEQ ID NO: 87195

SEQ ID NO: 196636 - RNA, 64 nt, Homo Sapiens; identical to SEQ ID NO: 87196

SEQ ID NO: 196637 - RNA, 64 nt, Homo Sapiens; identical to SEQ ID NO: 87197

SEQ ID NO: 196638 - RNA, 64 nt, Homo Sapiens; identical to SEQ ID NO: 87198

SEQ ID NO: 196639 - RNA, 64 nt, Homo Sapiens; identical to SEQ ID NO: 87199

SEQ ID NO: 196640 - RNA, 64 nt, Homo Sapiens; identical to SEQ ID NO: 87200

SEQ ID NO: 196641 - RNA, 64 nt, Homo Sapiens; identical to SEQ ID NO: 87201

SEQ ID NO: 196642 - RNA, 64 nt, Homo Sapiens; identical to SEQ ID NO: 87202

SEQ ID NO: 196643 - RNA, 64 nt, Homo Sapiens; identical to SEQ ID NO: 87203

SEQ ID NO: 196644 - RNA, 64 nt, Homo Sapiens; identical to SEQ ID NO: 87204

SEQ ID NO: 196645 - RNA, 64 nt, Homo Sapiens; identical to SEQ ID NO: 87205

SEQ ID NO: 196646 - RNA, 64 nt, Homo Sapiens; identical to SEQ ID NO: 87206

SEQ ID NO: 196647 - RNA, 64 nt, Homo Sapiens; identical to SEQ ID NO: 87207

SEQ ID NO: 196648 - RNA, 64 nt, Homo Sapiens; identical to SEQ ID NO: 87208

SEQ ID NO: 196649 - RNA, 64 nt, Homo Sapiens; identical to SEQ ID NO: 87209

SEQ ID NO: 196650 - RNA, 64 nt, Homo Sapiens; identical to SEQ ID NO: 87210

SEQ ID NO: 196651 - RNA, 64 nt, Homo Sapiens; identical to SEQ ID NO: 87211

SEQ ID NO: 196652 - RNA, 64 nt, Homo Sapiens; identical to SEQ ID NO: 87212

SEQ ID NO: 196653 - RNA, 64 nt, Homo Sapiens; identical to SEQ ID NO: 87213

SEQ ID NO: 196654 - RNA, 64 nt, Homo Sapiens; identical to SEQ ID NO: 87214

SEQ ID NO: 196655 - RNA, 64 nt, Homo Sapiens; identical to SEQ ID NO: 87215

SEQ ID NO: 196656 - RNA, 64 nt, Homo Sapiens; identical to SEQ ID NO: 87216

SEQ ID NO: 196657 - RNA, 64 nt, Homo Sapiens; identical to SEQ ID NO: 87217

SEQ ID NO: 196658 - RNA, 64 nt, Homo Sapiens; identical to SEQ ID NO: 87218

SEQ ID NO: 196659 - RNA, 64 nt, Homo Sapiens; identical to SEQ ID NO: 87219

SEQ ID NO: 196660 - RNA, 64 nt, Homo Sapiens; identical to SEQ ID NO: 87220

SEQ ID NO: 196661 - RNA, 64 nt, Homo Sapiens; identical to SEQ ID NO: 87221

SEQ ID NO: 196662 - RNA, 64 nt, Homo Sapiens; identical to SEQ ID NO: 87222

SEQ ID NO: 196663 - RNA, 64 nt, Homo Sapiens; identical to SEQ ID NO: 87223

SEQ ID NO: 196664 - RNA, 64 nt, Homo Sapiens; identical to SEQ ID NO: 87224

SEQ ID NO: 196665 - RNA, 64 nt, Homo Sapiens; identical to SEQ ID NO: 87225

SEQ ID NO: 196666 - RNA, 64 nt, Homo Sapiens; identical to SEQ ID NO: 87226

SEQ ID NO: 196667 - RNA, 64 nt, Homo Sapiens; identical to SEQ ID NO: 87227

SEQ ID NO: 196668 - RNA, 64 nt, Homo Sapiens; identical to SEQ ID NO: 87228

SEQ ID NO: 196669 - RNA, 64 nt, Homo Sapiens; identical to SEQ ID NO: 87229

SEQ ID NO: 196670 - RNA, 64 nt, Homo Sapiens; identical to SEQ ID NO: 87230

SEQ ID NO: 196671 - RNA, 64 nt, Homo Sapiens; identical to SEQ ID NO: 87231

SEQ ID NO: 196672 - RNA, 64 nt, Homo Sapiens; identical to SEQ ID NO: 87232

SEQ ID NO: 196673 - RNA, 64 nt, Homo Sapiens; identical to SEQ ID NO: 87233

SEQ ID NO: 196674 - RNA, 64 nt, Homo Sapiens; identical to SEQ ID NO: 87234

SEQ ID NO: 196675 - RNA, 64 nt, Homo Sapiens; identical to SEQ ID NO: 87235

SEQ ID NO: 196676 - RNA, 64 nt, Homo Sapiens; identical to SEQ ID NO: 87236

SEQ ID NO: 196677 - RNA, 64 nt, Homo Sapiens; identical to SEQ ID NO: 87237

SEQ ID NO: 196678 - RNA, 64 nt, Homo Sapiens; identical to SEQ ID NO: 87238

SEQ ID NO: 196679 - RNA, 62 nt, Homo Sapiens; identical to SEQ ID NO: 87239

SEQ ID NO: 196680 - RNA, 64 nt, Homo Sapiens; identical to SEQ ID NO: 87240

SEQ ID NO: 196681 - RNA, 64 nt, Homo Sapiens; identical to SEQ ID NO: 87241

SEQ ID NO: 196682 - RNA, 64 nt, Homo Sapiens; identical to SEQ ID NO: 87242

SEQ ID NO: 196683 - RNA, 64 nt, Homo Sapiens; identical to SEQ ID NO: 87243

SEQ ID NO: 196684 - RNA, 64 nt, Homo Sapiens; identical to SEQ ID NO: 87244

SEQ ID NO: 196685 - RNA, 64 nt, Homo Sapiens; identical to SEQ ID NO: 87245

SEQ ID NO: 196686 - RNA, 64 nt, Homo Sapiens; identical to SEQ ID NO: 87246

SEQ ID NO: 196687 - RNA, 64 nt, Homo Sapiens; identical to SEQ ID NO: 87247

SEQ ID NO: 196688 - RNA, 64 nt, Homo Sapiens; identical to SEQ ID NO: 87248

SEQ ID NO: 196689 - RNA, 64 nt, Homo Sapiens; identical to SEQ ID NO: 87249

SEQ ID NO: 196690 - RNA, 64 nt, Homo Sapiens; identical to SEQ ID NO: 87250

SEQ ID NO: 196691 - RNA, 64 nt, Homo Sapiens; identical to SEQ ID NO: 87251

SEQ ID NO: 196692 - RNA, 64 nt, Homo Sapiens; identical to SEQ ID NO: 87252

SEQ ID NO: 196693 - RNA, 64 nt, Homo Sapiens; identical to SEQ ID NO: 87253

SEQ ID NO: 196694 - RNA, 64 nt, Homo Sapiens; identical to SEQ ID NO: 87254

SEQ ID NO: 196695 - RNA, 64 nt, Homo Sapiens; identical to SEQ ID NO: 87255

SEQ ID NO: 196696 - RNA, 64 nt, Homo Sapiens; identical to SEQ ID NO: 87256

SEQ ID NO: 196697 - RNA, 64 nt, Homo Sapiens; identical to SEQ ID NO: 87257

SEQ ID NO: 196698 - RNA, 64 nt, Homo Sapiens; identical to SEQ ID NO: 87258

SEQ ID NO: 196699 - RNA, 64 nt, Homo Sapiens; identical to SEQ ID NO: 87259

SEQ ID NO: 196700 - RNA, 64 nt, Homo Sapiens; identical to SEQ ID NO: 87260

SEQ ID NO: 196701 - RNA, 64 nt, Homo Sapiens; identical to SEQ ID NO: 87261

SEQ ID NO: 196702 - RNA, 64 nt, Homo Sapiens; identical to SEQ ID NO: 87262

SEQ ID NO: 196703 - RNA, 64 nt, Homo Sapiens; identical to SEQ ID NO: 87263

SEQ ID NO: 196704 - RNA, 64 nt, Homo Sapiens; identical to SEQ ID NO: 87264

SEQ ID NO: 196705 - RNA, 64 nt, Homo Sapiens; identical to SEQ ID NO: 87265

SEQ ID NO: 196706 - RNA, 64 nt, Homo Sapiens; identical to SEQ ID NO: 87266

SEQ ID NO: 196707 - RNA, 64 nt, Homo Sapiens; identical to SEQ ID NO: 87267

SEQ ID NO: 196708 - RNA, 64 nt, Homo Sapiens; identical to SEQ ID NO: 87268

SEQ ID NO: 196709 - RNA, 64 nt, Homo Sapiens; identical to SEQ ID NO: 87269

SEQ ID NO: 196710 - RNA, 64 nt, Homo Sapiens; identical to SEQ ID NO: 87270

SEQ ID NO: 196711 - RNA, 64 nt, Homo Sapiens; identical to SEQ ID NO: 87271

SEQ ID NO: 196712 - RNA, 64 nt, Homo Sapiens; identical to SEQ ID NO: 87272

SEQ ID NO: 196713 - RNA, 64 nt, Homo Sapiens; identical to SEQ ID NO: 87273

SEQ ID NO: 196714 - RNA, 64 nt, Homo Sapiens; identical to SEQ ID NO: 87274

SEQ ID NO: 196715 - RNA, 64 nt, Homo Sapiens; identical to SEQ ID NO: 87275

SEQ ID NO: 196716 - RNA, 64 nt, Homo Sapiens; identical to SEQ ID NO: 87276

SEQ ID NO: 196717 - RNA, 64 nt, Homo Sapiens; identical to SEQ ID NO: 87277

SEQ ID NO: 196718 - RNA, 64 nt, Homo Sapiens; identical to SEQ ID NO: 87278

SEQ ID NO: 196719 - RNA, 64 nt, Homo Sapiens; identical to SEQ ID NO: 87279

SEQ ID NO: 196720 - RNA, 64 nt, Homo Sapiens; identical to SEQ ID NO: 87280

SEQ ID NO: 196721 - RNA, 64 nt, Homo Sapiens; identical to SEQ ID NO: 87281

SEQ ID NO: 196722 - RNA, 64 nt, Homo Sapiens; identical to SEQ ID NO: 87282

SEQ ID NO: 196723 - RNA, 64 nt, Homo Sapiens; identical to SEQ ID NO: 87283

SEQ ID NO: 196724 - RNA, 64 nt, Homo Sapiens; identical to SEQ ID NO: 87284

SEQ ID NO: 196725 - RNA, 64 nt, Homo Sapiens; identical to SEQ ID NO: 87285

SEQ ID NO: 196726 - RNA, 64 nt, Homo Sapiens; identical to SEQ ID NO: 87286

SEQ ID NO: 196727 - RNA, 64 nt, Homo Sapiens; identical to SEQ ID NO: 87287

SEQ ID NO: 196728 - RNA, 64 nt, Homo Sapiens; identical to SEQ ID NO: 87288

SEQ ID NO: 196729 - RNA, 64 nt, Homo Sapiens; identical to SEQ ID NO: 87289

SEQ ID NO: 196730 - RNA, 64 nt, Homo Sapiens; identical to SEQ ID NO: 87290

SEQ ID NO: 196731 - RNA, 64 nt, Homo Sapiens; identical to SEQ ID NO: 87291

SEQ ID NO: 196732 - RNA, 64 nt, Homo Sapiens; identical to SEQ ID NO: 87292

SEQ ID NO: 196733 - RNA, 64 nt, Homo Sapiens; identical to SEQ ID NO: 87293

SEQ ID NO: 196734 - RNA, 64 nt, Homo Sapiens; identical to SEQ ID NO: 87294

SEQ ID NO: 196735 - RNA, 64 nt, Homo Sapiens; identical to SEQ ID NO: 87295

SEQ ID NO: 196736 - RNA, 64 nt, Homo Sapiens; identical to SEQ ID NO: 87296

SEQ ID NO: 196737 - RNA, 64 nt, Homo Sapiens; identical to SEQ ID NO: 87297

SEQ ID NO: 196738 - RNA, 64 nt, Homo Sapiens; identical to SEQ ID NO: 87298

SEQ ID NO: 196739 - RNA, 64 nt, Homo Sapiens; identical to SEQ ID NO: 87299

SEQ ID NO: 196740 - RNA, 64 nt, Homo Sapiens; identical to SEQ ID NO: 87300

SEQ ID NO: 196741 - RNA, 64 nt, Homo Sapiens; identical to SEQ ID NO: 87301

SEQ ID NO: 196742 - RNA, 64 nt, Homo Sapiens; identical to SEQ ID NO: 87302

SEQ ID NO: 196743 - RNA, 64 nt, Homo Sapiens; identical to SEQ ID NO: 87303

SEQ ID NO: 196744 - RNA, 64 nt, Homo Sapiens; identical to SEQ ID NO: 87304

SEQ ID NO: 196745 - RNA, 64 nt, Homo Sapiens; identical to SEQ ID NO: 87305

SEQ ID NO: 196746 - RNA, 64 nt, Homo Sapiens; identical to SEQ ID NO: 87306

SEQ ID NO: 196747 - RNA, 64 nt, Homo Sapiens; identical to SEQ ID NO: 87307

SEQ ID NO: 196748 - RNA, 64 nt, Homo Sapiens; identical to SEQ ID NO: 87308

SEQ ID NO: 196749 - RNA, 64 nt, Homo Sapiens; identical to SEQ ID NO: 87309

SEQ ID NO: 196750 - RNA, 64 nt, Homo Sapiens; identical to SEQ ID NO: 87310

SEQ ID NO: 196751 - RNA, 64 nt, Homo Sapiens; identical to SEQ ID NO: 87311

SEQ ID NO: 196752 - RNA, 64 nt, Homo Sapiens; identical to SEQ ID NO: 87312

SEQ ID NO: 196753 - RNA, 64 nt, Homo Sapiens; identical to SEQ ID NO: 87313

SEQ ID NO: 196754 - RNA, 64 nt, Homo Sapiens; identical to SEQ ID NO: 87314

SEQ ID NO: 196755 - RNA, 64 nt, Homo Sapiens; identical to SEQ ID NO: 87315

SEQ ID NO: 196756 - RNA, 64 nt, Homo Sapiens; identical to SEQ ID NO: 87316

SEQ ID NO: 196757 - RNA, 64 nt, Homo Sapiens; identical to SEQ ID NO: 87317

SEQ ID NO: 196758 - RNA, 64 nt, Homo Sapiens; identical to SEQ ID NO: 87318

SEQ ID NO: 196759 - RNA, 64 nt, Homo Sapiens; identical to SEQ ID NO: 87319

SEQ ID NO: 196760 - RNA, 64 nt, Homo Sapiens; identical to SEQ ID NO: 87320

SEQ ID NO: 196761 - RNA, 64 nt, Homo Sapiens; identical to SEQ ID NO: 87321

SEQ ID NO: 196762 - RNA, 64 nt, Homo Sapiens; identical to SEQ ID NO: 87322

SEQ ID NO: 196763 - RNA, 64 nt, Homo Sapiens; identical to SEQ ID NO: 87323

SEQ ID NO: 196764 - RNA, 64 nt, Homo Sapiens; identical to SEQ ID NO: 87324

SEQ ID NO: 196765 - RNA, 64 nt, Homo Sapiens; identical to SEQ ID NO: 87325

SEQ ID NO: 196766 - RNA, 64 nt, Homo Sapiens; identical to SEQ ID NO: 87326

SEQ ID NO: 196767 - RNA, 64 nt, Homo Sapiens; identical to SEQ ID NO: 87327

SEQ ID NO: 196768 - RNA, 64 nt, Homo Sapiens; identical to SEQ ID NO: 87328

SEQ ID NO: 196769 - RNA, 64 nt, Homo Sapiens; identical to SEQ ID NO: 87329

SEQ ID NO: 196770 - RNA, 64 nt, Homo Sapiens; identical to SEQ ID NO: 87330

SEQ ID NO: 196771 - RNA, 64 nt, Homo Sapiens; identical to SEQ ID NO: 87331

SEQ ID NO: 196772 - RNA, 64 nt, Homo Sapiens; identical to SEQ ID NO: 87332

SEQ ID NO: 196773 - RNA, 64 nt, Homo Sapiens; identical to SEQ ID NO: 87333

SEQ ID NO: 196774 - RNA, 64 nt, Homo Sapiens; identical to SEQ ID NO: 87334

SEQ ID NO: 196775 - RNA, 64 nt, Homo Sapiens; identical to SEQ ID NO: 87335

SEQ ID NO: 196776 - RNA, 64 nt, Homo Sapiens; identical to SEQ ID NO: 87336

SEQ ID NO: 196777 - RNA, 64 nt, Homo Sapiens; identical to SEQ ID NO: 87337

SEQ ID NO: 196778 - RNA, 64 nt, Homo Sapiens; identical to SEQ ID NO: 87338

SEQ ID NO: 196779 - RNA, 64 nt, Homo Sapiens; identical to SEQ ID NO: 128854

SEQ ID NO: 196780 - RNA, 64 nt, Homo Sapiens; identical to SEQ ID NO: 128855

SEQ ID NO: 196781 - RNA, 64 nt, Homo Sapiens; identical to SEQ ID NO: 128856

SEQ ID NO: 196782 - RNA, 64 nt, Homo Sapiens; identical to SEQ ID NO: 128857

SEQ ID NO: 196783 - RNA, 64 nt, Homo Sapiens; identical to SEQ ID NO: 128858

SEQ ID NO: 196784 - RNA, 64 nt, Homo Sapiens; identical to SEQ ID NO: 128859

SEQ ID NO: 196785 - RNA, 64 nt, Homo Sapiens; identical to SEQ ID NO: 128860

SEQ ID NO: 196786 - RNA, 64 nt, Homo Sapiens; identical to SEQ ID NO: 128861

SEQ ID NO: 196787 - RNA, 64 nt, Homo Sapiens; identical to SEQ ID NO: 128862

SEQ ID NO: 196788 - RNA, 64 nt, Homo Sapiens; identical to SEQ ID NO: 128863

SEQ ID NO: 196789 - RNA, 64 nt, Homo Sapiens; identical to SEQ ID NO: 128864

SEQ ID NO: 196790 - RNA, 64 nt, Homo Sapiens; identical to SEQ ID NO: 128865

SEQ ID NO: 196791 - RNA, 64 nt, Homo Sapiens; identical to SEQ ID NO: 128866

SEQ ID NO: 196792 - RNA, 64 nt, Homo Sapiens; identical to SEQ ID NO: 128867

SEQ ID NO: 196793 - RNA, 64 nt, Homo Sapiens; identical to SEQ ID NO: 128868

SEQ ID NO: 196794 - RNA, 64 nt, Homo Sapiens; identical to SEQ ID NO: 128869

SEQ ID NO: 196795 - RNA, 64 nt, Homo Sapiens; identical to SEQ ID NO: 128870

SEQ ID NO: 196796 - RNA, 64 nt, Homo Sapiens; identical to SEQ ID NO: 128871

SEQ ID NO: 196797 - RNA, 64 nt, Homo Sapiens; identical to SEQ ID NO: 128872

SEQ ID NO: 196798 - RNA, 64 nt, Homo Sapiens; identical to SEQ ID NO: 128873

SEQ ID NO: 196799 - RNA, 64 nt, Homo Sapiens; identical to SEQ ID NO: 128874

SEQ ID NO: 196800 - RNA, 64 nt, Homo Sapiens; identical to SEQ ID NO: 128875

SEQ ID NO: 196801 - RNA, 64 nt, Homo Sapiens; identical to SEQ ID NO: 128876

SEQ ID NO: 196802 - RNA, 64 nt, Homo Sapiens; identical to SEQ ID NO: 128877

SEQ ID NO: 196803 - RNA, 64 nt, Homo Sapiens; identical to SEQ ID NO: 128878

SEQ ID NO: 196804 - RNA, 64 nt, Homo Sapiens; identical to SEQ ID NO: 128879

SEQ ID NO: 196805 - RNA, 64 nt, Homo Sapiens; identical to SEQ ID NO: 128880

SEQ ID NO: 196806 - RNA, 64 nt, Homo Sapiens; identical to SEQ ID NO: 128881

SEQ ID NO: 196807 - RNA, 64 nt, Homo Sapiens; identical to SEQ ID NO: 128882

SEQ ID NO: 196808 - RNA, 64 nt, Homo Sapiens; identical to SEQ ID NO: 128883

SEQ ID NO: 196809 - RNA, 64 nt, Homo Sapiens; identical to SEQ ID NO: 128884

SEQ ID NO: 196810 - RNA, 64 nt, Homo Sapiens; identical to SEQ ID NO: 128885

SEQ ID NO: 196811 - RNA, 64 nt, Homo Sapiens; identical to SEQ ID NO: 128886

SEQ ID NO: 196812 - RNA, 64 nt, Homo Sapiens; identical to SEQ ID NO: 104452

SEQ ID NO: 196813 - RNA, 64 nt, Homo Sapiens; identical to SEQ ID NO: 104453

SEQ ID NO: 196814 - RNA, 64 nt, Homo Sapiens; identical to SEQ ID NO: 104454

SEQ ID NO: 196815 - RNA, 64 nt, Homo Sapiens; identical to SEQ ID NO: 104455

SEQ ID NO: 196816 - RNA, 64 nt, Homo Sapiens; identical to SEQ ID NO: 104456

SEQ ID NO: 196817 - RNA, 64 nt, Homo Sapiens; identical to SEQ ID NO: 104457

SEQ ID NO: 196818 - RNA, 64 nt, Homo Sapiens; identical to SEQ ID NO: 104458

SEQ ID NO: 196819 - RNA, 64 nt, Homo Sapiens; identical to SEQ ID NO: 104459

SEQ ID NO: 196820 - RNA, 64 nt, Homo Sapiens; identical to SEQ ID NO: 104460

SEQ ID NO: 196821 - RNA, 64 nt, Homo Sapiens; identical to SEQ ID NO: 104461

SEQ ID NO: 196822 - RNA, 64 nt, Homo Sapiens; identical to SEQ ID NO: 104462

SEQ ID NO: 196823 - RNA, 64 nt, Homo Sapiens; identical to SEQ ID NO: 104463

SEQ ID NO: 196824 - RNA, 64 nt, Homo Sapiens; identical to SEQ ID NO: 104464

SEQ ID NO: 196825 - RNA, 64 nt, Homo Sapiens; identical to SEQ ID NO: 104465

SEQ ID NO: 196826 - RNA, 64 nt, Homo Sapiens; identical to SEQ ID NO: 104466

SEQ ID NO: 196827 - RNA, 64 nt, Homo Sapiens; identical to SEQ ID NO: 104467

SEQ ID NO: 196828 - RNA, 64 nt, Homo Sapiens; identical to SEQ ID NO: 104468

SEQ ID NO: 196829 - RNA, 64 nt, Homo Sapiens; identical to SEQ ID NO: 104469

SEQ ID NO: 196830 - RNA, 64 nt, Homo Sapiens; identical to SEQ ID NO: 104470

SEQ ID NO: 196831 - RNA, 64 nt, Homo Sapiens; identical to SEQ ID NO: 104471

SEQ ID NO: 196832 - RNA, 64 nt, Homo Sapiens; identical to SEQ ID NO: 104472

SEQ ID NO: 196833 - RNA, 64 nt, Homo Sapiens; identical to SEQ ID NO: 104473

SEQ ID NO: 196834 - RNA, 64 nt, Homo Sapiens; identical to SEQ ID NO: 104474

SEQ ID NO: 196835 - RNA, 64 nt, Homo Sapiens; identical to SEQ ID NO: 104475

SEQ ID NO: 196836 - RNA, 64 nt, Homo Sapiens; identical to SEQ ID NO: 104476

SEQ ID NO: 196837 - RNA, 64 nt, Homo Sapiens; identical to SEQ ID NO: 104477

SEQ ID NO: 196838 - RNA, 64 nt, Homo Sapiens; identical to SEQ ID NO: 104478

SEQ ID NO: 196839 - RNA, 64 nt, Homo Sapiens; identical to SEQ ID NO: 104479

SEQ ID NO: 196840 - RNA, 64 nt, Homo Sapiens; identical to SEQ ID NO: 104480

SEQ ID NO: 196841 - RNA, 64 nt, Homo Sapiens; identical to SEQ ID NO: 133463

SEQ ID NO: 196842 - RNA, 64 nt, Homo Sapiens; identical to SEQ ID NO: 133464

SEQ ID NO: 196843 - RNA, 64 nt, Homo Sapiens; identical to SEQ ID NO: 133465

SEQ ID NO: 196844 - RNA, 64 nt, Homo Sapiens; identical to SEQ ID NO: 133466

SEQ ID NO: 196845 - RNA, 64 nt, Homo Sapiens; identical to SEQ ID NO: 133467

SEQ ID NO: 196846 - RNA, 64 nt, Homo Sapiens; identical to SEQ ID NO: 133468

SEQ ID NO: 196847 - RNA, 64 nt, Homo Sapiens; identical to SEQ ID NO: 133469

SEQ ID NO: 196848 - RNA, 64 nt, Homo Sapiens; identical to SEQ ID NO: 133470

SEQ ID NO: 196849 - RNA, 64 nt, Homo Sapiens; identical to SEQ ID NO: 133471

SEQ ID NO: 196850 - RNA, 64 nt, Homo Sapiens; identical to SEQ ID NO: 133472

SEQ ID NO: 196851 - RNA, 64 nt, Homo Sapiens; identical to SEQ ID NO: 133473

SEQ ID NO: 196852 - RNA, 64 nt, Homo Sapiens; identical to SEQ ID NO: 133474

SEQ ID NO: 196853 - RNA, 64 nt, Homo Sapiens; identical to SEQ ID NO: 133475

SEQ ID NO: 196854 - RNA, 64 nt, Homo Sapiens; identical to SEQ ID NO: 133476

SEQ ID NO: 196855 - RNA, 64 nt, Homo Sapiens; identical to SEQ ID NO: 133477

SEQ ID NO: 196856 - RNA, 64 nt, Homo Sapiens; identical to SEQ ID NO: 133478

SEQ ID NO: 196857 - RNA, 64 nt, Homo Sapiens; identical to SEQ ID NO: 133479

SEQ ID NO: 196858 - RNA, 64 nt, Homo Sapiens; identical to SEQ ID NO: 133480

SEQ ID NO: 196859 - RNA, 64 nt, Homo Sapiens; identical to SEQ ID NO: 133481

SEQ ID NO: 196860 - RNA, 64 nt, Homo Sapiens; identical to SEQ ID NO: 133482

SEQ ID NO: 196861 - RNA, 64 nt, Homo Sapiens; identical to SEQ ID NO: 133483

SEQ ID NO: 196862 - RNA, 64 nt, Homo Sapiens; identical to SEQ ID NO: 133484

SEQ ID NO: 196863 - RNA, 64 nt, Homo Sapiens
uuaaauaaccaugcucaaaaugcuuugcccuguugguaaggauuguguauuucuccacagugcu

SEQ ID NO: 196864 - RNA, 64 nt, Homo Sapiens
aggaacucugaaaucagaugaacaaaaggccucagguaaggaugucauuccauuuaauuggggg

SEQ ID NO: 196865 - RNA, 64 nt, Homo Sapiens
ugaaaacuuuucaaacuuuucuaguuacaauccaauuuuucagauuugauaaugcuuuuccaaa

SEQ ID NO: 196866 - RNA, 64 nt, Homo Sapiens
cacacaggcauacuccaaaugcuucuuccaguucauuuuucagccaucaguucaagagccaaug

SEQ ID NO: 196867 - RNA, 64 nt, Homo Sapiens
agaguguauaaaauucugucuuucauuuccaaccauuuuucaagagaagcugcuacuaucuuga

SEQ ID NO: 196868 - RNA, 64 nt, Homo Sapiens
guuccugguaaaacucuguuuucauuaauuuguuauuuuucaaaaaccgagccacaccuuugga

SEQ ID NO: 196869 - RNA, 64 nt, Homo Sapiens
uggaaguccaauagggcaaaauuuguucuucaguauuuuucauuuguaguauuguuuaaacauc

SEQ ID NO: 196870 - RNA, 64 nt, Homo Sapiens
uuugccaguuauuuuuauuuuuuagaauggauuuauuuuucauuaaugcuauaugagaaacacu

SEQ ID NO: 196871 - RNA, 64 nt, Homo Sapiens
ugcuguuuuaugcuaauucugcuuauuuuagaguauuuuucauuaaaaggugagcaaagugaaa

SEQ ID NO: 196872 - RNA, 64 nt, Homo Sapiens
ucauguaacaaaauauuuuguagauuacauauugauuuuucaaaaauuaaaaauguauuucaaa

SEQ ID NO: 196873 - RNA, 64 nt, Homo Sapiens
ggccuuaaaauucuggauaauuuauuauuucauuauuuuucagauagaucucaaaaccacuauu

SEQ ID NO: 196874 - RNA, 64 nt, Homo Sapiens
auccuugagauuuagaacaucgaauaaaaaauguauuuuucagugguuuuauucuuuuauuuua

SEQ ID NO: 196875 - RNA, 64 nt, Homo Sapiens
auguguggcacggauacaauuuuuuaggaguguuauuuuucacuguggaaaagguagcauucuu

SEQ ID NO: 196876 - RNA, 64 nt, Homo Sapiens
uuuuuacuuuguaguuuauucucaauaaauaucuauuuuucauugaaaugguucuccuuucccu

SEQ ID NO: 196877 - RNA, 64 nt, Homo Sapiens
uaugauccuagauguucuccuaaaucggggcuugauuuuucauccauccuggagaagacaguuc

SEQ ID NO: 196878 - RNA, 64 nt, Homo Sapiens
auuugagcucaucaauuaugauuuggauucuuucauuuuucaggaccuagauaauucugaaaua

SEQ ID NO: 196879 - RNA, 64 nt, Homo Sapiens
auuuuuuuuucuccauaaaucccucauccuuuacauuuuucaacaugcuaucaaauuaucuuca

SEQ ID NO: 196880 - RNA, 64 nt, Homo Sapiens
cuaucaaauuaucuucacccaaagggaggcuaauauuuuucauguauacaaucuuuaaaauaag

SEQ ID NO: 196881 - RNA, 64 nt, Homo Sapiens
acuuuauucuacuguaagcaauaauuugcuugcaauuuuucauguaauuuuuaaauuaguaugu

SEQ ID NO: 196882 - RNA, 64 nt, Homo Sapiens
ggucauagaauauccuaaaguaucacauaguuaaauuuuucagucagugaagaccgggagggaa

SEQ ID NO: 196883 - RNA, 64 nt, Homo Sapiens
uuuauagacuuguuuuauuagauuuuaccaaugaauuuuucaaaauacaaaaaaaaguaguuuu

SEQ ID NO: 196884 - RNA, 64 nt, Homo Sapiens
auuaaggugaaaucauggaucagauauuccuuacauuuuucaaaacuacugcauguuuaaaacu

SEQ ID NO: 196885 - RNA, 64 nt, Homo Sapiens
aagauguguaaacucauuguccuugauaguuuuuauuuuucauuauaaaauuauaccaggagau

SEQ ID NO: 196886 - RNA, 64 nt, Homo Sapiens
uaaauaagguauuuuuccuuuucccucuuacuggauuuuucaauuuucaaaccauauggccuag

SEQ ID NO: 196887 - RNA, 64 nt, Homo Sapiens
gagugucuuuuuuauuucauucaugaacuuuuguauuuuucauuuuucauuugauuuguaaauu

SEQ ID NO: 196888 - RNA, 64 nt, Homo Sapiens
uuuuuuauuucauucaugaacuuuuguauuuuucauuuuucauuugauuuguaaauuuacuuau

SEQ ID NO: 196889 - RNA, 64 nt, Homo Sapiens
acugcgugaucgugcacuuuuaaaccuaacguguauuuuucaggauaaacuguuacacaaaaua

SEQ ID NO: 196890 - RNA, 64 nt, Homo Sapiens
ucaguuuuccauaaacuguuagucagaaaaaauaauuuuucauuucaagguauuuuauauuuuu

SEQ ID NO: 196891 - RNA, 64 nt, Homo Sapiens
aauucaacaaagguuuucacauuuuauaagguugauuuuucaauuaaaugcaaauuuguguggc

SEQ ID NO: 196892 - RNA, 64 nt, Homo Sapiens
uauaauguuuuaaaacauaaggcauuugucugccauuuuucaauuacaugcugacuucccuuac

SEQ ID NO: 196893 - RNA, 64 nt, Homo Sapiens
ugugagagauaagggcuaaugaacaacugucuccauuuuucaaggcuguuucccuuucuauucu

SEQ ID NO: 196894 - RNA, 64 nt, Homo Sapiens
cuauauucacaggcccauacagcauuucuuuuuuauuuuucaauuagcuaaguuuuuuuuuuuu

SEQ ID NO: 196895 - RNA, 64 nt, Homo Sapiens
aaucucaccuuaaaagugacaacuuugaaaggucauuuuucaauaaaaucacaggguuggaaag

SEQ ID NO: 196896 - RNA, 64 nt, Homo Sapiens
uauugcacuaccuuauaaugguuaauuggcaucgauuuuucagaauagaaaagaagugauagua

SEQ ID NO: 196897 - RNA, 64 nt, Homo Sapiens
cucuacugauaguggauaacaacauauucaaaauauuuuucagcacauuuauuuagagucugac

SEQ ID NO: 196898 - RNA, 64 nt, Homo Sapiens
cauuacccuccuuccgcccuguacccaauagguaauuuuucaucucaccugagugauguacauu

SEQ ID NO: 196899 - RNA, 64 nt, Homo Sapiens
uauacuaagaguaaagcaacaguccugacacugaauuuuucaagaucugaaaauaaaauauacu

SEQ ID NO: 196900 - RNA, 64 nt, Homo Sapiens
uuaaggucugcauagcagacacuccauugaacacauuuuucaacuaauuuucuaaaaccaugua

SEQ ID NO: 196901 - RNA, 64 nt, Homo Sapiens
cuguauagauuugggguaaauagacauauaaauuauuuuucaaaauucucaauuuucuuuaugc

SEQ ID NO: 196902 - RNA, 64 nt, Homo Sapiens
auuggaaaguguaacggggauuagaauuauaaacauuuuucauuucuuacauggguugcuguau

SEQ ID NO: 196903 - RNA, 64 nt, Homo Sapiens
guuuuaacuagauuuccaaguauguacagauuugauuuuucauaucucuuuuuuuuguaaauuu

SEQ ID NO: 196904 - RNA, 64 nt, Homo Sapiens
uagauucaaaauggaaaaccuauucauggcucagauuuuucauuguggguuaaaaauggguguc

SEQ ID NO: 196905 - RNA, 64 nt, Homo Sapiens
uguacugaugaaaguaccuauuuguguauauuggauuuuucacuugguuagcuaaagaagaugu

SEQ ID NO: 196906 - RNA, 64 nt, Homo Sapiens
gagaagagccugcaaauggcaugcguaaagauucauuuuucaagacugauuuuauaauuggaga

SEQ ID NO: 196907 - RNA, 64 nt, Homo Sapiens
guuucuaccugugugcuggacgagccgucaccugauuuuucagugauccacagccuggcagagc

SEQ ID NO: 196908 - RNA, 64 nt, Homo Sapiens
auaucaugaauaaaauauagauaauggaaaacagauuuuucaucaugaauuuaauuuuauaaau

SEQ ID NO: 196909 - RNA, 64 nt, Homo Sapiens
aaacugcaaguuuuugacuuagauuuuaaggaagauuuuucaagaauauuuaauucuaaauucc

SEQ ID NO: 196910 - RNA, 64 nt, Homo Sapiens
uaaaaggucaugcuguuacaauauuucauccuuuauuuuucagguauguaaauaaauaaaugua

SEQ ID NO: 196911 - RNA, 64 nt, Homo Sapiens
aaauuuaaaguaauauuucuaaauugguccuucuauuuuucaacugaaccuaggucagagcucu

SEQ ID NO: 196912 - RNA, 64 nt, Homo Sapiens
uuaucuuuuccccaacaucaagaaagccacuaccauuuuucaagaaaaagacauaaaaccuuag

SEQ ID NO: 196913 - RNA, 64 nt, Homo Sapiens
cagaaaagaaccacagguaugauaaggaugccacauuuuucaugacaugccauaguuaacaaau

SEQ ID NO: 196914 - RNA, 64 nt, Homo Sapiens
auuuuuaaccugauauucuuuuuaauuguuuuaaauuuuucauaggggaguuuuggacaaaaca

SEQ ID NO: 196915 - RNA, 64 nt, Homo Sapiens
cccccaacacuuucucuucuuagucucucucuuuauuuuucaaucucugaauauuuuagucucu

SEQ ID NO: 196916 - RNA, 64 nt, Homo Sapiens
cuugcucauauuucuggccaauguacagccucauauuuuucagaguaauacagauacuuguucu

SEQ ID NO: 196917 - RNA, 64 nt, Homo Sapiens
acauauucugaaaauggaguguuuguucccugccauuuuucacaccucucuuaauuuuaguucu

SEQ ID NO: 196918 - RNA, 64 nt, Homo Sapiens
uguggaaauauaccuaccucuauggcuguuccugauuuuucauaaggcuuuccuuguuuugauu

SEQ ID NO: 196919 - RNA, 64 nt, Homo Sapiens
uaucuuauagucacucauucgucuaaaggaugagauuuuucaugcccccuguucacauccaguu

SEQ ID NO: 196920 - RNA, 64 nt, Homo Sapiens
gucaagaacauuagccuagacaaggcuuaaauuuauuuuucaaagaucccugggauuacuuagc

SEQ ID NO: 196921 - RNA, 64 nt, Homo Sapiens
uucuuccccaccccaaccccggcaugcauucauaauuuuucauuaucuugugggaaaaaaaugg

SEQ ID NO: 196922 - RNA, 64 nt, Homo Sapiens
uuuuacacaugagggaccgaaggauagaaaaguuauuuuucaaaggucuugcaguuaauaaaug

SEQ ID NO: 196923 - RNA, 64 nt, Homo Sapiens
cuagagacauauaaucauacagauuauucauaaaauuuuucagugcuguccuuccacauuuaau

SEQ ID NO: 196924 - RNA, 64 nt, Homo Sapiens
cauauuuaaauaugaaucuauucaugcuaacauuauuuuucaaaacauacauggaaauuuagcc

SEQ ID NO: 196925 - RNA, 64 nt, Homo Sapiens
cacuugccuccucuuuuguccugauuuaaccagcauuuuucaacccugggaaaauuugcagaau

SEQ ID NO: 196926 - RNA, 64 nt, Homo Sapiens
agugccaauauucaaaacuuuuggauuaaaauguauuuuucaccgugcauuuacuuuggaugua

SEQ ID NO: 196927 - RNA, 64 nt, Homo Sapiens
uuuucuauaugcuuuccuuuuucuuuauaucaguauuuuucagaaauucuagaugacuuuaauu

SEQ ID NO: 196928 - RNA, 64 nt, Homo Sapiens
gugagacacuaaaaacuguuaagucacauuauuuauuuuucauuuuuaaguaugcaaaauguuu

SEQ ID NO: 196929 - RNA, 64 nt, Homo Sapiens
uccuauuuuuuuaaagaccaauagaugcaaccuuauuuuucaguuuauacaaagcacuuuaaug

SEQ ID NO: 196930 - RNA, 64 nt, Homo Sapiens
uguaaauguagguuuuuauggcauggaucauuacauuuuucacuaagcugcaguucauuuucau

SEQ ID NO: 196931 - RNA, 64 nt, Homo Sapiens
ggauaagaccugaguaacccgauucagagaacuaauuuuucacuugaaggagauguuuugcaaa

SEQ ID NO: 196932 - RNA, 64 nt, Homo Sapiens
auguaaacaaguuucccauuaaucucuuaauuauauuuuucaucgccauaagccauaaagaguc

SEQ ID NO: 196933 - RNA, 64 nt, Homo Sapiens
uuugauauuuuuuacgauaauuagcugcaugugaauuuuucaugaccuucuuuacauuuuuuau

SEQ ID NO: 196934 - RNA, 64 nt, Homo Sapiens
cuguuuacaauuuggggacaaaaaggcaggcuucauuuuucauauguuugaugaaaacuggcuc

SEQ ID NO: 196935 - RNA, 64 nt, Homo Sapiens
aauaauauaaaacacuuauuugagauuaaauuaaauuuuucaugagccccucuuuggcaggaac

SEQ ID NO: 196936 - RNA, 64 nt, Homo Sapiens
augaaaguuugcugguaucaacacagccugccauauuuuucacagcaugcaacaauggugcuag

SEQ ID NO: 196937 - RNA, 64 nt, Homo Sapiens
guauuguuccuuuaaagaauuuaaauuuuuuuuuauuuuucaaauugcaaguauguucaacgau

SEQ ID NO: 196938 - RNA, 64 nt, Homo Sapiens
ugugcuuuuuuaaaaaaaaaggaaagaauucuucauuuuucauugggaagccuuaaauugaucu

SEQ ID NO: 196939 - RNA, 64 nt, Homo Sapiens
ccagagcuguucacaugaaacacaguauaaauuaauuuuucaaauguacaaccuuaaggcucuu

SEQ ID NO: 196940 - RNA, 64 nt, Homo Sapiens
aguaauuucaauugguucauacaguuuugucuucauuuuucaacguuuauuucagaauaucaau

SEQ ID NO: 196941 - RNA, 64 nt, Homo Sapiens
gcaacauuaggaauguccugcacuuaauagaauuauuuuucaccgcuacaguuugaagaaugua

SEQ ID NO: 196942 - RNA, 64 nt, Homo Sapiens
caagacuuuuuugaccaaacaguagauauuuucuauuuuucaccagaacacauaaaaacacuuu

SEQ ID NO: 196943 - RNA, 64 nt, Homo Sapiens
uugagugacaucaagaaaagaugauaucagguucauuuuucaacuaaucuuauguggaauugaa

SEQ ID NO: 196944 - RNA, 64 nt, Homo Sapiens
cauucccaaauucuaaauagcugacccuaaauucauuuuucaugcuuaaaaauaauagaacaaa

SEQ ID NO: 196945 - RNA, 64 nt, Homo Sapiens
aaagcaucugagaucuaagagaccucaagauaacauuuuucauuucuccccauuugucaaaguu

SEQ ID NO: 196946 - RNA, 64 nt, Homo Sapiens
uagucugagaaauagcagauagcuauuuuauuaaauuuuucacuuguuuuccuccuaucaaggc

SEQ ID NO: 196947 - RNA, 64 nt, Homo Sapiens
ugugggguaguaaaauucauaacuuugcaacaucauuuuucauuuuuuucaacuucaccacagu

SEQ ID NO: 196948 - RNA, 64 nt, Homo Sapiens
uucaccacaguaacuuugcaaucauuuuagugauauuuuucaacaaaauuaauacuaaauuaua

SEQ ID NO: 196949 - RNA, 64 nt, Homo Sapiens
aucaaaguuaugguuuccucucuccucauuuaauauuuuucaaaacagaauuuauagaauaauu

SEQ ID NO: 196950 - RNA, 64 nt, Homo Sapiens
guuuucuaacccagucuuaucuuccauauggagcauuuuucagaaaauauaaaaacaacaaaua

SEQ ID NO: 196951 - RNA, 64 nt, Homo Sapiens
ucuucaaucacuagucaagaucugacagucucaaauuuuucaucauauuggauaccccauuaaa

SEQ ID NO: 196952 - RNA, 64 nt, Homo Sapiens
uucgcuuucuccucggcucacuuucucccuuuuuauuuuucaccaaaccauuuguagagcuaca

SEQ ID NO: 196953 - RNA, 64 nt, Homo Sapiens
uaaaucuaacccuaguuguaucccuccuuucaguauuuuucacuuguugccccaaaugugaaag

SEQ ID NO: 196954 - RNA, 64 nt, Homo Sapiens
augaaaugugcauucugaauguugcauauuuuaaauuuuucaugugcaguauggcucggaauau

SEQ ID NO: 196955 - RNA, 64 nt, Homo Sapiens
aaauuggaaagccaucuuauacaaaauuauucacauuuuucaucuacgauucaacuaaucgaag

SEQ ID NO: 196956 - RNA, 64 nt, Homo Sapiens
uuuuugcaagaauaagcaaagcccauggaauuuaauuuuucauugugaucagauuaaaauuacu

SEQ ID NO: 196957 - RNA, 64 nt, Homo Sapiens
uguguucagacagagccuaucuaucacuaucuacauuuuucauaagccagcccauauacagaaa

SEQ ID NO: 196958 - RNA, 64 nt, Homo Sapiens
acucauagauaaauaugaauauacucuauuaccaauuuuucagauuacugcaauugaaaaaauc

SEQ ID NO: 196959 - RNA, 64 nt, Homo Sapiens
auuuugaaaucaugaagauagaaaccaugaagagauuuuucaugaagauauuuuucaugauuuu

SEQ ID NO: 196960 - RNA, 64 nt, Homo Sapiens
auuuugaaaccaugaagagacaaaaucauaagauauuuuucauguaagaaauuuuugcccaucc

SEQ ID NO: 196961 - RNA, 64 nt, Homo Sapiens
cuuuaaagucugaaauacuacuaaucuucugcuuauuuuucagcgcaauguuauaaaaauauug

SEQ ID NO: 196962 - RNA, 64 nt, Homo Sapiens
aagcagaauugauccugugguuccucaggaauagauuuuucauacuucagaaguacgugaguug

SEQ ID NO: 196963 - RNA, 64 nt, Homo Sapiens
uuaauuuggcagcugagaauaccgcgcccggccuauuuuucacuugggauuacaggccugagcc

SEQ ID NO: 196964 - RNA, 64 nt, Homo Sapiens
uuuuuuuuuagacggaguuuuaagcuaaguuacuauuuuucaccggccaccagcagaucaucuu

SEQ ID NO: 196965 - RNA, 64 nt, Homo Sapiens
ucauucagcuaacaaacuagaaaagguuauguucauuuuucaaaaagggaaguaagcaaacaaa

SEQ ID NO: 196966 - RNA, 64 nt, Homo Sapiens
acacacuacuaccucuuaagucccaguauaccucauuuuucauacugaaaaaaaaagcuugugg

SEQ ID NO: 196967 - RNA, 64 nt, Homo Sapiens
ucuauguccuaacuaaauuucucaacuguuaugaauuuuucaucuacuucuugaacaguggucu

SEQ ID NO: 196968 - RNA, 64 nt, Homo Sapiens
auauaagcaaguaauaccuauuagucauaccuaaauuuuucagcacuucauucaauuaaaauac

SEQ ID NO: 196969 - RNA, 64 nt, Homo Sapiens
ccaauggcauuaagaugguguuuuuguucuacauauuuuucaauaauuuauucuuucuaauguu

SEQ ID NO: 196970 - RNA, 64 nt, Homo Sapiens
gaguuuggguucuaaauuuacugguugaacaugcauuuuucaugaagcccggcagaugugucuc

SEQ ID NO: 196971 - RNA, 64 nt, Homo Sapiens
aacuggauugucuuaagaaaaaaaaugcuuuucuauuuuucaguaauugcaaauaagggaaggg

SEQ ID NO: 196972 - RNA, 64 nt, Homo Sapiens
aaauuuacuucacauuauucuuccacuaaaauuuauuuuucaaagguguuauccuucaggauug

SEQ ID NO: 196973 - RNA, 64 nt, Homo Sapiens
cuguuuguuuuuuaaaaggcgccuacuuuaacccauuuuucaacaaggcagauaugcuguauuu

SEQ ID NO: 196974 - RNA, 64 nt, Homo Sapiens
agacaagaaaccuagauguuuggccacagcuuugauuuuucaagguggaaaagugggccuaggg

SEQ ID NO: 196975 - RNA, 64 nt, Homo Sapiens
aucuuuaaggacuucuuauaaugaguugcuucacauuuuucaucaccacuuacagcuuucucac

SEQ ID NO: 196976 - RNA, 64 nt, Homo Sapiens
aaacauuuucuugagagaguaaacuauaaaugaaauuuuucauaaaacucccugccuauggcug

SEQ ID NO: 196977 - RNA, 64 nt, Homo Sapiens
agccagcucugucaggaaagcuuggagcacauugauuuuucaaaagagcauuugagcugccacu

SEQ ID NO: 196978 - RNA, 64 nt, Homo Sapiens
ucucuaacuagagugaacucgauuaaacaaaaacauuuuucaagauguacauuacauggcuuaa

SEQ ID NO: 196979 - RNA, 64 nt, Homo Sapiens
aauacaaaauaaaaaaauauuuaguuaguauuaaauuuuucacuaugucccuggacauaaaagu

SEQ ID NO: 196980 - RNA, 64 nt, Homo Sapiens
ucuaaagaaauuggguauuuaaaacagacuacauauuuuucauguaaaugaagcagagccagga

SEQ ID NO: 196981 - RNA, 64 nt, Homo Sapiens
guacagacacuaauucauuauuaacaacuaccuuauuuuucacucaauaaaaauuuaaguuuuu

SEQ ID NO: 196982 - RNA, 64 nt, Homo Sapiens
aucauacagauuaguacauuauaguuaaaauacuauuuuucaaaucuagcauauguauaaugcu

SEQ ID NO: 196983 - RNA, 64 nt, Homo Sapiens
uuaaaguucagccucucaguuuuaauauagcuuuauuuuucaguggagaucauuguuuaggaug

SEQ ID NO: 196984 - RNA, 64 nt, Homo Sapiens
aguaaaagucccagugauguauucccauagaaauauuuuucaguuguuuaugucguuuacuaca

SEQ ID NO: 196985 - RNA, 64 nt, Homo Sapiens
aagaauuacuuauucugaugaugcacuuuuauguauuuuucauuagaaaguagaacuaauuuua

SEQ ID NO: 196986 - RNA, 64 nt, Homo Sapiens
aauccuccauugugcuccauucuaucacaugugcauuuuucauguuaaacugcaauuacuuaau

SEQ ID NO: 196987 - RNA, 64 nt, Homo Sapiens
guuugcuuuguuuuauaguaucuguacuccuuguauuuuucaagagcuauuuuguaaacagaug

SEQ ID NO: 196988 - RNA, 64 nt, Homo Sapiens
uuuuugcugucaauuuguuucuugacagagacuaauuuuucaucguuaacuaccuccuguccag

SEQ ID NO: 196989 - RNA, 64 nt, Homo Sapiens
ucuuuuuuuuuuuuuugaggucacagguggcagaauuuuucaguucacccgcuucaugacuaaa

SEQ ID NO: 196990 - RNA, 64 nt, Homo Sapiens
gaguuauuuccucauucuuucuuggcaccauggaauuuuucauuaaccauauguguaacugaua

SEQ ID NO: 196991 - RNA, 64 nt, Homo Sapiens
ugugaacauuaaaaauagggcauauuuuugaaagauuuuucagauaguauaauuagauuuuuuc

SEQ ID NO: 196992 - RNA, 64 nt, Homo Sapiens
aauaauuuuuauaguaaauaauuguuuugggcugauuuuucaguaaauccaaagugacuuaggu

SEQ ID NO: 196993 - RNA, 64 nt, Homo Sapiens
uugcuucacuuuguauuuaaaguuaaaaguuacuauuuuucauuugcuauuguacuuucauugu

SEQ ID NO: 196994 - RNA, 64 nt, Homo Sapiens
aauguauuuauucucagaaagaugucaggucaacauuuuucagauuaauacuucuguuaaauuu

SEQ ID NO: 196995 - RNA, 64 nt, Homo Sapiens
aagguauauagcuuauuuguauauuuauuaaaccauuuuucaauuuaacauuuauuuaauaauu

SEQ ID NO: 196996 - RNA, 64 nt, Homo Sapiens
aaaagaaagggcucagaaaauuuuauaauauguaauuuuucauguuuuuccccccaaacuucug

SEQ ID NO: 196997 - RNA, 64 nt, Homo Sapiens
aguuuuccauauaccuuaggacuagaauuaauguauuuuucaccgauuuguuuccucuuacaca

SEQ ID NO: 196998 - RNA, 64 nt, Homo Sapiens
gcaauguuaaaauaaauauguucuguuuagcagcauuuuucacucuuauugacuuuauuacauu

SEQ ID NO: 196999 - RNA, 64 nt, Homo Sapiens
ugaaucacagcuguugacaaagauaucugauuauauuuuucauaaaaacagaauuaggaauuug

SEQ ID NO: 197000 - RNA, 64 nt, Homo Sapiens
caauccuuuaguuuuaguuuucuugcuaaagacaauuuuucaagcuauaagucacucugcuuua

SEQ ID NO: 197001 - RNA, 64 nt, Homo Sapiens
uuaaauaacugucaacuguuucauugcuuuuuaaauuuuucacgugcauaacccccuuuagaag

SEQ ID NO: 197002 - RNA, 64 nt, Homo Sapiens
uuccuuuacauguuuacacuuuuauaaaaaucagauuuuucaguggucucuccagauauuaaca

SEQ ID NO: 197003 - RNA, 64 nt, Homo Sapiens
gacagaauguguucuuuucuccuuuaccaguccuauuuuucaaugggaagacucaggagucugc

SEQ ID NO: 197004 - RNA, 64 nt, Homo Sapiens
cugccacuugucaaagaaggugcugauccuaagaauuuuucauucucagaauucggugugcugc

SEQ ID NO: 197005 - RNA, 64 nt, Homo Sapiens
caaguaaauauagccauaaggguagucaucuuugauuuuucauuauuauacacuggaauauuca

SEQ ID NO: 197006 - RNA, 64 nt, Homo Sapiens
caucacguucucuauuggcugagauuaaguccauauuuuucaaaaaaaaugaacucuuucaauu

SEQ ID NO: 197007 - RNA, 64 nt, Homo Sapiens
guuguacuuuaucuuuuuguaauauuauuuuugaauuuuucauuauuauguugcuuuugaaauu

SEQ ID NO: 197008 - RNA, 64 nt, Homo Sapiens
uuaaaacagagucuuauuugagauguauugcuuuauuuuucaauuaaaagugguuuucuccuac

SEQ ID NO: 197009 - RNA, 64 nt, Homo Sapiens
gcuaggauuucuuuuaaaaaaauuuuucaaacucauuuuucauuguagaauuguagaaaauguc

SEQ ID NO: 197010 - RNA, 64 nt, Homo Sapiens
cucauuuuucauugcuaggauguagaaaaugucaauuuuucaaauauuuuucaaaauguagaau

SEQ ID NO: 197011 - RNA, 64 nt, Homo Sapiens
auguagaauuguagaaaaugaguauuagucaauuauuuuucaaaugaauuguguucuguaaaaa

SEQ ID NO: 197012 - RNA, 64 nt, Homo Sapiens
uugaucauaaaaccuuuaggaauugugagcucugauuuuucaaaggcaugagaauucaacauaa

SEQ ID NO: 197013 - RNA, 64 nt, Homo Sapiens
aucauguuacaagauagacagacuguaauuuaugauuuuucaaaucauaaucauguauucaaug

SEQ ID NO: 197014 - RNA, 64 nt, Homo Sapiens
gugggaaaugauuagauucugaacauauguaauuauuuuucagucuuuuucaaagauacaaaua

SEQ ID NO: 197015 - RNA, 64 nt, Homo Sapiens
caucucaaaaaaaaggagacuucaugugcccccaauuuuucacuauuguuauuugaaaaaauau

SEQ ID NO: 197016 - RNA, 64 nt, Homo Sapiens
cuccuuaaauaugaaaaauuuuaaaacuccacaaauuuuucauaacgcuacauguauucagcuu

SEQ ID NO: 197017 - RNA, 64 nt, Homo Sapiens
uugguauuaauaaaauguaauauaagcacaggccauuuuucacuuucauaugagauccuuguag

SEQ ID NO: 197018 - RNA, 64 nt, Homo Sapiens
cuuuaaaauaaauccuaccugguuuuuaaauuuuauuuuucaugaaaaugcuccuuucucuaca

SEQ ID NO: 197019 - RNA, 64 nt, Homo Sapiens
gguauuccauuuucaugguuuacuaugaaaagucauuuuucauauuauguaauauauuguuaga

SEQ ID NO: 197020 - RNA, 64 nt, Homo Sapiens
accuguuaacuuuuuuccacaaacucauuauaauauuuuucauaggcaaguuuccucucaguag

SEQ ID NO: 197021 - RNA, 64 nt, Homo Sapiens
aaaauacuguguaacuauuucucaaacuugugggauuuuucaaaagcucaguauaugaaucauc

SEQ ID NO: 197022 - RNA, 64 nt, Homo Sapiens
ggucuggauacgaaguuuaccaccauucuaaaccauuuuucaguuguuaccuuauuaaaaugac

SEQ ID NO: 197023 - RNA, 64 nt, Homo Sapiens
aaugcuaaaauuagcuacaaccaaucagaaauauauuuuucaauggacccauuaauuuccugag

SEQ ID NO: 197024 - RNA, 64 nt, Homo Sapiens
gcauaauugaguuuucuauagagaaacccuccacauuuuucaguauaucacuguugauagugca

SEQ ID NO: 197025 - RNA, 64 nt, Homo Sapiens
cuacugaaaucccuguagcacacucagguaugcaauuuuucagauuaggagagaacauuuaagc

SEQ ID NO: 197026 - RNA, 64 nt, Homo Sapiens
aacauuacuguaaugaauaagugguauugcaggaauuuuucaaaguauggguaaauuuacauug

SEQ ID NO: 197027 - RNA, 64 nt, Homo Sapiens
aagcagacugauacuaaauuugauaaucuugauuauuuuucagaucucuuuuuacuaagucagu

SEQ ID NO: 197028 - RNA, 64 nt, Homo Sapiens
ugaagaagcaacacauaaguguucuauuuuucauauuuuucaaauucauuccuuguucauuacu

SEQ ID NO: 197029 - RNA, 64 nt, Homo Sapiens
uuuuucaaaugaagaagcaauucauuacuguucuauuuuucauacauuuuuucuucauuccuug

SEQ ID NO: 197030 - RNA, 64 nt, Homo Sapiens
uaagcaguuuuuuacaucuagacugcaauauuacauuuuucacuuuuuucagcuugcaaaaugg

SEQ ID NO: 197031 - RNA, 64 nt, Homo Sapiens
uugcaaaaugggacugcaauguguugacaaaaucauuuuucagcuaaaugugcagauuuuaugc

SEQ ID NO: 197032 - RNA, 64 nt, Homo Sapiens
aaaagguucuucuggugagugcaagagccugagacuggaaaagguggacuugucucccagucga

SEQ ID NO: 197033 - RNA, 64 nt, Homo Sapiens
accugcaucauuccccgacacugccaagccaacccuggaaaaggaguucgcuggccauuggcua

SEQ ID NO: 197034 - RNA, 64 nt, Homo Sapiens
cagagcugugucaugccauccuuugggcccucugcuggaaaaguagaaucaagucucaaauaau

SEQ ID NO: 197035 - RNA, 64 nt, Homo Sapiens
ugucucuauaauuuuauucagaugacugcagaaccuggaaaagcuguugcugcuauugaugcau

SEQ ID NO: 197036 - RNA, 64 nt, Homo Sapiens
gucucuguuuucuuuuccuuuugaaaaagagucccuggaaaagaaagaauaaguggauucuccc

SEQ ID NO: 197037 - RNA, 64 nt, Homo Sapiens
ccuugucaguugcugagcugggcuuggcuccuuucuggaaaaugacaguauuuuuggcagggag

SEQ ID NO: 197038 - RNA, 64 nt, Homo Sapiens
aaccuuguagaggagcagggucuuccugcagugccuggaaaacaggcgcuguuuuuuugggacc

SEQ ID NO: 197039 - RNA, 64 nt, Homo Sapiens
auguucauaguuacauauuuauaauaguuaauaacuggaaaaagugaaauguaugucugucuac

SEQ ID NO: 197040 - RNA, 64 nt, Homo Sapiens
accagaaggaggcugggcaggaaaagaaccaggccuggaaaagaaaaggugggaagagagccug

SEQ ID NO: 197041 - RNA, 64 nt, Homo Sapiens
accaggccuggaaaagaaccggugggaagagagccuggaaaagacucuucugucauuguucaaa

SEQ ID NO: 197042 - RNA, 64 nt, Homo Sapiens
gguuuccaggaauuuuuuucaaauggggcuguuucuggaaaaaugaaaaauucuauuggacaau

SEQ ID NO: 197043 - RNA, 64 nt, Homo Sapiens
uaaauaagaaaaaaaucaaaucgaagucagccugcuggaaaagugaucacauggcaguugcagu

SEQ ID NO: 197044 - RNA, 64 nt, Homo Sapiens
caccuuuuuuauagaugauuuguuuaaauuauaucuggaaaauagaguugauuuacuuucagac

SEQ ID NO: 197045 - RNA, 64 nt, Homo Sapiens
uugaaauuaaacuaugaaauuaaaggcagaaaaacuggaaaaccuacugcagguccagagacuu

SEQ ID NO: 197046 - RNA, 64 nt, Homo Sapiens
aaauuuuuaagugcuuauuuacugcacccaaccccuggaaaacuugggauugcaggcaugagcc

SEQ ID NO: 197047 - RNA, 64 nt, Homo Sapiens
aaauuuuuuuuuucucuugaucagaaaacucauacuggaaaacuuuaaaauauaauugcgaaua

SEQ ID NO: 197048 - RNA, 64 nt, Homo Sapiens
uuuagggacauaaaaugaucuugcaggucguaaacuggaaaacaguauuuugguugucuuagga

SEQ ID NO: 197049 - RNA, 64 nt, Homo Sapiens
cucuuccugggauucauuuuuucaaaacacaaugcuggaaaaaaaagauuuguuucugaaagac

SEQ ID NO: 197050 - RNA, 64 nt, Homo Sapiens
uaaaaguacuuacuauaaccacaucauaagaauucuggaaaaauagagaacaaaaggaaaagau

SEQ ID NO: 197051 - RNA, 64 nt, Homo Sapiens
aaaggcaccuucuuuacagcagggcucuggggaacuggaaaaggggguuuguuucauuaucugg

SEQ ID NO: 197052 - RNA, 64 nt, Homo Sapiens
gcuccauuugccaguuuaaggaaggaaacacuaucuggaaaaguaccuuauugauaguggaauu

SEQ ID NO: 197053 - RNA, 64 nt, Homo Sapiens
uauauguagcacugugcuguguagauaguuccuacuggaaaaagaguggaaauuuauuaaaauc

SEQ ID NO: 197054 - RNA, 64 nt, Homo Sapiens
auuuagauuuuaagugccuuuucacugggagaaucuggaaaaaccuccauaagguauauagcaa

SEQ ID NO: 197055 - RNA, 64 nt, Homo Sapiens
uuauuauaauaaauuauauuaguaaaagucuuaacuggaaaaaagaaucuaaaucagaauagug

SEQ ID NO: 197056 - RNA, 64 nt, Homo Sapiens
augagggacuggaaccagggagaccgagcgcuuucuggaaaagaggaguuucgagguagaguuu

SEQ ID NO: 197057 - RNA, 64 nt, Homo Sapiens
agaggcuggugcuguggccagggugagagcugcucuggaaaaugugacccagauccucacaacc

SEQ ID NO: 197058 - RNA, 64 nt, Homo Sapiens
uaguagcucucuguagcauuuguuaaccuacuuccuggaaaaaguuguccuuuuucuuucuagc

SEQ ID NO: 197059 - RNA, 64 nt, Homo Sapiens
agauuuguaaaaucaccggauguagacuuuacaccuggaaaaaacucuaauuuuuuggaauuuu

SEQ ID NO: 197060 - RNA, 64 nt, Homo Sapiens
gauacagcucuggcuuucugagcacacuacggaucuggaaaauacuggaaaaugugauacuuag

SEQ ID NO: 197061 - RNA, 64 nt, Homo Sapiens
uggcuuucugagcacacuacggaucuggaaaauacuggaaaaugugauacuuagaauacuuugg

SEQ ID NO: 197062 - RNA, 64 nt, Homo Sapiens
auucagaauucuuaggcaaccuucauaccuuuaucuggaaaaugccuucucuccagacaauaag

SEQ ID NO: 197063 - RNA, 64 nt, Homo Sapiens
gcaggaauuuauacauuggguaccagagcuaaaucuggaaaacacauuuggaaugagcuuccac

SEQ ID NO: 197064 - RNA, 64 nt, Homo Sapiens
ucagaggccuaaaguuuaaacugaacuguguuuacuggaaaaauccauugacuuugccacauag

SEQ ID NO: 197065 - RNA, 64 nt, Homo Sapiens
ggaugacuauaugaugaggauaugagccaucagacuggaaaaaauaaaaagagggccaaggagg

SEQ ID NO: 197066 - RNA, 64 nt, Homo Sapiens
agggccuugauuuccagccgcaaucuggcuccuccuggaaaauuucccccaccugcagcgcugg

SEQ ID NO: 197067 - RNA, 64 nt, Homo Sapiens
gucaaccagagaacagcuccccuagacauggccucuggaaaaaggaaaucuuugguggccaaag

SEQ ID NO: 197068 - RNA, 64 nt, Homo Sapiens
uuguuugcauaggaauucaugaaggcgacccaaccuggaaaaagaacuauucacuuuggccaug

SEQ ID NO: 197069 - RNA, 64 nt, Homo Sapiens
auauuaauaccagaccaaagacauuuucuguuuccuggaaaaaaaaaaugaaucauguuaggcu

SEQ ID NO: 197070 - RNA, 64 nt, Homo Sapiens
cucugaaaggugacuuuuauuaccaacacacuggcuggaaaagggacaaaccacaucacgggug

SEQ ID NO: 197071 - RNA, 64 nt, Homo Sapiens
gugggcuggggcagaggucuuuuuucauuuaauacuggaaaaauauugaagagcauccauguuc

SEQ ID NO: 197072 - RNA, 64 nt, Homo Sapiens
agggcccaugauggcagacauucuaccccuuuuccuggaaaaacuggaagaaugaaaauaauuu

SEQ ID NO: 197073 - RNA, 63 nt, Homo Sapiens
aacuuccuuuaaaggaucuaugcauuuauuaaaucuggaaaacuauauguacacuguaggugg

SEQ ID NO: 197074 - RNA, 64 nt, Homo Sapiens
aaaaaaaaggcuuuggcuuagggaucacagaaaucuggaaaaaauugagcaacauggggcuagu

SEQ ID NO: 197075 - RNA, 64 nt, Homo Sapiens
gauuugcuucuuacccuguguaaaacuaaaaucucuggaaaaugcugccuggcugauucuuccu

SEQ ID NO: 197076 - RNA, 64 nt, Homo Sapiens
cgccuucuugagugauaccuauuacggaugaguucuggaaaagacccagcuaugauucauaaaa

SEQ ID NO: 197077 - RNA, 64 nt, Homo Sapiens
uuuuuucagaaaaacguggagugcuaggggcagccuggaaaagauggggaaccugcuagugaac

SEQ ID NO: 197078 - RNA, 64 nt, Homo Sapiens
ccuccuuggcgcugccaccugccccacccaguuucuggaaaaaguugaugcuaaugaggccaac

SEQ ID NO: 197079 - RNA, 64 nt, Homo Sapiens
gguggugcuggggcuggccugcaggcugcagucccuggaaaaacagucacugacucaagacacu

SEQ ID NO: 197080 - RNA, 64 nt, Homo Sapiens
caacauaccacauaacugaaaagcauugaacaaacuggaaaaugagaggcauccuugagcuuua

SEQ ID NO: 197081 - RNA, 64 nt, Homo Sapiens
auuccugugcccauauuuuacuuagauauacaaucuggaaaaauguugcagaacaagcaauugg

SEQ ID NO: 197082 - RNA, 64 nt, Homo Sapiens
aacaagcaaaagcuggaagcauuccccuugagaacuggaaaaugacagggaugaccacucucac

SEQ ID NO: 197083 - RNA, 64 nt, Homo Sapiens
gaaaacccaggaaaugccauucuggacauaagugcuggaaaagacuuaaugaugaacaccccaa

SEQ ID NO: 197084 - RNA, 64 nt, Homo Sapiens
auauuuuagugcaucauuuuguuuagaacuuaggcuggaaaaccaauuuaaagguugcuguagu

SEQ ID NO: 197085 - RNA, 64 nt, Homo Sapiens
aagggggaaagucuaugaacgucucaaauuuguucuggaaaagacagcccucuguuaauugugu

SEQ ID NO: 197086 - RNA, 64 nt, Homo Sapiens
ugggguaguuggugagcagaucuguucacagucucuggaaaagccuaguuggccagcgucuugc

SEQ ID NO: 197087 - RNA, 64 nt, Homo Sapiens
ugagauggaaaacaaaccauauguuccaccauugcuggaaaaaucuaauuguagcaucuaauga

SEQ ID NO: 197088 - RNA, 64 nt, Homo Sapiens
aaaaaaaaaaaggggagcagggaggcagaaaguccuggaaaaguaaauuguuuauuuuacaaua

SEQ ID NO: 197089 - RNA, 64 nt, Homo Sapiens
cggugguucuuaaucagggauguucauuaaaaugcuggaaaacuguaaagacuuccagguccca

SEQ ID NO: 197090 - RNA, 64 nt, Homo Sapiens
auggcauaaagaguaaauaaguuuuagaguuguucuggaaaaugucagaauaagucaguacuug

SEQ ID NO: 197091 - RNA, 64 nt, Homo Sapiens
auuuuuuuuuuuuuugcaaaggaaaaaauugauacuggaaaagauuguugugcauaguuauuag

SEQ ID NO: 197092 - RNA, 64 nt, Homo Sapiens
aagguaucuucuggaguuuuugggaggagagaaacuggaaaauuaaauuguauuuuugccagaa

SEQ ID NO: 197093 - RNA, 64 nt, Homo Sapiens
cauuggcauuauuuucaauacuccucaauacuaccuggaaaaagcaaacaagcacucagcccag

SEQ ID NO: 197094 - RNA, 64 nt, Homo Sapiens
ccagaguuggcuaugccuuuagaucaggaccaaccuggaaaaugcuacagacuaccaccuuucg

SEQ ID NO: 197095 - RNA, 64 nt, Homo Sapiens; identical to SEQ ID NO: 65415

SEQ ID NO: 197096 - RNA, 64 nt, Homo Sapiens; identical to SEQ ID NO: 65416

SEQ ID NO: 197097 - RNA, 64 nt, Homo Sapiens; identical to SEQ ID NO: 65417

SEQ ID NO: 197098 - RNA, 64 nt, Homo Sapiens; identical to SEQ ID NO: 65418

SEQ ID NO: 197099 - RNA, 64 nt, Homo Sapiens; identical to SEQ ID NO: 61352

SEQ ID NO: 197100 - RNA, 64 nt, Homo Sapiens; identical to SEQ ID NO: 61353

SEQ ID NO: 197101 - RNA, 64 nt, Homo Sapiens; identical to SEQ ID NO: 65421

SEQ ID NO: 197102 - RNA, 64 nt, Homo Sapiens; identical to SEQ ID NO: 65422

SEQ ID NO: 197103 - RNA, 64 nt, Homo Sapiens; identical to SEQ ID NO: 65423

SEQ ID NO: 197104 - RNA, 64 nt, Homo Sapiens; identical to SEQ ID NO: 65424

SEQ ID NO: 197105 - RNA, 64 nt, Homo Sapiens; identical to SEQ ID NO: 65425

SEQ ID NO: 197106 - RNA, 64 nt, Homo Sapiens; identical to SEQ ID NO: 65426

SEQ ID NO: 197107 - RNA, 64 nt, Homo Sapiens; identical to SEQ ID NO: 61354

SEQ ID NO: 197108 - RNA, 64 nt, Homo Sapiens; identical to SEQ ID NO: 61355

SEQ ID NO: 197109 - RNA, 64 nt, Homo Sapiens; identical to SEQ ID NO: 65429

SEQ ID NO: 197110 - RNA, 64 nt, Homo Sapiens; identical to SEQ ID NO: 65430

SEQ ID NO: 197111 - RNA, 64 nt, Homo Sapiens; identical to SEQ ID NO: 65431

SEQ ID NO: 197112 - RNA, 64 nt, Homo Sapiens; identical to SEQ ID NO: 65432

SEQ ID NO: 197113 - RNA, 64 nt, Homo Sapiens; identical to SEQ ID NO: 65433

SEQ ID NO: 197114 - RNA, 64 nt, Homo Sapiens; identical to SEQ ID NO: 65434

SEQ ID NO: 197115 - RNA, 64 nt, Homo Sapiens; identical to SEQ ID NO: 65435

SEQ ID NO: 197116 - RNA, 64 nt, Homo Sapiens; identical to SEQ ID NO: 65436

SEQ ID NO: 197117 - RNA, 64 nt, Homo Sapiens; identical to SEQ ID NO: 65437

SEQ ID NO: 197118 - RNA, 64 nt, Homo Sapiens; identical to SEQ ID NO: 65438

SEQ ID NO: 197119 - RNA, 64 nt, Homo Sapiens; identical to SEQ ID NO: 65439

SEQ ID NO: 197120 - RNA, 64 nt, Homo Sapiens; identical to SEQ ID NO: 65440

SEQ ID NO: 197121 - RNA, 64 nt, Homo Sapiens; identical to SEQ ID NO: 61356

SEQ ID NO: 197122 - RNA, 64 nt, Homo Sapiens; identical to SEQ ID NO: 61357

SEQ ID NO: 197123 - RNA, 64 nt, Homo Sapiens; identical to SEQ ID NO: 65443

SEQ ID NO: 197124 - RNA, 64 nt, Homo Sapiens; identical to SEQ ID NO: 65444

SEQ ID NO: 197125 - RNA, 64 nt, Homo Sapiens; identical to SEQ ID NO: 65445

SEQ ID NO: 197126 - RNA, 64 nt, Homo Sapiens; identical to SEQ ID NO: 65446

SEQ ID NO: 197127 - RNA, 64 nt, Homo Sapiens; identical to SEQ ID NO: 65447

SEQ ID NO: 197128 - RNA, 64 nt, Homo Sapiens; identical to SEQ ID NO: 65448

SEQ ID NO: 197129 - RNA, 64 nt, Homo Sapiens; identical to SEQ ID NO: 65449

SEQ ID NO: 197130 - RNA, 64 nt, Homo Sapiens; identical to SEQ ID NO: 65450

SEQ ID NO: 197131 - RNA, 64 nt, Homo Sapiens; identical to SEQ ID NO: 65451

SEQ ID NO: 197132 - RNA, 64 nt, Homo Sapiens; identical to SEQ ID NO: 65452

SEQ ID NO: 197133 - RNA, 64 nt, Homo Sapiens; identical to SEQ ID NO: 65453

SEQ ID NO: 197134 - RNA, 64 nt, Homo Sapiens; identical to SEQ ID NO: 65454

SEQ ID NO: 197135 - RNA, 64 nt, Homo Sapiens; identical to SEQ ID NO: 65455

SEQ ID NO: 197136 - RNA, 64 nt, Homo Sapiens; identical to SEQ ID NO: 65456

SEQ ID NO: 197137 - RNA, 64 nt, Homo Sapiens; identical to SEQ ID NO: 65457

SEQ ID NO: 197138 - RNA, 64 nt, Homo Sapiens; identical to SEQ ID NO: 65458

SEQ ID NO: 197139 - RNA, 64 nt, Homo Sapiens; identical to SEQ ID NO: 65459

SEQ ID NO: 197140 - RNA, 64 nt, Homo Sapiens; identical to SEQ ID NO: 65460

SEQ ID NO: 197141 - RNA, 64 nt, Homo Sapiens; identical to SEQ ID NO: 65461

SEQ ID NO: 197142 - RNA, 64 nt, Homo Sapiens; identical to SEQ ID NO: 65462

SEQ ID NO: 197143 - RNA, 64 nt, Homo Sapiens; identical to SEQ ID NO: 65463

SEQ ID NO: 197144 - RNA, 64 nt, Homo Sapiens; identical to SEQ ID NO: 65464

SEQ ID NO: 197145 - RNA, 64 nt, Homo Sapiens; identical to SEQ ID NO: 61358

SEQ ID NO: 197146 - RNA, 64 nt, Homo Sapiens; identical to SEQ ID NO: 61359

SEQ ID NO: 197147 - RNA, 64 nt, Homo Sapiens; identical to SEQ ID NO: 65467

SEQ ID NO: 197148 - RNA, 64 nt, Homo Sapiens; identical to SEQ ID NO: 65468

SEQ ID NO: 197149 - RNA, 64 nt, Homo Sapiens; identical to SEQ ID NO: 65469

SEQ ID NO: 197150 - RNA, 64 nt, Homo Sapiens; identical to SEQ ID NO: 65470

SEQ ID NO: 197151 - RNA, 64 nt, Homo Sapiens; identical to SEQ ID NO: 65471

SEQ ID NO: 197152 - RNA, 64 nt, Homo Sapiens; identical to SEQ ID NO: 65472

SEQ ID NO: 197153 - RNA, 64 nt, Homo Sapiens; identical to SEQ ID NO: 65473

SEQ ID NO: 197154 - RNA, 64 nt, Homo Sapiens; identical to SEQ ID NO: 65474

SEQ ID NO: 197155 - RNA, 64 nt, Homo Sapiens; identical to SEQ ID NO: 65475

SEQ ID NO: 197156 - RNA, 64 nt, Homo Sapiens; identical to SEQ ID NO: 65476

SEQ ID NO: 197157 - RNA, 64 nt, Homo Sapiens; identical to SEQ ID NO: 65477

SEQ ID NO: 197158 - RNA, 64 nt, Homo Sapiens; identical to SEQ ID NO: 65478

SEQ ID NO: 197159 - RNA, 64 nt, Homo Sapiens; identical to SEQ ID NO: 65479

SEQ ID NO: 197160 - RNA, 64 nt, Homo Sapiens; identical to SEQ ID NO: 65480

SEQ ID NO: 197161 - RNA, 64 nt, Homo Sapiens; identical to SEQ ID NO: 65481

SEQ ID NO: 197162 - RNA, 64 nt, Homo Sapiens; identical to SEQ ID NO: 65482

SEQ ID NO: 197163 - RNA, 64 nt, Homo Sapiens; identical to SEQ ID NO: 65483

SEQ ID NO: 197164 - RNA, 64 nt, Homo Sapiens; identical to SEQ ID NO: 65484

SEQ ID NO: 197165 - RNA, 64 nt, Homo Sapiens; identical to SEQ ID NO: 65485

SEQ ID NO: 197166 - RNA, 64 nt, Homo Sapiens; identical to SEQ ID NO: 65486

SEQ ID NO: 197167 - RNA, 64 nt, Homo Sapiens; identical to SEQ ID NO: 65487

SEQ ID NO: 197168 - RNA, 64 nt, Homo Sapiens; identical to SEQ ID NO: 65488

SEQ ID NO: 197169 - RNA, 64 nt, Homo Sapiens; identical to SEQ ID NO: 65489

SEQ ID NO: 197170 - RNA, 64 nt, Homo Sapiens; identical to SEQ ID NO: 65490

SEQ ID NO: 197171 - RNA, 64 nt, Homo Sapiens; identical to SEQ ID NO: 65491

SEQ ID NO: 197172 - RNA, 64 nt, Homo Sapiens; identical to SEQ ID NO: 65492

SEQ ID NO: 197173 - RNA, 64 nt, Homo Sapiens; identical to SEQ ID NO: 65493

SEQ ID NO: 197174 - RNA, 64 nt, Homo Sapiens; identical to SEQ ID NO: 65494

SEQ ID NO: 197175 - RNA, 64 nt, Homo Sapiens; identical to SEQ ID NO: 65495

SEQ ID NO: 197176 - RNA, 64 nt, Homo Sapiens; identical to SEQ ID NO: 65496

SEQ ID NO: 197177 - RNA, 64 nt, Homo Sapiens; identical to SEQ ID NO: 65497

SEQ ID NO: 197178 - RNA, 64 nt, Homo Sapiens; identical to SEQ ID NO: 65498

SEQ ID NO: 197179 - RNA, 64 nt, Homo Sapiens; identical to SEQ ID NO: 65499

SEQ ID NO: 197180 - RNA, 64 nt, Homo Sapiens; identical to SEQ ID NO: 65500

SEQ ID NO: 197181 - RNA, 64 nt, Homo Sapiens; identical to SEQ ID NO: 65501

SEQ ID NO: 197182 - RNA, 64 nt, Homo Sapiens; identical to SEQ ID NO: 65502

SEQ ID NO: 197183 - RNA, 64 nt, Homo Sapiens; identical to SEQ ID NO: 65503

SEQ ID NO: 197184 - RNA, 64 nt, Homo Sapiens; identical to SEQ ID NO: 65504

SEQ ID NO: 197185 - RNA, 64 nt, Homo Sapiens; identical to SEQ ID NO: 65505

SEQ ID NO: 197186 - RNA, 64 nt, Homo Sapiens; identical to SEQ ID NO: 65506

SEQ ID NO: 197187 - RNA, 64 nt, Homo Sapiens; identical to SEQ ID NO: 65507

SEQ ID NO: 197188 - RNA, 64 nt, Homo Sapiens; identical to SEQ ID NO: 65508

SEQ ID NO: 197189 - RNA, 64 nt, Homo Sapiens; identical to SEQ ID NO: 61360

SEQ ID NO: 197190 - RNA, 64 nt, Homo Sapiens; identical to SEQ ID NO: 61361

SEQ ID NO: 197191 - RNA, 64 nt, Homo Sapiens; identical to SEQ ID NO: 65511

SEQ ID NO: 197192 - RNA, 64 nt, Homo Sapiens; identical to SEQ ID NO: 65512

SEQ ID NO: 197193 - RNA, 64 nt, Homo Sapiens; identical to SEQ ID NO: 65513

SEQ ID NO: 197194 - RNA, 64 nt, Homo Sapiens; identical to SEQ ID NO: 65514

SEQ ID NO: 197195 - RNA, 64 nt, Homo Sapiens; identical to SEQ ID NO: 65515

SEQ ID NO: 197196 - RNA, 64 nt, Homo Sapiens; identical to SEQ ID NO: 65516

SEQ ID NO: 197197 - RNA, 64 nt, Homo Sapiens; identical to SEQ ID NO: 65517

SEQ ID NO: 197198 - RNA, 64 nt, Homo Sapiens; identical to SEQ ID NO: 65518

SEQ ID NO: 197199 - RNA, 64 nt, Homo Sapiens; identical to SEQ ID NO: 65519

SEQ ID NO: 197200 - RNA, 64 nt, Homo Sapiens; identical to SEQ ID NO: 65520

SEQ ID NO: 197201 - RNA, 64 nt, Homo Sapiens; identical to SEQ ID NO: 65521

SEQ ID NO: 197202 - RNA, 64 nt, Homo Sapiens; identical to SEQ ID NO: 65522

SEQ ID NO: 197203 - RNA, 64 nt, Homo Sapiens; identical to SEQ ID NO: 65523

SEQ ID NO: 197204 - RNA, 64 nt, Homo Sapiens; identical to SEQ ID NO: 65524

SEQ ID NO: 197205 - RNA, 64 nt, Homo Sapiens; identical to SEQ ID NO: 65525

SEQ ID NO: 197206 - RNA, 64 nt, Homo Sapiens; identical to SEQ ID NO: 65526

SEQ ID NO: 197207 - RNA, 64 nt, Homo Sapiens; identical to SEQ ID NO: 65527

SEQ ID NO: 197208 - RNA, 64 nt, Homo Sapiens; identical to SEQ ID NO: 65528

SEQ ID NO: 197209 - RNA, 64 nt, Homo Sapiens; identical to SEQ ID NO: 61362

SEQ ID NO: 197210 - RNA, 64 nt, Homo Sapiens; identical to SEQ ID NO: 61363

SEQ ID NO: 197211 - RNA, 64 nt, Homo Sapiens; identical to SEQ ID NO: 61364

SEQ ID NO: 197212 - RNA, 64 nt, Homo Sapiens; identical to SEQ ID NO: 61365

SEQ ID NO: 197213 - RNA, 64 nt, Homo Sapiens; identical to SEQ ID NO: 65533

SEQ ID NO: 197214 - RNA, 64 nt, Homo Sapiens; identical to SEQ ID NO: 65534

SEQ ID NO: 197215 - RNA, 64 nt, Homo Sapiens; identical to SEQ ID NO: 65535

SEQ ID NO: 197216 - RNA, 64 nt, Homo Sapiens; identical to SEQ ID NO: 65536

SEQ ID NO: 197217 - RNA, 64 nt, Homo Sapiens; identical to SEQ ID NO: 65537

SEQ ID NO: 197218 - RNA, 64 nt, Homo Sapiens; identical to SEQ ID NO: 65538

SEQ ID NO: 197219 - RNA, 64 nt, Homo Sapiens; identical to SEQ ID NO: 65539

SEQ ID NO: 197220 - RNA, 64 nt, Homo Sapiens; identical to SEQ ID NO: 65540

SEQ ID NO: 197221 - RNA, 64 nt, Homo Sapiens; identical to SEQ ID NO: 65541

SEQ ID NO: 197222 - RNA, 64 nt, Homo Sapiens; identical to SEQ ID NO: 65542

SEQ ID NO: 197223 - RNA, 64 nt, Homo Sapiens; identical to SEQ ID NO: 65543

SEQ ID NO: 197224 - RNA, 64 nt, Homo Sapiens; identical to SEQ ID NO: 65544

SEQ ID NO: 197225 - RNA, 64 nt, Homo Sapiens; identical to SEQ ID NO: 65545

SEQ ID NO: 197226 - RNA, 64 nt, Homo Sapiens; identical to SEQ ID NO: 65546

SEQ ID NO: 197227 - RNA, 64 nt, Homo Sapiens; identical to SEQ ID NO: 65547

SEQ ID NO: 197228 - RNA, 64 nt, Homo Sapiens; identical to SEQ ID NO: 61366

SEQ ID NO: 197229 - RNA, 64 nt, Homo Sapiens; identical to SEQ ID NO: 61367

SEQ ID NO: 197230 - RNA, 64 nt, Homo Sapiens; identical to SEQ ID NO: 65550

SEQ ID NO: 197231 - RNA, 64 nt, Homo Sapiens; identical to SEQ ID NO: 65551

SEQ ID NO: 197232 - RNA, 64 nt, Homo Sapiens; identical to SEQ ID NO: 61368

SEQ ID NO: 197233 - RNA, 56 nt, Homo Sapiens; identical to SEQ ID NO: 61369

SEQ ID NO: 197234 - RNA, 64 nt, Homo Sapiens; identical to SEQ ID NO: 65554

SEQ ID NO: 197235 - RNA, 64 nt, Homo Sapiens; identical to SEQ ID NO: 65555

SEQ ID NO: 197236 - RNA, 64 nt, Homo Sapiens; identical to SEQ ID NO: 65556

SEQ ID NO: 197237 - RNA, 64 nt, Homo Sapiens; identical to SEQ ID NO: 65557

SEQ ID NO: 197238 - RNA, 64 nt, Homo Sapiens; identical to SEQ ID NO: 65558

SEQ ID NO: 197239 - RNA, 64 nt, Homo Sapiens; identical to SEQ ID NO: 65559

SEQ ID NO: 197240 - RNA, 64 nt, Homo Sapiens; identical to SEQ ID NO: 65560

SEQ ID NO: 197241 - RNA, 64 nt, Homo Sapiens; identical to SEQ ID NO: 65561

SEQ ID NO: 197242 - RNA, 64 nt, Homo Sapiens; identical to SEQ ID NO: 65562

SEQ ID NO: 197243 - RNA, 64 nt, Homo Sapiens; identical to SEQ ID NO: 65563

SEQ ID NO: 197244 - RNA, 64 nt, Homo Sapiens; identical to SEQ ID NO: 65564

SEQ ID NO: 197245 - RNA, 64 nt, Homo Sapiens; identical to SEQ ID NO: 65565

SEQ ID NO: 197246 - RNA, 64 nt, Homo Sapiens; identical to SEQ ID NO: 65566

SEQ ID NO: 197247 - RNA, 64 nt, Homo Sapiens; identical to SEQ ID NO: 65567

SEQ ID NO: 197248 - RNA, 64 nt, Homo Sapiens; identical to SEQ ID NO: 65568

SEQ ID NO: 197249 - RNA, 64 nt, Homo Sapiens; identical to SEQ ID NO: 65569

SEQ ID NO: 197250 - RNA, 64 nt, Homo Sapiens; identical to SEQ ID NO: 65570

SEQ ID NO: 197251 - RNA, 64 nt, Homo Sapiens; identical to SEQ ID NO: 65571

SEQ ID NO: 197252 - RNA, 64 nt, Homo Sapiens; identical to SEQ ID NO: 65572

SEQ ID NO: 197253 - RNA, 64 nt, Homo Sapiens; identical to SEQ ID NO: 65573

SEQ ID NO: 197254 - RNA, 64 nt, Homo Sapiens; identical to SEQ ID NO: 61370

SEQ ID NO: 197255 - RNA, 64 nt, Homo Sapiens; identical to SEQ ID NO: 61371

SEQ ID NO: 197256 - RNA, 64 nt, Homo Sapiens; identical to SEQ ID NO: 65576

SEQ ID NO: 197257 - RNA, 64 nt, Homo Sapiens; identical to SEQ ID NO: 65577

SEQ ID NO: 197258 - RNA, 64 nt, Homo Sapiens; identical to SEQ ID NO: 65578

SEQ ID NO: 197259 - RNA, 64 nt, Homo Sapiens; identical to SEQ ID NO: 65579

SEQ ID NO: 197260 - RNA, 64 nt, Homo Sapiens; identical to SEQ ID NO: 65580

SEQ ID NO: 197261 - RNA, 64 nt, Homo Sapiens; identical to SEQ ID NO: 65581

SEQ ID NO: 197262 - RNA, 64 nt, Homo Sapiens; identical to SEQ ID NO: 65582

SEQ ID NO: 197263 - RNA, 64 nt, Homo Sapiens; identical to SEQ ID NO: 65583

SEQ ID NO: 197264 - RNA, 64 nt, Homo Sapiens; identical to SEQ ID NO: 65584

SEQ ID NO: 197265 - RNA, 64 nt, Homo Sapiens; identical to SEQ ID NO: 65585

SEQ ID NO: 197266 - RNA, 64 nt, Homo Sapiens; identical to SEQ ID NO: 65586

SEQ ID NO: 197267 - RNA, 64 nt, Homo Sapiens; identical to SEQ ID NO: 65587

SEQ ID NO: 197268 - RNA, 64 nt, Homo Sapiens; identical to SEQ ID NO: 65588

SEQ ID NO: 197269 - RNA, 64 nt, Homo Sapiens; identical to SEQ ID NO: 65589

SEQ ID NO: 197270 - RNA, 64 nt, Homo Sapiens; identical to SEQ ID NO: 65590

SEQ ID NO: 197271 - RNA, 64 nt, Homo Sapiens; identical to SEQ ID NO: 65591

SEQ ID NO: 197272 - RNA, 64 nt, Homo Sapiens; identical to SEQ ID NO: 65592

SEQ ID NO: 197273 - RNA, 64 nt, Homo Sapiens; identical to SEQ ID NO: 65593

SEQ ID NO: 197274 - RNA, 64 nt, Homo Sapiens; identical to SEQ ID NO: 65594

SEQ ID NO: 197275 - RNA, 64 nt, Homo Sapiens; identical to SEQ ID NO: 65595

SEQ ID NO: 197276 - RNA, 64 nt, Homo Sapiens; identical to SEQ ID NO: 65596

SEQ ID NO: 197277 - RNA, 64 nt, Homo Sapiens; identical to SEQ ID NO: 65597

SEQ ID NO: 197278 - RNA, 64 nt, Homo Sapiens; identical to SEQ ID NO: 65598

SEQ ID NO: 197279 - RNA, 64 nt, Homo Sapiens; identical to SEQ ID NO: 65599

SEQ ID NO: 197280 - RNA, 64 nt, Homo Sapiens; identical to SEQ ID NO: 65600

SEQ ID NO: 197281 - RNA, 64 nt, Homo Sapiens; identical to SEQ ID NO: 65601

SEQ ID NO: 197282 - RNA, 64 nt, Homo Sapiens; identical to SEQ ID NO: 65602

SEQ ID NO: 197283 - RNA, 64 nt, Homo Sapiens; identical to SEQ ID NO: 65603

SEQ ID NO: 197284 - RNA, 64 nt, Homo Sapiens; identical to SEQ ID NO: 65604

SEQ ID NO: 197285 - RNA, 64 nt, Homo Sapiens; identical to SEQ ID NO: 65605

SEQ ID NO: 197286 - RNA, 64 nt, Homo Sapiens; identical to SEQ ID NO: 65606

SEQ ID NO: 197287 - RNA, 64 nt, Homo Sapiens; identical to SEQ ID NO: 65607

SEQ ID NO: 197288 - RNA, 64 nt, Homo Sapiens; identical to SEQ ID NO: 65608

SEQ ID NO: 197289 - RNA, 64 nt, Homo Sapiens; identical to SEQ ID NO: 65609

SEQ ID NO: 197290 - RNA, 64 nt, Homo Sapiens; identical to SEQ ID NO: 65610

SEQ ID NO: 197291 - RNA, 64 nt, Homo Sapiens; identical to SEQ ID NO: 65611

SEQ ID NO: 197292 - RNA, 64 nt, Homo Sapiens; identical to SEQ ID NO: 61372

SEQ ID NO: 197293 - RNA, 64 nt, Homo Sapiens; identical to SEQ ID NO: 61373

SEQ ID NO: 197294 - RNA, 64 nt, Homo Sapiens; identical to SEQ ID NO: 65614

SEQ ID NO: 197295 - RNA, 64 nt, Homo Sapiens; identical to SEQ ID NO: 65615

SEQ ID NO: 197296 - RNA, 64 nt, Homo Sapiens; identical to SEQ ID NO: 65616

SEQ ID NO: 197297 - RNA, 64 nt, Homo Sapiens; identical to SEQ ID NO: 61374

SEQ ID NO: 197298 - RNA, 64 nt, Homo Sapiens; identical to SEQ ID NO: 61375

SEQ ID NO: 197299 - RNA, 64 nt, Homo Sapiens; identical to SEQ ID NO: 65619

SEQ ID NO: 197300 - RNA, 64 nt, Homo Sapiens; identical to SEQ ID NO: 65620

SEQ ID NO: 197301 - RNA, 64 nt, Homo Sapiens; identical to SEQ ID NO: 65621

SEQ ID NO: 197302 - RNA, 64 nt, Homo Sapiens; identical to SEQ ID NO: 65622

SEQ ID NO: 197303 - RNA, 64 nt, Homo Sapiens; identical to SEQ ID NO: 65623

SEQ ID NO: 197304 - RNA, 64 nt, Homo Sapiens; identical to SEQ ID NO: 65624

SEQ ID NO: 197305 - RNA, 64 nt, Homo Sapiens; identical to SEQ ID NO: 65625

SEQ ID NO: 197306 - RNA, 64 nt, Homo Sapiens; identical to SEQ ID NO: 65626

SEQ ID NO: 197307 - RNA, 64 nt, Homo Sapiens; identical to SEQ ID NO: 65627

SEQ ID NO: 197308 - RNA, 64 nt, Homo Sapiens; identical to SEQ ID NO: 65628

SEQ ID NO: 197309 - RNA, 64 nt, Homo Sapiens; identical to SEQ ID NO: 65629

SEQ ID NO: 197310 - RNA, 64 nt, Homo Sapiens; identical to SEQ ID NO: 65630

SEQ ID NO: 197311 - RNA, 64 nt, Homo Sapiens; identical to SEQ ID NO: 65631

SEQ ID NO: 197312 - RNA, 64 nt, Homo Sapiens; identical to SEQ ID NO: 65632

SEQ ID NO: 197313 - RNA, 64 nt, Homo Sapiens; identical to SEQ ID NO: 65633

SEQ ID NO: 197314 - RNA, 64 nt, Homo Sapiens; identical to SEQ ID NO: 65634

SEQ ID NO: 197315 - RNA, 64 nt, Homo Sapiens; identical to SEQ ID NO: 65635

SEQ ID NO: 197316 - RNA, 64 nt, Homo Sapiens; identical to SEQ ID NO: 65636

SEQ ID NO: 197317 - RNA, 64 nt, Homo Sapiens; identical to SEQ ID NO: 65637

SEQ ID NO: 197318 - RNA, 64 nt, Homo Sapiens; identical to SEQ ID NO: 65638

SEQ ID NO: 197319 - RNA, 64 nt, Homo Sapiens; identical to SEQ ID NO: 65639

SEQ ID NO: 197320 - RNA, 64 nt, Homo Sapiens; identical to SEQ ID NO: 65640

SEQ ID NO: 197321 - RNA, 64 nt, Homo Sapiens; identical to SEQ ID NO: 65641

SEQ ID NO: 197322 - RNA, 64 nt, Homo Sapiens; identical to SEQ ID NO: 65642

SEQ ID NO: 197323 - RNA, 64 nt, Homo Sapiens; identical to SEQ ID NO: 65643

SEQ ID NO: 197324 - RNA, 64 nt, Homo Sapiens; identical to SEQ ID NO: 65644

SEQ ID NO: 197325 - RNA, 60 nt, Homo Sapiens; identical to SEQ ID NO: 65087

SEQ ID NO: 197326 - RNA, 64 nt, Homo Sapiens; identical to SEQ ID NO: 65646

SEQ ID NO: 197327 - RNA, 64 nt, Homo Sapiens; identical to SEQ ID NO: 65647

SEQ ID NO: 197328 - RNA, 64 nt, Homo Sapiens; identical to SEQ ID NO: 65648

SEQ ID NO: 197329 - RNA, 64 nt, Homo Sapiens; identical to SEQ ID NO: 65649

SEQ ID NO: 197330 - RNA, 64 nt, Homo Sapiens; identical to SEQ ID NO: 65650

SEQ ID NO: 197331 - RNA, 64 nt, Homo Sapiens; identical to SEQ ID NO: 65651

SEQ ID NO: 197332 - RNA, 51 nt, Homo Sapiens; identical to SEQ ID NO: 65094

SEQ ID NO: 197333 - RNA, 64 nt, Homo Sapiens; identical to SEQ ID NO: 65653

SEQ ID NO: 197334 - RNA, 64 nt, Homo Sapiens; identical to SEQ ID NO: 65654

SEQ ID NO: 197335 - RNA, 64 nt, Homo Sapiens; identical to SEQ ID NO: 65655

SEQ ID NO: 197336 - RNA, 64 nt, Homo Sapiens; identical to SEQ ID NO: 65656

SEQ ID NO: 197337 - RNA, 64 nt, Homo Sapiens; identical to SEQ ID NO: 65657

SEQ ID NO: 197338 - RNA, 64 nt, Homo Sapiens; identical to SEQ ID NO: 65658

SEQ ID NO: 197339 - RNA, 64 nt, Homo Sapiens; identical to SEQ ID NO: 65659

SEQ ID NO: 197340 - RNA, 64 nt, Homo Sapiens; identical to SEQ ID NO: 65660

SEQ ID NO: 197341 - RNA, 64 nt, Homo Sapiens; identical to SEQ ID NO: 65661

SEQ ID NO: 197342 - RNA, 64 nt, Homo Sapiens; identical to SEQ ID NO: 65662

SEQ ID NO: 197343 - RNA, 64 nt, Homo Sapiens; identical to SEQ ID NO: 65663

SEQ ID NO: 197344 - RNA, 64 nt, Homo Sapiens; identical to SEQ ID NO: 65664

SEQ ID NO: 197345 - RNA, 64 nt, Homo Sapiens; identical to SEQ ID NO: 65665

SEQ ID NO: 197346 - RNA, 64 nt, Homo Sapiens; identical to SEQ ID NO: 65666

SEQ ID NO: 197347 - RNA, 64 nt, Homo Sapiens; identical to SEQ ID NO: 65667

SEQ ID NO: 197348 - RNA, 64 nt, Homo Sapiens; identical to SEQ ID NO: 65668

SEQ ID NO: 197349 - RNA, 64 nt, Homo Sapiens; identical to SEQ ID NO: 65669

SEQ ID NO: 197350 - RNA, 64 nt, Homo Sapiens; identical to SEQ ID NO: 65670

SEQ ID NO: 197351 - RNA, 64 nt, Homo Sapiens; identical to SEQ ID NO: 65671

SEQ ID NO: 197352 - RNA, 64 nt, Homo Sapiens; identical to SEQ ID NO: 65672

SEQ ID NO: 197353 - RNA, 64 nt, Homo Sapiens; identical to SEQ ID NO: 65673

SEQ ID NO: 197354 - RNA, 64 nt, Homo Sapiens; identical to SEQ ID NO: 65674

SEQ ID NO: 197355 - RNA, 64 nt, Homo Sapiens; identical to SEQ ID NO: 65675

SEQ ID NO: 197356 - RNA, 64 nt, Homo Sapiens; identical to SEQ ID NO: 65676

SEQ ID NO: 197357 - RNA, 64 nt, Homo Sapiens; identical to SEQ ID NO: 65677

SEQ ID NO: 197358 - RNA, 64 nt, Homo Sapiens; identical to SEQ ID NO: 65678

SEQ ID NO: 197359 - RNA, 64 nt, Homo Sapiens; identical to SEQ ID NO: 65679

SEQ ID NO: 197360 - RNA, 64 nt, Homo Sapiens; identical to SEQ ID NO: 65680

SEQ ID NO: 197361 - RNA, 64 nt, Homo Sapiens; identical to SEQ ID NO: 65681

SEQ ID NO: 197362 - RNA, 64 nt, Homo Sapiens; identical to SEQ ID NO: 65682

SEQ ID NO: 197363 - RNA, 64 nt, Homo Sapiens; identical to SEQ ID NO: 65683

SEQ ID NO: 197364 - RNA, 64 nt, Homo Sapiens; identical to SEQ ID NO: 65684

SEQ ID NO: 197365 - RNA, 64 nt, Homo Sapiens; identical to SEQ ID NO: 65685

SEQ ID NO: 197366 - RNA, 64 nt, Homo Sapiens; identical to SEQ ID NO: 65686

SEQ ID NO: 197367 - RNA, 64 nt, Homo Sapiens; identical to SEQ ID NO: 65687

SEQ ID NO: 197368 - RNA, 64 nt, Homo Sapiens; identical to SEQ ID NO: 65688

SEQ ID NO: 197369 - RNA, 64 nt, Homo Sapiens; identical to SEQ ID NO: 65689

SEQ ID NO: 197370 - RNA, 64 nt, Homo Sapiens; identical to SEQ ID NO: 65690

SEQ ID NO: 197371 - RNA, 64 nt, Homo Sapiens; identical to SEQ ID NO: 65691

SEQ ID NO: 197372 - RNA, 64 nt, Homo Sapiens; identical to SEQ ID NO: 65692

SEQ ID NO: 197373 - RNA, 64 nt, Homo Sapiens; identical to SEQ ID NO: 65693

SEQ ID NO: 197374 - RNA, 64 nt, Homo Sapiens
ugaagcacccagucucguaccauuuugagcccuccagcacuacuuauuuucccccaccuuugcc

SEQ ID NO: 197375 - RNA, 64 nt, Homo Sapiens
gucagagguauuuauuaaguaccuacugugugcucagcacuaaagguuuguugauaaaaugaca

SEQ ID NO: 197376 - RNA, 63 nt, Homo Sapiens
ucucguuuaaacaacaacaacaaaauaaauuuaucagcacuagauauuagauuugaaauaagu

SEQ ID NO: 197377 - RNA, 64 nt, Homo Sapiens
guacacacucuugugggacguaucauauaaaugucagcacuaaguaaugucuuguuuguggcug

SEQ ID NO: 197378 - RNA, 64 nt, Homo Sapiens
uauuuuuuaaaaucauuauauugaguuguguuuucagcacuauauuggucaagauagccaagca

SEQ ID NO: 197379 - RNA, 64 nt, Homo Sapiens
uggauguauuaauuggcucuauaaacuaugugcccagcacuaugcugagcuuacacuaauuggu

SEQ ID NO: 197380 - RNA, 64 nt, Homo Sapiens
gaaaucuuugcaaaggucgguucuauucagcgaacagcacuauagcaaaagaagaucguuccau

SEQ ID NO: 197381 - RNA, 64 nt, Homo Sapiens
ccuccuucaucacauccugcaguaucuccagaagcagcacuaggguuugaguuucauacuucag

SEQ ID NO: 197382 - RNA, 64 nt, Homo Sapiens
acuaaucaguuggggaaaaaaauacuauagcagacagcacuaaugucaucaacaaacauuguuc

SEQ ID NO: 197383 - RNA, 64 nt, Homo Sapiens
gugcucucuguaaugccucuuauggugguggguccagcacuauguugauugacucagagagcac

SEQ ID NO: 197384 - RNA, 64 nt, Homo Sapiens
cuaacauaacaggucacuaccaguaauagauacucagcacuagaggguucucugcagauggucc

SEQ ID NO: 197385 - RNA, 64 nt, Homo Sapiens
caugaaauauaaaccaaaaauaagguuggaacagcagcacuauaaagcagacagcuuuacuuug

SEQ ID NO: 197386 - RNA, 64 nt, Homo Sapiens
cuucauccuagaguuucaggucuaagaaagaauacagcacuagaauuacucuguguugcuauuu

SEQ ID NO: 197387 - RNA, 64 nt, Homo Sapiens
gaaguguguuuuacucauuuuaccugacucauuccagcacuacauccaucaauguacuuugaac

SEQ ID NO: 197388 - RNA, 64 nt, Homo Sapiens
gggccuauguccugcccagagcacaagugcacaucagcacuaugcagucucugcccaggucaca

SEQ ID NO: 197389 - RNA, 64 nt, Homo Sapiens
gaugucaguguacgagacggcagccuaugccaaacagcacuaagaagagcagacagcguaacag

SEQ ID NO: 197390 - RNA, 64 nt, Homo Sapiens
uuauaugcagauuccuaguagcaugccuuaccuacagcacuaugugcauuugcugucacaauaa

SEQ ID NO: 197391 - RNA, 64 nt, Homo Sapiens
uuuuguggccauggcagacauugcuaaucaaucacagcacuauuuccuauuaagcccacugauu

SEQ ID NO: 197392 - RNA, 64 nt, Homo Sapiens
uuuuaauuuaguaaaccaauccuaugcaugguuucagcacuagccaaaccucaccaacuccuag

SEQ ID NO: 197393 - RNA, 64 nt, Homo Sapiens
acuggccaggugcaguggcucaugccuguaaucccagcacuaugggaggcugaggcgggcagau

SEQ ID NO: 197394 - RNA, 64 nt, Homo Sapiens
agaugagcuuccggagacugcucuccucaccacacagcacuaguccauccucagcaccugagcc

SEQ ID NO: 197395 - RNA, 64 nt, Homo Sapiens
cacagagcucaggguggcagaucuccgguauccucagcacuacccacccccgccagcuccccag

SEQ ID NO: 197396 - RNA, 64 nt, Homo Sapiens
acaagaaccaacacugagccugguacccacacaucagcacuacccgacuguggccuggccucag

SEQ ID NO: 197397 - RNA, 64 nt, Homo Sapiens
aagaucgcauagaucaaauacaagauuuguagaccagcacuacaggaaagccuuugcaaucuug

SEQ ID NO: 197398 - RNA, 64 nt, Homo Sapiens
aggccuuuauuaaguaugauagagucuugagggacagcacuaacaaaggaagcccuuuagaauu

SEQ ID NO: 197399 - RNA, 64 nt, Homo Sapiens
ggaauuauuucccgcuguugcuggcugcuuacuucagcacuauuggugaacucagcaaggcaga

SEQ ID NO: 197400 - RNA, 64 nt, Homo Sapiens
uguuaugaagcuguaaauaacuacuugaagacuccagcacuacaccuacauuuuaacuggaaau

SEQ ID NO: 197401 - RNA, 64 nt, Homo Sapiens
aauggacuuuguuguuuuucaaguuugauuuuugcagcacuagcuaauggucugacacaaaagc

SEQ ID NO: 197402 - RNA, 64 nt, Homo Sapiens
auuuuaauugaagggugagcauaaccuugugaaccagcacuagcuuguuccaagcuggaauuua

SEQ ID NO: 197403 - RNA, 64 nt, Homo Sapiens
ccguccucuacgcuugggcuuuucuguuaccaaacagcacuaucccaggaacuauugucugccu

SEQ ID NO: 197404 - RNA, 64 nt, Homo Sapiens
aaugccuaccaucagcuccugaaucagggauuuucagcacuaccucugagccaugggguuggcu

SEQ ID NO: 197405 - RNA, 64 nt, Homo Sapiens
aaaaauguauagagugugauguccaauugguauucagcacuauaaauguguuuuuaaccucccg

SEQ ID NO: 197406 - RNA, 64 nt, Homo Sapiens
accuagcagguucugugaacucucaggccuuggccagcacuaguuaggggaggucaggugguca

SEQ ID NO: 197407 - RNA, 64 nt, Homo Sapiens
cuaagaugcccaugagaacagaccaagauguguacagcacuaugagcauuaaaaaaccuuccag

SEQ ID NO: 197408 - RNA, 64 nt, Homo Sapiens
ccauguccccuucuaaauuccaaagacuccaacgcagcacuagcaagcagguucgggacagccc

SEQ ID NO: 197409 - RNA, 64 nt, Homo Sapiens
aaucccacuuaauaagagcuuuuccccaagacaacagcacuagugugagaaaaggugguuauuu

SEQ ID NO: 197410 - RNA, 64 nt, Homo Sapiens
gggugucauuucauuccauuucucauaauuccuacagcacuacuauuagacugacuggauucau

SEQ ID NO: 197411 - RNA, 64 nt, Homo Sapiens
gucccauccguucucaugaaacaaguccacaccacagcacuaccaccggcauggccacucagac

SEQ ID NO: 197412 - RNA, 64 nt, Homo Sapiens
ggaggcugaggcaagcaggucacaccuauaaucccagcacuauguuuggccgggcacgguggcu

SEQ ID NO: 197413 - RNA, 64 nt, Homo Sapiens
ggaugggcagagguucaaccgaaaacuugaaagucagcacuaaagcugugguuaugggcauuua

SEQ ID NO: 197414 - RNA, 64 nt, Homo Sapiens
gguaauuauucuaaauuauuaauuauacccacaccagcacuaguauuaaggaugaccugugcaa

SEQ ID NO: 197415 - RNA, 64 nt, Homo Sapiens
ggaggccagggagggaggaucaugccuguaaucccagcacuauguugggccaggugcgguggcu

SEQ ID NO: 197416 - RNA, 64 nt, Homo Sapiens
augaauagugcugcgauaaaagugcugcgauaaacagcacuauuauaacuuugcuauuacgaau

SEQ ID NO: 197417 - RNA, 64 nt, Homo Sapiens
aagaguuaauaaaaugcaaucaaaauaagaauagcagcacuaugcuugaaaguuagauuaauau

SEQ ID NO: 197418 - RNA, 64 nt, Homo Sapiens
ugcugagccaguggcugccccgugcccuccuucccagcacuaucaugugucacguuucccggac

SEQ ID NO: 197419 - RNA, 64 nt, Homo Sapiens
ugagaguaauaaaacuuggcuucucucuaccucucagcacuaaugauggucaaaugccuuacau

SEQ ID NO: 197420 - RNA, 64 nt, Homo Sapiens
gauuuugccuccccgaucagugugugccuguuuacagcacuaucuaucuuucucucuccaaaug

SEQ ID NO: 197421 - RNA, 64 nt, Homo Sapiens
auugaucuaauuuacauauucugcguguuguauucagcacuaaaaaauggugggagcuggggga

SEQ ID NO: 197422 - RNA, 64 nt, Homo Sapiens
gauaucauauugaggauuaauacuuaucaaaagacagcacuacagaauacuugguuucuuuucu

SEQ ID NO: 197423 - RNA, 64 nt, Homo Sapiens
cuugguuuuauuucagucuguguguuuuuacaugcagcacuacuuguguuagacucucuccuuu

SEQ ID NO: 197424 - RNA, 64 nt, Homo Sapiens
cacaauagccaagauauaggcccuauguuuacugcagcacuauuauauuaaagagacauuugaa

SEQ ID NO: 197425 - RNA, 64 nt, Homo Sapiens
gguaaaauuuugaagacauuaccuacugugugcacagcacuacuucagucagcauuuaaugacc

SEQ ID NO: 197426 - RNA, 64 nt, Homo Sapiens
uacuuagagaugcuacugucugucuguauucauacagcacuacuuguagauacagauccgcaug

SEQ ID NO: 197427 - RNA, 64 nt, Homo Sapiens
aauggaugacaucaaacauuuacguuuacagucgcagcacuaaaucuaauuucuuacucuauug

SEQ ID NO: 197428 - RNA, 64 nt, Homo Sapiens
auuucugggauuuaaauagucaacugugcuucuucagcacuaauggguccuguauuuuuccaaa

SEQ ID NO: 197429 - RNA, 64 nt, Homo Sapiens
aguauguugaauuuauuaugaaaaucuuaucuugcagcacuaucuaauauguaauuugaaaaau

SEQ ID NO: 197430 - RNA, 64 nt, Homo Sapiens
gacauugcagucugcuucugaauauguacauaggcagcacuagcuggaauuuuuuauucuugug

SEQ ID NO: 197431 - RNA, 64 nt, Homo Sapiens
uaauuucucauuugcaggaaaugcuggcauagagcagcacuaaaugacaccacuaaagaaacga

SEQ ID NO: 197432 - RNA, 64 nt, Homo Sapiens; identical to SEQ ID NO: 197431

SEQ ID NO: 197433 - RNA, 64 nt, Homo Sapiens
uacauauugcaaccuaauuuguuaaaacuaacuccagcacuaaagcugaaaugccacaaacacu

SEQ ID NO: 197434 - RNA, 64 nt, Homo Sapiens
cacuuggagccaaggguucagagacucagggccccagcacuaaagcaguggacaccaggagucc

SEQ ID NO: 197435 - RNA, 64 nt, Homo Sapiens
caaaugacuagcuuugcacagacaccucuaccuucagcacuaugggauucuagauuaauggggg

SEQ ID NO: 197436 - RNA, 64 nt, Homo Sapiens
caacuuugcaauagaaauacuggugccugcagagcagcacuaacaguggcaggugcuguacuag

SEQ ID NO: 197437 - RNA, 64 nt, Homo Sapiens
gugaaauacacaaaaaaugaucauuuuguugucacagcacuacauaugcucugguacacagaug

SEQ ID NO: 197438 - RNA, 64 nt, Homo Sapiens
uaugcuuugaugcuacaucaagaaucucagacuacagcacuaaacaacaggaugaaaauccauc

SEQ ID NO: 197439 - RNA, 64 nt, Homo Sapiens
auucuagaguauuccaggugucugagugccuugccagcacuaacaauaagucggacuuauuaac

SEQ ID NO: 197440 - RNA, 64 nt, Homo Sapiens
gucccaggagaggggcauuuuagagcuccagaaacagcacuaggggguggagggaagcugagga

SEQ ID NO: 197441 - RNA, 64 nt, Homo Sapiens
uccugacccuucccagcccccuccagggccaaugcagcacuaaaucccucucuccuccagcauu

SEQ ID NO: 197442 - RNA, 64 nt, Homo Sapiens
cuuucucaguguccguggcauuuuugugacuucccagcacuagaauaaguuuuccugccaaaau

SEQ ID NO: 197443 - RNA, 64 nt, Homo Sapiens
acugcaaaucugccugauaggacccauauucccacagcacuaauucaacauauaccuuacugag

SEQ ID NO: 197444 - RNA, 64 nt, Homo Sapiens
cuaugagggugagcugguccuguuccugagccuucagcacuaaccauuucuaagccuuugagac

SEQ ID NO: 197445 - RNA, 64 nt, Homo Sapiens
ugcuuuggugguguuugcacaaagcucuggcuggcagcacuaaacacacauucuugcucuaccc

SEQ ID NO: 197446 - RNA, 64 nt, Homo Sapiens
ucaaucccugacguuagggacucucugacagccacagcacuacaccuacagguaagucuacauc

SEQ ID NO: 197447 - RNA, 64 nt, Homo Sapiens
cuuggugcuuauugauauucgacaauggggcugacagcacuaaaucauauauaauaaauuaagg

SEQ ID NO: 197448 - RNA, 64 nt, Homo Sapiens
auacaggugguuuuaaauauauagaugcaaauugcagcacuacuuuaaauauuagauuaugucu

SEQ ID NO: 197449 - RNA, 64 nt, Homo Sapiens
cucagcauuuaauccaaacagggguucuuagucucagcacuaugacauuuugggcugacuacuu

SEQ ID NO: 197450 - RNA, 64 nt, Homo Sapiens
gcauaacuaggauuauaaugcugccucauuuucacagcacuacuugcuuauauugacaacaaau

SEQ ID NO: 197451 - RNA, 64 nt, Homo Sapiens
uuuaauugggggaaauaagcacuauuaacagauucagcacuacaaguauuuugaauguuguugc

SEQ ID NO: 197452 - RNA, 64 nt, Homo Sapiens
uuaauaucauuugauagguaaagaguauucuaaacagcacuacauauuuuguaauucauauagu

SEQ ID NO: 197453 - RNA, 64 nt, Homo Sapiens
auuuauucuuucauuuauaguaguaucuggagagcagcacuacccaaaaauacggagcagugcc

SEQ ID NO: 197454 - RNA, 64 nt, Homo Sapiens
uacauuaugacaggaaguaaaacugcauucuguacagcacuaguaaguuagagaauuuuuuucc

SEQ ID NO: 197455 - RNA, 64 nt, Homo Sapiens
aauugggcagucuuaauguuggcuaaggaaguaucagcacuagagacgugugaccuccauacug

SEQ ID NO: 197456 - RNA, 53 nt, Homo Sapiens
auucucucuuaaaagauaagccucagcacuacuagucugucaaaaagaaguaa

SEQ ID NO: 197457 - RNA, 64 nt, Homo Sapiens
ccugugcguugucugaaagcuccugcacugugagcagcacuauacauguuucaguccucuacca

SEQ ID NO: 197458 - RNA, 64 nt, Homo Sapiens
cuccaccugccuccaggccacgaaaugggaauuccagcacuaagccaggcaccgggcagaagcu

SEQ ID NO: 197459 - RNA, 64 nt, Homo Sapiens
uguuaccuuuuuaaucaagggcaacuuccuuuuccagcacuaccauuguaagguuuuuuucagg

SEQ ID NO: 197460 - RNA, 64 nt, Homo Sapiens
gugcccaagagccuuaccgggcuaaaggcccauccagcacuauugcagaccgaguggcagucug

SEQ ID NO: 197461 - RNA, 64 nt, Homo Sapiens
aauuaacuaaugucuuuuauuuuuagaaauauaccagcacuacuuauuguuugucuguuuagua

SEQ ID NO: 197462 - RNA, 64 nt, Homo Sapiens
gaccgcucagugcucuuacugaguaauuccccuccagcacuagauauucugccuuuggcuaauu

SEQ ID NO: 197463 - RNA, 64 nt, Homo Sapiens
cugcaaacccagacggccaccaacuccuagaaggcagcacuaugucacacaaucgaagacugca

SEQ ID NO: 197464 - RNA, 64 nt, Homo Sapiens
ucaugggauccuaaaauaaaccaacuccucuagucagcacuagagggcucucacagauacccau

SEQ ID NO: 197465 - RNA, 64 nt, Homo Sapiens
aauggguaagcagacaggccaugauuuaguuggccagcacuaacuccaccucuguucuccuuga

SEQ ID NO: 197466 - RNA, 64 nt, Homo Sapiens
cacaaaaccacccauucauucauuuauucauucacagcacuagcaagugcugccuaugcugaga

SEQ ID NO: 197467 - RNA, 64 nt, Homo Sapiens
acuguacacugguuuuuuucguguguuauuuaaacagcacuaguaugcugcaauguauaaucug

SEQ ID NO: 197468 - RNA, 64 nt, Homo Sapiens
aagcaguuuuaggagguucccaugugucuaaugucagcacuagaugagacuugcauguuccucg

SEQ ID NO: 197469 - RNA, 64 nt, Homo Sapiens
uuggaaaccaucagguacugccugcagacuucuccagcacuaaauauauuuguucccucuauaa

SEQ ID NO: 197470 - RNA, 64 nt, Homo Sapiens
gcauauaaaacuaucagaaguuaguaaaucauaccagcacuaaaaauaagacaauuggaauaua

SEQ ID NO: 197471 - RNA, 64 nt, Homo Sapiens
ucauaauuaaugcguuacuguaugaaccacaaaacagcacuauuuauuuagccuuacuucuacu

SEQ ID NO: 197472 - RNA, 64 nt, Homo Sapiens
uuagauucuuggucacuucucuaccacaagccaccagcacuauaaccaguuuugcguggguucu

SEQ ID NO: 197473 - RNA, 64 nt, Homo Sapiens
ucaaaucuuucuaauuuuuuguaucuuuagagggcagcacuagaagaaaucagcaggucuaauc

SEQ ID NO: 197474 - RNA, 64 nt, Homo Sapiens
cacccucaacaaacaccagcgcuuuggguacgugcagcacuacggccugggcagugccugugac

SEQ ID NO: 197475 - RNA, 64 nt, Homo Sapiens
guaaauacacaacacacacacccaaggaaagccccagcacuaaccaacuucccaguucaggagu

SEQ ID NO: 197476 - RNA, 64 nt, Homo Sapiens
uaggaaagaccauuuuuccuauauccacuugagacagcacuaugaucuauuccugguagaauag

SEQ ID NO: 197477 - RNA, 64 nt, Homo Sapiens
auucagaccuuugaaaaucuacauaccaauaauucagcacuacaauuauaauaguguuuaccaa

SEQ ID NO: 197478 - RNA, 64 nt, Homo Sapiens
aaucucaaaucacacugaacuaaggugucagcaacagcacuaaauccaaauaaaacaguuucca

SEQ ID NO: 197479 - RNA, 64 nt, Homo Sapiens
uagcuguuuuguauuauagucagaauuuuaaaagcagcacuauaauucaauguuauaaaacaag

SEQ ID NO: 197480 - RNA, 64 nt, Homo Sapiens
uucugcauccagugugguugucaauaaauguagucagcacuauucuuauacagggagagagucu

SEQ ID NO: 197481 - RNA, 64 nt, Homo Sapiens
acgauuucagugaccaaaugcucagcuguaaccacagcacuaacuggccuucuuuccagauugg

SEQ ID NO: 197482 - RNA, 64 nt, Homo Sapiens
auuagugugauaaugugcugcaaaaaauauccaacagcacuacacauaaguacagaguauucac

SEQ ID NO: 197483 - RNA, 64 nt, Homo Sapiens
agcucuccaguggcuuuuaaagaaagcugguccucagcacuaacaaaaucacuacaauagccua

SEQ ID NO: 197484 - RNA, 64 nt, Homo Sapiens
gaaagaacaccucuggguccuucuguccaguuuucagcacuagucuuacucagcuauccauuau

SEQ ID NO: 197485 - RNA, 64 nt, Homo Sapiens
uuuaauggggccaagagggucaggguccugcccucagcacuagaugggugugccaaaauaugcc

SEQ ID NO: 197486 - RNA, 64 nt, Homo Sapiens
gacacccccccacaacaagaggcccuccagguggcagcacuaagcccuccaggaaccaaggagu

SEQ ID NO: 197487 - RNA, 64 nt, Homo Sapiens
aagaaauggucauucuacuucaaagaaauugagccagcacuaucuguacuccaacauuaccgga

SEQ ID NO: 197488 - RNA, 64 nt, Homo Sapiens
agcgcugcuguaacgacuucaggagucacugauucagcacuaauuuccugcugugaaaacucau

SEQ ID NO: 197489 - RNA, 64 nt, Homo Sapiens
cucagggccuucuguaucugugccuggccaguggcagcacuagcagugguauuagcuuaugcca

SEQ ID NO: 197490 - RNA, 64 nt, Homo Sapiens
aggugccugcuuacaaggaaucccagaguucuggcagcacuaguguuagaacaccaaggagguu

SEQ ID NO: 197491 - RNA, 64 nt, Homo Sapiens
uccaguuagcuaccucuucaagguaccaggcccgcagcacuaacagaucacaucugaagaaacu

SEQ ID NO: 197492 - RNA, 64 nt, Homo Sapiens
uccuuguggccucaagaaauuuagacgcccacgacagcacuacacagcaucuccaggugaugcc

SEQ ID NO: 197493 - RNA, 64 nt, Homo Sapiens
aaauugaggagaguccuuucagugucgaggaauccagcacuacgcccugcccucuacugacugg

SEQ ID NO: 197494 - RNA, 64 nt, Homo Sapiens
cccccucugcccuccugugugcuuccuccugaaccagcacuaauaccaugcagagauggcaguu

SEQ ID NO: 197495 - RNA, 64 nt, Homo Sapiens
aaguaccuuuuuuuaucagaauguuaccuccuaacagcacuacaagauugguaguaaagguauu

SEQ ID NO: 197496 - RNA, 64 nt, Homo Sapiens
ccucccaccuccaaagcaucaggugaaaucagagcagcacuaccuucacugucagcaguuuuaa

SEQ ID NO: 197497 - RNA, 64 nt, Homo Sapiens
guaaacccugcucuuucuguacagcccagccucacagcacuauuuguauucucaugugguuugc

SEQ ID NO: 197498 - RNA, 64 nt, Homo Sapiens
uagacuauuucaggcuuaauuuuccuaacuuguucagcacuagugcuuuaccucucauuuuuaa

SEQ ID NO: 197499 - RNA, 64 nt, Homo Sapiens
cuuaccaugaccugguuuuccagugugguucugacagcacuacugauaaccaaacuggagucag

SEQ ID NO: 197500 - RNA, 64 nt, Homo Sapiens
uugacacuuuauuaaaggaaggcuuucauuuggucagcacuagaacaguaucuucugaagacaa

SEQ ID NO: 197501 - RNA, 64 nt, Homo Sapiens
gcaugagcuacuuucaucuaaaaaacaauuugcacagcacuaaaaauuuaaagauugauaugcu

SEQ ID NO: 197502 - RNA, 64 nt, Homo Sapiens
gcaaauaucacucagaugaaaagucagguauuagcagcacuaaaugaaacuguuuauacagcaa

SEQ ID NO: 197503 - RNA, 64 nt, Homo Sapiens
gagguauuugguaacuugcuuugcuucucuaaaacagcacuaucaccaaaugccuuucuagcaa

SEQ ID NO: 197504 - RNA, 64 nt, Homo Sapiens
cagcagcucugaaugucaccugcccuggggcuuacagcacuauaugaguuccuggccuauccug

SEQ ID NO: 197505 - RNA, 64 nt, Homo Sapiens
acuuccugguuuuauuuuuagucauugggucauacagcacuaaagucugcuauuuauggaaacu

SEQ ID NO: 197506 - RNA, 64 nt, Homo Sapiens
ccccccucaaugagagaggcaggcagaucucacccagcacuaggacaccaggaggccagguaac

SEQ ID NO: 197507 - RNA, 64 nt, Homo Sapiens
ucgggacggugugucacacgggcuuggguggguucagcacuagcacagcuugucacaguagcca

SEQ ID NO: 197508 - RNA, 64 nt, Homo Sapiens
uuuuauuacuggagaaauggugggugccagaucccagcacuacugucaggauaaaaaccaaauc

SEQ ID NO: 197509 - RNA, 64 nt, Homo Sapiens
ccaugccaggacaccagcugccugucucccaccucagcacuagucagaaaccaaaugugaacuu

SEQ ID NO: 197510 - RNA, 64 nt, Homo Sapiens
auuucauguugcacacccacccuucugucccucacagcacuagugucuucagccucuuucuguc

SEQ ID NO: 197511 - RNA, 64 nt, Homo Sapiens
gccgugucucugaggacgucacacagcagccccccagcacuaagcucuccuggggguggcaggc

SEQ ID NO: 197512 - RNA, 64 nt, Homo Sapiens
auuacugcuugucucucaaggcugcugucuuuaucagcacuaacuaaauaaauuuguugguuca

SEQ ID NO: 197513 - RNA, 64 nt, Homo Sapiens
uuuauugagagucucauauucaugcuuuucuucacagcacuauaaaguuggacuuggaaaauuu

SEQ ID NO: 197514 - RNA, 64 nt, Homo Sapiens
acugcccucacccucagccgucccaaggagugcccagcacuacucagcauguaguccaggaccu

SEQ ID NO: 197515 - RNA, 64 nt, Homo Sapiens
cugaggagcgacaugugguugaggagguggaucacagcacuauccagaggagucaucacagacc

SEQ ID NO: 197516 - RNA, 64 nt, Homo Sapiens
gggagggagggggagggaggacuauuuuaauacucagcacuagauuggucacuugcuuuuauag

SEQ ID NO: 197517 - RNA, 64 nt, Homo Sapiens
aucuuuuccuccagagguggggcugcaccagacucagcacuagcacuccaucagcacuagcacc

SEQ ID NO: 197518 - RNA, 64 nt, Homo Sapiens
uggggcugcaccagacucagcacuagcacuccaucagcacuagcaccucacuccaucagcacua

SEQ ID NO: 197519 - RNA, 64 nt, Homo Sapiens
cuagcacuccaucagcacuagcaccucacuccaucagcacuagcaccucacuccaucggccccg

SEQ ID NO: 197520 - RNA, 64 nt, Homo Sapiens
cggcacuaaugccccacucggcgccccacuccaucagcacuaaugcuccacuccauuggcacua

SEQ ID NO: 197521 - RNA, 64 nt, Homo Sapiens
gacccgcuccuuugacauuggugccccacuccaucagcacuaacgcccugcuccaucggcacug

SEQ ID NO: 197522 - RNA, 64 nt, Homo Sapiens
cuuucucagaggggccagcuaacccgugcagaaccagcacuaagguggacagcagacaagaggg

SEQ ID NO: 197523 - RNA, 64 nt, Homo Sapiens
gugcucaccccaggcuucccugacggggaugacucagcacuaccccucaacagagaugacuuug

SEQ ID NO: 197524 - RNA, 64 nt, Homo Sapiens
uuuagggugaguuccucauuuacccucauauuuucagcacuaauuucuuuugguggcucgaugu

SEQ ID NO: 197525 - RNA, 64 nt, Homo Sapiens
uaauaguuuauaaaucaguggagcagacagaauucagcacuacuugcauucauuuaaacuaaua

SEQ ID NO: 197526 - RNA, 64 nt, Homo Sapiens
ugcacuaacaaggacuccagcccacccuucucaccagcacuaaauucagcguccaagacugggg

SEQ ID NO: 197527 - RNA, 64 nt, Homo Sapiens
acugaggagccucaacugcuacuguuuauuauuucagcacuaaaaaggauacuguugaccuguc

SEQ ID NO: 197528 - RNA, 64 nt, Homo Sapiens
gaacagcauguggaagaagaggaggagcucaaaccagcacuaauguggacauggccaucgcaug

SEQ ID NO: 197529 - RNA, 64 nt, Homo Sapiens
ugucauaaagacauauauacacaaauguucacggcagcacuauacacaaucgcaaagucaggga

SEQ ID NO: 197530 - RNA, 64 nt, Homo Sapiens
cauuuuauguuagucacagucuugaauguauaaacagcacuaagacucucaggucagguaccuu

SEQ ID NO: 197531 - RNA, 64 nt, Homo Sapiens
gcuaugaugcugcauggcagaggcagguauaacacagcacuacauauuggaaauuuuuuauuuu

SEQ ID NO: 197532 - RNA, 64 nt, Homo Sapiens
cagaagucaggugucaucaucagacuugcggccacagcacuagagucacccccccaggccucca

SEQ ID NO: 197533 - RNA, 64 nt, Homo Sapiens
agaaaggaguuauuaaaguaauuuacaaaccucucagcacuaauuaguguccaacuccaagugg

SEQ ID NO: 197534 - RNA, 64 nt, Homo Sapiens
ggaaaugugcuucuacuuugccaguuauuucagacagcacuaccaagaggagguggucagcacu

SEQ ID NO: 197535 - RNA, 64 nt, Homo Sapiens
guaauggaacuuugaugaugucugguuugccuuccagcacuaaaucucugcaaacaaguugcca

SEQ ID NO: 197536 - RNA, 64 nt, Homo Sapiens
uuucugaucugucacuguugacagccaaugaaaacagcacuauaccuugguuggauucuucaac

SEQ ID NO: 197537 - RNA, 64 nt, Homo Sapiens
agucugggggagccaguuuucagcccccugaagacagcacuacagagguggcguguaaggaaug

SEQ ID NO: 197538 - RNA, 64 nt, Homo Sapiens
auguguugaaugcuuaccaauccauacuuucccacagcacuacgucaggccugcugguucccac

SEQ ID NO: 197539 - RNA, 64 nt, Homo Sapiens
aaguuggaauuccacgcccgcaaccccagggcuccagcacuacccauauuggagaugaccccau

SEQ ID NO: 197540 - RNA, 64 nt, Homo Sapiens
uaacuugggggaaacgggggccagacuuuuaaaacagcacuaaagaagagacugcauuguggcc

SEQ ID NO: 197541 - RNA, 64 nt, Homo Sapiens
ucaccccgacccccacccuccagugcccuccccacagcacuaccagggacguuuccaucauuca

SEQ ID NO: 197542 - RNA, 64 nt, Homo Sapiens
ggagggugagacccagccaauccuugggagcaagcagcacuaaaucacaucagggagugauuag

SEQ ID NO: 197543 - RNA, 64 nt, Homo Sapiens
auggcugcuuggucuuggccacagugcucucagccagcacuaagggcugaggucaauaccgcag

SEQ ID NO: 197544 - RNA, 64 nt, Homo Sapiens
gugggggaaguggcuccuggcaggagauuucucccagcacuaauauccugguguucuauaaaau

SEQ ID NO: 197545 - RNA, 64 nt, Homo Sapiens
auuccuauaaggaagauuuggaagcucuucuucccagcacuaugcuuuccuucuuugggauaga

SEQ ID NO: 197546 - RNA, 64 nt, Homo Sapiens
cugcagcuggccacaccacaggcccccgugccugcagcacuacuggugccugaaacaccuggcc

SEQ ID NO: 197547 - RNA, 64 nt, Homo Sapiens
cgcacugaccacacccaccgcaaccucauccccucagcacuaaccacauccacucucaaccccg

SEQ ID NO: 197548 - RNA, 64 nt, Homo Sapiens
gcgggccaggcacaguggcucacaccuguaaucccagcacuaugggaggcccaggugagcagau

SEQ ID NO: 197549 - RNA, 64 nt, Homo Sapiens
uccaccauaaagacaaacacuuguauguucauugcagcacuauucucaauagcaaagaugugga

SEQ ID NO: 197550 - RNA, 64 nt, Homo Sapiens
ggcauccauuuccauacaggaacaaaauaggaggcagcacuacagacccuacacacagcuuuac

SEQ ID NO: 197551 - RNA, 64 nt, Homo Sapiens
guaaggcugggcgugguggcucacgccuguaacccagcacuaugggaggucgaggugggcagau

SEQ ID NO: 197552 - RNA, 64 nt, Homo Sapiens
agggccuccccaggcuuccaggauguccccaccccagcacuaucgaggccagggacacaugaag

SEQ ID NO: 197553 - RNA, 64 nt, Homo Sapiens
cuaacccucagccgacaguccuuccagacccuaccagcacuaccccacaccgacaacuccccgg

SEQ ID NO: 197554 - RNA, 52 nt, Homo Sapiens
cuucuugcaagacagccugauccagcacuaccugcgaguccgucuguccuag

SEQ ID NO: 197555 - RNA, 64 nt, Homo Sapiens
ggaggccgagacgggcggaucaugccuguaaucccagcacuaugguuggccaggcacggugguu

SEQ ID NO: 197556 - RNA, 64 nt, Homo Sapiens
cacccuuugggcugccuugcucaucuuuaugccccagcacuagguacggggcccaacacguggu

SEQ ID NO: 197557 - RNA, 64 nt, Homo Sapiens
gaacccaaaagauuggagccuuaacaauaaacaucagcacuaagugaccuguuccuccuuuuuu

SEQ ID NO: 197558 - RNA, 64 nt, Homo Sapiens
uccuggcuggaacccagcacccucugugggaagccagcacuagcucucaucccccauccgggag

SEQ ID NO: 197559 - RNA, 64 nt, Homo Sapiens
cugcagauccgcauguggaccaugagccggcugccagcacuagguccugggcagcuuuguuugu

SEQ ID NO: 197560 - RNA, 64 nt, Homo Sapiens
cuccugaggacucuucagugcauuccguggacaucagcacuacuuuguccaugugcugcuccca

SEQ ID NO: 197561 - RNA, 64 nt, Homo Sapiens
ucuaccagcggugguuccagcccugcccgcuggacagcacuaucucacgaugggaggccugggg

SEQ ID NO: 197562 - RNA, 64 nt, Homo Sapiens
cuagagaacuaaacuggcuuguccaucuguuggacagcacuauuuguacugacagcgagagcau

SEQ ID NO: 197563 - RNA, 64 nt, Homo Sapiens
acaugcacacacaaagugcagcacagaccacacacagcacuaaccaguauacacauacacaagu

SEQ ID NO: 197564 - RNA, 64 nt, Homo Sapiens
guucuaaaaagaaagugguauguugugugaugaucagcacuaaguccugcauuccuguuaaagc

SEQ ID NO: 197565 - RNA, 64 nt, Homo Sapiens
auggaaugugccuggauacaguacuacuuguggucagcacuaucccucuuagaucaguucuuuu

SEQ ID NO: 197566 - RNA, 64 nt, Homo Sapiens
ucuccccgcugaaaccagcaauuaucagagcugucagcacuaccucacaaagggcuucagguag

SEQ ID NO: 197567 - RNA, 64 nt, Homo Sapiens
ucauucuggaccugggaccuuaggagccgggugacagcacuaaccagaccuccagccacucaca

SEQ ID NO: 197568 - RNA, 64 nt, Homo Sapiens
ucagccacaccuuuuccaggaguucugaagcugacagcacuacaaaggagacgggggagcagca

SEQ ID NO: 197569 - RNA, 64 nt, Homo Sapiens
ggagggggcagauggugguuuccagccgguucugcagcacuaggcuucugaaagugugacagug

SEQ ID NO: 197570 - RNA, 64 nt, Homo Sapiens
acuuauucaacuuuggccaaugaguuacaucuagcagcacuaaacagauaucgagcaaaugguu

SEQ ID NO: 197571 - RNA, 64 nt, Homo Sapiens
aggcgcaaaaguagagcugugucagggaucagggcagcacuaacaaaauuagccagcucuuccu

SEQ ID NO: 197572 - RNA, 64 nt, Homo Sapiens
caggugugaggagcccugcuaagacagggcagugcagcacuaggugccccggcugugugaauuc

SEQ ID NO: 197573 - RNA, 64 nt, Homo Sapiens
gacagcccaguguagagauuggcacuucccuguccagcacuacaacuuaauugcucuaugccuc

SEQ ID NO: 197574 - RNA, 64 nt, Homo Sapiens
aaaacaaguauugucagguauucucuccauagaacagcacuacccuccucucuccccagaugug

SEQ ID NO: 197575 - RNA, 64 nt, Homo Sapiens
aaaacaaguauugucagguauucucuccauagaacagcacuauccucaucucuccccagaugug

SEQ ID NO: 197576 - RNA, 64 nt, Homo Sapiens
aaaacaaguauugucauguauucucugcauagaacagcacuauccucaucucuccccagaugug

SEQ ID NO: 197577 - RNA, 64 nt, Homo Sapiens
cucauauggcccagugucaaguugugcuuguuuacagcacuacucugugccagccacacaaacg

SEQ ID NO: 197578 - RNA, 64 nt, Homo Sapiens
gcuguggacauguggguggagaagggaggguggccagcacuaguaaaggaggaauagugcuugc

SEQ ID NO: 197579 - RNA, 64 nt, Homo Sapiens
ucaaauaaauccacaaguuaaugccuaaccucuucagcacuagccaaagguugucaagacacac

SEQ ID NO: 197580 - RNA, 64 nt, Homo Sapiens
gauuugaagcaugaaaguucuggcagguuaugagcagcacuagggauaaaguaugguuuuauuu

SEQ ID NO: 197581 - RNA, 64 nt, Homo Sapiens
aggugaacuguaagaugagaacaagaucacaagucagcacuaccuccucccuucuugaguucuc

SEQ ID NO: 197582 - RNA, 64 nt, Homo Sapiens
uuuaacuuguaaaugaaaaaauucucuuaaaccacagcacuauugagugaaacauugaacucau

SEQ ID NO: 197583 - RNA, 64 nt, Homo Sapiens
acauccaaacauaagucacucacauggcccugaucagcacuaccuuugcucuccaggacaucag

SEQ ID NO: 197584 - RNA, 64 nt, Homo Sapiens
caagaagccaaagaaacacuauaggcaguauacacagcacuacuuagagauguuauaaaaaugu

SEQ ID NO: 197585 - RNA, 64 nt, Homo Sapiens
uuccucucuccccacauguguucucuccauagaacagcacuaccaaaacaaguauagucaggua

SEQ ID NO: 197586 - RNA, 64 nt, Homo Sapiens
cuccucucuccccagauguguucucuccauagaacagcacuaccaaaacaaguauugucaggua

SEQ ID NO: 197587 - RNA, 64 nt, Homo Sapiens
cuccucucuccccagauguguucucuccauagaacagcacuaccaaagcaaguauagucaggua

SEQ ID NO: 197588 - RNA, 64 nt, Homo Sapiens
gcauaccccucuacaacauaguuaggaaaggauucagcacuacauccaagauucucagauccag

SEQ ID NO: 197589 - RNA, 64 nt, Homo Sapiens
uccucuguguaacugccauugaaaggcaugagagcagcacuaagacauuaauguuguuacuggu

SEQ ID NO: 197590 - RNA, 64 nt, Homo Sapiens
gcugaucaaaauuugcucucccaaaaguauuucacagcacuaauuauacuuuggggaugauaau

SEQ ID NO: 197591 - RNA, 64 nt, Homo Sapiens
uauguaaguguggcaaugugaacugaagcugaugggcugagaacauggacugagcuuguggugu

SEQ ID NO: 197592 - RNA, 64 nt, Homo Sapiens
ucacccaugaagacaggacagugcuucagccugaggcugagacugcgggaugguccuggggcuc

SEQ ID NO: 197593 - RNA, 64 nt, Homo Sapiens
acagggcaccccagcugaccugguacugagguugggcugagacccugcuucucuucccccauca

SEQ ID NO: 197594 - RNA, 64 nt, Homo Sapiens; identical to SEQ ID NO: 197593

SEQ ID NO: 197595 - RNA, 64 nt, Homo Sapiens
cugaucguaggaauugaggagugucccgccuuguggcugagaacuggacaguggcaggggcugg

SEQ ID NO: 197596 - RNA, 64 nt, Homo Sapiens
cuaguccugagauggaaacagcaacuuguacaguggcugagaaaauaggauauaguuuugauuu

SEQ ID NO: 197597 - RNA, 64 nt, Homo Sapiens
cagcugugugaguguugagaucucugccaucucuggcugagauacugcuguccugugaaguguu

SEQ ID NO: 197598 - RNA, 64 nt, Homo Sapiens
gguggugcaugccuguagucccaguuacucgggaggcugagacaggagaaucgcuugaacccag

SEQ ID NO: 197599 - RNA, 64 nt, Homo Sapiens
gagaggaggucuuccagcagcagcaggucuggagggcugagaaugaaccugacuagagguucug

SEQ ID NO: 197600 - RNA, 64 nt, Homo Sapiens
cugcaacauggggacauuugccaacucgaacaaaggcugagaagcagccacaccguuguuuagg

SEQ ID NO: 197601 - RNA, 64 nt, Homo Sapiens
gcuuggcucugaccccacggccccagcuggagcuggcugagagcaguccugcagguaaauguac

SEQ ID NO: 197602 - RNA, 64 nt, Homo Sapiens
cugaacaggugaaugaagaaggaagaggauuccaggcugagagcacuggacguggcaacuguuc

SEQ ID NO: 197603 - RNA, 64 nt, Homo Sapiens
accaguggccccuuguuugccaaaggcagaguggggcugagaaacaggcugcggugauugcaau

SEQ ID NO: 197604 - RNA, 64 nt, Homo Sapiens
guccagagcuucagggcugggcagguccuggggaggcugagacugcagaggagccaccugggcu

SEQ ID NO: 197605 - RNA, 64 nt, Homo Sapiens
ugcuucaguggauucacugguuagauuaaaaagaggcugagaugagcagugaacuaagaggcca

SEQ ID NO: 197606 - RNA, 64 nt, Homo Sapiens
cgauaacucccuaggggcuccugccugcccaagcggcugagaaccagcgccccgaugccugagg

SEQ ID NO: 197607 - RNA, 64 nt, Homo Sapiens
ugggaguuaugcuggggguuguaaauaaugacaaggcugagauuuuuaugauguuuaaauuggg

SEQ ID NO: 197608 - RNA, 64 nt, Homo Sapiens
agauuagggcggggagaagagcauccggcaugagggcugagaugcgcaaagagugugcucggga

SEQ ID NO: 197609 - RNA, 64 nt, Homo Sapiens
gcgguauuaaaucugugaaacucggccggaguuuggcugagaucgugaagacauuucucaacuu

SEQ ID NO: 197610 - RNA, 64 nt, Homo Sapiens
gcuggcgcggggggccccaagccgcacaggugguggcugagacagcugaccccucggagcaagc

SEQ ID NO: 197611 - RNA, 64 nt, Homo Sapiens
ugauucauuugaagauacaagcuguaauuaugauggcugagaaaagagaguucauacggacuaa

SEQ ID NO: 197612 - RNA, 64 nt, Homo Sapiens; identical to SEQ ID NO: 64824

SEQ ID NO: 197613 - RNA, 64 nt, Homo Sapiens; identical to SEQ ID NO: 64825

SEQ ID NO: 197614 - RNA, 64 nt, Homo Sapiens; identical to SEQ ID NO: 64826

SEQ ID NO: 197615 - RNA, 64 nt, Homo Sapiens; identical to SEQ ID NO: 64827

SEQ ID NO: 197616 - RNA, 64 nt, Homo Sapiens
cccaugaucagauauuugaugcauagucagucugggcugagaucucacucacccuaccuccagg

SEQ ID NO: 197617 - RNA, 64 nt, Homo Sapiens
cacgaaucccuugagcccagccagcuacuagggaggcugagacagguggccggcgccuguaauc

SEQ ID NO: 197618 - RNA, 64 nt, Homo Sapiens; identical to SEQ ID NO: 64828

SEQ ID NO: 197619 - RNA, 64 nt, Homo Sapiens; identical to SEQ ID NO: 64829

SEQ ID NO: 197620 - RNA, 64 nt, Homo Sapiens; identical to SEQ ID NO: 64830

SEQ ID NO: 197621 - RNA, 64 nt, Homo Sapiens
ccuuccuguucccagaugcccugcaguagaugauggcugagagcuccauuuguaaaacaagugg

SEQ ID NO: 197622 - RNA, 64 nt, Homo Sapiens
ucaaucgguaacaauuccccaugagucaggaaaaggcugagaccaaguugaaaaccuuuggaaa

SEQ ID NO: 197623 - RNA, 64 nt, Homo Sapiens
auccaauuagcuuguacgaucaugaggaaagugaggcugagagaagaauuauugucauuuuaca

SEQ ID NO: 197624 - RNA, 64 nt, Homo Sapiens
gagccugaagucuugcaggaagcagggagcugcuggcugagaaauuuccuacuuuuccaggcuc

SEQ ID NO: 197625 - RNA, 64 nt, Homo Sapiens
augacggcaagaggaacagaaggaccgaccccauggcugagaauuacuuggcccagcugcuugg

SEQ ID NO: 197626 - RNA, 64 nt, Homo Sapiens
ccuggcccgcuaaggugaaagacauaugguuucuggcugagaggcucuuaacuuacgaucucuu

SEQ ID NO: 197627 - RNA, 64 nt, Homo Sapiens
ucaaaugguuacccugcuucaccucccuguuccaggcugagaacucucuaggugcugagcccuc

SEQ ID NO: 197628 - RNA, 64 nt, Homo Sapiens
ggagaaucgcuugaacccagccagcuacucuggaggcugagacagguggcacacaucuguaguc

SEQ ID NO: 197629 - RNA, 64 nt, Homo Sapiens
gaggcaguuggaaucuagaccucaggcagcugagggcugagaaugaugcacauugaagggaggg

SEQ ID NO: 197630 - RNA, 64 nt, Homo Sapiens
uagcagguaguccaggauagaccaaugaaagcauggcugagaaagaucuagggaauucaguggg

SEQ ID NO: 197631 - RNA, 64 nt, Homo Sapiens
aagcacagggugguuucacugaagccugugaugaggcugagauaccacccucaugacugggaag

SEQ ID NO: 197632 - RNA, 64 nt, Homo Sapiens
ggagggauagggugcuacuucaacauggggcccuggcugagagugcuaaggugaggccuuccuc

SEQ ID NO: 197633 - RNA, 64 nt, Homo Sapiens
guuugcaguggagcccugagaucccagcucagaaggcugagaggccccaccucccaggaccugc

SEQ ID NO: 197634 - RNA, 64 nt, Homo Sapiens
aauggcucaugccuguaaucccagcacuuugggaggcugagaugggaggaucacuugaagccag

SEQ ID NO: 197635 - RNA, 64 nt, Homo Sapiens
ggugguacaugccuguaaucccagcuacucaggaggcugagacaggagaaucacuugaaccugg

SEQ ID NO: 197636 - RNA, 64 nt, Homo Sapiens
uuuccagaccugcuccugcugcacagagccgcagggcugagaccacguccaugcuggcugccuu

SEQ ID NO: 197637 - RNA, 64 nt, Homo Sapiens
ucacaccugcuucccaaugagcacucagcagcauggcugagaccuggggcuugacaggccugcg

SEQ ID NO: 197638 - RNA, 64 nt, Homo Sapiens
agaaugccagcccaaagcuggagccaauggugagggcugagagggcuguggcuggguggucagc

SEQ ID NO: 197639 - RNA, 64 nt, Homo Sapiens
guauuuuuuauuccauuucaauauuaaccaaauaggcugagaaauucauagcaauugaauuaag

SEQ ID NO: 197640 - RNA, 64 nt, Homo Sapiens
cucugucuauagcuuucccaugguagccugauaaggcugagagagaaaaauaugugcaguaucu

SEQ ID NO: 197641 - RNA, 64 nt, Homo Sapiens
ugcugaaguugcuuaucagcuuaaggagauuuugggcugagacaaugggguuuucuagauauac

SEQ ID NO: 197642 - RNA, 64 nt, Homo Sapiens
ggcggcgagcaccuguaaucccagcuacucgggaggcugagacaggagaaucucuugaauccag

SEQ ID NO: 197643 - RNA, 64 nt, Homo Sapiens
uccagucuaauuuuacgcuguagcagaaccagauggcugagaaaauucuggaacuauggaucuu

SEQ ID NO: 197644 - RNA, 64 nt, Homo Sapiens
gguggugagugccuguaaucacagcuacuugggaggcugagaugggagaaucacuugaacccgg

SEQ ID NO: 197645 - RNA, 64 nt, Homo Sapiens
uuuagcuaaagucccgcggguuccggcauggcuaggcugagagcagggaucuaccuggcuucuc

SEQ ID NO: 197646 - RNA, 64 nt, Homo Sapiens
ugggacagaaagaugauuaaucucgggccuuuguggcugagaagaccagccaaguucaugcccc

SEQ ID NO: 197647 - RNA, 64 nt, Homo Sapiens
ggagaaucgcuugaacccagccagcuacuugggaggcugagacagauggugguggccuguaauc

SEQ ID NO: 197648 - RNA, 64 nt, Homo Sapiens
ggaggauugcuuaagcccagccagcuacucaggaggcugagacaaguaguauccgccuguaguc

SEQ ID NO: 197649 - RNA, 64 nt, Homo Sapiens
gugaauuugggcugcuguaguuaugccccaccaaggcugagacagcacuugccauuccaaaaua

SEQ ID NO: 197650 - RNA, 64 nt, Homo Sapiens
ggggcuagacugggcuggcuaugcuggguucuggggcugagaguccuuccaggccccaggcugg

SEQ ID NO: 197651 - RNA, 64 nt, Homo Sapiens
aggaauccaaaauauuaauaagauaguagcuuuuggcugagaaauaaacugaaaagcuuaauuc

SEQ ID NO: 197652 - RNA, 64 nt, Homo Sapiens
ccaccaccaaagguuaaguggcuugugggggguaggcugagaccccuuccugaggggccucagg

SEQ ID NO: 197653 - RNA, 64 nt, Homo Sapiens
uaaaauaauuugcccgaagagcauuauuacauuaggcugagaggccgcgugagcaguguuaccu

SEQ ID NO: 197654 - RNA, 64 nt, Homo Sapiens
auaaacagaagcuguuugcuaaaagcgaauuuguggcugagaggggguauaggaaaauauaccu

SEQ ID NO: 197655 - RNA, 64 nt, Homo Sapiens
ccaaacugcugucccaaacagacucucuuaaggaggcugagagcuacagggaugaggcagaccu

SEQ ID NO: 197656 - RNA, 64 nt, Homo Sapiens; identical to SEQ ID NO: 64831

SEQ ID NO: 197657 - RNA, 64 nt, Homo Sapiens; identical to SEQ ID NO: 64832

SEQ ID NO: 197658 - RNA, 64 nt, Homo Sapiens
cccugauguaaagaucagucgucagaagugcugaggcugagaaaagaauuaccccucccaaaau

SEQ ID NO: 197659 - RNA, 64 nt, Homo Sapiens
ugggucccgggagauggaagccuuccucgccccgggcugagagcccgggugagccugucuggcg

SEQ ID NO: 197660 - RNA, 64 nt, Homo Sapiens
ggaggauugaucgaucgcuuccagcuacuuaggaggcugagaugcauggcacacaccuguaguc

SEQ ID NO: 197661 - RNA, 64 nt, Homo Sapiens
gguggauuaccugaggucagccagcacuuugggaggcugagacggguggcucaugccuguaauc

SEQ ID NO: 197662 - RNA, 64 nt, Homo Sapiens
aaggagggugaggcggugggggauugcagggggcggcugagagaaaaccuccuugggggccagg

SEQ ID NO: 197663 - RNA, 64 nt, Homo Sapiens
cacagcauauccaggcugccacagguggggacgaggcugagagagucagcaggcagagccagau

SEQ ID NO: 197664 - RNA, 64 nt, Homo Sapiens
aaggaugcuccggggccauuguuaguggguuuggggcugagaugagugauccugccucuggucc

SEQ ID NO: 197665 - RNA, 64 nt, Homo Sapiens
cuggccuccaagucgugaggaaauggguaugcaaggcugagauuucuacagcaauaaaggagac

SEQ ID NO: 197666 - RNA, 64 nt, Homo Sapiens
cuagugcuggagaaaguaccgggaagaaggagguggcugagaagagccagaucaaccucauuga

SEQ ID NO: 197667 - RNA, 64 nt, Homo Sapiens
cuacagccugaguaggccugaguggccguggccaggcugagaccugucaggccauacugacaag

SEQ ID NO: 197668 - RNA, 64 nt, Homo Sapiens
gggggcacacaccgguaaucccagcuacucaggaggcugagacaggagagucgcuugaaccugg

SEQ ID NO: 197669 - RNA, 64 nt, Homo Sapiens
ugugaaucuuggugucuacguuaccaggcaggaaggcugagaggagagagacuccagcuggguu

SEQ ID NO: 197670 - RNA, 64 nt, Homo Sapiens
agaugacuucaccucacucagccuuggcuucuaaggcugagaaaugggacuuaaugcuuuauuu

SEQ ID NO: 197671 - RNA, 54 nt, Homo Sapiens
ccagcagcaagcccaaguaguuauggcugagaagacagagcacugacaaugagc

SEQ ID NO: 197672 - RNA, 64 nt, Homo Sapiens
uggagaaucuuaagaaaugcaagcuuguucagggggcugagaagauccugaguacacuaggugc

SEQ ID NO: 197673 - RNA, 64 nt, Homo Sapiens
ggugccucacaucuguaaucccaacacuuugggaggcugagauggguggauugcuugagcccag

SEQ ID NO: 197674 - RNA, 64 nt, Homo Sapiens
gcucaagugauccucccgucucagccucccaaagggcugagauuacaggugugagcuaccucac

SEQ ID NO: 197675 - RNA, 64 nt, Homo Sapiens
augaauggaaggaggcuuaggacuuuccacuccuggcugagagaggaagagcugcaacggaauu

SEQ ID NO: 197676 - RNA, 64 nt, Homo Sapiens
aacuagcugcagagggaugagugaccaccauccaggcugagacugaaaggagcagaggcuggaa

SEQ ID NO: 197677 - RNA, 64 nt, Homo Sapiens
gguggcucacgucuguaaucccagcacuuugggaggcugagacagguggaucacuugaggucgg

SEQ ID NO: 197678 - RNA, 64 nt, Homo Sapiens
cucugaaagccuccugcugcccacuguuucccugggcugagaggggaagugcauauguguagcg

SEQ ID NO: 197679 - RNA, 64 nt, Homo Sapiens
aagcauucuccuguuuuuacagauuguauccugaggcugagagaguuaagugaaugucuaaggu

SEQ ID NO: 197680 - RNA, 64 nt, Homo Sapiens
ggugacucacacuuguaaucccagcaauuugggaggcugagacaggaggauugccugaggccag

SEQ ID NO: 197681 - RNA, 64 nt, Homo Sapiens
uuaguguuuucacagugaaguggagucucauuauggcugagaguuugggguuucugauaaugug

SEQ ID NO: 197682 - RNA, 64 nt, Homo Sapiens
cuauaaaaacagcucggcccuuaagaacacugguggcugagaugucuuuggcuauuuguauggu

SEQ ID NO: 197683 - RNA, 64 nt, Homo Sapiens
augaugcuugggcuuaggaucguugaucaauggaggcugagaccccagacgccagaaggucagc

SEQ ID NO: 197684 - RNA, 64 nt, Homo Sapiens; identical to SEQ ID NO: 64833

SEQ ID NO: 197685 - RNA, 64 nt, Homo Sapiens; identical to SEQ ID NO: 64834

SEQ ID NO: 197686 - RNA, 64 nt, Homo Sapiens
uggauaaagucuugggaaauguacccuacucaguggcugagaauagcacacuaggacccaggug

SEQ ID NO: 197687 - RNA, 59 nt, Homo Sapiens
ucaguuuugugaccaugacacagggaggaggcugagaacgcugcugccaccugaccuga

SEQ ID NO: 197688 - RNA, 64 nt, Homo Sapiens
ugcuugggagucucugcuggucaacagaguuguuggcugagaccgacuaucuuccaguugcugc

SEQ ID NO: 197689 - RNA, 64 nt, Homo Sapiens
auugagaugaaaguuaacaugcaaaucacaugaaggcugagaugaaacuagagaaacacaauaa

SEQ ID NO: 197690 - RNA, 64 nt, Homo Sapiens
augagaggaauauuuaaauagucuuugaaguuguggcugagaagugaaugacuggcaugaacac

SEQ ID NO: 197691 - RNA, 64 nt, Homo Sapiens
cugaagaagucacugaacaauuauuugcucagcuggcugagacaacuaugccuauguagugucu

SEQ ID NO: 197692 - RNA, 64 nt, Homo Sapiens
ggaagaaaacacggagccuuagcgacuucugugaggcugagagagcaugagcauuuucaggaua

SEQ ID NO: 197693 - RNA, 57 nt, Homo Sapiens
gccuugaagcacaucuguaggcaagauggcugagaaauacaggagaggcgucugcuu

SEQ ID NO: 197694 - RNA, 64 nt, Homo Sapiens
ugcgaccuuaauuuaacuuuccagucuuagcugaggcugagaaagcuaaaguuugguuuugaca

SEQ ID NO: 197695 - RNA, 64 nt, Homo Sapiens
ggcacaugccuguagucccagauacuugggagugggcugagaugggagaaucgcuugagcccag

SEQ ID NO: 197696 - RNA, 64 nt, Homo Sapiens
aaaauguagaaacuuaaacacaccuuccuguggaggcugagaugaaaacuagggcucauuuucc

SEQ ID NO: 197697 - RNA, 64 nt, Homo Sapiens
uugggaggcugaggugggaggguugaucacuugaggcugagaggucaagguugcagugagccau

SEQ ID NO: 197698 - RNA, 64 nt, Homo Sapiens
caguuacagaaugcuacacacuuaccuuuuuauuggcugagaaaucugguuauuucaucuuaau

SEQ ID NO: 197699 - RNA, 64 nt, Homo Sapiens
gcagggaaggagaaauaaagcacaguggaacgcaggcugagaacagaagaccuaggccauagag

SEQ ID NO: 197700 - RNA, 64 nt, Homo Sapiens
aaucccuccccuugcacuugcacugguaaauguuggcugagaacguuuuugcgugugucggaau

SEQ ID NO: 197701 - RNA, 64 nt, Homo Sapiens
gguaccuuuauauaacucuuuaaugaauaauuuuggcugagaauuucugguuaucuaugaauaa

SEQ ID NO: 197702 - RNA, 64 nt, Homo Sapiens
gcagcaauauugauauuauaugacuguugcaccaggcugagaaaucagaaaccuugugaugucu

SEQ ID NO: 197703 - RNA, 64 nt, Homo Sapiens
gcuuccuucuugaagacgagguucuucuucacaaggcugagaguuagccccaggaacccuugag

SEQ ID NO: 197704 - RNA, 64 nt, Homo Sapiens
aagcaaaagaaaagcaaaaaccaagcaaaaaucaggcugagaaaaggaaaccaagaaaaagaag

SEQ ID NO: 197705 - RNA, 64 nt, Homo Sapiens
ggaagaguuucagauaauaacugugccucuaagaggcugagaaugccacugaaacuugagccau

SEQ ID NO: 197706 - RNA, 64 nt, Homo Sapiens
gaagaacugcuugaaaccagccagcuacucgggaggcugagacagauggcggacgccuguaguc

SEQ ID NO: 197707 - RNA, 64 nt, Homo Sapiens
acccccuuuacucagagauaacauagauuauccaggcugagauggaaaacaagcccuuuauuga

SEQ ID NO: 197708 - RNA, 64 nt, Homo Sapiens
gguggcucacgccuguaaucccagcacuuugggaggcugagaagggcggaucacgaggucagga

SEQ ID NO: 197709 - RNA, 64 nt, Homo Sapiens
aguggcucauguguguaaucccagcacucugggaggcugagacagguagaucauuugaggucag

SEQ ID NO: 197710 - RNA, 64 nt, Homo Sapiens
uguggcuaccgcggguaugcgagugccagauauuggcugagacgagccagcuuagacuaauugg

SEQ ID NO: 197711 - RNA, 64 nt, Homo Sapiens
gguggugcaugccuguaaucccagcuacuugggaggcugagacaggagaaucacuugaacuagg

SEQ ID NO: 197712 - RNA, 64 nt, Homo Sapiens
auuugauauuuuuugagaugacacucaagcaucaggcugagauuugcacacaugggauguaaaa

SEQ ID NO: 197713 - RNA, 64 nt, Homo Sapiens
gaguugugcaugaacucgguaauacacaucacacggcugagaguccccuuuccaggcagggcca

SEQ ID NO: 197714 - RNA, 64 nt, Homo Sapiens
gggagucaggggaagccugucccgggaaggcccaggcugagaggcccuggcucuggccaggcug

SEQ ID NO: 197715 - RNA, 64 nt, Homo Sapiens
ccagcccacaauuacacaaaaaaaggcuuggugaggcugagaaacucccauuuuucuaauuaga

SEQ ID NO: 197716 - RNA, 64 nt, Homo Sapiens
guuguuuuuauaauagguaaaucucauuuguuaaggcugagaagcaaaaggagcauuuauaauu

SEQ ID NO: 197717 - RNA, 64 nt, Homo Sapiens
caagacuugcuugaacccggccagccacuagggcggcugagacggguggcacaugccuguaguc

SEQ ID NO: 197718 - RNA, 64 nt, Homo Sapiens
cccccccccaccuuuuuuuucugcuucuugcagaggcugagaguuucacucacacagcucccga

SEQ ID NO: 197719 - RNA, 64 nt, Homo Sapiens
gucgugcgacuccuacucccaaagucaaauccaaggcugagacagccccuagguggaugaggcc

SEQ ID NO: 197720 - RNA, 64 nt, Homo Sapiens
cccaaaaugagaauacuacuaaccuuuuuuuuaaggcugagauuucuaaaauauaaguaaagcc

SEQ ID NO: 197721 - RNA, 64 nt, Homo Sapiens
gaacagggaacauuggagcuuuagcaaagcaaaaggcugagaagaggacagucuggagaaggua

SEQ ID NO: 197722 - RNA, 64 nt, Homo Sapiens
uuguuuugcaaauggaucuaagguggagccuccuggcugagaaaucugucuacaaggaaauggg

SEQ ID NO: 197723 - RNA, 64 nt, Homo Sapiens
aguguuuccuggcaaaacaucagggacgguuuguggcugagauagcucugagucuuuuggagga

SEQ ID NO: 197724 - RNA, 64 nt, Homo Sapiens
gcccccacugugaaggccacagaucgcuaccccaggcugagaugagugccagagaaguggaggc

SEQ ID NO: 197725 - RNA, 64 nt, Homo Sapiens
gguggccagcuuguacaccaucagcuggaugagaggcugagaugugcacgguguggccagagcc

SEQ ID NO: 197726 - RNA, 64 nt, Homo Sapiens
ugagcagcaggggagcgggcggcauccuccuaggggcugagaggggagcucuagagggcugcgu

SEQ ID NO: 197727 - RNA, 64 nt, Homo Sapiens
ucguucaccuccaagcauuuggucggaucucacaggcugagaacaacuucaaaguuaaugggau

SEQ ID NO: 197728 - RNA, 64 nt, Homo Sapiens
uggcaggagcucccagggaaagacugcccugcagggcugagauguucuuuugucucccuuauga

SEQ ID NO: 197729 - RNA, 50 nt, Homo Sapiens
gugacaagaccaucaccaccggcugagaccagucuguaacuguggaauga

SEQ ID NO: 197730 - RNA, 64 nt, Homo Sapiens
gcuucucucucccugucacacacuggaccccacuggcugagaaucugggggugaggaggacaag

SEQ ID NO: 197731 - RNA, 64 nt, Homo Sapiens
ggccgggaggggacuagaagagcugcaugaugguggcugagacagggucaccuugggaaggcuu

SEQ ID NO: 197732 - RNA, 64 nt, Homo Sapiens
cccugcugcaaaggacagugggcaggaggccccaggcugagagccagaugccuccccaagacug

SEQ ID NO: 197733 - RNA, 64 nt, Homo Sapiens
ggggagcacaucaccugaaggugccaaggaggaaggcugagaggggggccaccccauuucuggu

SEQ ID NO: 197734 - RNA, 64 nt, Homo Sapiens
uucaugagucuauauaaaggcuuuuuaccaucuuggcugagaaugguaaaguuagguuuacuuc

SEQ ID NO: 197735 - RNA, 64 nt, Homo Sapiens
gagguuuuugagcauaguacuugacuacucuagaggcugagacgggagcaucucuugagccuga

SEQ ID NO: 197736 - RNA, 64 nt, Homo Sapiens
ccacauuaccaagcgcaauuccccauucuccaagggcugagaacuucggugacuucauccaccu

SEQ ID NO: 197737 - RNA, 64 nt, Homo Sapiens
ugcacccugcgcaucaggacugcuucaucgucuuggcugagaaagggaaaagacacacaagucg

SEQ ID NO: 197738 - RNA, 64 nt, Homo Sapiens
guuggcauaugccuguaaucccagcuacucgagaggcugagacacgaaaauugcuugaaccugg

SEQ ID NO: 197739 - RNA, 64 nt, Homo Sapiens
cuagaauuugccucuuugggacugaagucuaaggggcugagaccaagaagggagagcacaagac

SEQ ID NO: 197740 - RNA, 64 nt, Homo Sapiens
augaguuaucuucuacauucagaaaauguagucuggcugagacgacuauacaucaucggguauu

SEQ ID NO: 197741 - RNA, 64 nt, Homo Sapiens
gaccacgguucuugacuuagggcgcugagugaguggcugagacccggacuucggagcauagagu

SEQ ID NO: 197742 - RNA, 64 nt, Homo Sapiens
cagaaauaaaucaaccauuucuucgugagagacgggcugagaguuuuuggucaauaggcucugu

SEQ ID NO: 197743 - RNA, 64 nt, Homo Sapiens
agagaggagggucgggcagcgaaguagggacuggggcugagagccagccuccugggaggauccc

SEQ ID NO: 197744 - RNA, 64 nt, Homo Sapiens
uuggcucuguauggaggcugccauacccugggguggcugagacccccagcagccuccaggaagu

SEQ ID NO: 197745 - RNA, 64 nt, Homo Sapiens
cuggaucugcugcuuccugcagccagacagccugggcugagauguggauaaucacugggacuag

SEQ ID NO: 197746 - RNA, 64 nt, Homo Sapiens
ggaggaugucuugagcccggcuagcuacuugggaggcugagaugggugguaagugccuguaguc

SEQ ID NO: 197747 - RNA, 64 nt, Homo Sapiens
ggagaaucacuugaacccagccagcuacucgggaggcugagacaggugguguaccccuguaauc

SEQ ID NO: 197748 - RNA, 64 nt, Homo Sapiens
cacugccgcugacguuucaauaauguacaaccacggcugagaacauuugaggaugggauuauuc

SEQ ID NO: 197749 - RNA, 64 nt, Homo Sapiens
ggaaauaaaaguaguuaaaucaaucauuuuggagggcugagaugucuuaauguucauuuaaaaa

SEQ ID NO: 197750 - RNA, 64 nt, Homo Sapiens
aauaaauuuaacacuagacgaguucaaccuaaagggcugagaucagacuaaacauaauucuuua

SEQ ID NO: 197751 - RNA, 57 nt, Homo Sapiens
cccgcacugccaucuucuaguggccauggcugagacccaaucccugggcgccccugg

SEQ ID NO: 197752 - RNA, 64 nt, Homo Sapiens
gguggugcacgccuguagucccugcuacuuggaaggcugagacaggaaaauugcuugaacccag

SEQ ID NO: 197753 - RNA, 64 nt, Homo Sapiens
ccugaggacccaggguccaucugagcuggcugugggcugagauccuggcuggggcccugcuguc

SEQ ID NO: 197754 - RNA, 64 nt, Homo Sapiens
acugcuaccuuccuagauguuuccccagaccgcuggcugagauucccucaccugucgcuuccua

SEQ ID NO: 197755 - RNA, 64 nt, Homo Sapiens
ggugcaugugugccuguaguccaagcuacuugaaggcugagacaggaggaucgguugagcccag

SEQ ID NO: 197756 - RNA, 64 nt, Homo Sapiens
gcaugcgccuguagucccagcuacucccuccagaggcugagaauugcuugaaccugggaagugc

SEQ ID NO: 197757 - RNA, 64 nt, Homo Sapiens
guuugagggaagcagucuccugcgguucaguucaggcugagauuuucuccuucaguggacuguc

SEQ ID NO: 197758 - RNA, 64 nt, Homo Sapiens; identical to SEQ ID NO: 64835

SEQ ID NO: 197759 - RNA, 64 nt, Homo Sapiens; identical to SEQ ID NO: 64836

SEQ ID NO: 197760 - RNA, 64 nt, Homo Sapiens
uuuuauuugcauguggaucaaccaucgcuuuauuggcugagauaugaacauauuguugaaaggu

SEQ ID NO: 197761 - RNA, 64 nt, Homo Sapiens
gguggcgggcgccuguagucccagccacucgggaggcugagacaggagaaucgcuuaaaccugg

SEQ ID NO: 197762 - RNA, 64 nt, Homo Sapiens
cuuuugaaaaucugcugagcggccaccauaugcaggcugagagcugggcacaggcgaagccauu

SEQ ID NO: 197763 - RNA, 64 nt, Homo Sapiens
gcacgaugucugagacggugggcggggccguguuggcugagagagggcugggguccuucguggu

SEQ ID NO: 197764 - RNA, 64 nt, Homo Sapiens
gggcugcacaggcggcagagauacagggucugagggcugagacgccauggggccgcugcugcuu

SEQ ID NO: 197765 - RNA, 64 nt, Homo Sapiens
uccuuucccaggccaggccgucucuggaaagucaggcugagaaaccuaacuuucucauccucgg

SEQ ID NO: 197766 - RNA, 64 nt, Homo Sapiens
ggagauuugcuugaacccggccagcuacucgggaggcugagacagguggugcacaccuguaguc

SEQ ID NO: 197767 - RNA, 64 nt, Homo Sapiens
gcgggaaauaauuguguacauuucauguauuuguggcugagaggugaguaauauacaaaaaggu

SEQ ID NO: 197768 - RNA, 64 nt, Homo Sapiens
ggagaaucaccugaaccccaccagcuacucaggaggcugagacaagugacgggugcccguaauc

SEQ ID NO: 197769 - RNA, 64 nt, Homo Sapiens
gccgggccgggcggcggggagcgccgcggagggaggcugagaggcaggagggcacguucgcgcc

SEQ ID NO: 197770 - RNA, 64 nt, Homo Sapiens
cagccucuuuguaaguacaggcuguuuaagugcaggcugagaccuccuguccuuuguugcucau

SEQ ID NO: 197771 - RNA, 64 nt, Homo Sapiens
gacccguuuccuuucagggaaacuaucugcaucuggcugagagauagcaaaggcagugaguguc

SEQ ID NO: 197772 - RNA, 64 nt, Homo Sapiens
cucuaccaccauucccuucucagcucaaaauggaggcugagaauaauguuuguuuauucuguua

SEQ ID NO: 197773 - RNA, 64 nt, Homo Sapiens
ccggcuuccuccuuccagaucggggcuucugcggggcugagacggcggcgggaggcccacgguu

SEQ ID NO: 197774 - RNA, 64 nt, Homo Sapiens
uguuggcuuuggaaugguagcaaaagccuuuccuggcugagaugaugcuuaaaacacaccucac

SEQ ID NO: 197775 - RNA, 64 nt, Homo Sapiens
gcuugguucuacuguaagcaacagcuccuucaugggcugagaaggggaaaccaggaucucccca

SEQ ID NO: 197776 - RNA, 64 nt, Homo Sapiens
aagaguaugaugugaacaaguaaagacugaauggggcugagaugaaggcaauguuuccaaggaa

SEQ ID NO: 197777 - RNA, 64 nt, Homo Sapiens
auauucauuccaacugcugccccucugucugccuggcugagaugcaugugggcagcaggaagcc

SEQ ID NO: 197778 - RNA, 64 nt, Homo Sapiens
guggcuucucagaagcagcucauugccaaggccaggcugagaggggaccugcuugcuguggugg

SEQ ID NO: 197779 - RNA, 64 nt, Homo Sapiens
ugaaaccccgucucuacuaaaaauacaaaaauuaggcugagacaggagaauugcuugaacccag

SEQ ID NO: 197780 - RNA, 64 nt, Homo Sapiens
agcaggggacaggcacucaggagggcccgguaaaggcugagaugaaguggacugaguagaacug

SEQ ID NO: 197781 - RNA, 64 nt, Homo Sapiens
ccuccagucaggcuggacgggaggguagccuuguggcugagaggggucagacuagguggcacag

SEQ ID NO: 197782 - RNA, 64 nt, Homo Sapiens
gaggugacggcuggugacugauggauggguagugggcugagaagaggggacuaggaagggcuau

SEQ ID NO: 197783 - RNA, 64 nt, Homo Sapiens
cagacugacaguuuacagacaaagaugaacccgaggcugagaauauuagacagaacaccuaugc

SEQ ID NO: 197784 - RNA, 64 nt, Homo Sapiens
accucuucccugaggcuucuaucuuuagcgcaugggcugagaacgccguagcaugaugcugucc

SEQ ID NO: 197785 - RNA, 64 nt, Homo Sapiens
guauaaauaacccugggcuguccgggggacuuggggcugagagaaucagccuuuaggucuuuag

SEQ ID NO: 197786 - RNA, 64 nt, Homo Sapiens
agcaggguagaaaagaccaaggcucuguggcccaggcugagagcugagaccuuaguguucucca

SEQ ID NO: 197787 - RNA, 64 nt, Homo Sapiens
gcaguaguuuucaaaacacagacggcgauuuucgggcugagaagaccacagugagccugagaga

SEQ ID NO: 197788 - RNA, 64 nt, Homo Sapiens
ggagaaucgcuugaaccuggauggccacuugggaggcugagauaacaaaaauuagcugggugug

SEQ ID NO: 197789 - RNA, 64 nt, Homo Sapiens
gcuugaaaguccuuuucauauuucaguuaaacugggcugagagaaagauaguucuguaaaguug

SEQ ID NO: 197790 - RNA, 64 nt, Homo Sapiens
caccagguccaguuuugguugcugcguugccauuggcugagaccccgcugauuugaaacaucug

SEQ ID NO: 197791 - RNA, 64 nt, Homo Sapiens
auguaaggauucuggaauacacguggggagcgguggcugagaaacggggugggggugggaacuc

SEQ ID NO: 197792 - RNA, 64 nt, Homo Sapiens
ucuuuugucuaccauagaaucaggaaacccaagaggcugagaaugagcaugaagcaaagaauuc

SEQ ID NO: 197793 - RNA, 64 nt, Homo Sapiens
cucgccccgacgcauggaccuugcggucccgcccggcugagacggucggguggucccggggccu

SEQ ID NO: 197794 - RNA, 64 nt, Homo Sapiens
agauguaagugcuaguagaauauaagauaaaagaggcugagaauuaccauacaaggguauuaca

SEQ ID NO: 197795 - RNA, 64 nt, Homo Sapiens
gguggcauauacuuguggucccagauacuugggaggcugagauaggaucacuugggcccaggag

SEQ ID NO: 197796 - RNA, 64 nt, Homo Sapiens
ugaacagugaugaaaaagugggagggcuggcuugggcugagaagggagggacagaaaagagaag

SEQ ID NO: 197797 - RNA, 64 nt, Homo Sapiens; identical to SEQ ID NO: 64837

SEQ ID NO: 197798 - RNA, 64 nt, Homo Sapiens; identical to SEQ ID NO: 64838

SEQ ID NO: 197799 - RNA, 64 nt, Homo Sapiens; identical to SEQ ID NO: 64839

SEQ ID NO: 197800 - RNA, 64 nt, Homo Sapiens; identical to SEQ ID NO: 64840

SEQ ID NO: 197801 - RNA, 64 nt, Homo Sapiens
ugaccacacuuagugagaaggagccacaaguuguggcugagaguucccugugaacuugaguagu

SEQ ID NO: 197802 - RNA, 64 nt, Homo Sapiens; identical to SEQ ID NO: 64841

SEQ ID NO: 197803 - RNA, 64 nt, Homo Sapiens; identical to SEQ ID NO: 64842

SEQ ID NO: 197804 - RNA, 64 nt, Homo Sapiens
uuaaggcucugugccuuggucucuccuuccucuuggcugagauagcagaggggcuccccggguc

SEQ ID NO: 197805 - RNA, 64 nt, Homo Sapiens
ggccugacaguuucuaccaguccugcugucccucggcugagaauaaaacccauuucuggaugau

SEQ ID NO: 197806 - RNA, 64 nt, Homo Sapiens
cgucuucugggcugggcaggcccucugguucccaggcugagacugacggguuuucucaggauga

SEQ ID NO: 197807 - RNA, 64 nt, Homo Sapiens
gggucuggggcagggaacgaacaugguggcuuugggcugagaggaugagggaggucuuucccag

SEQ ID NO: 197808 - RNA, 64 nt, Homo Sapiens
caauccagccuucuucccccaggguccccugcauggcugagagggugugggugcccuguugacc

SEQ ID NO: 197809 - RNA, 64 nt, Homo Sapiens
aagaggcagagggacuugggaccugggagaauggggcugagaggaggcuucggguuggggccca

SEQ ID NO: 197810 - RNA, 64 nt, Homo Sapiens
augucauugguuugugaggcauauuuugaaauauggcugagaaccuggcauaaagaauguauau

SEQ ID NO: 197811 - RNA, 64 nt, Homo Sapiens
agcaucccuucagcuuccccgcuggaccucuguuggcugagaagucuguagugggggaaaggug

SEQ ID NO: 197812 - RNA, 64 nt, Homo Sapiens
gaauaaucugagcaaagguaggagguagggaucuggcugagaggaagaugaauagguguucuca

SEQ ID NO: 197813 - RNA, 64 nt, Homo Sapiens
acccuggaguggagggaggcccuagugauuaauuggcugagaaauaagcuguaguuagauaaca

SEQ ID NO: 197814 - RNA, 64 nt, Homo Sapiens
ggagaaucacuugaaccuggccagcuacucgggaggcugagaugguacgugcgugccuguaguc

SEQ ID NO: 197815 - RNA, 64 nt, Homo Sapiens
gaaggcugccaaugucagcuggcccagguauuaaggcugagaguucagaaggcaccagcaccag

SEQ ID NO: 197816 - RNA, 64 nt, Homo Sapiens
uaaggugauauugcuauugauuugguagaaaauaggcugagauaagagaagugaauaaucuuuc

SEQ ID NO: 197817 - RNA, 64 nt, Homo Sapiens
acgccauugcacuccagccuuggagguugcagugggcugagaucaaucgcuugaaccugggagg

SEQ ID NO: 197818 - RNA, 64 nt, Homo Sapiens
gacgguagacuuccaccauggucucuccaggcuuggcugagacgagggucuuguguugcuucug

SEQ ID NO: 197819 - RNA, 64 nt, Homo Sapiens
aguucccuggaggccacccagacccacgcuccaaggcugagaccggggagcugcugccuuuggg

SEQ ID NO: 197820 - RNA, 64 nt, Homo Sapiens
gguccugggguguuucagaccuccacacuaggguggcugagaggcagacaugaggcagcauuuc

SEQ ID NO: 197821 - RNA, 64 nt, Homo Sapiens
gcugcccagggcccugcagcucacagaauggcugggcugagaacgcugauucuuucaacaacug

SEQ ID NO: 197822 - RNA, 64 nt, Homo Sapiens
cgagucaucuccggugauccuuaaaugaacugcaggcugagaaaagaaggaaaaaggucacagc

SEQ ID NO: 197823 - RNA, 64 nt, Homo Sapiens
ugcggcuugcgccuguaaucucagcacuuugggaggcugagauggguggaucaccugagguugg

SEQ ID NO: 197824 - RNA, 64 nt, Homo Sapiens
aguggcucccuccuguagucccagcuacuugggaggcugagaugggaggaccauuugagccugg

SEQ ID NO: 197825 - RNA, 64 nt, Homo Sapiens
gguggcauaugccuguagucccaguuacuugggaggcugagacaggauugcuuaagcccaggag

SEQ ID NO: 197826 - RNA, 64 nt, Homo Sapiens
acuggcauugacgaaaaucauuugaaucucuucuggcugagauaauuugccaaugcaaaauaca

SEQ ID NO: 197827 - RNA, 64 nt, Homo Sapiens
gucauacuaggagcaauuaggagccauaugccugggcugagaagagcuaggcaguagugaccuu

SEQ ID NO: 197828 - RNA, 64 nt, Homo Sapiens
aucguguacugcagaguugagcuggcaggggaggggcugagagggugggggcuggaaccccucc

SEQ ID NO: 197829 - RNA, 64 nt, Homo Sapiens; identical to SEQ ID NO: 64843

SEQ ID NO: 197830 - RNA, 64 nt, Homo Sapiens; identical to SEQ ID NO: 64844

SEQ ID NO: 197831 - RNA, 64 nt, Homo Sapiens
gaccugagugucggucacagcccccuacacucaaggcugagaggccucaggaaagucauuccuu

SEQ ID NO: 197832 - RNA, 64 nt, Homo Sapiens
uaagagaacuuguauugugucauuucagauuguaggcugagaguuguaaauagugaaaauuuga

SEQ ID NO: 197833 - RNA, 64 nt, Homo Sapiens
ucaugggcugccugggacccaggacccaugagggggcugagagguuucuacacucgaggagcag

SEQ ID NO: 197834 - RNA, 64 nt, Homo Sapiens
uguucccuggagucagggugaacugcaaagcuuuggcugagaccugggauuugagauaccacaa

SEQ ID NO: 197835 - RNA, 64 nt, Homo Sapiens
acaggcugcagagggcuccagguucugggccccuggcugagaaggggaggauccuguccuggcu

SEQ ID NO: 197836 - RNA, 64 nt, Homo Sapiens; identical to SEQ ID NO: 64845

SEQ ID NO: 197837 - RNA, 64 nt, Homo Sapiens; identical to SEQ ID NO: 64846

SEQ ID NO: 197838 - RNA, 64 nt, Homo Sapiens
cggccguggaaggagggaugcuaaaaggcuuccaggcugagagcagagagguggauccuguagg

SEQ ID NO: 197839 - RNA, 64 nt, Homo Sapiens
gcuguguugcaguauugauggguauagcccacagggcugagauuuggugaaagcauguggcuau

SEQ ID NO: 197840 - RNA, 64 nt, Homo Sapiens
aaaggaaauguggaauaaaacaguuuuggagacuggcugagaugugaucaguauuuuuuuauac

SEQ ID NO: 197841 - RNA, 64 nt, Homo Sapiens
ggaaggguauccuuuucccacccaggccugagauggcugagaagcccccucuaccucaguagcc

SEQ ID NO: 197842 - RNA, 64 nt, Homo Sapiens
auucaggaguuuguugggcagaaaaggagagagaggcugagaucucaacaaaggaguguguuca

SEQ ID NO: 197843 - RNA, 64 nt, Homo Sapiens
agcucgugugggcgcucguccacaaacacuccguggcugagaggcagcggauccaggcagcgau

SEQ ID NO: 197844 - RNA, 64 nt, Homo Sapiens
gcucaagugccuuaggcccguggaccacagucuuggcugagaucaaagggaugagcaacaggga

SEQ ID NO: 197845 - RNA, 64 nt, Homo Sapiens
gcucuggucucugggcauucauuucccucauagaggcugagaauaaaacaaggacuuauucaca

SEQ ID NO: 197846 - RNA, 64 nt, Homo Sapiens
gguuuuccacuccuucuagauauucccaaaaagaggcugagacaggagguuauuuucaauuuua

SEQ ID NO: 197847 - RNA, 64 nt, Homo Sapiens
auagagaucaucuggccaccccuagaggcagaugggcugagauaaaagacuguuggggccaccu

SEQ ID NO: 197848 - RNA, 64 nt, Homo Sapiens
ccuccacucccacuucccugacacugcggggcuuggcugagagaguggcauuggcagcaggugc

SEQ ID NO: 197849 - RNA, 64 nt, Homo Sapiens
acuuuccaucgccuuuuccuuccaucaguugaguggcugagagagaagugccucaucccugagc

SEQ ID NO: 197850 - RNA, 64 nt, Homo Sapiens
ccuagucucuggauuuggggagcuugucuucaguggcugagacugugagcugggagcaguucuc

SEQ ID NO: 197851 - RNA, 54 nt, Homo Sapiens
gccugcagucaagugagugacucgggcugagaggcugcuuuugauuuuagccau

SEQ ID NO: 197852 - RNA, 64 nt, Homo Sapiens
gugaaggcuguccuuacccaucugcaccccccugggcugagagaaccucacgcaccucccaucc

SEQ ID NO: 197853 - RNA, 64 nt, Homo Sapiens
uagcugaagcccauugguuuccacgauuucaauuggcugagaaggcagagagcuagcuccuccc

SEQ ID NO: 197854 - RNA, 62 nt, Homo Sapiens
agucaucguuugugaucugagacccgcgguguggcugagagcgcacagagcgcacgugcaca

SEQ ID NO: 197855 - RNA, 64 nt, Homo Sapiens
uguauuucuacuucuggacugccucaauaucaagggcugagacuuuugaauuuugaauauucgu

SEQ ID NO: 197856 - RNA, 64 nt, Homo Sapiens
gucagccuccuggaggagugccuccauuguaccuggcugagacucccuuccuugugaccuggac

SEQ ID NO: 197857 - RNA, 64 nt, Homo Sapiens
cgcuuaccuuaguucaucugcugcaccagcggaaggcugagaccugaggcccugcguggagaug

SEQ ID NO: 197858 - RNA, 64 nt, Homo Sapiens
cccagcugacauggaaauacuccuccccuugggcggcugagagcucugcagcugaccucuguug

SEQ ID NO: 197859 - RNA, 64 nt, Homo Sapiens
ucaucccaggcugccugcuaaggaaaagugggcuggcugagauuccugggucacaguuaccgag

SEQ ID NO: 197860 - RNA, 64 nt, Homo Sapiens
agaaggaagaaucagcccagggaugaaggauagaggcugagagaggggguguggguaaagacag

SEQ ID NO: 197861 - RNA, 64 nt, Homo Sapiens
ugggcugccuccugccauccaguugcuggagcugggcugagaacgucagaaacagaagagcugc

SEQ ID NO: 197862 - RNA, 64 nt, Homo Sapiens
uagaggguggaugcccagggggggaagggaggugggcugagaggcuggaggacugagcaccugu

SEQ ID NO: 197863 - RNA, 64 nt, Homo Sapiens
aagaaaggccaaccugauccuuaccugggcaucuggcugagagggggagucugugguggccagu

SEQ ID NO: 197864 - RNA, 64 nt, Homo Sapiens
ugcgcuuuggggacuucagccugagcuucuacagggcugagagccacggggagggagcucuugg

SEQ ID NO: 197865 - RNA, 64 nt, Homo Sapiens
gcagugagccgaaaucacgcgcuugaaccuaggaggcugagauugaggcugaggcaggagaauu

SEQ ID NO: 197866 - RNA, 64 nt, Homo Sapiens
cuggcccauaguagaaucuguggcuccacugcuuggcugagaucgcuugugucuguccagccuc

SEQ ID NO: 197867 - RNA, 64 nt, Homo Sapiens
cuccugggcagauggggucacuagaggacuccauggcugagagguaggugggcuaagugccucc

SEQ ID NO: 197868 - RNA, 64 nt, Homo Sapiens; identical to SEQ ID NO: 64847

SEQ ID NO: 197869 - RNA, 64 nt, Homo Sapiens; identical to SEQ ID NO: 64848

SEQ ID NO: 197870 - RNA, 64 nt, Homo Sapiens
cccagggcggcagccugucugugagcccuagcagggcugagaccaccaccuaggcuuccaccug

SEQ ID NO: 197871 - RNA, 64 nt, Homo Sapiens
ggaccagggagguugcaucagccuggucuguccuggcugagaaguggcuuccgugaaagaccau

SEQ ID NO: 197872 - RNA, 64 nt, Homo Sapiens
agaaugaaaccaggaauggacuuggaguucaacaggcugagaggaugccuccaauggaccagag

SEQ ID NO: 197873 - RNA, 64 nt, Homo Sapiens
ugcagccauccugcagugggggugagcgggcacaggcugagaacugcucuugggugguggaagc

SEQ ID NO: 197874 - RNA, 64 nt, Homo Sapiens
uuggaacuaaacgucaccaagguggcuucuccuuggcugagagauggaaggcguggugggauuu

SEQ ID NO: 197875 - RNA, 64 nt, Homo Sapiens
ucuuccagacucauagcaucaguggauaccauguggcugagaaaagaacuguuugagugccauu

SEQ ID NO: 197876 - RNA, 64 nt, Homo Sapiens
cuccuggaauagaaucuuucuuuccauccugcauggcugagagccaggcuuccuuccuggucuc

SEQ ID NO: 197877 - RNA, 64 nt, Homo Sapiens
ucauuuguuuuucauauacugguaccuucuuuuuggcugagaucuuucuuuuacuugugauaua

SEQ ID NO: 197878 - RNA, 64 nt, Homo Sapiens
aguugaugagcagaucuguggaagaacaauccagggcugagaaaucguagagcagugaggcagg

SEQ ID NO: 197879 - RNA, 64 nt, Homo Sapiens
gcucaugccuguaaucccagccagcacuuugggaggcugagaugggaagaucacuugagcccag

SEQ ID NO: 197880 - RNA, 64 nt, Homo Sapiens
guaaaaacuuggccccagaugcuugucccuucugggcugagauuucgcagcccccuucucaucu

SEQ ID NO: 197881 - RNA, 64 nt, Homo Sapiens
ugggaggaugacgcagaugucugcugcagagcugggcugagaguucugcagucuagcucugacu

SEQ ID NO: 197882 - RNA, 64 nt, Homo Sapiens
auggugcgggcaccuguaguccuagcuaucaagaggcugagacaggagaaacacuugaaccugg

SEQ ID NO: 197883 - RNA, 64 nt, Homo Sapiens
uccaauugcugcauggaaauaugaaaagccaauaggcugagacacuaaaggaaaguuugcaucu

SEQ ID NO: 197884 - RNA, 64 nt, Homo Sapiens
uauuuuuuccuguggcugcauguccaucucauaaggcugagagcagcgggaguuaguauaggaa

SEQ ID NO: 197885 - RNA, 64 nt, Homo Sapiens
ugguccccaaggggccagaauugaagggggcaagggcugagaugggggcuagaccuccuuuuau

SEQ ID NO: 197886 - RNA, 64 nt, Homo Sapiens; identical to SEQ ID NO: 64849

SEQ ID NO: 197887 - RNA, 64 nt, Homo Sapiens; identical to SEQ ID NO: 64850

SEQ ID NO: 197888 - RNA, 64 nt, Homo Sapiens
gaagaaucgcuugaaccuguccagcuacucaggaggcugagacagguggcaugcgccuguaauc

SEQ ID NO: 197889 - RNA, 64 nt, Homo Sapiens
uggggcugugggcagcagacaacgagggccugcuggcugagauaaaccucgaagcgcccgagga

SEQ ID NO: 197890 - RNA, 64 nt, Homo Sapiens
cucaggcuucccuagauccagugaagccagcagaggcugagaacggaggauagggcuggccuuu

SEQ ID NO: 197891 - RNA, 64 nt, Homo Sapiens
uuuuccuuauaccuaccuuuaauggauuuuuaaaggcugagaaaaguuuuauuuaucaaaaugu

SEQ ID NO: 197892 - RNA, 64 nt, Homo Sapiens
caucugucuuccaucccacuuuauuccugcugauggcugagaagagcuuggcugccggcuucau

SEQ ID NO: 197893 - RNA, 64 nt, Homo Sapiens
cuucagcagcaguauuggaccuuucacggauuuaggcugagaaagagcaguagaaucccaggcu

SEQ ID NO: 197894 - RNA, 64 nt, Homo Sapiens
cuucguguauagcugugugaugcaaaaguacaagggcugagauucugauacguguaugagacua

SEQ ID NO: 197895 - RNA, 64 nt, Homo Sapiens
auucgagguggcugggagggccucucccagccagggcugagagggccauuccucacccccguga

SEQ ID NO: 197896 - RNA, 64 nt, Homo Sapiens
ggagaaucgcuugaacccuagcagccuuucaggaggcugagacagguggcgggcaccuguaauc

SEQ ID NO: 197897 - RNA, 64 nt, Homo Sapiens
auggauuuaagacauauuuugagccaccgugccuggcugagaagaguacugggauuacaggcgu

SEQ ID NO: 197898 - RNA, 64 nt, Homo Sapiens
ugaauuugugaauuaccuuggcuagucccgggagggcugagaugcucagggaccccucauaugg

SEQ ID NO: 197899 - RNA, 64 nt, Homo Sapiens
ucuuuuuucuuuuuucuuuuuccuuucuuucgugggcugagaaaggggcaggcaaaaugaagcu

SEQ ID NO: 197900 - RNA, 64 nt, Homo Sapiens
cugccugcccuuucucccaaaaggacaaagagguggcugagagaguuuuggaauuugacauugg

SEQ ID NO: 197901 - RNA, 64 nt, Homo Sapiens
ggcugugcaccuaaaugucugucugggaggagcaggcugagaagucuugcagucugcaggacac

SEQ ID NO: 197902 - RNA, 64 nt, Homo Sapiens
agauguggcaaauccaguguuaacacauauuucuggcugagauuuuggaacuagcuaguaacug

SEQ ID NO: 197903 - RNA, 64 nt, Homo Sapiens
uccgugcaagacagcacccauaguuuuucuuucuggcugagauuuuucuuuuuuuucuuuucuc

SEQ ID NO: 197904 - RNA, 64 nt, Homo Sapiens; identical to SEQ ID NO: 64851

SEQ ID NO: 197905 - RNA, 64 nt, Homo Sapiens; identical to SEQ ID NO: 64852

SEQ ID NO: 197906 - RNA, 64 nt, Homo Sapiens
aaagauccuuuaggacaugagacugguagaagcuggcugagauaaaauaaguauuuauuuaaac

SEQ ID NO: 197907 - RNA, 64 nt, Homo Sapiens
cccgccacccacuguggcagcuugaauuucuugaggcugagacaaacuaggauccaguagccua

SEQ ID NO: 197908 - RNA, 64 nt, Homo Sapiens
aggguuuugggggggugggggaggguguuguuggggcugagaagaaagagauuuauaugcugua

SEQ ID NO: 197909 - RNA, 64 nt, Homo Sapiens
agaugcucaggaaaguuauuugaguuaaauugcuggcugagagagcuuggaaguccuuuucaua

SEQ ID NO: 197910 - RNA, 64 nt, Homo Sapiens
gaauacuguuaucuaugugacggggcagucgugaggcugagaugagaaugcggauuaaaaugcc

SEQ ID NO: 197911 - RNA, 64 nt, Homo Sapiens
ugacuccauuuugaauagggguugaguaaaauaaggcugagaccuacugggcugcauucccaug

SEQ ID NO: 197912 - RNA, 64 nt, Homo Sapiens
agccucuuuuuaaagugugagucuuucuugcuuuggcugagagccaauaggcuuaaugaaagag

SEQ ID NO: 197913 - RNA, 64 nt, Homo Sapiens
gugcggaacuccacuaaaaauaauagcucaguguggcugagaaaacauuuccaaaugugauuuc

SEQ ID NO: 197914 - RNA, 64 nt, Homo Sapiens
ggagacuugcuugaacccggccagcuacucgggaggcugagacagguggcgggcgcccauaguc

SEQ ID NO: 197915 - RNA, 64 nt, Homo Sapiens
acggucucaucaggcgccuuugagcgcgcucucaggcugagaaccuccaucucccaccugcccu

SEQ ID NO: 197916 - RNA, 64 nt, Homo Sapiens
gagguuuccuuuuggaacauggcuccgggcaaauggcugagauggccuggagcccacaaccuuc

SEQ ID NO: 197917 - RNA, 64 nt, Homo Sapiens
aguggugggugccuguaaucccagcuacuugggaggcugagacaggagaaucacuugaacccgg

SEQ ID NO: 197918 - RNA, 64 nt, Homo Sapiens
uccacaagggcauaccccugggggcaggggcuggggcugagaacugcagcccugggucuucccu

SEQ ID NO: 197919 - RNA, 64 nt, Homo Sapiens
gguggcaugugccuguaaucccagcuacucaggaggcugagacaggagaauugcuugaaccugg

SEQ ID NO: 197920 - RNA, 64 nt, Homo Sapiens
cuuagugaaauagcaacagauuggaaguugaaauggcugagauuuggugaucuccccacagcug

SEQ ID NO: 197921 - RNA, 64 nt, Homo Sapiens
aucugagaugaggccucguccuccuggaagcugaggcugagaaggguggagcuuggcccugggg

SEQ ID NO: 197922 - RNA, 64 nt, Homo Sapiens
cgcaggggaaacguuuucuguuuggaggagcaaaggcugagaacacugugaaaacauuuugcgc

SEQ ID NO: 197923 - RNA, 64 nt, Homo Sapiens
caggcagaagcugugcucugaagcuaggacagcuggcugagaaguggguucaggcgaaggguga

SEQ ID NO: 197924 - RNA, 64 nt, Homo Sapiens
ggagaaucacuugaacccugucagcuacucaggaggcugagacaggugguaugugccuguaguc

SEQ ID NO: 197925 - RNA, 50 nt, Homo Sapiens
uggcccugccuugggcauugggcugagaagcugugcuggcccagagcuag

SEQ ID NO: 197926 - RNA, 64 nt, Homo Sapiens
cuccucagagcccagugcagggcugggauccucuggcugagaauugacauuugagggaggagga

SEQ ID NO: 197927 - RNA, 64 nt, Homo Sapiens
agacaaagcccgggaggcaggauugcagccccgaggcugagaccugcugcucagcacagcccug

SEQ ID NO: 197928 - RNA, 64 nt, Homo Sapiens
ggagaaucgcuugaaccuggccagguacucgggaggcugagacagguggcaggugccuguaguc

SEQ ID NO: 197929 - RNA, 64 nt, Homo Sapiens
gagggcaccgacugugaagccacggauggugaggggcugagaaucugcugggccccagguggcg

SEQ ID NO: 197930 - RNA, 64 nt, Homo Sapiens
cuggacagaggcugggguccccuggcuuggguguggcugagacuaccacugcaaggggugggag

SEQ ID NO: 197931 - RNA, 64 nt, Homo Sapiens
gcugcuggcccggccuccaaggaggggugggaggggcugagauguuggugcugcccuguggcau

SEQ ID NO: 197932 - RNA, 63 nt, Homo Sapiens
uggaaacccagguguugugacuggcacugcccaggcugagacucuucaagucccgcugacguc

SEQ ID NO: 197933 - RNA, 64 nt, Homo Sapiens
gguggugcaugccuguaguuccagcuacuugggaggcugagacaggcgaauugcuugaaccugg

SEQ ID NO: 197934 - RNA, 64 nt, Homo Sapiens
ucggguacuacgcagcaacacucacaacuguccaggcugagauaaaucccgggaccugaacuau

SEQ ID NO: 197935 - RNA, 64 nt, Homo Sapiens
gauggugcaugccuguaaucccagcuccucaguaggcugagacaggagcaucacuugaacgugg

SEQ ID NO: 197936 - RNA, 64 nt, Homo Sapiens
guccuuugaacagaagggccuggaaggccccuggggcugagaaaggguccgcccgguggccugg

SEQ ID NO: 197937 - RNA, 64 nt, Homo Sapiens
caugguggcacccgccuguaguccagcuacuugaggcugagaugggaggaugagggaggucggg

SEQ ID NO: 197938 - RNA, 64 nt, Homo Sapiens
ugggguggugagaugaugauuagaucaggggugaggcugagagacucuggguuuagggcuagcc

SEQ ID NO: 197939 - RNA, 64 nt, Homo Sapiens
gaggccuuccuccuccagggcccucugcagaccaggcugagauggaggaaccugcuaaaaucga

SEQ ID NO: 197940 - RNA, 64 nt, Homo Sapiens
guggacgggggaaggguuguggcggguguucugaggcugagaggacaccuauaugcguauuucc

SEQ ID NO: 197941 - RNA, 64 nt, Homo Sapiens
ugagcacacgcgugcuggggugguuuggggagagggcugagauuugucaccagugagcccuugg

SEQ ID NO: 197942 - RNA, 64 nt, Homo Sapiens
uguguccugaccaggcccuguccaugcucagaguggcugagacuggggccugugcacuguugcg

SEQ ID NO: 197943 - RNA, 64 nt, Homo Sapiens
auugggcagggagagggcgguuggucccuggccaggcugagagaguccgccccaaaacccggcc

SEQ ID NO: 197944 - RNA, 64 nt, Homo Sapiens
uuggcccagccugcugcuuagauccugagacccuggcugagaaccugugcuguccugucuccca

SEQ ID NO: 197945 - RNA, 64 nt, Homo Sapiens
gaaagugucuccuuuccugguaguccucacacagggcugagaaagaacacuuucugggcuaaca

SEQ ID NO: 197946 - RNA, 64 nt, Homo Sapiens
aucuucaaguggauuuuuagucucugagcuaugaggcugagaaggucucggccuucuuugugcu

SEQ ID NO: 197947 - RNA, 64 nt, Homo Sapiens
gcuaggcggagggcuuugaaaggaaccugagccuggcugagauguuggccugaugggugggaga

SEQ ID NO: 197948 - RNA, 63 nt, Homo Sapiens
cuggagcaagugcgcagcauagcggauccgccaggcugagaccgauccggcaggugcgccuag

SEQ ID NO: 197949 - RNA, 64 nt, Homo Sapiens
aucuucaaguggauuuuuagucucugagcuaugaggcugagaaggucuuggccuucuuugugcu

SEQ ID NO: 197950 - RNA, 64 nt, Homo Sapiens; identical to SEQ ID NO: 64853

SEQ ID NO: 197951 - RNA, 64 nt, Homo Sapiens; identical to SEQ ID NO: 64854

SEQ ID NO: 197952 - RNA, 64 nt, Homo Sapiens
ucagugcugguuuguaaauguccugaggagcggaggcugagaacguccggaucuugucuccuag

SEQ ID NO: 197953 - RNA, 64 nt, Homo Sapiens
cuuucagacccucuguguggugggugauggagaaggcugagaacucuuuucagaggccgcaggg

SEQ ID NO: 197954 - RNA, 64 nt, Homo Sapiens
gcccaggagggcucgggacauuagguuguggaguggcugagaggaugaggacgggugccugagc

SEQ ID NO: 197955 - RNA, 64 nt, Homo Sapiens
ggcuuugggcacagccugcuaggacuugcugggaggcugagagagucaccagcagcucuuggga

SEQ ID NO: 197956 - RNA, 64 nt, Homo Sapiens
gucagcuccaugacaacaugaccagcucagcaaaggcugagacugcccaugaccugaaggcucc

SEQ ID NO: 197957 - RNA, 64 nt, Homo Sapiens
ugauaucgcugcuacaucagacucuagaaaaaagggcugagaggaagcaagacguaaagaauuu

SEQ ID NO: 197958 - RNA, 64 nt, Homo Sapiens
ucugaaggaacagcuccugaaaccagucucccugggcugagacaaccugggcucuucuuaggaa

SEQ ID NO: 197959 - RNA, 64 nt, Homo Sapiens
gguggcucacaccuguaaucucggcacuuuggggggcugagacaggcggaucaccugaggccag

SEQ ID NO: 197960 - RNA, 64 nt, Homo Sapiens
ugcuggcccuggugaaggaccugccgagucagcuggcugagauuggggcagcggcucagcaguc

SEQ ID NO: 197961 - RNA, 64 nt, Homo Sapiens
uuucuuucuagaagauugagaagugcauaugacaggcugagagcaccuccccaaacacacaagc

SEQ ID NO: 197962 - RNA, 64 nt, Homo Sapiens
ccauuuuccucugugccaaagacagacagacagaggcugagagaggcuguuccugaaucaaagc

SEQ ID NO: 197963 - RNA, 64 nt, Homo Sapiens
aaaucucacuuuucuccaugaguuuuuucucuugggcugagacuggauacugcccggggcagcu

SEQ ID NO: 197964 - RNA, 64 nt, Homo Sapiens
aucaguguggacagccugucaacuuaggauggauggcugagagggcuuccuaggagccagucag

SEQ ID NO: 197965 - RNA, 64 nt, Homo Sapiens
gguggcucaugccuguaaucccagcacuuugggaggcugagacaggcggaucaucugaagucag

SEQ ID NO: 197966 - RNA, 64 nt, Homo Sapiens
gggcugguggggugccacccucccacaagggcugggcugagacccagcugagugcagcguggcg

SEQ ID NO: 197967 - RNA, 64 nt, Homo Sapiens
cauagcacuggaagccagagaaaauguuggaagaggcugagacauucuucaccuccuuggcgcu

SEQ ID NO: 197968 - RNA, 64 nt, Homo Sapiens
gaugcuggaugccgccugauagacaugcuggccuggcugagaaaccccugagcagguaacccag

SEQ ID NO: 197969 - RNA, 64 nt, Homo Sapiens
ugcaaaggcucauauuuauagggaaggcugcaaaggcugagaaagcaacgugagaacaggcuau

SEQ ID NO: 197970 - RNA, 64 nt, Homo Sapiens
acccuugccugcccccuucugacuuccaucugggggcugagacccaucuuuugcagcccacucu

SEQ ID NO: 197971 - RNA, 64 nt, Homo Sapiens
gaaccagccagcucuuaccuccucccguaacucaggcugagaagcuguucagagacagcaacuc

SEQ ID NO: 197972 - RNA, 64 nt, Homo Sapiens
ccuccagggcagacagaaagcagagcucucaggaggcugagaaacugcccagaccggggcccag

SEQ ID NO: 197973 - RNA, 64 nt, Homo Sapiens
gcagcccaugguaggagcuggugugggagggacuggcugagauugggccaagacacugccuaag

SEQ ID NO: 197974 - RNA, 64 nt, Homo Sapiens
gcagugcacacacccuccccugccagagaacaaaggcugagaugccucugccagcugccuuccc

SEQ ID NO: 197975 - RNA, 64 nt, Homo Sapiens
agauggugguuuauggcucccccagcaugcccugggcugagaugagugacuuuuccuggccucu

SEQ ID NO: 197976 - RNA, 64 nt, Homo Sapiens
agcccacccagccaguggucgggccugcaggagaggcugagaccacgguuaugauuucagcccu

SEQ ID NO: 197977 - RNA, 64 nt, Homo Sapiens
uuucuaaauugaaaacacgcucucggcucgagcuggcugagauuacuuccucuuucgcauucuc

SEQ ID NO: 197978 - RNA, 64 nt, Homo Sapiens
uuccaggcccugaggaauccaacccagggcagggggcugagaccauuucauuguaaaugccugc

SEQ ID NO: 197979 - RNA, 64 nt, Homo Sapiens
gugaaaguguguggggaagguuccccuuccccggggcugagaggucacacuccucacagccuac

SEQ ID NO: 197980 - RNA, 64 nt, Homo Sapiens
uucagaugagaagacaaauuacauugcugauaguggcugagaaaaacuuaaaaucacaaacaug

SEQ ID NO: 197981 - RNA, 64 nt, Homo Sapiens
uauugguuccauccaacacccauggugucaggaaggcugagauggugugugaccgaguggccau

SEQ ID NO: 197982 - RNA, 50 nt, Homo Sapiens
cuucggaccccgggaaaggcggcugagacguggacguuggccugggcuag

SEQ ID NO: 197983 - RNA, 64 nt, Homo Sapiens
agcuggaaguuuggguuugguaagcccgacuugaggcugagagcggacguaaaucccuaaucuu

SEQ ID NO: 197984 - RNA, 64 nt, Homo Sapiens
ggacguuuccaucauucacauuaggcacgacccaggcugagaagagugggauuugagacccagg

SEQ ID NO: 197985 - RNA, 64 nt, Homo Sapiens
guggacgaguucagguuuguggaccuggggacugggcugagaggcacugacgggggcuccauac

SEQ ID NO: 197986 - RNA, 64 nt, Homo Sapiens
gguggcacuucucuguaaucucagcuucucaggaggcugagacaggagaaucgcuugaacccgg

SEQ ID NO: 197987 - RNA, 64 nt, Homo Sapiens
uuauccagauagauccaaagcucaugucucuucaggcugagacuggcgcugucaccuccaccca

SEQ ID NO: 197988 - RNA, 64 nt, Homo Sapiens
ggagaacaucugugccaacgguuggacuuuuuauggcugagauucgggaggaagugugacacca

SEQ ID NO: 197989 - RNA, 64 nt, Homo Sapiens
ggguuuuuuuguacaaauuuagcuaauagcuacaggcugagagaauuguaacauagcaugacaa

SEQ ID NO: 197990 - RNA, 64 nt, Homo Sapiens
cagcccagagacugaacggcaagcaguauguacaggcugagacacauaucauucagaaugugca

SEQ ID NO: 197991 - RNA, 64 nt, Homo Sapiens
ccccagcuguaagacagggacggggcggcccaguggcugagaggagccggcuguggagccccgc

SEQ ID NO: 197992 - RNA, 64 nt, Homo Sapiens
ccaguggccggggcggccucuggccccugacgcuggcugagacaggcccguggggcgggguuuu

SEQ ID NO: 197993 - RNA, 64 nt, Homo Sapiens
gaccuaugcacuuuauuucugaccccguggcuucggcugagaccuguguaaccugcugcccccu

SEQ ID NO: 197994 - RNA, 64 nt, Homo Sapiens
auuucuguagcagccaaguccugcggcucccuggggcugagaucucccuuuguggaacuccgag

SEQ ID NO: 197995 - RNA, 64 nt, Homo Sapiens
gguggcucacaccuguaaucccagcacuuugggaggcugagacgggugaauuacaugagguugg

SEQ ID NO: 197996 - RNA, 64 nt, Homo Sapiens
uguaccuguuuccucauuccuuggcugagggagaggcugagaacugggcagacaccccuggagc

SEQ ID NO: 197997 - RNA, 64 nt, Homo Sapiens
ugguggugcgugcccagguucccagguacucggaggcugagaggugggaggaugccuugagcuu

SEQ ID NO: 197998 - RNA, 64 nt, Homo Sapiens
ucuuguaagugaguuaauuuaaaaaagaaaauuaggcugagagcaguggcucacgccuguaauc

SEQ ID NO: 197999 - RNA, 64 nt, Homo Sapiens
aaguuuugagacuggcagguagugaaacucauuaggcugagaaccuuguggaaugcagcugacc

SEQ ID NO: 198000 - RNA, 64 nt, Homo Sapiens
cacaggcagagagggccacauaucgugugccagaggcugagagacugagagggaugacaggcuu

SEQ ID NO: 198001 - RNA, 64 nt, Homo Sapiens
augcugcucaggagccagcaaugcucugaacucuggcugagaggugccccagggacccaggcuc

SEQ ID NO: 198002 - RNA, 64 nt, Homo Sapiens
agggggagaaggaggggaagugcaauucccgcuuggcugagaggcaaacuucgggcaucuaccc

SEQ ID NO: 198003 - RNA, 64 nt, Homo Sapiens
uuuccaaaucuccaaguucuuugcauuauggauaggcugagaaucaguacaaguuuucuaauuu

SEQ ID NO: 198004 - RNA, 64 nt, Homo Sapiens
uuuccaaaucuccaaguucuuugcaguauggauaggcugagaaucaguacaaguuuucuaauuu

SEQ ID NO: 198005 - RNA, 64 nt, Homo Sapiens
ggcagaucacuugaggucagccagcacuuugggaggcugagaugaguggcucacaucuguaacc

SEQ ID NO: 198006 - RNA, 64 nt, Homo Sapiens
agaaaggaagcacagaagucuacaggaagaagguggcugagauaauagcagggaauuccucuac

SEQ ID NO: 198007 - RNA, 64 nt, Homo Sapiens
uacugggcugcauucucagagcugaauaaaaugaggcugagacccaacuccaucuggaauagga

SEQ ID NO: 198008 - RNA, 64 nt, Homo Sapiens
gccugauaaacucauccuaugagaacauguauaaggcugagauaggccgaaaagcauacacuga

SEQ ID NO: 198009 - RNA, 64 nt, Homo Sapiens
guugggucacgugggccccgccauaauuuucagaggcugagacauguggcucaggccuguaauc

SEQ ID NO: 198010 - RNA, 64 nt, Homo Sapiens
agccagguucucauaucccagggguucagacuuuggcugagaacagccccuggagaacaugggg

SEQ ID NO: 198011 - RNA, 64 nt, Homo Sapiens
uuucuuucugccccguugaagaggugcagccucaggcugagaaacacugauagaccaagaggug

SEQ ID NO: 198012 - RNA, 64 nt, Homo Sapiens
gcgcggcccccgcgcgcgucccccugccggccggggcugagacuccggggagcgcccgcgcccg

SEQ ID NO: 198013 - RNA, 64 nt, Homo Sapiens
agaccaaacuugauucccaucaguaccuugaaugggcugagaacggcucccugccugaggguca

SEQ ID NO: 198014 - RNA, 64 nt, Homo Sapiens
gcuaccugcccagccccuccgauggccugccuuuggcugagagguggcaggacaagugggagca

SEQ ID NO: 198015 - RNA, 64 nt, Homo Sapiens
aagccccacugcccucgcucccaaaagugguggaggcugagaaguucccuacccugcccuagac

SEQ ID NO: 198016 - RNA, 64 nt, Homo Sapiens
ccuuucucccauccauuggacucacgugaagcugggcugagagccacacaugacccacaccgcc

SEQ ID NO: 198017 - RNA, 64 nt, Homo Sapiens
ucucucuucucuguuacaaagcugguguggccaaggcugagagcgcuggggaagggggcuccau

SEQ ID NO: 198018 - RNA, 64 nt, Homo Sapiens
guccucauauccucuugagcucagcccaaagccaggcugagacaccuugugugugugcauggug

SEQ ID NO: 198019 - RNA, 64 nt, Homo Sapiens
uaauacaagauauuuauuuaaccaaugaccuuauggcugagaguugaauugugguucaguauuc

SEQ ID NO: 198020 - RNA, 64 nt, Homo Sapiens
uuuagaaucuggacacuuucuaugaauguaauucggcugagaaacauguugcugagaugcaauc

SEQ ID NO: 198021 - RNA, 64 nt, Homo Sapiens
gaggagaaaaaaaugccccccuugcuuuguacagggcugagaugacaccucaaucuagaaagaa

SEQ ID NO: 198022 - RNA, 64 nt, Homo Sapiens
cuacccuaugggguauaugguguugcuuucaccaggcugagacccucacucaacaacaucuuug

SEQ ID NO: 198023 - RNA, 64 nt, Homo Sapiens
uauuuaagaauuccaagaggaugugguaaaaagaggcugagacaaaguuuuacugcucuuugcc

SEQ ID NO: 198024 - RNA, 64 nt, Homo Sapiens
uguauaaaacauuuuggacuaguugcauuuuccaggcugagagcgaaacagugccuuuuucauc

SEQ ID NO: 198025 - RNA, 64 nt, Homo Sapiens
gugaucagggcaagcuguggagggccagggguggggcugagacugggcugacaucuagaaucac

SEQ ID NO: 198026 - RNA, 64 nt, Homo Sapiens
ggugguucaugccuguaauaccagcguuuugggaggcugagaugggaggauugcuugagcccag

SEQ ID NO: 198027 - RNA, 64 nt, Homo Sapiens
ccuggcaccaugcacaugucugaggcugagcaagggcugagaggagaggcuugggccucaguuu

SEQ ID NO: 198028 - RNA, 64 nt, Homo Sapiens
ccaccucauguuuucaaacuuaauacuggagacuggcugagaacuuacggacaacauccuuucu

SEQ ID NO: 198029 - RNA, 64 nt, Homo Sapiens
uguacagggcacuuacuacgaauggagcuugcagggcugagaguugcuccagaugagucaguga

SEQ ID NO: 198030 - RNA, 64 nt, Homo Sapiens; identical to SEQ ID NO: 64855

SEQ ID NO: 198031 - RNA, 64 nt, Homo Sapiens; identical to SEQ ID NO: 64856

SEQ ID NO: 198032 - RNA, 64 nt, Homo Sapiens
gcucucugccaugauacuuccuugggacugacuuggcugagaacguguucugucagaggauuug

SEQ ID NO: 198033 - RNA, 64 nt, Homo Sapiens
cuaggauggcugcugucugagccaugagugccagggcugagagaggccucuucauuuccucucc

SEQ ID NO: 198034 - RNA, 64 nt, Homo Sapiens
gagaacgcugaagaugauccuucccagagaaugcggcugagaaugacaggaaccucuuucccug

SEQ ID NO: 198035 - RNA, 64 nt, Homo Sapiens
agcuuugaggagccucauuggucucccacucaggggcugagagucugugcccggagcuggccgu

SEQ ID NO: 198036 - RNA, 64 nt, Homo Sapiens
ggcagaucacuugaggucagccagcacuuugggaggcugagacagguggcucacgccuguaauc

SEQ ID NO: 198037 - RNA, 64 nt, Homo Sapiens
gguuaaggggugaaucuccucucuucugacccagggcugagacaccuggccaggcgggaggcuu

SEQ ID NO: 198038 - RNA, 64 nt, Homo Sapiens
uggucagcaggcugggggcagaggcccaggacauggcugagagguaggaucagggacagaucug

SEQ ID NO: 198039 - RNA, 64 nt, Homo Sapiens
gguggaucaccugagaucagccagcacuuugggaggcugagaugaguggcucacgccuguaauc

SEQ ID NO: 198040 - RNA, 64 nt, Homo Sapiens
ggacacuugcuugaacccggccagcuacucaggaggcugagacagguggcgugcaccuguaauc

SEQ ID NO: 198041 - RNA, 64 nt, Homo Sapiens
caaagauucgucaacuuucuuagcucaagagagaggcugagaaaugcagagaagaauaagacau

SEQ ID NO: 198042 - RNA, 64 nt, Homo Sapiens
gacaguugggaagugccuguaggaaaauggcgauggcugagaaaagcccggaggagaugcuccu

SEQ ID NO: 198043 - RNA, 64 nt, Homo Sapiens
agaacaggcuguaaauggguugccaacauaagcuggcugagaaauaaaagaaaacaagacaguu

SEQ ID NO: 198044 - RNA, 64 nt, Homo Sapiens
cccuuugacuaaagauaaugugcugucauaucuuggcugagaaacuguugagucaggcuagagg

SEQ ID NO: 198045 - RNA, 64 nt, Homo Sapiens
auugcacuucacugcagcuuuagagaucgguuuaggcugagacauugcgccugccuuagguugc

SEQ ID NO: 198046 - RNA, 64 nt, Homo Sapiens
uugguuuuuaccagagaggcuuugaauggaagcaggcugagaguagccaaagaggcaaggggua

SEQ ID NO: 198047 - RNA, 64 nt, Homo Sapiens
ccuggcugcugcgaagcuggaggaggacugcgugggcugagaugccacccuuugaagggugaac

SEQ ID NO: 198048 - RNA, 64 nt, Homo Sapiens
agaggaucacuugagccuggucagcuacucaggaggcugagauggguggcacgugaguguaguc

SEQ ID NO: 198049 - RNA, 64 nt, Homo Sapiens
agagccuggcaaccagcaagcuggagucuggacuggcugagauaugcguccuuccuggguuggg

SEQ ID NO: 198050 - RNA, 64 nt, Homo Sapiens
gggcaaaauuguugucauuuaugagaaugcagagggcugagagaauccuaccugguuucugcau

SEQ ID NO: 198051 - RNA, 64 nt, Homo Sapiens
gcccccaggcugacaucuguuaggggcuuccuuaggcugagaguuagggcugagggcucggcug

SEQ ID NO: 198052 - RNA, 64 nt, Homo Sapiens
aaaaucaccacuauuaaaaacagugagaagcucuggcugagaagggcuggggucuuuuuaauuc

SEQ ID NO: 198053 - RNA, 64 nt, Homo Sapiens; identical to SEQ ID NO: 198046

SEQ ID NO: 198054 - RNA, 64 nt, Homo Sapiens
gguggagcaugccuguagucucagcuacucaggaggcugagaugagaggaucacuugagccuga

SEQ ID NO: 198055 - RNA, 65 nt, Homo Sapiens
gggcaaacaaaaugugaaauucugcccucagcugagcugaguaagggcuccuggggguuggcugg

SEQ ID NO: 198056 - RNA, 65 nt, Homo Sapiens
ugaagaucaaggagaugcuuuguacaugaacagaugcugaguaucuguuaucauuguauuguuua

SEQ ID NO: 198057 - RNA, 65 nt, Homo Sapiens
cuuuguucccuacccgugcccccagugucuucccugcugaguaccaggagagguccugccccauc

SEQ ID NO: 198058 - RNA, 65 nt, Homo Sapiens
ggcauggaauaguuuuguaucgggaauuucucagagcugaguaaaaugaaggaaaagcauguuau

SEQ ID NO: 198059 - RNA, 65 nt, Homo Sapiens
gcuucugcagagccauguuuccacuuuaagccagugcugaguaggcugcgauuggaaauuuccag

SEQ ID NO: 198060 - RNA, 65 nt, Homo Sapiens
ugcgcagccccaucugugcaugggcguacgcuggugcugaguagaagugaaugccagugugcuga

SEQ ID NO: 198061 - RNA, 50 nt, Homo Sapiens
ugccuggacucuccccuggcgcugaguaaauguggaaaauuaaaucauaa

SEQ ID NO: 198062 - RNA, 65 nt, Homo Sapiens
ccugcagggcuggaggaacagagcuagccccuggggcugaguacuaagaggaagaaggguaaacu

SEQ ID NO: 198063 - RNA, 65 nt, Homo Sapiens
ugggacuacaggcacaugcccucucaccucagccugcugaguagcccucucaggcucaagcaaac

SEQ ID NO: 198064 - RNA, 65 nt, Homo Sapiens
uauuauacggcuacauuuacagauucugaggcuaggcugaguacuuuguaaaaauugacaacuuu

SEQ ID NO: 198065 - RNA, 65 nt, Homo Sapiens
ccuagagagcuuggcuguuucuauaccuugcauuugcugaguacacccuggguaugcaggaccca

SEQ ID NO: 198066 - RNA, 65 nt, Homo Sapiens
guuuaggggauccuuucuaacguuggaugucuuaagcugaguacaaugguuuuugugcucuugua

SEQ ID NO: 198067 - RNA, 65 nt, Homo Sapiens
ggaaaggaguucuuccgggggacacgaauugccuggcugaguagcaagaaagacacacucuuaag

SEQ ID NO: 198068 - RNA, 65 nt, Homo Sapiens
guaugcauuagccuucccauuuugcaguugaggaggcugaguagccucagaaggguuuaggcgac

SEQ ID NO: 198069 - RNA, 65 nt, Homo Sapiens
uagggagaacaagaugucauuuguguucaguguaagcugaguaaacaggcccuuccuagaguguc

SEQ ID NO: 198070 - RNA, 65 nt, Homo Sapiens
cuuccagcccccgcgggaacggggguacacggugggcugaguacagucauucuguugggcugugg

SEQ ID NO: 198071 - RNA, 65 nt, Homo Sapiens
aaguugcuuucgaaguaacuguggucuuagguucggcugaguaaagaaaaaggauuuuucuucga

SEQ ID NO: 198072 - RNA, 65 nt, Homo Sapiens
agaaauauggaggcuuuaaaccgcaaacugaaaaagcugaguagaacaaaggcaguggagcauac

SEQ ID NO: 198073 - RNA, 65 nt, Homo Sapiens
uuauacuaagguagugacugagauuuggugaucuggcugaguauuuugaaacacauuuugaauaa

SEQ ID NO: 198074 - RNA, 65 nt, Homo Sapiens
uauuguugcauuuaugaauaaaucauuuaucugcugcugaguagaacugcauuuuaugaauauau

SEQ ID NO: 198075 - RNA, 65 nt, Homo Sapiens
ucagucacguccacgggggacgagccguggguucugcugaguagguggagcucauugcuuucucc

SEQ ID NO: 198076 - RNA, 65 nt, Homo Sapiens
guuuaauuuuucaguccaaagagaggaaaucagucgcugaguauuauuugacuccggucuccuug

SEQ ID NO: 198077 - RNA, 65 nt, Homo Sapiens
ccgagauccagcguucuguaacgcuacagggagaggcugaguaaaaggugagugcacagccugug

SEQ ID NO: 198078 - RNA, 65 nt, Homo Sapiens
caggaacuugacuguaguaguauuagauaauuggagcugaguacuuaucagcauccuuucaagaa

SEQ ID NO: 198079 - RNA, 65 nt, Homo Sapiens
gaauggucuuccauccccagaugcccugguguagggcugaguacuccuccuaucuuccuggguag

SEQ ID NO: 198080 - RNA, 65 nt, Homo Sapiens
auggaaauaucuccaucuuggaaugauuucgacuugcugaguaaauuagagaugacuuuaaucuu

SEQ ID NO: 198081 - RNA, 65 nt, Homo Sapiens
augguucuaaggaaagccuugccuuccugaagauagcugaguagguuaugaggcuuugaaaucuu

SEQ ID NO: 198082 - RNA, 65 nt, Homo Sapiens
ggcucacuggaaacuugcagccaccuaagcaagcugcugaguaagcuguuucuaugaaccacaga

SEQ ID NO: 198083 - RNA, 65 nt, Homo Sapiens
gaaagcauauuuuacuacuuauuucuuguuggcuggcugaguagagacaucauuuccuuguuccu

SEQ ID NO: 198084 - RNA, 65 nt, Homo Sapiens
ggcaagcaggugugaagagcuugaaauaaauacuagcugaguaaaaccuaggcaggaaucaucuc

SEQ ID NO: 198085 - RNA, 65 nt, Homo Sapiens
uuucggucacagggcaggccuucaggggcugugaagcugaguaauggggaccaccucuccuugca

SEQ ID NO: 198086 - RNA, 65 nt, Homo Sapiens
caggcagcggcacucugagagcuuccuuuagcagugcugaguaagacacagcagcacaggaccgc

SEQ ID NO: 198087 - RNA, 65 nt, Homo Sapiens
cggacaccccgagcgagcaccccaaagugcacaaagcugaguaaaaagcugcccccuucaaacag

SEQ ID NO: 198088 - RNA, 65 nt, Homo Sapiens
aaaaagaaaaucucauuagugaacuuaucuuugcagcugaguacuuaaauucuuuuuaaaaagau

SEQ ID NO: 198089 - RNA, 65 nt, Homo Sapiens
ccccauggggugugccagucuugcaguccgccccagcugaguagcgugagccagaugacgccaca

SEQ ID NO: 198090 - RNA, 65 nt, Homo Sapiens
gagcagccuggagacccaccgagaggaacacaggcgcugaguaugcugauggaucccgaagaaug

SEQ ID NO: 198091 - RNA, 65 nt, Homo Sapiens
gcuucauugaauagauuuguuuuauguuuuucauugcugaguacuaugugucacgaguuuuuguu

SEQ ID NO: 198092 - RNA, 65 nt, Homo Sapiens
uuuuugaugaauucaaucaaauggcuguugucauggcugaguagugguccugggaauuuauuuuc

SEQ ID NO: 198093 - RNA, 65 nt, Homo Sapiens
cucgaaauaguucauccagguucccgagaauugcagcugaguaugagacagagagccaugagacu

SEQ ID NO: 198094 - RNA, 65 nt, Homo Sapiens
auucugugguguguaugugucauuauuuuuuuuuggcugaguaguuguugcaaaagauaagauuu

SEQ ID NO: 198095 - RNA, 65 nt, Homo Sapiens
uucacguaucuuccaaguacuuucauaauaucuaugcugaguauugguuacuuuguuauucagcu

SEQ ID NO: 198096 - RNA, 65 nt, Homo Sapiens
cagcagcccucauauaauagccucugaccacaggugcugaguacuacagcaaacagaucacuagg

SEQ ID NO: 198097 - RNA, 65 nt, Homo Sapiens
uggcacuugaauuccugcuuuaggaaaccuaauaugcugaguaucauauuacccugugacuuacg

SEQ ID NO: 198098 - RNA, 65 nt, Homo Sapiens
aauaagacaaaaauaauaguuuuagugaggauggugcugaguaaacauaaaaacugauuugcucu

SEQ ID NO: 198099 - RNA, 65 nt, Homo Sapiens
uaauuuuuaccuuauuuuggcucuaauuugaauaagcugaguaaaaccaccaaagaucaguuaua

SEQ ID NO: 198100 - RNA, 65 nt, Homo Sapiens
cuuaaugguccuuuuggccccuuggauaguuaacagcugaguaauucuaaucucuucuguguuuu

SEQ ID NO: 198101 - RNA, 65 nt, Homo Sapiens
gugcaagugguucaggggccagcgcagagcagagugcugaguaaagaugucagaaaaggaaagca

SEQ ID NO: 198102 - RNA, 65 nt, Homo Sapiens
aguccaugguacauauauacuuauucuucuuuauggcugaguaauccaaguugcugcaaaauaca

SEQ ID NO: 198103 - RNA, 65 nt, Homo Sapiens
acaugacauguggcugccuccccuuucagaaacaagcugaguaacccagccugccguuuguaugu

SEQ ID NO: 198104 - RNA, 65 nt, Homo Sapiens
gggacaggccuggaguuacuaggacaggccuuugugcugaguagcaauguauacaccauuugggc

SEQ ID NO: 198105 - RNA, 65 nt, Homo Sapiens
agcugccugauuagaugacucaacaguuagcuggagcugaguagcggacccaucuuugcucaugg

SEQ ID NO: 198106 - RNA, 65 nt, Homo Sapiens
uuuuaucaguaaguacaaauaacauacuucuccuagcugaguauuagauugugugacuuuaggca

SEQ ID NO: 198107 - RNA, 65 nt, Homo Sapiens
cuauaacuguuaaacuuaagggauguaacagugaagcugaguaaauugaauacaauacucaucua

SEQ ID NO: 198108 - RNA, 65 nt, Homo Sapiens
ugaucccugugugucaguugugcauuuuuuuuguugcugaguaguauguucuaucuuaugucaga

SEQ ID NO: 198109 - RNA, 65 nt, Homo Sapiens
ccacccuuagacccugugauccauccucucuccuagcugaguaaauccgggucucuaggaugcca

SEQ ID NO: 198110 - RNA, 65 nt, Homo Sapiens
accccugaguucaagcgauucuccugccucagccugcugaguaguugggauuacaggcgcccacc

SEQ ID NO: 198111 - RNA, 65 nt, Homo Sapiens
uuuuuuaaaacucaucacagaagauuggugaaaaugcugaguaugacacuuuucuucuugcaugc

SEQ ID NO: 198112 - RNA, 65 nt, Homo Sapiens
aaaugagaugaaagacauuuccuuugauagauaaugcugaguaaaacuagaugggacauccaguc

SEQ ID NO: 198113 - RNA, 65 nt, Homo Sapiens
aacuucaagaugaucauucuucagaaaacauuaaagcugaguagaucucucugccauuuucucua

SEQ ID NO: 198114 - RNA, 65 nt, Homo Sapiens
uccucuuuguagaugauguacaagcuggcugccaugcugaguaagagacguuuacucuggaggca

SEQ ID NO: 198115 - RNA, 64 nt, Homo Sapiens
uuaagcucuuuaugacuguuaccacgaucguuaugcugaguaugacauggcuugcaaaaaguaa

SEQ ID NO: 198116 - RNA, 65 nt, Homo Sapiens
guagaaauaucuaagguacugacacuucagacauugcugaguauagaaucagaaugcugaguaua

SEQ ID NO: 198117 - RNA, 65 nt, Homo Sapiens
gacacuucagacauugcugaguauagaaucagaaugcugaguauagaaaauaauuuaaaacuaaa

SEQ ID NO: 198118 - RNA, 65 nt, Homo Sapiens
auacugacacuucagacauuacacaaaaucagagugcugaguacagaaaguuauccaaaacaaaa

SEQ ID NO: 198119 - RNA, 65 nt, Homo Sapiens
cuuauuucagaauggaaauauuuuugagaaaaguagcugaguauacugguuuaagaaaaugcuug

SEQ ID NO: 198120 - RNA, 65 nt, Homo Sapiens
ugagggucacugguggaccaugcuaguauuuuggugcugaguaauuagauuauguauagggguaa

SEQ ID NO: 198121 - RNA, 65 nt, Homo Sapiens
uccacuuauccccuccgugauauggcucuucgcaugcugaguacuggaccucggaccagagccau

SEQ ID NO: 198122 - RNA, 65 nt, Homo Sapiens
acaaugaaaacucaauucuauuuacaaguauaaaugcugaguaugucuguugaagacgagcagag

SEQ ID NO: 198123 - RNA, 65 nt, Homo Sapiens
aaauaaaaccaaucaaacacgugauauaaaauaaagcugaguauauauaccugaauuacaguuuu

SEQ ID NO: 198124 - RNA, 65 nt, Homo Sapiens
guggugcaaucucacugcaagcccuuuucgcccaggcugaguacauuuuucugagacggaguuuc

SEQ ID NO: 198125 - RNA, 65 nt, Homo Sapiens
augggcuacagugucuggccacccuccucuagaaggcugaguaccggcuucuccucugcuaggcu

SEQ ID NO: 198126 - RNA, 65 nt, Homo Sapiens
uggcacaacucuaucuaaggagcagaugcuugugggcugaguaauccccugucuaauuaagacaa

SEQ ID NO: 198127 - RNA, 65 nt, Homo Sapiens
uccuuaugcuacagcaggagacgcugcagaagacagcugaguacaugcaggugagcaaagcuacc

SEQ ID NO: 198128 - RNA, 65 nt, Homo Sapiens
auauaauuuacaaucuuaagugaagaaauauuuuagcugaguacugcagguuuuguaacuauuua

SEQ ID NO: 198129 - RNA, 65 nt, Homo Sapiens
ugguauacaggcacaucgcccuuguaccucagccugcugaguagcccuccuaaguucaaacgauu

SEQ ID NO: 198130 - RNA, 65 nt, Homo Sapiens
aagcauguuuagcuucgaaguuuuacuuuuuuaaagcugaguaguuaagaauucccuguaaaaac

SEQ ID NO: 198131 - RNA, 65 nt, Homo Sapiens
uaaaaagaaggcuucucuguuuggguagcguaagagcugaguauaguaaguccucuuccaaagag

SEQ ID NO: 198132 - RNA, 65 nt, Homo Sapiens
ggaauaaacagugagcauauauauuuagguuuuuggcugaguacuauguauuuauaauuuaaaug

SEQ ID NO: 198133 - RNA, 65 nt, Homo Sapiens
gaugggaaacuauugugcacaucggggcaagagaggcugaguacgcuugaguagaaaagucgggg

SEQ ID NO: 198134 - RNA, 65 nt, Homo Sapiens
uaaagaauugugguuuauauauuuaaaagugucaagcugaguauuaaaauguaugcauguugucu

SEQ ID NO: 198135 - RNA, 65 nt, Homo Sapiens
ugcacagagcuagacucgggcagccagagcggcgagcugaguaacagggguaacaccucccugcu

SEQ ID NO: 198136 - RNA, 65 nt, Homo Sapiens
cguucccuacacagaaaucuuggaaaccaaaugcugcugaguaaggaugaagcuuugagccuccu

SEQ ID NO: 198137 - RNA, 65 nt, Homo Sapiens
uccuaauuguauagaaucuugaaaauacucuuaaagcugaguauuaacuaaaaaagugaagauaa

SEQ ID NO: 198138 - RNA, 65 nt, Homo Sapiens
guggccaccauguccaagguggguggcuucucccagcugaguaauggaggcaggaaccaggauaa

SEQ ID NO: 198139 - RNA, 65 nt, Homo Sapiens
aagcugcuuccccuccucucauaagggccuccccagcugaguaaggaggaggccugcaccccagu

SEQ ID NO: 198140 - RNA, 65 nt, Homo Sapiens
uauguguggcugugggugugggugggagugugucugcugaguaaggaacacgauuuucaagauuc

SEQ ID NO: 198141 - RNA, 65 nt, Homo Sapiens
uguuucuaaugucucugaacucuaacuucuuguuugcugaguaauucucucagccacugcuauag

SEQ ID NO: 198142 - RNA, 65 nt, Homo Sapiens
uaccaucaucgcuggugggguauaggagcccacuggcugaguagccauucugacguguaaccgca

SEQ ID NO: 198143 - RNA, 65 nt, Homo Sapiens
aauugauuccuccauccuugucaugucugugaauugcugaguacuuuaaaaaugucauguuuaug

SEQ ID NO: 198144 - RNA, 65 nt, Homo Sapiens
augucuaggacuaaagcaguggcuuuguauagcaagcugaguaaagguugacauauuccaaaacc

SEQ ID NO: 198145 - RNA, 65 nt, Homo Sapiens
uggaaggaaagcaacuuuaaaacauuuagaguuuugcugaguauagccaaaugccuguucugaaa

SEQ ID NO: 198146 - RNA, 65 nt, Homo Sapiens
uggguaacuuauuggggcugccaggagggagggcagcugaguaacgaacagaaggacagauggac

SEQ ID NO: 198147 - RNA, 65 nt, Homo Sapiens
guaguuucauauaugguuccuguagguuagaaacagcugaguaucccauauguaaucacuguguu

SEQ ID NO: 198148 - RNA, 65 nt, Homo Sapiens
caggccacuccaaucacccuccugaccucugaagagcugaguacuuaaccaaagaaaguggguca

SEQ ID NO: 198149 - RNA, 65 nt, Homo Sapiens
uaaaaaacaucaucgcucccaaaaauuucuucugggcugaguagauuaaaaaaacaaucccaagu

SEQ ID NO: 198150 - RNA, 65 nt, Homo Sapiens
aagguuccaaagggauuuagcagugaggcagcaaugcugaguagguaggauaauuauuucauuca

SEQ ID NO: 198151 - RNA, 65 nt, Homo Sapiens
uuuauuacuguuuaugauuucagauaaaaauaguugcugaguaaauuuuacuuguaaucuacaau

SEQ ID NO: 198152 - RNA, 65 nt, Homo Sapiens
guuuauuuuccaucuuguuuguuuuccuaccuuaugcugaguaguccagagaguuaaaaaaauuc

SEQ ID NO: 198153 - RNA, 65 nt, Homo Sapiens
cuagggagauuuauuucuguuaaauaguuaacucugcugaguaugacaaauagugucuacuaucu

SEQ ID NO: 198154 - RNA, 65 nt, Homo Sapiens
ucauaggaaagcugaaugcuuauaauauuuaagaugcugaguauuuuacuaaaaaaagaguugua

SEQ ID NO: 198155 - RNA, 65 nt, Homo Sapiens
gucaucagaugaguagucccacagccccaagcacugcugaguaaagugucaagacuuuuaacccg

SEQ ID NO: 198156 - RNA, 65 nt, Homo Sapiens
cccuauuucuuugaucccuuuggaucugcaugugugcugaguauugacagaaauuguauguauug

SEQ ID NO: 198157 - RNA, 65 nt, Homo Sapiens
uuuuauuucugaaacacucaaacaccuuacaaagugcugaguagguaauagugacccaacuuguu

SEQ ID NO: 198158 - RNA, 65 nt, Homo Sapiens
gacccacuguaacuuagccacugaugaaccuuaaagcugaguauuuuauuaacaccugauuugua

SEQ ID NO: 198159 - RNA, 65 nt, Homo Sapiens
caguuauaaaagcauaauugccuugggcuaaucuggcugaguaguggccaagaaagcaacuugag

SEQ ID NO: 198160 - RNA, 65 nt, Homo Sapiens
uguaacugucagaagaaggagaugagcuauguuuggcugaguacucuuuaauuaauaguauguau

SEQ ID NO: 198161 - RNA, 65 nt, Homo Sapiens
acaggaugggcagagaaaggguagugugugagggagcugaguaggccagguaggcgauuggaaga

SEQ ID NO: 198162 - RNA, 65 nt, Homo Sapiens
auauaguuccuugggauuagcucuuggccaagaaggcugaguaugguucccaauuuuuaaaucca

SEQ ID NO: 198163 - RNA, 65 nt, Homo Sapiens
gcaaaaguagcuuuugaacugauauaaaaaaaaaugcugaguaacagaaaaguauuaaugugcuu

SEQ ID NO: 198164 - RNA, 65 nt, Homo Sapiens
auccugcuuuagccugagacuugccauaagaaacugcugaguacuuggcaaacccuuucauaguu

SEQ ID NO: 198165 - RNA, 65 nt, Homo Sapiens
aaggauagcagaggccaaccggcucuggaccaugagcugaguaggacagguagccccucaugcug

SEQ ID NO: 198166 - RNA, 65 nt, Homo Sapiens
auuccaugguauggauguaccaguuccuuuugauugcugaguagugcaucguggugaaguggggg

SEQ ID NO: 198167 - RNA, 65 nt, Homo Sapiens
uaaccauaucaccucucuuccucaaauggcauugggcugaguaaggcuccauacuucuuucacua

SEQ ID NO: 198168 - RNA, 65 nt, Homo Sapiens
ccaugagugcuucgcagagcaauggcaccagcguugcugaguaucaaccacugagaaaagacgaa

SEQ ID NO: 198169 - RNA, 65 nt, Homo Sapiens
auugcuguucagccuuuguuuuuacgucauuacaagcugaguaaaauuccuucugaugauguuau

SEQ ID NO: 198170 - RNA, 65 nt, Homo Sapiens
uuccuuaguucaaggaacagcugagacagaccucugcugaguagcucugugaugacaaagccuug

SEQ ID NO: 198171 - RNA, 65 nt, Homo Sapiens
aaaaaacaaaagcccuggaaguugaggccaagccugcugaguauugcagcugcauuugcccaaag

SEQ ID NO: 198172 - RNA, 65 nt, Homo Sapiens
cugguaacagcagcccgcauuagcagagagcuguagcugaguagcugccaccucguugggagacu

SEQ ID NO: 198173 - RNA, 65 nt, Homo Sapiens
auucuauuguagagauguacuuguuccuuuucauugcugaguagucuguuguguguaucagcagu

SEQ ID NO: 198174 - RNA, 65 nt, Homo Sapiens
aucuaaacagguugguggaauugaauaugacccaagcugaguauuagagaaucucuguguagaau

SEQ ID NO: 198175 - RNA, 65 nt, Homo Sapiens
auugcagagaaugugaugagugaguguauaugagugcugaguaguuguccaggguauugcucccc

SEQ ID NO: 198176 - RNA, 65 nt, Homo Sapiens
guacuagcugccuccccaccggauacuucuggcuggcugaguauagcaauccguucuuagggacu

SEQ ID NO: 198177 - RNA, 65 nt, Homo Sapiens
aggggaaauuucuaaaccuaaacaaauuagucuuugcugaguaaauuuuuuuuuaauagcuguuu

SEQ ID NO: 198178 - RNA, 65 nt, Homo Sapiens
uuucaauaaaccuuuugauaagccaguacgucugagcugaguaugggaggacugaccgcuucaua

SEQ ID NO: 198179 - RNA, 65 nt, Homo Sapiens
gacucagggccaugccugccuggaggguggggggcgcugaguaggaaccugcugaagggcagagg

SEQ ID NO: 198180 - RNA, 65 nt, Homo Sapiens
aacuugccuuucugauagaaacuguuaaggagaaagcugaguaucgcuuucguaaaggucugaac

SEQ ID NO: 198181 - RNA, 65 nt, Homo Sapiens
uuucuugauugcacagaauggagccacugugcccagcugaguaaaagugcuggaauuacaggugu

SEQ ID NO: 198182 - RNA, 65 nt, Homo Sapiens
agaccaggguggguacauacuggagacagccaagagcugaguauauaaaggagagggaaugugca

SEQ ID NO: 198183 - RNA, 65 nt, Homo Sapiens
uugaccacggacuccagucuguguguagggagagagcugaguaggaggccuccacuccggaucga

SEQ ID NO: 198184 - RNA, 65 nt, Homo Sapiens
cagugggugcaaggcgccauacuugcugugagagagcugaguagaguguugguuuuuccauaacu

SEQ ID NO: 198185 - RNA, 65 nt, Homo Sapiens
guucaacaguuuugcugacaccgaugaggacuucagcugaguauaucugcuggaucaacagaauc

SEQ ID NO: 198186 - RNA, 65 nt, Homo Sapiens
agccagucugcugugaccacaaauaagggccuggagcugaguaguuccuggacaccgaggauugg

SEQ ID NO: 198187 - RNA, 65 nt, Homo Sapiens
uuucugcauauacuggauuggaucacgagugugaugcugaguaccaauggaaauaagaggauauu

SEQ ID NO: 198188 - RNA, 65 nt, Homo Sapiens
agaauuucacaagcuauucccucaaaucugagggagcugaguaacaccaucgaucaugauguaga

SEQ ID NO: 198189 - RNA, 65 nt, Homo Sapiens
gcauucaagcuuuagacauuacacuaaaucagagugcugaguauagaaaauaauacaaacagauu

SEQ ID NO: 198190 - RNA, 65 nt, Homo Sapiens
ccaccaaggacagcuacacgcugacggaggagcuagcugaguaugcugaaauccgggucaaguga

SEQ ID NO: 198191 - RNA, 65 nt, Homo Sapiens
cucccgucucuagggcugcauggggagcccggggagcugaguaguggggauccagagaggacccc

SEQ ID NO: 198192 - RNA, 65 nt, Homo Sapiens
gaaaauaaucuaaaacuaaauuacuaaaucagagugcugaguauagcacugaugcuucagguauu

SEQ ID NO: 198193 - RNA, 65 nt, Homo Sapiens
aauaucauuuccacaguuccaauuccuccuacauugcugaguacuagccaaggcuccucuuuaug

SEQ ID NO: 198194 - RNA, 65 nt, Homo Sapiens
aagaaguaaaauacauguuuuaucuguaguuccuugcugaguaacccuggccgcagugaggcaug

SEQ ID NO: 198195 - RNA, 65 nt, Homo Sapiens
aaauaagaaaaguuagggcauguuagaaucaauuugcugaguauguaaaagggcaugauuaugaa

SEQ ID NO: 198196 - RNA, 65 nt, Homo Sapiens
guccuggggguaaggggaugcaguagcuggucagggcugaguacaugucccccucccacccuaca

SEQ ID NO: 198197 - RNA, 65 nt, Homo Sapiens
uccacaaauaauggggacuucagccacucaccaaggcugaguaggcuuguggauccuguugggac

SEQ ID NO: 198198 - RNA, 65 nt, Homo Sapiens
ccgggaagaagccagcaaagucccccgugucccuugcugaguauucugucacagacaagccucca

SEQ ID NO: 198199 - RNA, 65 nt, Homo Sapiens
ggggagagguuggggcuggcaggccacuggcaugugcugaguagcgcagagcuacccagugagag

SEQ ID NO: 198200 - RNA, 65 nt, Homo Sapiens
aagaucuaugggcaugggaggugggcguuggaaaggcugaguaggaauggugccuggcaccccug

SEQ ID NO: 198201 - RNA, 65 nt, Homo Sapiens
ucagagaccugaggccuaguggggaucuguccuaagcugaguacagcagccaggggaccagaacu

SEQ ID NO: 198202 - RNA, 65 nt, Homo Sapiens
uacuagaagggcauuggccauucuauuguggcaaggcugaguagaagauccuaccccaauuccuu

SEQ ID NO: 198203 - RNA, 65 nt, Homo Sapiens
ugccaguaggcucaacuagggagugagugcaaaaagcugaguauggugagagaagccugugcccu

SEQ ID NO: 198204 - RNA, 65 nt, Homo Sapiens
cuaagaauauaggcuugaugggaaauugaagguaggcugaguauugggaauccaaauugaauuuu

SEQ ID NO: 198205 - RNA, 65 nt, Homo Sapiens
cauucaaaggccacuggugcuuuauuuuucuaucugcugaguaaacugaaaugagauggguccca

SEQ ID NO: 198206 - RNA, 65 nt, Homo Sapiens
uuugauaugauuuuaaagucagaauaguacagauugcugaguauuauacuuuaggcuagauuaau

SEQ ID NO: 198207 - RNA, 65 nt, Homo Sapiens
aauguuuugauucucuaaucauguuuucgucacaugcugaguaaaagugccuuacaauguaaaaa

SEQ ID NO: 198208 - RNA, 65 nt, Homo Sapiens
uaaacauguucugucacaaaccuuuugucuccggggcugaguaaacgcucccccauaucaauuuu

SEQ ID NO: 198209 - RNA, 65 nt, Homo Sapiens
ucugccuuugcucuggucuaggccagggagcaguggcugaguagcggaccagcagucugccugga

SEQ ID NO: 198210 - RNA, 65 nt, Homo Sapiens
gaagauauuucaaauuguuuaaucuucuuacacacgcugaguacauugucagugauguugccuag

SEQ ID NO: 198211 - RNA, 65 nt, Homo Sapiens
auuuugaacuuuccagaaccaggaagaaguucuuggcugaguacugacucauguguuuuggggaa

SEQ ID NO: 198212 - RNA, 65 nt, Homo Sapiens
uuuuccucauaaccaagcaucuccgugaaucuuaugcugaguagucagauaccuaacagguuuuu

SEQ ID NO: 198213 - RNA, 65 nt, Homo Sapiens
aaucaacuuauagugcugacagauuccacuagcaugcugaguaggauaguaaaucaggaugcuca

SEQ ID NO: 198214 - RNA, 64 nt, Homo Sapiens
caggggcuucuaauuaaauuuaggggauccugaugccacuuagcagugggauuucagaggaccu

SEQ ID NO: 198215 - RNA, 64 nt, Homo Sapiens
agggcauggacugcuugaguucagugccagcuaugccacuuaccagcugugggaccuugggcaa

SEQ ID NO: 198216 - RNA, 64 nt, Homo Sapiens
aaauuuucagguagucugaguaauagauuguuuugccacuuagaauagcauuugccacuuagua

SEQ ID NO: 198217 - RNA, 64 nt, Homo Sapiens
guaauagauuguuuugccacuuagaauagcauuugccacuuaguauuuuaaaaaauaauuguug

SEQ ID NO: 198218 - RNA, 64 nt, Homo Sapiens
ugcaguugaguuguucaagugagaguuuugauaagccacuuaugggccgcguugugaaucacuu

SEQ ID NO: 198219 - RNA, 64 nt, Homo Sapiens
uacuuugauauuugaaauguuauguacuggaaaggccacuuauauuucuagaacagauuggauu

SEQ ID NO: 198220 - RNA, 64 nt, Homo Sapiens
uaugcugccauaacacuugaaaaccaauuuaguuguuagucauucauuaaacauuaacaucacu

SEQ ID NO: 198221 - RNA, 64 nt, Homo Sapiens
uuuuguauuuuuaguagagaugggguuucaccguguuagucaggauggucucgaucuccugacc

SEQ ID NO: 198222 - RNA, 64 nt, Homo Sapiens
ccgggaaccccaacaguugguugucuugucuuccagggugcaggucacugagugacuuccccag

SEQ ID NO: 198223 - RNA, 64 nt, Homo Sapiens
ucuuccagggugcaggucacugagugacuuccccagggugcacagcgaguaacagaucaggacc

SEQ ID NO: 198224 - RNA, 64 nt, Homo Sapiens
ugcauucucuuuaggccacugguucucaaacauuagggugcacuguaaccauuacagagcuugu

SEQ ID NO: 198225 - RNA, 64 nt, Homo Sapiens
ugaggcaagagaaucacuugaacccgggaggcagagggugcaguaagccgagauugcaccacug

SEQ ID NO: 198226 - RNA, 64 nt, Homo Sapiens
gcuagacacgaagcuuaaacgcuguuaggcuaagagggugcagggggcacagcgcucgaggugu

SEQ ID NO: 198227 - RNA, 64 nt, Homo Sapiens
ucugguucuuccagagagaccacuccaguggugaagggugcagcguagagccugaagcugugau

SEQ ID NO: 198228 - RNA, 64 nt, Homo Sapiens
gugaggaugggcuucugccuggcacuggggguggagggugcacacgaauggcccgccuugaggg

SEQ ID NO: 198229 - RNA, 64 nt, Homo Sapiens
acaccacccuggguggaucgaggagucuggguccagggugcaacagagaaaaacuucaugcaug

SEQ ID NO: 198230 - RNA, 63 nt, Homo Sapiens
uuccuuaaguuuugaucuccgucuuccugaugaagcaggcagagcucagaggaucuuggcauc

SEQ ID NO: 198231 - RNA, 63 nt, Homo Sapiens
aucuucccccaccuucuacaugguauuagucccagcaggcaucccuggggcagacgugcuuug

SEQ ID NO: 198232 - RNA, 63 nt, Homo Sapiens
ccagcccugauguggagacagaggaaguaagguagcaggcaguguuggcuacaugaguauuua

SEQ ID NO: 198233 - RNA, 63 nt, Homo Sapiens
acuuuucugcucccuuucucaggaggagaagccagcaggcaccugucuucaggcugccagggg

SEQ ID NO: 198234 - RNA, 63 nt, Homo Sapiens
aggccugggauugagcuaaccugaaacaaagguagcaggcaggaccuaaugaccagagguuaa

SEQ ID NO: 198235 - RNA, 63 nt, Homo Sapiens
gccaacauuggugucccuguccccagagggaggagcaggcaggagagagaggggaaggaggua

SEQ ID NO: 198236 - RNA, 63 nt, Homo Sapiens
auaaauacaaagcagcuuccaucaggaacauggagcaggcagggacuccauuuuacagaauua

SEQ ID NO: 198237 - RNA, 63 nt, Homo Sapiens
caggggccggagugagggggcugcuggcuuaacagcaggcaucugggcaggccaguccucaaa

SEQ ID NO: 198238 - RNA, 63 nt, Homo Sapiens
accgugucuguggucgggugcucucacuccagcagcaggcagaugcagccucagaaaccaggc

SEQ ID NO: 198239 - RNA, 63 nt, Homo Sapiens
ucuuguugccaauuuacaaaccucagggcagccagcaggcaggugugggagcagacccguggg

SEQ ID NO: 198240 - RNA, 63 nt, Homo Sapiens
aaggcgcuggagccugcggggcagcaggggccaagcaggcacucuggggcuggcaccagcagg

SEQ ID NO: 198241 - RNA, 63 nt, Homo Sapiens
caggggccaagcaggcacucuggggcuggcaccagcaggcacugaagcugcggcccugaucuc

SEQ ID NO: 198242 - RNA, 63 nt, Homo Sapiens
cuguuaauaugcucauugaaaacauggcauugaagcaggcacuugcguggauguuucucacuu

SEQ ID NO: 198243 - RNA, 63 nt, Homo Sapiens
accuuuggaucugugagaaggugaauacaaagcagcaggcagaguaaaaucugcugggacugc

SEQ ID NO: 198244 - RNA, 63 nt, Homo Sapiens
gagccugggucuaggcuaaggagggccaggagcagcaggcaagucauccacuugagggcgccu

SEQ ID NO: 198245 - RNA, 63 nt, Homo Sapiens
uucgagaacggauccagaaaagcucugagcagcagcaggcaaccgggggggacucaacagcag

SEQ ID NO: 198246 - RNA, 63 nt, Homo Sapiens
guggaggcagccauccccugcucgagucccuggagcaggcaguaaggcucuccguggagugga

SEQ ID NO: 198247 - RNA, 63 nt, Homo Sapiens
ugcagccgggaaagccagggggacuggagcuggagcaggcacuggagccaugaggaggggcug

SEQ ID NO: 198248 - RNA, 63 nt, Homo Sapiens
gccugccucagcaugcuucgugccuagcuccagagcaggcacaccugaccucuucccaggcag

SEQ ID NO: 198249 - RNA, 63 nt, Homo Sapiens
gaugcuagagggugaugacccagggcaggcaggagcaggcacuaagugguggagccucagggc

SEQ ID NO: 198250 - RNA, 63 nt, Homo Sapiens
uucuaagacaggaaggaaagugaaggcagagugagcaggcaaaguagaaaauucgaaaagguc

SEQ ID NO: 198251 - RNA, 63 nt, Homo Sapiens
uuguugcaaugacuugggagugccauagcaccuagcaggcagaagccagaaacaccaaauguc

SEQ ID NO: 198252 - RNA, 63 nt, Homo Sapiens
ugccggagagacagccccuugugcugugagcagagcaggcaguggcucuggaggcugccugug

SEQ ID NO: 198253 - RNA, 63 nt, Homo Sapiens
aagguuuccucucuucccccaggaccugggcagagcaggcaugagcugggcuguggugcagag

SEQ ID NO: 198254 - RNA, 63 nt, Homo Sapiens
caggugauuuccuagggagagguucccagucccagcaggcagaaugcccaaaaccaggagcac

SEQ ID NO: 198255 - RNA, 63 nt, Homo Sapiens
cucccugguuucuuccuggcaugguguuugggcagcaggcaucauuuuccuuuucuagcuuca

SEQ ID NO: 198256 - RNA, 63 nt, Homo Sapiens
aguaauaagaaucuaggaggaauuccaaaccgaagcaggcagggucuggaacccaaaggacag

SEQ ID NO: 198257 - RNA, 63 nt, Homo Sapiens
ucagcacgcucacuaacccagcaugccacuuccagcaggcaugcaguccuggcccagcucuau

SEQ ID NO: 198258 - RNA, 63 nt, Homo Sapiens
guucuugcaagagcgcguggggacaguucuuccagcaggcacugguuuuguugccccagggcu

SEQ ID NO: 198259 - RNA, 63 nt, Homo Sapiens
cgugcaugcuuuaaaaaacacagucacgcaccaagcaggcaaauagcuuuaguccuucucacc

SEQ ID NO: 198260 - RNA, 63 nt, Homo Sapiens
cggauaguaagaaaacaaacagcccaagugaaaagcaggcaaaagacuugaauagacacuuca

SEQ ID NO: 198261 - RNA, 63 nt, Homo Sapiens
caguccaaggaauaucaaaauuaaucuuccucuagcaggcauggccauuuuggcugcuguucu

SEQ ID NO: 198262 - RNA, 63 nt, Homo Sapiens
caguccaaggaauaucaaaauuaauuuuccucuagcaggcaugaccauuuuggcugcugcucu

SEQ ID NO: 198263 - RNA, 63 nt, Homo Sapiens
augcgucgauuuuuuuuuuuggaagacguugcaagcaggcaaacccugacgucccccagcaaa

SEQ ID NO: 198264 - RNA, 63 nt, Homo Sapiens
uggccugacccaugagaccgcuggaguccaggaagcaggcaaccucagccauggcaaguccau

SEQ ID NO: 198265 - RNA, 64 nt, Homo Sapiens
cgguaaaggcacuaaagucacuuuaaagcuuuuggagaagcaggagggcauuggcuuaaccaag

SEQ ID NO: 198266 - RNA, 64 nt, Homo Sapiens
uuggcuccucagcaaggaagcaaacgccuuggaggagaagcacaugguugcccuuuuguccuug

SEQ ID NO: 198267 - RNA, 50 nt, Homo Sapiens
ucggcuuauauaagcucuaagagaagcacuuugggauucuuuccauuaug

SEQ ID NO: 198268 - RNA, 64 nt, Homo Sapiens
agaacauagaacucugggcugccaugugaagagggagaagcaugaaaaagcagcuaccaggugu

SEQ ID NO: 198269 - RNA, 64 nt, Homo Sapiens
uuauuacauuuuacucauccaggggacuaagagagagaagcaugacacacacacacacucuuuu

SEQ ID NO: 198270 - RNA, 64 nt, Homo Sapiens
gccuuggucuuguuucuguggucaguuucuucuugagaagcaguuaacucagacagugcaugag

SEQ ID NO: 198271 - RNA, 64 nt, Homo Sapiens
aggcaguuuugauuugaggagguuugcacauguagagaagcauacuggagaagcauauccagag

SEQ ID NO: 198272 - RNA, 64 nt, Homo Sapiens
uugaggagguuugcacauguagagaagcauacuggagaagcauauccagagggcgaaagauauc

SEQ ID NO: 198273 - RNA, 64 nt, Homo Sapiens
gguucaaagagaaagguuggagaugauagugggugagaagcaggcuggugagacugggcugagg

SEQ ID NO: 198274 - RNA, 64 nt, Homo Sapiens
agaaaaaucugcuauuuuucuaaguaagagucucgagaagcagaguuuuugucuugucauugag

SEQ ID NO: 198275 - RNA, 64 nt, Homo Sapiens
cagaaucaucuucagaaagugaacuugaacaugagagaagcagaaggaggaaacauaagaggag

SEQ ID NO: 198276 - RNA, 64 nt, Homo Sapiens
aaguguucaggccacacagucagcccaggaaaaagagaagcagggccaaauggaaagaacacau

SEQ ID NO: 198277 - RNA, 64 nt, Homo Sapiens
augguuuacuauuuuggcugcucuuggggacugcgagaagcagagagaaugagagaccaguggc

SEQ ID NO: 198278 - RNA, 64 nt, Homo Sapiens
uuccaagugguuuucaagugucaggcaguguucugagaagcagcagccuauaacuguaugugug

SEQ ID NO: 198279 - RNA, 64 nt, Homo Sapiens
ucaaugaucugaagagugaaagcaggaaucgcuagagaagcaaaugaagauuuacuuucugaga

SEQ ID NO: 198280 - RNA, 64 nt, Homo Sapiens
aaucgcuagaggugggugaaaagauuuacuuucugagaagcaggaauagaaaagaaaucgcuug

SEQ ID NO: 198281 - RNA, 64 nt, Homo Sapiens
cggguugggugggaggaggaccaaggcucaucuugagaagcagggacagcaucucacuauguug

SEQ ID NO: 198282 - RNA, 64 nt, Homo Sapiens
cggguugggugggaggaggaaguuuguugccacugagaagcaggguagcaugaugagcaacuug

SEQ ID NO: 198283 - RNA, 64 nt, Homo Sapiens
uauaaauguaaauauauuuuguauauuuuucuaugagaagcacuucauagggagaagcacuuau

SEQ ID NO: 198284 - RNA, 64 nt, Homo Sapiens
uuuguauauuuuucuaugagaagcacuucauagggagaagcacuuaugacaaggcuauuuuuua

SEQ ID NO: 198285 - RNA, 64 nt, Homo Sapiens
ccugauucuaccacuuaaggugguccaguaggaagagaagcagcgaguaugagagacagguaca

SEQ ID NO: 198286 - RNA, 64 nt, Homo Sapiens
gaugacuaucccauaucacauuaucuucagccaugagaagcaguggggacacauuuuuuaugug

SEQ ID NO: 198287 - RNA, 64 nt, Homo Sapiens
ugcagcuuaucaacgaccgcuguguggacaugcagagaagcagagaagaagaaaggagcugagg

SEQ ID NO: 198288 - RNA, 64 nt, Homo Sapiens
agcugaggaggagaagccaaagaggaggaggcaggagaagcaggcagccugccccuucuacaac

SEQ ID NO: 198289 - RNA, 64 nt, Homo Sapiens
aauccucuugggaagcuguguggaaauaagcacagagaagcagaacucuaauugcuuaauccac

SEQ ID NO: 198290 - RNA, 64 nt, Homo Sapiens
acuucugggaauuggcucaucauaaauuauccaagagaagcacaaaguuaugggcacaaagguu

SEQ ID NO: 198291 - RNA, 64 nt, Homo Sapiens
cagaggcccccgucccuccuagaggcuccuugaagcugcucaguuucagugggcagcagaaagg

SEQ ID NO: 198292 - RNA, 64 nt, Homo Sapiens
ggcugcagggagggcccaggaggagggaggccuagcugcucagagcagacucaugcacgcacac

SEQ ID NO: 198293 - RNA, 64 nt, Homo Sapiens
ucccucccaaugccacccucaucuuugacguggagcugcucaacuuagagugaaggcaggaagg

SEQ ID NO: 198294 - RNA, 64 nt, Homo Sapiens
ggcaggaaggaacucaagguggcuggagauggcugcugcucacccuccuagccugcucugccac

SEQ ID NO: 198295 - RNA, 64 nt, Homo Sapiens
uuugcugucacuuucucucuuauaaauucuguuagcugcucacuuaaacaauguccucuuugag

SEQ ID NO: 198296 - RNA, 64 nt, Homo Sapiens
cagguucgggacagcccuggacgauuucccgaccgcugcucaggcugcucauuccugcucaccc

SEQ ID NO: 198297 - RNA, 64 nt, Homo Sapiens
gacagcccuggacgauuucccgaccgcugcucaggcugcucauuccugcucacccucagucucc

SEQ ID NO: 198298 - RNA, 64 nt, Homo Sapiens
gcucacacgcugccuccucaguaccuggcuugaagcugcucacuaccucuucacaauuuaguuc

SEQ ID NO: 198299 - RNA, 64 nt, Homo Sapiens
ggcuuuagcugcugucuuccccugacugcugugggcugcucacuucacagcccaaccugaacaa

SEQ ID NO: 198300 - RNA, 64 nt, Homo Sapiens
cuuggcggagggagcggcauggguggcaucaggagcugcucaggaucuggggagugugaggaga

SEQ ID NO: 198301 - RNA, 64 nt, Homo Sapiens
cccgcugagcccacucuacucaacaccuccuccugcugcucacugggaaucauucuggcuuaaa

SEQ ID NO: 198302 - RNA, 64 nt, Homo Sapiens
guucccaggcccugugugccauguccuauccugggcugcucaguugugacacucgggaggaacg

SEQ ID NO: 198303 - RNA, 64 nt, Homo Sapiens
aggacccagcucugggaguggcccgaagaauucugcugcucaccaugaggaagcugccuaagga

SEQ ID NO: 198304 - RNA, 64 nt, Homo Sapiens
gucacagaacaaccgagggaguccuaaaaugaaagcugcucaaaaaaaaacuuaaaaaugggau

SEQ ID NO: 198305 - RNA, 64 nt, Homo Sapiens
cucggcaggucugcagcucagccuucccaggccagcugcucagguggucccgccauccuccuuu

SEQ ID NO: 198306 - RNA, 64 nt, Homo Sapiens
ccacacuguugagaccuugucauuuguugcugcugcugcucauuuugcgauguccucgguuucc

SEQ ID NO: 198307 - RNA, 64 nt, Homo Sapiens
gccaagggggcagagggcuuggugcccccagacagcugcucagacuauuuugagaacuccagcu

SEQ ID NO: 198308 - RNA, 64 nt, Homo Sapiens
ccggugaacagcagcaggaggagccgcuagagcagcugcucaugggcagagcagcccuugggca

SEQ ID NO: 198309 - RNA, 64 nt, Homo Sapiens
gggcuuaucugggggagcugcugauggaguccucgcugcucaugcccacagcccucccagagug

SEQ ID NO: 198310 - RNA, 64 nt, Homo Sapiens
agcaucgugacccuucagggagguacuuccuccugauggccaagccucgaggcaccggcgcugc

SEQ ID NO: 198311 - RNA, 64 nt, Homo Sapiens
gggguggacgcaauuguggguggaagagcagccugauggccaagagaugggcuguuucguguag

SEQ ID NO: 198312 - RNA, 64 nt, Homo Sapiens
uaggguaauggagaugaccagucccuuccuccaagauggccauggcaaaggcaacgcccucagg

SEQ ID NO: 198313 - RNA, 64 nt, Homo Sapiens
caguccugaguggucacccucaguggccuucauggauggccaucggcuguucaugggaagucuu

SEQ ID NO: 198314 - RNA, 64 nt, Homo Sapiens
uggcuggaccuuguauccccgggugggaagggaggauggccacuuauguggcaggccuacucau

SEQ ID NO: 198315 - RNA, 64 nt, Homo Sapiens
ggugccugacuaggagccccggggcccugcuguagauggccacaucaucccuccugaccuguga

SEQ ID NO: 198316 - RNA, 64 nt, Homo Sapiens
guagccuaggugucucaggccccugggccccgcagauggccauuuccggugccugcccaguggc

SEQ ID NO: 198317 - RNA, 64 nt, Homo Sapiens
gaagacagggauuggccugugcuucagcgaccaggauggccaggccagagcugcagcugggggc

SEQ ID NO: 198318 - RNA, 64 nt, Homo Sapiens
cccugugucccacuacacacagaaaacccugugagauggccagucuucauaauagcaacguacc

SEQ ID NO: 198319 - RNA, 64 nt, Homo Sapiens
ccccucuagugaaggguaggagagcucagccucggauggccaacauucaguuguucagguucau

SEQ ID NO: 198320 - RNA, 64 nt, Homo Sapiens
ggacucuaguccacuuccucccaugagacagagugauggccagcuuggggacauuugcuuuaaa

SEQ ID NO: 198321 - RNA, 64 nt, Homo Sapiens
auccucaguaacucucauugacuggauuagaggugauggccacagcaaaugggagagcaaaaug

SEQ ID NO: 198322 - RNA, 64 nt, Homo Sapiens
aagggcccuggccucuaaacuaggccacgggacagauggccagggagaugaacggagugucggc

SEQ ID NO: 198323 - RNA, 64 nt, Homo Sapiens
ccaugcaggaaaggccaggguccucggccccccugauggccaggcucugacucucugaguggug

SEQ ID NO: 198324 - RNA, 64 nt, Homo Sapiens
agacagagacuucaaaugcucaugagacaguggugauggccaucaaucagaaaaaggacaagga

SEQ ID NO: 198325 - RNA, 64 nt, Homo Sapiens
cuagagcagcaaggagcaggaggaagggaaaacugauggccaacggcagaagaugaaggacaaa

SEQ ID NO: 198326 - RNA, 64 nt, Homo Sapiens
gggaacuuugcucggccaauggaaaugcagccaagauggccauauacucccuaggaacccaaga

SEQ ID NO: 198327 - RNA, 64 nt, Homo Sapiens
agccaagauggccauauacucccuaggaacccaagauggccaccaucuugauuuuacuuuccuu

SEQ ID NO: 198328 - RNA, 64 nt, Homo Sapiens
uagugagcucuucaaaaugaaaacagaaugaccggauggccaucuguccuggaaacuguagaau

SEQ ID NO: 198329 - RNA, 64 nt, Homo Sapiens
gccagcggagcauggacuguuccagcacgggccagauggccagcugucgagagcagcccugccc

SEQ ID NO: 198330 - RNA, 64 nt, Homo Sapiens
aaaaggauaaacaucucccacgggagaggccacagauggccacuuccagagcuugcccauugcc

SEQ ID NO: 198331 - RNA, 64 nt, Homo Sapiens
cccugacauccagcaaauugugaauuugaaaaaugauggccaguuuucagaagugcugacaaau

SEQ ID NO: 198332 - RNA, 64 nt, Homo Sapiens
uccagacuaugggaaaauaauuucuucugacuucuuggcuaacuuucaacaacccagggcuuau

SEQ ID NO: 198333 - RNA, 64 nt, Homo Sapiens
uguuacugauauugacauaauuuggcuauuguaauuggcuaacuuaauggguuaacuuuuuaau

SEQ ID NO: 198334 - RNA, 64 nt, Homo Sapiens
gguaaugauuagcacuaauucaucugauaaucuuuuggcuaaagacuuuuagagauugucuauu

SEQ ID NO: 198335 - RNA, 64 nt, Homo Sapiens
uucuuagaaucaaugaaugcuuguuguucuuuuuuuggcuaagaguguuguuguuguuguuuug

SEQ ID NO: 198336 - RNA, 64 nt, Homo Sapiens
aucuuggauuauuugugauaguaaucacaaauuuuuggcuaauuuuuaaccugagguuuuguuu

SEQ ID NO: 198337 - RNA, 64 nt, Homo Sapiens
ucuagagugcuucaaaaugauguagucccucaacuuggcuaaagaaucucaaucucuugaaauu

SEQ ID NO: 198338 - RNA, 64 nt, Homo Sapiens
uguucaguuuuaacuaaaacuaaauuuauguuauuuggcuaaauguuaugaugcagucuaguac

SEQ ID NO: 198339 - RNA, 64 nt, Homo Sapiens
caacaguuaaagacuauggugguuuuuucagaguuuggcuaagaauguuguuaccaucuucuuu

SEQ ID NO: 198340 - RNA, 64 nt, Homo Sapiens
uuuuuguauauuuaauagaggcccuccaccacgcuuggcuaauugaguagcugggacuacaggu

SEQ ID NO: 198341 - RNA, 64 nt, Homo Sapiens
aaauuuuuuuuuuuuuuuuuuugcugauaaaagauuggcuaaacauagcaaacaaccuacaugu

SEQ ID NO: 198342 - RNA, 64 nt, Homo Sapiens
gggauggggacauuccugcccauaaaggauuuggggaaagaagauuaauccuaaaauacaggug

SEQ ID NO: 198343 - RNA, 64 nt, Homo Sapiens
caagauuuguuguuuuuguaagaaaugagaugcaggaaagaaaaccaaaucccauuccugcacc

SEQ ID NO: 198344 - RNA, 64 nt, Homo Sapiens
aacuguccaaguaggcuaggcuccagauuuaugaggaaagaaagggacagcauuugcugccccc

SEQ ID NO: 198345 - RNA, 64 nt, Homo Sapiens
caaaaccagccuuuaaaauaucauguccaggccuggaaagaauacaaauccagugcaaaauuaa

SEQ ID NO: 198346 - RNA, 64 nt, Homo Sapiens
ugcuaagugugcuuaguuuuuaaagauaggauugggaaagaaguuuuggcaccaggcaaacgaa

SEQ ID NO: 198347 - RNA, 64 nt, Homo Sapiens
agguucuguuuuguuuuguuuagcaaaggaugggggaaagaaguuuugaggagggaaugauugg

SEQ ID NO: 198348 - RNA, 64 nt, Homo Sapiens
augugaguaagugagagagaugagcagucccucuggaaagaaacuaggcucuuuuugcugccug

SEQ ID NO: 198349 - RNA, 64 nt, Homo Sapiens
ucugaagagaguggaggagauauggcuuguuuuuggaaagaaauccacuguuugccuuggauag

SEQ ID NO: 198350 - RNA, 64 nt, Homo Sapiens
cauuacuaccacagauagaaaaggaagcaguggaggaaagaaugaauuuuuaacacuaaaauuc

SEQ ID NO: 198351 - RNA, 64 nt, Homo Sapiens
ucugauucuaggcagaggaaugaagugugcuugaggaaagaaaugucuuuuggaggguuccuca

SEQ ID NO: 198352 - RNA, 64 nt, Homo Sapiens
cauuuuucuuaauauccuuucuuuugaauggggaggaaagaagaucacaguagaagaauggcug

SEQ ID NO: 198353 - RNA, 64 nt, Homo Sapiens
uccuucuuuuguuucuccaaguauacauuggauaggaaagaauuagagugcauuagucugaaga

SEQ ID NO: 198354 - RNA, 64 nt, Homo Sapiens
gugcuuaaaugaugcuauguaaaaugucaugaguggaaagaauauuuguaguaguaacaagaau

SEQ ID NO: 198355 - RNA, 64 nt, Homo Sapiens
uaaaacuuacugauauauuggacuuugagccaagggaaagaaugaguacuaucuuuccagauau

SEQ ID NO: 198356 - RNA, 64 nt, Homo Sapiens
ugacuggauugcucuuuauccagcccacagcaggggaaagaaaggcaacucgcaaagaugagau

SEQ ID NO: 198357 - RNA, 64 nt, Homo Sapiens
auauccugccugaauggggaagucuucuaaaaugggaaagaagugguuucaucuccacacagug

SEQ ID NO: 198358 - RNA, 64 nt, Homo Sapiens
agcuuagagaaaauguggagaggugaacauuccaggaaagaagcuuggcaggacacagagaggu

SEQ ID NO: 198359 - RNA, 64 nt, Homo Sapiens
accaggaacuaguuucaauacuuuuggggccucaggaaagaaaaaaugcuaugcuggauaugaa

SEQ ID NO: 198360 - RNA, 64 nt, Homo Sapiens
gccucuucuccguggggaccucccaaaacacuguggaaagaaggcccuggggaccccugaccca

SEQ ID NO: 198361 - RNA, 64 nt, Homo Sapiens
agagagagagaaaagagguagacugggagguucuggaaagaaagcucuccccauuuuccuguuc

SEQ ID NO: 198362 - RNA, 64 nt, Homo Sapiens
uaaagaaggcuuaaauaaauaaaacuacaaaauuggaaagaaauacaaaacaagugcaagacug

SEQ ID NO: 198363 - RNA, 64 nt, Homo Sapiens
agaaauaaauguauccagauuuaagaagcauuugggaaagaaaaaauguuuaagaagcuaaugu

SEQ ID NO: 198364 - RNA, 64 nt, Homo Sapiens
uccaaacucaggaaguuugcauguagagcuauugggaaagaacuccacaaccuuucagaugcug

SEQ ID NO: 198365 - RNA, 64 nt, Homo Sapiens
ucagcugacuccacggggauuccacgucugcccaggaaagaacugaaauggagaauuucagguc

SEQ ID NO: 198366 - RNA, 64 nt, Homo Sapiens
aacuugaaugaaauggauuucaaauuacagacaaggaaagaaaaucacaauaauguagauagaa

SEQ ID NO: 198367 - RNA, 64 nt, Homo Sapiens
ugaugccacuggcaccagaguuaaacacauggagggaaagaagaugcagaggggaacuacuucu

SEQ ID NO: 198368 - RNA, 64 nt, Homo Sapiens
acuggcaggacuguuguuuuaaguauuugccucuggaaagaacaggaaaaacuaagagaaugaa

SEQ ID NO: 198369 - RNA, 64 nt, Homo Sapiens
ucauugaagauaaagcaaaagauuuggggcauuuggaaagaaguaaaauaauaacuuauugcca

SEQ ID NO: 198370 - RNA, 64 nt, Homo Sapiens
cuaauuuuuaaaaauagcuuucguuuugaguucuggaaagaaaacugucaaaaucaguauauac

SEQ ID NO: 198371 - RNA, 64 nt, Homo Sapiens
ucaugucuuuaaaucagauaccaaauauuuuuuaggaaagaaaaauguuauuacugucauuagg

SEQ ID NO: 198372 - RNA, 64 nt, Homo Sapiens
uuuacauucgguuguucugucguggaaagcuccuggaaagaaauaauuguguuuauuccaacca

SEQ ID NO: 198373 - RNA, 64 nt, Homo Sapiens
gagggaaacagggagaaaggaaggaagaaaggaaggaaagaagggugaauucuaagaaggaagg

SEQ ID NO: 198374 - RNA, 64 nt, Homo Sapiens
uguaucauguuuuacuacaucuggaaauaaaguaggaaagaauucauguaauauaagugaacaa

SEQ ID NO: 198375 - RNA, 64 nt, Homo Sapiens
uuuaaaauuaaauaaauuuucuaccucuuccguuggaaagaacauuucauauguggaaauauac

SEQ ID NO: 198376 - RNA, 64 nt, Homo Sapiens
agacaauaaaauuguaauauucauaauauuugauggaaagaaaauaggaaaauuaucuaguuaa

SEQ ID NO: 198377 - RNA, 64 nt, Homo Sapiens
accuuaaaacuuuuaacagauucaucgcugcaaaggaaagaacaggacuccagaagaaacuuga

SEQ ID NO: 198378 - RNA, 64 nt, Homo Sapiens
uuaacccuuaacuguagauaagaaaauucauacuggaaagaaacccuacaaaugugaagucugu

SEQ ID NO: 198379 - RNA, 64 nt, Homo Sapiens
cucaacucuuacuacauguaagaguauuuauacuggaaagaaacccuacaaauguaaaaaacgu

SEQ ID NO: 198380 - RNA, 64 nt, Homo Sapiens
gggccaugaaagccacagaggaugggcugaggaaggaaagaaaugggguuacugcucccagugc

SEQ ID NO: 198381 - RNA, 64 nt, Homo Sapiens
uaccuuagaugcauccugguuaucuggaagcaugggaaagaaggcuacuuaucucuuuguaugu

SEQ ID NO: 198382 - RNA, 64 nt, Homo Sapiens
cauuucuguuaaccucuuaucacuaagaaagaaaggaaagaaggagaugaauagaagaaagaaa

SEQ ID NO: 198383 - RNA, 64 nt, Homo Sapiens
aaggaaagaaggagaugaauagaagaaagaaaauggaaagaaggaaaaaaggaggauagaaaaa

SEQ ID NO: 198384 - RNA, 64 nt, Homo Sapiens
gauauaggaagagagggaagaaagaaggcaggaaggaaagaaaggaagaagaaauggaaaaaug

SEQ ID NO: 198385 - RNA, 64 nt, Homo Sapiens
cacauguucagagccuaauuaaaacuaguguuagggaaagaaauaaauaaauuaguagauugga

SEQ ID NO: 198386 - RNA, 64 nt, Homo Sapiens
uuuaucuuuuagguaagagaaaagaaaaagauaaggaaagaagagagaagagagacaaagauca

SEQ ID NO: 198387 - RNA, 64 nt, Homo Sapiens
ucacugauuugugaugucaauaggauggcaccuuggaaagaaaaaugaagaacaacuuuaucaa

SEQ ID NO: 198388 - RNA, 64 nt, Homo Sapiens
acuuaagcaaagccuuuuucauauuugaaaauguggaaagaaaagauguuccuaaaagguuaga

SEQ ID NO: 198389 - RNA, 64 nt, Homo Sapiens
gucacuuuuuguuuuaauaucuugcucucugacaggaaagaaacaauucacuuaccagccuccu

SEQ ID NO: 198390 - RNA, 64 nt, Homo Sapiens
uuuuuuacuucagaaagaauuuuacagguuaaagggaaagaaauggugggaaacucuccccgua

SEQ ID NO: 198391 - RNA, 64 nt, Homo Sapiens
cagucauugugcaaaauucugcaucuucauugagggaaagaaaacuccucacacccagaccugg

SEQ ID NO: 198392 - RNA, 64 nt, Homo Sapiens
gcagaauuucuuccccaagcgcaaaucauauucaggaaagaaguaguuuaugcaguaucugacu

SEQ ID NO: 198393 - RNA, 64 nt, Homo Sapiens
aauacaaauuggcuuucaaguagugauaaguugaggaaagaaauauguuggcauuuaguagaaa

SEQ ID NO: 198394 - RNA, 64 nt, Homo Sapiens
uugcagcuuuaaccugcugguuugccauuguccaggaaagaaacucucucuuagaauuggagga

SEQ ID NO: 198395 - RNA, 64 nt, Homo Sapiens
cuguuuaaaugcucaguucacgcucccugcacacggaaagaacuuaugcaaaucuuagggcgcu

SEQ ID NO: 198396 - RNA, 64 nt, Homo Sapiens
cacgcccagcagagcugccugaccacuccaggguggaaagaagcacaccugugccugccgguga

SEQ ID NO: 198397 - RNA, 64 nt, Homo Sapiens
aaguugggcaggauauggccaccaggaggaauggggaaagaagcugaagaacccuugugaagua

SEQ ID NO: 198398 - RNA, 64 nt, Homo Sapiens
uaaagacuucgugugauugguccuguuugccaggggaaagaaccaguccucccaaucccacacc

SEQ ID NO: 198399 - RNA, 64 nt, Homo Sapiens
auaaagaagagaaacguguaaaaaaagaaaagaaggaaagaagauugaaagagcaagaggaaag

SEQ ID NO: 198400 - RNA, 64 nt, Homo Sapiens
aagaaaagaaggaaagaagauugaaagagcaagaggaaagaaaauuaguuccaagaggugguuu

SEQ ID NO: 198401 - RNA, 64 nt, Homo Sapiens
caaaugacuauccugaacaggguggaggggugugggaaagaaaccagccauauugguuuugguu

SEQ ID NO: 198402 - RNA, 64 nt, Homo Sapiens
uucccuagaaauuggcucaccuugggaaacccagggaaagaaucagcagguucucugcccuccc

SEQ ID NO: 198403 - RNA, 64 nt, Homo Sapiens
aaagaaguauaaugccuuacuucagagaacucuuggaaagaagccuuaugugaaagugaugacu

SEQ ID NO: 198404 - RNA, 64 nt, Homo Sapiens
gagucccuuacuuuacguguguaaauuccuaccaggaaagaauacauauccaauagauuggaga

SEQ ID NO: 198405 - RNA, 64 nt, Homo Sapiens
acuauauuuguacuguacccuccuagcccccucaggaaagaaggugccauucauugucuuucuc

SEQ ID NO: 198406 - RNA, 64 nt, Homo Sapiens
aucaaaccuuuccuccugacccaaaaagaaguggggaaagaaccaaccucacuuccuuacuccu

SEQ ID NO: 198407 - RNA, 64 nt, Homo Sapiens
cauuaaaugaccugacaaaaaguggcuuugugaaggaaagaaaccuguguugacucuggcauuu

SEQ ID NO: 198408 - RNA, 64 nt, Homo Sapiens
guggagcagagacucugccuuucccugcuagcugggaaagaagaagacaguucuuugccuucac

SEQ ID NO: 198409 - RNA, 64 nt, Homo Sapiens
cauuuuucucuuguagauuuuaauuuuuuaagugggaaagaacucaccuugccuuccuccccca

SEQ ID NO: 198410 - RNA, 64 nt, Homo Sapiens
guuaaaaaagcaccguggagaauggcccucuucaggaaagaaaaauaagcaaaugaauggucca

SEQ ID NO: 198411 - RNA, 64 nt, Homo Sapiens
uaugaauguaaggaauguggaaaagccuucagcaggaaagaaaaucucauuacacaucagaaaa

SEQ ID NO: 198412 - RNA, 64 nt, Homo Sapiens
auacuuuguuaaaagguguaagacuggaauaaauggaaagaaauaccauauacauagauggaaa

SEQ ID NO: 198413 - RNA, 64 nt, Homo Sapiens
acaaaaaguggcuugauggugaauuaaagaaagaggaaagaaacccaccacuaggucaguguaa

SEQ ID NO: 198414 - RNA, 64 nt, Homo Sapiens
gacuuuguucuguguguuucgagccaucuagaggggaaagaaaaggaaaaucugaacaaucuuu

SEQ ID NO: 198415 - RNA, 64 nt, Homo Sapiens
gguuuauuuuuccagcauaaaccucagaauuuaaggaaagaaaaugaugucuguuguuauaguu

SEQ ID NO: 198416 - RNA, 64 nt, Homo Sapiens
aaauuggcuuugaccaaaguucucuuguuuucagggaaagaacauaaaagcuuuuugaacuaca

SEQ ID NO: 198417 - RNA, 64 nt, Homo Sapiens
guucugugaaugcaaacacccuuuguuacagcugggaaagaacauagccaccgggagaggcuuc

SEQ ID NO: 198418 - RNA, 64 nt, Homo Sapiens
agauaaaccauccguggggugcggcaagucugauggaaagaaaaaauaacagccacauaaccuu

SEQ ID NO: 198419 - RNA, 64 nt, Homo Sapiens
gggcacucaaagagccacaccaguuaugagacugggaaagaacggauguggaggagguggagag

SEQ ID NO: 198420 - RNA, 64 nt, Homo Sapiens
gaacgugcccuuaacuaacuuccaaguaauccuuggaaagaaaauggaagugaagacuguaaug

SEQ ID NO: 198421 - RNA, 64 nt, Homo Sapiens
auuauauuuguaaaagaaccacagcagcuauuuuggaaagaagcuguuguucucaaaggaaaga

SEQ ID NO: 198422 - RNA, 64 nt, Homo Sapiens
gcagcuauuuuggaaagaagcuguuguucucaaaggaaagaaggauuuuuuugcauaauuaaac

SEQ ID NO: 198423 - RNA, 64 nt, Homo Sapiens
cgaaaauguuauugcacauguagcaaacucuuugggaaagaaaacacugguaaucaguacugca

SEQ ID NO: 198424 - RNA, 64 nt, Homo Sapiens
aaaguaaaugaaaaacacacaaauuugguuuaauggaaagaauacaaaaggauguuauuucauu

SEQ ID NO: 198425 - RNA, 64 nt, Homo Sapiens
auauuaaaaaagcuaauauuggaauaaagggugaggaaagaaaacuaaauauuuuuuuccuaaa

SEQ ID NO: 198426 - RNA, 64 nt, Homo Sapiens
augucaagaaggugaaaucccuacugagagcucuggaaagaagggaaaagaaaagcagagucag

SEQ ID NO: 198427 - RNA, 64 nt, Homo Sapiens; identical to SEQ ID NO: 128601

SEQ ID NO: 198428 - RNA, 64 nt, Homo Sapiens; identical to SEQ ID NO: 128602

SEQ ID NO: 198429 - RNA, 64 nt, Homo Sapiens; identical to SEQ ID NO: 128603

SEQ ID NO: 198430 - RNA, 64 nt, Homo Sapiens; identical to SEQ ID NO: 128604

SEQ ID NO: 198431 - RNA, 64 nt, Homo Sapiens; identical to SEQ ID NO: 128605

SEQ ID NO: 198432 - RNA, 64 nt, Homo Sapiens; identical to SEQ ID NO: 128606

SEQ ID NO: 198433 - RNA, 64 nt, Homo Sapiens; identical to SEQ ID NO: 128607

SEQ ID NO: 198434 - RNA, 64 nt, Homo Sapiens; identical to SEQ ID NO: 128608

SEQ ID NO: 198435 - RNA, 64 nt, Homo Sapiens; identical to SEQ ID NO: 128609

SEQ ID NO: 198436 - RNA, 64 nt, Homo Sapiens; identical to SEQ ID NO: 128610

SEQ ID NO: 198437 - RNA, 64 nt, Homo Sapiens; identical to SEQ ID NO: 128611

SEQ ID NO: 198438 - RNA, 64 nt, Homo Sapiens; identical to SEQ ID NO: 128612

SEQ ID NO: 198439 - RNA, 64 nt, Homo Sapiens; identical to SEQ ID NO: 128613

SEQ ID NO: 198440 - RNA, 64 nt, Homo Sapiens; identical to SEQ ID NO: 128614

SEQ ID NO: 198441 - RNA, 64 nt, Homo Sapiens; identical to SEQ ID NO: 128615

SEQ ID NO: 198442 - RNA, 64 nt, Homo Sapiens; identical to SEQ ID NO: 128616

SEQ ID NO: 198443 - RNA, 64 nt, Homo Sapiens; identical to SEQ ID NO: 128617

SEQ ID NO: 198444 - RNA, 64 nt, Homo Sapiens; identical to SEQ ID NO: 128618

SEQ ID NO: 198445 - RNA, 64 nt, Homo Sapiens; identical to SEQ ID NO: 128619

SEQ ID NO: 198446 - RNA, 64 nt, Homo Sapiens; identical to SEQ ID NO: 128620

SEQ ID NO: 198447 - RNA, 64 nt, Homo Sapiens; identical to SEQ ID NO: 128621

SEQ ID NO: 198448 - RNA, 64 nt, Homo Sapiens; identical to SEQ ID NO: 128622

SEQ ID NO: 198449 - RNA, 64 nt, Homo Sapiens; identical to SEQ ID NO: 128623

SEQ ID NO: 198450 - RNA, 64 nt, Homo Sapiens; identical to SEQ ID NO: 128624

SEQ ID NO: 198451 - RNA, 64 nt, Homo Sapiens; identical to SEQ ID NO: 128625

SEQ ID NO: 198452 - RNA, 64 nt, Homo Sapiens; identical to SEQ ID NO: 128626

SEQ ID NO: 198453 - RNA, 64 nt, Homo Sapiens; identical to SEQ ID NO: 128627

SEQ ID NO: 198454 - RNA, 64 nt, Homo Sapiens; identical to SEQ ID NO: 128628

SEQ ID NO: 198455 - RNA, 64 nt, Homo Sapiens; identical to SEQ ID NO: 128629

SEQ ID NO: 198456 - RNA, 64 nt, Homo Sapiens; identical to SEQ ID NO: 128630

SEQ ID NO: 198457 - RNA, 64 nt, Homo Sapiens; identical to SEQ ID NO: 128631

SEQ ID NO: 198458 - RNA, 64 nt, Homo Sapiens; identical to SEQ ID NO: 128632

SEQ ID NO: 198459 - RNA, 64 nt, Homo Sapiens; identical to SEQ ID NO: 128633

SEQ ID NO: 198460 - RNA, 64 nt, Homo Sapiens; identical to SEQ ID NO: 128634

SEQ ID NO: 198461 - RNA, 64 nt, Homo Sapiens; identical to SEQ ID NO: 128635

SEQ ID NO: 198462 - RNA, 64 nt, Homo Sapiens; identical to SEQ ID NO: 128636

SEQ ID NO: 198463 - RNA, 64 nt, Homo Sapiens; identical to SEQ ID NO: 128637

SEQ ID NO: 198464 - RNA, 64 nt, Homo Sapiens; identical to SEQ ID NO: 128638

SEQ ID NO: 198465 - RNA, 64 nt, Homo Sapiens; identical to SEQ ID NO: 128639

SEQ ID NO: 198466 - RNA, 64 nt, Homo Sapiens; identical to SEQ ID NO: 128640

SEQ ID NO: 198467 - RNA, 64 nt, Homo Sapiens; identical to SEQ ID NO: 128641

SEQ ID NO: 198468 - RNA, 64 nt, Homo Sapiens; identical to SEQ ID NO: 128642

SEQ ID NO: 198469 - RNA, 64 nt, Homo Sapiens; identical to SEQ ID NO: 128643

SEQ ID NO: 198470 - RNA, 64 nt, Homo Sapiens; identical to SEQ ID NO: 128644

SEQ ID NO: 198471 - RNA, 64 nt, Homo Sapiens; identical to SEQ ID NO: 128645

SEQ ID NO: 198472 - RNA, 64 nt, Homo Sapiens; identical to SEQ ID NO: 128646

SEQ ID NO: 198473 - RNA, 64 nt, Homo Sapiens; identical to SEQ ID NO: 128647

SEQ ID NO: 198474 - RNA, 64 nt, Homo Sapiens
uguuucuguguuuuagaggaauccuaaagucaaaacaccagagacuugaagaacuugcaaacug

SEQ ID NO: 198475 - RNA, 64 nt, Homo Sapiens
uacccguuagacaaggauauuuuacuucuuccagacaccagaagaaauggccuucaauuauuug

SEQ ID NO: 198476 - RNA, 64 nt, Homo Sapiens
gcuugcugaaauggaaaacucaucucugggaaaaacaccagaaaaauuuccugggcaguugaug

SEQ ID NO: 198477 - RNA, 64 nt, Homo Sapiens
aaucgauaacaacuuauauaccuuuccccuuaaaacaccagacaauuuaccuccuuuccuuuuc

SEQ ID NO: 198478 - RNA, 64 nt, Homo Sapiens
ccaagcucaggcauaauucagcauaagaaaauucacaccagagccaaaucuuacaaauguagca

SEQ ID NO: 198479 - RNA, 64 nt, Homo Sapiens
cauagcucagccauugcucagcaucagauaauucacaccagagagaaacccucugaaugugacg

SEQ ID NO: 198480 - RNA, 64 nt, Homo Sapiens
ucgacagaguggucuucucuccagagcaaccgccacaccagauaugugguaugacauacacaca

SEQ ID NO: 198481 - RNA, 64 nt, Homo Sapiens
aaccgccacaccagauaucggguaugacauacacacaccagagcgugccaucagugcgugaugu

SEQ ID NO: 198482 - RNA, 64 nt, Homo Sapiens
cuuaaucuucagaggugcuaaauugucugccauuacaccagaaggaugccucugauaggaggac

SEQ ID NO: 198483 - RNA, 64 nt, Homo Sapiens
guauuuuaggugcuguuauguuuuuucaugguuaacaccagaggggaaaaaaucauauucuaac

SEQ ID NO: 198484 - RNA, 64 nt, Homo Sapiens
uccuuuucuucugccucgccugaaucccccauaaacaccagaugauugagucuaccuucuuucc

SEQ ID NO: 198485 - RNA, 64 nt, Homo Sapiens
ccuuuuucuucugccucacuugaaucccccguaaacaccagacgauugagucuaccuucuuuuc

SEQ ID NO: 198486 - RNA, 64 nt, Homo Sapiens
cgcgggccagccucucucuuuugcccugcucuccacaccagaaaugcccccaggugcuuggcug

SEQ ID NO: 198487 - RNA, 64 nt, Homo Sapiens
ggagaugcucuuuaagaaguucgcaccccugcugacaccagaacagcccaaaucagaguuccca

SEQ ID NO: 198488 - RNA, 64 nt, Homo Sapiens
gugcuuccaaccuccugccaaccuggaguucacaacaccagagccccacggccucgcacacuga

SEQ ID NO: 198489 - RNA, 64 nt, Homo Sapiens
aaaaagacgucaauaucugcucacaucuuacuaaacaccagagaguucaugcuuaauaaaagca

SEQ ID NO: 198490 - RNA, 64 nt, Homo Sapiens
ggaaaacaaauuuucaaaaacuacagcuuagaaaacaccagaguuuauacgaaaauauauuuuc

SEQ ID NO: 198491 - RNA, 64 nt, Homo Sapiens
ugaaauccuuuagccagcguuucaaccucauucaacaccagaaaguucacaguggaaaaaaucu

SEQ ID NO: 198492 - RNA, 64 nt, Homo Sapiens
aaaaagguuucagccaaaggccuaacccuauucaacaccagaaaguuuacacuggagaaaggcc

SEQ ID NO: 198493 - RNA, 64 nt, Homo Sapiens
uauuucaaaacaggaauuaacaauauucugaauuguuaacuagguugauucaaaccucacaagg

SEQ ID NO: 198494 - RNA, 64 nt, Homo Sapiens
aaguuauaaauagacacuuauauuauuggccauaguuaacuagacuacaaauuaccuccaugua

SEQ ID NO: 198495 - RNA, 64 nt, Homo Sapiens; identical to SEQ ID NO: 160525

SEQ ID NO: 198496 - RNA, 64 nt, Homo Sapiens; identical to SEQ ID NO: 160526

SEQ ID NO: 198497 - RNA, 64 nt, Homo Sapiens; identical to SEQ ID NO: 160527

SEQ ID NO: 198498 - RNA, 64 nt, Homo Sapiens; identical to SEQ ID NO: 160528

SEQ ID NO: 198499 - RNA, 64 nt, Homo Sapiens; identical to SEQ ID NO: 160529

SEQ ID NO: 198500 - RNA, 64 nt, Homo Sapiens; identical to SEQ ID NO: 160530

SEQ ID NO: 198501 - RNA, 64 nt, Homo Sapiens; identical to SEQ ID NO: 160531

SEQ ID NO: 198502 - RNA, 64 nt, Homo Sapiens; identical to SEQ ID NO: 160532

SEQ ID NO: 198503 - RNA, 64 nt, Homo Sapiens; identical to SEQ ID NO: 160533

SEQ ID NO: 198504 - RNA, 64 nt, Homo Sapiens; identical to SEQ ID NO: 160534

SEQ ID NO: 198505 - RNA, 64 nt, Homo Sapiens; identical to SEQ ID NO: 160535

SEQ ID NO: 198506 - RNA, 64 nt, Homo Sapiens; identical to SEQ ID NO: 160536

SEQ ID NO: 198507 - RNA, 64 nt, Homo Sapiens; identical to SEQ ID NO: 160537

SEQ ID NO: 198508 - RNA, 64 nt, Homo Sapiens; identical to SEQ ID NO: 160538

SEQ ID NO: 198509 - RNA, 64 nt, Homo Sapiens; identical to SEQ ID NO: 160539

SEQ ID NO: 198510 - RNA, 64 nt, Homo Sapiens; identical to SEQ ID NO: 160540

SEQ ID NO: 198511 - RNA, 64 nt, Homo Sapiens; identical to SEQ ID NO: 160541

SEQ ID NO: 198512 - RNA, 64 nt, Homo Sapiens; identical to SEQ ID NO: 160542

SEQ ID NO: 198513 - RNA, 64 nt, Homo Sapiens; identical to SEQ ID NO: 160543

SEQ ID NO: 198514 - RNA, 64 nt, Homo Sapiens; identical to SEQ ID NO: 160544

SEQ ID NO: 198515 - RNA, 64 nt, Homo Sapiens; identical to SEQ ID NO: 160545

SEQ ID NO: 198516 - RNA, 64 nt, Homo Sapiens; identical to SEQ ID NO: 160546

SEQ ID NO: 198517 - RNA, 64 nt, Homo Sapiens; identical to SEQ ID NO: 160547

SEQ ID NO: 198518 - RNA, 64 nt, Homo Sapiens; identical to SEQ ID NO: 160548

SEQ ID NO: 198519 - RNA, 64 nt, Homo Sapiens; identical to SEQ ID NO: 160549

SEQ ID NO: 198520 - RNA, 64 nt, Homo Sapiens; identical to SEQ ID NO: 160550

SEQ ID NO: 198521 - RNA, 64 nt, Homo Sapiens; identical to SEQ ID NO: 160551

SEQ ID NO: 198522 - RNA, 64 nt, Homo Sapiens; identical to SEQ ID NO: 160552

SEQ ID NO: 198523 - RNA, 64 nt, Homo Sapiens; identical to SEQ ID NO: 160553

SEQ ID NO: 198524 - RNA, 55 nt, Homo Sapiens; identical to SEQ ID NO: 113265

SEQ ID NO: 198525 - RNA, 64 nt, Homo Sapiens; identical to SEQ ID NO: 113266

SEQ ID NO: 198526 - RNA, 64 nt, Homo Sapiens; identical to SEQ ID NO: 113267

SEQ ID NO: 198527 - RNA, 64 nt, Homo Sapiens; identical to SEQ ID NO: 113268

SEQ ID NO: 198528 - RNA, 64 nt, Homo Sapiens; identical to SEQ ID NO: 113269

SEQ ID NO: 198529 - RNA, 64 nt, Homo Sapiens; identical to SEQ ID NO: 113270

SEQ ID NO: 198530 - RNA, 64 nt, Homo Sapiens; identical to SEQ ID NO: 113271

SEQ ID NO: 198531 - RNA, 64 nt, Homo Sapiens; identical to SEQ ID NO: 113272

SEQ ID NO: 198532 - RNA, 64 nt, Homo Sapiens; identical to SEQ ID NO: 113273

SEQ ID NO: 198533 - RNA, 64 nt, Homo Sapiens; identical to SEQ ID NO: 113274

SEQ ID NO: 198534 - RNA, 64 nt, Homo Sapiens; identical to SEQ ID NO: 113275

SEQ ID NO: 198535 - RNA, 64 nt, Homo Sapiens; identical to SEQ ID NO: 113276

SEQ ID NO: 198536 - RNA, 64 nt, Homo Sapiens; identical to SEQ ID NO: 113277

SEQ ID NO: 198537 - RNA, 64 nt, Homo Sapiens; identical to SEQ ID NO: 113278

SEQ ID NO: 198538 - RNA, 64 nt, Homo Sapiens; identical to SEQ ID NO: 46370

SEQ ID NO: 198539 - RNA, 64 nt, Homo Sapiens; identical to SEQ ID NO: 46371

SEQ ID NO: 198540 - RNA, 64 nt, Homo Sapiens; identical to SEQ ID NO: 46372

SEQ ID NO: 198541 - RNA, 64 nt, Homo Sapiens; identical to SEQ ID NO: 46373

SEQ ID NO: 198542 - RNA, 64 nt, Homo Sapiens; identical to SEQ ID NO: 46374

SEQ ID NO: 198543 - RNA, 64 nt, Homo Sapiens; identical to SEQ ID NO: 46375

SEQ ID NO: 198544 - RNA, 64 nt, Homo Sapiens; identical to SEQ ID NO: 46376

SEQ ID NO: 198545 - RNA, 64 nt, Homo Sapiens; identical to SEQ ID NO: 46377

SEQ ID NO: 198546 - RNA, 64 nt, Homo Sapiens; identical to SEQ ID NO: 46378

SEQ ID NO: 198547 - RNA, 64 nt, Homo Sapiens; identical to SEQ ID NO: 46379

SEQ ID NO: 198548 - RNA, 64 nt, Homo Sapiens; identical to SEQ ID NO: 46380

SEQ ID NO: 198549 - RNA, 64 nt, Homo Sapiens; identical to SEQ ID NO: 46381

SEQ ID NO: 198550 - RNA, 64 nt, Homo Sapiens; identical to SEQ ID NO: 46382

SEQ ID NO: 198551 - RNA, 64 nt, Homo Sapiens; identical to SEQ ID NO: 46383

SEQ ID NO: 198552 - RNA, 64 nt, Homo Sapiens; identical to SEQ ID NO: 46384

SEQ ID NO: 198553 - RNA, 64 nt, Homo Sapiens; identical to SEQ ID NO: 46385

SEQ ID NO: 198554 - RNA, 64 nt, Homo Sapiens; identical to SEQ ID NO: 46386

SEQ ID NO: 198555 - RNA, 64 nt, Homo Sapiens; identical to SEQ ID NO: 46387

SEQ ID NO: 198556 - RNA, 64 nt, Homo Sapiens; identical to SEQ ID NO: 46388

SEQ ID NO: 198557 - RNA, 64 nt, Homo Sapiens; identical to SEQ ID NO: 46389

SEQ ID NO: 198558 - RNA, 64 nt, Homo Sapiens; identical to SEQ ID NO: 46390

SEQ ID NO: 198559 - RNA, 64 nt, Homo Sapiens; identical to SEQ ID NO: 46391

SEQ ID NO: 198560 - RNA, 64 nt, Homo Sapiens; identical to SEQ ID NO: 46392

SEQ ID NO: 198561 - RNA, 64 nt, Homo Sapiens; identical to SEQ ID NO: 46393

SEQ ID NO: 198562 - RNA, 64 nt, Homo Sapiens; identical to SEQ ID NO: 46394

SEQ ID NO: 198563 - RNA, 64 nt, Homo Sapiens; identical to SEQ ID NO: 46395

SEQ ID NO: 198564 - RNA, 64 nt, Homo Sapiens; identical to SEQ ID NO: 46396

SEQ ID NO: 198565 - RNA, 64 nt, Homo Sapiens; identical to SEQ ID NO: 46397

SEQ ID NO: 198566 - RNA, 64 nt, Homo Sapiens; identical to SEQ ID NO: 46398

SEQ ID NO: 198567 - RNA, 64 nt, Homo Sapiens; identical to SEQ ID NO: 46399

SEQ ID NO: 198568 - RNA, 64 nt, Homo Sapiens; identical to SEQ ID NO: 46400

SEQ ID NO: 198569 - RNA, 64 nt, Homo Sapiens; identical to SEQ ID NO: 46401

SEQ ID NO: 198570 - RNA, 64 nt, Homo Sapiens; identical to SEQ ID NO: 46402

SEQ ID NO: 198571 - RNA, 64 nt, Homo Sapiens; identical to SEQ ID NO: 46403

SEQ ID NO: 198572 - RNA, 64 nt, Homo Sapiens; identical to SEQ ID NO: 46404

SEQ ID NO: 198573 - RNA, 64 nt, Homo Sapiens; identical to SEQ ID NO: 46405

SEQ ID NO: 198574 - RNA, 64 nt, Homo Sapiens; identical to SEQ ID NO: 46406

SEQ ID NO: 198575 - RNA, 64 nt, Homo Sapiens; identical to SEQ ID NO: 46407

SEQ ID NO: 198576 - RNA, 64 nt, Homo Sapiens; identical to SEQ ID NO: 46408

SEQ ID NO: 198577 - RNA, 64 nt, Homo Sapiens; identical to SEQ ID NO: 46409

SEQ ID NO: 198578 - RNA, 64 nt, Homo Sapiens; identical to SEQ ID NO: 46410

SEQ ID NO: 198579 - RNA, 64 nt, Homo Sapiens; identical to SEQ ID NO: 46411

SEQ ID NO: 198580 - RNA, 64 nt, Homo Sapiens; identical to SEQ ID NO: 46412

SEQ ID NO: 198581 - RNA, 64 nt, Homo Sapiens; identical to SEQ ID NO: 46413

SEQ ID NO: 198582 - RNA, 64 nt, Homo Sapiens; identical to SEQ ID NO: 46414

SEQ ID NO: 198583 - RNA, 64 nt, Homo Sapiens; identical to SEQ ID NO: 46415

SEQ ID NO: 198584 - RNA, 64 nt, Homo Sapiens; identical to SEQ ID NO: 46416

SEQ ID NO: 198585 - RNA, 64 nt, Homo Sapiens; identical to SEQ ID NO: 46417

SEQ ID NO: 198586 - RNA, 64 nt, Homo Sapiens; identical to SEQ ID NO: 46418

SEQ ID NO: 198587 - RNA, 64 nt, Homo Sapiens; identical to SEQ ID NO: 46419

SEQ ID NO: 198588 - RNA, 64 nt, Homo Sapiens; identical to SEQ ID NO: 46420

SEQ ID NO: 198589 - RNA, 64 nt, Homo Sapiens; identical to SEQ ID NO: 46421

SEQ ID NO: 198590 - RNA, 64 nt, Homo Sapiens; identical to SEQ ID NO: 46422

SEQ ID NO: 198591 - RNA, 64 nt, Homo Sapiens; identical to SEQ ID NO: 46423

SEQ ID NO: 198592 - RNA, 64 nt, Homo Sapiens; identical to SEQ ID NO: 46424

SEQ ID NO: 198593 - RNA, 64 nt, Homo Sapiens; identical to SEQ ID NO: 46425

SEQ ID NO: 198594 - RNA, 64 nt, Homo Sapiens; identical to SEQ ID NO: 46426

SEQ ID NO: 198595 - RNA, 64 nt, Homo Sapiens; identical to SEQ ID NO: 46427

SEQ ID NO: 198596 - RNA, 64 nt, Homo Sapiens; identical to SEQ ID NO: 46428

SEQ ID NO: 198597 - RNA, 64 nt, Homo Sapiens; identical to SEQ ID NO: 46429

SEQ ID NO: 198598 - RNA, 64 nt, Homo Sapiens; identical to SEQ ID NO: 46430

SEQ ID NO: 198599 - RNA, 64 nt, Homo Sapiens; identical to SEQ ID NO: 46431

SEQ ID NO: 198600 - RNA, 64 nt, Homo Sapiens; identical to SEQ ID NO: 46432

SEQ ID NO: 198601 - RNA, 64 nt, Homo Sapiens; identical to SEQ ID NO: 46433

SEQ ID NO: 198602 - RNA, 64 nt, Homo Sapiens; identical to SEQ ID NO: 46434

SEQ ID NO: 198603 - RNA, 64 nt, Homo Sapiens; identical to SEQ ID NO: 46435

SEQ ID NO: 198604 - RNA, 64 nt, Homo Sapiens; identical to SEQ ID NO: 46436

SEQ ID NO: 198605 - RNA, 64 nt, Homo Sapiens; identical to SEQ ID NO: 46437

SEQ ID NO: 198606 - RNA, 64 nt, Homo Sapiens; identical to SEQ ID NO: 46438

SEQ ID NO: 198607 - RNA, 64 nt, Homo Sapiens; identical to SEQ ID NO: 46439

SEQ ID NO: 198608 - RNA, 64 nt, Homo Sapiens; identical to SEQ ID NO: 46440

SEQ ID NO: 198609 - RNA, 64 nt, Homo Sapiens; identical to SEQ ID NO: 46441

SEQ ID NO: 198610 - RNA, 64 nt, Homo Sapiens; identical to SEQ ID NO: 46442

SEQ ID NO: 198611 - RNA, 64 nt, Homo Sapiens; identical to SEQ ID NO: 46443

SEQ ID NO: 198612 - RNA, 64 nt, Homo Sapiens; identical to SEQ ID NO: 46444

SEQ ID NO: 198613 - RNA, 64 nt, Homo Sapiens; identical to SEQ ID NO: 46445

SEQ ID NO: 198614 - RNA, 64 nt, Homo Sapiens; identical to SEQ ID NO: 46446

SEQ ID NO: 198615 - RNA, 64 nt, Homo Sapiens; identical to SEQ ID NO: 46447

SEQ ID NO: 198616 - RNA, 64 nt, Homo Sapiens; identical to SEQ ID NO: 46448

SEQ ID NO: 198617 - RNA, 64 nt, Homo Sapiens; identical to SEQ ID NO: 46449

SEQ ID NO: 198618 - RNA, 64 nt, Homo Sapiens; identical to SEQ ID NO: 46450

SEQ ID NO: 198619 - RNA, 64 nt, Homo Sapiens; identical to SEQ ID NO: 46451

SEQ ID NO: 198620 - RNA, 64 nt, Homo Sapiens; identical to SEQ ID NO: 46452

SEQ ID NO: 198621 - RNA, 64 nt, Homo Sapiens; identical to SEQ ID NO: 46453

SEQ ID NO: 198622 - RNA, 64 nt, Homo Sapiens; identical to SEQ ID NO: 46454

SEQ ID NO: 198623 - RNA, 64 nt, Homo Sapiens; identical to SEQ ID NO: 46455

SEQ ID NO: 198624 - RNA, 64 nt, Homo Sapiens; identical to SEQ ID NO: 46456

SEQ ID NO: 198625 - RNA, 64 nt, Homo Sapiens; identical to SEQ ID NO: 46457

SEQ ID NO: 198626 - RNA, 64 nt, Homo Sapiens; identical to SEQ ID NO: 46458

SEQ ID NO: 198627 - RNA, 64 nt, Homo Sapiens; identical to SEQ ID NO: 46459

SEQ ID NO: 198628 - RNA, 64 nt, Homo Sapiens; identical to SEQ ID NO: 46460

SEQ ID NO: 198629 - RNA, 64 nt, Homo Sapiens; identical to SEQ ID NO: 46461

SEQ ID NO: 198630 - RNA, 64 nt, Homo Sapiens; identical to SEQ ID NO: 46462

SEQ ID NO: 198631 - RNA, 64 nt, Homo Sapiens; identical to SEQ ID NO: 46463

SEQ ID NO: 198632 - RNA, 64 nt, Homo Sapiens; identical to SEQ ID NO: 46464

SEQ ID NO: 198633 - RNA, 64 nt, Homo Sapiens; identical to SEQ ID NO: 46465

SEQ ID NO: 198634 - RNA, 64 nt, Homo Sapiens; identical to SEQ ID NO: 46466

SEQ ID NO: 198635 - RNA, 64 nt, Homo Sapiens; identical to SEQ ID NO: 46467

SEQ ID NO: 198636 - RNA, 64 nt, Homo Sapiens; identical to SEQ ID NO: 46468

SEQ ID NO: 198637 - RNA, 64 nt, Homo Sapiens; identical to SEQ ID NO: 46469

SEQ ID NO: 198638 - RNA, 64 nt, Homo Sapiens; identical to SEQ ID NO: 46470

SEQ ID NO: 198639 - RNA, 64 nt, Homo Sapiens; identical to SEQ ID NO: 46471

SEQ ID NO: 198640 - RNA, 64 nt, Homo Sapiens; identical to SEQ ID NO: 46472

SEQ ID NO: 198641 - RNA, 64 nt, Homo Sapiens; identical to SEQ ID NO: 46473

SEQ ID NO: 198642 - RNA, 64 nt, Homo Sapiens; identical to SEQ ID NO: 46474

SEQ ID NO: 198643 - RNA, 60 nt, Homo Sapiens; identical to SEQ ID NO: 46475

SEQ ID NO: 198644 - RNA, 64 nt, Homo Sapiens; identical to SEQ ID NO: 46476

SEQ ID NO: 198645 - RNA, 64 nt, Homo Sapiens; identical to SEQ ID NO: 46477

SEQ ID NO: 198646 - RNA, 64 nt, Homo Sapiens; identical to SEQ ID NO: 46478

SEQ ID NO: 198647 - RNA, 64 nt, Homo Sapiens; identical to SEQ ID NO: 46479

SEQ ID NO: 198648 - RNA, 64 nt, Homo Sapiens; identical to SEQ ID NO: 46480

SEQ ID NO: 198649 - RNA, 64 nt, Homo Sapiens; identical to SEQ ID NO: 46481

SEQ ID NO: 198650 - RNA, 64 nt, Homo Sapiens; identical to SEQ ID NO: 46482

SEQ ID NO: 198651 - RNA, 64 nt, Homo Sapiens; identical to SEQ ID NO: 46483

SEQ ID NO: 198652 - RNA, 64 nt, Homo Sapiens; identical to SEQ ID NO: 46484

SEQ ID NO: 198653 - RNA, 64 nt, Homo Sapiens; identical to SEQ ID NO: 46485

SEQ ID NO: 198654 - RNA, 64 nt, Homo Sapiens; identical to SEQ ID NO: 46486

SEQ ID NO: 198655 - RNA, 64 nt, Homo Sapiens; identical to SEQ ID NO: 46487

SEQ ID NO: 198656 - RNA, 64 nt, Homo Sapiens; identical to SEQ ID NO: 46488

SEQ ID NO: 198657 - RNA, 64 nt, Homo Sapiens; identical to SEQ ID NO: 46489

SEQ ID NO: 198658 - RNA, 64 nt, Homo Sapiens; identical to SEQ ID NO: 46490

SEQ ID NO: 198659 - RNA, 64 nt, Homo Sapiens; identical to SEQ ID NO: 46491

SEQ ID NO: 198660 - RNA, 64 nt, Homo Sapiens; identical to SEQ ID NO: 46492

SEQ ID NO: 198661 - RNA, 64 nt, Homo Sapiens; identical to SEQ ID NO: 46493

SEQ ID NO: 198662 - RNA, 64 nt, Homo Sapiens; identical to SEQ ID NO: 46494

SEQ ID NO: 198663 - RNA, 64 nt, Homo Sapiens; identical to SEQ ID NO: 46495

SEQ ID NO: 198664 - RNA, 64 nt, Homo Sapiens; identical to SEQ ID NO: 46496

SEQ ID NO: 198665 - RNA, 64 nt, Homo Sapiens; identical to SEQ ID NO: 46497

SEQ ID NO: 198666 - RNA, 64 nt, Homo Sapiens; identical to SEQ ID NO: 46498

SEQ ID NO: 198667 - RNA, 64 nt, Homo Sapiens; identical to SEQ ID NO: 46499

SEQ ID NO: 198668 - RNA, 64 nt, Homo Sapiens; identical to SEQ ID NO: 46500

SEQ ID NO: 198669 - RNA, 64 nt, Homo Sapiens; identical to SEQ ID NO: 46501

SEQ ID NO: 198670 - RNA, 64 nt, Homo Sapiens; identical to SEQ ID NO: 46502

SEQ ID NO: 198671 - RNA, 64 nt, Homo Sapiens; identical to SEQ ID NO: 46503

SEQ ID NO: 198672 - RNA, 64 nt, Homo Sapiens; identical to SEQ ID NO: 46504

SEQ ID NO: 198673 - RNA, 64 nt, Homo Sapiens; identical to SEQ ID NO: 46505

SEQ ID NO: 198674 - RNA, 64 nt, Homo Sapiens; identical to SEQ ID NO: 46506

SEQ ID NO: 198675 - RNA, 64 nt, Homo Sapiens; identical to SEQ ID NO: 46507

SEQ ID NO: 198676 - RNA, 64 nt, Homo Sapiens; identical to SEQ ID NO: 46508

SEQ ID NO: 198677 - RNA, 64 nt, Homo Sapiens; identical to SEQ ID NO: 46509

SEQ ID NO: 198678 - RNA, 64 nt, Homo Sapiens; identical to SEQ ID NO: 46510

SEQ ID NO: 198679 - RNA, 64 nt, Homo Sapiens; identical to SEQ ID NO: 46511

SEQ ID NO: 198680 - RNA, 64 nt, Homo Sapiens; identical to SEQ ID NO: 46512

SEQ ID NO: 198681 - RNA, 64 nt, Homo Sapiens; identical to SEQ ID NO: 46513

SEQ ID NO: 198682 - RNA, 64 nt, Homo Sapiens; identical to SEQ ID NO: 46514

SEQ ID NO: 198683 - RNA, 64 nt, Homo Sapiens; identical to SEQ ID NO: 46515

SEQ ID NO: 198684 - RNA, 64 nt, Homo Sapiens; identical to SEQ ID NO: 46516

SEQ ID NO: 198685 - RNA, 64 nt, Homo Sapiens; identical to SEQ ID NO: 46517

SEQ ID NO: 198686 - RNA, 64 nt, Homo Sapiens; identical to SEQ ID NO: 46518

SEQ ID NO: 198687 - RNA, 64 nt, Homo Sapiens; identical to SEQ ID NO: 46519

SEQ ID NO: 198688 - RNA, 64 nt, Homo Sapiens; identical to SEQ ID NO: 46520

SEQ ID NO: 198689 - RNA, 64 nt, Homo Sapiens; identical to SEQ ID NO: 46521

SEQ ID NO: 198690 - RNA, 64 nt, Homo Sapiens; identical to SEQ ID NO: 46522

SEQ ID NO: 198691 - RNA, 64 nt, Homo Sapiens; identical to SEQ ID NO: 46523

SEQ ID NO: 198692 - RNA, 64 nt, Homo Sapiens; identical to SEQ ID NO: 46524

SEQ ID NO: 198693 - RNA, 64 nt, Homo Sapiens; identical to SEQ ID NO: 46525

SEQ ID NO: 198694 - RNA, 64 nt, Homo Sapiens; identical to SEQ ID NO: 46526

SEQ ID NO: 198695 - RNA, 64 nt, Homo Sapiens; identical to SEQ ID NO: 46527

SEQ ID NO: 198696 - RNA, 64 nt, Homo Sapiens; identical to SEQ ID NO: 46528

SEQ ID NO: 198697 - RNA, 64 nt, Homo Sapiens; identical to SEQ ID NO: 46529

SEQ ID NO: 198698 - RNA, 50 nt, Homo Sapiens; identical to SEQ ID NO: 46530

SEQ ID NO: 198699 - RNA, 64 nt, Homo Sapiens; identical to SEQ ID NO: 46531

SEQ ID NO: 198700 - RNA, 64 nt, Homo Sapiens
ugggggaugaagacggcuccccucugaacaaggugcacgcgagccagagcaccucucguuuggc

SEQ ID NO: 198701 - RNA, 64 nt, Homo Sapiens
ucucaggacgacgaaucuucacacuccaccuccagcacgcgacucaccgcaaaugcuucuagac

SEQ ID NO: 198702 - RNA, 64 nt, Homo Sapiens
caggugugugugaauugaauucuugagugaagcagcacgcgaccauauuuauaagaagagaaga

SEQ ID NO: 198703 - RNA, 64 nt, Homo Sapiens
ugucagucuuuccuaaggccauauuuccccagaggcacgcgaacaaagauuuucuguagcguag

SEQ ID NO: 198704 - RNA, 64 nt, Homo Sapiens
uuuuuucuuucucccuuccucccgcucucugcuggcacgcgaggcuuccccuuccaccccaugu

SEQ ID NO: 198705 - RNA, 64 nt, Homo Sapiens
ugcaggcgaaaagcagccaccugaucugccuaaagcacgcgagaauccuccccugcacuccaga

SEQ ID NO: 198706 - RNA, 54 nt, Homo Sapiens
aggacgcauuccaaaucauaacuggcacgcgacgcgccgauccaccucagcuga

SEQ ID NO: 198707 - RNA, 64 nt, Homo Sapiens
agaggcagaucagcugaagcaggaccugcaggaagcacgcgaggcggagcgaagagccaagcag

SEQ ID NO: 198708 - RNA, 64 nt, Homo Sapiens
gcaaaaagauugucaaaauaaaaacaauaauucaaguaacaaugcccggaauauacguccuaac

SEQ ID NO: 198709 - RNA, 64 nt, Homo Sapiens
aguaaaauaaguaaauuucuuuuggaauauuuuuaguaacaaauagccacuauaauucuguagg

SEQ ID NO: 198710 - RNA, 64 nt, Homo Sapiens
ucuagaauauugacauucuccuccagucuguugcaguaacaaaccagucuguugcaguaacaaa

SEQ ID NO: 198711 - RNA, 64 nt, Homo Sapiens
uccagucuguugcaguaacacuccagucuguugcaguaacaaaccugucguuugcaguaacaaa

SEQ ID NO: 198712 - RNA, 64 nt, Homo Sapiens
uccagucuguugcaguaacaucccugucguuugcaguaacaaacgcaccucgugaagaacucuu

SEQ ID NO: 198713 - RNA, 64 nt, Homo Sapiens
ccuugcagaggaaaggugggcaguaacaaaaaauaguaacaauaaagguuauugcagcaaaaau

SEQ ID NO: 198714 - RNA, 64 nt, Homo Sapiens
aauaguaacaauaccuugcauugcagcaaaaaucaguaacaaaaugacugaaacaagaagguua

SEQ ID NO: 198715 - RNA, 64 nt, Homo Sapiens
aaagcugucucagaaauggccaauuuaacuuuacaguaacaauagacagcacaacacaaacucu

SEQ ID NO: 198716 - RNA, 64 nt, Homo Sapiens
uguuauucaaaagggauugccauuucugagacacaguaacaaaaaaaugaggaaauuauuuugc

SEQ ID NO: 198717 - RNA, 64 nt, Homo Sapiens
gcuggcaagggaauggauaaagcuguuuuguucuaguaacaauuuuggaaugaauacugacaau

SEQ ID NO: 198718 - RNA, 64 nt, Homo Sapiens
auucuaaugguaucugaaauaucagcucauagaaaguaacaaaauuugcugucaccuuaaauaa

SEQ ID NO: 198719 - RNA, 64 nt, Homo Sapiens
aagaacguggacguuuuuaacaagcugcuuuagaaguaacaaugcuccacgugguaagauccuc

SEQ ID NO: 198720 - RNA, 64 nt, Homo Sapiens
gaagugacaucuucagcaaagggaacuauaaagaaguaacaaaauaaaaaaaaaaucaauggug

SEQ ID NO: 198721 - RNA, 64 nt, Homo Sapiens
acaccaaacaaaguacaaaguugugagccaacauaguaacaaacagaacugagaaaacugcuuu

SEQ ID NO: 198722 - RNA, 64 nt, Homo Sapiens
ugaauugagucauugcuuucguacuuaaauguaaaguaacaaccuuauguccacuuuuugagug

SEQ ID NO: 198723 - RNA, 64 nt, Homo Sapiens
caucuucagacacauuugguacauccagaaauagauccaagaaauggggugguugagugggucc

SEQ ID NO: 198724 - RNA, 64 nt, Homo Sapiens
gaguuuuaaaggaagaaauauuuucaaauucuuaauccaagaaaauacugaguuggaaucuuag

SEQ ID NO: 198725 - RNA, 64 nt, Homo Sapiens
ggcauggcucagagguuguguccugcaaagcccaauccaagacugucucugggguccuguuccu

SEQ ID NO: 198726 - RNA, 64 nt, Homo Sapiens
gaguugcuuuguggaaggugagcggacuccaucaauccaagaaaagcuuggaagaaaucccaga

SEQ ID NO: 198727 - RNA, 64 nt, Homo Sapiens
ucauuuauguggagauccacaaccuuuaacagggauccaagaucuuugcaguucaaucgaccac

SEQ ID NO: 198728 - RNA, 64 nt, Homo Sapiens
uugcuuccuugacaaagaagccaucaugggugugauccaagaucccugucguaguguugaugau

SEQ ID NO: 198729 - RNA, 64 nt, Homo Sapiens
aaacuucccugugcaaggcaaguuuacaucacaaauccaagaauguuugcauccuaaaugcuag

SEQ ID NO: 198730 - RNA, 64 nt, Homo Sapiens
uaaaagucuuuuuaauuaauagaaagauuuuaauauccaagaguagucaaauuaaggauauaaa

SEQ ID NO: 198731 - RNA, 64 nt, Homo Sapiens
ucagccaaggagcccacuuaagcaaugugcuacgauccaagauaaaggacuugccaugguucac

SEQ ID NO: 198732 - RNA, 64 nt, Homo Sapiens
gagguuauguguacuucauuuauucaaagcaucaauccaagaagcugagccacuugucagauug

SEQ ID NO: 198733 - RNA, 64 nt, Homo Sapiens
gugcugcucucacagaucgguugcagggagccuucccuugcacugccuagccugcagcccuccc

SEQ ID NO: 198734 - RNA, 64 nt, Homo Sapiens
gagccuucccuugcacuguguagccugcagcccucccuugcaggacuacccugaagggccagcc

SEQ ID NO: 198735 - RNA, 64 nt, Homo Sapiens
cuaagugauagaagagcaaccugcacuguucauccccuugcauuuuucuuaguuucauaauaau

SEQ ID NO: 198736 - RNA, 64 nt, Homo Sapiens
ugaugacacaucugaggaacggguuuuuugucuccccuugcagcuauugcaacacauguucuuu

SEQ ID NO: 198737 - RNA, 64 nt, Homo Sapiens
gccagucacuuacuuaauucaguaaaauuuccaacccuugcaugacuucuaccaaggaaaaaua

SEQ ID NO: 198738 - RNA, 64 nt, Homo Sapiens
gcccuuuuacagccgcagccucugucacauggaucccuugcacuaucacaagagacagaacagu

SEQ ID NO: 198739 - RNA, 64 nt, Homo Sapiens
uggccuccucauucucuuuugccauuggaauguccccuugcaguucucuucucuuuuuuuuuuu

SEQ ID NO: 198740 - RNA, 64 nt, Homo Sapiens
cugagauuacaggcgugagccuccgcgcccggcccccuugcaguucucucugauuugguuuguu

SEQ ID NO: 198741 - RNA, 64 nt, Homo Sapiens
ucagcaccacccuagucccucaaagcuaggguggcccuugcagucuacaggaagcaccccaugc

SEQ ID NO: 198742 - RNA, 64 nt, Homo Sapiens
uaguuuucuagaauuuaucaggcccagaucuggucccuugcagcaccugcccaucacaggguug

SEQ ID NO: 198743 - RNA, 64 nt, Homo Sapiens
cauccugcacacaucucccucgccuuccacuccucccuugcacccuauccuccuccugcccuuc

SEQ ID NO: 198744 - RNA, 64 nt, Homo Sapiens
uagcaagguugugugacuaagcauuucccagacucccuugcagcggccucugagaauagcagcu

SEQ ID NO: 198745 - RNA, 62 nt, Homo Sapiens
accccaagaagaaaauguuacuuaggcaugcacagcuguaguauggagucccuuuggcaaaa

SEQ ID NO: 198746 - RNA, 62 nt, Homo Sapiens
aacaacaccuucagaggcugugugguugcucacagcuguaaugauccccaaaacaggccagg

SEQ ID NO: 198747 - RNA, 62 nt, Homo Sapiens
auuuugaucuuuuggaugcagcagaauuaucccagcuguauucauccauauggaaagcaaag

SEQ ID NO: 198748 - RNA, 62 nt, Homo Sapiens
caauugugcgcaguugggaacuaagucaguugcagcuguaauuuuaccuucaggggugggag

SEQ ID NO: 198749 - RNA, 62 nt, Homo Sapiens
aagccuuucagccaguugcuucugagccagaccagcuguaagcugaaaccucaaugaauaac

SEQ ID NO: 198750 - RNA, 62 nt, Homo Sapiens
aaaaugcacaauuuguagggguuuggaugaagcagcuguaacugcccuaguguaguuugacc

SEQ ID NO: 198751 - RNA, 62 nt, Homo Sapiens
aacuuuaaacaauauaguauuuauggcgaggacagcuguagucuguugugauauuucacauu

SEQ ID NO: 198752 - RNA, 62 nt, Homo Sapiens
uucaggcuagcuucuuucacauaaugcugucucagcuguauuuccaguaacacagcaucauc

SEQ ID NO: 198753 - RNA, 64 nt, Homo Sapiens
cuauguaugguaaaggaccauacucuagggcagucuuucucaaagacuugugguggaguuaugg

SEQ ID NO: 198754 - RNA, 64 nt, Homo Sapiens
auaauguuauauguggccacaugcacuuucuuuccuuucucaaagaaggcaucccuuuuggggc

SEQ ID NO: 198755 - RNA, 64 nt, Homo Sapiens
ucuuucuaacuguagcuaucugccuccugguuuccuuucucauuacuugugaauucccagacuc

SEQ ID NO: 198756 - RNA, 64 nt, Homo Sapiens
auguuggcaaaucacuucaaucuuuuaaaauaagcuuucucagaaccuaucuuuaaagccgugc

SEQ ID NO: 198757 - RNA, 64 nt, Homo Sapiens
uguucuauaccagaaugggaacaaugaauuccagcuuucucauucuuacuuaccuaaauguaac

SEQ ID NO: 198758 - RNA, 64 nt, Homo Sapiens
cucauauguuuuugucuugugcagcuacaauacacuuucucaauagauacgcaacuuuguuuuu

SEQ ID NO: 198759 - RNA, 64 nt, Homo Sapiens
aucuucacaccugccaccucauguucacaccuaucuuucucaccuuuuuuuugagauggagucu

SEQ ID NO: 198760 - RNA, 64 nt, Homo Sapiens
ugggauuacaggcgugagccaccaugcccggccucuuucucaccuuuacaccugucuucuuauc

SEQ ID NO: 198761 - RNA, 64 nt, Homo Sapiens
cugucuuaggaaggaccuucgacuuucuaucuuccuuucucaaacagccaaauagucccaugcu

SEQ ID NO: 198762 - RNA, 64 nt, Homo Sapiens
caaguuggccacuuacgcuaauggaucucucuggcuuucucacccguuguccguggaagaacac

SEQ ID NO: 198763 - RNA, 64 nt, Homo Sapiens
cagaccagccccucauaccacagccaagaggggccuuucucaccuggagagaaauuuccagacc

SEQ ID NO: 198764 - RNA, 64 nt, Homo Sapiens
cagaccagccccucauaccacagccaagaggggccuuucucaccuggagagaaacuuccagacc

SEQ ID NO: 198765 - RNA, 64 nt, Homo Sapiens
aagccucagcuuucuaagauccgaaggaaaagggcuuucucaauccauacaaaaauuccuuuuc

SEQ ID NO: 198766 - RNA, 64 nt, Homo Sapiens
uuguccccaacaccccacagaucugagucaacuccuuucucaucccugucauaugcucugauuu

SEQ ID NO: 198767 - RNA, 64 nt, Homo Sapiens
acugggaacgcccccucuuuauaaagcugggcuucuuucucaucucucucccaaauguuguauc

SEQ ID NO: 198768 - RNA, 64 nt, Homo Sapiens
uccugucaccccaauuucuccaagccagagguagcuuucucagagccccuuggugguucugucc

SEQ ID NO: 198769 - RNA, 64 nt, Homo Sapiens
uuucugcuuguuuguucagugcuaauacaguuagcuuucucacucauuugguacaucugugucu

SEQ ID NO: 198770 - RNA, 64 nt, Homo Sapiens
uuuauuuuguagcauggguucuuuauuuauauggcuuucucacuaaggcuagaacauuauucug

SEQ ID NO: 198771 - RNA, 64 nt, Homo Sapiens
guauacucaucuuuuuuggcccauuacaauacugcuuucucagguucuuaacagccugugcaaa

SEQ ID NO: 198772 - RNA, 64 nt, Homo Sapiens
uugagcacuuacuaugugcccaacccuguuaugccuuucucaggcucaugauaaauguauuagu

SEQ ID NO: 198773 - RNA, 64 nt, Homo Sapiens
auaucaaguuuaggcagcaacugcuuaggugucacuuucucagcugauacaaguaaccuccccu

SEQ ID NO: 198774 - RNA, 64 nt, Homo Sapiens
uccugaccuuccucugagccaccacacugcuucccuuucucaguggacuugugaguccuaggug

SEQ ID NO: 198775 - RNA, 64 nt, Homo Sapiens
ugguugcacagucacacugauaugcugauuugcucuuucucauuguaugucuaugcuuugucau

SEQ ID NO: 198776 - RNA, 64 nt, Homo Sapiens
cacaaaugccuaugauuuagguuaccaauguauucuuucucauuugggguuuugcuucugucug

SEQ ID NO: 198777 - RNA, 64 nt, Homo Sapiens
ugccuccccugcccucagaacugccuccccugcccuuucucagcccuggccugcccuuucucag

SEQ ID NO: 198778 - RNA, 64 nt, Homo Sapiens
ugccuccccugcccuuucucacaccuggccugcccuuucucagcgaugcaaggagcugccugug

SEQ ID NO: 198779 - RNA, 64 nt, Homo Sapiens
cuagagccuucugccuaucccuggcuuugccucccuuucucagaaggauccuacuuccuaaaau

SEQ ID NO: 198780 - RNA, 64 nt, Homo Sapiens
gcucuccuugccagcuuucuguccuguucuuguucuuucucaucuguuggagcucccuguccuu

SEQ ID NO: 198781 - RNA, 64 nt, Homo Sapiens
cgguucccacccuccuccacuuucucuccacugacuuucucaccgcgggagaggcaccagaaca

SEQ ID NO: 198782 - RNA, 64 nt, Homo Sapiens
caggucaggcauugacacuucuguguccuccugucuuucucauccacacuguccugcauccagu

SEQ ID NO: 198783 - RNA, 64 nt, Homo Sapiens
ugaaccccuacucccggagccggaaggccgcuuccuuucucagcagaggcugcuagagcagaag

SEQ ID NO: 198784 - RNA, 64 nt, Homo Sapiens
ugaaccccuacccggagccccggaaggccgcuuccuuucucagcagagccugcuagagcagaag

SEQ ID NO: 198785 - RNA, 64 nt, Homo Sapiens
acuggucuggcuucugaauuaguaaagaccugaucuuucucaucugaguuuugaaugauuuugc

SEQ ID NO: 198786 - RNA, 64 nt, Homo Sapiens
gucagagccccuagcucuucugcugagcccaccgcuuucucagcccaccccagugcgucucgcc

SEQ ID NO: 198787 - RNA, 64 nt, Homo Sapiens
gagcaaccaguaucacuucccuagugccgauaaacuuucucaaagcuaccuccccaagacuuua

SEQ ID NO: 198788 - RNA, 64 nt, Homo Sapiens
ccaauggcaacugccauuugggcacugccuuuuccuuucucaggucauacuuuuuccuaggcuu

SEQ ID NO: 198789 - RNA, 64 nt, Homo Sapiens
auuucuugaacaucuuucccaguuuaaaauaaaacuuucucauguggccucaggaggcaggcag

SEQ ID NO: 198790 - RNA, 64 nt, Homo Sapiens
ggagccuagugaaaccaaauaagaacucaaauuccuuucucauuucccaggguucauucuuccc

SEQ ID NO: 198791 - RNA, 64 nt, Homo Sapiens
cccucuccuccccuugcgcucgcgcucgcgcucgcuuucucacuggcgugcucucuuucucucu

SEQ ID NO: 198792 - RNA, 64 nt, Homo Sapiens
cgugcucucuuucucucucucucucccucuguaccuuucucauaguugcuucagaucuuagguc

SEQ ID NO: 198793 - RNA, 64 nt, Homo Sapiens
ggcauagauagggaugugagaguggaguaccuuccuuucucaagucucgagaugccagugaaac

SEQ ID NO: 198794 - RNA, 64 nt, Homo Sapiens
uuuugcuuaugguagugggcuaacauaacagccccuuucucaagcagagaccuggccccugggc

SEQ ID NO: 198795 - RNA, 64 nt, Homo Sapiens
ugucuuuuugccuuuagcucguuccccuuugauucuuucucaauaucccagcuuucucaccacc

SEQ ID NO: 198796 - RNA, 64 nt, Homo Sapiens
accguuccccuuugauucuucaauucaaucccagcuuucucaccgccucuuucuauugaaaugu

SEQ ID NO: 198797 - RNA, 64 nt, Homo Sapiens
ugaccaaguacauccuggugcaggaugccuuguucuuucucacaguaucuaucccacuccucuu

SEQ ID NO: 198798 - RNA, 64 nt, Homo Sapiens
uauuuccagguuuaacuaguuggaguuuuucucccuuucucaauaaucaacuuauagugcugac

SEQ ID NO: 198799 - RNA, 64 nt, Homo Sapiens
ggggcccuggguucugccauauacccagaggagccuuucucaguguguuucuaaauggccuuac

SEQ ID NO: 198800 - RNA, 64 nt, Homo Sapiens; identical to SEQ ID NO: 61495

SEQ ID NO: 198801 - RNA, 64 nt, Homo Sapiens; identical to SEQ ID NO: 61496

SEQ ID NO: 198802 - RNA, 64 nt, Homo Sapiens; identical to SEQ ID NO: 61497

SEQ ID NO: 198803 - RNA, 64 nt, Homo Sapiens; identical to SEQ ID NO: 61498

SEQ ID NO: 198804 - RNA, 64 nt, Homo Sapiens; identical to SEQ ID NO: 61499

SEQ ID NO: 198805 - RNA, 64 nt, Homo Sapiens; identical to SEQ ID NO: 61500

SEQ ID NO: 198806 - RNA, 64 nt, Homo Sapiens; identical to SEQ ID NO: 61501

SEQ ID NO: 198807 - RNA, 64 nt, Homo Sapiens; identical to SEQ ID NO: 61502

SEQ ID NO: 198808 - RNA, 64 nt, Homo Sapiens; identical to SEQ ID NO: 61503

SEQ ID NO: 198809 - RNA, 64 nt, Homo Sapiens; identical to SEQ ID NO: 61504

SEQ ID NO: 198810 - RNA, 64 nt, Homo Sapiens; identical to SEQ ID NO: 61505

SEQ ID NO: 198811 - RNA, 64 nt, Homo Sapiens; identical to SEQ ID NO: 61506

SEQ ID NO: 198812 - RNA, 64 nt, Homo Sapiens; identical to SEQ ID NO: 61507

SEQ ID NO: 198813 - RNA, 64 nt, Homo Sapiens; identical to SEQ ID NO: 61508

SEQ ID NO: 198814 - RNA, 64 nt, Homo Sapiens; identical to SEQ ID NO: 61509

SEQ ID NO: 198815 - RNA, 64 nt, Homo Sapiens; identical to SEQ ID NO: 61510

SEQ ID NO: 198816 - RNA, 64 nt, Homo Sapiens; identical to SEQ ID NO: 61511

SEQ ID NO: 198817 - RNA, 64 nt, Homo Sapiens; identical to SEQ ID NO: 61512

SEQ ID NO: 198818 - RNA, 64 nt, Homo Sapiens; identical to SEQ ID NO: 61513

SEQ ID NO: 198819 - RNA, 64 nt, Homo Sapiens; identical to SEQ ID NO: 61514

SEQ ID NO: 198820 - RNA, 64 nt, Homo Sapiens; identical to SEQ ID NO: 61515

SEQ ID NO: 198821 - RNA, 64 nt, Homo Sapiens; identical to SEQ ID NO: 61516

SEQ ID NO: 198822 - RNA, 64 nt, Homo Sapiens; identical to SEQ ID NO: 61517

SEQ ID NO: 198823 - RNA, 64 nt, Homo Sapiens; identical to SEQ ID NO: 167088

SEQ ID NO: 198824 - RNA, 64 nt, Homo Sapiens; identical to SEQ ID NO: 167089

SEQ ID NO: 198825 - RNA, 64 nt, Homo Sapiens; identical to SEQ ID NO: 167090

SEQ ID NO: 198826 - RNA, 64 nt, Homo Sapiens; identical to SEQ ID NO: 167091

SEQ ID NO: 198827 - RNA, 64 nt, Homo Sapiens; identical to SEQ ID NO: 167092

SEQ ID NO: 198828 - RNA, 64 nt, Homo Sapiens; identical to SEQ ID NO: 167093

SEQ ID NO: 198829 - RNA, 64 nt, Homo Sapiens; identical to SEQ ID NO: 167094

SEQ ID NO: 198830 - RNA, 64 nt, Homo Sapiens; identical to SEQ ID NO: 167095

SEQ ID NO: 198831 - RNA, 64 nt, Homo Sapiens; identical to SEQ ID NO: 167096

SEQ ID NO: 198832 - RNA, 64 nt, Homo Sapiens; identical to SEQ ID NO: 167097

SEQ ID NO: 198833 - RNA, 64 nt, Homo Sapiens; identical to SEQ ID NO: 167098

SEQ ID NO: 198834 - RNA, 64 nt, Homo Sapiens; identical to SEQ ID NO: 167099

SEQ ID NO: 198835 - RNA, 64 nt, Homo Sapiens; identical to SEQ ID NO: 167100

SEQ ID NO: 198836 - RNA, 64 nt, Homo Sapiens; identical to SEQ ID NO: 167101

SEQ ID NO: 198837 - RNA, 64 nt, Homo Sapiens; identical to SEQ ID NO: 167102

SEQ ID NO: 198838 - RNA, 64 nt, Homo Sapiens; identical to SEQ ID NO: 167103

SEQ ID NO: 198839 - RNA, 64 nt, Homo Sapiens; identical to SEQ ID NO: 167104

SEQ ID NO: 198840 - RNA, 64 nt, Homo Sapiens; identical to SEQ ID NO: 167105

SEQ ID NO: 198841 - RNA, 64 nt, Homo Sapiens; identical to SEQ ID NO: 167106

SEQ ID NO: 198842 - RNA, 64 nt, Homo Sapiens; identical to SEQ ID NO: 167107

SEQ ID NO: 198843 - RNA, 64 nt, Homo Sapiens; identical to SEQ ID NO: 167108

SEQ ID NO: 198844 - RNA, 64 nt, Homo Sapiens; identical to SEQ ID NO: 167109

SEQ ID NO: 198845 - RNA, 64 nt, Homo Sapiens; identical to SEQ ID NO: 167110

SEQ ID NO: 198846 - RNA, 64 nt, Homo Sapiens; identical to SEQ ID NO: 167111

SEQ ID NO: 198847 - RNA, 64 nt, Homo Sapiens; identical to SEQ ID NO: 167112

SEQ ID NO: 198848 - RNA, 64 nt, Homo Sapiens; identical to SEQ ID NO: 167113

SEQ ID NO: 198849 - RNA, 64 nt, Homo Sapiens; identical to SEQ ID NO: 167114

SEQ ID NO: 198850 - RNA, 64 nt, Homo Sapiens; identical to SEQ ID NO: 167115

SEQ ID NO: 198851 - RNA, 64 nt, Homo Sapiens; identical to SEQ ID NO: 167116

SEQ ID NO: 198852 - RNA, 64 nt, Homo Sapiens; identical to SEQ ID NO: 167117

SEQ ID NO: 198853 - RNA, 64 nt, Homo Sapiens; identical to SEQ ID NO: 167118

SEQ ID NO: 198854 - RNA, 64 nt, Homo Sapiens; identical to SEQ ID NO: 167119

SEQ ID NO: 198855 - RNA, 64 nt, Homo Sapiens; identical to SEQ ID NO: 167120

SEQ ID NO: 198856 - RNA, 64 nt, Homo Sapiens; identical to SEQ ID NO: 167121

SEQ ID NO: 198857 - RNA, 64 nt, Homo Sapiens; identical to SEQ ID NO: 167122

SEQ ID NO: 198858 - RNA, 64 nt, Homo Sapiens; identical to SEQ ID NO: 167123

SEQ ID NO: 198859 - RNA, 64 nt, Homo Sapiens; identical to SEQ ID NO: 167124

SEQ ID NO: 198860 - RNA, 64 nt, Homo Sapiens; identical to SEQ ID NO: 167125

SEQ ID NO: 198861 - RNA, 64 nt, Homo Sapiens; identical to SEQ ID NO: 167126

SEQ ID NO: 198862 - RNA, 64 nt, Homo Sapiens; identical to SEQ ID NO: 167127

SEQ ID NO: 198863 - RNA, 64 nt, Homo Sapiens; identical to SEQ ID NO: 167128

SEQ ID NO: 198864 - RNA, 64 nt, Homo Sapiens; identical to SEQ ID NO: 167129

SEQ ID NO: 198865 - RNA, 64 nt, Homo Sapiens; identical to SEQ ID NO: 167130

SEQ ID NO: 198866 - RNA, 64 nt, Homo Sapiens; identical to SEQ ID NO: 167131

SEQ ID NO: 198867 - RNA, 64 nt, Homo Sapiens; identical to SEQ ID NO: 167132

SEQ ID NO: 198868 - RNA, 64 nt, Homo Sapiens; identical to SEQ ID NO: 167133

SEQ ID NO: 198869 - RNA, 64 nt, Homo Sapiens; identical to SEQ ID NO: 167134

SEQ ID NO: 198870 - RNA, 64 nt, Homo Sapiens; identical to SEQ ID NO: 167135

SEQ ID NO: 198871 - RNA, 64 nt, Homo Sapiens; identical to SEQ ID NO: 167136

SEQ ID NO: 198872 - RNA, 64 nt, Homo Sapiens; identical to SEQ ID NO: 167137

SEQ ID NO: 198873 - RNA, 64 nt, Homo Sapiens; identical to SEQ ID NO: 167138

SEQ ID NO: 198874 - RNA, 64 nt, Homo Sapiens; identical to SEQ ID NO: 167139

SEQ ID NO: 198875 - RNA, 64 nt, Homo Sapiens; identical to SEQ ID NO: 167140

SEQ ID NO: 198876 - RNA, 64 nt, Homo Sapiens; identical to SEQ ID NO: 167141

SEQ ID NO: 198877 - RNA, 64 nt, Homo Sapiens; identical to SEQ ID NO: 167142

SEQ ID NO: 198878 - RNA, 64 nt, Homo Sapiens; identical to SEQ ID NO: 167143

SEQ ID NO: 198879 - RNA, 64 nt, Homo Sapiens; identical to SEQ ID NO: 167144

SEQ ID NO: 198880 - RNA, 64 nt, Homo Sapiens; identical to SEQ ID NO: 167145

SEQ ID NO: 198881 - RNA, 64 nt, Homo Sapiens; identical to SEQ ID NO: 167146

SEQ ID NO: 198882 - RNA, 64 nt, Homo Sapiens; identical to SEQ ID NO: 167147

SEQ ID NO: 198883 - RNA, 64 nt, Homo Sapiens; identical to SEQ ID NO: 167148

SEQ ID NO: 198884 - RNA, 64 nt, Homo Sapiens; identical to SEQ ID NO: 167149

SEQ ID NO: 198885 - RNA, 64 nt, Homo Sapiens; identical to SEQ ID NO: 167150

SEQ ID NO: 198886 - RNA, 64 nt, Homo Sapiens; identical to SEQ ID NO: 167151

SEQ ID NO: 198887 - RNA, 64 nt, Homo Sapiens; identical to SEQ ID NO: 167152

SEQ ID NO: 198888 - RNA, 64 nt, Homo Sapiens; identical to SEQ ID NO: 167153

SEQ ID NO: 198889 - RNA, 64 nt, Homo Sapiens; identical to SEQ ID NO: 167154

SEQ ID NO: 198890 - RNA, 64 nt, Homo Sapiens; identical to SEQ ID NO: 167155

SEQ ID NO: 198891 - RNA, 64 nt, Homo Sapiens; identical to SEQ ID NO: 167156

SEQ ID NO: 198892 - RNA, 64 nt, Homo Sapiens; identical to SEQ ID NO: 167157

SEQ ID NO: 198893 - RNA, 64 nt, Homo Sapiens; identical to SEQ ID NO: 167158

SEQ ID NO: 198894 - RNA, 64 nt, Homo Sapiens; identical to SEQ ID NO: 167159

SEQ ID NO: 198895 - RNA, 64 nt, Homo Sapiens; identical to SEQ ID NO: 167160

SEQ ID NO: 198896 - RNA, 64 nt, Homo Sapiens; identical to SEQ ID NO: 167161

SEQ ID NO: 198897 - RNA, 64 nt, Homo Sapiens; identical to SEQ ID NO: 167162

SEQ ID NO: 198898 - RNA, 64 nt, Homo Sapiens; identical to SEQ ID NO: 167163

SEQ ID NO: 198899 - RNA, 64 nt, Homo Sapiens; identical to SEQ ID NO: 167164

SEQ ID NO: 198900 - RNA, 64 nt, Homo Sapiens; identical to SEQ ID NO: 167165

SEQ ID NO: 198901 - RNA, 64 nt, Homo Sapiens; identical to SEQ ID NO: 167166

SEQ ID NO: 198902 - RNA, 64 nt, Homo Sapiens; identical to SEQ ID NO: 167167

SEQ ID NO: 198903 - RNA, 64 nt, Homo Sapiens; identical to SEQ ID NO: 167168

SEQ ID NO: 198904 - RNA, 62 nt, Homo Sapiens
ucauuccuuauugaacuuauuuugcacaauaguguuuacaaaucuuauacaucuuacuuuga

SEQ ID NO: 198905 - RNA, 62 nt, Homo Sapiens
gggggucuugacaaagcagaguaaaaauaugcuguuuacauuguuuacuuacaaguaaggag

SEQ ID NO: 198906 - RNA, 62 nt, Homo Sapiens
uuuuauuaauucuucauuuuuuguaaaacuuauguuuacaagaagaaaacaaaucaaaacau

SEQ ID NO: 198907 - RNA, 62 nt, Homo Sapiens
gccuaaaagaaaggacugacaagugugcaaaauguuuacaaucuuuugugaaauuguaguuu

SEQ ID NO: 198908 - RNA, 62 nt, Homo Sapiens
aucuuagcucacuuuccaauaacagaaggaguuguuuacagaugaauaguaucacaucauua

SEQ ID NO: 198909 - RNA, 62 nt, Homo Sapiens
gucuuuuguaaaacaaaaauuacaaaaaaauuuguuuacauuccacugguaccuuaauuuaa

SEQ ID NO: 198910 - RNA, 62 nt, Homo Sapiens
uuccccaacuacaaaaauguuuggcaacuuuguguuuacauuuaaagaucauuugcaccuuu

SEQ ID NO: 198911 - RNA, 62 nt, Homo Sapiens
uuuucaaggaaaaaaaguauugaguaaacaauuguuuacauauaucauuuaugcuuuuuucu

SEQ ID NO: 198912 - RNA, 62 nt, Homo Sapiens
uucuucuguuuuauacaagcucuguuaaguuauguuuacaguaucuuguaucgcuguuuaca

SEQ ID NO: 198913 - RNA, 62 nt, Homo Sapiens
uguuaaguuauguuuacaguaucuuguaucgcuguuuacaaaucuugcauggacuccugcca

SEQ ID NO: 198914 - RNA, 62 nt, Homo Sapiens
uaggcuauuuuuuaauauagacagcuaaauuuuguuuacaauccaaguugauuuuugugucu

SEQ ID NO: 198915 - RNA, 62 nt, Homo Sapiens
aaauacaaaaauuagccaggggcaaaaccgcguguuuacaaaaagacuagccugggcaaugu

SEQ ID NO: 198916 - RNA, 62 nt, Homo Sapiens
uucuuucaugguaagcucaauggacuuugaauuguuuacagugcuguauguccaauuguuaa

SEQ ID NO: 198917 - RNA, 62 nt, Homo Sapiens
acuccaacggagggagccuguugguguuaaauuguuuacauuucuuuauacaaauaaugugc

SEQ ID NO: 198918 - RNA, 62 nt, Homo Sapiens
uuaagacauaugcagugguucaaauguaaauauguuuacauuaggcucaauaacaaauacaa

SEQ ID NO: 198919 - RNA, 62 nt, Homo Sapiens
cagucccaagaaauggauugugaugucuuugcuguuuacaugcugcaaauuucaugaauuug

SEQ ID NO: 198920 - RNA, 62 nt, Homo Sapiens
guacaucuaccccagccccucaaaagaaaaacuguuuacauagaaauuccuacacauacguu

SEQ ID NO: 198921 - RNA, 62 nt, Homo Sapiens
uaaaacauaauugccaauugaaacccuaaauauguuuacauaccauuaagauaugauucaug

SEQ ID NO: 198922 - RNA, 62 nt, Homo Sapiens
aacaccagccccugccccagcccaaguccaaauguuuacagggagccuccugcccagucccc

SEQ ID NO: 198923 - RNA, 62 nt, Homo Sapiens
ccaagugacuccgugccuugagugugucugcguguuuacacccgucccucugcuggccgccc

SEQ ID NO: 198924 - RNA, 62 nt, Homo Sapiens
auacuuacaauuuuuagcagguagcuuuuuaauguuuacagaaauuuuaauuuuuuucuauu

SEQ ID NO: 198925 - RNA, 62 nt, Homo Sapiens
uuuaauuuuuuucuauuuugaaauuugaggcuuguuuacauugcuuagauaauuuagaauuu

SEQ ID NO: 198926 - RNA, 62 nt, Homo Sapiens
aacauaagugucucuggccaucaaagugaucuuguuuacagcagugcuuuugugaaacaauu

SEQ ID NO: 198927 - RNA, 62 nt, Homo Sapiens
agauaauuuuuuuuccuuugaguuuuacacuuuguuuacaguguuuacaacucaaaacuuug

SEQ ID NO: 198928 - RNA, 62 nt, Homo Sapiens
ucaaaacuuugaguuuuacaauguuuuuacuuuguuuacaacuacaaguccagauucaaaaa

SEQ ID NO: 198929 - RNA, 62 nt, Homo Sapiens
uccagauucaaaaaauguuuaaauuuuguuacuguuuacaagguccagaacugaagacuuua

SEQ ID NO: 198930 - RNA, 62 nt, Homo Sapiens
auccuccguggcccuaggcacacugccuccuauguuuacaggaagacccagaauguaggugc

SEQ ID NO: 198931 - RNA, 62 nt, Homo Sapiens
gcaaggcuucccugucuccccagcugaugucguguuuacagagcuguggggugcugguggag

SEQ ID NO: 198932 - RNA, 62 nt, Homo Sapiens
guauguacuaagcaguaagcaaaugagaucguuguuuacaguuaugagaaaguucucauuua

SEQ ID NO: 198933 - RNA, 62 nt, Homo Sapiens
agcccaauguaaugcauaggauuuuaugcugcuguuuacaaauccuaaugucagaguagaag

SEQ ID NO: 198934 - RNA, 62 nt, Homo Sapiens
uuucccuuucaguuaguauaugacuuugguuuuguuuacauugcaagaugccauuuucccca

SEQ ID NO: 198935 - RNA, 62 nt, Homo Sapiens
gaaaggacugaacuuuuucuugaguuucuuuguguuuacaagacuauuuuuaaaauuccugu

SEQ ID NO: 198936 - RNA, 62 nt, Homo Sapiens
gauuuuacaauaacauuaucaucugcaguuacuguuuacaagacugcuuuuaccuuaaacuu

SEQ ID NO: 198937 - RNA, 62 nt, Homo Sapiens
uacaagacugcuuuuaccuuaaacuuuguagauguuuacaucuuuuuguuguguuuuaagau

SEQ ID NO: 198938 - RNA, 62 nt, Homo Sapiens
cagcuggucugacacuacgcgcagugcucgguuguuuacaaucaguggggaaaagggcagaa

SEQ ID NO: 198939 - RNA, 62 nt, Homo Sapiens
uuuuuggaagugcaaaaaucucaauuugugucuguuuacagcucucucuccucacugcucac

SEQ ID NO: 198940 - RNA, 62 nt, Homo Sapiens
aauaauuagcaauacugaguuauugcaguuuuuguuuacaaguccgcgagccugcuugcuga

SEQ ID NO: 198941 - RNA, 62 nt, Homo Sapiens
uuuccgugccgggagcgcaccucucuucugacuguuuacaccaacaacaaagcagaagacuc

SEQ ID NO: 198942 - RNA, 62 nt, Homo Sapiens
ucauauccauuucuaauccaucaaacagcuuauguuuacauaaaauuuuaucauucacaagg

SEQ ID NO: 198943 - RNA, 62 nt, Homo Sapiens
agguuuugauaggaaguauguuuguuucuuaguguuuacaaauauuaaguacucuugauaca

SEQ ID NO: 198944 - RNA, 62 nt, Homo Sapiens
uuauuuuuuauaucuguagcgcauuuuaaagguguuuacagaucuuaaacuuuaauaaauuc

SEQ ID NO: 198945 - RNA, 62 nt, Homo Sapiens
aagauuauuuuguauuuaccuaaucuaagaauuguuuacaaauaaacauucugcauugggua

SEQ ID NO: 198946 - RNA, 62 nt, Homo Sapiens
auaaccuguauguguuccgagcuuuaauuuuuuguuuacaaauugaacaguguuacaugggc

SEQ ID NO: 198947 - RNA, 62 nt, Homo Sapiens
aacaaaccuguuuuaugaaaauucacuggugcuguuuacauuggaauaaaaagcucuauaag

SEQ ID NO: 198948 - RNA, 62 nt, Homo Sapiens
aagaauauuauccugguuuaacaacagugcccuguuuacaacagauugugcccuaucucauc

SEQ ID NO: 198949 - RNA, 62 nt, Homo Sapiens
guguuaacaucuguuucaggaacauggcaguauguuuacaugucagaaguuuuguuuaauuc

SEQ ID NO: 198950 - RNA, 62 nt, Homo Sapiens
ugagucgggaccaaagagaauuuauagguaguuguuuacauauuacaaguauaugaguauua

SEQ ID NO: 198951 - RNA, 62 nt, Homo Sapiens
guuaugugaauagauuagauaguaaauguacuuguuuacauauaugaacaugaagaaacuuu

SEQ ID NO: 198952 - RNA, 62 nt, Homo Sapiens
ugcccaggauuuugaagagcuuuauaaguagauguuuacauaaauaaauauuuauuuauuua

SEQ ID NO: 198953 - RNA, 62 nt, Homo Sapiens
gguugccuggauacaaaucacacuuauuaggcuguuuacauguggaaaaacuuuaggaaaug

SEQ ID NO: 198954 - RNA, 62 nt, Homo Sapiens
ucuaaauaaaauuugcuuauuuaauguuuacauguuuacaucgauaaaauuuaguugaguuu

SEQ ID NO: 198955 - RNA, 62 nt, Homo Sapiens
uuuacaucucuaaauaaaauuugaguuuuuaauguuuacaugauaauaaagauaaaauuuag

SEQ ID NO: 198956 - RNA, 62 nt, Homo Sapiens
gguuuaguuuuguaauaagguaaauuuaaacuuguuuacaaagcaauuugguucuugaaaau

SEQ ID NO: 198957 - RNA, 62 nt, Homo Sapiens
gaugucuucauucccaagguaacagcaggacuuguuuacaaaccuauguuagcuguuaaaga

SEQ ID NO: 198958 - RNA, 62 nt, Homo Sapiens
ggaagaaugggacauggccccaugcuuauuuuuguuuacaacguaacauggcaugagagagg

SEQ ID NO: 198959 - RNA, 62 nt, Homo Sapiens
auaccaggcacaagauaaaacuccaaaauuucuguuuacauugaccuuuacauuuaaagcug

SEQ ID NO: 198960 - RNA, 62 nt, Homo Sapiens
accuggcuccuaccuggaggacucaguuguucuguuuacauccugguggcaccucucacccu

SEQ ID NO: 198961 - RNA, 62 nt, Homo Sapiens
uuuccccuugcucguuucucccuuguuguaaguguuuacaacuggcaugugcuuuuaaacau

SEQ ID NO: 198962 - RNA, 62 nt, Homo Sapiens
uuugaggcuucaaauaaguugcggcuggaggauguuuacagccugauuugggguuaaacuag

SEQ ID NO: 198963 - RNA, 62 nt, Homo Sapiens
uuaucuguaauaagauaacucauccugggacuuguuuacauuaauuaccucccaugugugga

SEQ ID NO: 198964 - RNA, 62 nt, Homo Sapiens
uuugugugcaacugcuucauaauguuuacauauguuuacaugcaaaggcaucacuauuuuua

SEQ ID NO: 198965 - RNA, 62 nt, Homo Sapiens
uguuuacauguuugugugcaacuauuuuuaaauguuuacauaccuuacauuucaaaggcauc

SEQ ID NO: 198966 - RNA, 62 nt, Homo Sapiens
acuguaaguccuguuugguuauuuuuaaauaauguuuacauaagaguauuuauguuggaaua

SEQ ID NO: 198967 - RNA, 62 nt, Homo Sapiens
auuuuagcaccucaagguauuguagaggaugauguuuacauauggcacuuguucuagagaag

SEQ ID NO: 198968 - RNA, 62 nt, Homo Sapiens
caaucagaauacggugguugagaaggaaccaguguuuacaaguaauaucagaaaguugaagg

SEQ ID NO: 198969 - RNA, 62 nt, Homo Sapiens
uacaaguaauaucagaaaguugaaggaaccaguguuuacaaguaauaccagaaaguugccaa

SEQ ID NO: 198970 - RNA, 62 nt, Homo Sapiens
agcauucaaucaggcugagcugaauguagugauguuuacauuguuuacauucuuuguacugu

SEQ ID NO: 198971 - RNA, 62 nt, Homo Sapiens
ucaggcugagcugaauguagugauguuuacauuguuuacauucuuuguacugucuuccugcu

SEQ ID NO: 198972 - RNA, 62 nt, Homo Sapiens
cuuucuuucuuucugccaacuuuguuuuccaguguuuacaaggugacaaauguuugacuuug

SEQ ID NO: 198973 - RNA, 62 nt, Homo Sapiens
cuuuagcacaggacaacuuuacaaaacaugauuguuuacagcugcucuuccccucuuuucug

SEQ ID NO: 198974 - RNA, 62 nt, Homo Sapiens
cccaggacuaaaaauggacaggcugaccucaguguuuacaaauucagaauuuugauaggggu

SEQ ID NO: 198975 - RNA, 62 nt, Homo Sapiens
agugcugggugcagcuccaucacccucuuguguguuuacaugucucuuucuaugauaagagg

SEQ ID NO: 198976 - RNA, 62 nt, Homo Sapiens
uaugccugucuagacaucaaauuguugguuauuguuuacaaucuagaaaugaugaagcucuu

SEQ ID NO: 198977 - RNA, 62 nt, Homo Sapiens
cuagggugauugugucuggagacccuuaauuauguuuacaaagacccauguuccaaguaagu

SEQ ID NO: 198978 - RNA, 62 nt, Homo Sapiens
auuugaugugcaauaggguguccccauagccauguuuacaugcucacugcuguucugggcca

SEQ ID NO: 198979 - RNA, 62 nt, Homo Sapiens
ucaaucugccucacugcuguugaucccaaaucuguuuacacagggugacugggucuagcccc

SEQ ID NO: 198980 - RNA, 62 nt, Homo Sapiens
uccccucuaccccgcuguauuccccuccccucuguuuacauccuuggggggucagggugcug

SEQ ID NO: 198981 - RNA, 62 nt, Homo Sapiens
guggaauugaccccuuccucuuuauuagcuuuuguuuacaccccagaggaagccucuauuua

SEQ ID NO: 198982 - RNA, 62 nt, Homo Sapiens
aacaauugagaugcuaacagggaggauuacaguguuuacagaacaaccuucagcgccgaccu

SEQ ID NO: 198983 - RNA, 62 nt, Homo Sapiens
agguagaauaaccgaguaugacaauucuuaauuguuuacauuuuauaacuuccuguccuuca

SEQ ID NO: 198984 - RNA, 62 nt, Homo Sapiens
cccuugcagggcuuugcagcugcucaucuguuuguuuacaguuuguucuuucccuccuuccc

SEQ ID NO: 198985 - RNA, 62 nt, Homo Sapiens
uuguguuuuacuugaccaaaaccaaguguauauguuuacauguuuuuauccuguuuagcuug

SEQ ID NO: 198986 - RNA, 62 nt, Homo Sapiens
auagcagaugcugcugcugacaacauagccaguguuuacagccuccuuccuugcaguguuua

SEQ ID NO: 198987 - RNA, 62 nt, Homo Sapiens
auagccaguguuuacagcauccuuccuugcaguguuuacaaccuggcccuuguuucuagccu

SEQ ID NO: 198988 - RNA, 62 nt, Homo Sapiens
uuaagcuaauuucuguaguccaggguuuaucauguuuacagaauguaguaaauguauguuua

SEQ ID NO: 198989 - RNA, 62 nt, Homo Sapiens
guuuaucauguuuacagauuguaguaaauguauguuuacaggcuuuacacuuguacaauuau

SEQ ID NO: 198990 - RNA, 62 nt, Homo Sapiens
gggcuugcgcugggccguggugggaggcacaguguuuacaggcucugguggcagagcaguug

SEQ ID NO: 198991 - RNA, 62 nt, Homo Sapiens
auauauauuuuuugcaacuuggauuuccaguuuguuuacagaguagucuuagguaguagcaa

SEQ ID NO: 198992 - RNA, 62 nt, Homo Sapiens
cuuugaaaggcauugugggucugucuuuaaaguguuuacaaaaaaaaauuauauaaaaaaaa

SEQ ID NO: 198993 - RNA, 62 nt, Homo Sapiens
agucuagugucgacugguguuuucccucgugauguuuacagcuugcuguuugcugcccagcc

SEQ ID NO: 198994 - RNA, 62 nt, Homo Sapiens
cugacugugcuuaaaaacacggaaugcugcacuguuuacaccugcucccacggaggggagca

SEQ ID NO: 198995 - RNA, 62 nt, Homo Sapiens
aaauggggagaaagucaccgcccuggcaauucuguuuacaugacauauccacgguaaccggu

SEQ ID NO: 198996 - RNA, 62 nt, Homo Sapiens
gacaauaaaauggcuuuuaauuauuuguuauuuguuuacacccuauuccucaguuauuauua

SEQ ID NO: 198997 - RNA, 62 nt, Homo Sapiens
caaaacuauuuguucaaagaacccguuaguguuguuuacaggguuacaguuucucucacaug

SEQ ID NO: 198998 - RNA, 62 nt, Homo Sapiens
guggagucggggcuugcugauaacuggaguccuguuuacaagaaccauuugguaccuggugu

SEQ ID NO: 198999 - RNA, 62 nt, Homo Sapiens
ccgugaauccauucccaucaugcagugaacacuguuuacacagcuguuagccuuagagugau

SEQ ID NO: 199000 - RNA, 62 nt, Homo Sapiens
guaguuuggauguacaauuaagguguguucuguguuuacacaaguucacaagcauaauuugg

SEQ ID NO: 199001 - RNA, 62 nt, Homo Sapiens
agacucacucaccaggauaagcauugguugacuguuuacagacuugguuuccauaacauaga

SEQ ID NO: 199002 - RNA, 62 nt, Homo Sapiens
gagcacuagaacauguuugguaauaguuaaaauguuuacauuaaggaaaauuaauaaaucau

SEQ ID NO: 199003 - RNA, 62 nt, Homo Sapiens
uucuucauaaauacaugcauuuucacaaccuauguuuacagauucuauaguaguuacaacaa

SEQ ID NO: 199004 - RNA, 62 nt, Homo Sapiens
uuauaggucuuuaaaaauuacuuuuauuauauuguuuacaaauauauuucaugcaagaaaca

SEQ ID NO: 199005 - RNA, 62 nt, Homo Sapiens
aagaugcuguacccacuugaacaguccucagguguuuacauaaauacuauguuuuacaguuu

SEQ ID NO: 199006 - RNA, 64 nt, Homo Sapiens
uuuaagaacuuauuaauaauaaauuauugugaacaauuuagaucuaagcauguuuuaucaugaa

SEQ ID NO: 199007 - RNA, 64 nt, Homo Sapiens
guaguuaaacucuuguuagucaggugauuuaguaaauuuagacaaaaaaguugcccuuccucca

SEQ ID NO: 199008 - RNA, 64 nt, Homo Sapiens
accaaguagauaauggaaccgcuccuucaucguaaauuuagaaggcaaccugagaaagagaacu

SEQ ID NO: 199009 - RNA, 64 nt, Homo Sapiens
caaaugacaagcgauaggcuaaaggaggcaaaagaauuuagaggauauccucuuauuguugauc

SEQ ID NO: 199010 - RNA, 64 nt, Homo Sapiens
ucugcauaagucugauucuauuucuaugacuuugaauuuagaaucacuuaaagcuuuuauaaag

SEQ ID NO: 199011 - RNA, 64 nt, Homo Sapiens
aacuauaaaauaugaaagcucuaaauuuaaaauaaauuuagagauagaaucaugguacauuauu

SEQ ID NO: 199012 - RNA, 64 nt, Homo Sapiens
uauuuugacauaaaguugauaaagauuuuuuaauaauuuagacuucaagcauggcuauuuuaua

SEQ ID NO: 199013 - RNA, 64 nt, Homo Sapiens
uuguuuuaucugaauuuuuaaacaaguauuuguuaauuuagaaaacuuuaaagcguuugcacag

SEQ ID NO: 199014 - RNA, 64 nt, Homo Sapiens
gcaagcauucagaagaaaaagaagcaaccucaguaauuuagaaaucauuuugcaaucccuuaau

SEQ ID NO: 199015 - RNA, 64 nt, Homo Sapiens
aucauuuauauuuauuuggagagaaaacuguccuaauuuagaauuucccucaaaucugagggac

SEQ ID NO: 199016 - RNA, 64 nt, Homo Sapiens
cuuuuaagaaaugcuaacagauuuuucuggaggaaauuuagacaaaacaaugucauuuaguaga

SEQ ID NO: 199017 - RNA, 64 nt, Homo Sapiens
ggguacuuagaggauaaagcuucguggucguauaaauuuagaucauuuggauugauuuuuauac

SEQ ID NO: 199018 - RNA, 64 nt, Homo Sapiens
uguuauucaguaguuuugcagacuuaaaaguguaaauuuagaauuagaagaugaagcuauagua

SEQ ID NO: 199019 - RNA, 64 nt, Homo Sapiens
caagcuacucauucacacaguauuaaauauuuggaauuuagauguaugauuucuaaagaaaacc

SEQ ID NO: 199020 - RNA, 64 nt, Homo Sapiens
gaagcuauugggcagaaacauuucuacugaaaacaauuuagaaaaggucuccauauacuauuuu

SEQ ID NO: 199021 - RNA, 64 nt, Homo Sapiens
ucauuguguuaaagagagcuuaaagacuaauagaaauuuagaaaaacuaaugucaucuuuucau

SEQ ID NO: 199022 - RNA, 64 nt, Homo Sapiens
ucuaucucuuguaagucacucccaugagcucuuaaauuuagauuuuuucuuccccaccccaacc

SEQ ID NO: 199023 - RNA, 64 nt, Homo Sapiens
uaauaaauuuaauuuuaccaauaaauauucccauaauuuagaaaaggaugucgacuugcuaauu

SEQ ID NO: 199024 - RNA, 64 nt, Homo Sapiens
cuaagaaaacugagaacuaacauuaaaaaaauuaaauuuagaauaagaaugauuucuuuaauuu

SEQ ID NO: 199025 - RNA, 64 nt, Homo Sapiens
uaaacuaccacuuuuuuuaaccauuauuaugcaaaauuuagaagaaaaguuauuggcaugguug

SEQ ID NO: 199026 - RNA, 64 nt, Homo Sapiens
uaaacuuguacauggaauuuuuugaauaugccuuaauuuagaaacugaaaaauaucugguuaua

SEQ ID NO: 199027 - RNA, 64 nt, Homo Sapiens
aaaaaaccaccccauuaaaaacguaauuuaaacaaauuuagaaggucugaaauccagcaucuau

SEQ ID NO: 199028 - RNA, 64 nt, Homo Sapiens
ugagaccacacaccuauaauggaacagaauagagaauuuagaaaaaaaacacacguagacugau

SEQ ID NO: 199029 - RNA, 64 nt, Homo Sapiens
uaagucgagcucaguggcucauaaaauaaaauaaaauuuagauuagagggagcauggccauaaa

SEQ ID NO: 199030 - RNA, 64 nt, Homo Sapiens
uauuagagggagcauggccaacuuauuuauuuaaaauuuagauuauaaacacaacaauacuugg

SEQ ID NO: 199031 - RNA, 64 nt, Homo Sapiens
auauuauuugucuuaaaaaaaucaucugcuaaguaauuuagaagagaaaggacuguggaccucu

SEQ ID NO: 199032 - RNA, 64 nt, Homo Sapiens
aagucaauguacuuguuugaucuaaacagacaggaauuuagaaaaguuuugaguaauucaagcc

SEQ ID NO: 199033 - RNA, 64 nt, Homo Sapiens
gaggucaucugcugucauggauuuuucaauaaugaauuuagaauacaccuguuagcuacaguua

SEQ ID NO: 199034 - RNA, 64 nt, Homo Sapiens
uaugauucuuuauuuuuacuuuuucauuucaagaaauuuagaguuuccaaauuuagagcuucug

SEQ ID NO: 199035 - RNA, 64 nt, Homo Sapiens
uuacuuuuucauuucaagaaauuuagaguuuccaaauuuagagcuucugcauacagucuuaaag

SEQ ID NO: 199036 - RNA, 64 nt, Homo Sapiens
aagaaaagagucuccuuucgaaugugaagaaguaaauuuagaggaaaucaaacaagcaucacuu

SEQ ID NO: 199037 - RNA, 64 nt, Homo Sapiens
ccgagaggcagggcaacuaauaacuggucagaaaaauuuagacggucuucauuuuaaaauuggc

SEQ ID NO: 199038 - RNA, 64 nt, Homo Sapiens
ccaguaugauuaaguugaaggauuaggguuacaaaauuuagagaguguaauuuuuucccuuuuu

SEQ ID NO: 199039 - RNA, 64 nt, Homo Sapiens
ccaucuaugagagaaaguucuagaaagucuucggaauuuagaacuacacuggcagcucuaugag

SEQ ID NO: 199040 - RNA, 64 nt, Homo Sapiens
ugaauguuuuucuguaccauugaagguauaaaauaauuuagaaggucaggaagacuaccuguca

SEQ ID NO: 199041 - RNA, 64 nt, Homo Sapiens
auuugggguuuuguuuguuugauuuuuaaaauagaauuuagaguagaauaauuguggguugaca

SEQ ID NO: 199042 - RNA, 64 nt, Homo Sapiens
agguacagucuggaucauggcauguagaaauagaaauuuagaauuuuacugcagcuuugaugug

SEQ ID NO: 199043 - RNA, 64 nt, Homo Sapiens
aacaacuagaaaggaaagugugacacaguuuuuaaauuuagauguagaaaauaaugaauuaaug

SEQ ID NO: 199044 - RNA, 64 nt, Homo Sapiens
ccuuaauaguauauacgugacugaaaacaccaaaaauuuagaugaguagcaguaaaauuauaua

SEQ ID NO: 199045 - RNA, 64 nt, Homo Sapiens
uugcuaagugaaauaaacuguauauauuucccucaauuuagaguuuuucuguguguucucagau

SEQ ID NO: 199046 - RNA, 64 nt, Homo Sapiens
aauauucaauacaauuguaauguagaaauauaagaauuuagaaaaaaguaaacuugccauuugg

SEQ ID NO: 199047 - RNA, 64 nt, Homo Sapiens
ucuaaacuucaaggcuugcucuaucuccuagagcaauuuagagcuaaaaccaguaauaagcaaa

SEQ ID NO: 199048 - RNA, 64 nt, Homo Sapiens
gaccucuaacacuccuguaaacgugaagugaugaaauuuagaauuuucuuuuuucuuuuauauu

SEQ ID NO: 199049 - RNA, 64 nt, Homo Sapiens
aacuagcucauuauuuccauugauuuaggucauuaauuuagauaccguaauuuugauacaucug

SEQ ID NO: 199050 - RNA, 64 nt, Homo Sapiens
agaaucauuaacaucaugaauaauuagcuugauuaauuuagauucagugcuuacugcgacacau

SEQ ID NO: 199051 - RNA, 64 nt, Homo Sapiens
uagaguuuucauauacuuacuuuucaaaggaaucaauuuagagaucuaugguucuuacagaaau

SEQ ID NO: 199052 - RNA, 64 nt, Homo Sapiens
aagucacucuguuaccauuucaaacucccuaauaaauuuagagauaaagcccaaacauuuguaa

SEQ ID NO: 199053 - RNA, 64 nt, Homo Sapiens
auaacuuuuauagagaaagguauaaaacaacauaaauuuagaccaaauguauauacaguugccu

SEQ ID NO: 199054 - RNA, 64 nt, Homo Sapiens
uaaaguucuuugauguauuugucucuaaaaaaguaauuuagauucacuaugcaaacuuacccca

SEQ ID NO: 199055 - RNA, 64 nt, Homo Sapiens
auacuugaaaagaggugaccauaaagaucacaccaauuuagaaugaauauuaaagucugagaaa

SEQ ID NO: 199056 - RNA, 64 nt, Homo Sapiens
aaucuuaaccuucaaauacauucuaaaucacuuuaauuuagaagauaggugagcaacuugagug

SEQ ID NO: 199057 - RNA, 64 nt, Homo Sapiens
ucugaaaauuggaaccacucuuuuuaaaaaauacaauuuagauccugaucucuaaucagaaaua

SEQ ID NO: 199058 - RNA, 64 nt, Homo Sapiens
guuucucacccugauccaucauggcugccuauagaauuuagacuaauuuccccuuuaaguuaug

SEQ ID NO: 199059 - RNA, 64 nt, Homo Sapiens
uucauuugcucagucggggaucacucaaaacuacuagacaaaaaagugagaggauagauuuaga

SEQ ID NO: 199060 - RNA, 64 nt, Homo Sapiens
gcaauucaaugucaauagacauuaagcaacauaauagacaaacaucuccuaagggaacauuugu

SEQ ID NO: 199061 - RNA, 64 nt, Homo Sapiens
uaaauaaagccugugagucaaggaaaugauacuguagacaaaugcuguacuaguucauuucaua

SEQ ID NO: 199062 - RNA, 64 nt, Homo Sapiens
aaacaaaaauauauguuuuuuuuaagauauuucauagacaaaccuuaaauaaaaauuacgacau

SEQ ID NO: 199063 - RNA, 64 nt, Homo Sapiens
uaggucacugaaagaacuugauuugaauuacguuuagacaaaaaugauuuaauuguaaauucuu

SEQ ID NO: 199064 - RNA, 64 nt, Homo Sapiens
ugcugauuguugcuugagaaauaauuacuaauucuagacaaaacucaauccuguaucuuccauc

SEQ ID NO: 199065 - RNA, 64 nt, Homo Sapiens
acauucuggggaaacaacauacagugcauaguuguagacaaaguuuagugugugcauaauagcu

SEQ ID NO: 199066 - RNA, 64 nt, Homo Sapiens
guauauuaaacaaaguuucacccauaugcagaaauagacaaaaaugggaauccaagauuggucu

SEQ ID NO: 199067 - RNA, 64 nt, Homo Sapiens
aaguaucagugcaaauuucucaaccuuucuggguuagacaaagauccuuuuuuguguguucuuu

SEQ ID NO: 199068 - RNA, 64 nt, Homo Sapiens
uuuuugggggaaagugcugcugauaugauacaaguagacaaaauuuaaaugaaauuuugucaca

SEQ ID NO: 199069 - RNA, 64 nt, Homo Sapiens
ugaguuacuguuggccuuucgggaaauaguggguuagacaaaguuucuguggccaaguaaguuu

SEQ ID NO: 199070 - RNA, 64 nt, Homo Sapiens
aacaaaagacaggaaaauaacagaacaaaauaaguagacaaaauaaaugugauagaagauuauu

SEQ ID NO: 199071 - RNA, 64 nt, Homo Sapiens
cagcagcaagucaauuguauuauuagacaaacaguagacaaauggcucuguuuauaauuguuaa

SEQ ID NO: 199072 - RNA, 64 nt, Homo Sapiens
guagacaaaugcagcagcaaauaauuguuaauauuagacaaacacuaguugcacugcucuguuu

SEQ ID NO: 199073 - RNA, 64 nt, Homo Sapiens
caaauacuuuguuuuuaguuaguucuaaaguauuuagacaaaucuacuugauacauuuauauca

SEQ ID NO: 199074 - RNA, 64 nt, Homo Sapiens
cuguguguguguguguguauucucuguuugccuauagacaaagaagcugaacucaccggccacu

SEQ ID NO: 199075 - RNA, 64 nt, Homo Sapiens
acucauauaucagucucucacauggccacaauucuagacaaaaaccaaagacccagaggccaga

SEQ ID NO: 199076 - RNA, 64 nt, Homo Sapiens
uguuacacauaguuuuugacuugaauuaaaauacuagacaaagcagaaauguacaauuucuggu

SEQ ID NO: 199077 - RNA, 64 nt, Homo Sapiens
caagaggaucagaugaagaaaagaaaauggacuuuagacaaaagauuaauugaggaaaucagcu

SEQ ID NO: 199078 - RNA, 64 nt, Homo Sapiens
caagagcaucagacaaaggaugaagauacagauuuagacaaagacauaaaaggaaaaagaguua

SEQ ID NO: 199079 - RNA, 64 nt, Homo Sapiens; identical to SEQ ID NO: 199006

SEQ ID NO: 199080 - RNA, 64 nt, Homo Sapiens; identical to SEQ ID NO: 199007

SEQ ID NO: 199081 - RNA, 64 nt, Homo Sapiens; identical to SEQ ID NO: 199008

SEQ ID NO: 199082 - RNA, 64 nt, Homo Sapiens; identical to SEQ ID NO: 199009

SEQ ID NO: 199083 - RNA, 64 nt, Homo Sapiens; identical to SEQ ID NO: 199010

SEQ ID NO: 199084 - RNA, 64 nt, Homo Sapiens; identical to SEQ ID NO: 199011

SEQ ID NO: 199085 - RNA, 64 nt, Homo Sapiens; identical to SEQ ID NO: 199012

SEQ ID NO: 199086 - RNA, 64 nt, Homo Sapiens; identical to SEQ ID NO: 199013

SEQ ID NO: 199087 - RNA, 64 nt, Homo Sapiens; identical to SEQ ID NO: 199014

SEQ ID NO: 199088 - RNA, 64 nt, Homo Sapiens; identical to SEQ ID NO: 199015

SEQ ID NO: 199089 - RNA, 64 nt, Homo Sapiens; identical to SEQ ID NO: 199016

SEQ ID NO: 199090 - RNA, 64 nt, Homo Sapiens; identical to SEQ ID NO: 199017

SEQ ID NO: 199091 - RNA, 64 nt, Homo Sapiens; identical to SEQ ID NO: 199018

SEQ ID NO: 199092 - RNA, 64 nt, Homo Sapiens; identical to SEQ ID NO: 199019

SEQ ID NO: 199093 - RNA, 64 nt, Homo Sapiens; identical to SEQ ID NO: 199020

SEQ ID NO: 199094 - RNA, 64 nt, Homo Sapiens; identical to SEQ ID NO: 199021

SEQ ID NO: 199095 - RNA, 64 nt, Homo Sapiens; identical to SEQ ID NO: 199022

SEQ ID NO: 199096 - RNA, 64 nt, Homo Sapiens; identical to SEQ ID NO: 199023

SEQ ID NO: 199097 - RNA, 64 nt, Homo Sapiens; identical to SEQ ID NO: 199024

SEQ ID NO: 199098 - RNA, 64 nt, Homo Sapiens; identical to SEQ ID NO: 199025

SEQ ID NO: 199099 - RNA, 64 nt, Homo Sapiens; identical to SEQ ID NO: 199026

SEQ ID NO: 199100 - RNA, 64 nt, Homo Sapiens; identical to SEQ ID NO: 199027

SEQ ID NO: 199101 - RNA, 64 nt, Homo Sapiens; identical to SEQ ID NO: 199028

SEQ ID NO: 199102 - RNA, 64 nt, Homo Sapiens; identical to SEQ ID NO: 199029

SEQ ID NO: 199103 - RNA, 64 nt, Homo Sapiens; identical to SEQ ID NO: 199030

SEQ ID NO: 199104 - RNA, 64 nt, Homo Sapiens; identical to SEQ ID NO: 199031

SEQ ID NO: 199105 - RNA, 64 nt, Homo Sapiens; identical to SEQ ID NO: 199032

SEQ ID NO: 199106 - RNA, 64 nt, Homo Sapiens; identical to SEQ ID NO: 199033

SEQ ID NO: 199107 - RNA, 64 nt, Homo Sapiens; identical to SEQ ID NO: 199034

SEQ ID NO: 199108 - RNA, 64 nt, Homo Sapiens; identical to SEQ ID NO: 199035

SEQ ID NO: 199109 - RNA, 64 nt, Homo Sapiens; identical to SEQ ID NO: 199036

SEQ ID NO: 199110 - RNA, 64 nt, Homo Sapiens; identical to SEQ ID NO: 199037

SEQ ID NO: 199111 - RNA, 64 nt, Homo Sapiens; identical to SEQ ID NO: 199038

SEQ ID NO: 199112 - RNA, 64 nt, Homo Sapiens; identical to SEQ ID NO: 199039

SEQ ID NO: 199113 - RNA, 64 nt, Homo Sapiens; identical to SEQ ID NO: 199040

SEQ ID NO: 199114 - RNA, 64 nt, Homo Sapiens; identical to SEQ ID NO: 199041

SEQ ID NO: 199115 - RNA, 64 nt, Homo Sapiens; identical to SEQ ID NO: 199042

SEQ ID NO: 199116 - RNA, 64 nt, Homo Sapiens; identical to SEQ ID NO: 199043

SEQ ID NO: 199117 - RNA, 64 nt, Homo Sapiens; identical to SEQ ID NO: 199044

SEQ ID NO: 199118 - RNA, 64 nt, Homo Sapiens; identical to SEQ ID NO: 199045

SEQ ID NO: 199119 - RNA, 64 nt, Homo Sapiens; identical to SEQ ID NO: 199046

SEQ ID NO: 199120 - RNA, 64 nt, Homo Sapiens; identical to SEQ ID NO: 199047

SEQ ID NO: 199121 - RNA, 64 nt, Homo Sapiens; identical to SEQ ID NO: 199048

SEQ ID NO: 199122 - RNA, 64 nt, Homo Sapiens; identical to SEQ ID NO: 199049

SEQ ID NO: 199123 - RNA, 64 nt, Homo Sapiens; identical to SEQ ID NO: 199050

SEQ ID NO: 199124 - RNA, 64 nt, Homo Sapiens; identical to SEQ ID NO: 199051

SEQ ID NO: 199125 - RNA, 64 nt, Homo Sapiens; identical to SEQ ID NO: 199052

SEQ ID NO: 199126 - RNA, 64 nt, Homo Sapiens; identical to SEQ ID NO: 199053

SEQ ID NO: 199127 - RNA, 64 nt, Homo Sapiens; identical to SEQ ID NO: 199054

SEQ ID NO: 199128 - RNA, 64 nt, Homo Sapiens; identical to SEQ ID NO: 199055

SEQ ID NO: 199129 - RNA, 64 nt, Homo Sapiens; identical to SEQ ID NO: 199056

SEQ ID NO: 199130 - RNA, 64 nt, Homo Sapiens; identical to SEQ ID NO: 199057

SEQ ID NO: 199131 - RNA, 64 nt, Homo Sapiens; identical to SEQ ID NO: 199058

SEQ ID NO: 199132 - RNA, 64 nt, Homo Sapiens; identical to SEQ ID NO: 199059

SEQ ID NO: 199133 - RNA, 64 nt, Homo Sapiens; identical to SEQ ID NO: 199060

SEQ ID NO: 199134 - RNA, 64 nt, Homo Sapiens; identical to SEQ ID NO: 199061

SEQ ID NO: 199135 - RNA, 64 nt, Homo Sapiens; identical to SEQ ID NO: 199062

SEQ ID NO: 199136 - RNA, 64 nt, Homo Sapiens; identical to SEQ ID NO: 199063

SEQ ID NO: 199137 - RNA, 64 nt, Homo Sapiens; identical to SEQ ID NO: 199064

SEQ ID NO: 199138 - RNA, 64 nt, Homo Sapiens; identical to SEQ ID NO: 199065

SEQ ID NO: 199139 - RNA, 64 nt, Homo Sapiens; identical to SEQ ID NO: 199066

SEQ ID NO: 199140 - RNA, 64 nt, Homo Sapiens; identical to SEQ ID NO: 199067

SEQ ID NO: 199141 - RNA, 64 nt, Homo Sapiens; identical to SEQ ID NO: 199068

SEQ ID NO: 199142 - RNA, 64 nt, Homo Sapiens; identical to SEQ ID NO: 199069

SEQ ID NO: 199143 - RNA, 64 nt, Homo Sapiens; identical to SEQ ID NO: 199070

SEQ ID NO: 199144 - RNA, 64 nt, Homo Sapiens; identical to SEQ ID NO: 199071

SEQ ID NO: 199145 - RNA, 64 nt, Homo Sapiens; identical to SEQ ID NO: 199072

SEQ ID NO: 199146 - RNA, 64 nt, Homo Sapiens; identical to SEQ ID NO: 199073

SEQ ID NO: 199147 - RNA, 64 nt, Homo Sapiens; identical to SEQ ID NO: 199074

SEQ ID NO: 199148 - RNA, 64 nt, Homo Sapiens; identical to SEQ ID NO: 199075

SEQ ID NO: 199149 - RNA, 64 nt, Homo Sapiens; identical to SEQ ID NO: 199076

SEQ ID NO: 199150 - RNA, 64 nt, Homo Sapiens; identical to SEQ ID NO: 199077

SEQ ID NO: 199151 - RNA, 64 nt, Homo Sapiens; identical to SEQ ID NO: 199078

SEQ ID NO: 199152 - RNA, 64 nt, Homo Sapiens; identical to SEQ ID NO: 199006

SEQ ID NO: 199153 - RNA, 64 nt, Homo Sapiens; identical to SEQ ID NO: 199007

SEQ ID NO: 199154 - RNA, 64 nt, Homo Sapiens; identical to SEQ ID NO: 199008

SEQ ID NO: 199155 - RNA, 64 nt, Homo Sapiens; identical to SEQ ID NO: 199009

SEQ ID NO: 199156 - RNA, 64 nt, Homo Sapiens; identical to SEQ ID NO: 199010

SEQ ID NO: 199157 - RNA, 64 nt, Homo Sapiens; identical to SEQ ID NO: 199011

SEQ ID NO: 199158 - RNA, 64 nt, Homo Sapiens; identical to SEQ ID NO: 199012

SEQ ID NO: 199159 - RNA, 64 nt, Homo Sapiens; identical to SEQ ID NO: 199013

SEQ ID NO: 199160 - RNA, 64 nt, Homo Sapiens; identical to SEQ ID NO: 199014

SEQ ID NO: 199161 - RNA, 64 nt, Homo Sapiens; identical to SEQ ID NO: 199015

SEQ ID NO: 199162 - RNA, 64 nt, Homo Sapiens; identical to SEQ ID NO: 199016

SEQ ID NO: 199163 - RNA, 64 nt, Homo Sapiens; identical to SEQ ID NO: 199017

SEQ ID NO: 199164 - RNA, 64 nt, Homo Sapiens; identical to SEQ ID NO: 199018

SEQ ID NO: 199165 - RNA, 64 nt, Homo Sapiens; identical to SEQ ID NO: 199019

SEQ ID NO: 199166 - RNA, 64 nt, Homo Sapiens; identical to SEQ ID NO: 199020

SEQ ID NO: 199167 - RNA, 64 nt, Homo Sapiens; identical to SEQ ID NO: 199021

SEQ ID NO: 199168 - RNA, 64 nt, Homo Sapiens; identical to SEQ ID NO: 199022

SEQ ID NO: 199169 - RNA, 64 nt, Homo Sapiens; identical to SEQ ID NO: 199023

SEQ ID NO: 199170 - RNA, 64 nt, Homo Sapiens; identical to SEQ ID NO: 199024

SEQ ID NO: 199171 - RNA, 64 nt, Homo Sapiens; identical to SEQ ID NO: 199025

SEQ ID NO: 199172 - RNA, 64 nt, Homo Sapiens; identical to SEQ ID NO: 199026

SEQ ID NO: 199173 - RNA, 64 nt, Homo Sapiens; identical to SEQ ID NO: 199027

SEQ ID NO: 199174 - RNA, 64 nt, Homo Sapiens; identical to SEQ ID NO: 199028

SEQ ID NO: 199175 - RNA, 64 nt, Homo Sapiens; identical to SEQ ID NO: 199029

SEQ ID NO: 199176 - RNA, 64 nt, Homo Sapiens; identical to SEQ ID NO: 199030

SEQ ID NO: 199177 - RNA, 64 nt, Homo Sapiens; identical to SEQ ID NO: 199031

SEQ ID NO: 199178 - RNA, 64 nt, Homo Sapiens; identical to SEQ ID NO: 199032

SEQ ID NO: 199179 - RNA, 64 nt, Homo Sapiens; identical to SEQ ID NO: 199033

SEQ ID NO: 199180 - RNA, 64 nt, Homo Sapiens; identical to SEQ ID NO: 199034

SEQ ID NO: 199181 - RNA, 64 nt, Homo Sapiens; identical to SEQ ID NO: 199035

SEQ ID NO: 199182 - RNA, 64 nt, Homo Sapiens; identical to SEQ ID NO: 199036

SEQ ID NO: 199183 - RNA, 64 nt, Homo Sapiens; identical to SEQ ID NO: 199037

SEQ ID NO: 199184 - RNA, 64 nt, Homo Sapiens; identical to SEQ ID NO: 199038

SEQ ID NO: 199185 - RNA, 64 nt, Homo Sapiens; identical to SEQ ID NO: 199039

SEQ ID NO: 199186 - RNA, 64 nt, Homo Sapiens; identical to SEQ ID NO: 199040

SEQ ID NO: 199187 - RNA, 64 nt, Homo Sapiens; identical to SEQ ID NO: 199041

SEQ ID NO: 199188 - RNA, 64 nt, Homo Sapiens; identical to SEQ ID NO: 199042

SEQ ID NO: 199189 - RNA, 64 nt, Homo Sapiens; identical to SEQ ID NO: 199043

SEQ ID NO: 199190 - RNA, 64 nt, Homo Sapiens; identical to SEQ ID NO: 199044

SEQ ID NO: 199191 - RNA, 64 nt, Homo Sapiens; identical to SEQ ID NO: 199045

SEQ ID NO: 199192 - RNA, 64 nt, Homo Sapiens; identical to SEQ ID NO: 199046

SEQ ID NO: 199193 - RNA, 64 nt, Homo Sapiens; identical to SEQ ID NO: 199047

SEQ ID NO: 199194 - RNA, 64 nt, Homo Sapiens; identical to SEQ ID NO: 199048

SEQ ID NO: 199195 - RNA, 64 nt, Homo Sapiens; identical to SEQ ID NO: 199049

SEQ ID NO: 199196 - RNA, 64 nt, Homo Sapiens; identical to SEQ ID NO: 199050

SEQ ID NO: 199197 - RNA, 64 nt, Homo Sapiens; identical to SEQ ID NO: 199051

SEQ ID NO: 199198 - RNA, 64 nt, Homo Sapiens; identical to SEQ ID NO: 199052

SEQ ID NO: 199199 - RNA, 64 nt, Homo Sapiens; identical to SEQ ID NO: 199053

SEQ ID NO: 199200 - RNA, 64 nt, Homo Sapiens; identical to SEQ ID NO: 199054

SEQ ID NO: 199201 - RNA, 64 nt, Homo Sapiens; identical to SEQ ID NO: 199055

SEQ ID NO: 199202 - RNA, 64 nt, Homo Sapiens; identical to SEQ ID NO: 199056

SEQ ID NO: 199203 - RNA, 64 nt, Homo Sapiens; identical to SEQ ID NO: 199057

SEQ ID NO: 199204 - RNA, 64 nt, Homo Sapiens; identical to SEQ ID NO: 199058

SEQ ID NO: 199205 - RNA, 64 nt, Homo Sapiens; identical to SEQ ID NO: 199059

SEQ ID NO: 199206 - RNA, 64 nt, Homo Sapiens; identical to SEQ ID NO: 199060

SEQ ID NO: 199207 - RNA, 64 nt, Homo Sapiens; identical to SEQ ID NO: 199061

SEQ ID NO: 199208 - RNA, 64 nt, Homo Sapiens; identical to SEQ ID NO: 199062

SEQ ID NO: 199209 - RNA, 64 nt, Homo Sapiens; identical to SEQ ID NO: 199063

SEQ ID NO: 199210 - RNA, 64 nt, Homo Sapiens; identical to SEQ ID NO: 199064

SEQ ID NO: 199211 - RNA, 64 nt, Homo Sapiens; identical to SEQ ID NO: 199065

SEQ ID NO: 199212 - RNA, 64 nt, Homo Sapiens; identical to SEQ ID NO: 199066

SEQ ID NO: 199213 - RNA, 64 nt, Homo Sapiens; identical to SEQ ID NO: 199067

SEQ ID NO: 199214 - RNA, 64 nt, Homo Sapiens; identical to SEQ ID NO: 199068

SEQ ID NO: 199215 - RNA, 64 nt, Homo Sapiens; identical to SEQ ID NO: 199069

SEQ ID NO: 199216 - RNA, 64 nt, Homo Sapiens; identical to SEQ ID NO: 199070

SEQ ID NO: 199217 - RNA, 64 nt, Homo Sapiens; identical to SEQ ID NO: 199071

SEQ ID NO: 199218 - RNA, 64 nt, Homo Sapiens; identical to SEQ ID NO: 199072

SEQ ID NO: 199219 - RNA, 64 nt, Homo Sapiens; identical to SEQ ID NO: 199073

SEQ ID NO: 199220 - RNA, 64 nt, Homo Sapiens; identical to SEQ ID NO: 199074

SEQ ID NO: 199221 - RNA, 64 nt, Homo Sapiens; identical to SEQ ID NO: 199075

SEQ ID NO: 199222 - RNA, 64 nt, Homo Sapiens; identical to SEQ ID NO: 199076

SEQ ID NO: 199223 - RNA, 64 nt, Homo Sapiens; identical to SEQ ID NO: 199077

SEQ ID NO: 199224 - RNA, 64 nt, Homo Sapiens; identical to SEQ ID NO: 199078

SEQ ID NO: 199225 - RNA, 64 nt, Homo Sapiens; identical to SEQ ID NO: 199006

SEQ ID NO: 199226 - RNA, 64 nt, Homo Sapiens; identical to SEQ ID NO: 199007

SEQ ID NO: 199227 - RNA, 64 nt, Homo Sapiens; identical to SEQ ID NO: 199008

SEQ ID NO: 199228 - RNA, 64 nt, Homo Sapiens; identical to SEQ ID NO: 199009

SEQ ID NO: 199229 - RNA, 64 nt, Homo Sapiens; identical to SEQ ID NO: 199010

SEQ ID NO: 199230 - RNA, 64 nt, Homo Sapiens; identical to SEQ ID NO: 199011

SEQ ID NO: 199231 - RNA, 64 nt, Homo Sapiens; identical to SEQ ID NO: 199012

SEQ ID NO: 199232 - RNA, 64 nt, Homo Sapiens; identical to SEQ ID NO: 199013

SEQ ID NO: 199233 - RNA, 64 nt, Homo Sapiens; identical to SEQ ID NO: 199014

SEQ ID NO: 199234 - RNA, 64 nt, Homo Sapiens; identical to SEQ ID NO: 199015

SEQ ID NO: 199235 - RNA, 64 nt, Homo Sapiens; identical to SEQ ID NO: 199016

SEQ ID NO: 199236 - RNA, 64 nt, Homo Sapiens; identical to SEQ ID NO: 199017

SEQ ID NO: 199237 - RNA, 64 nt, Homo Sapiens; identical to SEQ ID NO: 199018

SEQ ID NO: 199238 - RNA, 64 nt, Homo Sapiens; identical to SEQ ID NO: 199019

SEQ ID NO: 199239 - RNA, 64 nt, Homo Sapiens; identical to SEQ ID NO: 199020

SEQ ID NO: 199240 - RNA, 64 nt, Homo Sapiens; identical to SEQ ID NO: 199021

SEQ ID NO: 199241 - RNA, 64 nt, Homo Sapiens; identical to SEQ ID NO: 199022

SEQ ID NO: 199242 - RNA, 64 nt, Homo Sapiens; identical to SEQ ID NO: 199023

SEQ ID NO: 199243 - RNA, 64 nt, Homo Sapiens; identical to SEQ ID NO: 199024

SEQ ID NO: 199244 - RNA, 64 nt, Homo Sapiens; identical to SEQ ID NO: 199025

SEQ ID NO: 199245 - RNA, 64 nt, Homo Sapiens; identical to SEQ ID NO: 199026

SEQ ID NO: 199246 - RNA, 64 nt, Homo Sapiens; identical to SEQ ID NO: 199027

SEQ ID NO: 199247 - RNA, 64 nt, Homo Sapiens; identical to SEQ ID NO: 199028

SEQ ID NO: 199248 - RNA, 64 nt, Homo Sapiens; identical to SEQ ID NO: 199029

SEQ ID NO: 199249 - RNA, 64 nt, Homo Sapiens; identical to SEQ ID NO: 199030

SEQ ID NO: 199250 - RNA, 64 nt, Homo Sapiens; identical to SEQ ID NO: 199031

SEQ ID NO: 199251 - RNA, 64 nt, Homo Sapiens; identical to SEQ ID NO: 199032

SEQ ID NO: 199252 - RNA, 64 nt, Homo Sapiens; identical to SEQ ID NO: 199033

SEQ ID NO: 199253 - RNA, 64 nt, Homo Sapiens; identical to SEQ ID NO: 199034

SEQ ID NO: 199254 - RNA, 64 nt, Homo Sapiens; identical to SEQ ID NO: 199035

SEQ ID NO: 199255 - RNA, 64 nt, Homo Sapiens; identical to SEQ ID NO: 199036

SEQ ID NO: 199256 - RNA, 64 nt, Homo Sapiens; identical to SEQ ID NO: 199037

SEQ ID NO: 199257 - RNA, 64 nt, Homo Sapiens; identical to SEQ ID NO: 199038

SEQ ID NO: 199258 - RNA, 64 nt, Homo Sapiens; identical to SEQ ID NO: 199039

SEQ ID NO: 199259 - RNA, 64 nt, Homo Sapiens; identical to SEQ ID NO: 199040

SEQ ID NO: 199260 - RNA, 64 nt, Homo Sapiens; identical to SEQ ID NO: 199041

SEQ ID NO: 199261 - RNA, 64 nt, Homo Sapiens; identical to SEQ ID NO: 199042

SEQ ID NO: 199262 - RNA, 64 nt, Homo Sapiens; identical to SEQ ID NO: 199043

SEQ ID NO: 199263 - RNA, 64 nt, Homo Sapiens; identical to SEQ ID NO: 199044

SEQ ID NO: 199264 - RNA, 64 nt, Homo Sapiens; identical to SEQ ID NO: 199045

SEQ ID NO: 199265 - RNA, 64 nt, Homo Sapiens; identical to SEQ ID NO: 199046

SEQ ID NO: 199266 - RNA, 64 nt, Homo Sapiens; identical to SEQ ID NO: 199047

SEQ ID NO: 199267 - RNA, 64 nt, Homo Sapiens; identical to SEQ ID NO: 199048

SEQ ID NO: 199268 - RNA, 64 nt, Homo Sapiens; identical to SEQ ID NO: 199049

SEQ ID NO: 199269 - RNA, 64 nt, Homo Sapiens; identical to SEQ ID NO: 199050

SEQ ID NO: 199270 - RNA, 64 nt, Homo Sapiens; identical to SEQ ID NO: 199051

SEQ ID NO: 199271 - RNA, 64 nt, Homo Sapiens; identical to SEQ ID NO: 199052

SEQ ID NO: 199272 - RNA, 64 nt, Homo Sapiens; identical to SEQ ID NO: 199053

SEQ ID NO: 199273 - RNA, 64 nt, Homo Sapiens; identical to SEQ ID NO: 199054

SEQ ID NO: 199274 - RNA, 64 nt, Homo Sapiens; identical to SEQ ID NO: 199055

SEQ ID NO: 199275 - RNA, 64 nt, Homo Sapiens; identical to SEQ ID NO: 199056

SEQ ID NO: 199276 - RNA, 64 nt, Homo Sapiens; identical to SEQ ID NO: 199057

SEQ ID NO: 199277 - RNA, 64 nt, Homo Sapiens; identical to SEQ ID NO: 199058

SEQ ID NO: 199278 - RNA, 64 nt, Homo Sapiens; identical to SEQ ID NO: 199059

SEQ ID NO: 199279 - RNA, 64 nt, Homo Sapiens; identical to SEQ ID NO: 199060

SEQ ID NO: 199280 - RNA, 64 nt, Homo Sapiens; identical to SEQ ID NO: 199061

SEQ ID NO: 199281 - RNA, 64 nt, Homo Sapiens; identical to SEQ ID NO: 199062

SEQ ID NO: 199282 - RNA, 64 nt, Homo Sapiens; identical to SEQ ID NO: 199063

SEQ ID NO: 199283 - RNA, 64 nt, Homo Sapiens; identical to SEQ ID NO: 199064

SEQ ID NO: 199284 - RNA, 64 nt, Homo Sapiens; identical to SEQ ID NO: 199065

SEQ ID NO: 199285 - RNA, 64 nt, Homo Sapiens; identical to SEQ ID NO: 199066

SEQ ID NO: 199286 - RNA, 64 nt, Homo Sapiens; identical to SEQ ID NO: 199067

SEQ ID NO: 199287 - RNA, 64 nt, Homo Sapiens; identical to SEQ ID NO: 199068

SEQ ID NO: 199288 - RNA, 64 nt, Homo Sapiens; identical to SEQ ID NO: 199069

SEQ ID NO: 199289 - RNA, 64 nt, Homo Sapiens; identical to SEQ ID NO: 199070

SEQ ID NO: 199290 - RNA, 64 nt, Homo Sapiens; identical to SEQ ID NO: 199071

SEQ ID NO: 199291 - RNA, 64 nt, Homo Sapiens; identical to SEQ ID NO: 199072

SEQ ID NO: 199292 - RNA, 64 nt, Homo Sapiens; identical to SEQ ID NO: 199073

SEQ ID NO: 199293 - RNA, 64 nt, Homo Sapiens; identical to SEQ ID NO: 199074

SEQ ID NO: 199294 - RNA, 64 nt, Homo Sapiens; identical to SEQ ID NO: 199075

SEQ ID NO: 199295 - RNA, 64 nt, Homo Sapiens; identical to SEQ ID NO: 199076

SEQ ID NO: 199296 - RNA, 64 nt, Homo Sapiens; identical to SEQ ID NO: 199077

SEQ ID NO: 199297 - RNA, 64 nt, Homo Sapiens; identical to SEQ ID NO: 199078

SEQ ID NO: 199298 - RNA, 64 nt, Homo Sapiens
gaucccuccccaacccacuccauauuugggucauggacaguaaaggcaguuggauucucauaga

SEQ ID NO: 199299 - RNA, 64 nt, Homo Sapiens
ccucaugggcauugucucuguuucccagugggguggacaguauaucagauggucagaacaaaua

SEQ ID NO: 199300 - RNA, 64 nt, Homo Sapiens
ucuacuucuuuuuccagggaaauuuaaugguuagggacaguaaaacauuauuugaaagacuggg

SEQ ID NO: 199301 - RNA, 64 nt, Homo Sapiens
ggauccuuucucguacagaagaaucuagugcgugggacaguaaaaaguuacacguaaaguagaa

SEQ ID NO: 199302 - RNA, 64 nt, Homo Sapiens
gacacacacacagccaggaguggguagauuucagggagacaagagggaauaguauagacaauaa

SEQ ID NO: 199303 - RNA, 64 nt, Homo Sapiens
aggauacgcugcucucauacuugggcuguaguuuggagacaaaauauuuuccugccacugugua

SEQ ID NO: 199304 - RNA, 64 nt, Homo Sapiens
aaaaagugaaggcuggguuuuuccccucuaaucuggagacaagcugcugcucucguacuaacug

SEQ ID NO: 199305 - RNA, 64 nt, Homo Sapiens
augaaugacaaugagauaacauacagaugucaguggagacaaaguuguggguuccuccucccac

SEQ ID NO: 199306 - RNA, 64 nt, Homo Sapiens
agggaguaagucguaggaguauggaggaguggguggagacaaggaaauucccaacucgguucuc

SEQ ID NO: 199307 - RNA, 64 nt, Homo Sapiens
ccuuugagccccacccuuguguuuguguugucguggagacaaggagucugugccugaagucugu

SEQ ID NO: 199308 - RNA, 64 nt, Homo Sapiens
caccugcagagguccccagacccaaagcaggacgggagacaacugcuuggaggagcgaagagcc

SEQ ID NO: 199309 - RNA, 64 nt, Homo Sapiens
gcugauucacaggaggaggggagguuggggggcgggagacaaaaaccacaccucuuuuuauaua

SEQ ID NO: 199310 - RNA, 64 nt, Homo Sapiens
agaggcaucgcauggacguucucuggucuguaguggagacaagcaguuaaccuagcaccauccu

SEQ ID NO: 199311 - RNA, 64 nt, Homo Sapiens
ucccuccacccacccuuccauauccucuggagcaggagacaaugugggugcccagaagugcccu

SEQ ID NO: 199312 - RNA, 64 nt, Homo Sapiens; identical to SEQ ID NO: 115857

SEQ ID NO: 199313 - RNA, 64 nt, Homo Sapiens; identical to SEQ ID NO: 115858

SEQ ID NO: 199314 - RNA, 64 nt, Homo Sapiens; identical to SEQ ID NO: 115859

SEQ ID NO: 199315 - RNA, 64 nt, Homo Sapiens; identical to SEQ ID NO: 115860

SEQ ID NO: 199316 - RNA, 64 nt, Homo Sapiens
ucuuuggauuugggguggggguccuggccaagaacucagucauuuuucuguguaccagguugcc

SEQ ID NO: 199317 - RNA, 64 nt, Homo Sapiens
ugaguggaaauaacugcauuauggcugcuuuaaccucagucaucaaaagaaacuugcuguuuuu

SEQ ID NO: 199318 - RNA, 64 nt, Homo Sapiens
caguccugccccccaggagcacaagcaggguccccucagucaaggcagugggaugggcggcuga

SEQ ID NO: 199319 - RNA, 64 nt, Homo Sapiens
gggcggcugaggaacggggcaggcaaggucacugcucagucacguccacgggggacgagccgug

SEQ ID NO: 199320 - RNA, 64 nt, Homo Sapiens
ccugggcccccacugccaggcugggcccagcuugcucagucaaggggcugccaggcccccagaa

SEQ ID NO: 199321 - RNA, 64 nt, Homo Sapiens
auuugucccccacucaaauuaucaaagcuuucugcucagucaguuguguggggauggugaggga

SEQ ID NO: 199322 - RNA, 64 nt, Homo Sapiens
ccccguagccuagagcaguggcauuucucugcuccucagucaacgaaguguucccuaaggaaca

SEQ ID NO: 199323 - RNA, 64 nt, Homo Sapiens
caaccacagucuguuaaucagcauauuuuguggacucagucaaggucacugugguaggcauuug

SEQ ID NO: 199324 - RNA, 64 nt, Homo Sapiens
auugagacaauucuauuuuucauauacucguugcucauuaaauaguaaaggguugauuugcugc

SEQ ID NO: 199325 - RNA, 64 nt, Homo Sapiens
ggucuuuacuagugcuaaguauuauggugagcuaucauuaaagugugccaucuuggauaaaggc

SEQ ID NO: 199326 - RNA, 64 nt, Homo Sapiens
aauuagguuuuguacaauugaacuuaaauaaaugucauuaaaauaaauaaaugcaauauguauu

SEQ ID NO: 199327 - RNA, 64 nt, Homo Sapiens
gcauaguucccauguuaaaucccauucauaacuuucauuaaagcauuuacuuugaauuucucca

SEQ ID NO: 199328 - RNA, 64 nt, Homo Sapiens
caccauugcuuucuguacugauuugaaagaaguuucauuaaaagcacagcuagcauguucacag

SEQ ID NO: 199329 - RNA, 64 nt, Homo Sapiens
uaacuacuaaggaaagguuaaauucuucuucaguucauuaaaagcacuaggccuuugaugcuuu

SEQ ID NO: 199330 - RNA, 64 nt, Homo Sapiens
ugacauuagcauugugguuuagcucauuauaaugucauuaaacaaaaugucccuaauuuaaccc

SEQ ID NO: 199331 - RNA, 64 nt, Homo Sapiens
uaauagagccccacuugacaggacaauugcuuacucauuaaaaaugggcuagccaauagaguug

SEQ ID NO: 199332 - RNA, 64 nt, Homo Sapiens
gcauaaaagucuuccucuuguaauuucaugguauucauuaaaaaccuaacuuaguaaaguagaa

SEQ ID NO: 199333 - RNA, 64 nt, Homo Sapiens
auuugguuugguggagugaggcaauuuuucuaaaucauuaaauuguuuagugauacaaaugauu

SEQ ID NO: 199334 - RNA, 64 nt, Homo Sapiens
ugacgggcaaggguuuucucugccugugggucuuucauuaaaggagacauccccaaagcuuguc

SEQ ID NO: 199335 - RNA, 64 nt, Homo Sapiens
cccaguuuccuggucauuucgcaucacaccuucuucauuaaaaauguguguacaguguccacag

SEQ ID NO: 199336 - RNA, 64 nt, Homo Sapiens
uuuuaugcuaauucugcuuauuuuagaguauuuuucauuaaaaggugagcaaagugaaagauac

SEQ ID NO: 199337 - RNA, 64 nt, Homo Sapiens
uugauguagaguagggcaaaucuguguguguaugucauuaaaaaaauucuaccaucuuucuuua

SEQ ID NO: 199338 - RNA, 64 nt, Homo Sapiens
ugaaggauuauuaagcaaccuuaaagcaauaaguucauuaaacagaagguaauaggaagaacag

SEQ ID NO: 199339 - RNA, 64 nt, Homo Sapiens
acauuugaugucuagauaacauucaugagauuggucauuaaauacuauuuugcuccuuuucugg

SEQ ID NO: 199340 - RNA, 64 nt, Homo Sapiens
uaauugucucaaagcaucaaauaauacaucuuuaucauuaaacaugaauuuaaugucuaggaua

SEQ ID NO: 199341 - RNA, 64 nt, Homo Sapiens
guauugauugaaaaaagagaaaggggcaagaaauucauuaaagaaaaaccacagauacugaaac

SEQ ID NO: 199342 - RNA, 64 nt, Homo Sapiens
guuauguuguucuccuugcauauugaagacagcaucauuaaacaauaaacagaauuagguagua

SEQ ID NO: 199343 - RNA, 64 nt, Homo Sapiens
aucuugaagggaguagggagcaagguaacugaauucauuaaaaaaaauuuuuuucucacagugu

SEQ ID NO: 199344 - RNA, 64 nt, Homo Sapiens
ucacugcugcuucaaaggacagguuccauuuagcucauuaaaggcuagguuugcguuuauaguc

SEQ ID NO: 199345 - RNA, 64 nt, Homo Sapiens
cuauaaaggguugagcugucucuaagaccucugaucauuaaaaccauggaccuauguauauaua

SEQ ID NO: 199346 - RNA, 64 nt, Homo Sapiens
gaaaggaguagcuuugacauagcagccauggcagucauuaaagagcauagcccuucucuaugua

SEQ ID NO: 199347 - RNA, 64 nt, Homo Sapiens
aacauugaugagagaagaugguuuauuucacuuuucauuaaaugcagcaucugauaaucuguug

SEQ ID NO: 199348 - RNA, 64 nt, Homo Sapiens
gugguaaauugcucaauguacuucauugugauugucauuaaaaauucagucugaugguucuguu

SEQ ID NO: 199349 - RNA, 64 nt, Homo Sapiens
ggaaauuguaucaggacccauucuuucuagcucaucauuaaaaaucuagaggaugugaucuaau

SEQ ID NO: 199350 - RNA, 64 nt, Homo Sapiens
cagggggaagaaaggagggcugugaggagauaccucauuaaacuuggcuuagugaagaagagag

SEQ ID NO: 199351 - RNA, 64 nt, Homo Sapiens
cccacucucagccugggagacuccugccaagcccucauuaaagaugccacccugggcugcccug

SEQ ID NO: 199352 - RNA, 64 nt, Homo Sapiens
caugauaacugguaccuuaucuacuguaaauauuucauuaaaaaugaugcacacauagauauau

SEQ ID NO: 199353 - RNA, 64 nt, Homo Sapiens
uuuuaauguuuuauuggcaacguaugcugcuuuuucauuaaaauaugcuauuaaaauuaaaugg

SEQ ID NO: 199354 - RNA, 64 nt, Homo Sapiens
ugaaacuaaaucuguguucaaagaugaagaccccucauuaaaagccaaggacguucuuaagauu

SEQ ID NO: 199355 - RNA, 64 nt, Homo Sapiens
agauuggaacugacauaauuagucuugacuuacuucauuaaagcaagauucaauuccuuguuca

SEQ ID NO: 199356 - RNA, 64 nt, Homo Sapiens
aauugucuauuaaaugcaaggaguaaaguuaguaucauuaaacaugagaaagucaauuaagugu

SEQ ID NO: 199357 - RNA, 64 nt, Homo Sapiens
caugaauuuagaauugauuugcaaaacauaguauucauuaaagagaucaguuuuuauacagguu

SEQ ID NO: 199358 - RNA, 64 nt, Homo Sapiens
uggaauuucaguauacuguacuauccuuuauaagucauuaaaauaauguuucaucaaaugguua

SEQ ID NO: 199359 - RNA, 64 nt, Homo Sapiens
uuguacagagguuacugcaauaaaggaaguggauucauuaaaccuauuuaauguccauucuuau

SEQ ID NO: 199360 - RNA, 64 nt, Homo Sapiens
auaacacuugaaaaccaauuuaguuguuagucauucauuaaacauuaacaucacuaucauuuau

SEQ ID NO: 199361 - RNA, 64 nt, Homo Sapiens
uucuuucaaaacuugaguggucucugagcuccugucauuaaaccuaucuauaucugucuaucag

SEQ ID NO: 199362 - RNA, 64 nt, Homo Sapiens
caauguugaacugcuuuuucuaacauuaaaauguucauuaaaauucauaauguucuguuauaca

SEQ ID NO: 199363 - RNA, 64 nt, Homo Sapiens
uggaugaucaguuuuuuauaguccauauaugaaaucauuaaaguccuuuuacuaccacucuuga

SEQ ID NO: 199364 - RNA, 64 nt, Homo Sapiens
uacacccucuacuugggcuuuguaagcaaaguagucauuaaaaagacauuugcacaaucuaaaa

SEQ ID NO: 199365 - RNA, 64 nt, Homo Sapiens
ucucagcaguggguuucuuggagagugaggauuuucauuaaaagaacuaaaaauacgaggaaag

SEQ ID NO: 199366 - RNA, 64 nt, Homo Sapiens
cagcucaaaggggguuuaaaacaaagcaacugggucauuaaaacucuaaauaaauggcuuucaa

SEQ ID NO: 199367 - RNA, 64 nt, Homo Sapiens
uuuagaucucuguuuucauaaggcuauuuuuaaaucauuaaauucuuugccgucuuguauguag

SEQ ID NO: 199368 - RNA, 64 nt, Homo Sapiens
aaaaaccaugaauuacgaaguugucugaugcauuucauuaaaaaucauguuuguuuguagaugu

SEQ ID NO: 199369 - RNA, 64 nt, Homo Sapiens
uuaugagaacugguucuugccuuccccuugaaccucauuaaauggugauuucuugcuaagcucc

SEQ ID NO: 199370 - RNA, 64 nt, Homo Sapiens
aucauguaccaagugcuuggcacauagugggccuucauuaaauguuuguugaauaaaagaggga

SEQ ID NO: 199371 - RNA, 64 nt, Homo Sapiens
ugcauagaauaaugaagaucuuuguuuuuuguuuucauuaaagagccauucuggcacuuuaaug

SEQ ID NO: 199372 - RNA, 64 nt, Homo Sapiens
auuuugagaacauucccuggaauugccacauaauucauuaaaaacauuuuuuuaagcaacacuu

SEQ ID NO: 199373 - RNA, 64 nt, Homo Sapiens
aguugggagaacaaauaggacagauuaacuuauuucauuaaagacaagcuacuggaugcacugu

SEQ ID NO: 199374 - RNA, 64 nt, Homo Sapiens
uauacagauuuaguuaaguaaccagccaaucccuucauuaaauggacugacaguugguauaugu

SEQ ID NO: 199375 - RNA, 64 nt, Homo Sapiens
ugcuuucugaacucuaaugugccuucauugauuaucauuaaaauuaucauuaaaauugccuuau

SEQ ID NO: 199376 - RNA, 64 nt, Homo Sapiens
ucuaaugugccuucauugauuaucauuaaaauuaucauuaaaauugccuuauuucuauggacuc

SEQ ID NO: 199377 - RNA, 64 nt, Homo Sapiens
uuucucauaguucagaaaaaaggugcuuuauguaucauuaaauucagaggacuugcuauuugcc

SEQ ID NO: 199378 - RNA, 64 nt, Homo Sapiens
uaguucuaucauuugguacucuaucauuaauuuaucauuaaauuuuuuccuuuuaaauuuaguu

SEQ ID NO: 199379 - RNA, 64 nt, Homo Sapiens
auguggauuuauugauguguuagaacggaugguuucauuaaagaaccuaacauaugucucuacc

SEQ ID NO: 199380 - RNA, 64 nt, Homo Sapiens
gauugcugggagcaaaaacucagaggacugugucucauuaaaguuacagaucagaauguggcac

SEQ ID NO: 199381 - RNA, 64 nt, Homo Sapiens
ggcacuuuggcauaccgaaaaaacaugaaauuuuucauuaaaaugccaugaaucaagccagggc

SEQ ID NO: 199382 - RNA, 64 nt, Homo Sapiens
uuucauguaauuuacccuuugcaauaaaaaugauucauuaaauauauaacuaaaugugauuugg

SEQ ID NO: 199383 - RNA, 64 nt, Homo Sapiens
aaauguauugugguuuaugcuugggaauaaucauucauuaaaaaguuucuuuucugguuuuagu

SEQ ID NO: 199384 - RNA, 64 nt, Homo Sapiens
ggcaacuacagccaaaaucagagcccccauuuguucauuaaagaucauaauacaaggaaccuca

SEQ ID NO: 199385 - RNA, 64 nt, Homo Sapiens
cuaauugauuguuuaaaagaguacagacacuaauucauuaaauacaacuaccuuauuuuucacu

SEQ ID NO: 199386 - RNA, 64 nt, Homo Sapiens
aaaaugaaacauuugccaaaauauuggaccgaagucauuaaaaccacuguauuucauuuucuuu

SEQ ID NO: 199387 - RNA, 64 nt, Homo Sapiens
cuuuuuugaauauugcaggguucagucuagauugucauuaaauugaagagucuacauucagaac

SEQ ID NO: 199388 - RNA, 62 nt, Homo Sapiens
uauccuaagcacaaaauaaaccuuucuaaccacuucauuaaagcugaagaccaguaugauuu

SEQ ID NO: 199389 - RNA, 64 nt, Homo Sapiens
agcauuuauuuaagggcuuuuucuuaaauaagaaucauuaaagucauuaaaaaaauuuacugaa

SEQ ID NO: 199390 - RNA, 64 nt, Homo Sapiens
uuaagggcuuuuucuuaaauaagaaucauuaaagucauuaaaaaaauuuacugaaaugcccauc

SEQ ID NO: 199391 - RNA, 64 nt, Homo Sapiens
acuacauuucugaauuuuugaaaaauguauuuuaucauuaaauggcauuauuuuaaagggugaa

SEQ ID NO: 199392 - RNA, 64 nt, Homo Sapiens
ggaguguguuuaaauuguuacaaacaauaaugcgucauuaaaggccaugcugaucuugcauaac

SEQ ID NO: 199393 - RNA, 64 nt, Homo Sapiens
aauaucuggcaaauuaaaaagucuuuuauaauucucauuaaaagguuugcaaaaaauguuuuug

SEQ ID NO: 199394 - RNA, 64 nt, Homo Sapiens
aauuugacuuuucuguaauuuuaauuuuaguuuuucauuaaauauguguauuugcuaauuuuua

SEQ ID NO: 199395 - RNA, 64 nt, Homo Sapiens
auaugcuguauuucuuuguagaauaaaugguuucucauuaaacucuaaagauuagggaaaaugg

SEQ ID NO: 199396 - RNA, 64 nt, Homo Sapiens
guccuucagcugacuccaguauaaucuccucugcucauuaaacugauuccaggagauuggauuu

SEQ ID NO: 199397 - RNA, 64 nt, Homo Sapiens
aaaaaaauaaaucuugcucuauacaccuuuuugaucauuaaaauaguuuucauagugcuuucaa

SEQ ID NO: 199398 - RNA, 64 nt, Homo Sapiens
uuuucagaaaaucuugagguauaagcaucaguugucauuaaaaguauauacccagucauaaagu

SEQ ID NO: 199399 - RNA, 64 nt, Homo Sapiens
uauuaauguauauaugaaaauagauacaaagaaaucauuaaaauaaaauauuaccuaaauuggu

SEQ ID NO: 199400 - RNA, 64 nt, Homo Sapiens
auaauaaacgaugcuauuuuaaugagcucaugacucauuaaaaaaugcuuuaugaagcuuuaga

SEQ ID NO: 199401 - RNA, 64 nt, Homo Sapiens
gggcggggagcugggccuggaggauccuggagucucauuaaaugccugauugugaaccaugucc

SEQ ID NO: 199402 - RNA, 64 nt, Homo Sapiens
ccagccuuguuucucauguaaugcagugacgcugucauuaaacacguggauucauguguggccg

SEQ ID NO: 199403 - RNA, 64 nt, Homo Sapiens
ugugggccaccaugucuggccucucaaguagcugggacuacagaagcuauucucaugccucagc

SEQ ID NO: 199404 - RNA, 64 nt, Homo Sapiens
cgccugccagcacgccuggccucccaaguagcugggacuacaggcaccauucuccugccucacc

SEQ ID NO: 199405 - RNA, 64 nt, Homo Sapiens
ggugauccucccaccucagccuccugaguagcuaggacuacagaugcucgccaccacaccuggc

SEQ ID NO: 199406 - RNA, 64 nt, Homo Sapiens
aaugauucuccugcuuuagccucccaaguagcugggacuacagguguacgccaccacacccagc

SEQ ID NO: 199407 - RNA, 64 nt, Homo Sapiens
uggcagaaaugauggaguaacugagacccaauuuggacuacauuggcuugauuucuugaauaug

SEQ ID NO: 199408 - RNA, 64 nt, Homo Sapiens
cacccgccaccauuccgagccucccgaguagcugggacuacaggagcaauucuccugccucagc

SEQ ID NO: 199409 - RNA, 64 nt, Homo Sapiens
ggcccgccaccacgcccggcuucccgaguagcugggacuacaggcgccauucuccugccucagc

SEQ ID NO: 199410 - RNA, 64 nt, Homo Sapiens
cguccuccaccaugccuggccucccaaguagcucggacuacaggcgccauucuccugccucagc

SEQ ID NO: 199411 - RNA, 64 nt, Homo Sapiens
cgccauucuccugccucagccucccgaguagcugggacuacaggagcucgccaccacacccagc

SEQ ID NO: 199412 - RNA, 64 nt, Homo Sapiens
cgccauucuccugccucagccucccguguagcugggacuacaggcacgcgccaccaugcccggc

SEQ ID NO: 199413 - RNA, 64 nt, Homo Sapiens
uccaccucccaggcucaagccucccgaauagcugggacuacaggcgcacaccaccauccccggc

SEQ ID NO: 199414 - RNA, 64 nt, Homo Sapiens
aauagaaagaacucggggaaacaucccaucaacaggacuacacacuuguauauacauucuugag

SEQ ID NO: 199415 - RNA, 64 nt, Homo Sapiens
agcgauucuucugcuucagccucccgaguagcugggacuacaggcacccaccaucaugucuggc

SEQ ID NO: 199416 - RNA, 64 nt, Homo Sapiens
agugauccucccaccucagccucccgaauagcugggacuacaggugugagucaccaagcccagu

SEQ ID NO: 199417 - RNA, 64 nt, Homo Sapiens
ugccauucuccugucucagccucccgaguagcugggacuacaggcacccgccaacacgcccggc

SEQ ID NO: 199418 - RNA, 64 nt, Homo Sapiens
agcaguucuccugccucagccuccugaguagcugggacuacaggcacccgccaccaugcccagc

SEQ ID NO: 199419 - RNA, 64 nt, Homo Sapiens
agugauccucccaccucagccucucaaguagcugggacuacaggcaugugccaccacaccuaau

SEQ ID NO: 199420 - RNA, 64 nt, Homo Sapiens
agcaguccaucugccucagccucccaaagugcugggacuacagacaugagccauugugccugac

SEQ ID NO: 199421 - RNA, 64 nt, Homo Sapiens
cgcccgccaccacgcccggccuccugaguagcugggacuacaggucaugccauucugccucagc

SEQ ID NO: 199422 - RNA, 64 nt, Homo Sapiens
cacaggccauuaugccuggccuccugaguagaugggacuacaggagcgauucuccugucucagc

SEQ ID NO: 199423 - RNA, 64 nt, Homo Sapiens
agcgauucuugugccucagccuccuaagcagcugggacuacaggcgcaugcaaccauacccagc

SEQ ID NO: 199424 - RNA, 64 nt, Homo Sapiens
guggggaguguuuuuguaucacaaagauuagagaggacuacacaucagggcuugauuuauuguu

SEQ ID NO: 199425 - RNA, 64 nt, Homo Sapiens
agcaauucuccugccucagccucccaaguagcugggacuacaggcaugcaccaccacacuuggc

SEQ ID NO: 199426 - RNA, 64 nt, Homo Sapiens
agagauucuccugccucagccucccgaguagcugggacuacaggcgugugccaccaugccuggc

SEQ ID NO: 199427 - RNA, 64 nt, Homo Sapiens
auagugguauuuuaacauagcagcugguuaaccgggacuacagaaguggaaggauaaugagaug

SEQ ID NO: 199428 - RNA, 64 nt, Homo Sapiens
gaugguagaaacuuuggaaguuuuacuugauuaaggacuacagaauugggcccuuagaauguga

SEQ ID NO: 199429 - RNA, 64 nt, Homo Sapiens
cgcacucuuaagacugaaaauuggcguugaguguuauagugaaaauuuuccaguuugauaauug

SEQ ID NO: 199430 - RNA, 64 nt, Homo Sapiens
auauguugaaggagguauaauaaacucagucauauauagugaacaguucaaaugggaaaguguu

SEQ ID NO: 199431 - RNA, 64 nt, Homo Sapiens
gagaugucuauuuuauuauuuuucugagauuuuguauagugauuugcucuguaagagcuuuaca

SEQ ID NO: 199432 - RNA, 64 nt, Homo Sapiens
uuaagcaucccgucaaaggcgaucuuagaucuaauauagugauuaaaaaacagguuuuagaaau

SEQ ID NO: 199433 - RNA, 64 nt, Homo Sapiens
uagaguaguuggccuuauaaucuuuccuuucaauuauagugacaacuuaauuuucuuaauuuau

SEQ ID NO: 199434 - RNA, 64 nt, Homo Sapiens
uuauccaaaacgccauuguacaagucauguaauguauagugaaugcuuuuuucuucguuguucc

SEQ ID NO: 199435 - RNA, 64 nt, Homo Sapiens
ggcaaagaggaauuuauugaaccagacuggcuuuuauagugacaguccuugauacugaguuggg

SEQ ID NO: 199436 - RNA, 64 nt, Homo Sapiens
caaugggacaugugaagaauuuauuauaaaaauguauagugauacuuucuuaauuuacgauuuu

SEQ ID NO: 199437 - RNA, 62 nt, Homo Sapiens
acauaaaagugcucuccugccugggcagcaacaaccaagaacaaagccccgggacuguuuuc

SEQ ID NO: 199438 - RNA, 62 nt, Homo Sapiens
auuaaaaagcugcguugguaaguuuuucauggaaccaagauuugacaaaggcaucucuuauc

SEQ ID NO: 199439 - RNA, 62 nt, Homo Sapiens
auguucacauugcuuuaccaguuuggcacuggaaccaagagcacaugucguggcuggcuaca

SEQ ID NO: 199440 - RNA, 62 nt, Homo Sapiens
gugauuuagauaucuaucuaucuagauuucugaaccaagauauauuuauaguucacuuuugg

SEQ ID NO: 199441 - RNA, 62 nt, Homo Sapiens
cccuggcucagaggauagcgguuuccaucauaaaccaagaugaugaguucagccuuuauccc

SEQ ID NO: 199442 - RNA, 62 nt, Homo Sapiens
cccugggucagaggauagcgguuuccaucauaaaccaagaugaugaguucagccuuuauccc

SEQ ID NO: 199443 - RNA, 62 nt, Homo Sapiens
gucagccugucugacauccagguugugcuauuaaccaagaaggaaacagauacuuggaggcu

SEQ ID NO: 199444 - RNA, 62 nt, Homo Sapiens
uugcuugaacccgggagguggagguugcagugaaccaagaucgcggcgcugcacucuagccu

SEQ ID NO: 199445 - RNA, 62 nt, Homo Sapiens
uugaauguaauaagaugaauucgucauuguucaaccaagauuucauucagaaaacuuuauaa

SEQ ID NO: 199446 - RNA, 62 nt, Homo Sapiens
aagaagccaagcaaaaaucaguauaaagaggaaaccaagaaaggaggggucuggggaccaug

SEQ ID NO: 199447 - RNA, 62 nt, Homo Sapiens
cagguuuucuugucuugacaagaugcuugaaaaaccaagaggauaugaaaaucugucucugg

SEQ ID NO: 199448 - RNA, 62 nt, Homo Sapiens
uuacuucuuauaaauugaagucuuaaaugugaaaccaagaaauguaaucaagcaguaaaaac

SEQ ID NO: 199449 - RNA, 62 nt, Homo Sapiens
gacaggagggagaagaaaaaacaaaacacuugaaccaagaaacucaaauguaauccuacgau

SEQ ID NO: 199450 - RNA, 62 nt, Homo Sapiens
ccccaaauaaacauugcuuuauuucuaauaauaaccaagacuuuucaagcuucuagaucuca

SEQ ID NO: 199451 - RNA, 62 nt, Homo Sapiens
aggaagagguugcuggagcauugagucgccugaaccaagagcaugugcaagaaaaugagggc

SEQ ID NO: 199452 - RNA, 58 nt, Homo Sapiens
aggaagagguugcucagguugucaccugaaccaagagcggaagaaaaugagggcuuga

SEQ ID NO: 199453 - RNA, 62 nt, Homo Sapiens
gagaaagcucaugggcaagaaacucuaugaauaaccaagauggagccgggugcaguugccaa

SEQ ID NO: 199454 - RNA, 62 nt, Homo Sapiens
ugugagagauugagacacucuaaauaaauaauaaccaagaugggaaauuucccugccagacc

SEQ ID NO: 199455 - RNA, 62 nt, Homo Sapiens
ugccuuuccccagggaauccucuccagaucuuaaccaagagccccuugcaaacuucuucgac

SEQ ID NO: 199456 - RNA, 62 nt, Homo Sapiens
gauauuuccuccaggaaucguguuucaauuguaaccaagaaauuuccauuugugcuucauga

SEQ ID NO: 199457 - RNA, 55 nt, Homo Sapiens
uaggugaagggcaacuauagguuuaaaccaagacaaaugaagacugaaaccaaga

SEQ ID NO: 199458 - RNA, 62 nt, Homo Sapiens
uauagguuuaaaccaagacaaaugaagacugaaaccaagaauauuguucuuaugcuggaaau

SEQ ID NO: 199459 - RNA, 64 nt, Homo Sapiens; identical to SEQ ID NO: 76092

SEQ ID NO: 199460 - RNA, 64 nt, Homo Sapiens; identical to SEQ ID NO: 76093

SEQ ID NO: 199461 - RNA, 64 nt, Homo Sapiens; identical to SEQ ID NO: 76094

SEQ ID NO: 199462 - RNA, 64 nt, Homo Sapiens; identical to SEQ ID NO: 76095

SEQ ID NO: 199463 - RNA, 64 nt, Homo Sapiens; identical to SEQ ID NO: 76096

SEQ ID NO: 199464 - RNA, 64 nt, Homo Sapiens; identical to SEQ ID NO: 76097

SEQ ID NO: 199465 - RNA, 64 nt, Homo Sapiens; identical to SEQ ID NO: 76098

SEQ ID NO: 199466 - RNA, 64 nt, Homo Sapiens; identical to SEQ ID NO: 76099

SEQ ID NO: 199467 - RNA, 64 nt, Homo Sapiens; identical to SEQ ID NO: 76100

SEQ ID NO: 199468 - RNA, 64 nt, Homo Sapiens; identical to SEQ ID NO: 76101

SEQ ID NO: 199469 - RNA, 64 nt, Homo Sapiens; identical to SEQ ID NO: 76102

SEQ ID NO: 199470 - RNA, 64 nt, Homo Sapiens; identical to SEQ ID NO: 76103

SEQ ID NO: 199471 - RNA, 53 nt, Homo Sapiens; identical to SEQ ID NO: 76104

SEQ ID NO: 199472 - RNA, 64 nt, Homo Sapiens; identical to SEQ ID NO: 76105

SEQ ID NO: 199473 - RNA, 64 nt, Homo Sapiens; identical to SEQ ID NO: 76106

SEQ ID NO: 199474 - RNA, 64 nt, Homo Sapiens; identical to SEQ ID NO: 76107

SEQ ID NO: 199475 - RNA, 64 nt, Homo Sapiens; identical to SEQ ID NO: 76108

SEQ ID NO: 199476 - RNA, 64 nt, Homo Sapiens; identical to SEQ ID NO: 76109

SEQ ID NO: 199477 - RNA, 64 nt, Homo Sapiens; identical to SEQ ID NO: 76110

SEQ ID NO: 199478 - RNA, 64 nt, Homo Sapiens; identical to SEQ ID NO: 76111

SEQ ID NO: 199479 - RNA, 64 nt, Homo Sapiens
ggauggacucuucucggcucaggcucugcugguggaaagcgauucacuguauaaacuuuuuuuu

SEQ ID NO: 199480 - RNA, 64 nt, Homo Sapiens
aaagugcuuggauuaggagaugccaagacguuaggaaagcgaggggaggguggggucccuuugu

SEQ ID NO: 199481 - RNA, 64 nt, Homo Sapiens
agggugaacugggagaggaccuggcugagcccaggaaagcgacauggggagcagggcugugacu

SEQ ID NO: 199482 - RNA, 64 nt, Homo Sapiens
aagaaugucucuagaagagaugacaauguagcuugaaagcgauguuucacaagacuuauuuuaa

SEQ ID NO: 199483 - RNA, 64 nt, Homo Sapiens
acaugaaaggaaaauuaguuguguauuucacgacgaaagcgacggaccaaaagaaauuuccugc

SEQ ID NO: 199484 - RNA, 64 nt, Homo Sapiens
uuauuggcaagauugcaaugauuauggaaaaauagaaagcgaauacucaguuuaagccaaggaa

SEQ ID NO: 199485 - RNA, 64 nt, Homo Sapiens
cuccuugaguucugaugaauaucggcgaggaaaugaaagcgauuauguuccuauauauuacaac

SEQ ID NO: 199486 - RNA, 64 nt, Homo Sapiens
ugucacggacuccacuuuuaccaggcuuuaccaugaaagcgaccucauaguaagacacacgaga

SEQ ID NO: 199487 - RNA, 64 nt, Homo Sapiens
aaacacuaaacauguuuuuauaaaauguaacuuggaaagcgaggcguuuuaaaucugcucaaga

SEQ ID NO: 199488 - RNA, 64 nt, Homo Sapiens
uggcucauuaguguugccucaaaaaguccuaggagaaagcgacggguucauaccaugggggaaa

SEQ ID NO: 199489 - RNA, 64 nt, Homo Sapiens
aaaugaguggugaaauaauguuuggagacauaaugaaagcgauuaacauuuggcaaaauauaau

SEQ ID NO: 199490 - RNA, 64 nt, Homo Sapiens
aauuccaccgcugcuuaauaacuuuauaaaaagugaaagcgacaaauaugacauuuuauguagc

SEQ ID NO: 199491 - RNA, 64 nt, Homo Sapiens
ugcugcaagauaauguauuuugacauuuuaacuugaaagcgauauaaauauugguguuuguuuc

SEQ ID NO: 199492 - RNA, 64 nt, Homo Sapiens
uuauaaauacuggaacaaauccugcugcaaaaaugaaagcgaucagacugucuucuguucaaga

SEQ ID NO: 199493 - RNA, 64 nt, Homo Sapiens
uguuuucacacgugucucuucucuucgacuuccugaaagcgaaagcuuuaccuccugcaaaugu

SEQ ID NO: 199494 - RNA, 64 nt, Homo Sapiens
agaaaacuauuaucaguuguuauuguuaucccuugaaagcgagggugacaaaaacaacaaaaca

SEQ ID NO: 199495 - RNA, 64 nt, Homo Sapiens
uucaagagaaguuguaaguauagugaccuaaauagaaagcgaacgguuggcuuuauuuaaaagc

SEQ ID NO: 199496 - RNA, 64 nt, Homo Sapiens
uuucucaaugcuucuaauaucucucaaacaaaaggaaagcgauuuaguuucuguuaagggaauu

SEQ ID NO: 199497 - RNA, 64 nt, Homo Sapiens
ccaaacgguugugaucuaaacgauauuuaagaaggaaagcgaauuugaagccaaaaugguacac

SEQ ID NO: 199498 - RNA, 64 nt, Homo Sapiens
gaauacauuucuaauuaaaaucuucaaugaacaggaaagcgacaucuccauucuccaagggcaa

SEQ ID NO: 199499 - RNA, 64 nt, Homo Sapiens
uuggcuucacuccugcagcacaaugcuggcccuagaaagcgagcauuuucauucuucccauggc

SEQ ID NO: 199500 - RNA, 64 nt, Homo Sapiens
aaagagagaaagaaagaaacagaaaaaccuaaaagaaagcgaaugaauuugacaccuguugguu

SEQ ID NO: 199501 - RNA, 64 nt, Homo Sapiens
ggguggggggcuucccgggaggaaagcggaggaggaaagcgagggcccccgcgagacggguuag

SEQ ID NO: 199502 - RNA, 64 nt, Homo Sapiens
uuuuggauaaugugucuggauugguauuaaagaggaaagcgauucagcugucuccugggguggg

SEQ ID NO: 199503 - RNA, 64 nt, Homo Sapiens
cuuguuguuuuucucuuugcaaagacauagcuaggaaagcgaaugauaagggaaaaguucucag

SEQ ID NO: 199504 - RNA, 64 nt, Homo Sapiens
acuugaaagguugccuggacucgcuggagcaaaggaaagcgauuuuguuuguauaauuaaauga

SEQ ID NO: 199505 - RNA, 64 nt, Homo Sapiens
ggaguacgguguacuggcccagcuuacagaugcagaaagcgagacguucugccaucagauaaag

SEQ ID NO: 199506 - RNA, 64 nt, Homo Sapiens
ugucugcagguguuaguggugugcuaaaagcaaggaaagcgaguuagucuuuucagugucuuuu

SEQ ID NO: 199507 - RNA, 64 nt, Homo Sapiens
gaguugcccauuaauuaugaugacuaaaaugcuggaaagcgaguuccugugauuaauuuuguga

SEQ ID NO: 199508 - RNA, 64 nt, Homo Sapiens
caggcccguggacagugauugcacuuuuaaaagagaaagcgagaaaagaaacagggcguggggc

SEQ ID NO: 199509 - RNA, 64 nt, Homo Sapiens
ucaggucagguggcugugggggcuaaaugagaaugaaagcgacuugcuguugaucggucuccua

SEQ ID NO: 199510 - RNA, 64 nt, Homo Sapiens
acacgaggcuccuugugucaagcuuccugugauggaaagcgaccucuccaaccaccacacuccc

SEQ ID NO: 199511 - RNA, 64 nt, Homo Sapiens
cccgaaaaacacaagaccgacccaaaaucuagaggaaagcgaaaagcugcuccccacccccuuu

SEQ ID NO: 199512 - RNA, 64 nt, Homo Sapiens
caccucauguaccuacgccacagacagccagagggaaagcgacccagacagcagccccuccucg

SEQ ID NO: 199513 - RNA, 64 nt, Homo Sapiens
cugcaggacugaagaagucguacugaguaacgaugaaagcgaggcaaggaaggaggcaaagagc

SEQ ID NO: 199514 - RNA, 64 nt, Homo Sapiens
ugggggcggggccucuucauuggcccagcuuggcgaaagcgaggcacacugcuuacugccuugg

SEQ ID NO: 199515 - RNA, 64 nt, Homo Sapiens
cauuauaucuucucuugcuuuucuuugcaaaugugaaagcgagagaugaggguuagccauagua

SEQ ID NO: 199516 - RNA, 64 nt, Homo Sapiens
gcuuggacuucuauucaaagcaaagucagggcaagaaagcgaaauccucagcaaugugaagaau

SEQ ID NO: 199517 - RNA, 64 nt, Homo Sapiens
guggacuguccaacagaaaguggaacuuagccuggaaagcgaaaagccuucuuuggacuugauu

SEQ ID NO: 199518 - RNA, 64 nt, Homo Sapiens
gaaagaggaacugaaggacggagugugcaugugagaaagcgagaaaagugacgaguguggcaga

SEQ ID NO: 199519 - RNA, 64 nt, Homo Sapiens
uaaauagucacuuuaaaaaggaguuaaggacauugaaagcgacaggcaagaacaguugcuuaaa

SEQ ID NO: 199520 - RNA, 56 nt, Homo Sapiens
gguaaugcggcauugaugcuagacuggaaagcgacggucucacggcagcacgauga

SEQ ID NO: 199521 - RNA, 64 nt, Homo Sapiens
cuguuuugcugcuuguugcaugcacacaggaauggaaagcgagcuccuuuuccccuuccccagc

SEQ ID NO: 199522 - RNA, 63 nt, Homo Sapiens
uugcccccgccugggucccuaguugucagcucagaaagcgaccggcugccagcuggaaccuga

SEQ ID NO: 199523 - RNA, 64 nt, Homo Sapiens
agcaucccccagauccaagccugggggaucccgggaaagcgauggacagacagacgauggggcc

SEQ ID NO: 199524 - RNA, 64 nt, Homo Sapiens
agcaucaagggcuuugcuucucaugaaaaagcuggaaagcgaucuauuuaaauuuccuagguuu

SEQ ID NO: 199525 - RNA, 64 nt, Homo Sapiens
gaucuagugccauuauuucuaccauuaaaaucuugaaagcgaaauacuugaaaagaggugacca

SEQ ID NO: 199526 - RNA, 64 nt, Homo Sapiens
aggggaccauuuacauaaaaaagaaauaaacaaugaaagcgaugaaaggucuuaucugaaaggu

SEQ ID NO: 199527 - RNA, 64 nt, Homo Sapiens
agaguucuccccaaaacccuagcucuuuacccuuccauuuuagccuuccacccagcuuccacaa

SEQ ID NO: 199528 - RNA, 64 nt, Homo Sapiens
gggauuacaggcaugagccaccaugccagacuucccauuuuacuuucugcaagcuguuucccua

SEQ ID NO: 199529 - RNA, 64 nt, Homo Sapiens
uuuccaauuucauugguuuucucuaaacagugcuccauuuuauuuuguugguguuucagauggg

SEQ ID NO: 199530 - RNA, 64 nt, Homo Sapiens
gacauacguugguuuugagggcuauucagccauuccauuuuacucucuauuuaaaggccgugag

SEQ ID NO: 199531 - RNA, 64 nt, Homo Sapiens
uucaacuuguagauacaucaacuuugaaauuauuccauuuuauaccugaccaaaacauguucug

SEQ ID NO: 199532 - RNA, 64 nt, Homo Sapiens
aucaaauauuuacauauugcuuaucacuuuuucuccauuuuaauaauggaaugaacuaaaauaa

SEQ ID NO: 199533 - RNA, 64 nt, Homo Sapiens
uaugaaaacuuaaagguauauauucaauuuuuuaccauuuuauggaaaauauuuaaaaucuguu

SEQ ID NO: 199534 - RNA, 64 nt, Homo Sapiens
gguaacauauacauagccacauuuacaguuuuaaccauuuuaaggcauguaauucagugggguu

SEQ ID NO: 199535 - RNA, 64 nt, Homo Sapiens
gacaagugggcagcauaaagucacucauuucuuaccauuuuauuccccucaauucucaauauau

SEQ ID NO: 199536 - RNA, 64 nt, Homo Sapiens
ucagggaaauaugaauuaggaccacaaugagauuccauuuuauauccauaagauuugcaaaggu

SEQ ID NO: 199537 - RNA, 64 nt, Homo Sapiens
aacaaaauacaggacaucaaauauuagccauuucccauuuuauuuuauuuuucuauguagguuc

SEQ ID NO: 199538 - RNA, 64 nt, Homo Sapiens
cagagcaaccauaugagcauuguaauuaauauucccauuuuacagaugaggaaacugaagcuaa

SEQ ID NO: 199539 - RNA, 64 nt, Homo Sapiens
uugccuuuaacuuuucuuauccaggggaaaauugccauuuuagggucagcaugaacagcucuuu

SEQ ID NO: 199540 - RNA, 64 nt, Homo Sapiens
cuccagggguccugaugcugucaugcucagugagccauuuuacaguucuccaaagucuagcccu

SEQ ID NO: 199541 - RNA, 64 nt, Homo Sapiens
auucagcauugcucaacuuaggaaagaaacuuacccauuuuaaagacugaaggcucucagacug

SEQ ID NO: 199542 - RNA, 64 nt, Homo Sapiens
uacauaggcaaaguaaaugucaaaucaauagaaaccauuuuacccauguaaauacaaguuggua

SEQ ID NO: 199543 - RNA, 64 nt, Homo Sapiens
uuucgauuagaagaagcugcaaaagaaaggcagcccauuuuaccauugccagccaggccgggga

SEQ ID NO: 199544 - RNA, 64 nt, Homo Sapiens
agauugaggugauucagauagguuugcgaauauaccauuuuauauuguugagaaagaacaaaaa

SEQ ID NO: 199545 - RNA, 64 nt, Homo Sapiens
gcuuaagagaguaaggccuuacagaaagauauugccauuuuacaaaaggccaucugcuuggagc

SEQ ID NO: 199546 - RNA, 64 nt, Homo Sapiens
uccucuucugaucacuuccagcucuccuucgauuccauuuuaccaaguaaagcccuuccggguc

SEQ ID NO: 199547 - RNA, 64 nt, Homo Sapiens
cuugacuucuuaggauggguagcugaaaagaccaccauuuuaagcauuugagaauucuuaaaua

SEQ ID NO: 199548 - RNA, 64 nt, Homo Sapiens
auuauuaguuuugcaagaucacacacuaauguaaccauuuuaugaagguugaaguggauuuaug

SEQ ID NO: 199549 - RNA, 64 nt, Homo Sapiens
ggugugcaguguuuuuccuguguauuaaaccuuuccauuuuacguuuuagaaaauuuuauguau

SEQ ID NO: 199550 - RNA, 64 nt, Homo Sapiens
auuaaaggugaaaauuguauaaauuacuuugauuccauuuuaaguggagacauauuucagugau

SEQ ID NO: 199551 - RNA, 64 nt, Homo Sapiens
gggauaacagugugccugguuaauauuaauauucccauuuuauuaauaauauuuauguuggguc

SEQ ID NO: 199552 - RNA, 64 nt, Homo Sapiens
gggaagauuuuaguucacacuuagucuaacucccccauuuuacagauuucucacuauauauauu

SEQ ID NO: 199553 - RNA, 64 nt, Homo Sapiens
cguauuucuuuuuccuuguaaauguaaucagaugccauuuuauauguggacguauuuauacugg

SEQ ID NO: 199554 - RNA, 64 nt, Homo Sapiens
uuuuuuuuuuuuuugguaguuguuguuacccacgccauuuuacgucuccuucacugaagggcua

SEQ ID NO: 199555 - RNA, 64 nt, Homo Sapiens
aauuauuuuguuguuacguuuuggugaguuauacccauuuuauuuauuuagaaaaauaguaucu

SEQ ID NO: 199556 - RNA, 64 nt, Homo Sapiens
aauuguuuuugagauauaaagacccugaaaaagcccauuuuagaaccuguuuaauaagagcaaa

SEQ ID NO: 199557 - RNA, 64 nt, Homo Sapiens
gcgcugugcuuuguauaaguuauuucuuuuugcuccauuuuaguucucaguuagaaguguucua

SEQ ID NO: 199558 - RNA, 64 nt, Homo Sapiens
gaaauuagcuuagcaauuuuuacuuaauuuuuauccauuuuauguguuuggaaagaugugugaa

SEQ ID NO: 199559 - RNA, 64 nt, Homo Sapiens
auuagcuaguuucaugcucacauguauuaaauggccauuuuaaagauacaagauuucuuacaug

SEQ ID NO: 199560 - RNA, 64 nt, Homo Sapiens
uuauuuguauuuauaguuuuuguuuuuuuaauggccauuuuauuuuguuuuuuguuuguuuguu

SEQ ID NO: 199561 - RNA, 64 nt, Homo Sapiens
cauuuuuaaguguacaguucauuuuaaacauuuaccauuuuaacuauauaaauacauauuugcc

SEQ ID NO: 199562 - RNA, 64 nt, Homo Sapiens
cauuuaccauuuuaaccauuuaaauacauauuugccauuuuaaacucuauugugguaaaauaua

SEQ ID NO: 199563 - RNA, 64 nt, Homo Sapiens
accauuuucuaucuuuuucaaauaagaaaaauauccauuuuauuuauuuaugaacauauuucuu

SEQ ID NO: 199564 - RNA, 64 nt, Homo Sapiens
auuugauaaagcauauuuauauuuugcaaaauaaccauuuuaacgcucugcucuauuuauuauu

SEQ ID NO: 199565 - RNA, 64 nt, Homo Sapiens
aaagguguauuuuuucuuuuaccaaacaaaaaugccauuuuaaacucaguacuuugcagaaaac

SEQ ID NO: 199566 - RNA, 64 nt, Homo Sapiens
cuggauaagggcagaaacgggacaaaguugugacccauuuuacugcugcagaaguguuccuuua

SEQ ID NO: 199567 - RNA, 64 nt, Homo Sapiens
auugggaaauuuuagugagaugcgccuggccagaccauuuuagaggauuacaggcgugagccac

SEQ ID NO: 199568 - RNA, 64 nt, Homo Sapiens
uuauuuuuuuauuuauuuauugaccaaauccagaccauuuuauuggauuuacugaauaaggugu

SEQ ID NO: 199569 - RNA, 64 nt, Homo Sapiens
uucagaguaacgucaguggcuuaggguuaaacggccauuuuauucaaaugcuugcuauacaauc

SEQ ID NO: 199570 - RNA, 64 nt, Homo Sapiens
gaaauuuuguauuuuuguauaacuugauugugugccauuuuauauaacagguccuguuuuacaa

SEQ ID NO: 199571 - RNA, 64 nt, Homo Sapiens
cucccaagccccaagagguguaccuuuucagaugccauuuuacaggcggaaaugcuccaugaaa

SEQ ID NO: 199572 - RNA, 64 nt, Homo Sapiens
cccgcuuacagcagcaacacaggagaucaucuguccauuuuagaaccauuaaucucuuuaucca

SEQ ID NO: 199573 - RNA, 64 nt, Homo Sapiens
uuuuacuuuaaaugccugcccaccgcgcccagccccauuuuauucugggauuacaggcgugagc

SEQ ID NO: 199574 - RNA, 64 nt, Homo Sapiens
uuaguuuuauuuugagacagacugugcccggcccccauuuuauuugggauuacagacaugagcc

SEQ ID NO: 199575 - RNA, 64 nt, Homo Sapiens
auuuuuuuuuuucgagacacacaguguggaggucccauuuuauucuagacuggcaagggccucc

SEQ ID NO: 199576 - RNA, 64 nt, Homo Sapiens
uuguacgaguaaggguuugagaacuaaauugccuccauuuuauuaagccugagaagucacuuug

SEQ ID NO: 199577 - RNA, 64 nt, Homo Sapiens
gacugaacuuuucucauauucuucaugaacaauuccauuuuauuaacaugcaaacagccuacuu

SEQ ID NO: 199578 - RNA, 64 nt, Homo Sapiens
uccaucugauacuccauugcgauccccagaagaaccauuuuaacgcuccaggagcaugagaauu

SEQ ID NO: 199579 - RNA, 64 nt, Homo Sapiens
uacuaacugggucuuucagauuuuuaacccuuuaccauuuuaaaagcagggagaaauauuaacu

SEQ ID NO: 199580 - RNA, 64 nt, Homo Sapiens
auuuccauugaagcuuguuuucuuuuuuuucuucccauuuuagcuacugcagugcuuuuguuuc

SEQ ID NO: 199581 - RNA, 64 nt, Homo Sapiens
uguaaaaauuuuauauauauguauuuaaaaugugccauuuuauugcuaagugaaguauguccug

SEQ ID NO: 199582 - RNA, 64 nt, Homo Sapiens
gcaaaguugacaagcucaggugcauauuuuauccccauuuuacuuuucuaucagcuagauaauu

SEQ ID NO: 199583 - RNA, 64 nt, Homo Sapiens
gauuuaaaauaaacagguuuuuuuauuuucagaaccauuuuacaaaccacucuugagaaguaau

SEQ ID NO: 199584 - RNA, 64 nt, Homo Sapiens
aagcccuguuauaaacguuguccaaaacuuuucuccauuuuaaaaaguuucuuuuuaaaaauuu

SEQ ID NO: 199585 - RNA, 64 nt, Homo Sapiens
ugacuacuuuuauuuuuuaacaucuacaauuccuccauuuuaaaugaauggauuuuuccauacu

SEQ ID NO: 199586 - RNA, 64 nt, Homo Sapiens
augaagcaaugaagucuauuauuagucaaaaauaccauuuuaguguaguuuaaguuuccuugug

SEQ ID NO: 199587 - RNA, 64 nt, Homo Sapiens
acuaauagcuugaacccuuuauuacuuauaacuuccauuuuauuuauuuuacacaugucaaggg

SEQ ID NO: 199588 - RNA, 64 nt, Homo Sapiens
gauuguuuacuuuccuuuuauaaaauuauacucuccauuuuagcaaaacagcuuucccucauca

SEQ ID NO: 199589 - RNA, 64 nt, Homo Sapiens
cccuuaauauuuuuugucuguaaauauguuguuaccauuuuauuggcuuuauaguauucaccug

SEQ ID NO: 199590 - RNA, 64 nt, Homo Sapiens
ucuacaccugcaaguccuggacccucuaugagucccauuuuacucugacuccaacuucucuuuc

SEQ ID NO: 199591 - RNA, 64 nt, Homo Sapiens
ucuagaccuauaaguucugggccccccaugaaucccauuuuacccugcuucaccuuugaccucu

SEQ ID NO: 199592 - RNA, 64 nt, Homo Sapiens
ugucucaagcucuaccuucccuuagugauacauaccauuuuaucuuaacacuuuaauuacagau

SEQ ID NO: 199593 - RNA, 64 nt, Homo Sapiens
uggcacaauguaaguggcagucugucuucucuguccauuuuagggacaaccuugacuguucugu

SEQ ID NO: 199594 - RNA, 64 nt, Homo Sapiens
uaguagagauuucauagcuauuuagagauauuuuccauuuuaagaaaacccgacaacauuucug

SEQ ID NO: 199595 - RNA, 64 nt, Homo Sapiens
aauguuugggaauggugcccuuggaggcaaccucccauuuuagauguuuaaaggacccuauaug

SEQ ID NO: 199596 - RNA, 64 nt, Homo Sapiens
cccacaucucugggauuugaauggggauuguaucccauuuuacugucuuuuagguuuacauuua

SEQ ID NO: 199597 - RNA, 64 nt, Homo Sapiens
uuguggccuuuuagacuuuuguugcccuaaaauuccauuuuauugggaacccauuuuccaccug

SEQ ID NO: 199598 - RNA, 64 nt, Homo Sapiens
auggauagcucagagguauccucuuuuugcucccccauuuuaacuugccacaucccagucacag

SEQ ID NO: 199599 - RNA, 64 nt, Homo Sapiens
guaacacagucuggcaguugcuaaauuuguguucccauuuuaaauugaccaauuuuggggugug

SEQ ID NO: 199600 - RNA, 64 nt, Homo Sapiens
uuaaaauuaauaauauuguaaguaaugaucagaaccauuuuacuauguacucuuagaggaggcc

SEQ ID NO: 199601 - RNA, 64 nt, Homo Sapiens
ucauguaauccucaugugaguuuauccauuuuauccauuuuaacuaaauaauuuacucucuacu

SEQ ID NO: 199602 - RNA, 64 nt, Homo Sapiens
cauuuuaacucauguaaucccucucuacuuuuauccauuuuaucgauaaaguuuaaauaauuua

SEQ ID NO: 199603 - RNA, 64 nt, Homo Sapiens
uuuuaacagcaagaauuuuaagaaaagauaaacaccauuuuauuuauuuauaaaaacaaaauua

SEQ ID NO: 199604 - RNA, 64 nt, Homo Sapiens
ucggcugauguuacucucacuugaugugguuaaaccauuuuagagguagagaagacagacaguu

SEQ ID NO: 199605 - RNA, 64 nt, Homo Sapiens
auuuugcuuuuguauuauaguauuugggguuuuguaacaauauauugcaaauugagauuaaaau

SEQ ID NO: 199606 - RNA, 64 nt, Homo Sapiens
ugauaccaaauacuuuuugucaauugagagcacauaacaauagauuaggaaacuaacuagaucu

SEQ ID NO: 199607 - RNA, 64 nt, Homo Sapiens
cguaaauacucaggauuggagcugcuuguaaguauaacaauauacagaauaacuuuauuuuauc

SEQ ID NO: 199608 - RNA, 64 nt, Homo Sapiens
aaauuaaaccuaugcucucaauucuuuuauauucuaacaauaaauaaaaaagaaaagauuacug

SEQ ID NO: 199609 - RNA, 64 nt, Homo Sapiens
cugagcaaaagguauaugugaaugagguaaaauuuaacaauaauaaagagcaauugauaaagua

SEQ ID NO: 199610 - RNA, 64 nt, Homo Sapiens
cugauacacauaaauagagaaauaagguaacauuuaacaauaauagagagcaauugauaaggca

SEQ ID NO: 199611 - RNA, 64 nt, Homo Sapiens
acccugucgaugguuuuagcguuaaggccaaauguaacaauaaaaaacaaauuuguuuuuuaag

SEQ ID NO: 199612 - RNA, 64 nt, Homo Sapiens
uuuuaucuaauaaaagcacuaaaagucaaaacguuaacaauagucuucuaaacaguauauucua

SEQ ID NO: 199613 - RNA, 64 nt, Homo Sapiens
ucuaccuuagcagaaaaaguaaacuaaccauguguaacaauaaaggcaggggauuacguuauga

SEQ ID NO: 199614 - RNA, 64 nt, Homo Sapiens
guuuguaacauuuuguuguggggguauuuuuuuuuaacaauaaucuccaacagacccgucugaa

SEQ ID NO: 199615 - RNA, 64 nt, Homo Sapiens
uucaaaaccaaggaagcagccucagaguggucgagugacacaccucacgcaggcugaguccaga

SEQ ID NO: 199616 - RNA, 64 nt, Homo Sapiens
gcuuguaaucaagccuuuauggcugcugggcugagugacacaagcacuuuaauggccuggaggg

SEQ ID NO: 199617 - RNA, 64 nt, Homo Sapiens
cacuuuggaccuuacgaucaggcacaggucaggggugacacagacucauccugaacagcauggc

SEQ ID NO: 199618 - RNA, 64 nt, Homo Sapiens
cccuccagcacaaacacaaggucauggccacacugugacacacuacaccacacacaacagccaa

SEQ ID NO: 199619 - RNA, 64 nt, Homo Sapiens
gcagcuccccugccuccaggacccuguugcuauggugacacagcguuucuaggacagaggggcc

SEQ ID NO: 199620 - RNA, 64 nt, Homo Sapiens
guucuuugcacgccaagucucuugguuguaccaugugacacacccugugcacuggucgcugucu

SEQ ID NO: 199621 - RNA, 64 nt, Homo Sapiens
uauuuuaacaaaccuguccuugauauuaguuaaggugacacauaagggugacacagaaugugua

SEQ ID NO: 199622 - RNA, 64 nt, Homo Sapiens
cuguccuugauauuaguuaaggugacacauaagggugacacagaauguguaaugcaaauuucau

SEQ ID NO: 199623 - RNA, 64 nt, Homo Sapiens
uuacaaguugauaucguugagaauuaaaacucaagugacacaagaguggaggugauuuacugcu

SEQ ID NO: 199624 - RNA, 64 nt, Homo Sapiens
aaggaagaaacuagcgguguugggguggccugcagugacacagaaggguaccuuuuuggggaga

SEQ ID NO: 199625 - RNA, 64 nt, Homo Sapiens
acggguaucccaucccgaucugccucccagaacugugacacacugggcucugcccucauuuucu

SEQ ID NO: 199626 - RNA, 64 nt, Homo Sapiens
gaucaugccaccaugccacugcacuccagccugggugacacagccaaaaaaaaaaccacuaagu

SEQ ID NO: 199627 - RNA, 64 nt, Homo Sapiens
cuaccugguaacugcccauguuucagcauuugaagugacacaagacuuuggaccaucacacaca

SEQ ID NO: 199628 - RNA, 64 nt, Homo Sapiens
caaaaauuucaucugagcuguaaaaaaaccuucugugacacauuuuggaggaauguacuguauu

SEQ ID NO: 199629 - RNA, 64 nt, Homo Sapiens; identical to SEQ ID NO: 161976

SEQ ID NO: 199630 - RNA, 64 nt, Homo Sapiens; identical to SEQ ID NO: 161977

SEQ ID NO: 199631 - RNA, 64 nt, Homo Sapiens; identical to SEQ ID NO: 161978

SEQ ID NO: 199632 - RNA, 64 nt, Homo Sapiens; identical to SEQ ID NO: 161979

SEQ ID NO: 199633 - RNA, 64 nt, Homo Sapiens; identical to SEQ ID NO: 161980

SEQ ID NO: 199634 - RNA, 64 nt, Homo Sapiens; identical to SEQ ID NO: 161981

SEQ ID NO: 199635 - RNA, 64 nt, Homo Sapiens; identical to SEQ ID NO: 161982

SEQ ID NO: 199636 - RNA, 64 nt, Homo Sapiens; identical to SEQ ID NO: 161983

SEQ ID NO: 199637 - RNA, 64 nt, Homo Sapiens; identical to SEQ ID NO: 161984

SEQ ID NO: 199638 - RNA, 64 nt, Homo Sapiens; identical to SEQ ID NO: 161985

SEQ ID NO: 199639 - RNA, 64 nt, Homo Sapiens; identical to SEQ ID NO: 161986

SEQ ID NO: 199640 - RNA, 64 nt, Homo Sapiens; identical to SEQ ID NO: 161987

SEQ ID NO: 199641 - RNA, 64 nt, Homo Sapiens; identical to SEQ ID NO: 161988

SEQ ID NO: 199642 - RNA, 64 nt, Homo Sapiens; identical to SEQ ID NO: 161989

SEQ ID NO: 199643 - RNA, 64 nt, Homo Sapiens; identical to SEQ ID NO: 161990

SEQ ID NO: 199644 - RNA, 64 nt, Homo Sapiens; identical to SEQ ID NO: 161991

SEQ ID NO: 199645 - RNA, 64 nt, Homo Sapiens; identical to SEQ ID NO: 161992

SEQ ID NO: 199646 - RNA, 64 nt, Homo Sapiens; identical to SEQ ID NO: 161993

SEQ ID NO: 199647 - RNA, 64 nt, Homo Sapiens; identical to SEQ ID NO: 161994

SEQ ID NO: 199648 - RNA, 64 nt, Homo Sapiens; identical to SEQ ID NO: 161995

SEQ ID NO: 199649 - RNA, 64 nt, Homo Sapiens; identical to SEQ ID NO: 161996

SEQ ID NO: 199650 - RNA, 64 nt, Homo Sapiens; identical to SEQ ID NO: 161997

SEQ ID NO: 199651 - RNA, 64 nt, Homo Sapiens; identical to SEQ ID NO: 161998

SEQ ID NO: 199652 - RNA, 64 nt, Homo Sapiens; identical to SEQ ID NO: 161999

SEQ ID NO: 199653 - RNA, 64 nt, Homo Sapiens; identical to SEQ ID NO: 162000

SEQ ID NO: 199654 - RNA, 64 nt, Homo Sapiens; identical to SEQ ID NO: 162001

SEQ ID NO: 199655 - RNA, 64 nt, Homo Sapiens; identical to SEQ ID NO: 162002

SEQ ID NO: 199656 - RNA, 64 nt, Homo Sapiens; identical to SEQ ID NO: 162003

SEQ ID NO: 199657 - RNA, 64 nt, Homo Sapiens; identical to SEQ ID NO: 162004

SEQ ID NO: 199658 - RNA, 64 nt, Homo Sapiens; identical to SEQ ID NO: 162005

SEQ ID NO: 199659 - RNA, 64 nt, Homo Sapiens; identical to SEQ ID NO: 162006

SEQ ID NO: 199660 - RNA, 64 nt, Homo Sapiens; identical to SEQ ID NO: 162007

SEQ ID NO: 199661 - RNA, 64 nt, Homo Sapiens; identical to SEQ ID NO: 162008

SEQ ID NO: 199662 - RNA, 64 nt, Homo Sapiens; identical to SEQ ID NO: 199006

SEQ ID NO: 199663 - RNA, 64 nt, Homo Sapiens; identical to SEQ ID NO: 199007

SEQ ID NO: 199664 - RNA, 64 nt, Homo Sapiens; identical to SEQ ID NO: 199008

SEQ ID NO: 199665 - RNA, 64 nt, Homo Sapiens; identical to SEQ ID NO: 199009

SEQ ID NO: 199666 - RNA, 64 nt, Homo Sapiens; identical to SEQ ID NO: 199010

SEQ ID NO: 199667 - RNA, 64 nt, Homo Sapiens; identical to SEQ ID NO: 199011

SEQ ID NO: 199668 - RNA, 64 nt, Homo Sapiens; identical to SEQ ID NO: 199012

SEQ ID NO: 199669 - RNA, 64 nt, Homo Sapiens; identical to SEQ ID NO: 199013

SEQ ID NO: 199670 - RNA, 64 nt, Homo Sapiens; identical to SEQ ID NO: 199014

SEQ ID NO: 199671 - RNA, 64 nt, Homo Sapiens; identical to SEQ ID NO: 199015

SEQ ID NO: 199672 - RNA, 64 nt, Homo Sapiens; identical to SEQ ID NO: 199016

SEQ ID NO: 199673 - RNA, 64 nt, Homo Sapiens; identical to SEQ ID NO: 199017

SEQ ID NO: 199674 - RNA, 64 nt, Homo Sapiens; identical to SEQ ID NO: 199018

SEQ ID NO: 199675 - RNA, 64 nt, Homo Sapiens; identical to SEQ ID NO: 199019

SEQ ID NO: 199676 - RNA, 64 nt, Homo Sapiens; identical to SEQ ID NO: 199020

SEQ ID NO: 199677 - RNA, 64 nt, Homo Sapiens; identical to SEQ ID NO: 199021

SEQ ID NO: 199678 - RNA, 64 nt, Homo Sapiens; identical to SEQ ID NO: 199022

SEQ ID NO: 199679 - RNA, 64 nt, Homo Sapiens; identical to SEQ ID NO: 199023

SEQ ID NO: 199680 - RNA, 64 nt, Homo Sapiens; identical to SEQ ID NO: 199024

SEQ ID NO: 199681 - RNA, 64 nt, Homo Sapiens; identical to SEQ ID NO: 199025

SEQ ID NO: 199682 - RNA, 64 nt, Homo Sapiens; identical to SEQ ID NO: 199026

SEQ ID NO: 199683 - RNA, 64 nt, Homo Sapiens; identical to SEQ ID NO: 199027

SEQ ID NO: 199684 - RNA, 64 nt, Homo Sapiens; identical to SEQ ID NO: 199028

SEQ ID NO: 199685 - RNA, 64 nt, Homo Sapiens; identical to SEQ ID NO: 199029

SEQ ID NO: 199686 - RNA, 64 nt, Homo Sapiens; identical to SEQ ID NO: 199030

SEQ ID NO: 199687 - RNA, 64 nt, Homo Sapiens; identical to SEQ ID NO: 199031

SEQ ID NO: 199688 - RNA, 64 nt, Homo Sapiens; identical to SEQ ID NO: 199032

SEQ ID NO: 199689 - RNA, 64 nt, Homo Sapiens; identical to SEQ ID NO: 199033

SEQ ID NO: 199690 - RNA, 64 nt, Homo Sapiens; identical to SEQ ID NO: 199034

SEQ ID NO: 199691 - RNA, 64 nt, Homo Sapiens; identical to SEQ ID NO: 199035

SEQ ID NO: 199692 - RNA, 64 nt, Homo Sapiens; identical to SEQ ID NO: 199036

SEQ ID NO: 199693 - RNA, 64 nt, Homo Sapiens; identical to SEQ ID NO: 199037

SEQ ID NO: 199694 - RNA, 64 nt, Homo Sapiens; identical to SEQ ID NO: 199038

SEQ ID NO: 199695 - RNA, 64 nt, Homo Sapiens; identical to SEQ ID NO: 199039

SEQ ID NO: 199696 - RNA, 64 nt, Homo Sapiens; identical to SEQ ID NO: 199040

SEQ ID NO: 199697 - RNA, 64 nt, Homo Sapiens; identical to SEQ ID NO: 199041

SEQ ID NO: 199698 - RNA, 64 nt, Homo Sapiens; identical to SEQ ID NO: 199042

SEQ ID NO: 199699 - RNA, 64 nt, Homo Sapiens; identical to SEQ ID NO: 199043

SEQ ID NO: 199700 - RNA, 64 nt, Homo Sapiens; identical to SEQ ID NO: 199044

SEQ ID NO: 199701 - RNA, 64 nt, Homo Sapiens; identical to SEQ ID NO: 199045

SEQ ID NO: 199702 - RNA, 64 nt, Homo Sapiens; identical to SEQ ID NO: 199046

SEQ ID NO: 199703 - RNA, 64 nt, Homo Sapiens; identical to SEQ ID NO: 199047

SEQ ID NO: 199704 - RNA, 64 nt, Homo Sapiens; identical to SEQ ID NO: 199048

SEQ ID NO: 199705 - RNA, 64 nt, Homo Sapiens; identical to SEQ ID NO: 199049

SEQ ID NO: 199706 - RNA, 64 nt, Homo Sapiens; identical to SEQ ID NO: 199050

SEQ ID NO: 199707 - RNA, 64 nt, Homo Sapiens; identical to SEQ ID NO: 199051

SEQ ID NO: 199708 - RNA, 64 nt, Homo Sapiens; identical to SEQ ID NO: 199052

SEQ ID NO: 199709 - RNA, 64 nt, Homo Sapiens; identical to SEQ ID NO: 199053

SEQ ID NO: 199710 - RNA, 64 nt, Homo Sapiens; identical to SEQ ID NO: 199054

SEQ ID NO: 199711 - RNA, 64 nt, Homo Sapiens; identical to SEQ ID NO: 199055

SEQ ID NO: 199712 - RNA, 64 nt, Homo Sapiens; identical to SEQ ID NO: 199056

SEQ ID NO: 199713 - RNA, 64 nt, Homo Sapiens; identical to SEQ ID NO: 199057

SEQ ID NO: 199714 - RNA, 64 nt, Homo Sapiens; identical to SEQ ID NO: 199058

SEQ ID NO: 199715 - RNA, 64 nt, Homo Sapiens
aagcccagagagagcacuggguuuguucaggaccacccagaaggugucacacgggguuucccca

SEQ ID NO: 199716 - RNA, 64 nt, Homo Sapiens
caaggaccaagggccauaucccaagugacuuuguacccagaaaauaacagcuguucaauaaaug

SEQ ID NO: 199717 - RNA, 64 nt, Homo Sapiens
uggcuguuucuuuggaucccucugucccagagccacccagaacccugacucuugagaaucaaga

SEQ ID NO: 199718 - RNA, 64 nt, Homo Sapiens
acccagaacccugacucuugagaaucaagaaaacacccagaaaggccuuaaugaccucauaggc

SEQ ID NO: 199719 - RNA, 64 nt, Homo Sapiens
agcucaaagaagggguuaaugaugcuaacuagagacccagaacgucugaaaacguccugauauu

SEQ ID NO: 199720 - RNA, 64 nt, Homo Sapiens
aucugaugccucuacuaucauuaccucuauugggacccagaaaccaauaccccaaaauauggug

SEQ ID NO: 199721 - RNA, 64 nt, Homo Sapiens
uauuuucuguucaaugcaaaaucccauugcuaacacccagaacauaauuauccuuucuuuuuca

SEQ ID NO: 199722 - RNA, 64 nt, Homo Sapiens
aaaagguagaauagggcugaagggugauuuaaaaacccagaaacagagugaauugcguauaaaa

SEQ ID NO: 199723 - RNA, 64 nt, Homo Sapiens
ggcuggacagcaccagcagcgcaucccggcgggaacccagaaaaggcuucuuacacagcagccu

SEQ ID NO: 199724 - RNA, 64 nt, Homo Sapiens
cugagaugacuaggacagucuguacccagaggccacccagaagcccucagauguacauacacag

SEQ ID NO: 199725 - RNA, 64 nt, Homo Sapiens
agcaggcgggcugaggagaguggaaaaggaagcgacccagaaauggcagggacacuucucuugc

SEQ ID NO: 199726 - RNA, 64 nt, Homo Sapiens
ccaggauacaaaaaaaaacauuuaaaaauccgagacccagaacacuucuggucccaagcauuuc

SEQ ID NO: 199727 - RNA, 64 nt, Homo Sapiens
agauugaauuguuuugcuuccaguguguugccuuacccagaaugacugucuuuauugcagaaga

SEQ ID NO: 199728 - RNA, 64 nt, Homo Sapiens
agugcuaggauuacaggcgucaguguguugccuuacccagaaugacacacacuauuucagaaga

SEQ ID NO: 199729 - RNA, 64 nt, Homo Sapiens
ugcagauucacucaguuuaaggcaaccacccagaacccagaaaauuucaauuuggcuaaugaag

SEQ ID NO: 199730 - RNA, 62 nt, Homo Sapiens
cagaaaaugcagauucacucugaagggcaaccacccagaaccucuuuuuucaauuuggcuaa

SEQ ID NO: 199731 - RNA, 64 nt, Homo Sapiens
ggaugcgaggccacggcucagugaugggcucaccacccagaaguggggagagacuuugggccuc

SEQ ID NO: 199732 - RNA, 64 nt, Homo Sapiens
ggcagccuccuccaaaucccuccuggaggggccuacccagaagccuccuugaaccagucugcaa

SEQ ID NO: 199733 - RNA, 64 nt, Homo Sapiens; identical to SEQ ID NO: 87364

SEQ ID NO: 199734 - RNA, 64 nt, Homo Sapiens; identical to SEQ ID NO: 87365

SEQ ID NO: 199735 - RNA, 64 nt, Homo Sapiens; identical to SEQ ID NO: 87366

SEQ ID NO: 199736 - RNA, 64 nt, Homo Sapiens; identical to SEQ ID NO: 87367

SEQ ID NO: 199737 - RNA, 64 nt, Homo Sapiens; identical to SEQ ID NO: 87368

SEQ ID NO: 199738 - RNA, 64 nt, Homo Sapiens; identical to SEQ ID NO: 87369

SEQ ID NO: 199739 - RNA, 64 nt, Homo Sapiens; identical to SEQ ID NO: 87370

SEQ ID NO: 199740 - RNA, 64 nt, Homo Sapiens; identical to SEQ ID NO: 87371

SEQ ID NO: 199741 - RNA, 64 nt, Homo Sapiens; identical to SEQ ID NO: 87372

SEQ ID NO: 199742 - RNA, 64 nt, Homo Sapiens; identical to SEQ ID NO: 87373

SEQ ID NO: 199743 - RNA, 64 nt, Homo Sapiens; identical to SEQ ID NO: 87374

SEQ ID NO: 199744 - RNA, 64 nt, Homo Sapiens; identical to SEQ ID NO: 87375

SEQ ID NO: 199745 - RNA, 64 nt, Homo Sapiens; identical to SEQ ID NO: 87376

SEQ ID NO: 199746 - RNA, 64 nt, Homo Sapiens; identical to SEQ ID NO: 87377

SEQ ID NO: 199747 - RNA, 64 nt, Homo Sapiens; identical to SEQ ID NO: 87378

SEQ ID NO: 199748 - RNA, 64 nt, Homo Sapiens; identical to SEQ ID NO: 87379

SEQ ID NO: 199749 - RNA, 64 nt, Homo Sapiens; identical to SEQ ID NO: 87380

SEQ ID NO: 199750 - RNA, 64 nt, Homo Sapiens; identical to SEQ ID NO: 87381

SEQ ID NO: 199751 - RNA, 64 nt, Homo Sapiens; identical to SEQ ID NO: 87382

SEQ ID NO: 199752 - RNA, 64 nt, Homo Sapiens; identical to SEQ ID NO: 87383

SEQ ID NO: 199753 - RNA, 64 nt, Homo Sapiens; identical to SEQ ID NO: 87384

SEQ ID NO: 199754 - RNA, 64 nt, Homo Sapiens; identical to SEQ ID NO: 87385

SEQ ID NO: 199755 - RNA, 64 nt, Homo Sapiens; identical to SEQ ID NO: 87386

SEQ ID NO: 199756 - RNA, 64 nt, Homo Sapiens; identical to SEQ ID NO: 87387

SEQ ID NO: 199757 - RNA, 64 nt, Homo Sapiens; identical to SEQ ID NO: 87388

SEQ ID NO: 199758 - RNA, 64 nt, Homo Sapiens; identical to SEQ ID NO: 87389

SEQ ID NO: 199759 - RNA, 64 nt, Homo Sapiens; identical to SEQ ID NO: 87390

SEQ ID NO: 199760 - RNA, 64 nt, Homo Sapiens; identical to SEQ ID NO: 87391

SEQ ID NO: 199761 - RNA, 64 nt, Homo Sapiens; identical to SEQ ID NO: 87392

SEQ ID NO: 199762 - RNA, 64 nt, Homo Sapiens; identical to SEQ ID NO: 87393

SEQ ID NO: 199763 - RNA, 64 nt, Homo Sapiens; identical to SEQ ID NO: 87394

SEQ ID NO: 199764 - RNA, 64 nt, Homo Sapiens; identical to SEQ ID NO: 87395

SEQ ID NO: 199765 - RNA, 64 nt, Homo Sapiens; identical to SEQ ID NO: 87396

SEQ ID NO: 199766 - RNA, 64 nt, Homo Sapiens; identical to SEQ ID NO: 87397

SEQ ID NO: 199767 - RNA, 64 nt, Homo Sapiens; identical to SEQ ID NO: 87398

SEQ ID NO: 199768 - RNA, 64 nt, Homo Sapiens; identical to SEQ ID NO: 87399

SEQ ID NO: 199769 - RNA, 64 nt, Homo Sapiens; identical to SEQ ID NO: 87400

SEQ ID NO: 199770 - RNA, 64 nt, Homo Sapiens; identical to SEQ ID NO: 87401

SEQ ID NO: 199771 - RNA, 64 nt, Homo Sapiens; identical to SEQ ID NO: 87402

SEQ ID NO: 199772 - RNA, 64 nt, Homo Sapiens; identical to SEQ ID NO: 87403

SEQ ID NO: 199773 - RNA, 64 nt, Homo Sapiens; identical to SEQ ID NO: 87404

SEQ ID NO: 199774 - RNA, 64 nt, Homo Sapiens; identical to SEQ ID NO: 87405

SEQ ID NO: 199775 - RNA, 64 nt, Homo Sapiens; identical to SEQ ID NO: 87406

SEQ ID NO: 199776 - RNA, 64 nt, Homo Sapiens
uuuauugaguuauaaaaguauuuccgaauguaucauugaauaauuucauauuuuauacauuuau

SEQ ID NO: 199777 - RNA, 64 nt, Homo Sapiens
ugcuucauuucaaauacuccuucuguuuaaaaauauugaauauuuagaaacuuucugaaauaau

SEQ ID NO: 199778 - RNA, 64 nt, Homo Sapiens
aaauauauuuauuuauccacagauuaaauugaauauugaauaaaagugaaacauaggcuaauau

SEQ ID NO: 199779 - RNA, 64 nt, Homo Sapiens
gaauaaaaaauauauuuauucuaauauagauuaaauugaauauuccuauaaagugaaacauagg

SEQ ID NO: 199780 - RNA, 64 nt, Homo Sapiens
uuuuuagaagguuacugaaauucuguguaauaauauugaauaauaaaaucacagcaaucucuga

SEQ ID NO: 199781 - RNA, 64 nt, Homo Sapiens
aaucacagcaaucucugauuaaucaagaugucaaauugaauaaaauucuuacuaguuucauucu

SEQ ID NO: 199782 - RNA, 64 nt, Homo Sapiens
guacugaaggugaaaaccagaucucauguaauuuauugaauacucuucuaaugaaguauggaau

SEQ ID NO: 199783 - RNA, 64 nt, Homo Sapiens
cccaaccuacugaacaucgugaaguugaaaaugcauugaauacaaucguaaguccaaaauauug

SEQ ID NO: 199784 - RNA, 64 nt, Homo Sapiens
ugaaagauaacuguagucaguucauuaucucuauauugaauaggaagguaugcuauaggcauca

SEQ ID NO: 199785 - RNA, 64 nt, Homo Sapiens
aauaucuuuugcguaaaaaccauuaccaaauaucauugaauauuucaaccuguauuugaacaag

SEQ ID NO: 199786 - RNA, 64 nt, Homo Sapiens
caugaaugaaguaguuuguuucauagcuugucucauugaauaguauuauugaagauacuaaaug

SEQ ID NO: 199787 - RNA, 64 nt, Homo Sapiens
aaaaagucccacugucagauuauauuaucuaacaauugaauauuguaaauauacuugucuuacc

SEQ ID NO: 199788 - RNA, 64 nt, Homo Sapiens
gaaaaauugacaaauuguguuaccuguacagaaaauugaauauuuauaagaauugucccaaaag

SEQ ID NO: 199789 - RNA, 64 nt, Homo Sapiens
cauugacaaaaacacuauuaauuuacagcaaaauauugaauaacgugagaaacaauucuuuuua

SEQ ID NO: 199790 - RNA, 64 nt, Homo Sapiens
cacggggacuugucucacuagcauccuguuacguauugaauauagaaaucauucuaacaaccca

SEQ ID NO: 199791 - RNA, 64 nt, Homo Sapiens
uaaauuuguauauaaucuaaugucuucauuauuaauugaauaguacauguuaacauuuuaaucu

SEQ ID NO: 199792 - RNA, 64 nt, Homo Sapiens
agccaguuguggagaauuguuugaauauuaucccauugaauacccagagccacuaaaucuuuuu

SEQ ID NO: 199793 - RNA, 64 nt, Homo Sapiens
cuuaaacuauguaaacccuuguccuaaggaaguaauugaauaauugcccaaagauuguauguau

SEQ ID NO: 199794 - RNA, 64 nt, Homo Sapiens
ccuuccucagggucugcuuggagcagcuccucugcaggcacagccuggacuauucccaggcaca

SEQ ID NO: 199795 - RNA, 64 nt, Homo Sapiens
gcagcuccucugcaggcacagccuggacuauucccaggcacagcugugggcccaggagccagcu

SEQ ID NO: 199796 - RNA, 64 nt, Homo Sapiens
ggcucacgccuguaaucucgaaaauuaaaaugaccaggcacaguagggcaauacaggcauuuaa

SEQ ID NO: 199797 - RNA, 64 nt, Homo Sapiens
cugccacgcccagcuaauuuaguagcugggacugcaggcacacauauccugccucagccucccg

SEQ ID NO: 199798 - RNA, 64 nt, Homo Sapiens
ggcucacgccuguaaucccagcauuguuuuaguccaggcacaguugcagaaugcgcuuuagaaa

SEQ ID NO: 199799 - RNA, 64 nt, Homo Sapiens
aggcugcagaaugcgcuuuacaccucucaccucacaggcacauccaaagcuucugucccuccca

SEQ ID NO: 199800 - RNA, 64 nt, Homo Sapiens
ccaccacacuuggguaauuaagcagcuaggacuacaggcacaugccuuuugcuucagccuccca

SEQ ID NO: 199801 - RNA, 64 nt, Homo Sapiens
aggaagggcuggauugggcccaacccggaaguggcaggcacagacuucaagcgcuguaaagcac

SEQ ID NO: 199802 - RNA, 64 nt, Homo Sapiens
ggcauggccuguggcccgagggccaaccaccgagcaggcacagcacagcagugacucggugagg

SEQ ID NO: 199803 - RNA, 64 nt, Homo Sapiens
gggaaggucacaaggccugggguuguucacaccacaggcacaauacagagcuguccacucuuga

SEQ ID NO: 199804 - RNA, 64 nt, Homo Sapiens
gccgccacacccagcucauugaguagcugguauacaggcacaucuucuuguaccucagccugcu

SEQ ID NO: 199805 - RNA, 55 nt, Homo Sapiens
ccaccagacccagcuaaugugacugcaggcacacaccucagucccaauuggcuag

SEQ ID NO: 199806 - RNA, 64 nt, Homo Sapiens
cacacacaugcacacauacacgugcacacauacacaggcacacaugcaugcacacauacacaug

SEQ ID NO: 199807 - RNA, 64 nt, Homo Sapiens
uacacaugcacacacacaugcacacauauaugcacaggcacacacauguacgcacacacacaug

SEQ ID NO: 199808 - RNA, 64 nt, Homo Sapiens
cuccacccugcaggggcccagacugccugcaggucaggcacaggggcaucuaccuagacaggac

SEQ ID NO: 199809 - RNA, 64 nt, Homo Sapiens
gagagagaagggcccggagggugucuccccaagccaggcacaccugcacaaacccagagccgac

SEQ ID NO: 199810 - RNA, 64 nt, Homo Sapiens
gcaaagggacugaacugaccaagaagcucaccaccaggcacacaugaccacugggacuucaggc

SEQ ID NO: 199811 - RNA, 51 nt, Homo Sapiens
ucccaggaccaaggagagguacaggcacaggcuggggcagggcaccaguga

SEQ ID NO: 199812 - RNA, 64 nt, Homo Sapiens
uagcuacugacagccuccugcugcccuacccuggcaggcacaggcgcagcuggcuggggggccc

SEQ ID NO: 199813 - RNA, 64 nt, Homo Sapiens
caccauggcaugaggaagaaacaaggucccugagcaggcacaaguccugacagucaagggacug

SEQ ID NO: 199814 - RNA, 64 nt, Homo Sapiens
agccuugaagcugaagcucaacguggagggagaacaggcacauugaucuggcauuuucugcuuu

SEQ ID NO: 199815 - RNA, 64 nt, Homo Sapiens
gaguggcagagcaagagggggcugggcagcaagccaggcacaguaggagagaaggcuggggagg

SEQ ID NO: 199816 - RNA, 64 nt, Homo Sapiens
uggcaaaacucggaagugaacauacauaugcacacaggcacacacuccagaggucuguacauca

SEQ ID NO: 199817 - RNA, 64 nt, Homo Sapiens
uacuuacgcgaacacagcaggucaccccaugggacaggcacagcccucccaugaccaggcagug

SEQ ID NO: 199818 - RNA, 64 nt, Homo Sapiens
cccugcccauugcagguggcgaagugaaaggucccaggcacacagcggccagaagacaagcagg

SEQ ID NO: 199819 - RNA, 64 nt, Homo Sapiens
ucagugggugguggggugauggauacacaucuaucaggcacagggcggaggugggcaccacuga

SEQ ID NO: 199820 - RNA, 64 nt, Homo Sapiens
agaaaaaugagaucagaaguggagauguuggggccaggcacaguggcccaggccuguaauccca

SEQ ID NO: 199821 - RNA, 64 nt, Homo Sapiens
aaacaaccguaugagcgcauuggcuugucugccgcaggcacagaaggguagaaagccacagcag

SEQ ID NO: 199822 - RNA, 64 nt, Homo Sapiens
acgacagccuuuaguuuuccugaaaucaccaggucaggcacaaggagaaaagguuccuggauac

SEQ ID NO: 199823 - RNA, 64 nt, Homo Sapiens
gacuggcuauuuaucaccacugacuuugauauuccaggcacacggugugaucccuggcacgcac

SEQ ID NO: 199824 - RNA, 64 nt, Homo Sapiens
cacucauauacauagacacaucccugaaaacacacaggcacauagcacccauccugcacacauc

SEQ ID NO: 199825 - RNA, 64 nt, Homo Sapiens; identical to SEQ ID NO: 145515

SEQ ID NO: 199826 - RNA, 64 nt, Homo Sapiens; identical to SEQ ID NO: 145516

SEQ ID NO: 199827 - RNA, 64 nt, Homo Sapiens; identical to SEQ ID NO: 145517

SEQ ID NO: 199828 - RNA, 64 nt, Homo Sapiens; identical to SEQ ID NO: 145518

SEQ ID NO: 199829 - RNA, 64 nt, Homo Sapiens; identical to SEQ ID NO: 145519

SEQ ID NO: 199830 - RNA, 64 nt, Homo Sapiens; identical to SEQ ID NO: 145520

SEQ ID NO: 199831 - RNA, 64 nt, Homo Sapiens; identical to SEQ ID NO: 145521

SEQ ID NO: 199832 - RNA, 64 nt, Homo Sapiens; identical to SEQ ID NO: 145522

SEQ ID NO: 199833 - RNA, 64 nt, Homo Sapiens; identical to SEQ ID NO: 145523

SEQ ID NO: 199834 - RNA, 64 nt, Homo Sapiens; identical to SEQ ID NO: 145524

SEQ ID NO: 199835 - RNA, 64 nt, Homo Sapiens; identical to SEQ ID NO: 145525

SEQ ID NO: 199836 - RNA, 64 nt, Homo Sapiens; identical to SEQ ID NO: 145526

SEQ ID NO: 199837 - RNA, 64 nt, Homo Sapiens; identical to SEQ ID NO: 145527

SEQ ID NO: 199838 - RNA, 64 nt, Homo Sapiens; identical to SEQ ID NO: 145528

SEQ ID NO: 199839 - RNA, 64 nt, Homo Sapiens; identical to SEQ ID NO: 145529

SEQ ID NO: 199840 - RNA, 64 nt, Homo Sapiens; identical to SEQ ID NO: 145530

SEQ ID NO: 199841 - RNA, 64 nt, Homo Sapiens; identical to SEQ ID NO: 145531

SEQ ID NO: 199842 - RNA, 64 nt, Homo Sapiens; identical to SEQ ID NO: 145532

SEQ ID NO: 199843 - RNA, 64 nt, Homo Sapiens; identical to SEQ ID NO: 145533

SEQ ID NO: 199844 - RNA, 64 nt, Homo Sapiens; identical to SEQ ID NO: 145534

SEQ ID NO: 199845 - RNA, 64 nt, Homo Sapiens; identical to SEQ ID NO: 145535

SEQ ID NO: 199846 - RNA, 64 nt, Homo Sapiens; identical to SEQ ID NO: 145536

SEQ ID NO: 199847 - RNA, 64 nt, Homo Sapiens
cgaagggcuuggaaggagacgguggggcaugggaggaccagagaguggcuguggcuuuuuggga

SEQ ID NO: 199848 - RNA, 64 nt, Homo Sapiens
caucuaaagcaaaaaaaaaaaggucccagugaugggaccagaagaccacaugugagcuucuuuu

SEQ ID NO: 199849 - RNA, 64 nt, Homo Sapiens
uuuggccagaugugugauucugugacuugucccaggaccagaauguaccuaagucagauccaua

SEQ ID NO: 199850 - RNA, 64 nt, Homo Sapiens
agucagauccauagacgcauguugguaggucacuggaccagagcuugugaagcaggcaaccucu

SEQ ID NO: 199851 - RNA, 64 nt, Homo Sapiens
cugcacccggugagugaggagaaacccucuucauggaccagacucuccccugggagcagagaga

SEQ ID NO: 199852 - RNA, 64 nt, Homo Sapiens
ggcccaggccagcugggcgcagccaagcacuuauggaccagaguccagggucuggcuggcuggu

SEQ ID NO: 199853 - RNA, 64 nt, Homo Sapiens
aaccuggccuggguugucuccgcaugcuucccauggaccagagauagucagggcaaaaagcaua

SEQ ID NO: 199854 - RNA, 64 nt, Homo Sapiens
cucagaugcucagaagaaagcacagcccugauuuggaccagaaugaaucccggcuccugguccu

SEQ ID NO: 199855 - RNA, 55 nt, Homo Sapiens
accaagauauucugccaaaauaucaggaccagaauuuucuaccuaaggaccagaa

SEQ ID NO: 199856 - RNA, 64 nt, Homo Sapiens
ugccaaaauaucaggaccagaauuuucuaccuaaggaccagaauuuuuuaucuagagaccagca

SEQ ID NO: 199857 - RNA, 64 nt, Homo Sapiens
uccccaaagaccaagauauucugccaaaauaucaggaccagaauuuucuaccuaaggaccagaa

SEQ ID NO: 199858 - RNA, 64 nt, Homo Sapiens
ugccaaaauaucaggaccagaauuuucuaccuaaggaccagaauuuuuugucuagagaccagca

SEQ ID NO: 199859 - RNA, 64 nt, Homo Sapiens
gauguccucucucagcuaucugagauuggggguuggaccagaguaagagcccuuauuugugggg

SEQ ID NO: 199860 - RNA, 64 nt, Homo Sapiens
agagaauuggagcuguacgaaaaugaaaagcuuaggaccagaagaugacuuucagucucucuga

SEQ ID NO: 199861 - RNA, 64 nt, Homo Sapiens
ucuuaauccuaucuauggauaaaacauacaccguggaccagaggaugcuauugaaaaaguucag

SEQ ID NO: 199862 - RNA, 64 nt, Homo Sapiens
ugacuagccuucauguaauuuuuuuuucaguaagggaccagaaguagaauauaaacaggacuug

SEQ ID NO: 199863 - RNA, 64 nt, Homo Sapiens
acagcuacaccuuccagcaggugcaggagcacacggaccagauuuggaaguuccagcgccauga

SEQ ID NO: 199864 - RNA, 64 nt, Homo Sapiens
ggaucgagacgguggccgucagcguccacuuccaggaccagaaugacguggagcugaacaggcu

SEQ ID NO: 199865 - RNA, 64 nt, Homo Sapiens
aagaauccagauuuccuuaugcugguaaagagcaggaccagagguuuaaguugaggaaguggag

SEQ ID NO: 199866 - RNA, 64 nt, Homo Sapiens
uucuaauuauauuuuaaaugaauaauuucaauguggaccagacauuaacaguuaugcuugcauu

SEQ ID NO: 199867 - RNA, 64 nt, Homo Sapiens
ugagcaccacuguaccuggcuagcuacuucuuuguuagaggauugagaaugaaauuucugcaaa

SEQ ID NO: 199868 - RNA, 64 nt, Homo Sapiens
aaaugcaccaggauggugucugugcacgugacuauuagaggagcgucuguagaaguaccugguu

SEQ ID NO: 199869 - RNA, 64 nt, Homo Sapiens
acaaaucagacauacacacauuagauagauaaauuuagaggacaaaauaaggaacaugaaaagc

SEQ ID NO: 199870 - RNA, 64 nt, Homo Sapiens
aaauggacaguacuaggguagaggggaagucagauuagaggaaagaaagagcaucaggaacagu

SEQ ID NO: 199871 - RNA, 64 nt, Homo Sapiens
aaaaaagguuagggaaguguuggauuuuaaccucuuagaggaagaguugucagugaaacuacuu

SEQ ID NO: 199872 - RNA, 64 nt, Homo Sapiens
uucgucagaaaaauguggagagcugccaccaccuuuagaggaaucaaagugccuucuguuucac

SEQ ID NO: 199873 - RNA, 64 nt, Homo Sapiens
agaacccacuccugagaacagcggagccaggcgcuuagaggaagaccaaaugcugccaggacac

SEQ ID NO: 199874 - RNA, 64 nt, Homo Sapiens
acggauuguccagggauuacauuccagcaucuuauuagaggacggaagcagagggugcuguuuc

SEQ ID NO: 199875 - RNA, 64 nt, Homo Sapiens
aaagauuguagguggcuuggggaauguggguggcuuagaggaucuaaaccgauucacuuccugg

SEQ ID NO: 199876 - RNA, 64 nt, Homo Sapiens
gguugagaagcaacgagggcuugcucuaaaucguuuagaggauaacaggaucuagagaugcucu

SEQ ID NO: 199877 - RNA, 64 nt, Homo Sapiens
ccugcuggcuacagcauggggugcccuauaggcacaagcccagcugaagaacagaauggagggc

SEQ ID NO: 199878 - RNA, 64 nt, Homo Sapiens
cuccuugacugcagaagaccaagaaccuguuccccaagcccagagauguccaccugggcuggac

SEQ ID NO: 199879 - RNA, 64 nt, Homo Sapiens
ugaagggggaggaugacaagccgcugcccaccuccaagcccaggaaacaguacaagauggcuaa

SEQ ID NO: 199880 - RNA, 64 nt, Homo Sapiens
auaaagguggcuccagaaagggcauccucuaccccaagcccaaagccugcugggugucccccau

SEQ ID NO: 199881 - RNA, 64 nt, Homo Sapiens
aggugucaggauagucacaguacagccacauccccaagcccaccgcuccugccccuuucaggcc

SEQ ID NO: 199882 - RNA, 64 nt, Homo Sapiens
cuugguuucugugagaauagcucucugccccacccaagcccaaaccugccucagcugacccggc

SEQ ID NO: 199883 - RNA, 64 nt, Homo Sapiens
cccagggcgcuuagggagaagucccaucgaccagcaagcccagcccccaccuccccgcaagcug

SEQ ID NO: 199884 - RNA, 64 nt, Homo Sapiens
cccuugucagcuuagggggacacccaccucaagacaagcccacguggcuguaaccagggcacau

SEQ ID NO: 199885 - RNA, 64 nt, Homo Sapiens
cucaucuaaagacaccuuccuuuccacuggcugucaagcccacagggcaccagugccacccagg

SEQ ID NO: 199886 - RNA, 64 nt, Homo Sapiens
caaccaggccuugccuucugagagcccccguggccaagcccaggucacagaucuucccccgacc

SEQ ID NO: 199887 - RNA, 64 nt, Homo Sapiens
uccuucucagugcagggacgucaccccugccaggcaagcccagggcacagaugccaggauggcu

SEQ ID NO: 199888 - RNA, 64 nt, Homo Sapiens
cucccucucagugcgaggcuucaccccugccaggcaagcccagggcauagaugcugagacagcc

SEQ ID NO: 199889 - RNA, 64 nt, Homo Sapiens
ucccucucagugcagggacgucaccccugccaggcaagcccagggcacagaggccgggacggcc

SEQ ID NO: 199890 - RNA, 64 nt, Homo Sapiens
cucccucucagugugaggcuucacccaugcuaggcaagcccagggcacagaugccgggauggcc

SEQ ID NO: 199891 - RNA, 64 nt, Homo Sapiens
ucccucucagugcgggaacgucaccccugccaggcaagcccagggcacagaugcugcgauggcc

SEQ ID NO: 199892 - RNA, 64 nt, Homo Sapiens
gaagagccaagcagaagcuccuggagauugccaccaagcccacguacccggugagccugggggc

SEQ ID NO: 199893 - RNA, 64 nt, Homo Sapiens
uggcagcagcaagcacaauaccauuaaaaagccucaagcccaaggcagaagaccuaucugcauu

SEQ ID NO: 199894 - RNA, 64 nt, Homo Sapiens
uugggcugagggagagggggccgggagggguugucaagcccacccgggaaacugagcccuggag

SEQ ID NO: 199895 - RNA, 64 nt, Homo Sapiens
ugggggcagguagaccuguggggauggcucgguccaagcccaacacugcccgcuccagagagcc

SEQ ID NO: 199896 - RNA, 64 nt, Homo Sapiens
gacaccuggagcccccaggagagugaugcggccacaagcccaggguggagacagaggcagacug

SEQ ID NO: 199897 - RNA, 64 nt, Homo Sapiens
gaugccuggaguccccaggaaagugaugcugccccaagcccaggaaagacagaggcagagacug

SEQ ID NO: 199898 - RNA, 64 nt, Homo Sapiens
cauagagauaaaauucuuugaaccacuaaguuggaguacugacucuccugguccacaaugugag

SEQ ID NO: 199899 - RNA, 64 nt, Homo Sapiens
caguauuuauuaaguaaauguaucuguauauauaaguacugaauugguuacucauccaucagac

SEQ ID NO: 199900 - RNA, 64 nt, Homo Sapiens
aaugggagcacacaguacugggaaaugggcauacaguacugagagaaaugggagcacaguacug

SEQ ID NO: 199901 - RNA, 64 nt, Homo Sapiens
aaugggaguacacuacugagagaagugggagcacaguacugagagaagugggagcacaguacug

SEQ ID NO: 199902 - RNA, 64 nt, Homo Sapiens
agugggagcacaguacugagggaagugggagcacaguacugagagaaaugggagcacaguacug

SEQ ID NO: 199903 - RNA, 64 nt, Homo Sapiens
gacauucauugugaugagggagcuggcuggagcuaguacugacuggauucuugaugggcugagc

SEQ ID NO: 199904 - RNA, 64 nt, Homo Sapiens
augcccacagccaccggcuguuuuggccugaggaaguacugacccaauagguuuuuuuuuuuuu

SEQ ID NO: 199905 - RNA, 64 nt, Homo Sapiens
ucaaaggagcugguucuucuuuacuuguuuuggcaguacugaaauuguaauuaacucugggggc

SEQ ID NO: 199906 - RNA, 64 nt, Homo Sapiens
guguaagcuaaauugcugauuagcauugcauuucaguacugacugaucaagguuuccuuaaauu

SEQ ID NO: 199907 - RNA, 64 nt, Homo Sapiens
ccaaauucgccuccacccacacuuaaugucuucuuccucucaagaacccagaccucagaugagg

SEQ ID NO: 199908 - RNA, 64 nt, Homo Sapiens
cucccugaugaagaguugacgauucccacuccccuccucucagcuucacagacauuaaagugac

SEQ ID NO: 199909 - RNA, 64 nt, Homo Sapiens
gcauguuucccuccaauauuguuuucccuuguuuuccucucauucugggcuguaacaauucagg

SEQ ID NO: 199910 - RNA, 64 nt, Homo Sapiens
ccacguuuugcucaagaagccgaaggcccucucuuccucucauaaauuuucagaaagggaacaa

SEQ ID NO: 199911 - RNA, 64 nt, Homo Sapiens
uuuccucuuugacuaaauggcccaauccugcuccuccucucauguacaugucauugaucuugcc

SEQ ID NO: 199912 - RNA, 64 nt, Homo Sapiens
uauuauacaauuuaaaaacuuuuauauucauagauccucucaaguaauuauaaacaggacccaa

SEQ ID NO: 199913 - RNA, 64 nt, Homo Sapiens
uuuggccugagcuugugggucuguucagacugucuccucucaugguuugaaacugcaucugaau

SEQ ID NO: 199914 - RNA, 64 nt, Homo Sapiens
uaugauuaguucacauuuacuggugcauccuugauccucucacagauagaggucuuaaagguug

SEQ ID NO: 199915 - RNA, 64 nt, Homo Sapiens
caaccaagguugaccacacaaaccaggaaauugcuccucucagcgggcugucuuuacuugugga

SEQ ID NO: 199916 - RNA, 64 nt, Homo Sapiens
uggugcagaaacagucaagaagcagagcagccccuccucucauuccccccccgccacgccuuag

SEQ ID NO: 199917 - RNA, 64 nt, Homo Sapiens
ucaccugagaagaaaguguacgaagagaguguccuccucucacaugagccagaucagccagaaa

SEQ ID NO: 199918 - RNA, 64 nt, Homo Sapiens
auguagaguguggaaaggaguugcugauugcauuuccucucauuaacaauuggguguguaauaa

SEQ ID NO: 199919 - RNA, 64 nt, Homo Sapiens
ggucuuggaugccauccugcucaucuccagcauuuccucucaccuccguguucucggggagugc

SEQ ID NO: 199920 - RNA, 64 nt, Homo Sapiens
ggugucagaucccauccugcucaucuccagcauuuccucucaccucuguguucucggggagugc

SEQ ID NO: 199921 - RNA, 64 nt, Homo Sapiens
ggugucagaucccauccugcuccucuccagcauuuccucucaccuccguguucucggggagugc

SEQ ID NO: 199922 - RNA, 64 nt, Homo Sapiens
ggugucagaucccauccugcuccucuccagaguuuccucucaccuccguguucucggggagugc

SEQ ID NO: 199923 - RNA, 64 nt, Homo Sapiens
uaugcaggugacauuuguucauucucuaaucccauccucucacccauccauuuccucacucagu

SEQ ID NO: 199924 - RNA, 64 nt, Homo Sapiens
ggccucugccuugggccucgccucuguccucagguccucucagaggcagauaccuaggggagcu

SEQ ID NO: 199925 - RNA, 64 nt, Homo Sapiens
cccaaaucuccuccuuccacaccugcugccagucuccucucaagcaagccuccugaaccacugg

SEQ ID NO: 199926 - RNA, 64 nt, Homo Sapiens
agaggaaggcaggggauuuaggaucgcccucccauccucucacccacuggaccccguaggaguc

SEQ ID NO: 199927 - RNA, 64 nt, Homo Sapiens
gguaccccaccuacuuagggaugaaauguggcaguccucucagguuaggcaccccucuuccuua

SEQ ID NO: 199928 - RNA, 64 nt, Homo Sapiens
uugggaccgaggggguggggagguggaaacacuguccucucaucagagggacucuaagaaccua

SEQ ID NO: 199929 - RNA, 64 nt, Homo Sapiens
gaacuaaugcucugaaaaggaggaccucuuuuuuuccucucaggauuuaugaaagcaauugguu

SEQ ID NO: 199930 - RNA, 64 nt, Homo Sapiens
uguaaaagaugaacucuuugcuccuucgauguuuuccucucaguggagagaggaguuuuauuuc

SEQ ID NO: 199931 - RNA, 64 nt, Homo Sapiens
ggcaaaugaaacgguauauuauuucuuugcagucuccucucagucauucaucaauguggccagc

SEQ ID NO: 199932 - RNA, 64 nt, Homo Sapiens
gucugucugcagaacuuucaggaugacuauuaauuccucucagaugucauuuuugaguggucca

SEQ ID NO: 199933 - RNA, 64 nt, Homo Sapiens
accccuagagcaggaaagagggaagguacagggguccucucagccuugaaggagcccacugcuc

SEQ ID NO: 199934 - RNA, 64 nt, Homo Sapiens
cuucucaucugcagguuggcuagaagugguggcauccucucacucuguaauuguaaucucagcu

SEQ ID NO: 199935 - RNA, 64 nt, Homo Sapiens
acugaccaaacacauggaaccucugaauuauucuuccucucaugaucucucuuguuuccucuca

SEQ ID NO: 199936 - RNA, 64 nt, Homo Sapiens
cugaauuauucuuccucucagaaucucucuuguuuccucucacugcuucccugagggcugccua

SEQ ID NO: 199937 - RNA, 64 nt, Homo Sapiens
cacacaucccaaauaccaccaccaaccaccuucuuccucucaacucugucccacaggccugucu

SEQ ID NO: 199938 - RNA, 64 nt, Homo Sapiens
ugaaggccauuucaagcgcugcuucucacuccauuccucucagcuguuauugcugcagggccaa

SEQ ID NO: 199939 - RNA, 64 nt, Homo Sapiens
gcuaaggacuucagacaccauguccgaaaccuguuccucucaagugcccuguuguguggaacac

SEQ ID NO: 199940 - RNA, 64 nt, Homo Sapiens
auaaggaaugcauuaugggucaaaaaucaaacauuccucucauguuauguauauuuuguuccug

SEQ ID NO: 199941 - RNA, 64 nt, Homo Sapiens
agcacaagugcauacuaggagucugauguaugaguccucucagaaaauauuuuuccccacaauu

SEQ ID NO: 199942 - RNA, 64 nt, Homo Sapiens
aaggaaauauuuuuccccaccauguucagagaauuccucucauuggcuuccaaaccucacugag

SEQ ID NO: 199943 - RNA, 64 nt, Homo Sapiens
guuggaagugguauuuagguuaauuuuuuuacaagucaaacaaucaaaaguguuauuuguaagu

SEQ ID NO: 199944 - RNA, 64 nt, Homo Sapiens
uaugaggaaaugagaucacaauaauuuuauuucagucaaacauucuaaacauucuucagugaaa

SEQ ID NO: 199945 - RNA, 64 nt, Homo Sapiens
ugcauuccacagagauucagaaggcaccucuucggucaaacauggccccucuauaaccccacua

SEQ ID NO: 199946 - RNA, 64 nt, Homo Sapiens
agagggaagucaaguagugacuaacucacuauaugucaaacacaucauuacucuucucuuuucc

SEQ ID NO: 199947 - RNA, 64 nt, Homo Sapiens; identical to SEQ ID NO: 154890

SEQ ID NO: 199948 - RNA, 64 nt, Homo Sapiens; identical to SEQ ID NO: 154891

SEQ ID NO: 199949 - RNA, 64 nt, Homo Sapiens; identical to SEQ ID NO: 154892

SEQ ID NO: 199950 - RNA, 64 nt, Homo Sapiens; identical to SEQ ID NO: 154893

SEQ ID NO: 199951 - RNA, 64 nt, Homo Sapiens; identical to SEQ ID NO: 154894

SEQ ID NO: 199952 - RNA, 64 nt, Homo Sapiens; identical to SEQ ID NO: 154895

SEQ ID NO: 199953 - RNA, 64 nt, Homo Sapiens; identical to SEQ ID NO: 154896

SEQ ID NO: 199954 - RNA, 64 nt, Homo Sapiens; identical to SEQ ID NO: 154897

SEQ ID NO: 199955 - RNA, 64 nt, Homo Sapiens; identical to SEQ ID NO: 154898

SEQ ID NO: 199956 - RNA, 64 nt, Homo Sapiens; identical to SEQ ID NO: 154899

SEQ ID NO: 199957 - RNA, 64 nt, Homo Sapiens; identical to SEQ ID NO: 154900

SEQ ID NO: 199958 - RNA, 55 nt, Homo Sapiens; identical to SEQ ID NO: 154901

SEQ ID NO: 199959 - RNA, 64 nt, Homo Sapiens; identical to SEQ ID NO: 154902

SEQ ID NO: 199960 - RNA, 64 nt, Homo Sapiens; identical to SEQ ID NO: 154903

SEQ ID NO: 199961 - RNA, 64 nt, Homo Sapiens; identical to SEQ ID NO: 154904

SEQ ID NO: 199962 - RNA, 64 nt, Homo Sapiens; identical to SEQ ID NO: 154905

SEQ ID NO: 199963 - RNA, 64 nt, Homo Sapiens; identical to SEQ ID NO: 154906

SEQ ID NO: 199964 - RNA, 64 nt, Homo Sapiens; identical to SEQ ID NO: 154907

SEQ ID NO: 199965 - RNA, 64 nt, Homo Sapiens; identical to SEQ ID NO: 154908

SEQ ID NO: 199966 - RNA, 64 nt, Homo Sapiens; identical to SEQ ID NO: 154909

SEQ ID NO: 199967 - RNA, 64 nt, Homo Sapiens; identical to SEQ ID NO: 154910

SEQ ID NO: 199968 - RNA, 64 nt, Homo Sapiens; identical to SEQ ID NO: 154911

SEQ ID NO: 199969 - RNA, 64 nt, Homo Sapiens
ggggggcgacaagucagacccgaaccuuaauaaccccgcggacgaggaccaugccuaugcucug

SEQ ID NO: 199970 - RNA, 64 nt, Homo Sapiens
caagaccggcugcgugauccagccugugccaaaacccgcggagaaggcugccauggcaccgugc

SEQ ID NO: 199971 - RNA, 64 nt, Homo Sapiens; identical to SEQ ID NO: 95035

SEQ ID NO: 199972 - RNA, 64 nt, Homo Sapiens; identical to SEQ ID NO: 95036

SEQ ID NO: 199973 - RNA, 64 nt, Homo Sapiens; identical to SEQ ID NO: 95037

SEQ ID NO: 199974 - RNA, 64 nt, Homo Sapiens; identical to SEQ ID NO: 95038

SEQ ID NO: 199975 - RNA, 64 nt, Homo Sapiens; identical to SEQ ID NO: 95039

SEQ ID NO: 199976 - RNA, 64 nt, Homo Sapiens; identical to SEQ ID NO: 95040

SEQ ID NO: 199977 - RNA, 64 nt, Homo Sapiens; identical to SEQ ID NO: 95041

SEQ ID NO: 199978 - RNA, 64 nt, Homo Sapiens; identical to SEQ ID NO: 95042

SEQ ID NO: 199979 - RNA, 64 nt, Homo Sapiens; identical to SEQ ID NO: 95043

SEQ ID NO: 199980 - RNA, 64 nt, Homo Sapiens; identical to SEQ ID NO: 95044

SEQ ID NO: 199981 - RNA, 64 nt, Homo Sapiens; identical to SEQ ID NO: 95045

SEQ ID NO: 199982 - RNA, 64 nt, Homo Sapiens; identical to SEQ ID NO: 95046

SEQ ID NO: 199983 - RNA, 64 nt, Homo Sapiens; identical to SEQ ID NO: 95047

SEQ ID NO: 199984 - RNA, 64 nt, Homo Sapiens; identical to SEQ ID NO: 95048

SEQ ID NO: 199985 - RNA, 64 nt, Homo Sapiens; identical to SEQ ID NO: 95049

SEQ ID NO: 199986 - RNA, 64 nt, Homo Sapiens; identical to SEQ ID NO: 95050

SEQ ID NO: 199987 - RNA, 64 nt, Homo Sapiens; identical to SEQ ID NO: 95051

SEQ ID NO: 199988 - RNA, 64 nt, Homo Sapiens; identical to SEQ ID NO: 95052

SEQ ID NO: 199989 - RNA, 64 nt, Homo Sapiens; identical to SEQ ID NO: 160465

SEQ ID NO: 199990 - RNA, 64 nt, Homo Sapiens; identical to SEQ ID NO: 160466

SEQ ID NO: 199991 - RNA, 64 nt, Homo Sapiens; identical to SEQ ID NO: 160467

SEQ ID NO: 199992 - RNA, 64 nt, Homo Sapiens; identical to SEQ ID NO: 160468

SEQ ID NO: 199993 - RNA, 64 nt, Homo Sapiens; identical to SEQ ID NO: 160469

SEQ ID NO: 199994 - RNA, 64 nt, Homo Sapiens; identical to SEQ ID NO: 160470

SEQ ID NO: 199995 - RNA, 64 nt, Homo Sapiens; identical to SEQ ID NO: 160471

SEQ ID NO: 199996 - RNA, 64 nt, Homo Sapiens; identical to SEQ ID NO: 160472

SEQ ID NO: 199997 - RNA, 64 nt, Homo Sapiens; identical to SEQ ID NO: 160473

SEQ ID NO: 199998 - RNA, 64 nt, Homo Sapiens; identical to SEQ ID NO: 160474

SEQ ID NO: 199999 - RNA, 64 nt, Homo Sapiens; identical to SEQ ID NO: 160475

SEQ ID NO: 200000 - RNA, 63 nt, Homo Sapiens
gggcccuccaccuguggcucacaucucgccagccccacagagcauccucaggccucuccaagg

SEQ ID NO: 200001 - RNA, 63 nt, Homo Sapiens
ccucaaccuccggaguccaggagaacccguacccccacagagccuuaagcaacuacuucugug

SEQ ID NO: 200002 - RNA, 63 nt, Homo Sapiens
cuauuucugaugaauaugaauuaaaacaugccucccacagaaugcgucagcccgaguucugaa

SEQ ID NO: 200003 - RNA, 63 nt, Homo Sapiens
cgugaguugauuaaaucucugaagcauguaaagcccacagaaccugaggccuccccagaagca

SEQ ID NO: 200004 - RNA, 63 nt, Homo Sapiens
cucucggaccucgcuguguuucacugccuccugcccacagacccaggccugccggcccggacc

SEQ ID NO: 200005 - RNA, 63 nt, Homo Sapiens
ccaaguggacacauggcugugcaggccaggaggcccacagauggacugagugcugggaagggg

SEQ ID NO: 200006 - RNA, 63 nt, Homo Sapiens
uaauauauguccggacagcucaugccugugugccccacagaccacugccacauggagucuugc

SEQ ID NO: 200007 - RNA, 63 nt, Homo Sapiens
cacagugugucuggacagcccagaucugagugccccacagagucacugucaugcaggucauau

SEQ ID NO: 200008 - RNA, 63 nt, Homo Sapiens
acaagaugguguucugcuaauguuaaaugucagcccacagagcuaauaauaccucaguauaau

SEQ ID NO: 200009 - RNA, 63 nt, Homo Sapiens
gaacaacaagguuaagcuucaucugcuuggugucccacagaacuugcacaagcaguuguuauu

SEQ ID NO: 200010 - RNA, 63 nt, Homo Sapiens
cugguggggagaccauggcuggaggcugcucaccccacagacacugagaccuuggcucuguau

SEQ ID NO: 200011 - RNA, 63 nt, Homo Sapiens
gguuggcagcuucucuugucuaaaagcuggggacccacagaggggaggagaggaaacagugac

SEQ ID NO: 200012 - RNA, 63 nt, Homo Sapiens
augcagcccccagcugcaugaggaugaagccaccccacagaggaggccccacagaccccacag

SEQ ID NO: 200013 - RNA, 63 nt, Homo Sapiens
augaagccaccccacagaggaggccccacagaccccacagagggaaugcugaugacuuggagc

SEQ ID NO: 200014 - RNA, 63 nt, Homo Sapiens
ccacagaggaugaagccaccacuuggagcaggccccacagaccgugggcauggaaugcugaug

SEQ ID NO: 200015 - RNA, 63 nt, Homo Sapiens
gacacugaaagcugaguccugccgucugucucacccacagaugucuguagucggucgguguga

SEQ ID NO: 200016 - RNA, 63 nt, Homo Sapiens
cccagauucucaagcagaugcccaagggagguccccacagagccagagugccugaggcuuccu

SEQ ID NO: 200017 - RNA, 63 nt, Homo Sapiens
uuuguuuuuaaguaugacagugaguuaccucuucccacagacauaaaugauugauaauaggaa

SEQ ID NO: 200018 - RNA, 63 nt, Homo Sapiens
cacauccaagcucacaaauaacucucaucuucccccacagauaauauuuuccagagucucuaa

SEQ ID NO: 200019 - RNA, 63 nt, Homo Sapiens
ggacccccagagccaagguggcugggaucuggccccacagauggggaaagauggggaagggug

SEQ ID NO: 200020 - RNA, 63 nt, Homo Sapiens
acuccauaugcaaucaguagcgagcagccgggccccacagacccucaugcacucucuuacgug

SEQ ID NO: 200021 - RNA, 63 nt, Homo Sapiens
cuccagagcuagcugaggcccaccugccccucccccacagagccgaauccugacugcaaggcc

SEQ ID NO: 200022 - RNA, 63 nt, Homo Sapiens
ucuuagccaauccuaugcaguucccgagccccgcccacagagcggggcaacggcuccccauuu

SEQ ID NO: 200023 - RNA, 63 nt, Homo Sapiens
acaaauuugcugggagagggaaagacauucagacccacagaaaggaggcagcacacagagaaa

SEQ ID NO: 200024 - RNA, 63 nt, Homo Sapiens
uggggagguuggucagggaagagagggguucuacccacagaucaacuguguaaucuuuuacua

SEQ ID NO: 200025 - RNA, 63 nt, Homo Sapiens
ugcaggagcauagaauaguuuggguaccaggaacccacagaggcacacaugaaaagccaaauu

SEQ ID NO: 200026 - RNA, 63 nt, Homo Sapiens
uuagucuccauuucauagaugaaaauagugaagcccacagaaaauaaguagcuccuccacagg

SEQ ID NO: 200027 - RNA, 63 nt, Homo Sapiens
ccaccagucuuucugggaacguaugcacucagccccacagaaccagggaccacccuccccaca

SEQ ID NO: 200028 - RNA, 63 nt, Homo Sapiens
guuugauggcugugcuguaugguuacucugcaccccacagaugagaguccccagccucccuca

SEQ ID NO: 200029 - RNA, 63 nt, Homo Sapiens
ccugcuccccacacggacuccaggcgguccccacccacagaagcagaccuucagcucagguaa

SEQ ID NO: 200030 - RNA, 63 nt, Homo Sapiens
gggguggcccuggaggccccugaccccaccccacccacagagcacgagggccccgucagcuca

SEQ ID NO: 200031 - RNA, 63 nt, Homo Sapiens
aacgggaugcuuugaagauaccaugaaauaaaacccacagagguauuugauguauuuaauugu

SEQ ID NO: 200032 - RNA, 63 nt, Homo Sapiens
cagggacuugcaguggauucuuggucaggugugcccacagaugcggaggcgaggugagugauu

SEQ ID NO: 200033 - RNA, 63 nt, Homo Sapiens
aaagguggugagggcggaggggccgcuccaggccccacagagcaggagacccccagagaaagc

SEQ ID NO: 200034 - RNA, 63 nt, Homo Sapiens
ggugaguuuggugcaugcaaaccugugugcucacccacagagcaugggguaaugguguguaga

SEQ ID NO: 200035 - RNA, 63 nt, Homo Sapiens
gcaaagaaacugcccaugguuaggauaggggugcccacagaggcucagcccaacugcaggugg

SEQ ID NO: 200036 - RNA, 63 nt, Homo Sapiens
gcugcuccuggaugccccugacacgggccccuccccacagaaaccugugcuggccugugcuca

SEQ ID NO: 200037 - RNA, 64 nt, Homo Sapiens; identical to SEQ ID NO: 125667

SEQ ID NO: 200038 - RNA, 64 nt, Homo Sapiens; identical to SEQ ID NO: 125668

SEQ ID NO: 200039 - RNA, 64 nt, Homo Sapiens; identical to SEQ ID NO: 125669

SEQ ID NO: 200040 - RNA, 64 nt, Homo Sapiens; identical to SEQ ID NO: 125670

SEQ ID NO: 200041 - RNA, 64 nt, Homo Sapiens; identical to SEQ ID NO: 125671

SEQ ID NO: 200042 - RNA, 64 nt, Homo Sapiens; identical to SEQ ID NO: 125672

SEQ ID NO: 200043 - RNA, 64 nt, Homo Sapiens; identical to SEQ ID NO: 125673

SEQ ID NO: 200044 - RNA, 64 nt, Homo Sapiens; identical to SEQ ID NO: 125674

SEQ ID NO: 200045 - RNA, 64 nt, Homo Sapiens; identical to SEQ ID NO: 125675

SEQ ID NO: 200046 - RNA, 64 nt, Homo Sapiens; identical to SEQ ID NO: 125676

SEQ ID NO: 200047 - RNA, 64 nt, Homo Sapiens; identical to SEQ ID NO: 125677

SEQ ID NO: 200048 - RNA, 64 nt, Homo Sapiens; identical to SEQ ID NO: 125678

SEQ ID NO: 200049 - RNA, 64 nt, Homo Sapiens; identical to SEQ ID NO: 125679

SEQ ID NO: 200050 - RNA, 64 nt, Homo Sapiens; identical to SEQ ID NO: 125680

SEQ ID NO: 200051 - RNA, 64 nt, Homo Sapiens; identical to SEQ ID NO: 125681

SEQ ID NO: 200052 - RNA, 64 nt, Homo Sapiens; identical to SEQ ID NO: 125682

SEQ ID NO: 200053 - RNA, 64 nt, Homo Sapiens; identical to SEQ ID NO: 125683

SEQ ID NO: 200054 - RNA, 64 nt, Homo Sapiens; identical to SEQ ID NO: 125684

SEQ ID NO: 200055 - RNA, 64 nt, Homo Sapiens; identical to SEQ ID NO: 125685

SEQ ID NO: 200056 - RNA, 64 nt, Homo Sapiens; identical to SEQ ID NO: 125686

SEQ ID NO: 200057 - RNA, 64 nt, Homo Sapiens; identical to SEQ ID NO: 125687

SEQ ID NO: 200058 - RNA, 64 nt, Homo Sapiens; identical to SEQ ID NO: 125688

SEQ ID NO: 200059 - RNA, 64 nt, Homo Sapiens; identical to SEQ ID NO: 125689

SEQ ID NO: 200060 - RNA, 64 nt, Homo Sapiens; identical to SEQ ID NO: 125690

SEQ ID NO: 200061 - RNA, 64 nt, Homo Sapiens; identical to SEQ ID NO: 125691

SEQ ID NO: 200062 - RNA, 64 nt, Homo Sapiens; identical to SEQ ID NO: 125692

SEQ ID NO: 200063 - RNA, 64 nt, Homo Sapiens; identical to SEQ ID NO: 125693

SEQ ID NO: 200064 - RNA, 64 nt, Homo Sapiens; identical to SEQ ID NO: 125694

SEQ ID NO: 200065 - RNA, 64 nt, Homo Sapiens; identical to SEQ ID NO: 125695

SEQ ID NO: 200066 - RNA, 64 nt, Homo Sapiens; identical to SEQ ID NO: 125696

SEQ ID NO: 200067 - RNA, 64 nt, Homo Sapiens; identical to SEQ ID NO: 125697

SEQ ID NO: 200068 - RNA, 64 nt, Homo Sapiens; identical to SEQ ID NO: 125698

SEQ ID NO: 200069 - RNA, 64 nt, Homo Sapiens; identical to SEQ ID NO: 125699

SEQ ID NO: 200070 - RNA, 64 nt, Homo Sapiens; identical to SEQ ID NO: 125700

SEQ ID NO: 200071 - RNA, 64 nt, Homo Sapiens; identical to SEQ ID NO: 108992

SEQ ID NO: 200072 - RNA, 64 nt, Homo Sapiens; identical to SEQ ID NO: 108993

SEQ ID NO: 200073 - RNA, 64 nt, Homo Sapiens; identical to SEQ ID NO: 108994

SEQ ID NO: 200074 - RNA, 64 nt, Homo Sapiens; identical to SEQ ID NO: 108995

SEQ ID NO: 200075 - RNA, 64 nt, Homo Sapiens; identical to SEQ ID NO: 108996

SEQ ID NO: 200076 - RNA, 64 nt, Homo Sapiens; identical to SEQ ID NO: 108997

SEQ ID NO: 200077 - RNA, 64 nt, Homo Sapiens; identical to SEQ ID NO: 108998

SEQ ID NO: 200078 - RNA, 64 nt, Homo Sapiens; identical to SEQ ID NO: 108999

SEQ ID NO: 200079 - RNA, 64 nt, Homo Sapiens; identical to SEQ ID NO: 109000

SEQ ID NO: 200080 - RNA, 64 nt, Homo Sapiens; identical to SEQ ID NO: 109001

SEQ ID NO: 200081 - RNA, 64 nt, Homo Sapiens; identical to SEQ ID NO: 109002

SEQ ID NO: 200082 - RNA, 64 nt, Homo Sapiens; identical to SEQ ID NO: 109003

SEQ ID NO: 200083 - RNA, 64 nt, Homo Sapiens; identical to SEQ ID NO: 109004

SEQ ID NO: 200084 - RNA, 64 nt, Homo Sapiens; identical to SEQ ID NO: 109005

SEQ ID NO: 200085 - RNA, 64 nt, Homo Sapiens; identical to SEQ ID NO: 109006

SEQ ID NO: 200086 - RNA, 64 nt, Homo Sapiens; identical to SEQ ID NO: 109007

SEQ ID NO: 200087 - RNA, 64 nt, Homo Sapiens; identical to SEQ ID NO: 109008

SEQ ID NO: 200088 - RNA, 64 nt, Homo Sapiens; identical to SEQ ID NO: 109009

SEQ ID NO: 200089 - RNA, 64 nt, Homo Sapiens; identical to SEQ ID NO: 109010

SEQ ID NO: 200090 - RNA, 64 nt, Homo Sapiens; identical to SEQ ID NO: 109011

SEQ ID NO: 200091 - RNA, 64 nt, Homo Sapiens; identical to SEQ ID NO: 109012

SEQ ID NO: 200092 - RNA, 64 nt, Homo Sapiens; identical to SEQ ID NO: 109013

SEQ ID NO: 200093 - RNA, 64 nt, Homo Sapiens; identical to SEQ ID NO: 109014

SEQ ID NO: 200094 - RNA, 64 nt, Homo Sapiens; identical to SEQ ID NO: 109015

SEQ ID NO: 200095 - RNA, 64 nt, Homo Sapiens; identical to SEQ ID NO: 109016

SEQ ID NO: 200096 - RNA, 64 nt, Homo Sapiens; identical to SEQ ID NO: 109017

SEQ ID NO: 200097 - RNA, 64 nt, Homo Sapiens; identical to SEQ ID NO: 109018

SEQ ID NO: 200098 - RNA, 64 nt, Homo Sapiens; identical to SEQ ID NO: 109019

SEQ ID NO: 200099 - RNA, 64 nt, Homo Sapiens; identical to SEQ ID NO: 109020

SEQ ID NO: 200100 - RNA, 64 nt, Homo Sapiens; identical to SEQ ID NO: 109021

SEQ ID NO: 200101 - RNA, 64 nt, Homo Sapiens; identical to SEQ ID NO: 109022

SEQ ID NO: 200102 - RNA, 64 nt, Homo Sapiens; identical to SEQ ID NO: 109023

SEQ ID NO: 200103 - RNA, 64 nt, Homo Sapiens; identical to SEQ ID NO: 109024

SEQ ID NO: 200104 - RNA, 64 nt, Homo Sapiens; identical to SEQ ID NO: 109025

SEQ ID NO: 200105 - RNA, 64 nt, Homo Sapiens; identical to SEQ ID NO: 109026

SEQ ID NO: 200106 - RNA, 64 nt, Homo Sapiens; identical to SEQ ID NO: 109027

SEQ ID NO: 200107 - RNA, 64 nt, Homo Sapiens; identical to SEQ ID NO: 109028

SEQ ID NO: 200108 - RNA, 64 nt, Homo Sapiens; identical to SEQ ID NO: 109029

SEQ ID NO: 200109 - RNA, 64 nt, Homo Sapiens; identical to SEQ ID NO: 109030

SEQ ID NO: 200110 - RNA, 64 nt, Homo Sapiens; identical to SEQ ID NO: 109031

SEQ ID NO: 200111 - RNA, 64 nt, Homo Sapiens; identical to SEQ ID NO: 109032

SEQ ID NO: 200112 - RNA, 64 nt, Homo Sapiens; identical to SEQ ID NO: 109033

SEQ ID NO: 200113 - RNA, 64 nt, Homo Sapiens; identical to SEQ ID NO: 109034

SEQ ID NO: 200114 - RNA, 64 nt, Homo Sapiens; identical to SEQ ID NO: 109035

SEQ ID NO: 200115 - RNA, 64 nt, Homo Sapiens; identical to SEQ ID NO: 109036

SEQ ID NO: 200116 - RNA, 64 nt, Homo Sapiens; identical to SEQ ID NO: 109037

SEQ ID NO: 200117 - RNA, 64 nt, Homo Sapiens; identical to SEQ ID NO: 109038

SEQ ID NO: 200118 - RNA, 64 nt, Homo Sapiens; identical to SEQ ID NO: 109039

SEQ ID NO: 200119 - RNA, 64 nt, Homo Sapiens; identical to SEQ ID NO: 109040

SEQ ID NO: 200120 - RNA, 64 nt, Homo Sapiens; identical to SEQ ID NO: 109041

SEQ ID NO: 200121 - RNA, 64 nt, Homo Sapiens; identical to SEQ ID NO: 109042

SEQ ID NO: 200122 - RNA, 64 nt, Homo Sapiens; identical to SEQ ID NO: 109043

SEQ ID NO: 200123 - RNA, 64 nt, Homo Sapiens; identical to SEQ ID NO: 109044

SEQ ID NO: 200124 - RNA, 64 nt, Homo Sapiens; identical to SEQ ID NO: 109045

SEQ ID NO: 200125 - RNA, 64 nt, Homo Sapiens; identical to SEQ ID NO: 109046

SEQ ID NO: 200126 - RNA, 64 nt, Homo Sapiens; identical to SEQ ID NO: 109047

SEQ ID NO: 200127 - RNA, 64 nt, Homo Sapiens; identical to SEQ ID NO: 109048

SEQ ID NO: 200128 - RNA, 64 nt, Homo Sapiens; identical to SEQ ID NO: 109049

SEQ ID NO: 200129 - RNA, 64 nt, Homo Sapiens; identical to SEQ ID NO: 109050

SEQ ID NO: 200130 - RNA, 64 nt, Homo Sapiens; identical to SEQ ID NO: 109051

SEQ ID NO: 200131 - RNA, 64 nt, Homo Sapiens; identical to SEQ ID NO: 109052

SEQ ID NO: 200132 - RNA, 64 nt, Homo Sapiens; identical to SEQ ID NO: 109053

SEQ ID NO: 200133 - RNA, 64 nt, Homo Sapiens; identical to SEQ ID NO: 109054

SEQ ID NO: 200134 - RNA, 64 nt, Homo Sapiens; identical to SEQ ID NO: 109055

SEQ ID NO: 200135 - RNA, 64 nt, Homo Sapiens; identical to SEQ ID NO: 109056

SEQ ID NO: 200136 - RNA, 64 nt, Homo Sapiens; identical to SEQ ID NO: 109057

SEQ ID NO: 200137 - RNA, 64 nt, Homo Sapiens; identical to SEQ ID NO: 109058

SEQ ID NO: 200138 - RNA, 64 nt, Homo Sapiens; identical to SEQ ID NO: 109059

SEQ ID NO: 200139 - RNA, 64 nt, Homo Sapiens; identical to SEQ ID NO: 109060

SEQ ID NO: 200140 - RNA, 64 nt, Homo Sapiens; identical to SEQ ID NO: 109061

SEQ ID NO: 200141 - RNA, 64 nt, Homo Sapiens; identical to SEQ ID NO: 109062

SEQ ID NO: 200142 - RNA, 64 nt, Homo Sapiens; identical to SEQ ID NO: 109063

SEQ ID NO: 200143 - RNA, 64 nt, Homo Sapiens; identical to SEQ ID NO: 109064

SEQ ID NO: 200144 - RNA, 64 nt, Homo Sapiens; identical to SEQ ID NO: 109065

SEQ ID NO: 200145 - RNA, 64 nt, Homo Sapiens; identical to SEQ ID NO: 109066

SEQ ID NO: 200146 - RNA, 64 nt, Homo Sapiens; identical to SEQ ID NO: 109067

SEQ ID NO: 200147 - RNA, 64 nt, Homo Sapiens; identical to SEQ ID NO: 109068

SEQ ID NO: 200148 - RNA, 64 nt, Homo Sapiens; identical to SEQ ID NO: 109069

SEQ ID NO: 200149 - RNA, 64 nt, Homo Sapiens; identical to SEQ ID NO: 109070

SEQ ID NO: 200150 - RNA, 64 nt, Homo Sapiens; identical to SEQ ID NO: 109071

SEQ ID NO: 200151 - RNA, 64 nt, Homo Sapiens; identical to SEQ ID NO: 109072

SEQ ID NO: 200152 - RNA, 64 nt, Homo Sapiens; identical to SEQ ID NO: 109073

SEQ ID NO: 200153 - RNA, 64 nt, Homo Sapiens; identical to SEQ ID NO: 109074

SEQ ID NO: 200154 - RNA, 64 nt, Homo Sapiens; identical to SEQ ID NO: 109075

SEQ ID NO: 200155 - RNA, 64 nt, Homo Sapiens; identical to SEQ ID NO: 109076

SEQ ID NO: 200156 - RNA, 64 nt, Homo Sapiens; identical to SEQ ID NO: 109077

SEQ ID NO: 200157 - RNA, 64 nt, Homo Sapiens; identical to SEQ ID NO: 109078

SEQ ID NO: 200158 - RNA, 64 nt, Homo Sapiens; identical to SEQ ID NO: 109079

SEQ ID NO: 200159 - RNA, 64 nt, Homo Sapiens; identical to SEQ ID NO: 109080

SEQ ID NO: 200160 - RNA, 64 nt, Homo Sapiens; identical to SEQ ID NO: 109081

SEQ ID NO: 200161 - RNA, 64 nt, Homo Sapiens; identical to SEQ ID NO: 109082

SEQ ID NO: 200162 - RNA, 64 nt, Homo Sapiens; identical to SEQ ID NO: 109083

SEQ ID NO: 200163 - RNA, 64 nt, Homo Sapiens; identical to SEQ ID NO: 109084

SEQ ID NO: 200164 - RNA, 64 nt, Homo Sapiens; identical to SEQ ID NO: 109085

SEQ ID NO: 200165 - RNA, 64 nt, Homo Sapiens; identical to SEQ ID NO: 109086

SEQ ID NO: 200166 - RNA, 64 nt, Homo Sapiens; identical to SEQ ID NO: 109087

SEQ ID NO: 200167 - RNA, 64 nt, Homo Sapiens; identical to SEQ ID NO: 109088

SEQ ID NO: 200168 - RNA, 64 nt, Homo Sapiens; identical to SEQ ID NO: 109089

SEQ ID NO: 200169 - RNA, 64 nt, Homo Sapiens; identical to SEQ ID NO: 109090

SEQ ID NO: 200170 - RNA, 64 nt, Homo Sapiens; identical to SEQ ID NO: 109091

SEQ ID NO: 200171 - RNA, 64 nt, Homo Sapiens; identical to SEQ ID NO: 109092

SEQ ID NO: 200172 - RNA, 64 nt, Homo Sapiens; identical to SEQ ID NO: 109093

SEQ ID NO: 200173 - RNA, 64 nt, Homo Sapiens; identical to SEQ ID NO: 109094

SEQ ID NO: 200174 - RNA, 64 nt, Homo Sapiens; identical to SEQ ID NO: 109095

SEQ ID NO: 200175 - RNA, 64 nt, Homo Sapiens; identical to SEQ ID NO: 109096

SEQ ID NO: 200176 - RNA, 64 nt, Homo Sapiens; identical to SEQ ID NO: 109097

SEQ ID NO: 200177 - RNA, 64 nt, Homo Sapiens; identical to SEQ ID NO: 109098

SEQ ID NO: 200178 - RNA, 64 nt, Homo Sapiens; identical to SEQ ID NO: 109099

SEQ ID NO: 200179 - RNA, 64 nt, Homo Sapiens; identical to SEQ ID NO: 109100

SEQ ID NO: 200180 - RNA, 64 nt, Homo Sapiens; identical to SEQ ID NO: 109101

SEQ ID NO: 200181 - RNA, 64 nt, Homo Sapiens; identical to SEQ ID NO: 109102

SEQ ID NO: 200182 - RNA, 64 nt, Homo Sapiens; identical to SEQ ID NO: 109103

SEQ ID NO: 200183 - RNA, 64 nt, Homo Sapiens; identical to SEQ ID NO: 109104

SEQ ID NO: 200184 - RNA, 64 nt, Homo Sapiens; identical to SEQ ID NO: 109105

SEQ ID NO: 200185 - RNA, 64 nt, Homo Sapiens; identical to SEQ ID NO: 109106

SEQ ID NO: 200186 - RNA, 64 nt, Homo Sapiens; identical to SEQ ID NO: 109107

SEQ ID NO: 200187 - RNA, 64 nt, Homo Sapiens; identical to SEQ ID NO: 109108

SEQ ID NO: 200188 - RNA, 64 nt, Homo Sapiens; identical to SEQ ID NO: 109109

SEQ ID NO: 200189 - RNA, 64 nt, Homo Sapiens; identical to SEQ ID NO: 109110

SEQ ID NO: 200190 - RNA, 64 nt, Homo Sapiens; identical to SEQ ID NO: 109111

SEQ ID NO: 200191 - RNA, 64 nt, Homo Sapiens; identical to SEQ ID NO: 109112

SEQ ID NO: 200192 - RNA, 64 nt, Homo Sapiens; identical to SEQ ID NO: 109113

SEQ ID NO: 200193 - RNA, 64 nt, Homo Sapiens; identical to SEQ ID NO: 109114

SEQ ID NO: 200194 - RNA, 64 nt, Homo Sapiens; identical to SEQ ID NO: 109115

SEQ ID NO: 200195 - RNA, 64 nt, Homo Sapiens; identical to SEQ ID NO: 109116

SEQ ID NO: 200196 - RNA, 64 nt, Homo Sapiens; identical to SEQ ID NO: 109117

SEQ ID NO: 200197 - RNA, 64 nt, Homo Sapiens; identical to SEQ ID NO: 109118

SEQ ID NO: 200198 - RNA, 64 nt, Homo Sapiens; identical to SEQ ID NO: 109119

SEQ ID NO: 200199 - RNA, 64 nt, Homo Sapiens; identical to SEQ ID NO: 109120

SEQ ID NO: 200200 - RNA, 64 nt, Homo Sapiens; identical to SEQ ID NO: 109121

SEQ ID NO: 200201 - RNA, 64 nt, Homo Sapiens; identical to SEQ ID NO: 109122

SEQ ID NO: 200202 - RNA, 64 nt, Homo Sapiens; identical to SEQ ID NO: 109123

SEQ ID NO: 200203 - RNA, 64 nt, Homo Sapiens; identical to SEQ ID NO: 109124

SEQ ID NO: 200204 - RNA, 64 nt, Homo Sapiens; identical to SEQ ID NO: 109125

SEQ ID NO: 200205 - RNA, 64 nt, Homo Sapiens; identical to SEQ ID NO: 109126

SEQ ID NO: 200206 - RNA, 64 nt, Homo Sapiens; identical to SEQ ID NO: 109127

SEQ ID NO: 200207 - RNA, 64 nt, Homo Sapiens; identical to SEQ ID NO: 109128

SEQ ID NO: 200208 - RNA, 64 nt, Homo Sapiens; identical to SEQ ID NO: 109129

SEQ ID NO: 200209 - RNA, 64 nt, Homo Sapiens; identical to SEQ ID NO: 109130

SEQ ID NO: 200210 - RNA, 64 nt, Homo Sapiens; identical to SEQ ID NO: 109131

SEQ ID NO: 200211 - RNA, 64 nt, Homo Sapiens; identical to SEQ ID NO: 109132

SEQ ID NO: 200212 - RNA, 64 nt, Homo Sapiens; identical to SEQ ID NO: 109133

SEQ ID NO: 200213 - RNA, 64 nt, Homo Sapiens; identical to SEQ ID NO: 109134

SEQ ID NO: 200214 - RNA, 64 nt, Homo Sapiens; identical to SEQ ID NO: 109135

SEQ ID NO: 200215 - RNA, 64 nt, Homo Sapiens; identical to SEQ ID NO: 109136

SEQ ID NO: 200216 - RNA, 64 nt, Homo Sapiens; identical to SEQ ID NO: 109137

SEQ ID NO: 200217 - RNA, 64 nt, Homo Sapiens; identical to SEQ ID NO: 109138

SEQ ID NO: 200218 - RNA, 64 nt, Homo Sapiens; identical to SEQ ID NO: 109139

SEQ ID NO: 200219 - RNA, 64 nt, Homo Sapiens; identical to SEQ ID NO: 109140

SEQ ID NO: 200220 - RNA, 64 nt, Homo Sapiens; identical to SEQ ID NO: 109141

SEQ ID NO: 200221 - RNA, 64 nt, Homo Sapiens; identical to SEQ ID NO: 109142

SEQ ID NO: 200222 - RNA, 64 nt, Homo Sapiens; identical to SEQ ID NO: 109143

SEQ ID NO: 200223 - RNA, 64 nt, Homo Sapiens; identical to SEQ ID NO: 109144

SEQ ID NO: 200224 - RNA, 64 nt, Homo Sapiens; identical to SEQ ID NO: 109145

SEQ ID NO: 200225 - RNA, 64 nt, Homo Sapiens; identical to SEQ ID NO: 109146

SEQ ID NO: 200226 - RNA, 64 nt, Homo Sapiens; identical to SEQ ID NO: 109147

SEQ ID NO: 200227 - RNA, 64 nt, Homo Sapiens; identical to SEQ ID NO: 109148

SEQ ID NO: 200228 - RNA, 64 nt, Homo Sapiens; identical to SEQ ID NO: 109149

SEQ ID NO: 200229 - RNA, 64 nt, Homo Sapiens; identical to SEQ ID NO: 109150

SEQ ID NO: 200230 - RNA, 64 nt, Homo Sapiens; identical to SEQ ID NO: 109151

SEQ ID NO: 200231 - RNA, 64 nt, Homo Sapiens; identical to SEQ ID NO: 109152

SEQ ID NO: 200232 - RNA, 64 nt, Homo Sapiens; identical to SEQ ID NO: 109153

SEQ ID NO: 200233 - RNA, 64 nt, Homo Sapiens; identical to SEQ ID NO: 109154

SEQ ID NO: 200234 - RNA, 64 nt, Homo Sapiens; identical to SEQ ID NO: 109155

SEQ ID NO: 200235 - RNA, 64 nt, Homo Sapiens; identical to SEQ ID NO: 109156

SEQ ID NO: 200236 - RNA, 64 nt, Homo Sapiens; identical to SEQ ID NO: 109157

SEQ ID NO: 200237 - RNA, 64 nt, Homo Sapiens; identical to SEQ ID NO: 109158

SEQ ID NO: 200238 - RNA, 64 nt, Homo Sapiens; identical to SEQ ID NO: 109159

SEQ ID NO: 200239 - RNA, 64 nt, Homo Sapiens; identical to SEQ ID NO: 109160

SEQ ID NO: 200240 - RNA, 64 nt, Homo Sapiens; identical to SEQ ID NO: 109161

SEQ ID NO: 200241 - RNA, 64 nt, Homo Sapiens; identical to SEQ ID NO: 109162

SEQ ID NO: 200242 - RNA, 64 nt, Homo Sapiens; identical to SEQ ID NO: 109163

SEQ ID NO: 200243 - RNA, 64 nt, Homo Sapiens; identical to SEQ ID NO: 109164

SEQ ID NO: 200244 - RNA, 64 nt, Homo Sapiens; identical to SEQ ID NO: 109165

SEQ ID NO: 200245 - RNA, 64 nt, Homo Sapiens; identical to SEQ ID NO: 109166

SEQ ID NO: 200246 - RNA, 64 nt, Homo Sapiens; identical to SEQ ID NO: 109167

SEQ ID NO: 200247 - RNA, 64 nt, Homo Sapiens; identical to SEQ ID NO: 109168

SEQ ID NO: 200248 - RNA, 64 nt, Homo Sapiens; identical to SEQ ID NO: 109169

SEQ ID NO: 200249 - RNA, 64 nt, Homo Sapiens; identical to SEQ ID NO: 109170

SEQ ID NO: 200250 - RNA, 64 nt, Homo Sapiens; identical to SEQ ID NO: 109171

SEQ ID NO: 200251 - RNA, 64 nt, Homo Sapiens; identical to SEQ ID NO: 109172

SEQ ID NO: 200252 - RNA, 63 nt, Homo Sapiens; identical to SEQ ID NO: 109173

SEQ ID NO: 200253 - RNA, 64 nt, Homo Sapiens; identical to SEQ ID NO: 109174

SEQ ID NO: 200254 - RNA, 64 nt, Homo Sapiens; identical to SEQ ID NO: 109175

SEQ ID NO: 200255 - RNA, 64 nt, Homo Sapiens; identical to SEQ ID NO: 109176

SEQ ID NO: 200256 - RNA, 64 nt, Homo Sapiens; identical to SEQ ID NO: 109177

SEQ ID NO: 200257 - RNA, 64 nt, Homo Sapiens; identical to SEQ ID NO: 109178

SEQ ID NO: 200258 - RNA, 64 nt, Homo Sapiens; identical to SEQ ID NO: 109179

SEQ ID NO: 200259 - RNA, 64 nt, Homo Sapiens; identical to SEQ ID NO: 109180

SEQ ID NO: 200260 - RNA, 64 nt, Homo Sapiens; identical to SEQ ID NO: 109181

SEQ ID NO: 200261 - RNA, 64 nt, Homo Sapiens; identical to SEQ ID NO: 109182

SEQ ID NO: 200262 - RNA, 64 nt, Homo Sapiens; identical to SEQ ID NO: 109183

SEQ ID NO: 200263 - RNA, 64 nt, Homo Sapiens; identical to SEQ ID NO: 109184

SEQ ID NO: 200264 - RNA, 64 nt, Homo Sapiens; identical to SEQ ID NO: 109185

SEQ ID NO: 200265 - RNA, 64 nt, Homo Sapiens; identical to SEQ ID NO: 109186

SEQ ID NO: 200266 - RNA, 64 nt, Homo Sapiens; identical to SEQ ID NO: 109187

SEQ ID NO: 200267 - RNA, 64 nt, Homo Sapiens; identical to SEQ ID NO: 109188

SEQ ID NO: 200268 - RNA, 64 nt, Homo Sapiens; identical to SEQ ID NO: 109189

SEQ ID NO: 200269 - RNA, 64 nt, Homo Sapiens; identical to SEQ ID NO: 109190

SEQ ID NO: 200270 - RNA, 64 nt, Homo Sapiens; identical to SEQ ID NO: 109191

SEQ ID NO: 200271 - RNA, 64 nt, Homo Sapiens; identical to SEQ ID NO: 109192

SEQ ID NO: 200272 - RNA, 64 nt, Homo Sapiens; identical to SEQ ID NO: 109193

SEQ ID NO: 200273 - RNA, 64 nt, Homo Sapiens; identical to SEQ ID NO: 109194

SEQ ID NO: 200274 - RNA, 64 nt, Homo Sapiens; identical to SEQ ID NO: 109195

SEQ ID NO: 200275 - RNA, 64 nt, Homo Sapiens; identical to SEQ ID NO: 109196

SEQ ID NO: 200276 - RNA, 64 nt, Homo Sapiens; identical to SEQ ID NO: 109197

SEQ ID NO: 200277 - RNA, 64 nt, Homo Sapiens; identical to SEQ ID NO: 109198

SEQ ID NO: 200278 - RNA, 64 nt, Homo Sapiens; identical to SEQ ID NO: 109199

SEQ ID NO: 200279 - RNA, 64 nt, Homo Sapiens; identical to SEQ ID NO: 109200

SEQ ID NO: 200280 - RNA, 64 nt, Homo Sapiens; identical to SEQ ID NO: 109201

SEQ ID NO: 200281 - RNA, 64 nt, Homo Sapiens; identical to SEQ ID NO: 109202

SEQ ID NO: 200282 - RNA, 64 nt, Homo Sapiens; identical to SEQ ID NO: 109203

SEQ ID NO: 200283 - RNA, 64 nt, Homo Sapiens; identical to SEQ ID NO: 109204

SEQ ID NO: 200284 - RNA, 64 nt, Homo Sapiens; identical to SEQ ID NO: 109205

SEQ ID NO: 200285 - RNA, 64 nt, Homo Sapiens; identical to SEQ ID NO: 109206

SEQ ID NO: 200286 - RNA, 64 nt, Homo Sapiens; identical to SEQ ID NO: 109207

SEQ ID NO: 200287 - RNA, 64 nt, Homo Sapiens; identical to SEQ ID NO: 109208

SEQ ID NO: 200288 - RNA, 64 nt, Homo Sapiens; identical to SEQ ID NO: 109209

SEQ ID NO: 200289 - RNA, 64 nt, Homo Sapiens; identical to SEQ ID NO: 109210

SEQ ID NO: 200290 - RNA, 64 nt, Homo Sapiens; identical to SEQ ID NO: 109211

SEQ ID NO: 200291 - RNA, 64 nt, Homo Sapiens; identical to SEQ ID NO: 109212

SEQ ID NO: 200292 - RNA, 64 nt, Homo Sapiens; identical to SEQ ID NO: 109213

SEQ ID NO: 200293 - RNA, 64 nt, Homo Sapiens; identical to SEQ ID NO: 109214

SEQ ID NO: 200294 - RNA, 64 nt, Homo Sapiens; identical to SEQ ID NO: 109215

SEQ ID NO: 200295 - RNA, 64 nt, Homo Sapiens; identical to SEQ ID NO: 109216

SEQ ID NO: 200296 - RNA, 64 nt, Homo Sapiens; identical to SEQ ID NO: 109217

SEQ ID NO: 200297 - RNA, 64 nt, Homo Sapiens; identical to SEQ ID NO: 109218

SEQ ID NO: 200298 - RNA, 64 nt, Homo Sapiens; identical to SEQ ID NO: 109219

SEQ ID NO: 200299 - RNA, 64 nt, Homo Sapiens; identical to SEQ ID NO: 109220

SEQ ID NO: 200300 - RNA, 64 nt, Homo Sapiens; identical to SEQ ID NO: 109221

SEQ ID NO: 200301 - RNA, 64 nt, Homo Sapiens; identical to SEQ ID NO: 109222

SEQ ID NO: 200302 - RNA, 64 nt, Homo Sapiens; identical to SEQ ID NO: 109223

SEQ ID NO: 200303 - RNA, 64 nt, Homo Sapiens; identical to SEQ ID NO: 109224

SEQ ID NO: 200304 - RNA, 64 nt, Homo Sapiens; identical to SEQ ID NO: 109225

SEQ ID NO: 200305 - RNA, 64 nt, Homo Sapiens; identical to SEQ ID NO: 109226

SEQ ID NO: 200306 - RNA, 64 nt, Homo Sapiens; identical to SEQ ID NO: 109227

SEQ ID NO: 200307 - RNA, 64 nt, Homo Sapiens; identical to SEQ ID NO: 109228

SEQ ID NO: 200308 - RNA, 64 nt, Homo Sapiens; identical to SEQ ID NO: 109229

SEQ ID NO: 200309 - RNA, 64 nt, Homo Sapiens; identical to SEQ ID NO: 109230

SEQ ID NO: 200310 - RNA, 64 nt, Homo Sapiens; identical to SEQ ID NO: 109231

SEQ ID NO: 200311 - RNA, 64 nt, Homo Sapiens; identical to SEQ ID NO: 109232

SEQ ID NO: 200312 - RNA, 64 nt, Homo Sapiens; identical to SEQ ID NO: 109233

SEQ ID NO: 200313 - RNA, 64 nt, Homo Sapiens; identical to SEQ ID NO: 109234

SEQ ID NO: 200314 - RNA, 64 nt, Homo Sapiens
aaaagagaaaaaaaaaaucaggcggucaaacuuagagcaacauugucuuauuaaagcauaguuu

SEQ ID NO: 200315 - RNA, 64 nt, Homo Sapiens
auuuaugugucugcauauugcagaacagcucugagagcaacaguuucccauuaacucuuucuga

SEQ ID NO: 200316 - RNA, 64 nt, Homo Sapiens
aaauaaccagugguuaaagagguaaucacagucugagcaacauggcaaaacccugugucuacaa

SEQ ID NO: 200317 - RNA, 64 nt, Homo Sapiens
agugagcugugacugugccacugcacuccagcuugagcaacacagugauacugucucaauaaau

SEQ ID NO: 200318 - RNA, 64 nt, Homo Sapiens
ccagcuucuagcagcucuacugagaaagcggggagagcaacaccagacaguaccucugugucua

SEQ ID NO: 200319 - RNA, 64 nt, Homo Sapiens
aggcuagaggggucuuguuccgccaaaggcucaugagcaacauucaccuugcguggaaugaaaa

SEQ ID NO: 200320 - RNA, 64 nt, Homo Sapiens
ccguuuugugaaaaccagccauaggaaaacaugugagcaacaacccccaugaacauuuguccua

SEQ ID NO: 200321 - RNA, 64 nt, Homo Sapiens
ggaauugugccacugcacuccaaccugagugacagagcaacacucugucuuaaaagaaaaaaaa

SEQ ID NO: 200322 - RNA, 64 nt, Homo Sapiens
agcgaaacuccaucucaggauugcaccccagccugagcaacaagagugagccaagacagcacca

SEQ ID NO: 200323 - RNA, 64 nt, Homo Sapiens
gugaggaucccaucucuacguucaagaccggccugagcaacauagaauggcuugagcccaggag

SEQ ID NO: 200324 - RNA, 56 nt, Homo Sapiens
cgacugcacagaauggcugacuugaagagcaacaucauagagugugaauuucuauu

SEQ ID NO: 200325 - RNA, 64 nt, Homo Sapiens
uguugcuuccagacauacuucucugcaacuuguugagcaacauuuuaagauguuggacuucugc

SEQ ID NO: 200326 - RNA, 64 nt, Homo Sapiens
guuuuccacugcuaaaacugaagcaccacugugugagcaacaggaagggagagcgcacgaggga

SEQ ID NO: 200327 - RNA, 64 nt, Homo Sapiens
acaguuuaaacaagccagcgcuacuggagaagaggagcaacaccugugccgcggccggaggagu

SEQ ID NO: 200328 - RNA, 61 nt, Homo Sapiens
ccaguagauugucugucagugaccuucuguaguaauaaaguuuuugccacuguaaauaaaa

SEQ ID NO: 200329 - RNA, 61 nt, Homo Sapiens
uaacuuuuuauauuaaugacuauugaaagugguaauaaaaauuuauauuauaggcuucaau

SEQ ID NO: 200330 - RNA, 61 nt, Homo Sapiens
cguuuggccaggcaccauggauguaauauuuguaauaaaaacaguugugagcuuuaguuua

SEQ ID NO: 200331 - RNA, 61 nt, Homo Sapiens
cccaaaacuaucauguugaugauaaauuuuaguaauaaauucuucauuccuugccugcuuu

SEQ ID NO: 200332 - RNA, 61 nt, Homo Sapiens
aaaauugaccucaaaagaaaagaggacaaguguaauaaaucuauuacugaggaaagggagg

SEQ ID NO: 200333 - RNA, 61 nt, Homo Sapiens
ccaauacaaguuacauacauauauucuaaaaguaauaaauuagauuuccuuuggcaauauc

SEQ ID NO: 200334 - RNA, 61 nt, Homo Sapiens
uuggcuccugucucuagcccacuuagaaaugguaauaaaucaaaacaauagaacucauaaa

SEQ ID NO: 200335 - RNA, 61 nt, Homo Sapiens
uaggaaaacaauagaacucaagcuaacgcugguaauaaagguuuucuagaauccucauuac

SEQ ID NO: 200336 - RNA, 61 nt, Homo Sapiens
guuauuccaagggaauauugccaaugcuacaguaauaaaugaaugucacuucuggauauag

SEQ ID NO: 200337 - RNA, 61 nt, Homo Sapiens
aaguagaucaugcauagagugugauguauguguaauaaauauguuucacacaaacaaggcc

SEQ ID NO: 200338 - RNA, 61 nt, Homo Sapiens
uguggaaguaauuggaucuguaaacugaacaguaauaaaacuaggcuugucagguuaguaa

SEQ ID NO: 200339 - RNA, 61 nt, Homo Sapiens
gaacaguaauaaaacugugguugucagguuaguaauaaacugaaauguuacccaauuaggc

SEQ ID NO: 200340 - RNA, 61 nt, Homo Sapiens
ugcacaacauaaaauguuuacaaaaguaaauguaauaaaaaaccuucuaacaacuaucuuu

SEQ ID NO: 200341 - RNA, 61 nt, Homo Sapiens
acuacuguugauguaguuuuauuuccaacuaguaauaaacaauucauuugugugcccugga

SEQ ID NO: 200342 - RNA, 61 nt, Homo Sapiens
gaguuuguccauugcuagggagagacuuccaguaauaaaauuuacuauucuagaugcuucu

SEQ ID NO: 200343 - RNA, 61 nt, Homo Sapiens
aucuugguuauaagggaguuaaaacaaugcuguaauaaauaaagugcuucaugugaucaaa

SEQ ID NO: 200344 - RNA, 61 nt, Homo Sapiens
cagauuuuacucaacauuagagaguuaguacguaauaaaagcauuauaaaugcaauuuuug

SEQ ID NO: 200345 - RNA, 61 nt, Homo Sapiens
uaguauaucauuuuacuauuuguacuuuuauguaauaaaaugcaauguguuuaaaaauuuu

SEQ ID NO: 200346 - RNA, 61 nt, Homo Sapiens
ggaauuuguauuggagaaaaacccugcaaauguaauaaauauggaaaaacauuuuuucaaa

SEQ ID NO: 200347 - RNA, 61 nt, Homo Sapiens
uuaauuaucauuuuguugauugugcuuuuauguaauaaaaugcaguacuuuaaaacauuua

SEQ ID NO: 200348 - RNA, 61 nt, Homo Sapiens
uuuuuaaaaucuccuuucuauagaaacaaauguaauaaauauuuuuauuuucuaugauuuc

SEQ ID NO: 200349 - RNA, 61 nt, Homo Sapiens
uuauuuguauuuuuaaguuuuucaaaucuuuguaauaaaaaguucagacucauauauggau

SEQ ID NO: 200350 - RNA, 61 nt, Homo Sapiens
auugcauuuccucucauuaacaauuggguguguaauaaaaagcauuguacuucaucuuaaa

SEQ ID NO: 200351 - RNA, 61 nt, Homo Sapiens
acagggacucuuuuuggaucucuauugacaaguaauaaaagucuggcccucauaacuuguu

SEQ ID NO: 200352 - RNA, 61 nt, Homo Sapiens
gauggcauaaaauaaucauuuuugaaccuguguaauaaagcuugaaagcagggaaaagaau

SEQ ID NO: 200353 - RNA, 61 nt, Homo Sapiens
uuauugggugccuuuguuuguaaaccaaaaaguaauaaaugaaucccuauauuuccauuau

SEQ ID NO: 200354 - RNA, 61 nt, Homo Sapiens
ccugggaaaaccuucagcugcuuuauuuuuaguaauaaauuucucuugucaauucuguuua

SEQ ID NO: 200355 - RNA, 61 nt, Homo Sapiens
aggacaacacaaaugggauugguacuuuauaguaauaaaucugaccagcagagggagggau

SEQ ID NO: 200356 - RNA, 61 nt, Homo Sapiens
auuaguaguuuaaacaauuuuauuuguauuaguaauaaaaccuguauaaaugugaaauuuu

SEQ ID NO: 200357 - RNA, 61 nt, Homo Sapiens
ucugcaccuaauccccauaaugcuguauaagguaauaaaacuuuauuguaaucauaaauac

SEQ ID NO: 200358 - RNA, 61 nt, Homo Sapiens
cauuuaagcaguaccaagacugaaaaaaaagguaauaaaugaaauguuuugaaauauacuu

SEQ ID NO: 200359 - RNA, 61 nt, Homo Sapiens
gauucuaaguaguugccaucuugaauccuuuguaauaaagccauacuuuugugugugugug

SEQ ID NO: 200360 - RNA, 61 nt, Homo Sapiens
aauauuaacuugguuucuuguguggggagauguaauaaaaccguaaaguaauauuuacaga

SEQ ID NO: 200361 - RNA, 61 nt, Homo Sapiens
ugcuggauaaauauuagucccggauauuuuaguaauaaauaucugcucuuuuuuuuuuuua

SEQ ID NO: 200362 - RNA, 61 nt, Homo Sapiens
ugaaagaccaacauuuuaacuuaaugggaggguaauaaagagagucccgguuuguuucauu

SEQ ID NO: 200363 - RNA, 61 nt, Homo Sapiens
aaucuaaucaaagaauauuagaaaaaauguuguaauaaaauacaggaaaugacugguaaug

SEQ ID NO: 200364 - RNA, 61 nt, Homo Sapiens
caguacuaaaaaaacuguugucaaagaggauguaauaaauuguaguaauaaauaugaccac

SEQ ID NO: 200365 - RNA, 61 nt, Homo Sapiens
acuguugucaaagaggauguaauaaauuguaguaauaaauaugaccacaagccauaaauga

SEQ ID NO: 200366 - RNA, 61 nt, Homo Sapiens
aaaugacagaugugacuuuggaaccaaacuuguaauaaaaggaauuccaaauggacaagca

SEQ ID NO: 200367 - RNA, 61 nt, Homo Sapiens
ugucauguauugacuuuaauauuguauuuugguaauaaauuuuuuguuaaaaaaaacuugg

SEQ ID NO: 200368 - RNA, 61 nt, Homo Sapiens
gcaguacauuuuuaaauuuuuguacuuuuauguaauaaaauuaguacguuauuuuacuauu

SEQ ID NO: 200369 - RNA, 61 nt, Homo Sapiens
ugaaaaaaaaguuuuccaaaacccugcaaauguaauaaauuggaauucagauuggagaaaa

SEQ ID NO: 200370 - RNA, 61 nt, Homo Sapiens
caaggaauuugcauucuagaaaguagaagauguaauaaauguacugugggacauguuaaua

SEQ ID NO: 200371 - RNA, 61 nt, Homo Sapiens
gaagaauucaaauauaaauaaaaaauugugaguaauaaaaugaacucacaguuucaacaau

SEQ ID NO: 200372 - RNA, 61 nt, Homo Sapiens
ggcaucuucaccugaauucuucaaugccaggguaauaaaccaaaauaguccuaaucaguau

SEQ ID NO: 200373 - RNA, 61 nt, Homo Sapiens
aaaaggucaucuuagauuuaucuuaguaaauguaauaaauuauuuuuuagaucuugaaauu

SEQ ID NO: 200374 - RNA, 61 nt, Homo Sapiens
gauggauuuuauuucacucacacuccaguuuguaauaaaaugccaaauucugucagcuauc

SEQ ID NO: 200375 - RNA, 61 nt, Homo Sapiens
ucuaagaugcugcgaucccguucugcugcccguaauaaaaaugcucucagacacugguuag

SEQ ID NO: 200376 - RNA, 61 nt, Homo Sapiens
aaauuuauacaaaguuucaguaguauuuacaguaauaaauaagguguuuucaaugugauuu

SEQ ID NO: 200377 - RNA, 61 nt, Homo Sapiens
uaauauucuguuuuauacuauccguuugccaguaauaaauuucaaaggaaauaaaucagug

SEQ ID NO: 200378 - RNA, 64 nt, Homo Sapiens; identical to SEQ ID NO: 158250

SEQ ID NO: 200379 - RNA, 64 nt, Homo Sapiens; identical to SEQ ID NO: 158251

SEQ ID NO: 200380 - RNA, 64 nt, Homo Sapiens; identical to SEQ ID NO: 158252

SEQ ID NO: 200381 - RNA, 64 nt, Homo Sapiens; identical to SEQ ID NO: 158253

SEQ ID NO: 200382 - RNA, 64 nt, Homo Sapiens; identical to SEQ ID NO: 158254

SEQ ID NO: 200383 - RNA, 64 nt, Homo Sapiens; identical to SEQ ID NO: 158255

SEQ ID NO: 200384 - RNA, 64 nt, Homo Sapiens; identical to SEQ ID NO: 158256

SEQ ID NO: 200385 - RNA, 64 nt, Homo Sapiens; identical to SEQ ID NO: 158257

SEQ ID NO: 200386 - RNA, 58 nt, Homo Sapiens; identical to SEQ ID NO: 158258

SEQ ID NO: 200387 - RNA, 64 nt, Homo Sapiens; identical to SEQ ID NO: 158259

SEQ ID NO: 200388 - RNA, 64 nt, Homo Sapiens; identical to SEQ ID NO: 158260

SEQ ID NO: 200389 - RNA, 64 nt, Homo Sapiens; identical to SEQ ID NO: 158261

SEQ ID NO: 200390 - RNA, 64 nt, Homo Sapiens; identical to SEQ ID NO: 158262

SEQ ID NO: 200391 - RNA, 64 nt, Homo Sapiens; identical to SEQ ID NO: 158263

SEQ ID NO: 200392 - RNA, 61 nt, Homo Sapiens; identical to SEQ ID NO: 158264

SEQ ID NO: 200393 - RNA, 64 nt, Homo Sapiens; identical to SEQ ID NO: 158265

SEQ ID NO: 200394 - RNA, 64 nt, Homo Sapiens; identical to SEQ ID NO: 158266

SEQ ID NO: 200395 - RNA, 64 nt, Homo Sapiens; identical to SEQ ID NO: 158267

SEQ ID NO: 200396 - RNA, 64 nt, Homo Sapiens; identical to SEQ ID NO: 158268

SEQ ID NO: 200397 - RNA, 64 nt, Homo Sapiens; identical to SEQ ID NO: 158269

SEQ ID NO: 200398 - RNA, 64 nt, Homo Sapiens; identical to SEQ ID NO: 158270

SEQ ID NO: 200399 - RNA, 64 nt, Homo Sapiens; identical to SEQ ID NO: 158271

SEQ ID NO: 200400 - RNA, 64 nt, Homo Sapiens; identical to SEQ ID NO: 158272

SEQ ID NO: 200401 - RNA, 64 nt, Homo Sapiens; identical to SEQ ID NO: 158273

SEQ ID NO: 200402 - RNA, 64 nt, Homo Sapiens; identical to SEQ ID NO: 158274

SEQ ID NO: 200403 - RNA, 64 nt, Homo Sapiens; identical to SEQ ID NO: 158275

SEQ ID NO: 200404 - RNA, 64 nt, Homo Sapiens; identical to SEQ ID NO: 158276

SEQ ID NO: 200405 - RNA, 64 nt, Homo Sapiens; identical to SEQ ID NO: 158277

SEQ ID NO: 200406 - RNA, 64 nt, Homo Sapiens; identical to SEQ ID NO: 158278

SEQ ID NO: 200407 - RNA, 64 nt, Homo Sapiens; identical to SEQ ID NO: 158279

SEQ ID NO: 200408 - RNA, 64 nt, Homo Sapiens; identical to SEQ ID NO: 158280

SEQ ID NO: 200409 - RNA, 64 nt, Homo Sapiens; identical to SEQ ID NO: 158281

SEQ ID NO: 200410 - RNA, 64 nt, Homo Sapiens; identical to SEQ ID NO: 158282

SEQ ID NO: 200411 - RNA, 64 nt, Homo Sapiens; identical to SEQ ID NO: 158283

SEQ ID NO: 200412 - RNA, 64 nt, Homo Sapiens; identical to SEQ ID NO: 158284

SEQ ID NO: 200413 - RNA, 64 nt, Homo Sapiens; identical to SEQ ID NO: 158285

SEQ ID NO: 200414 - RNA, 64 nt, Homo Sapiens; identical to SEQ ID NO: 158286

SEQ ID NO: 200415 - RNA, 64 nt, Homo Sapiens; identical to SEQ ID NO: 158287

SEQ ID NO: 200416 - RNA, 64 nt, Homo Sapiens; identical to SEQ ID NO: 158288

SEQ ID NO: 200417 - RNA, 64 nt, Homo Sapiens; identical to SEQ ID NO: 158289

SEQ ID NO: 200418 - RNA, 64 nt, Homo Sapiens; identical to SEQ ID NO: 158290

SEQ ID NO: 200419 - RNA, 64 nt, Homo Sapiens; identical to SEQ ID NO: 158291

SEQ ID NO: 200420 - RNA, 64 nt, Homo Sapiens; identical to SEQ ID NO: 158292

SEQ ID NO: 200421 - RNA, 64 nt, Homo Sapiens; identical to SEQ ID NO: 158293

SEQ ID NO: 200422 - RNA, 64 nt, Homo Sapiens; identical to SEQ ID NO: 158294

SEQ ID NO: 200423 - RNA, 64 nt, Homo Sapiens; identical to SEQ ID NO: 158295

SEQ ID NO: 200424 - RNA, 64 nt, Homo Sapiens; identical to SEQ ID NO: 158296

SEQ ID NO: 200425 - RNA, 64 nt, Homo Sapiens; identical to SEQ ID NO: 158297

SEQ ID NO: 200426 - RNA, 64 nt, Homo Sapiens; identical to SEQ ID NO: 158298

SEQ ID NO: 200427 - RNA, 64 nt, Homo Sapiens; identical to SEQ ID NO: 158299

SEQ ID NO: 200428 - RNA, 64 nt, Homo Sapiens; identical to SEQ ID NO: 158300

SEQ ID NO: 200429 - RNA, 64 nt, Homo Sapiens; identical to SEQ ID NO: 158301

SEQ ID NO: 200430 - RNA, 64 nt, Homo Sapiens; identical to SEQ ID NO: 158302

SEQ ID NO: 200431 - RNA, 64 nt, Homo Sapiens; identical to SEQ ID NO: 158303

SEQ ID NO: 200432 - RNA, 64 nt, Homo Sapiens; identical to SEQ ID NO: 158304

SEQ ID NO: 200433 - RNA, 64 nt, Homo Sapiens; identical to SEQ ID NO: 158305

SEQ ID NO: 200434 - RNA, 64 nt, Homo Sapiens; identical to SEQ ID NO: 158306

SEQ ID NO: 200435 - RNA, 64 nt, Homo Sapiens; identical to SEQ ID NO: 158307

SEQ ID NO: 200436 - RNA, 64 nt, Homo Sapiens; identical to SEQ ID NO: 158308

SEQ ID NO: 200437 - RNA, 64 nt, Homo Sapiens; identical to SEQ ID NO: 158309

SEQ ID NO: 200438 - RNA, 64 nt, Homo Sapiens; identical to SEQ ID NO: 158310

SEQ ID NO: 200439 - RNA, 64 nt, Homo Sapiens; identical to SEQ ID NO: 158311

SEQ ID NO: 200440 - RNA, 64 nt, Homo Sapiens; identical to SEQ ID NO: 158312

SEQ ID NO: 200441 - RNA, 64 nt, Homo Sapiens; identical to SEQ ID NO: 158313

SEQ ID NO: 200442 - RNA, 64 nt, Homo Sapiens; identical to SEQ ID NO: 158314

SEQ ID NO: 200443 - RNA, 64 nt, Homo Sapiens; identical to SEQ ID NO: 158315

SEQ ID NO: 200444 - RNA, 64 nt, Homo Sapiens; identical to SEQ ID NO: 158316

SEQ ID NO: 200445 - RNA, 64 nt, Homo Sapiens; identical to SEQ ID NO: 158317

SEQ ID NO: 200446 - RNA, 64 nt, Homo Sapiens; identical to SEQ ID NO: 158318

SEQ ID NO: 200447 - RNA, 64 nt, Homo Sapiens; identical to SEQ ID NO: 158319

SEQ ID NO: 200448 - RNA, 64 nt, Homo Sapiens; identical to SEQ ID NO: 158320

SEQ ID NO: 200449 - RNA, 64 nt, Homo Sapiens; identical to SEQ ID NO: 158321

SEQ ID NO: 200450 - RNA, 64 nt, Homo Sapiens; identical to SEQ ID NO: 158322

SEQ ID NO: 200451 - RNA, 64 nt, Homo Sapiens; identical to SEQ ID NO: 158323

SEQ ID NO: 200452 - RNA, 64 nt, Homo Sapiens; identical to SEQ ID NO: 158324

SEQ ID NO: 200453 - RNA, 64 nt, Homo Sapiens; identical to SEQ ID NO: 158325

SEQ ID NO: 200454 - RNA, 64 nt, Homo Sapiens; identical to SEQ ID NO: 158326

SEQ ID NO: 200455 - RNA, 64 nt, Homo Sapiens; identical to SEQ ID NO: 158327

SEQ ID NO: 200456 - RNA, 64 nt, Homo Sapiens; identical to SEQ ID NO: 158328

SEQ ID NO: 200457 - RNA, 64 nt, Homo Sapiens; identical to SEQ ID NO: 158329

SEQ ID NO: 200458 - RNA, 64 nt, Homo Sapiens; identical to SEQ ID NO: 158330

SEQ ID NO: 200459 - RNA, 64 nt, Homo Sapiens; identical to SEQ ID NO: 158331

SEQ ID NO: 200460 - RNA, 64 nt, Homo Sapiens; identical to SEQ ID NO: 158332

SEQ ID NO: 200461 - RNA, 64 nt, Homo Sapiens; identical to SEQ ID NO: 158333

SEQ ID NO: 200462 - RNA, 64 nt, Homo Sapiens; identical to SEQ ID NO: 158334

SEQ ID NO: 200463 - RNA, 64 nt, Homo Sapiens; identical to SEQ ID NO: 158335

SEQ ID NO: 200464 - RNA, 64 nt, Homo Sapiens; identical to SEQ ID NO: 158336

SEQ ID NO: 200465 - RNA, 64 nt, Homo Sapiens; identical to SEQ ID NO: 158337

SEQ ID NO: 200466 - RNA, 64 nt, Homo Sapiens; identical to SEQ ID NO: 158338

SEQ ID NO: 200467 - RNA, 64 nt, Homo Sapiens; identical to SEQ ID NO: 158339

SEQ ID NO: 200468 - RNA, 64 nt, Homo Sapiens; identical to SEQ ID NO: 158340

SEQ ID NO: 200469 - RNA, 64 nt, Homo Sapiens; identical to SEQ ID NO: 158341

SEQ ID NO: 200470 - RNA, 64 nt, Homo Sapiens; identical to SEQ ID NO: 158342

SEQ ID NO: 200471 - RNA, 64 nt, Homo Sapiens; identical to SEQ ID NO: 158343

SEQ ID NO: 200472 - RNA, 64 nt, Homo Sapiens; identical to SEQ ID NO: 158344

SEQ ID NO: 200473 - RNA, 64 nt, Homo Sapiens; identical to SEQ ID NO: 158345

SEQ ID NO: 200474 - RNA, 64 nt, Homo Sapiens; identical to SEQ ID NO: 158346

SEQ ID NO: 200475 - RNA, 64 nt, Homo Sapiens; identical to SEQ ID NO: 158347

SEQ ID NO: 200476 - RNA, 64 nt, Homo Sapiens; identical to SEQ ID NO: 158348

SEQ ID NO: 200477 - RNA, 64 nt, Homo Sapiens; identical to SEQ ID NO: 158349

SEQ ID NO: 200478 - RNA, 64 nt, Homo Sapiens; identical to SEQ ID NO: 158350

SEQ ID NO: 200479 - RNA, 64 nt, Homo Sapiens; identical to SEQ ID NO: 158351

SEQ ID NO: 200480 - RNA, 64 nt, Homo Sapiens; identical to SEQ ID NO: 158352

SEQ ID NO: 200481 - RNA, 64 nt, Homo Sapiens; identical to SEQ ID NO: 158353

SEQ ID NO: 200482 - RNA, 64 nt, Homo Sapiens; identical to SEQ ID NO: 158354

SEQ ID NO: 200483 - RNA, 64 nt, Homo Sapiens; identical to SEQ ID NO: 158355

SEQ ID NO: 200484 - RNA, 64 nt, Homo Sapiens; identical to SEQ ID NO: 158356

SEQ ID NO: 200485 - RNA, 64 nt, Homo Sapiens; identical to SEQ ID NO: 158357

SEQ ID NO: 200486 - RNA, 64 nt, Homo Sapiens; identical to SEQ ID NO: 158358

SEQ ID NO: 200487 - RNA, 64 nt, Homo Sapiens; identical to SEQ ID NO: 158359

SEQ ID NO: 200488 - RNA, 64 nt, Homo Sapiens; identical to SEQ ID NO: 158360

SEQ ID NO: 200489 - RNA, 64 nt, Homo Sapiens; identical to SEQ ID NO: 158361

SEQ ID NO: 200490 - RNA, 64 nt, Homo Sapiens; identical to SEQ ID NO: 158362

SEQ ID NO: 200491 - RNA, 64 nt, Homo Sapiens; identical to SEQ ID NO: 158363

SEQ ID NO: 200492 - RNA, 64 nt, Homo Sapiens; identical to SEQ ID NO: 158364

SEQ ID NO: 200493 - RNA, 64 nt, Homo Sapiens; identical to SEQ ID NO: 158365

SEQ ID NO: 200494 - RNA, 64 nt, Homo Sapiens; identical to SEQ ID NO: 158366

SEQ ID NO: 200495 - RNA, 64 nt, Homo Sapiens; identical to SEQ ID NO: 158367

SEQ ID NO: 200496 - RNA, 64 nt, Homo Sapiens; identical to SEQ ID NO: 158368

SEQ ID NO: 200497 - RNA, 64 nt, Homo Sapiens; identical to SEQ ID NO: 158369

SEQ ID NO: 200498 - RNA, 64 nt, Homo Sapiens; identical to SEQ ID NO: 158370

SEQ ID NO: 200499 - RNA, 64 nt, Homo Sapiens; identical to SEQ ID NO: 158371

SEQ ID NO: 200500 - RNA, 64 nt, Homo Sapiens; identical to SEQ ID NO: 158372

SEQ ID NO: 200501 - RNA, 64 nt, Homo Sapiens; identical to SEQ ID NO: 158373

SEQ ID NO: 200502 - RNA, 64 nt, Homo Sapiens; identical to SEQ ID NO: 158374

SEQ ID NO: 200503 - RNA, 64 nt, Homo Sapiens; identical to SEQ ID NO: 158375

SEQ ID NO: 200504 - RNA, 64 nt, Homo Sapiens; identical to SEQ ID NO: 158376

SEQ ID NO: 200505 - RNA, 64 nt, Homo Sapiens; identical to SEQ ID NO: 158377

SEQ ID NO: 200506 - RNA, 64 nt, Homo Sapiens; identical to SEQ ID NO: 158378

SEQ ID NO: 200507 - RNA, 64 nt, Homo Sapiens; identical to SEQ ID NO: 158379

SEQ ID NO: 200508 - RNA, 64 nt, Homo Sapiens; identical to SEQ ID NO: 158380

SEQ ID NO: 200509 - RNA, 64 nt, Homo Sapiens; identical to SEQ ID NO: 158381

SEQ ID NO: 200510 - RNA, 64 nt, Homo Sapiens; identical to SEQ ID NO: 158382

SEQ ID NO: 200511 - RNA, 64 nt, Homo Sapiens; identical to SEQ ID NO: 158383

SEQ ID NO: 200512 - RNA, 64 nt, Homo Sapiens; identical to SEQ ID NO: 158384

SEQ ID NO: 200513 - RNA, 64 nt, Homo Sapiens; identical to SEQ ID NO: 158385

SEQ ID NO: 200514 - RNA, 64 nt, Homo Sapiens; identical to SEQ ID NO: 158386

SEQ ID NO: 200515 - RNA, 64 nt, Homo Sapiens; identical to SEQ ID NO: 158387

SEQ ID NO: 200516 - RNA, 64 nt, Homo Sapiens; identical to SEQ ID NO: 158388

SEQ ID NO: 200517 - RNA, 64 nt, Homo Sapiens; identical to SEQ ID NO: 158389

SEQ ID NO: 200518 - RNA, 64 nt, Homo Sapiens; identical to SEQ ID NO: 158390

SEQ ID NO: 200519 - RNA, 64 nt, Homo Sapiens; identical to SEQ ID NO: 158391

SEQ ID NO: 200520 - RNA, 64 nt, Homo Sapiens; identical to SEQ ID NO: 158392

SEQ ID NO: 200521 - RNA, 64 nt, Homo Sapiens; identical to SEQ ID NO: 158393

SEQ ID NO: 200522 - RNA, 64 nt, Homo Sapiens; identical to SEQ ID NO: 158394

SEQ ID NO: 200523 - RNA, 64 nt, Homo Sapiens; identical to SEQ ID NO: 158395

SEQ ID NO: 200524 - RNA, 64 nt, Homo Sapiens; identical to SEQ ID NO: 158396

SEQ ID NO: 200525 - RNA, 64 nt, Homo Sapiens; identical to SEQ ID NO: 158397

SEQ ID NO: 200526 - RNA, 64 nt, Homo Sapiens; identical to SEQ ID NO: 158398

SEQ ID NO: 200527 - RNA, 64 nt, Homo Sapiens; identical to SEQ ID NO: 158399

SEQ ID NO: 200528 - RNA, 64 nt, Homo Sapiens; identical to SEQ ID NO: 158400

SEQ ID NO: 200529 - RNA, 64 nt, Homo Sapiens; identical to SEQ ID NO: 158401

SEQ ID NO: 200530 - RNA, 64 nt, Homo Sapiens; identical to SEQ ID NO: 158402

SEQ ID NO: 200531 - RNA, 64 nt, Homo Sapiens; identical to SEQ ID NO: 158403

SEQ ID NO: 200532 - RNA, 64 nt, Homo Sapiens; identical to SEQ ID NO: 158404

SEQ ID NO: 200533 - RNA, 64 nt, Homo Sapiens; identical to SEQ ID NO: 158405

SEQ ID NO: 200534 - RNA, 64 nt, Homo Sapiens; identical to SEQ ID NO: 158406

SEQ ID NO: 200535 - RNA, 64 nt, Homo Sapiens; identical to SEQ ID NO: 158407

SEQ ID NO: 200536 - RNA, 64 nt, Homo Sapiens; identical to SEQ ID NO: 158408

SEQ ID NO: 200537 - RNA, 64 nt, Homo Sapiens; identical to SEQ ID NO: 158409

SEQ ID NO: 200538 - RNA, 64 nt, Homo Sapiens; identical to SEQ ID NO: 158410

SEQ ID NO: 200539 - RNA, 64 nt, Homo Sapiens; identical to SEQ ID NO: 158411

SEQ ID NO: 200540 - RNA, 64 nt, Homo Sapiens; identical to SEQ ID NO: 158412

SEQ ID NO: 200541 - RNA, 64 nt, Homo Sapiens; identical to SEQ ID NO: 158413

SEQ ID NO: 200542 - RNA, 64 nt, Homo Sapiens; identical to SEQ ID NO: 158414

SEQ ID NO: 200543 - RNA, 64 nt, Homo Sapiens; identical to SEQ ID NO: 158415

SEQ ID NO: 200544 - RNA, 64 nt, Homo Sapiens; identical to SEQ ID NO: 158416

SEQ ID NO: 200545 - RNA, 64 nt, Homo Sapiens; identical to SEQ ID NO: 158417

SEQ ID NO: 200546 - RNA, 64 nt, Homo Sapiens; identical to SEQ ID NO: 158418

SEQ ID NO: 200547 - RNA, 64 nt, Homo Sapiens; identical to SEQ ID NO: 158419

SEQ ID NO: 200548 - RNA, 64 nt, Homo Sapiens; identical to SEQ ID NO: 158420

SEQ ID NO: 200549 - RNA, 64 nt, Homo Sapiens; identical to SEQ ID NO: 158421

SEQ ID NO: 200550 - RNA, 64 nt, Homo Sapiens; identical to SEQ ID NO: 158422

SEQ ID NO: 200551 - RNA, 64 nt, Homo Sapiens; identical to SEQ ID NO: 158423

SEQ ID NO: 200552 - RNA, 64 nt, Homo Sapiens; identical to SEQ ID NO: 158424

SEQ ID NO: 200553 - RNA, 64 nt, Homo Sapiens; identical to SEQ ID NO: 158425

SEQ ID NO: 200554 - RNA, 64 nt, Homo Sapiens; identical to SEQ ID NO: 158426

SEQ ID NO: 200555 - RNA, 64 nt, Homo Sapiens; identical to SEQ ID NO: 158427

SEQ ID NO: 200556 - RNA, 64 nt, Homo Sapiens; identical to SEQ ID NO: 158428

SEQ ID NO: 200557 - RNA, 64 nt, Homo Sapiens; identical to SEQ ID NO: 158429

SEQ ID NO: 200558 - RNA, 64 nt, Homo Sapiens; identical to SEQ ID NO: 158430

SEQ ID NO: 200559 - RNA, 64 nt, Homo Sapiens; identical to SEQ ID NO: 158431

SEQ ID NO: 200560 - RNA, 64 nt, Homo Sapiens; identical to SEQ ID NO: 158432

SEQ ID NO: 200561 - RNA, 64 nt, Homo Sapiens; identical to SEQ ID NO: 158433

SEQ ID NO: 200562 - RNA, 64 nt, Homo Sapiens; identical to SEQ ID NO: 158434

SEQ ID NO: 200563 - RNA, 64 nt, Homo Sapiens; identical to SEQ ID NO: 158435

SEQ ID NO: 200564 - RNA, 64 nt, Homo Sapiens; identical to SEQ ID NO: 158436

SEQ ID NO: 200565 - RNA, 64 nt, Homo Sapiens; identical to SEQ ID NO: 158437

SEQ ID NO: 200566 - RNA, 64 nt, Homo Sapiens; identical to SEQ ID NO: 158438

SEQ ID NO: 200567 - RNA, 64 nt, Homo Sapiens; identical to SEQ ID NO: 158439

SEQ ID NO: 200568 - RNA, 64 nt, Homo Sapiens; identical to SEQ ID NO: 158440

SEQ ID NO: 200569 - RNA, 64 nt, Homo Sapiens; identical to SEQ ID NO: 158441

SEQ ID NO: 200570 - RNA, 64 nt, Homo Sapiens; identical to SEQ ID NO: 158442

SEQ ID NO: 200571 - RNA, 64 nt, Homo Sapiens; identical to SEQ ID NO: 158443

SEQ ID NO: 200572 - RNA, 64 nt, Homo Sapiens; identical to SEQ ID NO: 158444

SEQ ID NO: 200573 - RNA, 64 nt, Homo Sapiens; identical to SEQ ID NO: 158445

SEQ ID NO: 200574 - RNA, 64 nt, Homo Sapiens; identical to SEQ ID NO: 158446

SEQ ID NO: 200575 - RNA, 64 nt, Homo Sapiens; identical to SEQ ID NO: 158447

SEQ ID NO: 200576 - RNA, 64 nt, Homo Sapiens; identical to SEQ ID NO: 158448

SEQ ID NO: 200577 - RNA, 64 nt, Homo Sapiens; identical to SEQ ID NO: 158449

SEQ ID NO: 200578 - RNA, 64 nt, Homo Sapiens; identical to SEQ ID NO: 158450

SEQ ID NO: 200579 - RNA, 64 nt, Homo Sapiens; identical to SEQ ID NO: 158451

SEQ ID NO: 200580 - RNA, 64 nt, Homo Sapiens; identical to SEQ ID NO: 158452

SEQ ID NO: 200581 - RNA, 64 nt, Homo Sapiens; identical to SEQ ID NO: 158453

SEQ ID NO: 200582 - RNA, 64 nt, Homo Sapiens; identical to SEQ ID NO: 158454

SEQ ID NO: 200583 - RNA, 64 nt, Homo Sapiens; identical to SEQ ID NO: 158455

SEQ ID NO: 200584 - RNA, 64 nt, Homo Sapiens; identical to SEQ ID NO: 158456

SEQ ID NO: 200585 - RNA, 64 nt, Homo Sapiens; identical to SEQ ID NO: 158457

SEQ ID NO: 200586 - RNA, 64 nt, Homo Sapiens; identical to SEQ ID NO: 158458

SEQ ID NO: 200587 - RNA, 64 nt, Homo Sapiens; identical to SEQ ID NO: 158459

SEQ ID NO: 200588 - RNA, 64 nt, Homo Sapiens; identical to SEQ ID NO: 106478

SEQ ID NO: 200589 - RNA, 64 nt, Homo Sapiens; identical to SEQ ID NO: 106479

SEQ ID NO: 200590 - RNA, 64 nt, Homo Sapiens; identical to SEQ ID NO: 106480

SEQ ID NO: 200591 - RNA, 64 nt, Homo Sapiens; identical to SEQ ID NO: 106481

SEQ ID NO: 200592 - RNA, 64 nt, Homo Sapiens; identical to SEQ ID NO: 106482

SEQ ID NO: 200593 - RNA, 64 nt, Homo Sapiens; identical to SEQ ID NO: 106483

SEQ ID NO: 200594 - RNA, 64 nt, Homo Sapiens; identical to SEQ ID NO: 106484

SEQ ID NO: 200595 - RNA, 64 nt, Homo Sapiens; identical to SEQ ID NO: 106485

SEQ ID NO: 200596 - RNA, 64 nt, Homo Sapiens; identical to SEQ ID NO: 106486

SEQ ID NO: 200597 - RNA, 64 nt, Homo Sapiens; identical to SEQ ID NO: 106487

SEQ ID NO: 200598 - RNA, 64 nt, Homo Sapiens; identical to SEQ ID NO: 106488

SEQ ID NO: 200599 - RNA, 64 nt, Homo Sapiens; identical to SEQ ID NO: 106489

SEQ ID NO: 200600 - RNA, 64 nt, Homo Sapiens; identical to SEQ ID NO: 106490

SEQ ID NO: 200601 - RNA, 64 nt, Homo Sapiens; identical to SEQ ID NO: 106491

SEQ ID NO: 200602 - RNA, 64 nt, Homo Sapiens; identical to SEQ ID NO: 106492

SEQ ID NO: 200603 - RNA, 64 nt, Homo Sapiens; identical to SEQ ID NO: 106493

SEQ ID NO: 200604 - RNA, 64 nt, Homo Sapiens; identical to SEQ ID NO: 106494

SEQ ID NO: 200605 - RNA, 64 nt, Homo Sapiens; identical to SEQ ID NO: 51918

SEQ ID NO: 200606 - RNA, 64 nt, Homo Sapiens; identical to SEQ ID NO: 51919

SEQ ID NO: 200607 - RNA, 64 nt, Homo Sapiens; identical to SEQ ID NO: 51920

SEQ ID NO: 200608 - RNA, 64 nt, Homo Sapiens; identical to SEQ ID NO: 51921

SEQ ID NO: 200609 - RNA, 64 nt, Homo Sapiens; identical to SEQ ID NO: 51922

SEQ ID NO: 200610 - RNA, 64 nt, Homo Sapiens; identical to SEQ ID NO: 51923

SEQ ID NO: 200611 - RNA, 64 nt, Homo Sapiens; identical to SEQ ID NO: 51924

SEQ ID NO: 200612 - RNA, 64 nt, Homo Sapiens; identical to SEQ ID NO: 51925

SEQ ID NO: 200613 - RNA, 64 nt, Homo Sapiens; identical to SEQ ID NO: 51926

SEQ ID NO: 200614 - RNA, 64 nt, Homo Sapiens; identical to SEQ ID NO: 51927

SEQ ID NO: 200615 - RNA, 64 nt, Homo Sapiens; identical to SEQ ID NO: 51928

SEQ ID NO: 200616 - RNA, 64 nt, Homo Sapiens; identical to SEQ ID NO: 51929

SEQ ID NO: 200617 - RNA, 64 nt, Homo Sapiens; identical to SEQ ID NO: 51930

SEQ ID NO: 200618 - RNA, 64 nt, Homo Sapiens; identical to SEQ ID NO: 51931

SEQ ID NO: 200619 - RNA, 64 nt, Homo Sapiens; identical to SEQ ID NO: 51932

SEQ ID NO: 200620 - RNA, 64 nt, Homo Sapiens; identical to SEQ ID NO: 51933

SEQ ID NO: 200621 - RNA, 64 nt, Homo Sapiens; identical to SEQ ID NO: 51934

SEQ ID NO: 200622 - RNA, 64 nt, Homo Sapiens; identical to SEQ ID NO: 51935

SEQ ID NO: 200623 - RNA, 64 nt, Homo Sapiens; identical to SEQ ID NO: 51936

SEQ ID NO: 200624 - RNA, 64 nt, Homo Sapiens; identical to SEQ ID NO: 51937

SEQ ID NO: 200625 - RNA, 64 nt, Homo Sapiens; identical to SEQ ID NO: 51938

SEQ ID NO: 200626 - RNA, 64 nt, Homo Sapiens; identical to SEQ ID NO: 51939

SEQ ID NO: 200627 - RNA, 64 nt, Homo Sapiens; identical to SEQ ID NO: 51940

SEQ ID NO: 200628 - RNA, 64 nt, Homo Sapiens; identical to SEQ ID NO: 51941

SEQ ID NO: 200629 - RNA, 64 nt, Homo Sapiens; identical to SEQ ID NO: 51942

SEQ ID NO: 200630 - RNA, 64 nt, Homo Sapiens; identical to SEQ ID NO: 51943

SEQ ID NO: 200631 - RNA, 64 nt, Homo Sapiens; identical to SEQ ID NO: 51944

SEQ ID NO: 200632 - RNA, 64 nt, Homo Sapiens; identical to SEQ ID NO: 108616

SEQ ID NO: 200633 - RNA, 64 nt, Homo Sapiens; identical to SEQ ID NO: 108617

SEQ ID NO: 200634 - RNA, 64 nt, Homo Sapiens; identical to SEQ ID NO: 108618

SEQ ID NO: 200635 - RNA, 64 nt, Homo Sapiens; identical to SEQ ID NO: 108619

SEQ ID NO: 200636 - RNA, 64 nt, Homo Sapiens; identical to SEQ ID NO: 108620

SEQ ID NO: 200637 - RNA, 64 nt, Homo Sapiens; identical to SEQ ID NO: 108621

SEQ ID NO: 200638 - RNA, 64 nt, Homo Sapiens; identical to SEQ ID NO: 108622

SEQ ID NO: 200639 - RNA, 64 nt, Homo Sapiens; identical to SEQ ID NO: 108623

SEQ ID NO: 200640 - RNA, 61 nt, Homo Sapiens; identical to SEQ ID NO: 108624

SEQ ID NO: 200641 - RNA, 64 nt, Homo Sapiens; identical to SEQ ID NO: 108625

SEQ ID NO: 200642 - RNA, 64 nt, Homo Sapiens; identical to SEQ ID NO: 108626

SEQ ID NO: 200643 - RNA, 64 nt, Homo Sapiens; identical to SEQ ID NO: 108627

SEQ ID NO: 200644 - RNA, 64 nt, Homo Sapiens; identical to SEQ ID NO: 108628

SEQ ID NO: 200645 - RNA, 64 nt, Homo Sapiens; identical to SEQ ID NO: 108629

SEQ ID NO: 200646 - RNA, 64 nt, Homo Sapiens; identical to SEQ ID NO: 108630

SEQ ID NO: 200647 - RNA, 64 nt, Homo Sapiens; identical to SEQ ID NO: 108631

SEQ ID NO: 200648 - RNA, 64 nt, Homo Sapiens; identical to SEQ ID NO: 108632

SEQ ID NO: 200649 - RNA, 64 nt, Homo Sapiens; identical to SEQ ID NO: 108633

SEQ ID NO: 200650 - RNA, 64 nt, Homo Sapiens; identical to SEQ ID NO: 108634

SEQ ID NO: 200651 - RNA, 64 nt, Homo Sapiens; identical to SEQ ID NO: 108635

SEQ ID NO: 200652 - RNA, 64 nt, Homo Sapiens; identical to SEQ ID NO: 108636

SEQ ID NO: 200653 - RNA, 64 nt, Homo Sapiens; identical to SEQ ID NO: 108637

SEQ ID NO: 200654 - RNA, 64 nt, Homo Sapiens; identical to SEQ ID NO: 108638

SEQ ID NO: 200655 - RNA, 64 nt, Homo Sapiens; identical to SEQ ID NO: 108639

SEQ ID NO: 200656 - RNA, 64 nt, Homo Sapiens; identical to SEQ ID NO: 108640

SEQ ID NO: 200657 - RNA, 64 nt, Homo Sapiens; identical to SEQ ID NO: 108641

SEQ ID NO: 200658 - RNA, 64 nt, Homo Sapiens; identical to SEQ ID NO: 108642

SEQ ID NO: 200659 - RNA, 64 nt, Homo Sapiens; identical to SEQ ID NO: 108643

SEQ ID NO: 200660 - RNA, 64 nt, Homo Sapiens; identical to SEQ ID NO: 108644

SEQ ID NO: 200661 - RNA, 64 nt, Homo Sapiens; identical to SEQ ID NO: 108645

SEQ ID NO: 200662 - RNA, 64 nt, Homo Sapiens; identical to SEQ ID NO: 108646

SEQ ID NO: 200663 - RNA, 64 nt, Homo Sapiens; identical to SEQ ID NO: 108647

SEQ ID NO: 200664 - RNA, 64 nt, Homo Sapiens; identical to SEQ ID NO: 108648

SEQ ID NO: 200665 - RNA, 64 nt, Homo Sapiens; identical to SEQ ID NO: 108649

SEQ ID NO: 200666 - RNA, 64 nt, Homo Sapiens; identical to SEQ ID NO: 108650

SEQ ID NO: 200667 - RNA, 64 nt, Homo Sapiens; identical to SEQ ID NO: 108651

SEQ ID NO: 200668 - RNA, 64 nt, Homo Sapiens; identical to SEQ ID NO: 108652

SEQ ID NO: 200669 - RNA, 64 nt, Homo Sapiens; identical to SEQ ID NO: 108653

SEQ ID NO: 200670 - RNA, 64 nt, Homo Sapiens; identical to SEQ ID NO: 108654

SEQ ID NO: 200671 - RNA, 64 nt, Homo Sapiens; identical to SEQ ID NO: 108655

SEQ ID NO: 200672 - RNA, 64 nt, Homo Sapiens; identical to SEQ ID NO: 108656

SEQ ID NO: 200673 - RNA, 64 nt, Homo Sapiens; identical to SEQ ID NO: 108657

SEQ ID NO: 200674 - RNA, 64 nt, Homo Sapiens; identical to SEQ ID NO: 108658

SEQ ID NO: 200675 - RNA, 64 nt, Homo Sapiens; identical to SEQ ID NO: 108659

SEQ ID NO: 200676 - RNA, 64 nt, Homo Sapiens; identical to SEQ ID NO: 108660

SEQ ID NO: 200677 - RNA, 64 nt, Homo Sapiens; identical to SEQ ID NO: 108661

SEQ ID NO: 200678 - RNA, 64 nt, Homo Sapiens; identical to SEQ ID NO: 108662

SEQ ID NO: 200679 - RNA, 64 nt, Homo Sapiens; identical to SEQ ID NO: 108663

SEQ ID NO: 200680 - RNA, 64 nt, Homo Sapiens; identical to SEQ ID NO: 108664

SEQ ID NO: 200681 - RNA, 64 nt, Homo Sapiens; identical to SEQ ID NO: 108665

SEQ ID NO: 200682 - RNA, 64 nt, Homo Sapiens; identical to SEQ ID NO: 108666

SEQ ID NO: 200683 - RNA, 64 nt, Homo Sapiens; identical to SEQ ID NO: 108667

SEQ ID NO: 200684 - RNA, 64 nt, Homo Sapiens; identical to SEQ ID NO: 108668

SEQ ID NO: 200685 - RNA, 64 nt, Homo Sapiens; identical to SEQ ID NO: 108669

SEQ ID NO: 200686 - RNA, 64 nt, Homo Sapiens; identical to SEQ ID NO: 108670

SEQ ID NO: 200687 - RNA, 64 nt, Homo Sapiens; identical to SEQ ID NO: 108671

SEQ ID NO: 200688 - RNA, 64 nt, Homo Sapiens; identical to SEQ ID NO: 108672

SEQ ID NO: 200689 - RNA, 64 nt, Homo Sapiens; identical to SEQ ID NO: 108673

SEQ ID NO: 200690 - RNA, 64 nt, Homo Sapiens; identical to SEQ ID NO: 108674

SEQ ID NO: 200691 - RNA, 64 nt, Homo Sapiens; identical to SEQ ID NO: 108675

SEQ ID NO: 200692 - RNA, 64 nt, Homo Sapiens; identical to SEQ ID NO: 108676

SEQ ID NO: 200693 - RNA, 64 nt, Homo Sapiens; identical to SEQ ID NO: 108677

SEQ ID NO: 200694 - RNA, 64 nt, Homo Sapiens; identical to SEQ ID NO: 108678

SEQ ID NO: 200695 - RNA, 64 nt, Homo Sapiens; identical to SEQ ID NO: 108679

SEQ ID NO: 200696 - RNA, 64 nt, Homo Sapiens; identical to SEQ ID NO: 108680

SEQ ID NO: 200697 - RNA, 64 nt, Homo Sapiens; identical to SEQ ID NO: 108681

SEQ ID NO: 200698 - RNA, 64 nt, Homo Sapiens; identical to SEQ ID NO: 108682

SEQ ID NO: 200699 - RNA, 64 nt, Homo Sapiens; identical to SEQ ID NO: 108683

SEQ ID NO: 200700 - RNA, 64 nt, Homo Sapiens; identical to SEQ ID NO: 108684

SEQ ID NO: 200701 - RNA, 64 nt, Homo Sapiens; identical to SEQ ID NO: 108685

SEQ ID NO: 200702 - RNA, 64 nt, Homo Sapiens; identical to SEQ ID NO: 108686

SEQ ID NO: 200703 - RNA, 64 nt, Homo Sapiens; identical to SEQ ID NO: 108687

SEQ ID NO: 200704 - RNA, 64 nt, Homo Sapiens; identical to SEQ ID NO: 108688

SEQ ID NO: 200705 - RNA, 64 nt, Homo Sapiens; identical to SEQ ID NO: 108689

SEQ ID NO: 200706 - RNA, 64 nt, Homo Sapiens; identical to SEQ ID NO: 108690

SEQ ID NO: 200707 - RNA, 64 nt, Homo Sapiens; identical to SEQ ID NO: 108691

SEQ ID NO: 200708 - RNA, 64 nt, Homo Sapiens; identical to SEQ ID NO: 108692

SEQ ID NO: 200709 - RNA, 64 nt, Homo Sapiens; identical to SEQ ID NO: 108693

SEQ ID NO: 200710 - RNA, 64 nt, Homo Sapiens; identical to SEQ ID NO: 108694

SEQ ID NO: 200711 - RNA, 64 nt, Homo Sapiens; identical to SEQ ID NO: 108695

SEQ ID NO: 200712 - RNA, 64 nt, Homo Sapiens; identical to SEQ ID NO: 108696

SEQ ID NO: 200713 - RNA, 64 nt, Homo Sapiens; identical to SEQ ID NO: 108697

SEQ ID NO: 200714 - RNA, 64 nt, Homo Sapiens; identical to SEQ ID NO: 108698

SEQ ID NO: 200715 - RNA, 64 nt, Homo Sapiens; identical to SEQ ID NO: 108699

SEQ ID NO: 200716 - RNA, 64 nt, Homo Sapiens; identical to SEQ ID NO: 108700

SEQ ID NO: 200717 - RNA, 64 nt, Homo Sapiens; identical to SEQ ID NO: 108701

SEQ ID NO: 200718 - RNA, 64 nt, Homo Sapiens; identical to SEQ ID NO: 108702

SEQ ID NO: 200719 - RNA, 64 nt, Homo Sapiens; identical to SEQ ID NO: 108703

SEQ ID NO: 200720 - RNA, 64 nt, Homo Sapiens; identical to SEQ ID NO: 108704

SEQ ID NO: 200721 - RNA, 64 nt, Homo Sapiens; identical to SEQ ID NO: 108705

SEQ ID NO: 200722 - RNA, 64 nt, Homo Sapiens; identical to SEQ ID NO: 108706

SEQ ID NO: 200723 - RNA, 64 nt, Homo Sapiens; identical to SEQ ID NO: 108707

SEQ ID NO: 200724 - RNA, 64 nt, Homo Sapiens; identical to SEQ ID NO: 108708

SEQ ID NO: 200725 - RNA, 64 nt, Homo Sapiens; identical to SEQ ID NO: 108709

SEQ ID NO: 200726 - RNA, 64 nt, Homo Sapiens; identical to SEQ ID NO: 108710

SEQ ID NO: 200727 - RNA, 64 nt, Homo Sapiens; identical to SEQ ID NO: 108711

SEQ ID NO: 200728 - RNA, 64 nt, Homo Sapiens; identical to SEQ ID NO: 108712

SEQ ID NO: 200729 - RNA, 64 nt, Homo Sapiens; identical to SEQ ID NO: 108713

SEQ ID NO: 200730 - RNA, 64 nt, Homo Sapiens; identical to SEQ ID NO: 108714

SEQ ID NO: 200731 - RNA, 64 nt, Homo Sapiens; identical to SEQ ID NO: 108715

SEQ ID NO: 200732 - RNA, 64 nt, Homo Sapiens; identical to SEQ ID NO: 108716

SEQ ID NO: 200733 - RNA, 64 nt, Homo Sapiens; identical to SEQ ID NO: 108717

SEQ ID NO: 200734 - RNA, 64 nt, Homo Sapiens; identical to SEQ ID NO: 108718

SEQ ID NO: 200735 - RNA, 64 nt, Homo Sapiens; identical to SEQ ID NO: 108719

SEQ ID NO: 200736 - RNA, 64 nt, Homo Sapiens; identical to SEQ ID NO: 108720

SEQ ID NO: 200737 - RNA, 64 nt, Homo Sapiens; identical to SEQ ID NO: 108721

SEQ ID NO: 200738 - RNA, 64 nt, Homo Sapiens; identical to SEQ ID NO: 108722

SEQ ID NO: 200739 - RNA, 64 nt, Homo Sapiens; identical to SEQ ID NO: 108723

SEQ ID NO: 200740 - RNA, 64 nt, Homo Sapiens; identical to SEQ ID NO: 108724

SEQ ID NO: 200741 - RNA, 64 nt, Homo Sapiens; identical to SEQ ID NO: 108725

SEQ ID NO: 200742 - RNA, 64 nt, Homo Sapiens; identical to SEQ ID NO: 108726

SEQ ID NO: 200743 - RNA, 64 nt, Homo Sapiens; identical to SEQ ID NO: 108727

SEQ ID NO: 200744 - RNA, 64 nt, Homo Sapiens; identical to SEQ ID NO: 108728

SEQ ID NO: 200745 - RNA, 64 nt, Homo Sapiens; identical to SEQ ID NO: 108729

SEQ ID NO: 200746 - RNA, 64 nt, Homo Sapiens; identical to SEQ ID NO: 108730

SEQ ID NO: 200747 - RNA, 64 nt, Homo Sapiens; identical to SEQ ID NO: 108731

SEQ ID NO: 200748 - RNA, 64 nt, Homo Sapiens; identical to SEQ ID NO: 108732

SEQ ID NO: 200749 - RNA, 64 nt, Homo Sapiens; identical to SEQ ID NO: 108733

SEQ ID NO: 200750 - RNA, 64 nt, Homo Sapiens; identical to SEQ ID NO: 108734

SEQ ID NO: 200751 - RNA, 64 nt, Homo Sapiens; identical to SEQ ID NO: 108735

SEQ ID NO: 200752 - RNA, 64 nt, Homo Sapiens; identical to SEQ ID NO: 108736

SEQ ID NO: 200753 - RNA, 64 nt, Homo Sapiens; identical to SEQ ID NO: 108737

SEQ ID NO: 200754 - RNA, 64 nt, Homo Sapiens; identical to SEQ ID NO: 108738

SEQ ID NO: 200755 - RNA, 64 nt, Homo Sapiens; identical to SEQ ID NO: 108739

SEQ ID NO: 200756 - RNA, 64 nt, Homo Sapiens; identical to SEQ ID NO: 108740

SEQ ID NO: 200757 - RNA, 64 nt, Homo Sapiens; identical to SEQ ID NO: 108741

SEQ ID NO: 200758 - RNA, 64 nt, Homo Sapiens; identical to SEQ ID NO: 108742

SEQ ID NO: 200759 - RNA, 64 nt, Homo Sapiens; identical to SEQ ID NO: 108743

SEQ ID NO: 200760 - RNA, 64 nt, Homo Sapiens; identical to SEQ ID NO: 108744

SEQ ID NO: 200761 - RNA, 64 nt, Homo Sapiens; identical to SEQ ID NO: 108745

SEQ ID NO: 200762 - RNA, 64 nt, Homo Sapiens; identical to SEQ ID NO: 108746

SEQ ID NO: 200763 - RNA, 64 nt, Homo Sapiens; identical to SEQ ID NO: 108747

SEQ ID NO: 200764 - RNA, 64 nt, Homo Sapiens; identical to SEQ ID NO: 108748

SEQ ID NO: 200765 - RNA, 64 nt, Homo Sapiens; identical to SEQ ID NO: 108749

SEQ ID NO: 200766 - RNA, 64 nt, Homo Sapiens; identical to SEQ ID NO: 108750

SEQ ID NO: 200767 - RNA, 64 nt, Homo Sapiens; identical to SEQ ID NO: 108751

SEQ ID NO: 200768 - RNA, 64 nt, Homo Sapiens; identical to SEQ ID NO: 108752

SEQ ID NO: 200769 - RNA, 64 nt, Homo Sapiens; identical to SEQ ID NO: 108753

SEQ ID NO: 200770 - RNA, 64 nt, Homo Sapiens; identical to SEQ ID NO: 108754

SEQ ID NO: 200771 - RNA, 64 nt, Homo Sapiens; identical to SEQ ID NO: 108755

SEQ ID NO: 200772 - RNA, 64 nt, Homo Sapiens; identical to SEQ ID NO: 108756

SEQ ID NO: 200773 - RNA, 64 nt, Homo Sapiens; identical to SEQ ID NO: 108757

SEQ ID NO: 200774 - RNA, 64 nt, Homo Sapiens; identical to SEQ ID NO: 108758

SEQ ID NO: 200775 - RNA, 64 nt, Homo Sapiens; identical to SEQ ID NO: 108759

SEQ ID NO: 200776 - RNA, 64 nt, Homo Sapiens; identical to SEQ ID NO: 108760

SEQ ID NO: 200777 - RNA, 64 nt, Homo Sapiens; identical to SEQ ID NO: 108761

SEQ ID NO: 200778 - RNA, 64 nt, Homo Sapiens; identical to SEQ ID NO: 108762

SEQ ID NO: 200779 - RNA, 64 nt, Homo Sapiens; identical to SEQ ID NO: 108763

SEQ ID NO: 200780 - RNA, 64 nt, Homo Sapiens; identical to SEQ ID NO: 108764

SEQ ID NO: 200781 - RNA, 64 nt, Homo Sapiens; identical to SEQ ID NO: 108765

SEQ ID NO: 200782 - RNA, 64 nt, Homo Sapiens
acugaucugccauuuucaccucuaaauccccaugucugaccauuaguuuucuucucuuuccuuc

SEQ ID NO: 200783 - RNA, 64 nt, Homo Sapiens
cuuauuguuuuuguaacuugcauuuuacaagaguucugaccagcaccagauaagcuucagugcu

SEQ ID NO: 200784 - RNA, 64 nt, Homo Sapiens
uggagauguuucuggacuugcauuugucauguggucugaccauguuugaucaaaccaaaagcaa

SEQ ID NO: 200785 - RNA, 64 nt, Homo Sapiens
cauucguuggguuuugcauuaacaccacaggcuuucugaccaucacaaagaauuaaaaacuggu

SEQ ID NO: 200786 - RNA, 64 nt, Homo Sapiens
ugaaugggaugucauagcuuuucauggggaacccucugaccacccagcucuugguuaauuuagg

SEQ ID NO: 200787 - RNA, 64 nt, Homo Sapiens
cuccugccuccagagaaagccuguauuggucccuucugaccacuauuggguaucuuggugcugc

SEQ ID NO: 200788 - RNA, 64 nt, Homo Sapiens
acagagauccagagaacagauggccaaaagaauaucugaccaucuuuuuucccuacaucucuuu

SEQ ID NO: 200789 - RNA, 64 nt, Homo Sapiens
ugugacgaggggggucauaaaaaacuguggugguucugaccaccgccuucucugauucauucac

SEQ ID NO: 200790 - RNA, 64 nt, Homo Sapiens
uccuuaagguuucacccaaacccuggaccacccaucugaccaucucucaguuguuaaaaguaua

SEQ ID NO: 200791 - RNA, 64 nt, Homo Sapiens
aacuccccuccaggcugcccuuccuggcuggggcucugaccacaacauucuggaacucucuccu

SEQ ID NO: 200792 - RNA, 64 nt, Homo Sapiens
cccuauagaggggcugcuuuaugggaaguuuuucucugaccagguacaacaccugacuuuaaag

SEQ ID NO: 200793 - RNA, 64 nt, Homo Sapiens
ugggcucagaaaugucugugguauugggucagacucugaccacagguuuuaugcuguuuagcac

SEQ ID NO: 200794 - RNA, 64 nt, Homo Sapiens
ucaaucuuagaugagguaaaagaacagccacugcucugaccacuauauucaaacagaaagaaua

SEQ ID NO: 200795 - RNA, 64 nt, Homo Sapiens
gagugacagguuaugacauuaucuggauaaguguucugaccaggugccuuagaucuuuucagug

SEQ ID NO: 200796 - RNA, 64 nt, Homo Sapiens
ucuuucauacagauacagguuauacuuugagaacucugaccaaacuugaauaaaauguuacauu

SEQ ID NO: 200797 - RNA, 64 nt, Homo Sapiens
ugcaaaaaaaugcuuuuuaaagugauagaaaagaucugaccaagaggucuuggcgccuuugcaa

SEQ ID NO: 200798 - RNA, 64 nt, Homo Sapiens; identical to SEQ ID NO: 48749

SEQ ID NO: 200799 - RNA, 64 nt, Homo Sapiens; identical to SEQ ID NO: 48750

SEQ ID NO: 200800 - RNA, 64 nt, Homo Sapiens; identical to SEQ ID NO: 48751

SEQ ID NO: 200801 - RNA, 64 nt, Homo Sapiens; identical to SEQ ID NO: 48752

SEQ ID NO: 200802 - RNA, 64 nt, Homo Sapiens; identical to SEQ ID NO: 48753

SEQ ID NO: 200803 - RNA, 64 nt, Homo Sapiens; identical to SEQ ID NO: 48754

SEQ ID NO: 200804 - RNA, 64 nt, Homo Sapiens; identical to SEQ ID NO: 48755

SEQ ID NO: 200805 - RNA, 64 nt, Homo Sapiens; identical to SEQ ID NO: 48756

SEQ ID NO: 200806 - RNA, 64 nt, Homo Sapiens; identical to SEQ ID NO: 48757

SEQ ID NO: 200807 - RNA, 64 nt, Homo Sapiens; identical to SEQ ID NO: 48758

SEQ ID NO: 200808 - RNA, 64 nt, Homo Sapiens
auauauuauuuuagguauaauuuacaaaugucacaccuaauaaucuuuuauaauauaccauauu

SEQ ID NO: 200809 - RNA, 64 nt, Homo Sapiens
auuacuauuuuguuauauggaaugguuaauuuuuaccuaauaaaaacauagaugaaauacauug

SEQ ID NO: 200810 - RNA, 64 nt, Homo Sapiens
cuguggagcacccagggacgugguuuuagagucuaccuaauauguuaaggacaaggaaaccucu

SEQ ID NO: 200811 - RNA, 64 nt, Homo Sapiens
cuaauauguuaaggacaaggaaaccucugagucuaccuaauauguuaaggacaaggaaaccucu

SEQ ID NO: 200812 - RNA, 64 nt, Homo Sapiens
uuugucuaaauuuaauaauuaguauaaggauaugaccuaauaaaugucuccuuaccuaaagauu

SEQ ID NO: 200813 - RNA, 64 nt, Homo Sapiens
augaccuauuuaucugaaguuuauaauuguuuauaccuaauacaguucuuuuuggaguaagaau

SEQ ID NO: 200814 - RNA, 64 nt, Homo Sapiens
agacacauuauuuucuucugaacuuggcaauauaaccuaauaaggcagaauaaguuucuguuaa

SEQ ID NO: 200815 - RNA, 64 nt, Homo Sapiens
guacuuuuauuacauuucuuaauccauuguuuuuaccuaauaaaauuuccuccucuauauucca

SEQ ID NO: 200816 - RNA, 64 nt, Homo Sapiens
auuuucaaagaaaaacgagggaaaugggaggggugcaaaagaggagaguaagaaacagcaugga

SEQ ID NO: 200817 - RNA, 64 nt, Homo Sapiens
aaaaaaaucccaucacccacagcaaaugacagcugcaaaagagaacaccaaucccauccacacu

SEQ ID NO: 200818 - RNA, 64 nt, Homo Sapiens
cauguucaaaauagucauuaauauauaggcagcagcaaaagagcagaaaauuaauaaaaaauuu

SEQ ID NO: 200819 - RNA, 64 nt, Homo Sapiens
uugaaagcaaaaagcacuaagcagugaauugugagcaaaagaucauauucacauccccucaguu

SEQ ID NO: 200820 - RNA, 64 nt, Homo Sapiens
caacugauaagaagaaaauuuuaucauucaacuugcaaaagagacaguaauuuccacaccuuaa

SEQ ID NO: 200821 - RNA, 64 nt, Homo Sapiens
ugucgcuguaaauaagauuuuuaacauaaaaauugcaaaagaaauaauuaggaaaaggcauaua

SEQ ID NO: 200822 - RNA, 64 nt, Homo Sapiens
aaaacgccaucucaaaaaauucacuccagccugggcaaaagagcugacccaagaucgugccacu

SEQ ID NO: 200823 - RNA, 64 nt, Homo Sapiens
gugaacauguggaagaaaauauagaugacugauggcaaaagauuccaaacaguuguagaauccg

SEQ ID NO: 200824 - RNA, 64 nt, Homo Sapiens
aggucagagugauccuguauaguugaagagggaggcaaaagagguaauuguagggaucuuuaaa

SEQ ID NO: 200825 - RNA, 64 nt, Homo Sapiens
uuugcagaagugauuaauuuuguuaugccacauugcaaaagaauauucucaggaacugugaaua

SEQ ID NO: 200826 - RNA, 64 nt, Homo Sapiens
cagauuucccuccaugauuugggaaccagcuuaggcaaaagaguccccacaagaugaaaauaaa

SEQ ID NO: 200827 - RNA, 64 nt, Homo Sapiens
ucuccuacuuaauauaugaccaugacuuugaaaggcaaaagaggaaucaagaauaaauaaaaca

SEQ ID NO: 200828 - RNA, 64 nt, Homo Sapiens
aguguucucaacugaguaacuuuuaaguggaaaccaaguuuagauuuggggagugguaaaggaa

SEQ ID NO: 200829 - RNA, 64 nt, Homo Sapiens
guacugcccaaguuaaauauugauagccuaaagacaaguuuauguaguacuuaauguacaugau

SEQ ID NO: 200830 - RNA, 64 nt, Homo Sapiens
aaaaugaauaagcuaucaauauauaauuuaaguacaaguuuaggcugggcgugguggcucacgc

SEQ ID NO: 200831 - RNA, 64 nt, Homo Sapiens
aucucaaaaaaagaaagaaagaaaaaagaaaguacaaguuuauaaaguauuauagugaaaaauu

SEQ ID NO: 200832 - RNA, 64 nt, Homo Sapiens
ucaaggaaaugaauauauuguuagaccagguaagcaaguuuauuuuuguuaaagagcacuuggu

SEQ ID NO: 200833 - RNA, 64 nt, Homo Sapiens
uguccuuuuaauuuuugcuuagaauagaauggaacaaguuuaaauuucaaggaaauaugaaggc

SEQ ID NO: 200834 - RNA, 64 nt, Homo Sapiens
uaaaacugcuuucucaagucaauuuuuucuauuacaaguuuauuuauaggucuuaaacaugaug

SEQ ID NO: 200835 - RNA, 64 nt, Homo Sapiens
gaaaagaaagcaguaaaugcuuuaaucugucuuucaaguuuacaauuauugccaaaaaguuuuu

SEQ ID NO: 200836 - RNA, 64 nt, Homo Sapiens
uuguauaaaacugcuuagaaauacaaauuuuacucaaguuuaaacaauaaggucuuuuuuaaau

SEQ ID NO: 200837 - RNA, 64 nt, Homo Sapiens
uccuagucaaacaaaauuuaacaacuuaacuuuccaaguuuauauuaauccauuguuuaaauuu

SEQ ID NO: 200838 - RNA, 64 nt, Homo Sapiens
cuucauauagcauugauaauuggacacaaauuuucaaguuuacaaauuguaucuuauuauaaaa

SEQ ID NO: 200839 - RNA, 64 nt, Homo Sapiens
agccauguauaaccaagugugcauaacuguagcucaaguuuaaaggaggguggggggauuugua

SEQ ID NO: 200840 - RNA, 64 nt, Homo Sapiens
gaucaaacagccaaacaccuggaaguauuagauacaaguuuaaaauaucuuuuauagguuuuau

SEQ ID NO: 200841 - RNA, 64 nt, Homo Sapiens
aauuuaaugauauguuagugccucuguuauaugucaaguuuaaagcagggcacauuguugcagc

SEQ ID NO: 200842 - RNA, 64 nt, Homo Sapiens
cacgacacuaaucuccccugcccagugacuuguccaaguuuacaggcacucccuggagagagga

SEQ ID NO: 200843 - RNA, 64 nt, Homo Sapiens
ucauccuuuauuuuuaaucaacauccucucucuccaaguuuaucgggcaagcagggcccaucuu

SEQ ID NO: 200844 - RNA, 64 nt, Homo Sapiens
accuguuuuagucaguugggaggaagggaaaaaucaaguuuaauucccuuuaucuggguuaauu

SEQ ID NO: 200845 - RNA, 64 nt, Homo Sapiens
gacuuauacucuugagaaugaauucaguuucaaucaaguuuacauuauguugcuuaaaaaaaua

SEQ ID NO: 200846 - RNA, 64 nt, Homo Sapiens
cugguuuucaauaccaccaagaggaaaauauugacaaguuuaaaggcugugucauugggccaug

SEQ ID NO: 200847 - RNA, 64 nt, Homo Sapiens
gggaauuaacaauugccagggaaaccagccaacccaaguuuauuauaucauuaaccuuaucaua

SEQ ID NO: 200848 - RNA, 64 nt, Homo Sapiens
uuaauuuuaauuuugcuucugguguauguuuuagccauaugauuaaguuuuggaaaguuauaaa

SEQ ID NO: 200849 - RNA, 64 nt, Homo Sapiens
ucuagcugccauggugguuagggagguacaauugccauaugauuaggagugcaccucucuacuu

SEQ ID NO: 200850 - RNA, 64 nt, Homo Sapiens
auacauaugcuauuucucuuaaaccucagagcaaccauaugagcauuguaauuaauauucccau

SEQ ID NO: 200851 - RNA, 64 nt, Homo Sapiens
acaucucuuucauccauaccacacugccuacaugccauaugacaggauguguaaugggcuaacg

SEQ ID NO: 200852 - RNA, 64 nt, Homo Sapiens
guaaauaaugugggaaagcaauaugggagagaagccauaugaauucaaaaucaugagacaacuc

SEQ ID NO: 200853 - RNA, 64 nt, Homo Sapiens
guaaggaauguaggaaguccacacaggacacaaaccauaugauuucaaacccacaaaauuucuc

SEQ ID NO: 200854 - RNA, 64 nt, Homo Sapiens; identical to SEQ ID NO: 156991

SEQ ID NO: 200855 - RNA, 64 nt, Homo Sapiens; identical to SEQ ID NO: 156992

SEQ ID NO: 200856 - RNA, 64 nt, Homo Sapiens; identical to SEQ ID NO: 156993

SEQ ID NO: 200857 - RNA, 64 nt, Homo Sapiens; identical to SEQ ID NO: 156994

SEQ ID NO: 200858 - RNA, 64 nt, Homo Sapiens; identical to SEQ ID NO: 156995

SEQ ID NO: 200859 - RNA, 64 nt, Homo Sapiens; identical to SEQ ID NO: 156996

SEQ ID NO: 200860 - RNA, 64 nt, Homo Sapiens; identical to SEQ ID NO: 156997

SEQ ID NO: 200861 - RNA, 64 nt, Homo Sapiens; identical to SEQ ID NO: 156998

SEQ ID NO: 200862 - RNA, 64 nt, Homo Sapiens; identical to SEQ ID NO: 156999

SEQ ID NO: 200863 - RNA, 64 nt, Homo Sapiens; identical to SEQ ID NO: 157000

SEQ ID NO: 200864 - RNA, 64 nt, Homo Sapiens; identical to SEQ ID NO: 157001

SEQ ID NO: 200865 - RNA, 64 nt, Homo Sapiens; identical to SEQ ID NO: 157002

SEQ ID NO: 200866 - RNA, 64 nt, Homo Sapiens; identical to SEQ ID NO: 157003

SEQ ID NO: 200867 - RNA, 64 nt, Homo Sapiens; identical to SEQ ID NO: 157004

SEQ ID NO: 200868 - RNA, 64 nt, Homo Sapiens; identical to SEQ ID NO: 157005

SEQ ID NO: 200869 - RNA, 64 nt, Homo Sapiens; identical to SEQ ID NO: 157006

SEQ ID NO: 200870 - RNA, 64 nt, Homo Sapiens; identical to SEQ ID NO: 157007

SEQ ID NO: 200871 - RNA, 64 nt, Homo Sapiens; identical to SEQ ID NO: 157008

SEQ ID NO: 200872 - RNA, 64 nt, Homo Sapiens; identical to SEQ ID NO: 157009

SEQ ID NO: 200873 - RNA, 64 nt, Homo Sapiens; identical to SEQ ID NO: 157010

SEQ ID NO: 200874 - RNA, 64 nt, Homo Sapiens; identical to SEQ ID NO: 157011

SEQ ID NO: 200875 - RNA, 64 nt, Homo Sapiens; identical to SEQ ID NO: 157012

SEQ ID NO: 200876 - RNA, 64 nt, Homo Sapiens; identical to SEQ ID NO: 157013

SEQ ID NO: 200877 - RNA, 64 nt, Homo Sapiens; identical to SEQ ID NO: 157014

SEQ ID NO: 200878 - RNA, 64 nt, Homo Sapiens; identical to SEQ ID NO: 157015

SEQ ID NO: 200879 - RNA, 64 nt, Homo Sapiens; identical to SEQ ID NO: 157016

SEQ ID NO: 200880 - RNA, 64 nt, Homo Sapiens; identical to SEQ ID NO: 157017

SEQ ID NO: 200881 - RNA, 64 nt, Homo Sapiens; identical to SEQ ID NO: 157018

SEQ ID NO: 200882 - RNA, 64 nt, Homo Sapiens; identical to SEQ ID NO: 157019

SEQ ID NO: 200883 - RNA, 64 nt, Homo Sapiens; identical to SEQ ID NO: 157020

SEQ ID NO: 200884 - RNA, 64 nt, Homo Sapiens; identical to SEQ ID NO: 157021

SEQ ID NO: 200885 - RNA, 64 nt, Homo Sapiens; identical to SEQ ID NO: 157022

SEQ ID NO: 200886 - RNA, 64 nt, Homo Sapiens; identical to SEQ ID NO: 157023

SEQ ID NO: 200887 - RNA, 64 nt, Homo Sapiens; identical to SEQ ID NO: 157024

SEQ ID NO: 200888 - RNA, 64 nt, Homo Sapiens; identical to SEQ ID NO: 157025

SEQ ID NO: 200889 - RNA, 64 nt, Homo Sapiens; identical to SEQ ID NO: 157026

SEQ ID NO: 200890 - RNA, 64 nt, Homo Sapiens; identical to SEQ ID NO: 157027

SEQ ID NO: 200891 - RNA, 64 nt, Homo Sapiens; identical to SEQ ID NO: 157028

SEQ ID NO: 200892 - RNA, 64 nt, Homo Sapiens; identical to SEQ ID NO: 157029

SEQ ID NO: 200893 - RNA, 64 nt, Homo Sapiens; identical to SEQ ID NO: 157030

SEQ ID NO: 200894 - RNA, 64 nt, Homo Sapiens; identical to SEQ ID NO: 157031

SEQ ID NO: 200895 - RNA, 64 nt, Homo Sapiens; identical to SEQ ID NO: 157032

SEQ ID NO: 200896 - RNA, 64 nt, Homo Sapiens; identical to SEQ ID NO: 157033

SEQ ID NO: 200897 - RNA, 64 nt, Homo Sapiens; identical to SEQ ID NO: 157034

SEQ ID NO: 200898 - RNA, 64 nt, Homo Sapiens; identical to SEQ ID NO: 157035

SEQ ID NO: 200899 - RNA, 64 nt, Homo Sapiens; identical to SEQ ID NO: 157036

SEQ ID NO: 200900 - RNA, 64 nt, Homo Sapiens; identical to SEQ ID NO: 157037

SEQ ID NO: 200901 - RNA, 64 nt, Homo Sapiens; identical to SEQ ID NO: 157038

SEQ ID NO: 200902 - RNA, 64 nt, Homo Sapiens; identical to SEQ ID NO: 157039

SEQ ID NO: 200903 - RNA, 64 nt, Homo Sapiens; identical to SEQ ID NO: 157040

SEQ ID NO: 200904 - RNA, 64 nt, Homo Sapiens; identical to SEQ ID NO: 157041

SEQ ID NO: 200905 - RNA, 64 nt, Homo Sapiens; identical to SEQ ID NO: 157042

SEQ ID NO: 200906 - RNA, 64 nt, Homo Sapiens; identical to SEQ ID NO: 157043

SEQ ID NO: 200907 - RNA, 64 nt, Homo Sapiens; identical to SEQ ID NO: 157044

SEQ ID NO: 200908 - RNA, 64 nt, Homo Sapiens; identical to SEQ ID NO: 157045

SEQ ID NO: 200909 - RNA, 64 nt, Homo Sapiens; identical to SEQ ID NO: 157046

SEQ ID NO: 200910 - RNA, 64 nt, Homo Sapiens; identical to SEQ ID NO: 157047

SEQ ID NO: 200911 - RNA, 64 nt, Homo Sapiens; identical to SEQ ID NO: 157048

SEQ ID NO: 200912 - RNA, 64 nt, Homo Sapiens; identical to SEQ ID NO: 157049

SEQ ID NO: 200913 - RNA, 64 nt, Homo Sapiens; identical to SEQ ID NO: 157050

SEQ ID NO: 200914 - RNA, 64 nt, Homo Sapiens; identical to SEQ ID NO: 157051

SEQ ID NO: 200915 - RNA, 64 nt, Homo Sapiens; identical to SEQ ID NO: 157052

SEQ ID NO: 200916 - RNA, 64 nt, Homo Sapiens; identical to SEQ ID NO: 157053

SEQ ID NO: 200917 - RNA, 64 nt, Homo Sapiens; identical to SEQ ID NO: 157054

SEQ ID NO: 200918 - RNA, 64 nt, Homo Sapiens; identical to SEQ ID NO: 157055

SEQ ID NO: 200919 - RNA, 64 nt, Homo Sapiens; identical to SEQ ID NO: 157056

SEQ ID NO: 200920 - RNA, 64 nt, Homo Sapiens; identical to SEQ ID NO: 157057

SEQ ID NO: 200921 - RNA, 64 nt, Homo Sapiens; identical to SEQ ID NO: 157058

SEQ ID NO: 200922 - RNA, 64 nt, Homo Sapiens; identical to SEQ ID NO: 157059

SEQ ID NO: 200923 - RNA, 64 nt, Homo Sapiens; identical to SEQ ID NO: 157060

SEQ ID NO: 200924 - RNA, 64 nt, Homo Sapiens; identical to SEQ ID NO: 157061

SEQ ID NO: 200925 - RNA, 64 nt, Homo Sapiens; identical to SEQ ID NO: 157062

SEQ ID NO: 200926 - RNA, 64 nt, Homo Sapiens; identical to SEQ ID NO: 157063

SEQ ID NO: 200927 - RNA, 64 nt, Homo Sapiens; identical to SEQ ID NO: 157064

SEQ ID NO: 200928 - RNA, 64 nt, Homo Sapiens; identical to SEQ ID NO: 157065

SEQ ID NO: 200929 - RNA, 64 nt, Homo Sapiens; identical to SEQ ID NO: 157066

SEQ ID NO: 200930 - RNA, 64 nt, Homo Sapiens; identical to SEQ ID NO: 157067

SEQ ID NO: 200931 - RNA, 64 nt, Homo Sapiens; identical to SEQ ID NO: 157068

SEQ ID NO: 200932 - RNA, 64 nt, Homo Sapiens; identical to SEQ ID NO: 157069

SEQ ID NO: 200933 - RNA, 64 nt, Homo Sapiens; identical to SEQ ID NO: 157070

SEQ ID NO: 200934 - RNA, 64 nt, Homo Sapiens; identical to SEQ ID NO: 157071

SEQ ID NO: 200935 - RNA, 64 nt, Homo Sapiens; identical to SEQ ID NO: 157072

SEQ ID NO: 200936 - RNA, 64 nt, Homo Sapiens; identical to SEQ ID NO: 157073

SEQ ID NO: 200937 - RNA, 64 nt, Homo Sapiens; identical to SEQ ID NO: 157074

SEQ ID NO: 200938 - RNA, 64 nt, Homo Sapiens; identical to SEQ ID NO: 157075

SEQ ID NO: 200939 - RNA, 64 nt, Homo Sapiens; identical to SEQ ID NO: 157076

SEQ ID NO: 200940 - RNA, 64 nt, Homo Sapiens; identical to SEQ ID NO: 157077

SEQ ID NO: 200941 - RNA, 64 nt, Homo Sapiens; identical to SEQ ID NO: 157078

SEQ ID NO: 200942 - RNA, 64 nt, Homo Sapiens; identical to SEQ ID NO: 157079

SEQ ID NO: 200943 - RNA, 64 nt, Homo Sapiens; identical to SEQ ID NO: 157080

SEQ ID NO: 200944 - RNA, 64 nt, Homo Sapiens; identical to SEQ ID NO: 157081

SEQ ID NO: 200945 - RNA, 64 nt, Homo Sapiens; identical to SEQ ID NO: 157082

SEQ ID NO: 200946 - RNA, 64 nt, Homo Sapiens; identical to SEQ ID NO: 157083

SEQ ID NO: 200947 - RNA, 64 nt, Homo Sapiens; identical to SEQ ID NO: 157084

SEQ ID NO: 200948 - RNA, 64 nt, Homo Sapiens; identical to SEQ ID NO: 157085

SEQ ID NO: 200949 - RNA, 64 nt, Homo Sapiens; identical to SEQ ID NO: 157086

SEQ ID NO: 200950 - RNA, 64 nt, Homo Sapiens; identical to SEQ ID NO: 157087

SEQ ID NO: 200951 - RNA, 64 nt, Homo Sapiens; identical to SEQ ID NO: 157088

SEQ ID NO: 200952 - RNA, 64 nt, Homo Sapiens; identical to SEQ ID NO: 157089

SEQ ID NO: 200953 - RNA, 64 nt, Homo Sapiens; identical to SEQ ID NO: 157090

SEQ ID NO: 200954 - RNA, 64 nt, Homo Sapiens; identical to SEQ ID NO: 157091

SEQ ID NO: 200955 - RNA, 64 nt, Homo Sapiens; identical to SEQ ID NO: 157092

SEQ ID NO: 200956 - RNA, 64 nt, Homo Sapiens; identical to SEQ ID NO: 157093

SEQ ID NO: 200957 - RNA, 64 nt, Homo Sapiens; identical to SEQ ID NO: 157094

SEQ ID NO: 200958 - RNA, 64 nt, Homo Sapiens; identical to SEQ ID NO: 157095

SEQ ID NO: 200959 - RNA, 64 nt, Homo Sapiens; identical to SEQ ID NO: 157096

SEQ ID NO: 200960 - RNA, 64 nt, Homo Sapiens; identical to SEQ ID NO: 157097

SEQ ID NO: 200961 - RNA, 64 nt, Homo Sapiens; identical to SEQ ID NO: 157098

SEQ ID NO: 200962 - RNA, 64 nt, Homo Sapiens; identical to SEQ ID NO: 157099

SEQ ID NO: 200963 - RNA, 64 nt, Homo Sapiens; identical to SEQ ID NO: 157100

SEQ ID NO: 200964 - RNA, 64 nt, Homo Sapiens; identical to SEQ ID NO: 157101

SEQ ID NO: 200965 - RNA, 64 nt, Homo Sapiens; identical to SEQ ID NO: 157102

SEQ ID NO: 200966 - RNA, 64 nt, Homo Sapiens; identical to SEQ ID NO: 157103

SEQ ID NO: 200967 - RNA, 64 nt, Homo Sapiens; identical to SEQ ID NO: 157104

SEQ ID NO: 200968 - RNA, 64 nt, Homo Sapiens; identical to SEQ ID NO: 157105

SEQ ID NO: 200969 - RNA, 64 nt, Homo Sapiens; identical to SEQ ID NO: 157106

SEQ ID NO: 200970 - RNA, 64 nt, Homo Sapiens; identical to SEQ ID NO: 157107

SEQ ID NO: 200971 - RNA, 64 nt, Homo Sapiens; identical to SEQ ID NO: 157108

SEQ ID NO: 200972 - RNA, 64 nt, Homo Sapiens; identical to SEQ ID NO: 157109

SEQ ID NO: 200973 - RNA, 64 nt, Homo Sapiens; identical to SEQ ID NO: 157110

SEQ ID NO: 200974 - RNA, 64 nt, Homo Sapiens; identical to SEQ ID NO: 157111

SEQ ID NO: 200975 - RNA, 64 nt, Homo Sapiens; identical to SEQ ID NO: 157112

SEQ ID NO: 200976 - RNA, 64 nt, Homo Sapiens; identical to SEQ ID NO: 157113

SEQ ID NO: 200977 - RNA, 64 nt, Homo Sapiens; identical to SEQ ID NO: 157114

SEQ ID NO: 200978 - RNA, 64 nt, Homo Sapiens; identical to SEQ ID NO: 157115

SEQ ID NO: 200979 - RNA, 64 nt, Homo Sapiens; identical to SEQ ID NO: 157116

SEQ ID NO: 200980 - RNA, 64 nt, Homo Sapiens; identical to SEQ ID NO: 157117

SEQ ID NO: 200981 - RNA, 64 nt, Homo Sapiens; identical to SEQ ID NO: 157118

SEQ ID NO: 200982 - RNA, 64 nt, Homo Sapiens; identical to SEQ ID NO: 157119

SEQ ID NO: 200983 - RNA, 64 nt, Homo Sapiens; identical to SEQ ID NO: 157120

SEQ ID NO: 200984 - RNA, 50 nt, Homo Sapiens; identical to SEQ ID NO: 157121

SEQ ID NO: 200985 - RNA, 52 nt, Homo Sapiens; identical to SEQ ID NO: 157122

SEQ ID NO: 200986 - RNA, 54 nt, Homo Sapiens; identical to SEQ ID NO: 157123

SEQ ID NO: 200987 - RNA, 56 nt, Homo Sapiens; identical to SEQ ID NO: 157124

SEQ ID NO: 200988 - RNA, 58 nt, Homo Sapiens; identical to SEQ ID NO: 157125

SEQ ID NO: 200989 - RNA, 60 nt, Homo Sapiens; identical to SEQ ID NO: 157126

SEQ ID NO: 200990 - RNA, 62 nt, Homo Sapiens; identical to SEQ ID NO: 157127

SEQ ID NO: 200991 - RNA, 64 nt, Homo Sapiens; identical to SEQ ID NO: 157128

SEQ ID NO: 200992 - RNA, 64 nt, Homo Sapiens; identical to SEQ ID NO: 157129

SEQ ID NO: 200993 - RNA, 64 nt, Homo Sapiens; identical to SEQ ID NO: 157130

SEQ ID NO: 200994 - RNA, 64 nt, Homo Sapiens; identical to SEQ ID NO: 157131

SEQ ID NO: 200995 - RNA, 64 nt, Homo Sapiens; identical to SEQ ID NO: 157132

SEQ ID NO: 200996 - RNA, 64 nt, Homo Sapiens; identical to SEQ ID NO: 157133

SEQ ID NO: 200997 - RNA, 64 nt, Homo Sapiens; identical to SEQ ID NO: 157134

SEQ ID NO: 200998 - RNA, 64 nt, Homo Sapiens; identical to SEQ ID NO: 157135

SEQ ID NO: 200999 - RNA, 64 nt, Homo Sapiens; identical to SEQ ID NO: 157136

SEQ ID NO: 201000 - RNA, 64 nt, Homo Sapiens; identical to SEQ ID NO: 157137

SEQ ID NO: 201001 - RNA, 64 nt, Homo Sapiens; identical to SEQ ID NO: 157138

SEQ ID NO: 201002 - RNA, 64 nt, Homo Sapiens; identical to SEQ ID NO: 157139

SEQ ID NO: 201003 - RNA, 64 nt, Homo Sapiens; identical to SEQ ID NO: 157140

SEQ ID NO: 201004 - RNA, 64 nt, Homo Sapiens; identical to SEQ ID NO: 157141

SEQ ID NO: 201005 - RNA, 64 nt, Homo Sapiens; identical to SEQ ID NO: 157142

SEQ ID NO: 201006 - RNA, 64 nt, Homo Sapiens; identical to SEQ ID NO: 157143

SEQ ID NO: 201007 - RNA, 64 nt, Homo Sapiens; identical to SEQ ID NO: 157144

SEQ ID NO: 201008 - RNA, 64 nt, Homo Sapiens; identical to SEQ ID NO: 157145

SEQ ID NO: 201009 - RNA, 64 nt, Homo Sapiens; identical to SEQ ID NO: 157146

SEQ ID NO: 201010 - RNA, 64 nt, Homo Sapiens; identical to SEQ ID NO: 157147

SEQ ID NO: 201011 - RNA, 64 nt, Homo Sapiens; identical to SEQ ID NO: 157148

SEQ ID NO: 201012 - RNA, 64 nt, Homo Sapiens; identical to SEQ ID NO: 157149

SEQ ID NO: 201013 - RNA, 64 nt, Homo Sapiens; identical to SEQ ID NO: 157150

SEQ ID NO: 201014 - RNA, 64 nt, Homo Sapiens; identical to SEQ ID NO: 157151

SEQ ID NO: 201015 - RNA, 64 nt, Homo Sapiens; identical to SEQ ID NO: 157152

SEQ ID NO: 201016 - RNA, 64 nt, Homo Sapiens; identical to SEQ ID NO: 157153

SEQ ID NO: 201017 - RNA, 64 nt, Homo Sapiens; identical to SEQ ID NO: 157154

SEQ ID NO: 201018 - RNA, 64 nt, Homo Sapiens; identical to SEQ ID NO: 157155

SEQ ID NO: 201019 - RNA, 64 nt, Homo Sapiens; identical to SEQ ID NO: 157156

SEQ ID NO: 201020 - RNA, 64 nt, Homo Sapiens; identical to SEQ ID NO: 157157

SEQ ID NO: 201021 - RNA, 64 nt, Homo Sapiens; identical to SEQ ID NO: 157158

SEQ ID NO: 201022 - RNA, 64 nt, Homo Sapiens; identical to SEQ ID NO: 157159

SEQ ID NO: 201023 - RNA, 64 nt, Homo Sapiens; identical to SEQ ID NO: 157160

SEQ ID NO: 201024 - RNA, 64 nt, Homo Sapiens; identical to SEQ ID NO: 157161

SEQ ID NO: 201025 - RNA, 64 nt, Homo Sapiens; identical to SEQ ID NO: 157162

SEQ ID NO: 201026 - RNA, 64 nt, Homo Sapiens; identical to SEQ ID NO: 157163

SEQ ID NO: 201027 - RNA, 64 nt, Homo Sapiens; identical to SEQ ID NO: 157164

SEQ ID NO: 201028 - RNA, 64 nt, Homo Sapiens; identical to SEQ ID NO: 157165

SEQ ID NO: 201029 - RNA, 64 nt, Homo Sapiens; identical to SEQ ID NO: 157166

SEQ ID NO: 201030 - RNA, 64 nt, Homo Sapiens; identical to SEQ ID NO: 157167

SEQ ID NO: 201031 - RNA, 64 nt, Homo Sapiens; identical to SEQ ID NO: 157168

SEQ ID NO: 201032 - RNA, 64 nt, Homo Sapiens; identical to SEQ ID NO: 157169

SEQ ID NO: 201033 - RNA, 64 nt, Homo Sapiens; identical to SEQ ID NO: 157170

SEQ ID NO: 201034 - RNA, 64 nt, Homo Sapiens; identical to SEQ ID NO: 157171

SEQ ID NO: 201035 - RNA, 64 nt, Homo Sapiens; identical to SEQ ID NO: 157172

SEQ ID NO: 201036 - RNA, 64 nt, Homo Sapiens; identical to SEQ ID NO: 157173

SEQ ID NO: 201037 - RNA, 64 nt, Homo Sapiens; identical to SEQ ID NO: 157174

SEQ ID NO: 201038 - RNA, 64 nt, Homo Sapiens; identical to SEQ ID NO: 157175

SEQ ID NO: 201039 - RNA, 64 nt, Homo Sapiens; identical to SEQ ID NO: 157176

SEQ ID NO: 201040 - RNA, 64 nt, Homo Sapiens; identical to SEQ ID NO: 157177

SEQ ID NO: 201041 - RNA, 64 nt, Homo Sapiens; identical to SEQ ID NO: 157178

SEQ ID NO: 201042 - RNA, 64 nt, Homo Sapiens; identical to SEQ ID NO: 157179

SEQ ID NO: 201043 - RNA, 64 nt, Homo Sapiens; identical to SEQ ID NO: 157180

SEQ ID NO: 201044 - RNA, 64 nt, Homo Sapiens; identical to SEQ ID NO: 157181

SEQ ID NO: 201045 - RNA, 64 nt, Homo Sapiens; identical to SEQ ID NO: 157182

SEQ ID NO: 201046 - RNA, 64 nt, Homo Sapiens; identical to SEQ ID NO: 157183

SEQ ID NO: 201047 - RNA, 64 nt, Homo Sapiens; identical to SEQ ID NO: 157184

SEQ ID NO: 201048 - RNA, 64 nt, Homo Sapiens; identical to SEQ ID NO: 157185

SEQ ID NO: 201049 - RNA, 64 nt, Homo Sapiens; identical to SEQ ID NO: 157186

SEQ ID NO: 201050 - RNA, 64 nt, Homo Sapiens; identical to SEQ ID NO: 157187

SEQ ID NO: 201051 - RNA, 64 nt, Homo Sapiens; identical to SEQ ID NO: 157188

SEQ ID NO: 201052 - RNA, 64 nt, Homo Sapiens; identical to SEQ ID NO: 157189

SEQ ID NO: 201053 - RNA, 64 nt, Homo Sapiens; identical to SEQ ID NO: 157190

SEQ ID NO: 201054 - RNA, 64 nt, Homo Sapiens; identical to SEQ ID NO: 157191

SEQ ID NO: 201055 - RNA, 64 nt, Homo Sapiens; identical to SEQ ID NO: 157192

SEQ ID NO: 201056 - RNA, 64 nt, Homo Sapiens; identical to SEQ ID NO: 157193

SEQ ID NO: 201057 - RNA, 64 nt, Homo Sapiens; identical to SEQ ID NO: 157194

SEQ ID NO: 201058 - RNA, 64 nt, Homo Sapiens; identical to SEQ ID NO: 157195

SEQ ID NO: 201059 - RNA, 64 nt, Homo Sapiens; identical to SEQ ID NO: 157196

SEQ ID NO: 201060 - RNA, 64 nt, Homo Sapiens; identical to SEQ ID NO: 157197

SEQ ID NO: 201061 - RNA, 64 nt, Homo Sapiens; identical to SEQ ID NO: 157198

SEQ ID NO: 201062 - RNA, 64 nt, Homo Sapiens; identical to SEQ ID NO: 157199

SEQ ID NO: 201063 - RNA, 64 nt, Homo Sapiens; identical to SEQ ID NO: 157200

SEQ ID NO: 201064 - RNA, 64 nt, Homo Sapiens; identical to SEQ ID NO: 157201

SEQ ID NO: 201065 - RNA, 64 nt, Homo Sapiens; identical to SEQ ID NO: 157202

SEQ ID NO: 201066 - RNA, 64 nt, Homo Sapiens; identical to SEQ ID NO: 157203

SEQ ID NO: 201067 - RNA, 64 nt, Homo Sapiens; identical to SEQ ID NO: 157204

SEQ ID NO: 201068 - RNA, 64 nt, Homo Sapiens; identical to SEQ ID NO: 157205

SEQ ID NO: 201069 - RNA, 64 nt, Homo Sapiens; identical to SEQ ID NO: 157206

SEQ ID NO: 201070 - RNA, 64 nt, Homo Sapiens; identical to SEQ ID NO: 157207

SEQ ID NO: 201071 - RNA, 64 nt, Homo Sapiens; identical to SEQ ID NO: 157208

SEQ ID NO: 201072 - RNA, 64 nt, Homo Sapiens; identical to SEQ ID NO: 157209

SEQ ID NO: 201073 - RNA, 64 nt, Homo Sapiens; identical to SEQ ID NO: 157210

SEQ ID NO: 201074 - RNA, 64 nt, Homo Sapiens; identical to SEQ ID NO: 157211

SEQ ID NO: 201075 - RNA, 64 nt, Homo Sapiens; identical to SEQ ID NO: 157212

SEQ ID NO: 201076 - RNA, 64 nt, Homo Sapiens; identical to SEQ ID NO: 157213

SEQ ID NO: 201077 - RNA, 64 nt, Homo Sapiens; identical to SEQ ID NO: 157214

SEQ ID NO: 201078 - RNA, 64 nt, Homo Sapiens; identical to SEQ ID NO: 157215

SEQ ID NO: 201079 - RNA, 64 nt, Homo Sapiens; identical to SEQ ID NO: 157216

SEQ ID NO: 201080 - RNA, 64 nt, Homo Sapiens; identical to SEQ ID NO: 157217

SEQ ID NO: 201081 - RNA, 64 nt, Homo Sapiens; identical to SEQ ID NO: 157218

SEQ ID NO: 201082 - RNA, 64 nt, Homo Sapiens; identical to SEQ ID NO: 157219

SEQ ID NO: 201083 - RNA, 64 nt, Homo Sapiens; identical to SEQ ID NO: 157220

SEQ ID NO: 201084 - RNA, 64 nt, Homo Sapiens; identical to SEQ ID NO: 157221

SEQ ID NO: 201085 - RNA, 64 nt, Homo Sapiens; identical to SEQ ID NO: 157222

SEQ ID NO: 201086 - RNA, 64 nt, Homo Sapiens; identical to SEQ ID NO: 157223

SEQ ID NO: 201087 - RNA, 64 nt, Homo Sapiens; identical to SEQ ID NO: 157224

SEQ ID NO: 201088 - RNA, 64 nt, Homo Sapiens; identical to SEQ ID NO: 157225

SEQ ID NO: 201089 - RNA, 64 nt, Homo Sapiens; identical to SEQ ID NO: 157226

SEQ ID NO: 201090 - RNA, 64 nt, Homo Sapiens; identical to SEQ ID NO: 157227

SEQ ID NO: 201091 - RNA, 64 nt, Homo Sapiens; identical to SEQ ID NO: 157228

SEQ ID NO: 201092 - RNA, 64 nt, Homo Sapiens; identical to SEQ ID NO: 157229

SEQ ID NO: 201093 - RNA, 64 nt, Homo Sapiens; identical to SEQ ID NO: 157230

SEQ ID NO: 201094 - RNA, 64 nt, Homo Sapiens; identical to SEQ ID NO: 157231

SEQ ID NO: 201095 - RNA, 63 nt, Homo Sapiens; identical to SEQ ID NO: 157232

SEQ ID NO: 201096 - RNA, 64 nt, Homo Sapiens; identical to SEQ ID NO: 157233

SEQ ID NO: 201097 - RNA, 64 nt, Homo Sapiens; identical to SEQ ID NO: 157234

SEQ ID NO: 201098 - RNA, 64 nt, Homo Sapiens; identical to SEQ ID NO: 157235

SEQ ID NO: 201099 - RNA, 64 nt, Homo Sapiens; identical to SEQ ID NO: 157236

SEQ ID NO: 201100 - RNA, 64 nt, Homo Sapiens; identical to SEQ ID NO: 157237

SEQ ID NO: 201101 - RNA, 64 nt, Homo Sapiens; identical to SEQ ID NO: 157238

SEQ ID NO: 201102 - RNA, 64 nt, Homo Sapiens; identical to SEQ ID NO: 157239

SEQ ID NO: 201103 - RNA, 64 nt, Homo Sapiens; identical to SEQ ID NO: 157240

SEQ ID NO: 201104 - RNA, 64 nt, Homo Sapiens; identical to SEQ ID NO: 157241

SEQ ID NO: 201105 - RNA, 64 nt, Homo Sapiens; identical to SEQ ID NO: 157242

SEQ ID NO: 201106 - RNA, 64 nt, Homo Sapiens; identical to SEQ ID NO: 157243

SEQ ID NO: 201107 - RNA, 64 nt, Homo Sapiens; identical to SEQ ID NO: 157244

SEQ ID NO: 201108 - RNA, 64 nt, Homo Sapiens; identical to SEQ ID NO: 157245

SEQ ID NO: 201109 - RNA, 64 nt, Homo Sapiens; identical to SEQ ID NO: 157246

SEQ ID NO: 201110 - RNA, 64 nt, Homo Sapiens; identical to SEQ ID NO: 157247

SEQ ID NO: 201111 - RNA, 64 nt, Homo Sapiens; identical to SEQ ID NO: 157248

SEQ ID NO: 201112 - RNA, 64 nt, Homo Sapiens; identical to SEQ ID NO: 157249

SEQ ID NO: 201113 - RNA, 64 nt, Homo Sapiens; identical to SEQ ID NO: 157250

SEQ ID NO: 201114 - RNA, 64 nt, Homo Sapiens; identical to SEQ ID NO: 157251

SEQ ID NO: 201115 - RNA, 64 nt, Homo Sapiens; identical to SEQ ID NO: 157252

SEQ ID NO: 201116 - RNA, 64 nt, Homo Sapiens; identical to SEQ ID NO: 157253

SEQ ID NO: 201117 - RNA, 64 nt, Homo Sapiens; identical to SEQ ID NO: 157254

SEQ ID NO: 201118 - RNA, 64 nt, Homo Sapiens; identical to SEQ ID NO: 157255

SEQ ID NO: 201119 - RNA, 64 nt, Homo Sapiens; identical to SEQ ID NO: 157256

SEQ ID NO: 201120 - RNA, 64 nt, Homo Sapiens; identical to SEQ ID NO: 157257

SEQ ID NO: 201121 - RNA, 64 nt, Homo Sapiens; identical to SEQ ID NO: 157258

SEQ ID NO: 201122 - RNA, 64 nt, Homo Sapiens; identical to SEQ ID NO: 157259

SEQ ID NO: 201123 - RNA, 64 nt, Homo Sapiens; identical to SEQ ID NO: 157260

SEQ ID NO: 201124 - RNA, 64 nt, Homo Sapiens; identical to SEQ ID NO: 157261

SEQ ID NO: 201125 - RNA, 64 nt, Homo Sapiens; identical to SEQ ID NO: 157262

SEQ ID NO: 201126 - RNA, 64 nt, Homo Sapiens; identical to SEQ ID NO: 157263

SEQ ID NO: 201127 - RNA, 64 nt, Homo Sapiens; identical to SEQ ID NO: 157264

SEQ ID NO: 201128 - RNA, 64 nt, Homo Sapiens; identical to SEQ ID NO: 157265

SEQ ID NO: 201129 - RNA, 64 nt, Homo Sapiens; identical to SEQ ID NO: 157266

SEQ ID NO: 201130 - RNA, 64 nt, Homo Sapiens; identical to SEQ ID NO: 157267

SEQ ID NO: 201131 - RNA, 64 nt, Homo Sapiens; identical to SEQ ID NO: 157268

SEQ ID NO: 201132 - RNA, 64 nt, Homo Sapiens; identical to SEQ ID NO: 157269

SEQ ID NO: 201133 - RNA, 64 nt, Homo Sapiens; identical to SEQ ID NO: 157270

SEQ ID NO: 201134 - RNA, 64 nt, Homo Sapiens; identical to SEQ ID NO: 157271

SEQ ID NO: 201135 - RNA, 64 nt, Homo Sapiens; identical to SEQ ID NO: 157272

SEQ ID NO: 201136 - RNA, 64 nt, Homo Sapiens; identical to SEQ ID NO: 157273

SEQ ID NO: 201137 - RNA, 64 nt, Homo Sapiens; identical to SEQ ID NO: 157274

SEQ ID NO: 201138 - RNA, 64 nt, Homo Sapiens; identical to SEQ ID NO: 157275

SEQ ID NO: 201139 - RNA, 64 nt, Homo Sapiens; identical to SEQ ID NO: 157276

SEQ ID NO: 201140 - RNA, 64 nt, Homo Sapiens; identical to SEQ ID NO: 157277

SEQ ID NO: 201141 - RNA, 64 nt, Homo Sapiens; identical to SEQ ID NO: 157278

SEQ ID NO: 201142 - RNA, 64 nt, Homo Sapiens; identical to SEQ ID NO: 157279

SEQ ID NO: 201143 - RNA, 64 nt, Homo Sapiens; identical to SEQ ID NO: 157280

SEQ ID NO: 201144 - RNA, 64 nt, Homo Sapiens; identical to SEQ ID NO: 157281

SEQ ID NO: 201145 - RNA, 64 nt, Homo Sapiens; identical to SEQ ID NO: 157282

SEQ ID NO: 201146 - RNA, 64 nt, Homo Sapiens; identical to SEQ ID NO: 157283

SEQ ID NO: 201147 - RNA, 64 nt, Homo Sapiens; identical to SEQ ID NO: 157284

SEQ ID NO: 201148 - RNA, 64 nt, Homo Sapiens; identical to SEQ ID NO: 157285

SEQ ID NO: 201149 - RNA, 64 nt, Homo Sapiens; identical to SEQ ID NO: 157286

SEQ ID NO: 201150 - RNA, 64 nt, Homo Sapiens; identical to SEQ ID NO: 157287

SEQ ID NO: 201151 - RNA, 64 nt, Homo Sapiens; identical to SEQ ID NO: 157288

SEQ ID NO: 201152 - RNA, 64 nt, Homo Sapiens; identical to SEQ ID NO: 157289

SEQ ID NO: 201153 - RNA, 64 nt, Homo Sapiens; identical to SEQ ID NO: 157290

SEQ ID NO: 201154 - RNA, 64 nt, Homo Sapiens; identical to SEQ ID NO: 157291

SEQ ID NO: 201155 - RNA, 64 nt, Homo Sapiens; identical to SEQ ID NO: 157292

SEQ ID NO: 201156 - RNA, 64 nt, Homo Sapiens; identical to SEQ ID NO: 157293

SEQ ID NO: 201157 - RNA, 64 nt, Homo Sapiens; identical to SEQ ID NO: 157294

SEQ ID NO: 201158 - RNA, 64 nt, Homo Sapiens; identical to SEQ ID NO: 157295

SEQ ID NO: 201159 - RNA, 64 nt, Homo Sapiens; identical to SEQ ID NO: 157296

SEQ ID NO: 201160 - RNA, 64 nt, Homo Sapiens; identical to SEQ ID NO: 157297

SEQ ID NO: 201161 - RNA, 64 nt, Homo Sapiens; identical to SEQ ID NO: 157298

SEQ ID NO: 201162 - RNA, 64 nt, Homo Sapiens; identical to SEQ ID NO: 157299

SEQ ID NO: 201163 - RNA, 64 nt, Homo Sapiens; identical to SEQ ID NO: 157300

SEQ ID NO: 201164 - RNA, 64 nt, Homo Sapiens; identical to SEQ ID NO: 157301

SEQ ID NO: 201165 - RNA, 64 nt, Homo Sapiens; identical to SEQ ID NO: 157302

SEQ ID NO: 201166 - RNA, 64 nt, Homo Sapiens; identical to SEQ ID NO: 157303

SEQ ID NO: 201167 - RNA, 64 nt, Homo Sapiens; identical to SEQ ID NO: 157304

SEQ ID NO: 201168 - RNA, 64 nt, Homo Sapiens; identical to SEQ ID NO: 157305

SEQ ID NO: 201169 - RNA, 64 nt, Homo Sapiens; identical to SEQ ID NO: 157306

SEQ ID NO: 201170 - RNA, 64 nt, Homo Sapiens; identical to SEQ ID NO: 157307

SEQ ID NO: 201171 - RNA, 64 nt, Homo Sapiens; identical to SEQ ID NO: 157308

SEQ ID NO: 201172 - RNA, 64 nt, Homo Sapiens; identical to SEQ ID NO: 157309

SEQ ID NO: 201173 - RNA, 64 nt, Homo Sapiens; identical to SEQ ID NO: 157310

SEQ ID NO: 201174 - RNA, 64 nt, Homo Sapiens; identical to SEQ ID NO: 157311

SEQ ID NO: 201175 - RNA, 64 nt, Homo Sapiens; identical to SEQ ID NO: 157312

SEQ ID NO: 201176 - RNA, 64 nt, Homo Sapiens; identical to SEQ ID NO: 157313

SEQ ID NO: 201177 - RNA, 64 nt, Homo Sapiens; identical to SEQ ID NO: 157314

SEQ ID NO: 201178 - RNA, 64 nt, Homo Sapiens; identical to SEQ ID NO: 157315

SEQ ID NO: 201179 - RNA, 64 nt, Homo Sapiens; identical to SEQ ID NO: 157316

SEQ ID NO: 201180 - RNA, 64 nt, Homo Sapiens; identical to SEQ ID NO: 157317

SEQ ID NO: 201181 - RNA, 64 nt, Homo Sapiens; identical to SEQ ID NO: 157318

SEQ ID NO: 201182 - RNA, 64 nt, Homo Sapiens; identical to SEQ ID NO: 157319

SEQ ID NO: 201183 - RNA, 64 nt, Homo Sapiens; identical to SEQ ID NO: 157320

SEQ ID NO: 201184 - RNA, 64 nt, Homo Sapiens; identical to SEQ ID NO: 157321

SEQ ID NO: 201185 - RNA, 64 nt, Homo Sapiens; identical to SEQ ID NO: 157322

SEQ ID NO: 201186 - RNA, 64 nt, Homo Sapiens; identical to SEQ ID NO: 157323

SEQ ID NO: 201187 - RNA, 64 nt, Homo Sapiens; identical to SEQ ID NO: 157324

SEQ ID NO: 201188 - RNA, 64 nt, Homo Sapiens; identical to SEQ ID NO: 157325

SEQ ID NO: 201189 - RNA, 64 nt, Homo Sapiens; identical to SEQ ID NO: 157326

SEQ ID NO: 201190 - RNA, 64 nt, Homo Sapiens; identical to SEQ ID NO: 157327

SEQ ID NO: 201191 - RNA, 64 nt, Homo Sapiens; identical to SEQ ID NO: 157328

SEQ ID NO: 201192 - RNA, 64 nt, Homo Sapiens; identical to SEQ ID NO: 157329

SEQ ID NO: 201193 - RNA, 64 nt, Homo Sapiens; identical to SEQ ID NO: 157330

SEQ ID NO: 201194 - RNA, 64 nt, Homo Sapiens; identical to SEQ ID NO: 157331

SEQ ID NO: 201195 - RNA, 64 nt, Homo Sapiens; identical to SEQ ID NO: 157332

SEQ ID NO: 201196 - RNA, 64 nt, Homo Sapiens; identical to SEQ ID NO: 157333

SEQ ID NO: 201197 - RNA, 64 nt, Homo Sapiens; identical to SEQ ID NO: 157334

SEQ ID NO: 201198 - RNA, 64 nt, Homo Sapiens; identical to SEQ ID NO: 157335

SEQ ID NO: 201199 - RNA, 64 nt, Homo Sapiens; identical to SEQ ID NO: 157336

SEQ ID NO: 201200 - RNA, 64 nt, Homo Sapiens; identical to SEQ ID NO: 157337

SEQ ID NO: 201201 - RNA, 64 nt, Homo Sapiens; identical to SEQ ID NO: 157338

SEQ ID NO: 201202 - RNA, 64 nt, Homo Sapiens; identical to SEQ ID NO: 157339

SEQ ID NO: 201203 - RNA, 64 nt, Homo Sapiens; identical to SEQ ID NO: 157340

SEQ ID NO: 201204 - RNA, 64 nt, Homo Sapiens; identical to SEQ ID NO: 157341

SEQ ID NO: 201205 - RNA, 64 nt, Homo Sapiens; identical to SEQ ID NO: 157342

SEQ ID NO: 201206 - RNA, 64 nt, Homo Sapiens; identical to SEQ ID NO: 157343

SEQ ID NO: 201207 - RNA, 64 nt, Homo Sapiens; identical to SEQ ID NO: 157344

SEQ ID NO: 201208 - RNA, 64 nt, Homo Sapiens; identical to SEQ ID NO: 157345

SEQ ID NO: 201209 - RNA, 64 nt, Homo Sapiens; identical to SEQ ID NO: 157346

SEQ ID NO: 201210 - RNA, 64 nt, Homo Sapiens; identical to SEQ ID NO: 157347

SEQ ID NO: 201211 - RNA, 64 nt, Homo Sapiens; identical to SEQ ID NO: 157348

SEQ ID NO: 201212 - RNA, 64 nt, Homo Sapiens; identical to SEQ ID NO: 157349

SEQ ID NO: 201213 - RNA, 64 nt, Homo Sapiens; identical to SEQ ID NO: 157350

SEQ ID NO: 201214 - RNA, 64 nt, Homo Sapiens; identical to SEQ ID NO: 157351

SEQ ID NO: 201215 - RNA, 64 nt, Homo Sapiens; identical to SEQ ID NO: 157352

SEQ ID NO: 201216 - RNA, 64 nt, Homo Sapiens; identical to SEQ ID NO: 157353

SEQ ID NO: 201217 - RNA, 64 nt, Homo Sapiens; identical to SEQ ID NO: 157354

SEQ ID NO: 201218 - RNA, 64 nt, Homo Sapiens; identical to SEQ ID NO: 157355

SEQ ID NO: 201219 - RNA, 64 nt, Homo Sapiens; identical to SEQ ID NO: 157356

SEQ ID NO: 201220 - RNA, 64 nt, Homo Sapiens; identical to SEQ ID NO: 157357

SEQ ID NO: 201221 - RNA, 64 nt, Homo Sapiens; identical to SEQ ID NO: 157358

SEQ ID NO: 201222 - RNA, 64 nt, Homo Sapiens; identical to SEQ ID NO: 157359

SEQ ID NO: 201223 - RNA, 64 nt, Homo Sapiens; identical to SEQ ID NO: 157360

SEQ ID NO: 201224 - RNA, 64 nt, Homo Sapiens; identical to SEQ ID NO: 157361

SEQ ID NO: 201225 - RNA, 64 nt, Homo Sapiens; identical to SEQ ID NO: 157362

SEQ ID NO: 201226 - RNA, 64 nt, Homo Sapiens; identical to SEQ ID NO: 157363

SEQ ID NO: 201227 - RNA, 64 nt, Homo Sapiens; identical to SEQ ID NO: 157364

SEQ ID NO: 201228 - RNA, 64 nt, Homo Sapiens; identical to SEQ ID NO: 157365

SEQ ID NO: 201229 - RNA, 64 nt, Homo Sapiens; identical to SEQ ID NO: 157366

SEQ ID NO: 201230 - RNA, 64 nt, Homo Sapiens; identical to SEQ ID NO: 157367

SEQ ID NO: 201231 - RNA, 64 nt, Homo Sapiens; identical to SEQ ID NO: 157368

SEQ ID NO: 201232 - RNA, 64 nt, Homo Sapiens; identical to SEQ ID NO: 157369

SEQ ID NO: 201233 - RNA, 64 nt, Homo Sapiens; identical to SEQ ID NO: 157370

SEQ ID NO: 201234 - RNA, 64 nt, Homo Sapiens; identical to SEQ ID NO: 157371

SEQ ID NO: 201235 - RNA, 64 nt, Homo Sapiens; identical to SEQ ID NO: 157372

SEQ ID NO: 201236 - RNA, 64 nt, Homo Sapiens; identical to SEQ ID NO: 157373

SEQ ID NO: 201237 - RNA, 64 nt, Homo Sapiens; identical to SEQ ID NO: 157374

SEQ ID NO: 201238 - RNA, 64 nt, Homo Sapiens; identical to SEQ ID NO: 157375

SEQ ID NO: 201239 - RNA, 64 nt, Homo Sapiens; identical to SEQ ID NO: 157376

SEQ ID NO: 201240 - RNA, 64 nt, Homo Sapiens; identical to SEQ ID NO: 157377

SEQ ID NO: 201241 - RNA, 64 nt, Homo Sapiens; identical to SEQ ID NO: 157378

SEQ ID NO: 201242 - RNA, 64 nt, Homo Sapiens; identical to SEQ ID NO: 157379

SEQ ID NO: 201243 - RNA, 64 nt, Homo Sapiens; identical to SEQ ID NO: 157380

SEQ ID NO: 201244 - RNA, 64 nt, Homo Sapiens; identical to SEQ ID NO: 157381

SEQ ID NO: 201245 - RNA, 64 nt, Homo Sapiens; identical to SEQ ID NO: 157382

SEQ ID NO: 201246 - RNA, 64 nt, Homo Sapiens; identical to SEQ ID NO: 157383

SEQ ID NO: 201247 - RNA, 64 nt, Homo Sapiens; identical to SEQ ID NO: 157384

SEQ ID NO: 201248 - RNA, 64 nt, Homo Sapiens; identical to SEQ ID NO: 157385

SEQ ID NO: 201249 - RNA, 64 nt, Homo Sapiens; identical to SEQ ID NO: 157386

SEQ ID NO: 201250 - RNA, 64 nt, Homo Sapiens; identical to SEQ ID NO: 157387

SEQ ID NO: 201251 - RNA, 64 nt, Homo Sapiens; identical to SEQ ID NO: 157388

SEQ ID NO: 201252 - RNA, 64 nt, Homo Sapiens; identical to SEQ ID NO: 157389

SEQ ID NO: 201253 - RNA, 64 nt, Homo Sapiens; identical to SEQ ID NO: 157390

SEQ ID NO: 201254 - RNA, 64 nt, Homo Sapiens; identical to SEQ ID NO: 157391

SEQ ID NO: 201255 - RNA, 64 nt, Homo Sapiens; identical to SEQ ID NO: 157392

SEQ ID NO: 201256 - RNA, 64 nt, Homo Sapiens; identical to SEQ ID NO: 157393

SEQ ID NO: 201257 - RNA, 64 nt, Homo Sapiens; identical to SEQ ID NO: 157394

SEQ ID NO: 201258 - RNA, 64 nt, Homo Sapiens; identical to SEQ ID NO: 157395

SEQ ID NO: 201259 - RNA, 64 nt, Homo Sapiens; identical to SEQ ID NO: 157396

SEQ ID NO: 201260 - RNA, 64 nt, Homo Sapiens; identical to SEQ ID NO: 157397

SEQ ID NO: 201261 - RNA, 64 nt, Homo Sapiens; identical to SEQ ID NO: 157398

SEQ ID NO: 201262 - RNA, 64 nt, Homo Sapiens; identical to SEQ ID NO: 157399

SEQ ID NO: 201263 - RNA, 64 nt, Homo Sapiens; identical to SEQ ID NO: 157400

SEQ ID NO: 201264 - RNA, 64 nt, Homo Sapiens; identical to SEQ ID NO: 157401

SEQ ID NO: 201265 - RNA, 64 nt, Homo Sapiens; identical to SEQ ID NO: 157402

SEQ ID NO: 201266 - RNA, 64 nt, Homo Sapiens; identical to SEQ ID NO: 157403

SEQ ID NO: 201267 - RNA, 64 nt, Homo Sapiens; identical to SEQ ID NO: 157404

SEQ ID NO: 201268 - RNA, 64 nt, Homo Sapiens; identical to SEQ ID NO: 157405

SEQ ID NO: 201269 - RNA, 64 nt, Homo Sapiens; identical to SEQ ID NO: 157406

SEQ ID NO: 201270 - RNA, 64 nt, Homo Sapiens; identical to SEQ ID NO: 157407

SEQ ID NO: 201271 - RNA, 64 nt, Homo Sapiens; identical to SEQ ID NO: 157408

SEQ ID NO: 201272 - RNA, 64 nt, Homo Sapiens; identical to SEQ ID NO: 157409

SEQ ID NO: 201273 - RNA, 64 nt, Homo Sapiens; identical to SEQ ID NO: 157410

SEQ ID NO: 201274 - RNA, 64 nt, Homo Sapiens; identical to SEQ ID NO: 157411

SEQ ID NO: 201275 - RNA, 64 nt, Homo Sapiens; identical to SEQ ID NO: 157412

SEQ ID NO: 201276 - RNA, 64 nt, Homo Sapiens; identical to SEQ ID NO: 157413

SEQ ID NO: 201277 - RNA, 64 nt, Homo Sapiens; identical to SEQ ID NO: 157414

SEQ ID NO: 201278 - RNA, 64 nt, Homo Sapiens; identical to SEQ ID NO: 157415

SEQ ID NO: 201279 - RNA, 64 nt, Homo Sapiens; identical to SEQ ID NO: 157416

SEQ ID NO: 201280 - RNA, 64 nt, Homo Sapiens; identical to SEQ ID NO: 157417

SEQ ID NO: 201281 - RNA, 64 nt, Homo Sapiens; identical to SEQ ID NO: 157418

SEQ ID NO: 201282 - RNA, 64 nt, Homo Sapiens; identical to SEQ ID NO: 157419

SEQ ID NO: 201283 - RNA, 64 nt, Homo Sapiens; identical to SEQ ID NO: 157420

SEQ ID NO: 201284 - RNA, 64 nt, Homo Sapiens; identical to SEQ ID NO: 157421

SEQ ID NO: 201285 - RNA, 64 nt, Homo Sapiens; identical to SEQ ID NO: 157422

SEQ ID NO: 201286 - RNA, 64 nt, Homo Sapiens; identical to SEQ ID NO: 157423

SEQ ID NO: 201287 - RNA, 64 nt, Homo Sapiens; identical to SEQ ID NO: 157424

SEQ ID NO: 201288 - RNA, 64 nt, Homo Sapiens; identical to SEQ ID NO: 157425

SEQ ID NO: 201289 - RNA, 64 nt, Homo Sapiens; identical to SEQ ID NO: 157426

SEQ ID NO: 201290 - RNA, 64 nt, Homo Sapiens; identical to SEQ ID NO: 157427

SEQ ID NO: 201291 - RNA, 64 nt, Homo Sapiens; identical to SEQ ID NO: 157428

SEQ ID NO: 201292 - RNA, 64 nt, Homo Sapiens; identical to SEQ ID NO: 157429

SEQ ID NO: 201293 - RNA, 64 nt, Homo Sapiens; identical to SEQ ID NO: 157430

SEQ ID NO: 201294 - RNA, 64 nt, Homo Sapiens; identical to SEQ ID NO: 157431

SEQ ID NO: 201295 - RNA, 64 nt, Homo Sapiens; identical to SEQ ID NO: 157432

SEQ ID NO: 201296 - RNA, 64 nt, Homo Sapiens; identical to SEQ ID NO: 157433

SEQ ID NO: 201297 - RNA, 64 nt, Homo Sapiens; identical to SEQ ID NO: 157434

SEQ ID NO: 201298 - RNA, 64 nt, Homo Sapiens; identical to SEQ ID NO: 157435

SEQ ID NO: 201299 - RNA, 64 nt, Homo Sapiens; identical to SEQ ID NO: 157436

SEQ ID NO: 201300 - RNA, 64 nt, Homo Sapiens; identical to SEQ ID NO: 157437

SEQ ID NO: 201301 - RNA, 64 nt, Homo Sapiens; identical to SEQ ID NO: 157438

SEQ ID NO: 201302 - RNA, 64 nt, Homo Sapiens; identical to SEQ ID NO: 157439

SEQ ID NO: 201303 - RNA, 64 nt, Homo Sapiens; identical to SEQ ID NO: 157440

SEQ ID NO: 201304 - RNA, 64 nt, Homo Sapiens; identical to SEQ ID NO: 157441

SEQ ID NO: 201305 - RNA, 64 nt, Homo Sapiens; identical to SEQ ID NO: 157442

SEQ ID NO: 201306 - RNA, 64 nt, Homo Sapiens; identical to SEQ ID NO: 157443

SEQ ID NO: 201307 - RNA, 64 nt, Homo Sapiens; identical to SEQ ID NO: 157444

SEQ ID NO: 201308 - RNA, 64 nt, Homo Sapiens; identical to SEQ ID NO: 157445

SEQ ID NO: 201309 - RNA, 64 nt, Homo Sapiens; identical to SEQ ID NO: 157446

SEQ ID NO: 201310 - RNA, 64 nt, Homo Sapiens; identical to SEQ ID NO: 157447

SEQ ID NO: 201311 - RNA, 64 nt, Homo Sapiens; identical to SEQ ID NO: 157448

SEQ ID NO: 201312 - RNA, 64 nt, Homo Sapiens; identical to SEQ ID NO: 157449

SEQ ID NO: 201313 - RNA, 64 nt, Homo Sapiens; identical to SEQ ID NO: 157450

SEQ ID NO: 201314 - RNA, 64 nt, Homo Sapiens; identical to SEQ ID NO: 157451

SEQ ID NO: 201315 - RNA, 64 nt, Homo Sapiens; identical to SEQ ID NO: 157452

SEQ ID NO: 201316 - RNA, 64 nt, Homo Sapiens; identical to SEQ ID NO: 157453

SEQ ID NO: 201317 - RNA, 64 nt, Homo Sapiens; identical to SEQ ID NO: 157454

SEQ ID NO: 201318 - RNA, 64 nt, Homo Sapiens; identical to SEQ ID NO: 157455

SEQ ID NO: 201319 - RNA, 64 nt, Homo Sapiens; identical to SEQ ID NO: 157456

SEQ ID NO: 201320 - RNA, 64 nt, Homo Sapiens; identical to SEQ ID NO: 157457

SEQ ID NO: 201321 - RNA, 64 nt, Homo Sapiens; identical to SEQ ID NO: 157458

SEQ ID NO: 201322 - RNA, 64 nt, Homo Sapiens; identical to SEQ ID NO: 157459

SEQ ID NO: 201323 - RNA, 64 nt, Homo Sapiens; identical to SEQ ID NO: 157460

SEQ ID NO: 201324 - RNA, 64 nt, Homo Sapiens; identical to SEQ ID NO: 157461

SEQ ID NO: 201325 - RNA, 64 nt, Homo Sapiens; identical to SEQ ID NO: 157462

SEQ ID NO: 201326 - RNA, 64 nt, Homo Sapiens; identical to SEQ ID NO: 157463

SEQ ID NO: 201327 - RNA, 64 nt, Homo Sapiens; identical to SEQ ID NO: 157464

SEQ ID NO: 201328 - RNA, 64 nt, Homo Sapiens; identical to SEQ ID NO: 157465

SEQ ID NO: 201329 - RNA, 64 nt, Homo Sapiens; identical to SEQ ID NO: 157466

SEQ ID NO: 201330 - RNA, 64 nt, Homo Sapiens; identical to SEQ ID NO: 157467

SEQ ID NO: 201331 - RNA, 64 nt, Homo Sapiens; identical to SEQ ID NO: 157468

SEQ ID NO: 201332 - RNA, 64 nt, Homo Sapiens; identical to SEQ ID NO: 157469

SEQ ID NO: 201333 - RNA, 64 nt, Homo Sapiens; identical to SEQ ID NO: 157470

SEQ ID NO: 201334 - RNA, 64 nt, Homo Sapiens; identical to SEQ ID NO: 157471

SEQ ID NO: 201335 - RNA, 64 nt, Homo Sapiens; identical to SEQ ID NO: 157472

SEQ ID NO: 201336 - RNA, 64 nt, Homo Sapiens; identical to SEQ ID NO: 157473

SEQ ID NO: 201337 - RNA, 64 nt, Homo Sapiens; identical to SEQ ID NO: 157474

SEQ ID NO: 201338 - RNA, 64 nt, Homo Sapiens; identical to SEQ ID NO: 157475

SEQ ID NO: 201339 - RNA, 64 nt, Homo Sapiens; identical to SEQ ID NO: 157476

SEQ ID NO: 201340 - RNA, 64 nt, Homo Sapiens; identical to SEQ ID NO: 157477

SEQ ID NO: 201341 - RNA, 64 nt, Homo Sapiens; identical to SEQ ID NO: 157478

SEQ ID NO: 201342 - RNA, 64 nt, Homo Sapiens; identical to SEQ ID NO: 157479

SEQ ID NO: 201343 - RNA, 64 nt, Homo Sapiens; identical to SEQ ID NO: 157480

SEQ ID NO: 201344 - RNA, 64 nt, Homo Sapiens; identical to SEQ ID NO: 157481

SEQ ID NO: 201345 - RNA, 64 nt, Homo Sapiens; identical to SEQ ID NO: 157482

SEQ ID NO: 201346 - RNA, 64 nt, Homo Sapiens; identical to SEQ ID NO: 157483

SEQ ID NO: 201347 - RNA, 64 nt, Homo Sapiens; identical to SEQ ID NO: 157484

SEQ ID NO: 201348 - RNA, 64 nt, Homo Sapiens; identical to SEQ ID NO: 157485

SEQ ID NO: 201349 - RNA, 64 nt, Homo Sapiens; identical to SEQ ID NO: 157486

SEQ ID NO: 201350 - RNA, 64 nt, Homo Sapiens; identical to SEQ ID NO: 157487

SEQ ID NO: 201351 - RNA, 64 nt, Homo Sapiens; identical to SEQ ID NO: 157488

SEQ ID NO: 201352 - RNA, 64 nt, Homo Sapiens; identical to SEQ ID NO: 157489

SEQ ID NO: 201353 - RNA, 64 nt, Homo Sapiens; identical to SEQ ID NO: 157490

SEQ ID NO: 201354 - RNA, 64 nt, Homo Sapiens; identical to SEQ ID NO: 157491

SEQ ID NO: 201355 - RNA, 64 nt, Homo Sapiens; identical to SEQ ID NO: 157492

SEQ ID NO: 201356 - RNA, 64 nt, Homo Sapiens; identical to SEQ ID NO: 157493

SEQ ID NO: 201357 - RNA, 64 nt, Homo Sapiens; identical to SEQ ID NO: 157494

SEQ ID NO: 201358 - RNA, 64 nt, Homo Sapiens; identical to SEQ ID NO: 157495

SEQ ID NO: 201359 - RNA, 64 nt, Homo Sapiens; identical to SEQ ID NO: 157496

SEQ ID NO: 201360 - RNA, 64 nt, Homo Sapiens; identical to SEQ ID NO: 157497

SEQ ID NO: 201361 - RNA, 64 nt, Homo Sapiens; identical to SEQ ID NO: 157498

SEQ ID NO: 201362 - RNA, 64 nt, Homo Sapiens; identical to SEQ ID NO: 157499

SEQ ID NO: 201363 - RNA, 64 nt, Homo Sapiens; identical to SEQ ID NO: 157500

SEQ ID NO: 201364 - RNA, 64 nt, Homo Sapiens; identical to SEQ ID NO: 157501

SEQ ID NO: 201365 - RNA, 64 nt, Homo Sapiens; identical to SEQ ID NO: 157502

SEQ ID NO: 201366 - RNA, 64 nt, Homo Sapiens; identical to SEQ ID NO: 157503

SEQ ID NO: 201367 - RNA, 64 nt, Homo Sapiens; identical to SEQ ID NO: 157504

SEQ ID NO: 201368 - RNA, 64 nt, Homo Sapiens; identical to SEQ ID NO: 157505

SEQ ID NO: 201369 - RNA, 64 nt, Homo Sapiens; identical to SEQ ID NO: 157506

SEQ ID NO: 201370 - RNA, 64 nt, Homo Sapiens; identical to SEQ ID NO: 157507

SEQ ID NO: 201371 - RNA, 64 nt, Homo Sapiens; identical to SEQ ID NO: 157508

SEQ ID NO: 201372 - RNA, 64 nt, Homo Sapiens; identical to SEQ ID NO: 157509

SEQ ID NO: 201373 - RNA, 64 nt, Homo Sapiens; identical to SEQ ID NO: 157510

SEQ ID NO: 201374 - RNA, 64 nt, Homo Sapiens; identical to SEQ ID NO: 157511

SEQ ID NO: 201375 - RNA, 64 nt, Homo Sapiens; identical to SEQ ID NO: 157512

SEQ ID NO: 201376 - RNA, 64 nt, Homo Sapiens; identical to SEQ ID NO: 157513

SEQ ID NO: 201377 - RNA, 64 nt, Homo Sapiens; identical to SEQ ID NO: 157514

SEQ ID NO: 201378 - RNA, 64 nt, Homo Sapiens; identical to SEQ ID NO: 157515

SEQ ID NO: 201379 - RNA, 64 nt, Homo Sapiens; identical to SEQ ID NO: 157516

SEQ ID NO: 201380 - RNA, 64 nt, Homo Sapiens; identical to SEQ ID NO: 157517

SEQ ID NO: 201381 - RNA, 64 nt, Homo Sapiens; identical to SEQ ID NO: 157518

SEQ ID NO: 201382 - RNA, 64 nt, Homo Sapiens; identical to SEQ ID NO: 157519

SEQ ID NO: 201383 - RNA, 64 nt, Homo Sapiens; identical to SEQ ID NO: 157520

SEQ ID NO: 201384 - RNA, 64 nt, Homo Sapiens; identical to SEQ ID NO: 157521

SEQ ID NO: 201385 - RNA, 64 nt, Homo Sapiens; identical to SEQ ID NO: 157522

SEQ ID NO: 201386 - RNA, 64 nt, Homo Sapiens; identical to SEQ ID NO: 157523

SEQ ID NO: 201387 - RNA, 64 nt, Homo Sapiens; identical to SEQ ID NO: 157524

SEQ ID NO: 201388 - RNA, 64 nt, Homo Sapiens; identical to SEQ ID NO: 157525

SEQ ID NO: 201389 - RNA, 64 nt, Homo Sapiens; identical to SEQ ID NO: 157526

SEQ ID NO: 201390 - RNA, 64 nt, Homo Sapiens; identical to SEQ ID NO: 157527

SEQ ID NO: 201391 - RNA, 64 nt, Homo Sapiens; identical to SEQ ID NO: 157528

SEQ ID NO: 201392 - RNA, 64 nt, Homo Sapiens; identical to SEQ ID NO: 157529

SEQ ID NO: 201393 - RNA, 64 nt, Homo Sapiens; identical to SEQ ID NO: 157530

SEQ ID NO: 201394 - RNA, 64 nt, Homo Sapiens; identical to SEQ ID NO: 157531

SEQ ID NO: 201395 - RNA, 64 nt, Homo Sapiens; identical to SEQ ID NO: 157532

SEQ ID NO: 201396 - RNA, 64 nt, Homo Sapiens; identical to SEQ ID NO: 157533

SEQ ID NO: 201397 - RNA, 64 nt, Homo Sapiens; identical to SEQ ID NO: 157534

SEQ ID NO: 201398 - RNA, 64 nt, Homo Sapiens; identical to SEQ ID NO: 157535

SEQ ID NO: 201399 - RNA, 64 nt, Homo Sapiens; identical to SEQ ID NO: 157536

SEQ ID NO: 201400 - RNA, 64 nt, Homo Sapiens; identical to SEQ ID NO: 157537

SEQ ID NO: 201401 - RNA, 64 nt, Homo Sapiens; identical to SEQ ID NO: 157538

SEQ ID NO: 201402 - RNA, 64 nt, Homo Sapiens; identical to SEQ ID NO: 157539

SEQ ID NO: 201403 - RNA, 64 nt, Homo Sapiens; identical to SEQ ID NO: 157540

SEQ ID NO: 201404 - RNA, 64 nt, Homo Sapiens; identical to SEQ ID NO: 157541

SEQ ID NO: 201405 - RNA, 64 nt, Homo Sapiens; identical to SEQ ID NO: 157542

SEQ ID NO: 201406 - RNA, 64 nt, Homo Sapiens; identical to SEQ ID NO: 157543

SEQ ID NO: 201407 - RNA, 64 nt, Homo Sapiens; identical to SEQ ID NO: 157544

SEQ ID NO: 201408 - RNA, 64 nt, Homo Sapiens; identical to SEQ ID NO: 157545

SEQ ID NO: 201409 - RNA, 64 nt, Homo Sapiens; identical to SEQ ID NO: 157546

SEQ ID NO: 201410 - RNA, 64 nt, Homo Sapiens; identical to SEQ ID NO: 157547

SEQ ID NO: 201411 - RNA, 64 nt, Homo Sapiens; identical to SEQ ID NO: 157548

SEQ ID NO: 201412 - RNA, 64 nt, Homo Sapiens; identical to SEQ ID NO: 157549

SEQ ID NO: 201413 - RNA, 64 nt, Homo Sapiens; identical to SEQ ID NO: 157550

SEQ ID NO: 201414 - RNA, 64 nt, Homo Sapiens; identical to SEQ ID NO: 157551

SEQ ID NO: 201415 - RNA, 64 nt, Homo Sapiens; identical to SEQ ID NO: 157552

SEQ ID NO: 201416 - RNA, 64 nt, Homo Sapiens; identical to SEQ ID NO: 157553

SEQ ID NO: 201417 - RNA, 64 nt, Homo Sapiens; identical to SEQ ID NO: 157554

SEQ ID NO: 201418 - RNA, 64 nt, Homo Sapiens; identical to SEQ ID NO: 157555

SEQ ID NO: 201419 - RNA, 64 nt, Homo Sapiens; identical to SEQ ID NO: 157556

SEQ ID NO: 201420 - RNA, 64 nt, Homo Sapiens; identical to SEQ ID NO: 157557

SEQ ID NO: 201421 - RNA, 64 nt, Homo Sapiens; identical to SEQ ID NO: 157558

SEQ ID NO: 201422 - RNA, 64 nt, Homo Sapiens; identical to SEQ ID NO: 157559

SEQ ID NO: 201423 - RNA, 64 nt, Homo Sapiens; identical to SEQ ID NO: 157560

SEQ ID NO: 201424 - RNA, 64 nt, Homo Sapiens; identical to SEQ ID NO: 157561

SEQ ID NO: 201425 - RNA, 64 nt, Homo Sapiens; identical to SEQ ID NO: 157562

SEQ ID NO: 201426 - RNA, 64 nt, Homo Sapiens; identical to SEQ ID NO: 157563

SEQ ID NO: 201427 - RNA, 64 nt, Homo Sapiens; identical to SEQ ID NO: 157564

SEQ ID NO: 201428 - RNA, 64 nt, Homo Sapiens; identical to SEQ ID NO: 157565

SEQ ID NO: 201429 - RNA, 64 nt, Homo Sapiens; identical to SEQ ID NO: 157566

SEQ ID NO: 201430 - RNA, 64 nt, Homo Sapiens; identical to SEQ ID NO: 157567

SEQ ID NO: 201431 - RNA, 64 nt, Homo Sapiens; identical to SEQ ID NO: 157568

SEQ ID NO: 201432 - RNA, 64 nt, Homo Sapiens; identical to SEQ ID NO: 157569

SEQ ID NO: 201433 - RNA, 64 nt, Homo Sapiens; identical to SEQ ID NO: 157570

SEQ ID NO: 201434 - RNA, 64 nt, Homo Sapiens; identical to SEQ ID NO: 157571

SEQ ID NO: 201435 - RNA, 64 nt, Homo Sapiens; identical to SEQ ID NO: 157572

SEQ ID NO: 201436 - RNA, 64 nt, Homo Sapiens; identical to SEQ ID NO: 157573

SEQ ID NO: 201437 - RNA, 64 nt, Homo Sapiens; identical to SEQ ID NO: 157574

SEQ ID NO: 201438 - RNA, 64 nt, Homo Sapiens; identical to SEQ ID NO: 157575

SEQ ID NO: 201439 - RNA, 64 nt, Homo Sapiens; identical to SEQ ID NO: 157576

SEQ ID NO: 201440 - RNA, 64 nt, Homo Sapiens; identical to SEQ ID NO: 157577

SEQ ID NO: 201441 - RNA, 64 nt, Homo Sapiens; identical to SEQ ID NO: 157578

SEQ ID NO: 201442 - RNA, 64 nt, Homo Sapiens; identical to SEQ ID NO: 157579

SEQ ID NO: 201443 - RNA, 64 nt, Homo Sapiens; identical to SEQ ID NO: 157580

SEQ ID NO: 201444 - RNA, 64 nt, Homo Sapiens; identical to SEQ ID NO: 157581

SEQ ID NO: 201445 - RNA, 64 nt, Homo Sapiens; identical to SEQ ID NO: 157582

SEQ ID NO: 201446 - RNA, 64 nt, Homo Sapiens; identical to SEQ ID NO: 157583

SEQ ID NO: 201447 - RNA, 64 nt, Homo Sapiens; identical to SEQ ID NO: 157584

SEQ ID NO: 201448 - RNA, 64 nt, Homo Sapiens; identical to SEQ ID NO: 157585

SEQ ID NO: 201449 - RNA, 64 nt, Homo Sapiens; identical to SEQ ID NO: 157586

SEQ ID NO: 201450 - RNA, 64 nt, Homo Sapiens; identical to SEQ ID NO: 157587

SEQ ID NO: 201451 - RNA, 64 nt, Homo Sapiens; identical to SEQ ID NO: 157588

SEQ ID NO: 201452 - RNA, 64 nt, Homo Sapiens; identical to SEQ ID NO: 157589

SEQ ID NO: 201453 - RNA, 64 nt, Homo Sapiens; identical to SEQ ID NO: 157590

SEQ ID NO: 201454 - RNA, 64 nt, Homo Sapiens; identical to SEQ ID NO: 157591

SEQ ID NO: 201455 - RNA, 64 nt, Homo Sapiens; identical to SEQ ID NO: 157592

SEQ ID NO: 201456 - RNA, 64 nt, Homo Sapiens; identical to SEQ ID NO: 157593

SEQ ID NO: 201457 - RNA, 64 nt, Homo Sapiens; identical to SEQ ID NO: 157594

SEQ ID NO: 201458 - RNA, 64 nt, Homo Sapiens; identical to SEQ ID NO: 157595

SEQ ID NO: 201459 - RNA, 64 nt, Homo Sapiens; identical to SEQ ID NO: 157596

SEQ ID NO: 201460 - RNA, 64 nt, Homo Sapiens; identical to SEQ ID NO: 157597

SEQ ID NO: 201461 - RNA, 64 nt, Homo Sapiens; identical to SEQ ID NO: 157598

SEQ ID NO: 201462 - RNA, 64 nt, Homo Sapiens; identical to SEQ ID NO: 157599

SEQ ID NO: 201463 - RNA, 64 nt, Homo Sapiens; identical to SEQ ID NO: 157600

SEQ ID NO: 201464 - RNA, 64 nt, Homo Sapiens; identical to SEQ ID NO: 157601

SEQ ID NO: 201465 - RNA, 64 nt, Homo Sapiens; identical to SEQ ID NO: 157602

SEQ ID NO: 201466 - RNA, 64 nt, Homo Sapiens; identical to SEQ ID NO: 157603

SEQ ID NO: 201467 - RNA, 64 nt, Homo Sapiens; identical to SEQ ID NO: 157604

SEQ ID NO: 201468 - RNA, 64 nt, Homo Sapiens; identical to SEQ ID NO: 157605

SEQ ID NO: 201469 - RNA, 64 nt, Homo Sapiens; identical to SEQ ID NO: 157606

SEQ ID NO: 201470 - RNA, 64 nt, Homo Sapiens
auuaacacacacaugaacuguuuuuuaaagaaggcacuuuuaaauauuuuuuaaaauuaaguaa

SEQ ID NO: 201471 - RNA, 64 nt, Homo Sapiens
uuuuaaaauuaaguaauuuuugaggaaguuuccccacuuuuauuuuuugcccuugaaagucacc

SEQ ID NO: 201472 - RNA, 64 nt, Homo Sapiens
uucuaaaaguaggacagugguuuuggggguuauccacuuuuauuuuuuugaaacuagcucucau

SEQ ID NO: 201473 - RNA, 64 nt, Homo Sapiens
guauauguguuguggaagugaguacacuaucauccacuuuuaaugacagaaaguuauaaacuua

SEQ ID NO: 201474 - RNA, 64 nt, Homo Sapiens
auaaauagaagaaaucaugaguaaaauuggaaaacacuuuuaacugaaaaaaacaaaagcacaa

SEQ ID NO: 201475 - RNA, 64 nt, Homo Sapiens
caauacaugucuucauguaccuguauguaaaucccacuuuuauucuaaaauucuuugaauauuu

SEQ ID NO: 201476 - RNA, 64 nt, Homo Sapiens
aauauuuauaaaaaguguauaugcaguaugauaccacuuuuaaaaaaagauaaauuuauagaaa

SEQ ID NO: 201477 - RNA, 64 nt, Homo Sapiens
augcuucagagucaucucuguccugcccgggaugcacuuuuaaaugaagaguuagaauauuuua

SEQ ID NO: 201478 - RNA, 64 nt, Homo Sapiens
cuuuauccuuuuugaugccauauuuucaguguuacacuuuuauggcuuuuaauuuucgauuuga

SEQ ID NO: 201479 - RNA, 64 nt, Homo Sapiens
gcgguuugacugcauugagcuuaccuauaaaaaccacuuuuauucuuaagagaugaaaucacuu

SEQ ID NO: 201480 - RNA, 64 nt, Homo Sapiens
uauaaaaaccacuuuuauuguuaagagaugaaaucacuuuuaccaaguucucgacauucagauc

SEQ ID NO: 201481 - RNA, 64 nt, Homo Sapiens
uggcauuuuauacuuaacuacacauuguacgugucacuuuuauuuuaagcuuauuuuuauaaac

SEQ ID NO: 201482 - RNA, 64 nt, Homo Sapiens
guuuucuucucacuuccaaucuuaucuaacuggacacuuuuacucucagaggugcaaaaagaua

SEQ ID NO: 201483 - RNA, 64 nt, Homo Sapiens
ccucucuucuaccuuaaaauaaagaauaaaauugcacuuuuaaaauguuauugcauaauuuaua

SEQ ID NO: 201484 - RNA, 64 nt, Homo Sapiens
cauuugaguuauuuuaauuagauuauucugauuccacuuuuauuugauaacugcaauuuuaauu

SEQ ID NO: 201485 - RNA, 64 nt, Homo Sapiens
ucggcuugaguucaccaucucuucauucaaacugcacuuuuagccagagaugcaauauaucccc

SEQ ID NO: 201486 - RNA, 64 nt, Homo Sapiens
gugcaccgagugauuuccaucucugguaaaguuacacuuuuauuuccuguauguuguacaauca

SEQ ID NO: 201487 - RNA, 64 nt, Homo Sapiens
uugccuauaggaaauauugcgguuggggcagcugcacuuuuagggacuucucaaacuuuucaag

SEQ ID NO: 201488 - RNA, 64 nt, Homo Sapiens
uacucuuuccccuuugaccucuggcauuaggcagcacuuuuaucccugcugugccaguuaccau

SEQ ID NO: 201489 - RNA, 64 nt, Homo Sapiens
auguuacucucgguugcuuuaaaguaguugaagccacuuuuagaaaaaacugacucaugucuuu

SEQ ID NO: 201490 - RNA, 64 nt, Homo Sapiens
uucuugcuggagguuuuaaagggaugauaaauuacacuuuuaagauaagucugggcagcucuau

SEQ ID NO: 201491 - RNA, 64 nt, Homo Sapiens
ccauagaguuuaguaaccguccagcaagugucaucacuuuuacagaaaacaagguccaguaaua

SEQ ID NO: 201492 - RNA, 64 nt, Homo Sapiens
caagguccaguaauagcaagucuuaguacauccucacuuuuauuauaaauggguguuuuuucau

SEQ ID NO: 201493 - RNA, 64 nt, Homo Sapiens
uacucaugagaaguggaagcgguuucuuggagaccacuuuuauuagacaugucuugugaaggaa

SEQ ID NO: 201494 - RNA, 64 nt, Homo Sapiens
uuuauauaugacagcauuuauggauuugaaauugcacuuuuaaucauucuggaaaugauuucug

SEQ ID NO: 201495 - RNA, 64 nt, Homo Sapiens
acccaaaucacaauaaaauuaaacaauuauuuaucacuuuuaugugcaauuuaugaaaacauau

SEQ ID NO: 201496 - RNA, 64 nt, Homo Sapiens
cucacuuccaauuauagcauauuucauauacacucacuuuuacauuuauucugccauaugguuu

SEQ ID NO: 201497 - RNA, 64 nt, Homo Sapiens
agauuauaucucugguguuauauuuuguuuuuuucacuuuuaaguguuaguuucauucaaacua

SEQ ID NO: 201498 - RNA, 64 nt, Homo Sapiens
auuuccaguucagaagagccuucacggugaacagcacuuuuauuuacuguguauuuuuuuuaaa

SEQ ID NO: 201499 - RNA, 64 nt, Homo Sapiens
cugcagacuaaauuucuuuccuggauuucagcuucacuuuuaacauugaggaaaacauuaacuc

SEQ ID NO: 201500 - RNA, 64 nt, Homo Sapiens
augagaaaacugugucacuccauuagaaauuagccacuuuuaaacucugcauaaccaguauuag

SEQ ID NO: 201501 - RNA, 64 nt, Homo Sapiens; identical to SEQ ID NO: 53018

SEQ ID NO: 201502 - RNA, 64 nt, Homo Sapiens; identical to SEQ ID NO: 53019

SEQ ID NO: 201503 - RNA, 64 nt, Homo Sapiens; identical to SEQ ID NO: 53020

SEQ ID NO: 201504 - RNA, 64 nt, Homo Sapiens; identical to SEQ ID NO: 53021

SEQ ID NO: 201505 - RNA, 64 nt, Homo Sapiens; identical to SEQ ID NO: 53022

SEQ ID NO: 201506 - RNA, 64 nt, Homo Sapiens; identical to SEQ ID NO: 53023

SEQ ID NO: 201507 - RNA, 64 nt, Homo Sapiens; identical to SEQ ID NO: 53024

SEQ ID NO: 201508 - RNA, 64 nt, Homo Sapiens; identical to SEQ ID NO: 53025

SEQ ID NO: 201509 - RNA, 64 nt, Homo Sapiens; identical to SEQ ID NO: 53026

SEQ ID NO: 201510 - RNA, 64 nt, Homo Sapiens; identical to SEQ ID NO: 53027

SEQ ID NO: 201511 - RNA, 64 nt, Homo Sapiens; identical to SEQ ID NO: 53028

SEQ ID NO: 201512 - RNA, 64 nt, Homo Sapiens; identical to SEQ ID NO: 53029

SEQ ID NO: 201513 - RNA, 64 nt, Homo Sapiens; identical to SEQ ID NO: 53030

SEQ ID NO: 201514 - RNA, 64 nt, Homo Sapiens; identical to SEQ ID NO: 53031

SEQ ID NO: 201515 - RNA, 64 nt, Homo Sapiens; identical to SEQ ID NO: 53032

SEQ ID NO: 201516 - RNA, 64 nt, Homo Sapiens; identical to SEQ ID NO: 53033

SEQ ID NO: 201517 - RNA, 64 nt, Homo Sapiens; identical to SEQ ID NO: 53034

SEQ ID NO: 201518 - RNA, 64 nt, Homo Sapiens; identical to SEQ ID NO: 53035

SEQ ID NO: 201519 - RNA, 64 nt, Homo Sapiens; identical to SEQ ID NO: 53036

SEQ ID NO: 201520 - RNA, 64 nt, Homo Sapiens; identical to SEQ ID NO: 53037

SEQ ID NO: 201521 - RNA, 64 nt, Homo Sapiens; identical to SEQ ID NO: 53038

SEQ ID NO: 201522 - RNA, 64 nt, Homo Sapiens; identical to SEQ ID NO: 53039

SEQ ID NO: 201523 - RNA, 64 nt, Homo Sapiens; identical to SEQ ID NO: 53040

SEQ ID NO: 201524 - RNA, 64 nt, Homo Sapiens; identical to SEQ ID NO: 53041

SEQ ID NO: 201525 - RNA, 64 nt, Homo Sapiens; identical to SEQ ID NO: 53042

SEQ ID NO: 201526 - RNA, 64 nt, Homo Sapiens; identical to SEQ ID NO: 53043

SEQ ID NO: 201527 - RNA, 64 nt, Homo Sapiens; identical to SEQ ID NO: 53044

SEQ ID NO: 201528 - RNA, 64 nt, Homo Sapiens; identical to SEQ ID NO: 53045

SEQ ID NO: 201529 - RNA, 64 nt, Homo Sapiens; identical to SEQ ID NO: 53046

SEQ ID NO: 201530 - RNA, 64 nt, Homo Sapiens; identical to SEQ ID NO: 53047

SEQ ID NO: 201531 - RNA, 64 nt, Homo Sapiens; identical to SEQ ID NO: 53048

SEQ ID NO: 201532 - RNA, 64 nt, Homo Sapiens; identical to SEQ ID NO: 53049

SEQ ID NO: 201533 - RNA, 64 nt, Homo Sapiens; identical to SEQ ID NO: 53050

SEQ ID NO: 201534 - RNA, 64 nt, Homo Sapiens; identical to SEQ ID NO: 53051

SEQ ID NO: 201535 - RNA, 64 nt, Homo Sapiens; identical to SEQ ID NO: 53052

SEQ ID NO: 201536 - RNA, 64 nt, Homo Sapiens; identical to SEQ ID NO: 53053

SEQ ID NO: 201537 - RNA, 64 nt, Homo Sapiens; identical to SEQ ID NO: 53054

SEQ ID NO: 201538 - RNA, 64 nt, Homo Sapiens; identical to SEQ ID NO: 53055

SEQ ID NO: 201539 - RNA, 64 nt, Homo Sapiens; identical to SEQ ID NO: 53056

SEQ ID NO: 201540 - RNA, 64 nt, Homo Sapiens; identical to SEQ ID NO: 53057

SEQ ID NO: 201541 - RNA, 64 nt, Homo Sapiens; identical to SEQ ID NO: 53058

SEQ ID NO: 201542 - RNA, 64 nt, Homo Sapiens; identical to SEQ ID NO: 53059

SEQ ID NO: 201543 - RNA, 64 nt, Homo Sapiens
cggauggauggaagguuggauggauggguggauggccguggauggccguggaugcgcagugccu

SEQ ID NO: 201544 - RNA, 64 nt, Homo Sapiens
gaagguuggauggauggguggauggccguggauggccguggaugcgcagugccuugcauaccca

SEQ ID NO: 201545 - RNA, 64 nt, Homo Sapiens
gugcccagcagacgugguauugaggcuuggaccugccguggaggggugggagagagauggcuca

SEQ ID NO: 201546 - RNA, 64 nt, Homo Sapiens
gugcccggcagacguggcgucaaagcucggaccugccguggagggacgugagagggacgguuca

SEQ ID NO: 201547 - RNA, 64 nt, Homo Sapiens
ugcugcagacccucgaacauggaaguccuacagcgccguggauggagcuguaacaugcaggccu

SEQ ID NO: 201548 - RNA, 64 nt, Homo Sapiens
cccugacgcaagcuuuaaaggccucauggagccagccguggagcuaguggcgcauuccacaccc

SEQ ID NO: 201549 - RNA, 64 nt, Homo Sapiens
gggucggagcucuuccuuccccucuguggagucacuuuuguauucuuuuuaaccagauuucuua

SEQ ID NO: 201550 - RNA, 64 nt, Homo Sapiens
guuguuguuuugugaauccugacauugguucuuacuuuuguaugcugccuccucugugcccucc

SEQ ID NO: 201551 - RNA, 64 nt, Homo Sapiens
augaaccacugccccuucauuaaagugaagaauccuuuuguagaaaccacugcaaguccuuuug

SEQ ID NO: 201552 - RNA, 64 nt, Homo Sapiens
gugaagaauccuuuuguagaaaccacugcaaguccuuuuguaaaccuucaucuuuuaaagaaau

SEQ ID NO: 201553 - RNA, 64 nt, Homo Sapiens
aaauguuuugacuuaggaaugguuaaaaccauuccuuuuguaugauuuccucuugauuugucug

SEQ ID NO: 201554 - RNA, 64 nt, Homo Sapiens
ggacugccaaaucauggguuuuuugacagggccucuuuuguauagcuuguuuugugaaagaaug

SEQ ID NO: 201555 - RNA, 64 nt, Homo Sapiens
auuugauuuagaguauuuugucuuuucaguugaccuuuuguaauaaguauaaaaggaggccuau

SEQ ID NO: 201556 - RNA, 64 nt, Homo Sapiens
uuacuauuuauuucagaaaucaagguaaguucaccuuuuguacuaguuuuaacuagauguuuuu

SEQ ID NO: 201557 - RNA, 64 nt, Homo Sapiens
ggaacauuucuguaaauaccauugacacauccgccuuuuguauacauccuggguaaugagaggu

SEQ ID NO: 201558 - RNA, 64 nt, Homo Sapiens
uagauauuacuuuaucacuuuuugaacuaagaaacuuuuguaaagaaauuuacuauauauauau

SEQ ID NO: 201559 - RNA, 64 nt, Homo Sapiens
uuuugauacuuucuaccuaaucccauacaacuuucuuuuguacaaauccuaccuuccacucaac

SEQ ID NO: 201560 - RNA, 64 nt, Homo Sapiens
uuccccuauacaagauguauucuugccaccauaccuuuuguacuugccccuuuaaggauuucuc

SEQ ID NO: 201561 - RNA, 64 nt, Homo Sapiens
uugcuuuauucugcaaaagugaacaaguugaagacuuuuguauuuuugacuuugcuaguuugug

SEQ ID NO: 201562 - RNA, 64 nt, Homo Sapiens
aaagcuaacauacgguuuugaagcagcauugaaacuuuuguagcaaucuggucuauagacuuuu

SEQ ID NO: 201563 - RNA, 64 nt, Homo Sapiens
guggaccagacuucugaauagagaauauuuauaacuuuuguaugagagagaauucacacucaac

SEQ ID NO: 201564 - RNA, 64 nt, Homo Sapiens
cccgugucgaugucuucagccaguggugacccugcuuuuguaaccgcguuaaccugacaaaacc

SEQ ID NO: 201565 - RNA, 64 nt, Homo Sapiens
caauuaacacugagaaauuaagguuaagauucuccuuuuguacugggaaacaggcuggaggacu

SEQ ID NO: 201566 - RNA, 64 nt, Homo Sapiens
uagcagggaaagagcugggcaaggccaagaccaucuuuuguaccguugguacaguaggcuaaag

SEQ ID NO: 201567 - RNA, 64 nt, Homo Sapiens
uaugacagaaaugugcuauucuguuuuuauucaucuuuuguaacaugguguuuuuaaacuguuu

SEQ ID NO: 201568 - RNA, 64 nt, Homo Sapiens
gguuucuguuuagaagcaccuugaugcacuccagcuuuuguauaucuauuccuuuguuuuuccu

SEQ ID NO: 201569 - RNA, 64 nt, Homo Sapiens
gaccccuuccucaaccucuucacgcuggcauguccuuuuguagcagucuguaacuuaacuauag

SEQ ID NO: 201570 - RNA, 64 nt, Homo Sapiens
ugucaugcacauaauguauauuuguuaugcacuacuuuuguauaucuuguuuuuccaacaguga

SEQ ID NO: 201571 - RNA, 64 nt, Homo Sapiens
gcucaugauuugcacucuuaggguuuuguuagcccuuuuguacuacuuucuuuuuaaauugaga

SEQ ID NO: 201572 - RNA, 64 nt, Homo Sapiens
acuguuuaacauuugugagaauuuuaugaaaaugcuuuuguaugagcuguggcuuuuucccauu

SEQ ID NO: 201573 - RNA, 64 nt, Homo Sapiens
uacugccauguaauugaaauagauguuuaaaaugcuuuuguauuaguauacuacacaguucaaa

SEQ ID NO: 201574 - RNA, 64 nt, Homo Sapiens
guuguguauguuuuugcuucaacaguauucccaacuuuuguaaauugauuauugcuuauuugaa

SEQ ID NO: 201575 - RNA, 64 nt, Homo Sapiens
aguguaaaauuguuguagcuugaauaagaaaccacuuuuguaguuuuaaccagacuuucucuua

SEQ ID NO: 201576 - RNA, 64 nt, Homo Sapiens
aauaagaauguuuugauuuugaucauacaaauaacuuuuguagauuuuuguuuacuuuuggggg

SEQ ID NO: 201577 - RNA, 64 nt, Homo Sapiens
ucccuucuugugcccuuaaaaccaaacccuaugccuuuuguagcugucauggugcaauuugucu

SEQ ID NO: 201578 - RNA, 64 nt, Homo Sapiens
gguauuuuauaagcacagacaauucuaaugguaacuuuuguagucuuaugaauagacauaaauu

SEQ ID NO: 201579 - RNA, 64 nt, Homo Sapiens
uaagagugaggccacaguucccaccacacgagggcuuuuguauuguucuacuuuuucagcccuu

SEQ ID NO: 201580 - RNA, 64 nt, Homo Sapiens
auuaaauugguuucuuuaaaaugcuuugguggcacuuuuguaaacagauugcuucuagauuguu

SEQ ID NO: 201581 - RNA, 64 nt, Homo Sapiens
guuugaaaaauaaagcuguuaaaaaaaaaaauaccuuuuguaauagaagaaagaauuggcaguc

SEQ ID NO: 201582 - RNA, 64 nt, Homo Sapiens
uuugguagagacaggguuuucaugccuagcuauucuuuuguauuggacuacaggcacgcaccac

SEQ ID NO: 201583 - RNA, 64 nt, Homo Sapiens
gcaauuaauuaucccuuaauuaaaguaaagcacccuuuuguaaucccagaagugaauucuuuug

SEQ ID NO: 201584 - RNA, 64 nt, Homo Sapiens
guaaagcacccuuuuguaaucccagaagugaauucuuuuguaaaaagcuggcuguuuaagggaa

SEQ ID NO: 201585 - RNA, 64 nt, Homo Sapiens
uaucgacaaagguguggggacacuuuguaaugcucuuuuguaaccuuccucugagcccuugaga

SEQ ID NO: 201586 - RNA, 64 nt, Homo Sapiens
ugcuaauacaugugacuaucguccaauuugcuuucuuuuguagugacauuaaauuuggcuauaa

SEQ ID NO: 201587 - RNA, 64 nt, Homo Sapiens
accguuuauuuuacugacuuguuuaaaugauucgcuuuuguaagaaucagauggcauuaugcuu

SEQ ID NO: 201588 - RNA, 64 nt, Homo Sapiens
guuacaagucaggagcccuguagggagaccccuccuuuuguacaaguaccugaaugcugcgaca

SEQ ID NO: 201589 - RNA, 64 nt, Homo Sapiens
cgacucgguuccuggggcugcagccagccugggacuuuuguaagaauuuuugggugacucacuu

SEQ ID NO: 201590 - RNA, 64 nt, Homo Sapiens
ucaggcguggcuucuucagucaaguguagugcaucuuuuguaucgaagcgaacauaaagcgggu

SEQ ID NO: 201591 - RNA, 64 nt, Homo Sapiens
gaaaauggagagaaugaagauauuguaaggccugcuuuuguaauaaugcauauaaugaaaucaa

SEQ ID NO: 201592 - RNA, 64 nt, Homo Sapiens
uuuugaacacuuaacaguuucuuugagacaaugacuuuuguaaggauugguacuaucuaucauu

SEQ ID NO: 201593 - RNA, 64 nt, Homo Sapiens
agccucuugguguagcaagcucacauacaaaauacuuuuguauaugcauaauauaaaucaucuc

SEQ ID NO: 201594 - RNA, 64 nt, Homo Sapiens
uuaauguucuuuauaccuuuguauguaugaccuacuuuuguaacagaccaugguuguguccaag

SEQ ID NO: 201595 - RNA, 64 nt, Homo Sapiens
guaaauguccccuuaugcuuuugaaauaaauuuccuuuuguaauuuuguuuugugucuugaugu

SEQ ID NO: 201596 - RNA, 64 nt, Homo Sapiens
uuaaugcaauuauuuuggucuucuucccuaucaccuuuuguauuagucacugcaaaucuuuuaa

SEQ ID NO: 201597 - RNA, 64 nt, Homo Sapiens
ugauucacgagcuuuuuuaggucucaaauagcugcuuuuguauaauuucugguguucaaccuug

SEQ ID NO: 201598 - RNA, 64 nt, Homo Sapiens
uugaaauggaauuuugugauuuguagucagguaucuuuuguauuugauugcaaacauuuggauu

SEQ ID NO: 201599 - RNA, 64 nt, Homo Sapiens
cuguuuacagucaauuauaaccugacaaacgagacuuuuguaacauauuauuguuacaucuuuc

SEQ ID NO: 201600 - RNA, 64 nt, Homo Sapiens
uuauggacgguuuauaaauguucagacugccuuucuuuuguaauuuuacucuuuauacauacuu

SEQ ID NO: 201601 - RNA, 64 nt, Homo Sapiens
ucuuguccacuuguaaauugauuugaugguuacucuuuuguaauacaaaguugcuggcagaugu

SEQ ID NO: 201602 - RNA, 64 nt, Homo Sapiens
caaauagugguauucuaaucccguagcauagcaccuuuuguauaaacaaugugauauugcuucu

SEQ ID NO: 201603 - RNA, 64 nt, Homo Sapiens
gcaacuuuuaaagucuuacuugucuuucuuguugcuuuuguauuaggaguuccccguguggguc

SEQ ID NO: 201604 - RNA, 64 nt, Homo Sapiens
gcuuuguguuaucacucgguguauauaguucauacuuuuguaaucugucaaaauacuaccuuca

SEQ ID NO: 201605 - RNA, 64 nt, Homo Sapiens
guuucagcaguggcucaaaaaauuucagaaauuacuuuuguaauuauuugcaauuaauuguucu

SEQ ID NO: 201606 - RNA, 64 nt, Homo Sapiens
cgcccggcucccgccccgccccggcgcggcguggcuuuuguacagacguucccacauucuuguc

SEQ ID NO: 201607 - RNA, 64 nt, Homo Sapiens
aaaaaagucaaaacgaggcgagaggcgaagcccacuuuuguauaccggccggcgcgcucacuuu

SEQ ID NO: 201608 - RNA, 64 nt, Homo Sapiens
gagacuguauuguuaugagcauagauuauuacgucuuuuguauuuugauuuaaaauaaauaaaa

SEQ ID NO: 201609 - RNA, 64 nt, Homo Sapiens
uuaccuguuuguuaggaaauaguaaaauggacuacuuuuguaacacagggaaagacugaugaaa

SEQ ID NO: 201610 - RNA, 64 nt, Homo Sapiens
uguuguaauucaccauucauacuaauguuauugacuuuuguaacuuacuaauagggauguuaaa

SEQ ID NO: 201611 - RNA, 64 nt, Homo Sapiens
aaaagucucauacuaccucaucuuuauuguggcgcuuuuguagaucacugagaagcuuaucuua

SEQ ID NO: 201612 - RNA, 64 nt, Homo Sapiens
caaucuucgcugugugugguagaagcaguagucacuuuuguaagccagucucuucaugccuaaa

SEQ ID NO: 201613 - RNA, 64 nt, Homo Sapiens
agaggagauguugacacuaugagcuaaggguuggcuuuuguaauuaccugaaucugaaaggaau

SEQ ID NO: 201614 - RNA, 64 nt, Homo Sapiens
cauuuuuaguuggaaaaacaucagacagucuguucuuuuguaaaggugggguuuuuuuguuugu

SEQ ID NO: 201615 - RNA, 64 nt, Homo Sapiens
uuuuaaauggguugugcaagcaaaauagaggcagcuuuuguagauugcguuuuuaaucagaaaa

SEQ ID NO: 201616 - RNA, 64 nt, Homo Sapiens
gaccuguuccuuaaaaaaugaaaggcauaucucgcuuuuguaucuaaacuuuucuuuaucuuau

SEQ ID NO: 201617 - RNA, 64 nt, Homo Sapiens
gacccugucucuacaaaaauaugaccagccuggucuuuuguagaucccucgaggccaagaguuc

SEQ ID NO: 201618 - RNA, 64 nt, Homo Sapiens
uaucaugaugaauugaaaugaagauaaaauugcucuuuuguaacuuuaucuuaguaauguaaag

SEQ ID NO: 201619 - RNA, 64 nt, Homo Sapiens
uuaauuuuacuaugcuccaacauuaaucaugacucuuuuguaaauuacaguuauuucaguauug

SEQ ID NO: 201620 - RNA, 64 nt, Homo Sapiens
uguuuguaaacauuugucagauucuaauuuuuuucuuuuguauuaaaauucaacuauggaugua

SEQ ID NO: 201621 - RNA, 64 nt, Homo Sapiens
uuuaacaaauuguggcaaauucuaaacagcaauucuuuuguacguaauaggacauuucauccua

SEQ ID NO: 201622 - RNA, 64 nt, Homo Sapiens
uauaaaagcuuaggaacuuuauuaaauuguacaacuuuuguauagaucuuuuguacuuuaggac

SEQ ID NO: 201623 - RNA, 64 nt, Homo Sapiens
uuaggacauuaaauuguacaauuuuauaaaugaucuuuuguacuauaguacuuaguguaaaaua

SEQ ID NO: 201624 - RNA, 64 nt, Homo Sapiens
uaacuuugauuuuauagcuuuugagcuaacguaacuuuuguaaagauuaagcucauuuaguguu

SEQ ID NO: 201625 - RNA, 64 nt, Homo Sapiens
gguuugaaaaacagugaaauggguaaacgcaaaacuuuuguacuuuauuacgaguaaaguguaa

SEQ ID NO: 201626 - RNA, 64 nt, Homo Sapiens
acucugguuauaagugaauugagcauuaauguuucuuuuguauaaauuccuguccugaaauauu

SEQ ID NO: 201627 - RNA, 64 nt, Homo Sapiens
uuaauauuucuuuuugugaaauuuccuguacagccuuuuguaggauuacuacagguuaauguga

SEQ ID NO: 201628 - RNA, 64 nt, Homo Sapiens
ucugaggagcagcagagucccuuguaaaagacugcuuuuguacagaaugcgcuauaaauuauac

SEQ ID NO: 201629 - RNA, 64 nt, Homo Sapiens
guugggaggaagaugaaaucgagcugucuuuuaacuuuuguauguguuuuaucagaauuugcug

SEQ ID NO: 201630 - RNA, 64 nt, Homo Sapiens
caaugauugugcaaaaagucacguguaaauugaacuuuuguaaaucaaauuguauuuuaaaugc

SEQ ID NO: 201631 - RNA, 64 nt, Homo Sapiens
uuuauaauacaaauaaccauucucugauuuaucucuuuuguauguuuggauuuucaauaucgac

SEQ ID NO: 201632 - RNA, 64 nt, Homo Sapiens
cgggaccgugagcgggagcgcagagagcggagccgggagcgagacaaggagcgagaacggcgac

SEQ ID NO: 201633 - RNA, 64 nt, Homo Sapiens
gacgguccagaggaaaagggccgggaucgugaccgggagcgacggcggagccaccggagcgagc

SEQ ID NO: 201634 - RNA, 64 nt, Homo Sapiens
uugucucuaacuguacaggagacuucucugccugggcugggaaaggggccuuucuuuuguuuug

SEQ ID NO: 201635 - RNA, 64 nt, Homo Sapiens
ccugggacccucuagagguuggaaagagaagagaggcugggagcggauggaaagcaugacugca

SEQ ID NO: 201636 - RNA, 64 nt, Homo Sapiens
accuggauguccugggcuagggggccggcccaggggcugggagugguuagccggaauacugggg

SEQ ID NO: 201637 - RNA, 64 nt, Homo Sapiens
auucacccucagcaugugggaagggacaggugggggcugggaguagaggauguuccugcuucuc

SEQ ID NO: 201638 - RNA, 64 nt, Homo Sapiens
gcaaccuccaccaggaccaggauccugggccacaggcugggaugguccuuccaagaaaggguca

SEQ ID NO: 201639 - RNA, 64 nt, Homo Sapiens
aguuccugcccccauucucuuggggucagggaggggcugggaagggcuacugaaggccccauuc

SEQ ID NO: 201640 - RNA, 64 nt, Homo Sapiens
cuacugaaggccccauucucccacaggauggugaggcugggaggaggaagacugagguagagau

SEQ ID NO: 201641 - RNA, 64 nt, Homo Sapiens
auagcacaggcuaggggcucgcuccucccccucaggcugggaggcugcagccaggauugccuca

SEQ ID NO: 201642 - RNA, 64 nt, Homo Sapiens
guggggucccuuuguugccaagggcccaggagccggcugggagggcugcucagaggcugcaggg

SEQ ID NO: 201643 - RNA, 64 nt, Homo Sapiens
acugggaguggaggguggaucaggcugggagaagggcugggaaacuagagggacugugcagaac

SEQ ID NO: 201644 - RNA, 64 nt, Homo Sapiens
agggcugggaaaacugggagacugugcagaaccaggcugggagaagaggacacaggcuagaggg

SEQ ID NO: 201645 - RNA, 64 nt, Homo Sapiens
caggcucaagcccuagagaugggcagggccuaggggcugggagcugccugcugccauagcagca

SEQ ID NO: 201646 - RNA, 64 nt, Homo Sapiens
cgcagccuaguuccuuccuggccccucucucacuggcugggaaacccuagaccaugucagauag

SEQ ID NO: 201647 - RNA, 64 nt, Homo Sapiens
acacugguccccccaucacacucaccccuaagugggcugggagccaggcagggccagggcagcu

SEQ ID NO: 201648 - RNA, 64 nt, Homo Sapiens
aguaacagaucaggacccaaacuugggcagucugggcugggagcccacaccccacucaccaguu

SEQ ID NO: 201649 - RNA, 64 nt, Homo Sapiens
ggaggcaggcccuccacagaagcucugcagcaggggcugggagagcagaagggcaggcccugca

SEQ ID NO: 201650 - RNA, 64 nt, Homo Sapiens
gcugggagagcagaagggcaggcccugcaacucaggcugggaguaucgaacccucugccuaggg

SEQ ID NO: 201651 - RNA, 64 nt, Homo Sapiens
ucacagaccucagacacagcaugggguucugagaggcugggagucuuguccuugucguguugcc

SEQ ID NO: 201652 - RNA, 64 nt, Homo Sapiens
auggcccgcagaggcacugcugcucaggguggggggcugggaccccugcgggccugggaagcau

SEQ ID NO: 201653 - RNA, 64 nt, Homo Sapiens
uccuacuacuuuaaucccuaaaagaacgcuguguggcugggaccuuuaggaaagugaaaugcag

SEQ ID NO: 201654 - RNA, 64 nt, Homo Sapiens
uuccuaagaaugcaaacugccuuuuccacacaaaggcugggaauaaaauucuggguauucucgu

SEQ ID NO: 201655 - RNA, 64 nt, Homo Sapiens
gaccagcaucuggaagauguccccagcagaggcaggcugggacgccugcaggcagagcuggagc

SEQ ID NO: 201656 - RNA, 64 nt, Homo Sapiens
cccuaccugcuucacguuggcagcuggggccagaggcugggaguagggagccuccccaucuguc

SEQ ID NO: 201657 - RNA, 64 nt, Homo Sapiens
ccaguccgcaaauauuuauugggggccagcccagggcugggacugggcaugagguggucaccag

SEQ ID NO: 201658 - RNA, 64 nt, Homo Sapiens
aggacauggcacuggauggcuggcagagagcccuggcugggaguuagggagcccuggguuggaa

SEQ ID NO: 201659 - RNA, 64 nt, Homo Sapiens
guguuugccgcagcauggaaaacagggcgccuaaggcugggagcuggaagaaggggcauugggu

SEQ ID NO: 201660 - RNA, 64 nt, Homo Sapiens
augguguccuucccuggccuucucuuggcucaaaggcugggagggagggaaggagagaagaguu

SEQ ID NO: 201661 - RNA, 64 nt, Homo Sapiens
ugggcugccuuaguuaguuaugagaacagggaagggcugggaagagacagccuccaaggucaac

SEQ ID NO: 201662 - RNA, 64 nt, Homo Sapiens
ucaccccuccucacugccucuccucucugggacaggcugggaccuuugaggaagauaaagccuu

SEQ ID NO: 201663 - RNA, 64 nt, Homo Sapiens
ggugggaauuuuauaaauauugggguagaaggaaggcugggaguagcugccaucugggcuauuc

SEQ ID NO: 201664 - RNA, 64 nt, Homo Sapiens
gaagcauugcacucuugaggagugauugccauagggcugggagacucuguguaggucacuggaa

SEQ ID NO: 201665 - RNA, 64 nt, Homo Sapiens
cccuaccucagcuuaggacccccagagccaagguggcugggaucuggccccacagauggggaaa

SEQ ID NO: 201666 - RNA, 64 nt, Homo Sapiens
gagaccucuguccacugcccagggaggggccuggggcugggagcagucccgguuuagccugagg

SEQ ID NO: 201667 - RNA, 64 nt, Homo Sapiens
gaaauacugugcuaccuuccagaguucccacaugggcugggauuuuuuuuucuuuuucuuuuuu

SEQ ID NO: 201668 - RNA, 64 nt, Homo Sapiens
gggauuacaggugugagccaccgcgccuggccugggcugggaaucuuuguugacuucuuuggga

SEQ ID NO: 201669 - RNA, 64 nt, Homo Sapiens
ggaggggagaauuucuaggggagagaacaacaggggcugggaauccaggaauuagaaguggcag

SEQ ID NO: 201670 - RNA, 64 nt, Homo Sapiens
uggggguguggguaaagacaacuugcccaucaggggcugggacaaugacugcuucucugagaga

SEQ ID NO: 201671 - RNA, 64 nt, Homo Sapiens
agagcggagaaugcccauggaggggaggagggcaggcugggaacgugggauaagcccaggugca

SEQ ID NO: 201672 - RNA, 64 nt, Homo Sapiens
auggcagcucacucaguacuaggagcuagggaggggcugggaaguagaaaaccuggccacuggu

SEQ ID NO: 201673 - RNA, 64 nt, Homo Sapiens
aaggaggcccagaaguuggaaagagauggaauguggcugggaacauugcaucccaaagagcuuc

SEQ ID NO: 201674 - RNA, 64 nt, Homo Sapiens
gucuugauggccuacgagaggccaaguuccacugggcugggaaaagucacuuugucugucuugu

SEQ ID NO: 201675 - RNA, 64 nt, Homo Sapiens
cugcucuugcucuccucgugcuggggaaaccaugggcugggaagggguagggagugcuaaggau

SEQ ID NO: 201676 - RNA, 64 nt, Homo Sapiens
ggaucagcagaaauccaaccagggcacuaaguaaggcugggauuggaccagggagaaugaccau

SEQ ID NO: 201677 - RNA, 64 nt, Homo Sapiens
ggcccugcuuccugcuugccaaggcagaggccugggcugggaaaaacuuuggaaccagacucuu

SEQ ID NO: 201678 - RNA, 64 nt, Homo Sapiens
ccucccgagcuccucuuccaugcugugcgcccagggcugggaggaaggacuucccuguguaguu

SEQ ID NO: 201679 - RNA, 64 nt, Homo Sapiens
uggcaucagcuggcgucaugcaaagucaugcaaaggcugggaccacgugagaucauucacucau

SEQ ID NO: 201680 - RNA, 64 nt, Homo Sapiens
agaucauucacucauacaucuggccguugauguuggcugggaacucaccuggggcugcuggccu

SEQ ID NO: 201681 - RNA, 64 nt, Homo Sapiens
guuuguuucugaaagggacgcuacccgggaagggggcugggacaugggaaaggggaaguuguag

SEQ ID NO: 201682 - RNA, 64 nt, Homo Sapiens
agugggcccaaugcacuuuguucuggcucuuccaggcugggagagccuuccaggggugggacac

SEQ ID NO: 201683 - RNA, 64 nt, Homo Sapiens
guccuuucugugggggcucuucucuugcucccgaggcugggacaggcccguccggagggagcca

SEQ ID NO: 201684 - RNA, 64 nt, Homo Sapiens
gccccuuuccucugucccuugaacugccuucuugggcugggacaaccugacugacuucccagug

SEQ ID NO: 201685 - RNA, 64 nt, Homo Sapiens
gggggccugcuccucggacucugguuaccucugaggcugggaaaggccuggcugcccacugccu

SEQ ID NO: 201686 - RNA, 64 nt, Homo Sapiens
uccagacccucaccgaccaccuguccugggaccaggcugggaggggaguguggcagggaggagg

SEQ ID NO: 201687 - RNA, 64 nt, Homo Sapiens
gaggccuccugcagguaccuccucaauagcugggggcugggacucccuuucccacaccuuuguu

SEQ ID NO: 201688 - RNA, 64 nt, Homo Sapiens
gugcccccacacugcgccucgggcuggggguuagggcugggacuccacuuuucuccugggggcu

SEQ ID NO: 201689 - RNA, 64 nt, Homo Sapiens
gucucugaucacacagaagcaaggccucacucccggcugggaagcggagaggcagguguggcgu

SEQ ID NO: 201690 - RNA, 64 nt, Homo Sapiens
cggagaggcagguguggcguggccaggagcuccuggcugggacaaaugugccuuuuucagaguu

SEQ ID NO: 201691 - RNA, 64 nt, Homo Sapiens
cggcggcggcggcucgggcuggcagcgcaggccgggcugggagguccuggccccaccgccaggg

SEQ ID NO: 201692 - RNA, 64 nt, Homo Sapiens
gcuccuggccccaccgccaggucgggggcuuagaggcugggauggccccgggggccgagguagg

SEQ ID NO: 201693 - RNA, 64 nt, Homo Sapiens
cggcaggguuuggggugugggccuccugugguugggcugggagcagaggcucccggagacugca

SEQ ID NO: 201694 - RNA, 64 nt, Homo Sapiens
ggcuuugaccauccuuggcuugaggcauccgcguggcugggagacgcccaguguguuuuaagca

SEQ ID NO: 201695 - RNA, 64 nt, Homo Sapiens
ugaugagagauuccagcccauccuccuuagggaaggcugggauauguuguagauuucaucugcu

SEQ ID NO: 201696 - RNA, 64 nt, Homo Sapiens
ccuacccccacccccuuugagucuccugaucccaggcugggacccccagaguuaagcacuggau

SEQ ID NO: 201697 - RNA, 64 nt, Homo Sapiens
aggucaugcagcugaaaguccuuccgagcuacagggcugggaccgugaaccucaccuccugggg

SEQ ID NO: 201698 - RNA, 64 nt, Homo Sapiens
ccucauuaaccaaccaagcaggccugggaccauuggcugggaccagccugacugugccuuccag

SEQ ID NO: 201699 - RNA, 64 nt, Homo Sapiens
cccagccuuccaaggugaggccaucucaucugcaggcugggaggcagggcuggacucaggaacc

SEQ ID NO: 201700 - RNA, 64 nt, Homo Sapiens
ggugccaugcccugaagaggcaggguacacauggggcugggagggcaaagauggggcggggccu

SEQ ID NO: 201701 - RNA, 64 nt, Homo Sapiens
gucucugcugcucuugccucggagaaagggaagaggcugggaugcgcgcagcucaguuagagac

SEQ ID NO: 201702 - RNA, 64 nt, Homo Sapiens
accccuagcucucccggggucugcugggguacagggcugggagaagugugcccaggagucugau

SEQ ID NO: 201703 - RNA, 64 nt, Homo Sapiens
ccuugucguccuggacaccacaggggcaccugcaggcugggagaccagguccucugugcauggg

SEQ ID NO: 201704 - RNA, 64 nt, Homo Sapiens
gauuccaggccugggguuagcagccugugcccccggcugggagaucagacccgguguugguccu

SEQ ID NO: 201705 - RNA, 64 nt, Homo Sapiens
cuuacccucuggggccucagcuuucccuccggaaggcugggaggaggugggcuagaugaucuuu

SEQ ID NO: 201706 - RNA, 64 nt, Homo Sapiens
uaacuauuucaguugugagccuucuagggccccaggcugggaggcucagaggacugaaucuggg

SEQ ID NO: 201707 - RNA, 64 nt, Homo Sapiens
ggacccugggcugugucucccuccuuggaggcagggcugggaaggagaacagaggggacaugaa

SEQ ID NO: 201708 - RNA, 64 nt, Homo Sapiens
cuuccccuuuguucaaggccucuaagagcagcugggcugggaauagcaaugaaaccuguucaug

SEQ ID NO: 201709 - RNA, 64 nt, Homo Sapiens
aaagaaaugggugucccccacuccguucccugggggcugggacucccacucccucugcccucug

SEQ ID NO: 201710 - RNA, 64 nt, Homo Sapiens
gucuagagcccccuuuggccuuucugucauuccaggcugggaaacuaaccccgccuuccagcac

SEQ ID NO: 201711 - RNA, 64 nt, Homo Sapiens
ccauccuggggcagggaaggacagaguguuggauggcugggacggggccuugcucuugucggcc

SEQ ID NO: 201712 - RNA, 64 nt, Homo Sapiens
ucaaauugagguggugacuuuuguuggaaaauugggcugggaucacguccuguuuuguaauaaa

SEQ ID NO: 201713 - RNA, 64 nt, Homo Sapiens
ggguggcuuuauauugauaaauguuuggggguggggcugggacccaaaguaauauucaaagggg

SEQ ID NO: 201714 - RNA, 64 nt, Homo Sapiens
gagaacuccauguugcucugcaaagcacgucaugggcugggauuucaugauuagaauuagacug

SEQ ID NO: 201715 - RNA, 64 nt, Homo Sapiens; identical to SEQ ID NO: 45461

SEQ ID NO: 201716 - RNA, 64 nt, Homo Sapiens; identical to SEQ ID NO: 45462

SEQ ID NO: 201717 - RNA, 64 nt, Homo Sapiens
aagaauaaaaaaaugagcuaggcgugguagugcacaccuguaguccuagcuacuugggaggcug

SEQ ID NO: 201718 - RNA, 64 nt, Homo Sapiens
ccuaucucuucaucucuucuugccagugauguugcaccuguaaccaucuuuuuauggguggagc

SEQ ID NO: 201719 - RNA, 64 nt, Homo Sapiens
auuaagaaccuaugcggcccggcaugguggcucacaccuguaaucccagcacuuugggaggcca

SEQ ID NO: 201720 - RNA, 64 nt, Homo Sapiens
aaagauacaaaaauuugcugagcgugguggugugcaccuguaaucccagcuacucgagaggcca

SEQ ID NO: 201721 - RNA, 64 nt, Homo Sapiens
cccagcugcucgggaagcugggccccauggcacacaccuguagucauaaaaacaaaauuacugg

SEQ ID NO: 201722 - RNA, 64 nt, Homo Sapiens
cucagcacuuugagaggccaaaaagaguggcugacaccuguaauuauucggccauuaaaaaaaa

SEQ ID NO: 201723 - RNA, 64 nt, Homo Sapiens
cccagcuacuugggagacugggcgugguggcgggcaccuguaauaaaauaagaaaaauuagcug

SEQ ID NO: 201724 - RNA, 64 nt, Homo Sapiens
cccagcacuuugggaggcuggccgugguggcucacaccuguaaugauuuuuggguccugagcca

SEQ ID NO: 201725 - RNA, 64 nt, Homo Sapiens
uaaaauguucucuucggccggguguggugacucacaccuguaaccucagcacuuugggaggcag

SEQ ID NO: 201726 - RNA, 64 nt, Homo Sapiens
aaaaaaugcuguccaggccaggcacaguggcucacaccuguaaucccaggacuucgggaggcug

SEQ ID NO: 201727 - RNA, 64 nt, Homo Sapiens
cccagcuacuugggaggcugggcaugguggcgcacaccuguaaugaaaacacaaaaauuagacg

SEQ ID NO: 201728 - RNA, 64 nt, Homo Sapiens
ccuagcacuuugggaggccgagcaugguggcucacaccuguaaucauugaaauuauguuggcug

SEQ ID NO: 201729 - RNA, 64 nt, Homo Sapiens
aaaaaaaaaaaaaaaagccaggcaugguggcacacaccuguaaucccagcuacucgggaggcug

SEQ ID NO: 201730 - RNA, 64 nt, Homo Sapiens
aaaauguuuugaauaggccaggcgcaguggcucacaccuguaaucccagcacguugggaggcca

SEQ ID NO: 201731 - RNA, 64 nt, Homo Sapiens
aaaaaaaaaaaaauuagcugggcaugguggcacacaccuguagucccagcuacuugggaggcug

SEQ ID NO: 201732 - RNA, 64 nt, Homo Sapiens
aaacacaauuuauuuggccgggcacgguggcucacaccuguaaucucagcacuuuggcaggcca

SEQ ID NO: 201733 - RNA, 64 nt, Homo Sapiens
aaaaauacaaaaauuagccaggcaugguggcgggcaccuguaaucccaguuacuugggaagcug

SEQ ID NO: 201734 - RNA, 64 nt, Homo Sapiens
aaaaaaaacaaaauuagccgggcgugguugcgggcaccuguagucccagcuacucaggaggcug

SEQ ID NO: 201735 - RNA, 64 nt, Homo Sapiens
aaaauuacggugauuggccaggugcaguggcucacaccuguaaucccagcacuuugggaggcca

SEQ ID NO: 201736 - RNA, 64 nt, Homo Sapiens
cccaucuagucaggaagcugggcauuguggcgcacaccuguauuaaaaacacaaaaauuagcug

SEQ ID NO: 201737 - RNA, 64 nt, Homo Sapiens
cccagcgcuuugggaggcuaggcacaguggcucacaccuguaauaauaaaagaaaaaccagcca

SEQ ID NO: 201738 - RNA, 64 nt, Homo Sapiens
uccaacacuuugggaggcagugugcaauggcucacaccuguaauuuagaacaggaccuaggccc

SEQ ID NO: 201739 - RNA, 64 nt, Homo Sapiens
ccuagcgcuuugggaggccgggcgccguggcucacaccuguaaugaauugugaaaauuggguug

SEQ ID NO: 201740 - RNA, 64 nt, Homo Sapiens
cccagccacucugaggcaggggcgucguggugcacaccuguaguaagaguaaacuagauaacug

SEQ ID NO: 201741 - RNA, 64 nt, Homo Sapiens
cucagcuacuugggaggcugggugugguggugggcaccuguaauaaaaacauaaaaauuagcca

SEQ ID NO: 201742 - RNA, 64 nt, Homo Sapiens
ccgacuguaagcucaucaccggcacaguggcucacaccuguaauaaaaaaaugcagacuggcca

SEQ ID NO: 201743 - RNA, 64 nt, Homo Sapiens
cccagcgcuuugggaggcugggugcgguggcucacaccuguaaucuuguuaaaaaugcaggcca

SEQ ID NO: 201744 - RNA, 64 nt, Homo Sapiens
aucuuggcgcagauguuuguguugccuccucaggcaccuguagauauaauuuacaccaugauau

SEQ ID NO: 201745 - RNA, 64 nt, Homo Sapiens
aagaugguuuggauuauugauauggacagauucccaccuguauguagcacgccaugcugggcca

SEQ ID NO: 201746 - RNA, 64 nt, Homo Sapiens
guggucauuucccuuggccgggcgcgguggcucacaccuguaaucccagcacuuugggaggcca

SEQ ID NO: 201747 - RNA, 64 nt, Homo Sapiens
aaaaauagaaauauuagccgggcauggugucaggcaccuguaaucccagcuacuugggaggcug

SEQ ID NO: 201748 - RNA, 64 nt, Homo Sapiens
uguccaaccucccaggauuguuuuauccuaaugucaccuguauauucauuugaaaggacuuggc

SEQ ID NO: 201749 - RNA, 64 nt, Homo Sapiens
uuagaagucaaacauggccaggcacaguggcucacaccuguaaucuucaggauuucaagaccag

SEQ ID NO: 201750 - RNA, 64 nt, Homo Sapiens
acugaaaauagaaaaaaaaaauuagccaggcuugcaccuguaaucccaguuaccugggaggcug

SEQ ID NO: 201751 - RNA, 64 nt, Homo Sapiens
uagauggucccgacauugaggacaggcaagagaacaccuguaaauacagagccuucaggcucuc

SEQ ID NO: 201752 - RNA, 64 nt, Homo Sapiens
acugcagggcuuucugcacuuacuccacagugcucaccuguauccagaccagaugaugcucugg

SEQ ID NO: 201753 - RNA, 64 nt, Homo Sapiens
aagucugccuauccuggccaggugugguggcucacaccuguaaucccagcacuuugggagacca

SEQ ID NO: 201754 - RNA, 64 nt, Homo Sapiens
uaaaaauacaaaaauuagcugggcauggugcgggcaccuguaguccuagcuaucaagaggcuga

SEQ ID NO: 201755 - RNA, 64 nt, Homo Sapiens
cccagcuacuugggaggcugggcgugguggcaggcaccuguaauaaaaauacaaaaauuagccg

SEQ ID NO: 201756 - RNA, 64 nt, Homo Sapiens
cgcagccuuucaggaggcugggugugguggcgggcaccuguaauucucuacuaaauauuagcgg

SEQ ID NO: 201757 - RNA, 64 nt, Homo Sapiens
auaauuacuuaauguggccgggcacgguggcucacaccuguaaucccagcacuuugggaggucg

SEQ ID NO: 201758 - RNA, 64 nt, Homo Sapiens
cuaaaaauaugaaauuagccagggugguggugcacaccuguaaucccagcuaccugggaggcug

SEQ ID NO: 201759 - RNA, 64 nt, Homo Sapiens
cccagcuacucaggauccugggcgugguggcgugcaccuguaguaaaaauacaaaaauuagcug

SEQ ID NO: 201760 - RNA, 64 nt, Homo Sapiens
cccagcucuucaggaggcuggguguaguggugugcaccuguaguaaaaauagaaaaauuagcca

SEQ ID NO: 201761 - RNA, 64 nt, Homo Sapiens
aagaagguucugccaggccgggcgcgguggcucacaccuguaaucccagcacuuugggaggccg

SEQ ID NO: 201762 - RNA, 64 nt, Homo Sapiens
aaauacaaaaaaauuagucggacaugguggcaggcaccuguagucccagcuacucgggaggcug

SEQ ID NO: 201763 - RNA, 64 nt, Homo Sapiens
cucuaccgaaaaauuagcagggugugguggcacgcaccuguaguccccgcuacgcagguggcug

SEQ ID NO: 201764 - RNA, 64 nt, Homo Sapiens
auauucaugaccacuggccaggcgagguggcucacaccuguaaucccagcacuuugggaggcca

SEQ ID NO: 201765 - RNA, 64 nt, Homo Sapiens
cuuuaaucuuaguuccgccaggcacgguggcucacaccuguaaucccagcacuuugggaggcca

SEQ ID NO: 201766 - RNA, 64 nt, Homo Sapiens
aauaccaaaaaaauuagcugggcaugguggcacacaccuguaguccccuguagucccagcuacu

SEQ ID NO: 201767 - RNA, 64 nt, Homo Sapiens
cccaguacuuugagacgcugaguguagaggcucacaccuguaauuguguagguucugcaggccc

SEQ ID NO: 201768 - RNA, 64 nt, Homo Sapiens
cccagcuacuugggaggcugggcgugguggugggcaccuguaauaaaauacaaaaaacuagcca

SEQ ID NO: 201769 - RNA, 64 nt, Homo Sapiens
cccagcuacucaggaggcugggcaugauggugugcaccuguaguaaaaauacaaaaauuagcca

SEQ ID NO: 201770 - RNA, 64 nt, Homo Sapiens
cucaacgcuuugggaggggaggcgcgguggcucacaccuguaauaagaagagggucgugggcug

SEQ ID NO: 201771 - RNA, 64 nt, Homo Sapiens
cguagcugaggcaggagaauggcaugguggcacacaccuguaauaaaaauacaaaaauuagcca

SEQ ID NO: 201772 - RNA, 64 nt, Homo Sapiens
cccagcauuuugggaggccaggugcgguggcucacaccuguaauuaaaaacuuaagaugggcca

SEQ ID NO: 201773 - RNA, 64 nt, Homo Sapiens
aaugcaauaauaaugggccaggugaaguggcucacaccuguaaucccagcacuguggaaagaca

SEQ ID NO: 201774 - RNA, 64 nt, Homo Sapiens
aauaaauaaaaugcgggccaggcacaguggcucacaccuguaaucccagcacuaugggaggccc

SEQ ID NO: 201775 - RNA, 64 nt, Homo Sapiens
acaaucgaagguaaaacaacauauuguguugggccaccuguacugaacgcugaaucguuuuucc

SEQ ID NO: 201776 - RNA, 64 nt, Homo Sapiens
uggaaauaaacucagggcccggagcgguggcucacaccuguaaucccagcacuuugagaggcca

SEQ ID NO: 201777 - RNA, 64 nt, Homo Sapiens
cccaggcugaggugggaggaggcaugguggcacacaccuguaguaaaaauacaaaauuuagcca

SEQ ID NO: 201778 - RNA, 64 nt, Homo Sapiens
cccagcacuuugggaggacauggcacaggggucacaccuguaauaaauucaaaugaauuuggcc

SEQ ID NO: 201779 - RNA, 64 nt, Homo Sapiens
ccaagcuacuugggaggcuggguacaguaguacacaccuguaguaaaaauacaaaaguuagcca

SEQ ID NO: 201780 - RNA, 64 nt, Homo Sapiens
cccugcacuuugggaggccaggcaggguggcucacaccuguaauaaaagaaaaaguuuggauca

SEQ ID NO: 201781 - RNA, 64 nt, Homo Sapiens
uccagcuacucgggaggcugggcuugguggugugcaccuguaauaaaauccaaaaaauuagccg

SEQ ID NO: 201782 - RNA, 64 nt, Homo Sapiens
cccagcacuuugggaggccgggugugguggcucacaccuguaauugaaagugaugcacaggaca

SEQ ID NO: 201783 - RNA, 64 nt, Homo Sapiens
cccagcacuuugagaggccaggcguggugucucacaccuguaauauguuaagaggauugggcca

SEQ ID NO: 201784 - RNA, 64 nt, Homo Sapiens
cccaguacuuugggaggccaggcacgguggcucacaccuguaaugagaaauauaaaucaggcca

SEQ ID NO: 201785 - RNA, 64 nt, Homo Sapiens
cccagcacuuugggaggcugggcgcgguggcucacaccuguaaugaaauugaagagagaggcca

SEQ ID NO: 201786 - RNA, 64 nt, Homo Sapiens
cacuccaaggccucgcguggagcauccuuagucccaccuguagcugaauccacagacccaaagc

SEQ ID NO: 201787 - RNA, 64 nt, Homo Sapiens
aaaacagagcuuuuaggccaggugugguggcucacaccuguaaucccagcacuuugggaggccg

SEQ ID NO: 201788 - RNA, 64 nt, Homo Sapiens
ccuagcaucuugggaggcccggugcaguggcucacaccuguaauguuagaaauagacuuagcug

SEQ ID NO: 201789 - RNA, 64 nt, Homo Sapiens
cccagcuacucgggaagcugagugugguggugugcaccuguaguaaaaauuuaaaaauuagcca

SEQ ID NO: 201790 - RNA, 64 nt, Homo Sapiens
uuccgguaguggccaucuuacuuucuucuuuuggcaccuguaagagguggucuccguuuauacc

SEQ ID NO: 201791 - RNA, 64 nt, Homo Sapiens
cccagcuacucggaaggcuggacaugguggcaggcaccuguaauaaagauagaaaaauuagcug

SEQ ID NO: 201792 - RNA, 64 nt, Homo Sapiens
cccagcuacucaggaggcugggcgugguggcgugcaccuguaauaaaaauacaaaaauuagcug

SEQ ID NO: 201793 - RNA, 64 nt, Homo Sapiens
cccagcacuuugggagaccgggcgcgguggcucacaccuguaaugaaaauccuaucaauggcug

SEQ ID NO: 201794 - RNA, 64 nt, Homo Sapiens
ccagagagcaaagugaugaggaacguccaggacacaccuguaucuuucuucucucugggaaaau

SEQ ID NO: 201795 - RNA, 64 nt, Homo Sapiens
aaugaaggagggacucaggaucauuguuaucagugggccaaaguuagauuuugcuuucaagauu

SEQ ID NO: 201796 - RNA, 64 nt, Homo Sapiens
uuacugcagucagaugccaucucauccccugugggggccaaaguuuuuaugugggcagaugcug

SEQ ID NO: 201797 - RNA, 64 nt, Homo Sapiens
ccaauggcuuucuagaugaguggccauucauuugcuugcucaguucuuaguggcacaucuucug

SEQ ID NO: 201798 - RNA, 64 nt, Homo Sapiens
cagaaacuggauacaguucugaggcacagccagacuugcucaggguggcccugccacaggcugc

SEQ ID NO: 201799 - RNA, 64 nt, Homo Sapiens
uuuuaguuggucuuuccaucuaucacugcauuaucuugcucauucuucaguucucuacucccuc

SEQ ID NO: 201800 - RNA, 64 nt, Homo Sapiens
agcugguccugaccaggauggagcaagcucuucccuugcucaugagcuccugaucagaggcauu

SEQ ID NO: 201801 - RNA, 64 nt, Homo Sapiens
cacugucccuaccacugagcccuugcacaggccacuugcucagacgagacacccuaacucuugc

SEQ ID NO: 201802 - RNA, 64 nt, Homo Sapiens
cacaggccacuugcucagacgagacacccuaacucuugcucacucccuaaagcccucuucaggg

SEQ ID NO: 201803 - RNA, 64 nt, Homo Sapiens
uuccuggaggcugccaacccagcccucauccucccuugcucacaaaguuacaggguaggcaccu

SEQ ID NO: 201804 - RNA, 64 nt, Homo Sapiens
ugcccacccucuuccugucuccaccuggacacaacuugcucaaaggcuggugacuugugggcca

SEQ ID NO: 201805 - RNA, 64 nt, Homo Sapiens
cccuuccaccaaagucaucuggcucugccagggccuugcucagucccuuccugccuccucccag

SEQ ID NO: 201806 - RNA, 64 nt, Homo Sapiens
ccugcaccacugcagccacccuucccccucuucucuugcucagggugcuauguucucuuuaccc

SEQ ID NO: 201807 - RNA, 64 nt, Homo Sapiens
guugauuucuauggccaacuuucucucuuuguaaaacaaagauugauugauuuucuuguaugcu

SEQ ID NO: 201808 - RNA, 64 nt, Homo Sapiens
cguagguguaagagaaauggaaaugaaugguuucaacaaagaucauuuaauacagcagagcaug

SEQ ID NO: 201809 - RNA, 64 nt, Homo Sapiens
aacaggaucugucccuacccuuucagagcccugaaacaaagagacuucugcuggcuucuccggc

SEQ ID NO: 201810 - RNA, 64 nt, Homo Sapiens
cugccaacuguggaaacuucauuuccccaauuuaaacaaagauucugcaacuccucccccuuuu

SEQ ID NO: 201811 - RNA, 64 nt, Homo Sapiens
gcguccgaggacuuugggccaggugaucaagguuaacaaagaaucagaagcuuccugagcuuca

SEQ ID NO: 201812 - RNA, 64 nt, Homo Sapiens
aucaucaacgggaagugagaaccccauucucaaaaacaaagaguucccuggauguggauuucac

SEQ ID NO: 201813 - RNA, 64 nt, Homo Sapiens
gaauguccugaaaaggguguugggagggugguucaacaaagaaacaaagauguuaugguguuua

SEQ ID NO: 201814 - RNA, 64 nt, Homo Sapiens
ugaaaaggguguugggagggugguucaacaaagaaacaaagauguuaugguguuuagauuuaug

SEQ ID NO: 201815 - RNA, 64 nt, Homo Sapiens
accaucagcuguuucucacauguaauggcuuguaaacaaagaugauuuugaauuuguucaaacc

SEQ ID NO: 201816 - RNA, 64 nt, Homo Sapiens
cagguuccugcucauuccagaaguuaauuaauauaacaaagaugagacaggaaaacuaaauaau

SEQ ID NO: 201817 - RNA, 64 nt, Homo Sapiens
cuucaucacagucacauucaaaauagugacucuaaacaaagaagaaagcagcacugucaucaga

SEQ ID NO: 201818 - RNA, 64 nt, Homo Sapiens
ucauuguuaguucuugucuaguuuucauuaaaagaacaaagaucuuuuauauggauaucuuaua

SEQ ID NO: 201819 - RNA, 64 nt, Homo Sapiens
cuuagcaaaggcucaugcugaaauuugccaguaaaacaaagaaguuuaaagacuggcagguaca

SEQ ID NO: 201820 - RNA, 64 nt, Homo Sapiens
aaaaaaagaaaaaaaagaaaaaaaggaaaagaagaacaaagaaacaugacugucucaaagagua

SEQ ID NO: 201821 - RNA, 64 nt, Homo Sapiens
gccugggaacgaggccaucagcugccaugcacauaacaaagagacaaugcauuccuucuuauuu

SEQ ID NO: 201822 - RNA, 64 nt, Homo Sapiens
uuuuaaaaaucgaugaaucauuugugaugcuuuuaacaaagauuaaaugaauuugaucagcuuu

SEQ ID NO: 201823 - RNA, 64 nt, Homo Sapiens
aaguuucugggaacacauaauauguagccaguuuaacaaagaagcugucaggugcacagcccuu

SEQ ID NO: 201824 - RNA, 64 nt, Homo Sapiens
cccucaaucugcccauuuaaaaauugguggagugaacaaagagcaugaaaauguugaagaccac

SEQ ID NO: 201825 - RNA, 64 nt, Homo Sapiens
cuuuugcucugcaacagcagagucgagucauugcaacaaagagcauauggccccacagugccua

SEQ ID NO: 201826 - RNA, 64 nt, Homo Sapiens
uuuuaaaaauacucuuuucagauucacguucucuaacaaagagucucauguucaagaucaauau

SEQ ID NO: 201827 - RNA, 64 nt, Homo Sapiens
aagaaccugauuugcacucuguaguguuuaaagaaacaaagaaacucuaauauugaaucucuua

SEQ ID NO: 201828 - RNA, 64 nt, Homo Sapiens
cacuggcauaugaccaugcaagacugucagugccaacaaagacaacacuaaucagcacaucgua

SEQ ID NO: 201829 - RNA, 64 nt, Homo Sapiens
caauccuagucucugauaaaacagaauuuaaaccaacaaagaucaaaagagacaaggccauuau

SEQ ID NO: 201830 - RNA, 64 nt, Homo Sapiens
ggcaggaauaaagauguucuuugaaacccaugagaacaaagacacaacauaccagaaucucugg

SEQ ID NO: 201831 - RNA, 64 nt, Homo Sapiens
agaauggguuccuguggagaaaaauggugaagaaaacaaagaugaugauaauguuuucagcagc

SEQ ID NO: 201832 - RNA, 64 nt, Homo Sapiens
aaugggcuggagagaaggagaaggauuaggaaaaaacaaagaaggcaauaaggaacccauccua

SEQ ID NO: 201833 - RNA, 64 nt, Homo Sapiens
cuuaaggguuuauuaagaacgcaaaguuaccuugaacaaagaauccaccuacucugcccuuuug

SEQ ID NO: 201834 - RNA, 64 nt, Homo Sapiens
gauugcccugcacauuuucuuuacuggguuagaaaacaaagaggucugugcuuuaaauuucuca

SEQ ID NO: 201835 - RNA, 64 nt, Homo Sapiens
ggaagauaugggagcgaauuacuuuaaaagaagaaacaaagagguucuuaccugguaacuugag

SEQ ID NO: 201836 - RNA, 64 nt, Homo Sapiens
ugcaccuaagcagaccagaauggaaucugccuggaacaaagaaccaugcuagaaacaggaagau

SEQ ID NO: 201837 - RNA, 64 nt, Homo Sapiens
acaacugcauguuggauuagauaaacuaacuuguaacaaagaccacuacauagguaaagaaaag

SEQ ID NO: 201838 - RNA, 64 nt, Homo Sapiens
augagcucuacuuauuccguaauuagcauaacuaaacaaagauuaaaaguuucacaauggggac

SEQ ID NO: 201839 - RNA, 64 nt, Homo Sapiens
uagcuugaaaaagggaggacagucuuuccccagcaggggucaggggggccccucaggaagccua

SEQ ID NO: 201840 - RNA, 64 nt, Homo Sapiens
ugcucagucaguuguguggggauggugagggaagaggggucacaugagggaggaaacuguaucc

SEQ ID NO: 201841 - RNA, 64 nt, Homo Sapiens
uguccagagaccuagacuggccuccuacccaaaaaggggucaaugucagauaaugcuggcaaau

SEQ ID NO: 201842 - RNA, 64 nt, Homo Sapiens
uaaugcuggcaaauccuccuaugaacuagaaauaaggggucagagcaaugaagaugucuaggag

SEQ ID NO: 201843 - RNA, 64 nt, Homo Sapiens
ucaggcuggacgggaggguagccuuguggcugagaggggucagacuagguggcacaggggcucc

SEQ ID NO: 201844 - RNA, 64 nt, Homo Sapiens
ucccagagagggggugccccaucuagcugggugcaggggucacugcuugucagcucagggcccu

SEQ ID NO: 201845 - RNA, 64 nt, Homo Sapiens
gagcagccaggggugguggaaggagcacugggcuaggggucaggggucagagauucuguccugc

SEQ ID NO: 201846 - RNA, 64 nt, Homo Sapiens
caggggugguggaaggagcacugggcuaggggucaggggucagagauucuguccugcuccuggg

SEQ ID NO: 201847 - RNA, 59 nt, Homo Sapiens
ugcucuccuccaggggcagaacauggggaggggacuagaugggcaaggggcagcacugc

SEQ ID NO: 201848 - RNA, 59 nt, Homo Sapiens
cccacagcuuaguggccaguaaacacccuggggacuaggaaaaggaaccaacuguaggc

SEQ ID NO: 201849 - RNA, 59 nt, Homo Sapiens
agggauaauaauuuaauuguucuagacaaggggacuauagggacugacuguuauuaaaa

SEQ ID NO: 201850 - RNA, 59 nt, Homo Sapiens
uuccagugucucccuccagcucaggggcaggggacuacccaacccucauccccaucuuc

SEQ ID NO: 201851 - RNA, 59 nt, Homo Sapiens
agagagaagcauguuauuacacucuuuuaggggacuaagacacacacacacacacacac

SEQ ID NO: 201852 - RNA, 59 nt, Homo Sapiens
cagaggcaaagaggagcugcggaacauguggggacuacuaguugaaaucucuggaagag

SEQ ID NO: 201853 - RNA, 59 nt, Homo Sapiens
agacucuaaauuggcuucuaguaaaguuaggggacuagauuuuguauaauuuaaggaag

SEQ ID NO: 201854 - RNA, 59 nt, Homo Sapiens
aauugaagguucuuaucagaugggauacuggggacuauaaacaauggaaauaaagccac

SEQ ID NO: 201855 - RNA, 59 nt, Homo Sapiens
uaagucuucauggauguucugcaugucauggggacuaaaacucacccaacagaucuuuc

SEQ ID NO: 201856 - RNA, 59 nt, Homo Sapiens
ucuuccuuggguguuuggugcuggcuccuggggacuacaaaucccagagugcggugugc

SEQ ID NO: 201857 - RNA, 59 nt, Homo Sapiens
aggagagagaaagccaggcagguagccagggggacuagccccuguggagacuggggggc

SEQ ID NO: 201858 - RNA, 59 nt, Homo Sapiens
uugguaaaccccugauucgggguggggugggggacuaggcucagccggaaccagcaccu

SEQ ID NO: 201859 - RNA, 59 nt, Homo Sapiens
uucugucacuggaguuuugacagcugguuggggacuauagagaguguucuugucucuag

SEQ ID NO: 201860 - RNA, 59 nt, Homo Sapiens
ugaaaugauucugguauuucacuauuugaggggacuauuaaagguagucaucaaaugag

SEQ ID NO: 201861 - RNA, 59 nt, Homo Sapiens
uauuuuguuuaugaaaaugggaugagagaggggacuaauaaaagacaugauagagaaaa

SEQ ID NO: 201862 - RNA, 59 nt, Homo Sapiens
auggaaaaggucuguccauacuuacccauggggacuaauguuuuggggcauuuguggaa

SEQ ID NO: 201863 - RNA, 59 nt, Homo Sapiens
uuaugagagagauccuggacuucuuuuugggggacuauuuuuguacagagaaaaccugg

SEQ ID NO: 201864 - RNA, 59 nt, Homo Sapiens
ggcuuccagagaguggcuggcagggaguuggggacuaaggacccugugacaccggucug

SEQ ID NO: 201865 - RNA, 59 nt, Homo Sapiens
aaagacagcuguuuaggguccaggugggcggggacuaaccuuguugcuggcaucccggc

SEQ ID NO: 201866 - RNA, 59 nt, Homo Sapiens
gugcaaccuauuuggguaaaaaaccauauggggacuauaagugguuguggaacaguaga

SEQ ID NO: 201867 - RNA, 59 nt, Homo Sapiens
aaggguguuagucuuggagagaauuuuuuggggacuauuuucuugggauacuaagacuu

SEQ ID NO: 201868 - RNA, 59 nt, Homo Sapiens
auacuguaauaauauuuuuaguuguuaguggggacuauguuguuauauguaccccaguu

SEQ ID NO: 201869 - RNA, 59 nt, Homo Sapiens
gaacauagaauuuuauuagcauauaguagggggacuaagcuucggaucuaugaaagaaa

SEQ ID NO: 201870 - RNA, 59 nt, Homo Sapiens
guggaagauucccuauuuaaugugauaaaggggacuagaucuuguucugaacaacacac

SEQ ID NO: 201871 - RNA, 59 nt, Homo Sapiens
aagaauaaagccuuuucuaagggugacuuggggacuagauggccaacuugcuaucuggu

SEQ ID NO: 201872 - RNA, 59 nt, Homo Sapiens
ggagcuugggggaugacuagaggcagggaggggacuauuuaugaaggcaaaaaaauuaa

SEQ ID NO: 201873 - RNA, 59 nt, Homo Sapiens
auugcucagcuccucagagugggccgggaggggacuagaagagcugcaugaugguggcu

SEQ ID NO: 201874 - RNA, 59 nt, Homo Sapiens
cugcuuacacuuuagaauguuuauuuuauggggacuaagggauuaggagugugaacuaa

SEQ ID NO: 201875 - RNA, 59 nt, Homo Sapiens
guauuuauauauuuaauugauggauaaguggggacuaguaaccaaggaaagugaaacuu

SEQ ID NO: 201876 - RNA, 59 nt, Homo Sapiens
ugugcauggcaccugcucugcggagagugggggacuagcggcgaagcuuuggugacaga

SEQ ID NO: 201877 - RNA, 59 nt, Homo Sapiens
cucaaaugcuguccccggcagcuuuccugggggacuagagcuccuucuggccauguuau

SEQ ID NO: 201878 - RNA, 59 nt, Homo Sapiens
ggagaaaauaagguggagucguacugcuuggggacuauuuuuaugucuucaagugaccu

SEQ ID NO: 201879 - RNA, 59 nt, Homo Sapiens
ggaaugcuguccaaguuuuauuuggggagggggacuacuauuguuaggauuuuggagua

SEQ ID NO: 201880 - RNA, 59 nt, Homo Sapiens
aaggccccaccuccuaauaccaucacucuggggacuaggugucagcaugugaauuuugg

SEQ ID NO: 201881 - RNA, 59 nt, Homo Sapiens
agcaaagaagcugcuuuaaaaaauaaaaaggggacuaaaaauuuguuuuguauaaagag

SEQ ID NO: 201882 - RNA, 59 nt, Homo Sapiens
caacuaggcaggcacaaaucuugggucuuggggacuaacccaaugccugugaagcaguc

SEQ ID NO: 201883 - RNA, 59 nt, Homo Sapiens
acugauggauggguagugggcugagaagaggggacuaggaagggcuauuccaggcucag

SEQ ID NO: 201884 - RNA, 59 nt, Homo Sapiens
caagcugacagcggaugguaucagaaugaggggacuacaucacauggccaagucuagag

SEQ ID NO: 201885 - RNA, 51 nt, Homo Sapiens
caaggauggagcuccgugggaggggacuacccucggauaccaugguccuag

SEQ ID NO: 201886 - RNA, 59 nt, Homo Sapiens
caguuagagacucugucacccuaacuaaaggggacuagacaauaaauauucuagcaucc

SEQ ID NO: 201887 - RNA, 59 nt, Homo Sapiens
caccuccuucuuaagagggugcacucucaggggacuagcccugcaccccaaagugagcc

SEQ ID NO: 201888 - RNA, 59 nt, Homo Sapiens
cuggggcuuugauuuggaggaauggggcaggggacuaucugaagcgcuuccauccuaaa

SEQ ID NO: 201889 - RNA, 59 nt, Homo Sapiens
ugggcucgucucucucugcuuuagcgcugggggacuaucgcagcggcuucgggaacaag

SEQ ID NO: 201890 - RNA, 59 nt, Homo Sapiens
uuguagaggugggaaggcccagcugaccaggggacuaggaaguugccuuuugccacugu

SEQ ID NO: 201891 - RNA, 59 nt, Homo Sapiens
aguacccccagcccaagagaugaacaucuggggacuaauaucauagacccaucuggagg

SEQ ID NO: 201892 - RNA, 59 nt, Homo Sapiens
cacuaaucagauuucaaggcccacaacuuggggacuagaccaccuuauguugagggaac

SEQ ID NO: 201893 - RNA, 59 nt, Homo Sapiens
uuuaaauaagauggagaauaaauuauugaggggacuaggcuauaugcauuugccuucau

SEQ ID NO: 201894 - RNA, 59 nt, Homo Sapiens
ggaucacuguccccccaccuucacucccuggggacuauguccaaucuucugccucccag

SEQ ID NO: 201895 - RNA, 59 nt, Homo Sapiens
gucacacggcuugugggcacuauuaucaaggggacuaaaagugagagaaaugaaguuua

SEQ ID NO: 201896 - RNA, 59 nt, Homo Sapiens
gugggguaagggggcgccuguuacuaaugggggacuacugaggacagggacuucggcau

SEQ ID NO: 201897 - RNA, 59 nt, Homo Sapiens
ccaguguugggcaccuccaggucagccuuggggacuagggucaggccagaccauguuuc

SEQ ID NO: 201898 - RNA, 59 nt, Homo Sapiens
ucuguuaucuccugcguaguaccaagguaggggacuaguggaucuuaucauaguuuugg

SEQ ID NO: 201899 - RNA, 59 nt, Homo Sapiens
aguucuacaaaagaauggccagcacgagcggggacuagaggguccugauuuugugucug

SEQ ID NO: 201900 - RNA, 59 nt, Homo Sapiens
gugucugcccuuccaaucaccagguagcuggggacuaugggaacgggggcucuugaagc

SEQ ID NO: 201901 - RNA, 59 nt, Homo Sapiens
ucacuggcgaggugcggccaaccuugguaggggacuaauaggaagggugggucuguaag

SEQ ID NO: 201902 - RNA, 59 nt, Homo Sapiens
aaugugggcauguggagagguacagugguggggacuaaacagcuugcccagcucuugag

SEQ ID NO: 201903 - RNA, 59 nt, Homo Sapiens
agucucagacugauuucuugcgggaggagggggacuaaacucaaccuaacacauuaaau

SEQ ID NO: 201904 - RNA, 59 nt, Homo Sapiens
gaacuuccaaggaaggagccugagccacuggggacuaagugggcagaagaaacccuugg

SEQ ID NO: 201905 - RNA, 59 nt, Homo Sapiens
acauuuugaaaaggaaaucuagcaugugaggggacuaaguguucucagagugauguuuu

SEQ ID NO: 201906 - RNA, 59 nt, Homo Sapiens
aucugcagagguauucaguuccuggcacaggggacuaggggcauguagaguauaugagg

SEQ ID NO: 201907 - RNA, 59 nt, Homo Sapiens
uuucucagggugguccuaugagcaugccaggggacuacgcucuauuuucagguuugcag

SEQ ID NO: 201908 - RNA, 59 nt, Homo Sapiens
agucccucacucuuagguuuccagucaacggggacuacuaugauguucccagccauacu

SEQ ID NO: 201909 - RNA, 59 nt, Homo Sapiens
cucccgggcugggcuuuugaauuggccuuggggacuacucggcucucacucagcuccca

SEQ ID NO: 201910 - RNA, 59 nt, Homo Sapiens
cugaaagcuaaauccucaaaaccuaguaaggggacuaaugauucauuaaaguaaauuga

SEQ ID NO: 201911 - RNA, 59 nt, Homo Sapiens
caauaagucaguucuaguggcugucgccuggggacuagugagaaagcuacucuucuccc

SEQ ID NO: 201912 - RNA, 59 nt, Homo Sapiens
acuauggacucuuguuguguggaauggaaggggacuagccagcucucugcauggcacau

SEQ ID NO: 201913 - RNA, 59 nt, Homo Sapiens
ucggaggagguggacauuucggaagugguggggacuaagggaagaacucucuaguuccc

SEQ ID NO: 201914 - RNA, 59 nt, Homo Sapiens
gauaguucuguguacuccuuuagggagugggggacuagaacugggaugucuuggcuugu

SEQ ID NO: 201915 - RNA, 59 nt, Homo Sapiens
aaauuucugcucaacugacucaucuuuugggggacuaauuuaauuugcugcugacagcc

SEQ ID NO: 201916 - RNA, 59 nt, Homo Sapiens
aacuuucugcucaacugacuuaucuuuugggggacuaauuuaauuugcugcugacagcc

SEQ ID NO: 201917 - RNA, 59 nt, Homo Sapiens
aagagggaaagccagaguucccuguucuaggggacuagccaaaugccuacaucagcugu

SEQ ID NO: 201918 - RNA, 59 nt, Homo Sapiens
ggagccugguauacaugcggcaaggugguggggacuaggccacgucaugauggaugggg

SEQ ID NO: 201919 - RNA, 59 nt, Homo Sapiens
aggaaggguguggcauggcuggagagcauggggacuagggcagagcugccaggcuccca

SEQ ID NO: 201920 - RNA, 59 nt, Homo Sapiens
ggguccccaaaguggcccacugucacuagggggacuagggccaccaccuucucuucucu

SEQ ID NO: 201921 - RNA, 59 nt, Homo Sapiens
ucugcccaccaccacugccaggcugaacaggggacuagugcccaggugacacugcacac

SEQ ID NO: 201922 - RNA, 59 nt, Homo Sapiens
uagguaaugauuuuccuagucaaaauaaaggggacuaaaucuucucauguuaaacccac

SEQ ID NO: 201923 - RNA, 59 nt, Homo Sapiens
aaaaacccguccagugugguacuggugcaggggacuaggccucauuauagcaaaggguu

SEQ ID NO: 201924 - RNA, 54 nt, Homo Sapiens
ucggugaggcaccccuguaacccuggggacuaggaggaagggggcagagagagu

SEQ ID NO: 201925 - RNA, 59 nt, Homo Sapiens
ccagcccugucccugccaccccuccuaguggggacuagugaaugacuugaccugugacc

SEQ ID NO: 201926 - RNA, 59 nt, Homo Sapiens
cgccugggggcugggguaggcgaggccguggggacuacccauuuuauagcuggggaaac

SEQ ID NO: 201927 - RNA, 59 nt, Homo Sapiens
gggacagaggucagccuaaggugacacacggggacuacugugcuuccggaggcucccug

SEQ ID NO: 201928 - RNA, 59 nt, Homo Sapiens
cuuuuauuucuuuuucucuuugauugaaaggggacuacgucuuagcaggaaaaaaaacu

SEQ ID NO: 201929 - RNA, 59 nt, Homo Sapiens
uccugccucagccuccugaguacccuccuggggacuacaggugcgugcuaccauaccca

SEQ ID NO: 201930 - RNA, 59 nt, Homo Sapiens
uguuucccaccccagguucccugagguugggggacuacucccaccugugguucuggccu

SEQ ID NO: 201931 - RNA, 59 nt, Homo Sapiens
agcagaaucuaccucccaacugugucaaaggggacuaacgcccauucuccauuucugug

SEQ ID NO: 201932 - RNA, 59 nt, Homo Sapiens
cccccgaccccaccccagucccacuccaaggggacuauuuugacucuggggguccacau

SEQ ID NO: 201933 - RNA, 59 nt, Homo Sapiens
uggccccgucugaaccuucucugggcacuggggacuaagguugcaggccuuagccucgu

SEQ ID NO: 201934 - RNA, 59 nt, Homo Sapiens
uggauaaacuaguacgagauauuuauggaggggacuaugagagguuuggacugccaggc

SEQ ID NO: 201935 - RNA, 59 nt, Homo Sapiens
ugugccuucugccaccugacuuuccgugaggggacuaaaauuuacuaauuguaguugcu

SEQ ID NO: 201936 - RNA, 59 nt, Homo Sapiens
uuucauagaccuaauuugcaaacucaaucggggacuaaaauuucccacugaaaauguua

SEQ ID NO: 201937 - RNA, 59 nt, Homo Sapiens
acuggcggcuucccuucuuggcucuugggggggacuagauccuguggagaagaugacuu

SEQ ID NO: 201938 - RNA, 59 nt, Homo Sapiens
ugcuuacuucugggguauuggaaauguuuggggacuagguagaggugaauguacuaaau

SEQ ID NO: 201939 - RNA, 59 nt, Homo Sapiens
caaacagucacaagcaaaggaagaggcugggggacuagaaagaggcccugcccucuaga

SEQ ID NO: 201940 - RNA, 59 nt, Homo Sapiens
gaggcaggcugcagcuucagccacagaauggggacuauggaagacagcaggagcucauu

SEQ ID NO: 201941 - RNA, 59 nt, Homo Sapiens
ggaaacaguuggagguucgucgaugccccggggacuaggccaugugggaacccagccuc

SEQ ID NO: 201942 - RNA, 59 nt, Homo Sapiens
agggcagcauugcuggggaguuuccacggggggacuaggcacaugucuuacuuucagaa

SEQ ID NO: 201943 - RNA, 59 nt, Homo Sapiens
uuggggcuuucuccagacuucugggaacaggggacuacuaucuguuuauucuuugggcu

SEQ ID NO: 201944 - RNA, 59 nt, Homo Sapiens
accccuggguuccuugagagccuuucaggggggacuaugagaucaaaauauuuuuauua

SEQ ID NO: 201945 - RNA, 59 nt, Homo Sapiens
gcccgccauccccaguugcagggggaucuggggacuaccagagacucugggaaauggac

SEQ ID NO: 201946 - RNA, 59 nt, Homo Sapiens
acacaaauccaacgcuuuucugguaucugggggacuagauaagagccacaauaagccac

SEQ ID NO: 201947 - RNA, 64 nt, Homo Sapiens
gcaauggugauaauggauuaauuccucaaaggaagagcagaacaccugaaaaucagcaauuucc

SEQ ID NO: 201948 - RNA, 64 nt, Homo Sapiens
gcaauggugaugauggauuaauuccuccaaggaagagcagaacaccugaaagccagcaauuucc

SEQ ID NO: 201949 - RNA, 64 nt, Homo Sapiens
ccugguaguuacaagcaaagagccggagaagccggagcagaagugccacggcagggaggaaagg

SEQ ID NO: 201950 - RNA, 64 nt, Homo Sapiens
aaacacaaaaaacauaagucaaaaaguuucagaagagcagaaguagaaaaaagauagaaaaaag

SEQ ID NO: 201951 - RNA, 64 nt, Homo Sapiens
uugaguuugagaauccugaaucauggaaacuucugagcagaacaucagagacaaauaggcuuca

SEQ ID NO: 201952 - RNA, 64 nt, Homo Sapiens
agucuaaaggcagagccccaacaaccuaugacuggagcagaauagaccaagaacaaagacaacc

SEQ ID NO: 201953 - RNA, 64 nt, Homo Sapiens
guauuaaauagccaugagcuucacugcuuagagggagcagaaaggucaacaucuaaaagcaccu

SEQ ID NO: 201954 - RNA, 64 nt, Homo Sapiens
aagaggaggagaaacagggugagucaagguaaaggagcagaaauguaguuacaagccaggucgu

SEQ ID NO: 201955 - RNA, 64 nt, Homo Sapiens
aggguucucaggcaggcaguucugcuucagcuuagagcagaacccauaaaauacucaaguacug

SEQ ID NO: 201956 - RNA, 64 nt, Homo Sapiens
uauuuugaaaguuggaaggagaagggagggaagagagcagaagggaagaagguguaagucaagc

SEQ ID NO: 201957 - RNA, 64 nt, Homo Sapiens
cugguuucugggaagggaacguuuauuuaguaaagagcagaacacccuugcguuuuguugggac

SEQ ID NO: 201958 - RNA, 64 nt, Homo Sapiens
ugagcaggcggagacuccaagcugggcugagccagagcagaaggcgagggauucccagccggac

SEQ ID NO: 201959 - RNA, 64 nt, Homo Sapiens
accuucagccacagccuuauggcaucgaaaacaagagcagaagcgguaaauauugaaaacucca

SEQ ID NO: 201960 - RNA, 64 nt, Homo Sapiens
gcauuauuucauuacauuacucccaugugggauggagcagaacucaagaaaaggaugauucaca

SEQ ID NO: 201961 - RNA, 64 nt, Homo Sapiens
ggaaggccgcuuccuuucucaggagaggcugcuagagcagaagcggagagguugcuggagcugc

SEQ ID NO: 201962 - RNA, 64 nt, Homo Sapiens
ggaaggccgcuuccuuucucaggagagccugcuagagcagaagcggagaggcuacuggagcugc

SEQ ID NO: 201963 - RNA, 64 nt, Homo Sapiens
uauaggaagacauaauuccagugccuuuaugguggagcagaauucgacaacacauguccauuca

SEQ ID NO: 201964 - RNA, 64 nt, Homo Sapiens
cccuccuccccacguaccauugcgcgugcagcuggagcagaauacccucauuuuuaggaaucua

SEQ ID NO: 201965 - RNA, 64 nt, Homo Sapiens
ugaggagcacgcgugagcuuccauucugugaaaggagcagaaugagggcaugaccggggacuga

SEQ ID NO: 201966 - RNA, 64 nt, Homo Sapiens
acacugucucccuggaggggaccucacguuuuuagagcagaaccuuugacauauuucaguuucc

SEQ ID NO: 201967 - RNA, 64 nt, Homo Sapiens
cuaggguuuuacagaggaccaguuaguucugguggagcagaacacacugaugguggaagagcgg

SEQ ID NO: 201968 - RNA, 64 nt, Homo Sapiens
auguguauaugcuauuuuuuuagcagccaugucugagcagaauguuaacauaauuuuuggaaaa

SEQ ID NO: 201969 - RNA, 64 nt, Homo Sapiens
cccuggcgacugggcugagcgagggaggaacaacgagcagaagggccuccagggcaggaccuug

SEQ ID NO: 201970 - RNA, 64 nt, Homo Sapiens
ucaccccauucccccagggagagggcucuggagugagcagaaccaacccaagauggaagagcca

SEQ ID NO: 201971 - RNA, 64 nt, Homo Sapiens
gcauucaagauuugcaggccccagccugggaugagagcagaaaagaaaagggacucagguaagc

SEQ ID NO: 201972 - RNA, 64 nt, Homo Sapiens
agauauauuuucagauuuuuguuaaugucauucugagcagaaauauuauugucacuuuuaaaau

SEQ ID NO: 201973 - RNA, 64 nt, Homo Sapiens
uugcucaauuuuuccucuucacuggcacaauguaucugaauaccuccuucccucccuucuagaa

SEQ ID NO: 201974 - RNA, 64 nt, Homo Sapiens
uuuuaagaaaaacaguauuuuauuuauaauaaaaucugaauauuuguaacccuuuauauuuggu

SEQ ID NO: 201975 - RNA, 64 nt, Homo Sapiens
uauuucccuugauuauucaccuaacuauagguacucugaauauauguaaggaccgauuugagca

SEQ ID NO: 201976 - RNA, 64 nt, Homo Sapiens
aaccaauuccauuuguuugaagguuuacucuuuaucugaauaagguuuacuuggauugauaauu

SEQ ID NO: 201977 - RNA, 64 nt, Homo Sapiens
gguuuaucagacucggaaucuauuuucucauugcucugaauaugucaucacucuagguuuuaca

SEQ ID NO: 201978 - RNA, 64 nt, Homo Sapiens
uaguuucucuuagaaaagcuaagagaagauaaggucugaauaauagcagaaaaaccaacaucua

SEQ ID NO: 201979 - RNA, 64 nt, Homo Sapiens
ucucugaagucagaucucaauuuuuagaaaacucucugaauauaaugaauauggggaauccaau

SEQ ID NO: 201980 - RNA, 64 nt, Homo Sapiens
gguguuuacaggaaagaucucagaggcuaugagcucugaauaaaucuucauuguauaaaaugaa

SEQ ID NO: 201981 - RNA, 64 nt, Homo Sapiens
caugguguguuuccugucugaauuugacuuucccucugaauauguaguacuuucaaauguuuuc

SEQ ID NO: 201982 - RNA, 64 nt, Homo Sapiens
acaauaugugaugaauauaagcacaagacaauaaucugaauaagucccauggaguuuugcuaag

SEQ ID NO: 201983 - RNA, 64 nt, Homo Sapiens
acaagggcugguuaauauaacaaaaagcuuaaacucugaauauauagucaucaaaauggcuuau

SEQ ID NO: 201984 - RNA, 64 nt, Homo Sapiens
caucaaaauggcuuaucaaaucuucuucagaauuucugaauaguugauguaagggggaaaauuc

SEQ ID NO: 201985 - RNA, 64 nt, Homo Sapiens
gcccaguagucuuguggaugccagagacauccuuucugaauacuucuugauggguacaggcuga

SEQ ID NO: 201986 - RNA, 64 nt, Homo Sapiens
caaauguguaccauuggugagacacauacaaugcucugaauacacuacgaauuuguauuaaaca

SEQ ID NO: 201987 - RNA, 64 nt, Homo Sapiens
guagcuuuauauuaacuacaagagacucugggagucugaauaaaagaaugaaaauauuaauuua

SEQ ID NO: 201988 - RNA, 64 nt, Homo Sapiens
cuaccggagccuuguuuuucauucuggaaguagaucugaauagguuugauucaagaaucgucuu

SEQ ID NO: 201989 - RNA, 64 nt, Homo Sapiens
guggaagaaacaauaaaacuaaauuuuuugcacaucugaauaucugcugacuuguuuucuugug

SEQ ID NO: 201990 - RNA, 64 nt, Homo Sapiens
uauaaugugucuauaaaauaaaauacuuaaucuuucugaauaaaagcuucauuuuuuaccuuug

SEQ ID NO: 201991 - RNA, 64 nt, Homo Sapiens
uuaagauaaaaugauuaauaaaacaauugguaauucugaauaaggaucugaauaaauccagauc

SEQ ID NO: 201992 - RNA, 64 nt, Homo Sapiens
gauuaauaaaacaauugguaauucugaauaaggaucugaauaaauccagaucacagacuguucc

SEQ ID NO: 201993 - RNA, 64 nt, Homo Sapiens
uaaugcucuuggacacauuuuguauuauucaugaucugaauaguaguuaguuaaaagaucauuu

SEQ ID NO: 201994 - RNA, 64 nt, Homo Sapiens
gauuccauuuccaguuuuauaauguauuucagguucugaauaacaauauuuuuccaaauugaaa

SEQ ID NO: 201995 - RNA, 64 nt, Homo Sapiens
uacccgugguauuugaaaaaaaucaagguaacugucugaauacuuuaauaucagcuuguuuugu

SEQ ID NO: 201996 - RNA, 64 nt, Homo Sapiens
ugaauacuuuaauaucagcuuguuuugugaauucucugaauacugucaacacucuuaucuaagu

SEQ ID NO: 201997 - RNA, 64 nt, Homo Sapiens
gggagcagaaagagaagguuuuuaaggaggggcuucugaauacuugggagauacggaacggacc

SEQ ID NO: 201998 - RNA, 64 nt, Homo Sapiens
cuuagaauguaaaauugauuguuaaaaguuuuguucugaauaaauauuuaucuuuuguauugcu

SEQ ID NO: 201999 - RNA, 64 nt, Homo Sapiens
uauaguuaaaugauuuauauucuccugaauguccucugaauauuguacuuuagacauacgcuug

SEQ ID NO: 202000 - RNA, 64 nt, Homo Sapiens
uucuuuaaauguguguuuagucugugcuuuggcaucugaauaugcauagaugcuuugcauuuuc

SEQ ID NO: 202001 - RNA, 64 nt, Homo Sapiens
cuugacauuacagcugucaaaggauuuuucuuguucugaauaucucuggacucucuuguauuau

SEQ ID NO: 202002 - RNA, 64 nt, Homo Sapiens
ugaaauguauauuuguacaguuucauguauucauucugaauagucuuugggaaaagcgauuuuu

SEQ ID NO: 202003 - RNA, 64 nt, Homo Sapiens
ccaggaacuaauucuauaauggaaaacuauccauucugaauaauagguauguaauuauuugcug

SEQ ID NO: 202004 - RNA, 64 nt, Homo Sapiens
uaauuauuugcugcugcugcugugcucuguaaauucugaauaugacauuuaaacucugugccua

SEQ ID NO: 202005 - RNA, 64 nt, Homo Sapiens
ugaacauuuuaacaguaacgucagcauauuuuugucugaauacucuuccauguuguuuaccuaa

SEQ ID NO: 202006 - RNA, 64 nt, Homo Sapiens
aguuuaaagcaauauuuguuuuaauauuugucuuucugaauaauucauacacacuuucuaguuc

SEQ ID NO: 202007 - RNA, 64 nt, Homo Sapiens; identical to SEQ ID NO: 39347

SEQ ID NO: 202008 - RNA, 64 nt, Homo Sapiens; identical to SEQ ID NO: 39348

SEQ ID NO: 202009 - RNA, 64 nt, Homo Sapiens; identical to SEQ ID NO: 39349

SEQ ID NO: 202010 - RNA, 64 nt, Homo Sapiens; identical to SEQ ID NO: 39350

SEQ ID NO: 202011 - RNA, 64 nt, Homo Sapiens; identical to SEQ ID NO: 39351

SEQ ID NO: 202012 - RNA, 64 nt, Homo Sapiens; identical to SEQ ID NO: 39352

SEQ ID NO: 202013 - RNA, 64 nt, Homo Sapiens; identical to SEQ ID NO: 39353

SEQ ID NO: 202014 - RNA, 64 nt, Homo Sapiens; identical to SEQ ID NO: 39354

SEQ ID NO: 202015 - RNA, 64 nt, Homo Sapiens; identical to SEQ ID NO: 39355

SEQ ID NO: 202016 - RNA, 64 nt, Homo Sapiens; identical to SEQ ID NO: 39356

SEQ ID NO: 202017 - RNA, 64 nt, Homo Sapiens; identical to SEQ ID NO: 39357

SEQ ID NO: 202018 - RNA, 64 nt, Homo Sapiens; identical to SEQ ID NO: 39358

SEQ ID NO: 202019 - RNA, 64 nt, Homo Sapiens; identical to SEQ ID NO: 39359

SEQ ID NO: 202020 - RNA, 64 nt, Homo Sapiens; identical to SEQ ID NO: 39360

SEQ ID NO: 202021 - RNA, 64 nt, Homo Sapiens; identical to SEQ ID NO: 39361

SEQ ID NO: 202022 - RNA, 64 nt, Homo Sapiens; identical to SEQ ID NO: 39362

SEQ ID NO: 202023 - RNA, 64 nt, Homo Sapiens; identical to SEQ ID NO: 39363

SEQ ID NO: 202024 - RNA, 64 nt, Homo Sapiens; identical to SEQ ID NO: 39364

SEQ ID NO: 202025 - RNA, 64 nt, Homo Sapiens; identical to SEQ ID NO: 39365

SEQ ID NO: 202026 - RNA, 64 nt, Homo Sapiens; identical to SEQ ID NO: 39366

SEQ ID NO: 202027 - RNA, 64 nt, Homo Sapiens; identical to SEQ ID NO: 39367

SEQ ID NO: 202028 - RNA, 64 nt, Homo Sapiens; identical to SEQ ID NO: 39368

SEQ ID NO: 202029 - RNA, 64 nt, Homo Sapiens; identical to SEQ ID NO: 39369

SEQ ID NO: 202030 - RNA, 64 nt, Homo Sapiens; identical to SEQ ID NO: 39370

SEQ ID NO: 202031 - RNA, 64 nt, Homo Sapiens; identical to SEQ ID NO: 39371

SEQ ID NO: 202032 - RNA, 64 nt, Homo Sapiens; identical to SEQ ID NO: 39372

SEQ ID NO: 202033 - RNA, 64 nt, Homo Sapiens; identical to SEQ ID NO: 39373

SEQ ID NO: 202034 - RNA, 64 nt, Homo Sapiens; identical to SEQ ID NO: 39374

SEQ ID NO: 202035 - RNA, 64 nt, Homo Sapiens; identical to SEQ ID NO: 39375

SEQ ID NO: 202036 - RNA, 64 nt, Homo Sapiens; identical to SEQ ID NO: 39376

SEQ ID NO: 202037 - RNA, 64 nt, Homo Sapiens; identical to SEQ ID NO: 39377

SEQ ID NO: 202038 - RNA, 64 nt, Homo Sapiens; identical to SEQ ID NO: 39378

SEQ ID NO: 202039 - RNA, 64 nt, Homo Sapiens; identical to SEQ ID NO: 39379

SEQ ID NO: 202040 - RNA, 64 nt, Homo Sapiens; identical to SEQ ID NO: 39380

SEQ ID NO: 202041 - RNA, 64 nt, Homo Sapiens; identical to SEQ ID NO: 39381

SEQ ID NO: 202042 - RNA, 64 nt, Homo Sapiens; identical to SEQ ID NO: 39382

SEQ ID NO: 202043 - RNA, 64 nt, Homo Sapiens; identical to SEQ ID NO: 39383

SEQ ID NO: 202044 - RNA, 64 nt, Homo Sapiens; identical to SEQ ID NO: 39384

SEQ ID NO: 202045 - RNA, 64 nt, Homo Sapiens; identical to SEQ ID NO: 39385

SEQ ID NO: 202046 - RNA, 64 nt, Homo Sapiens; identical to SEQ ID NO: 39386

SEQ ID NO: 202047 - RNA, 64 nt, Homo Sapiens; identical to SEQ ID NO: 39387

SEQ ID NO: 202048 - RNA, 64 nt, Homo Sapiens; identical to SEQ ID NO: 39388

SEQ ID NO: 202049 - RNA, 64 nt, Homo Sapiens; identical to SEQ ID NO: 39389

SEQ ID NO: 202050 - RNA, 64 nt, Homo Sapiens; identical to SEQ ID NO: 39390

SEQ ID NO: 202051 - RNA, 64 nt, Homo Sapiens; identical to SEQ ID NO: 39391

SEQ ID NO: 202052 - RNA, 64 nt, Homo Sapiens; identical to SEQ ID NO: 39392

SEQ ID NO: 202053 - RNA, 64 nt, Homo Sapiens; identical to SEQ ID NO: 39393

SEQ ID NO: 202054 - RNA, 64 nt, Homo Sapiens; identical to SEQ ID NO: 39394

SEQ ID NO: 202055 - RNA, 64 nt, Homo Sapiens; identical to SEQ ID NO: 39395

SEQ ID NO: 202056 - RNA, 64 nt, Homo Sapiens; identical to SEQ ID NO: 39396

SEQ ID NO: 202057 - RNA, 64 nt, Homo Sapiens; identical to SEQ ID NO: 39397

SEQ ID NO: 202058 - RNA, 64 nt, Homo Sapiens; identical to SEQ ID NO: 39398

SEQ ID NO: 202059 - RNA, 64 nt, Homo Sapiens; identical to SEQ ID NO: 39399

SEQ ID NO: 202060 - RNA, 64 nt, Homo Sapiens; identical to SEQ ID NO: 39400

SEQ ID NO: 202061 - RNA, 64 nt, Homo Sapiens; identical to SEQ ID NO: 39401

SEQ ID NO: 202062 - RNA, 64 nt, Homo Sapiens; identical to SEQ ID NO: 39402

SEQ ID NO: 202063 - RNA, 64 nt, Homo Sapiens; identical to SEQ ID NO: 39403

SEQ ID NO: 202064 - RNA, 64 nt, Homo Sapiens; identical to SEQ ID NO: 39404

SEQ ID NO: 202065 - RNA, 64 nt, Homo Sapiens; identical to SEQ ID NO: 39405

SEQ ID NO: 202066 - RNA, 64 nt, Homo Sapiens; identical to SEQ ID NO: 39406

SEQ ID NO: 202067 - RNA, 64 nt, Homo Sapiens; identical to SEQ ID NO: 39407

SEQ ID NO: 202068 - RNA, 64 nt, Homo Sapiens; identical to SEQ ID NO: 39408

SEQ ID NO: 202069 - RNA, 64 nt, Homo Sapiens; identical to SEQ ID NO: 39409

SEQ ID NO: 202070 - RNA, 64 nt, Homo Sapiens; identical to SEQ ID NO: 39410

SEQ ID NO: 202071 - RNA, 64 nt, Homo Sapiens; identical to SEQ ID NO: 39411

SEQ ID NO: 202072 - RNA, 64 nt, Homo Sapiens; identical to SEQ ID NO: 39412

SEQ ID NO: 202073 - RNA, 64 nt, Homo Sapiens; identical to SEQ ID NO: 39413

SEQ ID NO: 202074 - RNA, 64 nt, Homo Sapiens; identical to SEQ ID NO: 39414

SEQ ID NO: 202075 - RNA, 64 nt, Homo Sapiens; identical to SEQ ID NO: 39415

SEQ ID NO: 202076 - RNA, 64 nt, Homo Sapiens; identical to SEQ ID NO: 39416

SEQ ID NO: 202077 - RNA, 64 nt, Homo Sapiens; identical to SEQ ID NO: 39417

SEQ ID NO: 202078 - RNA, 64 nt, Homo Sapiens; identical to SEQ ID NO: 39418

SEQ ID NO: 202079 - RNA, 64 nt, Homo Sapiens; identical to SEQ ID NO: 39419

SEQ ID NO: 202080 - RNA, 64 nt, Homo Sapiens; identical to SEQ ID NO: 39420

SEQ ID NO: 202081 - RNA, 64 nt, Homo Sapiens; identical to SEQ ID NO: 39421

SEQ ID NO: 202082 - RNA, 64 nt, Homo Sapiens; identical to SEQ ID NO: 39422

SEQ ID NO: 202083 - RNA, 64 nt, Homo Sapiens; identical to SEQ ID NO: 39423

SEQ ID NO: 202084 - RNA, 64 nt, Homo Sapiens; identical to SEQ ID NO: 39424

SEQ ID NO: 202085 - RNA, 64 nt, Homo Sapiens; identical to SEQ ID NO: 39425

SEQ ID NO: 202086 - RNA, 64 nt, Homo Sapiens; identical to SEQ ID NO: 39426

SEQ ID NO: 202087 - RNA, 64 nt, Homo Sapiens; identical to SEQ ID NO: 39427

SEQ ID NO: 202088 - RNA, 64 nt, Homo Sapiens; identical to SEQ ID NO: 39428

SEQ ID NO: 202089 - RNA, 64 nt, Homo Sapiens; identical to SEQ ID NO: 39429

SEQ ID NO: 202090 - RNA, 64 nt, Homo Sapiens; identical to SEQ ID NO: 39430

SEQ ID NO: 202091 - RNA, 64 nt, Homo Sapiens; identical to SEQ ID NO: 39431

SEQ ID NO: 202092 - RNA, 64 nt, Homo Sapiens; identical to SEQ ID NO: 39432

SEQ ID NO: 202093 - RNA, 64 nt, Homo Sapiens; identical to SEQ ID NO: 39433

SEQ ID NO: 202094 - RNA, 64 nt, Homo Sapiens; identical to SEQ ID NO: 39434

SEQ ID NO: 202095 - RNA, 64 nt, Homo Sapiens; identical to SEQ ID NO: 39435

SEQ ID NO: 202096 - RNA, 64 nt, Homo Sapiens; identical to SEQ ID NO: 39436

SEQ ID NO: 202097 - RNA, 64 nt, Homo Sapiens; identical to SEQ ID NO: 39437

SEQ ID NO: 202098 - RNA, 64 nt, Homo Sapiens; identical to SEQ ID NO: 39438

SEQ ID NO: 202099 - RNA, 64 nt, Homo Sapiens; identical to SEQ ID NO: 39439

SEQ ID NO: 202100 - RNA, 64 nt, Homo Sapiens; identical to SEQ ID NO: 39440

SEQ ID NO: 202101 - RNA, 64 nt, Homo Sapiens; identical to SEQ ID NO: 39441

SEQ ID NO: 202102 - RNA, 64 nt, Homo Sapiens; identical to SEQ ID NO: 39442

SEQ ID NO: 202103 - RNA, 64 nt, Homo Sapiens; identical to SEQ ID NO: 39443

SEQ ID NO: 202104 - RNA, 64 nt, Homo Sapiens; identical to SEQ ID NO: 39444

SEQ ID NO: 202105 - RNA, 64 nt, Homo Sapiens; identical to SEQ ID NO: 39445

SEQ ID NO: 202106 - RNA, 64 nt, Homo Sapiens; identical to SEQ ID NO: 39446

SEQ ID NO: 202107 - RNA, 64 nt, Homo Sapiens; identical to SEQ ID NO: 39447

SEQ ID NO: 202108 - RNA, 64 nt, Homo Sapiens; identical to SEQ ID NO: 39448

SEQ ID NO: 202109 - RNA, 64 nt, Homo Sapiens; identical to SEQ ID NO: 39449

SEQ ID NO: 202110 - RNA, 64 nt, Homo Sapiens; identical to SEQ ID NO: 39450

SEQ ID NO: 202111 - RNA, 64 nt, Homo Sapiens; identical to SEQ ID NO: 39451

SEQ ID NO: 202112 - RNA, 64 nt, Homo Sapiens; identical to SEQ ID NO: 39452

SEQ ID NO: 202113 - RNA, 64 nt, Homo Sapiens; identical to SEQ ID NO: 39453

SEQ ID NO: 202114 - RNA, 64 nt, Homo Sapiens; identical to SEQ ID NO: 39454

SEQ ID NO: 202115 - RNA, 64 nt, Homo Sapiens; identical to SEQ ID NO: 39455

SEQ ID NO: 202116 - RNA, 64 nt, Homo Sapiens; identical to SEQ ID NO: 39456

SEQ ID NO: 202117 - RNA, 64 nt, Homo Sapiens; identical to SEQ ID NO: 39457

SEQ ID NO: 202118 - RNA, 64 nt, Homo Sapiens; identical to SEQ ID NO: 39458

SEQ ID NO: 202119 - RNA, 64 nt, Homo Sapiens; identical to SEQ ID NO: 39459

SEQ ID NO: 202120 - RNA, 64 nt, Homo Sapiens; identical to SEQ ID NO: 39460

SEQ ID NO: 202121 - RNA, 64 nt, Homo Sapiens; identical to SEQ ID NO: 39461

SEQ ID NO: 202122 - RNA, 64 nt, Homo Sapiens; identical to SEQ ID NO: 39462

SEQ ID NO: 202123 - RNA, 64 nt, Homo Sapiens; identical to SEQ ID NO: 39463

SEQ ID NO: 202124 - RNA, 64 nt, Homo Sapiens; identical to SEQ ID NO: 39464

SEQ ID NO: 202125 - RNA, 64 nt, Homo Sapiens; identical to SEQ ID NO: 39465

SEQ ID NO: 202126 - RNA, 64 nt, Homo Sapiens; identical to SEQ ID NO: 39466

SEQ ID NO: 202127 - RNA, 64 nt, Homo Sapiens; identical to SEQ ID NO: 39467

SEQ ID NO: 202128 - RNA, 64 nt, Homo Sapiens; identical to SEQ ID NO: 39468

SEQ ID NO: 202129 - RNA, 64 nt, Homo Sapiens; identical to SEQ ID NO: 39469

SEQ ID NO: 202130 - RNA, 64 nt, Homo Sapiens; identical to SEQ ID NO: 39470

SEQ ID NO: 202131 - RNA, 64 nt, Homo Sapiens; identical to SEQ ID NO: 39471

SEQ ID NO: 202132 - RNA, 64 nt, Homo Sapiens; identical to SEQ ID NO: 39472

SEQ ID NO: 202133 - RNA, 64 nt, Homo Sapiens; identical to SEQ ID NO: 39473

SEQ ID NO: 202134 - RNA, 64 nt, Homo Sapiens; identical to SEQ ID NO: 39474

SEQ ID NO: 202135 - RNA, 64 nt, Homo Sapiens; identical to SEQ ID NO: 39475

SEQ ID NO: 202136 - RNA, 64 nt, Homo Sapiens; identical to SEQ ID NO: 39476

SEQ ID NO: 202137 - RNA, 64 nt, Homo Sapiens; identical to SEQ ID NO: 39477

SEQ ID NO: 202138 - RNA, 64 nt, Homo Sapiens; identical to SEQ ID NO: 39478

SEQ ID NO: 202139 - RNA, 64 nt, Homo Sapiens; identical to SEQ ID NO: 39479

SEQ ID NO: 202140 - RNA, 64 nt, Homo Sapiens; identical to SEQ ID NO: 39480

SEQ ID NO: 202141 - RNA, 64 nt, Homo Sapiens; identical to SEQ ID NO: 39481

SEQ ID NO: 202142 - RNA, 64 nt, Homo Sapiens; identical to SEQ ID NO: 39482

SEQ ID NO: 202143 - RNA, 64 nt, Homo Sapiens; identical to SEQ ID NO: 39483

SEQ ID NO: 202144 - RNA, 64 nt, Homo Sapiens; identical to SEQ ID NO: 39484

SEQ ID NO: 202145 - RNA, 64 nt, Homo Sapiens; identical to SEQ ID NO: 39485

SEQ ID NO: 202146 - RNA, 64 nt, Homo Sapiens; identical to SEQ ID NO: 39486

SEQ ID NO: 202147 - RNA, 64 nt, Homo Sapiens; identical to SEQ ID NO: 39487

SEQ ID NO: 202148 - RNA, 64 nt, Homo Sapiens; identical to SEQ ID NO: 39488

SEQ ID NO: 202149 - RNA, 64 nt, Homo Sapiens; identical to SEQ ID NO: 39489

SEQ ID NO: 202150 - RNA, 64 nt, Homo Sapiens; identical to SEQ ID NO: 39490

SEQ ID NO: 202151 - RNA, 64 nt, Homo Sapiens; identical to SEQ ID NO: 39491

SEQ ID NO: 202152 - RNA, 64 nt, Homo Sapiens; identical to SEQ ID NO: 39492

SEQ ID NO: 202153 - RNA, 64 nt, Homo Sapiens; identical to SEQ ID NO: 39493

SEQ ID NO: 202154 - RNA, 64 nt, Homo Sapiens; identical to SEQ ID NO: 39494

SEQ ID NO: 202155 - RNA, 64 nt, Homo Sapiens; identical to SEQ ID NO: 39495

SEQ ID NO: 202156 - RNA, 64 nt, Homo Sapiens; identical to SEQ ID NO: 39496

SEQ ID NO: 202157 - RNA, 64 nt, Homo Sapiens; identical to SEQ ID NO: 39497

SEQ ID NO: 202158 - RNA, 64 nt, Homo Sapiens; identical to SEQ ID NO: 39498

SEQ ID NO: 202159 - RNA, 64 nt, Homo Sapiens; identical to SEQ ID NO: 39499

SEQ ID NO: 202160 - RNA, 64 nt, Homo Sapiens; identical to SEQ ID NO: 39500

SEQ ID NO: 202161 - RNA, 64 nt, Homo Sapiens; identical to SEQ ID NO: 39501

SEQ ID NO: 202162 - RNA, 64 nt, Homo Sapiens; identical to SEQ ID NO: 39502

SEQ ID NO: 202163 - RNA, 64 nt, Homo Sapiens; identical to SEQ ID NO: 39503

SEQ ID NO: 202164 - RNA, 64 nt, Homo Sapiens; identical to SEQ ID NO: 39504

SEQ ID NO: 202165 - RNA, 64 nt, Homo Sapiens; identical to SEQ ID NO: 39505

SEQ ID NO: 202166 - RNA, 64 nt, Homo Sapiens; identical to SEQ ID NO: 39506

SEQ ID NO: 202167 - RNA, 64 nt, Homo Sapiens; identical to SEQ ID NO: 39507

SEQ ID NO: 202168 - RNA, 64 nt, Homo Sapiens; identical to SEQ ID NO: 39508

SEQ ID NO: 202169 - RNA, 64 nt, Homo Sapiens; identical to SEQ ID NO: 39509

SEQ ID NO: 202170 - RNA, 64 nt, Homo Sapiens; identical to SEQ ID NO: 39510

SEQ ID NO: 202171 - RNA, 64 nt, Homo Sapiens; identical to SEQ ID NO: 39511

SEQ ID NO: 202172 - RNA, 64 nt, Homo Sapiens; identical to SEQ ID NO: 39512

SEQ ID NO: 202173 - RNA, 64 nt, Homo Sapiens; identical to SEQ ID NO: 39513

SEQ ID NO: 202174 - RNA, 64 nt, Homo Sapiens; identical to SEQ ID NO: 39514

SEQ ID NO: 202175 - RNA, 64 nt, Homo Sapiens; identical to SEQ ID NO: 39515

SEQ ID NO: 202176 - RNA, 64 nt, Homo Sapiens; identical to SEQ ID NO: 39516

SEQ ID NO: 202177 - RNA, 64 nt, Homo Sapiens; identical to SEQ ID NO: 39517

SEQ ID NO: 202178 - RNA, 64 nt, Homo Sapiens; identical to SEQ ID NO: 39518

SEQ ID NO: 202179 - RNA, 64 nt, Homo Sapiens; identical to SEQ ID NO: 39519

SEQ ID NO: 202180 - RNA, 64 nt, Homo Sapiens; identical to SEQ ID NO: 39520

SEQ ID NO: 202181 - RNA, 64 nt, Homo Sapiens; identical to SEQ ID NO: 39521

SEQ ID NO: 202182 - RNA, 64 nt, Homo Sapiens; identical to SEQ ID NO: 39522

SEQ ID NO: 202183 - RNA, 64 nt, Homo Sapiens; identical to SEQ ID NO: 39523

SEQ ID NO: 202184 - RNA, 64 nt, Homo Sapiens; identical to SEQ ID NO: 39524

SEQ ID NO: 202185 - RNA, 64 nt, Homo Sapiens; identical to SEQ ID NO: 39525

SEQ ID NO: 202186 - RNA, 64 nt, Homo Sapiens; identical to SEQ ID NO: 39526

SEQ ID NO: 202187 - RNA, 64 nt, Homo Sapiens; identical to SEQ ID NO: 39527

SEQ ID NO: 202188 - RNA, 64 nt, Homo Sapiens; identical to SEQ ID NO: 39528

SEQ ID NO: 202189 - RNA, 64 nt, Homo Sapiens; identical to SEQ ID NO: 39529

SEQ ID NO: 202190 - RNA, 64 nt, Homo Sapiens; identical to SEQ ID NO: 39530

SEQ ID NO: 202191 - RNA, 64 nt, Homo Sapiens; identical to SEQ ID NO: 39531

SEQ ID NO: 202192 - RNA, 64 nt, Homo Sapiens; identical to SEQ ID NO: 39532

SEQ ID NO: 202193 - RNA, 64 nt, Homo Sapiens; identical to SEQ ID NO: 39533

SEQ ID NO: 202194 - RNA, 64 nt, Homo Sapiens; identical to SEQ ID NO: 39534

SEQ ID NO: 202195 - RNA, 64 nt, Homo Sapiens; identical to SEQ ID NO: 39535

SEQ ID NO: 202196 - RNA, 64 nt, Homo Sapiens; identical to SEQ ID NO: 39536

SEQ ID NO: 202197 - RNA, 64 nt, Homo Sapiens; identical to SEQ ID NO: 39537

SEQ ID NO: 202198 - RNA, 64 nt, Homo Sapiens; identical to SEQ ID NO: 39538

SEQ ID NO: 202199 - RNA, 64 nt, Homo Sapiens; identical to SEQ ID NO: 39539

SEQ ID NO: 202200 - RNA, 64 nt, Homo Sapiens; identical to SEQ ID NO: 39540

SEQ ID NO: 202201 - RNA, 64 nt, Homo Sapiens; identical to SEQ ID NO: 39541

SEQ ID NO: 202202 - RNA, 64 nt, Homo Sapiens; identical to SEQ ID NO: 39542

SEQ ID NO: 202203 - RNA, 64 nt, Homo Sapiens; identical to SEQ ID NO: 39543

SEQ ID NO: 202204 - RNA, 64 nt, Homo Sapiens; identical to SEQ ID NO: 39544

SEQ ID NO: 202205 - RNA, 64 nt, Homo Sapiens; identical to SEQ ID NO: 39545

SEQ ID NO: 202206 - RNA, 64 nt, Homo Sapiens; identical to SEQ ID NO: 39546

SEQ ID NO: 202207 - RNA, 64 nt, Homo Sapiens; identical to SEQ ID NO: 39547

SEQ ID NO: 202208 - RNA, 64 nt, Homo Sapiens; identical to SEQ ID NO: 39548

SEQ ID NO: 202209 - RNA, 64 nt, Homo Sapiens; identical to SEQ ID NO: 39549

SEQ ID NO: 202210 - RNA, 64 nt, Homo Sapiens; identical to SEQ ID NO: 39550

SEQ ID NO: 202211 - RNA, 64 nt, Homo Sapiens; identical to SEQ ID NO: 39551

SEQ ID NO: 202212 - RNA, 64 nt, Homo Sapiens; identical to SEQ ID NO: 39552

SEQ ID NO: 202213 - RNA, 64 nt, Homo Sapiens; identical to SEQ ID NO: 39553

SEQ ID NO: 202214 - RNA, 64 nt, Homo Sapiens; identical to SEQ ID NO: 39554

SEQ ID NO: 202215 - RNA, 64 nt, Homo Sapiens; identical to SEQ ID NO: 39555

SEQ ID NO: 202216 - RNA, 64 nt, Homo Sapiens; identical to SEQ ID NO: 39556

SEQ ID NO: 202217 - RNA, 64 nt, Homo Sapiens; identical to SEQ ID NO: 39557

SEQ ID NO: 202218 - RNA, 64 nt, Homo Sapiens; identical to SEQ ID NO: 39558

SEQ ID NO: 202219 - RNA, 64 nt, Homo Sapiens; identical to SEQ ID NO: 39559

SEQ ID NO: 202220 - RNA, 64 nt, Homo Sapiens; identical to SEQ ID NO: 39560

SEQ ID NO: 202221 - RNA, 64 nt, Homo Sapiens; identical to SEQ ID NO: 39561

SEQ ID NO: 202222 - RNA, 64 nt, Homo Sapiens; identical to SEQ ID NO: 39562

SEQ ID NO: 202223 - RNA, 64 nt, Homo Sapiens; identical to SEQ ID NO: 39563

SEQ ID NO: 202224 - RNA, 64 nt, Homo Sapiens; identical to SEQ ID NO: 39564

SEQ ID NO: 202225 - RNA, 64 nt, Homo Sapiens; identical to SEQ ID NO: 39565

SEQ ID NO: 202226 - RNA, 64 nt, Homo Sapiens; identical to SEQ ID NO: 39566

SEQ ID NO: 202227 - RNA, 64 nt, Homo Sapiens; identical to SEQ ID NO: 39567

SEQ ID NO: 202228 - RNA, 64 nt, Homo Sapiens; identical to SEQ ID NO: 39568

SEQ ID NO: 202229 - RNA, 64 nt, Homo Sapiens; identical to SEQ ID NO: 39569

SEQ ID NO: 202230 - RNA, 64 nt, Homo Sapiens; identical to SEQ ID NO: 39570

SEQ ID NO: 202231 - RNA, 64 nt, Homo Sapiens; identical to SEQ ID NO: 39571

SEQ ID NO: 202232 - RNA, 64 nt, Homo Sapiens; identical to SEQ ID NO: 39572

SEQ ID NO: 202233 - RNA, 64 nt, Homo Sapiens; identical to SEQ ID NO: 39573

SEQ ID NO: 202234 - RNA, 64 nt, Homo Sapiens; identical to SEQ ID NO: 39574

SEQ ID NO: 202235 - RNA, 64 nt, Homo Sapiens; identical to SEQ ID NO: 39575

SEQ ID NO: 202236 - RNA, 64 nt, Homo Sapiens; identical to SEQ ID NO: 39576

SEQ ID NO: 202237 - RNA, 64 nt, Homo Sapiens; identical to SEQ ID NO: 39577

SEQ ID NO: 202238 - RNA, 64 nt, Homo Sapiens; identical to SEQ ID NO: 39578

SEQ ID NO: 202239 - RNA, 64 nt, Homo Sapiens; identical to SEQ ID NO: 39579

SEQ ID NO: 202240 - RNA, 64 nt, Homo Sapiens; identical to SEQ ID NO: 39580

SEQ ID NO: 202241 - RNA, 64 nt, Homo Sapiens; identical to SEQ ID NO: 39581

SEQ ID NO: 202242 - RNA, 64 nt, Homo Sapiens; identical to SEQ ID NO: 39582

SEQ ID NO: 202243 - RNA, 64 nt, Homo Sapiens; identical to SEQ ID NO: 39583

SEQ ID NO: 202244 - RNA, 64 nt, Homo Sapiens; identical to SEQ ID NO: 39584

SEQ ID NO: 202245 - RNA, 64 nt, Homo Sapiens; identical to SEQ ID NO: 39585

SEQ ID NO: 202246 - RNA, 64 nt, Homo Sapiens; identical to SEQ ID NO: 39586

SEQ ID NO: 202247 - RNA, 64 nt, Homo Sapiens; identical to SEQ ID NO: 39587

SEQ ID NO: 202248 - RNA, 64 nt, Homo Sapiens; identical to SEQ ID NO: 39588

SEQ ID NO: 202249 - RNA, 64 nt, Homo Sapiens; identical to SEQ ID NO: 39589

SEQ ID NO: 202250 - RNA, 64 nt, Homo Sapiens; identical to SEQ ID NO: 39590

SEQ ID NO: 202251 - RNA, 64 nt, Homo Sapiens; identical to SEQ ID NO: 39591

SEQ ID NO: 202252 - RNA, 64 nt, Homo Sapiens; identical to SEQ ID NO: 39592

SEQ ID NO: 202253 - RNA, 64 nt, Homo Sapiens; identical to SEQ ID NO: 39593

SEQ ID NO: 202254 - RNA, 64 nt, Homo Sapiens; identical to SEQ ID NO: 39594

SEQ ID NO: 202255 - RNA, 64 nt, Homo Sapiens; identical to SEQ ID NO: 39595

SEQ ID NO: 202256 - RNA, 64 nt, Homo Sapiens; identical to SEQ ID NO: 39596

SEQ ID NO: 202257 - RNA, 64 nt, Homo Sapiens; identical to SEQ ID NO: 39597

SEQ ID NO: 202258 - RNA, 64 nt, Homo Sapiens; identical to SEQ ID NO: 39598

SEQ ID NO: 202259 - RNA, 64 nt, Homo Sapiens; identical to SEQ ID NO: 39599

SEQ ID NO: 202260 - RNA, 64 nt, Homo Sapiens; identical to SEQ ID NO: 39600

SEQ ID NO: 202261 - RNA, 64 nt, Homo Sapiens; identical to SEQ ID NO: 39601

SEQ ID NO: 202262 - RNA, 64 nt, Homo Sapiens; identical to SEQ ID NO: 39602

SEQ ID NO: 202263 - RNA, 64 nt, Homo Sapiens; identical to SEQ ID NO: 39603

SEQ ID NO: 202264 - RNA, 64 nt, Homo Sapiens; identical to SEQ ID NO: 39604

SEQ ID NO: 202265 - RNA, 64 nt, Homo Sapiens; identical to SEQ ID NO: 39605

SEQ ID NO: 202266 - RNA, 64 nt, Homo Sapiens; identical to SEQ ID NO: 39606

SEQ ID NO: 202267 - RNA, 64 nt, Homo Sapiens; identical to SEQ ID NO: 39607

SEQ ID NO: 202268 - RNA, 64 nt, Homo Sapiens; identical to SEQ ID NO: 39608

SEQ ID NO: 202269 - RNA, 64 nt, Homo Sapiens; identical to SEQ ID NO: 39609

SEQ ID NO: 202270 - RNA, 64 nt, Homo Sapiens; identical to SEQ ID NO: 39610

SEQ ID NO: 202271 - RNA, 64 nt, Homo Sapiens; identical to SEQ ID NO: 39611

SEQ ID NO: 202272 - RNA, 64 nt, Homo Sapiens; identical to SEQ ID NO: 39612

SEQ ID NO: 202273 - RNA, 64 nt, Homo Sapiens; identical to SEQ ID NO: 39613

SEQ ID NO: 202274 - RNA, 64 nt, Homo Sapiens; identical to SEQ ID NO: 39614

SEQ ID NO: 202275 - RNA, 64 nt, Homo Sapiens; identical to SEQ ID NO: 39615

SEQ ID NO: 202276 - RNA, 64 nt, Homo Sapiens; identical to SEQ ID NO: 39616

SEQ ID NO: 202277 - RNA, 64 nt, Homo Sapiens; identical to SEQ ID NO: 39617

SEQ ID NO: 202278 - RNA, 64 nt, Homo Sapiens; identical to SEQ ID NO: 39618

SEQ ID NO: 202279 - RNA, 64 nt, Homo Sapiens; identical to SEQ ID NO: 39619

SEQ ID NO: 202280 - RNA, 64 nt, Homo Sapiens; identical to SEQ ID NO: 39620

SEQ ID NO: 202281 - RNA, 64 nt, Homo Sapiens; identical to SEQ ID NO: 39621

SEQ ID NO: 202282 - RNA, 64 nt, Homo Sapiens; identical to SEQ ID NO: 39622

SEQ ID NO: 202283 - RNA, 64 nt, Homo Sapiens; identical to SEQ ID NO: 39623

SEQ ID NO: 202284 - RNA, 64 nt, Homo Sapiens; identical to SEQ ID NO: 39624

SEQ ID NO: 202285 - RNA, 64 nt, Homo Sapiens; identical to SEQ ID NO: 39625

SEQ ID NO: 202286 - RNA, 64 nt, Homo Sapiens; identical to SEQ ID NO: 39626

SEQ ID NO: 202287 - RNA, 64 nt, Homo Sapiens; identical to SEQ ID NO: 39627

SEQ ID NO: 202288 - RNA, 64 nt, Homo Sapiens; identical to SEQ ID NO: 39628

SEQ ID NO: 202289 - RNA, 64 nt, Homo Sapiens; identical to SEQ ID NO: 39629

SEQ ID NO: 202290 - RNA, 64 nt, Homo Sapiens; identical to SEQ ID NO: 39630

SEQ ID NO: 202291 - RNA, 64 nt, Homo Sapiens; identical to SEQ ID NO: 39631

SEQ ID NO: 202292 - RNA, 64 nt, Homo Sapiens; identical to SEQ ID NO: 39632

SEQ ID NO: 202293 - RNA, 64 nt, Homo Sapiens; identical to SEQ ID NO: 39633

SEQ ID NO: 202294 - RNA, 64 nt, Homo Sapiens; identical to SEQ ID NO: 39634

SEQ ID NO: 202295 - RNA, 64 nt, Homo Sapiens; identical to SEQ ID NO: 39635

SEQ ID NO: 202296 - RNA, 64 nt, Homo Sapiens; identical to SEQ ID NO: 39636

SEQ ID NO: 202297 - RNA, 64 nt, Homo Sapiens; identical to SEQ ID NO: 39637

SEQ ID NO: 202298 - RNA, 64 nt, Homo Sapiens; identical to SEQ ID NO: 39638

SEQ ID NO: 202299 - RNA, 64 nt, Homo Sapiens; identical to SEQ ID NO: 39639

SEQ ID NO: 202300 - RNA, 64 nt, Homo Sapiens; identical to SEQ ID NO: 39640

SEQ ID NO: 202301 - RNA, 64 nt, Homo Sapiens; identical to SEQ ID NO: 39641

SEQ ID NO: 202302 - RNA, 64 nt, Homo Sapiens; identical to SEQ ID NO: 39642

SEQ ID NO: 202303 - RNA, 64 nt, Homo Sapiens; identical to SEQ ID NO: 39643

SEQ ID NO: 202304 - RNA, 64 nt, Homo Sapiens; identical to SEQ ID NO: 39644

SEQ ID NO: 202305 - RNA, 64 nt, Homo Sapiens; identical to SEQ ID NO: 39645

SEQ ID NO: 202306 - RNA, 64 nt, Homo Sapiens; identical to SEQ ID NO: 39646

SEQ ID NO: 202307 - RNA, 64 nt, Homo Sapiens; identical to SEQ ID NO: 39647

SEQ ID NO: 202308 - RNA, 64 nt, Homo Sapiens; identical to SEQ ID NO: 39648

SEQ ID NO: 202309 - RNA, 64 nt, Homo Sapiens; identical to SEQ ID NO: 39649

SEQ ID NO: 202310 - RNA, 64 nt, Homo Sapiens; identical to SEQ ID NO: 39650

SEQ ID NO: 202311 - RNA, 64 nt, Homo Sapiens; identical to SEQ ID NO: 39651

SEQ ID NO: 202312 - RNA, 64 nt, Homo Sapiens; identical to SEQ ID NO: 39652

SEQ ID NO: 202313 - RNA, 64 nt, Homo Sapiens; identical to SEQ ID NO: 39653

SEQ ID NO: 202314 - RNA, 64 nt, Homo Sapiens; identical to SEQ ID NO: 39654

SEQ ID NO: 202315 - RNA, 64 nt, Homo Sapiens; identical to SEQ ID NO: 39655

SEQ ID NO: 202316 - RNA, 64 nt, Homo Sapiens; identical to SEQ ID NO: 39656

SEQ ID NO: 202317 - RNA, 64 nt, Homo Sapiens; identical to SEQ ID NO: 39657

SEQ ID NO: 202318 - RNA, 64 nt, Homo Sapiens; identical to SEQ ID NO: 39658

SEQ ID NO: 202319 - RNA, 64 nt, Homo Sapiens; identical to SEQ ID NO: 39659

SEQ ID NO: 202320 - RNA, 64 nt, Homo Sapiens; identical to SEQ ID NO: 39660

SEQ ID NO: 202321 - RNA, 64 nt, Homo Sapiens; identical to SEQ ID NO: 39661

SEQ ID NO: 202322 - RNA, 64 nt, Homo Sapiens; identical to SEQ ID NO: 39662

SEQ ID NO: 202323 - RNA, 64 nt, Homo Sapiens; identical to SEQ ID NO: 39663

SEQ ID NO: 202324 - RNA, 64 nt, Homo Sapiens; identical to SEQ ID NO: 39664

SEQ ID NO: 202325 - RNA, 64 nt, Homo Sapiens; identical to SEQ ID NO: 39665

SEQ ID NO: 202326 - RNA, 64 nt, Homo Sapiens; identical to SEQ ID NO: 39666

SEQ ID NO: 202327 - RNA, 64 nt, Homo Sapiens; identical to SEQ ID NO: 39667

SEQ ID NO: 202328 - RNA, 64 nt, Homo Sapiens; identical to SEQ ID NO: 39668

SEQ ID NO: 202329 - RNA, 64 nt, Homo Sapiens; identical to SEQ ID NO: 39669

SEQ ID NO: 202330 - RNA, 64 nt, Homo Sapiens; identical to SEQ ID NO: 39670

SEQ ID NO: 202331 - RNA, 64 nt, Homo Sapiens; identical to SEQ ID NO: 39671

SEQ ID NO: 202332 - RNA, 64 nt, Homo Sapiens; identical to SEQ ID NO: 39672

SEQ ID NO: 202333 - RNA, 64 nt, Homo Sapiens; identical to SEQ ID NO: 39673

SEQ ID NO: 202334 - RNA, 64 nt, Homo Sapiens; identical to SEQ ID NO: 39674

SEQ ID NO: 202335 - RNA, 64 nt, Homo Sapiens; identical to SEQ ID NO: 39675

SEQ ID NO: 202336 - RNA, 64 nt, Homo Sapiens; identical to SEQ ID NO: 39676

SEQ ID NO: 202337 - RNA, 64 nt, Homo Sapiens; identical to SEQ ID NO: 39677

SEQ ID NO: 202338 - RNA, 64 nt, Homo Sapiens; identical to SEQ ID NO: 39678

SEQ ID NO: 202339 - RNA, 64 nt, Homo Sapiens; identical to SEQ ID NO: 39679

SEQ ID NO: 202340 - RNA, 64 nt, Homo Sapiens; identical to SEQ ID NO: 39680

SEQ ID NO: 202341 - RNA, 64 nt, Homo Sapiens; identical to SEQ ID NO: 39681

SEQ ID NO: 202342 - RNA, 64 nt, Homo Sapiens; identical to SEQ ID NO: 39682

SEQ ID NO: 202343 - RNA, 64 nt, Homo Sapiens; identical to SEQ ID NO: 39683

SEQ ID NO: 202344 - RNA, 64 nt, Homo Sapiens; identical to SEQ ID NO: 39684

SEQ ID NO: 202345 - RNA, 64 nt, Homo Sapiens; identical to SEQ ID NO: 39685

SEQ ID NO: 202346 - RNA, 64 nt, Homo Sapiens; identical to SEQ ID NO: 39686

SEQ ID NO: 202347 - RNA, 64 nt, Homo Sapiens; identical to SEQ ID NO: 39687

SEQ ID NO: 202348 - RNA, 64 nt, Homo Sapiens; identical to SEQ ID NO: 39688

SEQ ID NO: 202349 - RNA, 64 nt, Homo Sapiens; identical to SEQ ID NO: 39689

SEQ ID NO: 202350 - RNA, 64 nt, Homo Sapiens; identical to SEQ ID NO: 39690

SEQ ID NO: 202351 - RNA, 64 nt, Homo Sapiens; identical to SEQ ID NO: 39691

SEQ ID NO: 202352 - RNA, 64 nt, Homo Sapiens; identical to SEQ ID NO: 39692

SEQ ID NO: 202353 - RNA, 64 nt, Homo Sapiens; identical to SEQ ID NO: 39693

SEQ ID NO: 202354 - RNA, 64 nt, Homo Sapiens; identical to SEQ ID NO: 39694

SEQ ID NO: 202355 - RNA, 64 nt, Homo Sapiens; identical to SEQ ID NO: 39695

SEQ ID NO: 202356 - RNA, 64 nt, Homo Sapiens; identical to SEQ ID NO: 39696

SEQ ID NO: 202357 - RNA, 64 nt, Homo Sapiens; identical to SEQ ID NO: 39697

SEQ ID NO: 202358 - RNA, 64 nt, Homo Sapiens; identical to SEQ ID NO: 39698

SEQ ID NO: 202359 - RNA, 64 nt, Homo Sapiens; identical to SEQ ID NO: 39699

SEQ ID NO: 202360 - RNA, 64 nt, Homo Sapiens; identical to SEQ ID NO: 39700

SEQ ID NO: 202361 - RNA, 64 nt, Homo Sapiens; identical to SEQ ID NO: 39701

SEQ ID NO: 202362 - RNA, 64 nt, Homo Sapiens; identical to SEQ ID NO: 39702

SEQ ID NO: 202363 - RNA, 64 nt, Homo Sapiens; identical to SEQ ID NO: 39703

SEQ ID NO: 202364 - RNA, 64 nt, Homo Sapiens; identical to SEQ ID NO: 39704

SEQ ID NO: 202365 - RNA, 64 nt, Homo Sapiens; identical to SEQ ID NO: 39705

SEQ ID NO: 202366 - RNA, 64 nt, Homo Sapiens; identical to SEQ ID NO: 39706

SEQ ID NO: 202367 - RNA, 64 nt, Homo Sapiens; identical to SEQ ID NO: 39707

SEQ ID NO: 202368 - RNA, 64 nt, Homo Sapiens; identical to SEQ ID NO: 39708

SEQ ID NO: 202369 - RNA, 64 nt, Homo Sapiens; identical to SEQ ID NO: 39709

SEQ ID NO: 202370 - RNA, 64 nt, Homo Sapiens; identical to SEQ ID NO: 39710

SEQ ID NO: 202371 - RNA, 64 nt, Homo Sapiens; identical to SEQ ID NO: 39711

SEQ ID NO: 202372 - RNA, 64 nt, Homo Sapiens; identical to SEQ ID NO: 39712

SEQ ID NO: 202373 - RNA, 64 nt, Homo Sapiens; identical to SEQ ID NO: 39713

SEQ ID NO: 202374 - RNA, 64 nt, Homo Sapiens; identical to SEQ ID NO: 39714

SEQ ID NO: 202375 - RNA, 64 nt, Homo Sapiens; identical to SEQ ID NO: 39715

SEQ ID NO: 202376 - RNA, 64 nt, Homo Sapiens; identical to SEQ ID NO: 39716

SEQ ID NO: 202377 - RNA, 64 nt, Homo Sapiens; identical to SEQ ID NO: 39717

SEQ ID NO: 202378 - RNA, 64 nt, Homo Sapiens; identical to SEQ ID NO: 39718

SEQ ID NO: 202379 - RNA, 64 nt, Homo Sapiens; identical to SEQ ID NO: 39719

SEQ ID NO: 202380 - RNA, 64 nt, Homo Sapiens; identical to SEQ ID NO: 39720

SEQ ID NO: 202381 - RNA, 64 nt, Homo Sapiens; identical to SEQ ID NO: 39721

SEQ ID NO: 202382 - RNA, 64 nt, Homo Sapiens; identical to SEQ ID NO: 39722

SEQ ID NO: 202383 - RNA, 64 nt, Homo Sapiens; identical to SEQ ID NO: 39723

SEQ ID NO: 202384 - RNA, 64 nt, Homo Sapiens; identical to SEQ ID NO: 39724

SEQ ID NO: 202385 - RNA, 64 nt, Homo Sapiens; identical to SEQ ID NO: 39725

SEQ ID NO: 202386 - RNA, 64 nt, Homo Sapiens; identical to SEQ ID NO: 39726

SEQ ID NO: 202387 - RNA, 64 nt, Homo Sapiens; identical to SEQ ID NO: 39727

SEQ ID NO: 202388 - RNA, 64 nt, Homo Sapiens; identical to SEQ ID NO: 39728

SEQ ID NO: 202389 - RNA, 64 nt, Homo Sapiens; identical to SEQ ID NO: 39729

SEQ ID NO: 202390 - RNA, 64 nt, Homo Sapiens; identical to SEQ ID NO: 39730

SEQ ID NO: 202391 - RNA, 64 nt, Homo Sapiens; identical to SEQ ID NO: 39731

SEQ ID NO: 202392 - RNA, 64 nt, Homo Sapiens; identical to SEQ ID NO: 39732

SEQ ID NO: 202393 - RNA, 64 nt, Homo Sapiens; identical to SEQ ID NO: 39733

SEQ ID NO: 202394 - RNA, 64 nt, Homo Sapiens; identical to SEQ ID NO: 39734

SEQ ID NO: 202395 - RNA, 64 nt, Homo Sapiens; identical to SEQ ID NO: 39735

SEQ ID NO: 202396 - RNA, 64 nt, Homo Sapiens; identical to SEQ ID NO: 39736

SEQ ID NO: 202397 - RNA, 64 nt, Homo Sapiens; identical to SEQ ID NO: 39737

SEQ ID NO: 202398 - RNA, 64 nt, Homo Sapiens; identical to SEQ ID NO: 39738

SEQ ID NO: 202399 - RNA, 64 nt, Homo Sapiens; identical to SEQ ID NO: 39739

SEQ ID NO: 202400 - RNA, 64 nt, Homo Sapiens; identical to SEQ ID NO: 39740

SEQ ID NO: 202401 - RNA, 64 nt, Homo Sapiens; identical to SEQ ID NO: 39741

SEQ ID NO: 202402 - RNA, 64 nt, Homo Sapiens; identical to SEQ ID NO: 39742

SEQ ID NO: 202403 - RNA, 64 nt, Homo Sapiens; identical to SEQ ID NO: 39743

SEQ ID NO: 202404 - RNA, 64 nt, Homo Sapiens; identical to SEQ ID NO: 39744

SEQ ID NO: 202405 - RNA, 64 nt, Homo Sapiens; identical to SEQ ID NO: 39745

SEQ ID NO: 202406 - RNA, 64 nt, Homo Sapiens; identical to SEQ ID NO: 39746

SEQ ID NO: 202407 - RNA, 64 nt, Homo Sapiens; identical to SEQ ID NO: 39747

SEQ ID NO: 202408 - RNA, 64 nt, Homo Sapiens; identical to SEQ ID NO: 39748

SEQ ID NO: 202409 - RNA, 64 nt, Homo Sapiens; identical to SEQ ID NO: 39749

SEQ ID NO: 202410 - RNA, 64 nt, Homo Sapiens; identical to SEQ ID NO: 39750

SEQ ID NO: 202411 - RNA, 64 nt, Homo Sapiens; identical to SEQ ID NO: 39751

SEQ ID NO: 202412 - RNA, 64 nt, Homo Sapiens; identical to SEQ ID NO: 39752

SEQ ID NO: 202413 - RNA, 64 nt, Homo Sapiens; identical to SEQ ID NO: 39753

SEQ ID NO: 202414 - RNA, 64 nt, Homo Sapiens; identical to SEQ ID NO: 39754

SEQ ID NO: 202415 - RNA, 64 nt, Homo Sapiens; identical to SEQ ID NO: 39755

SEQ ID NO: 202416 - RNA, 64 nt, Homo Sapiens; identical to SEQ ID NO: 39756

SEQ ID NO: 202417 - RNA, 64 nt, Homo Sapiens; identical to SEQ ID NO: 39757

SEQ ID NO: 202418 - RNA, 64 nt, Homo Sapiens; identical to SEQ ID NO: 39758

SEQ ID NO: 202419 - RNA, 64 nt, Homo Sapiens; identical to SEQ ID NO: 39759

SEQ ID NO: 202420 - RNA, 64 nt, Homo Sapiens; identical to SEQ ID NO: 39760

SEQ ID NO: 202421 - RNA, 64 nt, Homo Sapiens; identical to SEQ ID NO: 39761

SEQ ID NO: 202422 - RNA, 64 nt, Homo Sapiens; identical to SEQ ID NO: 39762

SEQ ID NO: 202423 - RNA, 64 nt, Homo Sapiens; identical to SEQ ID NO: 39763

SEQ ID NO: 202424 - RNA, 64 nt, Homo Sapiens; identical to SEQ ID NO: 39764

SEQ ID NO: 202425 - RNA, 64 nt, Homo Sapiens; identical to SEQ ID NO: 39765

SEQ ID NO: 202426 - RNA, 64 nt, Homo Sapiens; identical to SEQ ID NO: 39766

SEQ ID NO: 202427 - RNA, 64 nt, Homo Sapiens; identical to SEQ ID NO: 39767

SEQ ID NO: 202428 - RNA, 64 nt, Homo Sapiens; identical to SEQ ID NO: 39768

SEQ ID NO: 202429 - RNA, 64 nt, Homo Sapiens; identical to SEQ ID NO: 39769

SEQ ID NO: 202430 - RNA, 64 nt, Homo Sapiens; identical to SEQ ID NO: 39770

SEQ ID NO: 202431 - RNA, 64 nt, Homo Sapiens; identical to SEQ ID NO: 39771

SEQ ID NO: 202432 - RNA, 64 nt, Homo Sapiens; identical to SEQ ID NO: 39772

SEQ ID NO: 202433 - RNA, 64 nt, Homo Sapiens; identical to SEQ ID NO: 39773

SEQ ID NO: 202434 - RNA, 64 nt, Homo Sapiens; identical to SEQ ID NO: 39774

SEQ ID NO: 202435 - RNA, 64 nt, Homo Sapiens; identical to SEQ ID NO: 39775

SEQ ID NO: 202436 - RNA, 64 nt, Homo Sapiens; identical to SEQ ID NO: 39776

SEQ ID NO: 202437 - RNA, 64 nt, Homo Sapiens; identical to SEQ ID NO: 39777

SEQ ID NO: 202438 - RNA, 64 nt, Homo Sapiens; identical to SEQ ID NO: 39778

SEQ ID NO: 202439 - RNA, 64 nt, Homo Sapiens; identical to SEQ ID NO: 39779

SEQ ID NO: 202440 - RNA, 64 nt, Homo Sapiens; identical to SEQ ID NO: 39780

SEQ ID NO: 202441 - RNA, 64 nt, Homo Sapiens; identical to SEQ ID NO: 39781

SEQ ID NO: 202442 - RNA, 64 nt, Homo Sapiens; identical to SEQ ID NO: 39782

SEQ ID NO: 202443 - RNA, 64 nt, Homo Sapiens; identical to SEQ ID NO: 39783

SEQ ID NO: 202444 - RNA, 64 nt, Homo Sapiens; identical to SEQ ID NO: 39784

SEQ ID NO: 202445 - RNA, 64 nt, Homo Sapiens; identical to SEQ ID NO: 39785

SEQ ID NO: 202446 - RNA, 64 nt, Homo Sapiens; identical to SEQ ID NO: 39786

SEQ ID NO: 202447 - RNA, 64 nt, Homo Sapiens; identical to SEQ ID NO: 39787

SEQ ID NO: 202448 - RNA, 64 nt, Homo Sapiens; identical to SEQ ID NO: 39788

SEQ ID NO: 202449 - RNA, 64 nt, Homo Sapiens; identical to SEQ ID NO: 39789

SEQ ID NO: 202450 - RNA, 64 nt, Homo Sapiens; identical to SEQ ID NO: 39790

SEQ ID NO: 202451 - RNA, 64 nt, Homo Sapiens; identical to SEQ ID NO: 39791

SEQ ID NO: 202452 - RNA, 64 nt, Homo Sapiens; identical to SEQ ID NO: 39792

SEQ ID NO: 202453 - RNA, 64 nt, Homo Sapiens; identical to SEQ ID NO: 39793

SEQ ID NO: 202454 - RNA, 64 nt, Homo Sapiens; identical to SEQ ID NO: 39794

SEQ ID NO: 202455 - RNA, 64 nt, Homo Sapiens; identical to SEQ ID NO: 39795

SEQ ID NO: 202456 - RNA, 64 nt, Homo Sapiens; identical to SEQ ID NO: 39796

SEQ ID NO: 202457 - RNA, 64 nt, Homo Sapiens; identical to SEQ ID NO: 39797

SEQ ID NO: 202458 - RNA, 64 nt, Homo Sapiens; identical to SEQ ID NO: 39798

SEQ ID NO: 202459 - RNA, 64 nt, Homo Sapiens; identical to SEQ ID NO: 39799

SEQ ID NO: 202460 - RNA, 64 nt, Homo Sapiens; identical to SEQ ID NO: 39800

SEQ ID NO: 202461 - RNA, 64 nt, Homo Sapiens; identical to SEQ ID NO: 39801

SEQ ID NO: 202462 - RNA, 64 nt, Homo Sapiens; identical to SEQ ID NO: 39802

SEQ ID NO: 202463 - RNA, 64 nt, Homo Sapiens; identical to SEQ ID NO: 39803

SEQ ID NO: 202464 - RNA, 64 nt, Homo Sapiens; identical to SEQ ID NO: 39804

SEQ ID NO: 202465 - RNA, 64 nt, Homo Sapiens; identical to SEQ ID NO: 39805

SEQ ID NO: 202466 - RNA, 64 nt, Homo Sapiens; identical to SEQ ID NO: 39806

SEQ ID NO: 202467 - RNA, 64 nt, Homo Sapiens; identical to SEQ ID NO: 39807

SEQ ID NO: 202468 - RNA, 64 nt, Homo Sapiens; identical to SEQ ID NO: 39808

SEQ ID NO: 202469 - RNA, 64 nt, Homo Sapiens; identical to SEQ ID NO: 39809

SEQ ID NO: 202470 - RNA, 64 nt, Homo Sapiens; identical to SEQ ID NO: 39810

SEQ ID NO: 202471 - RNA, 64 nt, Homo Sapiens; identical to SEQ ID NO: 39811

SEQ ID NO: 202472 - RNA, 64 nt, Homo Sapiens; identical to SEQ ID NO: 39812

SEQ ID NO: 202473 - RNA, 64 nt, Homo Sapiens; identical to SEQ ID NO: 39813

SEQ ID NO: 202474 - RNA, 64 nt, Homo Sapiens; identical to SEQ ID NO: 39814

SEQ ID NO: 202475 - RNA, 64 nt, Homo Sapiens; identical to SEQ ID NO: 39815

SEQ ID NO: 202476 - RNA, 64 nt, Homo Sapiens; identical to SEQ ID NO: 39816

SEQ ID NO: 202477 - RNA, 64 nt, Homo Sapiens; identical to SEQ ID NO: 39817

SEQ ID NO: 202478 - RNA, 64 nt, Homo Sapiens; identical to SEQ ID NO: 39818

SEQ ID NO: 202479 - RNA, 64 nt, Homo Sapiens; identical to SEQ ID NO: 39819

SEQ ID NO: 202480 - RNA, 64 nt, Homo Sapiens; identical to SEQ ID NO: 39820

SEQ ID NO: 202481 - RNA, 64 nt, Homo Sapiens; identical to SEQ ID NO: 39821

SEQ ID NO: 202482 - RNA, 64 nt, Homo Sapiens; identical to SEQ ID NO: 39822

SEQ ID NO: 202483 - RNA, 64 nt, Homo Sapiens; identical to SEQ ID NO: 39823

SEQ ID NO: 202484 - RNA, 64 nt, Homo Sapiens; identical to SEQ ID NO: 39824

SEQ ID NO: 202485 - RNA, 64 nt, Homo Sapiens; identical to SEQ ID NO: 39825

SEQ ID NO: 202486 - RNA, 64 nt, Homo Sapiens; identical to SEQ ID NO: 39826

SEQ ID NO: 202487 - RNA, 64 nt, Homo Sapiens; identical to SEQ ID NO: 39827

SEQ ID NO: 202488 - RNA, 64 nt, Homo Sapiens; identical to SEQ ID NO: 39828

SEQ ID NO: 202489 - RNA, 64 nt, Homo Sapiens; identical to SEQ ID NO: 39829

SEQ ID NO: 202490 - RNA, 64 nt, Homo Sapiens; identical to SEQ ID NO: 39830

SEQ ID NO: 202491 - RNA, 64 nt, Homo Sapiens; identical to SEQ ID NO: 39831

SEQ ID NO: 202492 - RNA, 64 nt, Homo Sapiens; identical to SEQ ID NO: 39832

SEQ ID NO: 202493 - RNA, 64 nt, Homo Sapiens; identical to SEQ ID NO: 39833

SEQ ID NO: 202494 - RNA, 64 nt, Homo Sapiens; identical to SEQ ID NO: 39834

SEQ ID NO: 202495 - RNA, 64 nt, Homo Sapiens; identical to SEQ ID NO: 39835

SEQ ID NO: 202496 - RNA, 64 nt, Homo Sapiens; identical to SEQ ID NO: 39836

SEQ ID NO: 202497 - RNA, 64 nt, Homo Sapiens; identical to SEQ ID NO: 39837

SEQ ID NO: 202498 - RNA, 64 nt, Homo Sapiens; identical to SEQ ID NO: 39838

SEQ ID NO: 202499 - RNA, 64 nt, Homo Sapiens; identical to SEQ ID NO: 39839

SEQ ID NO: 202500 - RNA, 64 nt, Homo Sapiens; identical to SEQ ID NO: 39840

SEQ ID NO: 202501 - RNA, 64 nt, Homo Sapiens; identical to SEQ ID NO: 39841

SEQ ID NO: 202502 - RNA, 64 nt, Homo Sapiens; identical to SEQ ID NO: 39842

SEQ ID NO: 202503 - RNA, 64 nt, Homo Sapiens; identical to SEQ ID NO: 39843

SEQ ID NO: 202504 - RNA, 64 nt, Homo Sapiens; identical to SEQ ID NO: 39844

SEQ ID NO: 202505 - RNA, 64 nt, Homo Sapiens; identical to SEQ ID NO: 39845

SEQ ID NO: 202506 - RNA, 64 nt, Homo Sapiens; identical to SEQ ID NO: 39846

SEQ ID NO: 202507 - RNA, 64 nt, Homo Sapiens; identical to SEQ ID NO: 39847

SEQ ID NO: 202508 - RNA, 64 nt, Homo Sapiens; identical to SEQ ID NO: 39848

SEQ ID NO: 202509 - RNA, 64 nt, Homo Sapiens; identical to SEQ ID NO: 39849

SEQ ID NO: 202510 - RNA, 64 nt, Homo Sapiens; identical to SEQ ID NO: 39850

SEQ ID NO: 202511 - RNA, 64 nt, Homo Sapiens; identical to SEQ ID NO: 39851

SEQ ID NO: 202512 - RNA, 64 nt, Homo Sapiens; identical to SEQ ID NO: 39852

SEQ ID NO: 202513 - RNA, 64 nt, Homo Sapiens; identical to SEQ ID NO: 39853

SEQ ID NO: 202514 - RNA, 64 nt, Homo Sapiens; identical to SEQ ID NO: 39854

SEQ ID NO: 202515 - RNA, 64 nt, Homo Sapiens; identical to SEQ ID NO: 39855

SEQ ID NO: 202516 - RNA, 64 nt, Homo Sapiens; identical to SEQ ID NO: 39856

SEQ ID NO: 202517 - RNA, 64 nt, Homo Sapiens; identical to SEQ ID NO: 39857

SEQ ID NO: 202518 - RNA, 64 nt, Homo Sapiens; identical to SEQ ID NO: 39858

SEQ ID NO: 202519 - RNA, 64 nt, Homo Sapiens; identical to SEQ ID NO: 39859

SEQ ID NO: 202520 - RNA, 64 nt, Homo Sapiens; identical to SEQ ID NO: 39860

SEQ ID NO: 202521 - RNA, 64 nt, Homo Sapiens; identical to SEQ ID NO: 39861

SEQ ID NO: 202522 - RNA, 64 nt, Homo Sapiens; identical to SEQ ID NO: 39862

SEQ ID NO: 202523 - RNA, 64 nt, Homo Sapiens; identical to SEQ ID NO: 39863

SEQ ID NO: 202524 - RNA, 64 nt, Homo Sapiens; identical to SEQ ID NO: 39864

SEQ ID NO: 202525 - RNA, 64 nt, Homo Sapiens; identical to SEQ ID NO: 39865

SEQ ID NO: 202526 - RNA, 64 nt, Homo Sapiens; identical to SEQ ID NO: 39866

SEQ ID NO: 202527 - RNA, 64 nt, Homo Sapiens; identical to SEQ ID NO: 39867

SEQ ID NO: 202528 - RNA, 64 nt, Homo Sapiens; identical to SEQ ID NO: 39868

SEQ ID NO: 202529 - RNA, 64 nt, Homo Sapiens; identical to SEQ ID NO: 39869

SEQ ID NO: 202530 - RNA, 64 nt, Homo Sapiens; identical to SEQ ID NO: 39870

SEQ ID NO: 202531 - RNA, 64 nt, Homo Sapiens; identical to SEQ ID NO: 39871

SEQ ID NO: 202532 - RNA, 64 nt, Homo Sapiens; identical to SEQ ID NO: 39872

SEQ ID NO: 202533 - RNA, 64 nt, Homo Sapiens; identical to SEQ ID NO: 39873

SEQ ID NO: 202534 - RNA, 64 nt, Homo Sapiens; identical to SEQ ID NO: 39874

SEQ ID NO: 202535 - RNA, 64 nt, Homo Sapiens; identical to SEQ ID NO: 39875

SEQ ID NO: 202536 - RNA, 64 nt, Homo Sapiens; identical to SEQ ID NO: 39876

SEQ ID NO: 202537 - RNA, 64 nt, Homo Sapiens; identical to SEQ ID NO: 39877

SEQ ID NO: 202538 - RNA, 64 nt, Homo Sapiens; identical to SEQ ID NO: 39878

SEQ ID NO: 202539 - RNA, 64 nt, Homo Sapiens; identical to SEQ ID NO: 39879

SEQ ID NO: 202540 - RNA, 64 nt, Homo Sapiens; identical to SEQ ID NO: 39880

SEQ ID NO: 202541 - RNA, 64 nt, Homo Sapiens; identical to SEQ ID NO: 39881

SEQ ID NO: 202542 - RNA, 64 nt, Homo Sapiens; identical to SEQ ID NO: 39882

SEQ ID NO: 202543 - RNA, 64 nt, Homo Sapiens; identical to SEQ ID NO: 39883

SEQ ID NO: 202544 - RNA, 64 nt, Homo Sapiens; identical to SEQ ID NO: 39884

SEQ ID NO: 202545 - RNA, 64 nt, Homo Sapiens; identical to SEQ ID NO: 39885

SEQ ID NO: 202546 - RNA, 64 nt, Homo Sapiens; identical to SEQ ID NO: 39886

SEQ ID NO: 202547 - RNA, 64 nt, Homo Sapiens; identical to SEQ ID NO: 39887

SEQ ID NO: 202548 - RNA, 64 nt, Homo Sapiens; identical to SEQ ID NO: 39888

SEQ ID NO: 202549 - RNA, 64 nt, Homo Sapiens; identical to SEQ ID NO: 39889

SEQ ID NO: 202550 - RNA, 64 nt, Homo Sapiens; identical to SEQ ID NO: 39890

SEQ ID NO: 202551 - RNA, 64 nt, Homo Sapiens; identical to SEQ ID NO: 39891

SEQ ID NO: 202552 - RNA, 64 nt, Homo Sapiens; identical to SEQ ID NO: 39892

SEQ ID NO: 202553 - RNA, 64 nt, Homo Sapiens; identical to SEQ ID NO: 39893

SEQ ID NO: 202554 - RNA, 64 nt, Homo Sapiens; identical to SEQ ID NO: 39894

SEQ ID NO: 202555 - RNA, 64 nt, Homo Sapiens; identical to SEQ ID NO: 39895

SEQ ID NO: 202556 - RNA, 64 nt, Homo Sapiens; identical to SEQ ID NO: 39896

SEQ ID NO: 202557 - RNA, 64 nt, Homo Sapiens; identical to SEQ ID NO: 39897

SEQ ID NO: 202558 - RNA, 64 nt, Homo Sapiens; identical to SEQ ID NO: 39898

SEQ ID NO: 202559 - RNA, 64 nt, Homo Sapiens; identical to SEQ ID NO: 39899

SEQ ID NO: 202560 - RNA, 64 nt, Homo Sapiens; identical to SEQ ID NO: 39900

SEQ ID NO: 202561 - RNA, 64 nt, Homo Sapiens; identical to SEQ ID NO: 39901

SEQ ID NO: 202562 - RNA, 64 nt, Homo Sapiens; identical to SEQ ID NO: 39902

SEQ ID NO: 202563 - RNA, 64 nt, Homo Sapiens; identical to SEQ ID NO: 39903

SEQ ID NO: 202564 - RNA, 64 nt, Homo Sapiens; identical to SEQ ID NO: 39904

SEQ ID NO: 202565 - RNA, 64 nt, Homo Sapiens; identical to SEQ ID NO: 39905

SEQ ID NO: 202566 - RNA, 64 nt, Homo Sapiens; identical to SEQ ID NO: 39906

SEQ ID NO: 202567 - RNA, 64 nt, Homo Sapiens; identical to SEQ ID NO: 39907

SEQ ID NO: 202568 - RNA, 64 nt, Homo Sapiens; identical to SEQ ID NO: 39908

SEQ ID NO: 202569 - RNA, 64 nt, Homo Sapiens; identical to SEQ ID NO: 39909

SEQ ID NO: 202570 - RNA, 64 nt, Homo Sapiens; identical to SEQ ID NO: 39910

SEQ ID NO: 202571 - RNA, 64 nt, Homo Sapiens; identical to SEQ ID NO: 39911

SEQ ID NO: 202572 - RNA, 64 nt, Homo Sapiens; identical to SEQ ID NO: 39912

SEQ ID NO: 202573 - RNA, 64 nt, Homo Sapiens; identical to SEQ ID NO: 39913

SEQ ID NO: 202574 - RNA, 64 nt, Homo Sapiens; identical to SEQ ID NO: 39914

SEQ ID NO: 202575 - RNA, 64 nt, Homo Sapiens; identical to SEQ ID NO: 39915

SEQ ID NO: 202576 - RNA, 64 nt, Homo Sapiens; identical to SEQ ID NO: 39916

SEQ ID NO: 202577 - RNA, 64 nt, Homo Sapiens; identical to SEQ ID NO: 39917

SEQ ID NO: 202578 - RNA, 64 nt, Homo Sapiens; identical to SEQ ID NO: 39918

SEQ ID NO: 202579 - RNA, 64 nt, Homo Sapiens; identical to SEQ ID NO: 39919

SEQ ID NO: 202580 - RNA, 64 nt, Homo Sapiens; identical to SEQ ID NO: 39920

SEQ ID NO: 202581 - RNA, 64 nt, Homo Sapiens; identical to SEQ ID NO: 39921

SEQ ID NO: 202582 - RNA, 64 nt, Homo Sapiens; identical to SEQ ID NO: 39922

SEQ ID NO: 202583 - RNA, 64 nt, Homo Sapiens; identical to SEQ ID NO: 39923

SEQ ID NO: 202584 - RNA, 64 nt, Homo Sapiens; identical to SEQ ID NO: 39924

SEQ ID NO: 202585 - RNA, 64 nt, Homo Sapiens; identical to SEQ ID NO: 39925

SEQ ID NO: 202586 - RNA, 64 nt, Homo Sapiens; identical to SEQ ID NO: 39926

SEQ ID NO: 202587 - RNA, 64 nt, Homo Sapiens; identical to SEQ ID NO: 39927

SEQ ID NO: 202588 - RNA, 64 nt, Homo Sapiens; identical to SEQ ID NO: 39928

SEQ ID NO: 202589 - RNA, 64 nt, Homo Sapiens; identical to SEQ ID NO: 39929

SEQ ID NO: 202590 - RNA, 64 nt, Homo Sapiens; identical to SEQ ID NO: 39930

SEQ ID NO: 202591 - RNA, 64 nt, Homo Sapiens; identical to SEQ ID NO: 39931

SEQ ID NO: 202592 - RNA, 64 nt, Homo Sapiens; identical to SEQ ID NO: 39932

SEQ ID NO: 202593 - RNA, 64 nt, Homo Sapiens; identical to SEQ ID NO: 39933

SEQ ID NO: 202594 - RNA, 64 nt, Homo Sapiens; identical to SEQ ID NO: 39934

SEQ ID NO: 202595 - RNA, 64 nt, Homo Sapiens; identical to SEQ ID NO: 39935

SEQ ID NO: 202596 - RNA, 64 nt, Homo Sapiens; identical to SEQ ID NO: 39936

SEQ ID NO: 202597 - RNA, 64 nt, Homo Sapiens; identical to SEQ ID NO: 39937

SEQ ID NO: 202598 - RNA, 64 nt, Homo Sapiens; identical to SEQ ID NO: 39938

SEQ ID NO: 202599 - RNA, 64 nt, Homo Sapiens; identical to SEQ ID NO: 39939

SEQ ID NO: 202600 - RNA, 64 nt, Homo Sapiens; identical to SEQ ID NO: 39940

SEQ ID NO: 202601 - RNA, 64 nt, Homo Sapiens; identical to SEQ ID NO: 39941

SEQ ID NO: 202602 - RNA, 64 nt, Homo Sapiens; identical to SEQ ID NO: 39942

SEQ ID NO: 202603 - RNA, 64 nt, Homo Sapiens; identical to SEQ ID NO: 39943

SEQ ID NO: 202604 - RNA, 64 nt, Homo Sapiens; identical to SEQ ID NO: 39944

SEQ ID NO: 202605 - RNA, 64 nt, Homo Sapiens; identical to SEQ ID NO: 39945

SEQ ID NO: 202606 - RNA, 64 nt, Homo Sapiens; identical to SEQ ID NO: 39946

SEQ ID NO: 202607 - RNA, 64 nt, Homo Sapiens; identical to SEQ ID NO: 39947

SEQ ID NO: 202608 - RNA, 64 nt, Homo Sapiens; identical to SEQ ID NO: 39948

SEQ ID NO: 202609 - RNA, 64 nt, Homo Sapiens; identical to SEQ ID NO: 39949

SEQ ID NO: 202610 - RNA, 64 nt, Homo Sapiens; identical to SEQ ID NO: 39950

SEQ ID NO: 202611 - RNA, 64 nt, Homo Sapiens; identical to SEQ ID NO: 39951

SEQ ID NO: 202612 - RNA, 64 nt, Homo Sapiens; identical to SEQ ID NO: 39952

SEQ ID NO: 202613 - RNA, 64 nt, Homo Sapiens; identical to SEQ ID NO: 39953

SEQ ID NO: 202614 - RNA, 64 nt, Homo Sapiens; identical to SEQ ID NO: 39954

SEQ ID NO: 202615 - RNA, 64 nt, Homo Sapiens; identical to SEQ ID NO: 39955

SEQ ID NO: 202616 - RNA, 64 nt, Homo Sapiens; identical to SEQ ID NO: 39956

SEQ ID NO: 202617 - RNA, 64 nt, Homo Sapiens; identical to SEQ ID NO: 39957

SEQ ID NO: 202618 - RNA, 64 nt, Homo Sapiens; identical to SEQ ID NO: 39958

SEQ ID NO: 202619 - RNA, 64 nt, Homo Sapiens; identical to SEQ ID NO: 39959

SEQ ID NO: 202620 - RNA, 64 nt, Homo Sapiens; identical to SEQ ID NO: 39960

SEQ ID NO: 202621 - RNA, 64 nt, Homo Sapiens; identical to SEQ ID NO: 39961

SEQ ID NO: 202622 - RNA, 64 nt, Homo Sapiens; identical to SEQ ID NO: 39962

SEQ ID NO: 202623 - RNA, 64 nt, Homo Sapiens; identical to SEQ ID NO: 39963

SEQ ID NO: 202624 - RNA, 64 nt, Homo Sapiens; identical to SEQ ID NO: 39964

SEQ ID NO: 202625 - RNA, 64 nt, Homo Sapiens; identical to SEQ ID NO: 39965

SEQ ID NO: 202626 - RNA, 64 nt, Homo Sapiens; identical to SEQ ID NO: 39966

SEQ ID NO: 202627 - RNA, 64 nt, Homo Sapiens; identical to SEQ ID NO: 39967

SEQ ID NO: 202628 - RNA, 64 nt, Homo Sapiens; identical to SEQ ID NO: 39968

SEQ ID NO: 202629 - RNA, 64 nt, Homo Sapiens; identical to SEQ ID NO: 39969

SEQ ID NO: 202630 - RNA, 64 nt, Homo Sapiens; identical to SEQ ID NO: 39970

SEQ ID NO: 202631 - RNA, 64 nt, Homo Sapiens; identical to SEQ ID NO: 39971

SEQ ID NO: 202632 - RNA, 64 nt, Homo Sapiens; identical to SEQ ID NO: 39972

SEQ ID NO: 202633 - RNA, 64 nt, Homo Sapiens; identical to SEQ ID NO: 39973

SEQ ID NO: 202634 - RNA, 64 nt, Homo Sapiens; identical to SEQ ID NO: 39974

SEQ ID NO: 202635 - RNA, 64 nt, Homo Sapiens; identical to SEQ ID NO: 39975

SEQ ID NO: 202636 - RNA, 64 nt, Homo Sapiens; identical to SEQ ID NO: 39976

SEQ ID NO: 202637 - RNA, 64 nt, Homo Sapiens; identical to SEQ ID NO: 39977

SEQ ID NO: 202638 - RNA, 64 nt, Homo Sapiens; identical to SEQ ID NO: 39978

SEQ ID NO: 202639 - RNA, 64 nt, Homo Sapiens; identical to SEQ ID NO: 39979

SEQ ID NO: 202640 - RNA, 64 nt, Homo Sapiens; identical to SEQ ID NO: 39980

SEQ ID NO: 202641 - RNA, 64 nt, Homo Sapiens; identical to SEQ ID NO: 39981

SEQ ID NO: 202642 - RNA, 64 nt, Homo Sapiens; identical to SEQ ID NO: 39982

SEQ ID NO: 202643 - RNA, 64 nt, Homo Sapiens; identical to SEQ ID NO: 39983

SEQ ID NO: 202644 - RNA, 64 nt, Homo Sapiens; identical to SEQ ID NO: 39984

SEQ ID NO: 202645 - RNA, 64 nt, Homo Sapiens; identical to SEQ ID NO: 39985

SEQ ID NO: 202646 - RNA, 64 nt, Homo Sapiens; identical to SEQ ID NO: 39986

SEQ ID NO: 202647 - RNA, 64 nt, Homo Sapiens; identical to SEQ ID NO: 39987

SEQ ID NO: 202648 - RNA, 64 nt, Homo Sapiens; identical to SEQ ID NO: 39988

SEQ ID NO: 202649 - RNA, 64 nt, Homo Sapiens; identical to SEQ ID NO: 39989

SEQ ID NO: 202650 - RNA, 64 nt, Homo Sapiens; identical to SEQ ID NO: 39990

SEQ ID NO: 202651 - RNA, 64 nt, Homo Sapiens; identical to SEQ ID NO: 39991

SEQ ID NO: 202652 - RNA, 64 nt, Homo Sapiens; identical to SEQ ID NO: 39992

SEQ ID NO: 202653 - RNA, 64 nt, Homo Sapiens; identical to SEQ ID NO: 39993

SEQ ID NO: 202654 - RNA, 64 nt, Homo Sapiens; identical to SEQ ID NO: 39994

SEQ ID NO: 202655 - RNA, 64 nt, Homo Sapiens; identical to SEQ ID NO: 39995

SEQ ID NO: 202656 - RNA, 64 nt, Homo Sapiens; identical to SEQ ID NO: 39996

SEQ ID NO: 202657 - RNA, 64 nt, Homo Sapiens; identical to SEQ ID NO: 39997

SEQ ID NO: 202658 - RNA, 64 nt, Homo Sapiens; identical to SEQ ID NO: 39998

SEQ ID NO: 202659 - RNA, 64 nt, Homo Sapiens; identical to SEQ ID NO: 39999

SEQ ID NO: 202660 - RNA, 64 nt, Homo Sapiens; identical to SEQ ID NO: 40000

SEQ ID NO: 202661 - RNA, 64 nt, Homo Sapiens; identical to SEQ ID NO: 40001

SEQ ID NO: 202662 - RNA, 64 nt, Homo Sapiens; identical to SEQ ID NO: 40002

SEQ ID NO: 202663 - RNA, 64 nt, Homo Sapiens; identical to SEQ ID NO: 40003

SEQ ID NO: 202664 - RNA, 64 nt, Homo Sapiens; identical to SEQ ID NO: 40004

SEQ ID NO: 202665 - RNA, 64 nt, Homo Sapiens; identical to SEQ ID NO: 40005

SEQ ID NO: 202666 - RNA, 64 nt, Homo Sapiens; identical to SEQ ID NO: 40006

SEQ ID NO: 202667 - RNA, 64 nt, Homo Sapiens; identical to SEQ ID NO: 40007

SEQ ID NO: 202668 - RNA, 64 nt, Homo Sapiens; identical to SEQ ID NO: 40008

SEQ ID NO: 202669 - RNA, 64 nt, Homo Sapiens; identical to SEQ ID NO: 40009

SEQ ID NO: 202670 - RNA, 64 nt, Homo Sapiens; identical to SEQ ID NO: 40010

SEQ ID NO: 202671 - RNA, 64 nt, Homo Sapiens; identical to SEQ ID NO: 40011

SEQ ID NO: 202672 - RNA, 64 nt, Homo Sapiens; identical to SEQ ID NO: 40012

SEQ ID NO: 202673 - RNA, 64 nt, Homo Sapiens; identical to SEQ ID NO: 40013

SEQ ID NO: 202674 - RNA, 64 nt, Homo Sapiens; identical to SEQ ID NO: 40014

SEQ ID NO: 202675 - RNA, 64 nt, Homo Sapiens; identical to SEQ ID NO: 40015

SEQ ID NO: 202676 - RNA, 64 nt, Homo Sapiens; identical to SEQ ID NO: 40016

SEQ ID NO: 202677 - RNA, 64 nt, Homo Sapiens; identical to SEQ ID NO: 40017

SEQ ID NO: 202678 - RNA, 64 nt, Homo Sapiens; identical to SEQ ID NO: 40018

SEQ ID NO: 202679 - RNA, 64 nt, Homo Sapiens; identical to SEQ ID NO: 40019

SEQ ID NO: 202680 - RNA, 64 nt, Homo Sapiens; identical to SEQ ID NO: 40020

SEQ ID NO: 202681 - RNA, 64 nt, Homo Sapiens; identical to SEQ ID NO: 40021

SEQ ID NO: 202682 - RNA, 64 nt, Homo Sapiens; identical to SEQ ID NO: 40022

SEQ ID NO: 202683 - RNA, 64 nt, Homo Sapiens; identical to SEQ ID NO: 40023

SEQ ID NO: 202684 - RNA, 64 nt, Homo Sapiens; identical to SEQ ID NO: 40024

SEQ ID NO: 202685 - RNA, 64 nt, Homo Sapiens; identical to SEQ ID NO: 40025

SEQ ID NO: 202686 - RNA, 64 nt, Homo Sapiens; identical to SEQ ID NO: 40026

SEQ ID NO: 202687 - RNA, 64 nt, Homo Sapiens; identical to SEQ ID NO: 40027

SEQ ID NO: 202688 - RNA, 64 nt, Homo Sapiens; identical to SEQ ID NO: 40028

SEQ ID NO: 202689 - RNA, 64 nt, Homo Sapiens; identical to SEQ ID NO: 40029

SEQ ID NO: 202690 - RNA, 64 nt, Homo Sapiens; identical to SEQ ID NO: 40030

SEQ ID NO: 202691 - RNA, 64 nt, Homo Sapiens; identical to SEQ ID NO: 40031

SEQ ID NO: 202692 - RNA, 64 nt, Homo Sapiens; identical to SEQ ID NO: 40032

SEQ ID NO: 202693 - RNA, 64 nt, Homo Sapiens; identical to SEQ ID NO: 40033

SEQ ID NO: 202694 - RNA, 64 nt, Homo Sapiens; identical to SEQ ID NO: 40034

SEQ ID NO: 202695 - RNA, 64 nt, Homo Sapiens; identical to SEQ ID NO: 40035

SEQ ID NO: 202696 - RNA, 64 nt, Homo Sapiens; identical to SEQ ID NO: 40036

SEQ ID NO: 202697 - RNA, 64 nt, Homo Sapiens; identical to SEQ ID NO: 40037

SEQ ID NO: 202698 - RNA, 64 nt, Homo Sapiens; identical to SEQ ID NO: 40038

SEQ ID NO: 202699 - RNA, 64 nt, Homo Sapiens; identical to SEQ ID NO: 40039

SEQ ID NO: 202700 - RNA, 64 nt, Homo Sapiens; identical to SEQ ID NO: 40040

SEQ ID NO: 202701 - RNA, 64 nt, Homo Sapiens; identical to SEQ ID NO: 40041

SEQ ID NO: 202702 - RNA, 64 nt, Homo Sapiens; identical to SEQ ID NO: 40042

SEQ ID NO: 202703 - RNA, 64 nt, Homo Sapiens; identical to SEQ ID NO: 40043

SEQ ID NO: 202704 - RNA, 64 nt, Homo Sapiens; identical to SEQ ID NO: 40044

SEQ ID NO: 202705 - RNA, 64 nt, Homo Sapiens; identical to SEQ ID NO: 40045

SEQ ID NO: 202706 - RNA, 64 nt, Homo Sapiens; identical to SEQ ID NO: 40046

SEQ ID NO: 202707 - RNA, 64 nt, Homo Sapiens; identical to SEQ ID NO: 40047

SEQ ID NO: 202708 - RNA, 64 nt, Homo Sapiens; identical to SEQ ID NO: 40048

SEQ ID NO: 202709 - RNA, 64 nt, Homo Sapiens; identical to SEQ ID NO: 40049

SEQ ID NO: 202710 - RNA, 64 nt, Homo Sapiens; identical to SEQ ID NO: 40050

SEQ ID NO: 202711 - RNA, 64 nt, Homo Sapiens; identical to SEQ ID NO: 40051

SEQ ID NO: 202712 - RNA, 64 nt, Homo Sapiens; identical to SEQ ID NO: 40052

SEQ ID NO: 202713 - RNA, 64 nt, Homo Sapiens; identical to SEQ ID NO: 40053

SEQ ID NO: 202714 - RNA, 64 nt, Homo Sapiens; identical to SEQ ID NO: 40054

SEQ ID NO: 202715 - RNA, 64 nt, Homo Sapiens; identical to SEQ ID NO: 40055

SEQ ID NO: 202716 - RNA, 64 nt, Homo Sapiens; identical to SEQ ID NO: 40056

SEQ ID NO: 202717 - RNA, 64 nt, Homo Sapiens; identical to SEQ ID NO: 40057

SEQ ID NO: 202718 - RNA, 64 nt, Homo Sapiens; identical to SEQ ID NO: 40058

SEQ ID NO: 202719 - RNA, 64 nt, Homo Sapiens; identical to SEQ ID NO: 40059

SEQ ID NO: 202720 - RNA, 64 nt, Homo Sapiens; identical to SEQ ID NO: 40060

SEQ ID NO: 202721 - RNA, 64 nt, Homo Sapiens; identical to SEQ ID NO: 40061

SEQ ID NO: 202722 - RNA, 64 nt, Homo Sapiens; identical to SEQ ID NO: 40062

SEQ ID NO: 202723 - RNA, 64 nt, Homo Sapiens; identical to SEQ ID NO: 40063

SEQ ID NO: 202724 - RNA, 64 nt, Homo Sapiens; identical to SEQ ID NO: 40064

SEQ ID NO: 202725 - RNA, 64 nt, Homo Sapiens; identical to SEQ ID NO: 40065

SEQ ID NO: 202726 - RNA, 64 nt, Homo Sapiens; identical to SEQ ID NO: 40066

SEQ ID NO: 202727 - RNA, 64 nt, Homo Sapiens; identical to SEQ ID NO: 40067

SEQ ID NO: 202728 - RNA, 64 nt, Homo Sapiens; identical to SEQ ID NO: 40068

SEQ ID NO: 202729 - RNA, 64 nt, Homo Sapiens; identical to SEQ ID NO: 40069

SEQ ID NO: 202730 - RNA, 64 nt, Homo Sapiens; identical to SEQ ID NO: 40070

SEQ ID NO: 202731 - RNA, 64 nt, Homo Sapiens; identical to SEQ ID NO: 40071

SEQ ID NO: 202732 - RNA, 64 nt, Homo Sapiens; identical to SEQ ID NO: 40072

SEQ ID NO: 202733 - RNA, 64 nt, Homo Sapiens; identical to SEQ ID NO: 40073

SEQ ID NO: 202734 - RNA, 64 nt, Homo Sapiens; identical to SEQ ID NO: 40074

SEQ ID NO: 202735 - RNA, 64 nt, Homo Sapiens; identical to SEQ ID NO: 40075

SEQ ID NO: 202736 - RNA, 64 nt, Homo Sapiens; identical to SEQ ID NO: 40076

SEQ ID NO: 202737 - RNA, 64 nt, Homo Sapiens; identical to SEQ ID NO: 40077

SEQ ID NO: 202738 - RNA, 64 nt, Homo Sapiens; identical to SEQ ID NO: 40078

SEQ ID NO: 202739 - RNA, 64 nt, Homo Sapiens; identical to SEQ ID NO: 40079

SEQ ID NO: 202740 - RNA, 64 nt, Homo Sapiens; identical to SEQ ID NO: 40080

SEQ ID NO: 202741 - RNA, 64 nt, Homo Sapiens; identical to SEQ ID NO: 40081

SEQ ID NO: 202742 - RNA, 64 nt, Homo Sapiens; identical to SEQ ID NO: 40082

SEQ ID NO: 202743 - RNA, 64 nt, Homo Sapiens; identical to SEQ ID NO: 40083

SEQ ID NO: 202744 - RNA, 64 nt, Homo Sapiens; identical to SEQ ID NO: 40084

SEQ ID NO: 202745 - RNA, 64 nt, Homo Sapiens; identical to SEQ ID NO: 40085

SEQ ID NO: 202746 - RNA, 64 nt, Homo Sapiens; identical to SEQ ID NO: 40086

SEQ ID NO: 202747 - RNA, 64 nt, Homo Sapiens; identical to SEQ ID NO: 40087

SEQ ID NO: 202748 - RNA, 64 nt, Homo Sapiens; identical to SEQ ID NO: 40088

SEQ ID NO: 202749 - RNA, 64 nt, Homo Sapiens; identical to SEQ ID NO: 40089

SEQ ID NO: 202750 - RNA, 64 nt, Homo Sapiens; identical to SEQ ID NO: 40090

SEQ ID NO: 202751 - RNA, 64 nt, Homo Sapiens; identical to SEQ ID NO: 40091

SEQ ID NO: 202752 - RNA, 64 nt, Homo Sapiens; identical to SEQ ID NO: 40092

SEQ ID NO: 202753 - RNA, 64 nt, Homo Sapiens; identical to SEQ ID NO: 40093

SEQ ID NO: 202754 - RNA, 64 nt, Homo Sapiens; identical to SEQ ID NO: 40094

SEQ ID NO: 202755 - RNA, 64 nt, Homo Sapiens; identical to SEQ ID NO: 40095

SEQ ID NO: 202756 - RNA, 64 nt, Homo Sapiens; identical to SEQ ID NO: 40096

SEQ ID NO: 202757 - RNA, 64 nt, Homo Sapiens; identical to SEQ ID NO: 40097

SEQ ID NO: 202758 - RNA, 64 nt, Homo Sapiens; identical to SEQ ID NO: 40098

SEQ ID NO: 202759 - RNA, 64 nt, Homo Sapiens; identical to SEQ ID NO: 40099

SEQ ID NO: 202760 - RNA, 64 nt, Homo Sapiens; identical to SEQ ID NO: 40100

SEQ ID NO: 202761 - RNA, 64 nt, Homo Sapiens; identical to SEQ ID NO: 40101

SEQ ID NO: 202762 - RNA, 64 nt, Homo Sapiens; identical to SEQ ID NO: 40102

SEQ ID NO: 202763 - RNA, 64 nt, Homo Sapiens; identical to SEQ ID NO: 40103

SEQ ID NO: 202764 - RNA, 64 nt, Homo Sapiens; identical to SEQ ID NO: 40104

SEQ ID NO: 202765 - RNA, 64 nt, Homo Sapiens; identical to SEQ ID NO: 40105

SEQ ID NO: 202766 - RNA, 64 nt, Homo Sapiens; identical to SEQ ID NO: 40106

SEQ ID NO: 202767 - RNA, 64 nt, Homo Sapiens; identical to SEQ ID NO: 40107

SEQ ID NO: 202768 - RNA, 64 nt, Homo Sapiens; identical to SEQ ID NO: 40108

SEQ ID NO: 202769 - RNA, 64 nt, Homo Sapiens; identical to SEQ ID NO: 40109

SEQ ID NO: 202770 - RNA, 64 nt, Homo Sapiens; identical to SEQ ID NO: 40110

SEQ ID NO: 202771 - RNA, 64 nt, Homo Sapiens; identical to SEQ ID NO: 40111

SEQ ID NO: 202772 - RNA, 64 nt, Homo Sapiens; identical to SEQ ID NO: 40112

SEQ ID NO: 202773 - RNA, 64 nt, Homo Sapiens; identical to SEQ ID NO: 40113

SEQ ID NO: 202774 - RNA, 64 nt, Homo Sapiens; identical to SEQ ID NO: 40114

SEQ ID NO: 202775 - RNA, 64 nt, Homo Sapiens; identical to SEQ ID NO: 40115

SEQ ID NO: 202776 - RNA, 64 nt, Homo Sapiens; identical to SEQ ID NO: 40116

SEQ ID NO: 202777 - RNA, 64 nt, Homo Sapiens; identical to SEQ ID NO: 40117

SEQ ID NO: 202778 - RNA, 64 nt, Homo Sapiens; identical to SEQ ID NO: 40118

SEQ ID NO: 202779 - RNA, 64 nt, Homo Sapiens; identical to SEQ ID NO: 40119

SEQ ID NO: 202780 - RNA, 64 nt, Homo Sapiens; identical to SEQ ID NO: 40120

SEQ ID NO: 202781 - RNA, 64 nt, Homo Sapiens; identical to SEQ ID NO: 40121

SEQ ID NO: 202782 - RNA, 64 nt, Homo Sapiens; identical to SEQ ID NO: 40122

SEQ ID NO: 202783 - RNA, 64 nt, Homo Sapiens; identical to SEQ ID NO: 40123

SEQ ID NO: 202784 - RNA, 64 nt, Homo Sapiens; identical to SEQ ID NO: 40124

SEQ ID NO: 202785 - RNA, 64 nt, Homo Sapiens; identical to SEQ ID NO: 40125

SEQ ID NO: 202786 - RNA, 64 nt, Homo Sapiens; identical to SEQ ID NO: 40126

SEQ ID NO: 202787 - RNA, 64 nt, Homo Sapiens; identical to SEQ ID NO: 40127

SEQ ID NO: 202788 - RNA, 64 nt, Homo Sapiens; identical to SEQ ID NO: 40128

SEQ ID NO: 202789 - RNA, 64 nt, Homo Sapiens; identical to SEQ ID NO: 40129

SEQ ID NO: 202790 - RNA, 64 nt, Homo Sapiens; identical to SEQ ID NO: 40130

SEQ ID NO: 202791 - RNA, 64 nt, Homo Sapiens; identical to SEQ ID NO: 40131

SEQ ID NO: 202792 - RNA, 64 nt, Homo Sapiens; identical to SEQ ID NO: 40132

SEQ ID NO: 202793 - RNA, 64 nt, Homo Sapiens; identical to SEQ ID NO: 40133

SEQ ID NO: 202794 - RNA, 64 nt, Homo Sapiens; identical to SEQ ID NO: 40134

SEQ ID NO: 202795 - RNA, 64 nt, Homo Sapiens; identical to SEQ ID NO: 40135

SEQ ID NO: 202796 - RNA, 64 nt, Homo Sapiens; identical to SEQ ID NO: 40136

SEQ ID NO: 202797 - RNA, 64 nt, Homo Sapiens; identical to SEQ ID NO: 40137

SEQ ID NO: 202798 - RNA, 64 nt, Homo Sapiens; identical to SEQ ID NO: 40138

SEQ ID NO: 202799 - RNA, 64 nt, Homo Sapiens; identical to SEQ ID NO: 40139

SEQ ID NO: 202800 - RNA, 64 nt, Homo Sapiens; identical to SEQ ID NO: 40140

SEQ ID NO: 202801 - RNA, 64 nt, Homo Sapiens; identical to SEQ ID NO: 40141

SEQ ID NO: 202802 - RNA, 64 nt, Homo Sapiens; identical to SEQ ID NO: 40142

SEQ ID NO: 202803 - RNA, 64 nt, Homo Sapiens; identical to SEQ ID NO: 40143

SEQ ID NO: 202804 - RNA, 64 nt, Homo Sapiens; identical to SEQ ID NO: 40144

SEQ ID NO: 202805 - RNA, 64 nt, Homo Sapiens; identical to SEQ ID NO: 40145

SEQ ID NO: 202806 - RNA, 64 nt, Homo Sapiens; identical to SEQ ID NO: 40146

SEQ ID NO: 202807 - RNA, 64 nt, Homo Sapiens; identical to SEQ ID NO: 40147

SEQ ID NO: 202808 - RNA, 64 nt, Homo Sapiens; identical to SEQ ID NO: 40148

SEQ ID NO: 202809 - RNA, 64 nt, Homo Sapiens; identical to SEQ ID NO: 40149

SEQ ID NO: 202810 - RNA, 64 nt, Homo Sapiens; identical to SEQ ID NO: 40150

SEQ ID NO: 202811 - RNA, 64 nt, Homo Sapiens; identical to SEQ ID NO: 40151

SEQ ID NO: 202812 - RNA, 64 nt, Homo Sapiens; identical to SEQ ID NO: 40152

SEQ ID NO: 202813 - RNA, 64 nt, Homo Sapiens; identical to SEQ ID NO: 40153

SEQ ID NO: 202814 - RNA, 64 nt, Homo Sapiens; identical to SEQ ID NO: 40154

SEQ ID NO: 202815 - RNA, 64 nt, Homo Sapiens; identical to SEQ ID NO: 40155

SEQ ID NO: 202816 - RNA, 64 nt, Homo Sapiens; identical to SEQ ID NO: 40156

SEQ ID NO: 202817 - RNA, 64 nt, Homo Sapiens; identical to SEQ ID NO: 40157

SEQ ID NO: 202818 - RNA, 64 nt, Homo Sapiens; identical to SEQ ID NO: 40158

SEQ ID NO: 202819 - RNA, 64 nt, Homo Sapiens; identical to SEQ ID NO: 40159

SEQ ID NO: 202820 - RNA, 64 nt, Homo Sapiens; identical to SEQ ID NO: 40160

SEQ ID NO: 202821 - RNA, 64 nt, Homo Sapiens; identical to SEQ ID NO: 40161

SEQ ID NO: 202822 - RNA, 64 nt, Homo Sapiens; identical to SEQ ID NO: 40162

SEQ ID NO: 202823 - RNA, 64 nt, Homo Sapiens; identical to SEQ ID NO: 40163

SEQ ID NO: 202824 - RNA, 64 nt, Homo Sapiens; identical to SEQ ID NO: 40164

SEQ ID NO: 202825 - RNA, 64 nt, Homo Sapiens; identical to SEQ ID NO: 40165

SEQ ID NO: 202826 - RNA, 64 nt, Homo Sapiens; identical to SEQ ID NO: 40166

SEQ ID NO: 202827 - RNA, 64 nt, Homo Sapiens; identical to SEQ ID NO: 40167

SEQ ID NO: 202828 - RNA, 64 nt, Homo Sapiens; identical to SEQ ID NO: 40168

SEQ ID NO: 202829 - RNA, 64 nt, Homo Sapiens; identical to SEQ ID NO: 40169

SEQ ID NO: 202830 - RNA, 64 nt, Homo Sapiens; identical to SEQ ID NO: 40170

SEQ ID NO: 202831 - RNA, 64 nt, Homo Sapiens; identical to SEQ ID NO: 40171

SEQ ID NO: 202832 - RNA, 64 nt, Homo Sapiens; identical to SEQ ID NO: 40172

SEQ ID NO: 202833 - RNA, 64 nt, Homo Sapiens; identical to SEQ ID NO: 40173

SEQ ID NO: 202834 - RNA, 64 nt, Homo Sapiens; identical to SEQ ID NO: 40174

SEQ ID NO: 202835 - RNA, 64 nt, Homo Sapiens; identical to SEQ ID NO: 40175

SEQ ID NO: 202836 - RNA, 64 nt, Homo Sapiens; identical to SEQ ID NO: 40176

SEQ ID NO: 202837 - RNA, 64 nt, Homo Sapiens; identical to SEQ ID NO: 40177

SEQ ID NO: 202838 - RNA, 64 nt, Homo Sapiens; identical to SEQ ID NO: 40178

SEQ ID NO: 202839 - RNA, 64 nt, Homo Sapiens; identical to SEQ ID NO: 40179

SEQ ID NO: 202840 - RNA, 64 nt, Homo Sapiens; identical to SEQ ID NO: 40180

SEQ ID NO: 202841 - RNA, 64 nt, Homo Sapiens; identical to SEQ ID NO: 40181

SEQ ID NO: 202842 - RNA, 64 nt, Homo Sapiens; identical to SEQ ID NO: 40182

SEQ ID NO: 202843 - RNA, 64 nt, Homo Sapiens; identical to SEQ ID NO: 40183

SEQ ID NO: 202844 - RNA, 64 nt, Homo Sapiens; identical to SEQ ID NO: 40184

SEQ ID NO: 202845 - RNA, 64 nt, Homo Sapiens; identical to SEQ ID NO: 40185

SEQ ID NO: 202846 - RNA, 64 nt, Homo Sapiens; identical to SEQ ID NO: 40186

SEQ ID NO: 202847 - RNA, 64 nt, Homo Sapiens; identical to SEQ ID NO: 40187

SEQ ID NO: 202848 - RNA, 64 nt, Homo Sapiens; identical to SEQ ID NO: 40188

SEQ ID NO: 202849 - RNA, 64 nt, Homo Sapiens; identical to SEQ ID NO: 40189

SEQ ID NO: 202850 - RNA, 64 nt, Homo Sapiens; identical to SEQ ID NO: 40190

SEQ ID NO: 202851 - RNA, 64 nt, Homo Sapiens; identical to SEQ ID NO: 40191

SEQ ID NO: 202852 - RNA, 64 nt, Homo Sapiens; identical to SEQ ID NO: 40192

SEQ ID NO: 202853 - RNA, 64 nt, Homo Sapiens; identical to SEQ ID NO: 40193

SEQ ID NO: 202854 - RNA, 64 nt, Homo Sapiens; identical to SEQ ID NO: 40194

SEQ ID NO: 202855 - RNA, 64 nt, Homo Sapiens; identical to SEQ ID NO: 40195

SEQ ID NO: 202856 - RNA, 64 nt, Homo Sapiens; identical to SEQ ID NO: 40196

SEQ ID NO: 202857 - RNA, 64 nt, Homo Sapiens; identical to SEQ ID NO: 40197

SEQ ID NO: 202858 - RNA, 64 nt, Homo Sapiens; identical to SEQ ID NO: 40198

SEQ ID NO: 202859 - RNA, 64 nt, Homo Sapiens; identical to SEQ ID NO: 40199

SEQ ID NO: 202860 - RNA, 64 nt, Homo Sapiens; identical to SEQ ID NO: 40200

SEQ ID NO: 202861 - RNA, 64 nt, Homo Sapiens; identical to SEQ ID NO: 40201

SEQ ID NO: 202862 - RNA, 64 nt, Homo Sapiens; identical to SEQ ID NO: 40202

SEQ ID NO: 202863 - RNA, 64 nt, Homo Sapiens; identical to SEQ ID NO: 40203

SEQ ID NO: 202864 - RNA, 64 nt, Homo Sapiens; identical to SEQ ID NO: 40204

SEQ ID NO: 202865 - RNA, 64 nt, Homo Sapiens; identical to SEQ ID NO: 40205

SEQ ID NO: 202866 - RNA, 64 nt, Homo Sapiens; identical to SEQ ID NO: 40206

SEQ ID NO: 202867 - RNA, 64 nt, Homo Sapiens; identical to SEQ ID NO: 40207

SEQ ID NO: 202868 - RNA, 64 nt, Homo Sapiens; identical to SEQ ID NO: 40208

SEQ ID NO: 202869 - RNA, 64 nt, Homo Sapiens; identical to SEQ ID NO: 40209

SEQ ID NO: 202870 - RNA, 64 nt, Homo Sapiens; identical to SEQ ID NO: 40210

SEQ ID NO: 202871 - RNA, 64 nt, Homo Sapiens; identical to SEQ ID NO: 40211

SEQ ID NO: 202872 - RNA, 64 nt, Homo Sapiens; identical to SEQ ID NO: 40212

SEQ ID NO: 202873 - RNA, 64 nt, Homo Sapiens; identical to SEQ ID NO: 40213

SEQ ID NO: 202874 - RNA, 64 nt, Homo Sapiens; identical to SEQ ID NO: 40214

SEQ ID NO: 202875 - RNA, 64 nt, Homo Sapiens; identical to SEQ ID NO: 40215

SEQ ID NO: 202876 - RNA, 64 nt, Homo Sapiens; identical to SEQ ID NO: 40216

SEQ ID NO: 202877 - RNA, 64 nt, Homo Sapiens; identical to SEQ ID NO: 40217

SEQ ID NO: 202878 - RNA, 64 nt, Homo Sapiens; identical to SEQ ID NO: 40218

SEQ ID NO: 202879 - RNA, 64 nt, Homo Sapiens; identical to SEQ ID NO: 40219

SEQ ID NO: 202880 - RNA, 64 nt, Homo Sapiens; identical to SEQ ID NO: 40220

SEQ ID NO: 202881 - RNA, 64 nt, Homo Sapiens; identical to SEQ ID NO: 40221

SEQ ID NO: 202882 - RNA, 64 nt, Homo Sapiens; identical to SEQ ID NO: 40222

SEQ ID NO: 202883 - RNA, 64 nt, Homo Sapiens; identical to SEQ ID NO: 40223

SEQ ID NO: 202884 - RNA, 64 nt, Homo Sapiens; identical to SEQ ID NO: 40224

SEQ ID NO: 202885 - RNA, 64 nt, Homo Sapiens; identical to SEQ ID NO: 40225

SEQ ID NO: 202886 - RNA, 64 nt, Homo Sapiens; identical to SEQ ID NO: 40226

SEQ ID NO: 202887 - RNA, 64 nt, Homo Sapiens; identical to SEQ ID NO: 40227

SEQ ID NO: 202888 - RNA, 64 nt, Homo Sapiens; identical to SEQ ID NO: 40228

SEQ ID NO: 202889 - RNA, 64 nt, Homo Sapiens; identical to SEQ ID NO: 40229

SEQ ID NO: 202890 - RNA, 64 nt, Homo Sapiens; identical to SEQ ID NO: 40230

SEQ ID NO: 202891 - RNA, 64 nt, Homo Sapiens; identical to SEQ ID NO: 40231

SEQ ID NO: 202892 - RNA, 64 nt, Homo Sapiens; identical to SEQ ID NO: 40232

SEQ ID NO: 202893 - RNA, 64 nt, Homo Sapiens; identical to SEQ ID NO: 40233

SEQ ID NO: 202894 - RNA, 64 nt, Homo Sapiens; identical to SEQ ID NO: 40234

SEQ ID NO: 202895 - RNA, 64 nt, Homo Sapiens; identical to SEQ ID NO: 40235

SEQ ID NO: 202896 - RNA, 64 nt, Homo Sapiens; identical to SEQ ID NO: 40236

SEQ ID NO: 202897 - RNA, 64 nt, Homo Sapiens; identical to SEQ ID NO: 40237

SEQ ID NO: 202898 - RNA, 64 nt, Homo Sapiens; identical to SEQ ID NO: 40238

SEQ ID NO: 202899 - RNA, 64 nt, Homo Sapiens; identical to SEQ ID NO: 40239

SEQ ID NO: 202900 - RNA, 64 nt, Homo Sapiens; identical to SEQ ID NO: 40240

SEQ ID NO: 202901 - RNA, 64 nt, Homo Sapiens; identical to SEQ ID NO: 40241

SEQ ID NO: 202902 - RNA, 64 nt, Homo Sapiens; identical to SEQ ID NO: 40242

SEQ ID NO: 202903 - RNA, 64 nt, Homo Sapiens; identical to SEQ ID NO: 40243

SEQ ID NO: 202904 - RNA, 64 nt, Homo Sapiens; identical to SEQ ID NO: 40244

SEQ ID NO: 202905 - RNA, 64 nt, Homo Sapiens; identical to SEQ ID NO: 40245

SEQ ID NO: 202906 - RNA, 64 nt, Homo Sapiens; identical to SEQ ID NO: 40246

SEQ ID NO: 202907 - RNA, 64 nt, Homo Sapiens; identical to SEQ ID NO: 40247

SEQ ID NO: 202908 - RNA, 64 nt, Homo Sapiens; identical to SEQ ID NO: 40248

SEQ ID NO: 202909 - RNA, 64 nt, Homo Sapiens; identical to SEQ ID NO: 40249

SEQ ID NO: 202910 - RNA, 64 nt, Homo Sapiens; identical to SEQ ID NO: 40250

SEQ ID NO: 202911 - RNA, 64 nt, Homo Sapiens; identical to SEQ ID NO: 40251

SEQ ID NO: 202912 - RNA, 64 nt, Homo Sapiens; identical to SEQ ID NO: 40252

SEQ ID NO: 202913 - RNA, 64 nt, Homo Sapiens; identical to SEQ ID NO: 40253

SEQ ID NO: 202914 - RNA, 64 nt, Homo Sapiens; identical to SEQ ID NO: 40254

SEQ ID NO: 202915 - RNA, 64 nt, Homo Sapiens; identical to SEQ ID NO: 40255

SEQ ID NO: 202916 - RNA, 64 nt, Homo Sapiens; identical to SEQ ID NO: 40256

SEQ ID NO: 202917 - RNA, 64 nt, Homo Sapiens; identical to SEQ ID NO: 40257

SEQ ID NO: 202918 - RNA, 64 nt, Homo Sapiens; identical to SEQ ID NO: 40258

SEQ ID NO: 202919 - RNA, 64 nt, Homo Sapiens; identical to SEQ ID NO: 40259

SEQ ID NO: 202920 - RNA, 64 nt, Homo Sapiens; identical to SEQ ID NO: 40260

SEQ ID NO: 202921 - RNA, 64 nt, Homo Sapiens; identical to SEQ ID NO: 40261

SEQ ID NO: 202922 - RNA, 64 nt, Homo Sapiens; identical to SEQ ID NO: 40262

SEQ ID NO: 202923 - RNA, 64 nt, Homo Sapiens; identical to SEQ ID NO: 40263

SEQ ID NO: 202924 - RNA, 64 nt, Homo Sapiens; identical to SEQ ID NO: 40264

SEQ ID NO: 202925 - RNA, 64 nt, Homo Sapiens; identical to SEQ ID NO: 40265

SEQ ID NO: 202926 - RNA, 64 nt, Homo Sapiens; identical to SEQ ID NO: 40266

SEQ ID NO: 202927 - RNA, 64 nt, Homo Sapiens; identical to SEQ ID NO: 40267

SEQ ID NO: 202928 - RNA, 64 nt, Homo Sapiens; identical to SEQ ID NO: 40268

SEQ ID NO: 202929 - RNA, 64 nt, Homo Sapiens; identical to SEQ ID NO: 40269

SEQ ID NO: 202930 - RNA, 64 nt, Homo Sapiens; identical to SEQ ID NO: 40270

SEQ ID NO: 202931 - RNA, 64 nt, Homo Sapiens; identical to SEQ ID NO: 40271

SEQ ID NO: 202932 - RNA, 64 nt, Homo Sapiens; identical to SEQ ID NO: 40272

SEQ ID NO: 202933 - RNA, 64 nt, Homo Sapiens; identical to SEQ ID NO: 40273

SEQ ID NO: 202934 - RNA, 64 nt, Homo Sapiens; identical to SEQ ID NO: 40274

SEQ ID NO: 202935 - RNA, 64 nt, Homo Sapiens; identical to SEQ ID NO: 40275

SEQ ID NO: 202936 - RNA, 64 nt, Homo Sapiens; identical to SEQ ID NO: 40276

SEQ ID NO: 202937 - RNA, 64 nt, Homo Sapiens; identical to SEQ ID NO: 40277

SEQ ID NO: 202938 - RNA, 64 nt, Homo Sapiens; identical to SEQ ID NO: 40278

SEQ ID NO: 202939 - RNA, 64 nt, Homo Sapiens; identical to SEQ ID NO: 40279

SEQ ID NO: 202940 - RNA, 64 nt, Homo Sapiens; identical to SEQ ID NO: 40280

SEQ ID NO: 202941 - RNA, 64 nt, Homo Sapiens; identical to SEQ ID NO: 40281

SEQ ID NO: 202942 - RNA, 64 nt, Homo Sapiens; identical to SEQ ID NO: 40282

SEQ ID NO: 202943 - RNA, 64 nt, Homo Sapiens; identical to SEQ ID NO: 40283

SEQ ID NO: 202944 - RNA, 64 nt, Homo Sapiens; identical to SEQ ID NO: 40284

SEQ ID NO: 202945 - RNA, 64 nt, Homo Sapiens; identical to SEQ ID NO: 40285

SEQ ID NO: 202946 - RNA, 64 nt, Homo Sapiens; identical to SEQ ID NO: 40286

SEQ ID NO: 202947 - RNA, 64 nt, Homo Sapiens; identical to SEQ ID NO: 40287

SEQ ID NO: 202948 - RNA, 64 nt, Homo Sapiens; identical to SEQ ID NO: 40288

SEQ ID NO: 202949 - RNA, 64 nt, Homo Sapiens; identical to SEQ ID NO: 40289

SEQ ID NO: 202950 - RNA, 64 nt, Homo Sapiens; identical to SEQ ID NO: 40290

SEQ ID NO: 202951 - RNA, 64 nt, Homo Sapiens; identical to SEQ ID NO: 40291

SEQ ID NO: 202952 - RNA, 64 nt, Homo Sapiens; identical to SEQ ID NO: 40292

SEQ ID NO: 202953 - RNA, 64 nt, Homo Sapiens; identical to SEQ ID NO: 40293

SEQ ID NO: 202954 - RNA, 64 nt, Homo Sapiens; identical to SEQ ID NO: 40294

SEQ ID NO: 202955 - RNA, 64 nt, Homo Sapiens; identical to SEQ ID NO: 40295

SEQ ID NO: 202956 - RNA, 64 nt, Homo Sapiens; identical to SEQ ID NO: 40296

SEQ ID NO: 202957 - RNA, 64 nt, Homo Sapiens; identical to SEQ ID NO: 40297

SEQ ID NO: 202958 - RNA, 64 nt, Homo Sapiens; identical to SEQ ID NO: 40298

SEQ ID NO: 202959 - RNA, 64 nt, Homo Sapiens; identical to SEQ ID NO: 40299

SEQ ID NO: 202960 - RNA, 64 nt, Homo Sapiens; identical to SEQ ID NO: 40300

SEQ ID NO: 202961 - RNA, 64 nt, Homo Sapiens; identical to SEQ ID NO: 40301

SEQ ID NO: 202962 - RNA, 64 nt, Homo Sapiens; identical to SEQ ID NO: 40302

SEQ ID NO: 202963 - RNA, 64 nt, Homo Sapiens; identical to SEQ ID NO: 40303

SEQ ID NO: 202964 - RNA, 64 nt, Homo Sapiens; identical to SEQ ID NO: 40304

SEQ ID NO: 202965 - RNA, 64 nt, Homo Sapiens; identical to SEQ ID NO: 40305

SEQ ID NO: 202966 - RNA, 64 nt, Homo Sapiens; identical to SEQ ID NO: 40306

SEQ ID NO: 202967 - RNA, 64 nt, Homo Sapiens; identical to SEQ ID NO: 40307

SEQ ID NO: 202968 - RNA, 64 nt, Homo Sapiens; identical to SEQ ID NO: 40308

SEQ ID NO: 202969 - RNA, 64 nt, Homo Sapiens; identical to SEQ ID NO: 40309

SEQ ID NO: 202970 - RNA, 64 nt, Homo Sapiens; identical to SEQ ID NO: 40310

SEQ ID NO: 202971 - RNA, 64 nt, Homo Sapiens; identical to SEQ ID NO: 40311

SEQ ID NO: 202972 - RNA, 64 nt, Homo Sapiens; identical to SEQ ID NO: 40312

SEQ ID NO: 202973 - RNA, 64 nt, Homo Sapiens; identical to SEQ ID NO: 40313

SEQ ID NO: 202974 - RNA, 64 nt, Homo Sapiens; identical to SEQ ID NO: 40314

SEQ ID NO: 202975 - RNA, 64 nt, Homo Sapiens; identical to SEQ ID NO: 40315

SEQ ID NO: 202976 - RNA, 64 nt, Homo Sapiens; identical to SEQ ID NO: 40316

SEQ ID NO: 202977 - RNA, 64 nt, Homo Sapiens; identical to SEQ ID NO: 40317

SEQ ID NO: 202978 - RNA, 64 nt, Homo Sapiens; identical to SEQ ID NO: 40318

SEQ ID NO: 202979 - RNA, 64 nt, Homo Sapiens; identical to SEQ ID NO: 40319

SEQ ID NO: 202980 - RNA, 64 nt, Homo Sapiens; identical to SEQ ID NO: 40320

SEQ ID NO: 202981 - RNA, 64 nt, Homo Sapiens; identical to SEQ ID NO: 40321

SEQ ID NO: 202982 - RNA, 64 nt, Homo Sapiens; identical to SEQ ID NO: 40322

SEQ ID NO: 202983 - RNA, 64 nt, Homo Sapiens; identical to SEQ ID NO: 40323

SEQ ID NO: 202984 - RNA, 64 nt, Homo Sapiens; identical to SEQ ID NO: 40324

SEQ ID NO: 202985 - RNA, 64 nt, Homo Sapiens; identical to SEQ ID NO: 40325

SEQ ID NO: 202986 - RNA, 64 nt, Homo Sapiens; identical to SEQ ID NO: 40326

SEQ ID NO: 202987 - RNA, 64 nt, Homo Sapiens; identical to SEQ ID NO: 40327

SEQ ID NO: 202988 - RNA, 64 nt, Homo Sapiens; identical to SEQ ID NO: 40328

SEQ ID NO: 202989 - RNA, 64 nt, Homo Sapiens; identical to SEQ ID NO: 40329

SEQ ID NO: 202990 - RNA, 64 nt, Homo Sapiens; identical to SEQ ID NO: 40330

SEQ ID NO: 202991 - RNA, 64 nt, Homo Sapiens; identical to SEQ ID NO: 40331

SEQ ID NO: 202992 - RNA, 64 nt, Homo Sapiens; identical to SEQ ID NO: 40332

SEQ ID NO: 202993 - RNA, 64 nt, Homo Sapiens; identical to SEQ ID NO: 40333

SEQ ID NO: 202994 - RNA, 64 nt, Homo Sapiens; identical to SEQ ID NO: 40334

SEQ ID NO: 202995 - RNA, 64 nt, Homo Sapiens; identical to SEQ ID NO: 40335

SEQ ID NO: 202996 - RNA, 64 nt, Homo Sapiens; identical to SEQ ID NO: 40336

SEQ ID NO: 202997 - RNA, 64 nt, Homo Sapiens; identical to SEQ ID NO: 40337

SEQ ID NO: 202998 - RNA, 64 nt, Homo Sapiens; identical to SEQ ID NO: 40338

SEQ ID NO: 202999 - RNA, 64 nt, Homo Sapiens; identical to SEQ ID NO: 40339

SEQ ID NO: 203000 - RNA, 64 nt, Homo Sapiens; identical to SEQ ID NO: 40340

SEQ ID NO: 203001 - RNA, 64 nt, Homo Sapiens; identical to SEQ ID NO: 40341

SEQ ID NO: 203002 - RNA, 64 nt, Homo Sapiens; identical to SEQ ID NO: 40342

SEQ ID NO: 203003 - RNA, 64 nt, Homo Sapiens; identical to SEQ ID NO: 40343

SEQ ID NO: 203004 - RNA, 64 nt, Homo Sapiens; identical to SEQ ID NO: 40344

SEQ ID NO: 203005 - RNA, 64 nt, Homo Sapiens; identical to SEQ ID NO: 40345

SEQ ID NO: 203006 - RNA, 64 nt, Homo Sapiens; identical to SEQ ID NO: 40346

SEQ ID NO: 203007 - RNA, 64 nt, Homo Sapiens; identical to SEQ ID NO: 40347

SEQ ID NO: 203008 - RNA, 64 nt, Homo Sapiens; identical to SEQ ID NO: 40348

SEQ ID NO: 203009 - RNA, 64 nt, Homo Sapiens; identical to SEQ ID NO: 40349

SEQ ID NO: 203010 - RNA, 64 nt, Homo Sapiens; identical to SEQ ID NO: 40350

SEQ ID NO: 203011 - RNA, 64 nt, Homo Sapiens; identical to SEQ ID NO: 40351

SEQ ID NO: 203012 - RNA, 64 nt, Homo Sapiens; identical to SEQ ID NO: 40352

SEQ ID NO: 203013 - RNA, 64 nt, Homo Sapiens; identical to SEQ ID NO: 40353

SEQ ID NO: 203014 - RNA, 64 nt, Homo Sapiens; identical to SEQ ID NO: 40354

SEQ ID NO: 203015 - RNA, 64 nt, Homo Sapiens; identical to SEQ ID NO: 40355

SEQ ID NO: 203016 - RNA, 64 nt, Homo Sapiens; identical to SEQ ID NO: 40356

SEQ ID NO: 203017 - RNA, 64 nt, Homo Sapiens; identical to SEQ ID NO: 40357

SEQ ID NO: 203018 - RNA, 64 nt, Homo Sapiens; identical to SEQ ID NO: 40358

SEQ ID NO: 203019 - RNA, 64 nt, Homo Sapiens; identical to SEQ ID NO: 40359

SEQ ID NO: 203020 - RNA, 64 nt, Homo Sapiens; identical to SEQ ID NO: 40360

SEQ ID NO: 203021 - RNA, 64 nt, Homo Sapiens; identical to SEQ ID NO: 40361

SEQ ID NO: 203022 - RNA, 64 nt, Homo Sapiens; identical to SEQ ID NO: 40362

SEQ ID NO: 203023 - RNA, 64 nt, Homo Sapiens; identical to SEQ ID NO: 40363

SEQ ID NO: 203024 - RNA, 64 nt, Homo Sapiens; identical to SEQ ID NO: 40364

SEQ ID NO: 203025 - RNA, 64 nt, Homo Sapiens; identical to SEQ ID NO: 40365

SEQ ID NO: 203026 - RNA, 64 nt, Homo Sapiens; identical to SEQ ID NO: 40366

SEQ ID NO: 203027 - RNA, 64 nt, Homo Sapiens; identical to SEQ ID NO: 40367

SEQ ID NO: 203028 - RNA, 64 nt, Homo Sapiens; identical to SEQ ID NO: 40368

SEQ ID NO: 203029 - RNA, 64 nt, Homo Sapiens; identical to SEQ ID NO: 40369

SEQ ID NO: 203030 - RNA, 64 nt, Homo Sapiens; identical to SEQ ID NO: 40370

SEQ ID NO: 203031 - RNA, 64 nt, Homo Sapiens; identical to SEQ ID NO: 40371

SEQ ID NO: 203032 - RNA, 64 nt, Homo Sapiens; identical to SEQ ID NO: 40372

SEQ ID NO: 203033 - RNA, 64 nt, Homo Sapiens; identical to SEQ ID NO: 40373

SEQ ID NO: 203034 - RNA, 64 nt, Homo Sapiens; identical to SEQ ID NO: 40374

SEQ ID NO: 203035 - RNA, 64 nt, Homo Sapiens; identical to SEQ ID NO: 40375

SEQ ID NO: 203036 - RNA, 64 nt, Homo Sapiens; identical to SEQ ID NO: 40376

SEQ ID NO: 203037 - RNA, 64 nt, Homo Sapiens; identical to SEQ ID NO: 40377

SEQ ID NO: 203038 - RNA, 64 nt, Homo Sapiens; identical to SEQ ID NO: 40378

SEQ ID NO: 203039 - RNA, 64 nt, Homo Sapiens; identical to SEQ ID NO: 40379

SEQ ID NO: 203040 - RNA, 64 nt, Homo Sapiens; identical to SEQ ID NO: 40380

SEQ ID NO: 203041 - RNA, 64 nt, Homo Sapiens; identical to SEQ ID NO: 40381

SEQ ID NO: 203042 - RNA, 64 nt, Homo Sapiens; identical to SEQ ID NO: 40382

SEQ ID NO: 203043 - RNA, 64 nt, Homo Sapiens; identical to SEQ ID NO: 40383

SEQ ID NO: 203044 - RNA, 64 nt, Homo Sapiens; identical to SEQ ID NO: 40384

SEQ ID NO: 203045 - RNA, 64 nt, Homo Sapiens; identical to SEQ ID NO: 40385

SEQ ID NO: 203046 - RNA, 64 nt, Homo Sapiens; identical to SEQ ID NO: 40386

SEQ ID NO: 203047 - RNA, 64 nt, Homo Sapiens; identical to SEQ ID NO: 40387

SEQ ID NO: 203048 - RNA, 64 nt, Homo Sapiens; identical to SEQ ID NO: 40388

SEQ ID NO: 203049 - RNA, 64 nt, Homo Sapiens; identical to SEQ ID NO: 40389

SEQ ID NO: 203050 - RNA, 64 nt, Homo Sapiens; identical to SEQ ID NO: 40390

SEQ ID NO: 203051 - RNA, 64 nt, Homo Sapiens; identical to SEQ ID NO: 40391

SEQ ID NO: 203052 - RNA, 64 nt, Homo Sapiens; identical to SEQ ID NO: 40392

SEQ ID NO: 203053 - RNA, 64 nt, Homo Sapiens; identical to SEQ ID NO: 40393

SEQ ID NO: 203054 - RNA, 64 nt, Homo Sapiens; identical to SEQ ID NO: 40394

SEQ ID NO: 203055 - RNA, 64 nt, Homo Sapiens; identical to SEQ ID NO: 40395

SEQ ID NO: 203056 - RNA, 64 nt, Homo Sapiens; identical to SEQ ID NO: 40396

SEQ ID NO: 203057 - RNA, 64 nt, Homo Sapiens; identical to SEQ ID NO: 40397

SEQ ID NO: 203058 - RNA, 64 nt, Homo Sapiens; identical to SEQ ID NO: 40398

SEQ ID NO: 203059 - RNA, 64 nt, Homo Sapiens; identical to SEQ ID NO: 40399

SEQ ID NO: 203060 - RNA, 64 nt, Homo Sapiens; identical to SEQ ID NO: 40400

SEQ ID NO: 203061 - RNA, 64 nt, Homo Sapiens; identical to SEQ ID NO: 40401

SEQ ID NO: 203062 - RNA, 64 nt, Homo Sapiens; identical to SEQ ID NO: 40402

SEQ ID NO: 203063 - RNA, 64 nt, Homo Sapiens; identical to SEQ ID NO: 40403

SEQ ID NO: 203064 - RNA, 64 nt, Homo Sapiens; identical to SEQ ID NO: 40404

SEQ ID NO: 203065 - RNA, 64 nt, Homo Sapiens; identical to SEQ ID NO: 40405

SEQ ID NO: 203066 - RNA, 64 nt, Homo Sapiens; identical to SEQ ID NO: 40406

SEQ ID NO: 203067 - RNA, 64 nt, Homo Sapiens; identical to SEQ ID NO: 40407

SEQ ID NO: 203068 - RNA, 64 nt, Homo Sapiens; identical to SEQ ID NO: 40408

SEQ ID NO: 203069 - RNA, 64 nt, Homo Sapiens; identical to SEQ ID NO: 40409

SEQ ID NO: 203070 - RNA, 64 nt, Homo Sapiens; identical to SEQ ID NO: 40410

SEQ ID NO: 203071 - RNA, 64 nt, Homo Sapiens; identical to SEQ ID NO: 40411

SEQ ID NO: 203072 - RNA, 64 nt, Homo Sapiens; identical to SEQ ID NO: 40412

SEQ ID NO: 203073 - RNA, 64 nt, Homo Sapiens; identical to SEQ ID NO: 40413

SEQ ID NO: 203074 - RNA, 64 nt, Homo Sapiens; identical to SEQ ID NO: 40414

SEQ ID NO: 203075 - RNA, 64 nt, Homo Sapiens; identical to SEQ ID NO: 40415

SEQ ID NO: 203076 - RNA, 64 nt, Homo Sapiens; identical to SEQ ID NO: 40416

SEQ ID NO: 203077 - RNA, 64 nt, Homo Sapiens; identical to SEQ ID NO: 40417

SEQ ID NO: 203078 - RNA, 64 nt, Homo Sapiens; identical to SEQ ID NO: 40418

SEQ ID NO: 203079 - RNA, 64 nt, Homo Sapiens; identical to SEQ ID NO: 40419

SEQ ID NO: 203080 - RNA, 64 nt, Homo Sapiens; identical to SEQ ID NO: 40420

SEQ ID NO: 203081 - RNA, 64 nt, Homo Sapiens; identical to SEQ ID NO: 40421

SEQ ID NO: 203082 - RNA, 64 nt, Homo Sapiens; identical to SEQ ID NO: 40422

SEQ ID NO: 203083 - RNA, 64 nt, Homo Sapiens; identical to SEQ ID NO: 40423

SEQ ID NO: 203084 - RNA, 64 nt, Homo Sapiens; identical to SEQ ID NO: 40424

SEQ ID NO: 203085 - RNA, 64 nt, Homo Sapiens; identical to SEQ ID NO: 40425

SEQ ID NO: 203086 - RNA, 64 nt, Homo Sapiens; identical to SEQ ID NO: 40426

SEQ ID NO: 203087 - RNA, 64 nt, Homo Sapiens; identical to SEQ ID NO: 40427

SEQ ID NO: 203088 - RNA, 64 nt, Homo Sapiens; identical to SEQ ID NO: 40428

SEQ ID NO: 203089 - RNA, 64 nt, Homo Sapiens; identical to SEQ ID NO: 40429

SEQ ID NO: 203090 - RNA, 64 nt, Homo Sapiens; identical to SEQ ID NO: 40430

SEQ ID NO: 203091 - RNA, 64 nt, Homo Sapiens; identical to SEQ ID NO: 40431

SEQ ID NO: 203092 - RNA, 64 nt, Homo Sapiens; identical to SEQ ID NO: 40432

SEQ ID NO: 203093 - RNA, 64 nt, Homo Sapiens; identical to SEQ ID NO: 40433

SEQ ID NO: 203094 - RNA, 64 nt, Homo Sapiens; identical to SEQ ID NO: 40434

SEQ ID NO: 203095 - RNA, 64 nt, Homo Sapiens; identical to SEQ ID NO: 40435

SEQ ID NO: 203096 - RNA, 64 nt, Homo Sapiens; identical to SEQ ID NO: 40436

SEQ ID NO: 203097 - RNA, 64 nt, Homo Sapiens; identical to SEQ ID NO: 40437

SEQ ID NO: 203098 - RNA, 64 nt, Homo Sapiens; identical to SEQ ID NO: 40438

SEQ ID NO: 203099 - RNA, 64 nt, Homo Sapiens; identical to SEQ ID NO: 40439

SEQ ID NO: 203100 - RNA, 64 nt, Homo Sapiens; identical to SEQ ID NO: 40440

SEQ ID NO: 203101 - RNA, 64 nt, Homo Sapiens; identical to SEQ ID NO: 40441

SEQ ID NO: 203102 - RNA, 64 nt, Homo Sapiens; identical to SEQ ID NO: 40442

SEQ ID NO: 203103 - RNA, 64 nt, Homo Sapiens; identical to SEQ ID NO: 40443

SEQ ID NO: 203104 - RNA, 64 nt, Homo Sapiens; identical to SEQ ID NO: 40444

SEQ ID NO: 203105 - RNA, 64 nt, Homo Sapiens; identical to SEQ ID NO: 40445

SEQ ID NO: 203106 - RNA, 64 nt, Homo Sapiens; identical to SEQ ID NO: 40446

SEQ ID NO: 203107 - RNA, 64 nt, Homo Sapiens; identical to SEQ ID NO: 40447

SEQ ID NO: 203108 - RNA, 64 nt, Homo Sapiens; identical to SEQ ID NO: 40448

SEQ ID NO: 203109 - RNA, 64 nt, Homo Sapiens; identical to SEQ ID NO: 40449

SEQ ID NO: 203110 - RNA, 64 nt, Homo Sapiens; identical to SEQ ID NO: 40450

SEQ ID NO: 203111 - RNA, 64 nt, Homo Sapiens; identical to SEQ ID NO: 40451

SEQ ID NO: 203112 - RNA, 64 nt, Homo Sapiens; identical to SEQ ID NO: 40452

SEQ ID NO: 203113 - RNA, 64 nt, Homo Sapiens; identical to SEQ ID NO: 40453

SEQ ID NO: 203114 - RNA, 64 nt, Homo Sapiens; identical to SEQ ID NO: 40454

SEQ ID NO: 203115 - RNA, 64 nt, Homo Sapiens; identical to SEQ ID NO: 40455

SEQ ID NO: 203116 - RNA, 64 nt, Homo Sapiens; identical to SEQ ID NO: 40456

SEQ ID NO: 203117 - RNA, 64 nt, Homo Sapiens; identical to SEQ ID NO: 40457

SEQ ID NO: 203118 - RNA, 64 nt, Homo Sapiens; identical to SEQ ID NO: 40458

SEQ ID NO: 203119 - RNA, 64 nt, Homo Sapiens; identical to SEQ ID NO: 40459

SEQ ID NO: 203120 - RNA, 64 nt, Homo Sapiens; identical to SEQ ID NO: 40460

SEQ ID NO: 203121 - RNA, 64 nt, Homo Sapiens; identical to SEQ ID NO: 40461

SEQ ID NO: 203122 - RNA, 64 nt, Homo Sapiens; identical to SEQ ID NO: 40462

SEQ ID NO: 203123 - RNA, 64 nt, Homo Sapiens; identical to SEQ ID NO: 40463

SEQ ID NO: 203124 - RNA, 64 nt, Homo Sapiens; identical to SEQ ID NO: 40464

SEQ ID NO: 203125 - RNA, 64 nt, Homo Sapiens; identical to SEQ ID NO: 40465

SEQ ID NO: 203126 - RNA, 64 nt, Homo Sapiens; identical to SEQ ID NO: 40466

SEQ ID NO: 203127 - RNA, 64 nt, Homo Sapiens; identical to SEQ ID NO: 40467

SEQ ID NO: 203128 - RNA, 64 nt, Homo Sapiens; identical to SEQ ID NO: 40468

SEQ ID NO: 203129 - RNA, 64 nt, Homo Sapiens; identical to SEQ ID NO: 40469

SEQ ID NO: 203130 - RNA, 64 nt, Homo Sapiens; identical to SEQ ID NO: 40470

SEQ ID NO: 203131 - RNA, 64 nt, Homo Sapiens; identical to SEQ ID NO: 40471

SEQ ID NO: 203132 - RNA, 64 nt, Homo Sapiens; identical to SEQ ID NO: 40472

SEQ ID NO: 203133 - RNA, 64 nt, Homo Sapiens; identical to SEQ ID NO: 40473

SEQ ID NO: 203134 - RNA, 64 nt, Homo Sapiens; identical to SEQ ID NO: 40474

SEQ ID NO: 203135 - RNA, 64 nt, Homo Sapiens; identical to SEQ ID NO: 40475

SEQ ID NO: 203136 - RNA, 64 nt, Homo Sapiens; identical to SEQ ID NO: 40476

SEQ ID NO: 203137 - RNA, 64 nt, Homo Sapiens; identical to SEQ ID NO: 40477

SEQ ID NO: 203138 - RNA, 64 nt, Homo Sapiens; identical to SEQ ID NO: 40478

SEQ ID NO: 203139 - RNA, 64 nt, Homo Sapiens; identical to SEQ ID NO: 40479

SEQ ID NO: 203140 - RNA, 64 nt, Homo Sapiens; identical to SEQ ID NO: 40480

SEQ ID NO: 203141 - RNA, 64 nt, Homo Sapiens; identical to SEQ ID NO: 40481

SEQ ID NO: 203142 - RNA, 64 nt, Homo Sapiens; identical to SEQ ID NO: 40482

SEQ ID NO: 203143 - RNA, 64 nt, Homo Sapiens; identical to SEQ ID NO: 40483

SEQ ID NO: 203144 - RNA, 64 nt, Homo Sapiens; identical to SEQ ID NO: 40484

SEQ ID NO: 203145 - RNA, 64 nt, Homo Sapiens; identical to SEQ ID NO: 40485

SEQ ID NO: 203146 - RNA, 64 nt, Homo Sapiens; identical to SEQ ID NO: 40486

SEQ ID NO: 203147 - RNA, 64 nt, Homo Sapiens; identical to SEQ ID NO: 40487

SEQ ID NO: 203148 - RNA, 64 nt, Homo Sapiens; identical to SEQ ID NO: 40488

SEQ ID NO: 203149 - RNA, 64 nt, Homo Sapiens; identical to SEQ ID NO: 40489

SEQ ID NO: 203150 - RNA, 64 nt, Homo Sapiens; identical to SEQ ID NO: 40490

SEQ ID NO: 203151 - RNA, 64 nt, Homo Sapiens; identical to SEQ ID NO: 40491

SEQ ID NO: 203152 - RNA, 64 nt, Homo Sapiens; identical to SEQ ID NO: 40492

SEQ ID NO: 203153 - RNA, 64 nt, Homo Sapiens; identical to SEQ ID NO: 40493

SEQ ID NO: 203154 - RNA, 64 nt, Homo Sapiens; identical to SEQ ID NO: 40494

SEQ ID NO: 203155 - RNA, 64 nt, Homo Sapiens; identical to SEQ ID NO: 40495

SEQ ID NO: 203156 - RNA, 64 nt, Homo Sapiens; identical to SEQ ID NO: 40496

SEQ ID NO: 203157 - RNA, 64 nt, Homo Sapiens; identical to SEQ ID NO: 40497

SEQ ID NO: 203158 - RNA, 64 nt, Homo Sapiens; identical to SEQ ID NO: 40498

SEQ ID NO: 203159 - RNA, 64 nt, Homo Sapiens; identical to SEQ ID NO: 40499

SEQ ID NO: 203160 - RNA, 64 nt, Homo Sapiens; identical to SEQ ID NO: 40500

SEQ ID NO: 203161 - RNA, 64 nt, Homo Sapiens; identical to SEQ ID NO: 40501

SEQ ID NO: 203162 - RNA, 64 nt, Homo Sapiens; identical to SEQ ID NO: 40502

SEQ ID NO: 203163 - RNA, 64 nt, Homo Sapiens; identical to SEQ ID NO: 40503

SEQ ID NO: 203164 - RNA, 64 nt, Homo Sapiens; identical to SEQ ID NO: 40504

SEQ ID NO: 203165 - RNA, 64 nt, Homo Sapiens; identical to SEQ ID NO: 40505

SEQ ID NO: 203166 - RNA, 64 nt, Homo Sapiens; identical to SEQ ID NO: 40506

SEQ ID NO: 203167 - RNA, 64 nt, Homo Sapiens; identical to SEQ ID NO: 40507

SEQ ID NO: 203168 - RNA, 64 nt, Homo Sapiens; identical to SEQ ID NO: 40508

SEQ ID NO: 203169 - RNA, 64 nt, Homo Sapiens; identical to SEQ ID NO: 40509

SEQ ID NO: 203170 - RNA, 64 nt, Homo Sapiens; identical to SEQ ID NO: 40510

SEQ ID NO: 203171 - RNA, 64 nt, Homo Sapiens; identical to SEQ ID NO: 40511

SEQ ID NO: 203172 - RNA, 64 nt, Homo Sapiens; identical to SEQ ID NO: 40512

SEQ ID NO: 203173 - RNA, 64 nt, Homo Sapiens; identical to SEQ ID NO: 40513

SEQ ID NO: 203174 - RNA, 64 nt, Homo Sapiens; identical to SEQ ID NO: 40514

SEQ ID NO: 203175 - RNA, 64 nt, Homo Sapiens; identical to SEQ ID NO: 40515

SEQ ID NO: 203176 - RNA, 64 nt, Homo Sapiens; identical to SEQ ID NO: 40516

SEQ ID NO: 203177 - RNA, 64 nt, Homo Sapiens; identical to SEQ ID NO: 40517

SEQ ID NO: 203178 - RNA, 64 nt, Homo Sapiens; identical to SEQ ID NO: 40518

SEQ ID NO: 203179 - RNA, 64 nt, Homo Sapiens; identical to SEQ ID NO: 40519

SEQ ID NO: 203180 - RNA, 64 nt, Homo Sapiens; identical to SEQ ID NO: 40520

SEQ ID NO: 203181 - RNA, 64 nt, Homo Sapiens; identical to SEQ ID NO: 40521

SEQ ID NO: 203182 - RNA, 64 nt, Homo Sapiens; identical to SEQ ID NO: 40522

SEQ ID NO: 203183 - RNA, 64 nt, Homo Sapiens; identical to SEQ ID NO: 40523

SEQ ID NO: 203184 - RNA, 64 nt, Homo Sapiens; identical to SEQ ID NO: 40524

SEQ ID NO: 203185 - RNA, 64 nt, Homo Sapiens; identical to SEQ ID NO: 40525

SEQ ID NO: 203186 - RNA, 64 nt, Homo Sapiens; identical to SEQ ID NO: 40526

SEQ ID NO: 203187 - RNA, 64 nt, Homo Sapiens; identical to SEQ ID NO: 40527

SEQ ID NO: 203188 - RNA, 64 nt, Homo Sapiens; identical to SEQ ID NO: 40528

SEQ ID NO: 203189 - RNA, 64 nt, Homo Sapiens; identical to SEQ ID NO: 40529

SEQ ID NO: 203190 - RNA, 64 nt, Homo Sapiens; identical to SEQ ID NO: 40530

SEQ ID NO: 203191 - RNA, 64 nt, Homo Sapiens; identical to SEQ ID NO: 40531

SEQ ID NO: 203192 - RNA, 64 nt, Homo Sapiens; identical to SEQ ID NO: 40532

SEQ ID NO: 203193 - RNA, 64 nt, Homo Sapiens; identical to SEQ ID NO: 40533

SEQ ID NO: 203194 - RNA, 64 nt, Homo Sapiens; identical to SEQ ID NO: 40534

SEQ ID NO: 203195 - RNA, 64 nt, Homo Sapiens; identical to SEQ ID NO: 40535

SEQ ID NO: 203196 - RNA, 64 nt, Homo Sapiens; identical to SEQ ID NO: 40536

SEQ ID NO: 203197 - RNA, 64 nt, Homo Sapiens; identical to SEQ ID NO: 40537

SEQ ID NO: 203198 - RNA, 64 nt, Homo Sapiens; identical to SEQ ID NO: 40538

SEQ ID NO: 203199 - RNA, 64 nt, Homo Sapiens; identical to SEQ ID NO: 40539

SEQ ID NO: 203200 - RNA, 64 nt, Homo Sapiens; identical to SEQ ID NO: 40540

SEQ ID NO: 203201 - RNA, 64 nt, Homo Sapiens; identical to SEQ ID NO: 40541

SEQ ID NO: 203202 - RNA, 64 nt, Homo Sapiens; identical to SEQ ID NO: 40542

SEQ ID NO: 203203 - RNA, 64 nt, Homo Sapiens; identical to SEQ ID NO: 40543

SEQ ID NO: 203204 - RNA, 64 nt, Homo Sapiens; identical to SEQ ID NO: 40544

SEQ ID NO: 203205 - RNA, 64 nt, Homo Sapiens; identical to SEQ ID NO: 40545

SEQ ID NO: 203206 - RNA, 64 nt, Homo Sapiens; identical to SEQ ID NO: 40546

SEQ ID NO: 203207 - RNA, 64 nt, Homo Sapiens; identical to SEQ ID NO: 40547

SEQ ID NO: 203208 - RNA, 64 nt, Homo Sapiens; identical to SEQ ID NO: 40548

SEQ ID NO: 203209 - RNA, 64 nt, Homo Sapiens; identical to SEQ ID NO: 40549

SEQ ID NO: 203210 - RNA, 64 nt, Homo Sapiens; identical to SEQ ID NO: 40550

SEQ ID NO: 203211 - RNA, 64 nt, Homo Sapiens; identical to SEQ ID NO: 40551

SEQ ID NO: 203212 - RNA, 64 nt, Homo Sapiens; identical to SEQ ID NO: 40552

SEQ ID NO: 203213 - RNA, 64 nt, Homo Sapiens; identical to SEQ ID NO: 40553

SEQ ID NO: 203214 - RNA, 64 nt, Homo Sapiens; identical to SEQ ID NO: 40554

SEQ ID NO: 203215 - RNA, 64 nt, Homo Sapiens; identical to SEQ ID NO: 40555

SEQ ID NO: 203216 - RNA, 64 nt, Homo Sapiens; identical to SEQ ID NO: 40556

SEQ ID NO: 203217 - RNA, 64 nt, Homo Sapiens; identical to SEQ ID NO: 40557

SEQ ID NO: 203218 - RNA, 64 nt, Homo Sapiens; identical to SEQ ID NO: 40558

SEQ ID NO: 203219 - RNA, 64 nt, Homo Sapiens; identical to SEQ ID NO: 40559

SEQ ID NO: 203220 - RNA, 64 nt, Homo Sapiens; identical to SEQ ID NO: 40560

SEQ ID NO: 203221 - RNA, 64 nt, Homo Sapiens; identical to SEQ ID NO: 40561

SEQ ID NO: 203222 - RNA, 64 nt, Homo Sapiens; identical to SEQ ID NO: 40562

SEQ ID NO: 203223 - RNA, 64 nt, Homo Sapiens; identical to SEQ ID NO: 40563

SEQ ID NO: 203224 - RNA, 64 nt, Homo Sapiens; identical to SEQ ID NO: 40564

SEQ ID NO: 203225 - RNA, 64 nt, Homo Sapiens; identical to SEQ ID NO: 40565

SEQ ID NO: 203226 - RNA, 64 nt, Homo Sapiens; identical to SEQ ID NO: 40566

SEQ ID NO: 203227 - RNA, 64 nt, Homo Sapiens; identical to SEQ ID NO: 40567

SEQ ID NO: 203228 - RNA, 64 nt, Homo Sapiens; identical to SEQ ID NO: 40568

SEQ ID NO: 203229 - RNA, 64 nt, Homo Sapiens; identical to SEQ ID NO: 40569

SEQ ID NO: 203230 - RNA, 64 nt, Homo Sapiens; identical to SEQ ID NO: 40570

SEQ ID NO: 203231 - RNA, 64 nt, Homo Sapiens; identical to SEQ ID NO: 40571

SEQ ID NO: 203232 - RNA, 64 nt, Homo Sapiens; identical to SEQ ID NO: 40572

SEQ ID NO: 203233 - RNA, 64 nt, Homo Sapiens; identical to SEQ ID NO: 40573

SEQ ID NO: 203234 - RNA, 64 nt, Homo Sapiens; identical to SEQ ID NO: 40574

SEQ ID NO: 203235 - RNA, 64 nt, Homo Sapiens; identical to SEQ ID NO: 40575

SEQ ID NO: 203236 - RNA, 64 nt, Homo Sapiens; identical to SEQ ID NO: 40576

SEQ ID NO: 203237 - RNA, 64 nt, Homo Sapiens; identical to SEQ ID NO: 40577

SEQ ID NO: 203238 - RNA, 64 nt, Homo Sapiens; identical to SEQ ID NO: 40578

SEQ ID NO: 203239 - RNA, 64 nt, Homo Sapiens; identical to SEQ ID NO: 40579

SEQ ID NO: 203240 - RNA, 64 nt, Homo Sapiens; identical to SEQ ID NO: 40580

SEQ ID NO: 203241 - RNA, 64 nt, Homo Sapiens; identical to SEQ ID NO: 40581

SEQ ID NO: 203242 - RNA, 64 nt, Homo Sapiens; identical to SEQ ID NO: 40582

SEQ ID NO: 203243 - RNA, 64 nt, Homo Sapiens; identical to SEQ ID NO: 40583

SEQ ID NO: 203244 - RNA, 64 nt, Homo Sapiens; identical to SEQ ID NO: 40584

SEQ ID NO: 203245 - RNA, 64 nt, Homo Sapiens; identical to SEQ ID NO: 40585

SEQ ID NO: 203246 - RNA, 64 nt, Homo Sapiens; identical to SEQ ID NO: 40586

SEQ ID NO: 203247 - RNA, 64 nt, Homo Sapiens; identical to SEQ ID NO: 40587

SEQ ID NO: 203248 - RNA, 64 nt, Homo Sapiens; identical to SEQ ID NO: 40588

SEQ ID NO: 203249 - RNA, 64 nt, Homo Sapiens; identical to SEQ ID NO: 40589

SEQ ID NO: 203250 - RNA, 64 nt, Homo Sapiens; identical to SEQ ID NO: 40590

SEQ ID NO: 203251 - RNA, 64 nt, Homo Sapiens; identical to SEQ ID NO: 40591

SEQ ID NO: 203252 - RNA, 64 nt, Homo Sapiens; identical to SEQ ID NO: 40592

SEQ ID NO: 203253 - RNA, 64 nt, Homo Sapiens; identical to SEQ ID NO: 40593

SEQ ID NO: 203254 - RNA, 64 nt, Homo Sapiens; identical to SEQ ID NO: 40594

SEQ ID NO: 203255 - RNA, 64 nt, Homo Sapiens; identical to SEQ ID NO: 40595

SEQ ID NO: 203256 - RNA, 64 nt, Homo Sapiens; identical to SEQ ID NO: 40596

SEQ ID NO: 203257 - RNA, 64 nt, Homo Sapiens; identical to SEQ ID NO: 40597

SEQ ID NO: 203258 - RNA, 64 nt, Homo Sapiens; identical to SEQ ID NO: 40598

SEQ ID NO: 203259 - RNA, 64 nt, Homo Sapiens; identical to SEQ ID NO: 40599

SEQ ID NO: 203260 - RNA, 64 nt, Homo Sapiens; identical to SEQ ID NO: 40600

SEQ ID NO: 203261 - RNA, 64 nt, Homo Sapiens; identical to SEQ ID NO: 40601

SEQ ID NO: 203262 - RNA, 64 nt, Homo Sapiens; identical to SEQ ID NO: 40602

SEQ ID NO: 203263 - RNA, 64 nt, Homo Sapiens; identical to SEQ ID NO: 40603

SEQ ID NO: 203264 - RNA, 64 nt, Homo Sapiens; identical to SEQ ID NO: 40604

SEQ ID NO: 203265 - RNA, 64 nt, Homo Sapiens; identical to SEQ ID NO: 40605

SEQ ID NO: 203266 - RNA, 64 nt, Homo Sapiens; identical to SEQ ID NO: 40606

SEQ ID NO: 203267 - RNA, 64 nt, Homo Sapiens; identical to SEQ ID NO: 40607

SEQ ID NO: 203268 - RNA, 64 nt, Homo Sapiens; identical to SEQ ID NO: 40608

SEQ ID NO: 203269 - RNA, 64 nt, Homo Sapiens; identical to SEQ ID NO: 40609

SEQ ID NO: 203270 - RNA, 64 nt, Homo Sapiens; identical to SEQ ID NO: 40610

SEQ ID NO: 203271 - RNA, 64 nt, Homo Sapiens; identical to SEQ ID NO: 40611

SEQ ID NO: 203272 - RNA, 64 nt, Homo Sapiens; identical to SEQ ID NO: 40612

SEQ ID NO: 203273 - RNA, 64 nt, Homo Sapiens; identical to SEQ ID NO: 40613

SEQ ID NO: 203274 - RNA, 64 nt, Homo Sapiens; identical to SEQ ID NO: 40614

SEQ ID NO: 203275 - RNA, 64 nt, Homo Sapiens; identical to SEQ ID NO: 40615

SEQ ID NO: 203276 - RNA, 64 nt, Homo Sapiens; identical to SEQ ID NO: 40616

SEQ ID NO: 203277 - RNA, 64 nt, Homo Sapiens; identical to SEQ ID NO: 40617

SEQ ID NO: 203278 - RNA, 64 nt, Homo Sapiens; identical to SEQ ID NO: 40618

SEQ ID NO: 203279 - RNA, 64 nt, Homo Sapiens; identical to SEQ ID NO: 40619

SEQ ID NO: 203280 - RNA, 64 nt, Homo Sapiens; identical to SEQ ID NO: 40620

SEQ ID NO: 203281 - RNA, 64 nt, Homo Sapiens; identical to SEQ ID NO: 40621

SEQ ID NO: 203282 - RNA, 64 nt, Homo Sapiens; identical to SEQ ID NO: 40622

SEQ ID NO: 203283 - RNA, 64 nt, Homo Sapiens; identical to SEQ ID NO: 40623

SEQ ID NO: 203284 - RNA, 64 nt, Homo Sapiens; identical to SEQ ID NO: 40624

SEQ ID NO: 203285 - RNA, 64 nt, Homo Sapiens; identical to SEQ ID NO: 40625

SEQ ID NO: 203286 - RNA, 64 nt, Homo Sapiens; identical to SEQ ID NO: 40626

SEQ ID NO: 203287 - RNA, 64 nt, Homo Sapiens; identical to SEQ ID NO: 40627

SEQ ID NO: 203288 - RNA, 64 nt, Homo Sapiens; identical to SEQ ID NO: 40628

SEQ ID NO: 203289 - RNA, 64 nt, Homo Sapiens; identical to SEQ ID NO: 40629

SEQ ID NO: 203290 - RNA, 64 nt, Homo Sapiens; identical to SEQ ID NO: 40630

SEQ ID NO: 203291 - RNA, 64 nt, Homo Sapiens; identical to SEQ ID NO: 40631

SEQ ID NO: 203292 - RNA, 64 nt, Homo Sapiens; identical to SEQ ID NO: 40632

SEQ ID NO: 203293 - RNA, 64 nt, Homo Sapiens; identical to SEQ ID NO: 40633

SEQ ID NO: 203294 - RNA, 64 nt, Homo Sapiens; identical to SEQ ID NO: 40634

SEQ ID NO: 203295 - RNA, 64 nt, Homo Sapiens; identical to SEQ ID NO: 40635

SEQ ID NO: 203296 - RNA, 64 nt, Homo Sapiens; identical to SEQ ID NO: 40636

SEQ ID NO: 203297 - RNA, 64 nt, Homo Sapiens; identical to SEQ ID NO: 40637

SEQ ID NO: 203298 - RNA, 64 nt, Homo Sapiens; identical to SEQ ID NO: 40638

SEQ ID NO: 203299 - RNA, 64 nt, Homo Sapiens; identical to SEQ ID NO: 40639

SEQ ID NO: 203300 - RNA, 64 nt, Homo Sapiens; identical to SEQ ID NO: 40640

SEQ ID NO: 203301 - RNA, 64 nt, Homo Sapiens; identical to SEQ ID NO: 40641

SEQ ID NO: 203302 - RNA, 64 nt, Homo Sapiens; identical to SEQ ID NO: 40642

SEQ ID NO: 203303 - RNA, 64 nt, Homo Sapiens; identical to SEQ ID NO: 40643

SEQ ID NO: 203304 - RNA, 64 nt, Homo Sapiens; identical to SEQ ID NO: 40644

SEQ ID NO: 203305 - RNA, 64 nt, Homo Sapiens; identical to SEQ ID NO: 40645

SEQ ID NO: 203306 - RNA, 64 nt, Homo Sapiens; identical to SEQ ID NO: 40646

SEQ ID NO: 203307 - RNA, 64 nt, Homo Sapiens; identical to SEQ ID NO: 40647

SEQ ID NO: 203308 - RNA, 64 nt, Homo Sapiens; identical to SEQ ID NO: 40648

SEQ ID NO: 203309 - RNA, 64 nt, Homo Sapiens; identical to SEQ ID NO: 40649

SEQ ID NO: 203310 - RNA, 64 nt, Homo Sapiens; identical to SEQ ID NO: 40650

SEQ ID NO: 203311 - RNA, 64 nt, Homo Sapiens; identical to SEQ ID NO: 40651

SEQ ID NO: 203312 - RNA, 64 nt, Homo Sapiens; identical to SEQ ID NO: 40652

SEQ ID NO: 203313 - RNA, 64 nt, Homo Sapiens; identical to SEQ ID NO: 40653

SEQ ID NO: 203314 - RNA, 64 nt, Homo Sapiens; identical to SEQ ID NO: 40654

SEQ ID NO: 203315 - RNA, 64 nt, Homo Sapiens; identical to SEQ ID NO: 40655

SEQ ID NO: 203316 - RNA, 64 nt, Homo Sapiens; identical to SEQ ID NO: 40656

SEQ ID NO: 203317 - RNA, 64 nt, Homo Sapiens; identical to SEQ ID NO: 40657

SEQ ID NO: 203318 - RNA, 64 nt, Homo Sapiens; identical to SEQ ID NO: 40658

SEQ ID NO: 203319 - RNA, 64 nt, Homo Sapiens; identical to SEQ ID NO: 40659

SEQ ID NO: 203320 - RNA, 64 nt, Homo Sapiens; identical to SEQ ID NO: 40660

SEQ ID NO: 203321 - RNA, 64 nt, Homo Sapiens; identical to SEQ ID NO: 40661

SEQ ID NO: 203322 - RNA, 64 nt, Homo Sapiens; identical to SEQ ID NO: 40662

SEQ ID NO: 203323 - RNA, 64 nt, Homo Sapiens; identical to SEQ ID NO: 40663

SEQ ID NO: 203324 - RNA, 64 nt, Homo Sapiens; identical to SEQ ID NO: 40664

SEQ ID NO: 203325 - RNA, 64 nt, Homo Sapiens; identical to SEQ ID NO: 40665

SEQ ID NO: 203326 - RNA, 64 nt, Homo Sapiens; identical to SEQ ID NO: 40666

SEQ ID NO: 203327 - RNA, 64 nt, Homo Sapiens; identical to SEQ ID NO: 40667

SEQ ID NO: 203328 - RNA, 64 nt, Homo Sapiens; identical to SEQ ID NO: 40668

SEQ ID NO: 203329 - RNA, 64 nt, Homo Sapiens; identical to SEQ ID NO: 40669

SEQ ID NO: 203330 - RNA, 64 nt, Homo Sapiens; identical to SEQ ID NO: 40670

SEQ ID NO: 203331 - RNA, 64 nt, Homo Sapiens; identical to SEQ ID NO: 40671

SEQ ID NO: 203332 - RNA, 64 nt, Homo Sapiens; identical to SEQ ID NO: 40672

SEQ ID NO: 203333 - RNA, 64 nt, Homo Sapiens; identical to SEQ ID NO: 40673

SEQ ID NO: 203334 - RNA, 64 nt, Homo Sapiens; identical to SEQ ID NO: 40674

SEQ ID NO: 203335 - RNA, 64 nt, Homo Sapiens; identical to SEQ ID NO: 40675

SEQ ID NO: 203336 - RNA, 64 nt, Homo Sapiens; identical to SEQ ID NO: 40676

SEQ ID NO: 203337 - RNA, 64 nt, Homo Sapiens; identical to SEQ ID NO: 40677

SEQ ID NO: 203338 - RNA, 64 nt, Homo Sapiens; identical to SEQ ID NO: 40678

SEQ ID NO: 203339 - RNA, 64 nt, Homo Sapiens; identical to SEQ ID NO: 40679

SEQ ID NO: 203340 - RNA, 64 nt, Homo Sapiens; identical to SEQ ID NO: 40680

SEQ ID NO: 203341 - RNA, 64 nt, Homo Sapiens; identical to SEQ ID NO: 40681

SEQ ID NO: 203342 - RNA, 64 nt, Homo Sapiens; identical to SEQ ID NO: 40682

SEQ ID NO: 203343 - RNA, 64 nt, Homo Sapiens; identical to SEQ ID NO: 40683

SEQ ID NO: 203344 - RNA, 64 nt, Homo Sapiens; identical to SEQ ID NO: 40684

SEQ ID NO: 203345 - RNA, 64 nt, Homo Sapiens; identical to SEQ ID NO: 40685

SEQ ID NO: 203346 - RNA, 64 nt, Homo Sapiens; identical to SEQ ID NO: 40686

SEQ ID NO: 203347 - RNA, 64 nt, Homo Sapiens; identical to SEQ ID NO: 40687

SEQ ID NO: 203348 - RNA, 64 nt, Homo Sapiens; identical to SEQ ID NO: 40688

SEQ ID NO: 203349 - RNA, 64 nt, Homo Sapiens; identical to SEQ ID NO: 40689

SEQ ID NO: 203350 - RNA, 64 nt, Homo Sapiens; identical to SEQ ID NO: 40690

SEQ ID NO: 203351 - RNA, 64 nt, Homo Sapiens; identical to SEQ ID NO: 40691

SEQ ID NO: 203352 - RNA, 64 nt, Homo Sapiens; identical to SEQ ID NO: 40692

SEQ ID NO: 203353 - RNA, 64 nt, Homo Sapiens; identical to SEQ ID NO: 40693

SEQ ID NO: 203354 - RNA, 64 nt, Homo Sapiens; identical to SEQ ID NO: 40694

SEQ ID NO: 203355 - RNA, 64 nt, Homo Sapiens; identical to SEQ ID NO: 40695

SEQ ID NO: 203356 - RNA, 64 nt, Homo Sapiens; identical to SEQ ID NO: 40696

SEQ ID NO: 203357 - RNA, 64 nt, Homo Sapiens; identical to SEQ ID NO: 40697

SEQ ID NO: 203358 - RNA, 64 nt, Homo Sapiens; identical to SEQ ID NO: 40698

SEQ ID NO: 203359 - RNA, 64 nt, Homo Sapiens; identical to SEQ ID NO: 40699

SEQ ID NO: 203360 - RNA, 64 nt, Homo Sapiens; identical to SEQ ID NO: 40700

SEQ ID NO: 203361 - RNA, 64 nt, Homo Sapiens; identical to SEQ ID NO: 40701

SEQ ID NO: 203362 - RNA, 64 nt, Homo Sapiens; identical to SEQ ID NO: 40702

SEQ ID NO: 203363 - RNA, 64 nt, Homo Sapiens; identical to SEQ ID NO: 40703

SEQ ID NO: 203364 - RNA, 64 nt, Homo Sapiens; identical to SEQ ID NO: 40704

SEQ ID NO: 203365 - RNA, 64 nt, Homo Sapiens; identical to SEQ ID NO: 40705

SEQ ID NO: 203366 - RNA, 64 nt, Homo Sapiens; identical to SEQ ID NO: 40706

SEQ ID NO: 203367 - RNA, 64 nt, Homo Sapiens; identical to SEQ ID NO: 40707

SEQ ID NO: 203368 - RNA, 64 nt, Homo Sapiens; identical to SEQ ID NO: 40708

SEQ ID NO: 203369 - RNA, 64 nt, Homo Sapiens; identical to SEQ ID NO: 40709

SEQ ID NO: 203370 - RNA, 64 nt, Homo Sapiens; identical to SEQ ID NO: 40710

SEQ ID NO: 203371 - RNA, 64 nt, Homo Sapiens; identical to SEQ ID NO: 40711

SEQ ID NO: 203372 - RNA, 64 nt, Homo Sapiens; identical to SEQ ID NO: 40712

SEQ ID NO: 203373 - RNA, 64 nt, Homo Sapiens; identical to SEQ ID NO: 40713

SEQ ID NO: 203374 - RNA, 64 nt, Homo Sapiens; identical to SEQ ID NO: 40714

SEQ ID NO: 203375 - RNA, 64 nt, Homo Sapiens; identical to SEQ ID NO: 40715

SEQ ID NO: 203376 - RNA, 64 nt, Homo Sapiens; identical to SEQ ID NO: 40716

SEQ ID NO: 203377 - RNA, 64 nt, Homo Sapiens; identical to SEQ ID NO: 40717

SEQ ID NO: 203378 - RNA, 64 nt, Homo Sapiens; identical to SEQ ID NO: 40718

SEQ ID NO: 203379 - RNA, 64 nt, Homo Sapiens; identical to SEQ ID NO: 40719

SEQ ID NO: 203380 - RNA, 64 nt, Homo Sapiens; identical to SEQ ID NO: 40720

SEQ ID NO: 203381 - RNA, 64 nt, Homo Sapiens; identical to SEQ ID NO: 40721

SEQ ID NO: 203382 - RNA, 64 nt, Homo Sapiens; identical to SEQ ID NO: 40722

SEQ ID NO: 203383 - RNA, 64 nt, Homo Sapiens; identical to SEQ ID NO: 40723

SEQ ID NO: 203384 - RNA, 64 nt, Homo Sapiens; identical to SEQ ID NO: 40724

SEQ ID NO: 203385 - RNA, 64 nt, Homo Sapiens; identical to SEQ ID NO: 40725

SEQ ID NO: 203386 - RNA, 64 nt, Homo Sapiens; identical to SEQ ID NO: 40726

SEQ ID NO: 203387 - RNA, 64 nt, Homo Sapiens; identical to SEQ ID NO: 40727

SEQ ID NO: 203388 - RNA, 64 nt, Homo Sapiens; identical to SEQ ID NO: 40728

SEQ ID NO: 203389 - RNA, 64 nt, Homo Sapiens; identical to SEQ ID NO: 40729

SEQ ID NO: 203390 - RNA, 64 nt, Homo Sapiens; identical to SEQ ID NO: 40730

SEQ ID NO: 203391 - RNA, 64 nt, Homo Sapiens; identical to SEQ ID NO: 40731

SEQ ID NO: 203392 - RNA, 64 nt, Homo Sapiens; identical to SEQ ID NO: 40732

SEQ ID NO: 203393 - RNA, 64 nt, Homo Sapiens; identical to SEQ ID NO: 40733

SEQ ID NO: 203394 - RNA, 64 nt, Homo Sapiens; identical to SEQ ID NO: 40734

SEQ ID NO: 203395 - RNA, 64 nt, Homo Sapiens; identical to SEQ ID NO: 40735

SEQ ID NO: 203396 - RNA, 64 nt, Homo Sapiens; identical to SEQ ID NO: 40736

SEQ ID NO: 203397 - RNA, 64 nt, Homo Sapiens; identical to SEQ ID NO: 40737

SEQ ID NO: 203398 - RNA, 64 nt, Homo Sapiens; identical to SEQ ID NO: 40738

SEQ ID NO: 203399 - RNA, 64 nt, Homo Sapiens; identical to SEQ ID NO: 40739

SEQ ID NO: 203400 - RNA, 64 nt, Homo Sapiens; identical to SEQ ID NO: 40740

SEQ ID NO: 203401 - RNA, 64 nt, Homo Sapiens; identical to SEQ ID NO: 40741

SEQ ID NO: 203402 - RNA, 64 nt, Homo Sapiens; identical to SEQ ID NO: 40742

SEQ ID NO: 203403 - RNA, 64 nt, Homo Sapiens; identical to SEQ ID NO: 40743

SEQ ID NO: 203404 - RNA, 64 nt, Homo Sapiens; identical to SEQ ID NO: 40744

SEQ ID NO: 203405 - RNA, 64 nt, Homo Sapiens; identical to SEQ ID NO: 40745

SEQ ID NO: 203406 - RNA, 64 nt, Homo Sapiens; identical to SEQ ID NO: 40746

SEQ ID NO: 203407 - RNA, 64 nt, Homo Sapiens; identical to SEQ ID NO: 40747

SEQ ID NO: 203408 - RNA, 64 nt, Homo Sapiens; identical to SEQ ID NO: 40748

SEQ ID NO: 203409 - RNA, 64 nt, Homo Sapiens; identical to SEQ ID NO: 40749

SEQ ID NO: 203410 - RNA, 64 nt, Homo Sapiens; identical to SEQ ID NO: 40750

SEQ ID NO: 203411 - RNA, 64 nt, Homo Sapiens; identical to SEQ ID NO: 40751

SEQ ID NO: 203412 - RNA, 64 nt, Homo Sapiens; identical to SEQ ID NO: 40752

SEQ ID NO: 203413 - RNA, 64 nt, Homo Sapiens; identical to SEQ ID NO: 40753

SEQ ID NO: 203414 - RNA, 64 nt, Homo Sapiens; identical to SEQ ID NO: 40754

SEQ ID NO: 203415 - RNA, 64 nt, Homo Sapiens; identical to SEQ ID NO: 40755

SEQ ID NO: 203416 - RNA, 64 nt, Homo Sapiens; identical to SEQ ID NO: 40756

SEQ ID NO: 203417 - RNA, 64 nt, Homo Sapiens; identical to SEQ ID NO: 40757

SEQ ID NO: 203418 - RNA, 64 nt, Homo Sapiens; identical to SEQ ID NO: 40758

SEQ ID NO: 203419 - RNA, 64 nt, Homo Sapiens; identical to SEQ ID NO: 40759

SEQ ID NO: 203420 - RNA, 64 nt, Homo Sapiens; identical to SEQ ID NO: 40760

SEQ ID NO: 203421 - RNA, 64 nt, Homo Sapiens; identical to SEQ ID NO: 40761

SEQ ID NO: 203422 - RNA, 64 nt, Homo Sapiens; identical to SEQ ID NO: 40762

SEQ ID NO: 203423 - RNA, 64 nt, Homo Sapiens; identical to SEQ ID NO: 40763

SEQ ID NO: 203424 - RNA, 64 nt, Homo Sapiens; identical to SEQ ID NO: 40764

SEQ ID NO: 203425 - RNA, 64 nt, Homo Sapiens; identical to SEQ ID NO: 40765

SEQ ID NO: 203426 - RNA, 64 nt, Homo Sapiens; identical to SEQ ID NO: 40766

SEQ ID NO: 203427 - RNA, 64 nt, Homo Sapiens; identical to SEQ ID NO: 40767

SEQ ID NO: 203428 - RNA, 64 nt, Homo Sapiens; identical to SEQ ID NO: 40768

SEQ ID NO: 203429 - RNA, 64 nt, Homo Sapiens; identical to SEQ ID NO: 40769

SEQ ID NO: 203430 - RNA, 64 nt, Homo Sapiens; identical to SEQ ID NO: 40770

SEQ ID NO: 203431 - RNA, 64 nt, Homo Sapiens; identical to SEQ ID NO: 40771

SEQ ID NO: 203432 - RNA, 64 nt, Homo Sapiens; identical to SEQ ID NO: 40772

SEQ ID NO: 203433 - RNA, 64 nt, Homo Sapiens; identical to SEQ ID NO: 40773

SEQ ID NO: 203434 - RNA, 64 nt, Homo Sapiens; identical to SEQ ID NO: 40774

SEQ ID NO: 203435 - RNA, 64 nt, Homo Sapiens; identical to SEQ ID NO: 40775

SEQ ID NO: 203436 - RNA, 64 nt, Homo Sapiens; identical to SEQ ID NO: 40776

SEQ ID NO: 203437 - RNA, 64 nt, Homo Sapiens; identical to SEQ ID NO: 40777

SEQ ID NO: 203438 - RNA, 64 nt, Homo Sapiens; identical to SEQ ID NO: 40778

SEQ ID NO: 203439 - RNA, 64 nt, Homo Sapiens; identical to SEQ ID NO: 40779

SEQ ID NO: 203440 - RNA, 64 nt, Homo Sapiens; identical to SEQ ID NO: 40780

SEQ ID NO: 203441 - RNA, 64 nt, Homo Sapiens; identical to SEQ ID NO: 40781

SEQ ID NO: 203442 - RNA, 64 nt, Homo Sapiens; identical to SEQ ID NO: 40782

SEQ ID NO: 203443 - RNA, 64 nt, Homo Sapiens; identical to SEQ ID NO: 40783

SEQ ID NO: 203444 - RNA, 64 nt, Homo Sapiens; identical to SEQ ID NO: 40784

SEQ ID NO: 203445 - RNA, 64 nt, Homo Sapiens; identical to SEQ ID NO: 40785

SEQ ID NO: 203446 - RNA, 64 nt, Homo Sapiens; identical to SEQ ID NO: 40786

SEQ ID NO: 203447 - RNA, 64 nt, Homo Sapiens; identical to SEQ ID NO: 40787

SEQ ID NO: 203448 - RNA, 64 nt, Homo Sapiens; identical to SEQ ID NO: 40788

SEQ ID NO: 203449 - RNA, 64 nt, Homo Sapiens; identical to SEQ ID NO: 40789

SEQ ID NO: 203450 - RNA, 64 nt, Homo Sapiens; identical to SEQ ID NO: 40790

SEQ ID NO: 203451 - RNA, 64 nt, Homo Sapiens; identical to SEQ ID NO: 40791

SEQ ID NO: 203452 - RNA, 64 nt, Homo Sapiens; identical to SEQ ID NO: 40792

SEQ ID NO: 203453 - RNA, 64 nt, Homo Sapiens; identical to SEQ ID NO: 40793

SEQ ID NO: 203454 - RNA, 64 nt, Homo Sapiens; identical to SEQ ID NO: 40794

SEQ ID NO: 203455 - RNA, 64 nt, Homo Sapiens; identical to SEQ ID NO: 40795

SEQ ID NO: 203456 - RNA, 64 nt, Homo Sapiens; identical to SEQ ID NO: 40796

SEQ ID NO: 203457 - RNA, 64 nt, Homo Sapiens; identical to SEQ ID NO: 40797

SEQ ID NO: 203458 - RNA, 64 nt, Homo Sapiens; identical to SEQ ID NO: 40798

SEQ ID NO: 203459 - RNA, 64 nt, Homo Sapiens; identical to SEQ ID NO: 40799

SEQ ID NO: 203460 - RNA, 64 nt, Homo Sapiens; identical to SEQ ID NO: 40800

SEQ ID NO: 203461 - RNA, 64 nt, Homo Sapiens; identical to SEQ ID NO: 40801

SEQ ID NO: 203462 - RNA, 64 nt, Homo Sapiens; identical to SEQ ID NO: 40802

SEQ ID NO: 203463 - RNA, 64 nt, Homo Sapiens; identical to SEQ ID NO: 40803

SEQ ID NO: 203464 - RNA, 64 nt, Homo Sapiens; identical to SEQ ID NO: 40804

SEQ ID NO: 203465 - RNA, 64 nt, Homo Sapiens; identical to SEQ ID NO: 40805

SEQ ID NO: 203466 - RNA, 64 nt, Homo Sapiens; identical to SEQ ID NO: 40806

SEQ ID NO: 203467 - RNA, 64 nt, Homo Sapiens; identical to SEQ ID NO: 40807

SEQ ID NO: 203468 - RNA, 64 nt, Homo Sapiens; identical to SEQ ID NO: 40808

SEQ ID NO: 203469 - RNA, 64 nt, Homo Sapiens; identical to SEQ ID NO: 40809

SEQ ID NO: 203470 - RNA, 64 nt, Homo Sapiens; identical to SEQ ID NO: 40810

SEQ ID NO: 203471 - RNA, 64 nt, Homo Sapiens; identical to SEQ ID NO: 40811

SEQ ID NO: 203472 - RNA, 64 nt, Homo Sapiens; identical to SEQ ID NO: 40812

SEQ ID NO: 203473 - RNA, 64 nt, Homo Sapiens; identical to SEQ ID NO: 40813

SEQ ID NO: 203474 - RNA, 64 nt, Homo Sapiens; identical to SEQ ID NO: 40814

SEQ ID NO: 203475 - RNA, 64 nt, Homo Sapiens; identical to SEQ ID NO: 40815

SEQ ID NO: 203476 - RNA, 64 nt, Homo Sapiens; identical to SEQ ID NO: 40816

SEQ ID NO: 203477 - RNA, 64 nt, Homo Sapiens; identical to SEQ ID NO: 40817

SEQ ID NO: 203478 - RNA, 64 nt, Homo Sapiens; identical to SEQ ID NO: 40818

SEQ ID NO: 203479 - RNA, 64 nt, Homo Sapiens; identical to SEQ ID NO: 40819

SEQ ID NO: 203480 - RNA, 64 nt, Homo Sapiens; identical to SEQ ID NO: 40820

SEQ ID NO: 203481 - RNA, 64 nt, Homo Sapiens; identical to SEQ ID NO: 40821

SEQ ID NO: 203482 - RNA, 64 nt, Homo Sapiens; identical to SEQ ID NO: 40822

SEQ ID NO: 203483 - RNA, 64 nt, Homo Sapiens; identical to SEQ ID NO: 40823

SEQ ID NO: 203484 - RNA, 64 nt, Homo Sapiens; identical to SEQ ID NO: 40824

SEQ ID NO: 203485 - RNA, 64 nt, Homo Sapiens; identical to SEQ ID NO: 40825

SEQ ID NO: 203486 - RNA, 64 nt, Homo Sapiens; identical to SEQ ID NO: 40826

SEQ ID NO: 203487 - RNA, 64 nt, Homo Sapiens; identical to SEQ ID NO: 40827

SEQ ID NO: 203488 - RNA, 64 nt, Homo Sapiens; identical to SEQ ID NO: 40828

SEQ ID NO: 203489 - RNA, 64 nt, Homo Sapiens; identical to SEQ ID NO: 40829

SEQ ID NO: 203490 - RNA, 64 nt, Homo Sapiens; identical to SEQ ID NO: 40830

SEQ ID NO: 203491 - RNA, 64 nt, Homo Sapiens; identical to SEQ ID NO: 40831

SEQ ID NO: 203492 - RNA, 64 nt, Homo Sapiens; identical to SEQ ID NO: 40832

SEQ ID NO: 203493 - RNA, 64 nt, Homo Sapiens; identical to SEQ ID NO: 40833

SEQ ID NO: 203494 - RNA, 64 nt, Homo Sapiens; identical to SEQ ID NO: 40834

SEQ ID NO: 203495 - RNA, 64 nt, Homo Sapiens; identical to SEQ ID NO: 40835

SEQ ID NO: 203496 - RNA, 64 nt, Homo Sapiens; identical to SEQ ID NO: 40836

SEQ ID NO: 203497 - RNA, 64 nt, Homo Sapiens; identical to SEQ ID NO: 40837

SEQ ID NO: 203498 - RNA, 64 nt, Homo Sapiens; identical to SEQ ID NO: 40838

SEQ ID NO: 203499 - RNA, 64 nt, Homo Sapiens; identical to SEQ ID NO: 40839

SEQ ID NO: 203500 - RNA, 64 nt, Homo Sapiens; identical to SEQ ID NO: 40840

SEQ ID NO: 203501 - RNA, 64 nt, Homo Sapiens; identical to SEQ ID NO: 40841

SEQ ID NO: 203502 - RNA, 64 nt, Homo Sapiens; identical to SEQ ID NO: 40842

SEQ ID NO: 203503 - RNA, 64 nt, Homo Sapiens; identical to SEQ ID NO: 40843

SEQ ID NO: 203504 - RNA, 64 nt, Homo Sapiens; identical to SEQ ID NO: 40844

SEQ ID NO: 203505 - RNA, 64 nt, Homo Sapiens; identical to SEQ ID NO: 40845

SEQ ID NO: 203506 - RNA, 64 nt, Homo Sapiens; identical to SEQ ID NO: 40846

SEQ ID NO: 203507 - RNA, 64 nt, Homo Sapiens; identical to SEQ ID NO: 40847

SEQ ID NO: 203508 - RNA, 64 nt, Homo Sapiens; identical to SEQ ID NO: 40848

SEQ ID NO: 203509 - RNA, 64 nt, Homo Sapiens; identical to SEQ ID NO: 40849

SEQ ID NO: 203510 - RNA, 64 nt, Homo Sapiens; identical to SEQ ID NO: 40850

SEQ ID NO: 203511 - RNA, 64 nt, Homo Sapiens; identical to SEQ ID NO: 40851

SEQ ID NO: 203512 - RNA, 64 nt, Homo Sapiens; identical to SEQ ID NO: 40852

SEQ ID NO: 203513 - RNA, 64 nt, Homo Sapiens; identical to SEQ ID NO: 40853

SEQ ID NO: 203514 - RNA, 64 nt, Homo Sapiens; identical to SEQ ID NO: 40854

SEQ ID NO: 203515 - RNA, 64 nt, Homo Sapiens; identical to SEQ ID NO: 40855

SEQ ID NO: 203516 - RNA, 64 nt, Homo Sapiens; identical to SEQ ID NO: 40856

SEQ ID NO: 203517 - RNA, 64 nt, Homo Sapiens; identical to SEQ ID NO: 40857

SEQ ID NO: 203518 - RNA, 64 nt, Homo Sapiens; identical to SEQ ID NO: 40858

SEQ ID NO: 203519 - RNA, 64 nt, Homo Sapiens; identical to SEQ ID NO: 40859

SEQ ID NO: 203520 - RNA, 64 nt, Homo Sapiens; identical to SEQ ID NO: 40860

SEQ ID NO: 203521 - RNA, 64 nt, Homo Sapiens; identical to SEQ ID NO: 40861

SEQ ID NO: 203522 - RNA, 64 nt, Homo Sapiens; identical to SEQ ID NO: 40862

SEQ ID NO: 203523 - RNA, 64 nt, Homo Sapiens; identical to SEQ ID NO: 40863

SEQ ID NO: 203524 - RNA, 64 nt, Homo Sapiens; identical to SEQ ID NO: 40864

SEQ ID NO: 203525 - RNA, 64 nt, Homo Sapiens; identical to SEQ ID NO: 40865

SEQ ID NO: 203526 - RNA, 64 nt, Homo Sapiens; identical to SEQ ID NO: 40866

SEQ ID NO: 203527 - RNA, 64 nt, Homo Sapiens; identical to SEQ ID NO: 40867

SEQ ID NO: 203528 - RNA, 64 nt, Homo Sapiens; identical to SEQ ID NO: 40868

SEQ ID NO: 203529 - RNA, 64 nt, Homo Sapiens; identical to SEQ ID NO: 40869

SEQ ID NO: 203530 - RNA, 64 nt, Homo Sapiens; identical to SEQ ID NO: 40870

SEQ ID NO: 203531 - RNA, 64 nt, Homo Sapiens; identical to SEQ ID NO: 40871

SEQ ID NO: 203532 - RNA, 64 nt, Homo Sapiens; identical to SEQ ID NO: 40872

SEQ ID NO: 203533 - RNA, 64 nt, Homo Sapiens; identical to SEQ ID NO: 40873

SEQ ID NO: 203534 - RNA, 64 nt, Homo Sapiens; identical to SEQ ID NO: 40874

SEQ ID NO: 203535 - RNA, 64 nt, Homo Sapiens; identical to SEQ ID NO: 40875

SEQ ID NO: 203536 - RNA, 64 nt, Homo Sapiens; identical to SEQ ID NO: 40876

SEQ ID NO: 203537 - RNA, 64 nt, Homo Sapiens; identical to SEQ ID NO: 40877

SEQ ID NO: 203538 - RNA, 64 nt, Homo Sapiens; identical to SEQ ID NO: 40878

SEQ ID NO: 203539 - RNA, 64 nt, Homo Sapiens; identical to SEQ ID NO: 40879

SEQ ID NO: 203540 - RNA, 64 nt, Homo Sapiens; identical to SEQ ID NO: 40880

SEQ ID NO: 203541 - RNA, 64 nt, Homo Sapiens; identical to SEQ ID NO: 40881

SEQ ID NO: 203542 - RNA, 64 nt, Homo Sapiens; identical to SEQ ID NO: 40882

SEQ ID NO: 203543 - RNA, 64 nt, Homo Sapiens; identical to SEQ ID NO: 40883

SEQ ID NO: 203544 - RNA, 64 nt, Homo Sapiens; identical to SEQ ID NO: 40884

SEQ ID NO: 203545 - RNA, 64 nt, Homo Sapiens; identical to SEQ ID NO: 40885

SEQ ID NO: 203546 - RNA, 64 nt, Homo Sapiens; identical to SEQ ID NO: 40886

SEQ ID NO: 203547 - RNA, 64 nt, Homo Sapiens; identical to SEQ ID NO: 40887

SEQ ID NO: 203548 - RNA, 64 nt, Homo Sapiens; identical to SEQ ID NO: 40888

SEQ ID NO: 203549 - RNA, 64 nt, Homo Sapiens; identical to SEQ ID NO: 40889

SEQ ID NO: 203550 - RNA, 64 nt, Homo Sapiens; identical to SEQ ID NO: 40890

SEQ ID NO: 203551 - RNA, 64 nt, Homo Sapiens; identical to SEQ ID NO: 40891

SEQ ID NO: 203552 - RNA, 64 nt, Homo Sapiens; identical to SEQ ID NO: 40892

SEQ ID NO: 203553 - RNA, 64 nt, Homo Sapiens; identical to SEQ ID NO: 40893

SEQ ID NO: 203554 - RNA, 64 nt, Homo Sapiens; identical to SEQ ID NO: 40894

SEQ ID NO: 203555 - RNA, 64 nt, Homo Sapiens; identical to SEQ ID NO: 40895

SEQ ID NO: 203556 - RNA, 64 nt, Homo Sapiens; identical to SEQ ID NO: 40896

SEQ ID NO: 203557 - RNA, 64 nt, Homo Sapiens; identical to SEQ ID NO: 40897

SEQ ID NO: 203558 - RNA, 64 nt, Homo Sapiens; identical to SEQ ID NO: 40898

SEQ ID NO: 203559 - RNA, 64 nt, Homo Sapiens; identical to SEQ ID NO: 40899

SEQ ID NO: 203560 - RNA, 64 nt, Homo Sapiens; identical to SEQ ID NO: 40900

SEQ ID NO: 203561 - RNA, 64 nt, Homo Sapiens; identical to SEQ ID NO: 40901

SEQ ID NO: 203562 - RNA, 64 nt, Homo Sapiens; identical to SEQ ID NO: 40902

SEQ ID NO: 203563 - RNA, 64 nt, Homo Sapiens; identical to SEQ ID NO: 40903

SEQ ID NO: 203564 - RNA, 64 nt, Homo Sapiens; identical to SEQ ID NO: 40904

SEQ ID NO: 203565 - RNA, 64 nt, Homo Sapiens; identical to SEQ ID NO: 40905

SEQ ID NO: 203566 - RNA, 64 nt, Homo Sapiens; identical to SEQ ID NO: 40906

SEQ ID NO: 203567 - RNA, 64 nt, Homo Sapiens; identical to SEQ ID NO: 40907

SEQ ID NO: 203568 - RNA, 64 nt, Homo Sapiens; identical to SEQ ID NO: 40908

SEQ ID NO: 203569 - RNA, 64 nt, Homo Sapiens; identical to SEQ ID NO: 40909

SEQ ID NO: 203570 - RNA, 64 nt, Homo Sapiens; identical to SEQ ID NO: 40910

SEQ ID NO: 203571 - RNA, 64 nt, Homo Sapiens; identical to SEQ ID NO: 40911

SEQ ID NO: 203572 - RNA, 64 nt, Homo Sapiens; identical to SEQ ID NO: 40912

SEQ ID NO: 203573 - RNA, 64 nt, Homo Sapiens; identical to SEQ ID NO: 40913

SEQ ID NO: 203574 - RNA, 64 nt, Homo Sapiens; identical to SEQ ID NO: 40914

SEQ ID NO: 203575 - RNA, 64 nt, Homo Sapiens; identical to SEQ ID NO: 40915

SEQ ID NO: 203576 - RNA, 64 nt, Homo Sapiens; identical to SEQ ID NO: 40916

SEQ ID NO: 203577 - RNA, 64 nt, Homo Sapiens; identical to SEQ ID NO: 40917

SEQ ID NO: 203578 - RNA, 64 nt, Homo Sapiens; identical to SEQ ID NO: 40918

SEQ ID NO: 203579 - RNA, 64 nt, Homo Sapiens; identical to SEQ ID NO: 40919

SEQ ID NO: 203580 - RNA, 64 nt, Homo Sapiens; identical to SEQ ID NO: 40920

SEQ ID NO: 203581 - RNA, 64 nt, Homo Sapiens; identical to SEQ ID NO: 40921

SEQ ID NO: 203582 - RNA, 64 nt, Homo Sapiens; identical to SEQ ID NO: 40922

SEQ ID NO: 203583 - RNA, 64 nt, Homo Sapiens; identical to SEQ ID NO: 40923

SEQ ID NO: 203584 - RNA, 64 nt, Homo Sapiens; identical to SEQ ID NO: 40924

SEQ ID NO: 203585 - RNA, 64 nt, Homo Sapiens; identical to SEQ ID NO: 40925

SEQ ID NO: 203586 - RNA, 64 nt, Homo Sapiens; identical to SEQ ID NO: 40926

SEQ ID NO: 203587 - RNA, 64 nt, Homo Sapiens; identical to SEQ ID NO: 40927

SEQ ID NO: 203588 - RNA, 64 nt, Homo Sapiens; identical to SEQ ID NO: 40928

SEQ ID NO: 203589 - RNA, 64 nt, Homo Sapiens; identical to SEQ ID NO: 40929

SEQ ID NO: 203590 - RNA, 64 nt, Homo Sapiens; identical to SEQ ID NO: 40930

SEQ ID NO: 203591 - RNA, 64 nt, Homo Sapiens; identical to SEQ ID NO: 40931

SEQ ID NO: 203592 - RNA, 64 nt, Homo Sapiens; identical to SEQ ID NO: 40932

SEQ ID NO: 203593 - RNA, 64 nt, Homo Sapiens; identical to SEQ ID NO: 40933

SEQ ID NO: 203594 - RNA, 64 nt, Homo Sapiens; identical to SEQ ID NO: 40934

SEQ ID NO: 203595 - RNA, 64 nt, Homo Sapiens; identical to SEQ ID NO: 40935

SEQ ID NO: 203596 - RNA, 64 nt, Homo Sapiens; identical to SEQ ID NO: 40936

SEQ ID NO: 203597 - RNA, 64 nt, Homo Sapiens; identical to SEQ ID NO: 40937

SEQ ID NO: 203598 - RNA, 64 nt, Homo Sapiens; identical to SEQ ID NO: 40938

SEQ ID NO: 203599 - RNA, 64 nt, Homo Sapiens; identical to SEQ ID NO: 40939

SEQ ID NO: 203600 - RNA, 64 nt, Homo Sapiens; identical to SEQ ID NO: 40940

SEQ ID NO: 203601 - RNA, 64 nt, Homo Sapiens; identical to SEQ ID NO: 40941

SEQ ID NO: 203602 - RNA, 64 nt, Homo Sapiens; identical to SEQ ID NO: 40942

SEQ ID NO: 203603 - RNA, 64 nt, Homo Sapiens; identical to SEQ ID NO: 40943

SEQ ID NO: 203604 - RNA, 64 nt, Homo Sapiens; identical to SEQ ID NO: 40944

SEQ ID NO: 203605 - RNA, 64 nt, Homo Sapiens; identical to SEQ ID NO: 40945

SEQ ID NO: 203606 - RNA, 64 nt, Homo Sapiens; identical to SEQ ID NO: 40946

SEQ ID NO: 203607 - RNA, 64 nt, Homo Sapiens; identical to SEQ ID NO: 40947

SEQ ID NO: 203608 - RNA, 64 nt, Homo Sapiens; identical to SEQ ID NO: 40948

SEQ ID NO: 203609 - RNA, 64 nt, Homo Sapiens; identical to SEQ ID NO: 40949

SEQ ID NO: 203610 - RNA, 64 nt, Homo Sapiens; identical to SEQ ID NO: 40950

SEQ ID NO: 203611 - RNA, 64 nt, Homo Sapiens; identical to SEQ ID NO: 40951

SEQ ID NO: 203612 - RNA, 64 nt, Homo Sapiens; identical to SEQ ID NO: 40952

SEQ ID NO: 203613 - RNA, 64 nt, Homo Sapiens; identical to SEQ ID NO: 40953

SEQ ID NO: 203614 - RNA, 64 nt, Homo Sapiens; identical to SEQ ID NO: 40954

SEQ ID NO: 203615 - RNA, 64 nt, Homo Sapiens; identical to SEQ ID NO: 40955

SEQ ID NO: 203616 - RNA, 64 nt, Homo Sapiens; identical to SEQ ID NO: 40956

SEQ ID NO: 203617 - RNA, 64 nt, Homo Sapiens; identical to SEQ ID NO: 40957

SEQ ID NO: 203618 - RNA, 64 nt, Homo Sapiens; identical to SEQ ID NO: 40958

SEQ ID NO: 203619 - RNA, 64 nt, Homo Sapiens; identical to SEQ ID NO: 40959

SEQ ID NO: 203620 - RNA, 64 nt, Homo Sapiens; identical to SEQ ID NO: 40960

SEQ ID NO: 203621 - RNA, 64 nt, Homo Sapiens; identical to SEQ ID NO: 40961

SEQ ID NO: 203622 - RNA, 64 nt, Homo Sapiens; identical to SEQ ID NO: 40962

SEQ ID NO: 203623 - RNA, 64 nt, Homo Sapiens; identical to SEQ ID NO: 40963

SEQ ID NO: 203624 - RNA, 64 nt, Homo Sapiens; identical to SEQ ID NO: 40964

SEQ ID NO: 203625 - RNA, 64 nt, Homo Sapiens; identical to SEQ ID NO: 40965

SEQ ID NO: 203626 - RNA, 64 nt, Homo Sapiens; identical to SEQ ID NO: 40966

SEQ ID NO: 203627 - RNA, 64 nt, Homo Sapiens; identical to SEQ ID NO: 40967

SEQ ID NO: 203628 - RNA, 64 nt, Homo Sapiens; identical to SEQ ID NO: 40968

SEQ ID NO: 203629 - RNA, 64 nt, Homo Sapiens; identical to SEQ ID NO: 40969

SEQ ID NO: 203630 - RNA, 64 nt, Homo Sapiens; identical to SEQ ID NO: 40970

SEQ ID NO: 203631 - RNA, 64 nt, Homo Sapiens; identical to SEQ ID NO: 40971

SEQ ID NO: 203632 - RNA, 64 nt, Homo Sapiens; identical to SEQ ID NO: 40972

SEQ ID NO: 203633 - RNA, 64 nt, Homo Sapiens; identical to SEQ ID NO: 40973

SEQ ID NO: 203634 - RNA, 64 nt, Homo Sapiens; identical to SEQ ID NO: 40974

SEQ ID NO: 203635 - RNA, 64 nt, Homo Sapiens; identical to SEQ ID NO: 40975

SEQ ID NO: 203636 - RNA, 64 nt, Homo Sapiens; identical to SEQ ID NO: 40976

SEQ ID NO: 203637 - RNA, 64 nt, Homo Sapiens; identical to SEQ ID NO: 40977

SEQ ID NO: 203638 - RNA, 64 nt, Homo Sapiens; identical to SEQ ID NO: 40978

SEQ ID NO: 203639 - RNA, 64 nt, Homo Sapiens; identical to SEQ ID NO: 40979

SEQ ID NO: 203640 - RNA, 64 nt, Homo Sapiens; identical to SEQ ID NO: 40980

SEQ ID NO: 203641 - RNA, 64 nt, Homo Sapiens; identical to SEQ ID NO: 40981

SEQ ID NO: 203642 - RNA, 64 nt, Homo Sapiens; identical to SEQ ID NO: 40982

SEQ ID NO: 203643 - RNA, 64 nt, Homo Sapiens; identical to SEQ ID NO: 40983

SEQ ID NO: 203644 - RNA, 64 nt, Homo Sapiens; identical to SEQ ID NO: 40984

SEQ ID NO: 203645 - RNA, 64 nt, Homo Sapiens; identical to SEQ ID NO: 40985

SEQ ID NO: 203646 - RNA, 64 nt, Homo Sapiens; identical to SEQ ID NO: 40986

SEQ ID NO: 203647 - RNA, 64 nt, Homo Sapiens; identical to SEQ ID NO: 40987

SEQ ID NO: 203648 - RNA, 64 nt, Homo Sapiens; identical to SEQ ID NO: 40988

SEQ ID NO: 203649 - RNA, 64 nt, Homo Sapiens; identical to SEQ ID NO: 40989

SEQ ID NO: 203650 - RNA, 64 nt, Homo Sapiens; identical to SEQ ID NO: 40990

SEQ ID NO: 203651 - RNA, 64 nt, Homo Sapiens; identical to SEQ ID NO: 40991

SEQ ID NO: 203652 - RNA, 64 nt, Homo Sapiens; identical to SEQ ID NO: 40992

SEQ ID NO: 203653 - RNA, 64 nt, Homo Sapiens; identical to SEQ ID NO: 40993

SEQ ID NO: 203654 - RNA, 64 nt, Homo Sapiens; identical to SEQ ID NO: 40994

SEQ ID NO: 203655 - RNA, 64 nt, Homo Sapiens; identical to SEQ ID NO: 40995

SEQ ID NO: 203656 - RNA, 64 nt, Homo Sapiens; identical to SEQ ID NO: 40996

SEQ ID NO: 203657 - RNA, 64 nt, Homo Sapiens; identical to SEQ ID NO: 40997

SEQ ID NO: 203658 - RNA, 64 nt, Homo Sapiens; identical to SEQ ID NO: 40998

SEQ ID NO: 203659 - RNA, 64 nt, Homo Sapiens; identical to SEQ ID NO: 40999

SEQ ID NO: 203660 - RNA, 64 nt, Homo Sapiens; identical to SEQ ID NO: 41000

SEQ ID NO: 203661 - RNA, 64 nt, Homo Sapiens; identical to SEQ ID NO: 41001

SEQ ID NO: 203662 - RNA, 64 nt, Homo Sapiens; identical to SEQ ID NO: 41002

SEQ ID NO: 203663 - RNA, 64 nt, Homo Sapiens; identical to SEQ ID NO: 41003

SEQ ID NO: 203664 - RNA, 64 nt, Homo Sapiens; identical to SEQ ID NO: 41004

SEQ ID NO: 203665 - RNA, 64 nt, Homo Sapiens; identical to SEQ ID NO: 41005

SEQ ID NO: 203666 - RNA, 64 nt, Homo Sapiens; identical to SEQ ID NO: 41006

SEQ ID NO: 203667 - RNA, 63 nt, Homo Sapiens; identical to SEQ ID NO: 41007

SEQ ID NO: 203668 - RNA, 64 nt, Homo Sapiens; identical to SEQ ID NO: 41008

SEQ ID NO: 203669 - RNA, 64 nt, Homo Sapiens; identical to SEQ ID NO: 41009

SEQ ID NO: 203670 - RNA, 64 nt, Homo Sapiens; identical to SEQ ID NO: 41010

SEQ ID NO: 203671 - RNA, 64 nt, Homo Sapiens; identical to SEQ ID NO: 41011

SEQ ID NO: 203672 - RNA, 64 nt, Homo Sapiens; identical to SEQ ID NO: 41012

SEQ ID NO: 203673 - RNA, 64 nt, Homo Sapiens; identical to SEQ ID NO: 41013

SEQ ID NO: 203674 - RNA, 64 nt, Homo Sapiens; identical to SEQ ID NO: 41014

SEQ ID NO: 203675 - RNA, 64 nt, Homo Sapiens; identical to SEQ ID NO: 41015

SEQ ID NO: 203676 - RNA, 64 nt, Homo Sapiens; identical to SEQ ID NO: 41016

SEQ ID NO: 203677 - RNA, 64 nt, Homo Sapiens; identical to SEQ ID NO: 41017

SEQ ID NO: 203678 - RNA, 64 nt, Homo Sapiens; identical to SEQ ID NO: 41018

SEQ ID NO: 203679 - RNA, 64 nt, Homo Sapiens; identical to SEQ ID NO: 41019

SEQ ID NO: 203680 - RNA, 64 nt, Homo Sapiens; identical to SEQ ID NO: 41020

SEQ ID NO: 203681 - RNA, 64 nt, Homo Sapiens; identical to SEQ ID NO: 41021

SEQ ID NO: 203682 - RNA, 64 nt, Homo Sapiens; identical to SEQ ID NO: 41022

SEQ ID NO: 203683 - RNA, 64 nt, Homo Sapiens; identical to SEQ ID NO: 41023

SEQ ID NO: 203684 - RNA, 64 nt, Homo Sapiens; identical to SEQ ID NO: 41024

SEQ ID NO: 203685 - RNA, 64 nt, Homo Sapiens; identical to SEQ ID NO: 41025

SEQ ID NO: 203686 - RNA, 64 nt, Homo Sapiens; identical to SEQ ID NO: 41026

SEQ ID NO: 203687 - RNA, 64 nt, Homo Sapiens; identical to SEQ ID NO: 41027

SEQ ID NO: 203688 - RNA, 64 nt, Homo Sapiens; identical to SEQ ID NO: 41028

SEQ ID NO: 203689 - RNA, 64 nt, Homo Sapiens; identical to SEQ ID NO: 41029

SEQ ID NO: 203690 - RNA, 64 nt, Homo Sapiens; identical to SEQ ID NO: 41030

SEQ ID NO: 203691 - RNA, 64 nt, Homo Sapiens; identical to SEQ ID NO: 41031

SEQ ID NO: 203692 - RNA, 64 nt, Homo Sapiens; identical to SEQ ID NO: 41032

SEQ ID NO: 203693 - RNA, 64 nt, Homo Sapiens; identical to SEQ ID NO: 41033

SEQ ID NO: 203694 - RNA, 64 nt, Homo Sapiens; identical to SEQ ID NO: 41034

SEQ ID NO: 203695 - RNA, 64 nt, Homo Sapiens; identical to SEQ ID NO: 41035

SEQ ID NO: 203696 - RNA, 64 nt, Homo Sapiens; identical to SEQ ID NO: 41036

SEQ ID NO: 203697 - RNA, 64 nt, Homo Sapiens; identical to SEQ ID NO: 41037

SEQ ID NO: 203698 - RNA, 64 nt, Homo Sapiens; identical to SEQ ID NO: 41038

SEQ ID NO: 203699 - RNA, 64 nt, Homo Sapiens; identical to SEQ ID NO: 41039

SEQ ID NO: 203700 - RNA, 64 nt, Homo Sapiens; identical to SEQ ID NO: 41040

SEQ ID NO: 203701 - RNA, 64 nt, Homo Sapiens; identical to SEQ ID NO: 41041

SEQ ID NO: 203702 - RNA, 64 nt, Homo Sapiens; identical to SEQ ID NO: 41042

SEQ ID NO: 203703 - RNA, 64 nt, Homo Sapiens; identical to SEQ ID NO: 41043

SEQ ID NO: 203704 - RNA, 64 nt, Homo Sapiens; identical to SEQ ID NO: 41044

SEQ ID NO: 203705 - RNA, 64 nt, Homo Sapiens; identical to SEQ ID NO: 41045

SEQ ID NO: 203706 - RNA, 64 nt, Homo Sapiens; identical to SEQ ID NO: 41046

SEQ ID NO: 203707 - RNA, 64 nt, Homo Sapiens; identical to SEQ ID NO: 41047

SEQ ID NO: 203708 - RNA, 64 nt, Homo Sapiens; identical to SEQ ID NO: 41048

SEQ ID NO: 203709 - RNA, 64 nt, Homo Sapiens; identical to SEQ ID NO: 41049

SEQ ID NO: 203710 - RNA, 64 nt, Homo Sapiens; identical to SEQ ID NO: 41050

SEQ ID NO: 203711 - RNA, 64 nt, Homo Sapiens; identical to SEQ ID NO: 41051

SEQ ID NO: 203712 - RNA, 64 nt, Homo Sapiens; identical to SEQ ID NO: 41052

SEQ ID NO: 203713 - RNA, 64 nt, Homo Sapiens; identical to SEQ ID NO: 41053

SEQ ID NO: 203714 - RNA, 64 nt, Homo Sapiens; identical to SEQ ID NO: 41054

SEQ ID NO: 203715 - RNA, 64 nt, Homo Sapiens; identical to SEQ ID NO: 41055

SEQ ID NO: 203716 - RNA, 64 nt, Homo Sapiens; identical to SEQ ID NO: 41056

SEQ ID NO: 203717 - RNA, 64 nt, Homo Sapiens; identical to SEQ ID NO: 41057

SEQ ID NO: 203718 - RNA, 64 nt, Homo Sapiens; identical to SEQ ID NO: 41058

SEQ ID NO: 203719 - RNA, 64 nt, Homo Sapiens; identical to SEQ ID NO: 41059

SEQ ID NO: 203720 - RNA, 64 nt, Homo Sapiens; identical to SEQ ID NO: 41060

SEQ ID NO: 203721 - RNA, 64 nt, Homo Sapiens; identical to SEQ ID NO: 41061

SEQ ID NO: 203722 - RNA, 64 nt, Homo Sapiens; identical to SEQ ID NO: 41062

SEQ ID NO: 203723 - RNA, 64 nt, Homo Sapiens; identical to SEQ ID NO: 41063

SEQ ID NO: 203724 - RNA, 64 nt, Homo Sapiens; identical to SEQ ID NO: 41064

SEQ ID NO: 203725 - RNA, 64 nt, Homo Sapiens; identical to SEQ ID NO: 41065

SEQ ID NO: 203726 - RNA, 64 nt, Homo Sapiens; identical to SEQ ID NO: 41066

SEQ ID NO: 203727 - RNA, 64 nt, Homo Sapiens; identical to SEQ ID NO: 41067

SEQ ID NO: 203728 - RNA, 64 nt, Homo Sapiens; identical to SEQ ID NO: 41068

SEQ ID NO: 203729 - RNA, 64 nt, Homo Sapiens; identical to SEQ ID NO: 41069

SEQ ID NO: 203730 - RNA, 64 nt, Homo Sapiens; identical to SEQ ID NO: 41070

SEQ ID NO: 203731 - RNA, 64 nt, Homo Sapiens; identical to SEQ ID NO: 41071

SEQ ID NO: 203732 - RNA, 64 nt, Homo Sapiens; identical to SEQ ID NO: 41072

SEQ ID NO: 203733 - RNA, 64 nt, Homo Sapiens; identical to SEQ ID NO: 41073

SEQ ID NO: 203734 - RNA, 64 nt, Homo Sapiens; identical to SEQ ID NO: 41074

SEQ ID NO: 203735 - RNA, 64 nt, Homo Sapiens; identical to SEQ ID NO: 41075

SEQ ID NO: 203736 - RNA, 64 nt, Homo Sapiens; identical to SEQ ID NO: 41076

SEQ ID NO: 203737 - RNA, 64 nt, Homo Sapiens; identical to SEQ ID NO: 41077

SEQ ID NO: 203738 - RNA, 64 nt, Homo Sapiens; identical to SEQ ID NO: 41078

SEQ ID NO: 203739 - RNA, 64 nt, Homo Sapiens; identical to SEQ ID NO: 41079

SEQ ID NO: 203740 - RNA, 64 nt, Homo Sapiens; identical to SEQ ID NO: 41080

SEQ ID NO: 203741 - RNA, 64 nt, Homo Sapiens; identical to SEQ ID NO: 41081

SEQ ID NO: 203742 - RNA, 64 nt, Homo Sapiens; identical to SEQ ID NO: 41082

SEQ ID NO: 203743 - RNA, 64 nt, Homo Sapiens; identical to SEQ ID NO: 41083

SEQ ID NO: 203744 - RNA, 64 nt, Homo Sapiens; identical to SEQ ID NO: 41084

SEQ ID NO: 203745 - RNA, 64 nt, Homo Sapiens; identical to SEQ ID NO: 41085

SEQ ID NO: 203746 - RNA, 64 nt, Homo Sapiens; identical to SEQ ID NO: 41086

SEQ ID NO: 203747 - RNA, 64 nt, Homo Sapiens; identical to SEQ ID NO: 41087

SEQ ID NO: 203748 - RNA, 64 nt, Homo Sapiens; identical to SEQ ID NO: 41088

SEQ ID NO: 203749 - RNA, 64 nt, Homo Sapiens; identical to SEQ ID NO: 41089

SEQ ID NO: 203750 - RNA, 64 nt, Homo Sapiens; identical to SEQ ID NO: 41090

SEQ ID NO: 203751 - RNA, 64 nt, Homo Sapiens; identical to SEQ ID NO: 41091

SEQ ID NO: 203752 - RNA, 64 nt, Homo Sapiens; identical to SEQ ID NO: 41092

SEQ ID NO: 203753 - RNA, 64 nt, Homo Sapiens; identical to SEQ ID NO: 41093

SEQ ID NO: 203754 - RNA, 64 nt, Homo Sapiens; identical to SEQ ID NO: 41094

SEQ ID NO: 203755 - RNA, 64 nt, Homo Sapiens; identical to SEQ ID NO: 41095

SEQ ID NO: 203756 - RNA, 64 nt, Homo Sapiens; identical to SEQ ID NO: 41096

SEQ ID NO: 203757 - RNA, 64 nt, Homo Sapiens; identical to SEQ ID NO: 41097

SEQ ID NO: 203758 - RNA, 64 nt, Homo Sapiens; identical to SEQ ID NO: 41098

SEQ ID NO: 203759 - RNA, 64 nt, Homo Sapiens; identical to SEQ ID NO: 41099

SEQ ID NO: 203760 - RNA, 64 nt, Homo Sapiens; identical to SEQ ID NO: 41100

SEQ ID NO: 203761 - RNA, 64 nt, Homo Sapiens; identical to SEQ ID NO: 41101

SEQ ID NO: 203762 - RNA, 64 nt, Homo Sapiens; identical to SEQ ID NO: 41102

SEQ ID NO: 203763 - RNA, 64 nt, Homo Sapiens; identical to SEQ ID NO: 41103

SEQ ID NO: 203764 - RNA, 64 nt, Homo Sapiens; identical to SEQ ID NO: 41104

SEQ ID NO: 203765 - RNA, 64 nt, Homo Sapiens; identical to SEQ ID NO: 41105

SEQ ID NO: 203766 - RNA, 64 nt, Homo Sapiens; identical to SEQ ID NO: 41106

SEQ ID NO: 203767 - RNA, 64 nt, Homo Sapiens; identical to SEQ ID NO: 41107

SEQ ID NO: 203768 - RNA, 64 nt, Homo Sapiens; identical to SEQ ID NO: 41108

SEQ ID NO: 203769 - RNA, 64 nt, Homo Sapiens; identical to SEQ ID NO: 41109

SEQ ID NO: 203770 - RNA, 64 nt, Homo Sapiens; identical to SEQ ID NO: 41110

SEQ ID NO: 203771 - RNA, 64 nt, Homo Sapiens; identical to SEQ ID NO: 41111

SEQ ID NO: 203772 - RNA, 64 nt, Homo Sapiens; identical to SEQ ID NO: 41112

SEQ ID NO: 203773 - RNA, 64 nt, Homo Sapiens; identical to SEQ ID NO: 41113

SEQ ID NO: 203774 - RNA, 64 nt, Homo Sapiens; identical to SEQ ID NO: 41114

SEQ ID NO: 203775 - RNA, 64 nt, Homo Sapiens; identical to SEQ ID NO: 41115

SEQ ID NO: 203776 - RNA, 64 nt, Homo Sapiens; identical to SEQ ID NO: 41116

SEQ ID NO: 203777 - RNA, 64 nt, Homo Sapiens; identical to SEQ ID NO: 41117

SEQ ID NO: 203778 - RNA, 64 nt, Homo Sapiens; identical to SEQ ID NO: 41118

SEQ ID NO: 203779 - RNA, 64 nt, Homo Sapiens; identical to SEQ ID NO: 41119

SEQ ID NO: 203780 - RNA, 64 nt, Homo Sapiens; identical to SEQ ID NO: 41120

SEQ ID NO: 203781 - RNA, 64 nt, Homo Sapiens; identical to SEQ ID NO: 41121

SEQ ID NO: 203782 - RNA, 64 nt, Homo Sapiens; identical to SEQ ID NO: 41122

SEQ ID NO: 203783 - RNA, 64 nt, Homo Sapiens; identical to SEQ ID NO: 41123

SEQ ID NO: 203784 - RNA, 64 nt, Homo Sapiens; identical to SEQ ID NO: 41124

SEQ ID NO: 203785 - RNA, 64 nt, Homo Sapiens; identical to SEQ ID NO: 41125

SEQ ID NO: 203786 - RNA, 64 nt, Homo Sapiens; identical to SEQ ID NO: 41126

SEQ ID NO: 203787 - RNA, 64 nt, Homo Sapiens; identical to SEQ ID NO: 41127

SEQ ID NO: 203788 - RNA, 64 nt, Homo Sapiens; identical to SEQ ID NO: 41128

SEQ ID NO: 203789 - RNA, 64 nt, Homo Sapiens; identical to SEQ ID NO: 41129

SEQ ID NO: 203790 - RNA, 64 nt, Homo Sapiens; identical to SEQ ID NO: 41130

SEQ ID NO: 203791 - RNA, 64 nt, Homo Sapiens; identical to SEQ ID NO: 41131

SEQ ID NO: 203792 - RNA, 64 nt, Homo Sapiens; identical to SEQ ID NO: 41132

SEQ ID NO: 203793 - RNA, 64 nt, Homo Sapiens; identical to SEQ ID NO: 41133

SEQ ID NO: 203794 - RNA, 64 nt, Homo Sapiens; identical to SEQ ID NO: 41134

SEQ ID NO: 203795 - RNA, 64 nt, Homo Sapiens; identical to SEQ ID NO: 41135

SEQ ID NO: 203796 - RNA, 64 nt, Homo Sapiens; identical to SEQ ID NO: 41136

SEQ ID NO: 203797 - RNA, 64 nt, Homo Sapiens; identical to SEQ ID NO: 41137

SEQ ID NO: 203798 - RNA, 64 nt, Homo Sapiens; identical to SEQ ID NO: 41138

SEQ ID NO: 203799 - RNA, 64 nt, Homo Sapiens; identical to SEQ ID NO: 41139

SEQ ID NO: 203800 - RNA, 64 nt, Homo Sapiens; identical to SEQ ID NO: 41140

SEQ ID NO: 203801 - RNA, 64 nt, Homo Sapiens; identical to SEQ ID NO: 41141

SEQ ID NO: 203802 - RNA, 64 nt, Homo Sapiens; identical to SEQ ID NO: 41142

SEQ ID NO: 203803 - RNA, 64 nt, Homo Sapiens; identical to SEQ ID NO: 41143

SEQ ID NO: 203804 - RNA, 64 nt, Homo Sapiens; identical to SEQ ID NO: 41144

SEQ ID NO: 203805 - RNA, 64 nt, Homo Sapiens; identical to SEQ ID NO: 41145

SEQ ID NO: 203806 - RNA, 64 nt, Homo Sapiens; identical to SEQ ID NO: 41146

SEQ ID NO: 203807 - RNA, 64 nt, Homo Sapiens; identical to SEQ ID NO: 41147

SEQ ID NO: 203808 - RNA, 64 nt, Homo Sapiens; identical to SEQ ID NO: 41148

SEQ ID NO: 203809 - RNA, 64 nt, Homo Sapiens; identical to SEQ ID NO: 41149

SEQ ID NO: 203810 - RNA, 64 nt, Homo Sapiens; identical to SEQ ID NO: 41150

SEQ ID NO: 203811 - RNA, 64 nt, Homo Sapiens; identical to SEQ ID NO: 41151

SEQ ID NO: 203812 - RNA, 64 nt, Homo Sapiens; identical to SEQ ID NO: 41152

SEQ ID NO: 203813 - RNA, 64 nt, Homo Sapiens; identical to SEQ ID NO: 41153

SEQ ID NO: 203814 - RNA, 64 nt, Homo Sapiens; identical to SEQ ID NO: 41154

SEQ ID NO: 203815 - RNA, 64 nt, Homo Sapiens; identical to SEQ ID NO: 41155

SEQ ID NO: 203816 - RNA, 64 nt, Homo Sapiens; identical to SEQ ID NO: 41156

SEQ ID NO: 203817 - RNA, 64 nt, Homo Sapiens; identical to SEQ ID NO: 41157

SEQ ID NO: 203818 - RNA, 64 nt, Homo Sapiens; identical to SEQ ID NO: 41158

SEQ ID NO: 203819 - RNA, 64 nt, Homo Sapiens; identical to SEQ ID NO: 41159

SEQ ID NO: 203820 - RNA, 64 nt, Homo Sapiens; identical to SEQ ID NO: 41160

SEQ ID NO: 203821 - RNA, 64 nt, Homo Sapiens; identical to SEQ ID NO: 41161

SEQ ID NO: 203822 - RNA, 64 nt, Homo Sapiens; identical to SEQ ID NO: 41162

SEQ ID NO: 203823 - RNA, 64 nt, Homo Sapiens; identical to SEQ ID NO: 41163

SEQ ID NO: 203824 - RNA, 64 nt, Homo Sapiens; identical to SEQ ID NO: 41164

SEQ ID NO: 203825 - RNA, 64 nt, Homo Sapiens; identical to SEQ ID NO: 41165

SEQ ID NO: 203826 - RNA, 64 nt, Homo Sapiens; identical to SEQ ID NO: 41166

SEQ ID NO: 203827 - RNA, 64 nt, Homo Sapiens; identical to SEQ ID NO: 41167

SEQ ID NO: 203828 - RNA, 64 nt, Homo Sapiens; identical to SEQ ID NO: 41168

SEQ ID NO: 203829 - RNA, 64 nt, Homo Sapiens; identical to SEQ ID NO: 41169

SEQ ID NO: 203830 - RNA, 64 nt, Homo Sapiens; identical to SEQ ID NO: 41170

SEQ ID NO: 203831 - RNA, 64 nt, Homo Sapiens; identical to SEQ ID NO: 41171

SEQ ID NO: 203832 - RNA, 64 nt, Homo Sapiens; identical to SEQ ID NO: 41172

SEQ ID NO: 203833 - RNA, 64 nt, Homo Sapiens; identical to SEQ ID NO: 41173

SEQ ID NO: 203834 - RNA, 64 nt, Homo Sapiens; identical to SEQ ID NO: 41174

SEQ ID NO: 203835 - RNA, 64 nt, Homo Sapiens; identical to SEQ ID NO: 41175

SEQ ID NO: 203836 - RNA, 64 nt, Homo Sapiens; identical to SEQ ID NO: 41176

SEQ ID NO: 203837 - RNA, 64 nt, Homo Sapiens; identical to SEQ ID NO: 41177

SEQ ID NO: 203838 - RNA, 64 nt, Homo Sapiens; identical to SEQ ID NO: 41178

SEQ ID NO: 203839 - RNA, 64 nt, Homo Sapiens; identical to SEQ ID NO: 41179

SEQ ID NO: 203840 - RNA, 64 nt, Homo Sapiens; identical to SEQ ID NO: 41180

SEQ ID NO: 203841 - RNA, 64 nt, Homo Sapiens; identical to SEQ ID NO: 41181

SEQ ID NO: 203842 - RNA, 64 nt, Homo Sapiens; identical to SEQ ID NO: 41182

SEQ ID NO: 203843 - RNA, 64 nt, Homo Sapiens; identical to SEQ ID NO: 41183

SEQ ID NO: 203844 - RNA, 64 nt, Homo Sapiens; identical to SEQ ID NO: 41184

SEQ ID NO: 203845 - RNA, 64 nt, Homo Sapiens; identical to SEQ ID NO: 41185

SEQ ID NO: 203846 - RNA, 64 nt, Homo Sapiens; identical to SEQ ID NO: 41186

SEQ ID NO: 203847 - RNA, 64 nt, Homo Sapiens; identical to SEQ ID NO: 41187

SEQ ID NO: 203848 - RNA, 64 nt, Homo Sapiens; identical to SEQ ID NO: 41188

SEQ ID NO: 203849 - RNA, 64 nt, Homo Sapiens; identical to SEQ ID NO: 41189

SEQ ID NO: 203850 - RNA, 64 nt, Homo Sapiens; identical to SEQ ID NO: 41190

SEQ ID NO: 203851 - RNA, 64 nt, Homo Sapiens; identical to SEQ ID NO: 41191

SEQ ID NO: 203852 - RNA, 64 nt, Homo Sapiens; identical to SEQ ID NO: 41192

SEQ ID NO: 203853 - RNA, 64 nt, Homo Sapiens; identical to SEQ ID NO: 41193

SEQ ID NO: 203854 - RNA, 64 nt, Homo Sapiens; identical to SEQ ID NO: 41194

SEQ ID NO: 203855 - RNA, 64 nt, Homo Sapiens; identical to SEQ ID NO: 41195

SEQ ID NO: 203856 - RNA, 64 nt, Homo Sapiens; identical to SEQ ID NO: 41196

SEQ ID NO: 203857 - RNA, 64 nt, Homo Sapiens; identical to SEQ ID NO: 41197

SEQ ID NO: 203858 - RNA, 64 nt, Homo Sapiens; identical to SEQ ID NO: 41198

SEQ ID NO: 203859 - RNA, 64 nt, Homo Sapiens; identical to SEQ ID NO: 41199

SEQ ID NO: 203860 - RNA, 64 nt, Homo Sapiens; identical to SEQ ID NO: 41200

SEQ ID NO: 203861 - RNA, 64 nt, Homo Sapiens; identical to SEQ ID NO: 41201

SEQ ID NO: 203862 - RNA, 64 nt, Homo Sapiens; identical to SEQ ID NO: 41202

SEQ ID NO: 203863 - RNA, 64 nt, Homo Sapiens; identical to SEQ ID NO: 41203

SEQ ID NO: 203864 - RNA, 64 nt, Homo Sapiens; identical to SEQ ID NO: 41204

SEQ ID NO: 203865 - RNA, 64 nt, Homo Sapiens; identical to SEQ ID NO: 41205

SEQ ID NO: 203866 - RNA, 64 nt, Homo Sapiens; identical to SEQ ID NO: 41206

SEQ ID NO: 203867 - RNA, 64 nt, Homo Sapiens; identical to SEQ ID NO: 41207

SEQ ID NO: 203868 - RNA, 64 nt, Homo Sapiens; identical to SEQ ID NO: 41208

SEQ ID NO: 203869 - RNA, 64 nt, Homo Sapiens; identical to SEQ ID NO: 41209

SEQ ID NO: 203870 - RNA, 64 nt, Homo Sapiens; identical to SEQ ID NO: 41210

SEQ ID NO: 203871 - RNA, 64 nt, Homo Sapiens; identical to SEQ ID NO: 41211

SEQ ID NO: 203872 - RNA, 64 nt, Homo Sapiens; identical to SEQ ID NO: 41212

SEQ ID NO: 203873 - RNA, 64 nt, Homo Sapiens; identical to SEQ ID NO: 41213

SEQ ID NO: 203874 - RNA, 64 nt, Homo Sapiens; identical to SEQ ID NO: 41214

SEQ ID NO: 203875 - RNA, 64 nt, Homo Sapiens; identical to SEQ ID NO: 41215

SEQ ID NO: 203876 - RNA, 64 nt, Homo Sapiens; identical to SEQ ID NO: 41216

SEQ ID NO: 203877 - RNA, 64 nt, Homo Sapiens; identical to SEQ ID NO: 41217

SEQ ID NO: 203878 - RNA, 64 nt, Homo Sapiens; identical to SEQ ID NO: 41218

SEQ ID NO: 203879 - RNA, 64 nt, Homo Sapiens; identical to SEQ ID NO: 41219

SEQ ID NO: 203880 - RNA, 64 nt, Homo Sapiens; identical to SEQ ID NO: 41220

SEQ ID NO: 203881 - RNA, 64 nt, Homo Sapiens; identical to SEQ ID NO: 41221

SEQ ID NO: 203882 - RNA, 64 nt, Homo Sapiens; identical to SEQ ID NO: 41222

SEQ ID NO: 203883 - RNA, 64 nt, Homo Sapiens; identical to SEQ ID NO: 41223

SEQ ID NO: 203884 - RNA, 64 nt, Homo Sapiens; identical to SEQ ID NO: 41224

SEQ ID NO: 203885 - RNA, 64 nt, Homo Sapiens; identical to SEQ ID NO: 41225

SEQ ID NO: 203886 - RNA, 64 nt, Homo Sapiens; identical to SEQ ID NO: 41226

SEQ ID NO: 203887 - RNA, 64 nt, Homo Sapiens; identical to SEQ ID NO: 41227

SEQ ID NO: 203888 - RNA, 64 nt, Homo Sapiens; identical to SEQ ID NO: 41228

SEQ ID NO: 203889 - RNA, 64 nt, Homo Sapiens; identical to SEQ ID NO: 41229

SEQ ID NO: 203890 - RNA, 64 nt, Homo Sapiens; identical to SEQ ID NO: 41230

SEQ ID NO: 203891 - RNA, 64 nt, Homo Sapiens; identical to SEQ ID NO: 41231

SEQ ID NO: 203892 - RNA, 64 nt, Homo Sapiens; identical to SEQ ID NO: 41232

SEQ ID NO: 203893 - RNA, 64 nt, Homo Sapiens; identical to SEQ ID NO: 41233

SEQ ID NO: 203894 - RNA, 64 nt, Homo Sapiens; identical to SEQ ID NO: 41234

SEQ ID NO: 203895 - RNA, 64 nt, Homo Sapiens; identical to SEQ ID NO: 41235

SEQ ID NO: 203896 - RNA, 62 nt, Homo Sapiens; identical to SEQ ID NO: 41236

SEQ ID NO: 203897 - RNA, 60 nt, Homo Sapiens; identical to SEQ ID NO: 41237

SEQ ID NO: 203898 - RNA, 58 nt, Homo Sapiens; identical to SEQ ID NO: 41238

SEQ ID NO: 203899 - RNA, 56 nt, Homo Sapiens; identical to SEQ ID NO: 41239

SEQ ID NO: 203900 - RNA, 54 nt, Homo Sapiens; identical to SEQ ID NO: 41240

SEQ ID NO: 203901 - RNA, 64 nt, Homo Sapiens; identical to SEQ ID NO: 41241

SEQ ID NO: 203902 - RNA, 64 nt, Homo Sapiens; identical to SEQ ID NO: 41242

SEQ ID NO: 203903 - RNA, 64 nt, Homo Sapiens; identical to SEQ ID NO: 41243

SEQ ID NO: 203904 - RNA, 64 nt, Homo Sapiens; identical to SEQ ID NO: 41244

SEQ ID NO: 203905 - RNA, 64 nt, Homo Sapiens; identical to SEQ ID NO: 41245

SEQ ID NO: 203906 - RNA, 64 nt, Homo Sapiens; identical to SEQ ID NO: 41246

SEQ ID NO: 203907 - RNA, 64 nt, Homo Sapiens; identical to SEQ ID NO: 41247

SEQ ID NO: 203908 - RNA, 64 nt, Homo Sapiens; identical to SEQ ID NO: 41248

SEQ ID NO: 203909 - RNA, 64 nt, Homo Sapiens; identical to SEQ ID NO: 41249

SEQ ID NO: 203910 - RNA, 64 nt, Homo Sapiens; identical to SEQ ID NO: 41250

SEQ ID NO: 203911 - RNA, 64 nt, Homo Sapiens; identical to SEQ ID NO: 41251

SEQ ID NO: 203912 - RNA, 64 nt, Homo Sapiens; identical to SEQ ID NO: 41252

SEQ ID NO: 203913 - RNA, 64 nt, Homo Sapiens; identical to SEQ ID NO: 41253

SEQ ID NO: 203914 - RNA, 64 nt, Homo Sapiens; identical to SEQ ID NO: 41254

SEQ ID NO: 203915 - RNA, 64 nt, Homo Sapiens; identical to SEQ ID NO: 41255

SEQ ID NO: 203916 - RNA, 64 nt, Homo Sapiens; identical to SEQ ID NO: 41256

SEQ ID NO: 203917 - RNA, 64 nt, Homo Sapiens; identical to SEQ ID NO: 41257

SEQ ID NO: 203918 - RNA, 64 nt, Homo Sapiens; identical to SEQ ID NO: 41258

SEQ ID NO: 203919 - RNA, 64 nt, Homo Sapiens; identical to SEQ ID NO: 41259

SEQ ID NO: 203920 - RNA, 64 nt, Homo Sapiens; identical to SEQ ID NO: 41260

SEQ ID NO: 203921 - RNA, 64 nt, Homo Sapiens; identical to SEQ ID NO: 41261

SEQ ID NO: 203922 - RNA, 64 nt, Homo Sapiens; identical to SEQ ID NO: 41262

SEQ ID NO: 203923 - RNA, 64 nt, Homo Sapiens; identical to SEQ ID NO: 41263

SEQ ID NO: 203924 - RNA, 64 nt, Homo Sapiens; identical to SEQ ID NO: 41264

SEQ ID NO: 203925 - RNA, 64 nt, Homo Sapiens; identical to SEQ ID NO: 41265

SEQ ID NO: 203926 - RNA, 64 nt, Homo Sapiens; identical to SEQ ID NO: 41266

SEQ ID NO: 203927 - RNA, 64 nt, Homo Sapiens; identical to SEQ ID NO: 41267

SEQ ID NO: 203928 - RNA, 64 nt, Homo Sapiens; identical to SEQ ID NO: 41268

SEQ ID NO: 203929 - RNA, 64 nt, Homo Sapiens; identical to SEQ ID NO: 41269

SEQ ID NO: 203930 - RNA, 64 nt, Homo Sapiens; identical to SEQ ID NO: 41270

SEQ ID NO: 203931 - RNA, 64 nt, Homo Sapiens; identical to SEQ ID NO: 41271

SEQ ID NO: 203932 - RNA, 64 nt, Homo Sapiens; identical to SEQ ID NO: 41272

SEQ ID NO: 203933 - RNA, 64 nt, Homo Sapiens; identical to SEQ ID NO: 41273

SEQ ID NO: 203934 - RNA, 64 nt, Homo Sapiens; identical to SEQ ID NO: 41274

SEQ ID NO: 203935 - RNA, 64 nt, Homo Sapiens; identical to SEQ ID NO: 41275

SEQ ID NO: 203936 - RNA, 64 nt, Homo Sapiens; identical to SEQ ID NO: 41276

SEQ ID NO: 203937 - RNA, 64 nt, Homo Sapiens; identical to SEQ ID NO: 41277

SEQ ID NO: 203938 - RNA, 64 nt, Homo Sapiens; identical to SEQ ID NO: 41278

SEQ ID NO: 203939 - RNA, 64 nt, Homo Sapiens; identical to SEQ ID NO: 41279

SEQ ID NO: 203940 - RNA, 64 nt, Homo Sapiens; identical to SEQ ID NO: 41280

SEQ ID NO: 203941 - RNA, 64 nt, Homo Sapiens; identical to SEQ ID NO: 41281

SEQ ID NO: 203942 - RNA, 64 nt, Homo Sapiens; identical to SEQ ID NO: 41282

SEQ ID NO: 203943 - RNA, 64 nt, Homo Sapiens; identical to SEQ ID NO: 41283

SEQ ID NO: 203944 - RNA, 64 nt, Homo Sapiens; identical to SEQ ID NO: 41284

SEQ ID NO: 203945 - RNA, 64 nt, Homo Sapiens; identical to SEQ ID NO: 41285

SEQ ID NO: 203946 - RNA, 64 nt, Homo Sapiens; identical to SEQ ID NO: 41286

SEQ ID NO: 203947 - RNA, 64 nt, Homo Sapiens; identical to SEQ ID NO: 41287

SEQ ID NO: 203948 - RNA, 64 nt, Homo Sapiens; identical to SEQ ID NO: 41288

SEQ ID NO: 203949 - RNA, 64 nt, Homo Sapiens; identical to SEQ ID NO: 41289

SEQ ID NO: 203950 - RNA, 64 nt, Homo Sapiens; identical to SEQ ID NO: 41290

SEQ ID NO: 203951 - RNA, 64 nt, Homo Sapiens; identical to SEQ ID NO: 41291

SEQ ID NO: 203952 - RNA, 64 nt, Homo Sapiens; identical to SEQ ID NO: 41292

SEQ ID NO: 203953 - RNA, 64 nt, Homo Sapiens; identical to SEQ ID NO: 41293

SEQ ID NO: 203954 - RNA, 64 nt, Homo Sapiens; identical to SEQ ID NO: 41294

SEQ ID NO: 203955 - RNA, 64 nt, Homo Sapiens; identical to SEQ ID NO: 41295

SEQ ID NO: 203956 - RNA, 64 nt, Homo Sapiens; identical to SEQ ID NO: 41296

SEQ ID NO: 203957 - RNA, 64 nt, Homo Sapiens; identical to SEQ ID NO: 41297

SEQ ID NO: 203958 - RNA, 64 nt, Homo Sapiens; identical to SEQ ID NO: 41298

SEQ ID NO: 203959 - RNA, 64 nt, Homo Sapiens; identical to SEQ ID NO: 41299

SEQ ID NO: 203960 - RNA, 64 nt, Homo Sapiens; identical to SEQ ID NO: 41300

SEQ ID NO: 203961 - RNA, 64 nt, Homo Sapiens; identical to SEQ ID NO: 41301

SEQ ID NO: 203962 - RNA, 64 nt, Homo Sapiens; identical to SEQ ID NO: 41302

SEQ ID NO: 203963 - RNA, 64 nt, Homo Sapiens; identical to SEQ ID NO: 41303

SEQ ID NO: 203964 - RNA, 64 nt, Homo Sapiens; identical to SEQ ID NO: 41304

SEQ ID NO: 203965 - RNA, 64 nt, Homo Sapiens; identical to SEQ ID NO: 41305

SEQ ID NO: 203966 - RNA, 64 nt, Homo Sapiens; identical to SEQ ID NO: 41306

SEQ ID NO: 203967 - RNA, 64 nt, Homo Sapiens; identical to SEQ ID NO: 41307

SEQ ID NO: 203968 - RNA, 64 nt, Homo Sapiens; identical to SEQ ID NO: 41308

SEQ ID NO: 203969 - RNA, 64 nt, Homo Sapiens; identical to SEQ ID NO: 41309

SEQ ID NO: 203970 - RNA, 64 nt, Homo Sapiens; identical to SEQ ID NO: 41310

SEQ ID NO: 203971 - RNA, 64 nt, Homo Sapiens; identical to SEQ ID NO: 41311

SEQ ID NO: 203972 - RNA, 64 nt, Homo Sapiens; identical to SEQ ID NO: 41312

SEQ ID NO: 203973 - RNA, 64 nt, Homo Sapiens; identical to SEQ ID NO: 41313

SEQ ID NO: 203974 - RNA, 64 nt, Homo Sapiens; identical to SEQ ID NO: 41314

SEQ ID NO: 203975 - RNA, 64 nt, Homo Sapiens; identical to SEQ ID NO: 41315

SEQ ID NO: 203976 - RNA, 64 nt, Homo Sapiens; identical to SEQ ID NO: 41316

SEQ ID NO: 203977 - RNA, 64 nt, Homo Sapiens; identical to SEQ ID NO: 41317

SEQ ID NO: 203978 - RNA, 64 nt, Homo Sapiens; identical to SEQ ID NO: 41318

SEQ ID NO: 203979 - RNA, 64 nt, Homo Sapiens; identical to SEQ ID NO: 41319

SEQ ID NO: 203980 - RNA, 64 nt, Homo Sapiens; identical to SEQ ID NO: 41320

SEQ ID NO: 203981 - RNA, 64 nt, Homo Sapiens; identical to SEQ ID NO: 41321

SEQ ID NO: 203982 - RNA, 64 nt, Homo Sapiens; identical to SEQ ID NO: 41322

SEQ ID NO: 203983 - RNA, 64 nt, Homo Sapiens; identical to SEQ ID NO: 41323

SEQ ID NO: 203984 - RNA, 64 nt, Homo Sapiens; identical to SEQ ID NO: 41324

SEQ ID NO: 203985 - RNA, 64 nt, Homo Sapiens; identical to SEQ ID NO: 41325

SEQ ID NO: 203986 - RNA, 64 nt, Homo Sapiens; identical to SEQ ID NO: 41326

SEQ ID NO: 203987 - RNA, 64 nt, Homo Sapiens; identical to SEQ ID NO: 41327

SEQ ID NO: 203988 - RNA, 64 nt, Homo Sapiens; identical to SEQ ID NO: 41328

SEQ ID NO: 203989 - RNA, 64 nt, Homo Sapiens; identical to SEQ ID NO: 41329

SEQ ID NO: 203990 - RNA, 64 nt, Homo Sapiens; identical to SEQ ID NO: 41330

SEQ ID NO: 203991 - RNA, 64 nt, Homo Sapiens; identical to SEQ ID NO: 41331

SEQ ID NO: 203992 - RNA, 64 nt, Homo Sapiens; identical to SEQ ID NO: 41332

SEQ ID NO: 203993 - RNA, 64 nt, Homo Sapiens; identical to SEQ ID NO: 41333

SEQ ID NO: 203994 - RNA, 64 nt, Homo Sapiens; identical to SEQ ID NO: 41334

SEQ ID NO: 203995 - RNA, 64 nt, Homo Sapiens; identical to SEQ ID NO: 41335

SEQ ID NO: 203996 - RNA, 64 nt, Homo Sapiens; identical to SEQ ID NO: 41336

SEQ ID NO: 203997 - RNA, 64 nt, Homo Sapiens; identical to SEQ ID NO: 41337

SEQ ID NO: 203998 - RNA, 64 nt, Homo Sapiens; identical to SEQ ID NO: 41338

SEQ ID NO: 203999 - RNA, 64 nt, Homo Sapiens; identical to SEQ ID NO: 41339

SEQ ID NO: 204000 - RNA, 64 nt, Homo Sapiens; identical to SEQ ID NO: 41340

SEQ ID NO: 204001 - RNA, 64 nt, Homo Sapiens; identical to SEQ ID NO: 41341

SEQ ID NO: 204002 - RNA, 64 nt, Homo Sapiens; identical to SEQ ID NO: 41342

SEQ ID NO: 204003 - RNA, 64 nt, Homo Sapiens; identical to SEQ ID NO: 41343

SEQ ID NO: 204004 - RNA, 64 nt, Homo Sapiens; identical to SEQ ID NO: 41344

SEQ ID NO: 204005 - RNA, 64 nt, Homo Sapiens; identical to SEQ ID NO: 41345

SEQ ID NO: 204006 - RNA, 64 nt, Homo Sapiens; identical to SEQ ID NO: 41346

SEQ ID NO: 204007 - RNA, 64 nt, Homo Sapiens; identical to SEQ ID NO: 41347

SEQ ID NO: 204008 - RNA, 64 nt, Homo Sapiens; identical to SEQ ID NO: 41348

SEQ ID NO: 204009 - RNA, 64 nt, Homo Sapiens; identical to SEQ ID NO: 41349

SEQ ID NO: 204010 - RNA, 64 nt, Homo Sapiens; identical to SEQ ID NO: 41350

SEQ ID NO: 204011 - RNA, 64 nt, Homo Sapiens; identical to SEQ ID NO: 41351

SEQ ID NO: 204012 - RNA, 64 nt, Homo Sapiens; identical to SEQ ID NO: 41352

SEQ ID NO: 204013 - RNA, 64 nt, Homo Sapiens; identical to SEQ ID NO: 41353

SEQ ID NO: 204014 - RNA, 64 nt, Homo Sapiens; identical to SEQ ID NO: 41354

SEQ ID NO: 204015 - RNA, 64 nt, Homo Sapiens; identical to SEQ ID NO: 41355

SEQ ID NO: 204016 - RNA, 64 nt, Homo Sapiens; identical to SEQ ID NO: 41356

SEQ ID NO: 204017 - RNA, 64 nt, Homo Sapiens; identical to SEQ ID NO: 41357

SEQ ID NO: 204018 - RNA, 64 nt, Homo Sapiens; identical to SEQ ID NO: 41358

SEQ ID NO: 204019 - RNA, 64 nt, Homo Sapiens; identical to SEQ ID NO: 41359

SEQ ID NO: 204020 - RNA, 64 nt, Homo Sapiens; identical to SEQ ID NO: 41360

SEQ ID NO: 204021 - RNA, 64 nt, Homo Sapiens; identical to SEQ ID NO: 41361

SEQ ID NO: 204022 - RNA, 64 nt, Homo Sapiens; identical to SEQ ID NO: 41362

SEQ ID NO: 204023 - RNA, 64 nt, Homo Sapiens; identical to SEQ ID NO: 41363

SEQ ID NO: 204024 - RNA, 64 nt, Homo Sapiens; identical to SEQ ID NO: 41364

SEQ ID NO: 204025 - RNA, 64 nt, Homo Sapiens; identical to SEQ ID NO: 41365

SEQ ID NO: 204026 - RNA, 64 nt, Homo Sapiens; identical to SEQ ID NO: 41366

SEQ ID NO: 204027 - RNA, 64 nt, Homo Sapiens; identical to SEQ ID NO: 41367

SEQ ID NO: 204028 - RNA, 64 nt, Homo Sapiens; identical to SEQ ID NO: 41368

SEQ ID NO: 204029 - RNA, 64 nt, Homo Sapiens; identical to SEQ ID NO: 41369

SEQ ID NO: 204030 - RNA, 64 nt, Homo Sapiens; identical to SEQ ID NO: 41370

SEQ ID NO: 204031 - RNA, 64 nt, Homo Sapiens; identical to SEQ ID NO: 41371

SEQ ID NO: 204032 - RNA, 64 nt, Homo Sapiens; identical to SEQ ID NO: 41372

SEQ ID NO: 204033 - RNA, 64 nt, Homo Sapiens; identical to SEQ ID NO: 41373

SEQ ID NO: 204034 - RNA, 64 nt, Homo Sapiens; identical to SEQ ID NO: 41374

SEQ ID NO: 204035 - RNA, 64 nt, Homo Sapiens; identical to SEQ ID NO: 41375

SEQ ID NO: 204036 - RNA, 64 nt, Homo Sapiens; identical to SEQ ID NO: 41376

SEQ ID NO: 204037 - RNA, 64 nt, Homo Sapiens; identical to SEQ ID NO: 41377

SEQ ID NO: 204038 - RNA, 64 nt, Homo Sapiens; identical to SEQ ID NO: 41378

SEQ ID NO: 204039 - RNA, 64 nt, Homo Sapiens; identical to SEQ ID NO: 41379

SEQ ID NO: 204040 - RNA, 64 nt, Homo Sapiens; identical to SEQ ID NO: 41380

SEQ ID NO: 204041 - RNA, 64 nt, Homo Sapiens; identical to SEQ ID NO: 41381

SEQ ID NO: 204042 - RNA, 64 nt, Homo Sapiens; identical to SEQ ID NO: 41382

SEQ ID NO: 204043 - RNA, 64 nt, Homo Sapiens; identical to SEQ ID NO: 41383

SEQ ID NO: 204044 - RNA, 64 nt, Homo Sapiens; identical to SEQ ID NO: 41384

SEQ ID NO: 204045 - RNA, 64 nt, Homo Sapiens; identical to SEQ ID NO: 41385

SEQ ID NO: 204046 - RNA, 64 nt, Homo Sapiens; identical to SEQ ID NO: 41386

SEQ ID NO: 204047 - RNA, 64 nt, Homo Sapiens; identical to SEQ ID NO: 41387

SEQ ID NO: 204048 - RNA, 64 nt, Homo Sapiens; identical to SEQ ID NO: 41388

SEQ ID NO: 204049 - RNA, 64 nt, Homo Sapiens; identical to SEQ ID NO: 41389

SEQ ID NO: 204050 - RNA, 64 nt, Homo Sapiens; identical to SEQ ID NO: 41390

SEQ ID NO: 204051 - RNA, 64 nt, Homo Sapiens; identical to SEQ ID NO: 41391

SEQ ID NO: 204052 - RNA, 64 nt, Homo Sapiens; identical to SEQ ID NO: 41392

SEQ ID NO: 204053 - RNA, 64 nt, Homo Sapiens; identical to SEQ ID NO: 41393

SEQ ID NO: 204054 - RNA, 64 nt, Homo Sapiens; identical to SEQ ID NO: 41394

SEQ ID NO: 204055 - RNA, 64 nt, Homo Sapiens; identical to SEQ ID NO: 41395

SEQ ID NO: 204056 - RNA, 64 nt, Homo Sapiens; identical to SEQ ID NO: 41396

SEQ ID NO: 204057 - RNA, 64 nt, Homo Sapiens; identical to SEQ ID NO: 41397

SEQ ID NO: 204058 - RNA, 64 nt, Homo Sapiens; identical to SEQ ID NO: 41398

SEQ ID NO: 204059 - RNA, 64 nt, Homo Sapiens; identical to SEQ ID NO: 41399

SEQ ID NO: 204060 - RNA, 64 nt, Homo Sapiens; identical to SEQ ID NO: 41400

SEQ ID NO: 204061 - RNA, 64 nt, Homo Sapiens; identical to SEQ ID NO: 41401

SEQ ID NO: 204062 - RNA, 64 nt, Homo Sapiens; identical to SEQ ID NO: 41402

SEQ ID NO: 204063 - RNA, 64 nt, Homo Sapiens; identical to SEQ ID NO: 41403

SEQ ID NO: 204064 - RNA, 64 nt, Homo Sapiens; identical to SEQ ID NO: 41404

SEQ ID NO: 204065 - RNA, 64 nt, Homo Sapiens; identical to SEQ ID NO: 41405

SEQ ID NO: 204066 - RNA, 64 nt, Homo Sapiens; identical to SEQ ID NO: 41406

SEQ ID NO: 204067 - RNA, 64 nt, Homo Sapiens; identical to SEQ ID NO: 41407

SEQ ID NO: 204068 - RNA, 64 nt, Homo Sapiens; identical to SEQ ID NO: 41408

SEQ ID NO: 204069 - RNA, 64 nt, Homo Sapiens; identical to SEQ ID NO: 41409

SEQ ID NO: 204070 - RNA, 64 nt, Homo Sapiens; identical to SEQ ID NO: 41410

SEQ ID NO: 204071 - RNA, 64 nt, Homo Sapiens; identical to SEQ ID NO: 41411

SEQ ID NO: 204072 - RNA, 64 nt, Homo Sapiens; identical to SEQ ID NO: 41412

SEQ ID NO: 204073 - RNA, 64 nt, Homo Sapiens; identical to SEQ ID NO: 41413

SEQ ID NO: 204074 - RNA, 64 nt, Homo Sapiens; identical to SEQ ID NO: 41414

SEQ ID NO: 204075 - RNA, 64 nt, Homo Sapiens; identical to SEQ ID NO: 41415

SEQ ID NO: 204076 - RNA, 64 nt, Homo Sapiens; identical to SEQ ID NO: 41416

SEQ ID NO: 204077 - RNA, 64 nt, Homo Sapiens; identical to SEQ ID NO: 41417

SEQ ID NO: 204078 - RNA, 64 nt, Homo Sapiens; identical to SEQ ID NO: 41418

SEQ ID NO: 204079 - RNA, 64 nt, Homo Sapiens; identical to SEQ ID NO: 41419

SEQ ID NO: 204080 - RNA, 64 nt, Homo Sapiens; identical to SEQ ID NO: 41420

SEQ ID NO: 204081 - RNA, 64 nt, Homo Sapiens; identical to SEQ ID NO: 41421

SEQ ID NO: 204082 - RNA, 64 nt, Homo Sapiens; identical to SEQ ID NO: 41422

SEQ ID NO: 204083 - RNA, 64 nt, Homo Sapiens; identical to SEQ ID NO: 41423

SEQ ID NO: 204084 - RNA, 64 nt, Homo Sapiens; identical to SEQ ID NO: 41424

SEQ ID NO: 204085 - RNA, 64 nt, Homo Sapiens; identical to SEQ ID NO: 41425

SEQ ID NO: 204086 - RNA, 64 nt, Homo Sapiens; identical to SEQ ID NO: 41426

SEQ ID NO: 204087 - RNA, 64 nt, Homo Sapiens; identical to SEQ ID NO: 41427

SEQ ID NO: 204088 - RNA, 64 nt, Homo Sapiens; identical to SEQ ID NO: 41428

SEQ ID NO: 204089 - RNA, 64 nt, Homo Sapiens; identical to SEQ ID NO: 41429

SEQ ID NO: 204090 - RNA, 64 nt, Homo Sapiens; identical to SEQ ID NO: 41430

SEQ ID NO: 204091 - RNA, 64 nt, Homo Sapiens; identical to SEQ ID NO: 41431

SEQ ID NO: 204092 - RNA, 64 nt, Homo Sapiens; identical to SEQ ID NO: 41432

SEQ ID NO: 204093 - RNA, 64 nt, Homo Sapiens; identical to SEQ ID NO: 41433

SEQ ID NO: 204094 - RNA, 64 nt, Homo Sapiens; identical to SEQ ID NO: 41434

SEQ ID NO: 204095 - RNA, 64 nt, Homo Sapiens; identical to SEQ ID NO: 41435

SEQ ID NO: 204096 - RNA, 64 nt, Homo Sapiens; identical to SEQ ID NO: 41436

SEQ ID NO: 204097 - RNA, 64 nt, Homo Sapiens; identical to SEQ ID NO: 41437

SEQ ID NO: 204098 - RNA, 64 nt, Homo Sapiens; identical to SEQ ID NO: 41438

SEQ ID NO: 204099 - RNA, 64 nt, Homo Sapiens; identical to SEQ ID NO: 41439

SEQ ID NO: 204100 - RNA, 64 nt, Homo Sapiens; identical to SEQ ID NO: 41440

SEQ ID NO: 204101 - RNA, 64 nt, Homo Sapiens; identical to SEQ ID NO: 41441

SEQ ID NO: 204102 - RNA, 64 nt, Homo Sapiens; identical to SEQ ID NO: 41442

SEQ ID NO: 204103 - RNA, 64 nt, Homo Sapiens; identical to SEQ ID NO: 41443

SEQ ID NO: 204104 - RNA, 64 nt, Homo Sapiens; identical to SEQ ID NO: 41444

SEQ ID NO: 204105 - RNA, 64 nt, Homo Sapiens; identical to SEQ ID NO: 41445

SEQ ID NO: 204106 - RNA, 64 nt, Homo Sapiens; identical to SEQ ID NO: 41446

SEQ ID NO: 204107 - RNA, 64 nt, Homo Sapiens; identical to SEQ ID NO: 41447

SEQ ID NO: 204108 - RNA, 64 nt, Homo Sapiens; identical to SEQ ID NO: 41448

SEQ ID NO: 204109 - RNA, 64 nt, Homo Sapiens; identical to SEQ ID NO: 41449

SEQ ID NO: 204110 - RNA, 64 nt, Homo Sapiens; identical to SEQ ID NO: 41450

SEQ ID NO: 204111 - RNA, 64 nt, Homo Sapiens; identical to SEQ ID NO: 41451

SEQ ID NO: 204112 - RNA, 64 nt, Homo Sapiens; identical to SEQ ID NO: 41452

SEQ ID NO: 204113 - RNA, 64 nt, Homo Sapiens; identical to SEQ ID NO: 41453

SEQ ID NO: 204114 - RNA, 64 nt, Homo Sapiens; identical to SEQ ID NO: 41454

SEQ ID NO: 204115 - RNA, 64 nt, Homo Sapiens; identical to SEQ ID NO: 41455

SEQ ID NO: 204116 - RNA, 64 nt, Homo Sapiens; identical to SEQ ID NO: 41456

SEQ ID NO: 204117 - RNA, 64 nt, Homo Sapiens; identical to SEQ ID NO: 41457

SEQ ID NO: 204118 - RNA, 64 nt, Homo Sapiens; identical to SEQ ID NO: 41458

SEQ ID NO: 204119 - RNA, 64 nt, Homo Sapiens; identical to SEQ ID NO: 41459

SEQ ID NO: 204120 - RNA, 64 nt, Homo Sapiens; identical to SEQ ID NO: 41460

SEQ ID NO: 204121 - RNA, 64 nt, Homo Sapiens; identical to SEQ ID NO: 41461

SEQ ID NO: 204122 - RNA, 64 nt, Homo Sapiens; identical to SEQ ID NO: 41462

SEQ ID NO: 204123 - RNA, 64 nt, Homo Sapiens; identical to SEQ ID NO: 41463

SEQ ID NO: 204124 - RNA, 64 nt, Homo Sapiens; identical to SEQ ID NO: 41464

SEQ ID NO: 204125 - RNA, 64 nt, Homo Sapiens; identical to SEQ ID NO: 41465

SEQ ID NO: 204126 - RNA, 64 nt, Homo Sapiens; identical to SEQ ID NO: 41466

SEQ ID NO: 204127 - RNA, 64 nt, Homo Sapiens; identical to SEQ ID NO: 41467

SEQ ID NO: 204128 - RNA, 64 nt, Homo Sapiens; identical to SEQ ID NO: 41468

SEQ ID NO: 204129 - RNA, 64 nt, Homo Sapiens; identical to SEQ ID NO: 41469

SEQ ID NO: 204130 - RNA, 64 nt, Homo Sapiens; identical to SEQ ID NO: 41470

SEQ ID NO: 204131 - RNA, 64 nt, Homo Sapiens; identical to SEQ ID NO: 41471

SEQ ID NO: 204132 - RNA, 64 nt, Homo Sapiens; identical to SEQ ID NO: 41472

SEQ ID NO: 204133 - RNA, 64 nt, Homo Sapiens; identical to SEQ ID NO: 41473

SEQ ID NO: 204134 - RNA, 64 nt, Homo Sapiens; identical to SEQ ID NO: 41474

SEQ ID NO: 204135 - RNA, 64 nt, Homo Sapiens; identical to SEQ ID NO: 41475

SEQ ID NO: 204136 - RNA, 64 nt, Homo Sapiens; identical to SEQ ID NO: 41476

SEQ ID NO: 204137 - RNA, 64 nt, Homo Sapiens; identical to SEQ ID NO: 41477

SEQ ID NO: 204138 - RNA, 64 nt, Homo Sapiens; identical to SEQ ID NO: 41478

SEQ ID NO: 204139 - RNA, 64 nt, Homo Sapiens; identical to SEQ ID NO: 41479

SEQ ID NO: 204140 - RNA, 64 nt, Homo Sapiens; identical to SEQ ID NO: 41480

SEQ ID NO: 204141 - RNA, 64 nt, Homo Sapiens; identical to SEQ ID NO: 41481

SEQ ID NO: 204142 - RNA, 64 nt, Homo Sapiens; identical to SEQ ID NO: 41482

SEQ ID NO: 204143 - RNA, 64 nt, Homo Sapiens; identical to SEQ ID NO: 41483

SEQ ID NO: 204144 - RNA, 64 nt, Homo Sapiens; identical to SEQ ID NO: 41484

SEQ ID NO: 204145 - RNA, 64 nt, Homo Sapiens; identical to SEQ ID NO: 41485

SEQ ID NO: 204146 - RNA, 64 nt, Homo Sapiens; identical to SEQ ID NO: 41486

SEQ ID NO: 204147 - RNA, 64 nt, Homo Sapiens; identical to SEQ ID NO: 41487

SEQ ID NO: 204148 - RNA, 64 nt, Homo Sapiens; identical to SEQ ID NO: 41488

SEQ ID NO: 204149 - RNA, 64 nt, Homo Sapiens; identical to SEQ ID NO: 41489

SEQ ID NO: 204150 - RNA, 64 nt, Homo Sapiens; identical to SEQ ID NO: 41490

SEQ ID NO: 204151 - RNA, 64 nt, Homo Sapiens; identical to SEQ ID NO: 41491

SEQ ID NO: 204152 - RNA, 64 nt, Homo Sapiens; identical to SEQ ID NO: 41492

SEQ ID NO: 204153 - RNA, 64 nt, Homo Sapiens; identical to SEQ ID NO: 41493

SEQ ID NO: 204154 - RNA, 64 nt, Homo Sapiens; identical to SEQ ID NO: 41494

SEQ ID NO: 204155 - RNA, 64 nt, Homo Sapiens; identical to SEQ ID NO: 41495

SEQ ID NO: 204156 - RNA, 64 nt, Homo Sapiens; identical to SEQ ID NO: 41496

SEQ ID NO: 204157 - RNA, 64 nt, Homo Sapiens; identical to SEQ ID NO: 41497

SEQ ID NO: 204158 - RNA, 64 nt, Homo Sapiens; identical to SEQ ID NO: 41498

SEQ ID NO: 204159 - RNA, 64 nt, Homo Sapiens; identical to SEQ ID NO: 41499

SEQ ID NO: 204160 - RNA, 64 nt, Homo Sapiens; identical to SEQ ID NO: 41500

SEQ ID NO: 204161 - RNA, 64 nt, Homo Sapiens; identical to SEQ ID NO: 41501

SEQ ID NO: 204162 - RNA, 64 nt, Homo Sapiens; identical to SEQ ID NO: 41502

SEQ ID NO: 204163 - RNA, 64 nt, Homo Sapiens; identical to SEQ ID NO: 41503

SEQ ID NO: 204164 - RNA, 64 nt, Homo Sapiens; identical to SEQ ID NO: 41504

SEQ ID NO: 204165 - RNA, 64 nt, Homo Sapiens; identical to SEQ ID NO: 41505

SEQ ID NO: 204166 - RNA, 64 nt, Homo Sapiens; identical to SEQ ID NO: 41506

SEQ ID NO: 204167 - RNA, 64 nt, Homo Sapiens; identical to SEQ ID NO: 41507

SEQ ID NO: 204168 - RNA, 64 nt, Homo Sapiens; identical to SEQ ID NO: 41508

SEQ ID NO: 204169 - RNA, 64 nt, Homo Sapiens; identical to SEQ ID NO: 41509

SEQ ID NO: 204170 - RNA, 64 nt, Homo Sapiens; identical to SEQ ID NO: 41510

SEQ ID NO: 204171 - RNA, 64 nt, Homo Sapiens; identical to SEQ ID NO: 41511

SEQ ID NO: 204172 - RNA, 64 nt, Homo Sapiens; identical to SEQ ID NO: 41512

SEQ ID NO: 204173 - RNA, 64 nt, Homo Sapiens; identical to SEQ ID NO: 41513

SEQ ID NO: 204174 - RNA, 64 nt, Homo Sapiens; identical to SEQ ID NO: 41514

SEQ ID NO: 204175 - RNA, 64 nt, Homo Sapiens; identical to SEQ ID NO: 41515

SEQ ID NO: 204176 - RNA, 64 nt, Homo Sapiens; identical to SEQ ID NO: 41516

SEQ ID NO: 204177 - RNA, 64 nt, Homo Sapiens; identical to SEQ ID NO: 41517

SEQ ID NO: 204178 - RNA, 64 nt, Homo Sapiens; identical to SEQ ID NO: 41518

SEQ ID NO: 204179 - RNA, 64 nt, Homo Sapiens; identical to SEQ ID NO: 41519

SEQ ID NO: 204180 - RNA, 64 nt, Homo Sapiens; identical to SEQ ID NO: 41520

SEQ ID NO: 204181 - RNA, 64 nt, Homo Sapiens; identical to SEQ ID NO: 41521

SEQ ID NO: 204182 - RNA, 64 nt, Homo Sapiens; identical to SEQ ID NO: 41522

SEQ ID NO: 204183 - RNA, 64 nt, Homo Sapiens; identical to SEQ ID NO: 41523

SEQ ID NO: 204184 - RNA, 64 nt, Homo Sapiens; identical to SEQ ID NO: 41524

SEQ ID NO: 204185 - RNA, 64 nt, Homo Sapiens; identical to SEQ ID NO: 41525

SEQ ID NO: 204186 - RNA, 64 nt, Homo Sapiens; identical to SEQ ID NO: 41526

SEQ ID NO: 204187 - RNA, 64 nt, Homo Sapiens; identical to SEQ ID NO: 41527

SEQ ID NO: 204188 - RNA, 64 nt, Homo Sapiens; identical to SEQ ID NO: 41528

SEQ ID NO: 204189 - RNA, 64 nt, Homo Sapiens; identical to SEQ ID NO: 41529

SEQ ID NO: 204190 - RNA, 64 nt, Homo Sapiens; identical to SEQ ID NO: 41530

SEQ ID NO: 204191 - RNA, 64 nt, Homo Sapiens; identical to SEQ ID NO: 41531

SEQ ID NO: 204192 - RNA, 64 nt, Homo Sapiens; identical to SEQ ID NO: 41532

SEQ ID NO: 204193 - RNA, 64 nt, Homo Sapiens; identical to SEQ ID NO: 41533

SEQ ID NO: 204194 - RNA, 64 nt, Homo Sapiens; identical to SEQ ID NO: 41534

SEQ ID NO: 204195 - RNA, 64 nt, Homo Sapiens; identical to SEQ ID NO: 41535

SEQ ID NO: 204196 - RNA, 64 nt, Homo Sapiens; identical to SEQ ID NO: 41536

SEQ ID NO: 204197 - RNA, 64 nt, Homo Sapiens; identical to SEQ ID NO: 41537

SEQ ID NO: 204198 - RNA, 64 nt, Homo Sapiens; identical to SEQ ID NO: 41538

SEQ ID NO: 204199 - RNA, 64 nt, Homo Sapiens; identical to SEQ ID NO: 41539

SEQ ID NO: 204200 - RNA, 64 nt, Homo Sapiens; identical to SEQ ID NO: 41540

SEQ ID NO: 204201 - RNA, 64 nt, Homo Sapiens; identical to SEQ ID NO: 41541

SEQ ID NO: 204202 - RNA, 64 nt, Homo Sapiens; identical to SEQ ID NO: 41542

SEQ ID NO: 204203 - RNA, 64 nt, Homo Sapiens; identical to SEQ ID NO: 41543

SEQ ID NO: 204204 - RNA, 64 nt, Homo Sapiens; identical to SEQ ID NO: 41544

SEQ ID NO: 204205 - RNA, 64 nt, Homo Sapiens; identical to SEQ ID NO: 41545

SEQ ID NO: 204206 - RNA, 64 nt, Homo Sapiens; identical to SEQ ID NO: 41546

SEQ ID NO: 204207 - RNA, 64 nt, Homo Sapiens; identical to SEQ ID NO: 41547

SEQ ID NO: 204208 - RNA, 64 nt, Homo Sapiens; identical to SEQ ID NO: 41548

SEQ ID NO: 204209 - RNA, 64 nt, Homo Sapiens; identical to SEQ ID NO: 41549

SEQ ID NO: 204210 - RNA, 64 nt, Homo Sapiens; identical to SEQ ID NO: 41550

SEQ ID NO: 204211 - RNA, 64 nt, Homo Sapiens; identical to SEQ ID NO: 41551

SEQ ID NO: 204212 - RNA, 64 nt, Homo Sapiens; identical to SEQ ID NO: 41552

SEQ ID NO: 204213 - RNA, 64 nt, Homo Sapiens; identical to SEQ ID NO: 41553

SEQ ID NO: 204214 - RNA, 64 nt, Homo Sapiens; identical to SEQ ID NO: 41554

SEQ ID NO: 204215 - RNA, 64 nt, Homo Sapiens; identical to SEQ ID NO: 41555

SEQ ID NO: 204216 - RNA, 64 nt, Homo Sapiens; identical to SEQ ID NO: 41556

SEQ ID NO: 204217 - RNA, 64 nt, Homo Sapiens; identical to SEQ ID NO: 41557

SEQ ID NO: 204218 - RNA, 64 nt, Homo Sapiens; identical to SEQ ID NO: 41558

SEQ ID NO: 204219 - RNA, 64 nt, Homo Sapiens; identical to SEQ ID NO: 41559

SEQ ID NO: 204220 - RNA, 64 nt, Homo Sapiens; identical to SEQ ID NO: 41560

SEQ ID NO: 204221 - RNA, 64 nt, Homo Sapiens; identical to SEQ ID NO: 41561

SEQ ID NO: 204222 - RNA, 64 nt, Homo Sapiens; identical to SEQ ID NO: 41562

SEQ ID NO: 204223 - RNA, 64 nt, Homo Sapiens; identical to SEQ ID NO: 41563

SEQ ID NO: 204224 - RNA, 64 nt, Homo Sapiens; identical to SEQ ID NO: 41564

SEQ ID NO: 204225 - RNA, 64 nt, Homo Sapiens; identical to SEQ ID NO: 41565

SEQ ID NO: 204226 - RNA, 64 nt, Homo Sapiens; identical to SEQ ID NO: 41566

SEQ ID NO: 204227 - RNA, 64 nt, Homo Sapiens; identical to SEQ ID NO: 41567

SEQ ID NO: 204228 - RNA, 64 nt, Homo Sapiens; identical to SEQ ID NO: 41568

SEQ ID NO: 204229 - RNA, 64 nt, Homo Sapiens; identical to SEQ ID NO: 41569

SEQ ID NO: 204230 - RNA, 64 nt, Homo Sapiens; identical to SEQ ID NO: 41570

SEQ ID NO: 204231 - RNA, 64 nt, Homo Sapiens; identical to SEQ ID NO: 41571

SEQ ID NO: 204232 - RNA, 64 nt, Homo Sapiens; identical to SEQ ID NO: 41572

SEQ ID NO: 204233 - RNA, 64 nt, Homo Sapiens; identical to SEQ ID NO: 41573

SEQ ID NO: 204234 - RNA, 64 nt, Homo Sapiens; identical to SEQ ID NO: 41574

SEQ ID NO: 204235 - RNA, 64 nt, Homo Sapiens; identical to SEQ ID NO: 41575

SEQ ID NO: 204236 - RNA, 64 nt, Homo Sapiens; identical to SEQ ID NO: 41576

SEQ ID NO: 204237 - RNA, 64 nt, Homo Sapiens; identical to SEQ ID NO: 41577

SEQ ID NO: 204238 - RNA, 64 nt, Homo Sapiens; identical to SEQ ID NO: 41578

SEQ ID NO: 204239 - RNA, 64 nt, Homo Sapiens; identical to SEQ ID NO: 41579

SEQ ID NO: 204240 - RNA, 64 nt, Homo Sapiens; identical to SEQ ID NO: 41580

SEQ ID NO: 204241 - RNA, 64 nt, Homo Sapiens; identical to SEQ ID NO: 41581

SEQ ID NO: 204242 - RNA, 64 nt, Homo Sapiens; identical to SEQ ID NO: 41582

SEQ ID NO: 204243 - RNA, 64 nt, Homo Sapiens; identical to SEQ ID NO: 41583

SEQ ID NO: 204244 - RNA, 64 nt, Homo Sapiens; identical to SEQ ID NO: 41584

SEQ ID NO: 204245 - RNA, 64 nt, Homo Sapiens; identical to SEQ ID NO: 41585

SEQ ID NO: 204246 - RNA, 64 nt, Homo Sapiens; identical to SEQ ID NO: 41586

SEQ ID NO: 204247 - RNA, 64 nt, Homo Sapiens; identical to SEQ ID NO: 41587

SEQ ID NO: 204248 - RNA, 64 nt, Homo Sapiens; identical to SEQ ID NO: 41588

SEQ ID NO: 204249 - RNA, 64 nt, Homo Sapiens; identical to SEQ ID NO: 41589

SEQ ID NO: 204250 - RNA, 64 nt, Homo Sapiens; identical to SEQ ID NO: 41590

SEQ ID NO: 204251 - RNA, 64 nt, Homo Sapiens; identical to SEQ ID NO: 41591

SEQ ID NO: 204252 - RNA, 64 nt, Homo Sapiens; identical to SEQ ID NO: 41592

SEQ ID NO: 204253 - RNA, 64 nt, Homo Sapiens; identical to SEQ ID NO: 41593

SEQ ID NO: 204254 - RNA, 64 nt, Homo Sapiens; identical to SEQ ID NO: 41594

SEQ ID NO: 204255 - RNA, 64 nt, Homo Sapiens; identical to SEQ ID NO: 41595

SEQ ID NO: 204256 - RNA, 64 nt, Homo Sapiens; identical to SEQ ID NO: 41596

SEQ ID NO: 204257 - RNA, 64 nt, Homo Sapiens; identical to SEQ ID NO: 41597

SEQ ID NO: 204258 - RNA, 64 nt, Homo Sapiens; identical to SEQ ID NO: 41598

SEQ ID NO: 204259 - RNA, 64 nt, Homo Sapiens; identical to SEQ ID NO: 41599

SEQ ID NO: 204260 - RNA, 64 nt, Homo Sapiens; identical to SEQ ID NO: 41600

SEQ ID NO: 204261 - RNA, 64 nt, Homo Sapiens; identical to SEQ ID NO: 41601

SEQ ID NO: 204262 - RNA, 64 nt, Homo Sapiens; identical to SEQ ID NO: 41602

SEQ ID NO: 204263 - RNA, 64 nt, Homo Sapiens; identical to SEQ ID NO: 41603

SEQ ID NO: 204264 - RNA, 64 nt, Homo Sapiens; identical to SEQ ID NO: 41604

SEQ ID NO: 204265 - RNA, 64 nt, Homo Sapiens; identical to SEQ ID NO: 41605

SEQ ID NO: 204266 - RNA, 64 nt, Homo Sapiens; identical to SEQ ID NO: 41606

SEQ ID NO: 204267 - RNA, 64 nt, Homo Sapiens; identical to SEQ ID NO: 41607

SEQ ID NO: 204268 - RNA, 64 nt, Homo Sapiens; identical to SEQ ID NO: 41608

SEQ ID NO: 204269 - RNA, 64 nt, Homo Sapiens; identical to SEQ ID NO: 41609

SEQ ID NO: 204270 - RNA, 64 nt, Homo Sapiens; identical to SEQ ID NO: 41610

SEQ ID NO: 204271 - RNA, 64 nt, Homo Sapiens; identical to SEQ ID NO: 41611

SEQ ID NO: 204272 - RNA, 64 nt, Homo Sapiens; identical to SEQ ID NO: 41612

SEQ ID NO: 204273 - RNA, 64 nt, Homo Sapiens; identical to SEQ ID NO: 41613

SEQ ID NO: 204274 - RNA, 64 nt, Homo Sapiens; identical to SEQ ID NO: 41614

SEQ ID NO: 204275 - RNA, 64 nt, Homo Sapiens; identical to SEQ ID NO: 41615

SEQ ID NO: 204276 - RNA, 64 nt, Homo Sapiens; identical to SEQ ID NO: 41616

SEQ ID NO: 204277 - RNA, 64 nt, Homo Sapiens; identical to SEQ ID NO: 41617

SEQ ID NO: 204278 - RNA, 64 nt, Homo Sapiens; identical to SEQ ID NO: 41618

SEQ ID NO: 204279 - RNA, 64 nt, Homo Sapiens; identical to SEQ ID NO: 41619

SEQ ID NO: 204280 - RNA, 64 nt, Homo Sapiens; identical to SEQ ID NO: 41620

SEQ ID NO: 204281 - RNA, 64 nt, Homo Sapiens; identical to SEQ ID NO: 41621

SEQ ID NO: 204282 - RNA, 63 nt, Homo Sapiens; identical to SEQ ID NO: 41622

SEQ ID NO: 204283 - RNA, 64 nt, Homo Sapiens; identical to SEQ ID NO: 41623

SEQ ID NO: 204284 - RNA, 64 nt, Homo Sapiens; identical to SEQ ID NO: 41624

SEQ ID NO: 204285 - RNA, 64 nt, Homo Sapiens; identical to SEQ ID NO: 41625

SEQ ID NO: 204286 - RNA, 64 nt, Homo Sapiens; identical to SEQ ID NO: 41626

SEQ ID NO: 204287 - RNA, 64 nt, Homo Sapiens; identical to SEQ ID NO: 41627

SEQ ID NO: 204288 - RNA, 64 nt, Homo Sapiens; identical to SEQ ID NO: 41628

SEQ ID NO: 204289 - RNA, 64 nt, Homo Sapiens; identical to SEQ ID NO: 41629

SEQ ID NO: 204290 - RNA, 64 nt, Homo Sapiens; identical to SEQ ID NO: 41630

SEQ ID NO: 204291 - RNA, 64 nt, Homo Sapiens; identical to SEQ ID NO: 41631

SEQ ID NO: 204292 - RNA, 64 nt, Homo Sapiens; identical to SEQ ID NO: 41632

SEQ ID NO: 204293 - RNA, 64 nt, Homo Sapiens; identical to SEQ ID NO: 41633

SEQ ID NO: 204294 - RNA, 64 nt, Homo Sapiens; identical to SEQ ID NO: 41634

SEQ ID NO: 204295 - RNA, 64 nt, Homo Sapiens; identical to SEQ ID NO: 41635

SEQ ID NO: 204296 - RNA, 64 nt, Homo Sapiens; identical to SEQ ID NO: 41636

SEQ ID NO: 204297 - RNA, 64 nt, Homo Sapiens; identical to SEQ ID NO: 41637

SEQ ID NO: 204298 - RNA, 64 nt, Homo Sapiens; identical to SEQ ID NO: 41638

SEQ ID NO: 204299 - RNA, 64 nt, Homo Sapiens; identical to SEQ ID NO: 41639

SEQ ID NO: 204300 - RNA, 64 nt, Homo Sapiens; identical to SEQ ID NO: 41640

SEQ ID NO: 204301 - RNA, 64 nt, Homo Sapiens; identical to SEQ ID NO: 41641

SEQ ID NO: 204302 - RNA, 64 nt, Homo Sapiens; identical to SEQ ID NO: 41642

SEQ ID NO: 204303 - RNA, 64 nt, Homo Sapiens; identical to SEQ ID NO: 41643

SEQ ID NO: 204304 - RNA, 64 nt, Homo Sapiens; identical to SEQ ID NO: 41644

SEQ ID NO: 204305 - RNA, 64 nt, Homo Sapiens; identical to SEQ ID NO: 41645

SEQ ID NO: 204306 - RNA, 64 nt, Homo Sapiens; identical to SEQ ID NO: 41646

SEQ ID NO: 204307 - RNA, 64 nt, Homo Sapiens; identical to SEQ ID NO: 41647

SEQ ID NO: 204308 - RNA, 64 nt, Homo Sapiens; identical to SEQ ID NO: 41648

SEQ ID NO: 204309 - RNA, 64 nt, Homo Sapiens; identical to SEQ ID NO: 41649

SEQ ID NO: 204310 - RNA, 64 nt, Homo Sapiens; identical to SEQ ID NO: 41650

SEQ ID NO: 204311 - RNA, 64 nt, Homo Sapiens; identical to SEQ ID NO: 41651

SEQ ID NO: 204312 - RNA, 64 nt, Homo Sapiens; identical to SEQ ID NO: 41652

SEQ ID NO: 204313 - RNA, 64 nt, Homo Sapiens; identical to SEQ ID NO: 41653

SEQ ID NO: 204314 - RNA, 64 nt, Homo Sapiens; identical to SEQ ID NO: 41654

SEQ ID NO: 204315 - RNA, 64 nt, Homo Sapiens; identical to SEQ ID NO: 41655

SEQ ID NO: 204316 - RNA, 64 nt, Homo Sapiens; identical to SEQ ID NO: 41656

SEQ ID NO: 204317 - RNA, 64 nt, Homo Sapiens; identical to SEQ ID NO: 41657

SEQ ID NO: 204318 - RNA, 64 nt, Homo Sapiens; identical to SEQ ID NO: 41658

SEQ ID NO: 204319 - RNA, 64 nt, Homo Sapiens; identical to SEQ ID NO: 41659

SEQ ID NO: 204320 - RNA, 64 nt, Homo Sapiens; identical to SEQ ID NO: 41660

SEQ ID NO: 204321 - RNA, 64 nt, Homo Sapiens; identical to SEQ ID NO: 41661

SEQ ID NO: 204322 - RNA, 64 nt, Homo Sapiens; identical to SEQ ID NO: 41662

SEQ ID NO: 204323 - RNA, 64 nt, Homo Sapiens; identical to SEQ ID NO: 41663

SEQ ID NO: 204324 - RNA, 64 nt, Homo Sapiens; identical to SEQ ID NO: 41664

SEQ ID NO: 204325 - RNA, 64 nt, Homo Sapiens; identical to SEQ ID NO: 41665

SEQ ID NO: 204326 - RNA, 64 nt, Homo Sapiens; identical to SEQ ID NO: 41666

SEQ ID NO: 204327 - RNA, 64 nt, Homo Sapiens; identical to SEQ ID NO: 41667

SEQ ID NO: 204328 - RNA, 64 nt, Homo Sapiens; identical to SEQ ID NO: 41668

SEQ ID NO: 204329 - RNA, 64 nt, Homo Sapiens; identical to SEQ ID NO: 41669

SEQ ID NO: 204330 - RNA, 64 nt, Homo Sapiens; identical to SEQ ID NO: 41670

SEQ ID NO: 204331 - RNA, 64 nt, Homo Sapiens; identical to SEQ ID NO: 41671

SEQ ID NO: 204332 - RNA, 64 nt, Homo Sapiens; identical to SEQ ID NO: 41672

SEQ ID NO: 204333 - RNA, 64 nt, Homo Sapiens; identical to SEQ ID NO: 41673

SEQ ID NO: 204334 - RNA, 64 nt, Homo Sapiens; identical to SEQ ID NO: 41674

SEQ ID NO: 204335 - RNA, 64 nt, Homo Sapiens; identical to SEQ ID NO: 41675

SEQ ID NO: 204336 - RNA, 64 nt, Homo Sapiens; identical to SEQ ID NO: 41676

SEQ ID NO: 204337 - RNA, 64 nt, Homo Sapiens; identical to SEQ ID NO: 41677

SEQ ID NO: 204338 - RNA, 64 nt, Homo Sapiens; identical to SEQ ID NO: 41678

SEQ ID NO: 204339 - RNA, 64 nt, Homo Sapiens; identical to SEQ ID NO: 41679

SEQ ID NO: 204340 - RNA, 64 nt, Homo Sapiens; identical to SEQ ID NO: 41680

SEQ ID NO: 204341 - RNA, 64 nt, Homo Sapiens; identical to SEQ ID NO: 41681

SEQ ID NO: 204342 - RNA, 64 nt, Homo Sapiens; identical to SEQ ID NO: 41682

SEQ ID NO: 204343 - RNA, 64 nt, Homo Sapiens; identical to SEQ ID NO: 41683

SEQ ID NO: 204344 - RNA, 64 nt, Homo Sapiens; identical to SEQ ID NO: 41684

SEQ ID NO: 204345 - RNA, 64 nt, Homo Sapiens; identical to SEQ ID NO: 41685

SEQ ID NO: 204346 - RNA, 64 nt, Homo Sapiens; identical to SEQ ID NO: 41686

SEQ ID NO: 204347 - RNA, 64 nt, Homo Sapiens; identical to SEQ ID NO: 41687

SEQ ID NO: 204348 - RNA, 64 nt, Homo Sapiens; identical to SEQ ID NO: 41688

SEQ ID NO: 204349 - RNA, 64 nt, Homo Sapiens; identical to SEQ ID NO: 41689

SEQ ID NO: 204350 - RNA, 64 nt, Homo Sapiens; identical to SEQ ID NO: 41690

SEQ ID NO: 204351 - RNA, 64 nt, Homo Sapiens; identical to SEQ ID NO: 41691

SEQ ID NO: 204352 - RNA, 64 nt, Homo Sapiens; identical to SEQ ID NO: 41692

SEQ ID NO: 204353 - RNA, 64 nt, Homo Sapiens; identical to SEQ ID NO: 41693

SEQ ID NO: 204354 - RNA, 64 nt, Homo Sapiens; identical to SEQ ID NO: 41694

SEQ ID NO: 204355 - RNA, 64 nt, Homo Sapiens; identical to SEQ ID NO: 41695

SEQ ID NO: 204356 - RNA, 64 nt, Homo Sapiens; identical to SEQ ID NO: 41696

SEQ ID NO: 204357 - RNA, 64 nt, Homo Sapiens; identical to SEQ ID NO: 41697

SEQ ID NO: 204358 - RNA, 64 nt, Homo Sapiens; identical to SEQ ID NO: 41698

SEQ ID NO: 204359 - RNA, 64 nt, Homo Sapiens; identical to SEQ ID NO: 41699

SEQ ID NO: 204360 - RNA, 64 nt, Homo Sapiens; identical to SEQ ID NO: 41700

SEQ ID NO: 204361 - RNA, 64 nt, Homo Sapiens; identical to SEQ ID NO: 41701

SEQ ID NO: 204362 - RNA, 64 nt, Homo Sapiens; identical to SEQ ID NO: 41702

SEQ ID NO: 204363 - RNA, 64 nt, Homo Sapiens; identical to SEQ ID NO: 41703

SEQ ID NO: 204364 - RNA, 64 nt, Homo Sapiens; identical to SEQ ID NO: 41704

SEQ ID NO: 204365 - RNA, 64 nt, Homo Sapiens; identical to SEQ ID NO: 41705

SEQ ID NO: 204366 - RNA, 64 nt, Homo Sapiens; identical to SEQ ID NO: 41706

SEQ ID NO: 204367 - RNA, 64 nt, Homo Sapiens; identical to SEQ ID NO: 41707

SEQ ID NO: 204368 - RNA, 64 nt, Homo Sapiens; identical to SEQ ID NO: 41708

SEQ ID NO: 204369 - RNA, 64 nt, Homo Sapiens; identical to SEQ ID NO: 41709

SEQ ID NO: 204370 - RNA, 64 nt, Homo Sapiens; identical to SEQ ID NO: 41710

SEQ ID NO: 204371 - RNA, 64 nt, Homo Sapiens; identical to SEQ ID NO: 41711

SEQ ID NO: 204372 - RNA, 64 nt, Homo Sapiens; identical to SEQ ID NO: 41712

SEQ ID NO: 204373 - RNA, 64 nt, Homo Sapiens; identical to SEQ ID NO: 41713

SEQ ID NO: 204374 - RNA, 64 nt, Homo Sapiens; identical to SEQ ID NO: 41714

SEQ ID NO: 204375 - RNA, 64 nt, Homo Sapiens; identical to SEQ ID NO: 41715

SEQ ID NO: 204376 - RNA, 64 nt, Homo Sapiens; identical to SEQ ID NO: 41716

SEQ ID NO: 204377 - RNA, 64 nt, Homo Sapiens; identical to SEQ ID NO: 41717

SEQ ID NO: 204378 - RNA, 64 nt, Homo Sapiens; identical to SEQ ID NO: 41718

SEQ ID NO: 204379 - RNA, 64 nt, Homo Sapiens; identical to SEQ ID NO: 41719

SEQ ID NO: 204380 - RNA, 64 nt, Homo Sapiens; identical to SEQ ID NO: 41720

SEQ ID NO: 204381 - RNA, 64 nt, Homo Sapiens; identical to SEQ ID NO: 41721

SEQ ID NO: 204382 - RNA, 64 nt, Homo Sapiens; identical to SEQ ID NO: 41722

SEQ ID NO: 204383 - RNA, 64 nt, Homo Sapiens; identical to SEQ ID NO: 41723

SEQ ID NO: 204384 - RNA, 64 nt, Homo Sapiens; identical to SEQ ID NO: 41724

SEQ ID NO: 204385 - RNA, 64 nt, Homo Sapiens; identical to SEQ ID NO: 41725

SEQ ID NO: 204386 - RNA, 64 nt, Homo Sapiens; identical to SEQ ID NO: 41726

SEQ ID NO: 204387 - RNA, 64 nt, Homo Sapiens; identical to SEQ ID NO: 41727

SEQ ID NO: 204388 - RNA, 64 nt, Homo Sapiens; identical to SEQ ID NO: 41728

SEQ ID NO: 204389 - RNA, 64 nt, Homo Sapiens; identical to SEQ ID NO: 41729

SEQ ID NO: 204390 - RNA, 64 nt, Homo Sapiens; identical to SEQ ID NO: 41730

SEQ ID NO: 204391 - RNA, 64 nt, Homo Sapiens; identical to SEQ ID NO: 41731

SEQ ID NO: 204392 - RNA, 64 nt, Homo Sapiens; identical to SEQ ID NO: 41732

SEQ ID NO: 204393 - RNA, 64 nt, Homo Sapiens; identical to SEQ ID NO: 41733

SEQ ID NO: 204394 - RNA, 64 nt, Homo Sapiens; identical to SEQ ID NO: 41734

SEQ ID NO: 204395 - RNA, 64 nt, Homo Sapiens; identical to SEQ ID NO: 41735

SEQ ID NO: 204396 - RNA, 64 nt, Homo Sapiens; identical to SEQ ID NO: 41736

SEQ ID NO: 204397 - RNA, 64 nt, Homo Sapiens; identical to SEQ ID NO: 41737

SEQ ID NO: 204398 - RNA, 64 nt, Homo Sapiens; identical to SEQ ID NO: 41738

SEQ ID NO: 204399 - RNA, 64 nt, Homo Sapiens; identical to SEQ ID NO: 41739

SEQ ID NO: 204400 - RNA, 64 nt, Homo Sapiens; identical to SEQ ID NO: 41740

SEQ ID NO: 204401 - RNA, 64 nt, Homo Sapiens; identical to SEQ ID NO: 41741

SEQ ID NO: 204402 - RNA, 64 nt, Homo Sapiens; identical to SEQ ID NO: 41742

SEQ ID NO: 204403 - RNA, 64 nt, Homo Sapiens; identical to SEQ ID NO: 41743

SEQ ID NO: 204404 - RNA, 64 nt, Homo Sapiens; identical to SEQ ID NO: 41744

SEQ ID NO: 204405 - RNA, 64 nt, Homo Sapiens; identical to SEQ ID NO: 41745

SEQ ID NO: 204406 - RNA, 64 nt, Homo Sapiens; identical to SEQ ID NO: 41746

SEQ ID NO: 204407 - RNA, 64 nt, Homo Sapiens; identical to SEQ ID NO: 41747

SEQ ID NO: 204408 - RNA, 64 nt, Homo Sapiens; identical to SEQ ID NO: 41748

SEQ ID NO: 204409 - RNA, 64 nt, Homo Sapiens; identical to SEQ ID NO: 41749

SEQ ID NO: 204410 - RNA, 64 nt, Homo Sapiens; identical to SEQ ID NO: 41750

SEQ ID NO: 204411 - RNA, 64 nt, Homo Sapiens; identical to SEQ ID NO: 41751

SEQ ID NO: 204412 - RNA, 64 nt, Homo Sapiens; identical to SEQ ID NO: 41752

SEQ ID NO: 204413 - RNA, 64 nt, Homo Sapiens; identical to SEQ ID NO: 41753

SEQ ID NO: 204414 - RNA, 64 nt, Homo Sapiens; identical to SEQ ID NO: 41754

SEQ ID NO: 204415 - RNA, 64 nt, Homo Sapiens; identical to SEQ ID NO: 41755

SEQ ID NO: 204416 - RNA, 64 nt, Homo Sapiens; identical to SEQ ID NO: 41756

SEQ ID NO: 204417 - RNA, 64 nt, Homo Sapiens; identical to SEQ ID NO: 41757

SEQ ID NO: 204418 - RNA, 64 nt, Homo Sapiens; identical to SEQ ID NO: 41758

SEQ ID NO: 204419 - RNA, 64 nt, Homo Sapiens; identical to SEQ ID NO: 41759

SEQ ID NO: 204420 - RNA, 64 nt, Homo Sapiens; identical to SEQ ID NO: 41760

SEQ ID NO: 204421 - RNA, 64 nt, Homo Sapiens; identical to SEQ ID NO: 41761

SEQ ID NO: 204422 - RNA, 64 nt, Homo Sapiens; identical to SEQ ID NO: 41762

SEQ ID NO: 204423 - RNA, 64 nt, Homo Sapiens; identical to SEQ ID NO: 41763

SEQ ID NO: 204424 - RNA, 64 nt, Homo Sapiens; identical to SEQ ID NO: 41764

SEQ ID NO: 204425 - RNA, 64 nt, Homo Sapiens; identical to SEQ ID NO: 41765

SEQ ID NO: 204426 - RNA, 64 nt, Homo Sapiens; identical to SEQ ID NO: 41766

SEQ ID NO: 204427 - RNA, 64 nt, Homo Sapiens; identical to SEQ ID NO: 41767

SEQ ID NO: 204428 - RNA, 64 nt, Homo Sapiens; identical to SEQ ID NO: 41768

SEQ ID NO: 204429 - RNA, 64 nt, Homo Sapiens; identical to SEQ ID NO: 41769

SEQ ID NO: 204430 - RNA, 64 nt, Homo Sapiens; identical to SEQ ID NO: 41770

SEQ ID NO: 204431 - RNA, 64 nt, Homo Sapiens; identical to SEQ ID NO: 41771

SEQ ID NO: 204432 - RNA, 64 nt, Homo Sapiens; identical to SEQ ID NO: 41772

SEQ ID NO: 204433 - RNA, 64 nt, Homo Sapiens; identical to SEQ ID NO: 41773

SEQ ID NO: 204434 - RNA, 64 nt, Homo Sapiens; identical to SEQ ID NO: 41774

SEQ ID NO: 204435 - RNA, 64 nt, Homo Sapiens; identical to SEQ ID NO: 41775

SEQ ID NO: 204436 - RNA, 64 nt, Homo Sapiens; identical to SEQ ID NO: 41776

SEQ ID NO: 204437 - RNA, 64 nt, Homo Sapiens; identical to SEQ ID NO: 41777

SEQ ID NO: 204438 - RNA, 64 nt, Homo Sapiens; identical to SEQ ID NO: 41778

SEQ ID NO: 204439 - RNA, 64 nt, Homo Sapiens; identical to SEQ ID NO: 41779

SEQ ID NO: 204440 - RNA, 64 nt, Homo Sapiens; identical to SEQ ID NO: 41780

SEQ ID NO: 204441 - RNA, 64 nt, Homo Sapiens; identical to SEQ ID NO: 41781

SEQ ID NO: 204442 - RNA, 64 nt, Homo Sapiens; identical to SEQ ID NO: 41782

SEQ ID NO: 204443 - RNA, 64 nt, Homo Sapiens; identical to SEQ ID NO: 41783

SEQ ID NO: 204444 - RNA, 64 nt, Homo Sapiens; identical to SEQ ID NO: 41784

SEQ ID NO: 204445 - RNA, 64 nt, Homo Sapiens; identical to SEQ ID NO: 41785

SEQ ID NO: 204446 - RNA, 64 nt, Homo Sapiens; identical to SEQ ID NO: 41786

SEQ ID NO: 204447 - RNA, 64 nt, Homo Sapiens; identical to SEQ ID NO: 41787

SEQ ID NO: 204448 - RNA, 64 nt, Homo Sapiens; identical to SEQ ID NO: 41788

SEQ ID NO: 204449 - RNA, 64 nt, Homo Sapiens; identical to SEQ ID NO: 41789

SEQ ID NO: 204450 - RNA, 64 nt, Homo Sapiens; identical to SEQ ID NO: 41790

SEQ ID NO: 204451 - RNA, 64 nt, Homo Sapiens; identical to SEQ ID NO: 41791

SEQ ID NO: 204452 - RNA, 64 nt, Homo Sapiens; identical to SEQ ID NO: 41792

SEQ ID NO: 204453 - RNA, 64 nt, Homo Sapiens; identical to SEQ ID NO: 41793

SEQ ID NO: 204454 - RNA, 64 nt, Homo Sapiens; identical to SEQ ID NO: 41794

SEQ ID NO: 204455 - RNA, 64 nt, Homo Sapiens; identical to SEQ ID NO: 41795

SEQ ID NO: 204456 - RNA, 64 nt, Homo Sapiens; identical to SEQ ID NO: 41796

SEQ ID NO: 204457 - RNA, 64 nt, Homo Sapiens; identical to SEQ ID NO: 41797

SEQ ID NO: 204458 - RNA, 64 nt, Homo Sapiens; identical to SEQ ID NO: 41798

SEQ ID NO: 204459 - RNA, 64 nt, Homo Sapiens; identical to SEQ ID NO: 41799

SEQ ID NO: 204460 - RNA, 64 nt, Homo Sapiens; identical to SEQ ID NO: 41800

SEQ ID NO: 204461 - RNA, 64 nt, Homo Sapiens; identical to SEQ ID NO: 41801

SEQ ID NO: 204462 - RNA, 64 nt, Homo Sapiens; identical to SEQ ID NO: 41802

SEQ ID NO: 204463 - RNA, 64 nt, Homo Sapiens; identical to SEQ ID NO: 41803

SEQ ID NO: 204464 - RNA, 64 nt, Homo Sapiens; identical to SEQ ID NO: 41804

SEQ ID NO: 204465 - RNA, 64 nt, Homo Sapiens; identical to SEQ ID NO: 41805

SEQ ID NO: 204466 - RNA, 64 nt, Homo Sapiens; identical to SEQ ID NO: 41806

SEQ ID NO: 204467 - RNA, 64 nt, Homo Sapiens; identical to SEQ ID NO: 41807

SEQ ID NO: 204468 - RNA, 64 nt, Homo Sapiens; identical to SEQ ID NO: 41808

SEQ ID NO: 204469 - RNA, 64 nt, Homo Sapiens; identical to SEQ ID NO: 41809

SEQ ID NO: 204470 - RNA, 64 nt, Homo Sapiens; identical to SEQ ID NO: 41810

SEQ ID NO: 204471 - RNA, 64 nt, Homo Sapiens; identical to SEQ ID NO: 41811

SEQ ID NO: 204472 - RNA, 64 nt, Homo Sapiens; identical to SEQ ID NO: 41812

SEQ ID NO: 204473 - RNA, 64 nt, Homo Sapiens; identical to SEQ ID NO: 41813

SEQ ID NO: 204474 - RNA, 64 nt, Homo Sapiens; identical to SEQ ID NO: 41814

SEQ ID NO: 204475 - RNA, 64 nt, Homo Sapiens; identical to SEQ ID NO: 41815

SEQ ID NO: 204476 - RNA, 64 nt, Homo Sapiens; identical to SEQ ID NO: 41816

SEQ ID NO: 204477 - RNA, 64 nt, Homo Sapiens; identical to SEQ ID NO: 41817

SEQ ID NO: 204478 - RNA, 64 nt, Homo Sapiens; identical to SEQ ID NO: 41818

SEQ ID NO: 204479 - RNA, 64 nt, Homo Sapiens; identical to SEQ ID NO: 41819

SEQ ID NO: 204480 - RNA, 64 nt, Homo Sapiens; identical to SEQ ID NO: 41820

SEQ ID NO: 204481 - RNA, 64 nt, Homo Sapiens; identical to SEQ ID NO: 41821

SEQ ID NO: 204482 - RNA, 64 nt, Homo Sapiens; identical to SEQ ID NO: 41822

SEQ ID NO: 204483 - RNA, 64 nt, Homo Sapiens; identical to SEQ ID NO: 41823

SEQ ID NO: 204484 - RNA, 64 nt, Homo Sapiens; identical to SEQ ID NO: 41824

SEQ ID NO: 204485 - RNA, 64 nt, Homo Sapiens; identical to SEQ ID NO: 41825

SEQ ID NO: 204486 - RNA, 64 nt, Homo Sapiens; identical to SEQ ID NO: 41826

SEQ ID NO: 204487 - RNA, 64 nt, Homo Sapiens; identical to SEQ ID NO: 41827

SEQ ID NO: 204488 - RNA, 64 nt, Homo Sapiens; identical to SEQ ID NO: 41828

SEQ ID NO: 204489 - RNA, 64 nt, Homo Sapiens; identical to SEQ ID NO: 41829

SEQ ID NO: 204490 - RNA, 64 nt, Homo Sapiens; identical to SEQ ID NO: 41830

SEQ ID NO: 204491 - RNA, 64 nt, Homo Sapiens; identical to SEQ ID NO: 41831

SEQ ID NO: 204492 - RNA, 64 nt, Homo Sapiens; identical to SEQ ID NO: 41832

SEQ ID NO: 204493 - RNA, 64 nt, Homo Sapiens; identical to SEQ ID NO: 41833

SEQ ID NO: 204494 - RNA, 64 nt, Homo Sapiens; identical to SEQ ID NO: 41834

SEQ ID NO: 204495 - RNA, 64 nt, Homo Sapiens; identical to SEQ ID NO: 41835

SEQ ID NO: 204496 - RNA, 64 nt, Homo Sapiens; identical to SEQ ID NO: 41836

SEQ ID NO: 204497 - RNA, 64 nt, Homo Sapiens; identical to SEQ ID NO: 41837

SEQ ID NO: 204498 - RNA, 64 nt, Homo Sapiens; identical to SEQ ID NO: 41838

SEQ ID NO: 204499 - RNA, 64 nt, Homo Sapiens; identical to SEQ ID NO: 41839

SEQ ID NO: 204500 - RNA, 64 nt, Homo Sapiens; identical to SEQ ID NO: 41840

SEQ ID NO: 204501 - RNA, 64 nt, Homo Sapiens; identical to SEQ ID NO: 41841

SEQ ID NO: 204502 - RNA, 64 nt, Homo Sapiens; identical to SEQ ID NO: 41842

SEQ ID NO: 204503 - RNA, 64 nt, Homo Sapiens; identical to SEQ ID NO: 41843

SEQ ID NO: 204504 - RNA, 64 nt, Homo Sapiens; identical to SEQ ID NO: 41844

SEQ ID NO: 204505 - RNA, 64 nt, Homo Sapiens; identical to SEQ ID NO: 41845

SEQ ID NO: 204506 - RNA, 64 nt, Homo Sapiens; identical to SEQ ID NO: 41846

SEQ ID NO: 204507 - RNA, 64 nt, Homo Sapiens; identical to SEQ ID NO: 41847

SEQ ID NO: 204508 - RNA, 64 nt, Homo Sapiens; identical to SEQ ID NO: 41848

SEQ ID NO: 204509 - RNA, 64 nt, Homo Sapiens; identical to SEQ ID NO: 41849

SEQ ID NO: 204510 - RNA, 64 nt, Homo Sapiens; identical to SEQ ID NO: 41850

SEQ ID NO: 204511 - RNA, 64 nt, Homo Sapiens; identical to SEQ ID NO: 41851

SEQ ID NO: 204512 - RNA, 64 nt, Homo Sapiens; identical to SEQ ID NO: 41852

SEQ ID NO: 204513 - RNA, 64 nt, Homo Sapiens; identical to SEQ ID NO: 41853

SEQ ID NO: 204514 - RNA, 64 nt, Homo Sapiens; identical to SEQ ID NO: 41854

SEQ ID NO: 204515 - RNA, 64 nt, Homo Sapiens; identical to SEQ ID NO: 41855

SEQ ID NO: 204516 - RNA, 64 nt, Homo Sapiens; identical to SEQ ID NO: 41856

SEQ ID NO: 204517 - RNA, 64 nt, Homo Sapiens; identical to SEQ ID NO: 41857

SEQ ID NO: 204518 - RNA, 64 nt, Homo Sapiens; identical to SEQ ID NO: 41858

SEQ ID NO: 204519 - RNA, 64 nt, Homo Sapiens; identical to SEQ ID NO: 41859

SEQ ID NO: 204520 - RNA, 64 nt, Homo Sapiens; identical to SEQ ID NO: 41860

SEQ ID NO: 204521 - RNA, 64 nt, Homo Sapiens; identical to SEQ ID NO: 41861

SEQ ID NO: 204522 - RNA, 64 nt, Homo Sapiens; identical to SEQ ID NO: 41862

SEQ ID NO: 204523 - RNA, 64 nt, Homo Sapiens; identical to SEQ ID NO: 41863

SEQ ID NO: 204524 - RNA, 64 nt, Homo Sapiens; identical to SEQ ID NO: 41864

SEQ ID NO: 204525 - RNA, 64 nt, Homo Sapiens; identical to SEQ ID NO: 41865

SEQ ID NO: 204526 - RNA, 64 nt, Homo Sapiens; identical to SEQ ID NO: 41866

SEQ ID NO: 204527 - RNA, 64 nt, Homo Sapiens; identical to SEQ ID NO: 41867

SEQ ID NO: 204528 - RNA, 64 nt, Homo Sapiens; identical to SEQ ID NO: 41868

SEQ ID NO: 204529 - RNA, 64 nt, Homo Sapiens; identical to SEQ ID NO: 41869

SEQ ID NO: 204530 - RNA, 64 nt, Homo Sapiens; identical to SEQ ID NO: 41870

SEQ ID NO: 204531 - RNA, 64 nt, Homo Sapiens; identical to SEQ ID NO: 41871

SEQ ID NO: 204532 - RNA, 64 nt, Homo Sapiens; identical to SEQ ID NO: 41872

SEQ ID NO: 204533 - RNA, 64 nt, Homo Sapiens; identical to SEQ ID NO: 41873

SEQ ID NO: 204534 - RNA, 64 nt, Homo Sapiens; identical to SEQ ID NO: 41874

SEQ ID NO: 204535 - RNA, 64 nt, Homo Sapiens; identical to SEQ ID NO: 41875

SEQ ID NO: 204536 - RNA, 64 nt, Homo Sapiens; identical to SEQ ID NO: 41876

SEQ ID NO: 204537 - RNA, 64 nt, Homo Sapiens; identical to SEQ ID NO: 41877

SEQ ID NO: 204538 - RNA, 64 nt, Homo Sapiens; identical to SEQ ID NO: 41878

SEQ ID NO: 204539 - RNA, 64 nt, Homo Sapiens; identical to SEQ ID NO: 41879

SEQ ID NO: 204540 - RNA, 64 nt, Homo Sapiens; identical to SEQ ID NO: 41880

SEQ ID NO: 204541 - RNA, 64 nt, Homo Sapiens; identical to SEQ ID NO: 41881

SEQ ID NO: 204542 - RNA, 64 nt, Homo Sapiens; identical to SEQ ID NO: 41882

SEQ ID NO: 204543 - RNA, 64 nt, Homo Sapiens; identical to SEQ ID NO: 41883

SEQ ID NO: 204544 - RNA, 64 nt, Homo Sapiens; identical to SEQ ID NO: 41884

SEQ ID NO: 204545 - RNA, 64 nt, Homo Sapiens; identical to SEQ ID NO: 41885

SEQ ID NO: 204546 - RNA, 64 nt, Homo Sapiens; identical to SEQ ID NO: 41886

SEQ ID NO: 204547 - RNA, 64 nt, Homo Sapiens; identical to SEQ ID NO: 41887

SEQ ID NO: 204548 - RNA, 64 nt, Homo Sapiens; identical to SEQ ID NO: 41888

SEQ ID NO: 204549 - RNA, 64 nt, Homo Sapiens; identical to SEQ ID NO: 41889

SEQ ID NO: 204550 - RNA, 64 nt, Homo Sapiens; identical to SEQ ID NO: 41890

SEQ ID NO: 204551 - RNA, 64 nt, Homo Sapiens; identical to SEQ ID NO: 41891

SEQ ID NO: 204552 - RNA, 64 nt, Homo Sapiens; identical to SEQ ID NO: 41892

SEQ ID NO: 204553 - RNA, 64 nt, Homo Sapiens; identical to SEQ ID NO: 41893

SEQ ID NO: 204554 - RNA, 64 nt, Homo Sapiens; identical to SEQ ID NO: 41894

SEQ ID NO: 204555 - RNA, 64 nt, Homo Sapiens; identical to SEQ ID NO: 41895

SEQ ID NO: 204556 - RNA, 64 nt, Homo Sapiens; identical to SEQ ID NO: 41896

SEQ ID NO: 204557 - RNA, 64 nt, Homo Sapiens; identical to SEQ ID NO: 41897

SEQ ID NO: 204558 - RNA, 64 nt, Homo Sapiens; identical to SEQ ID NO: 41898

SEQ ID NO: 204559 - RNA, 64 nt, Homo Sapiens; identical to SEQ ID NO: 41899

SEQ ID NO: 204560 - RNA, 64 nt, Homo Sapiens; identical to SEQ ID NO: 41900

SEQ ID NO: 204561 - RNA, 64 nt, Homo Sapiens; identical to SEQ ID NO: 41901

SEQ ID NO: 204562 - RNA, 64 nt, Homo Sapiens; identical to SEQ ID NO: 41902

SEQ ID NO: 204563 - RNA, 64 nt, Homo Sapiens; identical to SEQ ID NO: 41903

SEQ ID NO: 204564 - RNA, 64 nt, Homo Sapiens; identical to SEQ ID NO: 41904

SEQ ID NO: 204565 - RNA, 64 nt, Homo Sapiens; identical to SEQ ID NO: 41905

SEQ ID NO: 204566 - RNA, 64 nt, Homo Sapiens; identical to SEQ ID NO: 41906

SEQ ID NO: 204567 - RNA, 64 nt, Homo Sapiens; identical to SEQ ID NO: 41907

SEQ ID NO: 204568 - RNA, 64 nt, Homo Sapiens; identical to SEQ ID NO: 41908

SEQ ID NO: 204569 - RNA, 64 nt, Homo Sapiens; identical to SEQ ID NO: 41909

SEQ ID NO: 204570 - RNA, 64 nt, Homo Sapiens; identical to SEQ ID NO: 41910

SEQ ID NO: 204571 - RNA, 64 nt, Homo Sapiens; identical to SEQ ID NO: 41911

SEQ ID NO: 204572 - RNA, 64 nt, Homo Sapiens; identical to SEQ ID NO: 41912

SEQ ID NO: 204573 - RNA, 64 nt, Homo Sapiens; identical to SEQ ID NO: 41913

SEQ ID NO: 204574 - RNA, 64 nt, Homo Sapiens; identical to SEQ ID NO: 41914

SEQ ID NO: 204575 - RNA, 64 nt, Homo Sapiens; identical to SEQ ID NO: 41915

SEQ ID NO: 204576 - RNA, 64 nt, Homo Sapiens; identical to SEQ ID NO: 41916

SEQ ID NO: 204577 - RNA, 64 nt, Homo Sapiens; identical to SEQ ID NO: 41917

SEQ ID NO: 204578 - RNA, 64 nt, Homo Sapiens; identical to SEQ ID NO: 41918

SEQ ID NO: 204579 - RNA, 64 nt, Homo Sapiens; identical to SEQ ID NO: 41919

SEQ ID NO: 204580 - RNA, 64 nt, Homo Sapiens; identical to SEQ ID NO: 41920

SEQ ID NO: 204581 - RNA, 64 nt, Homo Sapiens; identical to SEQ ID NO: 41921

SEQ ID NO: 204582 - RNA, 64 nt, Homo Sapiens; identical to SEQ ID NO: 41922

SEQ ID NO: 204583 - RNA, 64 nt, Homo Sapiens; identical to SEQ ID NO: 41923

SEQ ID NO: 204584 - RNA, 64 nt, Homo Sapiens; identical to SEQ ID NO: 41924

SEQ ID NO: 204585 - RNA, 64 nt, Homo Sapiens; identical to SEQ ID NO: 41925

SEQ ID NO: 204586 - RNA, 64 nt, Homo Sapiens; identical to SEQ ID NO: 41926

SEQ ID NO: 204587 - RNA, 64 nt, Homo Sapiens; identical to SEQ ID NO: 41927

SEQ ID NO: 204588 - RNA, 64 nt, Homo Sapiens; identical to SEQ ID NO: 41928

SEQ ID NO: 204589 - RNA, 64 nt, Homo Sapiens; identical to SEQ ID NO: 41929

SEQ ID NO: 204590 - RNA, 64 nt, Homo Sapiens; identical to SEQ ID NO: 41930

SEQ ID NO: 204591 - RNA, 64 nt, Homo Sapiens; identical to SEQ ID NO: 41931

SEQ ID NO: 204592 - RNA, 64 nt, Homo Sapiens; identical to SEQ ID NO: 41932

SEQ ID NO: 204593 - RNA, 64 nt, Homo Sapiens; identical to SEQ ID NO: 41933

SEQ ID NO: 204594 - RNA, 64 nt, Homo Sapiens; identical to SEQ ID NO: 41934

SEQ ID NO: 204595 - RNA, 64 nt, Homo Sapiens; identical to SEQ ID NO: 41935

SEQ ID NO: 204596 - RNA, 64 nt, Homo Sapiens; identical to SEQ ID NO: 41936

SEQ ID NO: 204597 - RNA, 64 nt, Homo Sapiens; identical to SEQ ID NO: 41937

SEQ ID NO: 204598 - RNA, 64 nt, Homo Sapiens; identical to SEQ ID NO: 41938

SEQ ID NO: 204599 - RNA, 64 nt, Homo Sapiens; identical to SEQ ID NO: 41939

SEQ ID NO: 204600 - RNA, 64 nt, Homo Sapiens; identical to SEQ ID NO: 41940

SEQ ID NO: 204601 - RNA, 64 nt, Homo Sapiens; identical to SEQ ID NO: 41941

SEQ ID NO: 204602 - RNA, 64 nt, Homo Sapiens; identical to SEQ ID NO: 41942

SEQ ID NO: 204603 - RNA, 64 nt, Homo Sapiens; identical to SEQ ID NO: 41943

SEQ ID NO: 204604 - RNA, 64 nt, Homo Sapiens; identical to SEQ ID NO: 41944

SEQ ID NO: 204605 - RNA, 64 nt, Homo Sapiens; identical to SEQ ID NO: 41945

SEQ ID NO: 204606 - RNA, 64 nt, Homo Sapiens; identical to SEQ ID NO: 41946

SEQ ID NO: 204607 - RNA, 64 nt, Homo Sapiens; identical to SEQ ID NO: 41947

SEQ ID NO: 204608 - RNA, 64 nt, Homo Sapiens; identical to SEQ ID NO: 41948

SEQ ID NO: 204609 - RNA, 64 nt, Homo Sapiens; identical to SEQ ID NO: 41949

SEQ ID NO: 204610 - RNA, 64 nt, Homo Sapiens; identical to SEQ ID NO: 41950

SEQ ID NO: 204611 - RNA, 64 nt, Homo Sapiens; identical to SEQ ID NO: 41951

SEQ ID NO: 204612 - RNA, 64 nt, Homo Sapiens; identical to SEQ ID NO: 41952

SEQ ID NO: 204613 - RNA, 64 nt, Homo Sapiens; identical to SEQ ID NO: 41953

SEQ ID NO: 204614 - RNA, 64 nt, Homo Sapiens; identical to SEQ ID NO: 41954

SEQ ID NO: 204615 - RNA, 64 nt, Homo Sapiens; identical to SEQ ID NO: 41955

SEQ ID NO: 204616 - RNA, 64 nt, Homo Sapiens; identical to SEQ ID NO: 41956

SEQ ID NO: 204617 - RNA, 64 nt, Homo Sapiens; identical to SEQ ID NO: 41957

SEQ ID NO: 204618 - RNA, 64 nt, Homo Sapiens; identical to SEQ ID NO: 41958

SEQ ID NO: 204619 - RNA, 64 nt, Homo Sapiens; identical to SEQ ID NO: 41959

SEQ ID NO: 204620 - RNA, 64 nt, Homo Sapiens; identical to SEQ ID NO: 41960

SEQ ID NO: 204621 - RNA, 64 nt, Homo Sapiens; identical to SEQ ID NO: 41961

SEQ ID NO: 204622 - RNA, 64 nt, Homo Sapiens; identical to SEQ ID NO: 41962

SEQ ID NO: 204623 - RNA, 64 nt, Homo Sapiens; identical to SEQ ID NO: 41963

SEQ ID NO: 204624 - RNA, 64 nt, Homo Sapiens; identical to SEQ ID NO: 41964

SEQ ID NO: 204625 - RNA, 64 nt, Homo Sapiens; identical to SEQ ID NO: 41965

SEQ ID NO: 204626 - RNA, 64 nt, Homo Sapiens; identical to SEQ ID NO: 41966

SEQ ID NO: 204627 - RNA, 64 nt, Homo Sapiens; identical to SEQ ID NO: 41967

SEQ ID NO: 204628 - RNA, 64 nt, Homo Sapiens; identical to SEQ ID NO: 41968

SEQ ID NO: 204629 - RNA, 64 nt, Homo Sapiens; identical to SEQ ID NO: 41969

SEQ ID NO: 204630 - RNA, 64 nt, Homo Sapiens; identical to SEQ ID NO: 41970

SEQ ID NO: 204631 - RNA, 64 nt, Homo Sapiens; identical to SEQ ID NO: 41971

SEQ ID NO: 204632 - RNA, 64 nt, Homo Sapiens; identical to SEQ ID NO: 41972

SEQ ID NO: 204633 - RNA, 64 nt, Homo Sapiens; identical to SEQ ID NO: 41973

SEQ ID NO: 204634 - RNA, 64 nt, Homo Sapiens; identical to SEQ ID NO: 41974

SEQ ID NO: 204635 - RNA, 64 nt, Homo Sapiens; identical to SEQ ID NO: 41975

SEQ ID NO: 204636 - RNA, 64 nt, Homo Sapiens; identical to SEQ ID NO: 41976

SEQ ID NO: 204637 - RNA, 64 nt, Homo Sapiens; identical to SEQ ID NO: 41977

SEQ ID NO: 204638 - RNA, 64 nt, Homo Sapiens; identical to SEQ ID NO: 41978

SEQ ID NO: 204639 - RNA, 64 nt, Homo Sapiens; identical to SEQ ID NO: 41979

SEQ ID NO: 204640 - RNA, 64 nt, Homo Sapiens; identical to SEQ ID NO: 41980

SEQ ID NO: 204641 - RNA, 64 nt, Homo Sapiens; identical to SEQ ID NO: 41981

SEQ ID NO: 204642 - RNA, 64 nt, Homo Sapiens; identical to SEQ ID NO: 41982

SEQ ID NO: 204643 - RNA, 64 nt, Homo Sapiens; identical to SEQ ID NO: 41983

SEQ ID NO: 204644 - RNA, 64 nt, Homo Sapiens; identical to SEQ ID NO: 41984

SEQ ID NO: 204645 - RNA, 64 nt, Homo Sapiens; identical to SEQ ID NO: 41985

SEQ ID NO: 204646 - RNA, 64 nt, Homo Sapiens; identical to SEQ ID NO: 41986

SEQ ID NO: 204647 - RNA, 64 nt, Homo Sapiens; identical to SEQ ID NO: 41987

SEQ ID NO: 204648 - RNA, 64 nt, Homo Sapiens; identical to SEQ ID NO: 41988

SEQ ID NO: 204649 - RNA, 64 nt, Homo Sapiens; identical to SEQ ID NO: 41989

SEQ ID NO: 204650 - RNA, 64 nt, Homo Sapiens; identical to SEQ ID NO: 41990

SEQ ID NO: 204651 - RNA, 64 nt, Homo Sapiens; identical to SEQ ID NO: 41991

SEQ ID NO: 204652 - RNA, 64 nt, Homo Sapiens; identical to SEQ ID NO: 41992

SEQ ID NO: 204653 - RNA, 64 nt, Homo Sapiens; identical to SEQ ID NO: 41993

SEQ ID NO: 204654 - RNA, 64 nt, Homo Sapiens; identical to SEQ ID NO: 41994

SEQ ID NO: 204655 - RNA, 64 nt, Homo Sapiens; identical to SEQ ID NO: 41995

SEQ ID NO: 204656 - RNA, 64 nt, Homo Sapiens; identical to SEQ ID NO: 41996

SEQ ID NO: 204657 - RNA, 64 nt, Homo Sapiens; identical to SEQ ID NO: 41997

SEQ ID NO: 204658 - RNA, 64 nt, Homo Sapiens; identical to SEQ ID NO: 41998

SEQ ID NO: 204659 - RNA, 64 nt, Homo Sapiens; identical to SEQ ID NO: 41999

SEQ ID NO: 204660 - RNA, 64 nt, Homo Sapiens; identical to SEQ ID NO: 42000

SEQ ID NO: 204661 - RNA, 64 nt, Homo Sapiens; identical to SEQ ID NO: 42001

SEQ ID NO: 204662 - RNA, 64 nt, Homo Sapiens; identical to SEQ ID NO: 42002

SEQ ID NO: 204663 - RNA, 64 nt, Homo Sapiens; identical to SEQ ID NO: 42003

SEQ ID NO: 204664 - RNA, 64 nt, Homo Sapiens; identical to SEQ ID NO: 42004

SEQ ID NO: 204665 - RNA, 64 nt, Homo Sapiens; identical to SEQ ID NO: 42005

SEQ ID NO: 204666 - RNA, 64 nt, Homo Sapiens; identical to SEQ ID NO: 42006

SEQ ID NO: 204667 - RNA, 64 nt, Homo Sapiens; identical to SEQ ID NO: 42007

SEQ ID NO: 204668 - RNA, 64 nt, Homo Sapiens; identical to SEQ ID NO: 42008

SEQ ID NO: 204669 - RNA, 64 nt, Homo Sapiens; identical to SEQ ID NO: 42009

SEQ ID NO: 204670 - RNA, 64 nt, Homo Sapiens; identical to SEQ ID NO: 42010

SEQ ID NO: 204671 - RNA, 64 nt, Homo Sapiens; identical to SEQ ID NO: 42011

SEQ ID NO: 204672 - RNA, 64 nt, Homo Sapiens; identical to SEQ ID NO: 42012

SEQ ID NO: 204673 - RNA, 64 nt, Homo Sapiens; identical to SEQ ID NO: 42013

SEQ ID NO: 204674 - RNA, 64 nt, Homo Sapiens; identical to SEQ ID NO: 42014

SEQ ID NO: 204675 - RNA, 64 nt, Homo Sapiens; identical to SEQ ID NO: 42015

SEQ ID NO: 204676 - RNA, 64 nt, Homo Sapiens; identical to SEQ ID NO: 42016

SEQ ID NO: 204677 - RNA, 64 nt, Homo Sapiens; identical to SEQ ID NO: 42017

SEQ ID NO: 204678 - RNA, 64 nt, Homo Sapiens; identical to SEQ ID NO: 42018

SEQ ID NO: 204679 - RNA, 64 nt, Homo Sapiens; identical to SEQ ID NO: 42019

SEQ ID NO: 204680 - RNA, 64 nt, Homo Sapiens; identical to SEQ ID NO: 42020

SEQ ID NO: 204681 - RNA, 64 nt, Homo Sapiens; identical to SEQ ID NO: 42021

SEQ ID NO: 204682 - RNA, 64 nt, Homo Sapiens; identical to SEQ ID NO: 42022

SEQ ID NO: 204683 - RNA, 64 nt, Homo Sapiens; identical to SEQ ID NO: 42023

SEQ ID NO: 204684 - RNA, 64 nt, Homo Sapiens; identical to SEQ ID NO: 42024

SEQ ID NO: 204685 - RNA, 64 nt, Homo Sapiens; identical to SEQ ID NO: 42025

SEQ ID NO: 204686 - RNA, 64 nt, Homo Sapiens; identical to SEQ ID NO: 42026

SEQ ID NO: 204687 - RNA, 64 nt, Homo Sapiens; identical to SEQ ID NO: 42027

SEQ ID NO: 204688 - RNA, 64 nt, Homo Sapiens; identical to SEQ ID NO: 42028

SEQ ID NO: 204689 - RNA, 64 nt, Homo Sapiens; identical to SEQ ID NO: 42029

SEQ ID NO: 204690 - RNA, 64 nt, Homo Sapiens; identical to SEQ ID NO: 42030

SEQ ID NO: 204691 - RNA, 64 nt, Homo Sapiens; identical to SEQ ID NO: 42031

SEQ ID NO: 204692 - RNA, 64 nt, Homo Sapiens; identical to SEQ ID NO: 42032

SEQ ID NO: 204693 - RNA, 64 nt, Homo Sapiens; identical to SEQ ID NO: 42033

SEQ ID NO: 204694 - RNA, 64 nt, Homo Sapiens; identical to SEQ ID NO: 42034

SEQ ID NO: 204695 - RNA, 64 nt, Homo Sapiens; identical to SEQ ID NO: 42035

SEQ ID NO: 204696 - RNA, 64 nt, Homo Sapiens; identical to SEQ ID NO: 42036

SEQ ID NO: 204697 - RNA, 64 nt, Homo Sapiens; identical to SEQ ID NO: 42037

SEQ ID NO: 204698 - RNA, 64 nt, Homo Sapiens; identical to SEQ ID NO: 42038

SEQ ID NO: 204699 - RNA, 64 nt, Homo Sapiens; identical to SEQ ID NO: 42039

SEQ ID NO: 204700 - RNA, 64 nt, Homo Sapiens; identical to SEQ ID NO: 42040

SEQ ID NO: 204701 - RNA, 64 nt, Homo Sapiens; identical to SEQ ID NO: 42041

SEQ ID NO: 204702 - RNA, 64 nt, Homo Sapiens; identical to SEQ ID NO: 42042

SEQ ID NO: 204703 - RNA, 64 nt, Homo Sapiens; identical to SEQ ID NO: 42043

SEQ ID NO: 204704 - RNA, 64 nt, Homo Sapiens; identical to SEQ ID NO: 42044

SEQ ID NO: 204705 - RNA, 64 nt, Homo Sapiens; identical to SEQ ID NO: 42045

SEQ ID NO: 204706 - RNA, 64 nt, Homo Sapiens; identical to SEQ ID NO: 42046

SEQ ID NO: 204707 - RNA, 64 nt, Homo Sapiens; identical to SEQ ID NO: 42047

SEQ ID NO: 204708 - RNA, 64 nt, Homo Sapiens; identical to SEQ ID NO: 42048

SEQ ID NO: 204709 - RNA, 64 nt, Homo Sapiens; identical to SEQ ID NO: 42049

SEQ ID NO: 204710 - RNA, 64 nt, Homo Sapiens; identical to SEQ ID NO: 42050

SEQ ID NO: 204711 - RNA, 64 nt, Homo Sapiens; identical to SEQ ID NO: 42051

SEQ ID NO: 204712 - RNA, 64 nt, Homo Sapiens; identical to SEQ ID NO: 42052

SEQ ID NO: 204713 - RNA, 64 nt, Homo Sapiens; identical to SEQ ID NO: 42053

SEQ ID NO: 204714 - RNA, 64 nt, Homo Sapiens; identical to SEQ ID NO: 42054

SEQ ID NO: 204715 - RNA, 64 nt, Homo Sapiens; identical to SEQ ID NO: 42055

SEQ ID NO: 204716 - RNA, 64 nt, Homo Sapiens; identical to SEQ ID NO: 42056

SEQ ID NO: 204717 - RNA, 64 nt, Homo Sapiens; identical to SEQ ID NO: 42057

SEQ ID NO: 204718 - RNA, 64 nt, Homo Sapiens; identical to SEQ ID NO: 42058

SEQ ID NO: 204719 - RNA, 64 nt, Homo Sapiens; identical to SEQ ID NO: 42059

SEQ ID NO: 204720 - RNA, 64 nt, Homo Sapiens; identical to SEQ ID NO: 42060

SEQ ID NO: 204721 - RNA, 64 nt, Homo Sapiens; identical to SEQ ID NO: 42061

SEQ ID NO: 204722 - RNA, 64 nt, Homo Sapiens; identical to SEQ ID NO: 42062

SEQ ID NO: 204723 - RNA, 64 nt, Homo Sapiens; identical to SEQ ID NO: 42063

SEQ ID NO: 204724 - RNA, 64 nt, Homo Sapiens; identical to SEQ ID NO: 42064

SEQ ID NO: 204725 - RNA, 64 nt, Homo Sapiens; identical to SEQ ID NO: 42065

SEQ ID NO: 204726 - RNA, 64 nt, Homo Sapiens; identical to SEQ ID NO: 42066

SEQ ID NO: 204727 - RNA, 64 nt, Homo Sapiens; identical to SEQ ID NO: 42067

SEQ ID NO: 204728 - RNA, 64 nt, Homo Sapiens; identical to SEQ ID NO: 42068

SEQ ID NO: 204729 - RNA, 64 nt, Homo Sapiens; identical to SEQ ID NO: 42069

SEQ ID NO: 204730 - RNA, 64 nt, Homo Sapiens; identical to SEQ ID NO: 42070

SEQ ID NO: 204731 - RNA, 64 nt, Homo Sapiens; identical to SEQ ID NO: 42071

SEQ ID NO: 204732 - RNA, 64 nt, Homo Sapiens; identical to SEQ ID NO: 42072

SEQ ID NO: 204733 - RNA, 64 nt, Homo Sapiens; identical to SEQ ID NO: 42073

SEQ ID NO: 204734 - RNA, 64 nt, Homo Sapiens; identical to SEQ ID NO: 42074

SEQ ID NO: 204735 - RNA, 64 nt, Homo Sapiens; identical to SEQ ID NO: 42075

SEQ ID NO: 204736 - RNA, 64 nt, Homo Sapiens; identical to SEQ ID NO: 42076

SEQ ID NO: 204737 - RNA, 64 nt, Homo Sapiens; identical to SEQ ID NO: 42077

SEQ ID NO: 204738 - RNA, 64 nt, Homo Sapiens; identical to SEQ ID NO: 42078

SEQ ID NO: 204739 - RNA, 64 nt, Homo Sapiens; identical to SEQ ID NO: 42079

SEQ ID NO: 204740 - RNA, 64 nt, Homo Sapiens; identical to SEQ ID NO: 42080

SEQ ID NO: 204741 - RNA, 64 nt, Homo Sapiens; identical to SEQ ID NO: 42081

SEQ ID NO: 204742 - RNA, 64 nt, Homo Sapiens; identical to SEQ ID NO: 42082

SEQ ID NO: 204743 - RNA, 64 nt, Homo Sapiens; identical to SEQ ID NO: 42083

SEQ ID NO: 204744 - RNA, 64 nt, Homo Sapiens; identical to SEQ ID NO: 42084

SEQ ID NO: 204745 - RNA, 64 nt, Homo Sapiens; identical to SEQ ID NO: 42085

SEQ ID NO: 204746 - RNA, 64 nt, Homo Sapiens; identical to SEQ ID NO: 42086

SEQ ID NO: 204747 - RNA, 64 nt, Homo Sapiens; identical to SEQ ID NO: 42087

SEQ ID NO: 204748 - RNA, 64 nt, Homo Sapiens; identical to SEQ ID NO: 42088

SEQ ID NO: 204749 - RNA, 64 nt, Homo Sapiens; identical to SEQ ID NO: 42089

SEQ ID NO: 204750 - RNA, 64 nt, Homo Sapiens; identical to SEQ ID NO: 42090

SEQ ID NO: 204751 - RNA, 64 nt, Homo Sapiens; identical to SEQ ID NO: 42091

SEQ ID NO: 204752 - RNA, 64 nt, Homo Sapiens; identical to SEQ ID NO: 42092

SEQ ID NO: 204753 - RNA, 64 nt, Homo Sapiens; identical to SEQ ID NO: 42093

SEQ ID NO: 204754 - RNA, 64 nt, Homo Sapiens; identical to SEQ ID NO: 42094

SEQ ID NO: 204755 - RNA, 64 nt, Homo Sapiens; identical to SEQ ID NO: 42095

SEQ ID NO: 204756 - RNA, 64 nt, Homo Sapiens; identical to SEQ ID NO: 42096

SEQ ID NO: 204757 - RNA, 64 nt, Homo Sapiens; identical to SEQ ID NO: 42097

SEQ ID NO: 204758 - RNA, 64 nt, Homo Sapiens; identical to SEQ ID NO: 42098

SEQ ID NO: 204759 - RNA, 64 nt, Homo Sapiens; identical to SEQ ID NO: 42099

SEQ ID NO: 204760 - RNA, 64 nt, Homo Sapiens; identical to SEQ ID NO: 42100

SEQ ID NO: 204761 - RNA, 64 nt, Homo Sapiens; identical to SEQ ID NO: 42101

SEQ ID NO: 204762 - RNA, 64 nt, Homo Sapiens; identical to SEQ ID NO: 42102

SEQ ID NO: 204763 - RNA, 64 nt, Homo Sapiens; identical to SEQ ID NO: 42103

SEQ ID NO: 204764 - RNA, 64 nt, Homo Sapiens; identical to SEQ ID NO: 42104

SEQ ID NO: 204765 - RNA, 64 nt, Homo Sapiens; identical to SEQ ID NO: 42105

SEQ ID NO: 204766 - RNA, 64 nt, Homo Sapiens; identical to SEQ ID NO: 42106

SEQ ID NO: 204767 - RNA, 64 nt, Homo Sapiens; identical to SEQ ID NO: 42107

SEQ ID NO: 204768 - RNA, 64 nt, Homo Sapiens; identical to SEQ ID NO: 42108

SEQ ID NO: 204769 - RNA, 64 nt, Homo Sapiens; identical to SEQ ID NO: 42109

SEQ ID NO: 204770 - RNA, 64 nt, Homo Sapiens; identical to SEQ ID NO: 42110

SEQ ID NO: 204771 - RNA, 64 nt, Homo Sapiens; identical to SEQ ID NO: 42111

SEQ ID NO: 204772 - RNA, 64 nt, Homo Sapiens; identical to SEQ ID NO: 42112

SEQ ID NO: 204773 - RNA, 64 nt, Homo Sapiens; identical to SEQ ID NO: 42113

SEQ ID NO: 204774 - RNA, 64 nt, Homo Sapiens; identical to SEQ ID NO: 42114

SEQ ID NO: 204775 - RNA, 64 nt, Homo Sapiens; identical to SEQ ID NO: 42115

SEQ ID NO: 204776 - RNA, 64 nt, Homo Sapiens; identical to SEQ ID NO: 42116

SEQ ID NO: 204777 - RNA, 64 nt, Homo Sapiens; identical to SEQ ID NO: 42117

SEQ ID NO: 204778 - RNA, 64 nt, Homo Sapiens; identical to SEQ ID NO: 42118

SEQ ID NO: 204779 - RNA, 64 nt, Homo Sapiens; identical to SEQ ID NO: 42119

SEQ ID NO: 204780 - RNA, 64 nt, Homo Sapiens; identical to SEQ ID NO: 42120

SEQ ID NO: 204781 - RNA, 64 nt, Homo Sapiens; identical to SEQ ID NO: 42121

SEQ ID NO: 204782 - RNA, 64 nt, Homo Sapiens; identical to SEQ ID NO: 42122

SEQ ID NO: 204783 - RNA, 64 nt, Homo Sapiens; identical to SEQ ID NO: 42123

SEQ ID NO: 204784 - RNA, 64 nt, Homo Sapiens; identical to SEQ ID NO: 42124

SEQ ID NO: 204785 - RNA, 64 nt, Homo Sapiens; identical to SEQ ID NO: 42125

SEQ ID NO: 204786 - RNA, 64 nt, Homo Sapiens; identical to SEQ ID NO: 42126

SEQ ID NO: 204787 - RNA, 64 nt, Homo Sapiens; identical to SEQ ID NO: 42127

SEQ ID NO: 204788 - RNA, 64 nt, Homo Sapiens; identical to SEQ ID NO: 42128

SEQ ID NO: 204789 - RNA, 64 nt, Homo Sapiens; identical to SEQ ID NO: 42129

SEQ ID NO: 204790 - RNA, 64 nt, Homo Sapiens; identical to SEQ ID NO: 42130

SEQ ID NO: 204791 - RNA, 64 nt, Homo Sapiens; identical to SEQ ID NO: 42131

SEQ ID NO: 204792 - RNA, 64 nt, Homo Sapiens; identical to SEQ ID NO: 42132

SEQ ID NO: 204793 - RNA, 64 nt, Homo Sapiens; identical to SEQ ID NO: 42133

SEQ ID NO: 204794 - RNA, 64 nt, Homo Sapiens; identical to SEQ ID NO: 42134

SEQ ID NO: 204795 - RNA, 64 nt, Homo Sapiens; identical to SEQ ID NO: 42135

SEQ ID NO: 204796 - RNA, 64 nt, Homo Sapiens; identical to SEQ ID NO: 42136

SEQ ID NO: 204797 - RNA, 64 nt, Homo Sapiens; identical to SEQ ID NO: 42137

SEQ ID NO: 204798 - RNA, 64 nt, Homo Sapiens; identical to SEQ ID NO: 42138

SEQ ID NO: 204799 - RNA, 64 nt, Homo Sapiens; identical to SEQ ID NO: 42139

SEQ ID NO: 204800 - RNA, 64 nt, Homo Sapiens; identical to SEQ ID NO: 42140

SEQ ID NO: 204801 - RNA, 64 nt, Homo Sapiens; identical to SEQ ID NO: 42141

SEQ ID NO: 204802 - RNA, 64 nt, Homo Sapiens; identical to SEQ ID NO: 42142

SEQ ID NO: 204803 - RNA, 64 nt, Homo Sapiens; identical to SEQ ID NO: 42143

SEQ ID NO: 204804 - RNA, 64 nt, Homo Sapiens; identical to SEQ ID NO: 42144

SEQ ID NO: 204805 - RNA, 64 nt, Homo Sapiens; identical to SEQ ID NO: 42145

SEQ ID NO: 204806 - RNA, 64 nt, Homo Sapiens; identical to SEQ ID NO: 42146

SEQ ID NO: 204807 - RNA, 64 nt, Homo Sapiens; identical to SEQ ID NO: 42147

SEQ ID NO: 204808 - RNA, 64 nt, Homo Sapiens; identical to SEQ ID NO: 42148

SEQ ID NO: 204809 - RNA, 64 nt, Homo Sapiens; identical to SEQ ID NO: 42149

SEQ ID NO: 204810 - RNA, 64 nt, Homo Sapiens; identical to SEQ ID NO: 42150

SEQ ID NO: 204811 - RNA, 64 nt, Homo Sapiens; identical to SEQ ID NO: 42151

SEQ ID NO: 204812 - RNA, 64 nt, Homo Sapiens; identical to SEQ ID NO: 42152

SEQ ID NO: 204813 - RNA, 64 nt, Homo Sapiens; identical to SEQ ID NO: 42153

SEQ ID NO: 204814 - RNA, 64 nt, Homo Sapiens; identical to SEQ ID NO: 42154

SEQ ID NO: 204815 - RNA, 64 nt, Homo Sapiens; identical to SEQ ID NO: 42155

SEQ ID NO: 204816 - RNA, 64 nt, Homo Sapiens; identical to SEQ ID NO: 42156

SEQ ID NO: 204817 - RNA, 64 nt, Homo Sapiens; identical to SEQ ID NO: 42157

SEQ ID NO: 204818 - RNA, 64 nt, Homo Sapiens; identical to SEQ ID NO: 42158

SEQ ID NO: 204819 - RNA, 64 nt, Homo Sapiens; identical to SEQ ID NO: 42159

SEQ ID NO: 204820 - RNA, 64 nt, Homo Sapiens; identical to SEQ ID NO: 42160

SEQ ID NO: 204821 - RNA, 64 nt, Homo Sapiens; identical to SEQ ID NO: 42161

SEQ ID NO: 204822 - RNA, 64 nt, Homo Sapiens; identical to SEQ ID NO: 42162

SEQ ID NO: 204823 - RNA, 64 nt, Homo Sapiens; identical to SEQ ID NO: 42163

SEQ ID NO: 204824 - RNA, 64 nt, Homo Sapiens; identical to SEQ ID NO: 42164

SEQ ID NO: 204825 - RNA, 64 nt, Homo Sapiens; identical to SEQ ID NO: 42165

SEQ ID NO: 204826 - RNA, 64 nt, Homo Sapiens; identical to SEQ ID NO: 42166

SEQ ID NO: 204827 - RNA, 64 nt, Homo Sapiens; identical to SEQ ID NO: 42167

SEQ ID NO: 204828 - RNA, 64 nt, Homo Sapiens; identical to SEQ ID NO: 42168

SEQ ID NO: 204829 - RNA, 64 nt, Homo Sapiens; identical to SEQ ID NO: 42169

SEQ ID NO: 204830 - RNA, 64 nt, Homo Sapiens; identical to SEQ ID NO: 42170

SEQ ID NO: 204831 - RNA, 64 nt, Homo Sapiens; identical to SEQ ID NO: 42171

SEQ ID NO: 204832 - RNA, 64 nt, Homo Sapiens; identical to SEQ ID NO: 42172

SEQ ID NO: 204833 - RNA, 64 nt, Homo Sapiens; identical to SEQ ID NO: 42173

SEQ ID NO: 204834 - RNA, 64 nt, Homo Sapiens; identical to SEQ ID NO: 42174

SEQ ID NO: 204835 - RNA, 64 nt, Homo Sapiens; identical to SEQ ID NO: 42175

SEQ ID NO: 204836 - RNA, 64 nt, Homo Sapiens; identical to SEQ ID NO: 42176

SEQ ID NO: 204837 - RNA, 64 nt, Homo Sapiens; identical to SEQ ID NO: 42177

SEQ ID NO: 204838 - RNA, 64 nt, Homo Sapiens; identical to SEQ ID NO: 42178

SEQ ID NO: 204839 - RNA, 64 nt, Homo Sapiens; identical to SEQ ID NO: 42179

SEQ ID NO: 204840 - RNA, 64 nt, Homo Sapiens; identical to SEQ ID NO: 42180

SEQ ID NO: 204841 - RNA, 64 nt, Homo Sapiens; identical to SEQ ID NO: 42181

SEQ ID NO: 204842 - RNA, 64 nt, Homo Sapiens; identical to SEQ ID NO: 42182

SEQ ID NO: 204843 - RNA, 64 nt, Homo Sapiens; identical to SEQ ID NO: 42183

SEQ ID NO: 204844 - RNA, 64 nt, Homo Sapiens; identical to SEQ ID NO: 42184

SEQ ID NO: 204845 - RNA, 64 nt, Homo Sapiens; identical to SEQ ID NO: 42185

SEQ ID NO: 204846 - RNA, 64 nt, Homo Sapiens; identical to SEQ ID NO: 42186

SEQ ID NO: 204847 - RNA, 64 nt, Homo Sapiens; identical to SEQ ID NO: 42187

SEQ ID NO: 204848 - RNA, 64 nt, Homo Sapiens; identical to SEQ ID NO: 42188

SEQ ID NO: 204849 - RNA, 64 nt, Homo Sapiens; identical to SEQ ID NO: 42189

SEQ ID NO: 204850 - RNA, 64 nt, Homo Sapiens; identical to SEQ ID NO: 42190

SEQ ID NO: 204851 - RNA, 64 nt, Homo Sapiens; identical to SEQ ID NO: 42191

SEQ ID NO: 204852 - RNA, 64 nt, Homo Sapiens; identical to SEQ ID NO: 42192

SEQ ID NO: 204853 - RNA, 64 nt, Homo Sapiens; identical to SEQ ID NO: 42193

SEQ ID NO: 204854 - RNA, 64 nt, Homo Sapiens; identical to SEQ ID NO: 42194

SEQ ID NO: 204855 - RNA, 64 nt, Homo Sapiens; identical to SEQ ID NO: 42195

SEQ ID NO: 204856 - RNA, 64 nt, Homo Sapiens; identical to SEQ ID NO: 42196

SEQ ID NO: 204857 - RNA, 64 nt, Homo Sapiens; identical to SEQ ID NO: 42197

SEQ ID NO: 204858 - RNA, 64 nt, Homo Sapiens; identical to SEQ ID NO: 42198

SEQ ID NO: 204859 - RNA, 64 nt, Homo Sapiens; identical to SEQ ID NO: 42199

SEQ ID NO: 204860 - RNA, 64 nt, Homo Sapiens; identical to SEQ ID NO: 42200

SEQ ID NO: 204861 - RNA, 64 nt, Homo Sapiens; identical to SEQ ID NO: 42201

SEQ ID NO: 204862 - RNA, 64 nt, Homo Sapiens; identical to SEQ ID NO: 42202

SEQ ID NO: 204863 - RNA, 64 nt, Homo Sapiens; identical to SEQ ID NO: 42203

SEQ ID NO: 204864 - RNA, 64 nt, Homo Sapiens; identical to SEQ ID NO: 42204

SEQ ID NO: 204865 - RNA, 64 nt, Homo Sapiens; identical to SEQ ID NO: 42205

SEQ ID NO: 204866 - RNA, 64 nt, Homo Sapiens; identical to SEQ ID NO: 42206

SEQ ID NO: 204867 - RNA, 64 nt, Homo Sapiens; identical to SEQ ID NO: 42207

SEQ ID NO: 204868 - RNA, 64 nt, Homo Sapiens; identical to SEQ ID NO: 42208

SEQ ID NO: 204869 - RNA, 64 nt, Homo Sapiens; identical to SEQ ID NO: 42209

SEQ ID NO: 204870 - RNA, 64 nt, Homo Sapiens; identical to SEQ ID NO: 42210

SEQ ID NO: 204871 - RNA, 64 nt, Homo Sapiens; identical to SEQ ID NO: 42211

SEQ ID NO: 204872 - RNA, 64 nt, Homo Sapiens; identical to SEQ ID NO: 42212

SEQ ID NO: 204873 - RNA, 64 nt, Homo Sapiens; identical to SEQ ID NO: 42213

SEQ ID NO: 204874 - RNA, 64 nt, Homo Sapiens; identical to SEQ ID NO: 42214

SEQ ID NO: 204875 - RNA, 64 nt, Homo Sapiens; identical to SEQ ID NO: 42215

SEQ ID NO: 204876 - RNA, 64 nt, Homo Sapiens; identical to SEQ ID NO: 42216

SEQ ID NO: 204877 - RNA, 64 nt, Homo Sapiens; identical to SEQ ID NO: 42217

SEQ ID NO: 204878 - RNA, 64 nt, Homo Sapiens; identical to SEQ ID NO: 42218

SEQ ID NO: 204879 - RNA, 64 nt, Homo Sapiens; identical to SEQ ID NO: 42219

SEQ ID NO: 204880 - RNA, 64 nt, Homo Sapiens; identical to SEQ ID NO: 42220

SEQ ID NO: 204881 - RNA, 64 nt, Homo Sapiens; identical to SEQ ID NO: 42221

SEQ ID NO: 204882 - RNA, 64 nt, Homo Sapiens; identical to SEQ ID NO: 42222

SEQ ID NO: 204883 - RNA, 64 nt, Homo Sapiens; identical to SEQ ID NO: 42223

SEQ ID NO: 204884 - RNA, 64 nt, Homo Sapiens; identical to SEQ ID NO: 42224

SEQ ID NO: 204885 - RNA, 64 nt, Homo Sapiens; identical to SEQ ID NO: 42225

SEQ ID NO: 204886 - RNA, 64 nt, Homo Sapiens; identical to SEQ ID NO: 42226

SEQ ID NO: 204887 - RNA, 64 nt, Homo Sapiens; identical to SEQ ID NO: 42227

SEQ ID NO: 204888 - RNA, 64 nt, Homo Sapiens; identical to SEQ ID NO: 42228

SEQ ID NO: 204889 - RNA, 64 nt, Homo Sapiens; identical to SEQ ID NO: 42229

SEQ ID NO: 204890 - RNA, 64 nt, Homo Sapiens; identical to SEQ ID NO: 42230

SEQ ID NO: 204891 - RNA, 64 nt, Homo Sapiens; identical to SEQ ID NO: 42231

SEQ ID NO: 204892 - RNA, 64 nt, Homo Sapiens; identical to SEQ ID NO: 42232

SEQ ID NO: 204893 - RNA, 64 nt, Homo Sapiens; identical to SEQ ID NO: 42233

SEQ ID NO: 204894 - RNA, 64 nt, Homo Sapiens; identical to SEQ ID NO: 42234

SEQ ID NO: 204895 - RNA, 64 nt, Homo Sapiens; identical to SEQ ID NO: 42235

SEQ ID NO: 204896 - RNA, 64 nt, Homo Sapiens
cccaauuuagaaaaauggggucagaguuuaaaauuauugcuacuucugagggaauuuuauauuu

SEQ ID NO: 204897 - RNA, 64 nt, Homo Sapiens
aacauaguaagaugcagagaauauuuuaauuaucuauugcuaaaagagcuugaguugucaaaau

SEQ ID NO: 204898 - RNA, 64 nt, Homo Sapiens
agcagugcuuucaugaaugccauccuacacauauuauugcuauuaccugaacaaaauagaauua

SEQ ID NO: 204899 - RNA, 64 nt, Homo Sapiens
cccacuacuggguuuggauccacaguuugaaaaauauugcuacaagacacuuaaggagaccauc

SEQ ID NO: 204900 - RNA, 64 nt, Homo Sapiens
cuauuuacaucccacugcagcucuuaucuugccuuauugcuauaaaaaggcauaaccaagcacu

SEQ ID NO: 204901 - RNA, 64 nt, Homo Sapiens
ucuggugugauuuguaaugugcauaguaugcuacuauugcuacuguaacauauagucuacuaua

SEQ ID NO: 204902 - RNA, 64 nt, Homo Sapiens
acuaguacuauuacuaguacgcuaguacuaguacuauugcuauuaaaauaauaauaguacuauu

SEQ ID NO: 204903 - RNA, 64 nt, Homo Sapiens
acuaguacuauugcuauuacaauaauaauaguacuauugcuaguaaaauaaaauuuaccuuuaa

SEQ ID NO: 204904 - RNA, 64 nt, Homo Sapiens
auagguuacuacaaaaaagggucguauuaaguccuauugcuagaugcaguccuauuuaucugca

SEQ ID NO: 204905 - RNA, 64 nt, Homo Sapiens
uuuucuuuucuggcuuguguauuuaucagagcacuauugcuaagcuucaggacagugcagcugc

SEQ ID NO: 204906 - RNA, 64 nt, Homo Sapiens
ccagcaguauuugaacacaugaagcaccugcuacuauugcuacuggcaucagaagauuauugaa

SEQ ID NO: 204907 - RNA, 64 nt, Homo Sapiens
aggaucccaguacaaguaaggaauuaauucuugauauugcuaaaacaacaacuaugcaaaugug

SEQ ID NO: 204908 - RNA, 64 nt, Homo Sapiens
aauggcauugcagcagugaaauugagaagguucuuauugcuaacgcuuugggggaaauaaagug

SEQ ID NO: 204909 - RNA, 64 nt, Homo Sapiens
guaauucucuuucuccauaguauuuaagcagaaauauugcuaguuuaauauugugucaggucgu

SEQ ID NO: 204910 - RNA, 64 nt, Homo Sapiens
auaauacuaaaaaugcuucaauaacuuaucuugguauugcuaauaaaaaaaaaaagcugugaaa

SEQ ID NO: 204911 - RNA, 64 nt, Homo Sapiens
aauacuaauaaugaucuuagauauaaaaauacuuuauugcuaaauuauuuuuuaaaaagaaauu

SEQ ID NO: 204912 - RNA, 64 nt, Homo Sapiens
aagugagucacaaaaauggucacaauaaagcaaauauugcuauauggauuggguugcagcccac

SEQ ID NO: 204913 - RNA, 64 nt, Homo Sapiens
ggaaggggcauaugucacuaauagaaugucuccaaagcuggauugauguggagaaaacaccuuu

SEQ ID NO: 204914 - RNA, 64 nt, Homo Sapiens
auaccaugauuguuuauggaaaguaucuuuaauaaagcuggauacaguuuggcuuggaaugcug

SEQ ID NO: 204915 - RNA, 64 nt, Homo Sapiens
uuuuuccccauggcuuuacuacuaccagucugguaagcuggauuucagaaugagagaacauuaa

SEQ ID NO: 204916 - RNA, 64 nt, Homo Sapiens
gucacccaggcccaaccuucgaaucagagacuacaagcuggacauuuugccauuuggccagagg

SEQ ID NO: 204917 - RNA, 64 nt, Homo Sapiens
acucuuggucccauucccuacagcucuggagaagaagcuggaucggguggauuugugcagggug

SEQ ID NO: 204918 - RNA, 64 nt, Homo Sapiens
ugcuggagaggacauacggguggacccacgggagaagcuggaggacccugcugcaggaccacgg

SEQ ID NO: 204919 - RNA, 64 nt, Homo Sapiens
acgacuucaaagagaacuugagauucaaaagaaaaagcuggauaaauuaaaaucugagguuaau

SEQ ID NO: 204920 - RNA, 64 nt, Homo Sapiens
aacaaggcuagccauauuuaggacaacugaagaaaagcuggaaaaaaaaacaagcaaacuugaa

SEQ ID NO: 204921 - RNA, 64 nt, Homo Sapiens
auuguacagcauaaagcuaaugagauuuuuuuaaaagcuggaaguucauguauuaaaauaacac

SEQ ID NO: 204922 - RNA, 64 nt, Homo Sapiens
uuuuauuuuuccuucauguuuaaggauaccucauaagcuggaucuugcucucuauuuugacuug

SEQ ID NO: 204923 - RNA, 64 nt, Homo Sapiens
agcccaccuagagcuggccgaugagaacuccagaaagcuggagccccgccuagaacccagucua

SEQ ID NO: 204924 - RNA, 64 nt, Homo Sapiens
ccuggcugugccgagugcacgccugguccuggugaagcuggaacugggaggcccaaggagaaga

SEQ ID NO: 204925 - RNA, 64 nt, Homo Sapiens
caguuugaaagaaaaaaaaaaaguaucuuuaauaaagcuggauaauaccaugauuguuuaugga

SEQ ID NO: 204926 - RNA, 64 nt, Homo Sapiens
gauacggggaaaacaucuuuauagaauaucucugaagcuggauuggaagggguaugugucacua

SEQ ID NO: 204927 - RNA, 64 nt, Homo Sapiens
agaagggccauaugucacuaauagaaagccccugaagcuggacugauguggggaaaacaccuuu

SEQ ID NO: 204928 - RNA, 64 nt, Homo Sapiens
auaccaugauucuuuauggaaauuaucuuuaauaaagcuggauacaguuuggcuugggaaaaaa

SEQ ID NO: 204929 - RNA, 64 nt, Homo Sapiens
ugauuuuuuuuuucuggucaacaaaaggaaaaaaaagcuggauuacugcuccucuccccucccc

SEQ ID NO: 204930 - RNA, 64 nt, Homo Sapiens
uuuucccaaaggguuuugggaccuuacaaagcugaagcuggaacuaccuguuaggaacaugaau

SEQ ID NO: 204931 - RNA, 64 nt, Homo Sapiens
caaaaccacagccaacaucauacugaaugagcaaaagcuggagcauuacucuugagaaguagaa

SEQ ID NO: 204932 - RNA, 64 nt, Homo Sapiens
caaaaagccaaagcaauccuaagcaaaaagaacaaagcuggaggcaucgcauuacccaacuuca

SEQ ID NO: 204933 - RNA, 64 nt, Homo Sapiens
uuccagcugaaaaacuagaccugugccauuggggaagcuggacaaagucuagggggcccgccug

SEQ ID NO: 204934 - RNA, 64 nt, Homo Sapiens
agucuagggggcccgccugguagagggucccgggaagcuggaucugucagccucggcccugagg

SEQ ID NO: 204935 - RNA, 64 nt, Homo Sapiens
cuuggccacaccugggcuaauaauaauaauaauaaagcuggagacaagacucugucucaaauaa

SEQ ID NO: 204936 - RNA, 64 nt, Homo Sapiens
gccaggugcagugucucaccuuuucagcauaguaaagcuggaagggaggggaggaagaaaguug

SEQ ID NO: 204937 - RNA, 64 nt, Homo Sapiens
aguuccggaaagccaaggccaguacuaccgacagaagcuggagggcccaauagccaaggguaca

SEQ ID NO: 204938 - RNA, 64 nt, Homo Sapiens
gaaggcagccuuguacuucagugacuucuggaauaagcuggacgucggcgcaaucuugcucuuc

SEQ ID NO: 204939 - RNA, 64 nt, Homo Sapiens
gacuccggccaagaggcacaagcagcucaagaacaagcuggagaagaacgaggaggcggcccug

SEQ ID NO: 204940 - RNA, 64 nt, Homo Sapiens
gcgaucagcaucaagggcuuagguuuucaugaaaaagcuggaaaucaaaguauuuaaauuuccu

SEQ ID NO: 204941 - RNA, 64 nt, Homo Sapiens
gaggacugucccaacaacagguuuucccacuguuaagcuggaauccuggacugggcuaaauuua

SEQ ID NO: 204942 - RNA, 64 nt, Homo Sapiens; identical to SEQ ID NO: 194676

SEQ ID NO: 204943 - RNA, 64 nt, Homo Sapiens; identical to SEQ ID NO: 194677

SEQ ID NO: 204944 - RNA, 64 nt, Homo Sapiens; identical to SEQ ID NO: 194678

SEQ ID NO: 204945 - RNA, 64 nt, Homo Sapiens; identical to SEQ ID NO: 194679

SEQ ID NO: 204946 - RNA, 64 nt, Homo Sapiens; identical to SEQ ID NO: 194680

SEQ ID NO: 204947 - RNA, 64 nt, Homo Sapiens; identical to SEQ ID NO: 194681

SEQ ID NO: 204948 - RNA, 64 nt, Homo Sapiens; identical to SEQ ID NO: 194682

SEQ ID NO: 204949 - RNA, 64 nt, Homo Sapiens; identical to SEQ ID NO: 194683

SEQ ID NO: 204950 - RNA, 64 nt, Homo Sapiens; identical to SEQ ID NO: 194684

SEQ ID NO: 204951 - RNA, 64 nt, Homo Sapiens; identical to SEQ ID NO: 194685

SEQ ID NO: 204952 - RNA, 64 nt, Homo Sapiens; identical to SEQ ID NO: 194686

SEQ ID NO: 204953 - RNA, 64 nt, Homo Sapiens; identical to SEQ ID NO: 194687

SEQ ID NO: 204954 - RNA, 64 nt, Homo Sapiens; identical to SEQ ID NO: 194688

SEQ ID NO: 204955 - RNA, 64 nt, Homo Sapiens; identical to SEQ ID NO: 194689

SEQ ID NO: 204956 - RNA, 64 nt, Homo Sapiens; identical to SEQ ID NO: 194690

SEQ ID NO: 204957 - RNA, 64 nt, Homo Sapiens; identical to SEQ ID NO: 194691

SEQ ID NO: 204958 - RNA, 64 nt, Homo Sapiens; identical to SEQ ID NO: 194692

SEQ ID NO: 204959 - RNA, 64 nt, Homo Sapiens; identical to SEQ ID NO: 194693

SEQ ID NO: 204960 - RNA, 64 nt, Homo Sapiens; identical to SEQ ID NO: 194694

SEQ ID NO: 204961 - RNA, 64 nt, Homo Sapiens; identical to SEQ ID NO: 194695

SEQ ID NO: 204962 - RNA, 64 nt, Homo Sapiens; identical to SEQ ID NO: 194696

SEQ ID NO: 204963 - RNA, 64 nt, Homo Sapiens; identical to SEQ ID NO: 194697

SEQ ID NO: 204964 - RNA, 64 nt, Homo Sapiens; identical to SEQ ID NO: 194698

SEQ ID NO: 204965 - RNA, 64 nt, Homo Sapiens; identical to SEQ ID NO: 194699

SEQ ID NO: 204966 - RNA, 64 nt, Homo Sapiens; identical to SEQ ID NO: 194700

SEQ ID NO: 204967 - RNA, 64 nt, Homo Sapiens; identical to SEQ ID NO: 194701

SEQ ID NO: 204968 - RNA, 64 nt, Homo Sapiens; identical to SEQ ID NO: 194702

SEQ ID NO: 204969 - RNA, 64 nt, Homo Sapiens; identical to SEQ ID NO: 194703

SEQ ID NO: 204970 - RNA, 64 nt, Homo Sapiens; identical to SEQ ID NO: 194704

SEQ ID NO: 204971 - RNA, 64 nt, Homo Sapiens; identical to SEQ ID NO: 194705

SEQ ID NO: 204972 - RNA, 60 nt, Homo Sapiens; identical to SEQ ID NO: 194706

SEQ ID NO: 204973 - RNA, 64 nt, Homo Sapiens; identical to SEQ ID NO: 194707

SEQ ID NO: 204974 - RNA, 64 nt, Homo Sapiens; identical to SEQ ID NO: 194708

SEQ ID NO: 204975 - RNA, 64 nt, Homo Sapiens; identical to SEQ ID NO: 194709

SEQ ID NO: 204976 - RNA, 64 nt, Homo Sapiens; identical to SEQ ID NO: 194710

SEQ ID NO: 204977 - RNA, 64 nt, Homo Sapiens; identical to SEQ ID NO: 194711

SEQ ID NO: 204978 - RNA, 64 nt, Homo Sapiens; identical to SEQ ID NO: 194712

SEQ ID NO: 204979 - RNA, 64 nt, Homo Sapiens; identical to SEQ ID NO: 194713

SEQ ID NO: 204980 - RNA, 64 nt, Homo Sapiens; identical to SEQ ID NO: 194714

SEQ ID NO: 204981 - RNA, 64 nt, Homo Sapiens; identical to SEQ ID NO: 204913

SEQ ID NO: 204982 - RNA, 64 nt, Homo Sapiens; identical to SEQ ID NO: 204914

SEQ ID NO: 204983 - RNA, 64 nt, Homo Sapiens; identical to SEQ ID NO: 204915

SEQ ID NO: 204984 - RNA, 64 nt, Homo Sapiens; identical to SEQ ID NO: 204916

SEQ ID NO: 204985 - RNA, 64 nt, Homo Sapiens; identical to SEQ ID NO: 204917

SEQ ID NO: 204986 - RNA, 64 nt, Homo Sapiens; identical to SEQ ID NO: 204918

SEQ ID NO: 204987 - RNA, 64 nt, Homo Sapiens; identical to SEQ ID NO: 204919

SEQ ID NO: 204988 - RNA, 64 nt, Homo Sapiens; identical to SEQ ID NO: 204920

SEQ ID NO: 204989 - RNA, 64 nt, Homo Sapiens; identical to SEQ ID NO: 204921

SEQ ID NO: 204990 - RNA, 64 nt, Homo Sapiens; identical to SEQ ID NO: 204922

SEQ ID NO: 204991 - RNA, 64 nt, Homo Sapiens; identical to SEQ ID NO: 204923

SEQ ID NO: 204992 - RNA, 64 nt, Homo Sapiens; identical to SEQ ID NO: 204924

SEQ ID NO: 204993 - RNA, 64 nt, Homo Sapiens; identical to SEQ ID NO: 204925

SEQ ID NO: 204994 - RNA, 64 nt, Homo Sapiens; identical to SEQ ID NO: 204926

SEQ ID NO: 204995 - RNA, 64 nt, Homo Sapiens; identical to SEQ ID NO: 204927

SEQ ID NO: 204996 - RNA, 64 nt, Homo Sapiens; identical to SEQ ID NO: 204928

SEQ ID NO: 204997 - RNA, 64 nt, Homo Sapiens; identical to SEQ ID NO: 204929

SEQ ID NO: 204998 - RNA, 64 nt, Homo Sapiens; identical to SEQ ID NO: 204930

SEQ ID NO: 204999 - RNA, 64 nt, Homo Sapiens; identical to SEQ ID NO: 204931

SEQ ID NO: 205000 - RNA, 64 nt, Homo Sapiens; identical to SEQ ID NO: 204932

SEQ ID NO: 205001 - RNA, 64 nt, Homo Sapiens; identical to SEQ ID NO: 204933

SEQ ID NO: 205002 - RNA, 64 nt, Homo Sapiens; identical to SEQ ID NO: 204934

SEQ ID NO: 205003 - RNA, 64 nt, Homo Sapiens; identical to SEQ ID NO: 204935

SEQ ID NO: 205004 - RNA, 64 nt, Homo Sapiens; identical to SEQ ID NO: 204936

SEQ ID NO: 205005 - RNA, 64 nt, Homo Sapiens; identical to SEQ ID NO: 204937

SEQ ID NO: 205006 - RNA, 64 nt, Homo Sapiens; identical to SEQ ID NO: 204938

SEQ ID NO: 205007 - RNA, 64 nt, Homo Sapiens; identical to SEQ ID NO: 204939

SEQ ID NO: 205008 - RNA, 64 nt, Homo Sapiens; identical to SEQ ID NO: 204940

SEQ ID NO: 205009 - RNA, 64 nt, Homo Sapiens; identical to SEQ ID NO: 204941

SEQ ID NO: 205010 - RNA, 64 nt, Homo Sapiens; identical to SEQ ID NO: 194676

SEQ ID NO: 205011 - RNA, 64 nt, Homo Sapiens; identical to SEQ ID NO: 194677

SEQ ID NO: 205012 - RNA, 64 nt, Homo Sapiens; identical to SEQ ID NO: 194678

SEQ ID NO: 205013 - RNA, 64 nt, Homo Sapiens; identical to SEQ ID NO: 194679

SEQ ID NO: 205014 - RNA, 64 nt, Homo Sapiens; identical to SEQ ID NO: 194680

SEQ ID NO: 205015 - RNA, 64 nt, Homo Sapiens; identical to SEQ ID NO: 194681

SEQ ID NO: 205016 - RNA, 64 nt, Homo Sapiens; identical to SEQ ID NO: 194682

SEQ ID NO: 205017 - RNA, 64 nt, Homo Sapiens; identical to SEQ ID NO: 194683

SEQ ID NO: 205018 - RNA, 64 nt, Homo Sapiens; identical to SEQ ID NO: 194684

SEQ ID NO: 205019 - RNA, 64 nt, Homo Sapiens; identical to SEQ ID NO: 194685

SEQ ID NO: 205020 - RNA, 64 nt, Homo Sapiens; identical to SEQ ID NO: 194686

SEQ ID NO: 205021 - RNA, 64 nt, Homo Sapiens; identical to SEQ ID NO: 194687

SEQ ID NO: 205022 - RNA, 64 nt, Homo Sapiens; identical to SEQ ID NO: 194688

SEQ ID NO: 205023 - RNA, 64 nt, Homo Sapiens; identical to SEQ ID NO: 194689

SEQ ID NO: 205024 - RNA, 64 nt, Homo Sapiens; identical to SEQ ID NO: 194690

SEQ ID NO: 205025 - RNA, 64 nt, Homo Sapiens; identical to SEQ ID NO: 194691

SEQ ID NO: 205026 - RNA, 64 nt, Homo Sapiens; identical to SEQ ID NO: 194692

SEQ ID NO: 205027 - RNA, 64 nt, Homo Sapiens; identical to SEQ ID NO: 194693

SEQ ID NO: 205028 - RNA, 64 nt, Homo Sapiens; identical to SEQ ID NO: 194694

SEQ ID NO: 205029 - RNA, 64 nt, Homo Sapiens; identical to SEQ ID NO: 194695

SEQ ID NO: 205030 - RNA, 64 nt, Homo Sapiens; identical to SEQ ID NO: 194696

SEQ ID NO: 205031 - RNA, 64 nt, Homo Sapiens; identical to SEQ ID NO: 194697

SEQ ID NO: 205032 - RNA, 64 nt, Homo Sapiens; identical to SEQ ID NO: 194698

SEQ ID NO: 205033 - RNA, 64 nt, Homo Sapiens; identical to SEQ ID NO: 194699

SEQ ID NO: 205034 - RNA, 64 nt, Homo Sapiens; identical to SEQ ID NO: 194700

SEQ ID NO: 205035 - RNA, 64 nt, Homo Sapiens; identical to SEQ ID NO: 194701

SEQ ID NO: 205036 - RNA, 64 nt, Homo Sapiens; identical to SEQ ID NO: 194702

SEQ ID NO: 205037 - RNA, 64 nt, Homo Sapiens; identical to SEQ ID NO: 194703

SEQ ID NO: 205038 - RNA, 64 nt, Homo Sapiens; identical to SEQ ID NO: 194704

SEQ ID NO: 205039 - RNA, 64 nt, Homo Sapiens; identical to SEQ ID NO: 194705

SEQ ID NO: 205040 - RNA, 60 nt, Homo Sapiens; identical to SEQ ID NO: 194706

SEQ ID NO: 205041 - RNA, 64 nt, Homo Sapiens; identical to SEQ ID NO: 194707

SEQ ID NO: 205042 - RNA, 64 nt, Homo Sapiens; identical to SEQ ID NO: 194708

SEQ ID NO: 205043 - RNA, 64 nt, Homo Sapiens; identical to SEQ ID NO: 194709

SEQ ID NO: 205044 - RNA, 64 nt, Homo Sapiens; identical to SEQ ID NO: 194710

SEQ ID NO: 205045 - RNA, 64 nt, Homo Sapiens; identical to SEQ ID NO: 194711

SEQ ID NO: 205046 - RNA, 64 nt, Homo Sapiens; identical to SEQ ID NO: 194712

SEQ ID NO: 205047 - RNA, 64 nt, Homo Sapiens; identical to SEQ ID NO: 194713

SEQ ID NO: 205048 - RNA, 64 nt, Homo Sapiens; identical to SEQ ID NO: 194714

SEQ ID NO: 205049 - RNA, 64 nt, Homo Sapiens; identical to SEQ ID NO: 199907

SEQ ID NO: 205050 - RNA, 64 nt, Homo Sapiens; identical to SEQ ID NO: 199908

SEQ ID NO: 205051 - RNA, 64 nt, Homo Sapiens; identical to SEQ ID NO: 199909

SEQ ID NO: 205052 - RNA, 64 nt, Homo Sapiens; identical to SEQ ID NO: 199910

SEQ ID NO: 205053 - RNA, 64 nt, Homo Sapiens; identical to SEQ ID NO: 199911

SEQ ID NO: 205054 - RNA, 64 nt, Homo Sapiens; identical to SEQ ID NO: 199912

SEQ ID NO: 205055 - RNA, 64 nt, Homo Sapiens; identical to SEQ ID NO: 199913

SEQ ID NO: 205056 - RNA, 64 nt, Homo Sapiens; identical to SEQ ID NO: 199914

SEQ ID NO: 205057 - RNA, 64 nt, Homo Sapiens; identical to SEQ ID NO: 199915

SEQ ID NO: 205058 - RNA, 64 nt, Homo Sapiens; identical to SEQ ID NO: 199916

SEQ ID NO: 205059 - RNA, 64 nt, Homo Sapiens; identical to SEQ ID NO: 199917

SEQ ID NO: 205060 - RNA, 64 nt, Homo Sapiens; identical to SEQ ID NO: 199918

SEQ ID NO: 205061 - RNA, 64 nt, Homo Sapiens; identical to SEQ ID NO: 199919

SEQ ID NO: 205062 - RNA, 64 nt, Homo Sapiens; identical to SEQ ID NO: 199920

SEQ ID NO: 205063 - RNA, 64 nt, Homo Sapiens; identical to SEQ ID NO: 199921

SEQ ID NO: 205064 - RNA, 64 nt, Homo Sapiens; identical to SEQ ID NO: 199922

SEQ ID NO: 205065 - RNA, 64 nt, Homo Sapiens; identical to SEQ ID NO: 199923

SEQ ID NO: 205066 - RNA, 64 nt, Homo Sapiens; identical to SEQ ID NO: 199924

SEQ ID NO: 205067 - RNA, 64 nt, Homo Sapiens; identical to SEQ ID NO: 199925

SEQ ID NO: 205068 - RNA, 64 nt, Homo Sapiens; identical to SEQ ID NO: 199926

SEQ ID NO: 205069 - RNA, 64 nt, Homo Sapiens; identical to SEQ ID NO: 199927

SEQ ID NO: 205070 - RNA, 64 nt, Homo Sapiens; identical to SEQ ID NO: 199928

SEQ ID NO: 205071 - RNA, 64 nt, Homo Sapiens; identical to SEQ ID NO: 199929

SEQ ID NO: 205072 - RNA, 64 nt, Homo Sapiens; identical to SEQ ID NO: 199930

SEQ ID NO: 205073 - RNA, 64 nt, Homo Sapiens; identical to SEQ ID NO: 199931

SEQ ID NO: 205074 - RNA, 64 nt, Homo Sapiens; identical to SEQ ID NO: 199932

SEQ ID NO: 205075 - RNA, 64 nt, Homo Sapiens; identical to SEQ ID NO: 199933

SEQ ID NO: 205076 - RNA, 64 nt, Homo Sapiens; identical to SEQ ID NO: 199934

SEQ ID NO: 205077 - RNA, 64 nt, Homo Sapiens; identical to SEQ ID NO: 199935

SEQ ID NO: 205078 - RNA, 64 nt, Homo Sapiens; identical to SEQ ID NO: 199936

SEQ ID NO: 205079 - RNA, 64 nt, Homo Sapiens; identical to SEQ ID NO: 199937

SEQ ID NO: 205080 - RNA, 64 nt, Homo Sapiens; identical to SEQ ID NO: 199938

SEQ ID NO: 205081 - RNA, 64 nt, Homo Sapiens; identical to SEQ ID NO: 199939

SEQ ID NO: 205082 - RNA, 64 nt, Homo Sapiens; identical to SEQ ID NO: 199940

SEQ ID NO: 205083 - RNA, 64 nt, Homo Sapiens; identical to SEQ ID NO: 199941

SEQ ID NO: 205084 - RNA, 64 nt, Homo Sapiens; identical to SEQ ID NO: 199942

SEQ ID NO: 205085 - RNA, 64 nt, Homo Sapiens; identical to SEQ ID NO: 53816

SEQ ID NO: 205086 - RNA, 64 nt, Homo Sapiens; identical to SEQ ID NO: 53817

SEQ ID NO: 205087 - RNA, 64 nt, Homo Sapiens; identical to SEQ ID NO: 53818

SEQ ID NO: 205088 - RNA, 64 nt, Homo Sapiens; identical to SEQ ID NO: 53819

SEQ ID NO: 205089 - RNA, 64 nt, Homo Sapiens; identical to SEQ ID NO: 53820

SEQ ID NO: 205090 - RNA, 64 nt, Homo Sapiens; identical to SEQ ID NO: 53821

SEQ ID NO: 205091 - RNA, 64 nt, Homo Sapiens; identical to SEQ ID NO: 53822

SEQ ID NO: 205092 - RNA, 64 nt, Homo Sapiens; identical to SEQ ID NO: 53823

SEQ ID NO: 205093 - RNA, 64 nt, Homo Sapiens; identical to SEQ ID NO: 53824

SEQ ID NO: 205094 - RNA, 64 nt, Homo Sapiens; identical to SEQ ID NO: 53825

SEQ ID NO: 205095 - RNA, 64 nt, Homo Sapiens; identical to SEQ ID NO: 53826

SEQ ID NO: 205096 - RNA, 64 nt, Homo Sapiens; identical to SEQ ID NO: 53827

SEQ ID NO: 205097 - RNA, 64 nt, Homo Sapiens; identical to SEQ ID NO: 53828

SEQ ID NO: 205098 - RNA, 64 nt, Homo Sapiens; identical to SEQ ID NO: 53829

SEQ ID NO: 205099 - RNA, 64 nt, Homo Sapiens; identical to SEQ ID NO: 53830

SEQ ID NO: 205100 - RNA, 64 nt, Homo Sapiens; identical to SEQ ID NO: 53831

SEQ ID NO: 205101 - RNA, 64 nt, Homo Sapiens; identical to SEQ ID NO: 53832

SEQ ID NO: 205102 - RNA, 64 nt, Homo Sapiens; identical to SEQ ID NO: 53833

SEQ ID NO: 205103 - RNA, 64 nt, Homo Sapiens; identical to SEQ ID NO: 53834

SEQ ID NO: 205104 - RNA, 64 nt, Homo Sapiens; identical to SEQ ID NO: 53835

SEQ ID NO: 205105 - RNA, 64 nt, Homo Sapiens; identical to SEQ ID NO: 87004

SEQ ID NO: 205106 - RNA, 64 nt, Homo Sapiens; identical to SEQ ID NO: 87005

SEQ ID NO: 205107 - RNA, 64 nt, Homo Sapiens; identical to SEQ ID NO: 87006

SEQ ID NO: 205108 - RNA, 64 nt, Homo Sapiens; identical to SEQ ID NO: 87007

SEQ ID NO: 205109 - RNA, 64 nt, Homo Sapiens; identical to SEQ ID NO: 87008

SEQ ID NO: 205110 - RNA, 64 nt, Homo Sapiens; identical to SEQ ID NO: 87009

SEQ ID NO: 205111 - RNA, 64 nt, Homo Sapiens; identical to SEQ ID NO: 87010

SEQ ID NO: 205112 - RNA, 64 nt, Homo Sapiens; identical to SEQ ID NO: 87011

SEQ ID NO: 205113 - RNA, 64 nt, Homo Sapiens; identical to SEQ ID NO: 87012

SEQ ID NO: 205114 - RNA, 64 nt, Homo Sapiens; identical to SEQ ID NO: 87013

SEQ ID NO: 205115 - RNA, 64 nt, Homo Sapiens; identical to SEQ ID NO: 87014

SEQ ID NO: 205116 - RNA, 64 nt, Homo Sapiens; identical to SEQ ID NO: 87015

SEQ ID NO: 205117 - RNA, 64 nt, Homo Sapiens; identical to SEQ ID NO: 87016

SEQ ID NO: 205118 - RNA, 64 nt, Homo Sapiens; identical to SEQ ID NO: 87017

SEQ ID NO: 205119 - RNA, 64 nt, Homo Sapiens; identical to SEQ ID NO: 87018

SEQ ID NO: 205120 - RNA, 64 nt, Homo Sapiens; identical to SEQ ID NO: 87019

SEQ ID NO: 205121 - RNA, 64 nt, Homo Sapiens; identical to SEQ ID NO: 87020

SEQ ID NO: 205122 - RNA, 64 nt, Homo Sapiens; identical to SEQ ID NO: 87021

SEQ ID NO: 205123 - RNA, 64 nt, Homo Sapiens; identical to SEQ ID NO: 87022

SEQ ID NO: 205124 - RNA, 64 nt, Homo Sapiens; identical to SEQ ID NO: 87023

SEQ ID NO: 205125 - RNA, 64 nt, Homo Sapiens; identical to SEQ ID NO: 87024

SEQ ID NO: 205126 - RNA, 64 nt, Homo Sapiens; identical to SEQ ID NO: 87025

SEQ ID NO: 205127 - RNA, 64 nt, Homo Sapiens; identical to SEQ ID NO: 87026

SEQ ID NO: 205128 - RNA, 64 nt, Homo Sapiens; identical to SEQ ID NO: 87027

SEQ ID NO: 205129 - RNA, 64 nt, Homo Sapiens; identical to SEQ ID NO: 87028

SEQ ID NO: 205130 - RNA, 64 nt, Homo Sapiens; identical to SEQ ID NO: 87029

SEQ ID NO: 205131 - RNA, 64 nt, Homo Sapiens; identical to SEQ ID NO: 87030

SEQ ID NO: 205132 - RNA, 64 nt, Homo Sapiens; identical to SEQ ID NO: 87031

SEQ ID NO: 205133 - RNA, 64 nt, Homo Sapiens; identical to SEQ ID NO: 87032

SEQ ID NO: 205134 - RNA, 64 nt, Homo Sapiens; identical to SEQ ID NO: 87033

SEQ ID NO: 205135 - RNA, 64 nt, Homo Sapiens; identical to SEQ ID NO: 87034

SEQ ID NO: 205136 - RNA, 64 nt, Homo Sapiens; identical to SEQ ID NO: 87035

SEQ ID NO: 205137 - RNA, 64 nt, Homo Sapiens; identical to SEQ ID NO: 87036

SEQ ID NO: 205138 - RNA, 64 nt, Homo Sapiens; identical to SEQ ID NO: 87037

SEQ ID NO: 205139 - RNA, 64 nt, Homo Sapiens; identical to SEQ ID NO: 87038

SEQ ID NO: 205140 - RNA, 51 nt, Homo Sapiens; identical to SEQ ID NO: 87039

SEQ ID NO: 205141 - RNA, 64 nt, Homo Sapiens; identical to SEQ ID NO: 87040

SEQ ID NO: 205142 - RNA, 64 nt, Homo Sapiens; identical to SEQ ID NO: 87041

SEQ ID NO: 205143 - RNA, 64 nt, Homo Sapiens; identical to SEQ ID NO: 87042

SEQ ID NO: 205144 - RNA, 64 nt, Homo Sapiens; identical to SEQ ID NO: 87043

SEQ ID NO: 205145 - RNA, 64 nt, Homo Sapiens; identical to SEQ ID NO: 193898

SEQ ID NO: 205146 - RNA, 64 nt, Homo Sapiens; identical to SEQ ID NO: 193899

SEQ ID NO: 205147 - RNA, 64 nt, Homo Sapiens; identical to SEQ ID NO: 193900

SEQ ID NO: 205148 - RNA, 64 nt, Homo Sapiens; identical to SEQ ID NO: 193901

SEQ ID NO: 205149 - RNA, 64 nt, Homo Sapiens; identical to SEQ ID NO: 193902

SEQ ID NO: 205150 - RNA, 64 nt, Homo Sapiens; identical to SEQ ID NO: 193903

SEQ ID NO: 205151 - RNA, 64 nt, Homo Sapiens; identical to SEQ ID NO: 193904

SEQ ID NO: 205152 - RNA, 64 nt, Homo Sapiens; identical to SEQ ID NO: 193905

SEQ ID NO: 205153 - RNA, 64 nt, Homo Sapiens; identical to SEQ ID NO: 193906

SEQ ID NO: 205154 - RNA, 64 nt, Homo Sapiens; identical to SEQ ID NO: 193907

SEQ ID NO: 205155 - RNA, 64 nt, Homo Sapiens; identical to SEQ ID NO: 193908

SEQ ID NO: 205156 - RNA, 64 nt, Homo Sapiens; identical to SEQ ID NO: 193909

SEQ ID NO: 205157 - RNA, 64 nt, Homo Sapiens; identical to SEQ ID NO: 193910

SEQ ID NO: 205158 - RNA, 64 nt, Homo Sapiens; identical to SEQ ID NO: 193911

SEQ ID NO: 205159 - RNA, 64 nt, Homo Sapiens; identical to SEQ ID NO: 193912

SEQ ID NO: 205160 - RNA, 64 nt, Homo Sapiens; identical to SEQ ID NO: 193913

SEQ ID NO: 205161 - RNA, 64 nt, Homo Sapiens; identical to SEQ ID NO: 193914

SEQ ID NO: 205162 - RNA, 64 nt, Homo Sapiens; identical to SEQ ID NO: 193915

SEQ ID NO: 205163 - RNA, 64 nt, Homo Sapiens; identical to SEQ ID NO: 193916

SEQ ID NO: 205164 - RNA, 64 nt, Homo Sapiens; identical to SEQ ID NO: 193917

SEQ ID NO: 205165 - RNA, 64 nt, Homo Sapiens; identical to SEQ ID NO: 193918

SEQ ID NO: 205166 - RNA, 64 nt, Homo Sapiens; identical to SEQ ID NO: 193919

SEQ ID NO: 205167 - RNA, 64 nt, Homo Sapiens; identical to SEQ ID NO: 87004

SEQ ID NO: 205168 - RNA, 64 nt, Homo Sapiens; identical to SEQ ID NO: 87005

SEQ ID NO: 205169 - RNA, 64 nt, Homo Sapiens; identical to SEQ ID NO: 87006

SEQ ID NO: 205170 - RNA, 64 nt, Homo Sapiens; identical to SEQ ID NO: 87007

SEQ ID NO: 205171 - RNA, 64 nt, Homo Sapiens; identical to SEQ ID NO: 87008

SEQ ID NO: 205172 - RNA, 64 nt, Homo Sapiens; identical to SEQ ID NO: 87009

SEQ ID NO: 205173 - RNA, 64 nt, Homo Sapiens; identical to SEQ ID NO: 87010

SEQ ID NO: 205174 - RNA, 64 nt, Homo Sapiens; identical to SEQ ID NO: 87011

SEQ ID NO: 205175 - RNA, 64 nt, Homo Sapiens; identical to SEQ ID NO: 87012

SEQ ID NO: 205176 - RNA, 64 nt, Homo Sapiens; identical to SEQ ID NO: 87013

SEQ ID NO: 205177 - RNA, 64 nt, Homo Sapiens; identical to SEQ ID NO: 87014

SEQ ID NO: 205178 - RNA, 64 nt, Homo Sapiens; identical to SEQ ID NO: 87015

SEQ ID NO: 205179 - RNA, 64 nt, Homo Sapiens; identical to SEQ ID NO: 87016

SEQ ID NO: 205180 - RNA, 64 nt, Homo Sapiens; identical to SEQ ID NO: 87017

SEQ ID NO: 205181 - RNA, 64 nt, Homo Sapiens; identical to SEQ ID NO: 87018

SEQ ID NO: 205182 - RNA, 64 nt, Homo Sapiens; identical to SEQ ID NO: 87019

SEQ ID NO: 205183 - RNA, 64 nt, Homo Sapiens; identical to SEQ ID NO: 87020

SEQ ID NO: 205184 - RNA, 64 nt, Homo Sapiens; identical to SEQ ID NO: 87021

SEQ ID NO: 205185 - RNA, 64 nt, Homo Sapiens; identical to SEQ ID NO: 87022

SEQ ID NO: 205186 - RNA, 64 nt, Homo Sapiens; identical to SEQ ID NO: 87023

SEQ ID NO: 205187 - RNA, 64 nt, Homo Sapiens; identical to SEQ ID NO: 87024

SEQ ID NO: 205188 - RNA, 64 nt, Homo Sapiens; identical to SEQ ID NO: 87025

SEQ ID NO: 205189 - RNA, 64 nt, Homo Sapiens; identical to SEQ ID NO: 87026

SEQ ID NO: 205190 - RNA, 64 nt, Homo Sapiens; identical to SEQ ID NO: 87027

SEQ ID NO: 205191 - RNA, 64 nt, Homo Sapiens; identical to SEQ ID NO: 87028

SEQ ID NO: 205192 - RNA, 64 nt, Homo Sapiens; identical to SEQ ID NO: 87029

SEQ ID NO: 205193 - RNA, 64 nt, Homo Sapiens; identical to SEQ ID NO: 87030

SEQ ID NO: 205194 - RNA, 64 nt, Homo Sapiens; identical to SEQ ID NO: 87031

SEQ ID NO: 205195 - RNA, 64 nt, Homo Sapiens; identical to SEQ ID NO: 87032

SEQ ID NO: 205196 - RNA, 64 nt, Homo Sapiens; identical to SEQ ID NO: 87033

SEQ ID NO: 205197 - RNA, 64 nt, Homo Sapiens; identical to SEQ ID NO: 87034

SEQ ID NO: 205198 - RNA, 64 nt, Homo Sapiens; identical to SEQ ID NO: 87035

SEQ ID NO: 205199 - RNA, 64 nt, Homo Sapiens; identical to SEQ ID NO: 87036

SEQ ID NO: 205200 - RNA, 64 nt, Homo Sapiens; identical to SEQ ID NO: 87037

SEQ ID NO: 205201 - RNA, 64 nt, Homo Sapiens; identical to SEQ ID NO: 87038

SEQ ID NO: 205202 - RNA, 51 nt, Homo Sapiens; identical to SEQ ID NO: 87039

SEQ ID NO: 205203 - RNA, 64 nt, Homo Sapiens; identical to SEQ ID NO: 87040

SEQ ID NO: 205204 - RNA, 64 nt, Homo Sapiens; identical to SEQ ID NO: 87041

SEQ ID NO: 205205 - RNA, 64 nt, Homo Sapiens; identical to SEQ ID NO: 87042

SEQ ID NO: 205206 - RNA, 64 nt, Homo Sapiens; identical to SEQ ID NO: 87043

SEQ ID NO: 205207 - RNA, 64 nt, Homo Sapiens; identical to SEQ ID NO: 193898

SEQ ID NO: 205208 - RNA, 64 nt, Homo Sapiens; identical to SEQ ID NO: 193899

SEQ ID NO: 205209 - RNA, 64 nt, Homo Sapiens; identical to SEQ ID NO: 193900

SEQ ID NO: 205210 - RNA, 64 nt, Homo Sapiens; identical to SEQ ID NO: 193901

SEQ ID NO: 205211 - RNA, 64 nt, Homo Sapiens; identical to SEQ ID NO: 193902

SEQ ID NO: 205212 - RNA, 64 nt, Homo Sapiens; identical to SEQ ID NO: 193903

SEQ ID NO: 205213 - RNA, 64 nt, Homo Sapiens; identical to SEQ ID NO: 193904

SEQ ID NO: 205214 - RNA, 64 nt, Homo Sapiens; identical to SEQ ID NO: 193905

SEQ ID NO: 205215 - RNA, 64 nt, Homo Sapiens; identical to SEQ ID NO: 193906

SEQ ID NO: 205216 - RNA, 64 nt, Homo Sapiens; identical to SEQ ID NO: 193907

SEQ ID NO: 205217 - RNA, 64 nt, Homo Sapiens; identical to SEQ ID NO: 193908

SEQ ID NO: 205218 - RNA, 64 nt, Homo Sapiens; identical to SEQ ID NO: 193909

SEQ ID NO: 205219 - RNA, 64 nt, Homo Sapiens; identical to SEQ ID NO: 193910

SEQ ID NO: 205220 - RNA, 64 nt, Homo Sapiens; identical to SEQ ID NO: 193911

SEQ ID NO: 205221 - RNA, 64 nt, Homo Sapiens; identical to SEQ ID NO: 193912

SEQ ID NO: 205222 - RNA, 64 nt, Homo Sapiens; identical to SEQ ID NO: 193913

SEQ ID NO: 205223 - RNA, 64 nt, Homo Sapiens; identical to SEQ ID NO: 193914

SEQ ID NO: 205224 - RNA, 64 nt, Homo Sapiens; identical to SEQ ID NO: 193915

SEQ ID NO: 205225 - RNA, 64 nt, Homo Sapiens; identical to SEQ ID NO: 193916

SEQ ID NO: 205226 - RNA, 64 nt, Homo Sapiens; identical to SEQ ID NO: 193917

SEQ ID NO: 205227 - RNA, 64 nt, Homo Sapiens; identical to SEQ ID NO: 193918

SEQ ID NO: 205228 - RNA, 64 nt, Homo Sapiens; identical to SEQ ID NO: 193919

SEQ ID NO: 205229 - RNA, 64 nt, Homo Sapiens
agagcgccagccucugcuuucaggaaagguuuauuguggugagugccuucuguacagucgacug

SEQ ID NO: 205230 - RNA, 64 nt, Homo Sapiens
guucagcguggacugcagaaguggcucacgcuccuguggugagggcagggugcuccacagacac

SEQ ID NO: 205231 - RNA, 64 nt, Homo Sapiens
cuuguguguguuuauagcuuuuguuucgcgggguuguggugaggaaggggugauggcaugcgga

SEQ ID NO: 205232 - RNA, 64 nt, Homo Sapiens
agggauauaaauuuccaggaauguguauuuuuaauguggugagaugcacucuuuuguuguacca

SEQ ID NO: 205233 - RNA, 64 nt, Homo Sapiens
uuagcccgggaggugguggcucccuccugcucucuguggugaaagccaagcacacuuuccuaaa

SEQ ID NO: 205234 - RNA, 64 nt, Homo Sapiens
cuccaccaugaagauggguuaagagucucaagguuguggugacuguagauauaugagugugcau

SEQ ID NO: 205235 - RNA, 64 nt, Homo Sapiens
cuggguuagcucagcauggaagaauguauuaguuuguggugacaguugccaccuguuggagcca

SEQ ID NO: 205236 - RNA, 64 nt, Homo Sapiens
uugccacuagaaagggccaguuuggcuagauaaauguggugaaacacgcaaggcagccuuuccc

SEQ ID NO: 205237 - RNA, 64 nt, Homo Sapiens
gcaccaacaaugucacaagcacugugcuaaacacuguggugaaguagaacaauugcuaaucauu

SEQ ID NO: 205238 - RNA, 64 nt, Homo Sapiens
ugucucacuuuccagagguagcagucacuaauacuguggugagugauuuuacucaaaggaaauc

SEQ ID NO: 205239 - RNA, 64 nt, Homo Sapiens
aacugcccuuccuucugaccccucauaagaggaguguggugagggaggggacuggguagggguc

SEQ ID NO: 205240 - RNA, 64 nt, Homo Sapiens
gguagguauuuugucuuucaaacuacaaauggaauguggugacauaaacuagacauggggugcc

SEQ ID NO: 205241 - RNA, 64 nt, Homo Sapiens
gaucugcuccggcaguaccuggccacaugaaggcuguggugauggguaccgaaguggcauccga

SEQ ID NO: 205242 - RNA, 64 nt, Homo Sapiens
augaauggcucauguguagaucccccaacuccuauguggugauccccuacaggugacucgacag

SEQ ID NO: 205243 - RNA, 64 nt, Homo Sapiens
caagaucaugccacugcacucaggaggcggagguuguggugagcggcaggagagugcuugaacc

SEQ ID NO: 205244 - RNA, 51 nt, Homo Sapiens
ucauuagguacaauucacucguguggugagggagagaaaccuuacaaauga

SEQ ID NO: 205245 - RNA, 64 nt, Homo Sapiens
uuuaccuguacuguauucuuggucaucucaaauggcgucuaaacccagcuacuuugcauuccag

SEQ ID NO: 205246 - RNA, 64 nt, Homo Sapiens
cauacaauucuguguuccucaguaaaugagauuagcgucuaaugaguagcaccccuuuacuaac

SEQ ID NO: 205247 - RNA, 64 nt, Homo Sapiens
uuacguuaccacagacugacuuuguggucaggcagcgucuaaggguuaaauauaauuuccaaac

SEQ ID NO: 205248 - RNA, 64 nt, Homo Sapiens
cuguucuagggaacggaaaagaguucauggccaagcgucuaaccuaaagucccaggauuggcuc

SEQ ID NO: 205249 - RNA, 64 nt, Homo Sapiens
cccuuugucucuccucuauggggccaaugauguugcgucuaauaagcucuucucggacuccccu

SEQ ID NO: 205250 - RNA, 64 nt, Homo Sapiens
ccucgcagcugcugcccgggaaaagcuggcccaggcgucuaaggagucaaaagagaaacagcuu

SEQ ID NO: 205251 - RNA, 64 nt, Homo Sapiens
auuuuuuauuaacaugauuuuuuuauauuauuuugcgucuaaugacuucauguauucauuuaua

SEQ ID NO: 205252 - RNA, 64 nt, Homo Sapiens
cguugagaccagugcaacuuauauggcugaaugagcgucuaaauugcagcuuguggcaguggaa

SEQ ID NO: 205253 - RNA, 64 nt, Homo Sapiens
gaugagaaggggcagggacugggggcucugcuuugcgucuaaccuuugugggggagggccagca

SEQ ID NO: 205254 - RNA, 64 nt, Homo Sapiens
acccgugccgagaggguucccccaguggagacaggcgucuaagaccuaguccugucccuccggc

SEQ ID NO: 205255 - RNA, 64 nt, Homo Sapiens
ugagggggccaggcgguggcgcgccggacuuggugcgucuaagacguguccccucccuuccucu

SEQ ID NO: 205256 - RNA, 64 nt, Homo Sapiens; identical to SEQ ID NO: 162025

SEQ ID NO: 205257 - RNA, 64 nt, Homo Sapiens; identical to SEQ ID NO: 162026

SEQ ID NO: 205258 - RNA, 64 nt, Homo Sapiens; identical to SEQ ID NO: 162027

SEQ ID NO: 205259 - RNA, 64 nt, Homo Sapiens; identical to SEQ ID NO: 162028

SEQ ID NO: 205260 - RNA, 64 nt, Homo Sapiens; identical to SEQ ID NO: 162029

SEQ ID NO: 205261 - RNA, 64 nt, Homo Sapiens; identical to SEQ ID NO: 162030

SEQ ID NO: 205262 - RNA, 64 nt, Homo Sapiens; identical to SEQ ID NO: 162031

SEQ ID NO: 205263 - RNA, 64 nt, Homo Sapiens; identical to SEQ ID NO: 162032

SEQ ID NO: 205264 - RNA, 64 nt, Homo Sapiens; identical to SEQ ID NO: 162033

SEQ ID NO: 205265 - RNA, 64 nt, Homo Sapiens; identical to SEQ ID NO: 162034

SEQ ID NO: 205266 - RNA, 64 nt, Homo Sapiens; identical to SEQ ID NO: 162035

SEQ ID NO: 205267 - RNA, 64 nt, Homo Sapiens; identical to SEQ ID NO: 162036

SEQ ID NO: 205268 - RNA, 64 nt, Homo Sapiens; identical to SEQ ID NO: 162037

SEQ ID NO: 205269 - RNA, 64 nt, Homo Sapiens; identical to SEQ ID NO: 162038

SEQ ID NO: 205270 - RNA, 64 nt, Homo Sapiens; identical to SEQ ID NO: 162039

SEQ ID NO: 205271 - RNA, 64 nt, Homo Sapiens; identical to SEQ ID NO: 162040

SEQ ID NO: 205272 - RNA, 64 nt, Homo Sapiens; identical to SEQ ID NO: 162041

SEQ ID NO: 205273 - RNA, 64 nt, Homo Sapiens; identical to SEQ ID NO: 162042

SEQ ID NO: 205274 - RNA, 64 nt, Homo Sapiens; identical to SEQ ID NO: 162043

SEQ ID NO: 205275 - RNA, 64 nt, Homo Sapiens; identical to SEQ ID NO: 162044

SEQ ID NO: 205276 - RNA, 64 nt, Homo Sapiens; identical to SEQ ID NO: 162045

SEQ ID NO: 205277 - RNA, 64 nt, Homo Sapiens; identical to SEQ ID NO: 162046

SEQ ID NO: 205278 - RNA, 64 nt, Homo Sapiens; identical to SEQ ID NO: 162047

SEQ ID NO: 205279 - RNA, 64 nt, Homo Sapiens; identical to SEQ ID NO: 162048

SEQ ID NO: 205280 - RNA, 64 nt, Homo Sapiens; identical to SEQ ID NO: 162049

SEQ ID NO: 205281 - RNA, 64 nt, Homo Sapiens; identical to SEQ ID NO: 162050

SEQ ID NO: 205282 - RNA, 64 nt, Homo Sapiens; identical to SEQ ID NO: 162051

SEQ ID NO: 205283 - RNA, 64 nt, Homo Sapiens; identical to SEQ ID NO: 162052

SEQ ID NO: 205284 - RNA, 64 nt, Homo Sapiens; identical to SEQ ID NO: 162053

SEQ ID NO: 205285 - RNA, 64 nt, Homo Sapiens; identical to SEQ ID NO: 162054

SEQ ID NO: 205286 - RNA, 64 nt, Homo Sapiens; identical to SEQ ID NO: 162055

SEQ ID NO: 205287 - RNA, 64 nt, Homo Sapiens; identical to SEQ ID NO: 162056

SEQ ID NO: 205288 - RNA, 64 nt, Homo Sapiens; identical to SEQ ID NO: 162057

SEQ ID NO: 205289 - RNA, 64 nt, Homo Sapiens
uuaaaauauuuaacaguucaaucucaauaagaccucgcauuauguaugaauguuauucacugac

SEQ ID NO: 205290 - RNA, 64 nt, Homo Sapiens
aaacccuuuccugcgccccagauucugcaucgguucgcauuaucucgaaaugcugagcagcaug

SEQ ID NO: 205291 - RNA, 64 nt, Homo Sapiens
ccaaucagugucaucuccuggguaaauuuugaugucgcauuauaaagacaugcauaauugaugg

SEQ ID NO: 205292 - RNA, 64 nt, Homo Sapiens
agagguagggaggggaguauggguucauuuggcuucgcauuaugcaaggugaaaccguuuguuu

SEQ ID NO: 205293 - RNA, 64 nt, Homo Sapiens
ccauguggggaaaagaaagaccauaucuaugauaucgcauuaguaucuuguaacugaagacaca

SEQ ID NO: 205294 - RNA, 64 nt, Homo Sapiens
ccuuccaagagacuucccucccuugugccuuugcucgcauuaauugaaacauccuugugcacac

SEQ ID NO: 205295 - RNA, 64 nt, Homo Sapiens
gcgagucacauggagcauccgccuuuccugaaggucgcauuagaugaaggcuugcuuuucccuc

SEQ ID NO: 205296 - RNA, 64 nt, Homo Sapiens
gaaauaccaacuaugcguaauccaucuauauaaaucgcauuaauauuuguuuauccuuaagaau

SEQ ID NO: 205297 - RNA, 64 nt, Homo Sapiens
gcacccaugaccaccauucaaguguacaguucuuucgcauuaauuaccauuuuaaccauuuuua

SEQ ID NO: 205298 - RNA, 64 nt, Homo Sapiens
uguguuuacuucuaagggaaauacuaacuuucuuucgcauuaguauuaauuuugaaguagcuac

SEQ ID NO: 205299 - RNA, 64 nt, Homo Sapiens
ggauuuagcuaggcuacuagaaguuagacugcuuucgcauuaaacagcuaacuucauccacagc

SEQ ID NO: 205300 - RNA, 64 nt, Homo Sapiens
uuggcauaauggccagaaaaugaaauggacauuaucgcauuaucuaccauuagaaaauacuauu

SEQ ID NO: 205301 - RNA, 64 nt, Homo Sapiens
gaggcccuuccacaucauuuguuuccuugccccgucgcauuaauacugcgugcgggacaguuau

SEQ ID NO: 205302 - RNA, 64 nt, Homo Sapiens
uucuguugcugccaacagaucaaagucuacuagcucgcauuaguguaaguucuuuagcaguguu

SEQ ID NO: 205303 - RNA, 64 nt, Homo Sapiens
uauguugcuguuacuuuuguguaacaacacguguucgcauuaucuguuucacacuauaguuugu

SEQ ID NO: 205304 - RNA, 64 nt, Homo Sapiens
gaacccgggagguggagguugcagugagccgagaucgcauuacugcacuccagccuggguaaca

SEQ ID NO: 205305 - RNA, 64 nt, Homo Sapiens
uguggggagcagcaugggcaaggaagacacagacucgcauuacccuuggucacugugauuucug

SEQ ID NO: 205306 - RNA, 64 nt, Homo Sapiens
uaaugauggaagauucugggaggcaaauuuccacucgcauuauuuuggaauggccagcuuauga

SEQ ID NO: 205307 - RNA, 64 nt, Homo Sapiens
aaaagcuaauaccagucacucgauaauaaaguauucgcauuauaguuuuuuuuaaacugucuuc

SEQ ID NO: 205308 - RNA, 64 nt, Homo Sapiens
gcaauccuaagcaaaaagaacaaagcuggaggcaucgcauuacccaacuucaaacuauacuaca

SEQ ID NO: 205309 - RNA, 64 nt, Homo Sapiens
ucuguuuccucccagaagcaucucccagcuaagcucgcauuauuuuucuccucuggcuguuugc

SEQ ID NO: 205310 - RNA, 64 nt, Homo Sapiens
uguuuccaguaaaacucuuuuuugucuauuuggaucgcauuaauuucuuucuuucauagauauu

SEQ ID NO: 205311 - RNA, 64 nt, Homo Sapiens
uacccaguaaaaaagaaaaguaauacucuuuuugucgcauuauagugaaggacuuuauuccgac

SEQ ID NO: 205312 - RNA, 64 nt, Homo Sapiens
cagcucuggaugaaggcaaaaacuguacuguguuucgcauuaagcacacacaucuggcccugac

SEQ ID NO: 205313 - RNA, 64 nt, Homo Sapiens
acuguuguagaaucuuaaauccaccucugaaucgucgcauuauaacacuguaacaacuuugaga

SEQ ID NO: 205314 - RNA, 64 nt, Homo Sapiens
cggugugauucuacugugcucagccuagucaauuucgcauuaaacugauuaucagcugaguauc

SEQ ID NO: 205315 - RNA, 64 nt, Homo Sapiens
uucccauucuacucuagaaaacuaaacaggaaagucgcauuauuuacauuagcgcauuucuuaa

SEQ ID NO: 205316 - RNA, 64 nt, Homo Sapiens
cgaugcuguuagguugcgcaagcgauguuugcgcucgcauuacagggaccucaaccuaggugca

SEQ ID NO: 205317 - RNA, 64 nt, Homo Sapiens
ccaaacucuucugcuugguuggaauuucauuguaucgcauuauccagguggcuaguggcauuug

SEQ ID NO: 205318 - RNA, 64 nt, Homo Sapiens
uuuuucucacuguggugugauuggcuaaacaaucucgcauuaaaaauucaaauguaaauugaau

SEQ ID NO: 205319 - RNA, 64 nt, Homo Sapiens
accagucuggguuuuaaggcgcccuggcuaccuuucgcauuagguguuccuacuucccuaggaa

SEQ ID NO: 205320 - RNA, 64 nt, Homo Sapiens
aaaaugugauuaaucccaguaagauacagagcuaaugaauuaucaaaugaauuaagcaaccuag

SEQ ID NO: 205321 - RNA, 64 nt, Homo Sapiens
caaccuagaagauacagagcuguggauuugcuaaaugaauuaagccucgaggugguaccuaagc

SEQ ID NO: 205322 - RNA, 64 nt, Homo Sapiens
uggauguucuuuuuacgagguaauggaaaaugccaugaauuaccagcugugucugcccaaugaa

SEQ ID NO: 205323 - RNA, 64 nt, Homo Sapiens
auauacauacugcaucuuggacuuaaagggcccaaugaauuauugagauuuuuuugagucaaag

SEQ ID NO: 205324 - RNA, 64 nt, Homo Sapiens
acuagacaucugcuguuaucucagcauuagagaaaugaauuauauuuguucaugaauauauuaa

SEQ ID NO: 205325 - RNA, 64 nt, Homo Sapiens
uuugagacugucaggaaguaaaacaacacccaagaugaauuauuaccaggaaguguuuaugagg

SEQ ID NO: 205326 - RNA, 64 nt, Homo Sapiens
gugagcacuggcuucuauauuuuauuucauauuuaugaauuauaaauaugaauuuaauuacuaa

SEQ ID NO: 205327 - RNA, 64 nt, Homo Sapiens
uuguuguaaaacagauguuuguuucuaaaauauaaugaauuaaugauuaucaaaguacaggcau

SEQ ID NO: 205328 - RNA, 64 nt, Homo Sapiens
uucuuaaugaaguaaacccaacaaaacuagagguaugaauuaaugcuacacauuuuaauacaca

SEQ ID NO: 205329 - RNA, 64 nt, Homo Sapiens
cauaaucaucucuuggaagaaaaugcugagaucaaugaauuauucugugugccuauauugacgu

SEQ ID NO: 205330 - RNA, 64 nt, Homo Sapiens
aaacgguagcaacaacccaaauguccauccacagaugaauuaagacaugaaguguguucugucc

SEQ ID NO: 205331 - RNA, 64 nt, Homo Sapiens
ugguugcacaacuuugugaauauacuagaaaccaaugaauuaaaaacuuuggaagaugaauuuu

SEQ ID NO: 205332 - RNA, 64 nt, Homo Sapiens
cucucaaagcacagaaugugaaacuaaaauguagaugaauuaacugucuaaaaauauauuauac

SEQ ID NO: 205333 - RNA, 64 nt, Homo Sapiens
uguacaugagaggagauagugagauaagugcaucaugaauuacaauuuuuaaaaguuuuugaaa

SEQ ID NO: 205334 - RNA, 64 nt, Homo Sapiens
uuuaaaugggaguuguucaauaguuuaauuugaaaugaauuaauauagguauucacuaguugaa

SEQ ID NO: 205335 - RNA, 64 nt, Homo Sapiens
uuuagcuuauguuggaaguaacauagaacucuuuaugaauuaaccuggggucuucuuaaccagu

SEQ ID NO: 205336 - RNA, 64 nt, Homo Sapiens
gcuaauuugauacuauaauagaaugagacauaaaaugaauuaauggaaacauauccacacugua

SEQ ID NO: 205337 - RNA, 64 nt, Homo Sapiens
aaucuauggauaaauggaaaccuaauuauuuguaaugaauuauuuagacaguucuaagcccugu

SEQ ID NO: 205338 - RNA, 64 nt, Homo Sapiens
uugaacauauuuaaaauacauuuucacagaauggaugaauuaguuguuucuucagaguuacuua

SEQ ID NO: 205339 - RNA, 64 nt, Homo Sapiens
cuguuaaauagaauagguuuaaaugacuagucaaaugaauuauuuucuucuuguuaaauaaauu

SEQ ID NO: 205340 - RNA, 64 nt, Homo Sapiens
cguggaacaguuaccucugccucagaaaacaaggaugaauuaaguuuuuuuuuaaaaaagaaac

SEQ ID NO: 205341 - RNA, 64 nt, Homo Sapiens
agagaaugagagacacacugaagaagcaccaaucaugaauuaguuuuauaugcuucuguuuuau

SEQ ID NO: 205342 - RNA, 64 nt, Homo Sapiens
auauauaacaaugcuguauuuuaaaagaaugauuaugaauuacauuuguauaaaauaauuuuua

SEQ ID NO: 205343 - RNA, 64 nt, Homo Sapiens
aacacauucuaacaagggucacuccuuccuguuaaugaauuaaggguuuuaaaccuugugcucu

SEQ ID NO: 205344 - RNA, 64 nt, Homo Sapiens; identical to SEQ ID NO: 205343

SEQ ID NO: 205345 - RNA, 64 nt, Homo Sapiens
gagcauucugaccucauuuuggacagcucaagccaugaauuaguauucaguuuugcucuuauaa

SEQ ID NO: 205346 - RNA, 64 nt, Homo Sapiens
ggaauaucacacuuuaaaaacuaaagacgugccaaugaauuauuacuuaaaguacuguaaucca

SEQ ID NO: 205347 - RNA, 64 nt, Homo Sapiens
guuggaaaacugaggaaucuaaguaguagucagaaugaauuaugguucuuuaaaauauaucuga

SEQ ID NO: 205348 - RNA, 64 nt, Homo Sapiens
uaucccuucucuuuugguuuaucgugauuucagaaugaauuauguuuucugugaggaggagggg

SEQ ID NO: 205349 - RNA, 64 nt, Homo Sapiens
uacuaaaaacuauggaauuguuuaauuaugguauaugaauuaauuucuuucuuuuuuucuuuuu

SEQ ID NO: 205350 - RNA, 64 nt, Homo Sapiens
cugggauuacaggugggagccacaacacccggccaugaauuaacuccguuaaaaaauaaacgua

SEQ ID NO: 205351 - RNA, 64 nt, Homo Sapiens
aaaggacugguaaauacaagccuuggguuucagaaugaauuagaaacaaauaacucuuacuguc

SEQ ID NO: 205352 - RNA, 64 nt, Homo Sapiens
cuggaaauuugauacggagagaacuuggugagcuaugaauuacucucagucuccuuuuuacagg

SEQ ID NO: 205353 - RNA, 64 nt, Homo Sapiens
uccaaagaguauuuuuuaaaggaacaaaacgagcaugaauuaacucuucaauauaagcuaugaa

SEQ ID NO: 205354 - RNA, 64 nt, Homo Sapiens
aaugaaauucuaccuagaaugcaaaauuggguauaugaauuacauagcauguuguugggauuuu

SEQ ID NO: 205355 - RNA, 64 nt, Homo Sapiens
acuagaaaacaaauugaugcuauuuuauuuuuuaaugaauuaaaaacucauuauaccaauucac

SEQ ID NO: 205356 - RNA, 64 nt, Homo Sapiens
cagcauucagaucuuucuaguucucauuagaacaaugaauuaucccuaucugcagaucaagauu

SEQ ID NO: 205357 - RNA, 64 nt, Homo Sapiens
uuguccauacucuuccuaugaagagggaaugcguaugaauuaaggcuacuacugucacagaaga

SEQ ID NO: 205358 - RNA, 64 nt, Homo Sapiens
cucacaacacaaacagguaguucguugggggcaaaugaauuagccaacuguuaacuggaagcuu

SEQ ID NO: 205359 - RNA, 64 nt, Homo Sapiens
auauucauaaaugugacaaaugaacagcaggauuaugaauuaucaaaggaaaaaguauuugcug

SEQ ID NO: 205360 - RNA, 64 nt, Homo Sapiens
caauuuauuugaaugauuuucuuugcaucucaguaugaauuauuauaggaagaaagaagacaaa

SEQ ID NO: 205361 - RNA, 64 nt, Homo Sapiens
acaguguuuauccuuucauaccauuuugaaucacaugaauuauuagcuagucuuuugcuuuugc

SEQ ID NO: 205362 - RNA, 64 nt, Homo Sapiens
ucugaaauuuucuauuuaaccccgccuaaaacugaugaauuauuacagucgugagccacuguac

SEQ ID NO: 205363 - RNA, 64 nt, Homo Sapiens
uuuuuuuaauuauuugagauauaauugaaaacuuaugaauuauuacauuacucagaacaggcau

SEQ ID NO: 205364 - RNA, 64 nt, Homo Sapiens
uugcuggacuggauuucuucuggagggaagcaccaugaauuaaaggugccagagcuccaugcau

SEQ ID NO: 205365 - RNA, 64 nt, Homo Sapiens
ucacaauguaacggaugaccauaugcacaauuccaugaauuaaaucuguuuccuguguuaguca

SEQ ID NO: 205366 - RNA, 64 nt, Homo Sapiens
ugcuuucauucgugaagccgaaacguuuuuaaacaugaauuacauaugaauuauuaagcauaug

SEQ ID NO: 205367 - RNA, 64 nt, Homo Sapiens
gugaagccgaaacguuuuuaaacaugaauuacauaugaauuauuaagcauaugugcuuucgcag

SEQ ID NO: 205368 - RNA, 64 nt, Homo Sapiens
aauaucauuuuguaugccauaauauauaugauuuaugaauuauaguaauauuaauaaaaguguu

SEQ ID NO: 205369 - RNA, 64 nt, Homo Sapiens
aaugugaaaucggguuaaagaaaauaauuuagaaaugaauuaaauagaaaucugccgauaaccu

SEQ ID NO: 205370 - RNA, 64 nt, Homo Sapiens
guaaaauggucuucaauucucuguguuuugcagcaugaauuauauuggaaauacugugugacug

SEQ ID NO: 205371 - RNA, 64 nt, Homo Sapiens; identical to SEQ ID NO: 146107

SEQ ID NO: 205372 - RNA, 64 nt, Homo Sapiens; identical to SEQ ID NO: 146108

SEQ ID NO: 205373 - RNA, 64 nt, Homo Sapiens; identical to SEQ ID NO: 146109

SEQ ID NO: 205374 - RNA, 64 nt, Homo Sapiens; identical to SEQ ID NO: 146110

SEQ ID NO: 205375 - RNA, 64 nt, Homo Sapiens; identical to SEQ ID NO: 146111

SEQ ID NO: 205376 - RNA, 64 nt, Homo Sapiens; identical to SEQ ID NO: 146112

SEQ ID NO: 205377 - RNA, 64 nt, Homo Sapiens; identical to SEQ ID NO: 146113

SEQ ID NO: 205378 - RNA, 64 nt, Homo Sapiens; identical to SEQ ID NO: 146114

SEQ ID NO: 205379 - RNA, 64 nt, Homo Sapiens; identical to SEQ ID NO: 146115

SEQ ID NO: 205380 - RNA, 58 nt, Homo Sapiens; identical to SEQ ID NO: 146116

SEQ ID NO: 205381 - RNA, 64 nt, Homo Sapiens; identical to SEQ ID NO: 146117

SEQ ID NO: 205382 - RNA, 64 nt, Homo Sapiens; identical to SEQ ID NO: 146118

SEQ ID NO: 205383 - RNA, 64 nt, Homo Sapiens; identical to SEQ ID NO: 146119

SEQ ID NO: 205384 - RNA, 64 nt, Homo Sapiens; identical to SEQ ID NO: 146120

SEQ ID NO: 205385 - RNA, 64 nt, Homo Sapiens; identical to SEQ ID NO: 146121

SEQ ID NO: 205386 - RNA, 64 nt, Homo Sapiens; identical to SEQ ID NO: 146122

SEQ ID NO: 205387 - RNA, 64 nt, Homo Sapiens; identical to SEQ ID NO: 146123

SEQ ID NO: 205388 - RNA, 64 nt, Homo Sapiens; identical to SEQ ID NO: 146124

SEQ ID NO: 205389 - RNA, 64 nt, Homo Sapiens; identical to SEQ ID NO: 146125

SEQ ID NO: 205390 - RNA, 64 nt, Homo Sapiens; identical to SEQ ID NO: 146126

SEQ ID NO: 205391 - RNA, 64 nt, Homo Sapiens; identical to SEQ ID NO: 146127

SEQ ID NO: 205392 - RNA, 64 nt, Homo Sapiens; identical to SEQ ID NO: 146128

SEQ ID NO: 205393 - RNA, 64 nt, Homo Sapiens; identical to SEQ ID NO: 146129

SEQ ID NO: 205394 - RNA, 64 nt, Homo Sapiens; identical to SEQ ID NO: 146130

SEQ ID NO: 205395 - RNA, 64 nt, Homo Sapiens; identical to SEQ ID NO: 146131

SEQ ID NO: 205396 - RNA, 64 nt, Homo Sapiens; identical to SEQ ID NO: 146132

SEQ ID NO: 205397 - RNA, 64 nt, Homo Sapiens; identical to SEQ ID NO: 146133

SEQ ID NO: 205398 - RNA, 64 nt, Homo Sapiens; identical to SEQ ID NO: 146134

SEQ ID NO: 205399 - RNA, 64 nt, Homo Sapiens; identical to SEQ ID NO: 146135

SEQ ID NO: 205400 - RNA, 64 nt, Homo Sapiens; identical to SEQ ID NO: 146136

SEQ ID NO: 205401 - RNA, 64 nt, Homo Sapiens; identical to SEQ ID NO: 146137

SEQ ID NO: 205402 - RNA, 64 nt, Homo Sapiens; identical to SEQ ID NO: 146138

SEQ ID NO: 205403 - RNA, 64 nt, Homo Sapiens; identical to SEQ ID NO: 146139

SEQ ID NO: 205404 - RNA, 64 nt, Homo Sapiens; identical to SEQ ID NO: 146140

SEQ ID NO: 205405 - RNA, 64 nt, Homo Sapiens; identical to SEQ ID NO: 146141

SEQ ID NO: 205406 - RNA, 64 nt, Homo Sapiens; identical to SEQ ID NO: 146142

SEQ ID NO: 205407 - RNA, 64 nt, Homo Sapiens; identical to SEQ ID NO: 146143

SEQ ID NO: 205408 - RNA, 64 nt, Homo Sapiens; identical to SEQ ID NO: 146144

SEQ ID NO: 205409 - RNA, 64 nt, Homo Sapiens; identical to SEQ ID NO: 146145

SEQ ID NO: 205410 - RNA, 63 nt, Homo Sapiens; identical to SEQ ID NO: 146146

SEQ ID NO: 205411 - RNA, 64 nt, Homo Sapiens; identical to SEQ ID NO: 146147

SEQ ID NO: 205412 - RNA, 64 nt, Homo Sapiens; identical to SEQ ID NO: 146148

SEQ ID NO: 205413 - RNA, 64 nt, Homo Sapiens; identical to SEQ ID NO: 146149

SEQ ID NO: 205414 - RNA, 64 nt, Homo Sapiens; identical to SEQ ID NO: 146150

SEQ ID NO: 205415 - RNA, 64 nt, Homo Sapiens; identical to SEQ ID NO: 146151

SEQ ID NO: 205416 - RNA, 64 nt, Homo Sapiens; identical to SEQ ID NO: 146152

SEQ ID NO: 205417 - RNA, 64 nt, Homo Sapiens; identical to SEQ ID NO: 146153

SEQ ID NO: 205418 - RNA, 64 nt, Homo Sapiens; identical to SEQ ID NO: 146154

SEQ ID NO: 205419 - RNA, 64 nt, Homo Sapiens; identical to SEQ ID NO: 146155

SEQ ID NO: 205420 - RNA, 64 nt, Homo Sapiens; identical to SEQ ID NO: 146156

SEQ ID NO: 205421 - RNA, 64 nt, Homo Sapiens; identical to SEQ ID NO: 146157

SEQ ID NO: 205422 - RNA, 64 nt, Homo Sapiens; identical to SEQ ID NO: 146158

SEQ ID NO: 205423 - RNA, 64 nt, Homo Sapiens; identical to SEQ ID NO: 146159

SEQ ID NO: 205424 - RNA, 64 nt, Homo Sapiens; identical to SEQ ID NO: 146160

SEQ ID NO: 205425 - RNA, 64 nt, Homo Sapiens; identical to SEQ ID NO: 146161

SEQ ID NO: 205426 - RNA, 64 nt, Homo Sapiens; identical to SEQ ID NO: 146162

SEQ ID NO: 205427 - RNA, 64 nt, Homo Sapiens; identical to SEQ ID NO: 146163

SEQ ID NO: 205428 - RNA, 64 nt, Homo Sapiens; identical to SEQ ID NO: 146164

SEQ ID NO: 205429 - RNA, 64 nt, Homo Sapiens; identical to SEQ ID NO: 146165

SEQ ID NO: 205430 - RNA, 64 nt, Homo Sapiens; identical to SEQ ID NO: 146166

SEQ ID NO: 205431 - RNA, 64 nt, Homo Sapiens; identical to SEQ ID NO: 146167

SEQ ID NO: 205432 - RNA, 64 nt, Homo Sapiens; identical to SEQ ID NO: 146168

SEQ ID NO: 205433 - RNA, 64 nt, Homo Sapiens; identical to SEQ ID NO: 146169

SEQ ID NO: 205434 - RNA, 64 nt, Homo Sapiens; identical to SEQ ID NO: 146170

SEQ ID NO: 205435 - RNA, 64 nt, Homo Sapiens; identical to SEQ ID NO: 146171

SEQ ID NO: 205436 - RNA, 64 nt, Homo Sapiens; identical to SEQ ID NO: 146172

SEQ ID NO: 205437 - RNA, 64 nt, Homo Sapiens; identical to SEQ ID NO: 146173

SEQ ID NO: 205438 - RNA, 64 nt, Homo Sapiens; identical to SEQ ID NO: 146174

SEQ ID NO: 205439 - RNA, 64 nt, Homo Sapiens; identical to SEQ ID NO: 146175

SEQ ID NO: 205440 - RNA, 64 nt, Homo Sapiens; identical to SEQ ID NO: 146176

SEQ ID NO: 205441 - RNA, 64 nt, Homo Sapiens; identical to SEQ ID NO: 146177

SEQ ID NO: 205442 - RNA, 64 nt, Homo Sapiens; identical to SEQ ID NO: 146178

SEQ ID NO: 205443 - RNA, 64 nt, Homo Sapiens; identical to SEQ ID NO: 146179

SEQ ID NO: 205444 - RNA, 64 nt, Homo Sapiens; identical to SEQ ID NO: 146180

SEQ ID NO: 205445 - RNA, 64 nt, Homo Sapiens; identical to SEQ ID NO: 146181

SEQ ID NO: 205446 - RNA, 64 nt, Homo Sapiens; identical to SEQ ID NO: 146182

SEQ ID NO: 205447 - RNA, 64 nt, Homo Sapiens; identical to SEQ ID NO: 146183

SEQ ID NO: 205448 - RNA, 64 nt, Homo Sapiens; identical to SEQ ID NO: 146184

SEQ ID NO: 205449 - RNA, 64 nt, Homo Sapiens; identical to SEQ ID NO: 146185

SEQ ID NO: 205450 - RNA, 64 nt, Homo Sapiens; identical to SEQ ID NO: 146186

SEQ ID NO: 205451 - RNA, 64 nt, Homo Sapiens; identical to SEQ ID NO: 146187

SEQ ID NO: 205452 - RNA, 64 nt, Homo Sapiens; identical to SEQ ID NO: 146188

SEQ ID NO: 205453 - RNA, 64 nt, Homo Sapiens; identical to SEQ ID NO: 146189

SEQ ID NO: 205454 - RNA, 64 nt, Homo Sapiens; identical to SEQ ID NO: 146190

SEQ ID NO: 205455 - RNA, 64 nt, Homo Sapiens; identical to SEQ ID NO: 146191

SEQ ID NO: 205456 - RNA, 64 nt, Homo Sapiens; identical to SEQ ID NO: 146192

SEQ ID NO: 205457 - RNA, 64 nt, Homo Sapiens; identical to SEQ ID NO: 146193

SEQ ID NO: 205458 - RNA, 64 nt, Homo Sapiens; identical to SEQ ID NO: 146194

SEQ ID NO: 205459 - RNA, 64 nt, Homo Sapiens; identical to SEQ ID NO: 146195

SEQ ID NO: 205460 - RNA, 64 nt, Homo Sapiens; identical to SEQ ID NO: 146196

SEQ ID NO: 205461 - RNA, 64 nt, Homo Sapiens; identical to SEQ ID NO: 146197

SEQ ID NO: 205462 - RNA, 64 nt, Homo Sapiens; identical to SEQ ID NO: 146198

SEQ ID NO: 205463 - RNA, 64 nt, Homo Sapiens; identical to SEQ ID NO: 146199

SEQ ID NO: 205464 - RNA, 64 nt, Homo Sapiens; identical to SEQ ID NO: 146200

SEQ ID NO: 205465 - RNA, 64 nt, Homo Sapiens; identical to SEQ ID NO: 146201

SEQ ID NO: 205466 - RNA, 64 nt, Homo Sapiens; identical to SEQ ID NO: 146202

SEQ ID NO: 205467 - RNA, 64 nt, Homo Sapiens; identical to SEQ ID NO: 146203

SEQ ID NO: 205468 - RNA, 64 nt, Homo Sapiens; identical to SEQ ID NO: 146204

SEQ ID NO: 205469 - RNA, 64 nt, Homo Sapiens; identical to SEQ ID NO: 146205

SEQ ID NO: 205470 - RNA, 64 nt, Homo Sapiens; identical to SEQ ID NO: 146206

SEQ ID NO: 205471 - RNA, 58 nt, Homo Sapiens; identical to SEQ ID NO: 146207

SEQ ID NO: 205472 - RNA, 64 nt, Homo Sapiens; identical to SEQ ID NO: 146208

SEQ ID NO: 205473 - RNA, 64 nt, Homo Sapiens; identical to SEQ ID NO: 146209

SEQ ID NO: 205474 - RNA, 64 nt, Homo Sapiens; identical to SEQ ID NO: 146210

SEQ ID NO: 205475 - RNA, 64 nt, Homo Sapiens; identical to SEQ ID NO: 146211

SEQ ID NO: 205476 - RNA, 64 nt, Homo Sapiens; identical to SEQ ID NO: 146212

SEQ ID NO: 205477 - RNA, 64 nt, Homo Sapiens; identical to SEQ ID NO: 146213

SEQ ID NO: 205478 - RNA, 64 nt, Homo Sapiens; identical to SEQ ID NO: 146214

SEQ ID NO: 205479 - RNA, 64 nt, Homo Sapiens; identical to SEQ ID NO: 146215

SEQ ID NO: 205480 - RNA, 64 nt, Homo Sapiens; identical to SEQ ID NO: 146216

SEQ ID NO: 205481 - RNA, 64 nt, Homo Sapiens; identical to SEQ ID NO: 146217

SEQ ID NO: 205482 - RNA, 64 nt, Homo Sapiens; identical to SEQ ID NO: 146218

SEQ ID NO: 205483 - RNA, 64 nt, Homo Sapiens; identical to SEQ ID NO: 146219

SEQ ID NO: 205484 - RNA, 64 nt, Homo Sapiens; identical to SEQ ID NO: 146220

SEQ ID NO: 205485 - RNA, 64 nt, Homo Sapiens; identical to SEQ ID NO: 146221

SEQ ID NO: 205486 - RNA, 64 nt, Homo Sapiens; identical to SEQ ID NO: 146222

SEQ ID NO: 205487 - RNA, 64 nt, Homo Sapiens; identical to SEQ ID NO: 146223

SEQ ID NO: 205488 - RNA, 64 nt, Homo Sapiens; identical to SEQ ID NO: 146224

SEQ ID NO: 205489 - RNA, 64 nt, Homo Sapiens; identical to SEQ ID NO: 146225

SEQ ID NO: 205490 - RNA, 64 nt, Homo Sapiens; identical to SEQ ID NO: 146226

SEQ ID NO: 205491 - RNA, 64 nt, Homo Sapiens; identical to SEQ ID NO: 146227

SEQ ID NO: 205492 - RNA, 63 nt, Homo Sapiens; identical to SEQ ID NO: 146228

SEQ ID NO: 205493 - RNA, 64 nt, Homo Sapiens; identical to SEQ ID NO: 146229

SEQ ID NO: 205494 - RNA, 64 nt, Homo Sapiens; identical to SEQ ID NO: 146230

SEQ ID NO: 205495 - RNA, 64 nt, Homo Sapiens; identical to SEQ ID NO: 146231

SEQ ID NO: 205496 - RNA, 64 nt, Homo Sapiens; identical to SEQ ID NO: 146232

SEQ ID NO: 205497 - RNA, 64 nt, Homo Sapiens; identical to SEQ ID NO: 146233

SEQ ID NO: 205498 - RNA, 64 nt, Homo Sapiens; identical to SEQ ID NO: 146234

SEQ ID NO: 205499 - RNA, 64 nt, Homo Sapiens; identical to SEQ ID NO: 146235

SEQ ID NO: 205500 - RNA, 64 nt, Homo Sapiens; identical to SEQ ID NO: 146236

SEQ ID NO: 205501 - RNA, 64 nt, Homo Sapiens; identical to SEQ ID NO: 146237

SEQ ID NO: 205502 - RNA, 64 nt, Homo Sapiens; identical to SEQ ID NO: 146238

SEQ ID NO: 205503 - RNA, 64 nt, Homo Sapiens; identical to SEQ ID NO: 146239

SEQ ID NO: 205504 - RNA, 64 nt, Homo Sapiens; identical to SEQ ID NO: 146240

SEQ ID NO: 205505 - RNA, 64 nt, Homo Sapiens; identical to SEQ ID NO: 146241

SEQ ID NO: 205506 - RNA, 64 nt, Homo Sapiens; identical to SEQ ID NO: 146242

SEQ ID NO: 205507 - RNA, 64 nt, Homo Sapiens; identical to SEQ ID NO: 146243

SEQ ID NO: 205508 - RNA, 64 nt, Homo Sapiens; identical to SEQ ID NO: 146244

SEQ ID NO: 205509 - RNA, 64 nt, Homo Sapiens; identical to SEQ ID NO: 146245

SEQ ID NO: 205510 - RNA, 64 nt, Homo Sapiens; identical to SEQ ID NO: 146246

SEQ ID NO: 205511 - RNA, 64 nt, Homo Sapiens; identical to SEQ ID NO: 146247

SEQ ID NO: 205512 - RNA, 64 nt, Homo Sapiens; identical to SEQ ID NO: 146248

SEQ ID NO: 205513 - RNA, 64 nt, Homo Sapiens; identical to SEQ ID NO: 146249

SEQ ID NO: 205514 - RNA, 64 nt, Homo Sapiens; identical to SEQ ID NO: 146250

SEQ ID NO: 205515 - RNA, 64 nt, Homo Sapiens; identical to SEQ ID NO: 146251

SEQ ID NO: 205516 - RNA, 64 nt, Homo Sapiens; identical to SEQ ID NO: 146252

SEQ ID NO: 205517 - RNA, 64 nt, Homo Sapiens; identical to SEQ ID NO: 146253

SEQ ID NO: 205518 - RNA, 64 nt, Homo Sapiens; identical to SEQ ID NO: 146254

SEQ ID NO: 205519 - RNA, 64 nt, Homo Sapiens; identical to SEQ ID NO: 146255

SEQ ID NO: 205520 - RNA, 64 nt, Homo Sapiens; identical to SEQ ID NO: 146256

SEQ ID NO: 205521 - RNA, 64 nt, Homo Sapiens; identical to SEQ ID NO: 146257

SEQ ID NO: 205522 - RNA, 64 nt, Homo Sapiens; identical to SEQ ID NO: 146258

SEQ ID NO: 205523 - RNA, 64 nt, Homo Sapiens; identical to SEQ ID NO: 146259

SEQ ID NO: 205524 - RNA, 64 nt, Homo Sapiens; identical to SEQ ID NO: 146260

SEQ ID NO: 205525 - RNA, 64 nt, Homo Sapiens; identical to SEQ ID NO: 146261

SEQ ID NO: 205526 - RNA, 64 nt, Homo Sapiens; identical to SEQ ID NO: 146262

SEQ ID NO: 205527 - RNA, 64 nt, Homo Sapiens; identical to SEQ ID NO: 146263

SEQ ID NO: 205528 - RNA, 64 nt, Homo Sapiens; identical to SEQ ID NO: 146264

SEQ ID NO: 205529 - RNA, 64 nt, Homo Sapiens; identical to SEQ ID NO: 146265

SEQ ID NO: 205530 - RNA, 64 nt, Homo Sapiens; identical to SEQ ID NO: 146266

SEQ ID NO: 205531 - RNA, 64 nt, Homo Sapiens; identical to SEQ ID NO: 146267

SEQ ID NO: 205532 - RNA, 64 nt, Homo Sapiens; identical to SEQ ID NO: 146268

SEQ ID NO: 205533 - RNA, 64 nt, Homo Sapiens; identical to SEQ ID NO: 146269

SEQ ID NO: 205534 - RNA, 64 nt, Homo Sapiens; identical to SEQ ID NO: 146270

SEQ ID NO: 205535 - RNA, 64 nt, Homo Sapiens; identical to SEQ ID NO: 146271

SEQ ID NO: 205536 - RNA, 64 nt, Homo Sapiens; identical to SEQ ID NO: 146272

SEQ ID NO: 205537 - RNA, 64 nt, Homo Sapiens; identical to SEQ ID NO: 146273

SEQ ID NO: 205538 - RNA, 64 nt, Homo Sapiens; identical to SEQ ID NO: 146274

SEQ ID NO: 205539 - RNA, 64 nt, Homo Sapiens; identical to SEQ ID NO: 146275

SEQ ID NO: 205540 - RNA, 64 nt, Homo Sapiens; identical to SEQ ID NO: 146276

SEQ ID NO: 205541 - RNA, 64 nt, Homo Sapiens; identical to SEQ ID NO: 146277

SEQ ID NO: 205542 - RNA, 64 nt, Homo Sapiens; identical to SEQ ID NO: 146278

SEQ ID NO: 205543 - RNA, 64 nt, Homo Sapiens; identical to SEQ ID NO: 146279

SEQ ID NO: 205544 - RNA, 64 nt, Homo Sapiens; identical to SEQ ID NO: 146280

SEQ ID NO: 205545 - RNA, 64 nt, Homo Sapiens; identical to SEQ ID NO: 146281

SEQ ID NO: 205546 - RNA, 64 nt, Homo Sapiens; identical to SEQ ID NO: 146282

SEQ ID NO: 205547 - RNA, 64 nt, Homo Sapiens; identical to SEQ ID NO: 146283

SEQ ID NO: 205548 - RNA, 64 nt, Homo Sapiens; identical to SEQ ID NO: 146284

SEQ ID NO: 205549 - RNA, 64 nt, Homo Sapiens; identical to SEQ ID NO: 146285

SEQ ID NO: 205550 - RNA, 64 nt, Homo Sapiens; identical to SEQ ID NO: 146286

SEQ ID NO: 205551 - RNA, 64 nt, Homo Sapiens; identical to SEQ ID NO: 146287

SEQ ID NO: 205552 - RNA, 64 nt, Homo Sapiens; identical to SEQ ID NO: 146288

SEQ ID NO: 205553 - RNA, 64 nt, Homo Sapiens; identical to SEQ ID NO: 146289

SEQ ID NO: 205554 - RNA, 64 nt, Homo Sapiens; identical to SEQ ID NO: 146290

SEQ ID NO: 205555 - RNA, 64 nt, Homo Sapiens; identical to SEQ ID NO: 146291

SEQ ID NO: 205556 - RNA, 64 nt, Homo Sapiens; identical to SEQ ID NO: 146292

SEQ ID NO: 205557 - RNA, 64 nt, Homo Sapiens; identical to SEQ ID NO: 146293

SEQ ID NO: 205558 - RNA, 64 nt, Homo Sapiens; identical to SEQ ID NO: 146294

SEQ ID NO: 205559 - RNA, 64 nt, Homo Sapiens; identical to SEQ ID NO: 146295

SEQ ID NO: 205560 - RNA, 64 nt, Homo Sapiens; identical to SEQ ID NO: 146296

SEQ ID NO: 205561 - RNA, 64 nt, Homo Sapiens; identical to SEQ ID NO: 146297

SEQ ID NO: 205562 - RNA, 64 nt, Homo Sapiens; identical to SEQ ID NO: 146298

SEQ ID NO: 205563 - RNA, 64 nt, Homo Sapiens; identical to SEQ ID NO: 146299

SEQ ID NO: 205564 - RNA, 64 nt, Homo Sapiens; identical to SEQ ID NO: 146300

SEQ ID NO: 205565 - RNA, 64 nt, Homo Sapiens; identical to SEQ ID NO: 146301

SEQ ID NO: 205566 - RNA, 64 nt, Homo Sapiens; identical to SEQ ID NO: 146302

SEQ ID NO: 205567 - RNA, 64 nt, Homo Sapiens; identical to SEQ ID NO: 146303

SEQ ID NO: 205568 - RNA, 64 nt, Homo Sapiens; identical to SEQ ID NO: 146304

SEQ ID NO: 205569 - RNA, 64 nt, Homo Sapiens; identical to SEQ ID NO: 146305

SEQ ID NO: 205570 - RNA, 64 nt, Homo Sapiens; identical to SEQ ID NO: 146306

SEQ ID NO: 205571 - RNA, 64 nt, Homo Sapiens; identical to SEQ ID NO: 146307

SEQ ID NO: 205572 - RNA, 64 nt, Homo Sapiens; identical to SEQ ID NO: 146308

SEQ ID NO: 205573 - RNA, 64 nt, Homo Sapiens; identical to SEQ ID NO: 146309

SEQ ID NO: 205574 - RNA, 64 nt, Homo Sapiens; identical to SEQ ID NO: 146310

SEQ ID NO: 205575 - RNA, 64 nt, Homo Sapiens; identical to SEQ ID NO: 146311

SEQ ID NO: 205576 - RNA, 64 nt, Homo Sapiens; identical to SEQ ID NO: 146312

SEQ ID NO: 205577 - RNA, 64 nt, Homo Sapiens; identical to SEQ ID NO: 146313

SEQ ID NO: 205578 - RNA, 64 nt, Homo Sapiens; identical to SEQ ID NO: 146314

SEQ ID NO: 205579 - RNA, 64 nt, Homo Sapiens; identical to SEQ ID NO: 146315

SEQ ID NO: 205580 - RNA, 64 nt, Homo Sapiens; identical to SEQ ID NO: 146316

SEQ ID NO: 205581 - RNA, 64 nt, Homo Sapiens; identical to SEQ ID NO: 146317

SEQ ID NO: 205582 - RNA, 64 nt, Homo Sapiens; identical to SEQ ID NO: 146318

SEQ ID NO: 205583 - RNA, 64 nt, Homo Sapiens; identical to SEQ ID NO: 146319

SEQ ID NO: 205584 - RNA, 64 nt, Homo Sapiens; identical to SEQ ID NO: 146320

SEQ ID NO: 205585 - RNA, 64 nt, Homo Sapiens; identical to SEQ ID NO: 146321

SEQ ID NO: 205586 - RNA, 64 nt, Homo Sapiens; identical to SEQ ID NO: 146322

SEQ ID NO: 205587 - RNA, 64 nt, Homo Sapiens; identical to SEQ ID NO: 146323

SEQ ID NO: 205588 - RNA, 64 nt, Homo Sapiens; identical to SEQ ID NO: 146324

SEQ ID NO: 205589 - RNA, 64 nt, Homo Sapiens; identical to SEQ ID NO: 146325

SEQ ID NO: 205590 - RNA, 64 nt, Homo Sapiens; identical to SEQ ID NO: 146326

SEQ ID NO: 205591 - RNA, 64 nt, Homo Sapiens; identical to SEQ ID NO: 146327

SEQ ID NO: 205592 - RNA, 64 nt, Homo Sapiens; identical to SEQ ID NO: 146328

SEQ ID NO: 205593 - RNA, 64 nt, Homo Sapiens; identical to SEQ ID NO: 146329

SEQ ID NO: 205594 - RNA, 64 nt, Homo Sapiens; identical to SEQ ID NO: 146330

SEQ ID NO: 205595 - RNA, 64 nt, Homo Sapiens; identical to SEQ ID NO: 146331

SEQ ID NO: 205596 - RNA, 64 nt, Homo Sapiens; identical to SEQ ID NO: 146332

SEQ ID NO: 205597 - RNA, 64 nt, Homo Sapiens; identical to SEQ ID NO: 146333

SEQ ID NO: 205598 - RNA, 64 nt, Homo Sapiens; identical to SEQ ID NO: 146334

SEQ ID NO: 205599 - RNA, 64 nt, Homo Sapiens; identical to SEQ ID NO: 146335

SEQ ID NO: 205600 - RNA, 64 nt, Homo Sapiens; identical to SEQ ID NO: 146336

SEQ ID NO: 205601 - RNA, 64 nt, Homo Sapiens; identical to SEQ ID NO: 146337

SEQ ID NO: 205602 - RNA, 64 nt, Homo Sapiens; identical to SEQ ID NO: 146338

SEQ ID NO: 205603 - RNA, 64 nt, Homo Sapiens; identical to SEQ ID NO: 146339

SEQ ID NO: 205604 - RNA, 64 nt, Homo Sapiens; identical to SEQ ID NO: 146340

SEQ ID NO: 205605 - RNA, 64 nt, Homo Sapiens; identical to SEQ ID NO: 146341

SEQ ID NO: 205606 - RNA, 64 nt, Homo Sapiens; identical to SEQ ID NO: 146342

SEQ ID NO: 205607 - RNA, 64 nt, Homo Sapiens; identical to SEQ ID NO: 146343

SEQ ID NO: 205608 - RNA, 64 nt, Homo Sapiens; identical to SEQ ID NO: 146344

SEQ ID NO: 205609 - RNA, 64 nt, Homo Sapiens; identical to SEQ ID NO: 146345

SEQ ID NO: 205610 - RNA, 64 nt, Homo Sapiens; identical to SEQ ID NO: 146346

SEQ ID NO: 205611 - RNA, 64 nt, Homo Sapiens; identical to SEQ ID NO: 146347

SEQ ID NO: 205612 - RNA, 64 nt, Homo Sapiens; identical to SEQ ID NO: 146348

SEQ ID NO: 205613 - RNA, 64 nt, Homo Sapiens; identical to SEQ ID NO: 146349

SEQ ID NO: 205614 - RNA, 64 nt, Homo Sapiens; identical to SEQ ID NO: 146350

SEQ ID NO: 205615 - RNA, 64 nt, Homo Sapiens; identical to SEQ ID NO: 146351

SEQ ID NO: 205616 - RNA, 64 nt, Homo Sapiens; identical to SEQ ID NO: 146352

SEQ ID NO: 205617 - RNA, 64 nt, Homo Sapiens; identical to SEQ ID NO: 146353

SEQ ID NO: 205618 - RNA, 64 nt, Homo Sapiens; identical to SEQ ID NO: 146354

SEQ ID NO: 205619 - RNA, 64 nt, Homo Sapiens; identical to SEQ ID NO: 146355

SEQ ID NO: 205620 - RNA, 64 nt, Homo Sapiens; identical to SEQ ID NO: 146356

SEQ ID NO: 205621 - RNA, 64 nt, Homo Sapiens; identical to SEQ ID NO: 146357

SEQ ID NO: 205622 - RNA, 64 nt, Homo Sapiens; identical to SEQ ID NO: 146358

SEQ ID NO: 205623 - RNA, 64 nt, Homo Sapiens; identical to SEQ ID NO: 146359

SEQ ID NO: 205624 - RNA, 64 nt, Homo Sapiens; identical to SEQ ID NO: 146360

SEQ ID NO: 205625 - RNA, 64 nt, Homo Sapiens; identical to SEQ ID NO: 146361

SEQ ID NO: 205626 - RNA, 64 nt, Homo Sapiens; identical to SEQ ID NO: 146362

SEQ ID NO: 205627 - RNA, 64 nt, Homo Sapiens; identical to SEQ ID NO: 146363

SEQ ID NO: 205628 - RNA, 64 nt, Homo Sapiens; identical to SEQ ID NO: 146364

SEQ ID NO: 205629 - RNA, 64 nt, Homo Sapiens; identical to SEQ ID NO: 146365

SEQ ID NO: 205630 - RNA, 64 nt, Homo Sapiens; identical to SEQ ID NO: 146366

SEQ ID NO: 205631 - RNA, 64 nt, Homo Sapiens; identical to SEQ ID NO: 146367

SEQ ID NO: 205632 - RNA, 64 nt, Homo Sapiens; identical to SEQ ID NO: 146368

SEQ ID NO: 205633 - RNA, 64 nt, Homo Sapiens; identical to SEQ ID NO: 146369

SEQ ID NO: 205634 - RNA, 64 nt, Homo Sapiens; identical to SEQ ID NO: 146370

SEQ ID NO: 205635 - RNA, 64 nt, Homo Sapiens; identical to SEQ ID NO: 146371

SEQ ID NO: 205636 - RNA, 64 nt, Homo Sapiens; identical to SEQ ID NO: 146372

SEQ ID NO: 205637 - RNA, 64 nt, Homo Sapiens; identical to SEQ ID NO: 146373

SEQ ID NO: 205638 - RNA, 64 nt, Homo Sapiens; identical to SEQ ID NO: 146374

SEQ ID NO: 205639 - RNA, 64 nt, Homo Sapiens; identical to SEQ ID NO: 146375

SEQ ID NO: 205640 - RNA, 64 nt, Homo Sapiens; identical to SEQ ID NO: 146376

SEQ ID NO: 205641 - RNA, 64 nt, Homo Sapiens; identical to SEQ ID NO: 146377

SEQ ID NO: 205642 - RNA, 64 nt, Homo Sapiens; identical to SEQ ID NO: 146378

SEQ ID NO: 205643 - RNA, 64 nt, Homo Sapiens; identical to SEQ ID NO: 146379

SEQ ID NO: 205644 - RNA, 64 nt, Homo Sapiens; identical to SEQ ID NO: 146380

SEQ ID NO: 205645 - RNA, 64 nt, Homo Sapiens; identical to SEQ ID NO: 146381

SEQ ID NO: 205646 - RNA, 64 nt, Homo Sapiens; identical to SEQ ID NO: 146382

SEQ ID NO: 205647 - RNA, 64 nt, Homo Sapiens; identical to SEQ ID NO: 146383

SEQ ID NO: 205648 - RNA, 64 nt, Homo Sapiens; identical to SEQ ID NO: 146384

SEQ ID NO: 205649 - RNA, 64 nt, Homo Sapiens; identical to SEQ ID NO: 146385

SEQ ID NO: 205650 - RNA, 64 nt, Homo Sapiens; identical to SEQ ID NO: 146386

SEQ ID NO: 205651 - RNA, 64 nt, Homo Sapiens; identical to SEQ ID NO: 146387

SEQ ID NO: 205652 - RNA, 64 nt, Homo Sapiens; identical to SEQ ID NO: 146388

SEQ ID NO: 205653 - RNA, 64 nt, Homo Sapiens; identical to SEQ ID NO: 146389

SEQ ID NO: 205654 - RNA, 64 nt, Homo Sapiens; identical to SEQ ID NO: 146390

SEQ ID NO: 205655 - RNA, 64 nt, Homo Sapiens; identical to SEQ ID NO: 146391

SEQ ID NO: 205656 - RNA, 64 nt, Homo Sapiens; identical to SEQ ID NO: 146392

SEQ ID NO: 205657 - RNA, 64 nt, Homo Sapiens; identical to SEQ ID NO: 146393

SEQ ID NO: 205658 - RNA, 64 nt, Homo Sapiens; identical to SEQ ID NO: 146394

SEQ ID NO: 205659 - RNA, 64 nt, Homo Sapiens; identical to SEQ ID NO: 146395

SEQ ID NO: 205660 - RNA, 64 nt, Homo Sapiens; identical to SEQ ID NO: 146396

SEQ ID NO: 205661 - RNA, 64 nt, Homo Sapiens; identical to SEQ ID NO: 146397

SEQ ID NO: 205662 - RNA, 64 nt, Homo Sapiens; identical to SEQ ID NO: 146398

SEQ ID NO: 205663 - RNA, 64 nt, Homo Sapiens; identical to SEQ ID NO: 146399

SEQ ID NO: 205664 - RNA, 64 nt, Homo Sapiens; identical to SEQ ID NO: 146400

SEQ ID NO: 205665 - RNA, 64 nt, Homo Sapiens; identical to SEQ ID NO: 146401

SEQ ID NO: 205666 - RNA, 64 nt, Homo Sapiens; identical to SEQ ID NO: 146402

SEQ ID NO: 205667 - RNA, 64 nt, Homo Sapiens; identical to SEQ ID NO: 146403

SEQ ID NO: 205668 - RNA, 64 nt, Homo Sapiens; identical to SEQ ID NO: 146404

SEQ ID NO: 205669 - RNA, 64 nt, Homo Sapiens; identical to SEQ ID NO: 146405

SEQ ID NO: 205670 - RNA, 64 nt, Homo Sapiens; identical to SEQ ID NO: 146406

SEQ ID NO: 205671 - RNA, 64 nt, Homo Sapiens; identical to SEQ ID NO: 146407

SEQ ID NO: 205672 - RNA, 64 nt, Homo Sapiens; identical to SEQ ID NO: 146408

SEQ ID NO: 205673 - RNA, 64 nt, Homo Sapiens; identical to SEQ ID NO: 146409

SEQ ID NO: 205674 - RNA, 64 nt, Homo Sapiens; identical to SEQ ID NO: 146410

SEQ ID NO: 205675 - RNA, 64 nt, Homo Sapiens; identical to SEQ ID NO: 146411

SEQ ID NO: 205676 - RNA, 64 nt, Homo Sapiens; identical to SEQ ID NO: 146412

SEQ ID NO: 205677 - RNA, 64 nt, Homo Sapiens; identical to SEQ ID NO: 146413

SEQ ID NO: 205678 - RNA, 64 nt, Homo Sapiens; identical to SEQ ID NO: 146414

SEQ ID NO: 205679 - RNA, 64 nt, Homo Sapiens; identical to SEQ ID NO: 146415

SEQ ID NO: 205680 - RNA, 64 nt, Homo Sapiens; identical to SEQ ID NO: 146416

SEQ ID NO: 205681 - RNA, 64 nt, Homo Sapiens; identical to SEQ ID NO: 146417

SEQ ID NO: 205682 - RNA, 64 nt, Homo Sapiens; identical to SEQ ID NO: 146418

SEQ ID NO: 205683 - RNA, 64 nt, Homo Sapiens; identical to SEQ ID NO: 146419

SEQ ID NO: 205684 - RNA, 64 nt, Homo Sapiens; identical to SEQ ID NO: 146420

SEQ ID NO: 205685 - RNA, 64 nt, Homo Sapiens; identical to SEQ ID NO: 146421

SEQ ID NO: 205686 - RNA, 64 nt, Homo Sapiens; identical to SEQ ID NO: 146422

SEQ ID NO: 205687 - RNA, 64 nt, Homo Sapiens; identical to SEQ ID NO: 146423

SEQ ID NO: 205688 - RNA, 64 nt, Homo Sapiens; identical to SEQ ID NO: 146424

SEQ ID NO: 205689 - RNA, 64 nt, Homo Sapiens; identical to SEQ ID NO: 146425

SEQ ID NO: 205690 - RNA, 64 nt, Homo Sapiens; identical to SEQ ID NO: 146426

SEQ ID NO: 205691 - RNA, 64 nt, Homo Sapiens; identical to SEQ ID NO: 146427

SEQ ID NO: 205692 - RNA, 64 nt, Homo Sapiens; identical to SEQ ID NO: 146428

SEQ ID NO: 205693 - RNA, 64 nt, Homo Sapiens; identical to SEQ ID NO: 146429

SEQ ID NO: 205694 - RNA, 64 nt, Homo Sapiens; identical to SEQ ID NO: 146430

SEQ ID NO: 205695 - RNA, 64 nt, Homo Sapiens; identical to SEQ ID NO: 146431

SEQ ID NO: 205696 - RNA, 64 nt, Homo Sapiens; identical to SEQ ID NO: 146432

SEQ ID NO: 205697 - RNA, 64 nt, Homo Sapiens; identical to SEQ ID NO: 146433

SEQ ID NO: 205698 - RNA, 64 nt, Homo Sapiens; identical to SEQ ID NO: 146434

SEQ ID NO: 205699 - RNA, 64 nt, Homo Sapiens; identical to SEQ ID NO: 146435

SEQ ID NO: 205700 - RNA, 64 nt, Homo Sapiens; identical to SEQ ID NO: 146436

SEQ ID NO: 205701 - RNA, 64 nt, Homo Sapiens; identical to SEQ ID NO: 146437

SEQ ID NO: 205702 - RNA, 64 nt, Homo Sapiens; identical to SEQ ID NO: 146438

SEQ ID NO: 205703 - RNA, 64 nt, Homo Sapiens; identical to SEQ ID NO: 146439

SEQ ID NO: 205704 - RNA, 64 nt, Homo Sapiens; identical to SEQ ID NO: 146440

SEQ ID NO: 205705 - RNA, 64 nt, Homo Sapiens; identical to SEQ ID NO: 146441

SEQ ID NO: 205706 - RNA, 64 nt, Homo Sapiens; identical to SEQ ID NO: 146442

SEQ ID NO: 205707 - RNA, 64 nt, Homo Sapiens; identical to SEQ ID NO: 146443

SEQ ID NO: 205708 - RNA, 64 nt, Homo Sapiens; identical to SEQ ID NO: 146444

SEQ ID NO: 205709 - RNA, 64 nt, Homo Sapiens; identical to SEQ ID NO: 146445

SEQ ID NO: 205710 - RNA, 64 nt, Homo Sapiens; identical to SEQ ID NO: 146446

SEQ ID NO: 205711 - RNA, 64 nt, Homo Sapiens; identical to SEQ ID NO: 146447

SEQ ID NO: 205712 - RNA, 64 nt, Homo Sapiens; identical to SEQ ID NO: 146448

SEQ ID NO: 205713 - RNA, 64 nt, Homo Sapiens; identical to SEQ ID NO: 146449

SEQ ID NO: 205714 - RNA, 64 nt, Homo Sapiens; identical to SEQ ID NO: 146450

SEQ ID NO: 205715 - RNA, 64 nt, Homo Sapiens; identical to SEQ ID NO: 146451

SEQ ID NO: 205716 - RNA, 64 nt, Homo Sapiens; identical to SEQ ID NO: 146452

SEQ ID NO: 205717 - RNA, 64 nt, Homo Sapiens; identical to SEQ ID NO: 146453

SEQ ID NO: 205718 - RNA, 64 nt, Homo Sapiens; identical to SEQ ID NO: 146454

SEQ ID NO: 205719 - RNA, 64 nt, Homo Sapiens; identical to SEQ ID NO: 146455

SEQ ID NO: 205720 - RNA, 64 nt, Homo Sapiens; identical to SEQ ID NO: 146456

SEQ ID NO: 205721 - RNA, 64 nt, Homo Sapiens; identical to SEQ ID NO: 146457

SEQ ID NO: 205722 - RNA, 64 nt, Homo Sapiens; identical to SEQ ID NO: 146458

SEQ ID NO: 205723 - RNA, 64 nt, Homo Sapiens; identical to SEQ ID NO: 146459

SEQ ID NO: 205724 - RNA, 64 nt, Homo Sapiens; identical to SEQ ID NO: 146460

SEQ ID NO: 205725 - RNA, 64 nt, Homo Sapiens; identical to SEQ ID NO: 146461

SEQ ID NO: 205726 - RNA, 64 nt, Homo Sapiens; identical to SEQ ID NO: 146462

SEQ ID NO: 205727 - RNA, 64 nt, Homo Sapiens; identical to SEQ ID NO: 71859

SEQ ID NO: 205728 - RNA, 64 nt, Homo Sapiens; identical to SEQ ID NO: 71860

SEQ ID NO: 205729 - RNA, 64 nt, Homo Sapiens; identical to SEQ ID NO: 71861

SEQ ID NO: 205730 - RNA, 64 nt, Homo Sapiens; identical to SEQ ID NO: 71862

SEQ ID NO: 205731 - RNA, 64 nt, Homo Sapiens; identical to SEQ ID NO: 71863

SEQ ID NO: 205732 - RNA, 64 nt, Homo Sapiens; identical to SEQ ID NO: 71864

SEQ ID NO: 205733 - RNA, 64 nt, Homo Sapiens; identical to SEQ ID NO: 71865

SEQ ID NO: 205734 - RNA, 64 nt, Homo Sapiens; identical to SEQ ID NO: 71866

SEQ ID NO: 205735 - RNA, 64 nt, Homo Sapiens; identical to SEQ ID NO: 71867

SEQ ID NO: 205736 - RNA, 64 nt, Homo Sapiens; identical to SEQ ID NO: 71868

SEQ ID NO: 205737 - RNA, 64 nt, Homo Sapiens; identical to SEQ ID NO: 71869

SEQ ID NO: 205738 - RNA, 64 nt, Homo Sapiens; identical to SEQ ID NO: 71870

SEQ ID NO: 205739 - RNA, 64 nt, Homo Sapiens; identical to SEQ ID NO: 71871

SEQ ID NO: 205740 - RNA, 64 nt, Homo Sapiens; identical to SEQ ID NO: 71872

SEQ ID NO: 205741 - RNA, 64 nt, Homo Sapiens; identical to SEQ ID NO: 71873

SEQ ID NO: 205742 - RNA, 64 nt, Homo Sapiens; identical to SEQ ID NO: 71874

SEQ ID NO: 205743 - RNA, 64 nt, Homo Sapiens; identical to SEQ ID NO: 71875

SEQ ID NO: 205744 - RNA, 64 nt, Homo Sapiens; identical to SEQ ID NO: 71876

SEQ ID NO: 205745 - RNA, 64 nt, Homo Sapiens; identical to SEQ ID NO: 71877

SEQ ID NO: 205746 - RNA, 64 nt, Homo Sapiens; identical to SEQ ID NO: 71878

SEQ ID NO: 205747 - RNA, 64 nt, Homo Sapiens; identical to SEQ ID NO: 71879

SEQ ID NO: 205748 - RNA, 64 nt, Homo Sapiens; identical to SEQ ID NO: 108766

SEQ ID NO: 205749 - RNA, 64 nt, Homo Sapiens; identical to SEQ ID NO: 108767

SEQ ID NO: 205750 - RNA, 64 nt, Homo Sapiens; identical to SEQ ID NO: 108768

SEQ ID NO: 205751 - RNA, 64 nt, Homo Sapiens; identical to SEQ ID NO: 108769

SEQ ID NO: 205752 - RNA, 64 nt, Homo Sapiens; identical to SEQ ID NO: 108770

SEQ ID NO: 205753 - RNA, 64 nt, Homo Sapiens; identical to SEQ ID NO: 108771

SEQ ID NO: 205754 - RNA, 64 nt, Homo Sapiens; identical to SEQ ID NO: 108772

SEQ ID NO: 205755 - RNA, 64 nt, Homo Sapiens; identical to SEQ ID NO: 108773

SEQ ID NO: 205756 - RNA, 64 nt, Homo Sapiens; identical to SEQ ID NO: 108774

SEQ ID NO: 205757 - RNA, 64 nt, Homo Sapiens; identical to SEQ ID NO: 108775

SEQ ID NO: 205758 - RNA, 64 nt, Homo Sapiens; identical to SEQ ID NO: 108776

SEQ ID NO: 205759 - RNA, 64 nt, Homo Sapiens; identical to SEQ ID NO: 108777

SEQ ID NO: 205760 - RNA, 64 nt, Homo Sapiens; identical to SEQ ID NO: 108778

SEQ ID NO: 205761 - RNA, 64 nt, Homo Sapiens; identical to SEQ ID NO: 108779

SEQ ID NO: 205762 - RNA, 64 nt, Homo Sapiens; identical to SEQ ID NO: 108780

SEQ ID NO: 205763 - RNA, 64 nt, Homo Sapiens; identical to SEQ ID NO: 108781

SEQ ID NO: 205764 - RNA, 64 nt, Homo Sapiens; identical to SEQ ID NO: 108782

SEQ ID NO: 205765 - RNA, 64 nt, Homo Sapiens; identical to SEQ ID NO: 108783

SEQ ID NO: 205766 - RNA, 64 nt, Homo Sapiens; identical to SEQ ID NO: 108784

SEQ ID NO: 205767 - RNA, 64 nt, Homo Sapiens; identical to SEQ ID NO: 108785

SEQ ID NO: 205768 - RNA, 64 nt, Homo Sapiens; identical to SEQ ID NO: 108786

SEQ ID NO: 205769 - RNA, 64 nt, Homo Sapiens; identical to SEQ ID NO: 108787

SEQ ID NO: 205770 - RNA, 64 nt, Homo Sapiens; identical to SEQ ID NO: 108788

SEQ ID NO: 205771 - RNA, 64 nt, Homo Sapiens; identical to SEQ ID NO: 108789

SEQ ID NO: 205772 - RNA, 64 nt, Homo Sapiens; identical to SEQ ID NO: 108790

SEQ ID NO: 205773 - RNA, 64 nt, Homo Sapiens; identical to SEQ ID NO: 108791

SEQ ID NO: 205774 - RNA, 64 nt, Homo Sapiens; identical to SEQ ID NO: 108792

SEQ ID NO: 205775 - RNA, 64 nt, Homo Sapiens; identical to SEQ ID NO: 108793

SEQ ID NO: 205776 - RNA, 64 nt, Homo Sapiens; identical to SEQ ID NO: 108794

SEQ ID NO: 205777 - RNA, 64 nt, Homo Sapiens; identical to SEQ ID NO: 108795

SEQ ID NO: 205778 - RNA, 64 nt, Homo Sapiens; identical to SEQ ID NO: 108796

SEQ ID NO: 205779 - RNA, 64 nt, Homo Sapiens; identical to SEQ ID NO: 108797

SEQ ID NO: 205780 - RNA, 64 nt, Homo Sapiens; identical to SEQ ID NO: 108798

SEQ ID NO: 205781 - RNA, 64 nt, Homo Sapiens; identical to SEQ ID NO: 108799

SEQ ID NO: 205782 - RNA, 64 nt, Homo Sapiens; identical to SEQ ID NO: 108800

SEQ ID NO: 205783 - RNA, 64 nt, Homo Sapiens; identical to SEQ ID NO: 108801

SEQ ID NO: 205784 - RNA, 64 nt, Homo Sapiens; identical to SEQ ID NO: 108802

SEQ ID NO: 205785 - RNA, 64 nt, Homo Sapiens; identical to SEQ ID NO: 108803

SEQ ID NO: 205786 - RNA, 64 nt, Homo Sapiens; identical to SEQ ID NO: 108804

SEQ ID NO: 205787 - RNA, 64 nt, Homo Sapiens; identical to SEQ ID NO: 108805

SEQ ID NO: 205788 - RNA, 64 nt, Homo Sapiens; identical to SEQ ID NO: 108806

SEQ ID NO: 205789 - RNA, 64 nt, Homo Sapiens; identical to SEQ ID NO: 108807

SEQ ID NO: 205790 - RNA, 64 nt, Homo Sapiens; identical to SEQ ID NO: 108808

SEQ ID NO: 205791 - RNA, 64 nt, Homo Sapiens; identical to SEQ ID NO: 108809

SEQ ID NO: 205792 - RNA, 64 nt, Homo Sapiens; identical to SEQ ID NO: 108810

SEQ ID NO: 205793 - RNA, 64 nt, Homo Sapiens; identical to SEQ ID NO: 108811

SEQ ID NO: 205794 - RNA, 64 nt, Homo Sapiens; identical to SEQ ID NO: 108812

SEQ ID NO: 205795 - RNA, 64 nt, Homo Sapiens; identical to SEQ ID NO: 108813

SEQ ID NO: 205796 - RNA, 64 nt, Homo Sapiens; identical to SEQ ID NO: 108814

SEQ ID NO: 205797 - RNA, 64 nt, Homo Sapiens; identical to SEQ ID NO: 108815

SEQ ID NO: 205798 - RNA, 64 nt, Homo Sapiens; identical to SEQ ID NO: 108816

SEQ ID NO: 205799 - RNA, 64 nt, Homo Sapiens; identical to SEQ ID NO: 108817

SEQ ID NO: 205800 - RNA, 64 nt, Homo Sapiens; identical to SEQ ID NO: 108818

SEQ ID NO: 205801 - RNA, 64 nt, Homo Sapiens; identical to SEQ ID NO: 108819

SEQ ID NO: 205802 - RNA, 64 nt, Homo Sapiens; identical to SEQ ID NO: 108820

SEQ ID NO: 205803 - RNA, 64 nt, Homo Sapiens; identical to SEQ ID NO: 108821

SEQ ID NO: 205804 - RNA, 64 nt, Homo Sapiens; identical to SEQ ID NO: 108822

SEQ ID NO: 205805 - RNA, 64 nt, Homo Sapiens; identical to SEQ ID NO: 108823

SEQ ID NO: 205806 - RNA, 64 nt, Homo Sapiens; identical to SEQ ID NO: 108824

SEQ ID NO: 205807 - RNA, 64 nt, Homo Sapiens; identical to SEQ ID NO: 108825

SEQ ID NO: 205808 - RNA, 64 nt, Homo Sapiens
accuuaaaaaguugauuuccuugaagcaguuugaaaauuugaauugagucuuaacuuuaggaaa

SEQ ID NO: 205809 - RNA, 64 nt, Homo Sapiens
gucagacucuuuuaaggguauuuuaaaaauuaguaaauuugaaugaacuaaagauauaucucua

SEQ ID NO: 205810 - RNA, 64 nt, Homo Sapiens
gaguauaaggugugacuauuggauucuugaacuaaaauuugacccugucuucaccuuuguucuc

SEQ ID NO: 205811 - RNA, 64 nt, Homo Sapiens
uuagcugacuagggucagggaaacuuuucucuucaaauuugaaagcuguuucuguuuucauuuu

SEQ ID NO: 205812 - RNA, 64 nt, Homo Sapiens
aguuagcaaaacuuaauacauuauauuaucuuccaaauuugaucuuuagaauagacguucucau

SEQ ID NO: 205813 - RNA, 64 nt, Homo Sapiens
ugcuuacaggacagguuugcuaauguuuuaccuaaaauuugacauuaacagguuuguuucuuuu

SEQ ID NO: 205814 - RNA, 64 nt, Homo Sapiens
uucuuuuuuuuuaagccacauuugaauuggauguaaauuugaaagaaaccuuuuaaauagccag

SEQ ID NO: 205815 - RNA, 64 nt, Homo Sapiens
uagccacuaacuagccaugugagaucagaauuuuaaauuugacuagaauugaaugaaaagucag

SEQ ID NO: 205816 - RNA, 64 nt, Homo Sapiens
uguguguggcauuaucaaaacuaccauuugcuggaaauuugacaucauugaaaacgguaccuga

SEQ ID NO: 205817 - RNA, 64 nt, Homo Sapiens
uuuuuguuuguugaaugacaaaggcaauaaaaauaaauuugacuuuagcuuuuuuucuauacuu

SEQ ID NO: 205818 - RNA, 64 nt, Homo Sapiens
gaucuuugauaggucuuugguguugguuguaacaaaauuugauuugaacuaccuauaaaugaaa

SEQ ID NO: 205819 - RNA, 64 nt, Homo Sapiens
aucuucuguugugugcuuuucaaacacuguaaauaaauuugaaauuugaauaacuuuccacagu

SEQ ID NO: 205820 - RNA, 63 nt, Homo Sapiens
guugugugcuuuucaaacacuguaaauaaauuugaaauuugaauaacuuuccacaguauaacu

SEQ ID NO: 205821 - RNA, 64 nt, Homo Sapiens
aaaaaaaaaaagaugauugugcccuaucaguauaaaauuugaaaaaugagccacaaacaguaaa

SEQ ID NO: 205822 - RNA, 64 nt, Homo Sapiens
caaauauuggugcacuuuaaaaaauaaagcaagcaaauuugaguacuuucuguuuacuccuaac

SEQ ID NO: 205823 - RNA, 64 nt, Homo Sapiens
ccuuagugcuucagacccagcaagaaauuauugaaaauuugaagccauuacuuccagcugguau

SEQ ID NO: 205824 - RNA, 64 nt, Homo Sapiens
acaggauaaacuacauacacugaucccuugcaagaaauuugaucucaguuauaaucuaaauuac

SEQ ID NO: 205825 - RNA, 64 nt, Homo Sapiens
auuuaacuugauauagcucugggcuaaaaauuaaaaauuugagggguuauauacaauuuaaauu

SEQ ID NO: 205826 - RNA, 64 nt, Homo Sapiens
aauggaaccagagguuauauuuucuagcccauccaaauuugauaccuagaggagacuaauucuc

SEQ ID NO: 205827 - RNA, 64 nt, Homo Sapiens
guuaaauugcuauagcuagcuacaauguucugauaaauuugacuguuguuuguguuuuuuaaug

SEQ ID NO: 205828 - RNA, 64 nt, Homo Sapiens
guuaagauacaguaguggacugaauaaagcaauaaaauuugauugccuugcaaaaaacaccaca

SEQ ID NO: 205829 - RNA, 64 nt, Homo Sapiens
gcuuugcugaauucuaacauuaaaucacagcccaaaauuugauggacuaauuauuauuuuaaaa

SEQ ID NO: 205830 - RNA, 64 nt, Homo Sapiens
aaaaagaguaauuucauuuaaauaucuguuauucaaauuugaugauguuaaauguaauauaaug

SEQ ID NO: 205831 - RNA, 64 nt, Homo Sapiens
ugguaauaucacuaugcauuucuacacauuuuauaaauuugauuuaugcagauuuugauacacu

SEQ ID NO: 205832 - RNA, 64 nt, Homo Sapiens
gaaauuguauaaauauucaaaauuuuauuaggauaaauuugagaaacuuacguauaucuuaauu

SEQ ID NO: 205833 - RNA, 64 nt, Homo Sapiens
aauuuuauuuguuuuuguucuauguaaucaaauaaaauuugaguaacauguaaugguaaggauu

SEQ ID NO: 205834 - RNA, 64 nt, Homo Sapiens
cuuugaauuagaauuuugcuguaauaaaguuucaaaauuugaauaaaauaauuaaauuuuuuga

SEQ ID NO: 205835 - RNA, 64 nt, Homo Sapiens
gcaguggacauugggauuguugcuugaaaaauuaaaauuugaauauuuucucucucauuugcau

SEQ ID NO: 205836 - RNA, 64 nt, Homo Sapiens
ccuuuuaaagaucaucucuucagagcugcaugguaaauuugaauuuccccauuguucucuagag

SEQ ID NO: 205837 - RNA, 64 nt, Homo Sapiens
aucaaaacauguuuaggaaaauugguacugugauaaauuugaauccaaaauccuuuuaacuaug

SEQ ID NO: 205838 - RNA, 64 nt, Homo Sapiens
ggucuagaugagacuuggaaggcaaggagcaucgaaauuugagauacccaggacccuuucaagc

SEQ ID NO: 205839 - RNA, 64 nt, Homo Sapiens
aaauauuugaacugucacaucucucacugugggaaaauuugaugugaugaagagguuuuacuau

SEQ ID NO: 205840 - RNA, 64 nt, Homo Sapiens
ucaccauuaagaaaagguaaauuugcuagguuguaaauuugauuuuuaaaagauauucuuacuc

SEQ ID NO: 205841 - RNA, 64 nt, Homo Sapiens
aauaaaugaacucaaucuaaauuaaaaaagaaagaaauuugaaaaaacuuucucuuugccauuu

SEQ ID NO: 205842 - RNA, 64 nt, Homo Sapiens
acaguuucauuaacuccuucccccgcucccccaaaaauuugaauuuuuuuuucaacacucuuac

SEQ ID NO: 205843 - RNA, 64 nt, Homo Sapiens
guauugaguuguaucgugugguguauuuuuuaaaaaauuugauuuagcauucauauuuuccauc

SEQ ID NO: 205844 - RNA, 64 nt, Homo Sapiens
ucugccaguguuucuuugcuaagccuugcaugcaaaauuugaaauuuuaacauuggcacccaaa

SEQ ID NO: 205845 - RNA, 64 nt, Homo Sapiens
aaugaguuugaaaagaaacaaugaaauguguuaaaaauuugaccauauuagauaaauuuucgug

SEQ ID NO: 205846 - RNA, 64 nt, Homo Sapiens
ugaugacauccaauacagaguucugguaaagauaaaauuugauacagguuuggugucauuauaa

SEQ ID NO: 205847 - RNA, 64 nt, Homo Sapiens
uucucauuuuucuaaaauacaauuuuguuucuccaaauuugacagcagaauaaaaacccuaccc

SEQ ID NO: 205848 - RNA, 64 nt, Homo Sapiens
gugaaguaaaaccgauaccuguccugcaggucuaaaauuugaauggaaauucaagcacaaguac

SEQ ID NO: 205849 - RNA, 64 nt, Homo Sapiens
uucuaauuuaaguaaguuugaguuuagucacugcaaauuugacugugacuuuaaucuaaauuac

SEQ ID NO: 205850 - RNA, 64 nt, Homo Sapiens
uuauuuuaaauauuaacucuaaagcaggauuacuaaauuugauuaaucuggucaaugagaauca

SEQ ID NO: 205851 - RNA, 64 nt, Homo Sapiens
uauauuaggaaacugcuucuaccuagauugaaagaaauuugacucauaaacuuccaaguuagaa

SEQ ID NO: 205852 - RNA, 64 nt, Homo Sapiens
uuuuaaauauuauaagugguuggucauacuuuuuaaauuugauuuucuuaauauguucaaugua

SEQ ID NO: 205853 - RNA, 64 nt, Homo Sapiens
uuuuuaaaauuuuucacagcgauuuuuuauuuaaaaauuugagaccauccugaauuuuauaaau

SEQ ID NO: 205854 - RNA, 64 nt, Homo Sapiens
gaaacagaauucuaaaaugugaguucaauucaauaaauuugaauuucuguaggaagaaucaaau

SEQ ID NO: 205855 - RNA, 64 nt, Homo Sapiens
aaaaucagcucuaaaaccaaagcugauuuuuagaaaauuugaaaauguaaaucagcccuaucca

SEQ ID NO: 205856 - RNA, 64 nt, Homo Sapiens
auguaaaucagcccuauccaagcugauuuuuagaaaauuugaaaaaaaucagcucuaaaaccaa

SEQ ID NO: 205857 - RNA, 64 nt, Homo Sapiens
uucuguaggaagaaucaaaugaguucaauucaauaaauuugaaugaaacagaauucuaaaaugu

SEQ ID NO: 205858 - RNA, 64 nt, Homo Sapiens
ucaggucaacauuuuucagauuaauacuucuguuaaauuugauguaacauauggucccaauuua

SEQ ID NO: 205859 - RNA, 64 nt, Homo Sapiens
uaaaugaagaaauggauuuuguucaagauuuuuaaaauuugauuuguaaguuuuagauucuaag

SEQ ID NO: 205860 - RNA, 64 nt, Homo Sapiens
uugccguguagaauuuuuuuuagauauccauuguaaauuugaaacaaagaccgaucuguguaaa

SEQ ID NO: 205861 - RNA, 64 nt, Homo Sapiens
gcugcuagagugcagcauuugugacacguauuugaaauuugaaauuuccuucugcacuguauaa

SEQ ID NO: 205862 - RNA, 64 nt, Homo Sapiens
acaauuggaaaugccaaaaacaaaauuuguaguuaaauuugacuaauuugaccucaauugacua

SEQ ID NO: 205863 - RNA, 64 nt, Homo Sapiens
ucaauugacuacaaaauuugcaaaauuuguaguuaaauuugaccuguguucaauguagacaaug

SEQ ID NO: 205864 - RNA, 64 nt, Homo Sapiens
aauuguaauguuuaucugcugcuuuuuuuaaauaaaauuugacugaaaauguuuaauuggcauu

SEQ ID NO: 205865 - RNA, 64 nt, Homo Sapiens
cuauaguacaaaaugcauaaaccauguccccaggaaauuugaaaggaagcaggugcugaaugga

SEQ ID NO: 205866 - RNA, 64 nt, Homo Sapiens
uuuaauguaaugagauaccuuuguucauuuuuuuaaauuugaaauauacuuuaccugauccacu

SEQ ID NO: 205867 - RNA, 64 nt, Homo Sapiens
ccaucugauuggcugguaccgagagcuguggguaaaauuugaaaauuguauuuagaauaagaaa

SEQ ID NO: 205868 - RNA, 64 nt, Homo Sapiens
gcaagaggaaucucuugaaaacaggggcacacagaaauuugauuuguggccaaauuggaugaaa

SEQ ID NO: 205869 - RNA, 64 nt, Homo Sapiens
uuacgaguaaaguguaaugaguacuguggaaaccaaauuugaauacugcaaauuuguaggaguu

SEQ ID NO: 205870 - RNA, 64 nt, Homo Sapiens
uaauccagaaauauaccuaauaagauugagugaaaaauuugagucaaauaucuagggcauucac

SEQ ID NO: 205871 - RNA, 64 nt, Homo Sapiens
acaaaaugccacuugugugcuuuaaacaaaaaauaaauuugaucguaaaacaaaguaaaugaaa

SEQ ID NO: 205872 - RNA, 64 nt, Homo Sapiens
auauaaaguaaggagcaaagauuaucuuguagccaaauuugacacuauuuauuucuggaugguc

SEQ ID NO: 205873 - RNA, 64 nt, Homo Sapiens
caaaaaaaaaaaggcccaagaagaagaaaaugaaaaauuugaagauuugagagcaugaagauau

SEQ ID NO: 205874 - RNA, 64 nt, Homo Sapiens
uuuuccuaguuuaguaucaacauuuuagaaugucaaauuugaugccuugugaacaaguaauuuu

SEQ ID NO: 205875 - RNA, 64 nt, Homo Sapiens
ggguaaguugaugccauuuauaaauguuuuauugaaauuugauauuuaaugagaagccgguuaa

SEQ ID NO: 205876 - RNA, 64 nt, Homo Sapiens
cauaaauauguacuauuuuaauuaugucgaguguaaauuugacaucgcguugcauuuauuuuua

SEQ ID NO: 205877 - RNA, 64 nt, Homo Sapiens
cacuggcacacacaaaaaaguaguuuuaagcuuguuugcacaguucuuuuuuuccauuggaaau

SEQ ID NO: 205878 - RNA, 64 nt, Homo Sapiens
aagcagggagaauaaagauaauuguauuuuauguuuugcacacaaacgcagaauuuguauaacc

SEQ ID NO: 205879 - RNA, 64 nt, Homo Sapiens
aaccuccaucuugaagcuucuaugguucauagucuuugcacaggaaccugugguuuuaacaaac

SEQ ID NO: 205880 - RNA, 64 nt, Homo Sapiens
aaauguacugaaauaaucauuggaauauuugcauuuugcacaaugacugguaugauagcucuug

SEQ ID NO: 205881 - RNA, 64 nt, Homo Sapiens
cagcuguugcauuucuugcuuauucuguuuuguuuuugcacaucauaauggauuuuucuuagug

SEQ ID NO: 205882 - RNA, 64 nt, Homo Sapiens
aagguuuaugaauucaaguaauaauuagauuuuuuuugcacagacuuacuuaacuuccuuauug

SEQ ID NO: 205883 - RNA, 64 nt, Homo Sapiens
cccaggcaaaccaguaguggagguuuuacauuuguuugcacaucucaguauauuucuguugagg

SEQ ID NO: 205884 - RNA, 64 nt, Homo Sapiens
uugcacaucucaguauauuucuguugagguaaaguuugcacagucaucugacuucugaucaagc

SEQ ID NO: 205885 - RNA, 64 nt, Homo Sapiens
uguuuguguguguguguauguguguuugucuguauuugcacaugaaggcagaaguuucaagaug

SEQ ID NO: 205886 - RNA, 64 nt, Homo Sapiens
caccagcuaccucagggacaguguagcuccuacuuuugcacagggucggcgggaagcgugggag

SEQ ID NO: 205887 - RNA, 64 nt, Homo Sapiens
accuaauuaaccuuccuauuuccguugcaggcaguuugcacaauuuagauaaggacugagugcu

SEQ ID NO: 205888 - RNA, 64 nt, Homo Sapiens
gugaucaguuugcccagaauauaauauauuauuuuuugcacauuuauuuuaaaauuauaaauag

SEQ ID NO: 205889 - RNA, 64 nt, Homo Sapiens
cuagggcacuggacuuucuggcaugggggcuguguuugcacaaguuauuuucauguuaccugga

SEQ ID NO: 205890 - RNA, 64 nt, Homo Sapiens
cuaaggagggucuggccagaggaacagaccagcuuuugcacaaugaagcgcaagggaacaagug

SEQ ID NO: 205891 - RNA, 64 nt, Homo Sapiens
agccccagguugauucaaugccuugggaacuauuuuugcacauuggaagccucaaaaacagucc

SEQ ID NO: 205892 - RNA, 64 nt, Homo Sapiens
agccaauucuuuuuuaucccuuuuagaaguagaauuugcacacuuacuacaauugaggaguguc

SEQ ID NO: 205893 - RNA, 64 nt, Homo Sapiens
guaaagguauucguuaauccugugaaugguagcuuuugcacagaacuuccaaaagcaaaacaaa

SEQ ID NO: 205894 - RNA, 64 nt, Homo Sapiens
guugaucuuaaaacuaguugauuuaaagaguuuuuuugcacaacauuucaauuauauuugugaa

SEQ ID NO: 205895 - RNA, 64 nt, Homo Sapiens
ucugauuauauugaaagcaguuuaacaaauuguuuuugcacauaaauauaaucuucccauguua

SEQ ID NO: 205896 - RNA, 64 nt, Homo Sapiens
cuuauuuuucuguaaaauauaugugugagagggauuugcacacuauucacacaaucguuuuucu

SEQ ID NO: 205897 - RNA, 64 nt, Homo Sapiens
agaaaauuauuuuaaauuucuaaguuauaauaaauuugcacacagauaacaugcaugcuauuua

SEQ ID NO: 205898 - RNA, 64 nt, Homo Sapiens
gcuuagccuagcagucagugacuuacuugcacuuuuugcacauagauauaaaguaaaauuaugu

SEQ ID NO: 205899 - RNA, 64 nt, Homo Sapiens
aguaauacuuguauuuauuugaaacacugggcuguuugcacagcuccaacugugcaugcucaaa

SEQ ID NO: 205900 - RNA, 64 nt, Homo Sapiens
aauauaagguacaugccuauacagaacuuaacauuuugcacagaauauaucaaauauauuuuga

SEQ ID NO: 205901 - RNA, 64 nt, Homo Sapiens
cauauuauuguaauuuagguauguuuuguuuuguuuugcacaacuguaacccuguuguuacuuu

SEQ ID NO: 205902 - RNA, 64 nt, Homo Sapiens
uauacuaguuccuacuuagaacaaaaguaucaaguuugcacacaaguaaucugccagcugaccu

SEQ ID NO: 205903 - RNA, 64 nt, Homo Sapiens
uauguaaaauaucguguugauccuaaugcuuauauuugcacaagauuugccucagauauaucug

SEQ ID NO: 205904 - RNA, 64 nt, Homo Sapiens
uagugcugguuucagaaauugauugucugcugccuuugcacaucucuggcugcauugauggcca

SEQ ID NO: 205905 - RNA, 64 nt, Homo Sapiens
ugcaccagccuuuaaacacuuuucgugaagaaauuuugcacaguaguuuaaaucuuuuguuaau

SEQ ID NO: 205906 - RNA, 64 nt, Homo Sapiens
gaucuuagagaaaaugaauauuuaaauuuuaaaguuugcacauuucaucuuuguccuaacauga

SEQ ID NO: 205907 - RNA, 64 nt, Homo Sapiens
auuucuaaauuugauuauauucucugaugaucccuuugcacagaacuaugcuuaucucauguuu

SEQ ID NO: 205908 - RNA, 64 nt, Homo Sapiens
agucuguacauauuuuuguaccuuuuauguaaauuuugcacagaaauuuuuggcauaaguuuau

SEQ ID NO: 205909 - RNA, 64 nt, Homo Sapiens
uaguauguuuaggguucuguguucagauauuuuguuugcacacuacuuuuuaggaaacuuauaa

SEQ ID NO: 205910 - RNA, 64 nt, Homo Sapiens
uacuuaaaauaagcguccaguuauaaaaagccuauuugcacaacuuuuugggaauacuucuauu

SEQ ID NO: 205911 - RNA, 64 nt, Homo Sapiens
acacaauucagugguacuuggaauccuguuuuaauuugcacaaauuuaaauguagagagccccu

SEQ ID NO: 205912 - RNA, 64 nt, Homo Sapiens
uuccagauuucacaccuacaauaauuccaaaagguuugcacauuagaguuuguaacaaaauauu

SEQ ID NO: 205913 - RNA, 64 nt, Homo Sapiens
uuauuggauucuagagcaacgugcuaauaaguccuuugcacauaugauuuaagucucacacacu

SEQ ID NO: 205914 - RNA, 64 nt, Homo Sapiens
guaaaauuuuagguagagagaaaauguuuuucguuuugcacaugagaagagaugaucaauaacu

SEQ ID NO: 205915 - RNA, 64 nt, Homo Sapiens
accuguugcagaagcgguuaucuuucuuuuuuacuuugcacaucaguguuagccuuucccuauu

SEQ ID NO: 205916 - RNA, 64 nt, Homo Sapiens
ccuuucccuauuucagcacaaucuuagacucauauuugcacacuuuugugucgugaaguucuag

SEQ ID NO: 205917 - RNA, 64 nt, Homo Sapiens
aggaugagggaacaggcaaggaacaaaggcaaccuuugcacacucaccugagcccuggggaccc

SEQ ID NO: 205918 - RNA, 64 nt, Homo Sapiens
cccccugggaaugggggguacucacgcaccccgcuuugcacaccacagagugcccucacccacu

SEQ ID NO: 205919 - RNA, 64 nt, Homo Sapiens
gcuuuauuuucuagaggcucaugccauauuguauuuugcacacuaaaaccuagcuggaauaaua

SEQ ID NO: 205920 - RNA, 64 nt, Homo Sapiens
uuuaauagcuugcuauucaggaagugcuuuacuuuuugcacaauaaguucaguuauuagucugu

SEQ ID NO: 205921 - RNA, 64 nt, Homo Sapiens
cuaccuaaaauaaauaccaaagauaaugcauauuuuugcacaguggagcuuacacuuaaaagaa

SEQ ID NO: 205922 - RNA, 64 nt, Homo Sapiens
gugauguacucuuauauuuuucugggcuuuuccuuuugcacauuccaaaauucauuucauaaga

SEQ ID NO: 205923 - RNA, 64 nt, Homo Sapiens
uacacaauggcaguauuaacaagcauuuuaaaccuuugcacaugauauugaaccuguucaguuu

SEQ ID NO: 205924 - RNA, 64 nt, Homo Sapiens
ccaaaguggcacaacugcacaguucucagauuucuuugcacagauugauuuuuauugcggguuu

SEQ ID NO: 205925 - RNA, 64 nt, Homo Sapiens
cuuuccuaguuacucaaauugacuuucccccaccuuugcacaggugcuuucaauaguuuuaaaa

SEQ ID NO: 205926 - RNA, 64 nt, Homo Sapiens
uacgaugcucuaaucauauugcauuuaauuuuauuuugcacagugaccuuguagccacaugaga

SEQ ID NO: 205927 - RNA, 64 nt, Homo Sapiens
cuuccacccugacggccgcgccauggccaccaaguuugcacacuugaagcuguugcugcgacac

SEQ ID NO: 205928 - RNA, 64 nt, Homo Sapiens
ucuguuucuguuguuuuguuuuuaacaacuauacuuugcacacaugaaggucacugugguuugu

SEQ ID NO: 205929 - RNA, 64 nt, Homo Sapiens
ucacgaccugcaaggggccagcagggacguggccccacgccacacacaaccucuccacaugccu

SEQ ID NO: 205930 - RNA, 64 nt, Homo Sapiens
aagaugguggcggcacacgcucccucccgcagcaccacgccagcuggugcggcccccacucucu

SEQ ID NO: 205931 - RNA, 64 nt, Homo Sapiens
guaacagaccaggaggguggcggaggaacuccugccacgccacugugucaugaaggaaagugaa

SEQ ID NO: 205932 - RNA, 64 nt, Homo Sapiens
acguggucuuggagcuucugacuaguucagacugccacgccaaccccagaaaauaccccacaug

SEQ ID NO: 205933 - RNA, 64 nt, Homo Sapiens
agggagggccuccaugugcagacagcagccccuccaccuggaccaggcuggggccacacugcgg

SEQ ID NO: 205934 - RNA, 64 nt, Homo Sapiens
ccacuguuggccaccuugagaaugaccugagaggcaccuggagcaggucgugagauagaugugg

SEQ ID NO: 205935 - RNA, 64 nt, Homo Sapiens
ggaguuuuucuuaaacuugucugauaauaagaaucaccuggaguuaggagguggugguugcagu

SEQ ID NO: 205936 - RNA, 64 nt, Homo Sapiens
gcaaaacuccgucucaaaaguaaauaaaaauaaucaccuggaguuuguuaaaccauauggauuc

SEQ ID NO: 205937 - RNA, 64 nt, Homo Sapiens
uugaaaagagaaaagaaaaaccgcaucaggaauucaccuggaggcucagggcauggucucaucu

SEQ ID NO: 205938 - RNA, 64 nt, Homo Sapiens
aggcuugcaggcugccagacaucuuuccaccgcacaccuggaccccagaggcacauuccucucc

SEQ ID NO: 205939 - RNA, 64 nt, Homo Sapiens
uggggagacacaucugccuuaggggccagagggucaccuggagccuuaaaguggcuucaccugg

SEQ ID NO: 205940 - RNA, 64 nt, Homo Sapiens
ggccagagggucaccuggagccuuaaaguggcuucaccuggaggccgauccauccugaguggag

SEQ ID NO: 205941 - RNA, 64 nt, Homo Sapiens
ccccaugcucugcauuucuaggauauuucuaggacaccuggauuggcuccaucacaucagagug

SEQ ID NO: 205942 - RNA, 64 nt, Homo Sapiens
augcaaaaaauacucuuuuuugcuccuuuacccccaccuggacccugggcuauuggcugcuccc

SEQ ID NO: 205943 - RNA, 64 nt, Homo Sapiens
cccuucacacaccacagccaggaggggccuuucccaccuggagagaaacuuccagaccagcccc

SEQ ID NO: 205944 - RNA, 64 nt, Homo Sapiens
agccccucauaccacagccaagaggggccuuucucaccuggagagaaauuuccagaccaucccc

SEQ ID NO: 205945 - RNA, 64 nt, Homo Sapiens
ccucucacacaccacagccaggagaggccuuucccaccuggacagaaacuuccagaccagcccc

SEQ ID NO: 205946 - RNA, 64 nt, Homo Sapiens
agccccucucaccacagccaggagaggccuuuaccaccuggagagaagcuuccagaccagcccc

SEQ ID NO: 205947 - RNA, 64 nt, Homo Sapiens
agccccucacaccacagccaggagaggccuuucccaccuggagagaaacuuccagaccagcccc

SEQ ID NO: 205948 - RNA, 64 nt, Homo Sapiens
agccccucauaccacagccaagaggggccuuucucaccuggagagaaacuuccagaccagcccc

SEQ ID NO: 205949 - RNA, 64 nt, Homo Sapiens
agcccuucacaccacagccaggagaggccuuucccaccuggagagaaacuuccagaccagcccc

SEQ ID NO: 205950 - RNA, 64 nt, Homo Sapiens
agccccucucaccacagccaggagaggccguucccaccuggagggaaaauugcuccuuugaugg

SEQ ID NO: 205951 - RNA, 64 nt, Homo Sapiens
cuggugggauaugacuuagaaccagguggcuggucaccuggauguacagaagucuaacugguga

SEQ ID NO: 205952 - RNA, 64 nt, Homo Sapiens
ucucucucuuuccaauuauuuaaccaguuacuuccaccuggacauacgauaggaaauucaaacu

SEQ ID NO: 205953 - RNA, 64 nt, Homo Sapiens
uuuugugcuuuacaaaacugugaaggauuguggucaccuggaacaggucuccaaucuauguuag

SEQ ID NO: 205954 - RNA, 64 nt, Homo Sapiens
agggaaaaacaauuuuauuaccugcuuaaugguccaccuggaacuaaaagggauacuauuuucu

SEQ ID NO: 205955 - RNA, 64 nt, Homo Sapiens
cuguuacccguuagagagcugcucuuggcccucccaccuggagccgggaggaguggcaucuggg

SEQ ID NO: 205956 - RNA, 64 nt, Homo Sapiens
cccacaacaucagcucuguguucggaaccaggcccaccuggaauucucugucugauccugucca

SEQ ID NO: 205957 - RNA, 64 nt, Homo Sapiens
uugucaccuauuuauucacaacccuacagggggccaccuggagugaaaacucuaaauauaacag

SEQ ID NO: 205958 - RNA, 64 nt, Homo Sapiens
gcggcugcccaagcuugcagacagagcagaaaggcaccuggaaugcuacugucacaucuugauc

SEQ ID NO: 205959 - RNA, 64 nt, Homo Sapiens
cuuucuuguugaauccucccaccagaccaggcaccaccuggacaggggucggggggacuggggc

SEQ ID NO: 205960 - RNA, 64 nt, Homo Sapiens
caggccaggcccggcccggcccauugaccguggccaccuggacccaugaggaggccaacccuug

SEQ ID NO: 205961 - RNA, 64 nt, Homo Sapiens
uuuuuaguacuugaugacucuaauuacaugaaugcaccuggaaugacauuuguaacagaagacg

SEQ ID NO: 205962 - RNA, 64 nt, Homo Sapiens
gaaguacucaggauagugccuggcauguaggaagcaccuggaaaauauucgcugugauuaccau

SEQ ID NO: 205963 - RNA, 64 nt, Homo Sapiens
ugacucacagguaccuccaaccacaggacacauccaccuggaugucagacucgcgucccacugc

SEQ ID NO: 205964 - RNA, 64 nt, Homo Sapiens
ccacaguccuccauuaggcuucccuagcuuuuggcaccuggaugccucucucuccagagccguu

SEQ ID NO: 205965 - RNA, 64 nt, Homo Sapiens
cagggauugcucacuccaggucaacccacaucaccaccuggaauaauaaaguaaaaugugaaac

SEQ ID NO: 205966 - RNA, 64 nt, Homo Sapiens
ccuggacaggcaccuccaggcgccuacccuggagcaccuggagcuuaucccggagcaccugcac

SEQ ID NO: 205967 - RNA, 64 nt, Homo Sapiens
ccuggagcaccuggagcuuaucccggagcaccugcaccuggagucuacccagggccacccagcg

SEQ ID NO: 205968 - RNA, 64 nt, Homo Sapiens
gcacggcggccuaccuccacaccacaaccaccuucaccuggaugugcagccccuuccuggugag

SEQ ID NO: 205969 - RNA, 64 nt, Homo Sapiens
ucucugcaacuaugcccccgaugaggaccaagggcaccuggaggacagcuggaccgguaucugc

SEQ ID NO: 205970 - RNA, 64 nt, Homo Sapiens
uggaagugcaaccacccaaugucucuggaagugccaccuggaagugccaccuggaagugucucu

SEQ ID NO: 205971 - RNA, 64 nt, Homo Sapiens
acccaaugucucuggaagugccaccuggaagugccaccuggaagugucucuggaagagcaccca

SEQ ID NO: 205972 - RNA, 64 nt, Homo Sapiens
cagggcaccagcugcuggggacuugacucaccgucaccuggaagccucugucggccuccucccg

SEQ ID NO: 205973 - RNA, 64 nt, Homo Sapiens
uccgugcccucaccccagccggggccucuacccacaccuggaccagccagcaggguggaugcaa

SEQ ID NO: 205974 - RNA, 64 nt, Homo Sapiens
ugcuauuuccgaauaucugaauauugauuucuaacaccuggaugaggcugugaccgaucaacuu

SEQ ID NO: 205975 - RNA, 64 nt, Homo Sapiens
uaaacuaauuccauugauuguuacuuaaauuuuccaccuggaaucauggauuuaaaauuucccc

SEQ ID NO: 205976 - RNA, 64 nt, Homo Sapiens
gcuagcuguaggaguuuuuuugauagcccaguggcaccuggaaugccagugaaacagaaccgcu

SEQ ID NO: 205977 - RNA, 64 nt, Homo Sapiens
ucuuuugguuccccaguccaaaacacagucauuucaccuggacuauuucaaucauuacacaggu

SEQ ID NO: 205978 - RNA, 64 nt, Homo Sapiens
agggauucauguggaguuucaucgaugcuggcuccaccuggaccucaccuuuauggaacugcug

SEQ ID NO: 205979 - RNA, 64 nt, Homo Sapiens
cugcuggagggugugcaccuuaccuggccgccuucaccuggaugccggugcuuugcacuaucuc

SEQ ID NO: 205980 - RNA, 64 nt, Homo Sapiens
ccucacugagauccauguaaggggcuccucuucccaccuggaacuugugaguggggacccauga

SEQ ID NO: 205981 - RNA, 64 nt, Homo Sapiens
aggcccaggaccauggcuggggaggauaugucagcaccuggaaguggagugcaggcugcagcgc

SEQ ID NO: 205982 - RNA, 64 nt, Homo Sapiens
ggcugagacugggcugacaucuagaaucaccugccaccuggagccucaguaaaaugccuggggu

SEQ ID NO: 205983 - RNA, 64 nt, Homo Sapiens
uugccugguguguguggcuccccucuucacugggcaccuggauccaggcccaccugugucccug

SEQ ID NO: 205984 - RNA, 54 nt, Homo Sapiens
ugcgcaguggcaugaaguagacgccaccuggaugccccauccaccgcaugcggu

SEQ ID NO: 205985 - RNA, 64 nt, Homo Sapiens
auccagcgagcccuccccacccacccacgguccucaccuggagcuguggccuggcuguggaggg

SEQ ID NO: 205986 - RNA, 64 nt, Homo Sapiens
acuuucugcugcgcaucaacgcggcuaccagccccaccuggaggggugaccaagcuggugaacc

SEQ ID NO: 205987 - RNA, 64 nt, Homo Sapiens
cgcacuaugaggcacugcggucuucguggagcugcaccuggaggcaaggccgcugucgacuacu

SEQ ID NO: 205988 - RNA, 64 nt, Homo Sapiens
ccccaggagcugggagaggccacaagcccagggacaccuggagcgcagacuggagugaugcggc

SEQ ID NO: 205989 - RNA, 64 nt, Homo Sapiens
aucaggaugggaccauguuucccaaacccguguccaccuggaacuuuaguaaugaauuaucauu

SEQ ID NO: 205990 - RNA, 64 nt, Homo Sapiens; identical to SEQ ID NO: 199877

SEQ ID NO: 205991 - RNA, 64 nt, Homo Sapiens; identical to SEQ ID NO: 199878

SEQ ID NO: 205992 - RNA, 64 nt, Homo Sapiens; identical to SEQ ID NO: 199879

SEQ ID NO: 205993 - RNA, 64 nt, Homo Sapiens; identical to SEQ ID NO: 199880

SEQ ID NO: 205994 - RNA, 64 nt, Homo Sapiens; identical to SEQ ID NO: 199881

SEQ ID NO: 205995 - RNA, 64 nt, Homo Sapiens; identical to SEQ ID NO: 199882

SEQ ID NO: 205996 - RNA, 64 nt, Homo Sapiens; identical to SEQ ID NO: 199883

SEQ ID NO: 205997 - RNA, 64 nt, Homo Sapiens; identical to SEQ ID NO: 199884

SEQ ID NO: 205998 - RNA, 64 nt, Homo Sapiens; identical to SEQ ID NO: 199885

SEQ ID NO: 205999 - RNA, 64 nt, Homo Sapiens; identical to SEQ ID NO: 199886

SEQ ID NO: 206000 - RNA, 64 nt, Homo Sapiens; identical to SEQ ID NO: 199887

SEQ ID NO: 206001 - RNA, 64 nt, Homo Sapiens; identical to SEQ ID NO: 199888

SEQ ID NO: 206002 - RNA, 64 nt, Homo Sapiens; identical to SEQ ID NO: 199889

SEQ ID NO: 206003 - RNA, 64 nt, Homo Sapiens; identical to SEQ ID NO: 199890

SEQ ID NO: 206004 - RNA, 64 nt, Homo Sapiens; identical to SEQ ID NO: 199891

SEQ ID NO: 206005 - RNA, 64 nt, Homo Sapiens; identical to SEQ ID NO: 199892

SEQ ID NO: 206006 - RNA, 64 nt, Homo Sapiens; identical to SEQ ID NO: 199893

SEQ ID NO: 206007 - RNA, 64 nt, Homo Sapiens; identical to SEQ ID NO: 199894

SEQ ID NO: 206008 - RNA, 64 nt, Homo Sapiens; identical to SEQ ID NO: 199895

SEQ ID NO: 206009 - RNA, 64 nt, Homo Sapiens; identical to SEQ ID NO: 199896

SEQ ID NO: 206010 - RNA, 64 nt, Homo Sapiens; identical to SEQ ID NO: 199897

SEQ ID NO: 206011 - RNA, 64 nt, Homo Sapiens
ggcaauaaauuuugguagacuaauacaguacagcuagacccagaaauuuggaaggcuguagauc

SEQ ID NO: 206012 - RNA, 64 nt, Homo Sapiens
cguauaaaauauuuuaauuuucuuguauuucauuuagacccaagaacaugcugaccaauguguu

SEQ ID NO: 206013 - RNA, 64 nt, Homo Sapiens
uuggcgugccacccccacaaccccugaggagguguagacccagucugagagccgcaagcacuga

SEQ ID NO: 206014 - RNA, 64 nt, Homo Sapiens
cucgggggauuggggggacuggggaggcgcagccuagacccaauugcuugcccccaugaggcua

SEQ ID NO: 206015 - RNA, 64 nt, Homo Sapiens
caaguucuuugggccaggcaaaguggggaggccauagacccaaaacucggggcaacacagugga

SEQ ID NO: 206016 - RNA, 64 nt, Homo Sapiens
uaagauauuuaaaaagguauaacucuaauggggauagacccacucacuguaaguaaacuuuggu

SEQ ID NO: 206017 - RNA, 64 nt, Homo Sapiens
acuagacuucccaaauaauuuuaauauauacuuuuagacccacagugaaaccacagaaggucau

SEQ ID NO: 206018 - RNA, 64 nt, Homo Sapiens
cacccucagagauucugauuagguagaucuggaguagacccagaaauacacaguuuaaagaaaa

SEQ ID NO: 206019 - RNA, 64 nt, Homo Sapiens
cuuguggaaguaucaugugugauguaaaccuuuuuagacccaaacaguauauguuuuaaacuuu

SEQ ID NO: 206020 - RNA, 64 nt, Homo Sapiens
gauauauuuuugauaauuuuagucacaauuaguauagacccaucugcuuaauguaaauauaaac

SEQ ID NO: 206021 - RNA, 64 nt, Homo Sapiens
ugggacucuggaaucuucuuccaugggggcuggaggggggcagcuguugggacuggcucagagc

SEQ ID NO: 206022 - RNA, 64 nt, Homo Sapiens
ggagcugggagccccgucucuggaggggagggauggggggcacauucuccaggagcagggaggg

SEQ ID NO: 206023 - RNA, 64 nt, Homo Sapiens
cucugguaccugugugcgucgauuuuggggccguggggggcaguucugggcaucccgggugggg

SEQ ID NO: 206024 - RNA, 64 nt, Homo Sapiens
cucugccagcccucggccacacucagugaucccuggggggcaggcaaaaacgaccaccuccagg

SEQ ID NO: 206025 - RNA, 64 nt, Homo Sapiens
cuucucucagaaucagcgagcccagcuguaggguggggggcaggcucccccauggcaggguccu

SEQ ID NO: 206026 - RNA, 64 nt, Homo Sapiens
cccaugccucagccucauacagaugugccaucauggggggcauggguggagcagaggggcuccc

SEQ ID NO: 206027 - RNA, 64 nt, Homo Sapiens
acuuggggucuagaccaugguggugccagccuggggggggcaguggcccucagcucugcccgcu

SEQ ID NO: 206028 - RNA, 64 nt, Homo Sapiens
gggacaugaggugagagguauccuggccgagggcggggggcagcggggggucucccuccggacc

SEQ ID NO: 206029 - RNA, 64 nt, Homo Sapiens
aaggacuagauuuguuuaagaagaaaaaugaaaccagacccagaucaauauuuuaggauacuag

SEQ ID NO: 206030 - RNA, 64 nt, Homo Sapiens
ggugggagaggagguagauggggaagaaauaccccagacccaacaaaccuccagccagaaagcc

SEQ ID NO: 206031 - RNA, 64 nt, Homo Sapiens
cguccaggccgagcgcagacuguuuaggacucagcagacccagcaagaggcaucugcccuuucc

SEQ ID NO: 206032 - RNA, 64 nt, Homo Sapiens
cagggcugggcugugcaccugccucccacugacccagacccacuuccuccagagaggccucucu

SEQ ID NO: 206033 - RNA, 64 nt, Homo Sapiens
ucaaagaugccccauuccuucauugggcacaguccagacccaagugccugagggcaguacccuc

SEQ ID NO: 206034 - RNA, 64 nt, Homo Sapiens
acccccgaggggagggcaggcacucccugggacacagacccaggcagaccccuuugagagacgc

SEQ ID NO: 206035 - RNA, 64 nt, Homo Sapiens
cuguuccuuggaaccuagagacaucucgcugagccagacccacugggcucugcccuuagucaug

SEQ ID NO: 206036 - RNA, 64 nt, Homo Sapiens
uuguugccuauugugauaaaacauauuccaaaaccagacccaucgaaauuaaacacaaauggua

SEQ ID NO: 206037 - RNA, 64 nt, Homo Sapiens
aggaugacagacagggacgaagcagagaccucuacagacccaagucaccaaguggagccuuuuu

SEQ ID NO: 206038 - RNA, 64 nt, Homo Sapiens
cuuucugacaaaggagccugcacauuugggugagcagacccaagcuguuuacagcucuuucuug

SEQ ID NO: 206039 - RNA, 64 nt, Homo Sapiens
ucccagcgcgcuucugggcuacagacccaaaagccagacccaggggggccaaacgaggaaggac

SEQ ID NO: 206040 - RNA, 64 nt, Homo Sapiens
agccagacccaggucccagcaacgaggaaggacacagacccaaaaaugcggacaauuggggcca

SEQ ID NO: 206041 - RNA, 64 nt, Homo Sapiens
ucaggcccagccaaagcccccuccucagucuccacagacccacaugugagcagcccaggcccau

SEQ ID NO: 206042 - RNA, 64 nt, Homo Sapiens
agagguaggugcucccucaggaucaggugcccugcagacccagagccaguuccuauccccuaac

SEQ ID NO: 206043 - RNA, 64 nt, Homo Sapiens
gaguuguggugaggccaccaggcugaagucagcucagacccagaccucccugcuuaggccacuc

SEQ ID NO: 206044 - RNA, 64 nt, Homo Sapiens
gccugugcuuguguuugcugcuaauguccagcuacagacccagaggauaagccacugggcacug

SEQ ID NO: 206045 - RNA, 64 nt, Homo Sapiens
ccagaccucugacacauuaggcccucgucuagagcagacccagcgcaggggaugguguggucaa

SEQ ID NO: 206046 - RNA, 64 nt, Homo Sapiens
caugcugugauaccggcggagugaccuccccuuccagacccagcgacacccacagcugcagcag

SEQ ID NO: 206047 - RNA, 64 nt, Homo Sapiens
cucucccugaaucuacccacccccagucccccaccagacccaccccccaaagacccuucaaccu

SEQ ID NO: 206048 - RNA, 64 nt, Homo Sapiens
guauuuucauaccagacuaucagccaggggaccucagacccaggucacuucucaggagcaggaa

SEQ ID NO: 206049 - RNA, 64 nt, Homo Sapiens
uguggguggggggcacccuccacgugcacacacacagacccacaaggcggggaugcucccacgc

SEQ ID NO: 206050 - RNA, 64 nt, Homo Sapiens
acaaggcggggaugcucccauccuccauggggcacagacccaacggggagacaccccaccuccc

SEQ ID NO: 206051 - RNA, 64 nt, Homo Sapiens
cuggaaguuucugccucacucagaaugggcaggacagacccacugacuggacuucagagucugg

SEQ ID NO: 206052 - RNA, 64 nt, Homo Sapiens
cacagcccauggguggacucggcccccugggguucagacccagguccguucggccuagugauga

SEQ ID NO: 206053 - RNA, 64 nt, Homo Sapiens
augccuggagaggucaggauggcuccugucuucccagacccaccggguuuuaggaggaaggcuu

SEQ ID NO: 206054 - RNA, 64 nt, Homo Sapiens
gcccugcccuugucucugagccaggcccagaagacagacccacacugggggcucccccauauuc

SEQ ID NO: 206055 - RNA, 64 nt, Homo Sapiens
ucuccuccaccuugacaaaacuccaagugauaaccagacccaucaaggcauauguauaaccaaa

SEQ ID NO: 206056 - RNA, 64 nt, Homo Sapiens
gucuggaagcuuaauguugauaaugguccuaacccagacccagggugauacccucaccuugggg

SEQ ID NO: 206057 - RNA, 64 nt, Homo Sapiens
gaaacagacccggacagacagacacagccugaaacagacccagacaaacagacagacagacaca

SEQ ID NO: 206058 - RNA, 64 nt, Homo Sapiens
cccagacaaacagacagacagacacagccugaaacagacccagacagacagacagacagccuga

SEQ ID NO: 206059 - RNA, 64 nt, Homo Sapiens
aacagacccagacagacagacagacagccugaaacagacccagacacagccugaaacagauccg

SEQ ID NO: 206060 - RNA, 64 nt, Homo Sapiens
cagauccggacagacagacagaaacagccugaaacagacccagacagacagacagacacagccu

SEQ ID NO: 206061 - RNA, 64 nt, Homo Sapiens
gaaacagaccuagacagacagacacagauugaaacagacccagacaaacagacagacacagccu

SEQ ID NO: 206062 - RNA, 64 nt, Homo Sapiens
cagacccagacaaacagacagacacagccugaaacagacccagacacagccugaaacagacccg

SEQ ID NO: 206063 - RNA, 64 nt, Homo Sapiens
cagacccggacagacagacagacacagccugaaacagacccagacagacagacagacacagccu

SEQ ID NO: 206064 - RNA, 64 nt, Homo Sapiens
cagacccagacagacagacagacacagccugaaacagacccagacagacagaccgacgcagccu

SEQ ID NO: 206065 - RNA, 64 nt, Homo Sapiens
gguccaaugccaccuagacuagccccuccucccucagacccagcgacccagagguccagguccc

SEQ ID NO: 206066 - RNA, 64 nt, Homo Sapiens
gguccaggucccagccccucaaccccuccuuccccagacccagaacucagagguccaggccccc

SEQ ID NO: 206067 - RNA, 64 nt, Homo Sapiens
gguccaggcccccaaccccuagccccuccucccucagacccaggcccaggaguccagacccccc

SEQ ID NO: 206068 - RNA, 64 nt, Homo Sapiens
aguccagaccccccagccccagccccuccucccucagacccaggucccucagacccaggagucc

SEQ ID NO: 206069 - RNA, 64 nt, Homo Sapiens
aguccagccccuccucccucagccccuccucccucagacccaggcccaggaguccagacccccc

SEQ ID NO: 206070 - RNA, 64 nt, Homo Sapiens
aguccagaccccccagccccagccccuccucccucagacccaggaaccaaggguacagaucccc

SEQ ID NO: 206071 - RNA, 64 nt, Homo Sapiens
agccccaguccccagcauccagccccuccucccucagacccaggacccgggaguccaggccccc

SEQ ID NO: 206072 - RNA, 64 nt, Homo Sapiens
aguccaggcccccagccccuagccccuccucccucagacccagggacccaggaguccaggcccc

SEQ ID NO: 206073 - RNA, 64 nt, Homo Sapiens
acuccaggcccccagccccuaguaccuccucccucagacccaggacccaggauucccgggcccc

SEQ ID NO: 206074 - RNA, 64 nt, Homo Sapiens
auucccgggccccaguaccuagcuccuccucccucagacccaggauccaggagucuaguccucc

SEQ ID NO: 206075 - RNA, 64 nt, Homo Sapiens
cuuagaacaaaaggaggaguaggccugcacuucucagacccagauuggaacugacagcugugug

SEQ ID NO: 206076 - RNA, 64 nt, Homo Sapiens
gugggucuucccgugggaugucuucccaguaccccagacccacuugcgggauucagcaccaggc

SEQ ID NO: 206077 - RNA, 64 nt, Homo Sapiens
cauagaauguuggagcaaaagaaaugguugaugucagacccagauagaaacacacaggaacaga

SEQ ID NO: 206078 - RNA, 64 nt, Homo Sapiens
cauagaauguuugaacaaaggaaguggucgauuccagacccagauggaaacccguagauacaga

SEQ ID NO: 206079 - RNA, 64 nt, Homo Sapiens; identical to SEQ ID NO: 206021

SEQ ID NO: 206080 - RNA, 64 nt, Homo Sapiens; identical to SEQ ID NO: 206022

SEQ ID NO: 206081 - RNA, 64 nt, Homo Sapiens; identical to SEQ ID NO: 206023

SEQ ID NO: 206082 - RNA, 64 nt, Homo Sapiens; identical to SEQ ID NO: 206024

SEQ ID NO: 206083 - RNA, 64 nt, Homo Sapiens; identical to SEQ ID NO: 206025

SEQ ID NO: 206084 - RNA, 64 nt, Homo Sapiens; identical to SEQ ID NO: 206026

SEQ ID NO: 206085 - RNA, 64 nt, Homo Sapiens; identical to SEQ ID NO: 206027

SEQ ID NO: 206086 - RNA, 64 nt, Homo Sapiens; identical to SEQ ID NO: 206028

SEQ ID NO: 206087 - RNA, 64 nt, Homo Sapiens; identical to SEQ ID NO: 206029

SEQ ID NO: 206088 - RNA, 64 nt, Homo Sapiens; identical to SEQ ID NO: 206030

SEQ ID NO: 206089 - RNA, 64 nt, Homo Sapiens; identical to SEQ ID NO: 206031

SEQ ID NO: 206090 - RNA, 64 nt, Homo Sapiens; identical to SEQ ID NO: 206032

SEQ ID NO: 206091 - RNA, 64 nt, Homo Sapiens; identical to SEQ ID NO: 206033

SEQ ID NO: 206092 - RNA, 64 nt, Homo Sapiens; identical to SEQ ID NO: 206034

SEQ ID NO: 206093 - RNA, 64 nt, Homo Sapiens; identical to SEQ ID NO: 206035

SEQ ID NO: 206094 - RNA, 64 nt, Homo Sapiens; identical to SEQ ID NO: 206036

SEQ ID NO: 206095 - RNA, 64 nt, Homo Sapiens; identical to SEQ ID NO: 206037

SEQ ID NO: 206096 - RNA, 64 nt, Homo Sapiens; identical to SEQ ID NO: 206038

SEQ ID NO: 206097 - RNA, 64 nt, Homo Sapiens; identical to SEQ ID NO: 206039

SEQ ID NO: 206098 - RNA, 64 nt, Homo Sapiens; identical to SEQ ID NO: 206040

SEQ ID NO: 206099 - RNA, 64 nt, Homo Sapiens; identical to SEQ ID NO: 206041

SEQ ID NO: 206100 - RNA, 64 nt, Homo Sapiens; identical to SEQ ID NO: 206042

SEQ ID NO: 206101 - RNA, 64 nt, Homo Sapiens; identical to SEQ ID NO: 206043

SEQ ID NO: 206102 - RNA, 64 nt, Homo Sapiens; identical to SEQ ID NO: 206044

SEQ ID NO: 206103 - RNA, 64 nt, Homo Sapiens; identical to SEQ ID NO: 206045

SEQ ID NO: 206104 - RNA, 64 nt, Homo Sapiens; identical to SEQ ID NO: 206046

SEQ ID NO: 206105 - RNA, 64 nt, Homo Sapiens; identical to SEQ ID NO: 206047

SEQ ID NO: 206106 - RNA, 64 nt, Homo Sapiens; identical to SEQ ID NO: 206048

SEQ ID NO: 206107 - RNA, 64 nt, Homo Sapiens; identical to SEQ ID NO: 206049

SEQ ID NO: 206108 - RNA, 64 nt, Homo Sapiens; identical to SEQ ID NO: 206050

SEQ ID NO: 206109 - RNA, 64 nt, Homo Sapiens; identical to SEQ ID NO: 206051

SEQ ID NO: 206110 - RNA, 64 nt, Homo Sapiens; identical to SEQ ID NO: 206052

SEQ ID NO: 206111 - RNA, 64 nt, Homo Sapiens; identical to SEQ ID NO: 206053

SEQ ID NO: 206112 - RNA, 64 nt, Homo Sapiens; identical to SEQ ID NO: 206054

SEQ ID NO: 206113 - RNA, 64 nt, Homo Sapiens; identical to SEQ ID NO: 206055

SEQ ID NO: 206114 - RNA, 64 nt, Homo Sapiens; identical to SEQ ID NO: 206056

SEQ ID NO: 206115 - RNA, 64 nt, Homo Sapiens; identical to SEQ ID NO: 206057

SEQ ID NO: 206116 - RNA, 64 nt, Homo Sapiens; identical to SEQ ID NO: 206058

SEQ ID NO: 206117 - RNA, 64 nt, Homo Sapiens; identical to SEQ ID NO: 206059

SEQ ID NO: 206118 - RNA, 64 nt, Homo Sapiens; identical to SEQ ID NO: 206060

SEQ ID NO: 206119 - RNA, 64 nt, Homo Sapiens; identical to SEQ ID NO: 206061

SEQ ID NO: 206120 - RNA, 64 nt, Homo Sapiens; identical to SEQ ID NO: 206062

SEQ ID NO: 206121 - RNA, 64 nt, Homo Sapiens; identical to SEQ ID NO: 206063

SEQ ID NO: 206122 - RNA, 64 nt, Homo Sapiens; identical to SEQ ID NO: 206064

SEQ ID NO: 206123 - RNA, 64 nt, Homo Sapiens; identical to SEQ ID NO: 206065

SEQ ID NO: 206124 - RNA, 64 nt, Homo Sapiens; identical to SEQ ID NO: 206066

SEQ ID NO: 206125 - RNA, 64 nt, Homo Sapiens; identical to SEQ ID NO: 206067

SEQ ID NO: 206126 - RNA, 64 nt, Homo Sapiens; identical to SEQ ID NO: 206068

SEQ ID NO: 206127 - RNA, 64 nt, Homo Sapiens; identical to SEQ ID NO: 206069

SEQ ID NO: 206128 - RNA, 64 nt, Homo Sapiens; identical to SEQ ID NO: 206070

SEQ ID NO: 206129 - RNA, 64 nt, Homo Sapiens; identical to SEQ ID NO: 206071

SEQ ID NO: 206130 - RNA, 64 nt, Homo Sapiens; identical to SEQ ID NO: 206072

SEQ ID NO: 206131 - RNA, 64 nt, Homo Sapiens; identical to SEQ ID NO: 206073

SEQ ID NO: 206132 - RNA, 64 nt, Homo Sapiens; identical to SEQ ID NO: 206074

SEQ ID NO: 206133 - RNA, 64 nt, Homo Sapiens; identical to SEQ ID NO: 206075

SEQ ID NO: 206134 - RNA, 64 nt, Homo Sapiens; identical to SEQ ID NO: 206076

SEQ ID NO: 206135 - RNA, 64 nt, Homo Sapiens; identical to SEQ ID NO: 206077

SEQ ID NO: 206136 - RNA, 64 nt, Homo Sapiens; identical to SEQ ID NO: 206078

SEQ ID NO: 206137 - RNA, 64 nt, Homo Sapiens
acuaugcaggcaagacaccauaaaaguuuaauuccuuacagaagaaccaguggaagaauuuaaa

SEQ ID NO: 206138 - RNA, 64 nt, Homo Sapiens
gagcacuuggauuauggaucugaauagagaaaugcuuacagauaaucauuagcccacauaccag

SEQ ID NO: 206139 - RNA, 64 nt, Homo Sapiens
ugcucacagucucacaucugguuggggugggcuccuuacagaacacgcuuucacaguuacccua

SEQ ID NO: 206140 - RNA, 64 nt, Homo Sapiens
aauauaucuauauuauuguauuuaaaauguguuucuuacagacugcauguaguuggguauaauu

SEQ ID NO: 206141 - RNA, 64 nt, Homo Sapiens
uaauaaucauuauaugcagaccuuccucuuucaucuuacagaggcuuagugaggcucagaugag

SEQ ID NO: 206142 - RNA, 64 nt, Homo Sapiens
cuuuuagaaagaaccaggagaacaaccaaagcagcuuacagacgccugaacggagaaugaagug

SEQ ID NO: 206143 - RNA, 64 nt, Homo Sapiens
aauaauuauaucugacugauccuaacaagacuaacuuacagaaauuuuuagugcuaucaucauu

SEQ ID NO: 206144 - RNA, 64 nt, Homo Sapiens
ccuaugauauagaauucauauuuaacagauaaaacuuacagaaagaaagaacaaccuuaaaacu

SEQ ID NO: 206145 - RNA, 64 nt, Homo Sapiens
caucuggcuucauucuucuuuauucacauugggucuuacagaacuaauuccuguuguauauguc

SEQ ID NO: 206146 - RNA, 64 nt, Homo Sapiens
uaugaagagguaucuguuuaguuaaaagcaaacacuuacagaauagauaugacauuuauucaaa

SEQ ID NO: 206147 - RNA, 64 nt, Homo Sapiens
uuuggaucuuuccagggauagugaacagaguuaccuuacagaguuuuuaaaauguuucugaaaa

SEQ ID NO: 206148 - RNA, 64 nt, Homo Sapiens
cuuuaaacacgugugcauacuuuucaaggaaaaucuuacagaaccuauuucagcagcaaaaacu

SEQ ID NO: 206149 - RNA, 64 nt, Homo Sapiens
acacugcaggaagucaaacaauccccgagcaggccuuacagaccccaagcaccccuuuuauccc

SEQ ID NO: 206150 - RNA, 64 nt, Homo Sapiens
ggagccuccaucaccggaacguagagagccgcuccuuacagaaucugagaggaaccaacuccag

SEQ ID NO: 206151 - RNA, 64 nt, Homo Sapiens; identical to SEQ ID NO: 94836

SEQ ID NO: 206152 - RNA, 64 nt, Homo Sapiens; identical to SEQ ID NO: 94837

SEQ ID NO: 206153 - RNA, 64 nt, Homo Sapiens; identical to SEQ ID NO: 94838

SEQ ID NO: 206154 - RNA, 64 nt, Homo Sapiens; identical to SEQ ID NO: 94839

SEQ ID NO: 206155 - RNA, 64 nt, Homo Sapiens; identical to SEQ ID NO: 94840

SEQ ID NO: 206156 - RNA, 64 nt, Homo Sapiens; identical to SEQ ID NO: 94841

SEQ ID NO: 206157 - RNA, 64 nt, Homo Sapiens; identical to SEQ ID NO: 94842

SEQ ID NO: 206158 - RNA, 52 nt, Homo Sapiens; identical to SEQ ID NO: 94843

SEQ ID NO: 206159 - RNA, 64 nt, Homo Sapiens; identical to SEQ ID NO: 94844

SEQ ID NO: 206160 - RNA, 64 nt, Homo Sapiens; identical to SEQ ID NO: 94845

SEQ ID NO: 206161 - RNA, 64 nt, Homo Sapiens; identical to SEQ ID NO: 94846

SEQ ID NO: 206162 - RNA, 64 nt, Homo Sapiens; identical to SEQ ID NO: 94847

SEQ ID NO: 206163 - RNA, 64 nt, Homo Sapiens; identical to SEQ ID NO: 94848

SEQ ID NO: 206164 - RNA, 64 nt, Homo Sapiens; identical to SEQ ID NO: 94849

SEQ ID NO: 206165 - RNA, 64 nt, Homo Sapiens
ggaucuagaaagcaacuuggugaucagaauauuuuguaaugaaacuuuccuuuguaagauuauu

SEQ ID NO: 206166 - RNA, 64 nt, Homo Sapiens
gagcagaaaaucaaucacuuguaaagguccccaauguaaugacuugggaacuaacacgugccuc

SEQ ID NO: 206167 - RNA, 64 nt, Homo Sapiens
auguuugccagucaaauggcuuuucuuuugaaacuguaaugaaucuggugagucaaauagggug

SEQ ID NO: 206168 - RNA, 64 nt, Homo Sapiens
uuuucuacaacauguuuuauugugcuaaccuaacuguaaugaccuguggcauguugguuuuuua

SEQ ID NO: 206169 - RNA, 64 nt, Homo Sapiens
ccuuuuuauuuguagcagcauuaugagcuuccauuguaaugauucccacggugcuuauuauugu

SEQ ID NO: 206170 - RNA, 64 nt, Homo Sapiens
accguggagacuauguauuuuagugucuggaguuuguaaugagcgacuaccggguuuuuaaaag

SEQ ID NO: 206171 - RNA, 64 nt, Homo Sapiens
aagaaagacugggauuaauccagguugcauuuauuguaaugaaaucuacugaucaaugccccug

SEQ ID NO: 206172 - RNA, 64 nt, Homo Sapiens
ggagagaggccugagucaccgcgguuagccagccuguaaugagaugcuccucaacuuaggcugu

SEQ ID NO: 206173 - RNA, 64 nt, Homo Sapiens
ggucucuaaaaaagaaaaaaaaaaauaaaacugauguaaugaauauauaauuacaacaaaagag

SEQ ID NO: 206174 - RNA, 64 nt, Homo Sapiens
auagaccaagguaaaaaucucaaagaaugagacuuguaaugagaaugccacaaacuugaauacc

SEQ ID NO: 206175 - RNA, 64 nt, Homo Sapiens
aauuuuauuuuugacagacuggauggaaugaguguguaaugauugauaaagguuguaaauuuua

SEQ ID NO: 206176 - RNA, 64 nt, Homo Sapiens
gagaguaaauggagggcauuauuaauaauuaucuuguaaugaacuuaaaucuggacuguuccag

SEQ ID NO: 206177 - RNA, 64 nt, Homo Sapiens
gcccaucaaauccugaguguuaaauguauagcauuguaaugagaucacugauguuuguuccugu

SEQ ID NO: 206178 - RNA, 64 nt, Homo Sapiens
uaccuuauccuuagaaguagugaguacuaaagauuguaaugaguaagaucuuuaauacuuucca

SEQ ID NO: 206179 - RNA, 64 nt, Homo Sapiens
uaaccaccacuguguaguugcagaaagcccuagauguaaugauaguguaaucauuuugaauugu

SEQ ID NO: 206180 - RNA, 64 nt, Homo Sapiens
aggaaguuuucaaucagugugaucaguuugauucuguaaugagcacagcaccuaauauuuugag

SEQ ID NO: 206181 - RNA, 64 nt, Homo Sapiens
ucaaagaauucacacaggagagaaagcacaugaauguaaugaauguggaaaagcuuucagucaa

SEQ ID NO: 206182 - RNA, 64 nt, Homo Sapiens
ucacaaaaugcauaggaaagagaaaucguaugaauguaaugaguaugagggcaguuucagucau

SEQ ID NO: 206183 - RNA, 64 nt, Homo Sapiens
caucagagcauucauaccaaagagaacucaugaauguaaugaagaugggaagauauuuaucaaa

SEQ ID NO: 206184 - RNA, 64 nt, Homo Sapiens
accugagaagacacacuuggagaaaccuuuuggguguaaugaaugugggaaaaccuuucaucag

SEQ ID NO: 206185 - RNA, 64 nt, Homo Sapiens
ccacagaacucauauaagacagaaacccuauggguguaaugaauguggaaaaucauucugugug

SEQ ID NO: 206186 - RNA, 64 nt, Homo Sapiens
uaugaggguucuuuauccuaaucaucugcuucccuguaaugaaccugaaacugaacuugcucac

SEQ ID NO: 206187 - RNA, 64 nt, Homo Sapiens
aacagaaacagggguaccuuuuuuucauuuagauuguaaugauucccuuuuuuuucauuuauac

SEQ ID NO: 206188 - RNA, 64 nt, Homo Sapiens
uaaaaugugaucuaguguaaaaaaugugaucuaguguaaugaaaauuuucaaaaugcaguaauc

SEQ ID NO: 206189 - RNA, 64 nt, Homo Sapiens
aauuguaccaugaauuaggauuuagagaaaaugauguaaugaaacuuuuuuacccaaaauaauu

SEQ ID NO: 206190 - RNA, 64 nt, Homo Sapiens
uagugugcugugucacugugucugucuugaccuguguaaugaauuccccgccccaguggcugcc

SEQ ID NO: 206191 - RNA, 64 nt, Homo Sapiens
ucauguccacccagauguugacauaagaauuuguuguaaugaguagugacuucuuacaacaucc

SEQ ID NO: 206192 - RNA, 64 nt, Homo Sapiens
uuguuuuauccacauuacauggugagucuuuaauuguaaugacugccaaaaacucacuaauagg

SEQ ID NO: 206193 - RNA, 64 nt, Homo Sapiens
agccugcagucaauucuugaucuguaaugcagcuuguaaugaccgagaaaagaaagccuuuuca

SEQ ID NO: 206194 - RNA, 64 nt, Homo Sapiens
uuguuuuauccacaguuaagcucgagucuuuaauuguaaugacuacaauuggaaaugccaaaaa

SEQ ID NO: 206195 - RNA, 64 nt, Homo Sapiens; identical to SEQ ID NO: 206193

SEQ ID NO: 206196 - RNA, 64 nt, Homo Sapiens
uuauguauuguagugaauacuuauucuugguuuguguaaugaauugucaauauaaguuagaagc

SEQ ID NO: 206197 - RNA, 64 nt, Homo Sapiens
augcugcacuucaacugguagcuguuugacuaucuguaaugaaaguguguauuguauagcucua

SEQ ID NO: 206198 - RNA, 64 nt, Homo Sapiens
uaaggcuacaauucagaaucuucugaaccaucuauguaaugaauggggauuauacauuggaauu

SEQ ID NO: 206199 - RNA, 64 nt, Homo Sapiens
ugaaucucagggauggcccacaacuggguccacauguaaugagcccuguuuaauaacgaagggg

SEQ ID NO: 206200 - RNA, 64 nt, Homo Sapiens
uuugauuuguauucaaguacucuucaaguaucuuuguaaugaagguuuggcuacuuguauaggu

SEQ ID NO: 206201 - RNA, 64 nt, Homo Sapiens
uugaaggcaaccagugcaaaggcuacuacacuuguguaaugauauuuagcagaugcauacagga

SEQ ID NO: 206202 - RNA, 64 nt, Homo Sapiens
ugaaaaaauucauacuggagagaaaccauucaaauguaaugaaugugguaaagccuucucucga

SEQ ID NO: 206203 - RNA, 64 nt, Homo Sapiens
uaugagaagucauacuggugagaaacccuuugaauguaaugaaugugggaaagcauucucucaa

SEQ ID NO: 206204 - RNA, 64 nt, Homo Sapiens
uaggagaauucauacuggagagaaaccuuacaaguguaaugaguguggcaaagccuuuagugac

SEQ ID NO: 206205 - RNA, 64 nt, Homo Sapiens
ucaggccauucaugguguagggaaacuugacuaauguaaugauugucacaaagucuucaguaac

SEQ ID NO: 206206 - RNA, 64 nt, Homo Sapiens
gugagaaggccucuucuuguagaaacccuaugaauguaaugaauucaaagaauuccuacuggug

SEQ ID NO: 206207 - RNA, 64 nt, Homo Sapiens
gugggaaugccuucauuuguagaaacccuaugaauguaaugaauucagagaauucacagugggg

SEQ ID NO: 206208 - RNA, 64 nt, Homo Sapiens
gucacaaagucuucaguaauggaaacuugacuaauguaaugauuucaggcaauucaugguguag

SEQ ID NO: 206209 - RNA, 64 nt, Homo Sapiens
guggcaaagccuuuggcaagagaaaccuuacaaguguaaugaguuacuggacuucacacuggag

SEQ ID NO: 206210 - RNA, 64 nt, Homo Sapiens
guggcauaguuuuuaaucaaagaaacccuacaaguguaaugaauaaaggcaauucguauuggag

SEQ ID NO: 206211 - RNA, 64 nt, Homo Sapiens
guggcaagguuuuuaaucaaagaaacuuuacaaguguaaugaaucaaagccauucauacuggag

SEQ ID NO: 206212 - RNA, 64 nt, Homo Sapiens
guggcaacaccuuccaucacagaaaccuuaaaaguguaaugaguucauagacuucauaguggag

SEQ ID NO: 206213 - RNA, 53 nt, Homo Sapiens
guggcaagaccuucagucagaaguguaaugaguauaguggagagaaaccuuga

SEQ ID NO: 206214 - RNA, 64 nt, Homo Sapiens
gucacaaaguuuucaguaauggaaacuugacuaauguaaugauuucaagcaauccaugguauag

SEQ ID NO: 206215 - RNA, 64 nt, Homo Sapiens
guggcaagaccguuggucaaaaacucauuauaaguguaaugagucuagaauucacacuggagag

SEQ ID NO: 206216 - RNA, 53 nt, Homo Sapiens
guggcaagaccuuccaucacuaguguaaugaguauaguggagagaagccuuaa

SEQ ID NO: 206217 - RNA, 64 nt, Homo Sapiens
cucaucugcaaauaugugaucagugccgguaauuuguaaugaaugaagcgguaggcagguucua

SEQ ID NO: 206218 - RNA, 64 nt, Homo Sapiens
accucaguguacaauuuugaaagaaguuuugccuuguaaugaguaauaauuuagaaaguagaca

SEQ ID NO: 206219 - RNA, 64 nt, Homo Sapiens
ggaguagcaacuaguuuuguagcacuacauuuaauguaaugagauaccuuuguucauuuuuuua

SEQ ID NO: 206220 - RNA, 64 nt, Homo Sapiens
augccacagagcuauugauuaaucaguaaguaccuguaaugaguuuucagugaagcuuucucuc

SEQ ID NO: 206221 - RNA, 64 nt, Homo Sapiens
acuugaauugugaggcaauaagauaccuucuauauguaaugaucacagaacuaacccuuauaau

SEQ ID NO: 206222 - RNA, 64 nt, Homo Sapiens; identical to SEQ ID NO: 53591

SEQ ID NO: 206223 - RNA, 64 nt, Homo Sapiens; identical to SEQ ID NO: 53592

SEQ ID NO: 206224 - RNA, 64 nt, Homo Sapiens; identical to SEQ ID NO: 53593

SEQ ID NO: 206225 - RNA, 64 nt, Homo Sapiens; identical to SEQ ID NO: 53594

SEQ ID NO: 206226 - RNA, 64 nt, Homo Sapiens; identical to SEQ ID NO: 53595

SEQ ID NO: 206227 - RNA, 64 nt, Homo Sapiens; identical to SEQ ID NO: 53596

SEQ ID NO: 206228 - RNA, 64 nt, Homo Sapiens; identical to SEQ ID NO: 53597

SEQ ID NO: 206229 - RNA, 64 nt, Homo Sapiens; identical to SEQ ID NO: 53598

SEQ ID NO: 206230 - RNA, 64 nt, Homo Sapiens; identical to SEQ ID NO: 53599

SEQ ID NO: 206231 - RNA, 64 nt, Homo Sapiens; identical to SEQ ID NO: 53600

SEQ ID NO: 206232 - RNA, 64 nt, Homo Sapiens; identical to SEQ ID NO: 53601

SEQ ID NO: 206233 - RNA, 64 nt, Homo Sapiens; identical to SEQ ID NO: 53602

SEQ ID NO: 206234 - RNA, 64 nt, Homo Sapiens; identical to SEQ ID NO: 53603

SEQ ID NO: 206235 - RNA, 64 nt, Homo Sapiens; identical to SEQ ID NO: 53604

SEQ ID NO: 206236 - RNA, 64 nt, Homo Sapiens; identical to SEQ ID NO: 53605

SEQ ID NO: 206237 - RNA, 64 nt, Homo Sapiens; identical to SEQ ID NO: 53606

SEQ ID NO: 206238 - RNA, 64 nt, Homo Sapiens; identical to SEQ ID NO: 53607

SEQ ID NO: 206239 - RNA, 64 nt, Homo Sapiens; identical to SEQ ID NO: 53608

SEQ ID NO: 206240 - RNA, 64 nt, Homo Sapiens; identical to SEQ ID NO: 53609

SEQ ID NO: 206241 - RNA, 64 nt, Homo Sapiens; identical to SEQ ID NO: 53610

SEQ ID NO: 206242 - RNA, 64 nt, Homo Sapiens; identical to SEQ ID NO: 53611

SEQ ID NO: 206243 - RNA, 64 nt, Homo Sapiens; identical to SEQ ID NO: 53612

SEQ ID NO: 206244 - RNA, 64 nt, Homo Sapiens; identical to SEQ ID NO: 53613

SEQ ID NO: 206245 - RNA, 64 nt, Homo Sapiens; identical to SEQ ID NO: 53614

SEQ ID NO: 206246 - RNA, 64 nt, Homo Sapiens; identical to SEQ ID NO: 53615

SEQ ID NO: 206247 - RNA, 64 nt, Homo Sapiens; identical to SEQ ID NO: 53616

SEQ ID NO: 206248 - RNA, 64 nt, Homo Sapiens; identical to SEQ ID NO: 53617

SEQ ID NO: 206249 - RNA, 64 nt, Homo Sapiens; identical to SEQ ID NO: 53618

SEQ ID NO: 206250 - RNA, 64 nt, Homo Sapiens; identical to SEQ ID NO: 53619

SEQ ID NO: 206251 - RNA, 64 nt, Homo Sapiens; identical to SEQ ID NO: 53620

SEQ ID NO: 206252 - RNA, 64 nt, Homo Sapiens; identical to SEQ ID NO: 53621

SEQ ID NO: 206253 - RNA, 64 nt, Homo Sapiens; identical to SEQ ID NO: 53622

SEQ ID NO: 206254 - RNA, 64 nt, Homo Sapiens; identical to SEQ ID NO: 53623

SEQ ID NO: 206255 - RNA, 64 nt, Homo Sapiens; identical to SEQ ID NO: 53624

SEQ ID NO: 206256 - RNA, 64 nt, Homo Sapiens; identical to SEQ ID NO: 53625

SEQ ID NO: 206257 - RNA, 64 nt, Homo Sapiens
uaggccucacucaacaaccaagcgccuggaggacgggacagauggacagacagccacccugaga

SEQ ID NO: 206258 - RNA, 64 nt, Homo Sapiens
ggaggagcuucccacuccaggacuguugaugaaagggacagauugaggaggaagugggcucuga

SEQ ID NO: 206259 - RNA, 64 nt, Homo Sapiens
gaccuuuaaagaaaacaaaacugcacccgggugggggacagaggagcggugugcggcggggggu

SEQ ID NO: 206260 - RNA, 64 nt, Homo Sapiens
ccggcgacgcgcagacacaccucacagggaacacgggacagacggcacgccugggcguggcagc

SEQ ID NO: 206261 - RNA, 64 nt, Homo Sapiens
gagggaaugguaguuaaggccuguugucaugacggggacagagucccaguucaagacuuagcuc

SEQ ID NO: 206262 - RNA, 64 nt, Homo Sapiens
ggcccauguacuuguugggagcagcaggccacuggggacagaagcugcccaugggaaguaaacu

SEQ ID NO: 206263 - RNA, 64 nt, Homo Sapiens
aaaugacacuucucuuccucgggaaggccaggcagggacagagcauccuucucuuuccuggguu

SEQ ID NO: 206264 - RNA, 64 nt, Homo Sapiens
agcugggacgucagggaaaucaucuuaugacaaggggacagacaugagagcguguguagugcug

SEQ ID NO: 206265 - RNA, 64 nt, Homo Sapiens
aguaguccuggacucgaaagaagcaagcaugugggggacagaacuguucaggacguccgggagg

SEQ ID NO: 206266 - RNA, 64 nt, Homo Sapiens
gaagggaugguuggggauacggcaccuguggcuugggacagauacucgccucgaccccgcgccg

SEQ ID NO: 206267 - RNA, 64 nt, Homo Sapiens
gagcaggaguggagaaaggggccugccaacucaggggacagauguggccgccucuccuugccag

SEQ ID NO: 206268 - RNA, 64 nt, Homo Sapiens
cagaaagaacacagucugcccuaagucucaggcagggacagacccaacugucgcccccuucagg

SEQ ID NO: 206269 - RNA, 64 nt, Homo Sapiens
aaaacagccacaaacaagcccagaugccagggaagggacagaggccgcaccugcccucuggcac

SEQ ID NO: 206270 - RNA, 64 nt, Homo Sapiens
ccuggaaaugcggaggacuaugugugugugcguggggacagagguguacucguguuguguccau

SEQ ID NO: 206271 - RNA, 64 nt, Homo Sapiens
ggccuccgcagcuggacagagagugggggagggagggacagacagaaggccaaggcccgaugug

SEQ ID NO: 206272 - RNA, 64 nt, Homo Sapiens
uguggugugcagagguggggagguggcgaggauggggacagaaagcgcacagaaucuuggacca

SEQ ID NO: 206273 - RNA, 64 nt, Homo Sapiens
aguuaagagcuuucauccuuuuuuuggggggguggggacagagacucuuaugugacaguaaagu

SEQ ID NO: 206274 - RNA, 64 nt, Homo Sapiens
gugcauggaguggagcaugugaucacaauggcaggggacagaauuuggcugcauuuucuuaucu

SEQ ID NO: 206275 - RNA, 64 nt, Homo Sapiens
ggaagggacccacaggaaguggucuacagagucagggacagaagcuaggacccuuccugugggg

SEQ ID NO: 206276 - RNA, 64 nt, Homo Sapiens
aguggcucuguccugucacuuugggugcagcuuugggacagaugguugggguugcugacacccc

SEQ ID NO: 206277 - RNA, 64 nt, Homo Sapiens
aagcuauuccuggcuuuucccccuggggagggaagggacagaggagggcaaggagaaggaagua

SEQ ID NO: 206278 - RNA, 64 nt, Homo Sapiens
ggagucaagagcuggaaccuagucccagggguccgggacagagugguggaggguccugggagau

SEQ ID NO: 206279 - RNA, 64 nt, Homo Sapiens
ugaccugcgggcuugcuugcugacuccucucaaagggacagagcgccccugcuccagggaggag

SEQ ID NO: 206280 - RNA, 64 nt, Homo Sapiens
uuggcacggucucugcuccccaccagggcagcacgggacagaaacgucacggaggaguagccuc

SEQ ID NO: 206281 - RNA, 64 nt, Homo Sapiens
caucuggaugcaaacgcgggucacaccguaucuagggacagaggccagcucugaaauggaguuc

SEQ ID NO: 206282 - RNA, 64 nt, Homo Sapiens
ccgccaguggagaucauggccggccucgagucucgggacagaggagugccuucagggcuggccu

SEQ ID NO: 206283 - RNA, 64 nt, Homo Sapiens
uggacacaaaaccgauccaugauggcuuuuggcagggacagacucaggggugauggagacuuuu

SEQ ID NO: 206284 - RNA, 64 nt, Homo Sapiens
acuccccuacagcccagagacuaggucagagguggggacagagaagaagggcccucccuccagc

SEQ ID NO: 206285 - RNA, 64 nt, Homo Sapiens
ccugucuccacgccuccggggcuugaaguccucugggacagagacuugccucugggcuggguga

SEQ ID NO: 206286 - RNA, 64 nt, Homo Sapiens
auugauggccaagcccaucuuugccaauaaacuugggacagacuaagaagguggggucgaggag

SEQ ID NO: 206287 - RNA, 64 nt, Homo Sapiens
cagaacuagagccugagcccuuccuagcugaugagggacagaacaaauuaauuuccuuacaguu

SEQ ID NO: 206288 - RNA, 64 nt, Homo Sapiens
ucagagugaggcgggggccuuucggauaucacaugggacagaggaagagcccggcuggaaucug

SEQ ID NO: 206289 - RNA, 64 nt, Homo Sapiens
aauucaagacagugacagcauuacgucaccccuggggacagaggucagccuaaggugacacacg

SEQ ID NO: 206290 - RNA, 64 nt, Homo Sapiens
aaauguuuguauggauuuuacucaccuccaggcagggacagaaucucuccggacccccuucccc

SEQ ID NO: 206291 - RNA, 64 nt, Homo Sapiens
ccagugggggccagggccacugcggggugggggugggacagaccgggccugcugccuucccucc

SEQ ID NO: 206292 - RNA, 64 nt, Homo Sapiens
cccagagggcagcgucagaccagugggggagggagggacagagaaacaaacaaacaaaaagagc

SEQ ID NO: 206293 - RNA, 64 nt, Homo Sapiens
caaaaggauagagaaagagaccagacaugauagagggacagagcgggagaaaacuguacucugu

SEQ ID NO: 206294 - RNA, 64 nt, Homo Sapiens
uucacuuuaauguuuuacuucuuuugggacagaugggacagaugagucaggcaucacuguuagu

SEQ ID NO: 206295 - RNA, 64 nt, Homo Sapiens
ggacagauguucacuuuaauacuguuagucuuuugggacagauguguccccaaagucaggcauc

SEQ ID NO: 206296 - RNA, 64 nt, Homo Sapiens
aggggaggagggugcuggcuggggugagggcagagggacagauggaaggagauucuggcauguu

SEQ ID NO: 206297 - RNA, 64 nt, Homo Sapiens
uggaggcccaggacauggcucaagacuaggaucagggacagaucgaugauggaccccucagagg

SEQ ID NO: 206298 - RNA, 64 nt, Homo Sapiens
aggaugauggaccccucagacgugggaggucugggggacagacaagggugggagcaggggcugg

SEQ ID NO: 206299 - RNA, 64 nt, Homo Sapiens
aagccuccaaaucuggaagggaucccagcuauuagggacagaagcuggaccccugagagcuucu

SEQ ID NO: 206300 - RNA, 64 nt, Homo Sapiens
guuauggguucuggucccacgagcaugagcucuggggacagacauuggucaggcacuaggagug

SEQ ID NO: 206301 - RNA, 64 nt, Homo Sapiens; identical to SEQ ID NO: 51918

SEQ ID NO: 206302 - RNA, 64 nt, Homo Sapiens; identical to SEQ ID NO: 51919

SEQ ID NO: 206303 - RNA, 64 nt, Homo Sapiens; identical to SEQ ID NO: 51920

SEQ ID NO: 206304 - RNA, 64 nt, Homo Sapiens; identical to SEQ ID NO: 51921

SEQ ID NO: 206305 - RNA, 64 nt, Homo Sapiens; identical to SEQ ID NO: 51922

SEQ ID NO: 206306 - RNA, 64 nt, Homo Sapiens; identical to SEQ ID NO: 51923

SEQ ID NO: 206307 - RNA, 64 nt, Homo Sapiens; identical to SEQ ID NO: 51924

SEQ ID NO: 206308 - RNA, 64 nt, Homo Sapiens; identical to SEQ ID NO: 51925

SEQ ID NO: 206309 - RNA, 64 nt, Homo Sapiens; identical to SEQ ID NO: 51926

SEQ ID NO: 206310 - RNA, 64 nt, Homo Sapiens; identical to SEQ ID NO: 51927

SEQ ID NO: 206311 - RNA, 64 nt, Homo Sapiens; identical to SEQ ID NO: 51928

SEQ ID NO: 206312 - RNA, 64 nt, Homo Sapiens; identical to SEQ ID NO: 51929

SEQ ID NO: 206313 - RNA, 64 nt, Homo Sapiens; identical to SEQ ID NO: 51930

SEQ ID NO: 206314 - RNA, 64 nt, Homo Sapiens; identical to SEQ ID NO: 51931

SEQ ID NO: 206315 - RNA, 64 nt, Homo Sapiens; identical to SEQ ID NO: 51932

SEQ ID NO: 206316 - RNA, 64 nt, Homo Sapiens; identical to SEQ ID NO: 51933

SEQ ID NO: 206317 - RNA, 64 nt, Homo Sapiens; identical to SEQ ID NO: 51934

SEQ ID NO: 206318 - RNA, 64 nt, Homo Sapiens; identical to SEQ ID NO: 51935

SEQ ID NO: 206319 - RNA, 64 nt, Homo Sapiens; identical to SEQ ID NO: 51936

SEQ ID NO: 206320 - RNA, 64 nt, Homo Sapiens; identical to SEQ ID NO: 51937

SEQ ID NO: 206321 - RNA, 64 nt, Homo Sapiens; identical to SEQ ID NO: 51938

SEQ ID NO: 206322 - RNA, 64 nt, Homo Sapiens; identical to SEQ ID NO: 51939

SEQ ID NO: 206323 - RNA, 64 nt, Homo Sapiens; identical to SEQ ID NO: 51940

SEQ ID NO: 206324 - RNA, 64 nt, Homo Sapiens; identical to SEQ ID NO: 51941

SEQ ID NO: 206325 - RNA, 64 nt, Homo Sapiens; identical to SEQ ID NO: 51942

SEQ ID NO: 206326 - RNA, 64 nt, Homo Sapiens; identical to SEQ ID NO: 51943

SEQ ID NO: 206327 - RNA, 64 nt, Homo Sapiens; identical to SEQ ID NO: 51944

SEQ ID NO: 206328 - RNA, 64 nt, Homo Sapiens
cagaccuggacagacagacacagccugaaacagacccggacagacagacacagccugaaacaga

SEQ ID NO: 206329 - RNA, 64 nt, Homo Sapiens
cccagacagacagacagacacagccugaaacagacccggacagacagacagacacagccugaaa

SEQ ID NO: 206330 - RNA, 64 nt, Homo Sapiens
cccggacagacagacagacacagccugaaacagacccggacagacagacagacacagccugaaa

SEQ ID NO: 206331 - RNA, 64 nt, Homo Sapiens; identical to SEQ ID NO: 206330

SEQ ID NO: 206332 - RNA, 64 nt, Homo Sapiens
gccugaaacagacccagacacagccugaaacagacccggacagacagacagacacagccugaaa

SEQ ID NO: 206333 - RNA, 64 nt, Homo Sapiens
ggucugccccacccacuuccggauccgagggcgccccggacagagaugggagccagcaccagca

SEQ ID NO: 206334 - RNA, 64 nt, Homo Sapiens
gcccacccgggacccgccucgcguggaggggcuucccggacaccccgcuggagaggcaccaugg

SEQ ID NO: 206335 - RNA, 64 nt, Homo Sapiens
uauauauuuucauaauguuguuucucaguaacuacccggcaaaauagaguugaaaggauugaca

SEQ ID NO: 206336 - RNA, 64 nt, Homo Sapiens
ugccgccacucguucugcuggugugucugcacgccccggcaaacuccaagaugggaaacauguc

SEQ ID NO: 206337 - RNA, 64 nt, Homo Sapiens
cuuuuccuugcugccagguaagauucuguuucuuuuucccgacugaagaggggacuucugcaac

SEQ ID NO: 206338 - RNA, 64 nt, Homo Sapiens
ucugugguaagugugguccccaggcacagagaaauuucccgagcggcuuugcuacugacauacu

SEQ ID NO: 206339 - RNA, 64 nt, Homo Sapiens
ugagugggguauaugcauaagugggagagaaaaaccaaacaaucuacuucaguucaguguaacu

SEQ ID NO: 206340 - RNA, 64 nt, Homo Sapiens
uuccacucacagggagaugggauuccuuucuuguccaaacaaagggaguugcucuaaagcgagc

SEQ ID NO: 206341 - RNA, 64 nt, Homo Sapiens
ucgucaucuggaggugcagaugugaugagacuagccaaacaaucguuccuggaucucccauauu

SEQ ID NO: 206342 - RNA, 64 nt, Homo Sapiens
acaacuaugcaaauguggaacagugccuggaggaccaaacaacagauggcagaucacuaugugc

SEQ ID NO: 206343 - RNA, 64 nt, Homo Sapiens
ucauuucccaccacaugcaguagcucugagacuugcuuccaaaguagaucugaaauucagagug

SEQ ID NO: 206344 - RNA, 64 nt, Homo Sapiens
aaagguuugcccccaaaaccggacgauggauauugcuuccaaugcccaaaggaguucuugaucu

SEQ ID NO: 206345 - RNA, 64 nt, Homo Sapiens
aagaccuguggcuacugguagagaauuggaauaagcuuccaacaauggacuguagagauuaaug

SEQ ID NO: 206346 - RNA, 64 nt, Homo Sapiens
ugguguaaagccaacucgaggggaaucugaauaagcuuccaaaauuuuuuuuuuuaagaaauaa

SEQ ID NO: 206347 - RNA, 64 nt, Homo Sapiens
gcucuuuucagagccacuuauuaauugcuuccaagcuuccaaagccugcucuaucuuggguuuc

SEQ ID NO: 206348 - RNA, 64 nt, Homo Sapiens
uuccaaaggcucuuuucagauggguuucuuaauugcuuccaagccauaauccccugcucuaucu

SEQ ID NO: 206349 - RNA, 64 nt, Homo Sapiens
cagccacuuguggaauucuuugaagagcucagaggcuuccaagugaucugcuccugaacaaguu

SEQ ID NO: 206350 - RNA, 64 nt, Homo Sapiens
ccuagcagaccuggauuuuucuuccugaucugcugcuuccaaguugugugaccuuggcuaaguc

SEQ ID NO: 206351 - RNA, 64 nt, Homo Sapiens
ugauggacaggaaggggcaggaaggcuccugcuugcuuccaaaggagugucgguguguggcaca

SEQ ID NO: 206352 - RNA, 64 nt, Homo Sapiens
acuggaaugcguacgucuuucucgagggaagccagcuuccaagacccaaacccagcacuccaga

SEQ ID NO: 206353 - RNA, 64 nt, Homo Sapiens
cccgaggcgugcuuccuuccugauugucucuagagcuuccaaguccugggaaugugcggggcca

SEQ ID NO: 206354 - RNA, 64 nt, Homo Sapiens
ucuggucaggaacccucagggacccaggaacucagcuuccaaacaucugcaccuugaccggacu

SEQ ID NO: 206355 - RNA, 64 nt, Homo Sapiens
gucccagagaugaagcuccccucccagaagugcagcuuccaaaauggccgugcccgaugugcac

SEQ ID NO: 206356 - RNA, 64 nt, Homo Sapiens
gugccugagaugaaacuuccgucccugagaugaagcuuccaaagcgaaagugccagagaugaaa

SEQ ID NO: 206357 - RNA, 64 nt, Homo Sapiens
gugcccgaggcagcccuuccgcuccugaggucaagcuuccaaaacugaagugaagcuccccaag

SEQ ID NO: 206358 - RNA, 64 nt, Homo Sapiens
gcuagaaauaaaauagccaauuuucuugaaacaagcuuccaaggauguuuaugauauggugucu

SEQ ID NO: 206359 - RNA, 64 nt, Homo Sapiens
uggcauuuuuucuagaaccuaauuggugccacaagcuuccaaguugcuguuccaucccagcuug

SEQ ID NO: 206360 - RNA, 64 nt, Homo Sapiens
ccuuagcacccagcaugugaccccacuccugaucaggucccagcaucuucccuucuuguucugu

SEQ ID NO: 206361 - RNA, 64 nt, Homo Sapiens
gucccagcaucuucccuucuuguucuguuccuuaaggucccagcaccuuaccccaggacuuggu

SEQ ID NO: 206362 - RNA, 64 nt, Homo Sapiens
aauucuuagaauaucuaaaccuuuguuagauauuaggucccaucuucuuagaauaucuaagaau

SEQ ID NO: 206363 - RNA, 64 nt, Homo Sapiens
aauucuuagaauaucuaagacugaugcuucuaucaggucccaucauauucuuaaugacauuuca

SEQ ID NO: 206364 - RNA, 64 nt, Homo Sapiens
acagccuuugacccacaacgccucucagaggcagaggucccauggcugcccagaggaccccacg

SEQ ID NO: 206365 - RNA, 64 nt, Homo Sapiens
cuguggaaagccccagcccaccuagucucccaccaggucccaggcgcugcuauggaggcugccu

SEQ ID NO: 206366 - RNA, 64 nt, Homo Sapiens
auggaaaaaaaaaucagcuaccuguaagcauuuuaggucccagauccgacauguacugcuagua

SEQ ID NO: 206367 - RNA, 64 nt, Homo Sapiens
aaguccagcuccuuaaacugacaagaugccaaggaggucccaggcaggccacuccaaucacccu

SEQ ID NO: 206368 - RNA, 64 nt, Homo Sapiens
acgcgccgcucccucaugcuccagggcuggaggcaggucccagggagugaccacggccccaagc

SEQ ID NO: 206369 - RNA, 64 nt, Homo Sapiens
acgugcugcucccuugugugcuggggcuggacgcaggucccagggagugaccgcggccccgagc

SEQ ID NO: 206370 - RNA, 64 nt, Homo Sapiens
acaugcugcucccuugugugcuggggcuggacgcaggucccagggagugaccgcggccccgagc

SEQ ID NO: 206371 - RNA, 64 nt, Homo Sapiens
cgcuaaaaugggcaagggaguggccugcaggggcaggucccagccuagaccugccaggagcacu

SEQ ID NO: 206372 - RNA, 64 nt, Homo Sapiens
cuucgaaugcccaccuuugggaggccagggugaaaggucccagaagguagccaaggucagcccu

SEQ ID NO: 206373 - RNA, 64 nt, Homo Sapiens
uuucaguuaugcucuuuuaguugcaaggaaucucaagugggacaaacauaaaaagacucaaaag

SEQ ID NO: 206374 - RNA, 64 nt, Homo Sapiens
ggcaaccagagccucagcauccaaagauggacugaagugggauggcugacaggcacauaacuua

SEQ ID NO: 206375 - RNA, 64 nt, Homo Sapiens
gaaacuuuggccacuuggcuguucauuuuauucuaagugggauagggacauaccuaccuggauu

SEQ ID NO: 206376 - RNA, 64 nt, Homo Sapiens
accaggaggagcucuucguaguccagaaagguagaagugggaguuguuuacuuaauuuuacugu

SEQ ID NO: 206377 - RNA, 64 nt, Homo Sapiens
acaguacugagaaaugggagagcacaguacugagaagugggagcgcacaguacugggaaguggg

SEQ ID NO: 206378 - RNA, 64 nt, Homo Sapiens
acaguacugagaagugggagagcacaguacugggaagugggagcgcacaguauugggaaauggg

SEQ ID NO: 206379 - RNA, 64 nt, Homo Sapiens
uccacuggggcaacagacacacauacucauuaguaagugggaggcacuguggcuccucuguuuu

SEQ ID NO: 206380 - RNA, 64 nt, Homo Sapiens
gaauuaggggcuuauguauaacgcacugauuuucaagugggaggucaggaauuucucuccuuac

SEQ ID NO: 206381 - RNA, 64 nt, Homo Sapiens
guuucuguuguuggcuaauugcugugacugcaggaagugggaguguuuuuauuguuagcuaauu

SEQ ID NO: 206382 - RNA, 64 nt, Homo Sapiens
guuuuuauuguuagcuaauugcugugacugcaggaagugggagucugccuugaaaagucuuuca

SEQ ID NO: 206383 - RNA, 64 nt, Homo Sapiens
uucauacucacuaaaaaccccaugaaagccuugaaagugggaaagcuuucauuagaaauuugca

SEQ ID NO: 206384 - RNA, 64 nt, Homo Sapiens
gauaauggugaaaguuuaggcacauuuucacuaaaagugggaacagaaaauggaggccuguuuu

SEQ ID NO: 206385 - RNA, 64 nt, Homo Sapiens
ccccaaagcaauugcaacaaaaacaaaaauugacaagugggaccuaauuaaacuaaauaacuuc

SEQ ID NO: 206386 - RNA, 64 nt, Homo Sapiens
aacagaaaaugaaauaucccauguucucacuuauaagugggagcuaaacauugauuacacaugg

SEQ ID NO: 206387 - RNA, 64 nt, Homo Sapiens
ugggcccuccaccuguggcucacaucucgccagccccacagagcauccucaggccucuccaagg

SEQ ID NO: 206388 - RNA, 64 nt, Homo Sapiens
cccucaaccuccggaguccaggagaacccguacccccacagagccuuaagcaacuacuucugug

SEQ ID NO: 206389 - RNA, 64 nt, Homo Sapiens
cuauuucugaugaauaugaaauuaaaacaugccucccacagaauugcgucagcccgaguucuga

SEQ ID NO: 206390 - RNA, 64 nt, Homo Sapiens
cgugaguugauuaaaucucuagaagcauguaaagcccacagaacccugaggccuccccagaagc

SEQ ID NO: 206391 - RNA, 64 nt, Homo Sapiens
ccucucggaccucgcuguguuucacugccuccugcccacagacccaggccugccggcccggacc

SEQ ID NO: 206392 - RNA, 64 nt, Homo Sapiens
cccaaguggacacauggcugugcaggccaggaggcccacagauggacugagugcugggaagggg

SEQ ID NO: 206393 - RNA, 64 nt, Homo Sapiens
uaauauauguccggacagcuccaugccugugugccccacagacccacugccacauggagucuug

SEQ ID NO: 206394 - RNA, 64 nt, Homo Sapiens
cacagugugucuggacagccucagaucugagugccccacagaguccacugucaugcaggucaua

SEQ ID NO: 206395 - RNA, 64 nt, Homo Sapiens
gacaagaugguguucugcuaauguuaaaugucagcccacagagcuaauaauaccucaguauaau

SEQ ID NO: 206396 - RNA, 64 nt, Homo Sapiens
agaacaacaagguuaagcuucaucugcuuggugucccacagaacuugcacaagcaguuguuauu

SEQ ID NO: 206397 - RNA, 64 nt, Homo Sapiens
cugguggggagaccauggcuuggaggcugcucaccccacagacagcugagaccuuggcucugua

SEQ ID NO: 206398 - RNA, 64 nt, Homo Sapiens
gguuggcagcuucucuuguccuaaaagcuggggacccacagagguggaggagaggaaacaguga

SEQ ID NO: 206399 - RNA, 64 nt, Homo Sapiens
augcagcccccagcugcauggaggaugaagccaccccacagaggcaggccccacagaccccaca

SEQ ID NO: 206400 - RNA, 64 nt, Homo Sapiens
augaagccaccccacagaggcaggccccacagaccccacagaggggaaugcugaugacuuggag

SEQ ID NO: 206401 - RNA, 64 nt, Homo Sapiens
ccacagaggaugaagccaccgacuuggagcaggccccacagaccggugggcauggaaugcugau

SEQ ID NO: 206402 - RNA, 64 nt, Homo Sapiens
cgacacugaaagcugaguccugccgucugucucacccacagaugucuguagucggucgguguga

SEQ ID NO: 206403 - RNA, 64 nt, Homo Sapiens
ccccagauucucaagcagaugcccaagggagguccccacagagccagagugccugaggcuuccu

SEQ ID NO: 206404 - RNA, 64 nt, Homo Sapiens
uuuguuuuuaaguaugacagaugaguuaccucuucccacagacaguaaaugauugauaauagga

SEQ ID NO: 206405 - RNA, 64 nt, Homo Sapiens
cacauccaagcucacaaauaaacucucaucuucccccacagauaaauauuuuccagagucucua

SEQ ID NO: 206406 - RNA, 64 nt, Homo Sapiens
aggacccccagagccaagguggcugggaucuggccccacagauggggaaagauggggaagggug

SEQ ID NO: 206407 - RNA, 64 nt, Homo Sapiens
gacuccauaugcaaucaguagcgagcagccgggccccacagacccucaugcacucucuuacgug

SEQ ID NO: 206408 - RNA, 64 nt, Homo Sapiens
cuccagagcuagcugaggccccaccugccccucccccacagagcccgaauccugacugcaaggc

SEQ ID NO: 206409 - RNA, 64 nt, Homo Sapiens
ucuuagccaauccuaugcaguuucccgagccccgcccacagagccggggcaacggcuccccauu

SEQ ID NO: 206410 - RNA, 64 nt, Homo Sapiens
aacaaauuugcugggagagggaaagacauucagacccacagaaaggaggcagcacacagagaaa

SEQ ID NO: 206411 - RNA, 64 nt, Homo Sapiens
uuggggagguuggucagggaagagagggguucuacccacagaucaacuguguaaucuuuuacua

SEQ ID NO: 206412 - RNA, 64 nt, Homo Sapiens
uugcaggagcauagaauaguuuggguaccaggaacccacagaggcacacaugaaaagccaaauu

SEQ ID NO: 206413 - RNA, 64 nt, Homo Sapiens
guuagucuccauuucauagaugaaaauagugaagcccacagaaaauaaguagcuccuccacagg

SEQ ID NO: 206414 - RNA, 64 nt, Homo Sapiens
ccaccagucuuucugggaacaguaugcacucagccccacagaacucagggaccacccuccccac

SEQ ID NO: 206415 - RNA, 64 nt, Homo Sapiens
guuugauggcugugcuguauagguuacucugcaccccacagaugcagaguccccagccucccuc

SEQ ID NO: 206416 - RNA, 64 nt, Homo Sapiens
gccugcuccccacacggacuccaggcgguccccacccacagaagcagaccuucagcucagguaa

SEQ ID NO: 206417 - RNA, 64 nt, Homo Sapiens
cgggguggcccuggaggccccugaccccaccccacccacagagcacgagggccccgucagcuca

SEQ ID NO: 206418 - RNA, 64 nt, Homo Sapiens
gaacgggaugcuuugaagauaccaugaaauaaaacccacagagguauuugauguauuuaauugu

SEQ ID NO: 206419 - RNA, 64 nt, Homo Sapiens
gcagggacuugcaguggauucuuggucaggugugcccacagaugcggaggcgaggugagugauu

SEQ ID NO: 206420 - RNA, 64 nt, Homo Sapiens
gaaagguggugagggcggaggggccgcuccaggccccacagagcaggagacccccagagaaagc

SEQ ID NO: 206421 - RNA, 64 nt, Homo Sapiens
aggugaguuuggugcaugcaaaccugugugcucacccacagagcaugggguaaugguguguaga

SEQ ID NO: 206422 - RNA, 64 nt, Homo Sapiens
gcaaagaaacugcccaugguguaggauaggggugcccacagaggucucagcccaacugcaggug

SEQ ID NO: 206423 - RNA, 64 nt, Homo Sapiens
gcugcuccuggaugccccugaacacgggccccuccccacagaaaaccugugcuggccugugcuc

SEQ ID NO: 206424 - RNA, 64 nt, Homo Sapiens
cagaauuauuuaaguuuuaucucaaugauuuuaauugaucuagauucuuccauucauaaggaga

SEQ ID NO: 206425 - RNA, 64 nt, Homo Sapiens
cuuuuugguuaugagagaaaacuaaccuuauacuuugaucuauuuuuucucacugccaucacau

SEQ ID NO: 206426 - RNA, 64 nt, Homo Sapiens
uggagcucaguauucaggaagcuuaauacuguuuuugaucuacaagauccaaauaauuaucccu

SEQ ID NO: 206427 - RNA, 64 nt, Homo Sapiens
aaaaaguacugccacauauguagccuugaaguaguugaucuaauaaaugagagcagggaggaga

SEQ ID NO: 206428 - RNA, 64 nt, Homo Sapiens
acaagaaauuacaaaaauguuucuguuuugaaacuugaucuacaaucaguaaaaguuugauaau

SEQ ID NO: 206429 - RNA, 64 nt, Homo Sapiens
ggcuguccuuuuccacugaagaaggaaagacguuuugaucuagaaauagcguugugauuuccuu

SEQ ID NO: 206430 - RNA, 64 nt, Homo Sapiens
cuugaauacuuuuuucauaguuauuuguuuaaaaagauuuaaaaaucauugcacuuuggucaga

SEQ ID NO: 206431 - RNA, 64 nt, Homo Sapiens
acaaugcuaagugguauccgagguucuuaauaugagauuuaaaaucuuaaaauguuucuuauuu

SEQ ID NO: 206432 - RNA, 64 nt, Homo Sapiens
ucagcaauguugaucucauaaaaggaaaaacaaaagauuuaaguauucuauauaccaaguuuuu

SEQ ID NO: 206433 - RNA, 64 nt, Homo Sapiens
cccuauuguuggcuccacagccuuaaagugcuauagauuuaaauucauugauuaguuuuaauuu

SEQ ID NO: 206434 - RNA, 64 nt, Homo Sapiens
gagugauaugcuugcugcuuaaucaaaggauuaaagauuuaaagaugucuaugucuucuauuuu

SEQ ID NO: 206435 - RNA, 64 nt, Homo Sapiens
cuuaauugcagucacguguacuuccacagaugugagauuuaacaucagaagugagcuaccaaaa

SEQ ID NO: 206436 - RNA, 64 nt, Homo Sapiens
uucaaaacugaaauauucuguuuguaguuguaagagauuuaauaggauggagacuaugaagggg

SEQ ID NO: 206437 - RNA, 64 nt, Homo Sapiens
cugauuuaauuuauggaaaacuccaaauaugccuagauuuaaagaguguuagaaguuugugauu

SEQ ID NO: 206438 - RNA, 64 nt, Homo Sapiens
agcuuuuaaaucucucuuuuuuuuuuuauuguuuagauuuaaccuauaauauuguacauaugga

SEQ ID NO: 206439 - RNA, 64 nt, Homo Sapiens
aacauuuaaaaauccuuuggguaauucgaauuacagauuuaaaagagcuuaagaucugguguuu

SEQ ID NO: 206440 - RNA, 64 nt, Homo Sapiens
auuugacuguuuaaaauguuggccaaaaaaaucaagauuuaauuuuuuuauuuguacugaaaaa

SEQ ID NO: 206441 - RNA, 64 nt, Homo Sapiens
acucuacuaauuuuuagauauucauuaauaggaaagauuuaauguuacagcaucuacucuuugg

SEQ ID NO: 206442 - RNA, 64 nt, Homo Sapiens
aaaguuguaccuugacccuagaauuccuuuuauaagauuuaauuguaauugucucaaagcauca

SEQ ID NO: 206443 - RNA, 64 nt, Homo Sapiens
uuauaauucauugugguaagaaugauugaaaugcagauuuaacaaucuuauaaucuauugaaug

SEQ ID NO: 206444 - RNA, 64 nt, Homo Sapiens
uugugaagaaaguauuuaaauccaacuuuugaacagauuuaacaaacaugaggaacuuuuuuau

SEQ ID NO: 206445 - RNA, 64 nt, Homo Sapiens
uggcaaccuuauucaauagguuuucccauauuucagauuuaauaacugaaggccagagagauua

SEQ ID NO: 206446 - RNA, 64 nt, Homo Sapiens
uuuauaaagguuuccuugugccaaauaagugcaaagauuuaauuuacuauuaaaaaccauaagc

SEQ ID NO: 206447 - RNA, 64 nt, Homo Sapiens
agccaucuggguucugaucugcuguaaaagaugaagauuuaagugaccuuaauuaaccuguccu

SEQ ID NO: 206448 - RNA, 64 nt, Homo Sapiens
ggcauauuguacucgaaaucugaagaccugcagcagauuuaaauuacaacucuuguuauaacuu

SEQ ID NO: 206449 - RNA, 64 nt, Homo Sapiens
ugccucaacccuuuugagguuuugauuuggaaauagauuuaaaagaaaacaggcuaagauaaua

SEQ ID NO: 206450 - RNA, 64 nt, Homo Sapiens
auaaguuccugcauuauaaguauaaagggaaccgagauuuaauuuggagaucaucacuguuaaa

SEQ ID NO: 206451 - RNA, 64 nt, Homo Sapiens
acuucuuaguaugugcauuucaacaauuauuugaagauuuaauuagcagauuuaagauauguaa

SEQ ID NO: 206452 - RNA, 64 nt, Homo Sapiens
uauguaacaacaauuauuugucucaauguuuagcagauuuaagaaauuauauauacuauauuuu

SEQ ID NO: 206453 - RNA, 64 nt, Homo Sapiens
aaaauuuaugguggaaaaccguaacaggcaacaaagauuuaagauucugcuaacauucagacaa

SEQ ID NO: 206454 - RNA, 64 nt, Homo Sapiens
uaaaaugaacugauuauauaucugcauuaauuacagauuuaauaccauauuuaaguugaacugc

SEQ ID NO: 206455 - RNA, 64 nt, Homo Sapiens
agagaguacuauuuuuaaggcuuucugucaaauuagauuuaaugcuccuuuuucccuuaaacuu

SEQ ID NO: 206456 - RNA, 64 nt, Homo Sapiens
ugcuaauuuuuuuuuuuuuauuucaaauauagauagauuuaagcugguacuugugacuacguuu

SEQ ID NO: 206457 - RNA, 64 nt, Homo Sapiens
ugugggauggguaagaaauccacaaacaaaauuaagauuuaaacuauuuuccaucauuucaaac

SEQ ID NO: 206458 - RNA, 64 nt, Homo Sapiens
acaauuuuucuucuuuaauauaguuuagccaguaagauuuaauccugaaaacauguuaaggcua

SEQ ID NO: 206459 - RNA, 64 nt, Homo Sapiens
uuaaauuaguuaacauucaacauguaacuuuuuaagauuuaaaucguacggcagccacuaccca

SEQ ID NO: 206460 - RNA, 64 nt, Homo Sapiens
gaauacauuaacggugcuaacaaggugcuaacauagauuuaaguuuuguuguucugccuggaga

SEQ ID NO: 206461 - RNA, 64 nt, Homo Sapiens
gauuugaaaaucuuuaaugaacuggagaacacuaagauuuaaacucgaaaauucguuguucaag

SEQ ID NO: 206462 - RNA, 64 nt, Homo Sapiens
uuuuccuuuucuaaauuuguuugugaucauugacagauuuaaggguuggguuuuuuguuuuggu

SEQ ID NO: 206463 - RNA, 64 nt, Homo Sapiens
ccuauuaauaauauaagagcaaaaaaguauucacagauuuaauauaaauugaaauguuuuaaag

SEQ ID NO: 206464 - RNA, 64 nt, Homo Sapiens
uaaauugaaauguuuuaaagaauuuuuuggcuuuagauuuaaaguaauuuuuuuaaaggagaaa

SEQ ID NO: 206465 - RNA, 64 nt, Homo Sapiens
uuaaacaguaacauccagagugacaaauugcaggagauuuaauguauaaaauuucuaggaauua

SEQ ID NO: 206466 - RNA, 64 nt, Homo Sapiens
caaaccaaauacugugaacguaccagguguuuacagauuuaaaugcauguuaccauagaaacua

SEQ ID NO: 206467 - RNA, 64 nt, Homo Sapiens
ugucuucuucccucccauuaugaucuacccuugcagauuuaaccuuccaccuuauuuuuaccuu

SEQ ID NO: 206468 - RNA, 64 nt, Homo Sapiens
aaagauuucggcaucgacacauuccuccaaaaaaagauuuaaaacuuuugccuccguccaaaag

SEQ ID NO: 206469 - RNA, 64 nt, Homo Sapiens
uuuuaaaaaauaguaugaaugugaauacuagaaaagauuuaaaaaauaguaugagugugaguac

SEQ ID NO: 206470 - RNA, 64 nt, Homo Sapiens
agaaaugcuguuacuuuuuauuuuuacacccaucagauuuaaggaaaagacuuuuuagccauua

SEQ ID NO: 206471 - RNA, 64 nt, Homo Sapiens
gggauaugaaggauucaaugaaugaucucuagaaagauuuaaagaagaauauucagauaaggau

SEQ ID NO: 206472 - RNA, 64 nt, Homo Sapiens
uuaaagaauccaaggagacagauguuguaucuauagauuuaaaauaaucucaagcugcauccac

SEQ ID NO: 206473 - RNA, 64 nt, Homo Sapiens
gaacacauuuacacauaucacuuagguuuucucaagauuuaaguacaaaacaacagacuucauc

SEQ ID NO: 206474 - RNA, 64 nt, Homo Sapiens
aauauauauugauuaaaauguugaguuaaaaauaagauuuaaaaauaucauagcacuaaaaaga

SEQ ID NO: 206475 - RNA, 64 nt, Homo Sapiens
uguucaguuguuaguugggaaagauugaguuaucagauuuaauuugccgaugggagccuuuauc

SEQ ID NO: 206476 - RNA, 64 nt, Homo Sapiens
aucuuucucauuuaagaacuuaugaauaugcugaagauuuaauuugugauaccuuuguauguau

SEQ ID NO: 206477 - RNA, 64 nt, Homo Sapiens
ugacuacagaauaggugaggguuucuuaaaaaugagauuuaagggcugggcacgguggcucaug

SEQ ID NO: 206478 - RNA, 64 nt, Homo Sapiens
acuuuaugcaagauuggaauguaucuucaaauucagauuuaauaaacauguaaagauccucugu

SEQ ID NO: 206479 - RNA, 64 nt, Homo Sapiens
uuuuguuaagaggauagauucaauuuugcacuguagauuuaacacacaaugcgcauguaguuaa

SEQ ID NO: 206480 - RNA, 64 nt, Homo Sapiens
augaaugauuaguaggaaaggacuuuuugguaauagauuuaauucaggugaggcaaagugcugg

SEQ ID NO: 206481 - RNA, 64 nt, Homo Sapiens
auuuguguagaauaaugugggauaccugaauaauagauuuaaaaggaccaagugguaaaauugg

SEQ ID NO: 206482 - RNA, 64 nt, Homo Sapiens
ucauuguguucagaacuuaauugggcuugaacugagauuuaaaucuaauaaacaaguuaauaaa

SEQ ID NO: 206483 - RNA, 64 nt, Homo Sapiens
gauagaguguggcuucauuuuaauguuagaauuuagauuuaacaacuccaggauucaggaguuu

SEQ ID NO: 206484 - RNA, 64 nt, Homo Sapiens
agucuauaaugaacaugaaguaguaguuagaacuagauuuaacuuuugauuuuugaaguugggg

SEQ ID NO: 206485 - RNA, 64 nt, Homo Sapiens
uagaaggcuguguauaguccauuucccaggucugagauuuaaauauauuuguaauucuuguguc

SEQ ID NO: 206486 - RNA, 64 nt, Homo Sapiens
ggugccucuguuggcaaugaucaggcagcccaaaagauuuaaaugaucuauaauaauuuccaag

SEQ ID NO: 206487 - RNA, 64 nt, Homo Sapiens
auagauuccaaauaaagaaucuagaaauaggagaagauuuaauuaugaggccuugaacacggau

SEQ ID NO: 206488 - RNA, 64 nt, Homo Sapiens
uuuauugaguauuguuugugcuaagcauuguguuagauuuaaaaaauuaguggauugacuccac

SEQ ID NO: 206489 - RNA, 55 nt, Homo Sapiens
ugaggagcacauuuuguuaacauucagauuuaauuacuguaaguaaaauuuaaaa

SEQ ID NO: 206490 - RNA, 64 nt, Homo Sapiens
auaaaauguaaauuaucugaaaggacagaauauaagauuuaaccauguuugacguauuuuaauu

SEQ ID NO: 206491 - RNA, 64 nt, Homo Sapiens
uuaccuuccuuuuuggcugggccucaguggugcaagauuuaaaaaguuuccacggcgacacaca

SEQ ID NO: 206492 - RNA, 64 nt, Homo Sapiens
uuuaugguagacauuuaggacuauaauuuuuuagagauuuaaaagacuuugaagugaacccuug

SEQ ID NO: 206493 - RNA, 64 nt, Homo Sapiens
aucuauagcagaguuucucuauuuuauauuucauagauuuaaaaaacccaaauaaagauggauu

SEQ ID NO: 206494 - RNA, 64 nt, Homo Sapiens
cagugguggcacguagagaacuagaugguaauaaagauuuaaaacuaugaagaagguuacagug

SEQ ID NO: 206495 - RNA, 64 nt, Homo Sapiens
caagggguuacuuuacauccgauuuuuaaaacucagauuuaaaaggaccuuuucuuuacccaag

SEQ ID NO: 206496 - RNA, 64 nt, Homo Sapiens
augcuucaguggaaaucaaucaaugccacgauuuagauuuaaugauucagcuuccugcugcuag

SEQ ID NO: 206497 - RNA, 64 nt, Homo Sapiens
acaaaaaaagaaugcuguuccugcaccugccgguuauuuccaagaagcugaaucuuugggacug

SEQ ID NO: 206498 - RNA, 64 nt, Homo Sapiens
agacuggucuuuuagagacggcaugguauauuacuauuuccacauaaugaggagccaaagaaau

SEQ ID NO: 206499 - RNA, 64 nt, Homo Sapiens
aucauaaugcuuaaagccauauggaguuggaaauuauuuccaaagcauauuuauuccauuguuu

SEQ ID NO: 206500 - RNA, 64 nt, Homo Sapiens
aauuuauuuuccuccauucauguacuuuuccuuauauuuccaaaacuguuacugagaauggguc

SEQ ID NO: 206501 - RNA, 64 nt, Homo Sapiens
uuguaauagaucccauucauuguccccuuugggguauuuccaauacuugaauggcagauuggag

SEQ ID NO: 206502 - RNA, 64 nt, Homo Sapiens
uguuguaguauacauuggagaaacuggcagguuuuauuuccauuauuuuauuuccacuauaucu

SEQ ID NO: 206503 - RNA, 64 nt, Homo Sapiens
uuggagaaacuggcagguuuuauuuccauuauuuuauuuccacuauaucuaugauaagaugcaa

SEQ ID NO: 206504 - RNA, 64 nt, Homo Sapiens
uguuuuaaguuauauuuugguuuauauaaacugcuauuuccauaugagaauaaucuuccuugag

SEQ ID NO: 206505 - RNA, 64 nt, Homo Sapiens
uucauuugcauauacuuuuugguuuguauauugauauuuccagggacuggagaauugaaaaauu

SEQ ID NO: 206506 - RNA, 64 nt, Homo Sapiens
aacaguauauuguacugaucugaaaauauaagcauauuuccauugcucuuaagcaguguaagag

SEQ ID NO: 206507 - RNA, 64 nt, Homo Sapiens
auuuuagacauuauuacaggagucauauguauauuauuuccagacauuucuauuucaucuuuug

SEQ ID NO: 206508 - RNA, 64 nt, Homo Sapiens
cuuucagcugugucugacauucucucuaccagucuauuuccauucauguggcucagugccuucc

SEQ ID NO: 206509 - RNA, 64 nt, Homo Sapiens
gaacaaaaccuacgcacauaucucucuaccagucuauuuccacucaugugguucagugccuucc

SEQ ID NO: 206510 - RNA, 64 nt, Homo Sapiens
gaacaaaaccuacacacauaucucucuaccagucuauuuccacucaugugauucacugccuucc

SEQ ID NO: 206511 - RNA, 64 nt, Homo Sapiens
acucauaauccagagauaauaaauguaaaauaaguauuuccauaaacuuagaaauaagaaacac

SEQ ID NO: 206512 - RNA, 64 nt, Homo Sapiens
caugccaaagcaaaagaaguuauaaacauugguauauuuccauuuacugauugauugguccuuu

SEQ ID NO: 206513 - RNA, 64 nt, Homo Sapiens
cugguauuuuaaauagacacuuauuuccuuaguuuauuuccaaagauaucacauaguacauaua

SEQ ID NO: 206514 - RNA, 64 nt, Homo Sapiens
aaaugcauuuucuuagcaucuccccuauuuuacuuauuuccaagacuuggaagggcaaaaauca

SEQ ID NO: 206515 - RNA, 64 nt, Homo Sapiens
ucguucauaaaugugucuggugaguucuuuccaauauuuccauauuuguaucuaggaguccauu

SEQ ID NO: 206516 - RNA, 64 nt, Homo Sapiens
uuggucuucaauucaagagaucauucaugauguguauuuccaauccagugacuagagagagguu

SEQ ID NO: 206517 - RNA, 64 nt, Homo Sapiens
aggauugcaugugaagucuuuucuacugaaucuauauuuccauuuguaagugauuuuaaguuaa

SEQ ID NO: 206518 - RNA, 64 nt, Homo Sapiens
aauauguuauccccacuaauuaauuuucguauauuauuuccaauauuuggaaagcucuuuauag

SEQ ID NO: 206519 - RNA, 64 nt, Homo Sapiens
uaucaugauuuccauuuuaauuccaauuaaguuguauuuccaaaugaugagauuacuuaaugau

SEQ ID NO: 206520 - RNA, 64 nt, Homo Sapiens
uugaccacauaguuggaagucaccacaucacacuuauuuccacaagaauauacauucuucucag

SEQ ID NO: 206521 - RNA, 64 nt, Homo Sapiens
ccaucagacuaaaaucuaagagauaauaucaauuuauuuccaaucccccaagcuauccuguuuc

SEQ ID NO: 206522 - RNA, 64 nt, Homo Sapiens
ucuccaaagauggucacugucuguguaaugaggcuauuuccaaguuaguguauaacaucaaguu

SEQ ID NO: 206523 - RNA, 64 nt, Homo Sapiens
aggauuuagguaugcuauuaccuuagaauguuucuauuuccauauuucaaaauuguugcauccc

SEQ ID NO: 206524 - RNA, 64 nt, Homo Sapiens
aacuagugauauggcaucguaaguaaugaaggcauauuuccaauucaauauugauuuuaaauau

SEQ ID NO: 206525 - RNA, 64 nt, Homo Sapiens
aauaugccaaaaggaaaacuucccuagaguuuuauauuuccaaaguugauaaaaaucuuaacca

SEQ ID NO: 206526 - RNA, 64 nt, Homo Sapiens
ccuuauuaguauacauacuuccuuaaaauacuuuuauuuccauguuuuauacaggguuaauaau

SEQ ID NO: 206527 - RNA, 64 nt, Homo Sapiens
uuguuaaagagccagccauuguaaaacaaccuuuuauuuccaaagacuaccaaagaaauacaua

SEQ ID NO: 206528 - RNA, 64 nt, Homo Sapiens
cauuuagcacaaauaaaucauauucugaauacauuauuuccauugugcaguguacaaagaagua

SEQ ID NO: 206529 - RNA, 64 nt, Homo Sapiens
cucacaguagaauagaaauguugcuguuaccugguauuuccacugcaauuuccuccugugacgg

SEQ ID NO: 206530 - RNA, 64 nt, Homo Sapiens
guugcugagaaucaaagcacauuuugccaggaaguauuuccauaccuuuguuguucuguuuccu

SEQ ID NO: 206531 - RNA, 64 nt, Homo Sapiens
auuauuugguuuauuaugcgauuacugaagguauuauuuccaauauucugcuucuuacagaagu

SEQ ID NO: 206532 - RNA, 64 nt, Homo Sapiens
uucuccacugcguguggucacauuggaaauaguuuauuuccacagcuccauuucucugccuucc

SEQ ID NO: 206533 - RNA, 64 nt, Homo Sapiens
auaauauacauugaguacuccaucucuccaaauguauuuccauaauguguugaaaacaugcuaa

SEQ ID NO: 206534 - RNA, 64 nt, Homo Sapiens
guuuguaaaccaaaaaguaauaaaugaaucccuauauuuccauuauaguauuuauuguauuuuu

SEQ ID NO: 206535 - RNA, 64 nt, Homo Sapiens
aaauguauacaauaucagaauuuggauuuuguuuuauuuccaaauugacaauaacaaaaauggu

SEQ ID NO: 206536 - RNA, 64 nt, Homo Sapiens
uuuaagaguaaauuuaaucucuuuaaaauuccuguauuuccauugaacagaccuuuucuuuuua

SEQ ID NO: 206537 - RNA, 64 nt, Homo Sapiens
gcacauaaguaaaggugcuuuuuaaugugcagucuauuuccagagcuuacuuaguugcugauuu

SEQ ID NO: 206538 - RNA, 64 nt, Homo Sapiens
auuuuuuugcuuuucauuuucuaaaguuaguuauuauuuccauugaagcuuguuuucuuuuuuu

SEQ ID NO: 206539 - RNA, 64 nt, Homo Sapiens
uaaauuucuuuauuuuauauuucaggaauuuaauuauuuccagauuuccaaccacugauuacuu

SEQ ID NO: 206540 - RNA, 64 nt, Homo Sapiens
uuuggaaaaggaaaaaaaaaauaaacuagcucauuauuuccaucgauuuaggucauuaauuuag

SEQ ID NO: 206541 - RNA, 64 nt, Homo Sapiens
aguuuauuuugugauuuuuuggaaucguacuuuauauuuccaaauuuaaauuuaaaugcaagau

SEQ ID NO: 206542 - RNA, 64 nt, Homo Sapiens
cacuaguaccauugacucucguugaauaacuuuauauuuccauaauccugaauuguguagauag

SEQ ID NO: 206543 - RNA, 64 nt, Homo Sapiens
auauuuauauuucaguuuuuuuauuucuuagaacuauuuccaaacaaacaaaauauuuucauau

SEQ ID NO: 206544 - RNA, 64 nt, Homo Sapiens
ucagaagagccaaaaaaaagaacagcacuuuuauuauuuccaguuuuuuuuuaaauucacggug

SEQ ID NO: 206545 - RNA, 64 nt, Homo Sapiens
ugaagaguuacauuucguaucaaauuuuauuuuuuauuuccacuuguauucaauaguaaauaga

SEQ ID NO: 206546 - RNA, 64 nt, Homo Sapiens
cacaaggaaagauuuauuuacuucauuucaaaacuauuuccaaugacaaccuccaaucaguuua

SEQ ID NO: 206547 - RNA, 64 nt, Homo Sapiens
ucuuugauaugcuuacgaguaagugaauccugauuauuuccagacccaccaccagaguggaucu

SEQ ID NO: 206548 - RNA, 64 nt, Homo Sapiens
guauaaucuuuucaucugcuuuuagaaugugggauauuuccaguaccuacuuuuuuuuuuuuuu

SEQ ID NO: 206549 - RNA, 64 nt, Homo Sapiens
cugcugcuucucagggaauccgacaccagccaaccauuuuaagccucuaaaagaccucgggcaa

SEQ ID NO: 206550 - RNA, 64 nt, Homo Sapiens
cgucaaaguuguaagugacuaaccaagauuauuucauuuuaaaaccauagaauaaaaaugacac

SEQ ID NO: 206551 - RNA, 64 nt, Homo Sapiens
guuaauuugcuuuuuaaaacaaauuuaauuaucacauuuuaaauuacuuuguggacuguguuuu

SEQ ID NO: 206552 - RNA, 63 nt, Homo Sapiens
uuaacuuuuuuacucuuauaaaaccaguuccugacauuuuaaaaaacaauaucuguaaaaugg

SEQ ID NO: 206553 - RNA, 64 nt, Homo Sapiens
uauucuuuucaugguauuuucuuccauaauaucucauuuuaaaaagaaguucuuuaugaacuua

SEQ ID NO: 206554 - RNA, 64 nt, Homo Sapiens
guaacauauacauagccacauuuacaguuuuaaccauuuuaaggcauguaauucagugggguua

SEQ ID NO: 206555 - RNA, 64 nt, Homo Sapiens
auauuuagaauuuuuaaacauguacaaagggcuacauuuuaauuuuaaaauagcuucacauuau

SEQ ID NO: 206556 - RNA, 64 nt, Homo Sapiens
cuucacauuauuuuacuuauauuggguuuuucuucauuuuaauccuuuucaaguggaauggcuu

SEQ ID NO: 206557 - RNA, 64 nt, Homo Sapiens
uuguuuaacacgguuacugaaagcuguaacuugucauuuuaauuuuugaaauagacugugaagu

SEQ ID NO: 206558 - RNA, 64 nt, Homo Sapiens
gauagauaguggagaaaauuuguaagaaaauguucauuuuaaguaguuucuuacaaauaaaguu

SEQ ID NO: 206559 - RNA, 64 nt, Homo Sapiens
guaguaaugcuuauuuuaaaauucauuuuggaaccauuuuaaauauuuauauuaccauuuauag

SEQ ID NO: 206560 - RNA, 64 nt, Homo Sapiens
acucaaagguacacuauacaguuaucuuuuaagacauuuuaauguaauguucugguaacaagcu

SEQ ID NO: 206561 - RNA, 64 nt, Homo Sapiens
uauuucauagacaaaccaaaaauaaaaauuacgacauuuuaagaacauugucugcugcaauuua

SEQ ID NO: 206562 - RNA, 64 nt, Homo Sapiens
cauaaugucccaaaauagauuuaaaaguaaauagcauuuuaagcagcuguguuuauuugugaag

SEQ ID NO: 206563 - RNA, 64 nt, Homo Sapiens
cguaggaaacucaauauucuguaauccucuuacucauuuuaagaggcagaugcaccaauacaug

SEQ ID NO: 206564 - RNA, 64 nt, Homo Sapiens
ucuuuaacuucuuauuucucgagaaaaagggagacauuuuaaauacuuuuuuacaauuggcucu

SEQ ID NO: 206565 - RNA, 64 nt, Homo Sapiens
uguugaauggaauaacugcaaaauacucugucuucauuuuaacaaggaaacuagagugcauuua

SEQ ID NO: 206566 - RNA, 64 nt, Homo Sapiens
gaaauagacaaaacacaucuccuccuagaacuuacauuuuaauggaaaaacaacuuuguuccuu

SEQ ID NO: 206567 - RNA, 64 nt, Homo Sapiens
aaugagucacggcacuaacucaugguucuauacucauuuuaagaaauuguaaagguugaggugu

SEQ ID NO: 206568 - RNA, 64 nt, Homo Sapiens
uguacaguauaguaaaaauacccuuuacuucugacauuuuaaggucacguccuauaguuugggg

SEQ ID NO: 206569 - RNA, 64 nt, Homo Sapiens
ccuuccaaauaaaaagcuaaauauuccuccuugucauuuuaaugucauuauugaaauacuuuua

SEQ ID NO: 206570 - RNA, 64 nt, Homo Sapiens
auuaauaccaaauauuuuagccuuaaauuuuugucauuuuaaaaucugauuuaauguuuucugc

SEQ ID NO: 206571 - RNA, 64 nt, Homo Sapiens
gaaacauuuucuuucuuuuucuggaaauuuuguccauuuuaaaaaccaaucauuuuaagaagac

SEQ ID NO: 206572 - RNA, 64 nt, Homo Sapiens
uuuucuggaaauuuuguccauuuuaaaaaccaaucauuuuaagaagacaugacaaugcaaugaa

SEQ ID NO: 206573 - RNA, 64 nt, Homo Sapiens
uuuauagugcuuauuugcaacacugaagucuuaacauuuuaacaaggauguuauugacauuaua

SEQ ID NO: 206574 - RNA, 64 nt, Homo Sapiens
caguguuuauuuugcaugauugaguguaaucuagcauuuuaauauguuucauugccuugauguu

SEQ ID NO: 206575 - RNA, 64 nt, Homo Sapiens
acguucauuuaauuauguauuuucugaaaacucucauuuuaaaauaaaauguguuuaauuuucc

SEQ ID NO: 206576 - RNA, 64 nt, Homo Sapiens
auuucuaacauuucuuaacaugguauucucagaacauuuuaaugauuugcauucagugccuuac

SEQ ID NO: 206577 - RNA, 64 nt, Homo Sapiens
aggugcccgcacuaccauacaauuuauauuaauacauuuuaaaaaacuuuaaaaaacuaugucu

SEQ ID NO: 206578 - RNA, 60 nt, Homo Sapiens
uuccuauuuuuuuuuccaguuaaacuacugcauuuuaagcauauggaagauggcauguaa

SEQ ID NO: 206579 - RNA, 64 nt, Homo Sapiens
uacauuuucuuagaaaauuggauauucagaauaacauuuuaaacaacaauauaauucuuuggca

SEQ ID NO: 206580 - RNA, 64 nt, Homo Sapiens
aaaaggugaaaaucauuugggugcauuuauuguacauuuuaagagacagugaucaaaguuuuca

SEQ ID NO: 206581 - RNA, 64 nt, Homo Sapiens
gacuccuauacaaggaauuagaauuggauugggccauuuuaauuauggcucuucuuucaacaua

SEQ ID NO: 206582 - RNA, 64 nt, Homo Sapiens
augagagguaauuuuauuuuuuaaagacuucugucauuuuaaacauucauaggcccgaaacacc

SEQ ID NO: 206583 - RNA, 64 nt, Homo Sapiens
agccugaagaaaauugccucagccuccacaguaccauuuuaaauucacauaaaaggugaaagcu

SEQ ID NO: 206584 - RNA, 64 nt, Homo Sapiens
uucuucacaaaaaaagaaaagaucuuaagucauacauuuuaauuguguagagguuguucaacug

SEQ ID NO: 206585 - RNA, 64 nt, Homo Sapiens
aauuuuaaaaacucuauccaaaacauuuuuggagcauuuuaaagccccauacacagaaguauac

SEQ ID NO: 206586 - RNA, 64 nt, Homo Sapiens
uaucuauuuuuauaaccaccugugguccauuguucauuuuaauucacauuucuuaugaaguaug

SEQ ID NO: 206587 - RNA, 64 nt, Homo Sapiens
guuucaacgcugaccuuuucuugcauuauuguuucauuuuaaugauaguguuacuugucccacu

SEQ ID NO: 206588 - RNA, 64 nt, Homo Sapiens
uaauugcuagauuaaaaauagacuagaacagguucauuuuaagauuuacuuggaagagcaaaga

SEQ ID NO: 206589 - RNA, 64 nt, Homo Sapiens
uagcucucucaaaaauuaauuuuuauuccuuaagcauuuuaaaaacauuuuaaaaaauguuuug

SEQ ID NO: 206590 - RNA, 64 nt, Homo Sapiens
aaaauuaauuuuuauuccuuaagcauuuuaaaaacauuuuaaaaaauguuuuguaaauccaggu

SEQ ID NO: 206591 - RNA, 64 nt, Homo Sapiens
ugauuucaaaaucaguuuuuauuaaaacauauuucauuuuaacaauagccaacugcuaaugcaa

SEQ ID NO: 206592 - RNA, 64 nt, Homo Sapiens
acuuuauuggguuuuuauugucuuauugggauaucauuuuaaaacaaauugucguuuuuauucc

SEQ ID NO: 206593 - RNA, 64 nt, Homo Sapiens
aucaucuugaauuucuaaaccgaaccauagcuuucauuuuaagccuuacuaugaauacuaauuu

SEQ ID NO: 206594 - RNA, 64 nt, Homo Sapiens
gcuuauuguuguauuuuguaacuucccccgcccccauuuuaaaguaacuaucuuucaauuccau

SEQ ID NO: 206595 - RNA, 64 nt, Homo Sapiens
ucaguuaggcauaauauuucugaucagcagcucucauuuuaacaccauuaacaguauauuguac

SEQ ID NO: 206596 - RNA, 64 nt, Homo Sapiens
aauauaugaaguguaaauacugcauaaauauuuucauuuuaaguugaauggcaaacgcuauuua

SEQ ID NO: 206597 - RNA, 64 nt, Homo Sapiens
ucuagccauaccucagauaauauguuuaguuuuacauuuuaaaauguuuaaauucucuuucaca

SEQ ID NO: 206598 - RNA, 64 nt, Homo Sapiens
uuaagaaaauuuacaaaauuuauucucagguaaucauuuuaauaaaguucugcaaaauacacgu

SEQ ID NO: 206599 - RNA, 64 nt, Homo Sapiens
ugacuugcacuugugcauauacaugauuaauccacauuuuaaaacuagguauaaacauauauuu

SEQ ID NO: 206600 - RNA, 64 nt, Homo Sapiens
cugaaagauacugucgaaauccauagaaucaacacauuuuaagguggcugucuuucuagguauu

SEQ ID NO: 206601 - RNA, 64 nt, Homo Sapiens
aucugcccuaugaguaucaaaaaacagacuaugacauuuuaaaauauuuuuucauugauauuug

SEQ ID NO: 206602 - RNA, 64 nt, Homo Sapiens
uuaucuauggcuguuuuaaagccuacagauuuuacauuuuaaaagugaacuauaaaagcuuuuu

SEQ ID NO: 206603 - RNA, 64 nt, Homo Sapiens
ccagauauuauuuaauuccaauuagccaccuaaacauuuuaauuuguggucaaauaauauaguc

SEQ ID NO: 206604 - RNA, 64 nt, Homo Sapiens
aaccaugaauguugauuucacuuagcuuuuaaggcauuuuaaaugaguuacuauguauauuaug

SEQ ID NO: 206605 - RNA, 64 nt, Homo Sapiens
agcaagaagauauauuuagacuuuguaugugugucauuuuaauaugguagaucguguuuagagg

SEQ ID NO: 206606 - RNA, 64 nt, Homo Sapiens
agagcuuauauucuaguggaggaaguuagacaagcauuuuaaguaauaaauguauagagagugu

SEQ ID NO: 206607 - RNA, 64 nt, Homo Sapiens
aagugugagcuguguuaaaaggcauucuuagauucauuuuaaccacauuuuuaaaaacucacag

SEQ ID NO: 206608 - RNA, 64 nt, Homo Sapiens
ugggaagauuuugaaaacaggacaaagaaaacaucauuuuaaaaugucuucagcuuuuuuugaa

SEQ ID NO: 206609 - RNA, 64 nt, Homo Sapiens
guauucaaacauauucugaacauugauguuugaacauuuuaauuugugugaugauguagaaaau

SEQ ID NO: 206610 - RNA, 64 nt, Homo Sapiens
aggauuuuuaaauucaaauaaggauggcagugcccauuuuaaggaggauuucagcuauaacuga

SEQ ID NO: 206611 - RNA, 64 nt, Homo Sapiens
ugaauaugcaaucauuuacuucuacugagugcugcauuuuaagaugcuagaugagaagaguagu

SEQ ID NO: 206612 - RNA, 64 nt, Homo Sapiens
augaccaaccagauuaaacucuacccacauccugcauuuuaaggucuaaguuuaacuggucaac

SEQ ID NO: 206613 - RNA, 64 nt, Homo Sapiens
cucccacuucugaaauguucauuuauacugguugcauuuuaagaucaugaaacaauuccaguua

SEQ ID NO: 206614 - RNA, 64 nt, Homo Sapiens
auguauuaauaaugccuuauauauuguuuguagucauuuuaaguagcaugagccaugucccugu

SEQ ID NO: 206615 - RNA, 64 nt, Homo Sapiens
gaauuaaauauuguaagauauguauaaugcuggccauuuuaaagggguuuucucaaaaguuaaa

SEQ ID NO: 206616 - RNA, 64 nt, Homo Sapiens
auucugcuuuuuauacauuucagugcucugcauacauuuuaaauuaugaaugucgugcacuggc

SEQ ID NO: 206617 - RNA, 64 nt, Homo Sapiens
acuguguauggggagguuguaguauuuauuauagcauuuuaaauaaggguaauucauuuuuuau

SEQ ID NO: 206618 - RNA, 64 nt, Homo Sapiens
cagcccaguauuccuuuguacuucucaguuuucucauuuuaaaaggcuagaaaccuaacugauu

SEQ ID NO: 206619 - RNA, 64 nt, Homo Sapiens
aaaagcaaaaggagcauuuauaggcaugcugugacauuuuaauacagccauauaaacuguucuc

SEQ ID NO: 206620 - RNA, 64 nt, Homo Sapiens
acacaagauuuaauugaaagggcugcguguuuuucauuuuaaacaaauauggauauuuguacca

SEQ ID NO: 206621 - RNA, 64 nt, Homo Sapiens
gaucaaaacaaacaaacaaacugauaauaaacaucauuuuaaaaaccccauggaaacacuaguc

SEQ ID NO: 206622 - RNA, 64 nt, Homo Sapiens
uaacaccacaccccauggaacugugcaggggggucauuuuaaugaaugaaauauucaaccccug

SEQ ID NO: 206623 - RNA, 64 nt, Homo Sapiens
ugaacacuuuacaaagaacaugcccggguuuuuacauuuuaaaaguuauucuagacaaucacua

SEQ ID NO: 206624 - RNA, 64 nt, Homo Sapiens
caggccucaccuagacauccagaaucaaaaucugcauuuuaacaagaugcccaggugaucugca

SEQ ID NO: 206625 - RNA, 64 nt, Homo Sapiens
uauaaugaagguaaaauuaauuuuucuuacgccucauuuuaauuuauauauuauggucucaaug

SEQ ID NO: 206626 - RNA, 64 nt, Homo Sapiens
uuuuaauauauauuguaaaaaaugauuuuuuuagcauuuuaauacacaguguauucuauauugc

SEQ ID NO: 206627 - RNA, 64 nt, Homo Sapiens
guaguuugaauauuuuccacccauuuuacagaagcauuuuaaauuuguggagcaauagaguucu

SEQ ID NO: 206628 - RNA, 64 nt, Homo Sapiens
gucaguuacaauaugagaaagauguuuuaagaagcauuuuaaauguauuuuucguauucuggaa

SEQ ID NO: 206629 - RNA, 64 nt, Homo Sapiens
ucaaaacuaaaguguuuuucaacgaauuaauaaacauuuuaauauguuugggaaacauuuuaau

SEQ ID NO: 206630 - RNA, 64 nt, Homo Sapiens
acgaauuaauaaacauuuuaauauguuugggaaacauuuuaauaauaaaauggagacggcuuuc

SEQ ID NO: 206631 - RNA, 64 nt, Homo Sapiens
cucugguguuuauuauaaagcuuaaauuuuauaucauuuuaaaaugucuuggucuucuacugcc

SEQ ID NO: 206632 - RNA, 64 nt, Homo Sapiens
gagcucuuugaucgcuuuuaauaaacugcaaguucauuuuaaaugaagggccagcauauauacu

SEQ ID NO: 206633 - RNA, 64 nt, Homo Sapiens
ugaaaaguaugagaucugguuccauccaguaagacauuuuaauagagaagaucaaaauguuacc

SEQ ID NO: 206634 - RNA, 64 nt, Homo Sapiens
uuuuccuuuuucucagauguagcugagucuugaucauuuuaagacaacgauggguagaauuuug

SEQ ID NO: 206635 - RNA, 64 nt, Homo Sapiens
uagagugggaauuuuuuccuaaucauguuuuuaacauuuuaaaauaaaauuuaauacuaagaaa

SEQ ID NO: 206636 - RNA, 64 nt, Homo Sapiens
uguuuaauucacguuugggaauauugaaugaauccauuuuaacauaagcacuguggugccaucu

SEQ ID NO: 206637 - RNA, 64 nt, Homo Sapiens
ggaauuucuugcuuauagaggcaaaccacaguaucauuuuaacucuagaauugggcuuguacag

SEQ ID NO: 206638 - RNA, 64 nt, Homo Sapiens
cuucuauuauuuguuuaguauguuguaaguagaucauuuuaaaaaacugaaucuauauuauguu

SEQ ID NO: 206639 - RNA, 64 nt, Homo Sapiens
auuuuuaaguguacaguucuuuuuaaacauuuaccauuuuaaccauauaaauacauauuugcca

SEQ ID NO: 206640 - RNA, 64 nt, Homo Sapiens
auuuaccauuuuaaccauuuaaauacauauuugccauuuuaaacucuauugugguaaaauauau

SEQ ID NO: 206641 - RNA, 64 nt, Homo Sapiens
uauuuucaaucacauacaaguacauagaauuucacauuuuaauuuagcaaauugauuuaccuag

SEQ ID NO: 206642 - RNA, 64 nt, Homo Sapiens
cauagacacauaauuaugcuuaagcuuuuaacagcauuuuaaccgcucuaaaaauuaccagagu

SEQ ID NO: 206643 - RNA, 64 nt, Homo Sapiens
aauuaaaugcccuuaaauuucaccauuugucuuucauuuuaaagguuauuugcucccgauuaua

SEQ ID NO: 206644 - RNA, 64 nt, Homo Sapiens
acuagagauguuucaaauguagauuuuaccagaccauuuuaaucaacuuuauugagauucaauu

SEQ ID NO: 206645 - RNA, 64 nt, Homo Sapiens
ucugggauuuauagaucaauuuagggagaaaugacauuuuaacaauucugaguuuuccaauugu

SEQ ID NO: 206646 - RNA, 64 nt, Homo Sapiens
caguucuuuuuuuuuguuaauuauuuuaaauauacauuuuaaaggggauugaguuaaaacuauu

SEQ ID NO: 206647 - RNA, 64 nt, Homo Sapiens
auauuccuucaagugaguuugccccugcagcccacauuuuaaguauccccuuccccacguucca

SEQ ID NO: 206648 - RNA, 64 nt, Homo Sapiens
aacaaugcaaacaucuucagaaaucugauuaauccauuuuaacaggacaugguguuuaaaauuu

SEQ ID NO: 206649 - RNA, 64 nt, Homo Sapiens
ucuauagguuuuuaaauggagucuauauuuaaaucauuuuaacucuucaugcuuacuauuuuau

SEQ ID NO: 206650 - RNA, 64 nt, Homo Sapiens
uccuauuaccaaguucaguuacuguuaaaacuuucauuuuaaaauaccuuuauaguuaucgauc

SEQ ID NO: 206651 - RNA, 64 nt, Homo Sapiens
cuuuuuuuuuuccauauaggacugccaauugucacauuuuaagauggguauuuuguccugauuc

SEQ ID NO: 206652 - RNA, 64 nt, Homo Sapiens
ugcacaaaggaagucuguucccguaaacuuguaucauuuuaacuaaguagguuguuuuccugaa

SEQ ID NO: 206653 - RNA, 64 nt, Homo Sapiens
ugacacuguuaacccaacgguauuuaauuuauggcauuuuaaaaaaaaaaaaugugaacuaacu

SEQ ID NO: 206654 - RNA, 64 nt, Homo Sapiens
cccucuuuacagacacuaacguguuuaaaauacacauuuuaaauaugcacucagcucaacugcu

SEQ ID NO: 206655 - RNA, 64 nt, Homo Sapiens
uuuuauaccuuuaucuucuugguuuacuauugcacauuuuaagcuagaaaaagaaaaaaggcug

SEQ ID NO: 206656 - RNA, 64 nt, Homo Sapiens
uuugaauuggcaauauauauagguucauccaugucauuuuaaaucacccagcauaaugacuuug

SEQ ID NO: 206657 - RNA, 64 nt, Homo Sapiens
uguauaaaguaacaauucagaccaagauacuuuucauuuuaaaaucuuggauuccaaacuaaac

SEQ ID NO: 206658 - RNA, 64 nt, Homo Sapiens
uuucauuguaccaugaaaccauuugauuuuuacccauuuuaaauguguuucugaagcaagacaa

SEQ ID NO: 206659 - RNA, 64 nt, Homo Sapiens
cccacccugauguaauugacauuacauuucuuaacauuuuaaaaucuagaauuucuaaaaugga

SEQ ID NO: 206660 - RNA, 64 nt, Homo Sapiens
auaauggcuuauaaaugguguuuaaauaugcauucauuuuaaucuacugaacaaauauugggau

SEQ ID NO: 206661 - RNA, 64 nt, Homo Sapiens
aaauauuuacaaucauauagaauauauagaguuacauuuuaauagcaacuguguacaugucacg

SEQ ID NO: 206662 - RNA, 64 nt, Homo Sapiens
aucauaguuaacauaguaaguucagcacuugucucauuuuaauguaaagauuugcuuccauuuu

SEQ ID NO: 206663 - RNA, 64 nt, Homo Sapiens
ggcuggaaagcauuuguuauaaaccuauagugcacauuuuaacugcccccuaaauuacccuucc

SEQ ID NO: 206664 - RNA, 64 nt, Homo Sapiens
cacauaaauaugaaacauuuaucagaaauguugccauuuuaaugagaugauuuucuucaucuca

SEQ ID NO: 206665 - RNA, 64 nt, Homo Sapiens
aggaauaucuguauguuggaugacuuuaaugcuacauuuuaaaaaaagaaaauaaaguaauaau

SEQ ID NO: 206666 - RNA, 64 nt, Homo Sapiens
uuuaaugaguuaucacuuuuucagcugauauauucauuuuaauggcuuuuuugaaaguuccuuu

SEQ ID NO: 206667 - RNA, 64 nt, Homo Sapiens
uucaugguggcaaaauauuagcucuguuuugggacauuuuaaaauagaacuauccuuguucgau

SEQ ID NO: 206668 - RNA, 64 nt, Homo Sapiens
uccacugaaaauuuaacaguggaguugguguaaucauuuuaaauuucucuuccuggcaucauaa

SEQ ID NO: 206669 - RNA, 64 nt, Homo Sapiens
aaaagucuaccuguguuuuuccucaaguaauaggcauuuuaaguuuuguauacagagaagaaaa

SEQ ID NO: 206670 - RNA, 64 nt, Homo Sapiens
gagcaggagagaaaagagaguuucauggagguuucauuuuaauguacauuucagucuuuuucau

SEQ ID NO: 206671 - RNA, 64 nt, Homo Sapiens
acuuuuccaaagugauucuuggcuuaggaacgugcauuuuaaacugaaucagaaacuagguugg

SEQ ID NO: 206672 - RNA, 64 nt, Homo Sapiens
gccauuccuuuugcccaguuaaauguucaccaaucauuuuaacuaaauacucagacuuagaagu

SEQ ID NO: 206673 - RNA, 64 nt, Homo Sapiens
aauuguuuucuguaucuugaaaaaguauucuccacauuuuaaauguuuuauauuagagaauucu

SEQ ID NO: 206674 - RNA, 64 nt, Homo Sapiens
uuuaggcaacggguaucauauccaugaaaaaugucauuuuaagacacuaauaucaacaguauau

SEQ ID NO: 206675 - RNA, 64 nt, Homo Sapiens
aaaguaggaaguugagcacaaccuuguccacagccauuuuaaauauccacuuagcccuguguag

SEQ ID NO: 206676 - RNA, 64 nt, Homo Sapiens
uuuaucuuccaaacccaaucuaguaggauguucucauuuuaaaaacgaggggaaaagaccagag

SEQ ID NO: 206677 - RNA, 64 nt, Homo Sapiens
ucuauuuuauacuuaccauugacuuaagaaauaacauuuuaaaaaauuguaaagauugacaaua

SEQ ID NO: 206678 - RNA, 64 nt, Homo Sapiens
agaagauccagguuuuagugccuggccaaaacaacauuuuaaguuacaggcgugagccaccgcg

SEQ ID NO: 206679 - RNA, 64 nt, Homo Sapiens
ccaucugauacuccauugccauccccagaagaaccauuuuaacucuccaggagcaugagaauug

SEQ ID NO: 206680 - RNA, 64 nt, Homo Sapiens
acuaacugggucuuucagauuuuuaacccuuuaccauuuuaaaugcagggagaaauauuaacuu

SEQ ID NO: 206681 - RNA, 64 nt, Homo Sapiens
gguuucccuugcccuuuccaaggauaauggugaacauuuuaaugcaguucuguguacauuuuaa

SEQ ID NO: 206682 - RNA, 64 nt, Homo Sapiens
gauaauggugaacauuuuaauucaguucuguguacauuuuaaaggacaaauguguauguguggu

SEQ ID NO: 206683 - RNA, 64 nt, Homo Sapiens
uuaguuucaugagucuuuauuauuauucuguaaacauuuuaauucucauuuuaauaucuuaugc

SEQ ID NO: 206684 - RNA, 64 nt, Homo Sapiens
ucuuaugcuauuauucuguauuuuucuauauucucauuuuaauauauuuuccuaagcacaaauc

SEQ ID NO: 206685 - RNA, 64 nt, Homo Sapiens
ugccaaauuaccuuauaguaagguuaucugucugcauuuuaaacaaauagaaauuguaaaucag

SEQ ID NO: 206686 - RNA, 64 nt, Homo Sapiens
cuaacucauuuucuuugaguuaaagcuguguauacauuuuaaaaggcauauagauaguguaugc

SEQ ID NO: 206687 - RNA, 64 nt, Homo Sapiens
uaacaguacgcacugaauagugaaaauaauuagacauuuuaagaaccagagccauagaauuauu

SEQ ID NO: 206688 - RNA, 64 nt, Homo Sapiens
acugcaaugguauaaaggaacaaggaugagucuacauuuuaagaacacagcuuguuuuuuugcc

SEQ ID NO: 206689 - RNA, 64 nt, Homo Sapiens
agagaauugccaauacagaauuaauaaauccuuucauuuuaaaaaguacaaaucuuaaauauuu

SEQ ID NO: 206690 - RNA, 64 nt, Homo Sapiens
augcauaaaaugaauuagauuggcuuucugccuccauuuuaauccauaaguucauggaaugaaa

SEQ ID NO: 206691 - RNA, 64 nt, Homo Sapiens
gacuuucuuuugcuugauccaaacuguccuaucucauuuuaaaauucuuccaguauuuuuuaaa

SEQ ID NO: 206692 - RNA, 64 nt, Homo Sapiens
uggcauuucugccugguuccuauauaaacauuuucauuuuaaguuuaaacuggauggguuaauu

SEQ ID NO: 206693 - RNA, 64 nt, Homo Sapiens
uuuaauauaaaaagggguuucuggauuugucuuucauuuuaacuuugcaaucacuauguucaau

SEQ ID NO: 206694 - RNA, 64 nt, Homo Sapiens
agcccuguuauaaacguugaccaaaacuuuucuccauuuuaaaaaguuucuuuuuaaaaauuuu

SEQ ID NO: 206695 - RNA, 64 nt, Homo Sapiens
gacuacuuuuauuuuuuaauaucuacaauuccuccauuuuaaaugaauggauuuuuccauacuc

SEQ ID NO: 206696 - RNA, 64 nt, Homo Sapiens
gcugaauugagaucaggguuucuuuuccagggugcauuuuaauauacguaugaaaugaaauauu

SEQ ID NO: 206697 - RNA, 64 nt, Homo Sapiens
guuguuguuauagccaugcauugaccauuaaaugcauuuuaauaucucggcaaaaugagauuug

SEQ ID NO: 206698 - RNA, 64 nt, Homo Sapiens
ccugcuaccuaguuuguuagugcauuugagcacacauuuuaauuuuccucuaauuaaaaugugc

SEQ ID NO: 206699 - RNA, 64 nt, Homo Sapiens
aaaucacagauuuuuucuuuaaauaaaaauaagucauuuuaauaacuaaaccagauucuuugug

SEQ ID NO: 206700 - RNA, 64 nt, Homo Sapiens
aaacuaugccacagucuggauguguuuacugaaacauuuuaauaaggaaguuuauuuuugauaa

SEQ ID NO: 206701 - RNA, 64 nt, Homo Sapiens
uacuguguauuuuucacuuguuucuaagaucaaacauuuuaauaugugcauguuauauauaaau

SEQ ID NO: 206702 - RNA, 64 nt, Homo Sapiens
uucauagacaugaaauaguugcucagagauuaugcauuuuaagacacucauaguauauauugcc

SEQ ID NO: 206703 - RNA, 64 nt, Homo Sapiens
cgaucagauuuuuccagaauuccguaucagucaccauuuuaauauggggacaaugaagacaagc

SEQ ID NO: 206704 - RNA, 64 nt, Homo Sapiens
cucuuaaagaaauuaugaaaaauguacaauuuaacauuuuaaauaaauagugacagaaguuguu

SEQ ID NO: 206705 - RNA, 64 nt, Homo Sapiens
uuugagccuaggagaaaaugccacugugugcauccauuuuaaaggguucccucauaaaaaaaug

SEQ ID NO: 206706 - RNA, 64 nt, Homo Sapiens
caggugugagccacugugccuagccuauaaugaucauuuuaauguuucccaugcacucauuuag

SEQ ID NO: 206707 - RNA, 64 nt, Homo Sapiens
uuccagacauacuucucugcaacuuguugagcaacauuuuaagauguuggacuucugcaauaga

SEQ ID NO: 206708 - RNA, 64 nt, Homo Sapiens
gugauuugugggagacuaguguauuuuaaauuagcauuuuaauccauucuugacauucaguuag

SEQ ID NO: 206709 - RNA, 64 nt, Homo Sapiens
acuauaguuucucuaaaacuuuaucugaaagagucauuuuaaaauaacuauuaaacaauguaac

SEQ ID NO: 206710 - RNA, 64 nt, Homo Sapiens
aacugcuaucuuaauguucugaaauaaguuaaaacauuuuaaaauaugaauacuguaaaggaaa

SEQ ID NO: 206711 - RNA, 64 nt, Homo Sapiens
uaaucaagccacacuaacuauggaaaaugagcagcauuuuaaaugcuuucuagugaaaaauuau

SEQ ID NO: 206712 - RNA, 64 nt, Homo Sapiens
uagacaaaagaaaauacacacuaaaacuaaucuucauuuuaaaaggguaaaacaugacuauaca

SEQ ID NO: 206713 - RNA, 64 nt, Homo Sapiens
ccagacuuucuuuuucuacaugugagauaguuuucauuuuaacuggcaugucauuugcacacaa

SEQ ID NO: 206714 - RNA, 64 nt, Homo Sapiens
aaggcuguccacguacuuaauuuacuuaaguguucauuuuaaguaacgugcucacuguguauag

SEQ ID NO: 206715 - RNA, 64 nt, Homo Sapiens
aagcagagaccaucugugaccauagccuagcuagcauuuuaaaaggggaaauuuuguucucuag

SEQ ID NO: 206716 - RNA, 64 nt, Homo Sapiens
uaaccuguucauuaauaucagaaauuuacaauagcauuuuaagaccauaguaggauucuagcau

SEQ ID NO: 206717 - RNA, 64 nt, Homo Sapiens
guaaauagagagagagagaaacccccacccaagacauuuuaauaaaguugacucuucgaccccc

SEQ ID NO: 206718 - RNA, 64 nt, Homo Sapiens
uuauuuaaacagaaaaagaucucuucuuuuaaaacauuuuaacauggaagcuuucaugaauauu

SEQ ID NO: 206719 - RNA, 64 nt, Homo Sapiens
uaugaauacuguaaaggaaagaaauaaguuaaaacauuuuaaaaaacugcuaucuuaauguucu

SEQ ID NO: 206720 - RNA, 64 nt, Homo Sapiens
uaacuauuaaacaauguaacuuaucugaaagagucauuuuaaaaacuauaguuucucuaaaacu

SEQ ID NO: 206721 - RNA, 64 nt, Homo Sapiens
uauaaauccuguaguuuaaaguucugaaauaaaacauuuuaaaaaauguaacugcuaucuuaau

SEQ ID NO: 206722 - RNA, 64 nt, Homo Sapiens
uaauauaaauauuaaaaaauguaucuuaaagagucauuuuaaaauagcccauggguuuaaaacu

SEQ ID NO: 206723 - RNA, 64 nt, Homo Sapiens
ucagaguucguguucccuguuuguaucuacaauacauuuuaaagccuuuccuagcuuagagcau

SEQ ID NO: 206724 - RNA, 64 nt, Homo Sapiens
cugguauggucaagcuuguaaauaacuuuuuuuacauuuuaaucuuuuccauuaauuaagaggu

SEQ ID NO: 206725 - RNA, 64 nt, Homo Sapiens
agguugaaaagaagugcaguguaagaaaacccagcauuuuaauuacuugcaaauuaaguuacca

SEQ ID NO: 206726 - RNA, 64 nt, Homo Sapiens
cauuaacaugcugcaauucaggagcugguuagaacauuuuaaguggcagcauagaauuuuggaa

SEQ ID NO: 206727 - RNA, 64 nt, Homo Sapiens
uuugauuguuauaacaucucagcaccguuauucccauuuuaaugaugaggaaacugagucauag

SEQ ID NO: 206728 - RNA, 64 nt, Homo Sapiens
uguucuguauuuuuaaauugacuuaauguguauucauuuuaaauauaguagggauaaaacacua

SEQ ID NO: 206729 - RNA, 64 nt, Homo Sapiens
gcccuuuuuaaaaacuagacaaaguaagacccagcauuuuaaaauugaucuuuagauagcaugc

SEQ ID NO: 206730 - RNA, 64 nt, Homo Sapiens
ugggggauaauaacagaacuuuguccauuuucaucauuuuaaaauuaaguugcuugcuuuugcu

SEQ ID NO: 206731 - RNA, 64 nt, Homo Sapiens
guguuucuaauauuuuugauacuaaacauauggacauuuuaaauucaaugaauuuucuauuuau

SEQ ID NO: 206732 - RNA, 64 nt, Homo Sapiens
ugcaaauuuaauucuguucacagucuguaaaugacauuuuaagaacuucuagguauuacagaaa

SEQ ID NO: 206733 - RNA, 64 nt, Homo Sapiens
uguucacaguauguaaaucuagcaaagacaaccacauuuuaauucaguuaagaauaaaccuuaa

SEQ ID NO: 206734 - RNA, 64 nt, Homo Sapiens
gauggaucccuuaagcuacaagaugaaagaccaacauuuuaacuuuuuaaugggaggguaauaa

SEQ ID NO: 206735 - RNA, 64 nt, Homo Sapiens
ggaggguaauaaagaugaaagucccgguuuguuucauuuuaaugcuucuucgaaacugaaguga

SEQ ID NO: 206736 - RNA, 64 nt, Homo Sapiens
gugccagcugugauauugugcauaccauauggaccauuuuaaagaaaauuuuaaaauuucaaau

SEQ ID NO: 206737 - RNA, 64 nt, Homo Sapiens
caaauagauucaacaauuacauuacuugcuuucacauuuuaaaggcacuuuaaaaaaaucuacu

SEQ ID NO: 206738 - RNA, 64 nt, Homo Sapiens
uuauauucauuuucuccuuuuuucggaauugaaacauuuuaauuucaaauucaaauagaacauu

SEQ ID NO: 206739 - RNA, 64 nt, Homo Sapiens
aagauaaacugaauaagcauuuagcuuuuuaaaucauuuuaaaaauuaagucuaauuuugaagc

SEQ ID NO: 206740 - RNA, 64 nt, Homo Sapiens
guuacauuugcaaauauuucuuaaauuauauccucauuuuaaaacaaaaacugcucaaagccau

SEQ ID NO: 206741 - RNA, 64 nt, Homo Sapiens
cauuuuagcacaguucauagguuuugaaaguugucauuuuaaagaacgggagaugaugcacugu

SEQ ID NO: 206742 - RNA, 64 nt, Homo Sapiens
uggauagcucagagguauccucuuuuugcucccccauuuuaacuugccacaucccagucacagu

SEQ ID NO: 206743 - RNA, 64 nt, Homo Sapiens
uaacacagucuggcaguugcuaaauuuguguucccauuuuaaauugaccaauuuugggguguga

SEQ ID NO: 206744 - RNA, 64 nt, Homo Sapiens
uguaaguuauaguaccuguaacaaucaaacaaagcauuuuaaggcaagaauuuugcugaaugaa

SEQ ID NO: 206745 - RNA, 64 nt, Homo Sapiens
gaucugcugauccaccuaagguucuauggaaccacauuuuaagaaucuggaguauuaauguuug

SEQ ID NO: 206746 - RNA, 64 nt, Homo Sapiens
guaauauuugaagauuuguauaacaaauauugugcauuuuaacacucaaaguaagcaauggagg

SEQ ID NO: 206747 - RNA, 64 nt, Homo Sapiens
auaaaacuaaagcauauggguaaagaaaucuaugcauuuuaaggucuugccaucuuuguuuucu

SEQ ID NO: 206748 - RNA, 64 nt, Homo Sapiens
auuaccaugcuggaauaagaagaguugcauuucucauuuuaaugagcauauggaaagaugggaa

SEQ ID NO: 206749 - RNA, 64 nt, Homo Sapiens
aggauuuugcuaagggggcaaaaagcccagauaccauuuuaacuggcccaguucauuuucuccu

SEQ ID NO: 206750 - RNA, 64 nt, Homo Sapiens
uucuguuagugugauuucuugcaacuuuauuuuacauuuuaaacugcugauauuggauauaaug

SEQ ID NO: 206751 - RNA, 64 nt, Homo Sapiens
guguaaauaguauguauuuuauuauaauauuucucauuuuaagaugcuugguuuacauuaaauu

SEQ ID NO: 206752 - RNA, 64 nt, Homo Sapiens
uauuacaucauuuacuugagguucaaaaauaauucauuuuaaauuaaguaguuuuaaucagcuu

SEQ ID NO: 206753 - RNA, 64 nt, Homo Sapiens
aaguaguuuuaaucagcuuaaaagcuauuuaacccauuuuaauaagcuugcaguuuuguuucuc

SEQ ID NO: 206754 - RNA, 64 nt, Homo Sapiens
cacguugccuguuuucaguuaacacugguaaugccauuuuaauauauggcuuuuucaaaucagu

SEQ ID NO: 206755 - RNA, 64 nt, Homo Sapiens
gaauugcauauagagauguucaguggucguuuuucauuuuaaguaauuuuuguuuuggcauuuu

SEQ ID NO: 206756 - RNA, 64 nt, Homo Sapiens
aaauacugauccaauuuucauuuauaacagauuucauuuuaacaacaagcuuuccagaagcaau

SEQ ID NO: 206757 - RNA, 64 nt, Homo Sapiens
ggcaacacuuugacaaaauggguuucauguuagccauuuuaaaaucuuuagaacaaauauugga

SEQ ID NO: 206758 - RNA, 64 nt, Homo Sapiens
auaauuaauuuggacauuaugagcuuuauugcugcauuuuaagcaauauuugaacaaaaauuga

SEQ ID NO: 206759 - RNA, 64 nt, Homo Sapiens
aacuuuccacugacaacgaacuccagauguuucucauuuuaaaccacuaaaacauugucuacag

SEQ ID NO: 206760 - RNA, 64 nt, Homo Sapiens
auuuuuucucauaaauggguauugaauauugguacauuuuaauucuaggucuucaguguuuuac

SEQ ID NO: 206761 - RNA, 64 nt, Homo Sapiens
uauuucggguaaaggugaagggcaauuggcuuugcauuuuaaaggagguucagcaauuggaggu

SEQ ID NO: 206762 - RNA, 64 nt, Homo Sapiens
aaacuaguguggcuaccauuagauggcuuuucaacauuuuaaaauuguucauccuaacuuucug

SEQ ID NO: 206763 - RNA, 64 nt, Homo Sapiens
uggcccacuuucaaggcaauccaauaauuaauugcauuuuaaauauaguccaaaauuuaagucu

SEQ ID NO: 206764 - RNA, 64 nt, Homo Sapiens
aaagggaccaaaaguuauuuugguuucuccagcacauuuuaagaggggaaagugauuuuaaagg

SEQ ID NO: 206765 - RNA, 64 nt, Homo Sapiens
guaacgcagguguagaaucaucugaauacuugaacauuuuaacaaccuaaucagcauauuuuug

SEQ ID NO: 206766 - RNA, 64 nt, Homo Sapiens
uggggagagaggaccuccucugacaaacuggucugguacccaccaugugccaggauccacccug

SEQ ID NO: 206767 - RNA, 64 nt, Homo Sapiens
aucucaauucugacaguguggaaggaaaucuguagguacccagguccucagcuccagacugggu

SEQ ID NO: 206768 - RNA, 64 nt, Homo Sapiens
aaauuuuauuggccuggguagcaggaaauucagaugaggcaagacuuauuaauuaaucacauuu

SEQ ID NO: 206769 - RNA, 64 nt, Homo Sapiens
cuuuguggacaugaauuguuagggcaugagcaacugaggcaaacaaaccagaggaaaugcauac

SEQ ID NO: 206770 - RNA, 64 nt, Homo Sapiens
ucgcauguacccucuguauuucucaacaauccugugaggcaaauuaugcuuucucaugacaguu

SEQ ID NO: 206771 - RNA, 64 nt, Homo Sapiens
augccaccacaguauucuaaacccuuguaacugaugaggcaaugaaguuuauaauacucacuug

SEQ ID NO: 206772 - RNA, 64 nt, Homo Sapiens
ggaaaauccagcacaccaagcaccagucuucuucugaggcaaaagaaaaguguugucauuuuca

SEQ ID NO: 206773 - RNA, 64 nt, Homo Sapiens
guaagaaggaugcuggucagagcugcagaaaauaugaggcaauuaaaagucuuuagcuguuagc

SEQ ID NO: 206774 - RNA, 64 nt, Homo Sapiens
aaauuauuaaaaauacauuaauuuaucugguaaaugaggcaaaaagcaucuauuuauuuagaug

SEQ ID NO: 206775 - RNA, 64 nt, Homo Sapiens
agagggugauucuuuccccagucacagagucuacugaggcaaggcugcucuguguccucaggaa

SEQ ID NO: 206776 - RNA, 64 nt, Homo Sapiens
cuaguucaagaacucauucuuuuuaaauugccacugaggcaaccaugguccuuaaauuucuuuu

SEQ ID NO: 206777 - RNA, 64 nt, Homo Sapiens
uuuacucugcaaugguccuuacauacaguuuucaugaggcaaguuucugaguccauuaucuuuc

SEQ ID NO: 206778 - RNA, 64 nt, Homo Sapiens; identical to SEQ ID NO: 21195

SEQ ID NO: 206779 - RNA, 64 nt, Homo Sapiens; identical to SEQ ID NO: 21196

SEQ ID NO: 206780 - RNA, 64 nt, Homo Sapiens; identical to SEQ ID NO: 21197

SEQ ID NO: 206781 - RNA, 64 nt, Homo Sapiens; identical to SEQ ID NO: 21198

SEQ ID NO: 206782 - RNA, 64 nt, Homo Sapiens
ugagaugacauuauugucuccauaauugagugauagcuuuaaaaaaaagauuaguuuugcuuaa

SEQ ID NO: 206783 - RNA, 64 nt, Homo Sapiens
ggaacauaaauaguuucuaccugcuuguuagagaagcuuuaauuugguucuaauaaauacagua

SEQ ID NO: 206784 - RNA, 64 nt, Homo Sapiens
accucuugcacuguugucuuguuucacugaucuuagcuuuaaacacaagagaagucuuuaaaaa

SEQ ID NO: 206785 - RNA, 64 nt, Homo Sapiens
cccaucucuaaaaaaugaaaaaaagaagagagguagcuuuaaagugguuuuucucaugauauuc

SEQ ID NO: 206786 - RNA, 64 nt, Homo Sapiens
guaacaugggaagacgugaagaagaaauaaucugagcuuuaauuauuuauauuuggauauaagg

SEQ ID NO: 206787 - RNA, 64 nt, Homo Sapiens
uuaguugauagagauucauuuagucaaagacaaaagcuuuaacugugagggcacagccuugaag

SEQ ID NO: 206788 - RNA, 64 nt, Homo Sapiens
gagauguuuuugguaacuauauauaccuguuugaagcuuuaagaaauauacuuuuccucaagua

SEQ ID NO: 206789 - RNA, 64 nt, Homo Sapiens
gagauucuucucccaccccccuuuaugauuugaaagcuuuaaagcaauguguaaacaggaacaa

SEQ ID NO: 206790 - RNA, 64 nt, Homo Sapiens
cuucacaguauauggccugggugacacucuuuagagcuuuaaugggggauugcuuuuucacuuu

SEQ ID NO: 206791 - RNA, 64 nt, Homo Sapiens
uucugcaguaaguugagagauuuuccagaacaaaagcuuuaaacaagaacauuagauauuuuag

SEQ ID NO: 206792 - RNA, 64 nt, Homo Sapiens
aagaauggaaauacaagggaguuuuucaccacugagcuuuaaauggcauuccuuuguguacuug

SEQ ID NO: 206793 - RNA, 64 nt, Homo Sapiens
gagugucuuaccccuuuccuuuguguucugguaaagcuuuaaguauugauguucuugcuuugug

SEQ ID NO: 206794 - RNA, 64 nt, Homo Sapiens
cuaauuuuccaaagguuaggggguuaaaaaaagaagcuuuaacaaagauugaauguucaugugu

SEQ ID NO: 206795 - RNA, 64 nt, Homo Sapiens
ugauuaucucuugggauucuuggugguugggcccagcuuuaacuuaguuguguguguuuuaaau

SEQ ID NO: 206796 - RNA, 64 nt, Homo Sapiens
ugacuuauuuuuaaaacuuuuuuaaaaaagauuuagcuuuaaaauaguuggaaagaaugaagua

SEQ ID NO: 206797 - RNA, 64 nt, Homo Sapiens
uacuuuggagaaacuuugggaauacauuucauugagcuuuaaagauugguuuuaguaagaauua

SEQ ID NO: 206798 - RNA, 64 nt, Homo Sapiens
aaauucauauucugucuggauucauaaaugaagcagcuuuaaacugguaacaguucauguuugc

SEQ ID NO: 206799 - RNA, 64 nt, Homo Sapiens
ucuacuugcuauaaccguguuagguaagccaaugagcuuuaaucucuuuccucucuugguguuc

SEQ ID NO: 206800 - RNA, 64 nt, Homo Sapiens
uagcaggggcauggacuuuaucuuuuuuuuuuuaagcuuuaacuaguggcgguuucuccucgca

SEQ ID NO: 206801 - RNA, 64 nt, Homo Sapiens
ccaugugcaagaaaaugagggaaucugacaggacagcuuuaagccaccugcggaaggagcugga

SEQ ID NO: 206802 - RNA, 64 nt, Homo Sapiens
ccaaguggaagaaaaugagggaaucuggcaggacagcuuuaagccaccugcggaaggagcugga

SEQ ID NO: 206803 - RNA, 64 nt, Homo Sapiens
ucuuaaugggaacuuggcaucugggaucucaaggagcuuuaaagccauuuaugcaccccgcaac

SEQ ID NO: 206804 - RNA, 64 nt, Homo Sapiens
gaagacauucaaaauuugaugugugugcgcacauagcuuuaaaaccgcauaugugugugcgugc

SEQ ID NO: 206805 - RNA, 64 nt, Homo Sapiens
aggggccuggcugaccccuccagcuucagccuccagcuuuaacuucugucugcuccuaaugggg

SEQ ID NO: 206806 - RNA, 64 nt, Homo Sapiens
aaaucaggacacaacagagggcagaggccccauuagcuuuaaaauguagccccagguuggagcu

SEQ ID NO: 206807 - RNA, 64 nt, Homo Sapiens
uagcagcugccaguuuggagcauugcccucuaagagcuuuaaaacuauuuuuuuacaugccuua

SEQ ID NO: 206808 - RNA, 64 nt, Homo Sapiens
auacauuuagguaaugaaugguaguagaacuaauagcuuuaacaggagaauagggaaugagaaa

SEQ ID NO: 206809 - RNA, 64 nt, Homo Sapiens
agaaauggccaauuuaacuuuacaguaacaauagacagcacaacacaaacucucucaauacaga

SEQ ID NO: 206810 - RNA, 64 nt, Homo Sapiens
uucacaaaauuuaaaucauaaacaggcaaaccaaacagcacacuguagcuauaguuguuaugug

SEQ ID NO: 206811 - RNA, 64 nt, Homo Sapiens
aagacugugucuugaaagaauuaucaaagcugauacagcacauauacagaauuagccaaauggu

SEQ ID NO: 206812 - RNA, 64 nt, Homo Sapiens
uccgaucuugugagacuuauucacuaucacaagaacagcacaggaaaguucugcccccgugauu

SEQ ID NO: 206813 - RNA, 64 nt, Homo Sapiens
cccugcaaacccaaagagaaucacccccuaacucacagcacaaaagucuucgcaccucgccccc

SEQ ID NO: 206814 - RNA, 64 nt, Homo Sapiens
uuuauuaagagaaaaaaaguuuucucauuuuuaaacagcacauauuaaagaugcaguauauacu

SEQ ID NO: 206815 - RNA, 64 nt, Homo Sapiens
auaacugaagggccugcucuuuccauuguggaucacagcacacacauacauacacccuccaccu

SEQ ID NO: 206816 - RNA, 64 nt, Homo Sapiens
acuuuagggccccuuagcagggugagcuguuaaaacagcacacaucucucauccccucuuccuu

SEQ ID NO: 206817 - RNA, 64 nt, Homo Sapiens
ccccagagccaggaaccucucacccggugggggcacagcacagacaccucccaccaaccaacca

SEQ ID NO: 206818 - RNA, 64 nt, Homo Sapiens
ccccagaggcaggaaccucucacccggugggggcacagcacagacaccucccaccaaccagcca

SEQ ID NO: 206819 - RNA, 64 nt, Homo Sapiens
ccccagagccaggaaccucucacccagugggggcacagcacagacaccucccaccaaccagcca

SEQ ID NO: 206820 - RNA, 64 nt, Homo Sapiens
ccccaaagccaggaaccucucucccgguggggacacagcacagacaccucccaccaaccagcca

SEQ ID NO: 206821 - RNA, 64 nt, Homo Sapiens
gcaccccacuggcugcagcuagcccaccauaggcacagcacaucccaccacucuccuuccaguc

SEQ ID NO: 206822 - RNA, 64 nt, Homo Sapiens
gacacaucugacauccuguguuugguuagaauauacagcacauugugauaacauaaaguggauu

SEQ ID NO: 206823 - RNA, 64 nt, Homo Sapiens
acaccacaacacacaacacaccucaccucacaccacagcacaccucaccacaccacaccgcacu

SEQ ID NO: 206824 - RNA, 64 nt, Homo Sapiens
cacugcaccauaccucaccacaucucaccacaccacagcacaccucaccacacaacacaccaca

SEQ ID NO: 206825 - RNA, 64 nt, Homo Sapiens
ucuguccucaagaacaaguccuaggucaagggaaacagcacagccuguuuauaauuaggaaaca

SEQ ID NO: 206826 - RNA, 64 nt, Homo Sapiens
acauacauucuucaacagcagaucaccucuuaccacagcacagauuggaugauuugggcauuac

SEQ ID NO: 206827 - RNA, 64 nt, Homo Sapiens
accuagaagcaccugcugaccgaccugggggcucacagcacagaauccagagcccuacacucca

SEQ ID NO: 206828 - RNA, 64 nt, Homo Sapiens
caagugcacagagcacacugggugcacagaccacacagcacacaccacacagcacaugcacaca

SEQ ID NO: 206829 - RNA, 64 nt, Homo Sapiens
cacacaggugcacagaccacagugcauaggccacacagcacaugacuaacacaugcacacacaa

SEQ ID NO: 206830 - RNA, 56 nt, Homo Sapiens
aaaggauuagcagugugugagaaagaacagcacagucuuuuccuacgguacaagcu

SEQ ID NO: 206831 - RNA, 64 nt, Homo Sapiens
aaaguacuagcaauaaguugaaugauaauagcucacagcacauuuguuaaugauucuuguguca

SEQ ID NO: 206832 - RNA, 64 nt, Homo Sapiens
aaaugaagagaaccuucuuuuucucuugacuuugacagcacaugcuaaaaaucucuuccaagaa

SEQ ID NO: 206833 - RNA, 64 nt, Homo Sapiens
uaugagcuccagugcuuuugccaaaauucucuugacagcacaccuccucucuuuccauguuaua

SEQ ID NO: 206834 - RNA, 64 nt, Homo Sapiens; identical to SEQ ID NO: 173489

SEQ ID NO: 206835 - RNA, 64 nt, Homo Sapiens; identical to SEQ ID NO: 173490

SEQ ID NO: 206836 - RNA, 64 nt, Homo Sapiens; identical to SEQ ID NO: 173491

SEQ ID NO: 206837 - RNA, 64 nt, Homo Sapiens; identical to SEQ ID NO: 173492

SEQ ID NO: 206838 - RNA, 64 nt, Homo Sapiens; identical to SEQ ID NO: 173493

SEQ ID NO: 206839 - RNA, 64 nt, Homo Sapiens; identical to SEQ ID NO: 173494

SEQ ID NO: 206840 - RNA, 64 nt, Homo Sapiens; identical to SEQ ID NO: 173495

SEQ ID NO: 206841 - RNA, 64 nt, Homo Sapiens; identical to SEQ ID NO: 173496

SEQ ID NO: 206842 - RNA, 64 nt, Homo Sapiens; identical to SEQ ID NO: 173497

SEQ ID NO: 206843 - RNA, 64 nt, Homo Sapiens; identical to SEQ ID NO: 173498

SEQ ID NO: 206844 - RNA, 64 nt, Homo Sapiens; identical to SEQ ID NO: 173499

SEQ ID NO: 206845 - RNA, 64 nt, Homo Sapiens; identical to SEQ ID NO: 173500

SEQ ID NO: 206846 - RNA, 64 nt, Homo Sapiens; identical to SEQ ID NO: 173501

SEQ ID NO: 206847 - RNA, 64 nt, Homo Sapiens; identical to SEQ ID NO: 173502

SEQ ID NO: 206848 - RNA, 64 nt, Homo Sapiens; identical to SEQ ID NO: 173503

SEQ ID NO: 206849 - RNA, 64 nt, Homo Sapiens; identical to SEQ ID NO: 173504

SEQ ID NO: 206850 - RNA, 64 nt, Homo Sapiens; identical to SEQ ID NO: 173505

SEQ ID NO: 206851 - RNA, 64 nt, Homo Sapiens; identical to SEQ ID NO: 173506

SEQ ID NO: 206852 - RNA, 64 nt, Homo Sapiens; identical to SEQ ID NO: 173507

SEQ ID NO: 206853 - RNA, 64 nt, Homo Sapiens; identical to SEQ ID NO: 173508

SEQ ID NO: 206854 - RNA, 64 nt, Homo Sapiens; identical to SEQ ID NO: 173509

SEQ ID NO: 206855 - RNA, 64 nt, Homo Sapiens; identical to SEQ ID NO: 173510

SEQ ID NO: 206856 - RNA, 64 nt, Homo Sapiens; identical to SEQ ID NO: 173511

SEQ ID NO: 206857 - RNA, 64 nt, Homo Sapiens; identical to SEQ ID NO: 173512

SEQ ID NO: 206858 - RNA, 64 nt, Homo Sapiens; identical to SEQ ID NO: 173513

SEQ ID NO: 206859 - RNA, 64 nt, Homo Sapiens; identical to SEQ ID NO: 173514

SEQ ID NO: 206860 - RNA, 64 nt, Homo Sapiens; identical to SEQ ID NO: 173515

SEQ ID NO: 206861 - RNA, 64 nt, Homo Sapiens; identical to SEQ ID NO: 173516

SEQ ID NO: 206862 - RNA, 64 nt, Homo Sapiens; identical to SEQ ID NO: 173517

SEQ ID NO: 206863 - RNA, 64 nt, Homo Sapiens; identical to SEQ ID NO: 173518

SEQ ID NO: 206864 - RNA, 64 nt, Homo Sapiens; identical to SEQ ID NO: 173519

SEQ ID NO: 206865 - RNA, 64 nt, Homo Sapiens; identical to SEQ ID NO: 173520

SEQ ID NO: 206866 - RNA, 64 nt, Homo Sapiens; identical to SEQ ID NO: 173521

SEQ ID NO: 206867 - RNA, 64 nt, Homo Sapiens; identical to SEQ ID NO: 173522

SEQ ID NO: 206868 - RNA, 64 nt, Homo Sapiens; identical to SEQ ID NO: 173523

SEQ ID NO: 206869 - RNA, 64 nt, Homo Sapiens; identical to SEQ ID NO: 173524

SEQ ID NO: 206870 - RNA, 64 nt, Homo Sapiens; identical to SEQ ID NO: 173525

SEQ ID NO: 206871 - RNA, 64 nt, Homo Sapiens; identical to SEQ ID NO: 173526

SEQ ID NO: 206872 - RNA, 64 nt, Homo Sapiens; identical to SEQ ID NO: 173527

SEQ ID NO: 206873 - RNA, 64 nt, Homo Sapiens; identical to SEQ ID NO: 173528

SEQ ID NO: 206874 - RNA, 64 nt, Homo Sapiens; identical to SEQ ID NO: 173529

SEQ ID NO: 206875 - RNA, 64 nt, Homo Sapiens; identical to SEQ ID NO: 173530

SEQ ID NO: 206876 - RNA, 64 nt, Homo Sapiens; identical to SEQ ID NO: 173531

SEQ ID NO: 206877 - RNA, 64 nt, Homo Sapiens; identical to SEQ ID NO: 173532

SEQ ID NO: 206878 - RNA, 64 nt, Homo Sapiens
cccaacuuuccccaccagcucccuacccccaacuuuccccuaccaaggcacugcccaaaauuuc

SEQ ID NO: 206879 - RNA, 64 nt, Homo Sapiens
cccaacuuuccccuacccccgcacugcccaaaauuuccccuacccuaggacugggcugaugaag

SEQ ID NO: 206880 - RNA, 64 nt, Homo Sapiens
cacacacacacacacacacagaaugcagccuggauuccccuacaguccagcaaugaaggcugga

SEQ ID NO: 206881 - RNA, 64 nt, Homo Sapiens
guuagggaagaaagaaucggcguucugcuucagcuuccccuaagcuguguccucugcuucccuc

SEQ ID NO: 206882 - RNA, 64 nt, Homo Sapiens
cauaauaaucucuucuauuuauagcuauugguaguuccccuaaauucugacgauagaaauuuuu

SEQ ID NO: 206883 - RNA, 64 nt, Homo Sapiens
uaacauauauauuacauuuauagcuauguaguaguuccccuaaauucuuguaaaaauaaauuuu

SEQ ID NO: 206884 - RNA, 62 nt, Homo Sapiens
ccccuccaaauaccuugcauuuaagguuacucacuuccccuauuaacuaauauauuauuucu

SEQ ID NO: 206885 - RNA, 64 nt, Homo Sapiens
uccaaugacuguagacgggccaugcccuguggguuuccccuaugccugagcagcaggugugccc

SEQ ID NO: 206886 - RNA, 64 nt, Homo Sapiens
auucuccccaggcacugugggacugagaguccuauuccccuaguaauaggucauauuccccuag

SEQ ID NO: 206887 - RNA, 64 nt, Homo Sapiens
acugagaguccuauuccccuaguaauaggucauauuccccuaguaauaugaguucucaaagccu

SEQ ID NO: 206888 - RNA, 64 nt, Homo Sapiens
ugccuuaaccaaggcucauaucuuccacuccccuuuccccuacccuuacucugguuacuacauu

SEQ ID NO: 206889 - RNA, 64 nt, Homo Sapiens
augucuauaaauuaucaguccucccuuugccauauuccccuaaaaggugggaaacccagauuuc

SEQ ID NO: 206890 - RNA, 64 nt, Homo Sapiens
cucaucaucuuacucaucuugugauuucugcuuggcacgcuaccucaagauauuuuucucugaa

SEQ ID NO: 206891 - RNA, 64 nt, Homo Sapiens
gucagaucugucugaggagccccagucaugcucagcacgcuacagauguguuguuugucacacu

SEQ ID NO: 206892 - RNA, 64 nt, Homo Sapiens
auaaggugagcaucacuuguagggaaaacuguuggcacgcuaccugaugugguguuugauucuc

SEQ ID NO: 206893 - RNA, 64 nt, Homo Sapiens
cugggugacacagcaagacuaagauugcaccacggcacgcuagcgguggagguuguagugagcc

SEQ ID NO: 206894 - RNA, 64 nt, Homo Sapiens
gcgcacacacacagugcacgagcagaguuagggugcacgcuaugagcuuacauccuagcugggg

SEQ ID NO: 206895 - RNA, 64 nt, Homo Sapiens
ggugguuuucauuuuacaggacaguauuucaagagcacgcuaagcuuuucucacccugguaagu

SEQ ID NO: 206896 - RNA, 64 nt, Homo Sapiens
agcauuguggcugugaguggcaagcugacauucugcacgcuagcacuuuacaaaaauauugugc

SEQ ID NO: 206897 - RNA, 64 nt, Homo Sapiens
cugccagaauucccaggagguggggaacagagaggcacgcuaugagagugguuugugcucaggc

SEQ ID NO: 206898 - RNA, 64 nt, Homo Sapiens
aguucaggaacccuucuccauacccacaaucugagcacgcuaccaaaucucaaaauauccuaag

SEQ ID NO: 206899 - RNA, 64 nt, Homo Sapiens
cggguuguuguuuuguuuuacuuuggagaggcaagcacgcuaucugagaaaauaaaagacugca

SEQ ID NO: 206900 - RNA, 64 nt, Homo Sapiens
gccgccuucccggugggagcagcucgccgaggaggcacgcuagaaagcaccuuggccuccucuc

SEQ ID NO: 206901 - RNA, 64 nt, Homo Sapiens
ccagccugggcgacagagcgagagucugucucaaaagaaaaaaaaaagcaccgccuccaaaugc

SEQ ID NO: 206902 - RNA, 64 nt, Homo Sapiens
cagccugagcaacagagugagacccugucucuuaaagaaaaaaaaagucagacugcugggacug

SEQ ID NO: 206903 - RNA, 64 nt, Homo Sapiens
aagacauaggacuuaacuggaaaaugaaaaaaaaaagaaaaagaaaaaacuaaacaaaaaaucc

SEQ ID NO: 206904 - RNA, 64 nt, Homo Sapiens
uaggacuuaacuggaaaaugaaaaaaaaaagaaaaagaaaaaacuaaacaaaaaaucccucuag

SEQ ID NO: 206905 - RNA, 64 nt, Homo Sapiens
cacaaaaauaaaaaacaaaaaaaacaaaaaacccaagaaaaaaaaaaagagucagcccuuggcu

SEQ ID NO: 206906 - RNA, 64 nt, Homo Sapiens
uucacuguuguacacagucuguuuucuauuuguuaagaaaaacuacagcaucauugcauaauuc

SEQ ID NO: 206907 - RNA, 64 nt, Homo Sapiens
auuuaaagacaucuauuaucugcuuugugcuuaaaagaaaaauucaaccuuuuuuuuuuuuuuu

SEQ ID NO: 206908 - RNA, 64 nt, Homo Sapiens
ucugugaaaucgucugauggucuguguggaagaaaagaaaaaucugucugccgccuauuuccca

SEQ ID NO: 206909 - RNA, 64 nt, Homo Sapiens
auacaaaagccagcaauaauucuucaagauccaaaagaaaaaaauauacuaccucagauuuuca

SEQ ID NO: 206910 - RNA, 64 nt, Homo Sapiens
augguagauacaguuuaaaagugcuuacccaggcaagaaaaaacacagcuaggcuaagucaaca

SEQ ID NO: 206911 - RNA, 64 nt, Homo Sapiens
guguuuuuguccuaauguugcuacucccauggcaaagaaaaaaaaaagaaugaaaaaaagaaaa

SEQ ID NO: 206912 - RNA, 64 nt, Homo Sapiens
cucccauggcaaagaaaaaaaaaagaaugaaaaaaagaaaaaaauuuggaaaaaaaaaucaggc

SEQ ID NO: 206913 - RNA, 64 nt, Homo Sapiens
uagaaaauucccccuacuucuaauuugcugaaugaagaaaaaaaaaaaucuuuuauuugugaua

SEQ ID NO: 206914 - RNA, 64 nt, Homo Sapiens
ucuaguaugguguauuuaaauaauaaaaacuuaaaagaaaaaauauuuaaugguguuuggguuu

SEQ ID NO: 206915 - RNA, 64 nt, Homo Sapiens
auuauucaaaugccuagaaauccauaguuuggaaaagaaaaaucaugucaucuucuauuuguac

SEQ ID NO: 206916 - RNA, 64 nt, Homo Sapiens
aauggaaauugucggucauauuucuagaacuuuaaagaaaaaagaauguuauauuaguuuucua

SEQ ID NO: 206917 - RNA, 64 nt, Homo Sapiens
cuagggaagauaauauuaaggaagacaaugugaaaagaaaaaugagccuggcaagaauguguuu

SEQ ID NO: 206918 - RNA, 64 nt, Homo Sapiens
gggugacagagcaagugagacccugucucaaaaaaagaaaaagaaaaagaaaaaauauuuuccc

SEQ ID NO: 206919 - RNA, 64 nt, Homo Sapiens
cagagcaagugagacccugucucaaaaaaagaaaaagaaaaagaaaaaauauuuucccuauuag

SEQ ID NO: 206920 - RNA, 64 nt, Homo Sapiens
aagugagacccugucucaaaaaaagaaaaagaaaaagaaaaaauauuuucccuauuagagaaga

SEQ ID NO: 206921 - RNA, 64 nt, Homo Sapiens
ugggucaaaagaauuagauguacagugaagggaaaagaaaaaaaaugggcgaagagagggugga

SEQ ID NO: 206922 - RNA, 64 nt, Homo Sapiens
aagguguagauauaaugagguagaaguagaaaggaagaaaaacucaaagaauucuuaaaaggau

SEQ ID NO: 206923 - RNA, 64 nt, Homo Sapiens
agcaacaaaauauuuauucuacuguaaaugacaaaagaaaaagaaaaauugagccuugggacgu

SEQ ID NO: 206924 - RNA, 64 nt, Homo Sapiens
aaaauauuuauucuacuguaaaugacaaaagaaaaagaaaaauugagccuugggacgugcccau

SEQ ID NO: 206925 - RNA, 64 nt, Homo Sapiens
auuuaugcaguuguacaauuuuauuuuuuucugcaagaaaaaguguaauguaugaaauaaacca

SEQ ID NO: 206926 - RNA, 64 nt, Homo Sapiens
cuuuuuacugaaaguaagugacuuaaaaggauggaagaaaaacuacaugguuggaguguuuuua

SEQ ID NO: 206927 - RNA, 64 nt, Homo Sapiens
aauuacagugugaacaagagaaaaacaggaauagaagaaaaaaguugcagguugaauuaucuau

SEQ ID NO: 206928 - RNA, 64 nt, Homo Sapiens
ugggcuuuauuaucuugucagucacuaccuccuaaagaaaaaaaaaaaggcuagaagaaaaaac

SEQ ID NO: 206929 - RNA, 64 nt, Homo Sapiens
gucacuaccuccuaaagaaaaaaaaaaaggcuagaagaaaaaacauuacauucauguucuaauu

SEQ ID NO: 206930 - RNA, 64 nt, Homo Sapiens
ugaacuuauccuuccucccacaaaaaaagaaaagaagaaaaaauuccaagcagcaaaacuuacu

SEQ ID NO: 206931 - RNA, 64 nt, Homo Sapiens
uauucauagacaaauuuuuuucaauauauuuugcaagaaaaaucuuugaauaagacuaacugca

SEQ ID NO: 206932 - RNA, 64 nt, Homo Sapiens
uuggaauguaugcuaauugaacaugcaauuggggaagaaaaaauguagaaugauuuuugcuauu

SEQ ID NO: 206933 - RNA, 64 nt, Homo Sapiens
guaggaaggaaaaaauaagagauagcagaggaaaaagaaaaacauuuccucuuauaacuucuga

SEQ ID NO: 206934 - RNA, 62 nt, Homo Sapiens
aaaggggcaucugcuuauaagaagugagagagaagaaaaaucaugucccaaguucugagaau

SEQ ID NO: 206935 - RNA, 64 nt, Homo Sapiens
gauuuguuuuuuacaucuccuuuuuccuuccuugaagaaaaauucuuggcugucccaaggauuc

SEQ ID NO: 206936 - RNA, 64 nt, Homo Sapiens
agaacaguuaaucccuaaggucuugacaaaacagaagaaaaacaagccuccucguccuagucuu

SEQ ID NO: 206937 - RNA, 64 nt, Homo Sapiens
uaauaaaaugcaacacuuggcauuuuuauguuuuaagaaaaacaguauuuuauuuauaauaaaa

SEQ ID NO: 206938 - RNA, 64 nt, Homo Sapiens
uuaaaauuguauguuacuuauuuccagaaucucgaagaaaaaagaaaaaagagugguauuauua

SEQ ID NO: 206939 - RNA, 64 nt, Homo Sapiens
uguauguuacuuauuuccagaaucucgaagaaaaaagaaaaaagagugguauuauuaugggcaa

SEQ ID NO: 206940 - RNA, 64 nt, Homo Sapiens
gauugggggaguggggagggggaagaagaacaggaagaaaaaaaguacucugaacugcuccaag

SEQ ID NO: 206941 - RNA, 64 nt, Homo Sapiens
gauugaacucacagauggauaccaacacggucagaagaaaaacggacagaacgguucuuguaua

SEQ ID NO: 206942 - RNA, 64 nt, Homo Sapiens
aauguucuuaggcaucaaaauccaagguagcuguaagaaaaauacuggagcuaacaaugaagaa

SEQ ID NO: 206943 - RNA, 64 nt, Homo Sapiens
ugcagcagucagguacauaguuaggugaacccaaaagaaaaacucuugaaaacaagagauuucu

SEQ ID NO: 206944 - RNA, 64 nt, Homo Sapiens
caccgcugccagcccagaguuacccucuaaagauaagaaaaaggcuauuaauaucauacuaagu

SEQ ID NO: 206945 - RNA, 64 nt, Homo Sapiens
ugaguucuaauaauccauguucaguuuguagggaaagaaaaaauaauuuuuccuucuacccacu

SEQ ID NO: 206946 - RNA, 64 nt, Homo Sapiens
aagaacaguaaauuuuuagagaaacaacaaaacaaagaaaaagagcuuugagucuguaggggca

SEQ ID NO: 206947 - RNA, 64 nt, Homo Sapiens
guacaauugaauggaaaagcgagcucuauuuuuaaagaaaaaagcccuaaacuguuuaaauaaa

SEQ ID NO: 206948 - RNA, 64 nt, Homo Sapiens
uagcaaaccacuccuuuugugggauccacuacucaagaaaaagucacgugagguuuuguuuaga

SEQ ID NO: 206949 - RNA, 64 nt, Homo Sapiens
uagcuugguuuuauuugucaaguuaauguuuaaaaagaaaaaaaaaauguucuuuauacagccu

SEQ ID NO: 206950 - RNA, 64 nt, Homo Sapiens
ggaaaagguuuuuagcucauagcuuuaaaaaaaaaagaaaaaaauugguuuaacaaaaaaaaaa

SEQ ID NO: 206951 - RNA, 64 nt, Homo Sapiens
uaguucauaaguaaaggcacguauaucaaaagugaagaaaaagucaggauuauuuaacuuaccu

SEQ ID NO: 206952 - RNA, 64 nt, Homo Sapiens
aaauuuaugucauacuuauuugagugaaaguuuuaagaaaaauguuggaaguuuaggagccacg

SEQ ID NO: 206953 - RNA, 64 nt, Homo Sapiens
auuaaaggaacacauaccuucuuucaauaaacuaaagaaaaauugugucauguuguaaacauuu

SEQ ID NO: 206954 - RNA, 64 nt, Homo Sapiens
aaugaagacucgcaauuucagaauacaaagaaccaagaaaaaggacacacuaaauagcaucuuu

SEQ ID NO: 206955 - RNA, 64 nt, Homo Sapiens
auuauuugugggcaaauguuacaaaauuaagaaaaagaaaaaaacuguguuugguauuuuucug

SEQ ID NO: 206956 - RNA, 64 nt, Homo Sapiens
aaaaaaauuauuugugggcauuucugacaaaauuaagaaaaagaaaaucacuguguuugguauu

SEQ ID NO: 206957 - RNA, 64 nt, Homo Sapiens
uaaauuuaggucuaugggcuauauugugaagguuaagaaaaacaugaagugcucugauuucuaa

SEQ ID NO: 206958 - RNA, 64 nt, Homo Sapiens
agagguggcaccaugaagagcccucaggaaagggaagaaaaagacagagagcaaaccaaucagu

SEQ ID NO: 206959 - RNA, 64 nt, Homo Sapiens
aaaggaggcagaaagaggagagccccccaaaaaaaagaaaaagaucaacugcagucagagagca

SEQ ID NO: 206960 - RNA, 64 nt, Homo Sapiens
uguauacuaauauuaagaaaaccuacgaaauacuaagaaaaauuaauuaagaaaaaauaaaacu

SEQ ID NO: 206961 - RNA, 64 nt, Homo Sapiens
aaaacuaccuacgaaauacuuccugacucaaauuaagaaaaaauaugugugggucuuguuugga

SEQ ID NO: 206962 - RNA, 64 nt, Homo Sapiens
gaagacauauaaauuaaaugcaaaaaaagagaaaaagaaaaauauuugucacauguaucacccc

SEQ ID NO: 206963 - RNA, 64 nt, Homo Sapiens
aagaaaaguaauuagaauaugggagagagaagaaaagaaaaaugagaagagagggaggaagaaa

SEQ ID NO: 206964 - RNA, 64 nt, Homo Sapiens
augguguaauuuaaacucuggauuugcagaaagaaagaaaaacuaacugcaaaucagaaagaau

SEQ ID NO: 206965 - RNA, 64 nt, Homo Sapiens
uuacauaucaguuguccuuuuuuucauaucuguaaagaaaaaaacucagcuuugccuucuugcu

SEQ ID NO: 206966 - RNA, 64 nt, Homo Sapiens
ugguaggcgguaguuuagaaagguagauuuuucaaagaaaaauuuauauuaauuucacauauaa

SEQ ID NO: 206967 - RNA, 64 nt, Homo Sapiens
uacuucugugacauauacaauaaauauacuaccuaagaaaaaagauaauuauaacugaaagguu

SEQ ID NO: 206968 - RNA, 64 nt, Homo Sapiens
auggcaugaaagaaugacccauuguggcuggaggaagaaaaagguucccaaguggugaggugag

SEQ ID NO: 206969 - RNA, 64 nt, Homo Sapiens
gcagcagacgaaagagaaaauaaaaaucuguuagaagaaaaaaaguuccuucuuuuuaccuuuu

SEQ ID NO: 206970 - RNA, 64 nt, Homo Sapiens
agcugggcgugguggcgggcucucuacuaaaaauaagaaaaauugccaacauacugaaaccccg

SEQ ID NO: 206971 - RNA, 64 nt, Homo Sapiens
aauagucauuuuuaaacuaccgucucaaaaaaaaaagaaaaaagugggugacagagaaggacuc

SEQ ID NO: 206972 - RNA, 64 nt, Homo Sapiens
cauuuggccuuaaaauagcaggaaggggagaagaaagaaaaacagggagaaagggaaaagucag

SEQ ID NO: 206973 - RNA, 64 nt, Homo Sapiens
cuuguacuaaguuccccuuuauaagauucuggugaagaaaaaguagaauggggauacccccaaa

SEQ ID NO: 206974 - RNA, 64 nt, Homo Sapiens
cuuauagaauaaaagcuauaacagcaaaauguugaagaaaaaagaggacuguaaagauuuguug

SEQ ID NO: 206975 - RNA, 64 nt, Homo Sapiens
acaaugaacugcuuuuccucugcacuuuuuuaugaagaaaaaguaagcugacuuggcacuuaag

SEQ ID NO: 206976 - RNA, 64 nt, Homo Sapiens
ccaaaggaacauuuuaacuguaaaggcuggagacaagaaaaaauaaguagaucguuuuaauaac

SEQ ID NO: 206977 - RNA, 64 nt, Homo Sapiens
gaugccgaagaguugaugucaaucuuuuuuuccuaagaaaaaaaguccgcgaguauuaaauauu

SEQ ID NO: 206978 - RNA, 64 nt, Homo Sapiens
uuccucaacuugacaagaaaagcuaauuuaagagaagaaaaacauaaagucauuauauuaauua

SEQ ID NO: 206979 - RNA, 64 nt, Homo Sapiens
gagaagaaaaacauaaagucauuauauuaauuaaaagaaaaaacaccauuuaauauguucugaa

SEQ ID NO: 206980 - RNA, 64 nt, Homo Sapiens
uggauggggaaaugggugggagggugguguugggaagaaaaauuggucagcuuggcucggggag

SEQ ID NO: 206981 - RNA, 64 nt, Homo Sapiens
aagauuaaccauuuuuuugucuuagaauaucaaaaagaaaaagaaaaagguguucuagcuguuu

SEQ ID NO: 206982 - RNA, 64 nt, Homo Sapiens
aaccauuuuuuugucuuagaauaucaaaaagaaaaagaaaaagguguucuagcuguuugcauca

SEQ ID NO: 206983 - RNA, 64 nt, Homo Sapiens
cucuuuuacuuugguuccuguugugcucuuguaaaagaaaaauauaauuuccugaagaauaaaa

SEQ ID NO: 206984 - RNA, 64 nt, Homo Sapiens
aguguugcuagagaaaauuagggaaaaggugaaaaagaaaaaaugguaguaauugagcagaaaa

SEQ ID NO: 206985 - RNA, 64 nt, Homo Sapiens
auuuaucuaaguagaacugaauuggcuaggaaaaaagaaaaacugcauguuaaucauuuuccua

SEQ ID NO: 206986 - RNA, 64 nt, Homo Sapiens
cugucacaugacucauugaguaguaaugauucagaagaaaaagaaaaaggagacuuuauugguc

SEQ ID NO: 206987 - RNA, 64 nt, Homo Sapiens
caugacucauugaguaguaaugauucagaagaaaaagaaaaaggagacuuuauuggucaauauu

SEQ ID NO: 206988 - RNA, 64 nt, Homo Sapiens
agcccaggcaacaagagugaaacccugucucaaaaagaaaaaaaaaguugaccuugagaauuua

SEQ ID NO: 206989 - RNA, 64 nt, Homo Sapiens
agccugggcaacauggcuaaacucugucucuauuaagaaaaaaaauguuaacauuaugauuuaa

SEQ ID NO: 206990 - RNA, 64 nt, Homo Sapiens
uccagaacugugaaaaauaaauuuguuauuuaaaaagaaaaaaaaaaaaacaaaaaccugaguu

SEQ ID NO: 206991 - RNA, 64 nt, Homo Sapiens
aaaaaaaaaaaaaaaaaaaaaaaggaaaaaaaaaaagaaaaagaaaacgugugcauuuuguaua

SEQ ID NO: 206992 - RNA, 64 nt, Homo Sapiens
caaaaguuuuaccacagucugcacuugcagaagaaagaaaaaaauucaaaccacauguuuauuu

SEQ ID NO: 206993 - RNA, 64 nt, Homo Sapiens
guuaugauaaaaggaaguagaugugaaaaagccuaagaaaaaggaaauuggacaguuuugauac

SEQ ID NO: 206994 - RNA, 64 nt, Homo Sapiens
auugaaaaaagagaaaggggcaagaaauucauuaaagaaaaaccacagauacugaaacauuuga

SEQ ID NO: 206995 - RNA, 64 nt, Homo Sapiens
uaugaaugguuuuaugucauuuuuuuaauuaaaaaagaaaaauucauauaaucguguuuaaaac

SEQ ID NO: 206996 - RNA, 64 nt, Homo Sapiens
aaaauuccaacugcuguuggggaaggacacagaaaagaaaaauaaccacccaagaaaaacaaaa

SEQ ID NO: 206997 - RNA, 64 nt, Homo Sapiens
uucauacuuuuuauacuuugaggaaaaaaagucaaagaaaaauuguauuugagggaaaaaacca

SEQ ID NO: 206998 - RNA, 64 nt, Homo Sapiens
aauuuucuuugcauuuuaaaauaucuggauuaugaagaaaaagugaugaaaauaaauuaaaacu

SEQ ID NO: 206999 - RNA, 64 nt, Homo Sapiens
ugcagugcagagcacuuuaaugcaaccagcuuucaagaaaaagcccuaucuaguacuugauguu

SEQ ID NO: 207000 - RNA, 64 nt, Homo Sapiens
aauaauagcccugagauguuucuaacauuuaaauaagaaaaaaaucaaaucgaagucagccugc

SEQ ID NO: 207001 - RNA, 64 nt, Homo Sapiens
uuugugcuuuaggcaaacauuaaccagcucuaacaagaaaaaugucuagauuuacacauuguca

SEQ ID NO: 207002 - RNA, 64 nt, Homo Sapiens
accaaguaagacucaaaauugcaaauauaaacaaaagaaaaauccaacugaaaauaacacuaag

SEQ ID NO: 207003 - RNA, 64 nt, Homo Sapiens
auaacaaaguguuaguaaucauugcuuucuguagaagaaaaagguuuaaauuuaaaauguguau

SEQ ID NO: 207004 - RNA, 64 nt, Homo Sapiens
gccuauuuuucuguuccagcaacuguuuuuaugaaagaaaaacuugaaaugcuacuuaacuuac

SEQ ID NO: 207005 - RNA, 64 nt, Homo Sapiens
aguauuuuuauuaccaauaaauuuaaaauuuuuuaagaaaaauauuuuuauccuagggccaagu

SEQ ID NO: 207006 - RNA, 64 nt, Homo Sapiens
agcuuguauauguaguaguuugaugaauaauuuaaagaaaaacaccuaaaauuugaaaaaugau

SEQ ID NO: 207007 - RNA, 64 nt, Homo Sapiens
ugaagugaacuaugaaguaagcaacaaggaugacaagaaaaacauggggaaacagaugccucag

SEQ ID NO: 207008 - RNA, 64 nt, Homo Sapiens
uggggaaacagaugccucagccuacuuucacacuaagaaaaaaacuugucuucccuucugauug

SEQ ID NO: 207009 - RNA, 64 nt, Homo Sapiens
aacaugaauucuuuuucuggagcuuagcaaugagaagaaaaaaagugcccaacuuuucuaagug

SEQ ID NO: 207010 - RNA, 64 nt, Homo Sapiens
gcuagagacccuuuuugcaacuuaaugugccaaaaagaaaaaaagucagaaguauuuuaaaggg

SEQ ID NO: 207011 - RNA, 64 nt, Homo Sapiens
aaaaaaaggagcugugccccaguuuuuuaaaaaaaagaaaaaaagccacugcaagcucugaauc

SEQ ID NO: 207012 - RNA, 64 nt, Homo Sapiens
aaaaagguacuuagaggucggaucuugucucuuaaagaaaaaaaccaccugggcaacauaguaa

SEQ ID NO: 207013 - RNA, 64 nt, Homo Sapiens
gaggaagaagcaaaagcagaucuuacauuguggcaagaaaaaauggugggaggcaaaagacacu

SEQ ID NO: 207014 - RNA, 64 nt, Homo Sapiens
gguuuaauuggacuuaaaguuacccgagacugggaagaaaaaguucacgcugcugauaaagaca

SEQ ID NO: 207015 - RNA, 64 nt, Homo Sapiens
gguuuacuuggacuuacaguuacccgagacugggaagaaaaagauaaugcugcugauaaagacg

SEQ ID NO: 207016 - RNA, 64 nt, Homo Sapiens
aaggaaaaaaaaaaaaaaaccaguaaaagaaagaaagaaaaaaacagcaucuuaccuucauaug

SEQ ID NO: 207017 - RNA, 64 nt, Homo Sapiens
uuuuuuaaaaaacacuucauuaaauauaaauguuaagaaaaauuuuuuuuguacaaaacuuuuu

SEQ ID NO: 207018 - RNA, 64 nt, Homo Sapiens
gccuugaauugacaaauuaaaucaauuggaaaggaagaaaaaaggucucuaaaggguuaaaugu

SEQ ID NO: 207019 - RNA, 64 nt, Homo Sapiens
ugaaaaucauuuggggaguauuauuguacauuuuaagaaaaagggaucaaaguuuucagugcau

SEQ ID NO: 207020 - RNA, 64 nt, Homo Sapiens
cuuaaguacaacuguagugagcaagcaaaaaccgaagaaaaacauucaaugacaugaaaacugu

SEQ ID NO: 207021 - RNA, 64 nt, Homo Sapiens
aaaagaaaagaaaacuucaaugcaaaaaaagaaaaagaaaaaaaauuuuuaucaaauguuauga

SEQ ID NO: 207022 - RNA, 64 nt, Homo Sapiens
aaaaaaaaaagaaaagaaaauuaugaugcaaaaaaagaaaaagacaaaagauuuuuaucaaaug

SEQ ID NO: 207023 - RNA, 64 nt, Homo Sapiens
aguguucagggcauaacaacaaaggaagaaaagaaagaaaaacacaauaaagaaaaaaaaauac

SEQ ID NO: 207024 - RNA, 64 nt, Homo Sapiens
aauacaaaggaagaaaagaaugagaguaacaauaaagaaaaaaaucagaaagcaguagugagag

SEQ ID NO: 207025 - RNA, 64 nt, Homo Sapiens
uucagaagagcagaaguaaaaaaaagauagaaaaaagaaaaaguacuggagaagaaaaaaaaga

SEQ ID NO: 207026 - RNA, 64 nt, Homo Sapiens
auagaaaaaagaaaaaguuuuggagaagaaaaaaaagaaaaaaguuacaggaaauuagaucgac

SEQ ID NO: 207027 - RNA, 64 nt, Homo Sapiens
agaaaaaagauagaaaaaaguagaucgacuggagaagaaaaaaaauuucccaauuacaggaaau

SEQ ID NO: 207028 - RNA, 64 nt, Homo Sapiens
aauacccaggugugguagugaaaagaaaaagaaaaagaaaaaaggucuguacuaaaaaaaaaaa

SEQ ID NO: 207029 - RNA, 64 nt, Homo Sapiens
aaaaagaauacccaggugugaaaaaaaaaagaaaaagaaaaagaaacccggucuguacuaaaaa

SEQ ID NO: 207030 - RNA, 64 nt, Homo Sapiens
aaaagaaaaaagaauacccauaaaaaaaaaaaaaaagaaaaagauggugaaacccggucuguac

SEQ ID NO: 207031 - RNA, 64 nt, Homo Sapiens
gucuguacauguucacuacauagggaauaacaauaagaaaaacauguuguuauacuguauuguu

SEQ ID NO: 207032 - RNA, 64 nt, Homo Sapiens
guuuguauauauuuuaaaaauuugagaagaauagaagaaaaaaaaaguaucccuuucaaaugcc

SEQ ID NO: 207033 - RNA, 64 nt, Homo Sapiens
caguuuaaauacggagacuaaaaaaaaauuggaaaagaaaaacuucccuuauguugaggcaugg

SEQ ID NO: 207034 - RNA, 64 nt, Homo Sapiens
uguauuuuaagaugaaauauuauuuucugguaaaaagaaaaaugguggcaauuuauuuuaagag

SEQ ID NO: 207035 - RNA, 64 nt, Homo Sapiens
caauuaaaauuuuguuuauauaaaaauaauugagaagaaaaacugugcuuuguuuccgugcacu

SEQ ID NO: 207036 - RNA, 64 nt, Homo Sapiens
cauuuuagagaaaacuaaagccuuccucaucuaaaagaaaaaggaaaaauuuuuaggaaacuca

SEQ ID NO: 207037 - RNA, 64 nt, Homo Sapiens
aaaauucacacugccagcguauuuuuuuuuaaagaagaaaaaaaaaaccaugacgcaaagagag

SEQ ID NO: 207038 - RNA, 64 nt, Homo Sapiens
guuuaucuagcacuugugacacauuugucauauuaagaaaaaaaaaauaaaaaggacuacuuaa

SEQ ID NO: 207039 - RNA, 64 nt, Homo Sapiens
aaaaggacuacuuaaacauuguacuuuuuauuguaagaaaaauagaacuuauucuuaagaaauu

SEQ ID NO: 207040 - RNA, 64 nt, Homo Sapiens
ccuuucuguuccccucucaucagcuuuggggaagaagaaaaaugauuuugcacgccaaacucgg

SEQ ID NO: 207041 - RNA, 64 nt, Homo Sapiens
gagguaguuccaaaaaagugcuuuauugcuguuuaagaaaaauggcccggcggucccuguuuug

SEQ ID NO: 207042 - RNA, 64 nt, Homo Sapiens
aaacagcaggaaucggugggaggaacaaugccuuaagaaaaaacgcuggguuuucugaagucug

SEQ ID NO: 207043 - RNA, 64 nt, Homo Sapiens
uauuguugaauguacaucuaccccagccccucaaaagaaaaacuguuuacauagaaauuccuac

SEQ ID NO: 207044 - RNA, 64 nt, Homo Sapiens
accuuaucuuugucacaggguguucuuuuuuaugaagaaaaauuugaaaaugauaaaagcuaag

SEQ ID NO: 207045 - RNA, 64 nt, Homo Sapiens
aaguguuuuccacuaauuuugcaugcguauuuauaagaaaaaugugaauuuggugguuuuauuc

SEQ ID NO: 207046 - RNA, 64 nt, Homo Sapiens
ugacaauuuauuuuugccaucauuuuuuuaauuaaagaaaaaauuuccagaagaggaaaaaaaa

SEQ ID NO: 207047 - RNA, 64 nt, Homo Sapiens
gcacagaaguuuaagacuaugaguuuuuagggugaagaaaaaacuguacaguuuaaaugaaaau

SEQ ID NO: 207048 - RNA, 64 nt, Homo Sapiens
gcaagacacucuggccaccauaaaaaacgcagaaaagaaaaaaagguuaagcauaaaaagaaag

SEQ ID NO: 207049 - RNA, 64 nt, Homo Sapiens
agucugggcaccgaaagagagcaucaaaaucaccaagaaaaacagcuucucaguuaagugaaaa

SEQ ID NO: 207050 - RNA, 64 nt, Homo Sapiens
aagcagggccaaauggaaagaacacauaauaaacaagaaaaaaacagaggugaagaaaaaucca

SEQ ID NO: 207051 - RNA, 64 nt, Homo Sapiens
agaacacauaauaaacaagaaaaaaacagaggugaagaaaaauccaagucugaacgggaaugcc

SEQ ID NO: 207052 - RNA, 64 nt, Homo Sapiens
cagggcuggggccaagaggaaaaacagggaaaaaaagaaaaaaaaaagaaaaaggaaaaggaag

SEQ ID NO: 207053 - RNA, 64 nt, Homo Sapiens
ccaagaggaaaaacagggaaaaaaagaaaaaaaaaagaaaaaggaaaaggaagcgguguguggc

SEQ ID NO: 207054 - RNA, 64 nt, Homo Sapiens
aauuuaaacaaagaaacacuugaaagaaacuggaaagaaaaauaauuuuuuuaugugaacaaau

SEQ ID NO: 207055 - RNA, 64 nt, Homo Sapiens
aaaauaauuuuuuuaugugaacaaauuuugcaagaagaaaaaagcauaaaagacacuaacggca

SEQ ID NO: 207056 - RNA, 64 nt, Homo Sapiens
uaaaguuuaauugaaagaauguaaagcaaccaaaaagaaaaaaaaaaagaaagaaagaggaaaa

SEQ ID NO: 207057 - RNA, 64 nt, Homo Sapiens
cugcaaacuauuuaaagaaauauguauucuguaaaagaaaaaaaaaaugcggccuuuucaugag

SEQ ID NO: 207058 - RNA, 64 nt, Homo Sapiens
gugauaagcacaaaucucuacuccucaugacaugaagaaaaagacugaaugugaagggaguuuc

SEQ ID NO: 207059 - RNA, 64 nt, Homo Sapiens
auacguuugacccauuuugaauaaggaaauugaaaagaaaaauuuaaaaggagaaaaaaaugca

SEQ ID NO: 207060 - RNA, 64 nt, Homo Sapiens
cacuauuauauaguggguuauauuaaaagaaaagaagaaaaauaucuaauuucucuuggcagau

SEQ ID NO: 207061 - RNA, 64 nt, Homo Sapiens
aguuucaaagcagguaaauuguaaauguuucuuuaagaaaaagcaugugaaaggaaaaagguaa

SEQ ID NO: 207062 - RNA, 64 nt, Homo Sapiens
uuucuuuuguauuuuguuauaaucuuaagcaacaaagaaaaaacccuaauauuugaaucuauuu

SEQ ID NO: 207063 - RNA, 64 nt, Homo Sapiens
cuucugagguacauuuugaaugacagcauauuguaagaaaaaaaaaggugaauaaaauuugaca

SEQ ID NO: 207064 - RNA, 64 nt, Homo Sapiens
uuuauugcuguuuugucuuucuuuuuucuaaaaaaagaaaaaaaagaaaaaaaggaaaagaaga

SEQ ID NO: 207065 - RNA, 64 nt, Homo Sapiens
guuuugucuuucuuuuuucuaaaaaaagaaaaaaaagaaaaaaaggaaaagaagaacaaagaaa

SEQ ID NO: 207066 - RNA, 64 nt, Homo Sapiens
ccggacagcgaacuggaggggggagaaauuuucaaagaaaaacgagggaaaugggaggggugca

SEQ ID NO: 207067 - RNA, 64 nt, Homo Sapiens
agaaacagcauggagaaaacccgguacgcucaaaaagaaaaaggaaaaaaaaaaaucccaucac

SEQ ID NO: 207068 - RNA, 64 nt, Homo Sapiens
gaccaugauaauucaguuuauauucaccacaugaaagaaaaauggguaacagaagaacccuuaa

SEQ ID NO: 207069 - RNA, 64 nt, Homo Sapiens
aaguaauguugaccaucccccucucagcugaauaaagaaaaauuuaguucaauuuauugcaauu

SEQ ID NO: 207070 - RNA, 64 nt, Homo Sapiens
auuuauuaauuuuaaaacauucagaacuuguugaaagaaaaauuauaucugaaucaagauucau

SEQ ID NO: 207071 - RNA, 64 nt, Homo Sapiens
ugguaaaaucaguuuuuugauaguguguguauauaagaaaaaauagauacacacauucuuuuuu

SEQ ID NO: 207072 - RNA, 64 nt, Homo Sapiens
aagagcaggaugcauguuaguuacuacuaucaugaagaaaaaugcauuguuugggggccaggca

SEQ ID NO: 207073 - RNA, 64 nt, Homo Sapiens
auuuuuuaaauaaguuuaauagcaagacugucucaagaaaaaaacacuccagccugggccacag

SEQ ID NO: 207074 - RNA, 64 nt, Homo Sapiens
ugggaaauauauauguuucucuggggugcuuuuuaagaaaaauucuuuauucaagauaccugaa

SEQ ID NO: 207075 - RNA, 64 nt, Homo Sapiens
uuguaaugaucgaauacccaagaaacacugguuuaagaaaaacccugaugcacaguaaaauccg

SEQ ID NO: 207076 - RNA, 64 nt, Homo Sapiens
cagagguuauuaaaauguaagccuaaauguguaaaagaaaaaugaggagaaaagaaagcacacu

SEQ ID NO: 207077 - RNA, 64 nt, Homo Sapiens
auucuacauuauguaggauuaaggagccguacagaagaaaaauuugugguuacccauuuuuuag

SEQ ID NO: 207078 - RNA, 64 nt, Homo Sapiens
uguauuuuacuguuuucuguaaaaaaaaaagaaaaagaaaaaaggucuuguuuguaaaaaaaaa

SEQ ID NO: 207079 - RNA, 64 nt, Homo Sapiens
aaaaaguguauuuuacuguuaaaaaaaaaaaaaaaagaaaaagaaagcuagucuuguuuguaaa

SEQ ID NO: 207080 - RNA, 64 nt, Homo Sapiens
aauuguucacaucccaucugaguuucuauuucuaaagaaaaaacuuaugaaugacuuucuacag

SEQ ID NO: 207081 - RNA, 64 nt, Homo Sapiens
ggaagauaccugcacuaaucggaggaaauauguaaagaaaaacagagccuguugugggagguag

SEQ ID NO: 207082 - RNA, 64 nt, Homo Sapiens
aauguuguuuaaaaaauguuuucauacauuugaaaagaaaaaaauccuggcuaucuuaaacaag

SEQ ID NO: 207083 - RNA, 64 nt, Homo Sapiens
agauuuuacauaucuuugcaaaaaaaaaaaaaaaaagaaaaauucuuagucuaaagacuguagc

SEQ ID NO: 207084 - RNA, 64 nt, Homo Sapiens
uguacauuuauucauagauaauuggugcuauuugaagaaaaaaaugaauaucauugauuuuaua

SEQ ID NO: 207085 - RNA, 64 nt, Homo Sapiens
gagguuuaaguuuguugugguuuuccuggacuuaaagaaaaaaaaugaaccaaaugguucuuac

SEQ ID NO: 207086 - RNA, 64 nt, Homo Sapiens
aucggcaguauuuucuguuuacuaguguccgcauaagaaaaagaccagaaguaacuuauuuugu

SEQ ID NO: 207087 - RNA, 64 nt, Homo Sapiens
auuaaaaaaaugcauaggcucuacucugagacaaaagaaaaaaucccuucaacccccucgccuc

SEQ ID NO: 207088 - RNA, 64 nt, Homo Sapiens
acaacuuaauauauuuuggaaaaaaauauugugaaagaaaaaaaaaaaaagaggaaaaaaaggc

SEQ ID NO: 207089 - RNA, 64 nt, Homo Sapiens
aggaaaaaaaggcaaaaaauguuuacaaagcaaaaagaaaaaagacauuugguucaugugcauu

SEQ ID NO: 207090 - RNA, 64 nt, Homo Sapiens
ugauguauguguccaguauggcuaaagccauaggaagaaaaauguuuugguggggugggggugg

SEQ ID NO: 207091 - RNA, 64 nt, Homo Sapiens
cugcuggaaaauuuccaauuacagugcuuauuuaaagaaaaauaaaagaagagcugcagcuuug

SEQ ID NO: 207092 - RNA, 64 nt, Homo Sapiens
acauuaaccucauuguuuauaaaugaacuuuggcaagaaaaauaugaugcaacugauuuauaca

SEQ ID NO: 207093 - RNA, 64 nt, Homo Sapiens
uguauaaaauaguuuuaguauccuuuucuuaaagaagaaaaacaaguuucacagacaucauaga

SEQ ID NO: 207094 - RNA, 64 nt, Homo Sapiens
guuaaauaagacauacccaggaggcagauggaagaagaaaaacaugagaggaggcagagagagg

SEQ ID NO: 207095 - RNA, 64 nt, Homo Sapiens
uuuuauuauccuuacuuuuuucugucucaaaaaaaagaaaaaagccuggagagcagagcaagac

SEQ ID NO: 207096 - RNA, 64 nt, Homo Sapiens
aaacgcccaacucuugaaguuagauaugugcugaaagaaaaaaagcuuuugugccccuuaaaug

SEQ ID NO: 207097 - RNA, 64 nt, Homo Sapiens
gauuggaacaaaugcucucuaaucaaauuuaaccaagaaaaaaaacuuccguagauaaugugga

SEQ ID NO: 207098 - RNA, 64 nt, Homo Sapiens
uaugguggaaaaccuuaaaaggcaacaaagauuuaagaaaaauuuaacauucagacaaguaaca

SEQ ID NO: 207099 - RNA, 64 nt, Homo Sapiens
uggaaacaguagcauccauacaugcuaaauagucaagaaaaaaaaugucaacacacuuaaacua

SEQ ID NO: 207100 - RNA, 64 nt, Homo Sapiens
aaaaagaagaaucuugcugcgaauugguuauuaaaagaaaaaggaauuucuauucaggcuacug

SEQ ID NO: 207101 - RNA, 64 nt, Homo Sapiens
ugaaaauuucuauucaggcuugcaguuuuaccaaaagaaaaauuucauaacuuuaauucaagaa

SEQ ID NO: 207102 - RNA, 64 nt, Homo Sapiens
agaaauauauccagcuaacaaaaaaagaaaaaaaaagaaaaaacugugacaaaaaaaaaaaaaa

SEQ ID NO: 207103 - RNA, 64 nt, Homo Sapiens
aagaaaaaacagaaauauauaaaaaaaaaaaaaaaagaaaaaaaaacaguguucugugacaaaa

SEQ ID NO: 207104 - RNA, 64 nt, Homo Sapiens
gagagagagaauauuggagaaaaaaaagaugacaaagaaaaacaugaaaauguuuauuuaaaaa

SEQ ID NO: 207105 - RNA, 64 nt, Homo Sapiens
uccacaaugaaagaauguaucaaucaaccaaacaaagaaaaaaucaggaacccaccaaaccaac

SEQ ID NO: 207106 - RNA, 64 nt, Homo Sapiens
guacacauucagaaucuggcagugcauuuugaaaaagaaaaaaaaugaacuuugguucuucaug

SEQ ID NO: 207107 - RNA, 64 nt, Homo Sapiens
cucacuuuuccuuuauagugguacguuaaagaaaaagaaaaaacaagaagcucaaagaaaagaa

SEQ ID NO: 207108 - RNA, 64 nt, Homo Sapiens
aaaaaccucacuuuuccuuuaaagaaguacguuaaagaaaaagauugaccaagaagcucaaaga

SEQ ID NO: 207109 - RNA, 64 nt, Homo Sapiens
ucuguacaaaggagaaaaagguugcuccuagugaaagaaaaauccuuuuaaagauaguuuugcu

SEQ ID NO: 207110 - RNA, 64 nt, Homo Sapiens
uuuuuugccuuggugacuuuugaaaaaaaaagaaaagaaaaagcagcauccuuauauuucuuua

SEQ ID NO: 207111 - RNA, 64 nt, Homo Sapiens
caugauuuaauauaugugguuugggggaaaggacaagaaaaaacuauaauuccacauauaagaa

SEQ ID NO: 207112 - RNA, 64 nt, Homo Sapiens
gccagaacuuucuuucacgguuacuguuccugaaaagaaaaagccaccuagcccuaucaagcca

SEQ ID NO: 207113 - RNA, 64 nt, Homo Sapiens
cucaggaguuucuauaggugucuucagaguucugaagaaaaauuacuggacacagcuucagcua

SEQ ID NO: 207114 - RNA, 64 nt, Homo Sapiens
uccaguaguaaaauauguaaccauugucccaguaaagaaaaauaacaaaaguuguaaaauguau

SEQ ID NO: 207115 - RNA, 64 nt, Homo Sapiens
gguuaaacaugguuagaaacaacugaaagcauaaaagaaaaaucuaggccgggugcaguggcuc

SEQ ID NO: 207116 - RNA, 64 nt, Homo Sapiens
guugugacaaccacaagcacuuuuuuuuuuuuuaaagaaaaaaagguagugaauuuuuaaucau

SEQ ID NO: 207117 - RNA, 64 nt, Homo Sapiens
gaagauuuuuguccaugcuugauuuuuuuuuuuaaagaaaaacuuucauggguuagcauuaccu

SEQ ID NO: 207118 - RNA, 64 nt, Homo Sapiens
ugcaggaaaauaauauuuuuauguauaaaagaugaagaaaaaauuuugcaagucuuuaagcaca

SEQ ID NO: 207119 - RNA, 64 nt, Homo Sapiens
cuugaucccacugaucuugacaucaagucuaacaaagaaaaaguuuugaguuuuguauuuucuu

SEQ ID NO: 207120 - RNA, 64 nt, Homo Sapiens
ccacagugccuacaacccaggcccuaaguugaugaagaaaaagucaaggaaggaggugauacaa

SEQ ID NO: 207121 - RNA, 64 nt, Homo Sapiens
ccauuaccuuuccucugccugaaagacgugucucaagaaaaauaaauucuauuuuagaugcagg

SEQ ID NO: 207122 - RNA, 64 nt, Homo Sapiens
aaucuuaaacauacuauuucucauguuauuuagaaagaaaaacuucuuccuuuaaagcaagaaa

SEQ ID NO: 207123 - RNA, 64 nt, Homo Sapiens
ccaguguuuauuucucaagaagaaaccacuuguuaagaaaaaguaugaccagaacuugucaaug

SEQ ID NO: 207124 - RNA, 64 nt, Homo Sapiens
cugaauacuuugaaccacaaaagcauacucuuguaagaaaaacacugauucucauaguaaauac

SEQ ID NO: 207125 - RNA, 64 nt, Homo Sapiens
uagcugucggguaggaugccaaaugaaaggaguaaagaaaaaaauuuaaaauuaagagagcagc

SEQ ID NO: 207126 - RNA, 64 nt, Homo Sapiens
ucaucuuugagacuuugcuuagaaggcagaacccaagaaaaacgcaugacauuucgcagugcag

SEQ ID NO: 207127 - RNA, 64 nt, Homo Sapiens
ccugguuuuguuuuucccagagagaaagcccacgaagaaaaaagaggggggcagagauggauga

SEQ ID NO: 207128 - RNA, 64 nt, Homo Sapiens
auuuuauauuacuacucaauuuguaacaaugaaaaagaaaaagcuuggcaaucaaagcaugcac

SEQ ID NO: 207129 - RNA, 64 nt, Homo Sapiens
aaauggcuguaucggccuguuaugcauguuuuuuaagaaaaaaaaaaaaaaaaaaaaaucugcc

SEQ ID NO: 207130 - RNA, 64 nt, Homo Sapiens
agaacguugcaaauuuguuaaaaaaaaacagaaaaagaaaaaaaauuaggcagucuuaaaaaaa

SEQ ID NO: 207131 - RNA, 64 nt, Homo Sapiens
aauagauguagaguguuuuucauacauguauuuaaagaaaaaaaugugaagcagcuauacgugg

SEQ ID NO: 207132 - RNA, 64 nt, Homo Sapiens
aaauaacaaaaacaacccuuaagcagaagcaaaaaagaaaaacauccucagaagccuauuuuua

SEQ ID NO: 207133 - RNA, 64 nt, Homo Sapiens
uuugaguaccugaugaaaauuauuaaaauguaggaagaaaaaugguauauacauaugacauaua

SEQ ID NO: 207134 - RNA, 64 nt, Homo Sapiens
augugaauaugaauugacaggccuugccuuuuaaaagaaaaaguuccauguugcuuuauaugua

SEQ ID NO: 207135 - RNA, 64 nt, Homo Sapiens
uuaaaaaucuuguaccuagcagcuuuuuuauuaaaagaaaaauucuaauggcuuguuuguguaa

SEQ ID NO: 207136 - RNA, 64 nt, Homo Sapiens
aucgaaagggaccaagcagccugaacccaucaauaagaaaaaggccucuuacaguaggaaacaa

SEQ ID NO: 207137 - RNA, 64 nt, Homo Sapiens
caaauuauuuuuuuuuauuuugcuaaaugaaagaaagaaaaaagguggccaaacuuauuuaugc

SEQ ID NO: 207138 - RNA, 64 nt, Homo Sapiens
ucccuuguucucaguggugcaaaaagaaaagaaaaagaaaaaaaccuucccccugcaaaaagaa

SEQ ID NO: 207139 - RNA, 64 nt, Homo Sapiens
aaaaaaucccuuguucucagaaagaaaaaaagaaaagaaaaagacccugcccuucccccugcaa

SEQ ID NO: 207140 - RNA, 64 nt, Homo Sapiens
gaaaagaaaaagaaaaaaaucuucccccugcaaaaagaaaaaaauagacgauauacucccugcc

SEQ ID NO: 207141 - RNA, 64 nt, Homo Sapiens
gccuucuguuacaccucaaaauguguuacaugggaagaaaaagauuaagaaaaagcaagauaau

SEQ ID NO: 207142 - RNA, 64 nt, Homo Sapiens
accucaaaauguguuacaugggaagaaaaagauuaagaaaaagcaagauaauuuugaagaagga

SEQ ID NO: 207143 - RNA, 64 nt, Homo Sapiens
uaaagcugguuuaauguuuuggccaaugcaccuaaagaaaaacaaacucguuuuuuacaaagcc

SEQ ID NO: 207144 - RNA, 64 nt, Homo Sapiens
cucugaguggacuggccucaaagcaagcauucagaagaaaaagaagcaaccucaguaauuuaga

SEQ ID NO: 207145 - RNA, 64 nt, Homo Sapiens
aaacaugaaaugcuuccaagcaugacaacuuuuaaagaaaaauaugauacucucagauuuuaag

SEQ ID NO: 207146 - RNA, 64 nt, Homo Sapiens
ucagggagcuauuuucauuuagugcuaaacaaguaagaaaaauaagcucgagugaauuucuaaa

SEQ ID NO: 207147 - RNA, 64 nt, Homo Sapiens
accccgcaaacaagaauuaagaugaucccaauaaaagaaaaauugcucaggaaacugaaccuuu

SEQ ID NO: 207148 - RNA, 64 nt, Homo Sapiens
acaguuggagccaaugccucauaguguaaacugaaagaaaaauaguugcuuuuuaaaaugucag

SEQ ID NO: 207149 - RNA, 64 nt, Homo Sapiens
cccaaauuucauucuuagaaaguuauguuccaugaagaaaaauauauguucuuuugaauacuua

SEQ ID NO: 207150 - RNA, 64 nt, Homo Sapiens
gauucauaaggagcuuaucugaacagauuuaucuaagaaaaaaaaaaaacgacauaaaauaagu

SEQ ID NO: 207151 - RNA, 64 nt, Homo Sapiens
auauguuuuuguaucaaaaacacucauauauuucaagaaaaagaaauuauguuaaauagcccug

SEQ ID NO: 207152 - RNA, 64 nt, Homo Sapiens
aagaaaaagaaauuauguuaaauagcccuguuuuaagaaaaauauuuaugaagcaucucaacuu

SEQ ID NO: 207153 - RNA, 64 nt, Homo Sapiens
ggcaauguagugagacccugucucuaauuuaaaaaagaaaaagaaaaaaacauucccaguggca

SEQ ID NO: 207154 - RNA, 64 nt, Homo Sapiens
guagugagacccugucucuaauuuaaaaaagaaaaagaaaaaaacauucccaguggcagccugc

SEQ ID NO: 207155 - RNA, 64 nt, Homo Sapiens
uugaauuguucuuaaggcaucauaucuagaagcaaagaaaaaagaaaaauaacaauuuaaguug

SEQ ID NO: 207156 - RNA, 64 nt, Homo Sapiens
guucuuaaggcaucauaucuagaagcaaagaaaaaagaaaaauaacaauuuaaguuguguaaau

SEQ ID NO: 207157 - RNA, 64 nt, Homo Sapiens
cucugucucagaaaaaaaaaaaaagaaaaggaaaaagaaaaauauauauucuauauuuuuuuaa

SEQ ID NO: 207158 - RNA, 64 nt, Homo Sapiens
ugucguuuuaacaucuccacgucccuagcauaaaaagaaaaagaaaaaaauuuaaacugcuuuu

SEQ ID NO: 207159 - RNA, 64 nt, Homo Sapiens
uuuaacaucuccacgucccuagcauaaaaagaaaaagaaaaaaauuuaaacugcuuuuucggaa

SEQ ID NO: 207160 - RNA, 64 nt, Homo Sapiens
gugauaugauaaauaaaccccuaauuagccuuagaagaaaaaccacugcaagauauuaagcgug

SEQ ID NO: 207161 - RNA, 64 nt, Homo Sapiens
uauuuaacccuguaaguuacuuuaaagcuaauacaagaaaaacaaagacaagugaaaguaagga

SEQ ID NO: 207162 - RNA, 64 nt, Homo Sapiens
aaguuuauaguuuuauauuuggaccuugaaagguaagaaaaaaccagguucuccaaaguuagga

SEQ ID NO: 207163 - RNA, 64 nt, Homo Sapiens
acuagcagggaaguuuccuugagccuaaaauaaaaagaaaaaauuaaaaagaaucaguuuuuuu

SEQ ID NO: 207164 - RNA, 64 nt, Homo Sapiens
gagagaaaagagggggaagaugguucaaagauacaagaaaaaguagaaaaaaaaauaacacuua

SEQ ID NO: 207165 - RNA, 64 nt, Homo Sapiens
gguguuucaaaggguaaauuauaaauguuucaugaagaaaaaauuuuaaaaaucuacgucuuua

SEQ ID NO: 207166 - RNA, 64 nt, Homo Sapiens
ggugggggcuuaggcauccauauuggauucagaaaagaaaaagaaugaugcuucuugcaacaaa

SEQ ID NO: 207167 - RNA, 64 nt, Homo Sapiens
uaauauguaauauuagaacauauuacaaaguagcaagaaaaauacgacauugguguaaaaauaa

SEQ ID NO: 207168 - RNA, 64 nt, Homo Sapiens
cauuuucacuuuguagcacacaucaguuucuuguaagaaaaaaaucagauauuucaacucaucu

SEQ ID NO: 207169 - RNA, 64 nt, Homo Sapiens
uugaacauuuaugaugucaaucucucucccugcaaagaaaaaucuuuggauagacuccaugccu

SEQ ID NO: 207170 - RNA, 64 nt, Homo Sapiens
auguggccaaacaauuauucuauuucauaaaaugaagaaaaagaagaagugcauagguccauaa

SEQ ID NO: 207171 - RNA, 64 nt, Homo Sapiens
auuguuuauacuucuacuuaaaacauuccacaagaagaaaaauuauauaagaaaggaaauuuaa

SEQ ID NO: 207172 - RNA, 64 nt, Homo Sapiens
aaaaucauucaggaagaaauaaaaauaaaaauaaaagaaaaaggcaguaaauaauccuccuuca

SEQ ID NO: 207173 - RNA, 64 nt, Homo Sapiens
ccauuuaucaucuguuacaaaauaugauauaauaaagaaaaacuuucagcuuccuugauuuaga

SEQ ID NO: 207174 - RNA, 64 nt, Homo Sapiens
uugcugcuuuuuguccagggugcacugaauucaaaagaaaaauccucaagcacuucuagaauca

SEQ ID NO: 207175 - RNA, 64 nt, Homo Sapiens
cugcaagcuuuccugccaaucagaaggaaggaagaagaaaaagacucuugaugaaagaaaaaga

SEQ ID NO: 207176 - RNA, 64 nt, Homo Sapiens
cagaaggaaggaaggaaggagaugcucuugaugaaagaaaaagacuuuaaaaagcccucuuaau

SEQ ID NO: 207177 - RNA, 64 nt, Homo Sapiens
uugaaugaaauggauuuuacauuacagacaaggaaagaaaaaaccaauaauguagauagaacaa

SEQ ID NO: 207178 - RNA, 64 nt, Homo Sapiens
uaaagacguauguuugaccaguaaucuuucaaauaagaaaaaaauccucuguaaagaucagaug

SEQ ID NO: 207179 - RNA, 64 nt, Homo Sapiens
uuuuuccccuugugcugcuucagccaguuauaguaagaaaaagggcucauuuuuauuguuuuua

SEQ ID NO: 207180 - RNA, 64 nt, Homo Sapiens
guaacacuaaggugaacuuguuacuaguuaauugaagaaaaagucuugugagaacuugaacugu

SEQ ID NO: 207181 - RNA, 64 nt, Homo Sapiens
aaauucaaaaaguuuacauuaggaaaaaugucuaaagaaaaaaagccuugaaaaguuacucuag

SEQ ID NO: 207182 - RNA, 64 nt, Homo Sapiens
aaacccuaaaaccaaaaacuuugccuuaccagaaaagaaaaaaaaugauaucuaaagaucuauu

SEQ ID NO: 207183 - RNA, 64 nt, Homo Sapiens
cauguuuguaacaaaugauauuuauuucauucuuaagaaaaacugauagaaguuaaauagaauu

SEQ ID NO: 207184 - RNA, 64 nt, Homo Sapiens
uguuuaaaguuuuacaggaauaaugucuauuaggaagaaaaauguuucuuuucaacaaaacugc

SEQ ID NO: 207185 - RNA, 64 nt, Homo Sapiens
aucaacccauccauagaaauacuuaauuuagaggaagaaaaaaaaaauauauuagucuagggcc

SEQ ID NO: 207186 - RNA, 64 nt, Homo Sapiens
ccaacuaaacaugaaacuauaguaccagucaguaaagaaaaauguugcauauauuucagaggaa

SEQ ID NO: 207187 - RNA, 64 nt, Homo Sapiens
gcccacaauuagaaaaauuuccucaagcaauaacaagaaaaaagccauugucuagguaugaaau

SEQ ID NO: 207188 - RNA, 64 nt, Homo Sapiens
gggaaaaaagaaaagcaaggaaaagaaaaaagaaaagaaaaaaagacuuaauguauguuguaag

SEQ ID NO: 207189 - RNA, 64 nt, Homo Sapiens
aaaagaaaaaaagggaaaaaguauguuguaagaaaagaaaaaagcaucugauucacgacuuaau

SEQ ID NO: 207190 - RNA, 64 nt, Homo Sapiens
aaagccucucuguccuaugaaugccaaaaagaaaaagaaaaaaaagauugaccaaaccauccaa

SEQ ID NO: 207191 - RNA, 64 nt, Homo Sapiens
aaaaaaaaagccucucugucauccaaaugccaaaaagaaaaagaaagagaagauugaccaaacc

SEQ ID NO: 207192 - RNA, 64 nt, Homo Sapiens
cuucuguuuguuuuuagcagaugguuuccuuuaaaagaaaaaaaauuuuuuucaggacugcucu

SEQ ID NO: 207193 - RNA, 64 nt, Homo Sapiens
aaagcauacauaugugauuaauauauuuuuguccaagaaaaaaagaucaguuuuuuauaaaaau

SEQ ID NO: 207194 - RNA, 64 nt, Homo Sapiens
uugauuauacuugaaugccaaagaacuuguccagaagaaaaaccuguuaaauucaaguauuaaa

SEQ ID NO: 207195 - RNA, 64 nt, Homo Sapiens
ggaagauuguguuacugcccuucacagugaaaaaaagaaaaaucuuucauuuuuaaaauuagga

SEQ ID NO: 207196 - RNA, 64 nt, Homo Sapiens
agacgaagaguuuaaagagaaaagggaaaaaagaaagaaaaaguaagcagggcuggcuucgccc

SEQ ID NO: 207197 - RNA, 64 nt, Homo Sapiens
gucaguggagggcgagugguuucggaaaaaaaaaaagaaaaaaagaaaaaaaaagaaaaaaaaa

SEQ ID NO: 207198 - RNA, 64 nt, Homo Sapiens
agggcgagugguuucggaaaaaaaaaaagaaaaaaagaaaaaaaaagaaaaaaaaaagauuuuu

SEQ ID NO: 207199 - RNA, 64 nt, Homo Sapiens
guuucggaaaaaaaaaaagaaaaaaagaaaaaaaaagaaaaaaaaaagauuuuuuucuucucuu

SEQ ID NO: 207200 - RNA, 64 nt, Homo Sapiens
ggggaggagaauuagccaaacacuguaagcuuuuaagaaaaacaaaguuuuaaacgaaauacug

SEQ ID NO: 207201 - RNA, 64 nt, Homo Sapiens
ucaaggccacaaaaacaauguuugggggaaaaaaaagaaaaaaucaugccagcuaaucauguca

SEQ ID NO: 207202 - RNA, 64 nt, Homo Sapiens
gacuucaauucauauuuauggccuuuggaauccaaagaaaaacagaagaauaauucauggauuu

SEQ ID NO: 207203 - RNA, 64 nt, Homo Sapiens
uacuuuuuagacaggacagauacucucaacagacaagaaaaaagauuuagcuuaucacaagaag

SEQ ID NO: 207204 - RNA, 64 nt, Homo Sapiens
uuuaaauuuagauuauguauuccuuuugaaacauaagaaaaacauuuaaaccuaugcugaaaau

SEQ ID NO: 207205 - RNA, 64 nt, Homo Sapiens
aaaaacauuuaaaccuaugcugaaaauacgauaaaagaaaaacaacuccaauaugcuaaaaguu

SEQ ID NO: 207206 - RNA, 64 nt, Homo Sapiens
aauaggauuguguguauauuugggauaucuauugaagaaaaaaagaaaaccccuuaaagauaau

SEQ ID NO: 207207 - RNA, 64 nt, Homo Sapiens
ugucuuuaaaucagauaccaaauauuuuuuaggaaagaaaaauguuauuacugucauuagguug

SEQ ID NO: 207208 - RNA, 64 nt, Homo Sapiens
uucaggcaguguuucugggggagguuauggagggaagaaaaaagaaaaaucgauagugagugac

SEQ ID NO: 207209 - RNA, 64 nt, Homo Sapiens
aguguuucugggggagguuauggagggaagaaaaaagaaaaaucgauagugagugacugauugc

SEQ ID NO: 207210 - RNA, 64 nt, Homo Sapiens
aaauaccauuaaacugugaucaguuaaaauuuaaaagaaaaaucagcacaaaagggcgcuaaaa

SEQ ID NO: 207211 - RNA, 64 nt, Homo Sapiens
uggaguaucccauucugaugaguacagaaaaaaaaagaaaaagaaaagaagagaaaaaauuaag

SEQ ID NO: 207212 - RNA, 64 nt, Homo Sapiens
aaaaaaaaagaaaaagaaaagaagagaaaaaauuaagaaaaaaaucaaaaaaggaagaaaacua

SEQ ID NO: 207213 - RNA, 64 nt, Homo Sapiens
ggugucagauucaucaaacaaaaaauaaaucucgaagaaaaaaaaugcacuuacaugugcuuau

SEQ ID NO: 207214 - RNA, 64 nt, Homo Sapiens
ucugagaucccaauggugugagucugacuuuggaaagaaaaagggacuaaagagaaauguaaca

SEQ ID NO: 207215 - RNA, 64 nt, Homo Sapiens
ucaggauguggagcuuccuauucugugaaaaaccaagaaaaagauaugguuguauacucaaauu

SEQ ID NO: 207216 - RNA, 52 nt, Homo Sapiens
agcaacaacagcagaguugauuaagaaaaaugaagaaaaaacgcaaaaagag

SEQ ID NO: 207217 - RNA, 62 nt, Homo Sapiens
agcaacaacagcagaguugauuaagaaaaaugaagaaaaaacgcaaaaagagaacacaugua

SEQ ID NO: 207218 - RNA, 64 nt, Homo Sapiens
cuugaaagcaucaagauuccacucaauuguggagaagaaaaaaggugcuguagaaagugcacca

SEQ ID NO: 207219 - RNA, 64 nt, Homo Sapiens
uaaauacuuccugaacaucuuaggucuuuucaacaagaaaaagacagaggauuguccuuaaguc

SEQ ID NO: 207220 - RNA, 64 nt, Homo Sapiens
aauggaacgacuucaaagagaacuugagauucaaaagaaaaagcuggauaaauuaaaaucugag

SEQ ID NO: 207221 - RNA, 64 nt, Homo Sapiens
auucagaugaucaggaauguauauaacugaaaucaagaaaaagaacaguaugcauuuaaaaaga

SEQ ID NO: 207222 - RNA, 64 nt, Homo Sapiens
guauugcauuuuugggggaagcaaauugacuuuaaagaaaaaaguuguggcaaaagaugcuaag

SEQ ID NO: 207223 - RNA, 64 nt, Homo Sapiens
auuuuuucauuagggccauaucuccaaaaaaagaaagaaaaaauacaaaaaacaaaaacaaaaa

SEQ ID NO: 207224 - RNA, 64 nt, Homo Sapiens
guauuucaagauaauguaguuuaaaaaaaaaaaaaagaaaaaaacuugauguaaauuccuccuu

SEQ ID NO: 207225 - RNA, 64 nt, Homo Sapiens
uuauggaaauguugucuuuuauacuuaguuauauaagaaaaaagggaguuaugcaauuaauauc

SEQ ID NO: 207226 - RNA, 64 nt, Homo Sapiens
uuagcauugcaugugaauaagaaaauaauguuuaaagaaaaaaaaaaaaaagcaaaccuccaaa

SEQ ID NO: 207227 - RNA, 64 nt, Homo Sapiens
caaaaaaaaaaagcaaaaaaagaaaagagaaaaaaagaaaaaaugcaaauggaauaauuuucua

SEQ ID NO: 207228 - RNA, 64 nt, Homo Sapiens
aaugcugugacagcuuuuuggcugcuuuaaccauaagaaaaaugauugguggaugauuuuauua

SEQ ID NO: 207229 - RNA, 64 nt, Homo Sapiens
ccagccugggugauagagcaagacugucucaaaaaagaaaaaaaagaaaaaauuuuaauuuaau

SEQ ID NO: 207230 - RNA, 64 nt, Homo Sapiens
gugauagagcaagacugucucaaaaaagaaaaaaaagaaaaaauuuuaauuuaauccuucugua

SEQ ID NO: 207231 - RNA, 64 nt, Homo Sapiens
gaaauuguaaaaccugucaaugauacagucccuaaagaaaaaaaaucauugcuuugaagcaguu

SEQ ID NO: 207232 - RNA, 64 nt, Homo Sapiens
uaugauguguugugauagcuaacauuuuaaauaaaagaaaaaauaucuugaagauuuuugucac

SEQ ID NO: 207233 - RNA, 64 nt, Homo Sapiens
gaaugucagaaaugacuuuaucaucgucaucuugaagaaaaauaugaacacugaugaaggucau

SEQ ID NO: 207234 - RNA, 64 nt, Homo Sapiens
accagucacuaggauauuucuacccaugcaacggaagaaaaacccauuacuccagaagaguaua

SEQ ID NO: 207235 - RNA, 64 nt, Homo Sapiens
uggcaacagagcaagagucugucucaaaaaaaaaaagaaaaaaagaaaaaaagaaaaaagaaaa

SEQ ID NO: 207236 - RNA, 64 nt, Homo Sapiens
gagcaagagucugucucaaaaaaaaaaagaaaaaaagaaaaaaagaaaaaagaaaaaucucauu

SEQ ID NO: 207237 - RNA, 64 nt, Homo Sapiens
gucugucucaaaaaaaaaaagaaaaaaagaaaaaaagaaaaaagaaaaaucucauuauuucaaa

SEQ ID NO: 207238 - RNA, 64 nt, Homo Sapiens
ucaaaaaaaaaaagaaaaaaagaaaaaaagaaaaaagaaaaaucucauuauuucaaaaugauag

SEQ ID NO: 207239 - RNA, 64 nt, Homo Sapiens
guacauuuuaaaugguaaauaaucuguuuaugugaagaaaaagaauuaagucuuucuuccaacu

SEQ ID NO: 207240 - RNA, 64 nt, Homo Sapiens
uccuuuacuaacaagagcaggaauucagaggcacaagaaaaagcauuggcaugagccaaagagu

SEQ ID NO: 207241 - RNA, 64 nt, Homo Sapiens
cuauaaauacaaaucuguauuguagaugcagaaaaagaaaaaaaaugcauaaaagggucaaacc

SEQ ID NO: 207242 - RNA, 64 nt, Homo Sapiens
aagaauuaccaagagaagggaucccagcuuuaaaaagaaaaaaauuuuccuuccucuguaagau

SEQ ID NO: 207243 - RNA, 64 nt, Homo Sapiens
uaaguuuauucagauaagucuacauaaauauuuuaagaaaaauuuucauuguaaaaugaacaaa

SEQ ID NO: 207244 - RNA, 64 nt, Homo Sapiens
ggagacuuauaaucaugguauuauuagaauauugaagaaaaauuuuuacuuuuggaagacaaga

SEQ ID NO: 207245 - RNA, 64 nt, Homo Sapiens
aaagcacaaacauucuggcaaggcagugcuuaugaagaaaaauuucugcuuuugacucauuucu

SEQ ID NO: 207246 - RNA, 64 nt, Homo Sapiens
cagcuguucugaacuggaauucauaaguucacucaagaaaaauguugcuguuguaaaaguguuu

SEQ ID NO: 207247 - RNA, 64 nt, Homo Sapiens
ccugcauuuggcaggaagauuuaguaaauaugugaagaaaaagagcggcuuucuaauagagaga

SEQ ID NO: 207248 - RNA, 64 nt, Homo Sapiens
augaaauugaccuaguucagcaagcaaaguaucaaagaaaaacaaugcaaaugucacaguaaug

SEQ ID NO: 207249 - RNA, 64 nt, Homo Sapiens
cgggugaggugguguguaccaaaaaaaaagaaaaaagaaaaagcaccucccgucucucucggaa

SEQ ID NO: 207250 - RNA, 64 nt, Homo Sapiens
aaaaagccgggugagguggucucggaaaaaaaaaaagaaaaaagcauggugaccucccgucucu

SEQ ID NO: 207251 - RNA, 64 nt, Homo Sapiens
uguccauguaaagcuuaaauaaaucauuuuuucaaagaaaaauuuauuaaugggccaaugcaaa

SEQ ID NO: 207252 - RNA, 64 nt, Homo Sapiens
uaaacauuuaaacaaaaaugaaaaucaaaucaaaaagaaaaaacaacagaaaaauaaaugauuu

SEQ ID NO: 207253 - RNA, 64 nt, Homo Sapiens
uuaaaggaccacuuuagauauuuuuuuuucucccaagaaaaaucgaugcggguguaagcccuga

SEQ ID NO: 207254 - RNA, 64 nt, Homo Sapiens
uuuuucuaaauauucaacuaacuaugaggaaaaaaagaaaaacaacuaaacaucuucaaauggu

SEQ ID NO: 207255 - RNA, 64 nt, Homo Sapiens
aggaagacuaaacagaaaccuuaaguaaagaaaaaagaaaaaaauucuaaaaggaaaaauaauu

SEQ ID NO: 207256 - RNA, 64 nt, Homo Sapiens
aaaaaaaaggaagacuaaacaauaauuuuaaguaaagaaaaaaggugaacuuucuaaaaggaaa

SEQ ID NO: 207257 - RNA, 64 nt, Homo Sapiens
agaagauaagccauguuucuguauuguacauguaaagaaaaauaaaacuguuuaugauacuugu

SEQ ID NO: 207258 - RNA, 64 nt, Homo Sapiens
aaauauaauuaccuguaagguuaucugguuuuaaaagaaaaaaaaaaagccuacaaacucagug

SEQ ID NO: 207259 - RNA, 64 nt, Homo Sapiens
aaaacuaugaaaaaauguauuuucuucuaugugcaagaaaaauagggcauuucaaagagcuguu

SEQ ID NO: 207260 - RNA, 64 nt, Homo Sapiens
gcaacaagagugaaacuccaucuccaaaaaaaaaaagaaaaaguaacaaaaggaaauuauuugu

SEQ ID NO: 207261 - RNA, 64 nt, Homo Sapiens
caugacauacuuuugcuuucaguaguuucauguaaagaaaaaaacuugaaaauaguaauaccug

SEQ ID NO: 207262 - RNA, 64 nt, Homo Sapiens
aucuaaaauaaaaaucgaaauaauuuuuuuaaaaaagaaaaagacaauaguauuacccauggga

SEQ ID NO: 207263 - RNA, 64 nt, Homo Sapiens
augaucaaggaaagcaagagagcagauaauacaaaagaaaaagaagaagguucacauaaauagc

SEQ ID NO: 207264 - RNA, 64 nt, Homo Sapiens
uugaaauuaacucuuccaugaguuuucauugcugaagaaaaaccaaacauucuuguaaaaacau

SEQ ID NO: 207265 - RNA, 64 nt, Homo Sapiens
uagguauaaaaccuacugcaacuuagaaaaaggaaagaaaaaagaaaacuuuuccaacugcugc

SEQ ID NO: 207266 - RNA, 64 nt, Homo Sapiens
cauuuaagugcuguuuguucuuaaaaugcauuuaaagaaaaauuacccauauugacuuucacac

SEQ ID NO: 207267 - RNA, 64 nt, Homo Sapiens
ggaauaauauugugaaaaugaaucuguuaugauaaagaaaaaauaaaguggaaacuuuuagagu

SEQ ID NO: 207268 - RNA, 64 nt, Homo Sapiens
aguagaaaaggaaacuaguagggccaaaaaaaaaaagaaaaagaaaaagaaaaaagaaaaaaaa

SEQ ID NO: 207269 - RNA, 64 nt, Homo Sapiens
aaaggaaacuaguagggccaaaaaaaaaaagaaaaagaaaaagaaaaaagaaaaaaaaagaaaa

SEQ ID NO: 207270 - RNA, 64 nt, Homo Sapiens
aacuaguagggccaaaaaaaaaaagaaaaagaaaaagaaaaaagaaaaaaaaagaaaaaacugg

SEQ ID NO: 207271 - RNA, 64 nt, Homo Sapiens
agggccaaaaaaaaaaagaaaaagaaaaagaaaaaagaaaaaaaaagaaaaaacugggaccuaa

SEQ ID NO: 207272 - RNA, 64 nt, Homo Sapiens
aaaaaaagaaaaagaaaaagaaaaaagaaaaaaaaagaaaaaacugggaccuaaguauaaauau

SEQ ID NO: 207273 - RNA, 64 nt, Homo Sapiens
uacuuaaaacuuugguuguuuuccuguaauauaaaagaaaaaguuaauuuaucaauugauugaa

SEQ ID NO: 207274 - RNA, 64 nt, Homo Sapiens
uuucuugcaauuugaagguacgaguagagguuuaaagaaaaaucaguuuuuguucuuaaaaaug

SEQ ID NO: 207275 - RNA, 64 nt, Homo Sapiens
gaauaacaacugcugggaauauccgugccaggaaaagaaaaauuucuggcaaauauuuugucac

SEQ ID NO: 207276 - RNA, 64 nt, Homo Sapiens
aauugaacccauccacucugggcagguaagagaaaagaaaaagauaaggaaagaagagagaaga

SEQ ID NO: 207277 - RNA, 64 nt, Homo Sapiens
agacaaagaucacuacagaccaaaacagaagaagaagaaaaaaaagaaaaagaaaucuaagcaa

SEQ ID NO: 207278 - RNA, 64 nt, Homo Sapiens
ucacuacagaccaaaacagaagaagaagaaaaaaaagaaaaagaaaucuaagcaacaugguaag

SEQ ID NO: 207279 - RNA, 64 nt, Homo Sapiens
cugauuugugaugucaauaggauggcaccuuggaaagaaaaaugaagaacaacuuuaucaagga

SEQ ID NO: 207280 - RNA, 64 nt, Homo Sapiens
gaaguaccaauggguuuuucuaacuguguaaagaaagaaaaaggaaaaaaacaaacuaacuaac

SEQ ID NO: 207281 - RNA, 64 nt, Homo Sapiens
aauaguugcuugaauuaugaagccaaagccauagaagaaaaagcucaaucagcauauacauuuc

SEQ ID NO: 207282 - RNA, 64 nt, Homo Sapiens
aaaaaguuuguuuuuucuuuuacucuuuucucucaagaaaaaaacugauauuauuucuauuuaa

SEQ ID NO: 207283 - RNA, 64 nt, Homo Sapiens
aaaaucguucucuucaauuaugcuguuuauugucaagaaaaaguauuccuaauaauagggauaa

SEQ ID NO: 207284 - RNA, 64 nt, Homo Sapiens
uuaagaguguguuuacaacuuuaucuugcagauaaagaaaaaaauguguaaucuuuuaaaaaua

SEQ ID NO: 207285 - RNA, 64 nt, Homo Sapiens
auuguacaguguauauuccuugacaucagaaugaaagaaaaaaaaaaacugauaauaucuguaa

SEQ ID NO: 207286 - RNA, 64 nt, Homo Sapiens
auucuucuucagaaauuaaaguaguugaccuuauaagaaaaauggaaaccaggagguuaucaug

SEQ ID NO: 207287 - RNA, 64 nt, Homo Sapiens
cauccaaauaaagacuuuaucuguaauuuaauugaagaaaaauagaaauccuauauccaguuuc

SEQ ID NO: 207288 - RNA, 64 nt, Homo Sapiens
aacaaacaaacacuucuuucuguaagucuuugacaagaaaaaaaaguuuaauuuaaaacuaugg

SEQ ID NO: 207289 - RNA, 64 nt, Homo Sapiens
aacauugucaguuaacaucacucuugucuggcaaaagaaaaaaaauagacuuuuucaacucagc

SEQ ID NO: 207290 - RNA, 64 nt, Homo Sapiens
gaaugccaguagaaaauucauaacguguaucuuuaagaaaaaugagcauacaucuuaaaucuuu

SEQ ID NO: 207291 - RNA, 64 nt, Homo Sapiens
aaauuaaauccuugcaggaagagaaauuaacacuaagaaaaagucaucaauauuuuucaacuuu

SEQ ID NO: 207292 - RNA, 64 nt, Homo Sapiens
aucuuuuguacuucucauaaccuaaugucagacuaagaaaaauaaaauaucugagaguaaauac

SEQ ID NO: 207293 - RNA, 64 nt, Homo Sapiens
gcagagauuuauaaaaauauauaagaaagauguuaagaaaaauuaaggggggauccauugaaag

SEQ ID NO: 207294 - RNA, 64 nt, Homo Sapiens
uacuuucaaguaaauauagcauuccuuuggcaaaaagaaaaaaaaaguaaaagaaaagaaaaaa

SEQ ID NO: 207295 - RNA, 64 nt, Homo Sapiens
uuccuuuggcaaaaagaaaaaaaaaguaaaagaaaagaaaaaaaauguauuaccacccgaugag

SEQ ID NO: 207296 - RNA, 64 nt, Homo Sapiens
uacaugucuauuugucaaacauaagugggaaccaaagaaaaaaugugacaaguuugaagacaca

SEQ ID NO: 207297 - RNA, 64 nt, Homo Sapiens
aacuucaguuacugaccagucaagagaauuucucaagaaaaaucccagcaacguucccucuuuc

SEQ ID NO: 207298 - RNA, 64 nt, Homo Sapiens
uugcugagcaaccaguguguuucaggaugauacaaagaaaaauauagaauagaaauaagugcag

SEQ ID NO: 207299 - RNA, 64 nt, Homo Sapiens
cuggaugagaaaauuuucaauucuggccaugagaaagaaaaaaaaauaaacagccuucuuuuuu

SEQ ID NO: 207300 - RNA, 64 nt, Homo Sapiens
uauggaaucaacaccaccgagcucugugggaaaaaagaaaaaccugcucccuucgcucugcugg

SEQ ID NO: 207301 - RNA, 64 nt, Homo Sapiens
aacauguaucugucuacuuucucuuguuuaaaaaaagaaaaaaaaacuuaaaaaaaugggguua

SEQ ID NO: 207302 - RNA, 64 nt, Homo Sapiens
uccagccugggugacagagcgagacuguguuucaaagaaaaaaaaaaacaagcagccuuuugcu

SEQ ID NO: 207303 - RNA, 64 nt, Homo Sapiens
ccauguacucagauaaacaugaagaaaauaagcaaagaaaaauggagacugggaaagcaaagcu

SEQ ID NO: 207304 - RNA, 64 nt, Homo Sapiens
gaaaaaaacaguuugaacacaaaaaaaggaaaaaaagaaaaaaguuaaaaaaagaaaaaaugaa

SEQ ID NO: 207305 - RNA, 64 nt, Homo Sapiens
gaaaaaaaaaggaaaaaaagugaaaucuuaaaaaaagaaaaaauuuccaguguguaacccaguu

SEQ ID NO: 207306 - RNA, 64 nt, Homo Sapiens
cauggucuuguuuuuacuaccacauuuuuaaaaaaagaaaaaaacauuuauguuagcauuaaug

SEQ ID NO: 207307 - RNA, 64 nt, Homo Sapiens
aaacaaaaaggaacuucuuauaaaagggaaaaaaaagaaaaaagaugacuguugccugcaaaaa

SEQ ID NO: 207308 - RNA, 64 nt, Homo Sapiens
auuuauauauacauuguguguaauugucuaccugaagaaaaaaagaagagguacuuuccuggaa

SEQ ID NO: 207309 - RNA, 64 nt, Homo Sapiens
uauucugaacaaagcuauaguaaugaaaaaagcaaagaaaaaaaccuuuuuggucaguaaaacu

SEQ ID NO: 207310 - RNA, 64 nt, Homo Sapiens
auaaaacaguaacacuuuaauguguauucaacaaaagaaaaaaauggacugccaguaaaacaaa

SEQ ID NO: 207311 - RNA, 64 nt, Homo Sapiens
auauaaauuuuagaaguuaugguccuuuuuaaauaagaaaaauugcagcuuauuuaaaacuugg

SEQ ID NO: 207312 - RNA, 64 nt, Homo Sapiens
auuuuguaugucaauaacuucauuaaaaggaaaaaagaaaaaaauuucuaaguuaaaucauuuu

SEQ ID NO: 207313 - RNA, 64 nt, Homo Sapiens
ugauuguuuuagaaguuaaaacccacugcugaaaaagaaaaaaaaauuuacagaauauuauaua

SEQ ID NO: 207314 - RNA, 64 nt, Homo Sapiens
ugagagaacuauuguuugggcugucuugagagaaaagaaaaauaucacuaauacuuacuguuaa

SEQ ID NO: 207315 - RNA, 64 nt, Homo Sapiens
uaaaaacaacaaauacuuccuucaaucacuagucaagaaaaauaagucucaaauuuuucaucuc

SEQ ID NO: 207316 - RNA, 64 nt, Homo Sapiens
gcuggguuuacuauugcacauuacuguauagaaaaagaaaaaaguuacaggcugcauucuugcc

SEQ ID NO: 207317 - RNA, 64 nt, Homo Sapiens
ucuguuguaaaaacaguuuauuuaauuaaaaaaaaagaaaaaaccuucuguacaucuuacuggg

SEQ ID NO: 207318 - RNA, 64 nt, Homo Sapiens
acaguuguuugaugcauuaaaagaaaauaaaaaaaagaaaaaagagaaaagaaaaaaaaagaaa

SEQ ID NO: 207319 - RNA, 64 nt, Homo Sapiens
cauuaaaagaaaauaaaaaaaagaaaaaagagaaaagaaaaaaaaagaaaaaaguuguaggcga

SEQ ID NO: 207320 - RNA, 64 nt, Homo Sapiens
aaauaaaaaaaagaaaaaagagaaaagaaaaaaaaagaaaaaaguuguaggcgaaucauuuguu

SEQ ID NO: 207321 - RNA, 64 nt, Homo Sapiens
uauauauauagaaccacuuuuuguagauuaguauaagaaaaauauuuacccuguuuuggggcaa

SEQ ID NO: 207322 - RNA, 64 nt, Homo Sapiens
uguguucagcaaaaugugauguuuuuuucuuuuaaagaaaaaaagugaaaauauauagugccaa

SEQ ID NO: 207323 - RNA, 64 nt, Homo Sapiens
ugaaggugugaugguagaaauaggaaaacaacaaaagaaaaacaauaacaaaaaaagaaagugu

SEQ ID NO: 207324 - RNA, 64 nt, Homo Sapiens
ugaaaacgauuuaccaauguuguuuuuuuuuaacaagaaaaaaaauaaaagcacauugucauuu

SEQ ID NO: 207325 - RNA, 64 nt, Homo Sapiens
uaccugaucaggaucugggagaauuugaaaaaaaaagaaaaacuagaaaaauaaacaaaauuaa

SEQ ID NO: 207326 - RNA, 64 nt, Homo Sapiens
aaaaagaaaaacuagaaaaauaaacaaaauuaaaaagaaaaaaaaauaccugagacugaguaac

SEQ ID NO: 207327 - RNA, 64 nt, Homo Sapiens
agaaauaauaccaggcuuuuauaaacuuuucuagaagaaaaaagauggaacuuuuccaauucag

SEQ ID NO: 207328 - RNA, 64 nt, Homo Sapiens
cuggaagacagagugagaccccaucucaggaaaaaagaaaaaaaaaaagaugucauucagcagg

SEQ ID NO: 207329 - RNA, 64 nt, Homo Sapiens
cugacauuacuuuagcaauucaacuugaugugagaagaaaaaacaaauguuucaacacaaaauc

SEQ ID NO: 207330 - RNA, 64 nt, Homo Sapiens
gagaccuauguugaaaaccccugaaaauucacugaagaaaaaucauuacucuuuuucucaguaa

SEQ ID NO: 207331 - RNA, 64 nt, Homo Sapiens
uauagggcuuuuugacagcuuuuugagaccucuuaagaaaaaauaaaaaguaaaaaaugaaagg

SEQ ID NO: 207332 - RNA, 64 nt, Homo Sapiens
gccaaugacuacucaguuuuaggacuuucuguggaagaaaaaagggagaagaaaucaauuccac

SEQ ID NO: 207333 - RNA, 64 nt, Homo Sapiens
uuuagaucuacaugaauaaacaaacuauuuuaccaagaaaaaucucagcuugcuuacugcuuaa

SEQ ID NO: 207334 - RNA, 64 nt, Homo Sapiens
uuuugacuuuacaaaguauagauguuggaacauuaagaaaaauguauauucccaaugaaaaaau

SEQ ID NO: 207335 - RNA, 64 nt, Homo Sapiens
uaacggauaaaauaauguguuauuuuuauagagaaagaaaaaaauagcaacacaaucuaguuua

SEQ ID NO: 207336 - RNA, 64 nt, Homo Sapiens
gauuuauagcauugacuuuuacacacauucacacaagaaaaaaauccuuucaaaauucuuaaau

SEQ ID NO: 207337 - RNA, 64 nt, Homo Sapiens
uucaggcuuuuuuuugguuucauuuuguuuuuuuaagaaaaagaaaaugaaaggaaaaaaauaa

SEQ ID NO: 207338 - RNA, 64 nt, Homo Sapiens
gaaagcuucagaccgcuaguaaggcucaaagaagaagaaaaacaccaaaaccacaagggaaaag

SEQ ID NO: 207339 - RNA, 64 nt, Homo Sapiens
aaagaagaagaaaaacaccaaaaccacaagggaaaagaaaaacccaguuucuuaggaaacgcaa

SEQ ID NO: 207340 - RNA, 64 nt, Homo Sapiens
uuuauuauccagauuauuuggauaaguccuuuuuaagaaaaaaaaagaaaaugaaaaacaacac

SEQ ID NO: 207341 - RNA, 64 nt, Homo Sapiens
caucuacgauucaacuaaucgaaggauuaaacuaaagaaaaaacuaagaagaacaaugaaccuu

SEQ ID NO: 207342 - RNA, 64 nt, Homo Sapiens
guggucccuuuugaauuucaugagccucucaaaaaagaaaaacuuaaaaaaaaaaaaaaaaaaa

SEQ ID NO: 207343 - RNA, 64 nt, Homo Sapiens
uccccuuccauucccaacucucucucucuuuuuaaagaaaaaugcuaagggcagcccugccugc

SEQ ID NO: 207344 - RNA, 64 nt, Homo Sapiens
gagacaauuuaaggccugcacucuuauuucacuaaagaaaaacuaaugucagcacauguugcua

SEQ ID NO: 207345 - RNA, 64 nt, Homo Sapiens
aagacaaacaauaugucuuuuuuuuuuuugcaugaagaaaaaugucuaucauuuacaguuucaa

SEQ ID NO: 207346 - RNA, 64 nt, Homo Sapiens
gucuugugaaaaaguugaacaaauuuccuaaucaaagaaaaaaguaugagcuccauguuucuuu

SEQ ID NO: 207347 - RNA, 64 nt, Homo Sapiens
aauucagaaauuggguuuugguucagugauucucaagaaaaagaucucuugcccauuaagaagu

SEQ ID NO: 207348 - RNA, 64 nt, Homo Sapiens
ucacgcugcugauaaagacauaccugagaccaggaagaaaaagagguuuaauuggacuuacagu

SEQ ID NO: 207349 - RNA, 64 nt, Homo Sapiens
cacacugcugauaaagacauuccucaagauugugaagaaaaagagguuuaauuggacuuacagu

SEQ ID NO: 207350 - RNA, 64 nt, Homo Sapiens
uucgcuuuucauguaugugguaagcauaaaaacaaagaaaaaucaagcagaacugaaguuagcu

SEQ ID NO: 207351 - RNA, 64 nt, Homo Sapiens
uuaaugugugggagcugcacaaagaggaggaaagaagaaaaaaaacauuugugugcagauacca

SEQ ID NO: 207352 - RNA, 64 nt, Homo Sapiens
aagaacaugaggguuaaaaaacugguccuguucaaagaaaaagagaagaccaaagaccucaaac

SEQ ID NO: 207353 - RNA, 51 nt, Homo Sapiens
aagaagaccaaagaccucaacaagaaaaaaaacaagaccccugaggcauga

SEQ ID NO: 207354 - RNA, 64 nt, Homo Sapiens
aauuguucaacaauaagggcaagauuccguucccaagaaaaaaauccagccugggcgacagagc

SEQ ID NO: 207355 - RNA, 64 nt, Homo Sapiens
gagaaaagccugaucccuguagcauugcauacacaagaaaaacauguuuaggaauuguccuuau

SEQ ID NO: 207356 - RNA, 64 nt, Homo Sapiens
agcucuaaauaucuaaaagguucaacccaaaaauaagaaaaaauuuuauguuaguagagcuguu

SEQ ID NO: 207357 - RNA, 64 nt, Homo Sapiens
aagaagacaacuuacaaaaucuucuauuuggaggaagaaaaauuacacuguauaugaugaaagg

SEQ ID NO: 207358 - RNA, 64 nt, Homo Sapiens
auaguaacuugugcuuugagaugcccaauaaggcaagaaaaagccaaagccuugcuuuuagaga

SEQ ID NO: 207359 - RNA, 64 nt, Homo Sapiens
gauaucuuuuuuauauuuuuuuuuagguuuguaaaagaaaaaggcagagcuucauucuccuggc

SEQ ID NO: 207360 - RNA, 64 nt, Homo Sapiens
ucugucccuguggucugaauaagaacugcucugcaagaaaaauauacugcauugcaccaugagc

SEQ ID NO: 207361 - RNA, 64 nt, Homo Sapiens
aaguauucauacagaaauuagacuuaagguguauaagaaaaagaaugcagauaacagcaggaag

SEQ ID NO: 207362 - RNA, 64 nt, Homo Sapiens
gauuguuuaaaaaaaaaagguaagaaaaaaaaaaaagaaaaaaaaccgagguguuuuuuacauu

SEQ ID NO: 207363 - RNA, 64 nt, Homo Sapiens
aaaaagaaaaaaagauuguuuguuuuuuacauuuaagaaaaaaacugucucugcuguaccgagg

SEQ ID NO: 207364 - RNA, 64 nt, Homo Sapiens
uuaaacauauuuacauauuuaaagauuuuuugcuaagaaaaaaaauuuucauuguuauuuuuag

SEQ ID NO: 207365 - RNA, 64 nt, Homo Sapiens
gcauaaaucuuuauugcagagaaaaaaaaaagaaaagaaaaaaguacuguuuguauaaaaaaua

SEQ ID NO: 207366 - RNA, 64 nt, Homo Sapiens
acugacauuauauauaaccaagguuauauucugaaagaaaaauaagaauagguuacuacaaaaa

SEQ ID NO: 207367 - RNA, 64 nt, Homo Sapiens
aaauaaugugcuuaagaaguucugggaucaguaaaagaaaaaaauccuuaucuuuugcagucuc

SEQ ID NO: 207368 - RNA, 64 nt, Homo Sapiens
aagcacgucuuggcucagcuaaaaaaaaaaguaaaagaaaaauacaagacccugucucuaaaga

SEQ ID NO: 207369 - RNA, 64 nt, Homo Sapiens
aaaaguaaaagaaaaauaaaagacccugucucuaaagaaaaaaaccagccugggcaacauagca

SEQ ID NO: 207370 - RNA, 64 nt, Homo Sapiens
ggaagaagcagcuuugcugaaaaaaaaaaagaaaaagaaaaagaggcuuuuuuuuccucucaaa

SEQ ID NO: 207371 - RNA, 64 nt, Homo Sapiens
aaaagaggaagaagcagcuucucaaaaaaaaaaaaagaaaaagaccagugggcuuuuuuuuccu

SEQ ID NO: 207372 - RNA, 64 nt, Homo Sapiens
aaaucuccgcaguguccaaaacuaaaaaaggaaaaagaaaaacacuggaggaaaaccagaucgg

SEQ ID NO: 207373 - RNA, 64 nt, Homo Sapiens
aguucccaggugccagcaaagucacuguuaguugaagaaaaagcugcuucugggccaggccauu

SEQ ID NO: 207374 - RNA, 64 nt, Homo Sapiens
gcuucuuuccauaucaaguagcauccaacuugagaagaaaaaaauaucuuuuaaacucaguucu

SEQ ID NO: 207375 - RNA, 64 nt, Homo Sapiens
aagguauuugggaaacauggugaaaugucaauauaagaaaaaucaucacccagacaugugcaga

SEQ ID NO: 207376 - RNA, 64 nt, Homo Sapiens
auacuaauuuugaccuugaaagaugaauuccuucaagaaaaauaaaauaaugcuuaagauaaug

SEQ ID NO: 207377 - RNA, 64 nt, Homo Sapiens
ugcgcaaaaauuguuaaauccuuugucuuuauuaaagaaaaauuugaguaacauuaaguuugau

SEQ ID NO: 207378 - RNA, 64 nt, Homo Sapiens
ugcaugaauauaaaucuauauuauuugcuaaaaaaagaaaaaacauuuguguuuuaguuucuuu

SEQ ID NO: 207379 - RNA, 64 nt, Homo Sapiens
ccguuaggguuuaaaaccauauugaucaacuagaaagaaaaauaugaaaagagaaaaauauuuu

SEQ ID NO: 207380 - RNA, 64 nt, Homo Sapiens
cugauacuuuugaaacagaugugaaaaacagaaaaagaaaaaauugucugaaauguuuauuuug

SEQ ID NO: 207381 - RNA, 64 nt, Homo Sapiens
caggauuuguagccuugugcuucuugcuaagagaaagaaaaacaaaaucagagggcauuaaaug

SEQ ID NO: 207382 - RNA, 64 nt, Homo Sapiens
gcuagucaauaugaggauggugguuuauucucagaagaaaaagauauguaaggucuuuuagcuc

SEQ ID NO: 207383 - RNA, 64 nt, Homo Sapiens
cuucaccuucaauaugagaauucagcgaacuugaaagaaaaaucaucugugaguuccuucaggu

SEQ ID NO: 207384 - RNA, 64 nt, Homo Sapiens
aucuuugugccacacaggauuuuuuuuuuuuuuuaagaaaaaccuauagaugaaaaauuacuaa

SEQ ID NO: 207385 - RNA, 64 nt, Homo Sapiens
ugcucuuucccccuuccaucucugacuuaagcaaaagaaaaagauuacccaaaaacugucuuua

SEQ ID NO: 207386 - RNA, 64 nt, Homo Sapiens
ggugggguguuugggaggcugcgugccagucaagaagaaaaagguuugcauucucacauugcca

SEQ ID NO: 207387 - RNA, 64 nt, Homo Sapiens
agauccuuuuauaggugagaaaaaaacaaucuggaagaaaaaaaccacacaaagacauugauuc

SEQ ID NO: 207388 - RNA, 64 nt, Homo Sapiens
cuauagaaaauauuugagaauuucuuauacuaucaagaaaaaauucugugaauuaagauguaau

SEQ ID NO: 207389 - RNA, 64 nt, Homo Sapiens
cuuuuuaaaaaguaacuuuuuuaauaauauaagaaagaaaaaugcccuuucacacugaaucuuc

SEQ ID NO: 207390 - RNA, 64 nt, Homo Sapiens
ccaaccugagugacagagcaacacucugucuuaaaagaaaaaaaaaaaagagagagauaguaau

SEQ ID NO: 207391 - RNA, 64 nt, Homo Sapiens
agguuaagucuuuuaaauuuuguggcucauuuaaaagaaaaaaaacauuauaaaagagcacuuc

SEQ ID NO: 207392 - RNA, 64 nt, Homo Sapiens
auuuuauucaaacauuagauucauuuuuauaucgaagaaaaaauugauuuuuaucuaaaaaaau

SEQ ID NO: 207393 - RNA, 64 nt, Homo Sapiens
uaagugacaaauguuagaagaacauuuguacuuuaagaaaaauuuuucuguuacaacuuacagg

SEQ ID NO: 207394 - RNA, 64 nt, Homo Sapiens
aaaaggugaugagggcaauucacuuuuuucugacaagaaaaaguuaugguuccagagaugcaua

SEQ ID NO: 207395 - RNA, 64 nt, Homo Sapiens
aguugcgcguucugaaauauguuuuguuuuaaggaagaaaaauccccccucuggucuccucuuu

SEQ ID NO: 207396 - RNA, 64 nt, Homo Sapiens
uaauuuuaugaacugcauguuaaauuauucaguuaagaaaaaaauguauauauacauaacaggg

SEQ ID NO: 207397 - RNA, 64 nt, Homo Sapiens
caauuacagaaaauaagcaaggucagcaacaacaaagaaaaagaaaaaaauaaauaagauaaag

SEQ ID NO: 207398 - RNA, 64 nt, Homo Sapiens
agaaauaauuuuguaaaacuaagaguagaauuccaagaaaaaugauuuaaggcuuuguaaaaug

SEQ ID NO: 207399 - RNA, 64 nt, Homo Sapiens
agguagaguagaggccuauuagaagaaagagaagaagaaaaagaggauccugaacggaaaagga

SEQ ID NO: 207400 - RNA, 64 nt, Homo Sapiens
aagaggauccugaacggaaaacaagaagaagaaaaagaaaaaagaacaccaucugauucagauc

SEQ ID NO: 207401 - RNA, 64 nt, Homo Sapiens
aaaaagaagaggauccugaacagaucacaagaagaagaaaaagauacagaaacaccaucugauu

SEQ ID NO: 207402 - RNA, 64 nt, Homo Sapiens
aaaaacaggaaaaaaagaacaugaagaaaaacugaagaaaaaaaaaauuuugcagcgaagagaa

SEQ ID NO: 207403 - RNA, 64 nt, Homo Sapiens
gaagaaaaaaaaaaaacaggagcgaagagaaaugaagaaaaacucacaaaaaaaaaaauuuugc

SEQ ID NO: 207404 - RNA, 64 nt, Homo Sapiens
auguaaaaaccauucuuaguccucucaaaagaaaaagaaaaaagugggugacagagcaagacuc

SEQ ID NO: 207405 - RNA, 64 nt, Homo Sapiens
aaaaagauguaaaaaccauuagacucccucucaaaagaaaaagaccagccugggugacagagca

SEQ ID NO: 207406 - RNA, 64 nt, Homo Sapiens
aacuuuugugauuuaauaaugugcuagaaaguuaaagaaaaaaagcagccuuugugccacuuca

SEQ ID NO: 207407 - RNA, 64 nt, Homo Sapiens
aguggcuggucuacuaggcaaagcacaauauuuuaagaaaaaaauaguuguacagauaguuuau

SEQ ID NO: 207408 - RNA, 64 nt, Homo Sapiens
accgcuuguaugauuuucaaacacaccuaacuuuaagaaaaagaaaauuuuuaauugaguguaa

SEQ ID NO: 207409 - RNA, 64 nt, Homo Sapiens
aaauuuucaaauaaaacccaaaacaaaauacuccaagaaaaagaaacuguaguaguuggucuag

SEQ ID NO: 207410 - RNA, 64 nt, Homo Sapiens
ucaacauuuuuugugcuuuacugaagcauaauuuaagaaaaacaauuauacaaucaaacuagau

SEQ ID NO: 207411 - RNA, 64 nt, Homo Sapiens
cuauuuguuaaaauauuugccuuuuuaaguaaaaaagaaaaaucagaacagggcuauuugaaga

SEQ ID NO: 207412 - RNA, 64 nt, Homo Sapiens
ggucggguuuucaaucacacugaauuggcaggauaagaaaaauaggucagauaaguaugggaug

SEQ ID NO: 207413 - RNA, 64 nt, Homo Sapiens
cuucccuuuagugauuucaguaguuuauauuggaaagaaaaacaauuacaacaugugcccuuac

SEQ ID NO: 207414 - RNA, 64 nt, Homo Sapiens
aucauuugguuuuugaguuguuuuuucuuaauguaagaaaaauuguauuuuuuuuacaaguauc

SEQ ID NO: 207415 - RNA, 64 nt, Homo Sapiens
uaaauuuaaaugggaagggaagaaaacaccaaauaagaaaaaaauuugccuuuaagaguuacuu

SEQ ID NO: 207416 - RNA, 64 nt, Homo Sapiens
cgacagugcaagacucugucuccaaaaaaaaaaaaagaaaaaagaaaaucccccuucauccccc

SEQ ID NO: 207417 - RNA, 64 nt, Homo Sapiens
gaaucccuuuguucucuguuuaaaaaaaucuaaaaagaaaaaggaaaaaaaaaaaagaacugcu

SEQ ID NO: 207418 - RNA, 64 nt, Homo Sapiens
aguauggaauaauauaucucaugucauuuuuuagaagaaaaacuauuugaagguauuuuuuggu

SEQ ID NO: 207419 - RNA, 64 nt, Homo Sapiens
uacuaccuaaagggaaccugcaauaaucuugaaaaagaaaaagagaaaaauuuuaaaauccugc

SEQ ID NO: 207420 - RNA, 64 nt, Homo Sapiens
ugucuugaauucucuguuuaugcaaugugcucgaaagaaaaaaauguuaaaaauauaucuauaa

SEQ ID NO: 207421 - RNA, 64 nt, Homo Sapiens
caaagauuauauaugacaaucaguauugcaaugaaagaaaaacuaaaaacagaaaugauauucu

SEQ ID NO: 207422 - RNA, 64 nt, Homo Sapiens
uguggucuaucaccacugaauucauguaauagauaagaaaaaaauuagagguggaugucuuguu

SEQ ID NO: 207423 - RNA, 64 nt, Homo Sapiens
ucaacauuuaugaaauauugccugacuauuuaaaaagaaaaaaguagcucuccauuaucaccuu

SEQ ID NO: 207424 - RNA, 64 nt, Homo Sapiens
aaacagacaguauuguaaucccaucaaaagaugaaagaaaaacaaaaacaaaaaccaacaacaa

SEQ ID NO: 207425 - RNA, 64 nt, Homo Sapiens
aaagagcuaaacuuauucagaaaggaaugacuagaagaaaaaggagacaauaccauguuguuca

SEQ ID NO: 207426 - RNA, 64 nt, Homo Sapiens
ucauugauuuuaaacauuuuauuccuacuuucagaagaaaaauauaauacggaaaaaauuauag

SEQ ID NO: 207427 - RNA, 64 nt, Homo Sapiens
cuugucaguggcguugggagggggagaaaaggaaaagaaaaaaaaaagaagaagaagaagaaaa

SEQ ID NO: 207428 - RNA, 64 nt, Homo Sapiens
gaaaaaaaaaagaagaagaagaagaaaagagaagaagaaaaaaacgaaaacagucaaccaaccc

SEQ ID NO: 207429 - RNA, 64 nt, Homo Sapiens
ugauggaaaguucagcaagaucagcaacaaaaccaagaaaaaugauccuugcgugcugaauauc

SEQ ID NO: 207430 - RNA, 64 nt, Homo Sapiens
cugaaacgcuuccuauaacucgaguuuauaggggaagaaaaagcuauuguuuacaauuauauca

SEQ ID NO: 207431 - RNA, 64 nt, Homo Sapiens
aagcaaagauccaccgagagaagaagagaaagaaaagaaaaagaaaaagcacaaaaaaagaucu

SEQ ID NO: 207432 - RNA, 64 nt, Homo Sapiens
agauccaccgagagaagaagagaaagaaaagaaaaagaaaaagcacaaaaaaagaucucgaaca

SEQ ID NO: 207433 - RNA, 64 nt, Homo Sapiens
aauuucucuuuacuucucucccugacagaaaaaaaagaaaaauguuuuuuuucuuuguaaugca

SEQ ID NO: 207434 - RNA, 64 nt, Homo Sapiens
uuuuguuuuguuuuuuggggcuacaauuuuuaaaaagaaaaaagauguguuuuguuguuuugug

SEQ ID NO: 207435 - RNA, 64 nt, Homo Sapiens
aaauacaacaagcaaacaacucaaaaggcuuggaaagaaaaaaccugacuaauagaccucagcc

SEQ ID NO: 207436 - RNA, 64 nt, Homo Sapiens
uggaaaaaaauuacaaggcaauuuuuucuauaaaaagaaaaaaacacucuccccaaaauauuau

SEQ ID NO: 207437 - RNA, 64 nt, Homo Sapiens
agucaaagacaaaguguguaaagaugguaaaaagaagaaaaagaacauaaagaaaagaugagca

SEQ ID NO: 207438 - RNA, 64 nt, Homo Sapiens
aaaacuguagacccuaacagcaugauaacauuugaagaaaaaaucaaaauaucacauaagacau

SEQ ID NO: 207439 - RNA, 64 nt, Homo Sapiens
ugaaaaggaaacaacuagcaagauaaaguagaaaaagaaaaaagcagucaaagaaagagaaaaa

SEQ ID NO: 207440 - RNA, 64 nt, Homo Sapiens
auauuaaaaagauauuugaaauuauugucaucccaagaaaaaauaauacuaucauaguaauauu

SEQ ID NO: 207441 - RNA, 64 nt, Homo Sapiens
auauuuuaaaaauuuauuugauuauugucaucccaagaaaaaagaauacuaucauguuaauacu

SEQ ID NO: 207442 - RNA, 64 nt, Homo Sapiens
aauacuaucauguuaauacuauuuuaauaaaaauaagaaaaauuguaacaaucuugaagagcua

SEQ ID NO: 207443 - RNA, 64 nt, Homo Sapiens
cuaguguccaauuucauuuuccagaguuauuuuaaagaaaaacaacuuugcuaacuuacuagua

SEQ ID NO: 207444 - RNA, 64 nt, Homo Sapiens
aaacuuuauguauuagugucauuuaggauauugaaagaaaaaauaugacucccauugucccuuu

SEQ ID NO: 207445 - RNA, 64 nt, Homo Sapiens
aagucuagcgaaaaaacuccuuaauaagguuaaaaagaaaaaaauuuuaggaccaaucucauuu

SEQ ID NO: 207446 - RNA, 64 nt, Homo Sapiens
uaauuuuucuuuucuguuuuaagccaaaaaaagaaagaaaaaaaaugagguccuucuggacuaa

SEQ ID NO: 207447 - RNA, 64 nt, Homo Sapiens
gcagaagcccuggauucaaaagaaaaaagaaagaaagaaaaaagucugucucaaaaaaaaaaaa

SEQ ID NO: 207448 - RNA, 64 nt, Homo Sapiens
aaagaaagaaaaaaggcagacucaaaaaaaaaaaaagaaaaaaggugacagagcgaaccucugu

SEQ ID NO: 207449 - RNA, 64 nt, Homo Sapiens
aaauagcaacucuggugagcagcacuaaacagaaaagaaaaaaacuauaagaauuaagggguaa

SEQ ID NO: 207450 - RNA, 64 nt, Homo Sapiens
augccaugaaacauuugaacaaauuuuucacuuaaagaaaaaaaaaaacuguuuuacaguauca

SEQ ID NO: 207451 - RNA, 64 nt, Homo Sapiens
augaauggucaaaaugaauaucuucuuagaaagaaagaaaaagucaaagcacucagcucaauua

SEQ ID NO: 207452 - RNA, 64 nt, Homo Sapiens
agaaagcauagacauauuuuaaaaaaaagaaaaaaagaaaaaaauuaagaaaguacuugacuaa

SEQ ID NO: 207453 - RNA, 64 nt, Homo Sapiens
gaaaaaaaagaaagcauagauugacuaaaaaaaaaagaaaaaaauuguuucuuuaagaaaguac

SEQ ID NO: 207454 - RNA, 64 nt, Homo Sapiens
agaaaaacaaagagauuucuaagagagaaaggaaaagaaaaaggugaauacaaagauaagugaa

SEQ ID NO: 207455 - RNA, 64 nt, Homo Sapiens
aaauauauauauauauauauaauguucuauagaaaagaaaaaaagcuguugaucuuuuaucaau

SEQ ID NO: 207456 - RNA, 64 nt, Homo Sapiens
ccaaugaggaacaauuggaggauguguguuuuaaaagaaaaaacaaagcaaccccaaaagaguu

SEQ ID NO: 207457 - RNA, 64 nt, Homo Sapiens
agcacgugaccuuaugaggccaaaaaagaaaaaaaagaaaaaaaacaaaagcgaaacucugucu

SEQ ID NO: 207458 - RNA, 64 nt, Homo Sapiens
agaaaaaaaagcacgugaccacucugucucaaaaaagaaaaaaagccugggcaacaaaagcgaa

SEQ ID NO: 207459 - RNA, 64 nt, Homo Sapiens
aaaguccccuuuuaaaacaacauuuuuuuccauuaagaaaaaaaaagcuuuuggcucucuguuu

SEQ ID NO: 207460 - RNA, 64 nt, Homo Sapiens
caacaguuaaaagcuuuuggcuuucauugaagaaaagaaaaaaaugucuuuucaaaaugagagg

SEQ ID NO: 207461 - RNA, 64 nt, Homo Sapiens
ugucuuuucaaaaugagaggaccuuuguugcuugaagaaaaacaguugaggaauuuccucuacc

SEQ ID NO: 207462 - RNA, 64 nt, Homo Sapiens
uaucuuaaaacuaaauguaauuuauuaacuaaucaagaaaaacaucuuuggcugagcucggugg

SEQ ID NO: 207463 - RNA, 64 nt, Homo Sapiens
gccugggcaacauagggagacccccaucuuuacaaagaaaaaaaaaaggggaaaagaaaaucuu

SEQ ID NO: 207464 - RNA, 64 nt, Homo Sapiens
ucaauaauaauaauaauaauaaugaugauacucuaagaaaaaaaucucaacauacuucauuuaa

SEQ ID NO: 207465 - RNA, 64 nt, Homo Sapiens
agccugggugaaaaagacaggcugugucuccaaaaagaaaaaaaaaagucaaauucaaauauca

SEQ ID NO: 207466 - RNA, 64 nt, Homo Sapiens
uuugaauuucaauaaucagggguuugggucaaggaagaaaaaucaugggacuugccauuuagga

SEQ ID NO: 207467 - RNA, 64 nt, Homo Sapiens
uggaagagagaugagaaaauugagagcuauuauuaagaaaaacaguugagagaggaagaauuug

SEQ ID NO: 207468 - RNA, 64 nt, Homo Sapiens
gggaaacgacccuguggcugugagaaagugaaaaaagaaaaaaaaaaaggcauuggcauuuucu

SEQ ID NO: 207469 - RNA, 64 nt, Homo Sapiens
guauuaggacagaauuaaugaugcuuaaagagaaaagaaaaaaagagagaagaaaaaggagaga

SEQ ID NO: 207470 - RNA, 64 nt, Homo Sapiens
uaaugaugcuuaaagagaaaagaaaaaaagagagaagaaaaaggagagaugaaaaaggaggaug

SEQ ID NO: 207471 - RNA, 64 nt, Homo Sapiens
accauauguguauuagggugaaggaaaaaaaaaaaagaaaaaaaaaaaaaaaaaaaaaaaaaaa

SEQ ID NO: 207472 - RNA, 64 nt, Homo Sapiens
ugcaggcugggcgcgguggcuguuuucuucuaugaagaaaaaaaaauuugggaaguuuuacuuu

SEQ ID NO: 207473 - RNA, 64 nt, Homo Sapiens
gccagaagcaaagaaaugcuuagauauugugcccaagaaaaacauucauuacaggaaauguaac

SEQ ID NO: 207474 - RNA, 64 nt, Homo Sapiens
gaacaaauuuuuaucuaaaaccugggaguaagguaagaaaaaugcaagcagaugauugauaaaa

SEQ ID NO: 207475 - RNA, 64 nt, Homo Sapiens
acuauucaaaaauaguuucaauuagcauauauggaagaaaaaucuguaaaacuaauguaucaaa

SEQ ID NO: 207476 - RNA, 64 nt, Homo Sapiens
gaaaacuuuauacaaaaaagaacaauaaagaugaaagaaaaaauuaugaugccggaauucugua

SEQ ID NO: 207477 - RNA, 64 nt, Homo Sapiens
cuaucagcuguauguuaagauuuagcaaggauuaaagaaaaaaggauuugaaauaaaaggaaau

SEQ ID NO: 207478 - RNA, 64 nt, Homo Sapiens
uaacauuauagauacucugguuaauuacuugauuaagaaaaaauaauauaguucugauugggua

SEQ ID NO: 207479 - RNA, 64 nt, Homo Sapiens
gccuacaggccauaguuaacaaaaaaaaaaagagaagaaaaacuacagaacaagacugucucaa

SEQ ID NO: 207480 - RNA, 64 nt, Homo Sapiens
uuucauuuuccuacagaggauauuuaauauuuguaagaaaaaacuuuugcguaaguacuuugau

SEQ ID NO: 207481 - RNA, 64 nt, Homo Sapiens
uugaaagaacacuucuaagcgguuucuuuuuuaaaagaaaaaacaacaaaaaucuucaaagacu

SEQ ID NO: 207482 - RNA, 64 nt, Homo Sapiens
gcuuaucuagauucgaaaaucagcaacauaugagaagaaaaaagagugaugauaugcucuccua

SEQ ID NO: 207483 - RNA, 64 nt, Homo Sapiens
uauauauaaguaaucagaacuacaaagcuguuuaaagaaaaaggggaugaauguucucaaaugu

SEQ ID NO: 207484 - RNA, 64 nt, Homo Sapiens
aaaaaagauuauuguaaauauauucuuguauucaaagaaaaaggcacugaaaacauuuuuguca

SEQ ID NO: 207485 - RNA, 64 nt, Homo Sapiens
accugccgauuaacaagacuagaacaaaugagaaaagaaaaaaaauaacuaaaacauugaaaac

SEQ ID NO: 207486 - RNA, 64 nt, Homo Sapiens
agaaagguugcaauuauauaaaauaguaauagugaagaaaaaauaacuggaacuugacaauuau

SEQ ID NO: 207487 - RNA, 64 nt, Homo Sapiens
aacucagggaucacugggaggaaaaaaaaagaagaagaaaaagagcacagcaguaaacuauggg

SEQ ID NO: 207488 - RNA, 64 nt, Homo Sapiens
agaaaagcaaucucgcaguaguuauugauggaaaaagaaaaagaagaggcauuccagccccuau

SEQ ID NO: 207489 - RNA, 64 nt, Homo Sapiens
aaaaaggaaagaaagaaacuacaaaaaaaacaaaaagaaaaaaaaaccagugaggcugcccuga

SEQ ID NO: 207490 - RNA, 64 nt, Homo Sapiens
cgcaaugagagaagcagcaguggguacaaggaggaagaaaaagggcuugcagagaguggaaagu

SEQ ID NO: 207491 - RNA, 64 nt, Homo Sapiens
gaauauucaugaaacuucauugcagggguaauagaagaaaaaguaaauugggaggacuuaaugg

SEQ ID NO: 207492 - RNA, 64 nt, Homo Sapiens
agguuuguugaacaaugccuuuucagguuggaagaagaaaaauagccucaaucucccaccccau

SEQ ID NO: 207493 - RNA, 64 nt, Homo Sapiens
uuugcaacagaauuuuguagccuuaagggguaggaagaaaaaccugacugcaaaucaugucagu

SEQ ID NO: 207494 - RNA, 64 nt, Homo Sapiens
ugguuauuuaccuccuuuuuuuuuuuuuuuuuuaaagaaaaaaggacuuuuaaccuuugcugac

SEQ ID NO: 207495 - RNA, 64 nt, Homo Sapiens
gcuuacaaauauucuguuaagggguaguuuuauaaagaaaaaugauauauaguuauguugucuu

SEQ ID NO: 207496 - RNA, 64 nt, Homo Sapiens
cuccuaucgguauacaaauuccauuucuuuuuauaagaaaaacacauaaaccauuaucauuuau

SEQ ID NO: 207497 - RNA, 64 nt, Homo Sapiens
uguauagcuuacucuaccugcagacagaaaaugaaagaaaaaaauggacuugccuagaauaaua

SEQ ID NO: 207498 - RNA, 64 nt, Homo Sapiens
gucuugcauccagaaaggccagauuuuaccuaccaagaaaaaaagauauuuuuccagagaguua

SEQ ID NO: 207499 - RNA, 62 nt, Homo Sapiens
gaucauuuaacaaaaaauaaguagcuuuauuaaagaaaaaucuucaacacaaucaaacuuua

SEQ ID NO: 207500 - RNA, 64 nt, Homo Sapiens
ugaaaaugcuggugagcugagguagaaaaaaaacaagaaaaaaauuuuaaaaauagcguuaaaa

SEQ ID NO: 207501 - RNA, 64 nt, Homo Sapiens
gaacuauauuucaaaugaauuuaaauaucuuuuaaagaaaaaaacaccuaaaaauaaaucuuaa

SEQ ID NO: 207502 - RNA, 64 nt, Homo Sapiens
uaacuggacaccuuuuauuugaagaaacaaacugaagaaaaaaugcuuccuuaagugcugacag

SEQ ID NO: 207503 - RNA, 64 nt, Homo Sapiens
aauuauguaaaaaacaaaacuacaacaacaaaaaaagaaaaaaguuaaaaaagaaaaaaacacc

SEQ ID NO: 207504 - RNA, 64 nt, Homo Sapiens
aaacuacaacaacaaaaaaagaaaaaaguuaaaaaagaaaaaaacaccaaaaaacaaaaacaaa

SEQ ID NO: 207505 - RNA, 64 nt, Homo Sapiens
ccucuugcaugaaaauaguaucuuaguuauaagaaagaaaaagaccuuuguuuacuuagcuuuc

SEQ ID NO: 207506 - RNA, 64 nt, Homo Sapiens
gauacuaaaagucucuucugacuuucugacuacaaagaaaaacaauacauagaauuugccaguu

SEQ ID NO: 207507 - RNA, 64 nt, Homo Sapiens
caaauuuaaaugcacuggauugaaauucuuaaucaagaaaaaagugagcaaaaacagcaagugg

SEQ ID NO: 207508 - RNA, 64 nt, Homo Sapiens
cuaaucuuggcauccuaucacaaaugaacucuuaaagaaaaaaaaacagugggguuuaguacuc

SEQ ID NO: 207509 - RNA, 64 nt, Homo Sapiens
aaauuuaacuuaaaauauuuuaaaaaaaaaaaaaaagaaaaagacuuuuaaacuuauuuugcuu

SEQ ID NO: 207510 - RNA, 64 nt, Homo Sapiens
gacuccaguauuuguggccuuauuuugugggacaaagaaaaaaguaaguuaacuguaauuacug

SEQ ID NO: 207511 - RNA, 64 nt, Homo Sapiens
uuaaaggguguacuuauaucaaaaaagaaaaaagaagaaaaaauaaaaaaguuuuauuuuucua

SEQ ID NO: 207512 - RNA, 64 nt, Homo Sapiens
aagaaaaaauuuaaaggguguauuuuucuaaaaaaagaaaaaaguuuguacaaaaaaaaaguuu

SEQ ID NO: 207513 - RNA, 64 nt, Homo Sapiens
uuuuaaagugcacuaaaauguauuuaaagagcacaagaaaaauuuuaaauuauuccauaaauaa

SEQ ID NO: 207514 - RNA, 64 nt, Homo Sapiens
uaauaugaaacaaugagguaaauaaaacugugagaagaaaaaaaauuauaguuuuggcuguaua

SEQ ID NO: 207515 - RNA, 64 nt, Homo Sapiens
aacaaaaaaaacaaaaucuaugaccaaauuguuuaagaaaaaaauuuauaucaaaggugcaucg

SEQ ID NO: 207516 - RNA, 64 nt, Homo Sapiens
gacugucauuuccuuauaagauuuauaguaaaggaagaaaaaaaucugcuaagcuguuaaaugu

SEQ ID NO: 207517 - RNA, 64 nt, Homo Sapiens
gaaaaaaaucacaaaaacaacuuugaagaaaaaaaagaaaaagagauccacaaugcauggauuc

SEQ ID NO: 207518 - RNA, 64 nt, Homo Sapiens
agaaaaagagaaaaaaaucacauggauuccuuugaagaaaaaaagaaauuucugauccacaaug

SEQ ID NO: 207519 - RNA, 64 nt, Homo Sapiens
aaacaaaaacaaacaggcugaauuuggaaauaaaaagaaaaaaaaauguaccuuuuuguuagug

SEQ ID NO: 207520 - RNA, 64 nt, Homo Sapiens
auacccuuuucuuuuccuuggcauuuuacaaaacaagaaaaaaauaauaaucgagaaugccugg

SEQ ID NO: 207521 - RNA, 64 nt, Homo Sapiens
caauguauuagauaaacccaguuucagaaugauaaagaaaaaauguuagaccaaauaaugcggc

SEQ ID NO: 207522 - RNA, 64 nt, Homo Sapiens
uaccacucuuuguguagauauuugucauauauuuaagaaaaagcuaaaaagaauggaaaucgca

SEQ ID NO: 207523 - RNA, 64 nt, Homo Sapiens
acugcacaguugugaaaaaggaagagaaucauuaaagaaaaagaaaaaagauuuuaagaccguu

SEQ ID NO: 207524 - RNA, 64 nt, Homo Sapiens
caguugugaaaaaggaagagaaucauuaaagaaaaagaaaaaagauuuuaagaccguugaaauc

SEQ ID NO: 207525 - RNA, 64 nt, Homo Sapiens
aauuuguauuuuggaggugcuugaucuaucuacaaagaaaaauuaauuaggaauuacuuuauua

SEQ ID NO: 207526 - RNA, 64 nt, Homo Sapiens
ugaauacugucuguaucuuugguuauccuguuugaagaaaaaggacaaauaaaacauggccagc

SEQ ID NO: 207527 - RNA, 64 nt, Homo Sapiens
gauuaucugaagacacaaaccugacaggagggagaagaaaaaacaaaacacuugaaccaagaaa

SEQ ID NO: 207528 - RNA, 64 nt, Homo Sapiens
caguaugcccagaagcuuuccuucauaaaauagaaagaaaaaaacauuuggcuuauuuuucacu

SEQ ID NO: 207529 - RNA, 64 nt, Homo Sapiens
gauuaauaauccaacuuuaauaguauacauuuaaaagaaaaaaaacaaaagcccuggaaguuga

SEQ ID NO: 207530 - RNA, 64 nt, Homo Sapiens
ccagggcuugucuggaucagcaccaacgauuuuaaagaaaaaaggaagaguuucuuagaugagu

SEQ ID NO: 207531 - RNA, 64 nt, Homo Sapiens
cacaguugagugcaucccaggaaaggaagaccucaagaaaaauuuccacuucauccagaugaag

SEQ ID NO: 207532 - RNA, 64 nt, Homo Sapiens
agagccuuaacauauauaaauagaguauauugaaaagaaaaagauuauuuuuuaaaauucuaag

SEQ ID NO: 207533 - RNA, 64 nt, Homo Sapiens
uaaaaagaauggaaaucgcauuugucguauauugaagaaaaagcuaccacucuuuguguagaua

SEQ ID NO: 207534 - RNA, 64 nt, Homo Sapiens
guuagaccaaauaaugcggcguuucagaaugauaaagaaaaaaucaauguauuagauaaaccca

SEQ ID NO: 207535 - RNA, 64 nt, Homo Sapiens
uuuucccauauaauccaacuucugccguuugcaaaagaaaaaucccaggaacuacaagaugcca

SEQ ID NO: 207536 - RNA, 64 nt, Homo Sapiens
uguucacucccacuuaugugagacagagagauuaaagaaaaauaagagagagagagagaggaga

SEQ ID NO: 207537 - RNA, 64 nt, Homo Sapiens
ggggcuuaggggauuggaacugggguuuggcugaaagaaaaaaaaaaaaauguaacugaugaau

SEQ ID NO: 207538 - RNA, 64 nt, Homo Sapiens
aaggcccaggacacuugucagaaggaugcaaaaaaagaaaaaaguacauccacccucuuaaucc

SEQ ID NO: 207539 - RNA, 64 nt, Homo Sapiens
gguuuuguuucuguuguuguucaaaugcaaaaaaaagaaaaaaaaagaaaaaaaaaggugacuc

SEQ ID NO: 207540 - RNA, 64 nt, Homo Sapiens
cuguuguuguucaaaugcaaaaaaaagaaaaaaaaagaaaaaaaaaggugacucacauuguuac

SEQ ID NO: 207541 - RNA, 64 nt, Homo Sapiens
gcuggaucugaguuuugucacucuaaaauuaaacaagaaaaaaagugggaaaagggcauccccc

SEQ ID NO: 207542 - RNA, 64 nt, Homo Sapiens
cuuccauucaccauucuuuaucuuuucuuugaauaagaaaaaguaucuagcaaggauauuacuu

SEQ ID NO: 207543 - RNA, 64 nt, Homo Sapiens
uguuuguaaaucuagccaauagagucauuuacagaagaaaaaugagcauguaauaauacaagaa

SEQ ID NO: 207544 - RNA, 64 nt, Homo Sapiens
aaauccaaaagagagaagagaaaaaaaaagaaaaaagaaaaaaacaaaaaaaaaaaaaaaaaaa

SEQ ID NO: 207545 - RNA, 64 nt, Homo Sapiens
aaaaaaaaaauccaaaagagaaaaaaaaaaaaaaaagaaaaaaguaaaagccaaaaaaaaaaaa

SEQ ID NO: 207546 - RNA, 64 nt, Homo Sapiens
agucuuuacaccugauaaaacgguucuucccuagaagaaaaacauuaucaaauauauauccaga

SEQ ID NO: 207547 - RNA, 64 nt, Homo Sapiens
gaaaaagguuaaucacaaaaaauuacauuuuaaaaagaaaaacaagggucucgcauucaagggc

SEQ ID NO: 207548 - RNA, 64 nt, Homo Sapiens
gguauauuuauguaagaaaaugacuguaaaucucaagaaaaaucucagcagcuaauagcaacuc

SEQ ID NO: 207549 - RNA, 64 nt, Homo Sapiens
cacucguuaaauagguuuucuuuaaacuuaauuaaagaaaaacuauuuaaagguaaaggauauu

SEQ ID NO: 207550 - RNA, 64 nt, Homo Sapiens
cuucuguccuguucacagguucuccuucuucaucaagaaaaaguggaaccagcugucccuccag

SEQ ID NO: 207551 - RNA, 64 nt, Homo Sapiens
uaugugccuuccaaccagagggagacccaguagaaagaaaaacauccugggaaauccagcuacc

SEQ ID NO: 207552 - RNA, 64 nt, Homo Sapiens
uuuucuuacgaauauaccaacauccugaaaguuaaagaaaaaaaucuaauguaugaaugugacu

SEQ ID NO: 207553 - RNA, 64 nt, Homo Sapiens
gaccuaaaaauaauucucuuguauuuuggagaugaagaaaaaagucauucaccugggagggauu

SEQ ID NO: 207554 - RNA, 64 nt, Homo Sapiens
cagccugggugacagagcgagacuccguaucagaaagaaaaagaggaacugaaugaaaucucag

SEQ ID NO: 207555 - RNA, 64 nt, Homo Sapiens
agccugggcaacauagugagaccccaucucuacaaagaaaaaaaaauuagcuggacaugguaau

SEQ ID NO: 207556 - RNA, 64 nt, Homo Sapiens
cccaacuugggaguggggaaauugcuuaaaaaaaaagaaaaagaaaaaaaaaaagauuauucua

SEQ ID NO: 207557 - RNA, 64 nt, Homo Sapiens
uugggaguggggaaauugcuuaaaaaaaaagaaaaagaaaaaaaaaaagauuauucuaaauaaa

SEQ ID NO: 207558 - RNA, 64 nt, Homo Sapiens
gccccaccaagaggguggaucacaccucagugggaagaaaaauaaaauuuccuucagguuuuaa

SEQ ID NO: 207559 - RNA, 64 nt, Homo Sapiens
cugauagucuugaauauuuuauuuuuuuaaugaaaagaaaaaacaagaaaguuauguuucauaa

SEQ ID NO: 207560 - RNA, 64 nt, Homo Sapiens
caugcuuugauaucugguucagacuaucaucaggaagaaaaaaaaaucccacaguaccugaaau

SEQ ID NO: 207561 - RNA, 64 nt, Homo Sapiens
uccagcugggagacacagcaagacuccgucucaaaagaaaaaaaaaaaaaagaacaacugccaa

SEQ ID NO: 207562 - RNA, 64 nt, Homo Sapiens
aucuuaggcuggccagacuucagcuguuccuuugaagaaaaagacacagacaaagugacauucc

SEQ ID NO: 207563 - RNA, 64 nt, Homo Sapiens
caauuauauucuuggccaauuuuguccaacggacaagaaaaaagcaaagucaacgacaccauua

SEQ ID NO: 207564 - RNA, 64 nt, Homo Sapiens
gcagaagcgagaaaacuuuguuuauugaaaaaaaaagaaaaagaaagcaagaaaaaaagauacu

SEQ ID NO: 207565 - RNA, 64 nt, Homo Sapiens
acuuuguuuauugaaaaaaaaagaaaaagaaagcaagaaaaaaagauacuauggggucaagugu

SEQ ID NO: 207566 - RNA, 64 nt, Homo Sapiens
uuggacuuuguaauuauuuuuuuagcaguaauuaaagaaaaaaguccucugugaggaauauucu

SEQ ID NO: 207567 - RNA, 64 nt, Homo Sapiens
aguauuuuuguacagauuugcuuucucuuacaaaaagaaaaaaaaaauccuguuguauuaacau

SEQ ID NO: 207568 - RNA, 64 nt, Homo Sapiens
ucuaaggcucgccgugagccaggucuaaaguuugaagaaaaagaaaaaucuuaaaaaaaaaaaa

SEQ ID NO: 207569 - RNA, 64 nt, Homo Sapiens
gcucgccgugagccaggucuaaaguuugaagaaaaagaaaaaucuuaaaaaaaaaaaaaaaaaa

SEQ ID NO: 207570 - RNA, 64 nt, Homo Sapiens
aaagaaaaaucuuaaaaaaaaaaaaaaaaaaaaaaagaaaaaaagaaaaacaggaaaaaggacu

SEQ ID NO: 207571 - RNA, 64 nt, Homo Sapiens
aucuuaaaaaaaaaaaaaaaaaaaaaaagaaaaaaagaaaaacaggaaaaaggacuuuuuuuuu

SEQ ID NO: 207572 - RNA, 64 nt, Homo Sapiens
cugcuagucuuggcaaacauuacagaauguuuaaaagaaaaacuccccagucugacauauuuca

SEQ ID NO: 207573 - RNA, 64 nt, Homo Sapiens
augaauuagaagagauccccugcacaauguuuaaaagaaaaacaucuaugugaauauaagcuug

SEQ ID NO: 207574 - RNA, 64 nt, Homo Sapiens
aagucuuugguaaauggcaaagcuuuaaaagaaaaagaaaaaaauuuucccuugaggaaacaac

SEQ ID NO: 207575 - RNA, 64 nt, Homo Sapiens
aaaaaaaagucuuugguaaaaacaacagcuuuaaaagaaaaagaauaaaguuuucccuugagga

SEQ ID NO: 207576 - RNA, 64 nt, Homo Sapiens
ugcuagaggaaaacuuugaguuaaaacuaaauguaagaaaaaucuuuucccaucaagucauuug

SEQ ID NO: 207577 - RNA, 64 nt, Homo Sapiens
agagaaacuagaaacaguuauagccuuccaagagaagaaaaagacuuaaagaauuugucaaucc

SEQ ID NO: 207578 - RNA, 64 nt, Homo Sapiens
aguacaaccaaaugccagucgcagugaagagauaaagaaaaaaagcaaauugauaguuguucua

SEQ ID NO: 207579 - RNA, 64 nt, Homo Sapiens
cagaaagagaaauaggaggaaagaagaaggaagaaagaaaaagaaaaaaagaaaaagaaaaagc

SEQ ID NO: 207580 - RNA, 64 nt, Homo Sapiens
aagaagaaggaagaaagaaauuaaaaaaaagaaaaagaaaaagccaaaucucuugcuuucuuuc

SEQ ID NO: 207581 - RNA, 64 nt, Homo Sapiens
aaaagcaagaagaaggaagaucuuucuuaaaaaaaagaaaaagaaagauucaaaucucuugcuu

SEQ ID NO: 207582 - RNA, 64 nt, Homo Sapiens
acaaaaaauauauaucacucuuuuggaagaaaaaaagaaaaagaccuagagcucuaauuguuug

SEQ ID NO: 207583 - RNA, 64 nt, Homo Sapiens
gaaaaagaacaaaaaauauaauuguuuguuuuggaagaaaaaaagcgaggggccuagagcucua

SEQ ID NO: 207584 - RNA, 64 nt, Homo Sapiens
agcagccaggugcaguggcuaaacuuuauuuaaaaagaaaaauuugaaaguuaauccuuuuuaa

SEQ ID NO: 207585 - RNA, 64 nt, Homo Sapiens
cuaagucccagcaauacaaacuucaucaaaacagaagaaaaaggaucaagagaaaaccaaucag

SEQ ID NO: 207586 - RNA, 64 nt, Homo Sapiens
aaaaacaaaaaacuaaaggguauuuagaaaaaggaagaaaaacaucuccaccaagcauuugguu

SEQ ID NO: 207587 - RNA, 64 nt, Homo Sapiens
uucuggauguccagccagcuggcguggccgagggaagaaaaagcggacuggaggccgccaggca

SEQ ID NO: 207588 - RNA, 64 nt, Homo Sapiens
cccuucuccaccagauauuuuggcguguagcacaaagaaaaagcauguuucuuuauugcauaac

SEQ ID NO: 207589 - RNA, 64 nt, Homo Sapiens
cgaggaaaucagagaaacucaucuugguuuuugcaagaaaaaagcauuugcauacaccugggcc

SEQ ID NO: 207590 - RNA, 64 nt, Homo Sapiens
aucccuuucuuguaaacuuaaaaaaagaaaaaaaaagaaaaaaaagaaacuuugcuaguuaaaa

SEQ ID NO: 207591 - RNA, 64 nt, Homo Sapiens
aagaaaaaaaaucccuuucucuaguuaaaaaaaaaagaaaaaaaaaaguauaauagaaacuuug

SEQ ID NO: 207592 - RNA, 64 nt, Homo Sapiens
agcugcagaguauuuauaaaauguuuaaaaguuaaagaaaaaagaaaguuauuaaauuaauuau

SEQ ID NO: 207593 - RNA, 64 nt, Homo Sapiens
gugguauguucccuuaaaaaaaaaugacacuuggaagaaaaauguaugaaauucagaaauuccg

SEQ ID NO: 207594 - RNA, 64 nt, Homo Sapiens
cugggauuacaggugugagcugccgcacccagccaagaaaaauaauacucuuaaauacuuagau

SEQ ID NO: 207595 - RNA, 64 nt, Homo Sapiens
acauuuuaacuuaaugguacuuaaaauaauuuaaaagaaaaauguuaacuuagacauucuuaug

SEQ ID NO: 207596 - RNA, 64 nt, Homo Sapiens
acaacuacaucccauuuuauauuuccaauuguuaaagaaaaauauuucaagaacaaaucuucuc

SEQ ID NO: 207597 - RNA, 64 nt, Homo Sapiens
aacugaaauagaaaaggaaaaggaagaagcagagaagaaaaaaucaaagaaaucugucuaauuc

SEQ ID NO: 207598 - RNA, 64 nt, Homo Sapiens
augauugguauuauggaaggcuuauugggggaacaagaaaaauauaaaaagugaucucugccca

SEQ ID NO: 207599 - RNA, 64 nt, Homo Sapiens
auuucuguggauggcagccggagcauguuagcuuaagaaaaauguuguguguggugcucuaguc

SEQ ID NO: 207600 - RNA, 64 nt, Homo Sapiens
uuaugagagaaaaggaaaaaggaaucaaagguggaagaaaaaaaaagccaaauucuguuuacgg

SEQ ID NO: 207601 - RNA, 64 nt, Homo Sapiens
acgccuaaugaacaagcacaguuuuucaauggugaagaaaaaagcaccagacuuuuuuucuuuu

SEQ ID NO: 207602 - RNA, 64 nt, Homo Sapiens
uuuccaaacugcuuuguguauuguauauuuuuuuaagaaaaagaaaagccuuauuugacuuaug

SEQ ID NO: 207603 - RNA, 64 nt, Homo Sapiens
caggugaaucuagagccuacuuuuauuuugguuaaagaaaaagaaaauaucaauaauucaauuu

SEQ ID NO: 207604 - RNA, 64 nt, Homo Sapiens
uuaaaaaugggauguccuaauuuucaacuggaaaaagaaaaaacgucuaaaaacaucugcauag

SEQ ID NO: 207605 - RNA, 64 nt, Homo Sapiens
cagcuaaaaaagaguggacccaucauuuuaaaggaagaaaaaaggcuggggccuccuuccauug

SEQ ID NO: 207606 - RNA, 64 nt, Homo Sapiens
aagaaaagaugcacuuugcucaauguguauaaacaagaaaaauaaucauuauuuauguauugug

SEQ ID NO: 207607 - RNA, 64 nt, Homo Sapiens
uguauuuuauguuauauauaccugagauuuauuaaagaaaaaaaaaaggacuccugaaaaaaaa

SEQ ID NO: 207608 - RNA, 64 nt, Homo Sapiens
uggaugucacuggccacugaagucucagcuaccuaagaaaaaccagaaggugagauaagcccug

SEQ ID NO: 207609 - RNA, 64 nt, Homo Sapiens
gauuuauuuauuuaagacaguuuuuuacauuauuaagaaaaaaaccaaagggaaauaucauuua

SEQ ID NO: 207610 - RNA, 64 nt, Homo Sapiens
aacacacauauaaacaucacgcugcaggcuguuuaagaaaaaaugugauguaccaugaaacaaa

SEQ ID NO: 207611 - RNA, 64 nt, Homo Sapiens
gaaauguaccuguuggcaggaaaaaaaaaaaaaaaagaaaaaaaacagagcgagacuccgccuc

SEQ ID NO: 207612 - RNA, 64 nt, Homo Sapiens
aaauuucuuuuacuguguuuacuuaucuugcacaaagaaaaagauugaaaaggucuucugacac

SEQ ID NO: 207613 - RNA, 64 nt, Homo Sapiens
uccagaaaggagccacagcugacgccaaaaagaaaagaaaaaagauauauauauauauauauau

SEQ ID NO: 207614 - RNA, 64 nt, Homo Sapiens
uguguuccuucagggaaacuggucuugaaaaagcaagaaaaaaaagcaaaaaaaaaaaaaaaaa

SEQ ID NO: 207615 - RNA, 64 nt, Homo Sapiens
guugguuccauuuucuuuuuuucuuuuuuuuuuuaagaaaaaauaaaagguggauuugagcugu

SEQ ID NO: 207616 - RNA, 64 nt, Homo Sapiens
aggagugugcggucaauauuuauaucauccagaaaagaaaaacacgagaaacgccaucgcggga

SEQ ID NO: 207617 - RNA, 64 nt, Homo Sapiens
ucuuucuauaaauacauauuguuuaaaaaaaagcaagaaaaaaaggaaaacaaaggaaaauauc

SEQ ID NO: 207618 - RNA, 64 nt, Homo Sapiens
uauccccaaaguuguuuucuagauuuguggcuuuaagaaaaacaaaacaaaacaaacacauugu

SEQ ID NO: 207619 - RNA, 64 nt, Homo Sapiens
cuuuuuguggguguugcaugcaaaucaaguggacaagaaaaaauaacaaaacaaaaaacaagaa

SEQ ID NO: 207620 - RNA, 64 nt, Homo Sapiens
caaguggacaagaaaaaauaacaaaacaaaaaacaagaaaaaaaaaacacaaaaccccguaaaa

SEQ ID NO: 207621 - RNA, 64 nt, Homo Sapiens
gaagggaccuugcagggaccucucccuccaaaaaaagaaaaaaagaaaaagaaagaaaaaauaa

SEQ ID NO: 207622 - RNA, 64 nt, Homo Sapiens
cuugcagggaccucucccuccaaaaaaagaaaaaaagaaaaagaaagaaaaaauaaaugaggaa

SEQ ID NO: 207623 - RNA, 64 nt, Homo Sapiens
ccucucccuccaaaaaaagaaaaaaagaaaaagaaagaaaaaauaaaugaggaaacguguugca

SEQ ID NO: 207624 - RNA, 64 nt, Homo Sapiens
aaacuaauaaaaagcaaaaaaaaaaaaaaaagaaaagaaaaaacacugcauuugggcaccaucu

SEQ ID NO: 207625 - RNA, 64 nt, Homo Sapiens
ugaaucccugaaugacugcauggauagaaccacuaagaaaaauaaacuuuuauauuuuuauagc

SEQ ID NO: 207626 - RNA, 64 nt, Homo Sapiens
guuugguucuaugugguuggucuguuucccggacaagaaaaauugcaaucaaaugucagcagcu

SEQ ID NO: 207627 - RNA, 64 nt, Homo Sapiens
uuuaagaagcuuuuaaaagguaauaauacucugaaagaaaaaugacguaaccacagcguguacu

SEQ ID NO: 207628 - RNA, 64 nt, Homo Sapiens
gaaggaaaaagaaagagaaagagagagagagagaaagaaaaagaaagaaaaguaagaaagaaaa

SEQ ID NO: 207629 - RNA, 64 nt, Homo Sapiens
agagagagagaaagaaaaagaaagaaaaguaagaaagaaaaaagaaaaagaaagaaaaguaaga

SEQ ID NO: 207630 - RNA, 64 nt, Homo Sapiens
gagaaagaaaaagaaagaaaaguaagaaagaaaaaagaaaaagaaagaaaaguaagaaagaaaa

SEQ ID NO: 207631 - RNA, 64 nt, Homo Sapiens
aaaacacagcaugagaacuucgugaagcauacagaagaaaaaccuucagccagauugaaugcuu

SEQ ID NO: 207632 - RNA, 64 nt, Homo Sapiens
ccaaccuuuugucuucccugggccacauuggaagaagaaaaauugucuugugccacacauacaa

SEQ ID NO: 207633 - RNA, 64 nt, Homo Sapiens
acaauacacuaacauuaacaauagcugaugagcuaagaaaaaaaaaaagucugugcauaguuuu

SEQ ID NO: 207634 - RNA, 64 nt, Homo Sapiens
ucaaaaaagcgacaaaaaaaugcaaggaacaaaaaagaaaaaaaaacgucuguggagcuucugc

SEQ ID NO: 207635 - RNA, 64 nt, Homo Sapiens
cuauuuuuguaaaaagggaagggggugggaggggaagaaaaacuaaacaaaaugaaaaaaaaag

SEQ ID NO: 207636 - RNA, 64 nt, Homo Sapiens
aucucaucacuugaagccacaaaaaaaaaaagaaaagaaaaaaaaagaaaaaaaaaagacaaaa

SEQ ID NO: 207637 - RNA, 64 nt, Homo Sapiens
aaagacaaaaaaaaaaaaaaucaacgaaauggaaaagaaaaaaauccccauugcuguaaauauu

SEQ ID NO: 207638 - RNA, 64 nt, Homo Sapiens
gaaaauuucuacauauuaaaaaaacucuaucucaaagaaaaaaaccagccugggcaacaagagc

SEQ ID NO: 207639 - RNA, 64 nt, Homo Sapiens
aggaugaauaacaaguuugguuuuguucauacaaaagaaaaaugaugauauaucuggaaugucc

SEQ ID NO: 207640 - RNA, 64 nt, Homo Sapiens
gaagagagaguaguugucagaucuaaagaagaaaaagaaaaacuggcaacaagaacaaaacucc

SEQ ID NO: 207641 - RNA, 64 nt, Homo Sapiens
aaaacugaagagagaguaguaacuccaucuaaagaagaaaaagaagccugggcaacaagaacaa

SEQ ID NO: 207642 - RNA, 64 nt, Homo Sapiens
ugcuguucccaucccugaaacauugcauguauuuaagaaaaacaaaauguuaguggcauauuug

SEQ ID NO: 207643 - RNA, 64 nt, Homo Sapiens
cuuccacgguccuguuaauucuagaucagagagcaagaaaaaaguacagaacauauccucuacg

SEQ ID NO: 207644 - RNA, 64 nt, Homo Sapiens
aacugaucaaaagcauaauugaaaguucugaaaaaagaaaaauaauaauauguagaaaaaugua

SEQ ID NO: 207645 - RNA, 64 nt, Homo Sapiens
gauggauuggacguugugacucuugccuuuuaagaagaaaaaaaagauaggacaaaguauuuga

SEQ ID NO: 207646 - RNA, 64 nt, Homo Sapiens
aagaaaaggagucaagaacaauucacaguaugagaagaaaaauggaaaaaaaaaacuuuauuua

SEQ ID NO: 207647 - RNA, 64 nt, Homo Sapiens
gaagaaaaauggaaaaaaaaaacuuuauuuaaaaaagaaaaaaguccagauuguaguuauacuu

SEQ ID NO: 207648 - RNA, 64 nt, Homo Sapiens
aguggaaucuacuuucauuguuaacacugagcuaaagaaaaaaagccguguguuuuaugaauga

SEQ ID NO: 207649 - RNA, 64 nt, Homo Sapiens
aguccaucuguuuguccaucugcugaaaugagaaaagaaaaauuuaugcacugauuuaaaacaa

SEQ ID NO: 207650 - RNA, 64 nt, Homo Sapiens
aauuuaugcacugauuuaaaacaaaccaaaaaaaaagaaaaaaacaaaaaaaaaaaucccuccu

SEQ ID NO: 207651 - RNA, 64 nt, Homo Sapiens
gcacacccgugguugugaaaauaguauagcaaaaaagaaaaauccccgguuauugauguacuag

SEQ ID NO: 207652 - RNA, 64 nt, Homo Sapiens
auuuuuccccuuugcucuucuuuucccuccuuaaaagaaaaauuaccuucuaguccuaggauga

SEQ ID NO: 207653 - RNA, 64 nt, Homo Sapiens
uuacccagccacuugggaacagcagguaauacugaagaaaaauaaaaauagauuuugaaaacgu

SEQ ID NO: 207654 - RNA, 64 nt, Homo Sapiens
cugaggccucgggucaagauagucacccaucugcaagaaaaaugcaagaggauuucuggauauu

SEQ ID NO: 207655 - RNA, 64 nt, Homo Sapiens
uaaaccauccgugggguagagcaagucugauggaaagaaaaagaaacagccacauaaccuugcg

SEQ ID NO: 207656 - RNA, 64 nt, Homo Sapiens
aagcauucccaaucuugacaaaaugaccaagaaaaagaaaaaaaauaauguaagggucuguugu

SEQ ID NO: 207657 - RNA, 64 nt, Homo Sapiens
aaaaaaaagcauucccaaucuguuguaaaugaccaagaaaaagaaaaaaaauaauguaaggguc

SEQ ID NO: 207658 - RNA, 64 nt, Homo Sapiens
uccgggcauuuugcaucagaaaaagaaaaaaaaaaagaaaaaguguauuuuuguuuguaaguua

SEQ ID NO: 207659 - RNA, 64 nt, Homo Sapiens
aaaagaaaaaguuccgggcaguuuguaaguuaaaaagaaaaaaauuuauuauuacgguauuuuu

SEQ ID NO: 207660 - RNA, 64 nt, Homo Sapiens
cucuagacacaugaaggcccguuauaugcuggagaagaaaaaucucacauccauucucaaggua

SEQ ID NO: 207661 - RNA, 64 nt, Homo Sapiens
cuauaaaaaguggcuaaucuguuagucucuccugaagaaaaagcagaguugagaguugggugag

SEQ ID NO: 207662 - RNA, 64 nt, Homo Sapiens
auuuaaaaaaaaaaaaaaaaaaaaaaaaaagaaaaagaaaaacgauuaacuuuaacuuauuaaa

SEQ ID NO: 207663 - RNA, 64 nt, Homo Sapiens
aaaacgauuuaaaaaaaaaaauuaaaaaaaaaaaaagaaaaagaauuuguauuaacuuuaacuu

SEQ ID NO: 207664 - RNA, 64 nt, Homo Sapiens
uuacaaagcagggguuuagauguauuaccuuguaaagaaaaaaagagugccaagucagaaagug

SEQ ID NO: 207665 - RNA, 64 nt, Homo Sapiens
auuucuacaguagucuuucuugucuugaaggcaaaagaaaaaaacacguuucuuuguugagcug

SEQ ID NO: 207666 - RNA, 64 nt, Homo Sapiens
aaaaccacguuucuuuguugaaaaaaaaagaaaaaagaaaaaaacaagcuaagagagcuugcaa

SEQ ID NO: 207667 - RNA, 64 nt, Homo Sapiens
aaaaaaaaaaaccacguuuccuugcaaaaaaaaaaagaaaaaaggaaugcacaagcuaagagag

SEQ ID NO: 207668 - RNA, 64 nt, Homo Sapiens
aagcauccuuguacuuauaaucccaaugacuaugaagaaaaauaauuuagccaaauaguuccua

SEQ ID NO: 207669 - RNA, 64 nt, Homo Sapiens
aaguuaagcucuaguauaacaaugauaugggucaaagaaaaaugaaaacaaauuuuaaaaacgu

SEQ ID NO: 207670 - RNA, 64 nt, Homo Sapiens
guaacuacagagaggacguuucccuguuuagggaaagaaaaaacaucuucagaucauagguccu

SEQ ID NO: 207671 - RNA, 64 nt, Homo Sapiens
aaucauugaacugagggggaaaaauguaacuaggaagaaaaacccaauuuaagaaauuacauaa

SEQ ID NO: 207672 - RNA, 64 nt, Homo Sapiens
uuagagguuugucuacccacuuauuauaaaugauaagaaaaaucuuuaacacuugggacaacau

SEQ ID NO: 207673 - RNA, 64 nt, Homo Sapiens
aaauuagccaggcaugcgaaucuacaaaaaaaaaaagaaaaaaacaacauagugagacgucguc

SEQ ID NO: 207674 - RNA, 64 nt, Homo Sapiens
acuguugguuauuuguguuaugaaugugcaaaaaaagaaaaagauuuuuuuguucuaggggaaa

SEQ ID NO: 207675 - RNA, 64 nt, Homo Sapiens
ucaaguacuacauuuucuuuaauguacuuauauuaagaaaaauagauaauuuuuuaauuauuua

SEQ ID NO: 207676 - RNA, 64 nt, Homo Sapiens
uagcagauaucauguaggaaagagaggauaaacaaagaaaaaagaaaaaaaaauaagcucauac

SEQ ID NO: 207677 - RNA, 64 nt, Homo Sapiens
uaucauguaggaaagagaggauaaacaaagaaaaaagaaaaaaaaauaagcucauacccaaauu

SEQ ID NO: 207678 - RNA, 64 nt, Homo Sapiens
aagcccaaacuagugagaguuuuguaaaaagaaaaagaaaaaaguuucucuuuccagcugcugu

SEQ ID NO: 207679 - RNA, 64 nt, Homo Sapiens
aaaaagaagcccaaacuaguugcuguuuuguaaaaagaaaaagaccuacauuucucuuuccagc

SEQ ID NO: 207680 - RNA, 64 nt, Homo Sapiens
uguguucaggagcaugacucucuuuugaaauacgaagaaaaauggggagaccaaccccuuugug

SEQ ID NO: 207681 - RNA, 64 nt, Homo Sapiens
uacaaaaagauuuucgaucuaaaaaaaagaggaaaagaaaaauggaaaagagaaaggaaaggcc

SEQ ID NO: 207682 - RNA, 64 nt, Homo Sapiens
cuguuuuuuaaccuuuuguuccgccauuuaaaaaaagaaaaaaaaaaagcuuauguuucuuguc

SEQ ID NO: 207683 - RNA, 64 nt, Homo Sapiens
cccccgccaccuguacucacccucacgcucuuugaagaaaaaaaaaaaaaucaccuuguguguu

SEQ ID NO: 207684 - RNA, 64 nt, Homo Sapiens
gauaaucugauugcuguuguuuuguuuguuuggaaagaaaaaaaaugucuggcuucuucuacua

SEQ ID NO: 207685 - RNA, 64 nt, Homo Sapiens
uugaacauuuacaaaaugucacacuuuuucuuaaaagaaaaauauuuugggguuugaauaaaau

SEQ ID NO: 207686 - RNA, 64 nt, Homo Sapiens
cacuguggaaaagaguauugaguuacaaacugagaagaaaaagcaggaaguucccuaauaaucu

SEQ ID NO: 207687 - RNA, 64 nt, Homo Sapiens
uacuagcaagcuaauggaaacaugauuuucggggaagaaaaacuacagaaaauguagaaauuua

SEQ ID NO: 207688 - RNA, 64 nt, Homo Sapiens
uauuauuuaauuguguuggagcuucuuuuuccaaaagaaaaacuaguugcagucagggagccag

SEQ ID NO: 207689 - RNA, 64 nt, Homo Sapiens
aauguguaagucacccccaccaaaaacaaaagagaagaaaaagaauagaaagaauuauccagug

SEQ ID NO: 207690 - RNA, 64 nt, Homo Sapiens
ccaaucccuaguacauauauaauagaaaagggccaagaaaaauaugcaucuugauuuggagaga

SEQ ID NO: 207691 - RNA, 64 nt, Homo Sapiens
acucucuuuccaauuucacuuugguggucugaagaagaaaaagaaauuuuauguauguaugugu

SEQ ID NO: 207692 - RNA, 64 nt, Homo Sapiens
agcuuaucaugagagcccucaggggaaaggguuuaagaaaaacaacuccucuuucccauaguca

SEQ ID NO: 207693 - RNA, 64 nt, Homo Sapiens
gucuucaaguaaguaaaacauacaucguagcuagaagaaaaauguaccuuaaauuugcaucuuc

SEQ ID NO: 207694 - RNA, 64 nt, Homo Sapiens
uuuugauguugauuuugaccuguucaugauucagaagaaaaacaaacuuuuuuggauuuuuuuu

SEQ ID NO: 207695 - RNA, 64 nt, Homo Sapiens
cuccucuaaucuguguacacaucuccaagcaaggaagaaaaaacaaacucugcucagacgccua

SEQ ID NO: 207696 - RNA, 64 nt, Homo Sapiens
guguaaaguuacuuaagcuaaaucaauuucaaagaagaaaaacuuggaggacucauuuuaccug

SEQ ID NO: 207697 - RNA, 64 nt, Homo Sapiens
cagcgaggcuaugacuuacuuaucucaauggcuaaagaaaaaauagugaaaauaccaaauacug

SEQ ID NO: 207698 - RNA, 64 nt, Homo Sapiens
aaaauccuguccuaggcuuuaaugagaaaaaaguaagaaaaaaaaaaagagaaaaaagaaaaaa

SEQ ID NO: 207699 - RNA, 64 nt, Homo Sapiens
augagaaaaaaguaagaaaauaaaaaagagaaaaaagaaaaaaaaaaaauauacuugcuaucua

SEQ ID NO: 207700 - RNA, 64 nt, Homo Sapiens
gcuuuuauugguguuuucacacaaacagacaaacaagaaaaaaaugugaguuuaaacaaaaacc

SEQ ID NO: 207701 - RNA, 64 nt, Homo Sapiens
uauauagcugugaguuuaaagagacuuuguaaaaaagaaaaaugccagccugaacuauauuuaa

SEQ ID NO: 207702 - RNA, 64 nt, Homo Sapiens
cagugccucacaaagaaauuucaguuaaccaaacaagaaaaaggagaacuuguuuagaaaggau

SEQ ID NO: 207703 - RNA, 64 nt, Homo Sapiens
acugaaugcuuuuagauauugagucagauacaaaaagaaaaaucgaagccauauuuuuacauag

SEQ ID NO: 207704 - RNA, 64 nt, Homo Sapiens
auuauuaaauguuucucacaucauuuucuuaaaaaagaaaaaaauuuccucaaguuacuuuccu

SEQ ID NO: 207705 - RNA, 64 nt, Homo Sapiens
gccaugauguacccuccgaguuaagcaucgaaaaaagaaaaaaacaaggucaguucaggaaagc

SEQ ID NO: 207706 - RNA, 64 nt, Homo Sapiens
uuaaaaaagcuaauauuugaauaaagggugaggaaagaaaaauaaauauuuuuuuccuaaagga

SEQ ID NO: 207707 - RNA, 64 nt, Homo Sapiens
ucuuugguuuugauuucuugauucaugguacucuaagaaaaauccuaauugccaguuccagugu

SEQ ID NO: 207708 - RNA, 64 nt, Homo Sapiens
cguguuugucucuucuggaaccaaucaguagcuuaagaaaaaacaggaaccauaguugacaguu

SEQ ID NO: 207709 - RNA, 64 nt, Homo Sapiens
aaaaggcauuucccacccugcccucuucccugguaagaaaaagcucuugcucuccuagguagcc

SEQ ID NO: 207710 - RNA, 64 nt, Homo Sapiens
aggggguggggagguaaauuccucugacuugccaaagaaaaagaagggaaccacaguggauaug

SEQ ID NO: 207711 - RNA, 64 nt, Homo Sapiens
cauuccugaauaauuuccaaauguuuuuaauccaaagaaaaagguuuaaagcuuauuucccuuu

SEQ ID NO: 207712 - RNA, 64 nt, Homo Sapiens
cuucagguucaccucgaaaugggugaagcacagaccuugccaagcacuugcucuccgugggacc

SEQ ID NO: 207713 - RNA, 64 nt, Homo Sapiens
gccccugcagaauuaccuaccaucccccuguuacccuugccaaaggcaaaaggugcuuugaccu

SEQ ID NO: 207714 - RNA, 64 nt, Homo Sapiens
caugagaaagucccuuucugaggcccacugucuaccuugccagauccucagugcguaucgccaa

SEQ ID NO: 207715 - RNA, 64 nt, Homo Sapiens
uuucaagagggaaaguggucuguacugcuuucauccuugccacugucuugcuuuuauuuuuuac

SEQ ID NO: 207716 - RNA, 64 nt, Homo Sapiens
ccuccuggacgcaaauuaaaggccgagaaagaggccuugccaucaauggaauacugccauuuau

SEQ ID NO: 207717 - RNA, 64 nt, Homo Sapiens
guguccgaagauaagcuccaggucuuaucguaucccuugccaucugaacuuguuugcacugcuu

SEQ ID NO: 207718 - RNA, 64 nt, Homo Sapiens
cucacacugcuaugauugccaaggggguugcuccccuugccaacauaguuugugccuugucuug

SEQ ID NO: 207719 - RNA, 64 nt, Homo Sapiens
uaguuugugccuugucuugacaccccucaucucuccuugccaaaguccauugacagugaggucc

SEQ ID NO: 207720 - RNA, 64 nt, Homo Sapiens
ccuguuuccccaccaggaaaauuucggccuauuuccuugccaggacaacauuuuuuaaaucgug

SEQ ID NO: 207721 - RNA, 64 nt, Homo Sapiens
cucuuccuccuguccugccuuugcgccccugccuccuugccaggcccacacugcuugggcacua

SEQ ID NO: 207722 - RNA, 64 nt, Homo Sapiens
ugcugcuguggccuccagcucagauggggaccagccuugccaacuugacguggagggugggcac

SEQ ID NO: 207723 - RNA, 64 nt, Homo Sapiens
ggggguuugaaagagaauuuccucaaagggaagcccuugccagugagccugcaucauuugguuc

SEQ ID NO: 207724 - RNA, 64 nt, Homo Sapiens
gccucuguugagaccugggcucucccucccagcuccuugccaaacaugagaccugguaacagug

SEQ ID NO: 207725 - RNA, 64 nt, Homo Sapiens
ggcacacccggaccccacacucccccacuccccuccuugccagggcucccaagacuucccugac

SEQ ID NO: 207726 - RNA, 64 nt, Homo Sapiens
uccacgcuguuggucaaaccgcaaugaugccacaccuugccaugcacccucuggccccacacug

SEQ ID NO: 207727 - RNA, 64 nt, Homo Sapiens
uucguugccauacccucuugggcuggggccacagccuugccauuguccacccguggggcccagg

SEQ ID NO: 207728 - RNA, 64 nt, Homo Sapiens
ugugagccacugagaagagagacgccaacugcacccuugccacuuccaaagcaauagaggcaga

SEQ ID NO: 207729 - RNA, 64 nt, Homo Sapiens
caucgcauguccuacaaucugcucuuagacacggccuugccaggagagccugcccucagacugc

SEQ ID NO: 207730 - RNA, 64 nt, Homo Sapiens
cugaaugucaccugcuaggaccugcucccagagaccuugccacaggggacuuuaccugcuggga

SEQ ID NO: 207731 - RNA, 64 nt, Homo Sapiens
uggggcuggggauggugccuuccccugcuggggaccuugccagcgggcuucacugccaggagcc

SEQ ID NO: 207732 - RNA, 64 nt, Homo Sapiens
accggaccucuccuuucgcccccacacccccuccccuugccagcugugcccaccuuuguauuua

SEQ ID NO: 207733 - RNA, 64 nt, Homo Sapiens
agacaguccccuggcccugccccucccucgccccccuugccaccuucccaggacugcuuguccg

SEQ ID NO: 207734 - RNA, 64 nt, Homo Sapiens
cugggccagcccgcugugcacuuugaccccaguuccuugccagcacggcugcuaacagacugcc

SEQ ID NO: 207735 - RNA, 64 nt, Homo Sapiens; identical to SEQ ID NO: 206901

SEQ ID NO: 207736 - RNA, 64 nt, Homo Sapiens; identical to SEQ ID NO: 206902

SEQ ID NO: 207737 - RNA, 64 nt, Homo Sapiens; identical to SEQ ID NO: 206903

SEQ ID NO: 207738 - RNA, 64 nt, Homo Sapiens; identical to SEQ ID NO: 206904

SEQ ID NO: 207739 - RNA, 64 nt, Homo Sapiens; identical to SEQ ID NO: 206905

SEQ ID NO: 207740 - RNA, 64 nt, Homo Sapiens; identical to SEQ ID NO: 206906

SEQ ID NO: 207741 - RNA, 64 nt, Homo Sapiens; identical to SEQ ID NO: 206907

SEQ ID NO: 207742 - RNA, 64 nt, Homo Sapiens; identical to SEQ ID NO: 206908

SEQ ID NO: 207743 - RNA, 64 nt, Homo Sapiens; identical to SEQ ID NO: 206909

SEQ ID NO: 207744 - RNA, 64 nt, Homo Sapiens; identical to SEQ ID NO: 206910

SEQ ID NO: 207745 - RNA, 64 nt, Homo Sapiens; identical to SEQ ID NO: 206911

SEQ ID NO: 207746 - RNA, 64 nt, Homo Sapiens; identical to SEQ ID NO: 206912

SEQ ID NO: 207747 - RNA, 64 nt, Homo Sapiens; identical to SEQ ID NO: 206913

SEQ ID NO: 207748 - RNA, 64 nt, Homo Sapiens; identical to SEQ ID NO: 206914

SEQ ID NO: 207749 - RNA, 64 nt, Homo Sapiens; identical to SEQ ID NO: 206915

SEQ ID NO: 207750 - RNA, 64 nt, Homo Sapiens; identical to SEQ ID NO: 206916

SEQ ID NO: 207751 - RNA, 64 nt, Homo Sapiens; identical to SEQ ID NO: 206917

SEQ ID NO: 207752 - RNA, 64 nt, Homo Sapiens; identical to SEQ ID NO: 206918

SEQ ID NO: 207753 - RNA, 64 nt, Homo Sapiens; identical to SEQ ID NO: 206919

SEQ ID NO: 207754 - RNA, 64 nt, Homo Sapiens; identical to SEQ ID NO: 206920

SEQ ID NO: 207755 - RNA, 64 nt, Homo Sapiens; identical to SEQ ID NO: 206921

SEQ ID NO: 207756 - RNA, 64 nt, Homo Sapiens; identical to SEQ ID NO: 206922

SEQ ID NO: 207757 - RNA, 64 nt, Homo Sapiens; identical to SEQ ID NO: 206923

SEQ ID NO: 207758 - RNA, 64 nt, Homo Sapiens; identical to SEQ ID NO: 206924

SEQ ID NO: 207759 - RNA, 64 nt, Homo Sapiens; identical to SEQ ID NO: 206925

SEQ ID NO: 207760 - RNA, 64 nt, Homo Sapiens; identical to SEQ ID NO: 206926

SEQ ID NO: 207761 - RNA, 64 nt, Homo Sapiens; identical to SEQ ID NO: 206927

SEQ ID NO: 207762 - RNA, 64 nt, Homo Sapiens; identical to SEQ ID NO: 206928

SEQ ID NO: 207763 - RNA, 64 nt, Homo Sapiens; identical to SEQ ID NO: 206929

SEQ ID NO: 207764 - RNA, 64 nt, Homo Sapiens; identical to SEQ ID NO: 206930

SEQ ID NO: 207765 - RNA, 64 nt, Homo Sapiens; identical to SEQ ID NO: 206931

SEQ ID NO: 207766 - RNA, 64 nt, Homo Sapiens; identical to SEQ ID NO: 206932

SEQ ID NO: 207767 - RNA, 64 nt, Homo Sapiens; identical to SEQ ID NO: 206933

SEQ ID NO: 207768 - RNA, 62 nt, Homo Sapiens; identical to SEQ ID NO: 206934

SEQ ID NO: 207769 - RNA, 64 nt, Homo Sapiens; identical to SEQ ID NO: 206935

SEQ ID NO: 207770 - RNA, 64 nt, Homo Sapiens; identical to SEQ ID NO: 206936

SEQ ID NO: 207771 - RNA, 64 nt, Homo Sapiens; identical to SEQ ID NO: 206937

SEQ ID NO: 207772 - RNA, 64 nt, Homo Sapiens; identical to SEQ ID NO: 206938

SEQ ID NO: 207773 - RNA, 64 nt, Homo Sapiens; identical to SEQ ID NO: 206939

SEQ ID NO: 207774 - RNA, 64 nt, Homo Sapiens; identical to SEQ ID NO: 206940

SEQ ID NO: 207775 - RNA, 64 nt, Homo Sapiens; identical to SEQ ID NO: 206941

SEQ ID NO: 207776 - RNA, 64 nt, Homo Sapiens; identical to SEQ ID NO: 206942

SEQ ID NO: 207777 - RNA, 64 nt, Homo Sapiens; identical to SEQ ID NO: 206943

SEQ ID NO: 207778 - RNA, 64 nt, Homo Sapiens; identical to SEQ ID NO: 206944

SEQ ID NO: 207779 - RNA, 64 nt, Homo Sapiens; identical to SEQ ID NO: 206945

SEQ ID NO: 207780 - RNA, 64 nt, Homo Sapiens; identical to SEQ ID NO: 206946

SEQ ID NO: 207781 - RNA, 64 nt, Homo Sapiens; identical to SEQ ID NO: 206947

SEQ ID NO: 207782 - RNA, 64 nt, Homo Sapiens; identical to SEQ ID NO: 206948

SEQ ID NO: 207783 - RNA, 64 nt, Homo Sapiens; identical to SEQ ID NO: 206949

SEQ ID NO: 207784 - RNA, 64 nt, Homo Sapiens; identical to SEQ ID NO: 206950

SEQ ID NO: 207785 - RNA, 64 nt, Homo Sapiens; identical to SEQ ID NO: 206951

SEQ ID NO: 207786 - RNA, 64 nt, Homo Sapiens; identical to SEQ ID NO: 206952

SEQ ID NO: 207787 - RNA, 64 nt, Homo Sapiens; identical to SEQ ID NO: 206953

SEQ ID NO: 207788 - RNA, 64 nt, Homo Sapiens; identical to SEQ ID NO: 206954

SEQ ID NO: 207789 - RNA, 64 nt, Homo Sapiens; identical to SEQ ID NO: 206955

SEQ ID NO: 207790 - RNA, 64 nt, Homo Sapiens; identical to SEQ ID NO: 206956

SEQ ID NO: 207791 - RNA, 64 nt, Homo Sapiens; identical to SEQ ID NO: 206957

SEQ ID NO: 207792 - RNA, 64 nt, Homo Sapiens; identical to SEQ ID NO: 206958

SEQ ID NO: 207793 - RNA, 64 nt, Homo Sapiens; identical to SEQ ID NO: 206959

SEQ ID NO: 207794 - RNA, 64 nt, Homo Sapiens; identical to SEQ ID NO: 206960

SEQ ID NO: 207795 - RNA, 64 nt, Homo Sapiens; identical to SEQ ID NO: 206961

SEQ ID NO: 207796 - RNA, 64 nt, Homo Sapiens; identical to SEQ ID NO: 206962

SEQ ID NO: 207797 - RNA, 64 nt, Homo Sapiens; identical to SEQ ID NO: 206963

SEQ ID NO: 207798 - RNA, 64 nt, Homo Sapiens; identical to SEQ ID NO: 206964

SEQ ID NO: 207799 - RNA, 64 nt, Homo Sapiens; identical to SEQ ID NO: 206965

SEQ ID NO: 207800 - RNA, 64 nt, Homo Sapiens; identical to SEQ ID NO: 206966

SEQ ID NO: 207801 - RNA, 64 nt, Homo Sapiens; identical to SEQ ID NO: 206967

SEQ ID NO: 207802 - RNA, 64 nt, Homo Sapiens; identical to SEQ ID NO: 206968

SEQ ID NO: 207803 - RNA, 64 nt, Homo Sapiens; identical to SEQ ID NO: 206969

SEQ ID NO: 207804 - RNA, 64 nt, Homo Sapiens; identical to SEQ ID NO: 206970

SEQ ID NO: 207805 - RNA, 64 nt, Homo Sapiens; identical to SEQ ID NO: 206971

SEQ ID NO: 207806 - RNA, 64 nt, Homo Sapiens; identical to SEQ ID NO: 206972

SEQ ID NO: 207807 - RNA, 64 nt, Homo Sapiens; identical to SEQ ID NO: 206973

SEQ ID NO: 207808 - RNA, 64 nt, Homo Sapiens; identical to SEQ ID NO: 206974

SEQ ID NO: 207809 - RNA, 64 nt, Homo Sapiens; identical to SEQ ID NO: 206975

SEQ ID NO: 207810 - RNA, 64 nt, Homo Sapiens; identical to SEQ ID NO: 206976

SEQ ID NO: 207811 - RNA, 64 nt, Homo Sapiens; identical to SEQ ID NO: 206977

SEQ ID NO: 207812 - RNA, 64 nt, Homo Sapiens; identical to SEQ ID NO: 206978

SEQ ID NO: 207813 - RNA, 64 nt, Homo Sapiens; identical to SEQ ID NO: 206979

SEQ ID NO: 207814 - RNA, 64 nt, Homo Sapiens; identical to SEQ ID NO: 206980

SEQ ID NO: 207815 - RNA, 64 nt, Homo Sapiens; identical to SEQ ID NO: 206981

SEQ ID NO: 207816 - RNA, 64 nt, Homo Sapiens; identical to SEQ ID NO: 206982

SEQ ID NO: 207817 - RNA, 64 nt, Homo Sapiens; identical to SEQ ID NO: 206983

SEQ ID NO: 207818 - RNA, 64 nt, Homo Sapiens; identical to SEQ ID NO: 206984

SEQ ID NO: 207819 - RNA, 64 nt, Homo Sapiens; identical to SEQ ID NO: 206985

SEQ ID NO: 207820 - RNA, 64 nt, Homo Sapiens; identical to SEQ ID NO: 206986

SEQ ID NO: 207821 - RNA, 64 nt, Homo Sapiens; identical to SEQ ID NO: 206987

SEQ ID NO: 207822 - RNA, 64 nt, Homo Sapiens; identical to SEQ ID NO: 206988

SEQ ID NO: 207823 - RNA, 64 nt, Homo Sapiens; identical to SEQ ID NO: 206989

SEQ ID NO: 207824 - RNA, 64 nt, Homo Sapiens; identical to SEQ ID NO: 206990

SEQ ID NO: 207825 - RNA, 64 nt, Homo Sapiens; identical to SEQ ID NO: 206991

SEQ ID NO: 207826 - RNA, 64 nt, Homo Sapiens; identical to SEQ ID NO: 206992

SEQ ID NO: 207827 - RNA, 64 nt, Homo Sapiens; identical to SEQ ID NO: 206993

SEQ ID NO: 207828 - RNA, 64 nt, Homo Sapiens; identical to SEQ ID NO: 206994

SEQ ID NO: 207829 - RNA, 64 nt, Homo Sapiens; identical to SEQ ID NO: 206995

SEQ ID NO: 207830 - RNA, 64 nt, Homo Sapiens; identical to SEQ ID NO: 206996

SEQ ID NO: 207831 - RNA, 64 nt, Homo Sapiens; identical to SEQ ID NO: 206997

SEQ ID NO: 207832 - RNA, 64 nt, Homo Sapiens; identical to SEQ ID NO: 206998

SEQ ID NO: 207833 - RNA, 64 nt, Homo Sapiens; identical to SEQ ID NO: 206999

SEQ ID NO: 207834 - RNA, 64 nt, Homo Sapiens; identical to SEQ ID NO: 207000

SEQ ID NO: 207835 - RNA, 64 nt, Homo Sapiens; identical to SEQ ID NO: 207001

SEQ ID NO: 207836 - RNA, 64 nt, Homo Sapiens; identical to SEQ ID NO: 207002

SEQ ID NO: 207837 - RNA, 64 nt, Homo Sapiens; identical to SEQ ID NO: 207003

SEQ ID NO: 207838 - RNA, 64 nt, Homo Sapiens; identical to SEQ ID NO: 207004

SEQ ID NO: 207839 - RNA, 64 nt, Homo Sapiens; identical to SEQ ID NO: 207005

SEQ ID NO: 207840 - RNA, 64 nt, Homo Sapiens; identical to SEQ ID NO: 207006

SEQ ID NO: 207841 - RNA, 64 nt, Homo Sapiens; identical to SEQ ID NO: 207007

SEQ ID NO: 207842 - RNA, 64 nt, Homo Sapiens; identical to SEQ ID NO: 207008

SEQ ID NO: 207843 - RNA, 64 nt, Homo Sapiens; identical to SEQ ID NO: 207009

SEQ ID NO: 207844 - RNA, 64 nt, Homo Sapiens; identical to SEQ ID NO: 207010

SEQ ID NO: 207845 - RNA, 64 nt, Homo Sapiens; identical to SEQ ID NO: 207011

SEQ ID NO: 207846 - RNA, 64 nt, Homo Sapiens; identical to SEQ ID NO: 207012

SEQ ID NO: 207847 - RNA, 64 nt, Homo Sapiens; identical to SEQ ID NO: 207013

SEQ ID NO: 207848 - RNA, 64 nt, Homo Sapiens; identical to SEQ ID NO: 207014

SEQ ID NO: 207849 - RNA, 64 nt, Homo Sapiens; identical to SEQ ID NO: 207015

SEQ ID NO: 207850 - RNA, 64 nt, Homo Sapiens; identical to SEQ ID NO: 207016

SEQ ID NO: 207851 - RNA, 64 nt, Homo Sapiens; identical to SEQ ID NO: 207017

SEQ ID NO: 207852 - RNA, 64 nt, Homo Sapiens; identical to SEQ ID NO: 207018

SEQ ID NO: 207853 - RNA, 64 nt, Homo Sapiens; identical to SEQ ID NO: 207019

SEQ ID NO: 207854 - RNA, 64 nt, Homo Sapiens; identical to SEQ ID NO: 207020

SEQ ID NO: 207855 - RNA, 64 nt, Homo Sapiens; identical to SEQ ID NO: 207021

SEQ ID NO: 207856 - RNA, 64 nt, Homo Sapiens; identical to SEQ ID NO: 207022

SEQ ID NO: 207857 - RNA, 64 nt, Homo Sapiens; identical to SEQ ID NO: 207023

SEQ ID NO: 207858 - RNA, 64 nt, Homo Sapiens; identical to SEQ ID NO: 207024

SEQ ID NO: 207859 - RNA, 64 nt, Homo Sapiens; identical to SEQ ID NO: 207025

SEQ ID NO: 207860 - RNA, 64 nt, Homo Sapiens; identical to SEQ ID NO: 207026

SEQ ID NO: 207861 - RNA, 64 nt, Homo Sapiens; identical to SEQ ID NO: 207027

SEQ ID NO: 207862 - RNA, 64 nt, Homo Sapiens; identical to SEQ ID NO: 207028

SEQ ID NO: 207863 - RNA, 64 nt, Homo Sapiens; identical to SEQ ID NO: 207029

SEQ ID NO: 207864 - RNA, 64 nt, Homo Sapiens; identical to SEQ ID NO: 207030

SEQ ID NO: 207865 - RNA, 64 nt, Homo Sapiens; identical to SEQ ID NO: 207031

SEQ ID NO: 207866 - RNA, 64 nt, Homo Sapiens; identical to SEQ ID NO: 207032

SEQ ID NO: 207867 - RNA, 64 nt, Homo Sapiens; identical to SEQ ID NO: 207033

SEQ ID NO: 207868 - RNA, 64 nt, Homo Sapiens; identical to SEQ ID NO: 207034

SEQ ID NO: 207869 - RNA, 64 nt, Homo Sapiens; identical to SEQ ID NO: 207035

SEQ ID NO: 207870 - RNA, 64 nt, Homo Sapiens; identical to SEQ ID NO: 207036

SEQ ID NO: 207871 - RNA, 64 nt, Homo Sapiens; identical to SEQ ID NO: 207037

SEQ ID NO: 207872 - RNA, 64 nt, Homo Sapiens; identical to SEQ ID NO: 207038

SEQ ID NO: 207873 - RNA, 64 nt, Homo Sapiens; identical to SEQ ID NO: 207039

SEQ ID NO: 207874 - RNA, 64 nt, Homo Sapiens; identical to SEQ ID NO: 207040

SEQ ID NO: 207875 - RNA, 64 nt, Homo Sapiens; identical to SEQ ID NO: 207041

SEQ ID NO: 207876 - RNA, 64 nt, Homo Sapiens; identical to SEQ ID NO: 207042

SEQ ID NO: 207877 - RNA, 64 nt, Homo Sapiens; identical to SEQ ID NO: 207043

SEQ ID NO: 207878 - RNA, 64 nt, Homo Sapiens; identical to SEQ ID NO: 207044

SEQ ID NO: 207879 - RNA, 64 nt, Homo Sapiens; identical to SEQ ID NO: 207045

SEQ ID NO: 207880 - RNA, 64 nt, Homo Sapiens; identical to SEQ ID NO: 207046

SEQ ID NO: 207881 - RNA, 64 nt, Homo Sapiens; identical to SEQ ID NO: 207047

SEQ ID NO: 207882 - RNA, 64 nt, Homo Sapiens; identical to SEQ ID NO: 207048

SEQ ID NO: 207883 - RNA, 64 nt, Homo Sapiens; identical to SEQ ID NO: 207049

SEQ ID NO: 207884 - RNA, 64 nt, Homo Sapiens; identical to SEQ ID NO: 207050

SEQ ID NO: 207885 - RNA, 64 nt, Homo Sapiens; identical to SEQ ID NO: 207051

SEQ ID NO: 207886 - RNA, 64 nt, Homo Sapiens; identical to SEQ ID NO: 207052

SEQ ID NO: 207887 - RNA, 64 nt, Homo Sapiens; identical to SEQ ID NO: 207053

SEQ ID NO: 207888 - RNA, 64 nt, Homo Sapiens; identical to SEQ ID NO: 207054

SEQ ID NO: 207889 - RNA, 64 nt, Homo Sapiens; identical to SEQ ID NO: 207055

SEQ ID NO: 207890 - RNA, 64 nt, Homo Sapiens; identical to SEQ ID NO: 207056

SEQ ID NO: 207891 - RNA, 64 nt, Homo Sapiens; identical to SEQ ID NO: 207057

SEQ ID NO: 207892 - RNA, 64 nt, Homo Sapiens; identical to SEQ ID NO: 207058

SEQ ID NO: 207893 - RNA, 64 nt, Homo Sapiens; identical to SEQ ID NO: 207059

SEQ ID NO: 207894 - RNA, 64 nt, Homo Sapiens; identical to SEQ ID NO: 207060

SEQ ID NO: 207895 - RNA, 64 nt, Homo Sapiens; identical to SEQ ID NO: 207061

SEQ ID NO: 207896 - RNA, 64 nt, Homo Sapiens; identical to SEQ ID NO: 207062

SEQ ID NO: 207897 - RNA, 64 nt, Homo Sapiens; identical to SEQ ID NO: 207063

SEQ ID NO: 207898 - RNA, 64 nt, Homo Sapiens; identical to SEQ ID NO: 207064

SEQ ID NO: 207899 - RNA, 64 nt, Homo Sapiens; identical to SEQ ID NO: 207065

SEQ ID NO: 207900 - RNA, 64 nt, Homo Sapiens; identical to SEQ ID NO: 207066

SEQ ID NO: 207901 - RNA, 64 nt, Homo Sapiens; identical to SEQ ID NO: 207067

SEQ ID NO: 207902 - RNA, 64 nt, Homo Sapiens; identical to SEQ ID NO: 207068

SEQ ID NO: 207903 - RNA, 64 nt, Homo Sapiens; identical to SEQ ID NO: 207069

SEQ ID NO: 207904 - RNA, 64 nt, Homo Sapiens; identical to SEQ ID NO: 207070

SEQ ID NO: 207905 - RNA, 64 nt, Homo Sapiens; identical to SEQ ID NO: 207071

SEQ ID NO: 207906 - RNA, 64 nt, Homo Sapiens; identical to SEQ ID NO: 207072

SEQ ID NO: 207907 - RNA, 64 nt, Homo Sapiens; identical to SEQ ID NO: 207073

SEQ ID NO: 207908 - RNA, 64 nt, Homo Sapiens; identical to SEQ ID NO: 207074

SEQ ID NO: 207909 - RNA, 64 nt, Homo Sapiens; identical to SEQ ID NO: 207075

SEQ ID NO: 207910 - RNA, 64 nt, Homo Sapiens; identical to SEQ ID NO: 207076

SEQ ID NO: 207911 - RNA, 64 nt, Homo Sapiens; identical to SEQ ID NO: 207077

SEQ ID NO: 207912 - RNA, 64 nt, Homo Sapiens; identical to SEQ ID NO: 207078

SEQ ID NO: 207913 - RNA, 64 nt, Homo Sapiens; identical to SEQ ID NO: 207079

SEQ ID NO: 207914 - RNA, 64 nt, Homo Sapiens; identical to SEQ ID NO: 207080

SEQ ID NO: 207915 - RNA, 64 nt, Homo Sapiens; identical to SEQ ID NO: 207081

SEQ ID NO: 207916 - RNA, 64 nt, Homo Sapiens; identical to SEQ ID NO: 207082

SEQ ID NO: 207917 - RNA, 64 nt, Homo Sapiens; identical to SEQ ID NO: 207083

SEQ ID NO: 207918 - RNA, 64 nt, Homo Sapiens; identical to SEQ ID NO: 207084

SEQ ID NO: 207919 - RNA, 64 nt, Homo Sapiens; identical to SEQ ID NO: 207085

SEQ ID NO: 207920 - RNA, 64 nt, Homo Sapiens; identical to SEQ ID NO: 207086

SEQ ID NO: 207921 - RNA, 64 nt, Homo Sapiens; identical to SEQ ID NO: 207087

SEQ ID NO: 207922 - RNA, 64 nt, Homo Sapiens; identical to SEQ ID NO: 207088

SEQ ID NO: 207923 - RNA, 64 nt, Homo Sapiens; identical to SEQ ID NO: 207089

SEQ ID NO: 207924 - RNA, 64 nt, Homo Sapiens; identical to SEQ ID NO: 207090

SEQ ID NO: 207925 - RNA, 64 nt, Homo Sapiens; identical to SEQ ID NO: 207091

SEQ ID NO: 207926 - RNA, 64 nt, Homo Sapiens; identical to SEQ ID NO: 207092

SEQ ID NO: 207927 - RNA, 64 nt, Homo Sapiens; identical to SEQ ID NO: 207093

SEQ ID NO: 207928 - RNA, 64 nt, Homo Sapiens; identical to SEQ ID NO: 207094

SEQ ID NO: 207929 - RNA, 64 nt, Homo Sapiens; identical to SEQ ID NO: 207095

SEQ ID NO: 207930 - RNA, 64 nt, Homo Sapiens; identical to SEQ ID NO: 207096

SEQ ID NO: 207931 - RNA, 64 nt, Homo Sapiens; identical to SEQ ID NO: 207097

SEQ ID NO: 207932 - RNA, 64 nt, Homo Sapiens; identical to SEQ ID NO: 207098

SEQ ID NO: 207933 - RNA, 64 nt, Homo Sapiens; identical to SEQ ID NO: 207099

SEQ ID NO: 207934 - RNA, 64 nt, Homo Sapiens; identical to SEQ ID NO: 207100

SEQ ID NO: 207935 - RNA, 64 nt, Homo Sapiens; identical to SEQ ID NO: 207101

SEQ ID NO: 207936 - RNA, 64 nt, Homo Sapiens; identical to SEQ ID NO: 207102

SEQ ID NO: 207937 - RNA, 64 nt, Homo Sapiens; identical to SEQ ID NO: 207103

SEQ ID NO: 207938 - RNA, 64 nt, Homo Sapiens; identical to SEQ ID NO: 207104

SEQ ID NO: 207939 - RNA, 64 nt, Homo Sapiens; identical to SEQ ID NO: 207105

SEQ ID NO: 207940 - RNA, 64 nt, Homo Sapiens; identical to SEQ ID NO: 207106

SEQ ID NO: 207941 - RNA, 64 nt, Homo Sapiens; identical to SEQ ID NO: 207107

SEQ ID NO: 207942 - RNA, 64 nt, Homo Sapiens; identical to SEQ ID NO: 207108

SEQ ID NO: 207943 - RNA, 64 nt, Homo Sapiens; identical to SEQ ID NO: 207109

SEQ ID NO: 207944 - RNA, 64 nt, Homo Sapiens; identical to SEQ ID NO: 207110

SEQ ID NO: 207945 - RNA, 64 nt, Homo Sapiens; identical to SEQ ID NO: 207111

SEQ ID NO: 207946 - RNA, 64 nt, Homo Sapiens; identical to SEQ ID NO: 207112

SEQ ID NO: 207947 - RNA, 64 nt, Homo Sapiens; identical to SEQ ID NO: 207113

SEQ ID NO: 207948 - RNA, 64 nt, Homo Sapiens; identical to SEQ ID NO: 207114

SEQ ID NO: 207949 - RNA, 64 nt, Homo Sapiens; identical to SEQ ID NO: 207115

SEQ ID NO: 207950 - RNA, 64 nt, Homo Sapiens; identical to SEQ ID NO: 207116

SEQ ID NO: 207951 - RNA, 64 nt, Homo Sapiens; identical to SEQ ID NO: 207117

SEQ ID NO: 207952 - RNA, 64 nt, Homo Sapiens; identical to SEQ ID NO: 207118

SEQ ID NO: 207953 - RNA, 64 nt, Homo Sapiens; identical to SEQ ID NO: 207119

SEQ ID NO: 207954 - RNA, 64 nt, Homo Sapiens; identical to SEQ ID NO: 207120

SEQ ID NO: 207955 - RNA, 64 nt, Homo Sapiens; identical to SEQ ID NO: 207121

SEQ ID NO: 207956 - RNA, 64 nt, Homo Sapiens; identical to SEQ ID NO: 207122

SEQ ID NO: 207957 - RNA, 64 nt, Homo Sapiens; identical to SEQ ID NO: 207123

SEQ ID NO: 207958 - RNA, 64 nt, Homo Sapiens; identical to SEQ ID NO: 207124

SEQ ID NO: 207959 - RNA, 64 nt, Homo Sapiens; identical to SEQ ID NO: 207125

SEQ ID NO: 207960 - RNA, 64 nt, Homo Sapiens; identical to SEQ ID NO: 207126

SEQ ID NO: 207961 - RNA, 64 nt, Homo Sapiens; identical to SEQ ID NO: 207127

SEQ ID NO: 207962 - RNA, 64 nt, Homo Sapiens; identical to SEQ ID NO: 207128

SEQ ID NO: 207963 - RNA, 64 nt, Homo Sapiens; identical to SEQ ID NO: 207129

SEQ ID NO: 207964 - RNA, 64 nt, Homo Sapiens; identical to SEQ ID NO: 207130

SEQ ID NO: 207965 - RNA, 64 nt, Homo Sapiens; identical to SEQ ID NO: 207131

SEQ ID NO: 207966 - RNA, 64 nt, Homo Sapiens; identical to SEQ ID NO: 207132

SEQ ID NO: 207967 - RNA, 64 nt, Homo Sapiens; identical to SEQ ID NO: 207133

SEQ ID NO: 207968 - RNA, 64 nt, Homo Sapiens; identical to SEQ ID NO: 207134

SEQ ID NO: 207969 - RNA, 64 nt, Homo Sapiens; identical to SEQ ID NO: 207135

SEQ ID NO: 207970 - RNA, 64 nt, Homo Sapiens; identical to SEQ ID NO: 207136

SEQ ID NO: 207971 - RNA, 64 nt, Homo Sapiens; identical to SEQ ID NO: 207137

SEQ ID NO: 207972 - RNA, 64 nt, Homo Sapiens; identical to SEQ ID NO: 207138

SEQ ID NO: 207973 - RNA, 64 nt, Homo Sapiens; identical to SEQ ID NO: 207139

SEQ ID NO: 207974 - RNA, 64 nt, Homo Sapiens; identical to SEQ ID NO: 207140

SEQ ID NO: 207975 - RNA, 64 nt, Homo Sapiens; identical to SEQ ID NO: 207141

SEQ ID NO: 207976 - RNA, 64 nt, Homo Sapiens; identical to SEQ ID NO: 207142

SEQ ID NO: 207977 - RNA, 64 nt, Homo Sapiens; identical to SEQ ID NO: 207143

SEQ ID NO: 207978 - RNA, 64 nt, Homo Sapiens; identical to SEQ ID NO: 207144

SEQ ID NO: 207979 - RNA, 64 nt, Homo Sapiens; identical to SEQ ID NO: 207145

SEQ ID NO: 207980 - RNA, 64 nt, Homo Sapiens; identical to SEQ ID NO: 207146

SEQ ID NO: 207981 - RNA, 64 nt, Homo Sapiens; identical to SEQ ID NO: 207147

SEQ ID NO: 207982 - RNA, 64 nt, Homo Sapiens; identical to SEQ ID NO: 207148

SEQ ID NO: 207983 - RNA, 64 nt, Homo Sapiens; identical to SEQ ID NO: 207149

SEQ ID NO: 207984 - RNA, 64 nt, Homo Sapiens; identical to SEQ ID NO: 207150

SEQ ID NO: 207985 - RNA, 64 nt, Homo Sapiens; identical to SEQ ID NO: 207151

SEQ ID NO: 207986 - RNA, 64 nt, Homo Sapiens; identical to SEQ ID NO: 207152

SEQ ID NO: 207987 - RNA, 64 nt, Homo Sapiens; identical to SEQ ID NO: 207153

SEQ ID NO: 207988 - RNA, 64 nt, Homo Sapiens; identical to SEQ ID NO: 207154

SEQ ID NO: 207989 - RNA, 64 nt, Homo Sapiens; identical to SEQ ID NO: 207155

SEQ ID NO: 207990 - RNA, 64 nt, Homo Sapiens; identical to SEQ ID NO: 207156

SEQ ID NO: 207991 - RNA, 64 nt, Homo Sapiens; identical to SEQ ID NO: 207157

SEQ ID NO: 207992 - RNA, 64 nt, Homo Sapiens; identical to SEQ ID NO: 207158

SEQ ID NO: 207993 - RNA, 64 nt, Homo Sapiens; identical to SEQ ID NO: 207159

SEQ ID NO: 207994 - RNA, 64 nt, Homo Sapiens; identical to SEQ ID NO: 207160

SEQ ID NO: 207995 - RNA, 64 nt, Homo Sapiens; identical to SEQ ID NO: 207161

SEQ ID NO: 207996 - RNA, 64 nt, Homo Sapiens; identical to SEQ ID NO: 207162

SEQ ID NO: 207997 - RNA, 64 nt, Homo Sapiens; identical to SEQ ID NO: 207163

SEQ ID NO: 207998 - RNA, 64 nt, Homo Sapiens; identical to SEQ ID NO: 207164

SEQ ID NO: 207999 - RNA, 64 nt, Homo Sapiens; identical to SEQ ID NO: 207165

SEQ ID NO: 208000 - RNA, 64 nt, Homo Sapiens; identical to SEQ ID NO: 207166

SEQ ID NO: 208001 - RNA, 64 nt, Homo Sapiens; identical to SEQ ID NO: 207167

SEQ ID NO: 208002 - RNA, 64 nt, Homo Sapiens; identical to SEQ ID NO: 207168

SEQ ID NO: 208003 - RNA, 64 nt, Homo Sapiens; identical to SEQ ID NO: 207169

SEQ ID NO: 208004 - RNA, 64 nt, Homo Sapiens; identical to SEQ ID NO: 207170

SEQ ID NO: 208005 - RNA, 64 nt, Homo Sapiens; identical to SEQ ID NO: 207171

SEQ ID NO: 208006 - RNA, 64 nt, Homo Sapiens; identical to SEQ ID NO: 207172

SEQ ID NO: 208007 - RNA, 64 nt, Homo Sapiens; identical to SEQ ID NO: 207173

SEQ ID NO: 208008 - RNA, 64 nt, Homo Sapiens; identical to SEQ ID NO: 207174

SEQ ID NO: 208009 - RNA, 64 nt, Homo Sapiens; identical to SEQ ID NO: 207175

SEQ ID NO: 208010 - RNA, 64 nt, Homo Sapiens; identical to SEQ ID NO: 207176

SEQ ID NO: 208011 - RNA, 64 nt, Homo Sapiens; identical to SEQ ID NO: 207177

SEQ ID NO: 208012 - RNA, 64 nt, Homo Sapiens; identical to SEQ ID NO: 207178

SEQ ID NO: 208013 - RNA, 64 nt, Homo Sapiens; identical to SEQ ID NO: 207179

SEQ ID NO: 208014 - RNA, 64 nt, Homo Sapiens; identical to SEQ ID NO: 207180

SEQ ID NO: 208015 - RNA, 64 nt, Homo Sapiens; identical to SEQ ID NO: 207181

SEQ ID NO: 208016 - RNA, 64 nt, Homo Sapiens; identical to SEQ ID NO: 207182

SEQ ID NO: 208017 - RNA, 64 nt, Homo Sapiens; identical to SEQ ID NO: 207183

SEQ ID NO: 208018 - RNA, 64 nt, Homo Sapiens; identical to SEQ ID NO: 207184

SEQ ID NO: 208019 - RNA, 64 nt, Homo Sapiens; identical to SEQ ID NO: 207185

SEQ ID NO: 208020 - RNA, 64 nt, Homo Sapiens; identical to SEQ ID NO: 207186

SEQ ID NO: 208021 - RNA, 64 nt, Homo Sapiens; identical to SEQ ID NO: 207187

SEQ ID NO: 208022 - RNA, 64 nt, Homo Sapiens; identical to SEQ ID NO: 207188

SEQ ID NO: 208023 - RNA, 64 nt, Homo Sapiens; identical to SEQ ID NO: 207189

SEQ ID NO: 208024 - RNA, 64 nt, Homo Sapiens; identical to SEQ ID NO: 207190

SEQ ID NO: 208025 - RNA, 64 nt, Homo Sapiens; identical to SEQ ID NO: 207191

SEQ ID NO: 208026 - RNA, 64 nt, Homo Sapiens; identical to SEQ ID NO: 207192

SEQ ID NO: 208027 - RNA, 64 nt, Homo Sapiens; identical to SEQ ID NO: 207193

SEQ ID NO: 208028 - RNA, 64 nt, Homo Sapiens; identical to SEQ ID NO: 207194

SEQ ID NO: 208029 - RNA, 64 nt, Homo Sapiens; identical to SEQ ID NO: 207195

SEQ ID NO: 208030 - RNA, 64 nt, Homo Sapiens; identical to SEQ ID NO: 207196

SEQ ID NO: 208031 - RNA, 64 nt, Homo Sapiens; identical to SEQ ID NO: 207197

SEQ ID NO: 208032 - RNA, 64 nt, Homo Sapiens; identical to SEQ ID NO: 207198

SEQ ID NO: 208033 - RNA, 64 nt, Homo Sapiens; identical to SEQ ID NO: 207199

SEQ ID NO: 208034 - RNA, 64 nt, Homo Sapiens; identical to SEQ ID NO: 207200

SEQ ID NO: 208035 - RNA, 64 nt, Homo Sapiens; identical to SEQ ID NO: 207201

SEQ ID NO: 208036 - RNA, 64 nt, Homo Sapiens; identical to SEQ ID NO: 207202

SEQ ID NO: 208037 - RNA, 64 nt, Homo Sapiens; identical to SEQ ID NO: 207203

SEQ ID NO: 208038 - RNA, 64 nt, Homo Sapiens; identical to SEQ ID NO: 207204

SEQ ID NO: 208039 - RNA, 64 nt, Homo Sapiens; identical to SEQ ID NO: 207205

SEQ ID NO: 208040 - RNA, 64 nt, Homo Sapiens; identical to SEQ ID NO: 207206

SEQ ID NO: 208041 - RNA, 64 nt, Homo Sapiens; identical to SEQ ID NO: 207207

SEQ ID NO: 208042 - RNA, 64 nt, Homo Sapiens; identical to SEQ ID NO: 207208

SEQ ID NO: 208043 - RNA, 64 nt, Homo Sapiens; identical to SEQ ID NO: 207209

SEQ ID NO: 208044 - RNA, 64 nt, Homo Sapiens; identical to SEQ ID NO: 207210

SEQ ID NO: 208045 - RNA, 64 nt, Homo Sapiens; identical to SEQ ID NO: 207211

SEQ ID NO: 208046 - RNA, 64 nt, Homo Sapiens; identical to SEQ ID NO: 207212

SEQ ID NO: 208047 - RNA, 64 nt, Homo Sapiens; identical to SEQ ID NO: 207213

SEQ ID NO: 208048 - RNA, 64 nt, Homo Sapiens; identical to SEQ ID NO: 207214

SEQ ID NO: 208049 - RNA, 64 nt, Homo Sapiens; identical to SEQ ID NO: 207215

SEQ ID NO: 208050 - RNA, 52 nt, Homo Sapiens; identical to SEQ ID NO: 207216

SEQ ID NO: 208051 - RNA, 62 nt, Homo Sapiens; identical to SEQ ID NO: 207217

SEQ ID NO: 208052 - RNA, 64 nt, Homo Sapiens; identical to SEQ ID NO: 207218

SEQ ID NO: 208053 - RNA, 64 nt, Homo Sapiens; identical to SEQ ID NO: 207219

SEQ ID NO: 208054 - RNA, 64 nt, Homo Sapiens; identical to SEQ ID NO: 207220

SEQ ID NO: 208055 - RNA, 64 nt, Homo Sapiens; identical to SEQ ID NO: 207221

SEQ ID NO: 208056 - RNA, 64 nt, Homo Sapiens; identical to SEQ ID NO: 207222

SEQ ID NO: 208057 - RNA, 64 nt, Homo Sapiens; identical to SEQ ID NO: 207223

SEQ ID NO: 208058 - RNA, 64 nt, Homo Sapiens; identical to SEQ ID NO: 207224

SEQ ID NO: 208059 - RNA, 64 nt, Homo Sapiens; identical to SEQ ID NO: 207225

SEQ ID NO: 208060 - RNA, 64 nt, Homo Sapiens; identical to SEQ ID NO: 207226

SEQ ID NO: 208061 - RNA, 64 nt, Homo Sapiens; identical to SEQ ID NO: 207227

SEQ ID NO: 208062 - RNA, 64 nt, Homo Sapiens; identical to SEQ ID NO: 207228

SEQ ID NO: 208063 - RNA, 64 nt, Homo Sapiens; identical to SEQ ID NO: 207229

SEQ ID NO: 208064 - RNA, 64 nt, Homo Sapiens; identical to SEQ ID NO: 207230

SEQ ID NO: 208065 - RNA, 64 nt, Homo Sapiens; identical to SEQ ID NO: 207231

SEQ ID NO: 208066 - RNA, 64 nt, Homo Sapiens; identical to SEQ ID NO: 207232

SEQ ID NO: 208067 - RNA, 64 nt, Homo Sapiens; identical to SEQ ID NO: 207233

SEQ ID NO: 208068 - RNA, 64 nt, Homo Sapiens; identical to SEQ ID NO: 207234

SEQ ID NO: 208069 - RNA, 64 nt, Homo Sapiens; identical to SEQ ID NO: 207235

SEQ ID NO: 208070 - RNA, 64 nt, Homo Sapiens; identical to SEQ ID NO: 207236

SEQ ID NO: 208071 - RNA, 64 nt, Homo Sapiens; identical to SEQ ID NO: 207237

SEQ ID NO: 208072 - RNA, 64 nt, Homo Sapiens; identical to SEQ ID NO: 207238

SEQ ID NO: 208073 - RNA, 64 nt, Homo Sapiens; identical to SEQ ID NO: 207239

SEQ ID NO: 208074 - RNA, 64 nt, Homo Sapiens; identical to SEQ ID NO: 207240

SEQ ID NO: 208075 - RNA, 64 nt, Homo Sapiens; identical to SEQ ID NO: 207241

SEQ ID NO: 208076 - RNA, 64 nt, Homo Sapiens; identical to SEQ ID NO: 207242

SEQ ID NO: 208077 - RNA, 64 nt, Homo Sapiens; identical to SEQ ID NO: 207243

SEQ ID NO: 208078 - RNA, 64 nt, Homo Sapiens; identical to SEQ ID NO: 207244

SEQ ID NO: 208079 - RNA, 64 nt, Homo Sapiens; identical to SEQ ID NO: 207245

SEQ ID NO: 208080 - RNA, 64 nt, Homo Sapiens; identical to SEQ ID NO: 207246

SEQ ID NO: 208081 - RNA, 64 nt, Homo Sapiens; identical to SEQ ID NO: 207247

SEQ ID NO: 208082 - RNA, 64 nt, Homo Sapiens; identical to SEQ ID NO: 207248

SEQ ID NO: 208083 - RNA, 64 nt, Homo Sapiens; identical to SEQ ID NO: 207249

SEQ ID NO: 208084 - RNA, 64 nt, Homo Sapiens; identical to SEQ ID NO: 207250

SEQ ID NO: 208085 - RNA, 64 nt, Homo Sapiens; identical to SEQ ID NO: 207251

SEQ ID NO: 208086 - RNA, 64 nt, Homo Sapiens; identical to SEQ ID NO: 207252

SEQ ID NO: 208087 - RNA, 64 nt, Homo Sapiens; identical to SEQ ID NO: 207253

SEQ ID NO: 208088 - RNA, 64 nt, Homo Sapiens; identical to SEQ ID NO: 207254

SEQ ID NO: 208089 - RNA, 64 nt, Homo Sapiens; identical to SEQ ID NO: 207255

SEQ ID NO: 208090 - RNA, 64 nt, Homo Sapiens; identical to SEQ ID NO: 207256

SEQ ID NO: 208091 - RNA, 64 nt, Homo Sapiens; identical to SEQ ID NO: 207257

SEQ ID NO: 208092 - RNA, 64 nt, Homo Sapiens; identical to SEQ ID NO: 207258

SEQ ID NO: 208093 - RNA, 64 nt, Homo Sapiens; identical to SEQ ID NO: 207259

SEQ ID NO: 208094 - RNA, 64 nt, Homo Sapiens; identical to SEQ ID NO: 207260

SEQ ID NO: 208095 - RNA, 64 nt, Homo Sapiens; identical to SEQ ID NO: 207261

SEQ ID NO: 208096 - RNA, 64 nt, Homo Sapiens; identical to SEQ ID NO: 207262

SEQ ID NO: 208097 - RNA, 64 nt, Homo Sapiens; identical to SEQ ID NO: 207263

SEQ ID NO: 208098 - RNA, 64 nt, Homo Sapiens; identical to SEQ ID NO: 207264

SEQ ID NO: 208099 - RNA, 64 nt, Homo Sapiens; identical to SEQ ID NO: 207265

SEQ ID NO: 208100 - RNA, 64 nt, Homo Sapiens; identical to SEQ ID NO: 207266

SEQ ID NO: 208101 - RNA, 64 nt, Homo Sapiens; identical to SEQ ID NO: 207267

SEQ ID NO: 208102 - RNA, 64 nt, Homo Sapiens; identical to SEQ ID NO: 207268

SEQ ID NO: 208103 - RNA, 64 nt, Homo Sapiens; identical to SEQ ID NO: 207269

SEQ ID NO: 208104 - RNA, 64 nt, Homo Sapiens; identical to SEQ ID NO: 207270

SEQ ID NO: 208105 - RNA, 64 nt, Homo Sapiens; identical to SEQ ID NO: 207271

SEQ ID NO: 208106 - RNA, 64 nt, Homo Sapiens; identical to SEQ ID NO: 207272

SEQ ID NO: 208107 - RNA, 64 nt, Homo Sapiens; identical to SEQ ID NO: 207273

SEQ ID NO: 208108 - RNA, 64 nt, Homo Sapiens; identical to SEQ ID NO: 207274

SEQ ID NO: 208109 - RNA, 64 nt, Homo Sapiens; identical to SEQ ID NO: 207275

SEQ ID NO: 208110 - RNA, 64 nt, Homo Sapiens; identical to SEQ ID NO: 207276

SEQ ID NO: 208111 - RNA, 64 nt, Homo Sapiens; identical to SEQ ID NO: 207277

SEQ ID NO: 208112 - RNA, 64 nt, Homo Sapiens; identical to SEQ ID NO: 207278

SEQ ID NO: 208113 - RNA, 64 nt, Homo Sapiens; identical to SEQ ID NO: 207279

SEQ ID NO: 208114 - RNA, 64 nt, Homo Sapiens; identical to SEQ ID NO: 207280

SEQ ID NO: 208115 - RNA, 64 nt, Homo Sapiens; identical to SEQ ID NO: 207281

SEQ ID NO: 208116 - RNA, 64 nt, Homo Sapiens; identical to SEQ ID NO: 207282

SEQ ID NO: 208117 - RNA, 64 nt, Homo Sapiens; identical to SEQ ID NO: 207283

SEQ ID NO: 208118 - RNA, 64 nt, Homo Sapiens; identical to SEQ ID NO: 207284

SEQ ID NO: 208119 - RNA, 64 nt, Homo Sapiens; identical to SEQ ID NO: 207285

SEQ ID NO: 208120 - RNA, 64 nt, Homo Sapiens; identical to SEQ ID NO: 207286

SEQ ID NO: 208121 - RNA, 64 nt, Homo Sapiens; identical to SEQ ID NO: 207287

SEQ ID NO: 208122 - RNA, 64 nt, Homo Sapiens; identical to SEQ ID NO: 207288

SEQ ID NO: 208123 - RNA, 64 nt, Homo Sapiens; identical to SEQ ID NO: 207289

SEQ ID NO: 208124 - RNA, 64 nt, Homo Sapiens; identical to SEQ ID NO: 207290

SEQ ID NO: 208125 - RNA, 64 nt, Homo Sapiens; identical to SEQ ID NO: 207291

SEQ ID NO: 208126 - RNA, 64 nt, Homo Sapiens; identical to SEQ ID NO: 207292

SEQ ID NO: 208127 - RNA, 64 nt, Homo Sapiens; identical to SEQ ID NO: 207293

SEQ ID NO: 208128 - RNA, 64 nt, Homo Sapiens; identical to SEQ ID NO: 207294

SEQ ID NO: 208129 - RNA, 64 nt, Homo Sapiens; identical to SEQ ID NO: 207295

SEQ ID NO: 208130 - RNA, 64 nt, Homo Sapiens; identical to SEQ ID NO: 207296

SEQ ID NO: 208131 - RNA, 64 nt, Homo Sapiens; identical to SEQ ID NO: 207297

SEQ ID NO: 208132 - RNA, 64 nt, Homo Sapiens; identical to SEQ ID NO: 207298

SEQ ID NO: 208133 - RNA, 64 nt, Homo Sapiens; identical to SEQ ID NO: 207299

SEQ ID NO: 208134 - RNA, 64 nt, Homo Sapiens; identical to SEQ ID NO: 207300

SEQ ID NO: 208135 - RNA, 64 nt, Homo Sapiens; identical to SEQ ID NO: 207301

SEQ ID NO: 208136 - RNA, 64 nt, Homo Sapiens; identical to SEQ ID NO: 207302

SEQ ID NO: 208137 - RNA, 64 nt, Homo Sapiens; identical to SEQ ID NO: 207303

SEQ ID NO: 208138 - RNA, 64 nt, Homo Sapiens; identical to SEQ ID NO: 207304

SEQ ID NO: 208139 - RNA, 64 nt, Homo Sapiens; identical to SEQ ID NO: 207305

SEQ ID NO: 208140 - RNA, 64 nt, Homo Sapiens; identical to SEQ ID NO: 207306

SEQ ID NO: 208141 - RNA, 64 nt, Homo Sapiens; identical to SEQ ID NO: 207307

SEQ ID NO: 208142 - RNA, 64 nt, Homo Sapiens; identical to SEQ ID NO: 207308

SEQ ID NO: 208143 - RNA, 64 nt, Homo Sapiens; identical to SEQ ID NO: 207309

SEQ ID NO: 208144 - RNA, 64 nt, Homo Sapiens; identical to SEQ ID NO: 207310

SEQ ID NO: 208145 - RNA, 64 nt, Homo Sapiens; identical to SEQ ID NO: 207311

SEQ ID NO: 208146 - RNA, 64 nt, Homo Sapiens; identical to SEQ ID NO: 207312

SEQ ID NO: 208147 - RNA, 64 nt, Homo Sapiens; identical to SEQ ID NO: 207313

SEQ ID NO: 208148 - RNA, 64 nt, Homo Sapiens; identical to SEQ ID NO: 207314

SEQ ID NO: 208149 - RNA, 64 nt, Homo Sapiens; identical to SEQ ID NO: 207315

SEQ ID NO: 208150 - RNA, 64 nt, Homo Sapiens; identical to SEQ ID NO: 207316

SEQ ID NO: 208151 - RNA, 64 nt, Homo Sapiens; identical to SEQ ID NO: 207317

SEQ ID NO: 208152 - RNA, 64 nt, Homo Sapiens; identical to SEQ ID NO: 207318

SEQ ID NO: 208153 - RNA, 64 nt, Homo Sapiens; identical to SEQ ID NO: 207319

SEQ ID NO: 208154 - RNA, 64 nt, Homo Sapiens; identical to SEQ ID NO: 207320

SEQ ID NO: 208155 - RNA, 64 nt, Homo Sapiens; identical to SEQ ID NO: 207321

SEQ ID NO: 208156 - RNA, 64 nt, Homo Sapiens; identical to SEQ ID NO: 207322

SEQ ID NO: 208157 - RNA, 64 nt, Homo Sapiens; identical to SEQ ID NO: 207323

SEQ ID NO: 208158 - RNA, 64 nt, Homo Sapiens; identical to SEQ ID NO: 207324

SEQ ID NO: 208159 - RNA, 64 nt, Homo Sapiens; identical to SEQ ID NO: 207325

SEQ ID NO: 208160 - RNA, 64 nt, Homo Sapiens; identical to SEQ ID NO: 207326

SEQ ID NO: 208161 - RNA, 64 nt, Homo Sapiens; identical to SEQ ID NO: 207327

SEQ ID NO: 208162 - RNA, 64 nt, Homo Sapiens; identical to SEQ ID NO: 207328

SEQ ID NO: 208163 - RNA, 64 nt, Homo Sapiens; identical to SEQ ID NO: 207329

SEQ ID NO: 208164 - RNA, 64 nt, Homo Sapiens; identical to SEQ ID NO: 207330

SEQ ID NO: 208165 - RNA, 64 nt, Homo Sapiens; identical to SEQ ID NO: 207331

SEQ ID NO: 208166 - RNA, 64 nt, Homo Sapiens; identical to SEQ ID NO: 207332

SEQ ID NO: 208167 - RNA, 64 nt, Homo Sapiens; identical to SEQ ID NO: 207333

SEQ ID NO: 208168 - RNA, 64 nt, Homo Sapiens; identical to SEQ ID NO: 207334

SEQ ID NO: 208169 - RNA, 64 nt, Homo Sapiens; identical to SEQ ID NO: 207335

SEQ ID NO: 208170 - RNA, 64 nt, Homo Sapiens; identical to SEQ ID NO: 207336

SEQ ID NO: 208171 - RNA, 64 nt, Homo Sapiens; identical to SEQ ID NO: 207337

SEQ ID NO: 208172 - RNA, 64 nt, Homo Sapiens; identical to SEQ ID NO: 207338

SEQ ID NO: 208173 - RNA, 64 nt, Homo Sapiens; identical to SEQ ID NO: 207339

SEQ ID NO: 208174 - RNA, 64 nt, Homo Sapiens; identical to SEQ ID NO: 207340

SEQ ID NO: 208175 - RNA, 64 nt, Homo Sapiens; identical to SEQ ID NO: 207341

SEQ ID NO: 208176 - RNA, 64 nt, Homo Sapiens; identical to SEQ ID NO: 207342

SEQ ID NO: 208177 - RNA, 64 nt, Homo Sapiens; identical to SEQ ID NO: 207343

SEQ ID NO: 208178 - RNA, 64 nt, Homo Sapiens; identical to SEQ ID NO: 207344

SEQ ID NO: 208179 - RNA, 64 nt, Homo Sapiens; identical to SEQ ID NO: 207345

SEQ ID NO: 208180 - RNA, 64 nt, Homo Sapiens; identical to SEQ ID NO: 207346

SEQ ID NO: 208181 - RNA, 64 nt, Homo Sapiens; identical to SEQ ID NO: 207347

SEQ ID NO: 208182 - RNA, 64 nt, Homo Sapiens; identical to SEQ ID NO: 207348

SEQ ID NO: 208183 - RNA, 64 nt, Homo Sapiens; identical to SEQ ID NO: 207349

SEQ ID NO: 208184 - RNA, 64 nt, Homo Sapiens; identical to SEQ ID NO: 207350

SEQ ID NO: 208185 - RNA, 64 nt, Homo Sapiens; identical to SEQ ID NO: 207351

SEQ ID NO: 208186 - RNA, 64 nt, Homo Sapiens; identical to SEQ ID NO: 207352

SEQ ID NO: 208187 - RNA, 51 nt, Homo Sapiens; identical to SEQ ID NO: 207353

SEQ ID NO: 208188 - RNA, 64 nt, Homo Sapiens; identical to SEQ ID NO: 207354

SEQ ID NO: 208189 - RNA, 64 nt, Homo Sapiens; identical to SEQ ID NO: 207355

SEQ ID NO: 208190 - RNA, 64 nt, Homo Sapiens; identical to SEQ ID NO: 207356

SEQ ID NO: 208191 - RNA, 64 nt, Homo Sapiens; identical to SEQ ID NO: 207357

SEQ ID NO: 208192 - RNA, 64 nt, Homo Sapiens; identical to SEQ ID NO: 207358

SEQ ID NO: 208193 - RNA, 64 nt, Homo Sapiens; identical to SEQ ID NO: 207359

SEQ ID NO: 208194 - RNA, 64 nt, Homo Sapiens; identical to SEQ ID NO: 207360

SEQ ID NO: 208195 - RNA, 64 nt, Homo Sapiens; identical to SEQ ID NO: 207361

SEQ ID NO: 208196 - RNA, 64 nt, Homo Sapiens; identical to SEQ ID NO: 207362

SEQ ID NO: 208197 - RNA, 64 nt, Homo Sapiens; identical to SEQ ID NO: 207363

SEQ ID NO: 208198 - RNA, 64 nt, Homo Sapiens; identical to SEQ ID NO: 207364

SEQ ID NO: 208199 - RNA, 64 nt, Homo Sapiens; identical to SEQ ID NO: 207365

SEQ ID NO: 208200 - RNA, 64 nt, Homo Sapiens; identical to SEQ ID NO: 207366

SEQ ID NO: 208201 - RNA, 64 nt, Homo Sapiens; identical to SEQ ID NO: 207367

SEQ ID NO: 208202 - RNA, 64 nt, Homo Sapiens; identical to SEQ ID NO: 207368

SEQ ID NO: 208203 - RNA, 64 nt, Homo Sapiens; identical to SEQ ID NO: 207369

SEQ ID NO: 208204 - RNA, 64 nt, Homo Sapiens; identical to SEQ ID NO: 207370

SEQ ID NO: 208205 - RNA, 64 nt, Homo Sapiens; identical to SEQ ID NO: 207371

SEQ ID NO: 208206 - RNA, 64 nt, Homo Sapiens; identical to SEQ ID NO: 207372

SEQ ID NO: 208207 - RNA, 64 nt, Homo Sapiens; identical to SEQ ID NO: 207373

SEQ ID NO: 208208 - RNA, 64 nt, Homo Sapiens; identical to SEQ ID NO: 207374

SEQ ID NO: 208209 - RNA, 64 nt, Homo Sapiens; identical to SEQ ID NO: 207375

SEQ ID NO: 208210 - RNA, 64 nt, Homo Sapiens; identical to SEQ ID NO: 207376

SEQ ID NO: 208211 - RNA, 64 nt, Homo Sapiens; identical to SEQ ID NO: 207377

SEQ ID NO: 208212 - RNA, 64 nt, Homo Sapiens; identical to SEQ ID NO: 207378

SEQ ID NO: 208213 - RNA, 64 nt, Homo Sapiens; identical to SEQ ID NO: 207379

SEQ ID NO: 208214 - RNA, 64 nt, Homo Sapiens; identical to SEQ ID NO: 207380

SEQ ID NO: 208215 - RNA, 64 nt, Homo Sapiens; identical to SEQ ID NO: 207381

SEQ ID NO: 208216 - RNA, 64 nt, Homo Sapiens; identical to SEQ ID NO: 207382

SEQ ID NO: 208217 - RNA, 64 nt, Homo Sapiens; identical to SEQ ID NO: 207383

SEQ ID NO: 208218 - RNA, 64 nt, Homo Sapiens; identical to SEQ ID NO: 207384

SEQ ID NO: 208219 - RNA, 64 nt, Homo Sapiens; identical to SEQ ID NO: 207385

SEQ ID NO: 208220 - RNA, 64 nt, Homo Sapiens; identical to SEQ ID NO: 207386

SEQ ID NO: 208221 - RNA, 64 nt, Homo Sapiens; identical to SEQ ID NO: 207387

SEQ ID NO: 208222 - RNA, 64 nt, Homo Sapiens; identical to SEQ ID NO: 207388

SEQ ID NO: 208223 - RNA, 64 nt, Homo Sapiens; identical to SEQ ID NO: 207389

SEQ ID NO: 208224 - RNA, 64 nt, Homo Sapiens; identical to SEQ ID NO: 207390

SEQ ID NO: 208225 - RNA, 64 nt, Homo Sapiens; identical to SEQ ID NO: 207391

SEQ ID NO: 208226 - RNA, 64 nt, Homo Sapiens; identical to SEQ ID NO: 207392

SEQ ID NO: 208227 - RNA, 64 nt, Homo Sapiens; identical to SEQ ID NO: 207393

SEQ ID NO: 208228 - RNA, 64 nt, Homo Sapiens; identical to SEQ ID NO: 207394

SEQ ID NO: 208229 - RNA, 64 nt, Homo Sapiens; identical to SEQ ID NO: 207395

SEQ ID NO: 208230 - RNA, 64 nt, Homo Sapiens; identical to SEQ ID NO: 207396

SEQ ID NO: 208231 - RNA, 64 nt, Homo Sapiens; identical to SEQ ID NO: 207397

SEQ ID NO: 208232 - RNA, 64 nt, Homo Sapiens; identical to SEQ ID NO: 207398

SEQ ID NO: 208233 - RNA, 64 nt, Homo Sapiens; identical to SEQ ID NO: 207399

SEQ ID NO: 208234 - RNA, 64 nt, Homo Sapiens; identical to SEQ ID NO: 207400

SEQ ID NO: 208235 - RNA, 64 nt, Homo Sapiens; identical to SEQ ID NO: 207401

SEQ ID NO: 208236 - RNA, 64 nt, Homo Sapiens; identical to SEQ ID NO: 207402

SEQ ID NO: 208237 - RNA, 64 nt, Homo Sapiens; identical to SEQ ID NO: 207403

SEQ ID NO: 208238 - RNA, 64 nt, Homo Sapiens; identical to SEQ ID NO: 207404

SEQ ID NO: 208239 - RNA, 64 nt, Homo Sapiens; identical to SEQ ID NO: 207405

SEQ ID NO: 208240 - RNA, 64 nt, Homo Sapiens; identical to SEQ ID NO: 207406

SEQ ID NO: 208241 - RNA, 64 nt, Homo Sapiens; identical to SEQ ID NO: 207407

SEQ ID NO: 208242 - RNA, 64 nt, Homo Sapiens; identical to SEQ ID NO: 207408

SEQ ID NO: 208243 - RNA, 64 nt, Homo Sapiens; identical to SEQ ID NO: 207409

SEQ ID NO: 208244 - RNA, 64 nt, Homo Sapiens; identical to SEQ ID NO: 207410

SEQ ID NO: 208245 - RNA, 64 nt, Homo Sapiens; identical to SEQ ID NO: 207411

SEQ ID NO: 208246 - RNA, 64 nt, Homo Sapiens; identical to SEQ ID NO: 207412

SEQ ID NO: 208247 - RNA, 64 nt, Homo Sapiens; identical to SEQ ID NO: 207413

SEQ ID NO: 208248 - RNA, 64 nt, Homo Sapiens; identical to SEQ ID NO: 207414

SEQ ID NO: 208249 - RNA, 64 nt, Homo Sapiens; identical to SEQ ID NO: 207415

SEQ ID NO: 208250 - RNA, 64 nt, Homo Sapiens; identical to SEQ ID NO: 207416

SEQ ID NO: 208251 - RNA, 64 nt, Homo Sapiens; identical to SEQ ID NO: 207417

SEQ ID NO: 208252 - RNA, 64 nt, Homo Sapiens; identical to SEQ ID NO: 207418

SEQ ID NO: 208253 - RNA, 64 nt, Homo Sapiens; identical to SEQ ID NO: 207419

SEQ ID NO: 208254 - RNA, 64 nt, Homo Sapiens; identical to SEQ ID NO: 207420

SEQ ID NO: 208255 - RNA, 64 nt, Homo Sapiens; identical to SEQ ID NO: 207421

SEQ ID NO: 208256 - RNA, 64 nt, Homo Sapiens; identical to SEQ ID NO: 207422

SEQ ID NO: 208257 - RNA, 64 nt, Homo Sapiens; identical to SEQ ID NO: 207423

SEQ ID NO: 208258 - RNA, 64 nt, Homo Sapiens; identical to SEQ ID NO: 207424

SEQ ID NO: 208259 - RNA, 64 nt, Homo Sapiens; identical to SEQ ID NO: 207425

SEQ ID NO: 208260 - RNA, 64 nt, Homo Sapiens; identical to SEQ ID NO: 207426

SEQ ID NO: 208261 - RNA, 64 nt, Homo Sapiens; identical to SEQ ID NO: 207427

SEQ ID NO: 208262 - RNA, 64 nt, Homo Sapiens; identical to SEQ ID NO: 207428

SEQ ID NO: 208263 - RNA, 64 nt, Homo Sapiens; identical to SEQ ID NO: 207429

SEQ ID NO: 208264 - RNA, 64 nt, Homo Sapiens; identical to SEQ ID NO: 207430

SEQ ID NO: 208265 - RNA, 64 nt, Homo Sapiens; identical to SEQ ID NO: 207431

SEQ ID NO: 208266 - RNA, 64 nt, Homo Sapiens; identical to SEQ ID NO: 207432

SEQ ID NO: 208267 - RNA, 64 nt, Homo Sapiens; identical to SEQ ID NO: 207433

SEQ ID NO: 208268 - RNA, 64 nt, Homo Sapiens; identical to SEQ ID NO: 207434

SEQ ID NO: 208269 - RNA, 64 nt, Homo Sapiens; identical to SEQ ID NO: 207435

SEQ ID NO: 208270 - RNA, 64 nt, Homo Sapiens; identical to SEQ ID NO: 207436

SEQ ID NO: 208271 - RNA, 64 nt, Homo Sapiens; identical to SEQ ID NO: 207437

SEQ ID NO: 208272 - RNA, 64 nt, Homo Sapiens; identical to SEQ ID NO: 207438

SEQ ID NO: 208273 - RNA, 64 nt, Homo Sapiens; identical to SEQ ID NO: 207439

SEQ ID NO: 208274 - RNA, 64 nt, Homo Sapiens; identical to SEQ ID NO: 207440

SEQ ID NO: 208275 - RNA, 64 nt, Homo Sapiens; identical to SEQ ID NO: 207441

SEQ ID NO: 208276 - RNA, 64 nt, Homo Sapiens; identical to SEQ ID NO: 207442

SEQ ID NO: 208277 - RNA, 64 nt, Homo Sapiens; identical to SEQ ID NO: 207443

SEQ ID NO: 208278 - RNA, 64 nt, Homo Sapiens; identical to SEQ ID NO: 207444

SEQ ID NO: 208279 - RNA, 64 nt, Homo Sapiens; identical to SEQ ID NO: 207445

SEQ ID NO: 208280 - RNA, 64 nt, Homo Sapiens; identical to SEQ ID NO: 207446

SEQ ID NO: 208281 - RNA, 64 nt, Homo Sapiens; identical to SEQ ID NO: 207447

SEQ ID NO: 208282 - RNA, 64 nt, Homo Sapiens; identical to SEQ ID NO: 207448

SEQ ID NO: 208283 - RNA, 64 nt, Homo Sapiens; identical to SEQ ID NO: 207449

SEQ ID NO: 208284 - RNA, 64 nt, Homo Sapiens; identical to SEQ ID NO: 207450

SEQ ID NO: 208285 - RNA, 64 nt, Homo Sapiens; identical to SEQ ID NO: 207451

SEQ ID NO: 208286 - RNA, 64 nt, Homo Sapiens; identical to SEQ ID NO: 207452

SEQ ID NO: 208287 - RNA, 64 nt, Homo Sapiens; identical to SEQ ID NO: 207453

SEQ ID NO: 208288 - RNA, 64 nt, Homo Sapiens; identical to SEQ ID NO: 207454

SEQ ID NO: 208289 - RNA, 64 nt, Homo Sapiens; identical to SEQ ID NO: 207455

SEQ ID NO: 208290 - RNA, 64 nt, Homo Sapiens; identical to SEQ ID NO: 207456

SEQ ID NO: 208291 - RNA, 64 nt, Homo Sapiens; identical to SEQ ID NO: 207457

SEQ ID NO: 208292 - RNA, 64 nt, Homo Sapiens; identical to SEQ ID NO: 207458

SEQ ID NO: 208293 - RNA, 64 nt, Homo Sapiens; identical to SEQ ID NO: 207459

SEQ ID NO: 208294 - RNA, 64 nt, Homo Sapiens; identical to SEQ ID NO: 207460

SEQ ID NO: 208295 - RNA, 64 nt, Homo Sapiens; identical to SEQ ID NO: 207461

SEQ ID NO: 208296 - RNA, 64 nt, Homo Sapiens; identical to SEQ ID NO: 207462

SEQ ID NO: 208297 - RNA, 64 nt, Homo Sapiens; identical to SEQ ID NO: 207463

SEQ ID NO: 208298 - RNA, 64 nt, Homo Sapiens; identical to SEQ ID NO: 207464

SEQ ID NO: 208299 - RNA, 64 nt, Homo Sapiens; identical to SEQ ID NO: 207465

SEQ ID NO: 208300 - RNA, 64 nt, Homo Sapiens; identical to SEQ ID NO: 207466

SEQ ID NO: 208301 - RNA, 64 nt, Homo Sapiens; identical to SEQ ID NO: 207467

SEQ ID NO: 208302 - RNA, 64 nt, Homo Sapiens; identical to SEQ ID NO: 207468

SEQ ID NO: 208303 - RNA, 64 nt, Homo Sapiens; identical to SEQ ID NO: 207469

SEQ ID NO: 208304 - RNA, 64 nt, Homo Sapiens; identical to SEQ ID NO: 207470

SEQ ID NO: 208305 - RNA, 64 nt, Homo Sapiens; identical to SEQ ID NO: 207471

SEQ ID NO: 208306 - RNA, 64 nt, Homo Sapiens; identical to SEQ ID NO: 207472

SEQ ID NO: 208307 - RNA, 64 nt, Homo Sapiens; identical to SEQ ID NO: 207473

SEQ ID NO: 208308 - RNA, 64 nt, Homo Sapiens; identical to SEQ ID NO: 207474

SEQ ID NO: 208309 - RNA, 64 nt, Homo Sapiens; identical to SEQ ID NO: 207475

SEQ ID NO: 208310 - RNA, 64 nt, Homo Sapiens; identical to SEQ ID NO: 207476

SEQ ID NO: 208311 - RNA, 64 nt, Homo Sapiens; identical to SEQ ID NO: 207477

SEQ ID NO: 208312 - RNA, 64 nt, Homo Sapiens; identical to SEQ ID NO: 207478

SEQ ID NO: 208313 - RNA, 64 nt, Homo Sapiens; identical to SEQ ID NO: 207479

SEQ ID NO: 208314 - RNA, 64 nt, Homo Sapiens; identical to SEQ ID NO: 207480

SEQ ID NO: 208315 - RNA, 64 nt, Homo Sapiens; identical to SEQ ID NO: 207481

SEQ ID NO: 208316 - RNA, 64 nt, Homo Sapiens; identical to SEQ ID NO: 207482

SEQ ID NO: 208317 - RNA, 64 nt, Homo Sapiens; identical to SEQ ID NO: 207483

SEQ ID NO: 208318 - RNA, 64 nt, Homo Sapiens; identical to SEQ ID NO: 207484

SEQ ID NO: 208319 - RNA, 64 nt, Homo Sapiens; identical to SEQ ID NO: 207485

SEQ ID NO: 208320 - RNA, 64 nt, Homo Sapiens; identical to SEQ ID NO: 207486

SEQ ID NO: 208321 - RNA, 64 nt, Homo Sapiens; identical to SEQ ID NO: 207487

SEQ ID NO: 208322 - RNA, 64 nt, Homo Sapiens; identical to SEQ ID NO: 207488

SEQ ID NO: 208323 - RNA, 64 nt, Homo Sapiens; identical to SEQ ID NO: 207489

SEQ ID NO: 208324 - RNA, 64 nt, Homo Sapiens; identical to SEQ ID NO: 207490

SEQ ID NO: 208325 - RNA, 64 nt, Homo Sapiens; identical to SEQ ID NO: 207491

SEQ ID NO: 208326 - RNA, 64 nt, Homo Sapiens; identical to SEQ ID NO: 207492

SEQ ID NO: 208327 - RNA, 64 nt, Homo Sapiens; identical to SEQ ID NO: 207493

SEQ ID NO: 208328 - RNA, 64 nt, Homo Sapiens; identical to SEQ ID NO: 207494

SEQ ID NO: 208329 - RNA, 64 nt, Homo Sapiens; identical to SEQ ID NO: 207495

SEQ ID NO: 208330 - RNA, 64 nt, Homo Sapiens; identical to SEQ ID NO: 207496

SEQ ID NO: 208331 - RNA, 64 nt, Homo Sapiens; identical to SEQ ID NO: 207497

SEQ ID NO: 208332 - RNA, 64 nt, Homo Sapiens; identical to SEQ ID NO: 207498

SEQ ID NO: 208333 - RNA, 62 nt, Homo Sapiens; identical to SEQ ID NO: 207499

SEQ ID NO: 208334 - RNA, 64 nt, Homo Sapiens; identical to SEQ ID NO: 207500

SEQ ID NO: 208335 - RNA, 64 nt, Homo Sapiens; identical to SEQ ID NO: 207501

SEQ ID NO: 208336 - RNA, 64 nt, Homo Sapiens; identical to SEQ ID NO: 207502

SEQ ID NO: 208337 - RNA, 64 nt, Homo Sapiens; identical to SEQ ID NO: 207503

SEQ ID NO: 208338 - RNA, 64 nt, Homo Sapiens; identical to SEQ ID NO: 207504

SEQ ID NO: 208339 - RNA, 64 nt, Homo Sapiens; identical to SEQ ID NO: 207505

SEQ ID NO: 208340 - RNA, 64 nt, Homo Sapiens; identical to SEQ ID NO: 207506

SEQ ID NO: 208341 - RNA, 64 nt, Homo Sapiens; identical to SEQ ID NO: 207507

SEQ ID NO: 208342 - RNA, 64 nt, Homo Sapiens; identical to SEQ ID NO: 207508

SEQ ID NO: 208343 - RNA, 64 nt, Homo Sapiens; identical to SEQ ID NO: 207509

SEQ ID NO: 208344 - RNA, 64 nt, Homo Sapiens; identical to SEQ ID NO: 207510

SEQ ID NO: 208345 - RNA, 64 nt, Homo Sapiens; identical to SEQ ID NO: 207511

SEQ ID NO: 208346 - RNA, 64 nt, Homo Sapiens; identical to SEQ ID NO: 207512

SEQ ID NO: 208347 - RNA, 64 nt, Homo Sapiens; identical to SEQ ID NO: 207513

SEQ ID NO: 208348 - RNA, 64 nt, Homo Sapiens; identical to SEQ ID NO: 207514

SEQ ID NO: 208349 - RNA, 64 nt, Homo Sapiens; identical to SEQ ID NO: 207515

SEQ ID NO: 208350 - RNA, 64 nt, Homo Sapiens; identical to SEQ ID NO: 207516

SEQ ID NO: 208351 - RNA, 64 nt, Homo Sapiens; identical to SEQ ID NO: 207517

SEQ ID NO: 208352 - RNA, 64 nt, Homo Sapiens; identical to SEQ ID NO: 207518

SEQ ID NO: 208353 - RNA, 64 nt, Homo Sapiens; identical to SEQ ID NO: 207519

SEQ ID NO: 208354 - RNA, 64 nt, Homo Sapiens; identical to SEQ ID NO: 207520

SEQ ID NO: 208355 - RNA, 64 nt, Homo Sapiens; identical to SEQ ID NO: 207521

SEQ ID NO: 208356 - RNA, 64 nt, Homo Sapiens; identical to SEQ ID NO: 207522

SEQ ID NO: 208357 - RNA, 64 nt, Homo Sapiens; identical to SEQ ID NO: 207523

SEQ ID NO: 208358 - RNA, 64 nt, Homo Sapiens; identical to SEQ ID NO: 207524

SEQ ID NO: 208359 - RNA, 64 nt, Homo Sapiens; identical to SEQ ID NO: 207525

SEQ ID NO: 208360 - RNA, 64 nt, Homo Sapiens; identical to SEQ ID NO: 207526

SEQ ID NO: 208361 - RNA, 64 nt, Homo Sapiens; identical to SEQ ID NO: 207527

SEQ ID NO: 208362 - RNA, 64 nt, Homo Sapiens; identical to SEQ ID NO: 207528

SEQ ID NO: 208363 - RNA, 64 nt, Homo Sapiens; identical to SEQ ID NO: 207529

SEQ ID NO: 208364 - RNA, 64 nt, Homo Sapiens; identical to SEQ ID NO: 207530

SEQ ID NO: 208365 - RNA, 64 nt, Homo Sapiens; identical to SEQ ID NO: 207531

SEQ ID NO: 208366 - RNA, 64 nt, Homo Sapiens; identical to SEQ ID NO: 207532

SEQ ID NO: 208367 - RNA, 64 nt, Homo Sapiens; identical to SEQ ID NO: 207533

SEQ ID NO: 208368 - RNA, 64 nt, Homo Sapiens; identical to SEQ ID NO: 207534

SEQ ID NO: 208369 - RNA, 64 nt, Homo Sapiens; identical to SEQ ID NO: 207535

SEQ ID NO: 208370 - RNA, 64 nt, Homo Sapiens; identical to SEQ ID NO: 207536

SEQ ID NO: 208371 - RNA, 64 nt, Homo Sapiens; identical to SEQ ID NO: 207537

SEQ ID NO: 208372 - RNA, 64 nt, Homo Sapiens; identical to SEQ ID NO: 207538

SEQ ID NO: 208373 - RNA, 64 nt, Homo Sapiens; identical to SEQ ID NO: 207539

SEQ ID NO: 208374 - RNA, 64 nt, Homo Sapiens; identical to SEQ ID NO: 207540

SEQ ID NO: 208375 - RNA, 64 nt, Homo Sapiens; identical to SEQ ID NO: 207541

SEQ ID NO: 208376 - RNA, 64 nt, Homo Sapiens; identical to SEQ ID NO: 207542

SEQ ID NO: 208377 - RNA, 64 nt, Homo Sapiens; identical to SEQ ID NO: 207543

SEQ ID NO: 208378 - RNA, 64 nt, Homo Sapiens; identical to SEQ ID NO: 207544

SEQ ID NO: 208379 - RNA, 64 nt, Homo Sapiens; identical to SEQ ID NO: 207545

SEQ ID NO: 208380 - RNA, 64 nt, Homo Sapiens; identical to SEQ ID NO: 207546

SEQ ID NO: 208381 - RNA, 64 nt, Homo Sapiens; identical to SEQ ID NO: 207547

SEQ ID NO: 208382 - RNA, 64 nt, Homo Sapiens; identical to SEQ ID NO: 207548

SEQ ID NO: 208383 - RNA, 64 nt, Homo Sapiens; identical to SEQ ID NO: 207549

SEQ ID NO: 208384 - RNA, 64 nt, Homo Sapiens; identical to SEQ ID NO: 207550

SEQ ID NO: 208385 - RNA, 64 nt, Homo Sapiens; identical to SEQ ID NO: 207551

SEQ ID NO: 208386 - RNA, 64 nt, Homo Sapiens; identical to SEQ ID NO: 207552

SEQ ID NO: 208387 - RNA, 64 nt, Homo Sapiens; identical to SEQ ID NO: 207553

SEQ ID NO: 208388 - RNA, 64 nt, Homo Sapiens; identical to SEQ ID NO: 207554

SEQ ID NO: 208389 - RNA, 64 nt, Homo Sapiens; identical to SEQ ID NO: 207555

SEQ ID NO: 208390 - RNA, 64 nt, Homo Sapiens; identical to SEQ ID NO: 207556

SEQ ID NO: 208391 - RNA, 64 nt, Homo Sapiens; identical to SEQ ID NO: 207557

SEQ ID NO: 208392 - RNA, 64 nt, Homo Sapiens; identical to SEQ ID NO: 207558

SEQ ID NO: 208393 - RNA, 64 nt, Homo Sapiens; identical to SEQ ID NO: 207559

SEQ ID NO: 208394 - RNA, 64 nt, Homo Sapiens; identical to SEQ ID NO: 207560

SEQ ID NO: 208395 - RNA, 64 nt, Homo Sapiens; identical to SEQ ID NO: 207561

SEQ ID NO: 208396 - RNA, 64 nt, Homo Sapiens; identical to SEQ ID NO: 207562

SEQ ID NO: 208397 - RNA, 64 nt, Homo Sapiens; identical to SEQ ID NO: 207563

SEQ ID NO: 208398 - RNA, 64 nt, Homo Sapiens; identical to SEQ ID NO: 207564

SEQ ID NO: 208399 - RNA, 64 nt, Homo Sapiens; identical to SEQ ID NO: 207565

SEQ ID NO: 208400 - RNA, 64 nt, Homo Sapiens; identical to SEQ ID NO: 207566

SEQ ID NO: 208401 - RNA, 64 nt, Homo Sapiens; identical to SEQ ID NO: 207567

SEQ ID NO: 208402 - RNA, 64 nt, Homo Sapiens; identical to SEQ ID NO: 207568

SEQ ID NO: 208403 - RNA, 64 nt, Homo Sapiens; identical to SEQ ID NO: 207569

SEQ ID NO: 208404 - RNA, 64 nt, Homo Sapiens; identical to SEQ ID NO: 207570

SEQ ID NO: 208405 - RNA, 64 nt, Homo Sapiens; identical to SEQ ID NO: 207571

SEQ ID NO: 208406 - RNA, 64 nt, Homo Sapiens; identical to SEQ ID NO: 207572

SEQ ID NO: 208407 - RNA, 64 nt, Homo Sapiens; identical to SEQ ID NO: 207573

SEQ ID NO: 208408 - RNA, 64 nt, Homo Sapiens; identical to SEQ ID NO: 207574

SEQ ID NO: 208409 - RNA, 64 nt, Homo Sapiens; identical to SEQ ID NO: 207575

SEQ ID NO: 208410 - RNA, 64 nt, Homo Sapiens; identical to SEQ ID NO: 207576

SEQ ID NO: 208411 - RNA, 64 nt, Homo Sapiens; identical to SEQ ID NO: 207577

SEQ ID NO: 208412 - RNA, 64 nt, Homo Sapiens; identical to SEQ ID NO: 207578

SEQ ID NO: 208413 - RNA, 64 nt, Homo Sapiens; identical to SEQ ID NO: 207579

SEQ ID NO: 208414 - RNA, 64 nt, Homo Sapiens; identical to SEQ ID NO: 207580

SEQ ID NO: 208415 - RNA, 64 nt, Homo Sapiens; identical to SEQ ID NO: 207581

SEQ ID NO: 208416 - RNA, 64 nt, Homo Sapiens; identical to SEQ ID NO: 207582

SEQ ID NO: 208417 - RNA, 64 nt, Homo Sapiens; identical to SEQ ID NO: 207583

SEQ ID NO: 208418 - RNA, 64 nt, Homo Sapiens; identical to SEQ ID NO: 207584

SEQ ID NO: 208419 - RNA, 64 nt, Homo Sapiens; identical to SEQ ID NO: 207585

SEQ ID NO: 208420 - RNA, 64 nt, Homo Sapiens; identical to SEQ ID NO: 207586

SEQ ID NO: 208421 - RNA, 64 nt, Homo Sapiens; identical to SEQ ID NO: 207587

SEQ ID NO: 208422 - RNA, 64 nt, Homo Sapiens; identical to SEQ ID NO: 207588

SEQ ID NO: 208423 - RNA, 64 nt, Homo Sapiens; identical to SEQ ID NO: 207589

SEQ ID NO: 208424 - RNA, 64 nt, Homo Sapiens; identical to SEQ ID NO: 207590

SEQ ID NO: 208425 - RNA, 64 nt, Homo Sapiens; identical to SEQ ID NO: 207591

SEQ ID NO: 208426 - RNA, 64 nt, Homo Sapiens; identical to SEQ ID NO: 207592

SEQ ID NO: 208427 - RNA, 64 nt, Homo Sapiens; identical to SEQ ID NO: 207593

SEQ ID NO: 208428 - RNA, 64 nt, Homo Sapiens; identical to SEQ ID NO: 207594

SEQ ID NO: 208429 - RNA, 64 nt, Homo Sapiens; identical to SEQ ID NO: 207595

SEQ ID NO: 208430 - RNA, 64 nt, Homo Sapiens; identical to SEQ ID NO: 207596

SEQ ID NO: 208431 - RNA, 64 nt, Homo Sapiens; identical to SEQ ID NO: 207597

SEQ ID NO: 208432 - RNA, 64 nt, Homo Sapiens; identical to SEQ ID NO: 207598

SEQ ID NO: 208433 - RNA, 64 nt, Homo Sapiens; identical to SEQ ID NO: 207599

SEQ ID NO: 208434 - RNA, 64 nt, Homo Sapiens; identical to SEQ ID NO: 207600

SEQ ID NO: 208435 - RNA, 64 nt, Homo Sapiens; identical to SEQ ID NO: 207601

SEQ ID NO: 208436 - RNA, 64 nt, Homo Sapiens; identical to SEQ ID NO: 207602

SEQ ID NO: 208437 - RNA, 64 nt, Homo Sapiens; identical to SEQ ID NO: 207603

SEQ ID NO: 208438 - RNA, 64 nt, Homo Sapiens; identical to SEQ ID NO: 207604

SEQ ID NO: 208439 - RNA, 64 nt, Homo Sapiens; identical to SEQ ID NO: 207605

SEQ ID NO: 208440 - RNA, 64 nt, Homo Sapiens; identical to SEQ ID NO: 207606

SEQ ID NO: 208441 - RNA, 64 nt, Homo Sapiens; identical to SEQ ID NO: 207607

SEQ ID NO: 208442 - RNA, 64 nt, Homo Sapiens; identical to SEQ ID NO: 207608

SEQ ID NO: 208443 - RNA, 64 nt, Homo Sapiens; identical to SEQ ID NO: 207609

SEQ ID NO: 208444 - RNA, 64 nt, Homo Sapiens; identical to SEQ ID NO: 207610

SEQ ID NO: 208445 - RNA, 64 nt, Homo Sapiens; identical to SEQ ID NO: 207611

SEQ ID NO: 208446 - RNA, 64 nt, Homo Sapiens; identical to SEQ ID NO: 207612

SEQ ID NO: 208447 - RNA, 64 nt, Homo Sapiens; identical to SEQ ID NO: 207613

SEQ ID NO: 208448 - RNA, 64 nt, Homo Sapiens; identical to SEQ ID NO: 207614

SEQ ID NO: 208449 - RNA, 64 nt, Homo Sapiens; identical to SEQ ID NO: 207615

SEQ ID NO: 208450 - RNA, 64 nt, Homo Sapiens; identical to SEQ ID NO: 207616

SEQ ID NO: 208451 - RNA, 64 nt, Homo Sapiens; identical to SEQ ID NO: 207617

SEQ ID NO: 208452 - RNA, 64 nt, Homo Sapiens; identical to SEQ ID NO: 207618

SEQ ID NO: 208453 - RNA, 64 nt, Homo Sapiens; identical to SEQ ID NO: 207619

SEQ ID NO: 208454 - RNA, 64 nt, Homo Sapiens; identical to SEQ ID NO: 207620

SEQ ID NO: 208455 - RNA, 64 nt, Homo Sapiens; identical to SEQ ID NO: 207621

SEQ ID NO: 208456 - RNA, 64 nt, Homo Sapiens; identical to SEQ ID NO: 207622

SEQ ID NO: 208457 - RNA, 64 nt, Homo Sapiens; identical to SEQ ID NO: 207623

SEQ ID NO: 208458 - RNA, 64 nt, Homo Sapiens; identical to SEQ ID NO: 207624

SEQ ID NO: 208459 - RNA, 64 nt, Homo Sapiens; identical to SEQ ID NO: 207625

SEQ ID NO: 208460 - RNA, 64 nt, Homo Sapiens; identical to SEQ ID NO: 207626

SEQ ID NO: 208461 - RNA, 64 nt, Homo Sapiens; identical to SEQ ID NO: 207627

SEQ ID NO: 208462 - RNA, 64 nt, Homo Sapiens; identical to SEQ ID NO: 207628

SEQ ID NO: 208463 - RNA, 64 nt, Homo Sapiens; identical to SEQ ID NO: 207629

SEQ ID NO: 208464 - RNA, 64 nt, Homo Sapiens; identical to SEQ ID NO: 207630

SEQ ID NO: 208465 - RNA, 64 nt, Homo Sapiens; identical to SEQ ID NO: 207631

SEQ ID NO: 208466 - RNA, 64 nt, Homo Sapiens; identical to SEQ ID NO: 207632

SEQ ID NO: 208467 - RNA, 64 nt, Homo Sapiens; identical to SEQ ID NO: 207633

SEQ ID NO: 208468 - RNA, 64 nt, Homo Sapiens; identical to SEQ ID NO: 207634

SEQ ID NO: 208469 - RNA, 64 nt, Homo Sapiens; identical to SEQ ID NO: 207635

SEQ ID NO: 208470 - RNA, 64 nt, Homo Sapiens; identical to SEQ ID NO: 207636

SEQ ID NO: 208471 - RNA, 64 nt, Homo Sapiens; identical to SEQ ID NO: 207637

SEQ ID NO: 208472 - RNA, 64 nt, Homo Sapiens; identical to SEQ ID NO: 207638

SEQ ID NO: 208473 - RNA, 64 nt, Homo Sapiens; identical to SEQ ID NO: 207639

SEQ ID NO: 208474 - RNA, 64 nt, Homo Sapiens; identical to SEQ ID NO: 207640

SEQ ID NO: 208475 - RNA, 64 nt, Homo Sapiens; identical to SEQ ID NO: 207641

SEQ ID NO: 208476 - RNA, 64 nt, Homo Sapiens; identical to SEQ ID NO: 207642

SEQ ID NO: 208477 - RNA, 64 nt, Homo Sapiens; identical to SEQ ID NO: 207643

SEQ ID NO: 208478 - RNA, 64 nt, Homo Sapiens; identical to SEQ ID NO: 207644

SEQ ID NO: 208479 - RNA, 64 nt, Homo Sapiens; identical to SEQ ID NO: 207645

SEQ ID NO: 208480 - RNA, 64 nt, Homo Sapiens; identical to SEQ ID NO: 207646

SEQ ID NO: 208481 - RNA, 64 nt, Homo Sapiens; identical to SEQ ID NO: 207647

SEQ ID NO: 208482 - RNA, 64 nt, Homo Sapiens; identical to SEQ ID NO: 207648

SEQ ID NO: 208483 - RNA, 64 nt, Homo Sapiens; identical to SEQ ID NO: 207649

SEQ ID NO: 208484 - RNA, 64 nt, Homo Sapiens; identical to SEQ ID NO: 207650

SEQ ID NO: 208485 - RNA, 64 nt, Homo Sapiens; identical to SEQ ID NO: 207651

SEQ ID NO: 208486 - RNA, 64 nt, Homo Sapiens; identical to SEQ ID NO: 207652

SEQ ID NO: 208487 - RNA, 64 nt, Homo Sapiens; identical to SEQ ID NO: 207653

SEQ ID NO: 208488 - RNA, 64 nt, Homo Sapiens; identical to SEQ ID NO: 207654

SEQ ID NO: 208489 - RNA, 64 nt, Homo Sapiens; identical to SEQ ID NO: 207655

SEQ ID NO: 208490 - RNA, 64 nt, Homo Sapiens; identical to SEQ ID NO: 207656

SEQ ID NO: 208491 - RNA, 64 nt, Homo Sapiens; identical to SEQ ID NO: 207657

SEQ ID NO: 208492 - RNA, 64 nt, Homo Sapiens; identical to SEQ ID NO: 207658

SEQ ID NO: 208493 - RNA, 64 nt, Homo Sapiens; identical to SEQ ID NO: 207659

SEQ ID NO: 208494 - RNA, 64 nt, Homo Sapiens; identical to SEQ ID NO: 207660

SEQ ID NO: 208495 - RNA, 64 nt, Homo Sapiens; identical to SEQ ID NO: 207661

SEQ ID NO: 208496 - RNA, 64 nt, Homo Sapiens; identical to SEQ ID NO: 207662

SEQ ID NO: 208497 - RNA, 64 nt, Homo Sapiens; identical to SEQ ID NO: 207663

SEQ ID NO: 208498 - RNA, 64 nt, Homo Sapiens; identical to SEQ ID NO: 207664

SEQ ID NO: 208499 - RNA, 64 nt, Homo Sapiens; identical to SEQ ID NO: 207665

SEQ ID NO: 208500 - RNA, 64 nt, Homo Sapiens; identical to SEQ ID NO: 207666

SEQ ID NO: 208501 - RNA, 64 nt, Homo Sapiens; identical to SEQ ID NO: 207667

SEQ ID NO: 208502 - RNA, 64 nt, Homo Sapiens; identical to SEQ ID NO: 207668

SEQ ID NO: 208503 - RNA, 64 nt, Homo Sapiens; identical to SEQ ID NO: 207669

SEQ ID NO: 208504 - RNA, 64 nt, Homo Sapiens; identical to SEQ ID NO: 207670

SEQ ID NO: 208505 - RNA, 64 nt, Homo Sapiens; identical to SEQ ID NO: 207671

SEQ ID NO: 208506 - RNA, 64 nt, Homo Sapiens; identical to SEQ ID NO: 207672

SEQ ID NO: 208507 - RNA, 64 nt, Homo Sapiens; identical to SEQ ID NO: 207673

SEQ ID NO: 208508 - RNA, 64 nt, Homo Sapiens; identical to SEQ ID NO: 207674

SEQ ID NO: 208509 - RNA, 64 nt, Homo Sapiens; identical to SEQ ID NO: 207675

SEQ ID NO: 208510 - RNA, 64 nt, Homo Sapiens; identical to SEQ ID NO: 207676

SEQ ID NO: 208511 - RNA, 64 nt, Homo Sapiens; identical to SEQ ID NO: 207677

SEQ ID NO: 208512 - RNA, 64 nt, Homo Sapiens; identical to SEQ ID NO: 207678

SEQ ID NO: 208513 - RNA, 64 nt, Homo Sapiens; identical to SEQ ID NO: 207679

SEQ ID NO: 208514 - RNA, 64 nt, Homo Sapiens; identical to SEQ ID NO: 207680

SEQ ID NO: 208515 - RNA, 64 nt, Homo Sapiens; identical to SEQ ID NO: 207681

SEQ ID NO: 208516 - RNA, 64 nt, Homo Sapiens; identical to SEQ ID NO: 207682

SEQ ID NO: 208517 - RNA, 64 nt, Homo Sapiens; identical to SEQ ID NO: 207683

SEQ ID NO: 208518 - RNA, 64 nt, Homo Sapiens; identical to SEQ ID NO: 207684

SEQ ID NO: 208519 - RNA, 64 nt, Homo Sapiens; identical to SEQ ID NO: 207685

SEQ ID NO: 208520 - RNA, 64 nt, Homo Sapiens; identical to SEQ ID NO: 207686

SEQ ID NO: 208521 - RNA, 64 nt, Homo Sapiens; identical to SEQ ID NO: 207687

SEQ ID NO: 208522 - RNA, 64 nt, Homo Sapiens; identical to SEQ ID NO: 207688

SEQ ID NO: 208523 - RNA, 64 nt, Homo Sapiens; identical to SEQ ID NO: 207689

SEQ ID NO: 208524 - RNA, 64 nt, Homo Sapiens; identical to SEQ ID NO: 207690

SEQ ID NO: 208525 - RNA, 64 nt, Homo Sapiens; identical to SEQ ID NO: 207691

SEQ ID NO: 208526 - RNA, 64 nt, Homo Sapiens; identical to SEQ ID NO: 207692

SEQ ID NO: 208527 - RNA, 64 nt, Homo Sapiens; identical to SEQ ID NO: 207693

SEQ ID NO: 208528 - RNA, 64 nt, Homo Sapiens; identical to SEQ ID NO: 207694

SEQ ID NO: 208529 - RNA, 64 nt, Homo Sapiens; identical to SEQ ID NO: 207695

SEQ ID NO: 208530 - RNA, 64 nt, Homo Sapiens; identical to SEQ ID NO: 207696

SEQ ID NO: 208531 - RNA, 64 nt, Homo Sapiens; identical to SEQ ID NO: 207697

SEQ ID NO: 208532 - RNA, 64 nt, Homo Sapiens; identical to SEQ ID NO: 207698

SEQ ID NO: 208533 - RNA, 64 nt, Homo Sapiens; identical to SEQ ID NO: 207699

SEQ ID NO: 208534 - RNA, 64 nt, Homo Sapiens; identical to SEQ ID NO: 207700

SEQ ID NO: 208535 - RNA, 64 nt, Homo Sapiens; identical to SEQ ID NO: 207701

SEQ ID NO: 208536 - RNA, 64 nt, Homo Sapiens; identical to SEQ ID NO: 207702

SEQ ID NO: 208537 - RNA, 64 nt, Homo Sapiens; identical to SEQ ID NO: 207703

SEQ ID NO: 208538 - RNA, 64 nt, Homo Sapiens; identical to SEQ ID NO: 207704

SEQ ID NO: 208539 - RNA, 64 nt, Homo Sapiens; identical to SEQ ID NO: 207705

SEQ ID NO: 208540 - RNA, 64 nt, Homo Sapiens; identical to SEQ ID NO: 207706

SEQ ID NO: 208541 - RNA, 64 nt, Homo Sapiens; identical to SEQ ID NO: 207707

SEQ ID NO: 208542 - RNA, 64 nt, Homo Sapiens; identical to SEQ ID NO: 207708

SEQ ID NO: 208543 - RNA, 64 nt, Homo Sapiens; identical to SEQ ID NO: 207709

SEQ ID NO: 208544 - RNA, 64 nt, Homo Sapiens; identical to SEQ ID NO: 207710

SEQ ID NO: 208545 - RNA, 64 nt, Homo Sapiens; identical to SEQ ID NO: 207711

SEQ ID NO: 208546 - RNA, 64 nt, Homo Sapiens; identical to SEQ ID NO: 207712

SEQ ID NO: 208547 - RNA, 64 nt, Homo Sapiens; identical to SEQ ID NO: 207713

SEQ ID NO: 208548 - RNA, 64 nt, Homo Sapiens; identical to SEQ ID NO: 207714

SEQ ID NO: 208549 - RNA, 64 nt, Homo Sapiens; identical to SEQ ID NO: 207715

SEQ ID NO: 208550 - RNA, 64 nt, Homo Sapiens; identical to SEQ ID NO: 207716

SEQ ID NO: 208551 - RNA, 64 nt, Homo Sapiens; identical to SEQ ID NO: 207717

SEQ ID NO: 208552 - RNA, 64 nt, Homo Sapiens; identical to SEQ ID NO: 207718

SEQ ID NO: 208553 - RNA, 64 nt, Homo Sapiens; identical to SEQ ID NO: 207719

SEQ ID NO: 208554 - RNA, 64 nt, Homo Sapiens; identical to SEQ ID NO: 207720

SEQ ID NO: 208555 - RNA, 64 nt, Homo Sapiens; identical to SEQ ID NO: 207721

SEQ ID NO: 208556 - RNA, 64 nt, Homo Sapiens; identical to SEQ ID NO: 207722

SEQ ID NO: 208557 - RNA, 64 nt, Homo Sapiens; identical to SEQ ID NO: 207723

SEQ ID NO: 208558 - RNA, 64 nt, Homo Sapiens; identical to SEQ ID NO: 207724

SEQ ID NO: 208559 - RNA, 64 nt, Homo Sapiens; identical to SEQ ID NO: 207725

SEQ ID NO: 208560 - RNA, 64 nt, Homo Sapiens; identical to SEQ ID NO: 207726

SEQ ID NO: 208561 - RNA, 64 nt, Homo Sapiens; identical to SEQ ID NO: 207727

SEQ ID NO: 208562 - RNA, 64 nt, Homo Sapiens; identical to SEQ ID NO: 207728

SEQ ID NO: 208563 - RNA, 64 nt, Homo Sapiens; identical to SEQ ID NO: 207729

SEQ ID NO: 208564 - RNA, 64 nt, Homo Sapiens; identical to SEQ ID NO: 207730

SEQ ID NO: 208565 - RNA, 64 nt, Homo Sapiens; identical to SEQ ID NO: 207731

SEQ ID NO: 208566 - RNA, 64 nt, Homo Sapiens; identical to SEQ ID NO: 207732

SEQ ID NO: 208567 - RNA, 64 nt, Homo Sapiens; identical to SEQ ID NO: 207733

SEQ ID NO: 208568 - RNA, 64 nt, Homo Sapiens; identical to SEQ ID NO: 207734

SEQ ID NO: 208569 - RNA, 64 nt, Homo Sapiens; identical to SEQ ID NO: 133159

SEQ ID NO: 208570 - RNA, 64 nt, Homo Sapiens; identical to SEQ ID NO: 133160

SEQ ID NO: 208571 - RNA, 64 nt, Homo Sapiens; identical to SEQ ID NO: 133161

SEQ ID NO: 208572 - RNA, 64 nt, Homo Sapiens; identical to SEQ ID NO: 133162

SEQ ID NO: 208573 - RNA, 64 nt, Homo Sapiens; identical to SEQ ID NO: 133163

SEQ ID NO: 208574 - RNA, 64 nt, Homo Sapiens; identical to SEQ ID NO: 133164

SEQ ID NO: 208575 - RNA, 64 nt, Homo Sapiens; identical to SEQ ID NO: 133165

SEQ ID NO: 208576 - RNA, 64 nt, Homo Sapiens; identical to SEQ ID NO: 133166

SEQ ID NO: 208577 - RNA, 64 nt, Homo Sapiens; identical to SEQ ID NO: 133167

SEQ ID NO: 208578 - RNA, 64 nt, Homo Sapiens; identical to SEQ ID NO: 133168

SEQ ID NO: 208579 - RNA, 64 nt, Homo Sapiens; identical to SEQ ID NO: 133169

SEQ ID NO: 208580 - RNA, 64 nt, Homo Sapiens; identical to SEQ ID NO: 133170

SEQ ID NO: 208581 - RNA, 64 nt, Homo Sapiens; identical to SEQ ID NO: 133171

SEQ ID NO: 208582 - RNA, 64 nt, Homo Sapiens; identical to SEQ ID NO: 133172

SEQ ID NO: 208583 - RNA, 64 nt, Homo Sapiens; identical to SEQ ID NO: 133173

SEQ ID NO: 208584 - RNA, 64 nt, Homo Sapiens; identical to SEQ ID NO: 133174

SEQ ID NO: 208585 - RNA, 64 nt, Homo Sapiens; identical to SEQ ID NO: 133175

SEQ ID NO: 208586 - RNA, 64 nt, Homo Sapiens; identical to SEQ ID NO: 133176

SEQ ID NO: 208587 - RNA, 64 nt, Homo Sapiens; identical to SEQ ID NO: 133177

SEQ ID NO: 208588 - RNA, 64 nt, Homo Sapiens; identical to SEQ ID NO: 133178

SEQ ID NO: 208589 - RNA, 64 nt, Homo Sapiens; identical to SEQ ID NO: 133179

SEQ ID NO: 208590 - RNA, 64 nt, Homo Sapiens; identical to SEQ ID NO: 133180

SEQ ID NO: 208591 - RNA, 64 nt, Homo Sapiens; identical to SEQ ID NO: 133181

SEQ ID NO: 208592 - RNA, 64 nt, Homo Sapiens; identical to SEQ ID NO: 133182

SEQ ID NO: 208593 - RNA, 64 nt, Homo Sapiens; identical to SEQ ID NO: 133183

SEQ ID NO: 208594 - RNA, 64 nt, Homo Sapiens; identical to SEQ ID NO: 133184

SEQ ID NO: 208595 - RNA, 64 nt, Homo Sapiens; identical to SEQ ID NO: 133185

SEQ ID NO: 208596 - RNA, 64 nt, Homo Sapiens; identical to SEQ ID NO: 133186

SEQ ID NO: 208597 - RNA, 64 nt, Homo Sapiens; identical to SEQ ID NO: 133187

SEQ ID NO: 208598 - RNA, 64 nt, Homo Sapiens; identical to SEQ ID NO: 133188

SEQ ID NO: 208599 - RNA, 64 nt, Homo Sapiens; identical to SEQ ID NO: 133189

SEQ ID NO: 208600 - RNA, 64 nt, Homo Sapiens; identical to SEQ ID NO: 133190

SEQ ID NO: 208601 - RNA, 64 nt, Homo Sapiens; identical to SEQ ID NO: 133191

SEQ ID NO: 208602 - RNA, 64 nt, Homo Sapiens; identical to SEQ ID NO: 133192

SEQ ID NO: 208603 - RNA, 64 nt, Homo Sapiens; identical to SEQ ID NO: 133193

SEQ ID NO: 208604 - RNA, 64 nt, Homo Sapiens; identical to SEQ ID NO: 133194

SEQ ID NO: 208605 - RNA, 64 nt, Homo Sapiens; identical to SEQ ID NO: 133195

SEQ ID NO: 208606 - RNA, 64 nt, Homo Sapiens; identical to SEQ ID NO: 133196

SEQ ID NO: 208607 - RNA, 64 nt, Homo Sapiens; identical to SEQ ID NO: 133197

SEQ ID NO: 208608 - RNA, 64 nt, Homo Sapiens; identical to SEQ ID NO: 133198

SEQ ID NO: 208609 - RNA, 64 nt, Homo Sapiens; identical to SEQ ID NO: 133199

SEQ ID NO: 208610 - RNA, 64 nt, Homo Sapiens; identical to SEQ ID NO: 133200

SEQ ID NO: 208611 - RNA, 64 nt, Homo Sapiens; identical to SEQ ID NO: 133201

SEQ ID NO: 208612 - RNA, 64 nt, Homo Sapiens; identical to SEQ ID NO: 133202

SEQ ID NO: 208613 - RNA, 64 nt, Homo Sapiens; identical to SEQ ID NO: 133203

SEQ ID NO: 208614 - RNA, 64 nt, Homo Sapiens
cccggcgccugccggcgggcuccgcucuugggacaccggagaaccuaucaugucagccagcggg

SEQ ID NO: 208615 - RNA, 64 nt, Homo Sapiens
gaaguguucuagugugguuuuggcucucguucucaccggagaagggugguauggggguuagcac

SEQ ID NO: 208616 - RNA, 64 nt, Homo Sapiens
ccagggggccggccggguucgccggggccuccccaccggagagcccaagcacagccuuauuucu

SEQ ID NO: 208617 - RNA, 64 nt, Homo Sapiens
ugguacccaguaagugguuauuuaauaagcaaucaccggagacugcccucacuauugaugcauu

SEQ ID NO: 208618 - RNA, 64 nt, Homo Sapiens
gaauguauuugcugacaacccucauuguguuucuaccggagagauacugcuuuaaucagaaacc

SEQ ID NO: 208619 - RNA, 64 nt, Homo Sapiens
uggccuuccuucccgccagagggcuugugaacagaccggagaggacaguggauuguuuauacuc

SEQ ID NO: 208620 - RNA, 64 nt, Homo Sapiens
ugugacaaggcuacgcugacaaucaguuaaacacaccggagaagaaccauuuacaugcaccuua

SEQ ID NO: 208621 - RNA, 64 nt, Homo Sapiens
auacagugacuuuaccucacacauugugcuuuagaccggagauauaguuucuuuugcacaugcu

SEQ ID NO: 208622 - RNA, 64 nt, Homo Sapiens
auucucaaaccuugauaaacauaagagaauucauaccggagagaaacuguacaaaugugaagaa

SEQ ID NO: 208623 - RNA, 64 nt, Homo Sapiens
aagaggagcccucccgcucacaggccuccuggugaccggagagaagagcggugccggcagcaag

SEQ ID NO: 208624 - RNA, 64 nt, Homo Sapiens
aucugccaucaaggcccuuaacccaaggaagaugaccggagaacuacgaccacuggaagccagc

SEQ ID NO: 208625 - RNA, 64 nt, Homo Sapiens
gaauaaauagaaccuguugugcaaccacgguuuaaccggagauuuugaggcuaggguguguuuc

SEQ ID NO: 208626 - RNA, 64 nt, Homo Sapiens
gggcuucugaacuuggacucgaagccgccaacccaccggagaggaagacuagcgcggccaccgc

SEQ ID NO: 208627 - RNA, 64 nt, Homo Sapiens
gacaccgcucaucccgaucucuuccugucagaggaccggagaagugugagaaggugccccuuca

SEQ ID NO: 208628 - RNA, 64 nt, Homo Sapiens
aacuuuuuaaaugccuucagguaagagaauucacaccggagaacaaugcucagcccuucucguu

SEQ ID NO: 208629 - RNA, 64 nt, Homo Sapiens
gaaauccuuuaguuauaacucagccuuuaggaacaccggagaacccacaauaauagaaaucuuu

SEQ ID NO: 208630 - RNA, 64 nt, Homo Sapiens
guguguggaaagcgcugugggggaagagccggucaccggagagugagcaggcggagacuccaag

SEQ ID NO: 208631 - RNA, 64 nt, Homo Sapiens
agugccgaugaccacguuuuaccucacggaugugaccggagauggcuucuguggcucuucacag

SEQ ID NO: 208632 - RNA, 64 nt, Homo Sapiens
agugauuggaaaugaacucugcuuaggaacaagaaccggagagaugaucaucuuggcuugggcc

SEQ ID NO: 208633 - RNA, 64 nt, Homo Sapiens
gggcccagaagcuuuagagguaugaggcugcagaaccggagagauuuuccucugugcagugcuc

SEQ ID NO: 208634 - RNA, 64 nt, Homo Sapiens
uauccugauaaauuaaccucccgccuaguuaccuaccggagagucaguaugaaaaucagcaugc

SEQ ID NO: 208635 - RNA, 64 nt, Homo Sapiens
uaacauguaguauuugugcuuuuagcaacuaauaaccggagaacgcccaguggcucuuaaacag

SEQ ID NO: 208636 - RNA, 64 nt, Homo Sapiens; identical to SEQ ID NO: 208628

SEQ ID NO: 208637 - RNA, 64 nt, Homo Sapiens
accuuggaccuguuaggcgcagggcagcucccagaccggagaggagaaugcucgaggggcgcag

SEQ ID NO: 208638 - RNA, 64 nt, Homo Sapiens
acuccguggauagagaggcacacugucagaggugaccggagaacugaguugcaaaauauauuaa

SEQ ID NO: 208639 - RNA, 64 nt, Homo Sapiens
uuuaaugucaagauguguuuucccacauaaauucaccggagacauccgggccccgcuucgaugu

SEQ ID NO: 208640 - RNA, 64 nt, Homo Sapiens
cugagccuuucccucuaggcccugagguacaggaaccggagaaacguccccucaccccaucccu

SEQ ID NO: 208641 - RNA, 64 nt, Homo Sapiens
cuuggguucucccgucucacucauuugggaucagaccggagaccuuaccugguaccuaaagguu

SEQ ID NO: 208642 - RNA, 64 nt, Homo Sapiens
agcuugugagcucaccaaacaguuacaagaaauuaccggagaaaguuaaaaaucuauacuggac

SEQ ID NO: 208643 - RNA, 64 nt, Homo Sapiens
agagcuaugguuaguuacacuuugucccagccuuaccggagaaacuuggcaagaccgaggucga

SEQ ID NO: 208644 - RNA, 64 nt, Homo Sapiens
accuugggaaaugaguugaugucuccgguaaaacaccggagacuaauuccugcccugcccaauu

SEQ ID NO: 208645 - RNA, 64 nt, Homo Sapiens
aagugcggguccggcagcuucugcccccugcagaaccggagagccagcuaagggguggggcugc

SEQ ID NO: 208646 - RNA, 64 nt, Homo Sapiens
uacuacugauggccuuucgggggucccugccccaaccggagaggccggugcacagggccccgcc

SEQ ID NO: 208647 - RNA, 64 nt, Homo Sapiens
uaguauuagccaccccccuccaucuguucccagcaccggagaagggggugcucagguggaggug

SEQ ID NO: 208648 - RNA, 64 nt, Homo Sapiens
uggaacuucagaauaggucaaggguugaggauggaccggagaauaacaggcaugggaaaaugga

SEQ ID NO: 208649 - RNA, 64 nt, Homo Sapiens
ggggguggggggucccaaagggcauggacaauggaccggagaguacuucugcacuugcgguucc

SEQ ID NO: 208650 - RNA, 64 nt, Homo Sapiens
cuacugaccuucucaccuccggccucugccuuccaccggagagacccagccaguccuggugacu

SEQ ID NO: 208651 - RNA, 64 nt, Homo Sapiens
cccaggacgcccucacugcacaaggguggugagaaccggagaacguggacuagacggcguggcc

SEQ ID NO: 208652 - RNA, 64 nt, Homo Sapiens
ucuucccccaggcccuccccagccgacgacagccaccggagaggagaucggaacacgauugucu

SEQ ID NO: 208653 - RNA, 64 nt, Homo Sapiens
ucuccccgccgcccccaacaggcugucaaacaaaaccggagagggggugggggagccagccucc

SEQ ID NO: 208654 - RNA, 64 nt, Homo Sapiens
gguuaugaagaugguugaacaccccacacauagcaccggagauaugagaucaacaguuucuuag

SEQ ID NO: 208655 - RNA, 64 nt, Homo Sapiens
aaagguccgcuugcacuuuuucagguuacaauaaaccggagagaucaacgacaguauugagugg

SEQ ID NO: 208656 - RNA, 64 nt, Homo Sapiens
uccucuaaccgguaccucugaauggggcuggauaaccggagaccccaugggaggucccugaaga

SEQ ID NO: 208657 - RNA, 64 nt, Homo Sapiens
uuucucuagacuauuaggcuggcaucgucuuggaaccggagaauaauuaauggcuacauagcaa

SEQ ID NO: 208658 - RNA, 64 nt, Homo Sapiens
gauggcucaugaggcuuggacucacagggcuuggaccggagagaacguggugugagagggacgg

SEQ ID NO: 208659 - RNA, 64 nt, Homo Sapiens
gccggccccucaccuaacagcugguuccuaccagaccggagaggggagaagucauguugccccu

SEQ ID NO: 208660 - RNA, 64 nt, Homo Sapiens
cauguuggauuccguccccaccacacuuccagagaccggagaacugugcagggccuaaggccgu

SEQ ID NO: 208661 - RNA, 64 nt, Homo Sapiens
acagaauuaccucugcucuugaucgugcugcacaaccggagaaguggcaugacgagcuggagca

SEQ ID NO: 208662 - RNA, 64 nt, Homo Sapiens
cacgggaaaggggucgggacaccgaggggcggacaccggagagagagggcgacacagacacggg

SEQ ID NO: 208663 - RNA, 64 nt, Homo Sapiens
ucccugguaucuauaaacccuuuucaggggagagaccggagaccccaucuuagauacugucaac

SEQ ID NO: 208664 - RNA, 64 nt, Homo Sapiens
aguuuuauccuguguugggggcaaucauuucugcaccggagaugugacaugagaaaggucuuua

SEQ ID NO: 208665 - RNA, 64 nt, Homo Sapiens; identical to SEQ ID NO: 201634

SEQ ID NO: 208666 - RNA, 64 nt, Homo Sapiens; identical to SEQ ID NO: 201635

SEQ ID NO: 208667 - RNA, 64 nt, Homo Sapiens; identical to SEQ ID NO: 201636

SEQ ID NO: 208668 - RNA, 64 nt, Homo Sapiens; identical to SEQ ID NO: 201637

SEQ ID NO: 208669 - RNA, 64 nt, Homo Sapiens; identical to SEQ ID NO: 201638

SEQ ID NO: 208670 - RNA, 64 nt, Homo Sapiens; identical to SEQ ID NO: 201639

SEQ ID NO: 208671 - RNA, 64 nt, Homo Sapiens; identical to SEQ ID NO: 201640

SEQ ID NO: 208672 - RNA, 64 nt, Homo Sapiens; identical to SEQ ID NO: 201641

SEQ ID NO: 208673 - RNA, 64 nt, Homo Sapiens; identical to SEQ ID NO: 201642

SEQ ID NO: 208674 - RNA, 64 nt, Homo Sapiens; identical to SEQ ID NO: 201643

SEQ ID NO: 208675 - RNA, 64 nt, Homo Sapiens; identical to SEQ ID NO: 201644

SEQ ID NO: 208676 - RNA, 64 nt, Homo Sapiens; identical to SEQ ID NO: 201645

SEQ ID NO: 208677 - RNA, 64 nt, Homo Sapiens; identical to SEQ ID NO: 201646

SEQ ID NO: 208678 - RNA, 64 nt, Homo Sapiens; identical to SEQ ID NO: 201647

SEQ ID NO: 208679 - RNA, 64 nt, Homo Sapiens; identical to SEQ ID NO: 201648

SEQ ID NO: 208680 - RNA, 64 nt, Homo Sapiens; identical to SEQ ID NO: 201649

SEQ ID NO: 208681 - RNA, 64 nt, Homo Sapiens; identical to SEQ ID NO: 201650

SEQ ID NO: 208682 - RNA, 64 nt, Homo Sapiens; identical to SEQ ID NO: 201651

SEQ ID NO: 208683 - RNA, 64 nt, Homo Sapiens; identical to SEQ ID NO: 201652

SEQ ID NO: 208684 - RNA, 64 nt, Homo Sapiens; identical to SEQ ID NO: 201653

SEQ ID NO: 208685 - RNA, 64 nt, Homo Sapiens; identical to SEQ ID NO: 201654

SEQ ID NO: 208686 - RNA, 64 nt, Homo Sapiens; identical to SEQ ID NO: 201655

SEQ ID NO: 208687 - RNA, 64 nt, Homo Sapiens; identical to SEQ ID NO: 201656

SEQ ID NO: 208688 - RNA, 64 nt, Homo Sapiens; identical to SEQ ID NO: 201657

SEQ ID NO: 208689 - RNA, 64 nt, Homo Sapiens; identical to SEQ ID NO: 201658

SEQ ID NO: 208690 - RNA, 64 nt, Homo Sapiens; identical to SEQ ID NO: 201659

SEQ ID NO: 208691 - RNA, 64 nt, Homo Sapiens; identical to SEQ ID NO: 201660

SEQ ID NO: 208692 - RNA, 64 nt, Homo Sapiens; identical to SEQ ID NO: 201661

SEQ ID NO: 208693 - RNA, 64 nt, Homo Sapiens; identical to SEQ ID NO: 201662

SEQ ID NO: 208694 - RNA, 64 nt, Homo Sapiens; identical to SEQ ID NO: 201663

SEQ ID NO: 208695 - RNA, 64 nt, Homo Sapiens; identical to SEQ ID NO: 201664

SEQ ID NO: 208696 - RNA, 64 nt, Homo Sapiens; identical to SEQ ID NO: 201665

SEQ ID NO: 208697 - RNA, 64 nt, Homo Sapiens; identical to SEQ ID NO: 201666

SEQ ID NO: 208698 - RNA, 64 nt, Homo Sapiens; identical to SEQ ID NO: 201667

SEQ ID NO: 208699 - RNA, 64 nt, Homo Sapiens; identical to SEQ ID NO: 201668

SEQ ID NO: 208700 - RNA, 64 nt, Homo Sapiens; identical to SEQ ID NO: 201669

SEQ ID NO: 208701 - RNA, 64 nt, Homo Sapiens; identical to SEQ ID NO: 201670

SEQ ID NO: 208702 - RNA, 64 nt, Homo Sapiens; identical to SEQ ID NO: 201671

SEQ ID NO: 208703 - RNA, 64 nt, Homo Sapiens; identical to SEQ ID NO: 201672

SEQ ID NO: 208704 - RNA, 64 nt, Homo Sapiens; identical to SEQ ID NO: 201673

SEQ ID NO: 208705 - RNA, 64 nt, Homo Sapiens; identical to SEQ ID NO: 201674

SEQ ID NO: 208706 - RNA, 64 nt, Homo Sapiens; identical to SEQ ID NO: 201675

SEQ ID NO: 208707 - RNA, 64 nt, Homo Sapiens; identical to SEQ ID NO: 201676

SEQ ID NO: 208708 - RNA, 64 nt, Homo Sapiens; identical to SEQ ID NO: 201677

SEQ ID NO: 208709 - RNA, 64 nt, Homo Sapiens; identical to SEQ ID NO: 201678

SEQ ID NO: 208710 - RNA, 64 nt, Homo Sapiens; identical to SEQ ID NO: 201679

SEQ ID NO: 208711 - RNA, 64 nt, Homo Sapiens; identical to SEQ ID NO: 201680

SEQ ID NO: 208712 - RNA, 64 nt, Homo Sapiens; identical to SEQ ID NO: 201681

SEQ ID NO: 208713 - RNA, 64 nt, Homo Sapiens; identical to SEQ ID NO: 201682

SEQ ID NO: 208714 - RNA, 64 nt, Homo Sapiens; identical to SEQ ID NO: 201683

SEQ ID NO: 208715 - RNA, 64 nt, Homo Sapiens; identical to SEQ ID NO: 201684

SEQ ID NO: 208716 - RNA, 64 nt, Homo Sapiens; identical to SEQ ID NO: 201685

SEQ ID NO: 208717 - RNA, 64 nt, Homo Sapiens; identical to SEQ ID NO: 201686

SEQ ID NO: 208718 - RNA, 64 nt, Homo Sapiens; identical to SEQ ID NO: 201687

SEQ ID NO: 208719 - RNA, 64 nt, Homo Sapiens; identical to SEQ ID NO: 201688

SEQ ID NO: 208720 - RNA, 64 nt, Homo Sapiens; identical to SEQ ID NO: 201689

SEQ ID NO: 208721 - RNA, 64 nt, Homo Sapiens; identical to SEQ ID NO: 201690

SEQ ID NO: 208722 - RNA, 64 nt, Homo Sapiens; identical to SEQ ID NO: 201691

SEQ ID NO: 208723 - RNA, 64 nt, Homo Sapiens; identical to SEQ ID NO: 201692

SEQ ID NO: 208724 - RNA, 64 nt, Homo Sapiens; identical to SEQ ID NO: 201693

SEQ ID NO: 208725 - RNA, 64 nt, Homo Sapiens; identical to SEQ ID NO: 201694

SEQ ID NO: 208726 - RNA, 64 nt, Homo Sapiens; identical to SEQ ID NO: 201695

SEQ ID NO: 208727 - RNA, 64 nt, Homo Sapiens; identical to SEQ ID NO: 201696

SEQ ID NO: 208728 - RNA, 64 nt, Homo Sapiens; identical to SEQ ID NO: 201697

SEQ ID NO: 208729 - RNA, 64 nt, Homo Sapiens; identical to SEQ ID NO: 201698

SEQ ID NO: 208730 - RNA, 64 nt, Homo Sapiens; identical to SEQ ID NO: 201699

SEQ ID NO: 208731 - RNA, 64 nt, Homo Sapiens; identical to SEQ ID NO: 201700

SEQ ID NO: 208732 - RNA, 64 nt, Homo Sapiens; identical to SEQ ID NO: 201701

SEQ ID NO: 208733 - RNA, 64 nt, Homo Sapiens; identical to SEQ ID NO: 201702

SEQ ID NO: 208734 - RNA, 64 nt, Homo Sapiens; identical to SEQ ID NO: 201703

SEQ ID NO: 208735 - RNA, 64 nt, Homo Sapiens; identical to SEQ ID NO: 201704

SEQ ID NO: 208736 - RNA, 64 nt, Homo Sapiens; identical to SEQ ID NO: 201705

SEQ ID NO: 208737 - RNA, 64 nt, Homo Sapiens; identical to SEQ ID NO: 201706

SEQ ID NO: 208738 - RNA, 64 nt, Homo Sapiens; identical to SEQ ID NO: 201707

SEQ ID NO: 208739 - RNA, 64 nt, Homo Sapiens; identical to SEQ ID NO: 201708

SEQ ID NO: 208740 - RNA, 64 nt, Homo Sapiens; identical to SEQ ID NO: 201709

SEQ ID NO: 208741 - RNA, 64 nt, Homo Sapiens; identical to SEQ ID NO: 201710

SEQ ID NO: 208742 - RNA, 64 nt, Homo Sapiens; identical to SEQ ID NO: 201711

SEQ ID NO: 208743 - RNA, 64 nt, Homo Sapiens; identical to SEQ ID NO: 201712

SEQ ID NO: 208744 - RNA, 64 nt, Homo Sapiens; identical to SEQ ID NO: 201713

SEQ ID NO: 208745 - RNA, 64 nt, Homo Sapiens; identical to SEQ ID NO: 201714

SEQ ID NO: 208746 - RNA, 64 nt, Homo Sapiens; identical to SEQ ID NO: 159255

SEQ ID NO: 208747 - RNA, 64 nt, Homo Sapiens; identical to SEQ ID NO: 159256

SEQ ID NO: 208748 - RNA, 64 nt, Homo Sapiens; identical to SEQ ID NO: 159257

SEQ ID NO: 208749 - RNA, 64 nt, Homo Sapiens; identical to SEQ ID NO: 159258

SEQ ID NO: 208750 - RNA, 64 nt, Homo Sapiens; identical to SEQ ID NO: 159259

SEQ ID NO: 208751 - RNA, 64 nt, Homo Sapiens; identical to SEQ ID NO: 159260

SEQ ID NO: 208752 - RNA, 59 nt, Homo Sapiens
ggaagcuguuccuggacugacugcuggcuggcgaggaggcugcgagcguggaaucggaa

SEQ ID NO: 208753 - RNA, 64 nt, Homo Sapiens
uguauuuuuaguagagaugggguuucaccguaucggcgaggaugaucucuaucucuugaccucg

SEQ ID NO: 208754 - RNA, 64 nt, Homo Sapiens
aaggagcagaggggugcggguaaacgaggaguggggcgaggaaagcgggaugggaacaaguggc

SEQ ID NO: 208755 - RNA, 64 nt, Homo Sapiens
ugcacacucagggccagacccaccauccuggacuggcgaggaagaucagugccuccugcucugc

SEQ ID NO: 208756 - RNA, 59 nt, Homo Sapiens
ccucccuguccaagaagugacuguugagaggcgaggagguagugggugaggcuaccuga

SEQ ID NO: 208757 - RNA, 64 nt, Homo Sapiens
ucaaggagaguugagauacagugaaaugagccagggcgaggagggagggugaaggaacggaggg

SEQ ID NO: 208758 - RNA, 58 nt, Homo Sapiens
augaugagaucgccguguaggugccgagggcgaggagauggaggcggcggcguggcug

SEQ ID NO: 208759 - RNA, 64 nt, Homo Sapiens
guggcacuucagcugccagcaggaggaggaggaaggcgaggacaggaggaagaggaggaggagg

SEQ ID NO: 208760 - RNA, 64 nt, Homo Sapiens
gugguuguugccaacuaagcgcaccuccugagaaggcgaggagagcagaggaccacagugggug

SEQ ID NO: 208761 - RNA, 64 nt, Homo Sapiens
ggauuuguggugcuuggaaggggaaagggaccugggcgaggagaccccacgaaggccagaaagg

SEQ ID NO: 208762 - RNA, 64 nt, Homo Sapiens
uggaguggcuguucuuaaugcaugaauguggcuaggcgaggagcaccuggacuuuaauugcacc

SEQ ID NO: 208763 - RNA, 64 nt, Homo Sapiens
gcgguccagaggcggccggcguuaggcuguggagggcgaggaagcccaaaugcgcccggaggcc

SEQ ID NO: 208764 - RNA, 64 nt, Homo Sapiens
auucuucaucauucaaguucuaccuggacacaaaggcgaggacccugggguuccaacaaagcuc

SEQ ID NO: 208765 - RNA, 64 nt, Homo Sapiens
cuucuuccuuccuuccccgagaaggccucaauguggcgaggaagaugcuggggccgguagggcu

SEQ ID NO: 208766 - RNA, 64 nt, Homo Sapiens
uggcacaagggauggggacgcgagggggaggggaggcgaggaacaaggagaaggggcaacuuuc

SEQ ID NO: 208767 - RNA, 64 nt, Homo Sapiens
accguuccaacagcauucacugccaguucuaauaggcgaggaaaaugcccgaggcgcugucuuc

SEQ ID NO: 208768 - RNA, 64 nt, Homo Sapiens
ugaaagcgauucuccuugaguauauuacaacaucggcgaggaaaaaauuacauuuauguuccua

SEQ ID NO: 208769 - RNA, 64 nt, Homo Sapiens
ccaagaacucacugaugcacacuauuugcuccuuggcgaggacuaagugccguaagaaaaagaa

SEQ ID NO: 208770 - RNA, 64 nt, Homo Sapiens
ugguuuguaagaggggaaagggcgaguuucuaaaggcgaggaaaagggcgcguuuggguuugau

SEQ ID NO: 208771 - RNA, 64 nt, Homo Sapiens
aguaauauuuagcauucaggaccucaggaggggaggcgaggaagcaggaauguuugcaugaccu

SEQ ID NO: 208772 - RNA, 64 nt, Homo Sapiens
cgugugcugcagcuacgggccagcuucaccucuuggcgaggaggcucggcaguaggcagcugug

SEQ ID NO: 208773 - RNA, 64 nt, Homo Sapiens
aggacggagcugcagacgaaggcaggggacccauggcgaggaggaauggccagcaccccaggca

SEQ ID NO: 208774 - RNA, 64 nt, Homo Sapiens
uucuguaaacuuaaaauuacaaugacaauucagaggcgaggagaugauaguauaaaaaaugguu

SEQ ID NO: 208775 - RNA, 64 nt, Homo Sapiens
gagacucuuuuaggaucagaucugugagcacguuggcgaggaaaaacaaaacaaacaaaaaaaa

SEQ ID NO: 208776 - RNA, 64 nt, Homo Sapiens
ccaaucauccaccagucagacugaauguguagcuggcgaggaauuacuuccacuucuggcccag

SEQ ID NO: 208777 - RNA, 64 nt, Homo Sapiens
cugcaccuggauggggguccgugcccuguacacaggcgaggaccaauuuggagugaccaaaggu

SEQ ID NO: 208778 - RNA, 64 nt, Homo Sapiens
ccaccuggacggggaggcggccaaaaagcugaugggcgaggaggcccuggcggggggcgacaag

SEQ ID NO: 208779 - RNA, 64 nt, Homo Sapiens
ggagaaggccaggggaaugaccuccuaauaggaaggcgaggagaaacaugaaaaaugaugggcu

SEQ ID NO: 208780 - RNA, 64 nt, Homo Sapiens
gagccgagacgucaacuguggagaagggugaccaggcgaggagggucugucuccaggcugggga

SEQ ID NO: 208781 - RNA, 64 nt, Homo Sapiens
guuggugaugaagcugaguuugaauucaacugaaggcgaggaaucucuacucccuuaacagugu

SEQ ID NO: 208782 - RNA, 64 nt, Homo Sapiens
acuguggccgaccgcagcugugccguggcacgauggcgaggaagccagccccaaggaaacacug

SEQ ID NO: 208783 - RNA, 64 nt, Homo Sapiens
ucccagaccacucaucacauaagccacuuuguuaggcgaggauuuucuucaggccuugaaucaa

SEQ ID NO: 208784 - RNA, 64 nt, Homo Sapiens
uccccguggcgcuguuugggacagcaacagugauggcgaggacugcagagcggggagcugcagc

SEQ ID NO: 208785 - RNA, 64 nt, Homo Sapiens
gagccagaaaacauagauccauuaauuggaguggggcgaggagaaggaugggguugggggcuaa

SEQ ID NO: 208786 - RNA, 64 nt, Homo Sapiens
ugcugcgcuuccuucacaugcuggcugucuggcuggcgaggagcucgacuccugcggugcgggg

SEQ ID NO: 208787 - RNA, 64 nt, Homo Sapiens
cgcggccggcggccucagaguccacggagcucgcggcgaggacgacuucugcuuuuguuguugu

SEQ ID NO: 208788 - RNA, 64 nt, Homo Sapiens
acuccuaaaccaaaagugcuuuaaaaaccagccuggcgaggacagcccuggacccacuccacug

SEQ ID NO: 208789 - RNA, 64 nt, Homo Sapiens
cccaggcuuaccuguaggacacuuaagaaucugaggcgaggacccgggguuccuuguguuaggg

SEQ ID NO: 208790 - RNA, 64 nt, Homo Sapiens
caguacagggucugaguucuccagcauccgagcuggcgaggaaagggcugcggggucaggggcu

SEQ ID NO: 208791 - RNA, 64 nt, Homo Sapiens
auuuuacaaaaauuauaaaaaaugaauuaguacuggcgaggacuaaaugaaacaauaauuuuuc

SEQ ID NO: 208792 - RNA, 64 nt, Homo Sapiens
ggacgggugguccggagggaggcuggagcggggaggcgaggagggggcugugaguccucagagg

SEQ ID NO: 208793 - RNA, 64 nt, Homo Sapiens
ugaagccucccgaacacgcaacccagggaccacgggcgaggacgcccccuggugccugcaggcc

SEQ ID NO: 208794 - RNA, 64 nt, Homo Sapiens
ccugcaccccaguauaaggggucgccugccauggggcgaggagguccccuccacuuggcugcaa

SEQ ID NO: 208795 - RNA, 64 nt, Homo Sapiens
cagcucacucgaggccuggggaaggggacucaggggcgaggaggaugacuggguccggucgcca

SEQ ID NO: 208796 - RNA, 64 nt, Homo Sapiens
cuggaaagcaggagggaacaaaggugaacaugaaggcgaggaugcuggggcccugcagugcgcu

SEQ ID NO: 208797 - RNA, 64 nt, Homo Sapiens
ucuuggcuggcguugcugacaaugccacgguaaaggcgaggaagagagccugaaaaacugcccc

SEQ ID NO: 208798 - RNA, 64 nt, Homo Sapiens
gccaagugcagcgaagggacgggguggggaggggggcgaggagaaggggagggggcgcccagga

SEQ ID NO: 208799 - RNA, 64 nt, Homo Sapiens
acccauggcugcuuugugucuuccccauaaaaaaggcgaggaaacuaggauugaaaggugcauu

SEQ ID NO: 208800 - RNA, 64 nt, Homo Sapiens
cccugcaugccuuccugcucgccccgagcggggaggcgaggaggcauccaggcugucaacacca

SEQ ID NO: 208801 - RNA, 64 nt, Homo Sapiens
ggccucuacugcccuggcugcagucagugcccagggcgaggaauguggccaggggauccaggac

SEQ ID NO: 208802 - RNA, 64 nt, Homo Sapiens
ucgggacggaggcagacgugaggcugucugguuuggcgaggacagcggccggagggcggguaca

SEQ ID NO: 208803 - RNA, 64 nt, Homo Sapiens
gccuggcgagcguggcccugguggguucagcgugggcgaggaaaggagcugcugugcccaggac

SEQ ID NO: 208804 - RNA, 64 nt, Homo Sapiens
auaaaugaaauuugcaaaauuuagguaauuguagggcgaggauuuuaaccugcagaaacaguac

SEQ ID NO: 208805 - RNA, 64 nt, Homo Sapiens
ggugggugggagacagggcuuuuucucucccucuggcgaggacucucaggauguagggacuugg

SEQ ID NO: 208806 - RNA, 64 nt, Homo Sapiens
caaggcccgauguggugugcagagguggggagguggcgaggauggggacagaaagcgcacagaa

SEQ ID NO: 208807 - RNA, 64 nt, Homo Sapiens
aaacuuguagguguuuaagaauugguuuugggagggcgaggacugggccagguuagaggcagau

SEQ ID NO: 208808 - RNA, 64 nt, Homo Sapiens
gagccaggcccggcaugaggggagacaggaauggggcgaggaaggccacggugagggcuuggaa

SEQ ID NO: 208809 - RNA, 64 nt, Homo Sapiens
cugcccgccgagcggacugaaggcgccuggaccuggcgaggacgugcccccuccuccccggcca

SEQ ID NO: 208810 - RNA, 64 nt, Homo Sapiens
uuugaacgugucugaaggguccugauaggcucucggcgaggagcgaaugaccaacucuuaaaag

SEQ ID NO: 208811 - RNA, 64 nt, Homo Sapiens
uucucuggagcuuugggccucagggcgccuagaaggcgaggacgcagaccugaaggcggccggu

SEQ ID NO: 208812 - RNA, 64 nt, Homo Sapiens
uuaauauuaccaacuacauuggaagccugagcagggcgaggaccaauaauuuuaauuauuuaua

SEQ ID NO: 208813 - RNA, 64 nt, Homo Sapiens
ccuggcuucucugugagcacggaugcacagcccaggcgaggaagccagcugcagccuaggcagg

SEQ ID NO: 208814 - RNA, 64 nt, Homo Sapiens
auagacaguguggagacauucuaagugacucaugggcgaggagcacugauuauagagaaggcua

SEQ ID NO: 208815 - RNA, 64 nt, Homo Sapiens
auagaaugaaugaccccaaaauaggguuuucuugggcgaggaugugcuggauuaggaaagguga

SEQ ID NO: 208816 - RNA, 64 nt, Homo Sapiens
cuauguacagaacuuuaaacaauauaguauuuauggcgaggacagcuguagucuguugugauau

SEQ ID NO: 208817 - RNA, 64 nt, Homo Sapiens
aaucggggugguggcaauggucguggaggccgagggcgaggaggacccaugggccguggaggcu

SEQ ID NO: 208818 - RNA, 64 nt, Homo Sapiens
agaaucacugaggcaccaauggcugagcaggaagggcgaggagacaccuugaucagcgucccag

SEQ ID NO: 208819 - RNA, 64 nt, Homo Sapiens
ugccgcagaggccggagaccuccuggacuaguucggcgaggagacuggccacuggggguggcug

SEQ ID NO: 208820 - RNA, 64 nt, Homo Sapiens
ugaagcuggacaagagccucaauaaggacacccuggcgaggaagcuggcagugcucaccccagg

SEQ ID NO: 208821 - RNA, 64 nt, Homo Sapiens
guguguggguggccccuuaagcugguguguucaaggcgaggacgaauccauaacugauuuccaa

SEQ ID NO: 208822 - RNA, 57 nt, Homo Sapiens
cgagaccucuuucguuccuuugcaccaggcgaggaaacacaggaaacuucgcaguga

SEQ ID NO: 208823 - RNA, 64 nt, Homo Sapiens
ucgcguuucaggggagggccccgccucuccauggggcgaggacugauccgggaauaaagaaugu

SEQ ID NO: 208824 - RNA, 64 nt, Homo Sapiens
cucugggcagacccaagaaccuccuuagggggugggcgaggagcuugcagagcuggccagcccc

SEQ ID NO: 208825 - RNA, 64 nt, Homo Sapiens
ugggcacagcacagccagggcgcucuuccaggcaggcgaggauaacuugagaguuuccuagggc

SEQ ID NO: 208826 - RNA, 64 nt, Homo Sapiens
uuaggacuugaagagggaagguauuuaauaacugggcgaggaugggugugguggcucacaccug

SEQ ID NO: 208827 - RNA, 59 nt, Homo Sapiens
accccuacgugugggacugagucagcgguggcgaggagaggcgggcggauuuggggagg

SEQ ID NO: 208828 - RNA, 64 nt, Homo Sapiens
cccgccauuacuuucuuuucuggagugccaugcuggcgaggauccggaugcggcagcacccucu

SEQ ID NO: 208829 - RNA, 64 nt, Homo Sapiens
uuucaauuuauuuuuuaaagauucuuacggcaugggcgaggauuaucaugaaggugugcaaaug

SEQ ID NO: 208830 - RNA, 64 nt, Homo Sapiens
cguuuccacccccuggugccgugauuguguugugggcgaggagguagccaggaaaggggugaga

SEQ ID NO: 208831 - RNA, 64 nt, Homo Sapiens
cuggugacaugcuccucuccccccgcccaccccaggcgaggaucgcgaaggaaauggucacacc

SEQ ID NO: 208832 - RNA, 64 nt, Homo Sapiens
uucuuucugugaggagauugaguacucugcagcuggcgaggaguugguugaggcacuucuucaa

SEQ ID NO: 208833 - RNA, 64 nt, Homo Sapiens
gccuccugacaccagcagaggaauuuuguacccaggcgaggacuucuugaacuucugcguaucu

SEQ ID NO: 208834 - RNA, 64 nt, Homo Sapiens
agccgaggccgagcgcccccugcuggcccgcggcggcgaggagcagagggagcggaggaggggc

SEQ ID NO: 208835 - RNA, 64 nt, Homo Sapiens
uccccagcucugucccuguagucaccugccggugggcgaggauccucucccugggauaagcacu

SEQ ID NO: 208836 - RNA, 64 nt, Homo Sapiens
ccauggccggggccuacgaccgggcagcgggggcggcgaggaggcuacgacgaggccgauggcc

SEQ ID NO: 208837 - RNA, 64 nt, Homo Sapiens
uggccugucccgggaagcagaggaggcaugagcaggcgaggagcgaggucugugaagagcgggc

SEQ ID NO: 208838 - RNA, 64 nt, Homo Sapiens
accuggcccacccagggcgguuuacuggaacgagggcgaggaaccccacccugaagguuguggg

SEQ ID NO: 208839 - RNA, 64 nt, Homo Sapiens
ccagugguggggacgcagaguugccugggaagagggcgaggaggcuggucccugccuugguccc

SEQ ID NO: 208840 - RNA, 64 nt, Homo Sapiens
acugcauccagccuggggcugaggcugaggcacuggcgaggagagggcgcuccucucugcacac

SEQ ID NO: 208841 - RNA, 64 nt, Homo Sapiens
gguccagugaggggugacugcagccggucaggugggcgaggagaaggggggcugccccuuuccu

SEQ ID NO: 208842 - RNA, 64 nt, Homo Sapiens
gaagcacacaccuccacgcgcuuuugcaugcccgggcgaggaccccacuaccuccuccgcugcg

SEQ ID NO: 208843 - RNA, 64 nt, Homo Sapiens
ccucgguccuuauggugguuccggcggcgguggcggcgaggaggccccaggcccaggccccacc

SEQ ID NO: 208844 - RNA, 64 nt, Homo Sapiens
gcguggcacuggcugcgaguuaucaauauuggauggcgaggacacuggcaggaacugggguggc

SEQ ID NO: 208845 - RNA, 64 nt, Homo Sapiens
gacagguggucggcgucggggugcgguggguaggggcgaggacaacgcagggugcgcuggguug

SEQ ID NO: 208846 - RNA, 64 nt, Homo Sapiens
cuggggagacgaggguaugaguggaaagaggaugggcgaggaggccgggcuuaccuggacacua

SEQ ID NO: 208847 - RNA, 64 nt, Homo Sapiens
cccgggaggugcuucugcggaccugcccagcguuggcgaggagcccgcugcucgcucccggacc

SEQ ID NO: 208848 - RNA, 64 nt, Homo Sapiens
cugacaaauuaugcuagagcaauuagacacccauggcgaggagaaaaaagaaccucuacuuaaa

SEQ ID NO: 208849 - RNA, 64 nt, Homo Sapiens
ugugggcgcagggccugccgguggucaaaggacaggcgaggagcagucaugcaggaugggaucu

SEQ ID NO: 208850 - RNA, 64 nt, Homo Sapiens; identical to SEQ ID NO: 153164

SEQ ID NO: 208851 - RNA, 64 nt, Homo Sapiens; identical to SEQ ID NO: 153165

SEQ ID NO: 208852 - RNA, 64 nt, Homo Sapiens; identical to SEQ ID NO: 153166

SEQ ID NO: 208853 - RNA, 64 nt, Homo Sapiens; identical to SEQ ID NO: 153167

SEQ ID NO: 208854 - RNA, 63 nt, Homo Sapiens; identical to SEQ ID NO: 153168

SEQ ID NO: 208855 - RNA, 64 nt, Homo Sapiens; identical to SEQ ID NO: 153169

SEQ ID NO: 208856 - RNA, 64 nt, Homo Sapiens; identical to SEQ ID NO: 153170

SEQ ID NO: 208857 - RNA, 64 nt, Homo Sapiens; identical to SEQ ID NO: 153171

SEQ ID NO: 208858 - RNA, 64 nt, Homo Sapiens; identical to SEQ ID NO: 153172

SEQ ID NO: 208859 - RNA, 64 nt, Homo Sapiens; identical to SEQ ID NO: 153173

SEQ ID NO: 208860 - RNA, 64 nt, Homo Sapiens; identical to SEQ ID NO: 153174

SEQ ID NO: 208861 - RNA, 64 nt, Homo Sapiens; identical to SEQ ID NO: 153175

SEQ ID NO: 208862 - RNA, 64 nt, Homo Sapiens; identical to SEQ ID NO: 153176

SEQ ID NO: 208863 - RNA, 64 nt, Homo Sapiens; identical to SEQ ID NO: 153177

SEQ ID NO: 208864 - RNA, 64 nt, Homo Sapiens; identical to SEQ ID NO: 153178

SEQ ID NO: 208865 - RNA, 64 nt, Homo Sapiens; identical to SEQ ID NO: 153179

SEQ ID NO: 208866 - RNA, 64 nt, Homo Sapiens; identical to SEQ ID NO: 153180

SEQ ID NO: 208867 - RNA, 64 nt, Homo Sapiens; identical to SEQ ID NO: 153181

SEQ ID NO: 208868 - RNA, 64 nt, Homo Sapiens; identical to SEQ ID NO: 153182

SEQ ID NO: 208869 - RNA, 64 nt, Homo Sapiens; identical to SEQ ID NO: 153183

SEQ ID NO: 208870 - RNA, 64 nt, Homo Sapiens; identical to SEQ ID NO: 153184

SEQ ID NO: 208871 - RNA, 64 nt, Homo Sapiens; identical to SEQ ID NO: 153185

SEQ ID NO: 208872 - RNA, 64 nt, Homo Sapiens; identical to SEQ ID NO: 153186

SEQ ID NO: 208873 - RNA, 64 nt, Homo Sapiens; identical to SEQ ID NO: 153187

SEQ ID NO: 208874 - RNA, 64 nt, Homo Sapiens; identical to SEQ ID NO: 153188

SEQ ID NO: 208875 - RNA, 64 nt, Homo Sapiens; identical to SEQ ID NO: 153189

SEQ ID NO: 208876 - RNA, 64 nt, Homo Sapiens; identical to SEQ ID NO: 153190

SEQ ID NO: 208877 - RNA, 64 nt, Homo Sapiens; identical to SEQ ID NO: 153191

SEQ ID NO: 208878 - RNA, 64 nt, Homo Sapiens
gggggagccuggagccccugugugggagggcgaggcgggggagccuggagccccugugugggag

SEQ ID NO: 208879 - RNA, 64 nt, Homo Sapiens
gggggagccuggagccccugugugggagggcgaggcgggggauccuggagccccugugucgggg

SEQ ID NO: 208880 - RNA, 64 nt, Homo Sapiens
gacugcaaggcugucuccuuaaggcacugagugggcgggggaggcugggagccggcggcaggau

SEQ ID NO: 208881 - RNA, 64 nt, Homo Sapiens
cagaaucuaagaccuuucagcuucgagccagggggcgggggaucccgagcaaaagccuuccgug

SEQ ID NO: 208882 - RNA, 64 nt, Homo Sapiens; identical to SEQ ID NO: 72205

SEQ ID NO: 208883 - RNA, 64 nt, Homo Sapiens; identical to SEQ ID NO: 72206

SEQ ID NO: 208884 - RNA, 64 nt, Homo Sapiens; identical to SEQ ID NO: 72207

SEQ ID NO: 208885 - RNA, 64 nt, Homo Sapiens; identical to SEQ ID NO: 72208

SEQ ID NO: 208886 - RNA, 64 nt, Homo Sapiens; identical to SEQ ID NO: 72209

SEQ ID NO: 208887 - RNA, 64 nt, Homo Sapiens; identical to SEQ ID NO: 72210

SEQ ID NO: 208888 - RNA, 64 nt, Homo Sapiens; identical to SEQ ID NO: 72211

SEQ ID NO: 208889 - RNA, 64 nt, Homo Sapiens; identical to SEQ ID NO: 72212

SEQ ID NO: 208890 - RNA, 64 nt, Homo Sapiens; identical to SEQ ID NO: 72213

SEQ ID NO: 208891 - RNA, 64 nt, Homo Sapiens; identical to SEQ ID NO: 72214

SEQ ID NO: 208892 - RNA, 64 nt, Homo Sapiens; identical to SEQ ID NO: 72215

SEQ ID NO: 208893 - RNA, 64 nt, Homo Sapiens; identical to SEQ ID NO: 72216

SEQ ID NO: 208894 - RNA, 64 nt, Homo Sapiens; identical to SEQ ID NO: 72217

SEQ ID NO: 208895 - RNA, 64 nt, Homo Sapiens; identical to SEQ ID NO: 72218

SEQ ID NO: 208896 - RNA, 64 nt, Homo Sapiens; identical to SEQ ID NO: 72219

SEQ ID NO: 208897 - RNA, 64 nt, Homo Sapiens; identical to SEQ ID NO: 72220

SEQ ID NO: 208898 - RNA, 64 nt, Homo Sapiens; identical to SEQ ID NO: 72221

SEQ ID NO: 208899 - RNA, 64 nt, Homo Sapiens; identical to SEQ ID NO: 72222

SEQ ID NO: 208900 - RNA, 64 nt, Homo Sapiens; identical to SEQ ID NO: 72223

SEQ ID NO: 208901 - RNA, 64 nt, Homo Sapiens; identical to SEQ ID NO: 72224

SEQ ID NO: 208902 - RNA, 64 nt, Homo Sapiens; identical to SEQ ID NO: 72225

SEQ ID NO: 208903 - RNA, 64 nt, Homo Sapiens; identical to SEQ ID NO: 72226

SEQ ID NO: 208904 - RNA, 64 nt, Homo Sapiens; identical to SEQ ID NO: 72227

SEQ ID NO: 208905 - RNA, 64 nt, Homo Sapiens; identical to SEQ ID NO: 72228

SEQ ID NO: 208906 - RNA, 64 nt, Homo Sapiens; identical to SEQ ID NO: 72229

SEQ ID NO: 208907 - RNA, 64 nt, Homo Sapiens; identical to SEQ ID NO: 72230

SEQ ID NO: 208908 - RNA, 64 nt, Homo Sapiens; identical to SEQ ID NO: 72231

SEQ ID NO: 208909 - RNA, 64 nt, Homo Sapiens; identical to SEQ ID NO: 72232

SEQ ID NO: 208910 - RNA, 64 nt, Homo Sapiens; identical to SEQ ID NO: 72233

SEQ ID NO: 208911 - RNA, 64 nt, Homo Sapiens; identical to SEQ ID NO: 72234

SEQ ID NO: 208912 - RNA, 64 nt, Homo Sapiens; identical to SEQ ID NO: 72235

SEQ ID NO: 208913 - RNA, 64 nt, Homo Sapiens; identical to SEQ ID NO: 72236

SEQ ID NO: 208914 - RNA, 64 nt, Homo Sapiens; identical to SEQ ID NO: 72237

SEQ ID NO: 208915 - RNA, 64 nt, Homo Sapiens; identical to SEQ ID NO: 72238

SEQ ID NO: 208916 - RNA, 64 nt, Homo Sapiens; identical to SEQ ID NO: 72239

SEQ ID NO: 208917 - RNA, 64 nt, Homo Sapiens; identical to SEQ ID NO: 72240

SEQ ID NO: 208918 - RNA, 64 nt, Homo Sapiens; identical to SEQ ID NO: 72241

SEQ ID NO: 208919 - RNA, 64 nt, Homo Sapiens; identical to SEQ ID NO: 72242

SEQ ID NO: 208920 - RNA, 64 nt, Homo Sapiens; identical to SEQ ID NO: 72243

SEQ ID NO: 208921 - RNA, 64 nt, Homo Sapiens; identical to SEQ ID NO: 72244

SEQ ID NO: 208922 - RNA, 64 nt, Homo Sapiens; identical to SEQ ID NO: 72245

SEQ ID NO: 208923 - RNA, 64 nt, Homo Sapiens; identical to SEQ ID NO: 72246

SEQ ID NO: 208924 - RNA, 64 nt, Homo Sapiens; identical to SEQ ID NO: 72247

SEQ ID NO: 208925 - RNA, 64 nt, Homo Sapiens; identical to SEQ ID NO: 72248

SEQ ID NO: 208926 - RNA, 64 nt, Homo Sapiens; identical to SEQ ID NO: 72249

SEQ ID NO: 208927 - RNA, 64 nt, Homo Sapiens; identical to SEQ ID NO: 72250

SEQ ID NO: 208928 - RNA, 64 nt, Homo Sapiens; identical to SEQ ID NO: 72251

SEQ ID NO: 208929 - RNA, 64 nt, Homo Sapiens; identical to SEQ ID NO: 72252

SEQ ID NO: 208930 - RNA, 64 nt, Homo Sapiens; identical to SEQ ID NO: 72253

SEQ ID NO: 208931 - RNA, 64 nt, Homo Sapiens; identical to SEQ ID NO: 72254

SEQ ID NO: 208932 - RNA, 64 nt, Homo Sapiens; identical to SEQ ID NO: 72255

SEQ ID NO: 208933 - RNA, 64 nt, Homo Sapiens; identical to SEQ ID NO: 72256

SEQ ID NO: 208934 - RNA, 64 nt, Homo Sapiens; identical to SEQ ID NO: 72257

SEQ ID NO: 208935 - RNA, 64 nt, Homo Sapiens; identical to SEQ ID NO: 72258

SEQ ID NO: 208936 - RNA, 64 nt, Homo Sapiens; identical to SEQ ID NO: 72259

SEQ ID NO: 208937 - RNA, 64 nt, Homo Sapiens; identical to SEQ ID NO: 72260

SEQ ID NO: 208938 - RNA, 64 nt, Homo Sapiens; identical to SEQ ID NO: 72261

SEQ ID NO: 208939 - RNA, 64 nt, Homo Sapiens; identical to SEQ ID NO: 72262

SEQ ID NO: 208940 - RNA, 64 nt, Homo Sapiens; identical to SEQ ID NO: 72263

SEQ ID NO: 208941 - RNA, 64 nt, Homo Sapiens; identical to SEQ ID NO: 72264

SEQ ID NO: 208942 - RNA, 64 nt, Homo Sapiens; identical to SEQ ID NO: 72265

SEQ ID NO: 208943 - RNA, 64 nt, Homo Sapiens; identical to SEQ ID NO: 72266

SEQ ID NO: 208944 - RNA, 64 nt, Homo Sapiens; identical to SEQ ID NO: 72267

SEQ ID NO: 208945 - RNA, 64 nt, Homo Sapiens; identical to SEQ ID NO: 72268

SEQ ID NO: 208946 - RNA, 64 nt, Homo Sapiens; identical to SEQ ID NO: 72269

SEQ ID NO: 208947 - RNA, 64 nt, Homo Sapiens; identical to SEQ ID NO: 72270

SEQ ID NO: 208948 - RNA, 64 nt, Homo Sapiens; identical to SEQ ID NO: 72271

SEQ ID NO: 208949 - RNA, 64 nt, Homo Sapiens; identical to SEQ ID NO: 72272

SEQ ID NO: 208950 - RNA, 64 nt, Homo Sapiens; identical to SEQ ID NO: 72273

SEQ ID NO: 208951 - RNA, 64 nt, Homo Sapiens
aaaacaucaaaacacugcagcaguuccuaaaugauucucacaagcaacccugagagagacaguc

SEQ ID NO: 208952 - RNA, 64 nt, Homo Sapiens
ggagaucugggggaggcaggaagcuccucagauuuucucacagacccuucccaauuccaucacc

SEQ ID NO: 208953 - RNA, 64 nt, Homo Sapiens
aaagaguaggaagagagaaaugguagccugcugcuucucacagacaccucacauccucacuugg

SEQ ID NO: 208954 - RNA, 64 nt, Homo Sapiens
cuccuccuaaaggcaugcagcuugcagccccucuuucucacacgugugauccuagcgugagagg

SEQ ID NO: 208955 - RNA, 64 nt, Homo Sapiens
cccuccuccucuucccuggcccauugaucaucccuucucacagagggucaucauuauuuccaaa

SEQ ID NO: 208956 - RNA, 64 nt, Homo Sapiens
uacugaaggcuuuauaugucguaauugaaucaacuucucacacaagaaugagugucaccagugg

SEQ ID NO: 208957 - RNA, 64 nt, Homo Sapiens
gucaagguaacugaauucauccaaauaaauuuuuuucucacagucaugauaccauggaaauauu

SEQ ID NO: 208958 - RNA, 64 nt, Homo Sapiens
ugacuuuggaguuauucaguuaaugacccuuuaauucucacaaccaaccagucauguugcuuga

SEQ ID NO: 208959 - RNA, 64 nt, Homo Sapiens
ucccgcaaaaugggcuuccugccugguuuuucucuucucacauuuuuuaaaugguccccugugu

SEQ ID NO: 208960 - RNA, 64 nt, Homo Sapiens
guacucugagguccaaauacuguaaaguuucugguucucacacuugaagggaguaugucuuaaa

SEQ ID NO: 208961 - RNA, 64 nt, Homo Sapiens
agaaauuaggggcgggugggggacuuacaagcacuucucacauggagcaucuguuucaaaugug

SEQ ID NO: 208962 - RNA, 64 nt, Homo Sapiens
ucuauuuuuauaacuggagugugaguucuguaucuucucacauucuguauacuguauccauuuu

SEQ ID NO: 208963 - RNA, 64 nt, Homo Sapiens
ugcauuucgaaagcaaacagaagaaaaaaguauauucucacaguuuuuccccaggaagucugga

SEQ ID NO: 208964 - RNA, 64 nt, Homo Sapiens
guggggcagccguccuucuauaggaacagcaguguucucacagucucuaaaaguaaacuacugu

SEQ ID NO: 208965 - RNA, 64 nt, Homo Sapiens
ccucuaaaaguaaacuacuguaaggucaaacuaauucucacaucgaggcaugcacaucuggaau

SEQ ID NO: 208966 - RNA, 64 nt, Homo Sapiens
gaguggugccugaaaauugugucuguccgugucuuucucacacucgaauccacauccuuugaac

SEQ ID NO: 208967 - RNA, 64 nt, Homo Sapiens
ggaaauucacaacauacucaacuuuuggguuuuguucucacaguauuuuucacaaaaaaagggu

SEQ ID NO: 208968 - RNA, 64 nt, Homo Sapiens
uguuaugugcaggacacaauuagucccaguuguauucucacaggauaugcuucccgcauugucc

SEQ ID NO: 208969 - RNA, 64 nt, Homo Sapiens
ugcagucaugccguucucugucgggugcacccaguucucacauggggauuccuauugacacugc

SEQ ID NO: 208970 - RNA, 64 nt, Homo Sapiens
ucccaucgcacgugcuuucugcucuucugggaauuucucacacuggcaaagcaguccagccucc

SEQ ID NO: 208971 - RNA, 64 nt, Homo Sapiens
gcacauaccaucaagccacacuaucaugguauuguucucacagucuuuuggugguugauggcca

SEQ ID NO: 208972 - RNA, 64 nt, Homo Sapiens
aguuaccguguucaccucaccccaaccgauuuccauaauguagcacuacaauauuuaacuaagg

SEQ ID NO: 208973 - RNA, 64 nt, Homo Sapiens
uagaauaauagcuuugaaauuaugcaucucuccuauaauguaaaccaacuuuucucuauuuaca

SEQ ID NO: 208974 - RNA, 64 nt, Homo Sapiens
auuuaagaauuggugcuuuauaacauuuuaauauauaauguacaaauauuuugacauaauguau

SEQ ID NO: 208975 - RNA, 64 nt, Homo Sapiens
aacauuuuaauauauaauguuucaauauuuugacauaauguauucuguuauuaaaacaauguuc

SEQ ID NO: 208976 - RNA, 64 nt, Homo Sapiens
ggggccaacuccaauauaggguggguaaggccuuauaauguaaagagcauauaauguaaagggc

SEQ ID NO: 208977 - RNA, 64 nt, Homo Sapiens
uaggguggguaaggccuuauaauguaaagagcauauaauguaaagggcuuuagagugagacaga

SEQ ID NO: 208978 - RNA, 64 nt, Homo Sapiens
uauggaaagugacagacaaacuuguacagccaaaauaauguauaucugagugacacuuuucacc

SEQ ID NO: 208979 - RNA, 64 nt, Homo Sapiens
auauguguccaugagaaguagauuaauuuagaagauaauguacauuucagccaucaaaaauaag

SEQ ID NO: 208980 - RNA, 64 nt, Homo Sapiens
cuaaaugacuuuuguauuuuuacaauggggaguaauaauguauauacuguaccaaaucuggaau

SEQ ID NO: 208981 - RNA, 64 nt, Homo Sapiens
uaaguuacuaugaucugcauuucuuauggcaaaaauaauguaaaugacuguugcuuaagaaguu

SEQ ID NO: 208982 - RNA, 64 nt, Homo Sapiens
gaagauaaaaaaauuuauaaggcucccuaaugcaauaauguacaaugaugcuacauaauuuugu

SEQ ID NO: 208983 - RNA, 64 nt, Homo Sapiens
uucuuuauuucacauuuuaugaauaaaagauaaaauaauguauuuuugaauuuucucuguaaga

SEQ ID NO: 208984 - RNA, 64 nt, Homo Sapiens
aauaaguuguauucauaaaagcuguuuuuaccugauaauguaguuucuaugcaugcauuugaaa

SEQ ID NO: 208985 - RNA, 64 nt, Homo Sapiens
ucuacuauaaaauagaaucacauuuuauucuuccauaauguauuuuuuugcaugacuuuucucu

SEQ ID NO: 208986 - RNA, 64 nt, Homo Sapiens
ggcaaauuuauguagcuauguggaaugauaugucauaauguaaaauuagauaaauucuuuuuuc

SEQ ID NO: 208987 - RNA, 64 nt, Homo Sapiens
uuucaguacaugaacuauagaaaaaaaucuauauauaauguacauaaauguuacauuuguaaag

SEQ ID NO: 208988 - RNA, 64 nt, Homo Sapiens
cagaaagaugagaggauuagcuuucaaggaacauauaauguaguaaaagggaauauaaagauga

SEQ ID NO: 208989 - RNA, 64 nt, Homo Sapiens
augagguuaacacugaaauagcuucauagcauuuauaauguaugaucuaaccauuuuauucucu

SEQ ID NO: 208990 - RNA, 64 nt, Homo Sapiens
auauaaacuaaaauuuauggauaaucuauacauuauaauguaauugguucauaaauuauaaugu

SEQ ID NO: 208991 - RNA, 64 nt, Homo Sapiens
aucuauacauuauaauguaaaugguucauaaauuauaauguauaaauuauucuauaugaauauu

SEQ ID NO: 208992 - RNA, 64 nt, Homo Sapiens
aauauuuaaaauaccuucaguuucucuuugcauaauaauguacuuuauguagguuucuuaucac

SEQ ID NO: 208993 - RNA, 64 nt, Homo Sapiens
ugaauguuuuaaaaacagaaaaaaaaucugcaagauaauguaacuagagauaauguaaacugaa

SEQ ID NO: 208994 - RNA, 64 nt, Homo Sapiens
cugaaaaaaaaucugcaagaaaaucaauguagagauaauguaaacauaugaccaucuuuccauc

SEQ ID NO: 208995 - RNA, 64 nt, Homo Sapiens
ucaaugaaaacuguuggagaagccuaguguuuucauaauguaauuuuauuaguaccuggcuuga

SEQ ID NO: 208996 - RNA, 64 nt, Homo Sapiens
gcugucaccuuaaauaagacauuuuaauuuuguuauaauguacaauuuagaaguuugauuaauu

SEQ ID NO: 208997 - RNA, 64 nt, Homo Sapiens
ggagaaucgggcuaauuuauuaaugaugauaauuauaauguaucuguacagcacuuuuuacauu

SEQ ID NO: 208998 - RNA, 64 nt, Homo Sapiens
ggcuagauuguuguguguuuuguugaauuuuuucauaauguaaugccguauuuauuguuuuuaa

SEQ ID NO: 208999 - RNA, 64 nt, Homo Sapiens
guuguaugcuaguuuaaaaaagaaaauauguaauauaauguaaaaaaaaacaaaaaaaagcuuu

SEQ ID NO: 209000 - RNA, 64 nt, Homo Sapiens
uguuuuuuccauauauauauaccuaugauaaaguauaauguauaaauuaagcauagcaagagau

SEQ ID NO: 209001 - RNA, 64 nt, Homo Sapiens
uaauguauaaauuaagcauagcaagagauuaauaauaauguaauagaacaaugauaacauacua

SEQ ID NO: 209002 - RNA, 64 nt, Homo Sapiens
caaucuacucucaaaaaauuugagguaaagggccauaauguaugaaauacacaauaaaguauuu

SEQ ID NO: 209003 - RNA, 64 nt, Homo Sapiens
gaauuguagucucaguuaaagagaaugggcuauuauaauguaaaucagaaaugaggcaagcuag

SEQ ID NO: 209004 - RNA, 64 nt, Homo Sapiens
gagaguucaccucuacucugcccuccucauagucauaauguagcaaguaaagaaugagaaugga

SEQ ID NO: 209005 - RNA, 64 nt, Homo Sapiens
agaauggauucuguacaauacacuagaaaccaacauaauguauuucuuuaaaaccugugugaaa

SEQ ID NO: 209006 - RNA, 64 nt, Homo Sapiens
uguuaaaucuuaaauaugcuuuuuaaaaauuggaauaauguauuaaggucaaauaauaucccau

SEQ ID NO: 209007 - RNA, 64 nt, Homo Sapiens
uaacuaaguuguguuuaacuuaugugcagucuuuauaauguauguauguuauuacaguuucaac

SEQ ID NO: 209008 - RNA, 64 nt, Homo Sapiens
guuuuuugugaauuuaaauuuuagugacuuuuugauaauguacaauauaaccaaaugugguguu

SEQ ID NO: 209009 - RNA, 64 nt, Homo Sapiens
acuaucguguacggguuccuuuuucucucauccaauaauguaaacccaccccccaguuuucaga

SEQ ID NO: 209010 - RNA, 64 nt, Homo Sapiens
gugaauucugguuuguuuguaaaacagcauuauuauaauguagguauggucaaugagcaguggu

SEQ ID NO: 209011 - RNA, 64 nt, Homo Sapiens
gugcauauuuuuuaacaaugcccaaucuguaugaauaauguaaacuucgauuuuuuuuuaaaaa

SEQ ID NO: 209012 - RNA, 64 nt, Homo Sapiens
auaguuaugcauuuauauucucaaaaaugaaaucauaauguacauugcuuuguagucugcucua

SEQ ID NO: 209013 - RNA, 64 nt, Homo Sapiens
auuuauuuccuauucagcaauuugauuauguauuauaauguaaucuguaaauagugauaugauu

SEQ ID NO: 209014 - RNA, 64 nt, Homo Sapiens
cauguagacuagcaaaauaguaagcuuguuggaaauaauguaccagcccauucaugguaagucu

SEQ ID NO: 209015 - RNA, 64 nt, Homo Sapiens
cacuacuguuuuaaaagaauuuuauaggaggaguauaauguauggguuuuuaaucaaaguuggc

SEQ ID NO: 209016 - RNA, 64 nt, Homo Sapiens
ucaagcuggucucgaacuccagagacaggguuucauaauguaaggcuaauuuuuguauuuuagu

SEQ ID NO: 209017 - RNA, 64 nt, Homo Sapiens
ucaacucuuaaauuauuuccuugaaaagugaguaauaauguaauuuuugaaaaaauuagauuuu

SEQ ID NO: 209018 - RNA, 64 nt, Homo Sapiens
caguaucacaucuagcucccuuacuuguccacagauaauguaaacaaaggagggaaaaacuuau

SEQ ID NO: 209019 - RNA, 64 nt, Homo Sapiens
aaagucgugugaaauccuguacacuguguauagaauaauguaauuuuauguuaauuguuauuac

SEQ ID NO: 209020 - RNA, 64 nt, Homo Sapiens
aagccacauuaaggagugagucuucuuuuuuacaauaauguaaaaauuaaacuguuuacauuuu

SEQ ID NO: 209021 - RNA, 64 nt, Homo Sapiens
guuguugaauuugaaagccuuuguaaauaucaauauaauguaccaaugaaauaacaucuggggc

SEQ ID NO: 209022 - RNA, 64 nt, Homo Sapiens
auuuccagggagaacaugaagauaaaauggguaucaaugcuaauccuucccccauaaguuggag

SEQ ID NO: 209023 - RNA, 64 nt, Homo Sapiens
cuuggcucaggcugaucaccuugucccuaggcuacaaugcuacagaguccucugucaugugucc

SEQ ID NO: 209024 - RNA, 64 nt, Homo Sapiens; identical to SEQ ID NO: 45780

SEQ ID NO: 209025 - RNA, 64 nt, Homo Sapiens; identical to SEQ ID NO: 45781

SEQ ID NO: 209026 - RNA, 64 nt, Homo Sapiens; identical to SEQ ID NO: 45782

SEQ ID NO: 209027 - RNA, 64 nt, Homo Sapiens; identical to SEQ ID NO: 45783

SEQ ID NO: 209028 - RNA, 64 nt, Homo Sapiens; identical to SEQ ID NO: 45784

SEQ ID NO: 209029 - RNA, 64 nt, Homo Sapiens; identical to SEQ ID NO: 45785

SEQ ID NO: 209030 - RNA, 64 nt, Homo Sapiens; identical to SEQ ID NO: 45786

SEQ ID NO: 209031 - RNA, 64 nt, Homo Sapiens; identical to SEQ ID NO: 45787

SEQ ID NO: 209032 - RNA, 64 nt, Homo Sapiens; identical to SEQ ID NO: 45788

SEQ ID NO: 209033 - RNA, 64 nt, Homo Sapiens; identical to SEQ ID NO: 45789

SEQ ID NO: 209034 - RNA, 64 nt, Homo Sapiens; identical to SEQ ID NO: 45790

SEQ ID NO: 209035 - RNA, 64 nt, Homo Sapiens; identical to SEQ ID NO: 45791

SEQ ID NO: 209036 - RNA, 64 nt, Homo Sapiens; identical to SEQ ID NO: 45792

SEQ ID NO: 209037 - RNA, 64 nt, Homo Sapiens; identical to SEQ ID NO: 45793

SEQ ID NO: 209038 - RNA, 64 nt, Homo Sapiens; identical to SEQ ID NO: 45794

SEQ ID NO: 209039 - RNA, 64 nt, Homo Sapiens; identical to SEQ ID NO: 45795

SEQ ID NO: 209040 - RNA, 64 nt, Homo Sapiens; identical to SEQ ID NO: 45796

SEQ ID NO: 209041 - RNA, 64 nt, Homo Sapiens; identical to SEQ ID NO: 45797

SEQ ID NO: 209042 - RNA, 64 nt, Homo Sapiens; identical to SEQ ID NO: 45798

SEQ ID NO: 209043 - RNA, 64 nt, Homo Sapiens; identical to SEQ ID NO: 45799

SEQ ID NO: 209044 - RNA, 64 nt, Homo Sapiens; identical to SEQ ID NO: 45800

SEQ ID NO: 209045 - RNA, 64 nt, Homo Sapiens; identical to SEQ ID NO: 45801

SEQ ID NO: 209046 - RNA, 64 nt, Homo Sapiens; identical to SEQ ID NO: 45802

SEQ ID NO: 209047 - RNA, 64 nt, Homo Sapiens; identical to SEQ ID NO: 45803

SEQ ID NO: 209048 - RNA, 64 nt, Homo Sapiens; identical to SEQ ID NO: 45804

SEQ ID NO: 209049 - RNA, 64 nt, Homo Sapiens; identical to SEQ ID NO: 45805

SEQ ID NO: 209050 - RNA, 64 nt, Homo Sapiens; identical to SEQ ID NO: 45806

SEQ ID NO: 209051 - RNA, 64 nt, Homo Sapiens
gcauuugcacaagaauccuuuccagaaaguacucccucaguaaacugguucccucacagguuuc

SEQ ID NO: 209052 - RNA, 64 nt, Homo Sapiens
uaaccugaaccagccuggcucucuggcauccccaccucaguauccccuguuccucagcauggag

SEQ ID NO: 209053 - RNA, 64 nt, Homo Sapiens
cccucuccaugcuccccgccccaacccacucuggccucaguagauuuuuuuuucaguugugguu

SEQ ID NO: 209054 - RNA, 64 nt, Homo Sapiens
cugagauuacaggugugagccaccgugcccagccccucaguagguuuuaaggagcccccagccc

SEQ ID NO: 209055 - RNA, 64 nt, Homo Sapiens; identical to SEQ ID NO: 167990

SEQ ID NO: 209056 - RNA, 64 nt, Homo Sapiens; identical to SEQ ID NO: 167991

SEQ ID NO: 209057 - RNA, 64 nt, Homo Sapiens; identical to SEQ ID NO: 167992

SEQ ID NO: 209058 - RNA, 64 nt, Homo Sapiens; identical to SEQ ID NO: 167993

SEQ ID NO: 209059 - RNA, 64 nt, Homo Sapiens; identical to SEQ ID NO: 167994

SEQ ID NO: 209060 - RNA, 64 nt, Homo Sapiens; identical to SEQ ID NO: 167995

SEQ ID NO: 209061 - RNA, 64 nt, Homo Sapiens; identical to SEQ ID NO: 167996

SEQ ID NO: 209062 - RNA, 64 nt, Homo Sapiens; identical to SEQ ID NO: 167997

SEQ ID NO: 209063 - RNA, 64 nt, Homo Sapiens; identical to SEQ ID NO: 167998

SEQ ID NO: 209064 - RNA, 64 nt, Homo Sapiens; identical to SEQ ID NO: 167999

SEQ ID NO: 209065 - RNA, 64 nt, Homo Sapiens; identical to SEQ ID NO: 168000

SEQ ID NO: 209066 - RNA, 64 nt, Homo Sapiens; identical to SEQ ID NO: 168001

SEQ ID NO: 209067 - RNA, 64 nt, Homo Sapiens; identical to SEQ ID NO: 168002

SEQ ID NO: 209068 - RNA, 64 nt, Homo Sapiens; identical to SEQ ID NO: 168003

SEQ ID NO: 209069 - RNA, 64 nt, Homo Sapiens; identical to SEQ ID NO: 168004

SEQ ID NO: 209070 - RNA, 64 nt, Homo Sapiens; identical to SEQ ID NO: 168005

SEQ ID NO: 209071 - RNA, 64 nt, Homo Sapiens; identical to SEQ ID NO: 168006

SEQ ID NO: 209072 - RNA, 64 nt, Homo Sapiens; identical to SEQ ID NO: 168007

SEQ ID NO: 209073 - RNA, 64 nt, Homo Sapiens; identical to SEQ ID NO: 168008

SEQ ID NO: 209074 - RNA, 64 nt, Homo Sapiens; identical to SEQ ID NO: 168009

SEQ ID NO: 209075 - RNA, 64 nt, Homo Sapiens; identical to SEQ ID NO: 168010

SEQ ID NO: 209076 - RNA, 64 nt, Homo Sapiens; identical to SEQ ID NO: 168011

SEQ ID NO: 209077 - RNA, 64 nt, Homo Sapiens; identical to SEQ ID NO: 168012

SEQ ID NO: 209078 - RNA, 64 nt, Homo Sapiens; identical to SEQ ID NO: 168013

SEQ ID NO: 209079 - RNA, 64 nt, Homo Sapiens; identical to SEQ ID NO: 168014

SEQ ID NO: 209080 - RNA, 64 nt, Homo Sapiens; identical to SEQ ID NO: 168015

SEQ ID NO: 209081 - RNA, 64 nt, Homo Sapiens; identical to SEQ ID NO: 168016

SEQ ID NO: 209082 - RNA, 64 nt, Homo Sapiens; identical to SEQ ID NO: 168017

SEQ ID NO: 209083 - RNA, 64 nt, Homo Sapiens; identical to SEQ ID NO: 168018

SEQ ID NO: 209084 - RNA, 64 nt, Homo Sapiens; identical to SEQ ID NO: 168018

SEQ ID NO: 209085 - RNA, 64 nt, Homo Sapiens; identical to SEQ ID NO: 168020

SEQ ID NO: 209086 - RNA, 64 nt, Homo Sapiens; identical to SEQ ID NO: 168021

SEQ ID NO: 209087 - RNA, 64 nt, Homo Sapiens; identical to SEQ ID NO: 168022

SEQ ID NO: 209088 - RNA, 64 nt, Homo Sapiens; identical to SEQ ID NO: 168023

SEQ ID NO: 209089 - RNA, 64 nt, Homo Sapiens; identical to SEQ ID NO: 168024

SEQ ID NO: 209090 - RNA, 64 nt, Homo Sapiens; identical to SEQ ID NO: 168025

SEQ ID NO: 209091 - RNA, 64 nt, Homo Sapiens; identical to SEQ ID NO: 168026

SEQ ID NO: 209092 - RNA, 64 nt, Homo Sapiens
cuuuccuugggccauaccuucccugcagaucuccagcccagaaccaucuuccccuguuguccuc

SEQ ID NO: 209093 - RNA, 64 nt, Homo Sapiens
agaggagaggggaccagaccaucuccgcaaccacagcccagagcuccagucaccagauagaaaa

SEQ ID NO: 209094 - RNA, 64 nt, Homo Sapiens
ccaacacugugggugugugacuugaccuuuguacagcccagaggggaguaaccgcuccagguac

SEQ ID NO: 209095 - RNA, 64 nt, Homo Sapiens
gucuuaauuucuaucuuguucagccauugcacccagcccagauuagcacugggaucacaggugu

SEQ ID NO: 209096 - RNA, 64 nt, Homo Sapiens
agggucucucuaaaggggacccuagccccaaaccagcccagagccgccuccccaagucagcagu

SEQ ID NO: 209097 - RNA, 64 nt, Homo Sapiens
acccauuccggguucacuccggaauggcugcaagagcccagauccuccccuacaccaacaaaga

SEQ ID NO: 209098 - RNA, 64 nt, Homo Sapiens
gggguccagagcuaagugaccucugaaugaacagagcccagaugcgccagccuagaacauccug

SEQ ID NO: 209099 - RNA, 64 nt, Homo Sapiens
aggcggcuugggauccucugacgagacggugcgaagcccagaggagcacuaaggaugucagugu

SEQ ID NO: 209100 - RNA, 64 nt, Homo Sapiens
ugcagccacuggcuugauugggcccuggacguugagcccagauguuggagccacaccagccugg

SEQ ID NO: 209101 - RNA, 64 nt, Homo Sapiens
ugugcccacugcccgugcagccuccuucagccagagcccagagcauagacaggaguguaggagu

SEQ ID NO: 209102 - RNA, 64 nt, Homo Sapiens
ugcccugggcucagaucugugaacccuuuccaaaagcccagagaugggaacucaggaaaagcag

SEQ ID NO: 209103 - RNA, 64 nt, Homo Sapiens
gagaacugagcaggaaaccaggggggugaggcuuagcccagaagaccaggcuuugcagaggggc

SEQ ID NO: 209104 - RNA, 64 nt, Homo Sapiens
gccuuucuggaaagcaggaguucaagccuuagcaagcccagaggcccccagcagacgaugagga

SEQ ID NO: 209105 - RNA, 64 nt, Homo Sapiens
augauuauuuuauuuaguaaauaaaauaauagagagcccagaaaucaaccugcacaccuaccgc

SEQ ID NO: 209106 - RNA, 64 nt, Homo Sapiens
guggcaagaacagugggcgugagcccagccugggagcccagaggggggagacaggagccuagcg

SEQ ID NO: 209107 - RNA, 64 nt, Homo Sapiens
caccuggaucuaucccugcgagagaagagggcccagcccagagcacagcaccuccccgcuggga

SEQ ID NO: 209108 - RNA, 64 nt, Homo Sapiens
gcccgacggcagcgccgccgccgcccagaaucccagcccagaaucccgaccgccgcgccggacg

SEQ ID NO: 209109 - RNA, 64 nt, Homo Sapiens
ccagccccuuccuuuccaaaccaugcaauggaagagcccagaugggugaagauugauuuugccu

SEQ ID NO: 209110 - RNA, 64 nt, Homo Sapiens
gauuauaagaacugaugugggaagcagccacuucagcccagagaacaagguccaacccugcaau

SEQ ID NO: 209111 - RNA, 64 nt, Homo Sapiens
agugugggcagaagcagugaggccacuucagccaagcccagagaucccagcguuugccagaggu

SEQ ID NO: 209112 - RNA, 64 nt, Homo Sapiens
ccugaaugccuucugggguauuuccauaugcaacagcccagagucauagccuugggcaaccaca

SEQ ID NO: 209113 - RNA, 64 nt, Homo Sapiens
uagcagaaauauugucuguaaagcuaggcagaugagcccagaagaauggucccagagaaagcag

SEQ ID NO: 209114 - RNA, 59 nt, Homo Sapiens
ugauacagaagaucagcuaagacacacccagcccagauucaacaggaaaccgaucuucc

SEQ ID NO: 209115 - RNA, 64 nt, Homo Sapiens
uuaccgugcacguaaauuggucagcagaaaagggagcccagaaaaggcagcagauggaccaugc

SEQ ID NO: 209116 - RNA, 64 nt, Homo Sapiens
gcaaagggccucaauuccuauaagagacccucgcagcccagaggcgcccagaggaagucagcag

SEQ ID NO: 209117 - RNA, 64 nt, Homo Sapiens
cacacuacugaauggaagcaggcugucuuguaaaagcccagaucacugugggcuggagaggaga

SEQ ID NO: 209118 - RNA, 64 nt, Homo Sapiens
ccuaccccacggaggaugagaagaggcagaucgcagcccagaccaaccucacccuccugcaagu

SEQ ID NO: 209119 - RNA, 64 nt, Homo Sapiens
cuuggaacacagugacucccuggaguagucgggcagcccagauggcacugaucacugagcagga

SEQ ID NO: 209120 - RNA, 64 nt, Homo Sapiens
uaccuuugcacuccugguuuuaacagaacugccaagcccagaaguccuuuaccccuguucugcu

SEQ ID NO: 209121 - RNA, 64 nt, Homo Sapiens
cuuguuuggggacuguuuuacugaucugagaaugagcccagaggcagaguagggaagacuccca

SEQ ID NO: 209122 - RNA, 64 nt, Homo Sapiens
agauucucaucagcacuuuugucaagccaaguaaagcccagagaacagugccagaauuaaguga

SEQ ID NO: 209123 - RNA, 64 nt, Homo Sapiens
ccaagcucccuggcugagcuagcaucgagcuccaagcccagaugagccucccagcggcucauga

SEQ ID NO: 209124 - RNA, 64 nt, Homo Sapiens
ucuuccgggcccugcugucaggcagcuuugcagaagcccagauggaccuggugccccugcgagg

SEQ ID NO: 209125 - RNA, 64 nt, Homo Sapiens
cagguucuggguguagggcccagagaagcagaacagcccagagccccaggugccuggccuggcc

SEQ ID NO: 209126 - RNA, 64 nt, Homo Sapiens
gcaccccgacguagcugccccccuggggggccacagcccagagaaccagccuaggaacacucgg

SEQ ID NO: 209127 - RNA, 64 nt, Homo Sapiens
cuaucuggccccaacacaccugagagaauucagcagcccagacugagggucugggaugggguga

SEQ ID NO: 209128 - RNA, 64 nt, Homo Sapiens
gcuagugcuaagagggaaggcccagguuugagagagcccagaggggcagagcccagagccuugu

SEQ ID NO: 209129 - RNA, 64 nt, Homo Sapiens
gaaggcccagguuugagagagcccagaggggcagagcccagagccuuguuuggcccugaucucu

SEQ ID NO: 209130 - RNA, 64 nt, Homo Sapiens
cccaggcccacugaagcauguuccauuucuaaaaagcccagaguucagugugucccaaggaaaa

SEQ ID NO: 209131 - RNA, 64 nt, Homo Sapiens
uguucugagagcagcgugggcagcaaggcagggcagcccagagguggcagcggcaggcaaucug

SEQ ID NO: 209132 - RNA, 64 nt, Homo Sapiens
cccagcccccugccccggcccugcuccagaacccagcccagaucggaggacaaguuccucucua

SEQ ID NO: 209133 - RNA, 64 nt, Homo Sapiens
cccaacuccagaacccaacccuucucuagaauccagcccagaucugaggccaagcuaugugcua

SEQ ID NO: 209134 - RNA, 64 nt, Homo Sapiens
agggaagggacuucauuuccaggggccacagccaagcccagagucccccagcggcucgcauguc

SEQ ID NO: 209135 - RNA, 64 nt, Homo Sapiens
gccaagcccagagucccccagcggcucgcaugucagcccagaccccaggguccuuggccuagga

SEQ ID NO: 209136 - RNA, 64 nt, Homo Sapiens
ugacacagacaccggacaaaccauugucuuggggagcccagaagagaaagugggcagggugggg

SEQ ID NO: 209137 - RNA, 64 nt, Homo Sapiens
gaguuaguuaggcauugaguuugcccugggcaaaagcccagaagugggaguaugugguauaucu

SEQ ID NO: 209138 - RNA, 64 nt, Homo Sapiens
aauguuuaugcagucaaggccaaagccugcccugagcccagacacaccuggguccccauucugg

SEQ ID NO: 209139 - RNA, 64 nt, Homo Sapiens
cagaaggcuucccuggugcucucaguccaggcaaagcccagagcaucugagcacgucucugacu

SEQ ID NO: 209140 - RNA, 64 nt, Homo Sapiens
aguccgcguguugcuggagggacacguguauuggagcccagaagaggggcuguguggccuggga

SEQ ID NO: 209141 - RNA, 64 nt, Homo Sapiens
guguaagggcuuggggucuuagaagcugcucuuuagcccagauacacauacucuuuuuugucuu

SEQ ID NO: 209142 - RNA, 64 nt, Homo Sapiens
agcggcagccaccaccaguguuguuuugaauaaaagcccagaagccuauuuaagaauuucuccg

SEQ ID NO: 209143 - RNA, 64 nt, Homo Sapiens
aagggaccucuguggcuccagcugccaacccuggagcccagaccgagguggccauggagacucc

SEQ ID NO: 209144 - RNA, 64 nt, Homo Sapiens
aaucgucuaagcccgggagguggagguugcagugagcccagauggcgcugcugcacucaagcuu

SEQ ID NO: 209145 - RNA, 64 nt, Homo Sapiens
ucagcugcccacagcccucuugccugaccccugaagcccagaacucugaucuucacagcccuag

SEQ ID NO: 209146 - RNA, 64 nt, Homo Sapiens
uggaggauagcaacaucaguacgguggggaggcuucccaugauucaugaugucccaugagggag

SEQ ID NO: 209147 - RNA, 63 nt, Homo Sapiens
gagacgguggggaggcuuccagaaagcaugaugucccaugaggaggaugggcacggaaaauga

SEQ ID NO: 209148 - RNA, 64 nt, Homo Sapiens
uguuccugucugaggcauagagaucccagauccaucccaugauugccucauggagcuguuguau

SEQ ID NO: 209149 - RNA, 64 nt, Homo Sapiens
gaagcacgacagggcugaugaaaugagcauugcaucccaugagguaaaaagcagaggcccaguc

SEQ ID NO: 209150 - RNA, 64 nt, Homo Sapiens
ccuguugauuggcucagucauggugggaaagaucacacuacaugaagaaucccucuguucacug

SEQ ID NO: 209151 - RNA, 64 nt, Homo Sapiens
aauuacuguugaugauuuuuugcacuaguuuucuacacuacaggugcugaccagcagugaaggc

SEQ ID NO: 209152 - RNA, 64 nt, Homo Sapiens
gggauguguaauaaccaugcgcacuuuuuuucauacacuacaaguaguacauaaaucccgucau

SEQ ID NO: 209153 - RNA, 61 nt, Homo Sapiens; identical to SEQ ID NO: 179696

SEQ ID NO: 209154 - RNA, 50 nt, Homo Sapiens; identical to SEQ ID NO: 179697

SEQ ID NO: 209155 - RNA, 64 nt, Homo Sapiens
augcaaauggucauuucagauguaugguguuuuuacacuacaaagaagucccccauguggauau

SEQ ID NO: 209156 - RNA, 64 nt, Homo Sapiens
guagucuaauaaaguguaaaguuacauuuacacuacacuacacuacucccucucaaaaaaaaaa

SEQ ID NO: 209157 - RNA, 64 nt, Homo Sapiens
acacuguagucuaauaaaguaaaaaguuacauuuacacuacacugcgagacucccucucaaaaa

SEQ ID NO: 209158 - RNA, 64 nt, Homo Sapiens
aaauuuaacuccauauguguuccucuuguucuaaucuugucaaccagugcaagugaccgacaaa

SEQ ID NO: 209159 - RNA, 64 nt, Homo Sapiens
gauaucaacugcuuguaaaggugcuccucuuuuuucuugucauugcuggucaagauuacuaaua

SEQ ID NO: 209160 - RNA, 64 nt, Homo Sapiens
cuacacauaugacuauacggaugcaguggcccauucuugucacuauuuaggacaacaauuaaca

SEQ ID NO: 209161 - RNA, 64 nt, Homo Sapiens
ccucccucacagucuuauagucgccuuugcauugucuugucacaucauucaucacuuggacaca

SEQ ID NO: 209162 - RNA, 64 nt, Homo Sapiens
ggcaucucugcagcucaaagauguggguucuuuuucuugucauuaacacauuguuauuucugua

SEQ ID NO: 209163 - RNA, 64 nt, Homo Sapiens
caguguuauuucuauuggauaugguuugggcuucucuugucaaaucugugucggcugcccccug

SEQ ID NO: 209164 - RNA, 64 nt, Homo Sapiens
aguaaguauaacaaacuauggcuucuggcuuuguucuugucaucgauacucaagcagguuucuu

SEQ ID NO: 209165 - RNA, 64 nt, Homo Sapiens
ggaagaaacccuuccacgugguauugcuccauuuucuugucaauggcaaacaugugcaacucuu

SEQ ID NO: 209166 - RNA, 64 nt, Homo Sapiens
uuagagcuuguuuauggaagcuccuguaauauagucuugucaccacucuguacauuuuucuuuu

SEQ ID NO: 209167 - RNA, 64 nt, Homo Sapiens
uauaucacuaccauugucacuuugcuagaugaggucuugucaaagugucugaaccuuauccaug

SEQ ID NO: 209168 - RNA, 64 nt, Homo Sapiens
uucuuuuuuucuuuuuuuugagauggagucucacucuugucacccaggcuggagugcaguagug

SEQ ID NO: 209169 - RNA, 64 nt, Homo Sapiens
gaugggcuccauuaaaaccagcucaaaaauaaauucuugucaguaaagauuucuugucaagaug

SEQ ID NO: 209170 - RNA, 64 nt, Homo Sapiens
ccagcucaaaaauaaauucuugucaguaaagauuucuugucaagaugucuuggauugcacuuuu

SEQ ID NO: 209171 - RNA, 64 nt, Homo Sapiens
ucccggguacacuagauggcuccaucccaaggcaucuugucauaaaacagcuuucccccacccc

SEQ ID NO: 209172 - RNA, 64 nt, Homo Sapiens
gaaaauaaaguugaguuggcuguguuuucucugcucuugucagaacauugggacaauuggucgu

SEQ ID NO: 209173 - RNA, 64 nt, Homo Sapiens
uguccccaucccuccccugucucuuugagcuggcucuugucacuuaggucucaucucaguggcc

SEQ ID NO: 209174 - RNA, 64 nt, Homo Sapiens
ccaaagacaaaauugggagaacaaaagaaaagcgucuugucacauacagaaggucccugauaaa

SEQ ID NO: 209175 - RNA, 64 nt, Homo Sapiens
auggggcuggcagcaccgagagccuggggggccccccggagacggagcuuccugagggcaggga

SEQ ID NO: 209176 - RNA, 64 nt, Homo Sapiens
ugggcccugagauccuccacggucagcgccggggcccggagauggagcugggacgagugugugg

SEQ ID NO: 209177 - RNA, 64 nt, Homo Sapiens
gcagccuccugugguugggcgagccccagaggcucccggagacuaaccugcuguuggcccggga

SEQ ID NO: 209178 - RNA, 64 nt, Homo Sapiens
aaaacguccgcucaaaacguaggugagacguugucccggagaucugacucugaaggacucuggg

SEQ ID NO: 209179 - RNA, 64 nt, Homo Sapiens
caucuuuuuauggguggagcagagagucaaucccugcagccacccugcagccagccaucucugc

SEQ ID NO: 209180 - RNA, 64 nt, Homo Sapiens
ggguggagcagagagucaaucccugcagccacccugcagccagccaucucugcaguucucucag

SEQ ID NO: 209181 - RNA, 64 nt, Homo Sapiens
ccugccucaucccaaagaucagguaugggcugaaugcagccaucugagcaagggcugagggaag

SEQ ID NO: 209182 - RNA, 64 nt, Homo Sapiens
ccuugcauggaugcaguugugacucuggggacaaugcagccagaagcugagggaccagcacuug

SEQ ID NO: 209183 - RNA, 64 nt, Homo Sapiens
gcgguuaaaaaauauaaguauaguuucgguuuucugcagccauucugcuuuauugccaaagggc

SEQ ID NO: 209184 - RNA, 64 nt, Homo Sapiens
guuuccauuaugcaacuuguggugacaaaugcagugcagccagugaacugaauagauuagaaug

SEQ ID NO: 209185 - RNA, 64 nt, Homo Sapiens
cagccagacaccuuguacugggcacgcgucagacugcagccaguccguuuccuuucuuuagcca

SEQ ID NO: 209186 - RNA, 64 nt, Homo Sapiens
cacagcgcgguggcugggucugcacacuggccucugcagccagauuucuauauugggaguuuuu

SEQ ID NO: 209187 - RNA, 64 nt, Homo Sapiens
gauucucucuuguccuucacauauauagaaggacugcagccacucuggcggaucuagugaccag

SEQ ID NO: 209188 - RNA, 64 nt, Homo Sapiens
caaaugccugccaaauuuuauuucauuuugcaccugcagccaagggcaaagccagaaaaagauc

SEQ ID NO: 209189 - RNA, 64 nt, Homo Sapiens
ugugugccacacggcagccuccccacccgccaucugcagccaggcuucugcagagaaaaugucc

SEQ ID NO: 209190 - RNA, 64 nt, Homo Sapiens
uuuagccuuuggcuuugguccccauccaauaaaaugcagccaggacucccacccacuuccauca

SEQ ID NO: 209191 - RNA, 64 nt, Homo Sapiens
agguguguuuaucccacaguagccauuguggaacugcagccaugacgguuaguccauaaucuag

SEQ ID NO: 209192 - RNA, 64 nt, Homo Sapiens
aauuuauuuucauuguuggcaggggugggucaagugcagccagcuuuuccaccuuucacaucca

SEQ ID NO: 209193 - RNA, 64 nt, Homo Sapiens
uggacucgcugauccugggccgcagccuggggugugcagccaucucauucugugaaugugccaa

SEQ ID NO: 209194 - RNA, 64 nt, Homo Sapiens
ccuggaggccggcuuaguucuuccauuucacccuugcagccagcuguuggccacggccccugcc

SEQ ID NO: 209195 - RNA, 64 nt, Homo Sapiens
cuggccuugcuggaggcacagggcucugcggaccugcagccaucugugaggcccgcggggaugg

SEQ ID NO: 209196 - RNA, 64 nt, Homo Sapiens
ugcaaaagacccaacgccaacaccuggugccuucugcagccagcgcccacccauccgugcccgg

SEQ ID NO: 209197 - RNA, 64 nt, Homo Sapiens
cuuucagcaaagcuucauugcaaagagcaugagaugcagccauucaagagauacauacucucuu

SEQ ID NO: 209198 - RNA, 64 nt, Homo Sapiens
ggcaccucaagaagaagaggugugagcucccaggugcagccagaugcaggugaaacccagucac

SEQ ID NO: 209199 - RNA, 64 nt, Homo Sapiens
agucucuuauuuaucugcagaaggaacuuuggggugcagccaggacccgguaggccugagccuc

SEQ ID NO: 209200 - RNA, 64 nt, Homo Sapiens
cuccuggagugaguuuccauuuccagcuggaaucugcagccacccccauuuccuguuuuccauu

SEQ ID NO: 209201 - RNA, 64 nt, Homo Sapiens
cccagcucuaugucugugucugaauuguggaucgugcagccaugguuauuguggaacuguggaa

SEQ ID NO: 209202 - RNA, 64 nt, Homo Sapiens
cgugcagccaugguuauuguggaacuguggaaccugcagccauaguuauuugacuauaucuuga

SEQ ID NO: 209203 - RNA, 64 nt, Homo Sapiens
cagacuccugccagauggggcucaugggaagggaugcagccaggcccugcacauuccagaagcc

SEQ ID NO: 209204 - RNA, 64 nt, Homo Sapiens
agccgucagccagaucccaaacauacucuaauaaugcagccagggccaagaacuuaccuucaga

SEQ ID NO: 209205 - RNA, 64 nt, Homo Sapiens
ucucacaaaguacaaaacgaguuuucucuccaggugcagccagaaguuccugggaaagggguau

SEQ ID NO: 209206 - RNA, 64 nt, Homo Sapiens
uuuuacugaguuuguggcaaauguuuuguucauuugcagccaguucacuuguuccuucaucuac

SEQ ID NO: 209207 - RNA, 64 nt, Homo Sapiens
agccacaugccuagacuuauauacuaguuaguggugcagccagggagaggacucagauuuccug

SEQ ID NO: 209208 - RNA, 64 nt, Homo Sapiens
gcaaagucuaucucugaaacuccaugaagacuuuugcagccaguucccaccaauaugccccaga

SEQ ID NO: 209209 - RNA, 64 nt, Homo Sapiens
acuacuagaugugaacuugaagaagguugucagcugcagccacuuucugccagcaucugcagcc

SEQ ID NO: 209210 - RNA, 64 nt, Homo Sapiens
agguugucagcugcagccacuuucugccagcaucugcagccacuuucugccagcaucugcagcc

SEQ ID NO: 209211 - RNA, 64 nt, Homo Sapiens
cugccagcaucugcagccacuuucugccagcaucugcagccagcaagcugggacuggcaggaaa

SEQ ID NO: 209212 - RNA, 64 nt, Homo Sapiens
ucaucguugcgcagccccuguugcaccucugaccugcagccacgggcagugugccgggccuccg

SEQ ID NO: 209213 - RNA, 64 nt, Homo Sapiens
cguguccgaacucuccaauggcccuggcugggggugcagccaguggcccuuugugcagugaaca

SEQ ID NO: 209214 - RNA, 64 nt, Homo Sapiens
agccagaggauacccagggaaaaaagaccagcuuugcagccagauaucaaugaaaaaaaaaaaa

SEQ ID NO: 209215 - RNA, 64 nt, Homo Sapiens
ugcaguggcucacaccuguggucaagaccagccuugcagccaggacuacugccugacguuguca

SEQ ID NO: 209216 - RNA, 64 nt, Homo Sapiens
ccuuacacugggcacauggaggagacguccacccugcagccaggacugggguucacgucacugc

SEQ ID NO: 209217 - RNA, 64 nt, Homo Sapiens
uccucgcucuccuaaguuuaauuacaacagcacgugcagccacgucagccaaaugacuucauuu

SEQ ID NO: 209218 - RNA, 64 nt, Homo Sapiens
gacugggggcagagcucuggaaaagggcccaugcugcagccacuaacaagcccugggauuggac

SEQ ID NO: 209219 - RNA, 64 nt, Homo Sapiens
cacgcaccaucugugggucucuucacugcagcccugcagccacccuauucaggugccauguggc

SEQ ID NO: 209220 - RNA, 64 nt, Homo Sapiens
cagguagcauacgcucuuugcacuugguagcgucugcagccaccaaucuuuaagaauccgccag

SEQ ID NO: 209221 - RNA, 64 nt, Homo Sapiens; identical to SEQ ID NO: 126039

SEQ ID NO: 209222 - RNA, 64 nt, Homo Sapiens; identical to SEQ ID NO: 126040

SEQ ID NO: 209223 - RNA, 64 nt, Homo Sapiens; identical to SEQ ID NO: 126041

SEQ ID NO: 209224 - RNA, 64 nt, Homo Sapiens; identical to SEQ ID NO: 126042

SEQ ID NO: 209225 - RNA, 64 nt, Homo Sapiens
uuuacaguacuaaagaaagcugacugaaaugaaucuuucuaaacaaaguaacuuuggcaguaau

SEQ ID NO: 209226 - RNA, 64 nt, Homo Sapiens
uagcacagcugucaucucaucugaacucauauuccuuucuaauauaaauucaaguuuucuggcc

SEQ ID NO: 209227 - RNA, 64 nt, Homo Sapiens
gaauacuuguuuuauagaaagaauccauucaagucuuucuaacuaugccccaaguguuaaaacu

SEQ ID NO: 209228 - RNA, 64 nt, Homo Sapiens
cuucucaugcauaugcauucucaacucauuccagcuuucuaauuccuugcggccccuggaauga

SEQ ID NO: 209229 - RNA, 64 nt, Homo Sapiens
gcuccccgacugcagugcaaccuuuacccccaaacuuucuaagguuucuaguugcuuccucauu

SEQ ID NO: 209230 - RNA, 64 nt, Homo Sapiens
guaaagcauuuucaaaacucuacaguaauuuauucuuucuaaagguauggcuacccuugugauc

SEQ ID NO: 209231 - RNA, 64 nt, Homo Sapiens
caugcacuaguguuuggaggguguugugguuugucuuucuaauuagguguauagccuauucacu

SEQ ID NO: 209232 - RNA, 64 nt, Homo Sapiens
agaaaggauauggcuaccuuuuguuaaaucugcacuuucuaaauaucaaaaaagggaaaugaag

SEQ ID NO: 209233 - RNA, 64 nt, Homo Sapiens
uguagcaucaagaugcccaacagaggaacucuuucuuucuaaccuuguucagauugaggugaaa

SEQ ID NO: 209234 - RNA, 64 nt, Homo Sapiens
uuaucagggaagugaggaaauguuugggagaggacuuucuaagcucuauuuagguguuagaucu

SEQ ID NO: 209235 - RNA, 64 nt, Homo Sapiens
uuuuucuuucacaaaggcaguggguauaauauagcuuucuaauuacguacuuaaauuuucugug

SEQ ID NO: 209236 - RNA, 64 nt, Homo Sapiens
uguguguauguuugugugaagccaagcacacagucuuucuaaagaugauauuaaauaugccgaa

SEQ ID NO: 209237 - RNA, 64 nt, Homo Sapiens
agagagcaucugcaacaaaacaaguacugguugacuuucuaauugaacugcaauaauaucaaaa

SEQ ID NO: 209238 - RNA, 64 nt, Homo Sapiens
caaaccaggugcaauuauuuuuugcaaaaugagacuuucuaaaucacuuuugacugagggcagc

SEQ ID NO: 209239 - RNA, 64 nt, Homo Sapiens
caaaccuguaacuuguauccugacuuaucucuugcuuucuaaaccuuguuucuaacugucuauc

SEQ ID NO: 209240 - RNA, 64 nt, Homo Sapiens
uuuuagcaaguuuucuuaugaaaauaccuuugugcuuucuaaguauaaagauuuaaauuauuuu

SEQ ID NO: 209241 - RNA, 64 nt, Homo Sapiens
ucuuacccaaccuguuucucggccuuaugaaacucuuucuaaccuacaaugagcugaauuagau

SEQ ID NO: 209242 - RNA, 64 nt, Homo Sapiens
uaaauuuagguuugcagaaagaaagaauauuaaccuuucuaaacauaguauaugccauaguuua

SEQ ID NO: 209243 - RNA, 64 nt, Homo Sapiens
cuuuuauagggaaacauucugugacauuaauuuccuuucuaauuuaaaggagaguuacuuuguu

SEQ ID NO: 209244 - RNA, 64 nt, Homo Sapiens
aggaguuggaaggaaacucuuacuaaaauguuaacuuucuaaaaaccuucuuuuagaucuuccu

SEQ ID NO: 209245 - RNA, 64 nt, Homo Sapiens
acuugucccauuucauucucuaaaauaauugguucuuucuaaacuauuucagguauaggaauua

SEQ ID NO: 209246 - RNA, 64 nt, Homo Sapiens
ugccuaaacucuaggccauuauguagcaaaauuucuuucuaaccgacugaacgagcauaaauaa

SEQ ID NO: 209247 - RNA, 64 nt, Homo Sapiens
guggucuuguucacaugcucauucuuaagugaaccuuucuaaauguuuugcgcauugucauggg

SEQ ID NO: 209248 - RNA, 64 nt, Homo Sapiens
ugaaagcugaugaaucuuaauggcauuuuucucccuuucuaaaaaugaguucauacuuucuacg

SEQ ID NO: 209249 - RNA, 64 nt, Homo Sapiens
ugaccagauuucuuaaugaagcuuauuuuacagacuuucuaauuaaaccuguggcaaaaugaac

SEQ ID NO: 209250 - RNA, 64 nt, Homo Sapiens
guaguauuuuuagaauggcauauaacaaaagauacuuucuaacagccuuuuuauauucugaaau

SEQ ID NO: 209251 - RNA, 64 nt, Homo Sapiens
gguaauggaggaagacuaguagaaacaaucauaucuuucuaagcugauucuauuuuguaaaugg

SEQ ID NO: 209252 - RNA, 64 nt, Homo Sapiens
ccaguuaagcauggaagagauacgcauagcucaccuuucuaaacaauaucccaaguaguucuuc

SEQ ID NO: 209253 - RNA, 64 nt, Homo Sapiens
aaauauacaccuuauacccaaguaagccucuucccuuucuaauauuuacugggauuccugauca

SEQ ID NO: 209254 - RNA, 64 nt, Homo Sapiens
auugguuaacagagcucuguugucugguuuuagucuuucuaaaggauauuuuaacuaaaacuau

SEQ ID NO: 209255 - RNA, 64 nt, Homo Sapiens
uuuaacuaaaacuauggagaugcuaagagagugacuuucuaaauaugaaacagauaauuuacgg

SEQ ID NO: 209256 - RNA, 64 nt, Homo Sapiens
ccaaaggaugacuguaggccgugugcuggccuuucuuucuaagaagcugcuuugagcuccugga

SEQ ID NO: 209257 - RNA, 64 nt, Homo Sapiens
cugugaaauucguuuucuuuuucauggugccuuucuuucuaagaaaagauagaaagaauggggc

SEQ ID NO: 209258 - RNA, 64 nt, Homo Sapiens
uaggaagcagaaaaacaaauuuuuucuuugaagacuuucuaaaucauuaauuugucaaguuuuu

SEQ ID NO: 209259 - RNA, 64 nt, Homo Sapiens
cuucccaccuuaccuuuuaguuucuuuucacucucuuucuaaugcgugugaggccuuuuuuauu

SEQ ID NO: 209260 - RNA, 64 nt, Homo Sapiens
gacauuccccuauggauuaucuuuauaucacugucuuucuaagcccagagaugucauaagugac

SEQ ID NO: 209261 - RNA, 64 nt, Homo Sapiens
aacuuagaagcagcucuaaaucuaguagagcagacuuucuaacauaccuaguuuuguguauugg

SEQ ID NO: 209262 - RNA, 64 nt, Homo Sapiens
uucaguaguggugaugguugugucgugaugaaaacuuucuaaauauugauagaacguuucuuug

SEQ ID NO: 209263 - RNA, 64 nt, Homo Sapiens
guugcauguuaugugagucauugugguuuucagccuuucuaaaacauuuugcucaacaugguau

SEQ ID NO: 209264 - RNA, 64 nt, Homo Sapiens
uucaguaguggugaugguugugucgugaugaaaacuuucuaaauacugauagaacguuacuuug

SEQ ID NO: 209265 - RNA, 64 nt, Homo Sapiens; identical to SEQ ID NO: 209263

SEQ ID NO: 209266 - RNA, 64 nt, Homo Sapiens
aucucauuccuacuuuuauaguuuuuguuugaggcuuucuaaccaagauccccuccuuccuaac

SEQ ID NO: 209267 - RNA, 64 nt, Homo Sapiens
agguggagucuuccgggauugacccuggugauaccuuucuaaaaauauauucaacugugaagaa

SEQ ID NO: 209268 - RNA, 64 nt, Homo Sapiens
cucuuuuuuuaacaaaugccuucuuauagaaaaacuuucuaagaggcaacaauuuagaauggau

SEQ ID NO: 209269 - RNA, 64 nt, Homo Sapiens
acccuuguucaaaaaagaaauggauaaacuuggccuuucuaagugguaagaaugaccugucacu

SEQ ID NO: 209270 - RNA, 64 nt, Homo Sapiens
uuuuucucgacauucuuggggcuuuuagccagugcuuucuaauuugguguauccagauugcuuu

SEQ ID NO: 209271 - RNA, 64 nt, Homo Sapiens
uuaagcuaccaagauccugaagauggaaugcaaucuuucuaacaaguagaaaucuugaguaauc

SEQ ID NO: 209272 - RNA, 64 nt, Homo Sapiens
ugauauaggaaugaaccaauacgcuuuuauuacccuuucuaacucugauuuuauaaucagacuu

SEQ ID NO: 209273 - RNA, 64 nt, Homo Sapiens
uuagcccaguuauucuccccuaugccuuccuucucuuucuaagcguccacuaggucuggccuug

SEQ ID NO: 209274 - RNA, 64 nt, Homo Sapiens
gccauugccuuccauguuguuuuuugcaaaugugcuuucuaauaagucucugggcuauuuuuua

SEQ ID NO: 209275 - RNA, 64 nt, Homo Sapiens
ucuuauugauggcuaauauacaguccuuuuauagcuuucuaaguaaaauccauucuuuaucaau

SEQ ID NO: 209276 - RNA, 64 nt, Homo Sapiens
agaauuacacacuaggaaauagaacauaaccaauacuuucgaguccucccugugucccgcugug

SEQ ID NO: 209277 - RNA, 64 nt, Homo Sapiens
uccuaaagacauguggaggauucacuuucuccacacuuucgaaugugccuuugcucagaggcgc

SEQ ID NO: 209278 - RNA, 64 nt, Homo Sapiens
aaaaccaaacacccggacgaaaaaaagcccagaaacuuucgaacuuuggauuuuacaaaaaaaa

SEQ ID NO: 209279 - RNA, 64 nt, Homo Sapiens
cuccuuauauugcuggaaacuucuuauaaaagaaacuuucgagcggaacccuugcuagcaggca

SEQ ID NO: 209280 - RNA, 64 nt, Homo Sapiens
cuaacaaaagguacuaggauuagcugcaaucucuacuuucgaugaggaaaucccaguaagcuuu

SEQ ID NO: 209281 - RNA, 64 nt, Homo Sapiens
ugucaugagacuucaguguuaauguucacaauauacuuucgaaagaauaaaauaguucuccuac

SEQ ID NO: 209282 - RNA, 64 nt, Homo Sapiens
uuuguuaaauguuggcacuaugaaguccugcauaacuuucgaacacagccauuccguacaugug

SEQ ID NO: 209283 - RNA, 64 nt, Homo Sapiens
uugggcgcuggcguuuguguuugcagauugaagcacuuucgaugaaacucuuccugccacgggc

SEQ ID NO: 209284 - RNA, 64 nt, Homo Sapiens
aaaguaaauuauaggaaaaaaacaaagauaauauacuuucgaugugcuucuaucuagcauguua

SEQ ID NO: 209285 - RNA, 64 nt, Homo Sapiens
ggaggucuuugccaccaaugggagaugagcccaaacuuucgaucuaggugggugauguguagca

SEQ ID NO: 209286 - RNA, 64 nt, Homo Sapiens
uuuuuuaaaccucugaauuuauucugugucugugacuuucgaagcucagccuucagcuuccuaa

SEQ ID NO: 209287 - RNA, 64 nt, Homo Sapiens
cuguacuucagaugcgaaaucaaaugaucuagucacuuucgauaagcagcugaagaaaaaagcu

SEQ ID NO: 209288 - RNA, 64 nt, Homo Sapiens
uccaguucucccugaugacauuccuaggagcaacacuuucgaccacaagaagaauaugaggugg

SEQ ID NO: 209289 - RNA, 64 nt, Homo Sapiens
guaagacacuuaaaguaaguuugugaauuugucaacuuucgagcaucaaacaaauauuuuacuu

SEQ ID NO: 209290 - RNA, 64 nt, Homo Sapiens
uuuaaauuaaaucaaugaucuucaaguauuugccacuuucgaguacagcuaauuggauaaucuc

SEQ ID NO: 209291 - RNA, 53 nt, Homo Sapiens
aaagcuggagagcugcuuaauauacuuucgaaaguaagaagaguuucuucaag

SEQ ID NO: 209292 - RNA, 64 nt, Homo Sapiens
auuugcagugcgucuagcaccuuucaucuuaaacacuuucgaggaagaucuuaaguguauugcu

SEQ ID NO: 209293 - RNA, 64 nt, Homo Sapiens
augcuuuguuuuggggcuguuuucaccugggaugacuuucgauuaccucccccaagccaaccac

SEQ ID NO: 209294 - RNA, 64 nt, Homo Sapiens
aacaaacaaacaaacaaaaaaguaaaaaaagauuacuuucgagagagaaguuuaagcuucacca

SEQ ID NO: 209295 - RNA, 64 nt, Homo Sapiens
caccaagaucuaaguuacuuguugaaagaaaguuacuuucgacaagaucuaauaugaaagcaua

SEQ ID NO: 209296 - RNA, 64 nt, Homo Sapiens
uuuuuuuuccauaaaggaaaaaaacacuuauuuuacuuucgauuagcauuaucuucaucauggg

SEQ ID NO: 209297 - RNA, 64 nt, Homo Sapiens
aucuaacuuuugccauugggggcacugaagaggcacuuucgaguuccacuuguuaguuuaucuu

SEQ ID NO: 209298 - RNA, 64 nt, Homo Sapiens
uuucauuuuccuucagaauagaucaucaagaaauacuuucgaaauaauucauaaccauagccuc

SEQ ID NO: 209299 - RNA, 64 nt, Homo Sapiens
agguugucaacagguacuauuugucacauaacuaacuuucgaggcacuggaacauaccugaacu

SEQ ID NO: 209300 - RNA, 64 nt, Homo Sapiens
uaaauugggcccaagagcuuauguucucagagugacuuucgaaauuccagcaaaacacagugca

SEQ ID NO: 209301 - RNA, 64 nt, Homo Sapiens
uucguuugauuccuggcugaggccucccuguuccacuuucgagguccaggcagccaugggaggc

SEQ ID NO: 209302 - RNA, 64 nt, Homo Sapiens
uauuuggcuuuuguuaauaucuguuuacuucuucacuuucgaagccaacuaacucacagaaaaa

SEQ ID NO: 209303 - RNA, 64 nt, Homo Sapiens
guugugcgugugcgcgcacacguguguaaaaagcacuuucgauugugccuccuguuuucucgag

SEQ ID NO: 209304 - RNA, 64 nt, Homo Sapiens
ccuuacuguagcuaauucuaccauucuucaggcaacuuucgauucggacgcagccguucugugc

SEQ ID NO: 209305 - RNA, 64 nt, Homo Sapiens
uacaguugaauaccugaucagucuauucggggugacuuucgaacgugguggcuuugaaggagcu

SEQ ID NO: 209306 - RNA, 64 nt, Homo Sapiens
gacuuuccccaagagaaaauaauaugaucagguaacuuucgacccaguggagaugaagccuaag

SEQ ID NO: 209307 - RNA, 64 nt, Homo Sapiens
cccugaacuugagacaccaaaacaaauauucgggacuuucgaagaaaacucuucucucgggaca

SEQ ID NO: 209308 - RNA, 64 nt, Homo Sapiens
ucccagcuccagcuucgucugggagcugggggacacuuucgagcaguuacaggcaaagugagga

SEQ ID NO: 209309 - RNA, 64 nt, Homo Sapiens
cuccuucuggacuguggcgucaccucaugaaaccacuuucgaggucuucaccaggaguaaauuc

SEQ ID NO: 209310 - RNA, 64 nt, Homo Sapiens
ugccccugaaccuaugacauacccaagucccaauacuuucgagccaucugccacugccuuuuga

SEQ ID NO: 209311 - RNA, 64 nt, Homo Sapiens
aaaaaaaaaaaaaaaaaaagagaaucguacgucgacuuucgauuuuucacagccucagccuagg

SEQ ID NO: 209312 - RNA, 64 nt, Homo Sapiens
acacugaagagaccaccuugaucccccagugauuacuuucgauuccaugggcacagcuaacauu

SEQ ID NO: 209313 - RNA, 64 nt, Homo Sapiens
uaggcccuggcaggcagcugggggguucccccaaacuuucgaagauacgaaaggaaaaagggca

SEQ ID NO: 209314 - RNA, 64 nt, Homo Sapiens
ugcaaauaugccuccaaacuaagagaaaugaggaacuuucgaacauguaauuucugauaaaagu

SEQ ID NO: 209315 - RNA, 64 nt, Homo Sapiens
gacagcuggucugcauugcugguacugguugcaucauccucauccucagagcuggcuucacagg

SEQ ID NO: 209316 - RNA, 64 nt, Homo Sapiens
uggucugcauugcugguacugguugcaucauccucauccucagagcuggcuucacaggcagugu

SEQ ID NO: 209317 - RNA, 64 nt, Homo Sapiens
cuucaaggagcauauuuugcaccgugcuucuccacauccucaucuucccuuguuuuuuaaagau

SEQ ID NO: 209318 - RNA, 64 nt, Homo Sapiens
cuacugacaugcccauuucucaccugccacuaggcauccucaucacaaagucacagacauccug

SEQ ID NO: 209319 - RNA, 64 nt, Homo Sapiens
aucagaaguuuauaaaaauaaaucugacuauaugcauccucauuuauucccuuuagaaccuagg

SEQ ID NO: 209320 - RNA, 64 nt, Homo Sapiens
gccagggccucaagcucaagauacuuauugaaaacauccucaauugcaauaaaaacauuauaac

SEQ ID NO: 209321 - RNA, 64 nt, Homo Sapiens
acacaggaaccuaggggaggaggggagcgcugggcauccucaggcuggcggccaaggccugccc

SEQ ID NO: 209322 - RNA, 64 nt, Homo Sapiens
ggacaagcaaaaggcugcaaacaacccagaagcccauccucagaagacuggagaaaugauugag

SEQ ID NO: 209323 - RNA, 64 nt, Homo Sapiens
cggccucuguuugaguccuuuucuggguguucagcauccucaucguacgcugcacaacuggaag

SEQ ID NO: 209324 - RNA, 64 nt, Homo Sapiens
cggggccguccagacagcaaucucccccgcaacccauccucagcggacucugagcguccguguc

SEQ ID NO: 209325 - RNA, 64 nt, Homo Sapiens
uggagugagagccaaagaaacaaagauccacacacauccucaccccacagaaacugcuggacac

SEQ ID NO: 209326 - RNA, 64 nt, Homo Sapiens
aacuaaagcagcaaaugcaggaaggcugucucgccauccucaagacucagcagcucucauucuc

SEQ ID NO: 209327 - RNA, 64 nt, Homo Sapiens
cccaccccugggcaccauuuugacucuccuucaacauccucaccuaauuuuagcacacaucugc

SEQ ID NO: 209328 - RNA, 64 nt, Homo Sapiens
cccacucaucucugaggagcucaagucaaucccccauccucacauugcauaucuguauagaaaa

SEQ ID NO: 209329 - RNA, 64 nt, Homo Sapiens
aagugcugagucugugaauaauguucuuuccuuucauccucagccaggcccagccuggccccaa

SEQ ID NO: 209330 - RNA, 64 nt, Homo Sapiens
cccagggcccugcucaggccgagggcaggggcugcauccucagcccgggaaaggccggugggaa

SEQ ID NO: 209331 - RNA, 64 nt, Homo Sapiens
gacaccagugaugaaauggaccccuccacacaggcauccucagggcacagggcccugggggcac

SEQ ID NO: 209332 - RNA, 64 nt, Homo Sapiens
uccuaggcugccugagauuucugugugcugaucgcauccucaguuucuuguccaccgcuucacu

SEQ ID NO: 209333 - RNA, 64 nt, Homo Sapiens
aucacggggugaaggucagaaacaauauaaaggacauccucaucugggaguguggacuuaggaa

SEQ ID NO: 209334 - RNA, 64 nt, Homo Sapiens
gucuggggugggaguguggauuuccucugucugccauccucagauaauucuccauaaaaugggc

SEQ ID NO: 209335 - RNA, 64 nt, Homo Sapiens
cuucuugcugcugaucacguuccaagagaaccaccauccucacacaacaaauuucugcucaacu

SEQ ID NO: 209336 - RNA, 64 nt, Homo Sapiens
uccuuaccuauauguuucugaauaaauucugaaccauccucaucucauauaguguuuuguuuua

SEQ ID NO: 209337 - RNA, 64 nt, Homo Sapiens
cuucuugcugcuaaucaacucccaagagaacuaccauccucacacaacaaccuucagcucaacu

SEQ ID NO: 209338 - RNA, 64 nt, Homo Sapiens
cuugggaaucugcuugagggagggcagaauacuucauccucauucccucuuuccuuacaccuug

SEQ ID NO: 209339 - RNA, 64 nt, Homo Sapiens
caauugggagguggcauucuauauuaccauaauucauccucacuacugggugaggaguggucgu

SEQ ID NO: 209340 - RNA, 64 nt, Homo Sapiens
aagaugcuggagacuuuuuaugcugccuacugggcauccucagcuccauccauccucacucagc

SEQ ID NO: 209341 - RNA, 64 nt, Homo Sapiens
cagcugcugccuacugggcacccugcauuccauccauccucacugcacuugggcuccccuccug

SEQ ID NO: 209342 - RNA, 64 nt, Homo Sapiens
ugugcaaccgcccguccucccucaucuucauccucauccucaucccuccuggcccauccucauc

SEQ ID NO: 209343 - RNA, 64 nt, Homo Sapiens
cucaucugugcaaccgcccgcucauccucaucuucauccucaucguguccccuccuggcccauc

SEQ ID NO: 209344 - RNA, 64 nt, Homo Sapiens
uucauccucauccucaucuguccuggcccauccucauccucaucguggcuccugcugugucccc

SEQ ID NO: 209345 - RNA, 64 nt, Homo Sapiens
cucaucuucauccucauccuguccccuccuggcccauccucaucgcugcuguggcuccugcugu

SEQ ID NO: 209346 - RNA, 64 nt, Homo Sapiens
gguccuccgggggaggaggguguagcuggcaugucauccucagggcgcuuccucgcucacgcca

SEQ ID NO: 209347 - RNA, 64 nt, Homo Sapiens
cagugaguggcaggggcaggagaggggagaaccccauccucagagcugcucccagccagcgagu

SEQ ID NO: 209348 - RNA, 64 nt, Homo Sapiens
ccacaucccaccacauccaccuccauccccaacccauccucauccccaacuacagccccaaacc

SEQ ID NO: 209349 - RNA, 64 nt, Homo Sapiens
ccagccccagacuaauccacagccauccccaacucauccucauccccaacugcagccccaaacc

SEQ ID NO: 209350 - RNA, 64 nt, Homo Sapiens
uccccucaacuccaauccauaacccccuucaaaccauccucaacuaagcuccucuccagcccug

SEQ ID NO: 209351 - RNA, 64 nt, Homo Sapiens
acaagcccuuguuugaguguugcuuugucuuuuccauccucaucauuuuuuuuucucuucaagu

SEQ ID NO: 209352 - RNA, 64 nt, Homo Sapiens
gcuuugaacuccccauuccagagucaccagccaccauccucagaagguggcccuagagacacua

SEQ ID NO: 209353 - RNA, 64 nt, Homo Sapiens
gaaacuauggcuuuaaacuacccuccagagugugcagacugaugggacaucaaauuugccacca

SEQ ID NO: 209354 - RNA, 64 nt, Homo Sapiens
agaaugucaccaguccugcccaaugccuugacaacagacugaauuuuaaauguucacaacauaa

SEQ ID NO: 209355 - RNA, 64 nt, Homo Sapiens
agaacagauuacuuaaagcuauuucauuucaaagcagacugaaugugacuucaucuaaaggcag

SEQ ID NO: 209356 - RNA, 64 nt, Homo Sapiens
cacggcuuaaccccagucuugaugguauauugaacagacugaauauauuuuaccauuacagggc

SEQ ID NO: 209357 - RNA, 64 nt, Homo Sapiens
ucuggguccuugcagcugugaugguuucagagcucagacugaucaggcaucaagcuacccucaa

SEQ ID NO: 209358 - RNA, 64 nt, Homo Sapiens
auagauuccucuagaaaggcaucaaaaggcucaacagacugaauggccucuuggucugcgaaaa

SEQ ID NO: 209359 - RNA, 64 nt, Homo Sapiens
agcagucccagauaaccaaguacccuccccuacucagacugagcaggaggccugacugguucau

SEQ ID NO: 209360 - RNA, 64 nt, Homo Sapiens
ugccacccucugcuaguccuaagaagacagggaccagacugaaccuaagaacacagcuggcugg

SEQ ID NO: 209361 - RNA, 64 nt, Homo Sapiens
uuaggauaaaccuccaagcucacauuuaauauaacagacugaaguaaacauuagaauccuguuu

SEQ ID NO: 209362 - RNA, 64 nt, Homo Sapiens
cauacgaaauguauuugguuuuguuggagagugucagacugaucuggaagugaaacacaguuua

SEQ ID NO: 209363 - RNA, 64 nt, Homo Sapiens
auuuuauauguaaaucaagauccuagagcgugugcagacugaugugucccuaugucuuggccac

SEQ ID NO: 209364 - RNA, 64 nt, Homo Sapiens
gugcccauguguucgccuccuccgguguguaccucagacugauggcugggaacagaguggaguc

SEQ ID NO: 209365 - RNA, 64 nt, Homo Sapiens
agaacuuauugggcaugugguauacugaagcaauacccguuagacaaggauauuuuacuucuuc

SEQ ID NO: 209366 - RNA, 64 nt, Homo Sapiens
gcuucaaugaugcugagucuauuaauuuacaaggacccguuaggguccuucgauaauaugaaac

SEQ ID NO: 209367 - RNA, 64 nt, Homo Sapiens
uaaaaagaagucugaaauguguauaauagaguauacccguuacucacguaacguagcauaugau

SEQ ID NO: 209368 - RNA, 64 nt, Homo Sapiens
gagcugagacccuuauuuaaaccuggagccuguuacccguuagacuggggcucuuggcccuccc

SEQ ID NO: 209369 - RNA, 64 nt, Homo Sapiens
cccuugaugcuauucacauggcacauuuaguuccacccguuagagcacacuaccaguguugugg

SEQ ID NO: 209370 - RNA, 64 nt, Homo Sapiens
ggguccagacugaauguggguuucugaaagaaacacccguuaccgcagaacugcgcacgcuccc

SEQ ID NO: 209371 - RNA, 64 nt, Homo Sapiens
auaagaggagccgucuggugugucagggucacgaacccguuacauuucaggacgauccuuuuuc

SEQ ID NO: 209372 - RNA, 64 nt, Homo Sapiens
cuugggcccaaugaauuaggggugaggccccagaacccguuaucuaugaguuguaugggggagc

SEQ ID NO: 209373 - RNA, 64 nt, Homo Sapiens
ugcaucugcccuggcuguuuaagcacugggggcuacccguuagccaaucuuggagaggugcaaa

SEQ ID NO: 209374 - RNA, 64 nt, Homo Sapiens
aacaauggauagagaacacaugucccuuauuucaacccguuagcucuuccagcugugggaccgc

SEQ ID NO: 209375 - RNA, 64 nt, Homo Sapiens
cuuuuuccguaauaacacccuuccuucuguaaauacccguuaccauauuuauccauuuguaauu

SEQ ID NO: 209376 - RNA, 64 nt, Homo Sapiens
cuuugaggcuuuucagugaacugacaccgcaauaacccguuagggucacuagaccucagcuagc

SEQ ID NO: 209377 - RNA, 64 nt, Homo Sapiens
aaauguuccauacugacaugccggaggcagccugacccguuauuuggaaagaauuugugaauua

SEQ ID NO: 209378 - RNA, 64 nt, Homo Sapiens
gcuggggggaaggcgauguggugaccccacccccacccguuaauuuaaagcuguuucuaaacag

SEQ ID NO: 209379 - RNA, 64 nt, Homo Sapiens
cuguguguccuuguguaaauuuaaguauuuuguaacccguuacaucccuggauauggauuucag

SEQ ID NO: 209380 - RNA, 64 nt, Homo Sapiens
cacuacccuucucucccccaccccaacaucccagacccguuaccuaucguccuguugugcucag

SEQ ID NO: 209381 - RNA, 64 nt, Homo Sapiens
uuaccuggccuuccaugugggacacugugaauaaacccguuaccggugggggcugccuguaaau

SEQ ID NO: 209382 - RNA, 64 nt, Homo Sapiens
uuaucuguucuguucaaaacuauuuguucaaagaacccguuaguguuguuuacaggguuacagu

SEQ ID NO: 209383 - RNA, 64 nt, Homo Sapiens
acuucagguaagugaggugaaaugguagccagugacccguuaggagcucucaccguacauacuc

SEQ ID NO: 209384 - RNA, 64 nt, Homo Sapiens
cccgagguggcuccugcuuaccuuaucaucccagggcucugauuagccaggccuggucaggguc

SEQ ID NO: 209385 - RNA, 64 nt, Homo Sapiens
accaucugagggagaggaacguggaacaggagcaggcucugaugcugagaggcuugccuccggg

SEQ ID NO: 209386 - RNA, 64 nt, Homo Sapiens
uccuguccugaccuucugugauguggaaacccuaggcucugagacacacucucuggugucugag

SEQ ID NO: 209387 - RNA, 64 nt, Homo Sapiens
uuugucuuaagcuauaguguaaaaacaaaguuugggcucugaaaauuuaacugaaaaagauuuc

SEQ ID NO: 209388 - RNA, 64 nt, Homo Sapiens
cugguggguacgaaagguguugaauaucccugcuggcucugaugggagaacaugugauggugug

SEQ ID NO: 209389 - RNA, 64 nt, Homo Sapiens
cucuagcaugguucaguccugucuggggagccuuggcucugagcaggcccauucccagcuccuu

SEQ ID NO: 209390 - RNA, 64 nt, Homo Sapiens
gcagaagaaaugccuccccaggucugucucuggaggcucugagggagaugggcuugggggcugu

SEQ ID NO: 209391 - RNA, 64 nt, Homo Sapiens
uggccugcaccucaccaagccuagccacucucgcggcucugaguggcucacaggcuugugaggg

SEQ ID NO: 209392 - RNA, 64 nt, Homo Sapiens
gguaccucacacucggagcucgccugcccugcuuggcucugaggaccugcccagcgcucaaagg

SEQ ID NO: 209393 - RNA, 64 nt, Homo Sapiens
ugccuuugcccucggccuacuugcccuagcaugaggcucugagagccaccugcccaccaaucug

SEQ ID NO: 209394 - RNA, 64 nt, Homo Sapiens
agcagcccuuggugcaaagccagagacugauccuggcucugacggcugaagagggaagacccaa

SEQ ID NO: 209395 - RNA, 64 nt, Homo Sapiens
ggaagcugcggcagggagcgggcgccggcuucguggcucugagguguaacgggggugggcuccc

SEQ ID NO: 209396 - RNA, 61 nt, Homo Sapiens
uccgcaccaucagcgucugaggcgucccacuggcucugaucuugcuuccugcuuggaaacu

SEQ ID NO: 209397 - RNA, 64 nt, Homo Sapiens
gauucuguuugacguauuguucucuagaaggccuggcucugauccagugaccccucucaccaaa

SEQ ID NO: 209398 - RNA, 64 nt, Homo Sapiens
ugccggaggagaccccacuaacccagccugccugggcucugaccacuaacacucuuggccaugg

SEQ ID NO: 209399 - RNA, 64 nt, Homo Sapiens
ugagucccccugcugccccugccacaucccagugggcucugacccccugaucucaacucguggc

SEQ ID NO: 209400 - RNA, 64 nt, Homo Sapiens
uuucacaggucuugcccaaacagauggagaaacaggcucugagaugcccuaccugccuguucuc

SEQ ID NO: 209401 - RNA, 64 nt, Homo Sapiens
aguggaguucucuguucuagcccuccaaacacugggcucugaggcccggugcagaacaggggca

SEQ ID NO: 209402 - RNA, 64 nt, Homo Sapiens
gaagcugucugggcagcugcucgagggaggcccuggcucugaucccaggcuggauggaguggcu

SEQ ID NO: 209403 - RNA, 64 nt, Homo Sapiens
ucucaaucuccagagccauguccauggggaggugggcucugaagggcgaaggugggagagcagg

SEQ ID NO: 209404 - RNA, 64 nt, Homo Sapiens
ggagcuguggccuggcuguggagggccgggugguggcucugaggaugguccccagccccacccu

SEQ ID NO: 209405 - RNA, 64 nt, Homo Sapiens
ccagcugaggaaggaggcagagcuggggccugaaggcucugagcagccuccagccagggggcuc

SEQ ID NO: 209406 - RNA, 64 nt, Homo Sapiens
uaaguauaucagaugacacuggcaauggaucucaggcucugagaaaagaaagacaagugacagg

SEQ ID NO: 209407 - RNA, 64 nt, Homo Sapiens
gaaucuagccuccccucuguugccuuccggagggggcucugagagaagaaaagaaggaagcagu

SEQ ID NO: 209408 - RNA, 64 nt, Homo Sapiens; identical to SEQ ID NO: 74140

SEQ ID NO: 209409 - RNA, 64 nt, Homo Sapiens; identical to SEQ ID NO: 74141

SEQ ID NO: 209410 - RNA, 64 nt, Homo Sapiens; identical to SEQ ID NO: 74142

SEQ ID NO: 209411 - RNA, 64 nt, Homo Sapiens; identical to SEQ ID NO: 74143

SEQ ID NO: 209412 - RNA, 64 nt, Homo Sapiens; identical to SEQ ID NO: 74144

SEQ ID NO: 209413 - RNA, 64 nt, Homo Sapiens; identical to SEQ ID NO: 74145

SEQ ID NO: 209414 - RNA, 64 nt, Homo Sapiens; identical to SEQ ID NO: 74146

SEQ ID NO: 209415 - RNA, 64 nt, Homo Sapiens; identical to SEQ ID NO: 74147

SEQ ID NO: 209416 - RNA, 64 nt, Homo Sapiens; identical to SEQ ID NO: 74148

SEQ ID NO: 209417 - RNA, 64 nt, Homo Sapiens; identical to SEQ ID NO: 74149

SEQ ID NO: 209418 - RNA, 64 nt, Homo Sapiens; identical to SEQ ID NO: 74150

SEQ ID NO: 209419 - RNA, 64 nt, Homo Sapiens; identical to SEQ ID NO: 74151

SEQ ID NO: 209420 - RNA, 64 nt, Homo Sapiens; identical to SEQ ID NO: 74152

SEQ ID NO: 209421 - RNA, 64 nt, Homo Sapiens; identical to SEQ ID NO: 74153

SEQ ID NO: 209422 - RNA, 64 nt, Homo Sapiens; identical to SEQ ID NO: 74154

SEQ ID NO: 209423 - RNA, 64 nt, Homo Sapiens; identical to SEQ ID NO: 74155

SEQ ID NO: 209424 - RNA, 64 nt, Homo Sapiens; identical to SEQ ID NO: 74156

SEQ ID NO: 209425 - RNA, 64 nt, Homo Sapiens; identical to SEQ ID NO: 74157

SEQ ID NO: 209426 - RNA, 64 nt, Homo Sapiens; identical to SEQ ID NO: 74158

SEQ ID NO: 209427 - RNA, 64 nt, Homo Sapiens; identical to SEQ ID NO: 74159

SEQ ID NO: 209428 - RNA, 64 nt, Homo Sapiens; identical to SEQ ID NO: 74160

SEQ ID NO: 209429 - RNA, 64 nt, Homo Sapiens; identical to SEQ ID NO: 74161

SEQ ID NO: 209430 - RNA, 64 nt, Homo Sapiens; identical to SEQ ID NO: 74162

SEQ ID NO: 209431 - RNA, 64 nt, Homo Sapiens; identical to SEQ ID NO: 74163

SEQ ID NO: 209432 - RNA, 64 nt, Homo Sapiens; identical to SEQ ID NO: 74164

SEQ ID NO: 209433 - RNA, 64 nt, Homo Sapiens; identical to SEQ ID NO: 74165

SEQ ID NO: 209434 - RNA, 64 nt, Homo Sapiens; identical to SEQ ID NO: 74166

SEQ ID NO: 209435 - RNA, 64 nt, Homo Sapiens; identical to SEQ ID NO: 74167

SEQ ID NO: 209436 - RNA, 64 nt, Homo Sapiens; identical to SEQ ID NO: 74168

SEQ ID NO: 209437 - RNA, 64 nt, Homo Sapiens; identical to SEQ ID NO: 74169

SEQ ID NO: 209438 - RNA, 64 nt, Homo Sapiens; identical to SEQ ID NO: 74170

SEQ ID NO: 209439 - RNA, 64 nt, Homo Sapiens; identical to SEQ ID NO: 74171

SEQ ID NO: 209440 - RNA, 64 nt, Homo Sapiens; identical to SEQ ID NO: 74172

SEQ ID NO: 209441 - RNA, 64 nt, Homo Sapiens; identical to SEQ ID NO: 74173

SEQ ID NO: 209442 - RNA, 64 nt, Homo Sapiens; identical to SEQ ID NO: 74174

SEQ ID NO: 209443 - RNA, 64 nt, Homo Sapiens; identical to SEQ ID NO: 74175

SEQ ID NO: 209444 - RNA, 64 nt, Homo Sapiens; identical to SEQ ID NO: 74176

SEQ ID NO: 209445 - RNA, 64 nt, Homo Sapiens; identical to SEQ ID NO: 74177

SEQ ID NO: 209446 - RNA, 64 nt, Homo Sapiens; identical to SEQ ID NO: 74178

SEQ ID NO: 209447 - RNA, 64 nt, Homo Sapiens; identical to SEQ ID NO: 74179

SEQ ID NO: 209448 - RNA, 64 nt, Homo Sapiens; identical to SEQ ID NO: 74180

SEQ ID NO: 209449 - RNA, 64 nt, Homo Sapiens; identical to SEQ ID NO: 74181

SEQ ID NO: 209450 - RNA, 64 nt, Homo Sapiens; identical to SEQ ID NO: 74182

SEQ ID NO: 209451 - RNA, 64 nt, Homo Sapiens; identical to SEQ ID NO: 74183

SEQ ID NO: 209452 - RNA, 64 nt, Homo Sapiens; identical to SEQ ID NO: 74184

SEQ ID NO: 209453 - RNA, 64 nt, Homo Sapiens; identical to SEQ ID NO: 74185

SEQ ID NO: 209454 - RNA, 64 nt, Homo Sapiens; identical to SEQ ID NO: 74186

SEQ ID NO: 209455 - RNA, 64 nt, Homo Sapiens; identical to SEQ ID NO: 74187

SEQ ID NO: 209456 - RNA, 64 nt, Homo Sapiens; identical to SEQ ID NO: 74188

SEQ ID NO: 209457 - RNA, 64 nt, Homo Sapiens; identical to SEQ ID NO: 74189

SEQ ID NO: 209458 - RNA, 64 nt, Homo Sapiens; identical to SEQ ID NO: 74190

SEQ ID NO: 209459 - RNA, 64 nt, Homo Sapiens; identical to SEQ ID NO: 74191

SEQ ID NO: 209460 - RNA, 64 nt, Homo Sapiens; identical to SEQ ID NO: 74192

SEQ ID NO: 209461 - RNA, 64 nt, Homo Sapiens; identical to SEQ ID NO: 74193

SEQ ID NO: 209462 - RNA, 64 nt, Homo Sapiens; identical to SEQ ID NO: 74194

SEQ ID NO: 209463 - RNA, 64 nt, Homo Sapiens; identical to SEQ ID NO: 74195

SEQ ID NO: 209464 - RNA, 64 nt, Homo Sapiens; identical to SEQ ID NO: 74196

SEQ ID NO: 209465 - RNA, 64 nt, Homo Sapiens; identical to SEQ ID NO: 74197

SEQ ID NO: 209466 - RNA, 64 nt, Homo Sapiens; identical to SEQ ID NO: 74198

SEQ ID NO: 209467 - RNA, 64 nt, Homo Sapiens; identical to SEQ ID NO: 74199

SEQ ID NO: 209468 - RNA, 64 nt, Homo Sapiens; identical to SEQ ID NO: 74200

SEQ ID NO: 209469 - RNA, 64 nt, Homo Sapiens; identical to SEQ ID NO: 74201

SEQ ID NO: 209470 - RNA, 64 nt, Homo Sapiens; identical to SEQ ID NO: 74202

SEQ ID NO: 209471 - RNA, 64 nt, Homo Sapiens; identical to SEQ ID NO: 74203

SEQ ID NO: 209472 - RNA, 64 nt, Homo Sapiens; identical to SEQ ID NO: 74204

SEQ ID NO: 209473 - RNA, 64 nt, Homo Sapiens; identical to SEQ ID NO: 74205

SEQ ID NO: 209474 - RNA, 64 nt, Homo Sapiens; identical to SEQ ID NO: 74206

SEQ ID NO: 209475 - RNA, 64 nt, Homo Sapiens; identical to SEQ ID NO: 74207

SEQ ID NO: 209476 - RNA, 64 nt, Homo Sapiens; identical to SEQ ID NO: 74208

SEQ ID NO: 209477 - RNA, 64 nt, Homo Sapiens; identical to SEQ ID NO: 74209

SEQ ID NO: 209478 - RNA, 64 nt, Homo Sapiens; identical to SEQ ID NO: 74210

SEQ ID NO: 209479 - RNA, 64 nt, Homo Sapiens; identical to SEQ ID NO: 74211

SEQ ID NO: 209480 - RNA, 64 nt, Homo Sapiens; identical to SEQ ID NO: 74212

SEQ ID NO: 209481 - RNA, 64 nt, Homo Sapiens; identical to SEQ ID NO: 74213

SEQ ID NO: 209482 - RNA, 64 nt, Homo Sapiens; identical to SEQ ID NO: 74214

SEQ ID NO: 209483 - RNA, 64 nt, Homo Sapiens; identical to SEQ ID NO: 74215

SEQ ID NO: 209484 - RNA, 64 nt, Homo Sapiens; identical to SEQ ID NO: 74216

SEQ ID NO: 209485 - RNA, 58 nt, Homo Sapiens; identical to SEQ ID NO: 74217

SEQ ID NO: 209486 - RNA, 64 nt, Homo Sapiens; identical to SEQ ID NO: 74218

SEQ ID NO: 209487 - RNA, 64 nt, Homo Sapiens; identical to SEQ ID NO: 74219

SEQ ID NO: 209488 - RNA, 64 nt, Homo Sapiens; identical to SEQ ID NO: 74220

SEQ ID NO: 209489 - RNA, 64 nt, Homo Sapiens; identical to SEQ ID NO: 74221

SEQ ID NO: 209490 - RNA, 56 nt, Homo Sapiens; identical to SEQ ID NO: 74222

SEQ ID NO: 209491 - RNA, 64 nt, Homo Sapiens; identical to SEQ ID NO: 74223

SEQ ID NO: 209492 - RNA, 64 nt, Homo Sapiens; identical to SEQ ID NO: 74224

SEQ ID NO: 209493 - RNA, 64 nt, Homo Sapiens; identical to SEQ ID NO: 74225

SEQ ID NO: 209494 - RNA, 64 nt, Homo Sapiens; identical to SEQ ID NO: 74226

SEQ ID NO: 209495 - RNA, 64 nt, Homo Sapiens; identical to SEQ ID NO: 74227

SEQ ID NO: 209496 - RNA, 64 nt, Homo Sapiens; identical to SEQ ID NO: 74228

SEQ ID NO: 209497 - RNA, 53 nt, Homo Sapiens; identical to SEQ ID NO: 74229

SEQ ID NO: 209498 - RNA, 64 nt, Homo Sapiens; identical to SEQ ID NO: 74230

SEQ ID NO: 209499 - RNA, 64 nt, Homo Sapiens; identical to SEQ ID NO: 74231

SEQ ID NO: 209500 - RNA, 64 nt, Homo Sapiens; identical to SEQ ID NO: 74232

SEQ ID NO: 209501 - RNA, 64 nt, Homo Sapiens; identical to SEQ ID NO: 74233

SEQ ID NO: 209502 - RNA, 64 nt, Homo Sapiens; identical to SEQ ID NO: 74234

SEQ ID NO: 209503 - RNA, 64 nt, Homo Sapiens; identical to SEQ ID NO: 74235

SEQ ID NO: 209504 - RNA, 64 nt, Homo Sapiens; identical to SEQ ID NO: 74236

SEQ ID NO: 209505 - RNA, 64 nt, Homo Sapiens; identical to SEQ ID NO: 74237

SEQ ID NO: 209506 - RNA, 64 nt, Homo Sapiens; identical to SEQ ID NO: 74238

SEQ ID NO: 209507 - RNA, 64 nt, Homo Sapiens; identical to SEQ ID NO: 74239

SEQ ID NO: 209508 - RNA, 64 nt, Homo Sapiens; identical to SEQ ID NO: 74240

SEQ ID NO: 209509 - RNA, 64 nt, Homo Sapiens; identical to SEQ ID NO: 74241

SEQ ID NO: 209510 - RNA, 64 nt, Homo Sapiens; identical to SEQ ID NO: 74242

SEQ ID NO: 209511 - RNA, 64 nt, Homo Sapiens; identical to SEQ ID NO: 74243

SEQ ID NO: 209512 - RNA, 64 nt, Homo Sapiens; identical to SEQ ID NO: 74244

SEQ ID NO: 209513 - RNA, 64 nt, Homo Sapiens; identical to SEQ ID NO: 74245

SEQ ID NO: 209514 - RNA, 64 nt, Homo Sapiens; identical to SEQ ID NO: 74246

SEQ ID NO: 209515 - RNA, 64 nt, Homo Sapiens; identical to SEQ ID NO: 74247

SEQ ID NO: 209516 - RNA, 64 nt, Homo Sapiens; identical to SEQ ID NO: 74248

SEQ ID NO: 209517 - RNA, 64 nt, Homo Sapiens; identical to SEQ ID NO: 74249

SEQ ID NO: 209518 - RNA, 64 nt, Homo Sapiens; identical to SEQ ID NO: 74250

SEQ ID NO: 209519 - RNA, 64 nt, Homo Sapiens; identical to SEQ ID NO: 74251

SEQ ID NO: 209520 - RNA, 64 nt, Homo Sapiens; identical to SEQ ID NO: 74252

SEQ ID NO: 209521 - RNA, 64 nt, Homo Sapiens; identical to SEQ ID NO: 74253

SEQ ID NO: 209522 - RNA, 64 nt, Homo Sapiens; identical to SEQ ID NO: 74254

SEQ ID NO: 209523 - RNA, 64 nt, Homo Sapiens; identical to SEQ ID NO: 74255

SEQ ID NO: 209524 - RNA, 64 nt, Homo Sapiens; identical to SEQ ID NO: 74256

SEQ ID NO: 209525 - RNA, 64 nt, Homo Sapiens; identical to SEQ ID NO: 74257

SEQ ID NO: 209526 - RNA, 64 nt, Homo Sapiens; identical to SEQ ID NO: 74258

SEQ ID NO: 209527 - RNA, 64 nt, Homo Sapiens; identical to SEQ ID NO: 74259

SEQ ID NO: 209528 - RNA, 64 nt, Homo Sapiens; identical to SEQ ID NO: 74260

SEQ ID NO: 209529 - RNA, 64 nt, Homo Sapiens; identical to SEQ ID NO: 74261

SEQ ID NO: 209530 - RNA, 64 nt, Homo Sapiens; identical to SEQ ID NO: 74262

SEQ ID NO: 209531 - RNA, 64 nt, Homo Sapiens; identical to SEQ ID NO: 74263

SEQ ID NO: 209532 - RNA, 64 nt, Homo Sapiens; identical to SEQ ID NO: 74264

SEQ ID NO: 209533 - RNA, 64 nt, Homo Sapiens; identical to SEQ ID NO: 209384

SEQ ID NO: 209534 - RNA, 64 nt, Homo Sapiens; identical to SEQ ID NO: 209385

SEQ ID NO: 209535 - RNA, 64 nt, Homo Sapiens; identical to SEQ ID NO: 209386

SEQ ID NO: 209536 - RNA, 64 nt, Homo Sapiens; identical to SEQ ID NO: 209387

SEQ ID NO: 209537 - RNA, 64 nt, Homo Sapiens; identical to SEQ ID NO: 209388

SEQ ID NO: 209538 - RNA, 64 nt, Homo Sapiens; identical to SEQ ID NO: 209389

SEQ ID NO: 209539 - RNA, 64 nt, Homo Sapiens; identical to SEQ ID NO: 209390

SEQ ID NO: 209540 - RNA, 64 nt, Homo Sapiens; identical to SEQ ID NO: 209391

SEQ ID NO: 209541 - RNA, 64 nt, Homo Sapiens; identical to SEQ ID NO: 209392

SEQ ID NO: 209542 - RNA, 64 nt, Homo Sapiens; identical to SEQ ID NO: 209393

SEQ ID NO: 209543 - RNA, 64 nt, Homo Sapiens; identical to SEQ ID NO: 209394

SEQ ID NO: 209544 - RNA, 64 nt, Homo Sapiens; identical to SEQ ID NO: 209395

SEQ ID NO: 209545 - RNA, 61 nt, Homo Sapiens; identical to SEQ ID NO: 209396

SEQ ID NO: 209546 - RNA, 64 nt, Homo Sapiens; identical to SEQ ID NO: 209397

SEQ ID NO: 209547 - RNA, 64 nt, Homo Sapiens; identical to SEQ ID NO: 209398

SEQ ID NO: 209548 - RNA, 64 nt, Homo Sapiens; identical to SEQ ID NO: 209399

SEQ ID NO: 209549 - RNA, 64 nt, Homo Sapiens; identical to SEQ ID NO: 209400

SEQ ID NO: 209550 - RNA, 64 nt, Homo Sapiens; identical to SEQ ID NO: 209401

SEQ ID NO: 209551 - RNA, 64 nt, Homo Sapiens; identical to SEQ ID NO: 209402

SEQ ID NO: 209552 - RNA, 64 nt, Homo Sapiens; identical to SEQ ID NO: 209403

SEQ ID NO: 209553 - RNA, 64 nt, Homo Sapiens; identical to SEQ ID NO: 209404

SEQ ID NO: 209554 - RNA, 64 nt, Homo Sapiens; identical to SEQ ID NO: 209405

SEQ ID NO: 209555 - RNA, 64 nt, Homo Sapiens; identical to SEQ ID NO: 209406

SEQ ID NO: 209556 - RNA, 64 nt, Homo Sapiens; identical to SEQ ID NO: 209407

SEQ ID NO: 209557 - RNA, 64 nt, Homo Sapiens; identical to SEQ ID NO: 74140

SEQ ID NO: 209558 - RNA, 64 nt, Homo Sapiens; identical to SEQ ID NO: 74141

SEQ ID NO: 209559 - RNA, 64 nt, Homo Sapiens; identical to SEQ ID NO: 74142

SEQ ID NO: 209560 - RNA, 64 nt, Homo Sapiens; identical to SEQ ID NO: 74143

SEQ ID NO: 209561 - RNA, 64 nt, Homo Sapiens; identical to SEQ ID NO: 74144

SEQ ID NO: 209562 - RNA, 64 nt, Homo Sapiens; identical to SEQ ID NO: 74145

SEQ ID NO: 209563 - RNA, 64 nt, Homo Sapiens; identical to SEQ ID NO: 74146

SEQ ID NO: 209564 - RNA, 64 nt, Homo Sapiens; identical to SEQ ID NO: 74147

SEQ ID NO: 209565 - RNA, 64 nt, Homo Sapiens; identical to SEQ ID NO: 74148

SEQ ID NO: 209566 - RNA, 64 nt, Homo Sapiens; identical to SEQ ID NO: 74149

SEQ ID NO: 209567 - RNA, 64 nt, Homo Sapiens; identical to SEQ ID NO: 74150

SEQ ID NO: 209568 - RNA, 64 nt, Homo Sapiens; identical to SEQ ID NO: 74151

SEQ ID NO: 209569 - RNA, 64 nt, Homo Sapiens; identical to SEQ ID NO: 74152

SEQ ID NO: 209570 - RNA, 64 nt, Homo Sapiens; identical to SEQ ID NO: 74153

SEQ ID NO: 209571 - RNA, 64 nt, Homo Sapiens; identical to SEQ ID NO: 74154

SEQ ID NO: 209572 - RNA, 64 nt, Homo Sapiens; identical to SEQ ID NO: 74155

SEQ ID NO: 209573 - RNA, 64 nt, Homo Sapiens; identical to SEQ ID NO: 74156

SEQ ID NO: 209574 - RNA, 64 nt, Homo Sapiens; identical to SEQ ID NO: 74157

SEQ ID NO: 209575 - RNA, 64 nt, Homo Sapiens; identical to SEQ ID NO: 74158

SEQ ID NO: 209576 - RNA, 64 nt, Homo Sapiens; identical to SEQ ID NO: 74159

SEQ ID NO: 209577 - RNA, 64 nt, Homo Sapiens; identical to SEQ ID NO: 74160

SEQ ID NO: 209578 - RNA, 64 nt, Homo Sapiens; identical to SEQ ID NO: 74161

SEQ ID NO: 209579 - RNA, 64 nt, Homo Sapiens; identical to SEQ ID NO: 74162

SEQ ID NO: 209580 - RNA, 64 nt, Homo Sapiens; identical to SEQ ID NO: 74163

SEQ ID NO: 209581 - RNA, 64 nt, Homo Sapiens; identical to SEQ ID NO: 74164

SEQ ID NO: 209582 - RNA, 64 nt, Homo Sapiens; identical to SEQ ID NO: 74165

SEQ ID NO: 209583 - RNA, 64 nt, Homo Sapiens; identical to SEQ ID NO: 74166

SEQ ID NO: 209584 - RNA, 64 nt, Homo Sapiens; identical to SEQ ID NO: 74167

SEQ ID NO: 209585 - RNA, 64 nt, Homo Sapiens; identical to SEQ ID NO: 74168

SEQ ID NO: 209586 - RNA, 64 nt, Homo Sapiens; identical to SEQ ID NO: 74169

SEQ ID NO: 209587 - RNA, 64 nt, Homo Sapiens; identical to SEQ ID NO: 74170

SEQ ID NO: 209588 - RNA, 64 nt, Homo Sapiens; identical to SEQ ID NO: 74171

SEQ ID NO: 209589 - RNA, 64 nt, Homo Sapiens; identical to SEQ ID NO: 74172

SEQ ID NO: 209590 - RNA, 64 nt, Homo Sapiens; identical to SEQ ID NO: 74173

SEQ ID NO: 209591 - RNA, 64 nt, Homo Sapiens; identical to SEQ ID NO: 74174

SEQ ID NO: 209592 - RNA, 64 nt, Homo Sapiens; identical to SEQ ID NO: 74175

SEQ ID NO: 209593 - RNA, 64 nt, Homo Sapiens; identical to SEQ ID NO: 74176

SEQ ID NO: 209594 - RNA, 64 nt, Homo Sapiens; identical to SEQ ID NO: 74177

SEQ ID NO: 209595 - RNA, 64 nt, Homo Sapiens; identical to SEQ ID NO: 74178

SEQ ID NO: 209596 - RNA, 64 nt, Homo Sapiens; identical to SEQ ID NO: 74179

SEQ ID NO: 209597 - RNA, 64 nt, Homo Sapiens; identical to SEQ ID NO: 74180

SEQ ID NO: 209598 - RNA, 64 nt, Homo Sapiens; identical to SEQ ID NO: 74181

SEQ ID NO: 209599 - RNA, 64 nt, Homo Sapiens; identical to SEQ ID NO: 74182

SEQ ID NO: 209600 - RNA, 64 nt, Homo Sapiens; identical to SEQ ID NO: 74183

SEQ ID NO: 209601 - RNA, 64 nt, Homo Sapiens; identical to SEQ ID NO: 74184

SEQ ID NO: 209602 - RNA, 64 nt, Homo Sapiens; identical to SEQ ID NO: 74185

SEQ ID NO: 209603 - RNA, 64 nt, Homo Sapiens; identical to SEQ ID NO: 74186

SEQ ID NO: 209604 - RNA, 64 nt, Homo Sapiens; identical to SEQ ID NO: 74187

SEQ ID NO: 209605 - RNA, 64 nt, Homo Sapiens; identical to SEQ ID NO: 74188

SEQ ID NO: 209606 - RNA, 64 nt, Homo Sapiens; identical to SEQ ID NO: 74189

SEQ ID NO: 209607 - RNA, 64 nt, Homo Sapiens; identical to SEQ ID NO: 74190

SEQ ID NO: 209608 - RNA, 64 nt, Homo Sapiens; identical to SEQ ID NO: 74191

SEQ ID NO: 209609 - RNA, 64 nt, Homo Sapiens; identical to SEQ ID NO: 74192

SEQ ID NO: 209610 - RNA, 64 nt, Homo Sapiens; identical to SEQ ID NO: 74193

SEQ ID NO: 209611 - RNA, 64 nt, Homo Sapiens; identical to SEQ ID NO: 74194

SEQ ID NO: 209612 - RNA, 64 nt, Homo Sapiens; identical to SEQ ID NO: 74195

SEQ ID NO: 209613 - RNA, 64 nt, Homo Sapiens; identical to SEQ ID NO: 74196

SEQ ID NO: 209614 - RNA, 64 nt, Homo Sapiens; identical to SEQ ID NO: 74197

SEQ ID NO: 209615 - RNA, 64 nt, Homo Sapiens; identical to SEQ ID NO: 74198

SEQ ID NO: 209616 - RNA, 64 nt, Homo Sapiens; identical to SEQ ID NO: 74199

SEQ ID NO: 209617 - RNA, 64 nt, Homo Sapiens; identical to SEQ ID NO: 74200

SEQ ID NO: 209618 - RNA, 64 nt, Homo Sapiens; identical to SEQ ID NO: 74201

SEQ ID NO: 209619 - RNA, 64 nt, Homo Sapiens; identical to SEQ ID NO: 74202

SEQ ID NO: 209620 - RNA, 64 nt, Homo Sapiens; identical to SEQ ID NO: 74203

SEQ ID NO: 209621 - RNA, 64 nt, Homo Sapiens; identical to SEQ ID NO: 74204

SEQ ID NO: 209622 - RNA, 64 nt, Homo Sapiens; identical to SEQ ID NO: 74205

SEQ ID NO: 209623 - RNA, 64 nt, Homo Sapiens; identical to SEQ ID NO: 74206

SEQ ID NO: 209624 - RNA, 64 nt, Homo Sapiens; identical to SEQ ID NO: 74207

SEQ ID NO: 209625 - RNA, 64 nt, Homo Sapiens; identical to SEQ ID NO: 74208

SEQ ID NO: 209626 - RNA, 64 nt, Homo Sapiens; identical to SEQ ID NO: 74209

SEQ ID NO: 209627 - RNA, 64 nt, Homo Sapiens; identical to SEQ ID NO: 74210

SEQ ID NO: 209628 - RNA, 64 nt, Homo Sapiens; identical to SEQ ID NO: 74211

SEQ ID NO: 209629 - RNA, 64 nt, Homo Sapiens; identical to SEQ ID NO: 74212

SEQ ID NO: 209630 - RNA, 64 nt, Homo Sapiens; identical to SEQ ID NO: 74213

SEQ ID NO: 209631 - RNA, 64 nt, Homo Sapiens; identical to SEQ ID NO: 74214

SEQ ID NO: 209632 - RNA, 64 nt, Homo Sapiens; identical to SEQ ID NO: 74215

SEQ ID NO: 209633 - RNA, 64 nt, Homo Sapiens; identical to SEQ ID NO: 74216

SEQ ID NO: 209634 - RNA, 58 nt, Homo Sapiens; identical to SEQ ID NO: 74217

SEQ ID NO: 209635 - RNA, 64 nt, Homo Sapiens; identical to SEQ ID NO: 74218

SEQ ID NO: 209636 - RNA, 64 nt, Homo Sapiens; identical to SEQ ID NO: 74219

SEQ ID NO: 209637 - RNA, 64 nt, Homo Sapiens; identical to SEQ ID NO: 74220

SEQ ID NO: 209638 - RNA, 64 nt, Homo Sapiens; identical to SEQ ID NO: 74221

SEQ ID NO: 209639 - RNA, 56 nt, Homo Sapiens; identical to SEQ ID NO: 74222

SEQ ID NO: 209640 - RNA, 64 nt, Homo Sapiens; identical to SEQ ID NO: 74223

SEQ ID NO: 209641 - RNA, 64 nt, Homo Sapiens; identical to SEQ ID NO: 74224

SEQ ID NO: 209642 - RNA, 64 nt, Homo Sapiens; identical to SEQ ID NO: 74225

SEQ ID NO: 209643 - RNA, 64 nt, Homo Sapiens; identical to SEQ ID NO: 74226

SEQ ID NO: 209644 - RNA, 64 nt, Homo Sapiens; identical to SEQ ID NO: 74227

SEQ ID NO: 209645 - RNA, 64 nt, Homo Sapiens; identical to SEQ ID NO: 74228

SEQ ID NO: 209646 - RNA, 53 nt, Homo Sapiens; identical to SEQ ID NO: 74229

SEQ ID NO: 209647 - RNA, 64 nt, Homo Sapiens; identical to SEQ ID NO: 74230

SEQ ID NO: 209648 - RNA, 64 nt, Homo Sapiens; identical to SEQ ID NO: 74231

SEQ ID NO: 209649 - RNA, 64 nt, Homo Sapiens; identical to SEQ ID NO: 74232

SEQ ID NO: 209650 - RNA, 64 nt, Homo Sapiens; identical to SEQ ID NO: 74233

SEQ ID NO: 209651 - RNA, 64 nt, Homo Sapiens; identical to SEQ ID NO: 74234

SEQ ID NO: 209652 - RNA, 64 nt, Homo Sapiens; identical to SEQ ID NO: 74235

SEQ ID NO: 209653 - RNA, 64 nt, Homo Sapiens; identical to SEQ ID NO: 74236

SEQ ID NO: 209654 - RNA, 64 nt, Homo Sapiens; identical to SEQ ID NO: 74237

SEQ ID NO: 209655 - RNA, 64 nt, Homo Sapiens; identical to SEQ ID NO: 74238

SEQ ID NO: 209656 - RNA, 64 nt, Homo Sapiens; identical to SEQ ID NO: 74239

SEQ ID NO: 209657 - RNA, 64 nt, Homo Sapiens; identical to SEQ ID NO: 74240

SEQ ID NO: 209658 - RNA, 64 nt, Homo Sapiens; identical to SEQ ID NO: 74241

SEQ ID NO: 209659 - RNA, 64 nt, Homo Sapiens; identical to SEQ ID NO: 74242

SEQ ID NO: 209660 - RNA, 64 nt, Homo Sapiens; identical to SEQ ID NO: 74243

SEQ ID NO: 209661 - RNA, 64 nt, Homo Sapiens; identical to SEQ ID NO: 74244

SEQ ID NO: 209662 - RNA, 64 nt, Homo Sapiens; identical to SEQ ID NO: 74245

SEQ ID NO: 209663 - RNA, 64 nt, Homo Sapiens; identical to SEQ ID NO: 74246

SEQ ID NO: 209664 - RNA, 64 nt, Homo Sapiens; identical to SEQ ID NO: 74247

SEQ ID NO: 209665 - RNA, 64 nt, Homo Sapiens; identical to SEQ ID NO: 74248

SEQ ID NO: 209666 - RNA, 64 nt, Homo Sapiens; identical to SEQ ID NO: 74249

SEQ ID NO: 209667 - RNA, 64 nt, Homo Sapiens; identical to SEQ ID NO: 74250

SEQ ID NO: 209668 - RNA, 64 nt, Homo Sapiens; identical to SEQ ID NO: 74251

SEQ ID NO: 209669 - RNA, 64 nt, Homo Sapiens; identical to SEQ ID NO: 74252

SEQ ID NO: 209670 - RNA, 64 nt, Homo Sapiens; identical to SEQ ID NO: 74253

SEQ ID NO: 209671 - RNA, 64 nt, Homo Sapiens; identical to SEQ ID NO: 74254

SEQ ID NO: 209672 - RNA, 64 nt, Homo Sapiens; identical to SEQ ID NO: 74255

SEQ ID NO: 209673 - RNA, 64 nt, Homo Sapiens; identical to SEQ ID NO: 74256

SEQ ID NO: 209674 - RNA, 64 nt, Homo Sapiens; identical to SEQ ID NO: 74257

SEQ ID NO: 209675 - RNA, 64 nt, Homo Sapiens; identical to SEQ ID NO: 74258

SEQ ID NO: 209676 - RNA, 64 nt, Homo Sapiens; identical to SEQ ID NO: 74259

SEQ ID NO: 209677 - RNA, 64 nt, Homo Sapiens; identical to SEQ ID NO: 74260

SEQ ID NO: 209678 - RNA, 64 nt, Homo Sapiens; identical to SEQ ID NO: 74261

SEQ ID NO: 209679 - RNA, 64 nt, Homo Sapiens; identical to SEQ ID NO: 74262

SEQ ID NO: 209680 - RNA, 64 nt, Homo Sapiens; identical to SEQ ID NO: 74263

SEQ ID NO: 209681 - RNA, 64 nt, Homo Sapiens; identical to SEQ ID NO: 74264

SEQ ID NO: 209682 - RNA, 64 nt, Homo Sapiens
cggcauaacuuuuuagaaaacagaaaugcccuugaugguggaaaaaagaaaacaaccacccccc

SEQ ID NO: 209683 - RNA, 64 nt, Homo Sapiens
cuaaaacucacccaacagaucuuuccagagguccaugguggaagacgauaacccugugaaauac

SEQ ID NO: 209684 - RNA, 64 nt, Homo Sapiens
aaagucacuguaauuuucaugugguuaucuuuguaugguggaacggcauacuaaaaaauguuga

SEQ ID NO: 209685 - RNA, 64 nt, Homo Sapiens
accgcgcagacauuaaaaguguaucuccauccagaugguggagugauugcuuaaguaaauuauu

SEQ ID NO: 209686 - RNA, 64 nt, Homo Sapiens
cuaaugauucagcccacaggaaguaauagauuuucuuggcaaauugcugaaauaaaaagugagc

SEQ ID NO: 209687 - RNA, 64 nt, Homo Sapiens
cucaggcagcugauugugaauauuuaacccuguacuuggcaauguauuuuaauuuauuuuuuac

SEQ ID NO: 209688 - RNA, 64 nt, Homo Sapiens
agaaaucuuuucaucuuuagccucagcccuaacccuuggcaaucuguuuauagucacaaccucu

SEQ ID NO: 209689 - RNA, 64 nt, Homo Sapiens
ugauggaugagagcuuucugugaaggaaagaagccuuggcaaaagaaaauaucagagaauuuaa

SEQ ID NO: 209690 - RNA, 64 nt, Homo Sapiens
caagugguccaguaucucaacuguauugccauaguggucacaccgccagucccauaaugaaaug

SEQ ID NO: 209691 - RNA, 64 nt, Homo Sapiens
ggcuggauucucugacaaaacuucuacaggggucuggucacaaggaauuuaggaagcauucccu

SEQ ID NO: 209692 - RNA, 64 nt, Homo Sapiens
aacaguuuccauaaagauguggggaagauaaagauggucacacagugcauacaucucauccaca

SEQ ID NO: 209693 - RNA, 64 nt, Homo Sapiens
gaucaacgaauaguaaauaaucuuaguacacuuguggucacagguauaauuuaaaggauuggug

SEQ ID NO: 209694 - RNA, 64 nt, Homo Sapiens
gaugacaaccagcccagccaggccugacucaucauggucacauccagcccccacccccggccaa

SEQ ID NO: 209695 - RNA, 64 nt, Homo Sapiens
ccaccacgccuggccaguuucuucauuuuacauauggucacauuggcgccuagaacaguuaggu

SEQ ID NO: 209696 - RNA, 64 nt, Homo Sapiens
ggggagcaugccuucccccacccuggcuugcucuuggucacagggcgguucugggcacuugaac

SEQ ID NO: 209697 - RNA, 64 nt, Homo Sapiens
cucuccccucucccauuuucucucuugggagcaauggucacagucccugguaccugaaaaggua

SEQ ID NO: 209698 - RNA, 64 nt, Homo Sapiens
caaaguccagcucagucucaaccgccggccacacuggucacagggagguugugggccuucucaa

SEQ ID NO: 209699 - RNA, 64 nt, Homo Sapiens
ggggcucgguggcccaggugcgccuggcccucuguggucacagacagguggguucgggcuucac

SEQ ID NO: 209700 - RNA, 64 nt, Homo Sapiens
gcuuauugugaguaccauuucaagaagaaucuucuggucacaauuucucucacgcucaagucac

SEQ ID NO: 209701 - RNA, 64 nt, Homo Sapiens
ugaagaccuuaaagccaauguagauucguugucauggucacaccuuucgaaaugaacgugcaau

SEQ ID NO: 209702 - RNA, 64 nt, Homo Sapiens
gaagggccuuuauuuucaggcauagacuccucuguggucacagcuggagcacagagagggaccc

SEQ ID NO: 209703 - RNA, 64 nt, Homo Sapiens
uacaccagagcucuguggaccaaggggucauuccuggucacacacuccaucagcaaaauguauu

SEQ ID NO: 209704 - RNA, 64 nt, Homo Sapiens; identical to SEQ ID NO: 51559

SEQ ID NO: 209705 - RNA, 64 nt, Homo Sapiens; identical to SEQ ID NO: 51560

SEQ ID NO: 209706 - RNA, 64 nt, Homo Sapiens; identical to SEQ ID NO: 51561

SEQ ID NO: 209707 - RNA, 64 nt, Homo Sapiens; identical to SEQ ID NO: 51562

SEQ ID NO: 209708 - RNA, 64 nt, Homo Sapiens; identical to SEQ ID NO: 51563

SEQ ID NO: 209709 - RNA, 64 nt, Homo Sapiens; identical to SEQ ID NO: 51564

SEQ ID NO: 209710 - RNA, 64 nt, Homo Sapiens; identical to SEQ ID NO: 51565

SEQ ID NO: 209711 - RNA, 64 nt, Homo Sapiens; identical to SEQ ID NO: 51566

SEQ ID NO: 209712 - RNA, 64 nt, Homo Sapiens; identical to SEQ ID NO: 51567

SEQ ID NO: 209713 - RNA, 64 nt, Homo Sapiens; identical to SEQ ID NO: 51568

SEQ ID NO: 209714 - RNA, 64 nt, Homo Sapiens; identical to SEQ ID NO: 51569

SEQ ID NO: 209715 - RNA, 64 nt, Homo Sapiens; identical to SEQ ID NO: 51570

SEQ ID NO: 209716 - RNA, 64 nt, Homo Sapiens; identical to SEQ ID NO: 51571

SEQ ID NO: 209717 - RNA, 64 nt, Homo Sapiens; identical to SEQ ID NO: 51572

SEQ ID NO: 209718 - RNA, 64 nt, Homo Sapiens; identical to SEQ ID NO: 51573

SEQ ID NO: 209719 - RNA, 64 nt, Homo Sapiens; identical to SEQ ID NO: 51574

SEQ ID NO: 209720 - RNA, 64 nt, Homo Sapiens; identical to SEQ ID NO: 51575

SEQ ID NO: 209721 - RNA, 64 nt, Homo Sapiens; identical to SEQ ID NO: 51576

SEQ ID NO: 209722 - RNA, 64 nt, Homo Sapiens; identical to SEQ ID NO: 51577

SEQ ID NO: 209723 - RNA, 64 nt, Homo Sapiens; identical to SEQ ID NO: 51578

SEQ ID NO: 209724 - RNA, 64 nt, Homo Sapiens
ugcauucagaggucuuguaaucuacuuguugcaggagaaagaagguaaaaaaugauuuuuuuaa

SEQ ID NO: 209725 - RNA, 64 nt, Homo Sapiens
uugagaggggcaaaacugagaggggcuuuuccuagagaaagagaacaaggagcuugccaggcuu

SEQ ID NO: 209726 - RNA, 64 nt, Homo Sapiens
uuaacaauaaagaauuuucaaaauauaucuguuggagaaagaaauggcuccauauuucaacuaa

SEQ ID NO: 209727 - RNA, 64 nt, Homo Sapiens
caguccucaggaagggggccggggagagcggcuggagaaagaugcacuggcaggugugggaucu

SEQ ID NO: 209728 - RNA, 64 nt, Homo Sapiens
aacagaaagaauagagaacagagaagcugaacaggagaaagacacccguggaaagagggagaaa

SEQ ID NO: 209729 - RNA, 64 nt, Homo Sapiens
agcugaacaggagaaagacacccguggaaagagggagaaagagacauugauauucccaguggug

SEQ ID NO: 209730 - RNA, 64 nt, Homo Sapiens
ucagaaacaaccagcugagaaggcuacaagugacgagaaagauucuguuucaaauauagccaca

SEQ ID NO: 209731 - RNA, 64 nt, Homo Sapiens
ucagaaacaaccagccuugaaggcuacaacugaugagaaagauucuguuucgaacauagccaca

SEQ ID NO: 209732 - RNA, 64 nt, Homo Sapiens
ugagaaaccaccaggcuugaaggcuacaagugaugagaaagauucuguuuugaauauagccaga

SEQ ID NO: 209733 - RNA, 64 nt, Homo Sapiens
ggaaauuuguauuuuguuuuguuugguuugcaaugagaaagaguagucacuuauuaacuuuuca

SEQ ID NO: 209734 - RNA, 63 nt, Homo Sapiens
auaauuuaaccaugugaaaaauuacaggagcaagagaaagaagcaccaaauggaaugcuguaa

SEQ ID NO: 209735 - RNA, 64 nt, Homo Sapiens
caaagaggaggaccccugaaggagcagaguccaugagaaagaaggagggaugggaccuuuguag

SEQ ID NO: 209736 - RNA, 64 nt, Homo Sapiens
guugggguuuugccagggaaguaaaaggaguugagagaaagaugggucaguucagaagacauac

SEQ ID NO: 209737 - RNA, 64 nt, Homo Sapiens
agugagagcacaaagauaacgcaggagagagagagagaaagaaugagaaagaaaaggaaugcaa

SEQ ID NO: 209738 - RNA, 64 nt, Homo Sapiens
caaagauaacgcaggagagagagagagaaagaaugagaaagaaaaggaaugcaagagaaggaga

SEQ ID NO: 209739 - RNA, 64 nt, Homo Sapiens
cuuuuaguaucgaugccacucaucugcagcagaagagaaagaaguccucuuggggcuuuuuagu

SEQ ID NO: 209740 - RNA, 64 nt, Homo Sapiens
aaucggacgagaggaugugacauucgguccaggagagaaagagcaguuucuguuaaagauguaa

SEQ ID NO: 209741 - RNA, 64 nt, Homo Sapiens
accagacgcaggaagaugaaauucuuuucugccugagaaagagauaaaaugcaauaaggaauca

SEQ ID NO: 209742 - RNA, 64 nt, Homo Sapiens
aauauauauauauccaccccuuuuaauacauuaagagaaagagagugcaauguccuuugauuuu

SEQ ID NO: 209743 - RNA, 64 nt, Homo Sapiens
ggugaaaauagacuaacuacuggagaaacaaagagagaaagaaaacccaguguuuccauagggg

SEQ ID NO: 209744 - RNA, 64 nt, Homo Sapiens
ccaucuaugugucuccccuccccuccacaaaaaggagaaagagugcauuaaaauguuuaguugg

SEQ ID NO: 209745 - RNA, 64 nt, Homo Sapiens
gagucacaaugaucaucuuacccaugugguuuuugagaaagaaagaucaauucuuuguuugcag

SEQ ID NO: 209746 - RNA, 64 nt, Homo Sapiens
caauuugaugaauacccaguucucuucuuuucuagagaaagauaguugcaaccucaccucccuc

SEQ ID NO: 209747 - RNA, 64 nt, Homo Sapiens
uagaagagaagagccaucuuaaaagagagagagagagaaagaaaagacuccaucucaaaaaaaa

SEQ ID NO: 209748 - RNA, 64 nt, Homo Sapiens
ccagacauggugucucacacguuuguuuacauaagagaaagagggagaccucuagagaaaagau

SEQ ID NO: 209749 - RNA, 64 nt, Homo Sapiens
uuuuuuaaaagacugucgcccuucuuaaagcccagagaaagaggcaacaaauauuaaauggcuu

SEQ ID NO: 209750 - RNA, 64 nt, Homo Sapiens
ggaaacacggaguuugggcuagcagaaaccgaaagagaaagaacccagugugucaccagcccuc

SEQ ID NO: 209751 - RNA, 64 nt, Homo Sapiens
augcuggaaggguaaggauuuaggaauaucuggagagaaagagagccugcaguuauguacauuu

SEQ ID NO: 209752 - RNA, 64 nt, Homo Sapiens
aguuguagucaaaaugcuacaauaaaacaaaaaagagaaagaaaaugaagagcauuugacuccc

SEQ ID NO: 209753 - RNA, 64 nt, Homo Sapiens
gucaggaagguagagagagaaaaagggagggaaggagaaagaaugggaauaaaauaaggaggua

SEQ ID NO: 209754 - RNA, 64 nt, Homo Sapiens
auuucuggaugagaaaauuuucaauucuggccaugagaaagaaaaaaaaauaaacagccuucuu

SEQ ID NO: 209755 - RNA, 64 nt, Homo Sapiens
ccuggaggaaagucauuccugccuaauccaucgagagaaagaggcuuacgaaaaacuuugccuc

SEQ ID NO: 209756 - RNA, 64 nt, Homo Sapiens
ucuuucccaagcuccuagccaacacuauccuugggagaaagaaauuugcagaaacugcuaagac

SEQ ID NO: 209757 - RNA, 64 nt, Homo Sapiens
accuugcuguugcucugaggagauauaauucugggagaaagaaucuuuuauaagaacaguacag

SEQ ID NO: 209758 - RNA, 64 nt, Homo Sapiens
gaauaaaagcuggagagagauggaccuagggaaagagaaagaaagugaguugggucaagugcau

SEQ ID NO: 209759 - RNA, 64 nt, Homo Sapiens
gaguuucagcgucauccuugcacagaucccaugugagaaagagaugaguugugagggcccagau

SEQ ID NO: 209760 - RNA, 64 nt, Homo Sapiens
cugccagcuuaaugaauuuagauguacuuuaagagagaaagacugguuauuucuccuuugugua

SEQ ID NO: 209761 - RNA, 64 nt, Homo Sapiens
gagguauaacugaauaagaaauuuuuuuaagcaagagaaagacaacuguucugcggguuggaga

SEQ ID NO: 209762 - RNA, 64 nt, Homo Sapiens
aaagaggcagcugagugagagacacagagagaaggagaaagagggagggagagagagaaagaga

SEQ ID NO: 209763 - RNA, 64 nt, Homo Sapiens
gacacagagagaaggagaaagagggagggagagagagaaagagagagaaagagagagagagaga

SEQ ID NO: 209764 - RNA, 64 nt, Homo Sapiens
gaaggagaaagagggagggagagagagaaagagagagaaagagagagagagagagagagagaga

SEQ ID NO: 209765 - RNA, 64 nt, Homo Sapiens
uucugauaaaccucuuaguaacuauaaacuauaggagaaagaaguuauggacugggcaaagccc

SEQ ID NO: 209766 - RNA, 64 nt, Homo Sapiens
gaaacaaaagccuguucagcugaaagaaggcucagagaaagaggcauuuuucccaggguaauca

SEQ ID NO: 209767 - RNA, 64 nt, Homo Sapiens
uuuuuuuuuuuuaauggcaguaaagagaaaagaagagaaagauuaccccucugucaugccucuu

SEQ ID NO: 209768 - RNA, 64 nt, Homo Sapiens
uggccuuuagcugguuucauaucccuucugcuuagagaaagaaacaggggagaaaaugguggcu

SEQ ID NO: 209769 - RNA, 64 nt, Homo Sapiens
uugugaaacuguagagagcagguagcccaaaauagagaaagauuagauaaagagaaaauaagua

SEQ ID NO: 209770 - RNA, 64 nt, Homo Sapiens
gaguaaaugaauaaaacauuugcaaagaccuuuagagaaagagaaugggagcauaugugagaaa

SEQ ID NO: 209771 - RNA, 64 nt, Homo Sapiens
acuuaaaguucuuaagaugagacuguguaaaugagagaaagacuugauucagaggaaaaaaaug

SEQ ID NO: 209772 - RNA, 64 nt, Homo Sapiens
uauuugcauuuaaauugcaauccagcacacgugugagaaagaagaggcacuagucuaaaaggcu

SEQ ID NO: 209773 - RNA, 64 nt, Homo Sapiens
acgccccuuaaaauaaguaaauaaauaaccuugagagaaagaacaagaucaauauauccugcag

SEQ ID NO: 209774 - RNA, 64 nt, Homo Sapiens
acauagaaaggaaacugcaucagaaacaugaacagagaaagauugucugccuucuagaaucaga

SEQ ID NO: 209775 - RNA, 64 nt, Homo Sapiens
caaaggcagagaagaccagcggcaucuggagacugagaaagaaugccugagcuaugccuguuga

SEQ ID NO: 209776 - RNA, 64 nt, Homo Sapiens
ggagaggcuagggugguguguguggaagauucaggagaaagaaagauggccaggggaggggguc

SEQ ID NO: 209777 - RNA, 64 nt, Homo Sapiens
cccuuugcuguagcuacacuucagauuaaaguaggagaaagaaugugcugaguguuuuccuccc

SEQ ID NO: 209778 - RNA, 64 nt, Homo Sapiens
cuggcccucaucccaacagcccagcaaggggagagagaaagagaauucuuuucuauagaacgag

SEQ ID NO: 209779 - RNA, 64 nt, Homo Sapiens
gagaaggagagagacaguagagagagagagagaggagaaagagaaacagacauuuccuagagaa

SEQ ID NO: 209780 - RNA, 64 nt, Homo Sapiens
gagagagaggagaaagagagacagacauuuccuagagaaagagaaaagugaggccugcuucaca

SEQ ID NO: 209781 - RNA, 64 nt, Homo Sapiens
acuuauuguguguuugauuuucaacagcuauagagagaaagauaaaugugcuuuuuauuguaau

SEQ ID NO: 209782 - RNA, 64 nt, Homo Sapiens
aacugaaggacgcgguuaauaugugagaaagcgagagaaagagggaguguggcagagagugugc

SEQ ID NO: 209783 - RNA, 64 nt, Homo Sapiens
gaaggggaugcuaaaggagagccgccaugcccaagagaaagacucacaucccgccgccgccgcc

SEQ ID NO: 209784 - RNA, 64 nt, Homo Sapiens
caagauuuccauucccacaagucauacuaucaaagagaaagaaagacaauauccuuacacauuu

SEQ ID NO: 209785 - RNA, 64 nt, Homo Sapiens
ugccuggaugagaaacagcuugggccccgggcuggagaaagagcccuaagagacacauacagag

SEQ ID NO: 209786 - RNA, 64 nt, Homo Sapiens
gaagccagccacagaccccucuucaacaacgugagagaaagagagacccucaggaauucagugc

SEQ ID NO: 209787 - RNA, 64 nt, Homo Sapiens
uagaacauacacagauccuauuuuuucuaaaggagagaaagacuaauagaaucagauuaucucu

SEQ ID NO: 209788 - RNA, 64 nt, Homo Sapiens
uagaauguacacagauccaauuuucucuaaaugagagaaagacuuucuauagacuugagaaugu

SEQ ID NO: 209789 - RNA, 64 nt, Homo Sapiens
gagagagaugcuguugaaucgagugagagagagagagaaagagagagagugagagagagaaaga

SEQ ID NO: 209790 - RNA, 64 nt, Homo Sapiens
gugagagagagagagaaagacagagagugagagagagaaagagaguaaccaguuuccagagagc

SEQ ID NO: 209791 - RNA, 64 nt, Homo Sapiens
ggccgggcuguagaucagguuugcccacuugauugagaaagauguuccagugaggaacccugau

SEQ ID NO: 209792 - RNA, 64 nt, Homo Sapiens
guacaauacggaaugaagaagaggggaaaauggggagaaagaugguuaaaauacauaauaaucc

SEQ ID NO: 209793 - RNA, 64 nt, Homo Sapiens
aagaggaggaguuaggucuaagaggagaaaaccagagaaagaugguggguuccaaauuacucau

SEQ ID NO: 209794 - RNA, 64 nt, Homo Sapiens
gguguaaucugcuuuccugucuuggacuagagaggagaaagauuucaggguaggugggcacagg

SEQ ID NO: 209795 - RNA, 64 nt, Homo Sapiens
guggucuccucaggaugucucacaguaaagaguggagaaagacuaauuguugaguuuauuuuua

SEQ ID NO: 209796 - RNA, 64 nt, Homo Sapiens
gcaggcucgggaggcccugcugugugcgcuaagugagaaagagaguguguguguguugugugug

SEQ ID NO: 209797 - RNA, 64 nt, Homo Sapiens
uuggcucuuguaauaaaugcaugggaucagaaaagagaaagauguucugcccuuacagcaccuc

SEQ ID NO: 209798 - RNA, 64 nt, Homo Sapiens
aaauacagaagacuggccccuuaacuugcaaaaggagaaagauaaaaaacucuucaugugaauc

SEQ ID NO: 209799 - RNA, 64 nt, Homo Sapiens
cugagagugguugaguaauuauuccuguuuuacagagaaagauaaaggcccucagaagcagauu

SEQ ID NO: 209800 - RNA, 64 nt, Homo Sapiens
agauuccuuuuagcuaauucugaauuaugggcaggagaaagagcgugggagaauuauacuugac

SEQ ID NO: 209801 - RNA, 64 nt, Homo Sapiens
gcgggacagagugagacccugucugaaagaaagagagaaagaaagaaagaaagagagagaaaga

SEQ ID NO: 209802 - RNA, 64 nt, Homo Sapiens
cugaaagaaagagagaaagaaagaaagaaagagagagaaagaaagaaagaaagaaagggaaaga

SEQ ID NO: 209803 - RNA, 64 nt, Homo Sapiens
aagggaaagauggaaggaaggaaggaaaaagaaagagaaagagagagagagagaaagaaaaaga

SEQ ID NO: 209804 - RNA, 64 nt, Homo Sapiens
gaaggaaggaaaaagaaagagaaagagagagagagagaaagaaaaagaaagaaaaguaagaaag

SEQ ID NO: 209805 - RNA, 64 nt, Homo Sapiens
gacauucaaacaaaggaggaggagucauagggaagagaaagaaauggaagcacagcuucuuuca

SEQ ID NO: 209806 - RNA, 64 nt, Homo Sapiens
uccacucuugaggagcagaagcauauaucuuuaugagaaagauggaggcuugaguuaugaaaua

SEQ ID NO: 209807 - RNA, 64 nt, Homo Sapiens
gcagacucugacucaacuuucuaggcaccuagcagagaaagauaagaucaaaagguguuugguu

SEQ ID NO: 209808 - RNA, 64 nt, Homo Sapiens
auacugacuaacuuggguggguggaucuagccaggagaaagacaguaacauguguucuguacuu

SEQ ID NO: 209809 - RNA, 64 nt, Homo Sapiens
aucugaagggccccuggccucagggcugaugugagagaaagaaauaaucuuccgaccuuccucc

SEQ ID NO: 209810 - RNA, 64 nt, Homo Sapiens
auuauccccacuucacagauuuggccuuguguuggagaaagagaguacaugaaccaggucaugu

SEQ ID NO: 209811 - RNA, 64 nt, Homo Sapiens
ggcuuuuuacaggagaaaaaaaaaugacuuauaagagaaagagccuggaguauuuuuggaaaaa

SEQ ID NO: 209812 - RNA, 64 nt, Homo Sapiens
aucuuuauaauuucuuugucucacagaagacuaggagaaagaucuuuuuuaaauaaucuuuuug

SEQ ID NO: 209813 - RNA, 64 nt, Homo Sapiens
aacguaagcacaggaaagagaugauguacccuccgagaaagaagucgaaaaaagaaaaaaagcc

SEQ ID NO: 209814 - RNA, 64 nt, Homo Sapiens
aguccaagcauaaaaggaaagcaaagaaaggccagagaaagagcaaaacgacaccuagaagaag

SEQ ID NO: 209815 - RNA, 62 nt, Homo Sapiens
augcugugccaucaugugaugcagccugccagaggcccaaugcuggaauggcaccaucauuc

SEQ ID NO: 209816 - RNA, 62 nt, Homo Sapiens
caccacagaggccacaggcaggcccccacuucaggcccaaggccuggggcggggggaacagu

SEQ ID NO: 209817 - RNA, 62 nt, Homo Sapiens
gcagagucugggccucugacuggguaaugugaaggcccaagacucgugguuauuagcaaggc

SEQ ID NO: 209818 - RNA, 62 nt, Homo Sapiens
uccccuccacaucccagcagggggacagugauaggcccaaggugggacagccagagcugggu

SEQ ID NO: 209819 - RNA, 62 nt, Homo Sapiens
ccuccugcuaggaaaagcuucuuguuuugcaaaggcccaagucucuggggaggcccaagcag

SEQ ID NO: 209820 - RNA, 62 nt, Homo Sapiens
agcuuguuuugcaaaggcccggcccucuggggaggcccaagcgguaggugcaugggagggug

SEQ ID NO: 209821 - RNA, 62 nt, Homo Sapiens
ggcuguaggggagaguguggcaggugacccaaaggcccaaagagggccguggggccugagga

SEQ ID NO: 209822 - RNA, 62 nt, Homo Sapiens
cuguuggcagaggacagccccuggggaaccccaggcccaacucuguccgguaucccuuuucc

SEQ ID NO: 209823 - RNA, 62 nt, Homo Sapiens
ccauguaacuaacuuuaaacugucccucugaaaggcccaaugucaaucuaguccuagaguug

SEQ ID NO: 209824 - RNA, 62 nt, Homo Sapiens
uugagaugcuaugaagcuugauaauuuugacaaggcccaaagcccaaaaguccaaaaaugua

SEQ ID NO: 209825 - RNA, 64 nt, Homo Sapiens; identical to SEQ ID NO: 87137

SEQ ID NO: 209826 - RNA, 64 nt, Homo Sapiens; identical to SEQ ID NO: 87138

SEQ ID NO: 209827 - RNA, 64 nt, Homo Sapiens; identical to SEQ ID NO: 87139

SEQ ID NO: 209828 - RNA, 64 nt, Homo Sapiens; identical to SEQ ID NO: 87140

SEQ ID NO: 209829 - RNA, 64 nt, Homo Sapiens; identical to SEQ ID NO: 87141

SEQ ID NO: 209830 - RNA, 64 nt, Homo Sapiens; identical to SEQ ID NO: 87142

SEQ ID NO: 209831 - RNA, 64 nt, Homo Sapiens; identical to SEQ ID NO: 87143

SEQ ID NO: 209832 - RNA, 64 nt, Homo Sapiens; identical to SEQ ID NO: 87144

SEQ ID NO: 209833 - RNA, 64 nt, Homo Sapiens; identical to SEQ ID NO: 87145

SEQ ID NO: 209834 - RNA, 64 nt, Homo Sapiens; identical to SEQ ID NO: 87146

SEQ ID NO: 209835 - RNA, 64 nt, Homo Sapiens; identical to SEQ ID NO: 87147

SEQ ID NO: 209836 - RNA, 64 nt, Homo Sapiens; identical to SEQ ID NO: 87148

SEQ ID NO: 209837 - RNA, 64 nt, Homo Sapiens; identical to SEQ ID NO: 87149

SEQ ID NO: 209838 - RNA, 64 nt, Homo Sapiens; identical to SEQ ID NO: 87150

SEQ ID NO: 209839 - RNA, 64 nt, Homo Sapiens; identical to SEQ ID NO: 87151

SEQ ID NO: 209840 - RNA, 64 nt, Homo Sapiens; identical to SEQ ID NO: 87152

SEQ ID NO: 209841 - RNA, 64 nt, Homo Sapiens; identical to SEQ ID NO: 87153

SEQ ID NO: 209842 - RNA, 64 nt, Homo Sapiens; identical to SEQ ID NO: 87154

SEQ ID NO: 209843 - RNA, 64 nt, Homo Sapiens; identical to SEQ ID NO: 87155

SEQ ID NO: 209844 - RNA, 64 nt, Homo Sapiens; identical to SEQ ID NO: 87156

SEQ ID NO: 209845 - RNA, 64 nt, Homo Sapiens; identical to SEQ ID NO: 87157

SEQ ID NO: 209846 - RNA, 64 nt, Homo Sapiens; identical to SEQ ID NO: 87158

SEQ ID NO: 209847 - RNA, 64 nt, Homo Sapiens; identical to SEQ ID NO: 87159

SEQ ID NO: 209848 - RNA, 64 nt, Homo Sapiens; identical to SEQ ID NO: 87160

SEQ ID NO: 209849 - RNA, 64 nt, Homo Sapiens; identical to SEQ ID NO: 87161

SEQ ID NO: 209850 - RNA, 64 nt, Homo Sapiens; identical to SEQ ID NO: 87162

SEQ ID NO: 209851 - RNA, 64 nt, Homo Sapiens; identical to SEQ ID NO: 87163

SEQ ID NO: 209852 - RNA, 64 nt, Homo Sapiens; identical to SEQ ID NO: 87164

SEQ ID NO: 209853 - RNA, 64 nt, Homo Sapiens; identical to SEQ ID NO: 87165

SEQ ID NO: 209854 - RNA, 64 nt, Homo Sapiens; identical to SEQ ID NO: 87166

SEQ ID NO: 209855 - RNA, 64 nt, Homo Sapiens; identical to SEQ ID NO: 87167

SEQ ID NO: 209856 - RNA, 64 nt, Homo Sapiens; identical to SEQ ID NO: 87168

SEQ ID NO: 209857 - RNA, 64 nt, Homo Sapiens; identical to SEQ ID NO: 87169

SEQ ID NO: 209858 - RNA, 64 nt, Homo Sapiens; identical to SEQ ID NO: 87170

SEQ ID NO: 209859 - RNA, 64 nt, Homo Sapiens; identical to SEQ ID NO: 87171

SEQ ID NO: 209860 - RNA, 64 nt, Homo Sapiens; identical to SEQ ID NO: 87172

SEQ ID NO: 209861 - RNA, 64 nt, Homo Sapiens; identical to SEQ ID NO: 87173

SEQ ID NO: 209862 - RNA, 64 nt, Homo Sapiens; identical to SEQ ID NO: 87174

SEQ ID NO: 209863 - RNA, 64 nt, Homo Sapiens; identical to SEQ ID NO: 87175

SEQ ID NO: 209864 - RNA, 64 nt, Homo Sapiens; identical to SEQ ID NO: 87176

SEQ ID NO: 209865 - RNA, 63 nt, Homo Sapiens
gaaguuauuuuuaaaaagguacucugcauguucccgcaguaauguucugcacaacaguauugu

SEQ ID NO: 209866 - RNA, 63 nt, Homo Sapiens
guuacugucgggcaguaacugccgcuugccuugccgcaguaggagggaaaucucaccuuccuu

SEQ ID NO: 209867 - RNA, 52 nt, Homo Sapiens
ucagauggaagucuucauaaagccgcaguagaacuugagcugaaaacccaga

SEQ ID NO: 209868 - RNA, 63 nt, Homo Sapiens
ucccaguguugccuuaacagggugucugucgugccgcaguagagcacugcugcuuccuccaac

SEQ ID NO: 209869 - RNA, 63 nt, Homo Sapiens
uauuaaaacauacuuuuuuuuuggucaauguuuccgcaguauuaagucacuguguauguuugu

SEQ ID NO: 209870 - RNA, 63 nt, Homo Sapiens
gcuuuugucagcacagacugaauucuuugagguccgcaguaguggggccuucuucugacagag

SEQ ID NO: 209871 - RNA, 61 nt, Homo Sapiens
cggauuagguggcugcccuuugugguggacuccgcaguaucguuuuccagaugggaauuaa

SEQ ID NO: 209872 - RNA, 63 nt, Homo Sapiens
aucucaucccauucccauguaaauuaccacagaccgcaguaccggggcuggagcggagugaag

SEQ ID NO: 209873 - RNA, 63 nt, Homo Sapiens
cuaagcugaguuaggugucuguccuuuaugaucccgcaguauuccaugaauacguauauucuc

SEQ ID NO: 209874 - RNA, 63 nt, Homo Sapiens
ggcuuaagucacuuuugugauagugugaacaucccgcaguauaguaacugcacuaaagggacg

SEQ ID NO: 209875 - RNA, 63 nt, Homo Sapiens
uguucauaacacuuugcuccauaacccugauguccgcaguaucuaaguaucucagccuucauc

SEQ ID NO: 209876 - RNA, 63 nt, Homo Sapiens
uccccuguccccuccccaacgccccgcccagucccgcaguacacugccaaaccccagggccug

SEQ ID NO: 209877 - RNA, 63 nt, Homo Sapiens
agagggcaaaaggaugguuuugcaucuuccucaccgcaguaaaccaaugagguauuagacauu

SEQ ID NO: 209878 - RNA, 63 nt, Homo Sapiens
agacacaguauuuaauugcauuugagguucgugccgcaguaacgaacacuuguauauuguuug

SEQ ID NO: 209879 - RNA, 63 nt, Homo Sapiens
aguaagagacuccagcauggccuucuguuugccccgcaguaaaguaacuuccauauaaaaugg

SEQ ID NO: 209880 - RNA, 63 nt, Homo Sapiens
uccuugagugggucccccccucgaagccugaagccgcaguauggagcgagcguucugggcugg

SEQ ID NO: 209881 - RNA, 63 nt, Homo Sapiens
ucagggacaggcucuuccccguucccucccagcccgcaguauugcacaggacccugcccucgu

SEQ ID NO: 209882 - RNA, 63 nt, Homo Sapiens
gccuccuggaacggaagcaugcugcugcucccaccgcaguacccucgguuucccgcggacuug

SEQ ID NO: 209883 - RNA, 63 nt, Homo Sapiens
uucuagggggcggugcuggcgcggccgccaugcccgcaguaggagccgggagacccaggacug

SEQ ID NO: 209884 - RNA, 63 nt, Homo Sapiens
ccccagaguauauugaauaggccaugagucaccccgcaguaagggaguguagauaaggcuuca

SEQ ID NO: 209885 - RNA, 63 nt, Homo Sapiens
ugcucgccacacaggcuguugugacgugcugucccgcaguagcuccgccgucucagcauccag

SEQ ID NO: 209886 - RNA, 63 nt, Homo Sapiens
aucuucccucugaugcuggaagaagcugcccauccgcaguaauucauacugugguucuucgag

SEQ ID NO: 209887 - RNA, 64 nt, Homo Sapiens
ggcaacgcccucagggucccggacacaccucaguaaagagcaaauggucacccuggggguccug

SEQ ID NO: 209888 - RNA, 64 nt, Homo Sapiens
uauauuggacuaaucagauguaaagggauugugaaaagagcauuaaaaaaagaaaagaaaaaga

SEQ ID NO: 209889 - RNA, 64 nt, Homo Sapiens
gacaguuugaggagucgaauugagauucaucaucaaagagcaaugcagcgucguuaaaauaaaa

SEQ ID NO: 209890 - RNA, 64 nt, Homo Sapiens
cggacgagaggaugugacauucgguccaggagagaaagagcaguuucuguuaaagauguaacaa

SEQ ID NO: 209891 - RNA, 64 nt, Homo Sapiens
ucuaaaggucaguuuugggccaguucuugcaacuaaagagcagagaucucucugggcccuagac

SEQ ID NO: 209892 - RNA, 64 nt, Homo Sapiens
uccaugggacuuaucauaggccuggugauucuugaaagagcauuuuucaugacucaaaaaugag

SEQ ID NO: 209893 - RNA, 64 nt, Homo Sapiens
ucuguucccuaccuuuuuucacuuuuccuccuccaaagagcaaaaugaaaauuuugccuuagcu

SEQ ID NO: 209894 - RNA, 64 nt, Homo Sapiens
caaaaugaaaauuuugccuuagcuacugcaguggaaagagcacugaacuaggaguuggaagaca

SEQ ID NO: 209895 - RNA, 64 nt, Homo Sapiens
gguaagaauaguagauguggaaagacaggagacaaaagagcaguaacgaaauaucaaagucauu

SEQ ID NO: 209896 - RNA, 64 nt, Homo Sapiens
ugauucuuguugcuguacaaaauggaggaucucuaaagagcaucgaagaauguuagaguaauga

SEQ ID NO: 209897 - RNA, 64 nt, Homo Sapiens
guggccuccccuuccccucccugccccaggacuuaaagagcaauaguuugccccuuuuggaaug

SEQ ID NO: 209898 - RNA, 64 nt, Homo Sapiens
uggaaugaucucugaauauauaaaacacacacacaaagagcaauaguuugccccuuuuggaacg

SEQ ID NO: 209899 - RNA, 64 nt, Homo Sapiens
gcccagggccgcguggugaaaucuggcaguggggaaagagcaaccccagcccgucccuuccccc

SEQ ID NO: 209900 - RNA, 64 nt, Homo Sapiens
gcugaaguaaaggggcaagauagggcaguuaacuaaagagcacuuuauuucuuugaagccuuuc

SEQ ID NO: 209901 - RNA, 64 nt, Homo Sapiens
uucuaauugaauauuuuuauauuuuuaugaaacaaaagagcauuucuucagguuucuauuguau

SEQ ID NO: 209902 - RNA, 64 nt, Homo Sapiens
cugguagagacaucuucaaggcaugaaauagcuuaaagagcagaguagaaacggaagaggcuuu

SEQ ID NO: 209903 - RNA, 64 nt, Homo Sapiens
aaaaaaagaauaaauguauuuccccuaauccauuaaagagcauguuucacuaaagcauguuuau

SEQ ID NO: 209904 - RNA, 64 nt, Homo Sapiens
acuaagugauagaaaauauuuauaacauuuacaaaaagagcaaaagaugaguuaggaauaaacc

SEQ ID NO: 209905 - RNA, 64 nt, Homo Sapiens
aauaauuaauucacacaccaauguggccagaaagaaagagcaaucaguaaaccaaaacccaaca

SEQ ID NO: 209906 - RNA, 64 nt, Homo Sapiens
gcuguuuuugaaaaucauuaggagggaguaacagaaagagcaaguggaaacauuuaaaugauca

SEQ ID NO: 209907 - RNA, 64 nt, Homo Sapiens
caacauaguaugugugcagauggacgauggauuuaaagagcauaccuuaugauuaaaccgaggu

SEQ ID NO: 209908 - RNA, 64 nt, Homo Sapiens
agucagugaccuaugucugccaucuuacuggggaaaagagcaaguagccugucuuccuuuaagu

SEQ ID NO: 209909 - RNA, 64 nt, Homo Sapiens
uuugaguaaacugauagauuuuacucugacugcaaaagagcacaccuaugcugcuuguugcagu

SEQ ID NO: 209910 - RNA, 64 nt, Homo Sapiens
cuuaaaaugaagaauuaacuuguguuacaucuauaaagagcaaaauaacacacuccagaacuug

SEQ ID NO: 209911 - RNA, 64 nt, Homo Sapiens
gaauacuguucucagaccauagagaucugauuccaaagagcacaauugagcuauaugauuuauc

SEQ ID NO: 209912 - RNA, 64 nt, Homo Sapiens
agcaagugucacugcucaucagacuaccuuggcaaaagagcauuaugagcaaucccuuaugcau

SEQ ID NO: 209913 - RNA, 64 nt, Homo Sapiens
aaggacucauucaugucacgcuuccuugagcagaaaagagcacugagagcacuugggaccccug

SEQ ID NO: 209914 - RNA, 64 nt, Homo Sapiens
cugccauucaagacuggagacaccugggaaauaaaaagagcagggcacugcuggugggaagagg

SEQ ID NO: 209915 - RNA, 64 nt, Homo Sapiens
cuauccauaaaaugaagguagccaggccugccucaaagagcauucaggaggcucugagaggaca

SEQ ID NO: 209916 - RNA, 64 nt, Homo Sapiens
uggaugaaaggagaaggcuagaggcugagggaggaaagagcaguuaacaaacaaaggcaguagc

SEQ ID NO: 209917 - RNA, 64 nt, Homo Sapiens
gggacaggcacagcagaggugagagugggaggagggcacguaccgggugccagcccuggagccc

SEQ ID NO: 209918 - RNA, 64 nt, Homo Sapiens
aacaaacaaacaaacaccugugcuaggucagucuggcacguaagaugaacaucccuaccaauac

SEQ ID NO: 209919 - RNA, 64 nt, Homo Sapiens
aagauucuacaugucuagaaucaaacucaaaucuggcacguaggugcuucuuaguaaaugcuua

SEQ ID NO: 209920 - RNA, 64 nt, Homo Sapiens
uuuauucagccccuuaaucuauuuucagucuucuggcacguaauuuuuuucacaguuauuauuc

SEQ ID NO: 209921 - RNA, 64 nt, Homo Sapiens
uuaauucagguguugaaggagcuuagguuuuagaggcacguagacuugguucaagucucguuag

SEQ ID NO: 209922 - RNA, 64 nt, Homo Sapiens
gcagugugaagaaauguucuacuccugcacuaaaggcacguacuaggaauaccacuuauguuac

SEQ ID NO: 209923 - RNA, 64 nt, Homo Sapiens
aaaacauagaccuguuuugaaagcgcccugcccaggcacguaaccugcgcauuccagcuacgcu

SEQ ID NO: 209924 - RNA, 64 nt, Homo Sapiens
ugaacgcacaacaugcacauucauccucacauguggcacguaaggucucauuugauauugugua

SEQ ID NO: 209925 - RNA, 64 nt, Homo Sapiens
uuaaugaaaauagauauggucacaaguacauuaaggcacguagaagguaggaguaagaaaagcu

SEQ ID NO: 209926 - RNA, 64 nt, Homo Sapiens
gacgugcuuauuuucacucagcaguguuaugaaaggcacguaguauauagagcccaaagcccug

SEQ ID NO: 209927 - RNA, 64 nt, Homo Sapiens
auuacaggaaagcaccuguccuggcucuguaccuggcacguaguaggugcucaguucaugcugg

SEQ ID NO: 209928 - RNA, 64 nt, Homo Sapiens
ugcugaccagucagccacuggccagccucacucaggcacguaccggagccccaguggcugacag

SEQ ID NO: 209929 - RNA, 64 nt, Homo Sapiens
agcacugaaaaauuacucauucaaauuuccccugggcacguaaggcaaaauauugccgguuggg

SEQ ID NO: 209930 - RNA, 64 nt, Homo Sapiens
guuaagagaguuuuauuuuaaaaaauuuguuaaaggcacguauauuauauuuauauauaaauau

SEQ ID NO: 209931 - RNA, 64 nt, Homo Sapiens
aguuggaauauccaguuauuucaugucacacaucggcacguaugauggugguuuggucagaugg

SEQ ID NO: 209932 - RNA, 64 nt, Homo Sapiens
uuuaagcuuuuuuuuuuuuuuuaauaaccuguaaggcacguaaguuuguuaauucuaguuucau

SEQ ID NO: 209933 - RNA, 64 nt, Homo Sapiens
gaacccagauagacgccggugggugcagaggcccggcacguagaggagggaagaacaggcccug

SEQ ID NO: 209934 - RNA, 64 nt, Homo Sapiens
gcccuggggaguaaaugcgggcucccgcuggacaggcacguacuccaggcauuuugucuccagg

SEQ ID NO: 209935 - RNA, 64 nt, Homo Sapiens
cagacuacuagacuuauugucagccuuaucccuuggcacguaaauaaaggguuaauuuauuguu

SEQ ID NO: 209936 - RNA, 64 nt, Homo Sapiens
ggccaggccuagaaaugaugcagaguuagggagaggcacguacauggguaggaugcaucugauc

SEQ ID NO: 209937 - RNA, 64 nt, Homo Sapiens
acuaaucaucagaaaaucuguggccauuagggcuggcacguaaaaauccaaaaucacucagagg

SEQ ID NO: 209938 - RNA, 64 nt, Homo Sapiens
guguaaaauagaauuaauguaucuugcuaguaagggcacguagagcauuuagaguugucuuuca

SEQ ID NO: 209939 - RNA, 64 nt, Homo Sapiens
guagggagaagaagggcaccuaagagaaagccaaggcacguagauggggcuccuccuucugucu

SEQ ID NO: 209940 - RNA, 64 nt, Homo Sapiens
acuugggcuugggauguccuucaguucugagugaggcacguaccccuagauagaacucggcccg

SEQ ID NO: 209941 - RNA, 64 nt, Homo Sapiens
ggguaccaagcagcugcacagucggugccugggaggcacguagaggcccagagagucccugggg

SEQ ID NO: 209942 - RNA, 64 nt, Homo Sapiens
agaugcaggugaugccauuacagaaccaaaucguggcacguauugcugugucuccucucagagu

SEQ ID NO: 209943 - RNA, 64 nt, Homo Sapiens
ugaucggagcauucugggaacaguuagaacguccggcacguaacauguaaauagaaagugcgua

SEQ ID NO: 209944 - RNA, 64 nt, Homo Sapiens
uggggccugccggaaugacuguguuagauugugaggcacguacacuuucuggccaaggugggcg

SEQ ID NO: 209945 - RNA, 64 nt, Homo Sapiens
guuggggagauaaaggaacauugguugcuuugguggcacguaagcuccuugucugucuccagca

SEQ ID NO: 209946 - RNA, 64 nt, Homo Sapiens
uuccgaucuuuuugcucaggggccaaacacugaaggcacguacugcccaacccacugagcgccu

SEQ ID NO: 209947 - RNA, 64 nt, Homo Sapiens
aacaagcaaugagaagaccagaggaagagagggaggcacguagggacuaaagaguauauugggg

SEQ ID NO: 209948 - RNA, 64 nt, Homo Sapiens
aaggucagugagugagugcauuugcugcagugguggcacguagagaacuagaugguaauaaaga

SEQ ID NO: 209949 - RNA, 64 nt, Homo Sapiens
cucccacuuccggccuagucugccagcuuuugcuggcacguaggcuaccacucuccgggcaccg

SEQ ID NO: 209950 - RNA, 64 nt, Homo Sapiens
auguacguauuucugaaauacagggucccuucuuggcacguaaccuuguuucuuacaagcaaac

SEQ ID NO: 209951 - RNA, 64 nt, Homo Sapiens
augugaagaaggucguugcuuccccuucaccuuccaccaccaugauuguaaguuccuuuuuucu

SEQ ID NO: 209952 - RNA, 64 nt, Homo Sapiens
cucagccucuggaguagcugagacuacaggcgcccaccaccaugcccggcuaauuuuguuugua

SEQ ID NO: 209953 - RNA, 64 nt, Homo Sapiens
uuuucuguuuguuuguuuucauguugaaugcccacaccaccauccucucaucccagccaguaag

SEQ ID NO: 209954 - RNA, 64 nt, Homo Sapiens
cuacaaauauaaguagucauuagaaguuugcaaccaccaccaagucugagagaacucugggaua

SEQ ID NO: 209955 - RNA, 64 nt, Homo Sapiens
cucacccuccugaguagcugggacuacaggugugcaccaccacaccuggcuaauucuucuuaaa

SEQ ID NO: 209956 - RNA, 64 nt, Homo Sapiens
cucagccucccaaguagcugggauuacaggcauacaccaccacgccccacuaauuuuuuguauu

SEQ ID NO: 209957 - RNA, 64 nt, Homo Sapiens
ugugcugguaacugcuuugcuucuugaguagagccaccaccaccauagcccagccagaugagug

SEQ ID NO: 209958 - RNA, 64 nt, Homo Sapiens
gcugguaacugcuuugcuucuugaguagagccaccaccaccauagcccagccagaugagugcuc

SEQ ID NO: 209959 - RNA, 64 nt, Homo Sapiens
uaguuaacaaauguuccuccucccucugggauaccaccaccacuuguuucuguguguguuuauu

SEQ ID NO: 209960 - RNA, 64 nt, Homo Sapiens
gauuuaagcuugaagcuacagauuauaucacuaucaccaccaccccucacccuaugcaaucaau

SEQ ID NO: 209961 - RNA, 64 nt, Homo Sapiens
ucuagauaccuucaggcaacuguucaggaugcaccaccaccaccgaucccuuuggugaguaugg

SEQ ID NO: 209962 - RNA, 64 nt, Homo Sapiens
accucuagauaccuucaggcugguguucaggaugcaccaccacccaggaucccuuuggugagua

SEQ ID NO: 209963 - RNA, 64 nt, Homo Sapiens
accaguuuaugcaguuggacuaaccaaccaccaccaccaccaaauaagugcaauaguugacuuu

SEQ ID NO: 209964 - RNA, 64 nt, Homo Sapiens
aaaaccaguuuaugcaguuguuuuaaccaaccaccaccaccacccuguaagugcaauaguugac

SEQ ID NO: 209965 - RNA, 64 nt, Homo Sapiens
accaaaaccaguuuaugcaggacuuuuaaccaaccaccaccaccuuacuguaagugcaauaguu

SEQ ID NO: 209966 - RNA, 64 nt, Homo Sapiens
uauaauugcacaaggucuuggcuagacccaugaucaccaccaacgagaaacacaaaauuuugag

SEQ ID NO: 209967 - RNA, 64 nt, Homo Sapiens
aaguuuggugacuugaggcuccccuaccucccaccaccaccaugugguuggaaggauagacugc

SEQ ID NO: 209968 - RNA, 64 nt, Homo Sapiens
augaaguuuggugacuugagugcccccuaccucccaccaccaccaugugguuggaaggauagac

SEQ ID NO: 209969 - RNA, 64 nt, Homo Sapiens
cucagccucccgaguagcugggacuacaggcgcccaccaccacgcccggcuaauuuuuuguauu

SEQ ID NO: 209970 - RNA, 64 nt, Homo Sapiens
cucagccucccgaguagcugggauuaugggcgcccaccaccaugcccagcuaauuuuuguauuu

SEQ ID NO: 209971 - RNA, 64 nt, Homo Sapiens
ccagcccagcccacuccccgcauggggaggccgccaccaccaacaccucaucauccuucucauc

SEQ ID NO: 209972 - RNA, 64 nt, Homo Sapiens
accaccaacaccucaucauccuucucaucgcuaacaccaccaccuccaucggcacccaagcggg

SEQ ID NO: 209973 - RNA, 64 nt, Homo Sapiens
cucaucacucagaaacccuaagaccucucuuuaccaccaccaccagaccuguuccucuuccaaa

SEQ ID NO: 209974 - RNA, 64 nt, Homo Sapiens
uggaccugagcuugggcaacagaagguugccugccaccaccagcgccuuuggaauuacuccugc

SEQ ID NO: 209975 - RNA, 64 nt, Homo Sapiens
ccuggcuaauuuuuguauuuggacuaugggugcacaccaccacgcucagccucccaaguagcug

SEQ ID NO: 209976 - RNA, 64 nt, Homo Sapiens
gacagguguuaaugcaucuagugagccuucucuccaccaccauaccaguggccugggagaggca

SEQ ID NO: 209977 - RNA, 64 nt, Homo Sapiens
cuucucaucacugcacacaagugccaugcuuugccaccaccaccaagcacaucugugauccuga

SEQ ID NO: 209978 - RNA, 64 nt, Homo Sapiens
cucaucacugcacacaagugccaugcuuugccaccaccaccaagcacaucugugauccugaagg

SEQ ID NO: 209979 - RNA, 64 nt, Homo Sapiens
ugggaagcuauccuuucucagcuaugugguuuggcaccaccaccaucuucaugaguggacccug

SEQ ID NO: 209980 - RNA, 64 nt, Homo Sapiens
gaagcuauccuuucucagcuaugugguuuggcaccaccaccaucuucaugaguggacccuguuu

SEQ ID NO: 209981 - RNA, 64 nt, Homo Sapiens
cugaggccaaagccagagacucgaacagccuccccaccaccaccagcauaugucaaggagcacu

SEQ ID NO: 209982 - RNA, 64 nt, Homo Sapiens
aggccaaagccagagacucgaacagccuccccaccaccaccagcauaugucaaggagcacuugc

SEQ ID NO: 209983 - RNA, 64 nt, Homo Sapiens
cucagccucccgaguagcugggacuacaggcgcccaccaccaugcccggcuaauuuuuguuuuu

SEQ ID NO: 209984 - RNA, 64 nt, Homo Sapiens
cucagccucucaaguggcugggaccacagaagugcaccaccaugccuggcuuuuuuuuuuuuuu

SEQ ID NO: 209985 - RNA, 64 nt, Homo Sapiens
cccaguugauuuuuguauuuggauuacaggcgugcaccaccacgcuuagccucccaaguagcug

SEQ ID NO: 209986 - RNA, 64 nt, Homo Sapiens
ccuggcuaaauuuuuguugugggauugcagccugcaccaccacaccucagccaccugacuagcu

SEQ ID NO: 209987 - RNA, 64 nt, Homo Sapiens
gugcauggggcagcaaacaccccugccuucccaccaccaccaccaguaggcgcuggccacccgg

SEQ ID NO: 209988 - RNA, 64 nt, Homo Sapiens
accgugcauggggcagcaaacggcccugccuucccaccaccaccgcaaguaggcgcuggccacc

SEQ ID NO: 209989 - RNA, 64 nt, Homo Sapiens
aagacuauccuuaccuuuuaguuucagcaguccucaccaccaccauauccccagugcugggaug

SEQ ID NO: 209990 - RNA, 64 nt, Homo Sapiens
acuauccuuaccuuuuaguuucagcaguccucaccaccaccauauccccagugcugggauggca

SEQ ID NO: 209991 - RNA, 64 nt, Homo Sapiens
cugcaccccaaauaugaacaacugcagcaggugccaccaccaccacaaaagacaccacuacccu

SEQ ID NO: 209992 - RNA, 64 nt, Homo Sapiens
caccccaaauaugaacaacugcagcaggugccaccaccaccacaaaagacaccacuacccuugu

SEQ ID NO: 209993 - RNA, 64 nt, Homo Sapiens
uuaugauugucuuguugauuaaauuguucaugcucaccaccaccaauaagguauuuuucucuga

SEQ ID NO: 209994 - RNA, 64 nt, Homo Sapiens
ugauugucuuguugauuaaauuguucaugcucaccaccaccaauaagguauuuuucucugauug

SEQ ID NO: 209995 - RNA, 64 nt, Homo Sapiens
cccaacuaauuuuauuuuuuagacuacaggcaugcaccaccauacucagccucccaaguaacua

SEQ ID NO: 209996 - RNA, 64 nt, Homo Sapiens
cccagcuacuaaaaauacuuaguagcugggauuacaccaccaugccucccaggucagccuccca

SEQ ID NO: 209997 - RNA, 64 nt, Homo Sapiens
uucagacaucugcaugagugacaaacuuucugaacaccaccaccaccaauaauacuuaucagca

SEQ ID NO: 209998 - RNA, 64 nt, Homo Sapiens
agacaucugcaugagugacaaacuuucugaacaccaccaccaccaauaauacuuaucagcauca

SEQ ID NO: 209999 - RNA, 64 nt, Homo Sapiens
caucugcaugagugacaaacuuucugaacaccaccaccaccaauaauacuuaucagcaucauaa

SEQ ID NO: 210000 - RNA, 64 nt, Homo Sapiens
aaaaaaauaauaauaauaaaaugaaagaaacaaucaccaccaccauuauuaaacuguaacuugu

SEQ ID NO: 210001 - RNA, 64 nt, Homo Sapiens
aaaauaauaauaauaaaaugaaagaaacaaucaccaccaccauuauuaaacuguaacuugucua

SEQ ID NO: 210002 - RNA, 64 nt, Homo Sapiens
gcgagcuggagcgcgcaccaaccaccaacaccaccaccaccaccgagaccccaccaccaccacc

SEQ ID NO: 210003 - RNA, 64 nt, Homo Sapiens
accgcgagcuggagcgcgcaaccaccaccaacaccaccaccaccagggagaccccaccaccacc

SEQ ID NO: 210004 - RNA, 64 nt, Homo Sapiens
accaccgcgagcuggagcgcaccaccaccaccaacaccaccacccgcagggagaccccaccacc

SEQ ID NO: 210005 - RNA, 64 nt, Homo Sapiens
accaccaccaccaccgcgagcccaccaccaccaccaccaccaacagggacagacgcagggagac

SEQ ID NO: 210006 - RNA, 64 nt, Homo Sapiens
aacaccaccaccaccaccgcgaccccaccaccaccaccaccacccuaagggacagacgcaggga

SEQ ID NO: 210007 - RNA, 64 nt, Homo Sapiens
accaacaccaccaccaccacggagaccccaccaccaccaccacccgucuaagggacagacgcag

SEQ ID NO: 210008 - RNA, 64 nt, Homo Sapiens
accaccaacaccaccaccaccagggagaccccaccaccaccacccuacgucuaagggacagacg

SEQ ID NO: 210009 - RNA, 64 nt, Homo Sapiens
accaccaccaacaccaccacacgcagggagaccccaccaccaccggacuacgucuaagggacag

SEQ ID NO: 210010 - RNA, 64 nt, Homo Sapiens
gaucuuacuccagccucccaagcagcugggacuacaccaccacagguaugcaccaccauaccug

SEQ ID NO: 210011 - RNA, 64 nt, Homo Sapiens
cccaagcagcugggacuacaccaccacagguaugcaccaccauaccuggcugauuuuuaaaauu

SEQ ID NO: 210012 - RNA, 64 nt, Homo Sapiens
acaaaaaaaaaagaauuaaucaccgccacaccaacaccaccacuaccaccgccaccaccaccaa

SEQ ID NO: 210013 - RNA, 64 nt, Homo Sapiens
accgccacaccaacaccaccagaaccaccgccaccaccaccaacccucccuucccccaauacac

SEQ ID NO: 210014 - RNA, 64 nt, Homo Sapiens
aacaccgccacaccaacacccacagaaccaccgccaccaccaccaacccucccuucccccaaua

SEQ ID NO: 210015 - RNA, 64 nt, Homo Sapiens
uuuacuuuuauuuucagauuaacacaucagcauucaccaccaggugggcugauaaccaaauuuu

SEQ ID NO: 210016 - RNA, 64 nt, Homo Sapiens
cccagcuaauuuuuguauuuggauuacaggcacccaccaccacgcucagccucccgaguagcug

SEQ ID NO: 210017 - RNA, 64 nt, Homo Sapiens
ccuagcuauucuuuuguauuggacuacaggcacgcaccaccaugcuuagccucccaaguaccug

SEQ ID NO: 210018 - RNA, 64 nt, Homo Sapiens
gucugggccaggcagaggugcuccucauccaugacaccaccagucugaaugguccugggggcug

SEQ ID NO: 210019 - RNA, 64 nt, Homo Sapiens
augguccugggggcuggggcuggagaggccgcugcaccaccacccgagccugggagccagcguc

SEQ ID NO: 210020 - RNA, 64 nt, Homo Sapiens
uuccgcaggaugcacaggugacucacagcugcugcaccaccaccgccagcccaccagcagcccc

SEQ ID NO: 210021 - RNA, 64 nt, Homo Sapiens
aauggcaaacaucaccagcuauuuggagagcuugcaccaccaaaucauccguccuuggcucagg

SEQ ID NO: 210022 - RNA, 64 nt, Homo Sapiens
ccggggcuccuuggcucaccccucccacuaccaccaccaccaccaucuggaccccagagccagc

SEQ ID NO: 210023 - RNA, 64 nt, Homo Sapiens
accccggggcuccuuggcucagcccucccacuaccaccaccaccaucaucuggaccccagagcc

SEQ ID NO: 210024 - RNA, 64 nt, Homo Sapiens
cccagcuaauuuuuuuguauggacuacaggugcccaccaccacaaguagucccaggaguagcug

SEQ ID NO: 210025 - RNA, 64 nt, Homo Sapiens
cccagcuaauuuuuuuuuuugagcuacaagcaugcaccaccacacagccuccugaguagccggg

SEQ ID NO: 210026 - RNA, 64 nt, Homo Sapiens
gagugccacuuccccacccgggaaaggcugccgccaccaccaccaccaacacaacagcaauggc

SEQ ID NO: 210027 - RNA, 64 nt, Homo Sapiens
ugccacuuccccacccgggaaaggcugccgccaccaccaccaccaacacaacagcaauggcaac

SEQ ID NO: 210028 - RNA, 64 nt, Homo Sapiens
cacuuccccacccgggaaaggcugccgccaccaccaccaccaacacaacagcaauggcaacacc

SEQ ID NO: 210029 - RNA, 64 nt, Homo Sapiens
ugcagguggagcucugggauccccagcgccccaccaccaccacguagcgaccaggcuugggcuu

SEQ ID NO: 210030 - RNA, 64 nt, Homo Sapiens
acgugcagguggagcucuggcuuccccagcgccccaccaccacccauuagcgaccaggcuuggg

SEQ ID NO: 210031 - RNA, 64 nt, Homo Sapiens
gccuccugcccagcccuggcggugucuccaucaccaccaccagaccuucugagagcuuggugaa

SEQ ID NO: 210032 - RNA, 64 nt, Homo Sapiens
agagccuccugcccagcccugaaggugucuccaucaccaccaccaagccuucugagagcuuggu

SEQ ID NO: 210033 - RNA, 64 nt, Homo Sapiens
ccuggcuaauuuuuguauuuggacuacaggcaugcaccaccaugccucagcccccagguaacug

SEQ ID NO: 210034 - RNA, 64 nt, Homo Sapiens
ccuggcuaaauuuuguauuuggauuacaggugugcaccaccacgcucggccucuccaguagcug

SEQ ID NO: 210035 - RNA, 64 nt, Homo Sapiens
ccucacagccaugcccagaagccucacaccucgucaccaccaccaccccccaccccauccugag

SEQ ID NO: 210036 - RNA, 64 nt, Homo Sapiens
cacagccaugcccagaagccucacaccucgucaccaccaccaccccccaccccauccugaggca

SEQ ID NO: 210037 - RNA, 64 nt, Homo Sapiens
uuuuuuaaagaaacuggggaaggauuuaugaauacaccaccaccagaguggauaaugcuuagaa

SEQ ID NO: 210038 - RNA, 64 nt, Homo Sapiens
uuuaaagaaacuggggaaggauuuaugaauacaccaccaccagaguggauaaugcuuagaauuc

SEQ ID NO: 210039 - RNA, 64 nt, Homo Sapiens
auuugcauccuucuuccugagccaacugcuugggcaccaccacagcgucuucuauagcucggug

SEQ ID NO: 210040 - RNA, 64 nt, Homo Sapiens
acccacccucucccaccucaugcuccugcaccugcaccaccaagguugaugccggauucgaagc

SEQ ID NO: 210041 - RNA, 64 nt, Homo Sapiens
uuggaauuuucuggcacuuccucucuauugcccccaccaccaccacccccaucacugcuuucuc

SEQ ID NO: 210042 - RNA, 64 nt, Homo Sapiens
gaauuuucuggcacuuccucucuauugcccccaccaccaccacccccaucacugcuuucuccca

SEQ ID NO: 210043 - RNA, 64 nt, Homo Sapiens
ucuucagcacauugacccauagcacacacauacacaccaccaccaacaacgcuugugaauguau

SEQ ID NO: 210044 - RNA, 64 nt, Homo Sapiens
ucagcacauugacccauagcacacacauacacaccaccaccaacaacgcuugugaauguauuuu

SEQ ID NO: 210045 - RNA, 64 nt, Homo Sapiens
uguacguggccauggccagacaccccagucccuucaccaccaccugcuccccacgccaccacca

SEQ ID NO: 210046 - RNA, 64 nt, Homo Sapiens
ccccagucccuucaccaccaccugcuccccacgccaccaccauuuggguggcuguuuuuaaaaa

SEQ ID NO: 210047 - RNA, 64 nt, Homo Sapiens
cucaaagacucaagugggaacgacugggcacugccaccaccagaaagcuguucgacgagacggu

SEQ ID NO: 210048 - RNA, 64 nt, Homo Sapiens
gucuugcccagaggaucacagugcugagaccccccaccaccagccgguaccugggaagggggag

SEQ ID NO: 210049 - RNA, 64 nt, Homo Sapiens
cagccaaucuguucugggcccuccuaagaaccaucaccaccacugggacugacuccagagcccc

SEQ ID NO: 210050 - RNA, 64 nt, Homo Sapiens
cgcuuuaaugcuucagccacuugcuuggcucaagcaccaccaaucggucauugccuccaugccc

SEQ ID NO: 210051 - RNA, 64 nt, Homo Sapiens
ucucccgcccuuaccagcagccuguggcggucaccaccaccacccuuccuucucuaccaucacu

SEQ ID NO: 210052 - RNA, 64 nt, Homo Sapiens
accucucccgcccuuaccagacuccuguggcggucaccaccacccaucuuccuucucuaccauc

SEQ ID NO: 210053 - RNA, 56 nt, Homo Sapiens
ugcgcuucuccaucaacugaagaagacaccaccauucugaggccagggagcgagug

SEQ ID NO: 210054 - RNA, 64 nt, Homo Sapiens
cucagccucccaaguagcugagacuacaggcacacaccaccacgccuggcuaauuuuuguauuu

SEQ ID NO: 210055 - RNA, 64 nt, Homo Sapiens
cugcccgcguuucagggccucgguccauagagaacaccaccaccauggccagguggaaggguuu

SEQ ID NO: 210056 - RNA, 64 nt, Homo Sapiens
cccgcguuucagggccucgguccauagagaacaccaccaccauggccagguggaaggguuuauu

SEQ ID NO: 210057 - RNA, 64 nt, Homo Sapiens
ccuacuaccccuguauucaaucaaccaccaccaccaccaccaccugggcaacagagacccuguc

SEQ ID NO: 210058 - RNA, 64 nt, Homo Sapiens
accccuacuaccccuguauugucucaaccaccaccaccaccaccgccugggcaacagagacccu

SEQ ID NO: 210059 - RNA, 64 nt, Homo Sapiens
accaccccuacuaccccuguccugucucaaccaccaccaccaccccagccugggcaacagagac

SEQ ID NO: 210060 - RNA, 64 nt, Homo Sapiens
accaccaccccuacuaccccgacccugucucaaccaccaccaccacuccagccugggcaacaga

SEQ ID NO: 210061 - RNA, 64 nt, Homo Sapiens
cauaggcuggcacucucaauccuacaucaggugccaccaccaccagacucaggcccugguguaa

SEQ ID NO: 210062 - RNA, 64 nt, Homo Sapiens
aggcuggcacucucaauccuacaucaggugccaccaccaccagacucaggcccugguguaagaa

SEQ ID NO: 210063 - RNA, 64 nt, Homo Sapiens
ggaugaggaaucugaguugcacuccuccuguggccaccaccaaagccuccugaagccucuggga

SEQ ID NO: 210064 - RNA, 64 nt, Homo Sapiens
acccagccaaugggccaccucaacgauguccacacaccaccaaaguucacaccccaaaaugacc

SEQ ID NO: 210065 - RNA, 64 nt, Homo Sapiens
cgguggggagggucguccgguaucccccagugcccaccaccaccaaccagaaucacuucucaga

SEQ ID NO: 210066 - RNA, 64 nt, Homo Sapiens
uggggagggucguccgguaucccccagugcccaccaccaccaaccagaaucacuucucagacug

SEQ ID NO: 210067 - RNA, 64 nt, Homo Sapiens
caggacuucccuuaacaguuuccggaucagugaccaccaccacguucagguuucugaaugcaga

SEQ ID NO: 210068 - RNA, 64 nt, Homo Sapiens
ucuguccuggcagggaaacauacaccccuugucucaccaccaaccuugcuuguguagucagcag

SEQ ID NO: 210069 - RNA, 64 nt, Homo Sapiens
aaauucugacaguguuuuucuuccucuuucauaccaccaccaccacaaucaucaacauaaagga

SEQ ID NO: 210070 - RNA, 64 nt, Homo Sapiens
uucugacaguguuuuucuuccucuuucauaccaccaccaccacaaucaucaacauaaaggaagu

SEQ ID NO: 210071 - RNA, 55 nt, Homo Sapiens
cugaguagcugggauuaugaguacacaccaccacgcccagcuaauuuuuguguuu

SEQ ID NO: 210072 - RNA, 64 nt, Homo Sapiens
cucagccucccgaguagcagggauuaccggugugcaccaccaugccuggauaacuuuuuuuuuu

SEQ ID NO: 210073 - RNA, 64 nt, Homo Sapiens
uugauucaaccuuaaaaauagcuaugaaauauaucaccaccagcuguauuuccuccauuuuccu

SEQ ID NO: 210074 - RNA, 64 nt, Homo Sapiens
cccggcuaguuuuuuuguauggauuacaggcgcccaccaccaugcucagccucccgaguagcug

SEQ ID NO: 210075 - RNA, 64 nt, Homo Sapiens
agaaaaucccaccuccccugaccuccaccaccuccaccaccaccaccaccaccaccaccaccac

SEQ ID NO: 210076 - RNA, 64 nt, Homo Sapiens
aaaucccaccuccccugaccuccaccaccuccaccaccaccaccaccaccaccaccaccacuac

SEQ ID NO: 210077 - RNA, 64 nt, Homo Sapiens
ucccaccuccccugaccuccaccaccuccaccaccaccaccaccaccaccaccaccacuaccac

SEQ ID NO: 210078 - RNA, 64 nt, Homo Sapiens
caccuccccugaccuccaccaccuccaccaccaccaccaccaccaccaccaccacuaccaccac

SEQ ID NO: 210079 - RNA, 64 nt, Homo Sapiens
cuccccugaccuccaccaccuccaccaccaccaccaccaccaccaccaccacuaccaccaccac

SEQ ID NO: 210080 - RNA, 64 nt, Homo Sapiens
cccugaccuccaccaccuccaccaccaccaccaccaccaccaccaccacuaccaccaccaccca

SEQ ID NO: 210081 - RNA, 64 nt, Homo Sapiens
ugaccuccaccaccuccaccaccaccaccaccaccaccaccaccacuaccaccaccacccaacu

SEQ ID NO: 210082 - RNA, 64 nt, Homo Sapiens
ccuccaccaccuccaccaccaccaccaccaccaccaccaccacuaccaccaccacccaacuggg

SEQ ID NO: 210083 - RNA, 64 nt, Homo Sapiens
ccaccaccaccaccaccaccaccaccaccacuaccaccaccacccaacuggggcuagagugggg

SEQ ID NO: 210084 - RNA, 64 nt, Homo Sapiens
aggcugccagcagcucucuggugcaucgucucaacaccaccaaguuuguaggaccugcccaagu

SEQ ID NO: 210085 - RNA, 64 nt, Homo Sapiens
cuuccugagggcuguagccagguccgcaucuccccaccaccaccagggcacucacucgcagcua

SEQ ID NO: 210086 - RNA, 64 nt, Homo Sapiens
ccugagggcuguagccagguccgcaucuccccaccaccaccagggcacucacucgcagcuauag

SEQ ID NO: 210087 - RNA, 64 nt, Homo Sapiens
ccuuaauggcugcuugcugccauaugugacaaaucaccaccaccaguguuaagugcuucuggau

SEQ ID NO: 210088 - RNA, 64 nt, Homo Sapiens
uaauggcugcuugcugccauaugugacaaaucaccaccaccaguguuaagugcuucuggauuca

SEQ ID NO: 210089 - RNA, 64 nt, Homo Sapiens
ccuggcuaauuuuuuuguauggauuacaggcguacaccaccaugcucagccuccagaauagcug

SEQ ID NO: 210090 - RNA, 64 nt, Homo Sapiens
ccucagaagguaggacugugagucucguugagaccaccaccauaucauuuucagaaaaucuaca

SEQ ID NO: 210091 - RNA, 64 nt, Homo Sapiens
uugaauuccgucaucaaugcacgcagggcaccaccaccaccaacgcccccugcggcggaggcca

SEQ ID NO: 210092 - RNA, 64 nt, Homo Sapiens
aacuugaauuccgucaucaaccaacgcagggcaccaccaccacccuggcccccugcggcggagg

SEQ ID NO: 210093 - RNA, 64 nt, Homo Sapiens
accaacuugaauuccgucauaggccaacgcagggcaccaccaccacacuggcccccugcggcgg

SEQ ID NO: 210094 - RNA, 64 nt, Homo Sapiens
gcaucaucaccaugguaacaguucccaucaccaucaccaccaccaccaccaucaccaccaccau

SEQ ID NO: 210095 - RNA, 64 nt, Homo Sapiens
ucaucaccaugguaacaguucccaucaccaucaccaccaccaccaccaucaccaccaccaugga

SEQ ID NO: 210096 - RNA, 64 nt, Homo Sapiens
ucaccaugguaacaguucccaucaccaucaccaccaccaccaccaucaccaccaccauggacaa

SEQ ID NO: 210097 - RNA, 64 nt, Homo Sapiens
ccaugguaacaguucccaucaccaucaccaccaccaccaccaucaccaccaccauggacaacaa

SEQ ID NO: 210098 - RNA, 64 nt, Homo Sapiens
caguucccaucaccaucaccaccaccaccaccaucaccaccaccauggacaacaagccuugggu

SEQ ID NO: 210099 - RNA, 64 nt, Homo Sapiens
uucccaucaccaucaccaccaccaccaccaucaccaccaccauggacaacaagccuuggguaac

SEQ ID NO: 210100 - RNA, 64 nt, Homo Sapiens
cuguguggccaccuggggcuaccaccaccaccaccaccaccauggccaaggcugccugccgugc

SEQ ID NO: 210101 - RNA, 64 nt, Homo Sapiens
augcuguguggccaccugggugcaccaccaccaccaccaccacccaggccaaggcugccugccg

SEQ ID NO: 210102 - RNA, 64 nt, Homo Sapiens
accaugcuguguggccaccuccgugcaccaccaccaccaccaccugccaggccaaggcugccug

SEQ ID NO: 210103 - RNA, 64 nt, Homo Sapiens
accaccaugcuguguggccacugccgugcaccaccaccaccaccagcugccaggccaaggcugc

SEQ ID NO: 210104 - RNA, 64 nt, Homo Sapiens
accaccaccaugcuguguggugccugccgugcaccaccaccaccacgagcugccaggccaaggc

SEQ ID NO: 210105 - RNA, 64 nt, Homo Sapiens
accaccaccaccaugcugugggcugccugccgugcaccaccacccccacgagcugccaggccaa

SEQ ID NO: 210106 - RNA, 64 nt, Homo Sapiens
cuucuagcuggaagccagcccagcguuucucuaccaccaccaccaugccuccaccugacuuugg

SEQ ID NO: 210107 - RNA, 64 nt, Homo Sapiens
cuagcuggaagccagcccagcguuucucuaccaccaccaccaugccuccaccugacuuuggcuu

SEQ ID NO: 210108 - RNA, 64 nt, Homo Sapiens
acauacccacuucacacacacacaucccaaauaccaccaccaaccaccuucuuccucucaacuc

SEQ ID NO: 210109 - RNA, 64 nt, Homo Sapiens
gccaagcccuuuuuagugcugugcucguccagcucaccaccacagccccucucagcccucagua

SEQ ID NO: 210110 - RNA, 64 nt, Homo Sapiens
ccugcacucaccccaccuugagcacaaaagaccucaccaccacagcgaacguggggugauucac

SEQ ID NO: 210111 - RNA, 64 nt, Homo Sapiens
aucauucuccucuagugacgucaccugcccgggacaccaccauuagggcaggauggggacagga

SEQ ID NO: 210112 - RNA, 64 nt, Homo Sapiens
ccuggcuaauuuuuguguuuggauuacaggcaugcaccaccacauucagccucccgaguagcug

SEQ ID NO: 210113 - RNA, 64 nt, Homo Sapiens
ccuggcuaauuuuuguauuuagauuauaggcgugcaccaccacauucagccucccgaguagcug

SEQ ID NO: 210114 - RNA, 63 nt, Homo Sapiens
ccuucuggggucacuccauccuacuaccaccaccaccaccacccagggccccagaagccauga

SEQ ID NO: 210115 - RNA, 60 nt, Homo Sapiens
accccuucuggggucacucccuacuaccaccaccaccacccagggccccagaagccauga

SEQ ID NO: 210116 - RNA, 57 nt, Homo Sapiens
accaccccuucuggggucaccuacuaccaccaccacccagggccccagaagccauga

SEQ ID NO: 210117 - RNA, 64 nt, Homo Sapiens
auggccauagccacgguggcaccaccaccaccaccaccaccaucuucaucugcuucuuccacgc

SEQ ID NO: 210118 - RNA, 64 nt, Homo Sapiens
aucauggccauagccacggucgcaccaccaccaccaccaccacccucuucaucugcuucuucca

SEQ ID NO: 210119 - RNA, 64 nt, Homo Sapiens
accaucauggccauagccacccacgcaccaccaccaccaccacccuccucuucaucugcuucuu

SEQ ID NO: 210120 - RNA, 64 nt, Homo Sapiens
accaccaucauggccauagccuuccacgcaccaccaccaccaccugccuccucuucaucugcuu

SEQ ID NO: 210121 - RNA, 64 nt, Homo Sapiens
accaccaccaucauggccaucuucuuccacgcaccaccaccacccucugccuccucuucaucug

SEQ ID NO: 210122 - RNA, 64 nt, Homo Sapiens
accaccaccaccaucauggccugcuucuuccacgcaccaccaccggccucugccuccucuucau

SEQ ID NO: 210123 - RNA, 64 nt, Homo Sapiens
aucaccuccggaaaguguagccaccaccaccacucaccaccaucaccaccaaccacgaccacca

SEQ ID NO: 210124 - RNA, 64 nt, Homo Sapiens
caccaccaucaucaccuccgacgaccaccaccaccaccaccacucacugccaccaccaccaacc

SEQ ID NO: 210125 - RNA, 64 nt, Homo Sapiens
acucaccaccaucaucaccuaccacgaccaccaccaccaccacccaccacugccaccaccacca

SEQ ID NO: 210126 - RNA, 64 nt, Homo Sapiens
accacucaccaccaucaucaccaaccacgaccaccaccaccaccagacaccacugccaccacca

SEQ ID NO: 210127 - RNA, 64 nt, Homo Sapiens
accaccacucaccaccaucaccaccaaccacgaccaccaccaccuacagacaccacugccacca

SEQ ID NO: 210128 - RNA, 64 nt, Homo Sapiens
cacgaccaccaccaccaccagacaccacugccaccaccaccaacuuaaguccccaacccuuaca

SEQ ID NO: 210129 - RNA, 64 nt, Homo Sapiens
aaccacgaccaccaccaccaacagacaccacugccaccaccaccgcuuuaaguccccaacccuu

SEQ ID NO: 210130 - RNA, 64 nt, Homo Sapiens
aacaucaacacagaucuucaaucaguacuaccaccaccaccaacuucacuuaaaaauuaaaaac

SEQ ID NO: 210131 - RNA, 64 nt, Homo Sapiens
aacaacaucaacacagaucuaacaucaguacuaccaccaccaccuccuucacuuaaaaauuaaa

SEQ ID NO: 210132 - RNA, 64 nt, Homo Sapiens
uuuaaauuucuacuuaagggcaaguaauuugagaauucugaaauuaagcaugaugcuuagauug

SEQ ID NO: 210133 - RNA, 64 nt, Homo Sapiens
uaaaauaauucccuucucccauuccuugucugccauucugaauaugcuuauuaaaauauuuuuu

SEQ ID NO: 210134 - RNA, 64 nt, Homo Sapiens
uuuuuucugaauuuuuuuuuuugagugggacaccauucugaauuccccccacccaccgcaagcu

SEQ ID NO: 210135 - RNA, 64 nt, Homo Sapiens
ugaaacccaugaucaccccuugcgccaucuucacauucugaaguuccuucuuccccaauaugcc

SEQ ID NO: 210136 - RNA, 64 nt, Homo Sapiens
ucaguuaguuacuuuugccuucuuuuacuucugaauucugaaauccagggauccuccuccuuuc

SEQ ID NO: 210137 - RNA, 64 nt, Homo Sapiens
augucuucuugaucagucaguuaguugccaguauauucugaagaauuuuuggugugaaaauuau

SEQ ID NO: 210138 - RNA, 64 nt, Homo Sapiens
uggguagagugguuggguguacaugccauuucacauucugaaacaauaauaugcccugcugaau

SEQ ID NO: 210139 - RNA, 64 nt, Homo Sapiens
guuaaguagaagauuacauuaaaggauuaauaaaauucugaaauaaagaaauagggugauuuuu

SEQ ID NO: 210140 - RNA, 64 nt, Homo Sapiens
gauaaauucagaaaugcucuaagcuaccaaaguuauucugaaaguaugggaacugcuacaacua

SEQ ID NO: 210141 - RNA, 64 nt, Homo Sapiens
agugaaucuaaucuuaaaacuacaaguuguaaguauucugaaauugggaaacauuuauuuuaaa

SEQ ID NO: 210142 - RNA, 64 nt, Homo Sapiens
gguaacuuuguggcaaaaauuuucaauauaauacauucugaaacaauaguugcugccuugcaaa

SEQ ID NO: 210143 - RNA, 64 nt, Homo Sapiens
ugacuguuucccuuuccuucaaggccuagaguauauucugaaaauuuaggaaugaggaagaaau

SEQ ID NO: 210144 - RNA, 64 nt, Homo Sapiens
uagcuugagccugaaaugcaaaacccauggaggaauucugaagccauugucuccuugaguacca

SEQ ID NO: 210145 - RNA, 64 nt, Homo Sapiens
auuuaaaaaacuaucuuuuugcuuacaguuuuaaauucugaacaauucucucuuauauguguau

SEQ ID NO: 210146 - RNA, 64 nt, Homo Sapiens
ugaaggagagagucuuuuaauccuuaaaauuuucauucugaaucugcccccuagggucuauaau

SEQ ID NO: 210147 - RNA, 64 nt, Homo Sapiens
uugguaaaucacacucaaacccacuauuauagaaauucugaauuaauauuaagcuaaaagguuu

SEQ ID NO: 210148 - RNA, 64 nt, Homo Sapiens
uuuuuaaauuuauggcuauuaugcaauguuaguaauucugaaguauaucuguaaucauaucuac

SEQ ID NO: 210149 - RNA, 64 nt, Homo Sapiens
aaagcauacaucaugauuaugaaaaguguuuucaauucugaaaaacuauagaugucuauacugu

SEQ ID NO: 210150 - RNA, 64 nt, Homo Sapiens
caauuuuuuuuuguucccuuaaauacuauauuaaauucugaaugacaggcuaaaauuaguuuua

SEQ ID NO: 210151 - RNA, 64 nt, Homo Sapiens
guuuuuaauguauuugugcauacaauuuuauauaauucugaaauugguucuacuuccuguaaug

SEQ ID NO: 210152 - RNA, 64 nt, Homo Sapiens
cuuuuccacguagacuuauccaaaaaccuaguaaauucugaauguagaugaaauagugauguag

SEQ ID NO: 210153 - RNA, 64 nt, Homo Sapiens
caauguuuugcuuuuacuccgaagaaaauuucuaauucugaacuuaccaugguguuccuuaaaa

SEQ ID NO: 210154 - RNA, 64 nt, Homo Sapiens
uuugucagaaaagagauuuggacauucacccuaaauucugaauuaaaauacaaaauuggaucaa

SEQ ID NO: 210155 - RNA, 64 nt, Homo Sapiens
cgucuuuucugagaaacauauaggauuucuuaaaauucugaauuuaacaagauagccaaaagca

SEQ ID NO: 210156 - RNA, 64 nt, Homo Sapiens
uagugucuuugcguuaaaaaaucauugcaaaaguauucugaacugucaagcugcccagucagau

SEQ ID NO: 210157 - RNA, 64 nt, Homo Sapiens
uuuuaaacaaggcaaggucuaaugcuguuuugagauucugaaauuaaugaaaauacuuauuuca

SEQ ID NO: 210158 - RNA, 64 nt, Homo Sapiens
ucugcagauuccaaacuggaauaagcucuaucauauucugaaacaagaauuagaaugacuugag

SEQ ID NO: 210159 - RNA, 64 nt, Homo Sapiens
cugccuccuguuuauugagaacuaugcauugaacauucugaaucauucuaagccucuggagaga

SEQ ID NO: 210160 - RNA, 64 nt, Homo Sapiens
uacacuuucugucucaaaccgguuaagagaaugaauucugaaugcucuggcagcauaauuuugu

SEQ ID NO: 210161 - RNA, 64 nt, Homo Sapiens
cucaccacacauaauaaccaaagcauuuuuucauauucugaagugcaaaugaaagcauaagcuu

SEQ ID NO: 210162 - RNA, 64 nt, Homo Sapiens
uuccuaugacuaauucacaacugaaaauaacagaauucugaaguaaaugaauucaaccucagcc

SEQ ID NO: 210163 - RNA, 64 nt, Homo Sapiens
aagcacacuguauguucaguuucuacaaaauaacauucugaauccaccagguuaaaauuuuaau

SEQ ID NO: 210164 - RNA, 64 nt, Homo Sapiens
cugguaauuaaaaguuuggguuguucucuuaaauauucugaaucuauuugauucuuaacuaaaa

SEQ ID NO: 210165 - RNA, 64 nt, Homo Sapiens
gaucauaaugaguuaaaaguugaauagagaaaaaauucugaacuaaauuuuauaacaguuucag

SEQ ID NO: 210166 - RNA, 64 nt, Homo Sapiens
aggaaaagaaacugacauggacugcaggaaauuaauucugaagagcugauuugcuuuuuauuaa

SEQ ID NO: 210167 - RNA, 64 nt, Homo Sapiens
uuagacuuucugaggggguuaauaugauggagacauucugaaucauacaguacauuuuucuucu

SEQ ID NO: 210168 - RNA, 64 nt, Homo Sapiens
gguacuuuccuggaauaauucucuguaaugagugauucugaagacaaauggaguuacaggaauu

SEQ ID NO: 210169 - RNA, 64 nt, Homo Sapiens
aagcuauaggguuuuaaguugcaaagaaaaaaauauucugaacaaguaaaacuuaaugaaaaaa

SEQ ID NO: 210170 - RNA, 64 nt, Homo Sapiens
uguauuuaacauagcuguuuuggcuaacaaaugcauucugaaaacuuuuaguauguuuaucaag

SEQ ID NO: 210171 - RNA, 64 nt, Homo Sapiens
uugucuaguucuuccuucaucuugccagacuccaauucugaaaguuucuguucauauuaauuca

SEQ ID NO: 210172 - RNA, 64 nt, Homo Sapiens
uauuugauuaauauauuucuuuguagucuagucuauucugaagaauuuuuuuuaauguuuagau

SEQ ID NO: 210173 - RNA, 64 nt, Homo Sapiens
cucuaaguuuugaugugugggcuucugaguuuauauucugaaaggaaauacacuucuuuugaac

SEQ ID NO: 210174 - RNA, 64 nt, Homo Sapiens
cuaacagaaauuaauuuaacugacaugcauauugauucugaaauuuuuuuccuaaguuuuuuuc

SEQ ID NO: 210175 - RNA, 64 nt, Homo Sapiens
acuguguaugcuuuugaauuuuauuuuuaggaaaauucugaagccagcuaucacagguuuguua

SEQ ID NO: 210176 - RNA, 64 nt, Homo Sapiens
aaaauuuguggugcuccuguaacaguaagaacuaauucugaaauaaaagacaucuccuaaugcu

SEQ ID NO: 210177 - RNA, 64 nt, Homo Sapiens
aguaaaacuauguauaauagaaggacugguuccuauucugaaacaugguuuuaagcugaacuug

SEQ ID NO: 210178 - RNA, 64 nt, Homo Sapiens
aacuacaaaaaugugacugguugaguaggaauccauucugaacaauuaaggcucuacuuccagg

SEQ ID NO: 210179 - RNA, 64 nt, Homo Sapiens
uacagucuacaacugauaaaaaacagacucuuguauucugaaagcagcugaauaaaugugucua

SEQ ID NO: 210180 - RNA, 64 nt, Homo Sapiens
gacugguuuauguuaagcuauguaaucaccagagauucugaaauacucuaauggcauuugaaca

SEQ ID NO: 210181 - RNA, 64 nt, Homo Sapiens
cugaaauaauauuuuucucuuaguauucaacaucauucugaaccgauuacaaguuugagucucc

SEQ ID NO: 210182 - RNA, 64 nt, Homo Sapiens
gugauuuaaaauuuucaaaauauaugucuuuuagauucugaaugguuagccacaaucugucaua

SEQ ID NO: 210183 - RNA, 64 nt, Homo Sapiens
uugaaaaucaacccaauaauucuguauuaacugaauucugaacuuuucaggagguacugugagg

SEQ ID NO: 210184 - RNA, 64 nt, Homo Sapiens
aucauguugaagucaaauuuggauuuuccaccaaauucugaauuuguagacauacuuguacgcu

SEQ ID NO: 210185 - RNA, 64 nt, Homo Sapiens
uucuuuucuuggggaaaugaaguauuccaaagagauucugaaauaaaucuagaaacaugaaauu

SEQ ID NO: 210186 - RNA, 64 nt, Homo Sapiens
uuuuagucaagcuacaacagcuuuaaaaucauacauucugaacacuuuguauaaagagaccugc

SEQ ID NO: 210187 - RNA, 64 nt, Homo Sapiens
uccccaggaaaaaaauaaaugccuuugaaugaaaauucugaaauuguaaaugucuauuuuaaua

SEQ ID NO: 210188 - RNA, 64 nt, Homo Sapiens
aaauaaguaguuaagggcuuuugguauuaaagauauucugaagcucugaaaugcuagaaaaaaa

SEQ ID NO: 210189 - RNA, 64 nt, Homo Sapiens
uauucuuccauugagaaaaauuaaaaacugauauauucugaauuuucauauucucauucguuuu

SEQ ID NO: 210190 - RNA, 64 nt, Homo Sapiens
uuaacgguggugaaaaggggggggaggaaaacuuauucugaauaauacauuaaaugguugauuu

SEQ ID NO: 210191 - RNA, 64 nt, Homo Sapiens
cuuaguuauuuuaaaaaaguuuguaaaacacaagauucugaagacaaauucaaaugguguuuuu

SEQ ID NO: 210192 - RNA, 64 nt, Homo Sapiens
uguguaaaugaaaggaaaguuagggaaccacuucauucugaaaauauauacacacgaagguugc

SEQ ID NO: 210193 - RNA, 64 nt, Homo Sapiens
guucugagcagaagaggggcaugagcugauucacauucugaaggaccucucuagcuggccagug

SEQ ID NO: 210194 - RNA, 64 nt, Homo Sapiens
ggccauugcauugaaggaggugggaaaugauuagauucugaacauauguaauuauuuuucaguc

SEQ ID NO: 210195 - RNA, 64 nt, Homo Sapiens
uucuguguugacccuuuguccaguggaauuggugauucugaauuguccuuuacuaaugguguug

SEQ ID NO: 210196 - RNA, 64 nt, Homo Sapiens
aauaaacuucugaaaacccaaggccagguacugcauucugaaucagaaucucgcaguguuucug

SEQ ID NO: 210197 - RNA, 64 nt, Homo Sapiens
aaccaggaacuaauucuauaauggaaaacuauccauucugaauaauagguauguaauuauuugc

SEQ ID NO: 210198 - RNA, 64 nt, Homo Sapiens
uguaauuauuugcugcugcugcugugcucuguaaauucugaauaugacauuuaaacucugugcc

SEQ ID NO: 210199 - RNA, 64 nt, Homo Sapiens
gcacaggcauugcacacggugcccagucagcccugcugcacaugugccaaggcugaaucccugg

SEQ ID NO: 210200 - RNA, 64 nt, Homo Sapiens
gugcaggcauugcacacggugcccugccagcccugcugcacaggugcaagggcugaguucccag

SEQ ID NO: 210201 - RNA, 64 nt, Homo Sapiens
uuggcugcaugaguugggcuuccccuuacccagggcugcacagccaggugugagggucaccggc

SEQ ID NO: 210202 - RNA, 64 nt, Homo Sapiens
gucccaugcgugagugugguggugugaccuucaggcugcacagaggcaaggacccagauguggc

SEQ ID NO: 210203 - RNA, 64 nt, Homo Sapiens
cacauucaggagccugacuuggaucagacuuggggcugcacaguggagcagguggguucccgug

SEQ ID NO: 210204 - RNA, 64 nt, Homo Sapiens
uccucuaccugccacaccucagaggguuccuacagcugcacacaagcaguugagaguugaugac

SEQ ID NO: 210205 - RNA, 64 nt, Homo Sapiens
augcauacaaaggacacacagggauuuugaaaaugcugcacaucccuuaauagucaucuacaua

SEQ ID NO: 210206 - RNA, 64 nt, Homo Sapiens
aaaaguugauuuacuuuuuauuaaguucuccagagcugcacaacuaguuauguuuugauuuguu

SEQ ID NO: 210207 - RNA, 64 nt, Homo Sapiens
ucaggcacuguaguugcugaguggucuguaaacggcugcacacuuaauaaugcccucauauuga

SEQ ID NO: 210208 - RNA, 64 nt, Homo Sapiens
aacaaaauauaaaucuguauuuuucagugcauaugcugcacaagcaaguggaacagcagcaagu

SEQ ID NO: 210209 - RNA, 64 nt, Homo Sapiens
guucgccugccagcccagagcccuggaggagccggcugcacagagaggcuuuucuucccagcug

SEQ ID NO: 210210 - RNA, 64 nt, Homo Sapiens
aaugcagggcuccucauugcucccaucugccucugcugcacacacaggcaccagcagggaugcc

SEQ ID NO: 210211 - RNA, 64 nt, Homo Sapiens
cugaaauauccacccagcagugggaacacaucuggcugcacaggggcuggaaagcagagccucc

SEQ ID NO: 210212 - RNA, 60 nt, Homo Sapiens; identical to SEQ ID NO: 44968

SEQ ID NO: 210213 - RNA, 64 nt, Homo Sapiens
caggagcuuuccaugacccgggagaccuagagaagcugcacacccgcagguuccugucccuccg

SEQ ID NO: 210214 - RNA, 64 nt, Homo Sapiens
cccauugacacaaacccucagaucacagguugaugcugcacagcagaggcuggggcauuggcaa

SEQ ID NO: 210215 - RNA, 64 nt, Homo Sapiens
ccaagcuguaucuucgccauugcaucuacucuuugcugcacacacugugcuugcuccuggcuuu

SEQ ID NO: 210216 - RNA, 64 nt, Homo Sapiens
guucugaaucuuccugaaguguacugacauuugggcugcacagagccccacaccuucacuuaca

SEQ ID NO: 210217 - RNA, 64 nt, Homo Sapiens
cugggcauaggcuuccugauuccaagccuuuucugggagcaaagccagggccuggugccugauu

SEQ ID NO: 210218 - RNA, 64 nt, Homo Sapiens
auuaagaaaccuacauggguggcauggggcucuggggagcaagcccuuacuugcucagcacugg

SEQ ID NO: 210219 - RNA, 64 nt, Homo Sapiens
ccuuuucucucguggaagauaaaaccuggacucagggagcaaccacaggcucuccacuuugaaa

SEQ ID NO: 210220 - RNA, 64 nt, Homo Sapiens
ccucugcucccccaaagcuguuucugauccugcugggagcaacuaacuaguuauuaugcacauc

SEQ ID NO: 210221 - RNA, 64 nt, Homo Sapiens
guauuuuugauguuuuaauguuccuaaauuguaugggagcaauauucuccguugcaaagaaugu

SEQ ID NO: 210222 - RNA, 64 nt, Homo Sapiens
gaggccgcagagggaaaaaaugagcuaguggagagggagcaaggccuuuccugcucauccccag

SEQ ID NO: 210223 - RNA, 64 nt, Homo Sapiens
ccuguacugcccugccaucucaggccaaagggaggggagcaaguggggaccuggccauggcccc

SEQ ID NO: 210224 - RNA, 64 nt, Homo Sapiens
uggggcaagcggggaaguugggaugagugcgugugggagcaaagaguuaaaaaucacuaugcua

SEQ ID NO: 210225 - RNA, 64 nt, Homo Sapiens
uggggcuucuguaaguagagaggauggugaaguugggagcaaaacucauagagcugccuccccc

SEQ ID NO: 210226 - RNA, 64 nt, Homo Sapiens
gugaagggcacagcugcugggaagcagggagggagggagcaaguggacugaggaggaguggagg

SEQ ID NO: 210227 - RNA, 64 nt, Homo Sapiens
guaaccaauccugccagaccuguuuggggcaguggggagcaaaccuagauaaggaccuguuugg

SEQ ID NO: 210228 - RNA, 64 nt, Homo Sapiens
agcaaaccuagauaaggaccuguuuggggcagcagggagcaaaaucuccuuuaacaaccaagca

SEQ ID NO: 210229 - RNA, 64 nt, Homo Sapiens
gcuggcaggcggcagggcugccuucuggcucugagggagcaagaaggaagccuggagccaagaa

SEQ ID NO: 210230 - RNA, 64 nt, Homo Sapiens
ccugccccugcccgccucucaucccagcaccagggggagcaaacggcugcaaugucucuaccac

SEQ ID NO: 210231 - RNA, 64 nt, Homo Sapiens
aaacacgacauauuuaaagaagguucuuucaccugggagcaaaugaacaauagcuaagugucuu

SEQ ID NO: 210232 - RNA, 64 nt, Homo Sapiens
guaaauuauuuguggcuuugcugagugaaggaaggggagcaagggguggugccccuggucccag

SEQ ID NO: 210233 - RNA, 64 nt, Homo Sapiens
uauuuuaaugguguuacagcauuugcaaaaauuauucugcuaaguauuuacaacucuauuuauu

SEQ ID NO: 210234 - RNA, 64 nt, Homo Sapiens
acauuugucgugguuaccagugcagccugucaaauucugcuauuugacacagcuuuggaaagau

SEQ ID NO: 210235 - RNA, 64 nt, Homo Sapiens
cuggcuaaaucugcucauuacccguccucuuccuuucugcuagcucugcuaacuccugcacagc

SEQ ID NO: 210236 - RNA, 64 nt, Homo Sapiens
uccugcacagccccguccucagcaagaaucaagauucugcuaacugugcaaguaccgaccauag

SEQ ID NO: 210237 - RNA, 64 nt, Homo Sapiens
gguauauguugaucugaacuugguaaugaauaaauucugcuaguuggucucacagcuuaauauu

SEQ ID NO: 210238 - RNA, 64 nt, Homo Sapiens
gcccagggauacaauggcaacuuuguauaacacauucugcuaaguccacacacuugaccaucua

SEQ ID NO: 210239 - RNA, 64 nt, Homo Sapiens
uugcugucauccccacuuuagucacgagaucuuuuucugcuaacuguucauagucuguguagug

SEQ ID NO: 210240 - RNA, 64 nt, Homo Sapiens
cccugcugguucuaauauuaacagaacugcagucuucugcuagccaauagcauuuaccugaugg

SEQ ID NO: 210241 - RNA, 64 nt, Homo Sapiens
uguuagugaugcacauguguaacagcccccucuaaaagcgcaagccagucauaccccuguauau

SEQ ID NO: 210242 - RNA, 64 nt, Homo Sapiens
auaaccauguucuuugguaaugaagccagaaaagaaagcgcaaaagaauggugacucauuugga

SEQ ID NO: 210243 - RNA, 64 nt, Homo Sapiens
ggccuguguccauuguagauuuuccacgggauggaaagcgcaugucuccagugucacuguucug

SEQ ID NO: 210244 - RNA, 64 nt, Homo Sapiens
aggugaaaaugcuuucuuggagcacacaggaaggaaagcgcaggagaagaaagaaccaaccaca

SEQ ID NO: 210245 - RNA, 64 nt, Homo Sapiens
ugcuagcacaugcccuaauguaaaguccccagagaaagcgcagagaguuguugagucuguuuug

SEQ ID NO: 210246 - RNA, 64 nt, Homo Sapiens
caaaagacaccagccacucagaguucuauacuguaaagcgcagauaacauuuguguguuauacc

SEQ ID NO: 210247 - RNA, 64 nt, Homo Sapiens
aaaaggaaaagggcaaauugaaagucaaggagaaaaagcgcaaagaggagaaugaagauccaga

SEQ ID NO: 210248 - RNA, 64 nt, Homo Sapiens
gggcuguuuuaccuuucuuuuuagaugccuagaaaaagcgcacugaggcauugaaggguuuuuc

SEQ ID NO: 210249 - RNA, 64 nt, Homo Sapiens
gcauagcuuuucccuguccugacaccaggcaagaaaagcgcagagaaaucggugucugacgauu

SEQ ID NO: 210250 - RNA, 64 nt, Homo Sapiens
gaugggugacacuuggaguggcacaaguugggggaaagcgcacuugagacagagguaaugaugg

SEQ ID NO: 210251 - RNA, 64 nt, Homo Sapiens
uuggucauugccuugccaaacaggagcuccagcaaaagcgcaggaagagagacuggccuccuug

SEQ ID NO: 210252 - RNA, 64 nt, Homo Sapiens
uccagauuccagacccugccuuuaaauugucacaaaagcgcaucuauauacaugagcuaacuuu

SEQ ID NO: 210253 - RNA, 64 nt, Homo Sapiens
gucuucccaggccagagaaaguggaagagaccacaaagcgcaggcaauuggcaggcaguggggg

SEQ ID NO: 210254 - RNA, 62 nt, Homo Sapiens
aaaacaaaggcucuuuucagagaccgaguugaaaagcgcauagccaccacaagacuaaguaa

SEQ ID NO: 210255 - RNA, 64 nt, Homo Sapiens
uucuguuuuccguguucguaacagaagggaggggaaagcgcagcuacugacaaguagaacacug

SEQ ID NO: 210256 - RNA, 64 nt, Homo Sapiens
gggauggcccccggcgcgggguuuaacucgauagaaagcgcaggaaggagauauuguggggucc

SEQ ID NO: 210257 - RNA, 64 nt, Homo Sapiens
uucacucuuaaugggagagcggagagaauugaagaaagcgcacuagcaagacuaauggaaaugu

SEQ ID NO: 210258 - RNA, 64 nt, Homo Sapiens
gcaugcugggugcaugaaggaaaagagggccuggaaagcgcaguugauucuccugugccacagg

SEQ ID NO: 210259 - RNA, 64 nt, Homo Sapiens
ugaauucaaccucagcccugcagcaguugauauuaaagcgcaaagugacugccugcagaaagac

SEQ ID NO: 210260 - RNA, 64 nt, Homo Sapiens
gcuugcugcccgccgcacgcguaaggagcgcaccaaagcgcagaagacucgagagggggagggg

SEQ ID NO: 210261 - RNA, 64 nt, Homo Sapiens
ccgcccuggcugagcagcacugagcaaggucucgaaagcgcaggaccucacauggggccuuuuc

SEQ ID NO: 210262 - RNA, 64 nt, Homo Sapiens
gcaucuucuucccuccuucuacuguacuggauuuaaagcgcaccuuauagagacaucauauacu

SEQ ID NO: 210263 - RNA, 64 nt, Homo Sapiens
uuaaugcuuaauacauacauggugcaaaauuuaaaaagcgcaaauagguaucuaguggaaaacc

SEQ ID NO: 210264 - RNA, 64 nt, Homo Sapiens
guguauacaaagaaggcaaauucuuuaaucaaauaaagcgcauuauaaaaugagauguuuauug

SEQ ID NO: 210265 - RNA, 64 nt, Homo Sapiens
ccuaaacagaguccgggggguuaaaaagcaaguaaaagcgcauuagcauguugcuuuuguuuuu

SEQ ID NO: 210266 - RNA, 64 nt, Homo Sapiens
ugcagagguggggagguggcgaggauggggacagaaagcgcacagaaucuuggaccaggucucu

SEQ ID NO: 210267 - RNA, 64 nt, Homo Sapiens
ucucuuaauguuguguaauugauuagguaacuaaaaagcgcaaauuguuggcagguuuugcugc

SEQ ID NO: 210268 - RNA, 64 nt, Homo Sapiens
gcccaugucauuuaauugucaguuucuuugacauaaagcgcaucuucuccacaugggcuucacg

SEQ ID NO: 210269 - RNA, 64 nt, Homo Sapiens
cuggauggauggucuuuuaucuugcacacagucaaaagcgcagacaaaagcauuauuacugaua

SEQ ID NO: 210270 - RNA, 64 nt, Homo Sapiens
accaaguacauagugacgauuuuuuaaggaaaaaaaagcgcaaaauuucaguggccuuuuuuuu

SEQ ID NO: 210271 - RNA, 64 nt, Homo Sapiens
cuguacaugacucucuguggagagaagacaagugaaagcgcagcgcucuucaggagacugagac

SEQ ID NO: 210272 - RNA, 64 nt, Homo Sapiens
ggucucuugugaaugacugaacaaaauccacaacaaagcgcaguguucuccaccccucccccau

SEQ ID NO: 210273 - RNA, 64 nt, Homo Sapiens
gggauaacucagaggaacagacacucaaacucccaaagcgcaugauugcugggaaacaguagaa

SEQ ID NO: 210274 - RNA, 64 nt, Homo Sapiens
uacuccuaaacuagcuauccaaaccuuacuauuaaaagcgcaggcagauuuaauuugcuaaaua

SEQ ID NO: 210275 - RNA, 64 nt, Homo Sapiens
gacauccacuugcaaaauguuuggauguaauguuaaagcgcaaugugcaaaauuuaaaauaaag

SEQ ID NO: 210276 - RNA, 64 nt, Homo Sapiens
uuccaggugcugcgcuuggcagaggggucucgccaaagcgcaugugugugcaugugugaacgug

SEQ ID NO: 210277 - RNA, 64 nt, Homo Sapiens
guguccuugcuuuucgaccaccaggccugggcaaaaagcgcaaaccccacucccaaugagcagc

SEQ ID NO: 210278 - RNA, 64 nt, Homo Sapiens
uagagcuacagauccagauacuguagcuguauauaaagcgcaugauauguaugugugcauaugu

SEQ ID NO: 210279 - RNA, 64 nt, Homo Sapiens
caguaugguacuuggacagcaggaaugauacauauaaucugaacuugggaaauuuuggaccuac

SEQ ID NO: 210280 - RNA, 64 nt, Homo Sapiens
acuuugacucuaugaccuaugaagaauaaaaagauaaucugaagguguuugagucagaggcuac

SEQ ID NO: 210281 - RNA, 64 nt, Homo Sapiens
uauacacuguaagcuuuguucugggaguugcuguuaaucugauguauaauguaauguuuuuauu

SEQ ID NO: 210282 - RNA, 64 nt, Homo Sapiens
aauguaauguuuuuauuucaauuguuuauauggauaaucugagcagguacauuucugauucuga

SEQ ID NO: 210283 - RNA, 64 nt, Homo Sapiens
uucaguaucauuuugauugauucaauaaaccuaauaaucugaagagccaagccaagaggauggu

SEQ ID NO: 210284 - RNA, 64 nt, Homo Sapiens
aucacauuugguuuguugagugaacgcuucugcuuaaucugagauucuucuacugcccugagcc

SEQ ID NO: 210285 - RNA, 64 nt, Homo Sapiens
uauuauuuuuauacuauauaaauacugucauugcuaaucugaaccacagucauauucacaaacc

SEQ ID NO: 210286 - RNA, 64 nt, Homo Sapiens
auguaaaugaauacauuuuauaauaaacuuaguuuaaucugaauugaguaaaauggucuuugau

SEQ ID NO: 210287 - RNA, 64 nt, Homo Sapiens
aaaagguauauguguuuucuguaaaauuuaacaauaaucugagccaauugauaaaguaaaugag

SEQ ID NO: 210288 - RNA, 64 nt, Homo Sapiens
cacauaaauagagaaagagcguaacauuuaacaauaaucugauacaauugauaaggcaaauaag

SEQ ID NO: 210289 - RNA, 64 nt, Homo Sapiens
agcuaaugagguucuauuauaaagguucuacuuuuaaucugagggaaaacauguucagggcuuc

SEQ ID NO: 210290 - RNA, 64 nt, Homo Sapiens
uggugccaaacuucgaauggaauacaaauucacauaaucugaacuuuguucacagguuauccua

SEQ ID NO: 210291 - RNA, 64 nt, Homo Sapiens; identical to SEQ ID NO: 84425

SEQ ID NO: 210292 - RNA, 64 nt, Homo Sapiens; identical to SEQ ID NO: 84426

SEQ ID NO: 210293 - RNA, 64 nt, Homo Sapiens; identical to SEQ ID NO: 84427

SEQ ID NO: 210294 - RNA, 64 nt, Homo Sapiens; identical to SEQ ID NO: 84428

SEQ ID NO: 210295 - RNA, 64 nt, Homo Sapiens; identical to SEQ ID NO: 84429

SEQ ID NO: 210296 - RNA, 64 nt, Homo Sapiens; identical to SEQ ID NO: 84430

SEQ ID NO: 210297 - RNA, 64 nt, Homo Sapiens; identical to SEQ ID NO: 84431

SEQ ID NO: 210298 - RNA, 64 nt, Homo Sapiens; identical to SEQ ID NO: 84432

SEQ ID NO: 210299 - RNA, 64 nt, Homo Sapiens; identical to SEQ ID NO: 84433

SEQ ID NO: 210300 - RNA, 64 nt, Homo Sapiens; identical to SEQ ID NO: 84434

SEQ ID NO: 210301 - RNA, 64 nt, Homo Sapiens; identical to SEQ ID NO: 84435

SEQ ID NO: 210302 - RNA, 64 nt, Homo Sapiens; identical to SEQ ID NO: 84436

SEQ ID NO: 210303 - RNA, 64 nt, Homo Sapiens
ucucuguguuuuaugaagagaaaaugaucugauuuucccuuauacuucauuuuacaauacauau

SEQ ID NO: 210304 - RNA, 64 nt, Homo Sapiens
uuuaucuguaggucaguguuccuugugcugucauuucccuuauaucuggaauuugucagcauuc

SEQ ID NO: 210305 - RNA, 64 nt, Homo Sapiens
cagguuucugugggaaaaauuucuuuucugaaauuucccuuauuuucaaacagauuuguggcug

SEQ ID NO: 210306 - RNA, 64 nt, Homo Sapiens
uccaguuuaagaugaucauucuaaaaugagcccuuucccuuauguguuuuuuauuuuaucuaug

SEQ ID NO: 210307 - RNA, 64 nt, Homo Sapiens
aauuuacuuguuuuggauggcuugucuauacuccuucccuuaagggguaucauguauggugaua

SEQ ID NO: 210308 - RNA, 64 nt, Homo Sapiens
gcuguuccuugguccuaguaagaagacaaacugcuucccuuacuuugcugaggguuugaauaaa

SEQ ID NO: 210309 - RNA, 64 nt, Homo Sapiens
auggcucaauaacuuaaaaaauaaaauuaauguuuucccuuaacaaacauuuguucaaguucua

SEQ ID NO: 210310 - RNA, 64 nt, Homo Sapiens
uggcaaucaggcagaggcguuacuagguucuugauucccuuauacccugagaguacuccacgau

SEQ ID NO: 210311 - RNA, 64 nt, Homo Sapiens
gugaauaguggacaacugcccaugagcauuugacuucccuuacucuuugaugaucguagagaaa

SEQ ID NO: 210312 - RNA, 64 nt, Homo Sapiens
ugcaauuaaaaauccuuauuucuuguucuagggcuucccuuaguuaaugguuauuauaaaccua

SEQ ID NO: 210313 - RNA, 64 nt, Homo Sapiens
uuauuuucuuuuagagaggggaaagugugagcucuucccuuauuccuaauggcuauuuuugaag

SEQ ID NO: 210314 - RNA, 64 nt, Homo Sapiens
cuaaaggacuugauguacauaacuccugucccuuuucccuuacaagguggggauugccccuggc

SEQ ID NO: 210315 - RNA, 64 nt, Homo Sapiens
caugcaacuggaguuccuuaucccucucuuccccuucccuuauauauugaggcuaugggguagg

SEQ ID NO: 210316 - RNA, 64 nt, Homo Sapiens
uacuccuguaauucuuaauguccuacuaucuguguucccuuagaugagguuuuuuaauaaccau

SEQ ID NO: 210317 - RNA, 64 nt, Homo Sapiens
gcauacuacugucagucagagcagggacuccccuuucccuuaggugguauaauauauaaaguca

SEQ ID NO: 210318 - RNA, 64 nt, Homo Sapiens
ccagacaguugaugucuagauaggaccucaaugauucccuuagaaucuuagauaccaggauauu

SEQ ID NO: 210319 - RNA, 64 nt, Homo Sapiens
gggagaacaaaauuguccaaaccaugcuguuuuuuucccuuaaauaaaucuuguauucuucagu

SEQ ID NO: 210320 - RNA, 64 nt, Homo Sapiens
aaaaaaugccaugugauuguaauuauccuggauucagaauaauacugugauggggagccagauc

SEQ ID NO: 210321 - RNA, 64 nt, Homo Sapiens
uucucucacaggcuugggaaauccuguuagcaugcagaauaaugugguaacuuugucaauuucc

SEQ ID NO: 210322 - RNA, 64 nt, Homo Sapiens
gcgcaccagcuaacaauguggaauaagagcgcaccagaauaagaggaagaauaagagugcacca

SEQ ID NO: 210323 - RNA, 64 nt, Homo Sapiens
gcgcaccagaauaagagcgcgaauaagagugcaccagaauaagaaaaucuucucuugaaaggaa

SEQ ID NO: 210324 - RNA, 64 nt, Homo Sapiens
gagguuuuuuucaauuaaaaaacuugcaaaugagcagaauaaauuucuugccaguuaaaauuau

SEQ ID NO: 210325 - RNA, 64 nt, Homo Sapiens
ugagaccauuaaucuaauauaaguaagauuuugucagaauaaaugucuaaaugacuaaacuuca

SEQ ID NO: 210326 - RNA, 64 nt, Homo Sapiens
ggucuuguuaagagugcaauaaagagaaaauaugcagaauaacuccgaauuucaucauuuaucu

SEQ ID NO: 210327 - RNA, 64 nt, Homo Sapiens
cuuuuaggaaaccauuucaucuuuaaacaggaggcagaauaauuaacagaauuauaaaagcuua

SEQ ID NO: 210328 - RNA, 64 nt, Homo Sapiens
ugagggaaaucaggucuuuaacaauaucaguuuccagaauaaagaccuauggauuucauguguu

SEQ ID NO: 210329 - RNA, 64 nt, Homo Sapiens
uucuuuccuuagaaaccugauauuaacaguaucucagaauaauuucuauuaccacauuuucucu

SEQ ID NO: 210330 - RNA, 64 nt, Homo Sapiens
uuucaaaacaauuugcauuuagaguguuucgcaucagaauaacaugaguaagaugaacuggaac

SEQ ID NO: 210331 - RNA, 64 nt, Homo Sapiens
uuuaaacaacuaaugcucuuugaagaaucauaaucagaauaaagauaaauucuugaucagcuau

SEQ ID NO: 210332 - RNA, 64 nt, Homo Sapiens
uuaauuauauucuggucuucuaaauauguuagaccagaauaaaaaaaagcaauguaaaucagaa

SEQ ID NO: 210333 - RNA, 64 nt, Homo Sapiens
auguuagaccagaauaaaauaaagcaauguaaaucagaauaaauuucuguaauuauguuacaua

SEQ ID NO: 210334 - RNA, 64 nt, Homo Sapiens
ccauagguucaacuacugcugaaagucuggauuucagaauaaagcagaauguaaguuucaguug

SEQ ID NO: 210335 - RNA, 64 nt, Homo Sapiens
cuuaauuuuggcaaccacuagcaaaaaaacuugucagaauaauuuaaccaagccccucuccacu

SEQ ID NO: 210336 - RNA, 64 nt, Homo Sapiens
aacaauuauccuaaagguuaauaguugaucgaaacagaauaauagaaaaauucuacuuuaauuu

SEQ ID NO: 210337 - RNA, 64 nt, Homo Sapiens
uugaguuaaguguuuuuaauucagucagugaauucagaauaaguacauucauguauaacauagg

SEQ ID NO: 210338 - RNA, 64 nt, Homo Sapiens
cuuauuuacgugugaaagcaaauauucuccuguucagaauaauagcauuaaucagggcauaacu

SEQ ID NO: 210339 - RNA, 64 nt, Homo Sapiens
ugauacauuaguaccugauuggaggucuauccugcagaauaaguaauccugggguugguaugua

SEQ ID NO: 210340 - RNA, 64 nt, Homo Sapiens
uuuuucaucauuuaggugcacagauaccuugacgcagaauaaauccaaaugcagcuucauuuuc

SEQ ID NO: 210341 - RNA, 64 nt, Homo Sapiens
aucacaggaacuuaaauguuuguuaaaauuggaucagaauaauuagauugcuccuaaauccaau

SEQ ID NO: 210342 - RNA, 64 nt, Homo Sapiens
caugucugugcugucuaguuuguguucaaaaugucagaauaaacacagaauaaauguucccacg

SEQ ID NO: 210343 - RNA, 64 nt, Homo Sapiens
ugucuaguuuguguucaaaaugucagaauaaacacagaauaaauguucccacggccacacaguc

SEQ ID NO: 210344 - RNA, 64 nt, Homo Sapiens
caguuuuuuuucuccuacaaacaaucaggaagaacagaauaacuuaaaguaguguaauggauug

SEQ ID NO: 210345 - RNA, 64 nt, Homo Sapiens
aacauauuuaacuuuuuuucauaaaucaaaaacacagaauaagguagagucuuguuauaguugu

SEQ ID NO: 210346 - RNA, 64 nt, Homo Sapiens
gggaaaauccacaccacacucuaaguggacagcucagaauaauuuagcauauuuccuuucacac

SEQ ID NO: 210347 - RNA, 64 nt, Homo Sapiens
gauucaccacaaauuuucaugggcguugagugcucagaauaaugcuugaacaccucaccuugaa

SEQ ID NO: 210348 - RNA, 64 nt, Homo Sapiens
guuacugucauucccauuccuuuucguuuagaaucagaauaaaguuguauuucaaauaucuaag

SEQ ID NO: 210349 - RNA, 64 nt, Homo Sapiens
cuagggaagcacuugcucaaaaucugugaccugucagaauaaaaaugugguuuguacauaucaa

SEQ ID NO: 210350 - RNA, 64 nt, Homo Sapiens
cauuggcauucaaaugucuacuccagugucucuccagaauaagaugaucauuguugaacuucag

SEQ ID NO: 210351 - RNA, 64 nt, Homo Sapiens
caauugaauauccaucacuucagaauuauuuaugcagaauaauuuacuauacuucuggguugaa

SEQ ID NO: 210352 - RNA, 64 nt, Homo Sapiens
ggauacacaucaaccacuuugcuguugaagcugucagaauaaauuccugguggucagaugaaag

SEQ ID NO: 210353 - RNA, 64 nt, Homo Sapiens
gcccaacuuauauguuuuaaucucccuugucccucagaauaagcagaaaauauaacugcagcug

SEQ ID NO: 210354 - RNA, 64 nt, Homo Sapiens
acuaagaauuaaaaguuugauuguuuucauuuaccagaauaaaaaaauucuuuuugauuauuuu

SEQ ID NO: 210355 - RNA, 64 nt, Homo Sapiens
gaauuaauguuuuacuuaauuucugauaauagugcagaauaaauuuacggaaaaauuagaaaaa

SEQ ID NO: 210356 - RNA, 64 nt, Homo Sapiens
uuaucugcagaacaucgauauguauaucauucuacagaauaauccaguauugcugauuuuaaag

SEQ ID NO: 210357 - RNA, 64 nt, Homo Sapiens
uuggaaacugcuaaauucuauguuaaauacugugcagaauaauggaaacauuacaguucauaau

SEQ ID NO: 210358 - RNA, 64 nt, Homo Sapiens
cauguacuacauuugcuaauaagacugauucuagcagaauaaaaacauuguaaaacgugacagu

SEQ ID NO: 210359 - RNA, 64 nt, Homo Sapiens
cuccccaucaugaugaggcuuuuucccaagaugucagaauaagagacuucacacuguggacagc

SEQ ID NO: 210360 - RNA, 64 nt, Homo Sapiens
gucucuaaggaaggcagagaccuggguugagcagcagaauaaaagaucuucuuccaagaaaugc

SEQ ID NO: 210361 - RNA, 64 nt, Homo Sapiens
aaguacacaauaguaagauuaugcucaauauucucagaauaauuuucaauguauuaaugaaaug

SEQ ID NO: 210362 - RNA, 64 nt, Homo Sapiens
acaucagccauucccuucugcagccucucacccucagaauaaaggucaaggguccacagggugc

SEQ ID NO: 210363 - RNA, 64 nt, Homo Sapiens
aacugcucaacaaaggguguaaggcugugagggccagaauaaacagggccuuuguggacuagcc

SEQ ID NO: 210364 - RNA, 64 nt, Homo Sapiens
auuuguaaauaacuauguaaauagaaacagauaccagaauaaaucuacagcuagacccuuaguc

SEQ ID NO: 210365 - RNA, 64 nt, Homo Sapiens
guaaaguuccuuaagucauauuugacugggcgugcagaauaacuucuuaacuuuuaacuaucag

SEQ ID NO: 210366 - RNA, 64 nt, Homo Sapiens
uaguagaaaaauaacugguucauuggagaguuaacagaauaaucaggcuuguuuaaugcaguac

SEQ ID NO: 210367 - RNA, 64 nt, Homo Sapiens
aaauaguaucaaugcaucagaauacuugaaaauacagaauaacuuuuuucccaaguacauaagg

SEQ ID NO: 210368 - RNA, 64 nt, Homo Sapiens
uguacuguauacuuuuccucauugucucauauuucagaauaaaaacaacugcauguuggauuag

SEQ ID NO: 210369 - RNA, 64 nt, Homo Sapiens
aaaccaaaucaugaaaauuagaauuugcuuuagccagaauaaaggaccgaaucugaaacuuugg

SEQ ID NO: 210370 - RNA, 64 nt, Homo Sapiens; identical to SEQ ID NO: 210364

SEQ ID NO: 210371 - RNA, 64 nt, Homo Sapiens
guaaaguuccuuaagucauauuugacugggcgugcagaauaacuucuuaacuauuaacuaucag

SEQ ID NO: 210372 - RNA, 64 nt, Homo Sapiens
uaauacucuccucgacaagucaugcuguuuuaugcagaauaauccaggcgugagaguguucucu

SEQ ID NO: 210373 - RNA, 64 nt, Homo Sapiens
caacucaguaggugagaauaauuaguagguucagcagaauaaacucuuuacaauuaauaacuca

SEQ ID NO: 210374 - RNA, 64 nt, Homo Sapiens; identical to SEQ ID NO: 155946

SEQ ID NO: 210375 - RNA, 64 nt, Homo Sapiens; identical to SEQ ID NO: 155947

SEQ ID NO: 210376 - RNA, 64 nt, Homo Sapiens; identical to SEQ ID NO: 155948

SEQ ID NO: 210377 - RNA, 64 nt, Homo Sapiens; identical to SEQ ID NO: 155949

SEQ ID NO: 210378 - RNA, 64 nt, Homo Sapiens; identical to SEQ ID NO: 155950

SEQ ID NO: 210379 - RNA, 64 nt, Homo Sapiens; identical to SEQ ID NO: 155951

SEQ ID NO: 210380 - RNA, 64 nt, Homo Sapiens; identical to SEQ ID NO: 155952

SEQ ID NO: 210381 - RNA, 64 nt, Homo Sapiens; identical to SEQ ID NO: 155953

SEQ ID NO: 210382 - RNA, 64 nt, Homo Sapiens; identical to SEQ ID NO: 155954

SEQ ID NO: 210383 - RNA, 64 nt, Homo Sapiens; identical to SEQ ID NO: 155955

SEQ ID NO: 210384 - RNA, 64 nt, Homo Sapiens; identical to SEQ ID NO: 155956

SEQ ID NO: 210385 - RNA, 64 nt, Homo Sapiens; identical to SEQ ID NO: 155957

SEQ ID NO: 210386 - RNA, 64 nt, Homo Sapiens; identical to SEQ ID NO: 155958

SEQ ID NO: 210387 - RNA, 64 nt, Homo Sapiens; identical to SEQ ID NO: 155959

SEQ ID NO: 210388 - RNA, 64 nt, Homo Sapiens; identical to SEQ ID NO: 155960

SEQ ID NO: 210389 - RNA, 64 nt, Homo Sapiens; identical to SEQ ID NO: 155961

SEQ ID NO: 210390 - RNA, 64 nt, Homo Sapiens; identical to SEQ ID NO: 155962

SEQ ID NO: 210391 - RNA, 64 nt, Homo Sapiens; identical to SEQ ID NO: 155963

SEQ ID NO: 210392 - RNA, 64 nt, Homo Sapiens; identical to SEQ ID NO: 155964

SEQ ID NO: 210393 - RNA, 64 nt, Homo Sapiens; identical to SEQ ID NO: 155965

SEQ ID NO: 210394 - RNA, 64 nt, Homo Sapiens; identical to SEQ ID NO: 155966

SEQ ID NO: 210395 - RNA, 64 nt, Homo Sapiens; identical to SEQ ID NO: 155967

SEQ ID NO: 210396 - RNA, 64 nt, Homo Sapiens; identical to SEQ ID NO: 155968

SEQ ID NO: 210397 - RNA, 64 nt, Homo Sapiens; identical to SEQ ID NO: 155969

SEQ ID NO: 210398 - RNA, 64 nt, Homo Sapiens; identical to SEQ ID NO: 155970

SEQ ID NO: 210399 - RNA, 64 nt, Homo Sapiens; identical to SEQ ID NO: 155971

SEQ ID NO: 210400 - RNA, 64 nt, Homo Sapiens; identical to SEQ ID NO: 155972

SEQ ID NO: 210401 - RNA, 64 nt, Homo Sapiens; identical to SEQ ID NO: 155973

SEQ ID NO: 210402 - RNA, 64 nt, Homo Sapiens; identical to SEQ ID NO: 155974

SEQ ID NO: 210403 - RNA, 64 nt, Homo Sapiens; identical to SEQ ID NO: 155975

SEQ ID NO: 210404 - RNA, 64 nt, Homo Sapiens; identical to SEQ ID NO: 155976

SEQ ID NO: 210405 - RNA, 64 nt, Homo Sapiens; identical to SEQ ID NO: 155977

SEQ ID NO: 210406 - RNA, 64 nt, Homo Sapiens; identical to SEQ ID NO: 155978

SEQ ID NO: 210407 - RNA, 64 nt, Homo Sapiens; identical to SEQ ID NO: 155979

SEQ ID NO: 210408 - RNA, 64 nt, Homo Sapiens; identical to SEQ ID NO: 155980

SEQ ID NO: 210409 - RNA, 64 nt, Homo Sapiens; identical to SEQ ID NO: 155981

SEQ ID NO: 210410 - RNA, 64 nt, Homo Sapiens; identical to SEQ ID NO: 155982

SEQ ID NO: 210411 - RNA, 64 nt, Homo Sapiens; identical to SEQ ID NO: 155983

SEQ ID NO: 210412 - RNA, 64 nt, Homo Sapiens; identical to SEQ ID NO: 155984

SEQ ID NO: 210413 - RNA, 64 nt, Homo Sapiens; identical to SEQ ID NO: 155985

SEQ ID NO: 210414 - RNA, 64 nt, Homo Sapiens; identical to SEQ ID NO: 155986

SEQ ID NO: 210415 - RNA, 64 nt, Homo Sapiens; identical to SEQ ID NO: 155987

SEQ ID NO: 210416 - RNA, 64 nt, Homo Sapiens; identical to SEQ ID NO: 155988

SEQ ID NO: 210417 - RNA, 64 nt, Homo Sapiens
aagaugggauugccacucacuucuuuucccugagaaaggagaaaugggcagaauggcccuagag

SEQ ID NO: 210418 - RNA, 64 nt, Homo Sapiens
uuuaacuuugcuauuuauuuuugcuuuauuuuuaaaaggagaaguuuguugcuugguugguuug

SEQ ID NO: 210419 - RNA, 64 nt, Homo Sapiens
uaguuuauuucauaugggcaacaaauuuggauagaaaggagaugaaaagcaauugcuccaccuu

SEQ ID NO: 210420 - RNA, 64 nt, Homo Sapiens
accacagauccuacaggacucagugagauugucaaaaggagacauggagggcaggcacgaagaa

SEQ ID NO: 210421 - RNA, 64 nt, Homo Sapiens
uagauguguauguguagugcgauuuucuucaaggaaaggagacaaguccaaagcucguuugugg

SEQ ID NO: 210422 - RNA, 64 nt, Homo Sapiens
augaguucaugcugauacucaaauuucuuuuuaaaaaggagaaacaggaagguuucuuuuggag

SEQ ID NO: 210423 - RNA, 64 nt, Homo Sapiens
ugcaaauuuuaccaaaagauuagcuuauuuugaaaaaggagaauuuggugacuccaacuaugga

SEQ ID NO: 210424 - RNA, 64 nt, Homo Sapiens
aucaauuaucaggaaagcuaauaagaaaaaauauaaaggagaaagguaguaaauuauagaaugu

SEQ ID NO: 210425 - RNA, 64 nt, Homo Sapiens
gggaucugguuuagggcaaucacuguucucaaccaaaggagaugucuccaucuagcaaaugagg

SEQ ID NO: 210426 - RNA, 64 nt, Homo Sapiens
ggccauacaaauguuuucuauagagcaagauaauaaaggagaugggaacaggaacauuguuuuc

SEQ ID NO: 210427 - RNA, 64 nt, Homo Sapiens
aaauucuaguauauuuuaaguauacacacagcaaaaaggagaaaagcaguaaaagaugaaguuu

SEQ ID NO: 210428 - RNA, 64 nt, Homo Sapiens
gguggcgccauggacguggcuuucaguugggaagaaaggagaggagaaggaaagagggcacccu

SEQ ID NO: 210429 - RNA, 64 nt, Homo Sapiens
uuguuacuuacgguucugagggggacugccauggaaaggagaguguaaagccauuggaugagga

SEQ ID NO: 210430 - RNA, 64 nt, Homo Sapiens
auguucuuauuuggaagcagggcugacaggauuuaaaggagagagcaagcagcaaccucugcag

SEQ ID NO: 210431 - RNA, 64 nt, Homo Sapiens
ucagaaugauacaguauuuuccugcaguauugaaaaaggagaauugugacaucagaguauuuga

SEQ ID NO: 210432 - RNA, 64 nt, Homo Sapiens
gggugaggggagauuugcaccuagacacuucuugaaaggagacacucaguuucacaagugagcc

SEQ ID NO: 210433 - RNA, 64 nt, Homo Sapiens
acaucccuuaccuccuuucguugauggccaaagcaaaggagaguccugggagcccacaagaucc

SEQ ID NO: 210434 - RNA, 64 nt, Homo Sapiens
aaacgaugcaucaagcuuguaggaaaagggaaaaaaaggagaaacagugcaucuuuuuaaaaca

SEQ ID NO: 210435 - RNA, 64 nt, Homo Sapiens
uauguguuaacgcuuuguuuaggaaaauaacauuaaaggagacuaccaaagaugaguuaaccaa

SEQ ID NO: 210436 - RNA, 64 nt, Homo Sapiens
gcuaacucuaggaugaagcuacuggcuaaugagaaaaggagacaagagcaggaaguuguaaauc

SEQ ID NO: 210437 - RNA, 64 nt, Homo Sapiens
aggaaguuguaaaucacuggagaugguggaaagcaaaggagagcuuagggacaggguauagcuu

SEQ ID NO: 210438 - RNA, 64 nt, Homo Sapiens
uacuggaguuugagaggagggaggugcuggggccaaaggagacacuagaaaagugguagauggg

SEQ ID NO: 210439 - RNA, 64 nt, Homo Sapiens
uagaauguaaaagggcaguaauuaggggugagggaaaggagauaggggacccuaggagguagag

SEQ ID NO: 210440 - RNA, 64 nt, Homo Sapiens
ggugauuauucaugacaggcaggggagcgagacgaaaggagaacucagacaggcgagaaguacg

SEQ ID NO: 210441 - RNA, 64 nt, Homo Sapiens
gcuagucuagauaaaaaaagggaagaaguaaggaaaaggagagaauuuuuuucuacagauucau

SEQ ID NO: 210442 - RNA, 64 nt, Homo Sapiens
auuguagaccaucaagaagauacuagaccaaacuaaaggagaucgaguccaggacauaugguaa

SEQ ID NO: 210443 - RNA, 64 nt, Homo Sapiens
gucucgaugucauggauuuagguuagguuaaggaaaaggagaugcuguguuccaguuugauaug

SEQ ID NO: 210444 - RNA, 64 nt, Homo Sapiens
gguaggcgagggguucggaguguguucacacaccaaaggagaagaagccugucccgcuagccug

SEQ ID NO: 210445 - RNA, 64 nt, Homo Sapiens
uuagcaggaguccuagcccugcaaaagcguccagaaaggagagcggaaaguucugcuguuuuua

SEQ ID NO: 210446 - RNA, 64 nt, Homo Sapiens
uacaucaggccuucauccuguaaauuaaagcguaaaaggagacccaagagcguccccucacaaa

SEQ ID NO: 210447 - RNA, 64 nt, Homo Sapiens
aaacccacagagguauuugauguauuuaauugugaaaggagacuuugcagauaaaugaggccag

SEQ ID NO: 210448 - RNA, 64 nt, Homo Sapiens
cacaguaacauccacagaacuaguccaacucuuaaaaggagagaggaaaaacacaggcaccagu

SEQ ID NO: 210449 - RNA, 64 nt, Homo Sapiens
ugguguucugcauguagccuucuguggucaugugaaaggagacaggcucuucuaaguugaguug

SEQ ID NO: 210450 - RNA, 64 nt, Homo Sapiens
aguuucucuggaauuccugucucuccuuuaaaagaaaggagagaacauuuuagaacaauaguuc

SEQ ID NO: 210451 - RNA, 64 nt, Homo Sapiens
cccuguucucggugcugggaguacagcagugagcaaaggagacaauauucccugcucacagaga

SEQ ID NO: 210452 - RNA, 64 nt, Homo Sapiens
auaccaugaguauguauguuuaccugugccuaauaaaggagaauuaugaaauaauuuuauuuuu

SEQ ID NO: 210453 - RNA, 64 nt, Homo Sapiens
gagacgcugcaauaaagguugggagaaggcgcggaaaggagaggagcuggggccuuggggaccc

SEQ ID NO: 210454 - RNA, 64 nt, Homo Sapiens
caguauugaucuuguguucuuugugccaauaugaaaaggagaggguugguucuuuccuuuauug

SEQ ID NO: 210455 - RNA, 64 nt, Homo Sapiens
cauucaaagcuuuagaugugucccauguggcaagaaaggagacagugaauuuugucaaacaaua

SEQ ID NO: 210456 - RNA, 64 nt, Homo Sapiens
aucagcauaugagaaucucugagagguccucuagaaaggagagaaaaagcaccucuuuuggcuc

SEQ ID NO: 210457 - RNA, 64 nt, Homo Sapiens
uagauacagucagugucacuggaucagaugaagaaaaggagagggacuuuagacaaaagcaaga

SEQ ID NO: 210458 - RNA, 64 nt, Homo Sapiens
uagauacagucagugucacuacaccugaugaagaaaaggagaggauauggauuuagaaaaagga

SEQ ID NO: 210459 - RNA, 64 nt, Homo Sapiens
uuuuccuuucaacuuaguugacauacgugccuuaaaaaggaaaacuaguguugcuauugugcau

SEQ ID NO: 210460 - RNA, 64 nt, Homo Sapiens
gaaaacuaguguugcuauugugcauuuacuagaaaaaaggaauugguuguuuagggcacacugu

SEQ ID NO: 210461 - RNA, 64 nt, Homo Sapiens
uuauuuuaagaugccuuaaaaaucuuaaagucacaaaaggaaaaagguuuuuaacauuuacaug

SEQ ID NO: 210462 - RNA, 64 nt, Homo Sapiens
guucaauauauacccuucucuaaacugugcggguaaaaggaaugacuguccuugagagaaccau

SEQ ID NO: 210463 - RNA, 64 nt, Homo Sapiens
aauuugcacuguguucauauuaauccucuuuuaaaaaaggaaauauacagaagacaaacauugu

SEQ ID NO: 210464 - RNA, 64 nt, Homo Sapiens
uuggaagggaaguuagacaagcuuuggggaagagaaaaggaauauaguccauuuccaaaggagc

SEQ ID NO: 210465 - RNA, 64 nt, Homo Sapiens
cuugagugacagagcaagacuguaucucaaaggaaaaaggaaacuaggccaggcgugguggcuc

SEQ ID NO: 210466 - RNA, 64 nt, Homo Sapiens
gguuuuuagcucauuugccuaaaaaaaaaagaaaaaaaggaaaauaacaaaaaaaaaaagcuuu

SEQ ID NO: 210467 - RNA, 64 nt, Homo Sapiens
aaauccacgaguggaaaagcacucccuccuccaaaaaaggaauccaagugguugcuccaggauu

SEQ ID NO: 210468 - RNA, 64 nt, Homo Sapiens
acuccuguguacagaugcgaauagaauuaaauguaaaaggaagcaaaaggaaacuucaaacaau

SEQ ID NO: 210469 - RNA, 64 nt, Homo Sapiens
uucaaacaauauagaauuaacugagggagaaaggaaaaggaaacggcagagggaaagggguaca

SEQ ID NO: 210470 - RNA, 64 nt, Homo Sapiens
ccagaagcccugcugucuguaaaaggaaaaaaaaaaaaggaaaauuaaaaaaaaaaaaaaagga

SEQ ID NO: 210471 - RNA, 64 nt, Homo Sapiens
aaaaaaaaggaaaaccagaaaaaaaaaaaaaggaaaaaggaaaaucuaugcuuucuucuuaaaa

SEQ ID NO: 210472 - RNA, 64 nt, Homo Sapiens
aggaaaaaaaaaaaaggaaacuuaaaaaaaaaaaaaaaggaaaaaucaaccucuaugcuuucuu

SEQ ID NO: 210473 - RNA, 64 nt, Homo Sapiens
agcaaguuugcucagucaaguuuguguuuuaaauaaaaggaaaguuuaguucaggaaguuuugu

SEQ ID NO: 210474 - RNA, 64 nt, Homo Sapiens
aaaaaauguuuuacuaugugccgacugauuuuuaaaaaggaaaaauguagggaaaaacuuuugc

SEQ ID NO: 210475 - RNA, 64 nt, Homo Sapiens
guacauuguguagaaaaaaauucuugauccauuuaaaaggaauucguucauguauauaagcuau

SEQ ID NO: 210476 - RNA, 64 nt, Homo Sapiens
agcuauagaacugcuuuguauuccuuuccccuuuaaaaggaauuuuuuccugcuuugguuaccu

SEQ ID NO: 210477 - RNA, 64 nt, Homo Sapiens
ugugggucuuguuuggauccgagacaugucgaccaaaaggaaugacauauaaauuaaaugagac

SEQ ID NO: 210478 - RNA, 64 nt, Homo Sapiens
uguuuaaauaacauuauggggaaaaugcauggagaaaaggaauuaacugaauacuuguuuuaua

SEQ ID NO: 210479 - RNA, 64 nt, Homo Sapiens
aucagaaguugcaaaagaugcauaagaaauugagaaaaggaacauuucaguaucacagauuauu

SEQ ID NO: 210480 - RNA, 64 nt, Homo Sapiens
augaagugccccaggagaagaaguaacuuagaccaaaaggaaaacacuuaaaauagcuuccaau

SEQ ID NO: 210481 - RNA, 64 nt, Homo Sapiens
aagggccaaauagaguuuuuauauuuguuaugauaaaaggaaguagaugugaaaaagccuaaga

SEQ ID NO: 210482 - RNA, 64 nt, Homo Sapiens
ugauaaaaggaaguagaugugaaaaagccuaagaaaaaggaaauuggacaguuuugauacaaac

SEQ ID NO: 210483 - RNA, 64 nt, Homo Sapiens
uagguuuuaaacgacuuuuguuugcggggcuuuuaaaaggaaaaccgaauuagguccacuucaa

SEQ ID NO: 210484 - RNA, 64 nt, Homo Sapiens
uucuguuuguguuauuucagaugauucaaauaucaaaaggaagauucuuccauuaaauugccuu

SEQ ID NO: 210485 - RNA, 64 nt, Homo Sapiens
uggucauagcucauuacucuaccaccaagaaccuaaaaggaauuagaauacagcagaauuggcc

SEQ ID NO: 210486 - RNA, 64 nt, Homo Sapiens
gaucauuuggaagacuuuagacucuauuaauuuuaaaaggaauauuuauuagccauaugcagaa

SEQ ID NO: 210487 - RNA, 64 nt, Homo Sapiens
gcuugauggugauuguauuguauuccuuuaaucaaaaaggaaacacaauauucuaaguaucuuu

SEQ ID NO: 210488 - RNA, 64 nt, Homo Sapiens
ucuagagacauuuuuauuuaugaauauuuauacaaaaaggaauucugucaagaugacugcucua

SEQ ID NO: 210489 - RNA, 57 nt, Homo Sapiens
agaccgacgaggaugacuagacagcaaaaaaggaaaaguuaaacuaaaaaaaaaaag

SEQ ID NO: 210490 - RNA, 64 nt, Homo Sapiens
ccaaggcccugcuuuuuuucuuaaaaguacuuuaaaaaggaaauuuguuuguauuuuuuauuua

SEQ ID NO: 210491 - RNA, 64 nt, Homo Sapiens
gggccucugcucuccugggagacaaagcaauaauaaaaggaaguguuuguaaucccagcacuuu

SEQ ID NO: 210492 - RNA, 64 nt, Homo Sapiens
auaaacaaauaaauuuuaaaaauaaauaaauaauaaaaggaaguguuagacaauguaaugccag

SEQ ID NO: 210493 - RNA, 64 nt, Homo Sapiens
ucuauagaaaucuauauauugugggagagaggaaaaaaggaaaucaauaccuugcagaggaaag

SEQ ID NO: 210494 - RNA, 64 nt, Homo Sapiens
uaaaacaaaaaccacagagggcacccagaagagaaaaaggaauugaggauggagagaaguauca

SEQ ID NO: 210495 - RNA, 64 nt, Homo Sapiens
ugaaggaauggucuaaagaaccuaggaagcuaggaaaaggaaagcugucucccuucugacauuu

SEQ ID NO: 210496 - RNA, 64 nt, Homo Sapiens
ugucucccuucugacauuucaaugccggcaugguaaaaggaagccuugugacugagaaaaguuu

SEQ ID NO: 210497 - RNA, 64 nt, Homo Sapiens
agcuagaauaugaccauuaacagaaugucaaauaaaaaggaauuugauuugggucugccauuga

SEQ ID NO: 210498 - RNA, 64 nt, Homo Sapiens
aguuuucucaaccauuuaaaaagguuauuccaguaaaaggaaauaaaguuaccaucgcaaagga

SEQ ID NO: 210499 - RNA, 64 nt, Homo Sapiens
agcaugacauuguguaucgaaaaaaaaaaaaaggaaaaggaaaaucgcugagcugcuuguuuaa

SEQ ID NO: 210500 - RNA, 64 nt, Homo Sapiens
ggaaaaagcaugacauugugguuuaaaaaaaaaaaaaaggaaaacccaaaucgcugagcugcuu

SEQ ID NO: 210501 - RNA, 64 nt, Homo Sapiens
uaaaaguguauugcacaaugaugacugcaaagguaaaaggaaaauacacaacgauuacucgaag

SEQ ID NO: 210502 - RNA, 64 nt, Homo Sapiens
uucuauccagaagccuauuuuauuuauuggcaacaaaaggaauugaaauacacucagguggucu

SEQ ID NO: 210503 - RNA, 64 nt, Homo Sapiens
accauauagccaaccugugggaaaaaggaaauauaaaaggaacagggaaaguuugucaucauuu

SEQ ID NO: 210504 - RNA, 64 nt, Homo Sapiens
auaaaaggaacaaccauauauugucaucauuugaaaaaggaaauaacaauuuaauugggaaagu

SEQ ID NO: 210505 - RNA, 64 nt, Homo Sapiens
aaaaauuuuacaauuaggagauuuaaaaaaauaaaaaaggaagucagaauaaggaucacugaga

SEQ ID NO: 210506 - RNA, 64 nt, Homo Sapiens
agaauaaggaucacugagaauaauugucaaaaccaaaaggaauccaaccagcuuucauaauuuu

SEQ ID NO: 210507 - RNA, 64 nt, Homo Sapiens
aaagaccauaagcaaacugguuauuuaaaauguaaaaaggaauaugaaagucuuauuaaaacac

SEQ ID NO: 210508 - RNA, 64 nt, Homo Sapiens
auacuauuuggcaacuacugggacucuucagcacaaaaggaauagaucuaugauugacccugau

SEQ ID NO: 210509 - RNA, 64 nt, Homo Sapiens
caggaccauacagugauuuaccauuuugauaauuaaaaggaaaaaaaaaggaagacucucacug

SEQ ID NO: 210510 - RNA, 64 nt, Homo Sapiens
agugauuuaccauuuugauaauuaaaaggaaaaaaaaaggaagacucucacuguaaaaacagcu

SEQ ID NO: 210511 - RNA, 64 nt, Homo Sapiens
ugccacaaaaucaauaaaagauguuuuugagaaaaaaaggaagaaaccaacucauucagaaggc

SEQ ID NO: 210512 - RNA, 64 nt, Homo Sapiens
ucuuucugaucaccuuagaaauggcaguaagcccaaaaggaagaauuaugcugguaguaaaugg

SEQ ID NO: 210513 - RNA, 64 nt, Homo Sapiens
gaaauagauguguguuuaauggaauugaagucugaaaaggaaguaguuauuuuagcagaaaauu

SEQ ID NO: 210514 - RNA, 64 nt, Homo Sapiens
auugaauuauuuuucuccaaauugagacucucagaaaaggaagauugaauuagcguguuuuuug

SEQ ID NO: 210515 - RNA, 64 nt, Homo Sapiens
aacuaugaggaugugcugguuuguugaaucaaacaaaaggaaauguuguggaauauuuuuccaa

SEQ ID NO: 210516 - RNA, 64 nt, Homo Sapiens
agacaaggucaaaaaauagaugcaggcugaaaagaaaaggaagugggcuaagaugggaaaaaua

SEQ ID NO: 210517 - RNA, 64 nt, Homo Sapiens
cuggucaacauagugagacacugucucuaccaaaaaaaggaaggaagggacacauaucaaacug

SEQ ID NO: 210518 - RNA, 64 nt, Homo Sapiens
uugagagugugguuacgaaauacguuaggaggacaaaaggaauguguaagucuuuaaugccgau

SEQ ID NO: 210519 - RNA, 64 nt, Homo Sapiens
acagcauggagaaaacccgguacgcucaaaaagaaaaaggaaaaaaaaaaaucccaucacccac

SEQ ID NO: 210520 - RNA, 64 nt, Homo Sapiens
aaauuuggacauuuuaauuguuuaaaaauuguacaaaaggaaaaaauuagaauaaguacuggcg

SEQ ID NO: 210521 - RNA, 64 nt, Homo Sapiens
aaugcauacaccuguuugucagauauuguuccuaaaaaggaauacagagggcgguucuuuuuuu

SEQ ID NO: 210522 - RNA, 64 nt, Homo Sapiens
uguacucugugcauuggauguacuuuuuguugaaaaaaggaauugggaguauuuuugauuuuuc

SEQ ID NO: 210523 - RNA, 64 nt, Homo Sapiens
aaaaaaaaacacgucaaaaggaaugaagauuggaaaaaggaaaaucggggcgggccaaccccga

SEQ ID NO: 210524 - RNA, 64 nt, Homo Sapiens
uauauauguuagaguuuugacguuaagugguggaaaaaggaaaguaagccgaugggggcagugg

SEQ ID NO: 210525 - RNA, 64 nt, Homo Sapiens
agaaaacaggaccuaggugucaagauccugucucaaaaggaaaacuccagcuugggcaacagag

SEQ ID NO: 210526 - RNA, 64 nt, Homo Sapiens
uaguuauuccuagcuccauuucccaaugaagaggaaaaggaaagcagaucauucaguuggauuu

SEQ ID NO: 210527 - RNA, 64 nt, Homo Sapiens
uucauucauauuuauccucuugucauuugacuuuaaaaggaaguugcacagggcuugagcuuuc

SEQ ID NO: 210528 - RNA, 64 nt, Homo Sapiens
uuagaugggcugugacacaaacuaaaaaauaccuaaaaggaagcagguguuuucucuuggacau

SEQ ID NO: 210529 - RNA, 64 nt, Homo Sapiens
aagaaaaacuguuucaucauaaagcaggaggaagaaaaggaagacucaugacaguugcccuuuc

SEQ ID NO: 210530 - RNA, 64 nt, Homo Sapiens
ccaagggcucucuaaauuuacuuugagccacaccaaaaggaauguagauucagcuuguaauaau

SEQ ID NO: 210531 - RNA, 64 nt, Homo Sapiens
auuagcaagcaugaauuuuucacccaagagugaaaaaaggaaaaucuaccauggcuugaaguua

SEQ ID NO: 210532 - RNA, 64 nt, Homo Sapiens
ugguggcagguacuaugaauguaauucauaauuuaaaaggaaaacuaaaaacuauuuugauuug

SEQ ID NO: 210533 - RNA, 64 nt, Homo Sapiens
ucuuaucacacugauguguucaacuguuuaugggaaaaggaaacuaggaugguuuuauuuguga

SEQ ID NO: 210534 - RNA, 64 nt, Homo Sapiens
cagcgcagagcagagugcugaguaaagaugucagaaaaggaaagcaauggucugguacaagucu

SEQ ID NO: 210535 - RNA, 64 nt, Homo Sapiens
cuuuucaugccuuuagauguuugggucaguugauaaaaggaaacgcacuauugggguaugaugu

SEQ ID NO: 210536 - RNA, 64 nt, Homo Sapiens
aaaacuaacaaccaaccaacauauauauaaauuaaaaaggaaagauauauauauauauauauau

SEQ ID NO: 210537 - RNA, 64 nt, Homo Sapiens
auauauauauauauauauauuucguauucuauucaaaaggaaauaaaccuagaacuucaaaaug

SEQ ID NO: 210538 - RNA, 64 nt, Homo Sapiens
ggaauaguauaaacacugauaauuaaacauuggcaaaaggaaaugaaaaggaauuuuccuguua

SEQ ID NO: 210539 - RNA, 64 nt, Homo Sapiens
uuccuguuaaauuaaacauuuuaggaacuucaagaaaaggaauuagugaccuuuggugaucuuc

SEQ ID NO: 210540 - RNA, 64 nt, Homo Sapiens
ugaguauuuaugaagaauaucuuuuaaaaauaauaaaaggaagaguuucguaaaacuugcgugu

SEQ ID NO: 210541 - RNA, 64 nt, Homo Sapiens
gcagugcaacaaaguacguguuguaaaagaauaaaaaaggaauuaagguaaaacuuagaugucc

SEQ ID NO: 210542 - RNA, 64 nt, Homo Sapiens
guuccacagagucaaucuaaaggacuccuuguaaaaaaggaaauuccuauuauaauaaaaggug

SEQ ID NO: 210543 - RNA, 64 nt, Homo Sapiens
cuggagagaaaacuacagcugaugcuugauacacaaaaggaacuagcaaaugcacaagcaaaaa

SEQ ID NO: 210544 - RNA, 64 nt, Homo Sapiens
aagaaagguuuuuugguuuuggacccaagagaagaaaaggaagagcuauuacauaagaaacaau

SEQ ID NO: 210545 - RNA, 64 nt, Homo Sapiens
guacuggcuauuacauaagaaaagcuaacacaggaaaaggaacucaauuuuaggcucaaaaauu

SEQ ID NO: 210546 - RNA, 64 nt, Homo Sapiens
guuaaaaugacuguuuucucucucuauggaaauaaaaaggaaaaaaaaaaaggaaacuuuuuuu

SEQ ID NO: 210547 - RNA, 64 nt, Homo Sapiens
uuuucucucucuauggaaauaaaaaggaaaaaaaaaaaggaaacuuuuuuuguuugcucuugca

SEQ ID NO: 210548 - RNA, 64 nt, Homo Sapiens
gugauuggcaagacauguauuuaaacaauaaacuaaaaggaaauaaucuccacguacuaccauc

SEQ ID NO: 210549 - RNA, 64 nt, Homo Sapiens
uuuuucuucaaaggcuuguuaaaccaaucauguuaaaaggaaauucuugguuuugguuuguugu

SEQ ID NO: 210550 - RNA, 64 nt, Homo Sapiens
auuuuuguuuggccuugcauugccuugguaaaguaaaaggaaacaguacacuuggagcuaggaa

SEQ ID NO: 210551 - RNA, 64 nt, Homo Sapiens
uaccuugaaccacauauaccaauuauaauuuuggaaaaggaauuaagccucacggaacaaugga

SEQ ID NO: 210552 - RNA, 64 nt, Homo Sapiens
aaaaaacugacaaugcaugcuacuguucucuuucaaaaggaagagcaaccguguugaauacuaa

SEQ ID NO: 210553 - RNA, 64 nt, Homo Sapiens
uugucagcuguagguggcaaaggugcccuuauaaaaaaggaaacuggcuuuucaaaaugggcua

SEQ ID NO: 210554 - RNA, 64 nt, Homo Sapiens
uccaaaagugcagcaggagaacucuuuucccugaaaaaggaaaaauauugaacucaaugauagc

SEQ ID NO: 210555 - RNA, 64 nt, Homo Sapiens
uacggucaguuaugucaauguuucauggucaauaaaaaggaaguugcaaauugugauuuaagca

SEQ ID NO: 210556 - RNA, 64 nt, Homo Sapiens
uauauauccucuguauaaaaugagguuucaguacaaaaggaaccaugggugacccugcgauauc

SEQ ID NO: 210557 - RNA, 64 nt, Homo Sapiens
cccgugauugguugguuuguagcacuaaggucuaaaaaggaaaaccauaaaagacaucagauua

SEQ ID NO: 210558 - RNA, 64 nt, Homo Sapiens
aacagggaggaugggauuaguggaagcuuaauggaaaaggaaaguuaugauccuccaagacccu

SEQ ID NO: 210559 - RNA, 64 nt, Homo Sapiens
aagauaaauggguauguaggggacaaaagggagaaaaaggaagccacaaucucuuauacuagug

SEQ ID NO: 210560 - RNA, 64 nt, Homo Sapiens
auacgaagagucaucaacuuggugcccauauggaaaaaggaaauauugauacuuuaaaagccaa

SEQ ID NO: 210561 - RNA, 64 nt, Homo Sapiens
guaaauguacccuaaugauuuaaaguccuacuaaaaaaggaacgagcaguaucugccacuggga

SEQ ID NO: 210562 - RNA, 64 nt, Homo Sapiens
cagacccucagacaccaaaaacuaggcuuuuuccaaaaggaagaaucaugaucuaaugcagaug

SEQ ID NO: 210563 - RNA, 64 nt, Homo Sapiens
guaaaaauauuaaucgguuauggagcuagcuuuaaaaaggaacacacaggcaauauuccagcua

SEQ ID NO: 210564 - RNA, 64 nt, Homo Sapiens
ugaaaacaauggaaccaugcgagaccuugucucgaaaaggaauccuccagccggggugacagaa

SEQ ID NO: 210565 - RNA, 64 nt, Homo Sapiens
uuuaggcuuucuuuguccuugcccagaaaaaaggaaaaggaaagaaaugcugcuuccuauugga

SEQ ID NO: 210566 - RNA, 64 nt, Homo Sapiens
ggaaaguuuaggcuuucuuuauuggagcccagaaaaaaggaaaacguuguaaaugcugcuuccu

SEQ ID NO: 210567 - RNA, 64 nt, Homo Sapiens
cuaaagaagacuaugauaccuuaaucucucuggaaaaaggaaagauuaagaaccagaaaaauaa

SEQ ID NO: 210568 - RNA, 64 nt, Homo Sapiens
gcagauuuugaaaucugacuagaggugagggauuaaaaggaaagugguaacuugaaggcagcac

SEQ ID NO: 210569 - RNA, 64 nt, Homo Sapiens
ucagugacaucugauuggcagaugagcuuauuucaaaaggaaggguggcuuugcauuucuugug

SEQ ID NO: 210570 - RNA, 64 nt, Homo Sapiens
gguuaggaauccuagcacuugucucaggacucugaaaaggaacggcuuccucauuccuugucuu

SEQ ID NO: 210571 - RNA, 64 nt, Homo Sapiens
auagcauccuuaagauuuaaaaaaaaaaaaaaaaaaaaggaaaaaaaagugauggaagccguaa

SEQ ID NO: 210572 - RNA, 64 nt, Homo Sapiens
caucuugucuauuuuuucucuucauguuguaacaaaaaggaaaaaagaaaaaaaaaucccaucc

SEQ ID NO: 210573 - RNA, 61 nt, Homo Sapiens
gacaccaagggcucuuaugaaucccauccugaaaaggaaggugcaucaccaucuacaggag

SEQ ID NO: 210574 - RNA, 64 nt, Homo Sapiens
aaaaaaagucuguacuaauuucaauauggcucuuaaaaggaaugacagagaaauaggauacaag

SEQ ID NO: 210575 - RNA, 64 nt, Homo Sapiens
agccaaaggauuuaagaguuuuguuguuguuaauaaaaggaauacuccuuuuccuuuuggauca

SEQ ID NO: 210576 - RNA, 64 nt, Homo Sapiens
aaguuaguguaucaguaagaaacagaccuaguuuaaaaggaauaaucaacaauuuuauaaagga

SEQ ID NO: 210577 - RNA, 64 nt, Homo Sapiens
uccccgucccuuaaaaagacaaaaaaaauaaggcaaaaggaaagcaacuaagacacuggacuau

SEQ ID NO: 210578 - RNA, 64 nt, Homo Sapiens
agauaaauaccuggcaaaacuaaauaaauuaccaaaaaggaaaaaaaauccaccaaaccaugau

SEQ ID NO: 210579 - RNA, 64 nt, Homo Sapiens
aggaggugccuccgaauuagaaaucagaauaaguaaaaggaacguucacucacaggguacgcuc

SEQ ID NO: 210580 - RNA, 64 nt, Homo Sapiens
agaaaagaagagaaaaaauuaagaaaaaaaucaaaaaaggaagaaaacuaaaaaaaaaaaaaau

SEQ ID NO: 210581 - RNA, 64 nt, Homo Sapiens
ugagcaccuuuuaaaccugcugcacauuggacucaaaaggaaaacuggaccaacaauaauugag

SEQ ID NO: 210582 - RNA, 64 nt, Homo Sapiens
ccuuuggauuuuauuccaaaccuugcuguaauauaaaaggaaguuuacaagacaugauauugcu

SEQ ID NO: 210583 - RNA, 64 nt, Homo Sapiens
ccucaccuguguggcccagauggcuccaacaagcaaaaggaaggaugcagugacucuugcugcc

SEQ ID NO: 210584 - RNA, 64 nt, Homo Sapiens
aaaguauguuauugaaaguuucuauuugguugauaaaaggaacaauuuuuucccacuuuugaug

SEQ ID NO: 210585 - RNA, 64 nt, Homo Sapiens
uaaugucauugguauaugguggcuguuuaccaauaaaaggaaaaaauucauuaaccgguugcuu

SEQ ID NO: 210586 - RNA, 64 nt, Homo Sapiens
aucuuccuugucucaugaaaaccuaaauauaaaaaaaaggaaaauacuggaguuuuuauuucuc

SEQ ID NO: 210587 - RNA, 64 nt, Homo Sapiens
ccagacaguuauuccauaaagcauuuguauaauuaaaaggaaaacagaaaaaggaaaaguaggc

SEQ ID NO: 210588 - RNA, 64 nt, Homo Sapiens
cauaaagcauuuguauaauuaaaaggaaaacagaaaaaggaaaaguaggcaaaugugaaaauag

SEQ ID NO: 210589 - RNA, 64 nt, Homo Sapiens
aaacuaccuuuuuauaaugcuccugacuuaaaacaaaaggaaagauuuuuaaaaaucuaccugu

SEQ ID NO: 210590 - RNA, 64 nt, Homo Sapiens
guugaggggggggcauuagucauuuucuauaagaaaaaggaaaaaggagguauuguaagcuuuc

SEQ ID NO: 210591 - RNA, 64 nt, Homo Sapiens
cuaaacagaaaccagaacugaagaaaaaagaaaaaaaaggaagaaggaaaaauaauuuuaagua

SEQ ID NO: 210592 - RNA, 64 nt, Homo Sapiens
auaauuuuaaguaaagaaaacuggugaacuuucuaaaaggaaaagugggaggggagcugguuuc

SEQ ID NO: 210593 - RNA, 64 nt, Homo Sapiens
cagagaggagagucuuacggagggcugggagcuuaaaaggaaaacaauguccuuacuuguaaac

SEQ ID NO: 210594 - RNA, 64 nt, Homo Sapiens
uguuuaugauaccaaaaaaauuacaguuuuguuuaaaaggaaauguugauguuuucaacuccaa

SEQ ID NO: 210595 - RNA, 55 nt, Homo Sapiens
ccacuguugaguuuuccugacuuggaaaaggaaauguaaugaacuuauggaaagc

SEQ ID NO: 210596 - RNA, 64 nt, Homo Sapiens
agcgucucgugaguccgacccagacauccaaacuaaaaggaagucauccagucuauucacagaa

SEQ ID NO: 210597 - RNA, 64 nt, Homo Sapiens
auacauggcauuuucuagcuguguccuuauacauaaaaggaaaaagguagcucucucgagucuc

SEQ ID NO: 210598 - RNA, 64 nt, Homo Sapiens
auuuuuauauacugaacugccauagaugcuggaaaaaaggaacugauguuuucagcauauuuuc

SEQ ID NO: 210599 - RNA, 64 nt, Homo Sapiens
uuuccuguuuuucccccuuugaaaaacucaggaaaaaaggaagauugaacuaauaaaauuuuau

SEQ ID NO: 210600 - RNA, 64 nt, Homo Sapiens
uucacauacacauauauacuggaaccuauaguagaaaaggaaacuaguagggccaaaaaaaaaa

SEQ ID NO: 210601 - RNA, 64 nt, Homo Sapiens
guagaauaacuuagcucagcauauuagagcucuaaaaaggaauacacuuuuggauuaggguaca

SEQ ID NO: 210602 - RNA, 64 nt, Homo Sapiens
guagacucacuuagcucagcuauuagagcuuuuaaaaaggaaggaucuuuugguuaggggacaa

SEQ ID NO: 210603 - RNA, 64 nt, Homo Sapiens
gcagugccaaauaugagagguuauuuaccuaauuaaaaggaaagaagaugaagauuauaacugu

SEQ ID NO: 210604 - RNA, 64 nt, Homo Sapiens
gaacuacugggaaauuaugcaauuaaggcucauuaaaaggaaaggcuuuuaauuagucaaacua

SEQ ID NO: 210605 - RNA, 64 nt, Homo Sapiens
uagcucaacuugugauaaaacaacucuauaaaggaaaaggaaugaaucaccccugccuuuuguu

SEQ ID NO: 210606 - RNA, 64 nt, Homo Sapiens
ucauuuauauuaaagaauuugcuguucuuauuguaaaaggaaagauaaaaagugggaaggugau

SEQ ID NO: 210607 - RNA, 64 nt, Homo Sapiens
aauaaugcuccucuuucaggguaauaaaguggggaaaaggaacgucuucucaaugcaagaacau

SEQ ID NO: 210608 - RNA, 64 nt, Homo Sapiens
agcaugagcuuguucagagugaggggcauagugaaaaaggaacagccaugccucaaaaucaaau

SEQ ID NO: 210609 - RNA, 64 nt, Homo Sapiens
uucaaggacuguuucagugugagucagaaugugaaaaaggaauaaaaaauacuguugggcucaa

SEQ ID NO: 210610 - RNA, 64 nt, Homo Sapiens
gcacauguauugacaacaguuuuauaauuuaauaaaaaggaauacauugcaauccguaauuuuc

SEQ ID NO: 210611 - RNA, 64 nt, Homo Sapiens
cagguuugaggggcuggggagugggaggggggagaaaaggaauguauuuaaacaauuuccgaug

SEQ ID NO: 210612 - RNA, 64 nt, Homo Sapiens
gacaagaaauuuaaagaaucaaaacgaugguuugaaaaggaaaccuaugauacaugcaggagaa

SEQ ID NO: 210613 - RNA, 64 nt, Homo Sapiens
uguuuaagaacuauuuuaaaguguuccagacccaaaaaggaaaaauaaaaaaaaaggaauauuu

SEQ ID NO: 210614 - RNA, 64 nt, Homo Sapiens
aaaguguuccagacccaaaaaggaaaaauaaaaaaaaaggaauauuuguacccaacagcuagaa

SEQ ID NO: 210615 - RNA, 64 nt, Homo Sapiens
aaacaguuugaacacaaaggaaggaaaaaaagaaaaaaggaaaaaaaagaaaaaaugaaaaaaa

SEQ ID NO: 210616 - RNA, 64 nt, Homo Sapiens
aaagaaaaaaggaaaaaaacgaaaaaaugaaaaaaaaaggaaaaaguuugaaaucuuaaaaaaa

SEQ ID NO: 210617 - RNA, 64 nt, Homo Sapiens
gaggaagacuggacaaaacauuuuuaaauaaaaaaaaaggaaaacaauaguuuaagaaauuuuu

SEQ ID NO: 210618 - RNA, 64 nt, Homo Sapiens
caaaauuauguggugugaaaacguuaaguuacauaaaaggaaaaauugcauccuucuugcuuau

SEQ ID NO: 210619 - RNA, 64 nt, Homo Sapiens
ucuuauaguugucuuuugugagaaaaaagaaacaaaaaggaacuaaaaauaaaagggaaaaaaa

SEQ ID NO: 210620 - RNA, 64 nt, Homo Sapiens
augucgucuacugcagucuauguuauaaaaaggaaaaaggaagacauuucauugagaauuauga

SEQ ID NO: 210621 - RNA, 64 nt, Homo Sapiens
aggaagaaugucgucuacugauuaugauguuauaaaaaggaaaagccaaagcauuucauugaga

SEQ ID NO: 210622 - RNA, 64 nt, Homo Sapiens
ggaaggagaaauuaauugaggaggcagagcauggaaaaggaauaccuucaauuucugagaaaau

SEQ ID NO: 210623 - RNA, 64 nt, Homo Sapiens
auuauaauaauauaaaugacccuuccuucuccaaaaaaggaaaacuuggaggaagaaaaacugu

SEQ ID NO: 210624 - RNA, 64 nt, Homo Sapiens
acccaaaacauauauacagauuguuggcauuugcaaaaggaagcaucaauaguggacccagagg

SEQ ID NO: 210625 - RNA, 64 nt, Homo Sapiens
agugcaugcacuaauaaaacugguuguuuaauuuaaaaggaauauauaagacuuuacccauguu

SEQ ID NO: 210626 - RNA, 64 nt, Homo Sapiens
caaaacaaacuuguucuuugagauucuaaauuuaaaaaggaaaaaugcuaauguguuguaaaca

SEQ ID NO: 210627 - RNA, 64 nt, Homo Sapiens
uaugcuggucaucacaggaaugugaaaauuccucaaaaggaaaugaauccugaggcugaugaau

SEQ ID NO: 210628 - RNA, 64 nt, Homo Sapiens
aaaucaccuacuuucaugcagguguauaaucuugaaaaggaaaaaugcuuccauguugaagcca

SEQ ID NO: 210629 - RNA, 64 nt, Homo Sapiens
aaaaacuuuccaaacuuuugcaugagaaacuagaaaaaggaauguaugccacguaacuggauua

SEQ ID NO: 210630 - RNA, 64 nt, Homo Sapiens
ccugugagguuuauacuauuucugguuuuuaaccaaaaggaaaucaucuggaagcaggaggcaa

SEQ ID NO: 210631 - RNA, 64 nt, Homo Sapiens
guaaagguugacauauuccaaaacccuucuuuuuaaaaggaaaaaggauggagagaaggaugga

SEQ ID NO: 210632 - RNA, 64 nt, Homo Sapiens
ucugaauaagaugauagacgagaauuuuuuuuaaaaaaggaauuuaaaggaaucuugugcaacu

SEQ ID NO: 210633 - RNA, 64 nt, Homo Sapiens
auagguguugccuauugcugugcuuauaaaaugaaaaaggaaauugaggacacuuuugcaaaug

SEQ ID NO: 210634 - RNA, 63 nt, Homo Sapiens
guggcaagauuccaucagcuauuaaagucuauucaaaaggaaacauuuuucacuuugcucuca

SEQ ID NO: 210635 - RNA, 64 nt, Homo Sapiens
uucaguugaucuucuucaucacuccuccucacuaaaaaggaaacgcuuucaagucugacucucc

SEQ ID NO: 210636 - RNA, 64 nt, Homo Sapiens
uaaaagauauugaggucuucuuuuuuuuaaauuaaaaaggaaaauguaucuggggaaaaaaaac

SEQ ID NO: 210637 - RNA, 64 nt, Homo Sapiens
gagauuucaccaaccccaguacuauaaaaccaaaaaaaggaauuccuguuucuaaacuuucgcu

SEQ ID NO: 210638 - RNA, 64 nt, Homo Sapiens
ggaaagaaugaggaaggaccucaucucauaaacaaaaaggaagaagccacagcagaagagccau

SEQ ID NO: 210639 - RNA, 64 nt, Homo Sapiens
caccacugaugccucccacuggauuucacagucgaaaaggaagcguggcugaccagcuggccca

SEQ ID NO: 210640 - RNA, 64 nt, Homo Sapiens
uuuuguuuucauaaagaggaaaaguuuuauaaagaaaaggaauaagcuugauaaauuugccuau

SEQ ID NO: 210641 - RNA, 64 nt, Homo Sapiens
aaguuuuuuuccuuaaaaaacaaguuccuaggaaaaaaggaauauggucacuaaaguauccuga

SEQ ID NO: 210642 - RNA, 64 nt, Homo Sapiens
cagauuucuucagugacuuuuugccuugaaaguuaaaaggaaagagagaacuacauuuuucuua

SEQ ID NO: 210643 - RNA, 64 nt, Homo Sapiens
auaugguuuccagagaaaaguaguugauuauuaaaaaaggaaaagcuuucuuacauauacaucu

SEQ ID NO: 210644 - RNA, 64 nt, Homo Sapiens
aauaucuagggucuguaaccguuuugguuugagaaaaaggaaaggccccuugucacauccucua

SEQ ID NO: 210645 - RNA, 64 nt, Homo Sapiens
gacauauuuuagugggagccagacuauaaggaauaaaaggaaaaacuuucuuccucucucucca

SEQ ID NO: 210646 - RNA, 64 nt, Homo Sapiens
uauacuauauacagccaguaaauacaugcuuaacaaaaggaaugagccugaaguucauaaagaa

SEQ ID NO: 210647 - RNA, 64 nt, Homo Sapiens
gaaguucauaaagaauacauaucaauauucuuauaaaaggaauauaugaagauggcuuugauac

SEQ ID NO: 210648 - RNA, 64 nt, Homo Sapiens
gaaacuucagccuuucuaagagugaaaacauuuaaaaaggaagaugauaguggauaauagacaa

SEQ ID NO: 210649 - RNA, 64 nt, Homo Sapiens
aacuagcaaaaagaauagccaaaagaaaaaagugaaaaggaaacgagaaaaaagauaaaguaga

SEQ ID NO: 210650 - RNA, 64 nt, Homo Sapiens
caguaguuaaggauaccugaucaagauaguuucuaaaaggaaauuaauuaugaaaaucuaacac

SEQ ID NO: 210651 - RNA, 64 nt, Homo Sapiens
uuuauuuucaaaaaccuaauuagaccauuuuccaaaaaggaaacuucuaagacauuucugaaug

SEQ ID NO: 210652 - RNA, 64 nt, Homo Sapiens
ugaggccagguauggggugugagaaugaagauaaaaaaggaauugauuaauauuuguucaagua

SEQ ID NO: 210653 - RNA, 64 nt, Homo Sapiens
uggagugaauaucaucuuuguguauaguuugccuaaaaggaaguuuaauaucaaaaauugcuau

SEQ ID NO: 210654 - RNA, 64 nt, Homo Sapiens
gagaaaaaucacgacuacugaaacugauauuuaaaaaaggaaaguuuguuuguuuuuguguggu

SEQ ID NO: 210655 - RNA, 64 nt, Homo Sapiens
acugucuugaacaagaugaaauauacccuaucccaaaaggaagaaugaguagcaacagcugguc

SEQ ID NO: 210656 - RNA, 64 nt, Homo Sapiens
guucuauucauaaucaggguaagacaaguuauuaaaaaggaaaggucauuggaauuuauauuaa

SEQ ID NO: 210657 - RNA, 64 nt, Homo Sapiens
gaauaaguauucuugcaucucaugucuucuauuuaaaaggaaaaaacuuucauaaauuuuaugg

SEQ ID NO: 210658 - RNA, 64 nt, Homo Sapiens
ugauugucaggggaaaaacuaagcuuaagugggaaaaaggaagaagcacuuuucauucacuuga

SEQ ID NO: 210659 - RNA, 64 nt, Homo Sapiens
uuuuaaaacauuaagcaacaguuggaugguauucaaaaggaauuuugaaacaaggacaauuugu

SEQ ID NO: 210660 - RNA, 64 nt, Homo Sapiens
uucaauuauuagcuuuguuuaacacauuuuagaaaaaaggaaccucauuugcaaauugcaauaa

SEQ ID NO: 210661 - RNA, 64 nt, Homo Sapiens
aggcacugcuccuauuuuccgacacaguuuacaaaaaaggaaaaguccacucgcuuggauuucu

SEQ ID NO: 210662 - RNA, 64 nt, Homo Sapiens
cccaauuggcagccucucacuacucuuucuggcuaaaaggaaucuaaucuuguugaggguagag

SEQ ID NO: 210663 - RNA, 64 nt, Homo Sapiens
aggcagaacagccagagggggcaggaggggaccaaaaaggaaaaugaggacgugcagcagcauu

SEQ ID NO: 210664 - RNA, 64 nt, Homo Sapiens
ggaaacuaauuuagucaucagagauacuuuccuaaaaaggaaaaauaaaaaacaaaauggugcc

SEQ ID NO: 210665 - RNA, 64 nt, Homo Sapiens
cuugggaaauauuaugacaguugacuuuaagaucaaaaggaagggaagaccugaaagucauuug

SEQ ID NO: 210666 - RNA, 64 nt, Homo Sapiens
ggggacagauucgcagcacaaaguuugugguauaaaaaggaagugaaagaccagauccuuagag

SEQ ID NO: 210667 - RNA, 64 nt, Homo Sapiens
gcaaguaaccaccuggguuauggaagaugcaaguaaaaggaaauucacuucucuuccucccuca

SEQ ID NO: 210668 - RNA, 64 nt, Homo Sapiens
aguauuuucuuauuucacuuuuacaccuaucuuuaaaaggaauuuaaauuuuguuuauauacau

SEQ ID NO: 210669 - RNA, 64 nt, Homo Sapiens
uauacauuaacuaaaucaguacaaguuuggggugaaaaggaaauuuuuaauccaucucaaaugu

SEQ ID NO: 210670 - RNA, 62 nt, Homo Sapiens
gagaacagguccugaugugaacaaccuaugggaaaaggaaaggucgagagaaucuuguccag

SEQ ID NO: 210671 - RNA, 64 nt, Homo Sapiens
ucuaagucaagugcaaggacuuaacuugcguuugaaaaggaauuagagggucagaaacacccag

SEQ ID NO: 210672 - RNA, 64 nt, Homo Sapiens
cacccgcuuagccuuuacauuccucuccaccgacaaaaggaaggggaaacucaaucagcaggac

SEQ ID NO: 210673 - RNA, 64 nt, Homo Sapiens
aaacauucacugcacacguguacagcggaguacgaaaaggaacguuguccacaggggauuuaug

SEQ ID NO: 210674 - RNA, 64 nt, Homo Sapiens
aauggugggaaggaaaaguaaaauccuguaguuuaaaaggaagaaauaaaacauuuuaaaauau

SEQ ID NO: 210675 - RNA, 64 nt, Homo Sapiens
uuaguagacaguauuauauuacuuaguugaaacaaaaaggaauuaaacuaauauaugugagagu

SEQ ID NO: 210676 - RNA, 64 nt, Homo Sapiens
ucugcaugcuauuuuaaucucaaaaggaaacaauaaaaggaauguaccacagacacaguuaaag

SEQ ID NO: 210677 - RNA, 64 nt, Homo Sapiens
aauaaaaggaaugucugcaugacacaguuaaagcaaaaggaaaccagcacuuaaaaauaccaca

SEQ ID NO: 210678 - RNA, 64 nt, Homo Sapiens
aaugugucaugcuuuuuaaaaagccaucucaaguaaaaggaauagugguaccuugaaaauccaa

SEQ ID NO: 210679 - RNA, 64 nt, Homo Sapiens
ucauuuggagaugugaagauagggaauuucacuuaaaaggaaggauuugcuaugcagacaggga

SEQ ID NO: 210680 - RNA, 64 nt, Homo Sapiens
uuauuacccccccacuaugcccucauuuuuuuaaaaaaggaaaaaaaaaagaaacuggguucca

SEQ ID NO: 210681 - RNA, 64 nt, Homo Sapiens
aaaauaaaaaaauaaauaaaaauaaaaaaaauaaaaaaggaaaaaaaaaaaagaagaaacaaga

SEQ ID NO: 210682 - RNA, 64 nt, Homo Sapiens
uuccugcucacacuccagaauuaaauucuauugaaaaaggaaaaucagcaauucagcaaaaaau

SEQ ID NO: 210683 - RNA, 64 nt, Homo Sapiens
guuaaugacagauguucuguuuuuauaaccuaccaaaaggaaacuagaggcuucuuggugaaga

SEQ ID NO: 210684 - RNA, 64 nt, Homo Sapiens
aauccuucccuagagcuaguugauacgcuguuuaaaaaggaaaacuccauccuaggcaacagag

SEQ ID NO: 210685 - RNA, 64 nt, Homo Sapiens
uaggagaagguggaaaugggcaacagaaggaaaaaaaaggaaaagacagagugagacuccaucu

SEQ ID NO: 210686 - RNA, 64 nt, Homo Sapiens
aaaucaaggaaagaaugaguuuuugaaugugaacaaaaggaagaaaacaaaguccaaaagucac

SEQ ID NO: 210687 - RNA, 64 nt, Homo Sapiens
uaacucuccugaacaucuaacuauaauuuugcaaaaaaggaaaauauuuuacagaugcaaacag

SEQ ID NO: 210688 - RNA, 64 nt, Homo Sapiens
uuaauguccguuguaucacaguuuuuuucuuuuuaaaaggaaguaaagggagagcuaccaaauu

SEQ ID NO: 210689 - RNA, 64 nt, Homo Sapiens
gagguucagaaugauuaagggaccuuuuuuaaaaaaaaggaacuagagcuuguucuuguauugu

SEQ ID NO: 210690 - RNA, 64 nt, Homo Sapiens
aagaaaagauuuuugcagaauuuuaacagaagggaaaaggaaagaaaaaagaaaggacauugag

SEQ ID NO: 210691 - RNA, 64 nt, Homo Sapiens
aaaaaaaagaaaggacauugaggugccuggagcaaaaaggaaaaacugagcagaacaaaucguc

SEQ ID NO: 210692 - RNA, 64 nt, Homo Sapiens
guuggcucuuuuuuuaaaagaugcgcucuaccugaaaaggaaauuggauuuuagaacuggaugu

SEQ ID NO: 210693 - RNA, 64 nt, Homo Sapiens
uuauaaaaccucuugcuugugugcaaaaguuccuaaaaggaaacacaaguaaugccuauccauu

SEQ ID NO: 210694 - RNA, 64 nt, Homo Sapiens
aacgacagccccaaucuucccgucuuuaugagagaaaaggaaaaaggaaucaaagguggaagaa

SEQ ID NO: 210695 - RNA, 64 nt, Homo Sapiens
gccccaaucuucccgucuuuaugagagaaaaggaaaaaggaaucaaagguggaagaaaaaaaaa

SEQ ID NO: 210696 - RNA, 64 nt, Homo Sapiens
uggcaaaaacagccuucuaguuaacccuuaccaaaaaaggaaguucagugucuuaauguggaag

SEQ ID NO: 210697 - RNA, 64 nt, Homo Sapiens
uaaacaggaucucaaacuuggggccagguuuuucaaaaggaauagcuuucuuuugcauggacau

SEQ ID NO: 210698 - RNA, 64 nt, Homo Sapiens
cuucauuuucucaagaaaugcaaacauucuuccuaaaaggaagaaacaugguaagccuuagcag

SEQ ID NO: 210699 - RNA, 64 nt, Homo Sapiens
acgaguaauuuauaaaauugaaagaaacacuaacaaaaggaacauauuuuuguauauuguugag

SEQ ID NO: 210700 - RNA, 64 nt, Homo Sapiens
ugagaccgaaaacuuaggguagaucuaucaaaggaaaaggaaacucuguucauacagugaauaa

SEQ ID NO: 210701 - RNA, 64 nt, Homo Sapiens
auucaaaagacuuaggacaaaucugcucucuuucaaaaggaauaacugauuuuuccccccuaau

SEQ ID NO: 210702 - RNA, 64 nt, Homo Sapiens
guccauccauacaauggaguauuacacagccauaaaaaggaaugaagcagugauccccacuaca

SEQ ID NO: 210703 - RNA, 64 nt, Homo Sapiens
agcuagauucucucucucaaaaaaaaaaaaaaaaaaaaggaaagaaagaaagaaaagaaaagaa

SEQ ID NO: 210704 - RNA, 64 nt, Homo Sapiens
gaucagacuaggaacaaguugauaccaaaaccugaaaaggaaacuacagaaugggaaagucaua

SEQ ID NO: 210705 - RNA, 64 nt, Homo Sapiens
caaaaacucaaucaauguaauucaguauuuuaacaaaaggaaugaaaaauuaucaucucaauag

SEQ ID NO: 210706 - RNA, 64 nt, Homo Sapiens
aacaaaauaaaaccaacccauauuuccgucaagaaaaaggaaacguguugagggaaugaauaag

SEQ ID NO: 210707 - RNA, 64 nt, Homo Sapiens
ucuguagacauaauaaauguuagugaauucacguaaaaggaagaguuauuauugucauuaguau

SEQ ID NO: 210708 - RNA, 64 nt, Homo Sapiens
aaagggacuacaucguuggcuuuugaccuugcugaaaaggaacauauaauuguauggaugguag

SEQ ID NO: 210709 - RNA, 64 nt, Homo Sapiens
uuucauauguucuaaaaugacuagcaaugguuuaaaaaggaagaagaguggaagugaagaaggu

SEQ ID NO: 210710 - RNA, 64 nt, Homo Sapiens
aaggcauaaaaugaccuucuauuuaucacugcuaaaaaggaaaauaauuaauagguugcuaauu

SEQ ID NO: 210711 - RNA, 64 nt, Homo Sapiens
acagaacaugcaaaaggccuuaauucaggagaacaaaaggaaacgcuagaugaggacaugagaa

SEQ ID NO: 210712 - RNA, 64 nt, Homo Sapiens
gccucaaagcaaaggcaagccacuuuagagguucaaaaggaagucuugaucaaggaagggcugu

SEQ ID NO: 210713 - RNA, 64 nt, Homo Sapiens
ucaggcaaagggauccauaugcauaaaaaggaaaaaaaggaaacuuccugcugggucuuaacaa

SEQ ID NO: 210714 - RNA, 64 nt, Homo Sapiens
aaaggaaacucaggcaaaggucuuaacaagcauaaaaaggaaaaggacguccauuccugcuggg

SEQ ID NO: 210715 - RNA, 64 nt, Homo Sapiens
uuugaggaaaaaagccuucuaccaaaguaagccuaaaaggaaucuauaauuggagauccugaac

SEQ ID NO: 210716 - RNA, 64 nt, Homo Sapiens
aacaccuuuacauugcucaaucuguuguguugguaaaaggaaucaaauggaucacagaccugaa

SEQ ID NO: 210717 - RNA, 64 nt, Homo Sapiens
uuccacugaaacauuuggaucagcucauguuuggaaaaggaaucuaauuaaaaacccaaagaac

SEQ ID NO: 210718 - RNA, 64 nt, Homo Sapiens
cuccaucaaagaggacccccggcaagacuuggagaaaaggaaagugcuuuuccucaggaaauuc

SEQ ID NO: 210719 - RNA, 64 nt, Homo Sapiens
uauuaagcauaugugcuuucgcagcugauaauauaaaaggaaaucccacagucuagauauagcc

SEQ ID NO: 210720 - RNA, 64 nt, Homo Sapiens
auuauuaugagugggggacuggugacuuuauaugaaaaggaaggaagagugaccuaagcuagca

SEQ ID NO: 210721 - RNA, 64 nt, Homo Sapiens
cuguuacagaaaagacaagaggagaacauaagagaaaaggaaacaaaagaacauaagaacucaa

SEQ ID NO: 210722 - RNA, 64 nt, Homo Sapiens
ccugaugaagaaaaggagagaauauggauuuagaaaaaggaacaauugaaaaaaaaaaacaguc

SEQ ID NO: 210723 - RNA, 64 nt, Homo Sapiens
agaguuaugaagauacagauagcaguccaagcauaaaaggaaaacaaagaaaggccagagaaag

SEQ ID NO: 210724 - RNA, 64 nt, Homo Sapiens
uaaaaacuguggcugaccaauauucauagaaaugaaaaggaaaaacaaagucaacugaaucuuu

SEQ ID NO: 210725 - RNA, 64 nt, Homo Sapiens
cuguauuuucuauuagccauccaacucucuuaugaaaaggaacuaaaaauacuguuucuucuau

SEQ ID NO: 210726 - RNA, 64 nt, Homo Sapiens
acgggagaaauccacguaacguuuaagucuguggaaaaggaagcuauccuuacguccugagccg

SEQ ID NO: 210727 - RNA, 64 nt, Homo Sapiens
agauuugagaagugagagagaccuagaagguggaaaaaggaaaggaccauccacugucuuugac

SEQ ID NO: 210728 - RNA, 64 nt, Homo Sapiens
ggucaaguugaagucauucuaaaaaaaaauguuaacacaucacaagguacuguagcuuuuaggg

SEQ ID NO: 210729 - RNA, 64 nt, Homo Sapiens
ggcugugaccccucaggcuaaacugccucugcacacacaucacuaggcaaggagcuucugaaga

SEQ ID NO: 210730 - RNA, 64 nt, Homo Sapiens
aaggcaaaaagaacgagugauuuuuccuuaggauacacaucaaccacuuugcuguugaagcugu

SEQ ID NO: 210731 - RNA, 64 nt, Homo Sapiens
aguacuaauuuucacugcuaauaauucuguaaggacacaucaaagcuggccaaaauaaugaauu

SEQ ID NO: 210732 - RNA, 64 nt, Homo Sapiens
ugggugagcuacucugguugguaauacucugugcacacaucauuguagccacacaucauugcug

SEQ ID NO: 210733 - RNA, 64 nt, Homo Sapiens
guugguaauacucugugcacacaucauuguagccacacaucauugcugggagaauuaagcauua

SEQ ID NO: 210734 - RNA, 64 nt, Homo Sapiens
aaaggcagacuuuauugugaauaguaaacaugauacacaucaaugaacucaccacuuacccggg

SEQ ID NO: 210735 - RNA, 64 nt, Homo Sapiens
auuaucaucaucaucauuguaaacacacacacacacacaucauccagaguauguggauacccgg

SEQ ID NO: 210736 - RNA, 64 nt, Homo Sapiens
gugacgccguggagcaggaucuucauucaucucaccagagcaacagcccaguccugaggauggg

SEQ ID NO: 210737 - RNA, 64 nt, Homo Sapiens
aagaagugagaauuuccgaaaaagaucugccggcccagagcacucccucuugcccuaauccugg

SEQ ID NO: 210738 - RNA, 64 nt, Homo Sapiens
cagaucagacucuccuucagcccccagcuaauacccagagcaccgcccagcuccauacucuguc

SEQ ID NO: 210739 - RNA, 64 nt, Homo Sapiens
gggaccuaggcuccucuuaccaccccaggcccugccagagcaggacaagugaucgccacccccc

SEQ ID NO: 210740 - RNA, 64 nt, Homo Sapiens
gccaacucuuggaggucccacaaguauuccuaugccagagcagucuucauuuaaccaagcuauu

SEQ ID NO: 210741 - RNA, 64 nt, Homo Sapiens
guguaacggccaacacuuugcaugacaaauauuaccagagcaaaaugaugucacacaaaauuau

SEQ ID NO: 210742 - RNA, 64 nt, Homo Sapiens
cucugucaccgcuucugugugggccccgaggcucccagagcagcuccuguuugcagacguuggc

SEQ ID NO: 210743 - RNA, 64 nt, Homo Sapiens
gcuggagggaaggagccaggcuuccccauucuggccagagcagguuuuuccuuguuugguugau

SEQ ID NO: 210744 - RNA, 64 nt, Homo Sapiens
ggcuuggcguccagcaaugaucagccucuauuguccagagcacucacugacucagggcucagac

SEQ ID NO: 210745 - RNA, 64 nt, Homo Sapiens
gggcaucagggagaaaguccaccuggggaggggcccagagcaaauguucuccuugggggcagga

SEQ ID NO: 210746 - RNA, 64 nt, Homo Sapiens
caguauuuaauguauuuauucuuguauguuuuuuccagagcauuaaagcuuucauaagguucuc

SEQ ID NO: 210747 - RNA, 64 nt, Homo Sapiens
ccccacauaacuuuguccccucuuccccaacaacccagagcagguguugcagacaggagggcca

SEQ ID NO: 210748 - RNA, 64 nt, Homo Sapiens
aguccuugaagagcagcuuuggaaggagcugcccccagagcaucgccaccugagaagauggaaa

SEQ ID NO: 210749 - RNA, 64 nt, Homo Sapiens
uggcacaagcaccacugauacaccacugcaggugccagagcaagcagcaaaggccagccucucc

SEQ ID NO: 210750 - RNA, 64 nt, Homo Sapiens
gccaggagagauucaacuuuccaaucuaaguauuccagagcauugcccaggcagaguugguuug

SEQ ID NO: 210751 - RNA, 64 nt, Homo Sapiens
uagaagagauggggagauucaggaucccccugugccagagcacagccucaccggaugcugcuuc

SEQ ID NO: 210752 - RNA, 64 nt, Homo Sapiens
gaucuguuucgugcauuggagggguagagcugauccagagcacagucucuccaucuguuuggug

SEQ ID NO: 210753 - RNA, 64 nt, Homo Sapiens
aggccccuggcccagcggccaacagaggagagucccagagcaggcguccgcgcgccagcacaga

SEQ ID NO: 210754 - RNA, 64 nt, Homo Sapiens
aaucaaguggugaggcacugggacuucuguuucaccagagcaggagcuagguggacugccccua

SEQ ID NO: 210755 - RNA, 64 nt, Homo Sapiens
uuuuugaccacucagcaaaaagaaaguuuccuaaccagagcaucuggauuuaacauagguucac

SEQ ID NO: 210756 - RNA, 64 nt, Homo Sapiens
ccuguuguacaaacagacacaaagaaauccuguuccagagcauagaaacacgugccuacgcugu

SEQ ID NO: 210757 - RNA, 64 nt, Homo Sapiens
uguccgcccacugcccuugcaaacgcugggcuccccagagcacccaggaagaucagcuguaaau

SEQ ID NO: 210758 - RNA, 64 nt, Homo Sapiens
caugaagucuucccgccugggcuugguguccaucccagagcauuaaccauuuccccuuccagua

SEQ ID NO: 210759 - RNA, 64 nt, Homo Sapiens
agcuggcgggugucuuccugcagccugaccccacccagagcaggccagcagcugcucugcucac

SEQ ID NO: 210760 - RNA, 64 nt, Homo Sapiens
gcucagcaucacacugacacagcgugcugguuccccagagcacacagccccacuaucagugucc

SEQ ID NO: 210761 - RNA, 64 nt, Homo Sapiens
aggccccgagccccuucagggcuaccacucuuccccagagcagccaugugccccuuugcugcug

SEQ ID NO: 210762 - RNA, 64 nt, Homo Sapiens
ugcccagccccuccaccaccaccagagcaugugaccagagcauguugccauugccuggaggggg

SEQ ID NO: 210763 - RNA, 64 nt, Homo Sapiens
ugaccagagcaugugcccagugccuggagggggaccagagcauguguggggucacucuugccau

SEQ ID NO: 210764 - RNA, 64 nt, Homo Sapiens
ucagcgucucgagaggccccaggcaccaccguccccagagcaggugugaaauugagcaauaggc

SEQ ID NO: 210765 - RNA, 64 nt, Homo Sapiens
uaacauagcuuggaggcguaauuucucccguuuuccagagcauuggauacuguuguucacgaua

SEQ ID NO: 210766 - RNA, 64 nt, Homo Sapiens
ugauaaagaacuguauuuaaucaggucggcagacccagagcacuugggggcagggguuaguucu

SEQ ID NO: 210767 - RNA, 64 nt, Homo Sapiens
cccucuccccagaaggacccccaagcccccauucccagagcagagaccauccuggccauagcag

SEQ ID NO: 210768 - RNA, 64 nt, Homo Sapiens
uugugacuagagggugguggagguaaggccuuccagagcccauggcuucaggagagggucucuc

SEQ ID NO: 210769 - RNA, 64 nt, Homo Sapiens
uugaagcuuuaacaugguucaggcccuuggugugagagcccagggggaggacagcuugucugcu

SEQ ID NO: 210770 - RNA, 64 nt, Homo Sapiens
cccaugcccaccaguguuggugcucaccugccacagagcccacaaccacaucaguguuuccguc

SEQ ID NO: 210771 - RNA, 64 nt, Homo Sapiens
uccgcccugggcaggagcccucccuguuccccagagagcccaccccugggaagacacauucccu

SEQ ID NO: 210772 - RNA, 64 nt, Homo Sapiens
cugcuggaacagccaaggacugcauccggcucacagagcccagagacgucugugcugccugguu

SEQ ID NO: 210773 - RNA, 64 nt, Homo Sapiens
ccccacgucuuacagucgccggguugagcaauggagagcccagcgcucucccagacaggagcca

SEQ ID NO: 210774 - RNA, 64 nt, Homo Sapiens
agcagcccuggcccuguaagcccacuugguagaaagagcccagacuuuguuuugaacuuccuuu

SEQ ID NO: 210775 - RNA, 64 nt, Homo Sapiens
gggccggccggguuccugguggccuccccaccggagagcccaggcacagccuuauuucugccgg

SEQ ID NO: 210776 - RNA, 64 nt, Homo Sapiens
agucagugcuggugguuggauucugugauucuucagagcccagguuauuuuauauaaaaagugu

SEQ ID NO: 210777 - RNA, 64 nt, Homo Sapiens
acaccacaaagagcagcaccgagcagaacagaccagagcccaccuugcucccaggcccagcacc

SEQ ID NO: 210778 - RNA, 64 nt, Homo Sapiens
acaucauugaaguggagcccggcacaggggucauagagcccagugaggucggggauuuugaguu

SEQ ID NO: 210779 - RNA, 64 nt, Homo Sapiens
gucagccagcucccagccacauggcgcaugaaggagagcccagucucccuccaggaaaggccug

SEQ ID NO: 210780 - RNA, 64 nt, Homo Sapiens
agccugaccagaggggagguggauggcacuuuccagagcccagguucuuauggcauuucccagg

SEQ ID NO: 210781 - RNA, 64 nt, Homo Sapiens
gaugugcccacugcccgugcagccuccuucagccagagcccagagcauagacaggaguguagga

SEQ ID NO: 210782 - RNA, 64 nt, Homo Sapiens
cugaguugaagaaccuauuggcugaugguuucccagagcccacaagaaguguuccguacccacu

SEQ ID NO: 210783 - RNA, 64 nt, Homo Sapiens
gaaguguuccguacccacugagugaccccagggcagagcccagacuugacucccauuugcucuc

SEQ ID NO: 210784 - RNA, 64 nt, Homo Sapiens
cugcaagaccuggcugagccgguuagaucucagcagagcccauuaacagauagcaaaugugucu

SEQ ID NO: 210785 - RNA, 64 nt, Homo Sapiens
gucaggaguucguucaguaacagcucaucagcucagagcccaggugauuaacaccuucuggagc

SEQ ID NO: 210786 - RNA, 64 nt, Homo Sapiens
auccaucucugucaucaucugaaccaggacccucagagcccagcccccuggauguccuucgaag

SEQ ID NO: 210787 - RNA, 64 nt, Homo Sapiens
aucucagaggccccuggaugacaggccaggaaccagagcccauccuccugcuccuacccaugcu

SEQ ID NO: 210788 - RNA, 64 nt, Homo Sapiens
aaauccugagugucaguuugauagcauuguaaugagagcccaucuguuuguuccuguuaaaugu

SEQ ID NO: 210789 - RNA, 64 nt, Homo Sapiens
cuacagugggugguuuugguuacaguaacauccaagagcccauuuuguuaccuugaccacgcug

SEQ ID NO: 210790 - RNA, 64 nt, Homo Sapiens
ugcacugugugaugaugggaaggcaaggggcugcagagcccaggucuugcugcggcugcaaugg

SEQ ID NO: 210791 - RNA, 64 nt, Homo Sapiens
ccagugcagucccggcugugaguagagagcaauaagagcccagcguccuaucagugccccccag

SEQ ID NO: 210792 - RNA, 64 nt, Homo Sapiens
ccccuccacgggggucccagagcagugaccgggcagagcccaacccuuguauauacccugcacc

SEQ ID NO: 210793 - RNA, 64 nt, Homo Sapiens
cuggccucaucugcaccaugcuacccagacugccagagcccaggccaccucccugcacauggca

SEQ ID NO: 210794 - RNA, 64 nt, Homo Sapiens
ugggcacagagaaggguggagauacaucugcuggagagcccaggcucuuuggagaaaccaacca

SEQ ID NO: 210795 - RNA, 64 nt, Homo Sapiens
aagaacugcugucaugaagggaaacaguguuaccagagcccaguagccuugaagggcaaggagg

SEQ ID NO: 210796 - RNA, 64 nt, Homo Sapiens
aaaucaaaauguuaacacaaagcuaagauucaucagagcccacccuauucuaaggaaccacaau

SEQ ID NO: 210797 - RNA, 64 nt, Homo Sapiens
guaacucugguaaagcauccuguggagggagaggagagcccagucauuugcuuagaugguguuu

SEQ ID NO: 210798 - RNA, 64 nt, Homo Sapiens
uccucaguuccuguggauaguucuguaagaguccagagcccacccugucucacucucaggacua

SEQ ID NO: 210799 - RNA, 64 nt, Homo Sapiens
gggaugagaggagagagcaaagaucucucccacuagagcccagauuagccuaaacagggcacau

SEQ ID NO: 210800 - RNA, 64 nt, Homo Sapiens
aauggaggcugcaggaggcuuucaggcccagccaagagcccauggaguugaggcccuaacaaau

SEQ ID NO: 210801 - RNA, 64 nt, Homo Sapiens
cccaagccuggcaccaagccuuggcugacuuuccagagcccaguagggccuugaaguagcagcc

SEQ ID NO: 210802 - RNA, 64 nt, Homo Sapiens
aggcuagugcuaagagggaaggcccagguuugagagagcccagaggggcagagcccagagccuu

SEQ ID NO: 210803 - RNA, 64 nt, Homo Sapiens
gggaaggcccagguuugagagagcccagaggggcagagcccagagccuuguuuggcccugaucu

SEQ ID NO: 210804 - RNA, 64 nt, Homo Sapiens
ccauccccaucggcccuguccccuggagugugucagagcccaggggagaaugcagcccaccagg

SEQ ID NO: 210805 - RNA, 64 nt, Homo Sapiens
cuguugaucuacccgugccugggccccuccccucagagcccaugguaacgaaccccuagaaagg

SEQ ID NO: 210806 - RNA, 64 nt, Homo Sapiens
aagucccagaagcagucccugacccccagcuuucagagcccagccaccagcuuggggcuggaug

SEQ ID NO: 210807 - RNA, 64 nt, Homo Sapiens
uauacacagaagugauaaaggaauccaaaguugaagagcccaggaaacgggaaacuguauccau

SEQ ID NO: 210808 - RNA, 64 nt, Homo Sapiens
gcugcaaccagucuggggccauucagccagggacagagcccacagagcccauacaccugucucc

SEQ ID NO: 210809 - RNA, 64 nt, Homo Sapiens
agucuggggccauucagccagggacagagcccacagagcccauacaccugucucccaccagcgg

SEQ ID NO: 210810 - RNA, 64 nt, Homo Sapiens; identical to SEQ ID NO: 88792

SEQ ID NO: 210811 - RNA, 64 nt, Homo Sapiens; identical to SEQ ID NO: 88793

SEQ ID NO: 210812 - RNA, 64 nt, Homo Sapiens; identical to SEQ ID NO: 88794

SEQ ID NO: 210813 - RNA, 64 nt, Homo Sapiens; identical to SEQ ID NO: 88795

SEQ ID NO: 210814 - RNA, 64 nt, Homo Sapiens; identical to SEQ ID NO: 88796

SEQ ID NO: 210815 - RNA, 64 nt, Homo Sapiens; identical to SEQ ID NO: 88797

SEQ ID NO: 210816 - RNA, 64 nt, Homo Sapiens; identical to SEQ ID NO: 88798

SEQ ID NO: 210817 - RNA, 64 nt, Homo Sapiens; identical to SEQ ID NO: 88799

SEQ ID NO: 210818 - RNA, 64 nt, Homo Sapiens; identical to SEQ ID NO: 88800

SEQ ID NO: 210819 - RNA, 64 nt, Homo Sapiens; identical to SEQ ID NO: 88801

SEQ ID NO: 210820 - RNA, 64 nt, Homo Sapiens; identical to SEQ ID NO: 88802

SEQ ID NO: 210821 - RNA, 64 nt, Homo Sapiens
agcggaucgcuccgggccaccaagccgcaccugugccugagacuccggauggacgacacagucg

SEQ ID NO: 210822 - RNA, 64 nt, Homo Sapiens
gguguggagcaguggcuggggugggcgugguguggccugagagacugcccagcuggagaggccu

SEQ ID NO: 210823 - RNA, 64 nt, Homo Sapiens
cccuaguggggcugugggaauuggcaacuuccuagccugagaaucagugauguagucuugcagu

SEQ ID NO: 210824 - RNA, 64 nt, Homo Sapiens
cuguucaccaggacuccacagcagugggucgagcgccugagaucccuuggcccuucaaggucau

SEQ ID NO: 210825 - RNA, 64 nt, Homo Sapiens
uccugccaggaaguguuuauuugccucuaauugggccugagagaccauagggagguuggggcuc

SEQ ID NO: 210826 - RNA, 64 nt, Homo Sapiens
ggcuaguuaccacuaggcuaccaggucucuaggggccugagagaggcccucuagagaauccagg

SEQ ID NO: 210827 - RNA, 64 nt, Homo Sapiens
cgccggcucucuugcuccucgcuuuaccuuggaagccugagagggcggucccgcccugcccuag

SEQ ID NO: 210828 - RNA, 64 nt, Homo Sapiens
gccaucucggcucccgggcagacccacugccccugccugagaacgacagcguaucgagcauccu

SEQ ID NO: 210829 - RNA, 64 nt, Homo Sapiens
ucgcggugaccccucucucugguucccagcaccugccugagaccugccccaggcacccauaacc

SEQ ID NO: 210830 - RNA, 64 nt, Homo Sapiens
ucccaggggugagaggccucauguauccuaggcugccugagauuucugugugcugaucgcaucc

SEQ ID NO: 210831 - RNA, 64 nt, Homo Sapiens
cauggcguccugcccuugcuccagccugacaacagccugagaaauccccccguaacuuauuauc

SEQ ID NO: 210832 - RNA, 64 nt, Homo Sapiens
ugugucccccgaacgcucugcaccuucugacgcagccugagaaugaccugcccuggccccagcc

SEQ ID NO: 210833 - RNA, 64 nt, Homo Sapiens
acagaccaccagacgccagggcugauuggugggggccugagaccccgguugcccauucauggcu

SEQ ID NO: 210834 - RNA, 64 nt, Homo Sapiens
ccccaggugguuuugaggcucgcucuugcgcggugccugagaagagggugaaggagcuggggca

SEQ ID NO: 210835 - RNA, 64 nt, Homo Sapiens
ccucaccagugcugaugaugccgucaugcugcuggccugagacaguaucccagcuacaacagga

SEQ ID NO: 210836 - RNA, 64 nt, Homo Sapiens
ccugugagccccaugcuggcugugcacugcgcgggccugagacugcuggauacaauguugggca

SEQ ID NO: 210837 - RNA, 64 nt, Homo Sapiens
gcugugcccgaugugcaccuaaacuccccaaggugccugagaugacaugaagcucccagagaua

SEQ ID NO: 210838 - RNA, 64 nt, Homo Sapiens
gcugugccagagguucgacuaaacucccuaaaaugccugagaugucccgaaagucccagagaug

SEQ ID NO: 210839 - RNA, 64 nt, Homo Sapiens
aaacuuccugagaugaaacuaagcuuccaaaggugccugagaugagaugaaagucccugagaug

SEQ ID NO: 210840 - RNA, 64 nt, Homo Sapiens
aucauugaucuguuugaggaagugucugaccugggccugagagcuggagaaggugcagauucaa

SEQ ID NO: 210841 - RNA, 64 nt, Homo Sapiens
aauguccuauaaaugcaccuccugucaaaaccaugccugagaggucccggcugggagugacagg

SEQ ID NO: 210842 - RNA, 64 nt, Homo Sapiens; identical to SEQ ID NO: 125569

SEQ ID NO: 210843 - RNA, 64 nt, Homo Sapiens; identical to SEQ ID NO: 125570

SEQ ID NO: 210844 - RNA, 64 nt, Homo Sapiens; identical to SEQ ID NO: 125571

SEQ ID NO: 210845 - RNA, 64 nt, Homo Sapiens; identical to SEQ ID NO: 125572

SEQ ID NO: 210846 - RNA, 64 nt, Homo Sapiens; identical to SEQ ID NO: 125573

SEQ ID NO: 210847 - RNA, 64 nt, Homo Sapiens; identical to SEQ ID NO: 125574

SEQ ID NO: 210848 - RNA, 64 nt, Homo Sapiens; identical to SEQ ID NO: 125575

SEQ ID NO: 210849 - RNA, 64 nt, Homo Sapiens; identical to SEQ ID NO: 125576

SEQ ID NO: 210850 - RNA, 64 nt, Homo Sapiens; identical to SEQ ID NO: 125577

SEQ ID NO: 210851 - RNA, 64 nt, Homo Sapiens; identical to SEQ ID NO: 125578

SEQ ID NO: 210852 - RNA, 64 nt, Homo Sapiens; identical to SEQ ID NO: 125579

SEQ ID NO: 210853 - RNA, 64 nt, Homo Sapiens; identical to SEQ ID NO: 125580

SEQ ID NO: 210854 - RNA, 64 nt, Homo Sapiens; identical to SEQ ID NO: 125581

SEQ ID NO: 210855 - RNA, 64 nt, Homo Sapiens; identical to SEQ ID NO: 125582

SEQ ID NO: 210856 - RNA, 64 nt, Homo Sapiens; identical to SEQ ID NO: 125583

SEQ ID NO: 210857 - RNA, 64 nt, Homo Sapiens; identical to SEQ ID NO: 125584

SEQ ID NO: 210858 - RNA, 64 nt, Homo Sapiens; identical to SEQ ID NO: 125585

SEQ ID NO: 210859 - RNA, 64 nt, Homo Sapiens; identical to SEQ ID NO: 125586

SEQ ID NO: 210860 - RNA, 64 nt, Homo Sapiens; identical to SEQ ID NO: 125587

SEQ ID NO: 210861 - RNA, 64 nt, Homo Sapiens; identical to SEQ ID NO: 125588

SEQ ID NO: 210862 - RNA, 64 nt, Homo Sapiens; identical to SEQ ID NO: 125589

SEQ ID NO: 210863 - RNA, 64 nt, Homo Sapiens; identical to SEQ ID NO: 125590

SEQ ID NO: 210864 - RNA, 64 nt, Homo Sapiens; identical to SEQ ID NO: 125591

SEQ ID NO: 210865 - RNA, 64 nt, Homo Sapiens; identical to SEQ ID NO: 125592

SEQ ID NO: 210866 - RNA, 64 nt, Homo Sapiens; identical to SEQ ID NO: 125593

SEQ ID NO: 210867 - RNA, 64 nt, Homo Sapiens; identical to SEQ ID NO: 125594

SEQ ID NO: 210868 - RNA, 64 nt, Homo Sapiens; identical to SEQ ID NO: 125595

SEQ ID NO: 210869 - RNA, 64 nt, Homo Sapiens; identical to SEQ ID NO: 125596

SEQ ID NO: 210870 - RNA, 64 nt, Homo Sapiens; identical to SEQ ID NO: 125597

SEQ ID NO: 210871 - RNA, 64 nt, Homo Sapiens; identical to SEQ ID NO: 125598

SEQ ID NO: 210872 - RNA, 64 nt, Homo Sapiens; identical to SEQ ID NO: 125599

SEQ ID NO: 210873 - RNA, 64 nt, Homo Sapiens; identical to SEQ ID NO: 125600

SEQ ID NO: 210874 - RNA, 64 nt, Homo Sapiens; identical to SEQ ID NO: 125601

SEQ ID NO: 210875 - RNA, 64 nt, Homo Sapiens; identical to SEQ ID NO: 125602

SEQ ID NO: 210876 - RNA, 64 nt, Homo Sapiens; identical to SEQ ID NO: 125603

SEQ ID NO: 210877 - RNA, 64 nt, Homo Sapiens; identical to SEQ ID NO: 125604

SEQ ID NO: 210878 - RNA, 64 nt, Homo Sapiens; identical to SEQ ID NO: 125605

SEQ ID NO: 210879 - RNA, 64 nt, Homo Sapiens; identical to SEQ ID NO: 125606

SEQ ID NO: 210880 - RNA, 64 nt, Homo Sapiens; identical to SEQ ID NO: 125607

SEQ ID NO: 210881 - RNA, 64 nt, Homo Sapiens; identical to SEQ ID NO: 125608

SEQ ID NO: 210882 - RNA, 64 nt, Homo Sapiens; identical to SEQ ID NO: 125609

SEQ ID NO: 210883 - RNA, 64 nt, Homo Sapiens; identical to SEQ ID NO: 125610

SEQ ID NO: 210884 - RNA, 64 nt, Homo Sapiens; identical to SEQ ID NO: 125611

SEQ ID NO: 210885 - RNA, 64 nt, Homo Sapiens; identical to SEQ ID NO: 125612

SEQ ID NO: 210886 - RNA, 64 nt, Homo Sapiens; identical to SEQ ID NO: 125613

SEQ ID NO: 210887 - RNA, 64 nt, Homo Sapiens; identical to SEQ ID NO: 125614

SEQ ID NO: 210888 - RNA, 64 nt, Homo Sapiens; identical to SEQ ID NO: 125615

SEQ ID NO: 210889 - RNA, 64 nt, Homo Sapiens; identical to SEQ ID NO: 125616

SEQ ID NO: 210890 - RNA, 64 nt, Homo Sapiens; identical to SEQ ID NO: 125617

SEQ ID NO: 210891 - RNA, 64 nt, Homo Sapiens; identical to SEQ ID NO: 125618

SEQ ID NO: 210892 - RNA, 64 nt, Homo Sapiens; identical to SEQ ID NO: 125619

SEQ ID NO: 210893 - RNA, 64 nt, Homo Sapiens; identical to SEQ ID NO: 125620

SEQ ID NO: 210894 - RNA, 64 nt, Homo Sapiens; identical to SEQ ID NO: 125621

SEQ ID NO: 210895 - RNA, 64 nt, Homo Sapiens; identical to SEQ ID NO: 125622

SEQ ID NO: 210896 - RNA, 64 nt, Homo Sapiens; identical to SEQ ID NO: 125623

SEQ ID NO: 210897 - RNA, 64 nt, Homo Sapiens; identical to SEQ ID NO: 125624

SEQ ID NO: 210898 - RNA, 64 nt, Homo Sapiens; identical to SEQ ID NO: 125625

SEQ ID NO: 210899 - RNA, 64 nt, Homo Sapiens; identical to SEQ ID NO: 125626

SEQ ID NO: 210900 - RNA, 64 nt, Homo Sapiens; identical to SEQ ID NO: 125627

SEQ ID NO: 210901 - RNA, 64 nt, Homo Sapiens; identical to SEQ ID NO: 125628

SEQ ID NO: 210902 - RNA, 64 nt, Homo Sapiens; identical to SEQ ID NO: 125629

SEQ ID NO: 210903 - RNA, 64 nt, Homo Sapiens; identical to SEQ ID NO: 125630

SEQ ID NO: 210904 - RNA, 64 nt, Homo Sapiens; identical to SEQ ID NO: 125631

SEQ ID NO: 210905 - RNA, 64 nt, Homo Sapiens; identical to SEQ ID NO: 125632

SEQ ID NO: 210906 - RNA, 64 nt, Homo Sapiens; identical to SEQ ID NO: 125633

SEQ ID NO: 210907 - RNA, 64 nt, Homo Sapiens; identical to SEQ ID NO: 125634

SEQ ID NO: 210908 - RNA, 64 nt, Homo Sapiens; identical to SEQ ID NO: 125635

SEQ ID NO: 210909 - RNA, 64 nt, Homo Sapiens; identical to SEQ ID NO: 125636

SEQ ID NO: 210910 - RNA, 64 nt, Homo Sapiens; identical to SEQ ID NO: 125637

SEQ ID NO: 210911 - RNA, 64 nt, Homo Sapiens; identical to SEQ ID NO: 125638

SEQ ID NO: 210912 - RNA, 64 nt, Homo Sapiens; identical to SEQ ID NO: 125639

SEQ ID NO: 210913 - RNA, 64 nt, Homo Sapiens; identical to SEQ ID NO: 125640

SEQ ID NO: 210914 - RNA, 64 nt, Homo Sapiens; identical to SEQ ID NO: 125641

SEQ ID NO: 210915 - RNA, 64 nt, Homo Sapiens; identical to SEQ ID NO: 125642

SEQ ID NO: 210916 - RNA, 64 nt, Homo Sapiens; identical to SEQ ID NO: 163185

SEQ ID NO: 210917 - RNA, 64 nt, Homo Sapiens; identical to SEQ ID NO: 163186

SEQ ID NO: 210918 - RNA, 64 nt, Homo Sapiens; identical to SEQ ID NO: 163187

SEQ ID NO: 210919 - RNA, 64 nt, Homo Sapiens; identical to SEQ ID NO: 163188

SEQ ID NO: 210920 - RNA, 64 nt, Homo Sapiens; identical to SEQ ID NO: 99150

SEQ ID NO: 210921 - RNA, 64 nt, Homo Sapiens; identical to SEQ ID NO: 99151

SEQ ID NO: 210922 - RNA, 64 nt, Homo Sapiens; identical to SEQ ID NO: 99152

SEQ ID NO: 210923 - RNA, 64 nt, Homo Sapiens; identical to SEQ ID NO: 99153

SEQ ID NO: 210924 - RNA, 64 nt, Homo Sapiens; identical to SEQ ID NO: 146929

SEQ ID NO: 210925 - RNA, 64 nt, Homo Sapiens; identical to SEQ ID NO: 146930

SEQ ID NO: 210926 - RNA, 64 nt, Homo Sapiens; identical to SEQ ID NO: 146931

SEQ ID NO: 210927 - RNA, 64 nt, Homo Sapiens; identical to SEQ ID NO: 146932

SEQ ID NO: 210928 - RNA, 64 nt, Homo Sapiens; identical to SEQ ID NO: 146933

SEQ ID NO: 210929 - RNA, 64 nt, Homo Sapiens; identical to SEQ ID NO: 146934

SEQ ID NO: 210930 - RNA, 64 nt, Homo Sapiens
gcagaacaagaggcgcggggccacacccgugaaccaugcagacggccgaagaagucuuaggcag

SEQ ID NO: 210931 - RNA, 64 nt, Homo Sapiens
auggggaagucgagggccuguggcuuggauccgccaugcagagauguggccgggcacccaucuu

SEQ ID NO: 210932 - RNA, 64 nt, Homo Sapiens
uauauguugucaugcaggguuugggccaagaaagcaugcagaaaaaaaugccaugugauuguaa

SEQ ID NO: 210933 - RNA, 64 nt, Homo Sapiens
augauucucucacaggcuugggaaauccuguuagcaugcagaauaaugugguaacuuugucaau

SEQ ID NO: 210934 - RNA, 64 nt, Homo Sapiens
aggaagaaaacuuaggggcugcucaguagagggucaugcagacacaagagaccccaaauagccu

SEQ ID NO: 210935 - RNA, 64 nt, Homo Sapiens
gaguucagugcuacucugcgccagccuccaggcccaugcagaaaggccugccuagggacacugu

SEQ ID NO: 210936 - RNA, 64 nt, Homo Sapiens
gugugcacagauaugcugucuggacacgcacacacaugcagauaugcugccuggacacacacuu

SEQ ID NO: 210937 - RNA, 64 nt, Homo Sapiens
gcagauaugcuguccggauacacacgcacgcacacaugcagauaugcugccugggcacacacuu

SEQ ID NO: 210938 - RNA, 64 nt, Homo Sapiens
guaguaguagcugccaccacaucucuaggguagccaugcagaggagggcuucauauucccaaua

SEQ ID NO: 210939 - RNA, 64 nt, Homo Sapiens
ugaauccaugcaagccccauaaaacaguuccuagcaugcagaaaaugcccacguaaauagcugu

SEQ ID NO: 210940 - RNA, 64 nt, Homo Sapiens
gagggacauucugcuggcccacccugcgcgcugucaugcagaggccauucccccaggccugugu

SEQ ID NO: 210941 - RNA, 64 nt, Homo Sapiens
guguacaugcaccaaagcaugugugaccuacagacaugcagaacaugcacguguacacauacca

SEQ ID NO: 210942 - RNA, 64 nt, Homo Sapiens
cacucuugcucacaaugggcauggaucagaagaccaugcagaaguuacuguaucucuugugacc

SEQ ID NO: 210943 - RNA, 64 nt, Homo Sapiens
caccccuggagggguggaguuucuaccccugacucaugcagacaucuauuacauggaggcagua

SEQ ID NO: 210944 - RNA, 64 nt, Homo Sapiens
gagaagacucuccgccccacgccaaucccaaaggcaugcagauggcugugcauguuggcuucuu

SEQ ID NO: 210945 - RNA, 64 nt, Homo Sapiens
cuucaaaacuagaaggaucuacuccgcaugggugcaugcagaggcuccuggaucugggaagccc

SEQ ID NO: 210946 - RNA, 64 nt, Homo Sapiens
caaaacuggguucuggcucuuucacauuuccuggcaugcagaccguggccacauuuggaggaag

SEQ ID NO: 210947 - RNA, 64 nt, Homo Sapiens
guaucuuuuuuuaaauuucuaugccccuucagaacaugcagaguaaccacuaacuagguagugu

SEQ ID NO: 210948 - RNA, 64 nt, Homo Sapiens
cgcuggugcugggucucugguuugcugcagagccguaggacacuccuggcuccucaguaggaca

SEQ ID NO: 210949 - RNA, 64 nt, Homo Sapiens
ugcugcagagccguaggacacuccuggcuccucaguaggacagacagacgcaggcggguuuauu

SEQ ID NO: 210950 - RNA, 64 nt, Homo Sapiens
gaacggcaaucuacaaaacuccaaguuucaugugguaggacagacagagaacagaaggccgaau

SEQ ID NO: 210951 - RNA, 64 nt, Homo Sapiens
gaacagaaggccgaauccaaccaaguuucauguaguaggacagaagcuuuagugaaggcugaau

SEQ ID NO: 210952 - RNA, 64 nt, Homo Sapiens
gaaaauuguucuaagcaaagcuuuucuccagguaguaggacaaucuuagcuuuuuugacaaacu

SEQ ID NO: 210953 - RNA, 64 nt, Homo Sapiens
agcugugagcaaucugcaguugugaaguuacacuguaggacacaguuccuucuucccucccucc

SEQ ID NO: 210954 - RNA, 64 nt, Homo Sapiens
aggacuccgucccuguccccgacugugccacgugguaggacacauaggacacaggaauuccugg

SEQ ID NO: 210955 - RNA, 64 nt, Homo Sapiens
auuccuggguccuugcccaugacugugccaugugguaggacacaggacacaggaauuccuggaa

SEQ ID NO: 210956 - RNA, 64 nt, Homo Sapiens
ccaagcugcuugagcccacucacaagcuguggagagggccaaaaugggacauaagccuuugccc

SEQ ID NO: 210957 - RNA, 64 nt, Homo Sapiens
guccagagaagugauaacuugagcagagaacuacagggccaaggaggccccugagagcuggaca

SEQ ID NO: 210958 - RNA, 64 nt, Homo Sapiens
acaaagguuccagugagcgccagccgcgcugccgagggccaagcgcacaccucacacgggacca

SEQ ID NO: 210959 - RNA, 64 nt, Homo Sapiens
cacccccgccucacacacgcccuggcccuacuccagggccaauggccuggugcuggugaugggc

SEQ ID NO: 210960 - RNA, 64 nt, Homo Sapiens
guacuagaucuauguaaguuaaauuuuaagaggacucaccaaaacagauugguaaugccagaaa

SEQ ID NO: 210961 - RNA, 64 nt, Homo Sapiens
caaaucaucaguccucauauacuuccauaacuaacucaccaaauaaauaagagaugccagaacu

SEQ ID NO: 210962 - RNA, 64 nt, Homo Sapiens
gaaucaaguaugucccugaguagcaagauuaggccucaccaaagaagaaauuaaccugcacuuu

SEQ ID NO: 210963 - RNA, 64 nt, Homo Sapiens
aucucaucccuuuguagaaauucuugccugaauucucaccaaguuuugaauuccuaagguagcc

SEQ ID NO: 210964 - RNA, 64 nt, Homo Sapiens
ugagaagaagcagauccccuguguggucuccaugcucaccaaggaacucuacuucagucaauag

SEQ ID NO: 210965 - RNA, 64 nt, Homo Sapiens
agcaccuuacugcccaggccuaucuggaagccaccucaccaaggaccuuggaagagcaagggac

SEQ ID NO: 210966 - RNA, 64 nt, Homo Sapiens
uaccaaaaaguaaggcuuagauguacuaaauacauagcccuaugccucaaaugggcauagcccu

SEQ ID NO: 210967 - RNA, 64 nt, Homo Sapiens
uacuaaauacauagcccuaucccucaaaugggcauagcccuauguauacagcuucauucuguug

SEQ ID NO: 210968 - RNA, 64 nt, Homo Sapiens
uggguugaauacacuuuuaacagcccuagaucgauagcccuagcccuagauagauagcccuagc

SEQ ID NO: 210969 - RNA, 64 nt, Homo Sapiens
gaauacacuuuuaacagcccuagaucgauagcccuagcccuagauagauagcccuagcccuaga

SEQ ID NO: 210970 - RNA, 64 nt, Homo Sapiens
cagcccuagaucgauagcccuagcccuagauagauagcccuagcccuagauagauagcuauuag

SEQ ID NO: 210971 - RNA, 64 nt, Homo Sapiens
uagaucgauagcccuagcccuagauagauagcccuagcccuagauagauagcuauuagguuggu

SEQ ID NO: 210972 - RNA, 64 nt, Homo Sapiens
uguguuugguuucagacaaaacaauguuauuuauuagcccuaaucagacugguaucaauauuag

SEQ ID NO: 210973 - RNA, 64 nt, Homo Sapiens
uguguuugauuucagacaaauguaaguuauuuauuagcccuaauauauguuacaguaccccacc

SEQ ID NO: 210974 - RNA, 64 nt, Homo Sapiens; identical to SEQ ID NO: 80686

SEQ ID NO: 210975 - RNA, 64 nt, Homo Sapiens; identical to SEQ ID NO: 80687

SEQ ID NO: 210976 - RNA, 64 nt, Homo Sapiens; identical to SEQ ID NO: 80688

SEQ ID NO: 210977 - RNA, 64 nt, Homo Sapiens; identical to SEQ ID NO: 80689

SEQ ID NO: 210978 - RNA, 64 nt, Homo Sapiens; identical to SEQ ID NO: 80690

SEQ ID NO: 210979 - RNA, 64 nt, Homo Sapiens; identical to SEQ ID NO: 80691

SEQ ID NO: 210980 - RNA, 64 nt, Homo Sapiens; identical to SEQ ID NO: 80692

SEQ ID NO: 210981 - RNA, 64 nt, Homo Sapiens; identical to SEQ ID NO: 80693

SEQ ID NO: 210982 - RNA, 64 nt, Homo Sapiens; identical to SEQ ID NO: 80694

SEQ ID NO: 210983 - RNA, 50 nt, Homo Sapiens; identical to SEQ ID NO: 80695

SEQ ID NO: 210984 - RNA, 64 nt, Homo Sapiens; identical to SEQ ID NO: 80696

SEQ ID NO: 210985 - RNA, 64 nt, Homo Sapiens; identical to SEQ ID NO: 80697

SEQ ID NO: 210986 - RNA, 64 nt, Homo Sapiens; identical to SEQ ID NO: 80698

SEQ ID NO: 210987 - RNA, 64 nt, Homo Sapiens; identical to SEQ ID NO: 80699

SEQ ID NO: 210988 - RNA, 64 nt, Homo Sapiens; identical to SEQ ID NO: 80700

SEQ ID NO: 210989 - RNA, 64 nt, Homo Sapiens; identical to SEQ ID NO: 80701

SEQ ID NO: 210990 - RNA, 64 nt, Homo Sapiens; identical to SEQ ID NO: 80702

SEQ ID NO: 210991 - RNA, 64 nt, Homo Sapiens; identical to SEQ ID NO: 80703

SEQ ID NO: 210992 - RNA, 64 nt, Homo Sapiens; identical to SEQ ID NO: 80704

SEQ ID NO: 210993 - RNA, 64 nt, Homo Sapiens; identical to SEQ ID NO: 80705

SEQ ID NO: 210994 - RNA, 64 nt, Homo Sapiens; identical to SEQ ID NO: 80706

SEQ ID NO: 210995 - RNA, 64 nt, Homo Sapiens; identical to SEQ ID NO: 80707

SEQ ID NO: 210996 - RNA, 64 nt, Homo Sapiens; identical to SEQ ID NO: 80708

SEQ ID NO: 210997 - RNA, 64 nt, Homo Sapiens; identical to SEQ ID NO: 80709

SEQ ID NO: 210998 - RNA, 64 nt, Homo Sapiens; identical to SEQ ID NO: 80710

SEQ ID NO: 210999 - RNA, 64 nt, Homo Sapiens; identical to SEQ ID NO: 80711

SEQ ID NO: 211000 - RNA, 64 nt, Homo Sapiens; identical to SEQ ID NO: 80712

SEQ ID NO: 211001 - RNA, 64 nt, Homo Sapiens; identical to SEQ ID NO: 80713

SEQ ID NO: 211002 - RNA, 64 nt, Homo Sapiens; identical to SEQ ID NO: 80714

SEQ ID NO: 211003 - RNA, 64 nt, Homo Sapiens; identical to SEQ ID NO: 80715

SEQ ID NO: 211004 - RNA, 53 nt, Homo Sapiens; identical to SEQ ID NO: 80716

SEQ ID NO: 211005 - RNA, 64 nt, Homo Sapiens; identical to SEQ ID NO: 80717

SEQ ID NO: 211006 - RNA, 64 nt, Homo Sapiens; identical to SEQ ID NO: 80718

SEQ ID NO: 211007 - RNA, 64 nt, Homo Sapiens; identical to SEQ ID NO: 80719

SEQ ID NO: 211008 - RNA, 64 nt, Homo Sapiens; identical to SEQ ID NO: 80720

SEQ ID NO: 211009 - RNA, 64 nt, Homo Sapiens; identical to SEQ ID NO: 80721

SEQ ID NO: 211010 - RNA, 64 nt, Homo Sapiens; identical to SEQ ID NO: 80722

SEQ ID NO: 211011 - RNA, 64 nt, Homo Sapiens; identical to SEQ ID NO: 80723

SEQ ID NO: 211012 - RNA, 64 nt, Homo Sapiens; identical to SEQ ID NO: 80724

SEQ ID NO: 211013 - RNA, 64 nt, Homo Sapiens; identical to SEQ ID NO: 80725

SEQ ID NO: 211014 - RNA, 64 nt, Homo Sapiens; identical to SEQ ID NO: 80726

SEQ ID NO: 211015 - RNA, 52 nt, Homo Sapiens; identical to SEQ ID NO: 80727

SEQ ID NO: 211016 - RNA, 64 nt, Homo Sapiens; identical to SEQ ID NO: 80728

SEQ ID NO: 211017 - RNA, 64 nt, Homo Sapiens; identical to SEQ ID NO: 80729

SEQ ID NO: 211018 - RNA, 64 nt, Homo Sapiens; identical to SEQ ID NO: 80730

SEQ ID NO: 211019 - RNA, 64 nt, Homo Sapiens; identical to SEQ ID NO: 80731

SEQ ID NO: 211020 - RNA, 64 nt, Homo Sapiens; identical to SEQ ID NO: 80732

SEQ ID NO: 211021 - RNA, 64 nt, Homo Sapiens; identical to SEQ ID NO: 80733

SEQ ID NO: 211022 - RNA, 64 nt, Homo Sapiens; identical to SEQ ID NO: 80734

SEQ ID NO: 211023 - RNA, 64 nt, Homo Sapiens; identical to SEQ ID NO: 80735

SEQ ID NO: 211024 - RNA, 64 nt, Homo Sapiens; identical to SEQ ID NO: 80736

SEQ ID NO: 211025 - RNA, 64 nt, Homo Sapiens; identical to SEQ ID NO: 80737

SEQ ID NO: 211026 - RNA, 64 nt, Homo Sapiens; identical to SEQ ID NO: 80738

SEQ ID NO: 211027 - RNA, 64 nt, Homo Sapiens; identical to SEQ ID NO: 80739

SEQ ID NO: 211028 - RNA, 64 nt, Homo Sapiens; identical to SEQ ID NO: 80740

SEQ ID NO: 211029 - RNA, 64 nt, Homo Sapiens; identical to SEQ ID NO: 80741

SEQ ID NO: 211030 - RNA, 64 nt, Homo Sapiens; identical to SEQ ID NO: 80742

SEQ ID NO: 211031 - RNA, 64 nt, Homo Sapiens; identical to SEQ ID NO: 80743

SEQ ID NO: 211032 - RNA, 64 nt, Homo Sapiens; identical to SEQ ID NO: 80744

SEQ ID NO: 211033 - RNA, 64 nt, Homo Sapiens; identical to SEQ ID NO: 80745

SEQ ID NO: 211034 - RNA, 64 nt, Homo Sapiens; identical to SEQ ID NO: 80746

SEQ ID NO: 211035 - RNA, 64 nt, Homo Sapiens; identical to SEQ ID NO: 80747

SEQ ID NO: 211036 - RNA, 64 nt, Homo Sapiens; identical to SEQ ID NO: 80748

SEQ ID NO: 211037 - RNA, 64 nt, Homo Sapiens; identical to SEQ ID NO: 80749

SEQ ID NO: 211038 - RNA, 64 nt, Homo Sapiens; identical to SEQ ID NO: 80750

SEQ ID NO: 211039 - RNA, 64 nt, Homo Sapiens; identical to SEQ ID NO: 80751

SEQ ID NO: 211040 - RNA, 64 nt, Homo Sapiens; identical to SEQ ID NO: 80752

SEQ ID NO: 211041 - RNA, 64 nt, Homo Sapiens; identical to SEQ ID NO: 80753

SEQ ID NO: 211042 - RNA, 64 nt, Homo Sapiens; identical to SEQ ID NO: 80754

SEQ ID NO: 211043 - RNA, 64 nt, Homo Sapiens; identical to SEQ ID NO: 80755

SEQ ID NO: 211044 - RNA, 64 nt, Homo Sapiens; identical to SEQ ID NO: 80756

SEQ ID NO: 211045 - RNA, 64 nt, Homo Sapiens; identical to SEQ ID NO: 80757

SEQ ID NO: 211046 - RNA, 64 nt, Homo Sapiens; identical to SEQ ID NO: 80758

SEQ ID NO: 211047 - RNA, 64 nt, Homo Sapiens; identical to SEQ ID NO: 80759

SEQ ID NO: 211048 - RNA, 64 nt, Homo Sapiens; identical to SEQ ID NO: 80760

SEQ ID NO: 211049 - RNA, 64 nt, Homo Sapiens; identical to SEQ ID NO: 80761

SEQ ID NO: 211050 - RNA, 64 nt, Homo Sapiens; identical to SEQ ID NO: 80762

SEQ ID NO: 211051 - RNA, 64 nt, Homo Sapiens; identical to SEQ ID NO: 80763

SEQ ID NO: 211052 - RNA, 64 nt, Homo Sapiens; identical to SEQ ID NO: 80764

SEQ ID NO: 211053 - RNA, 64 nt, Homo Sapiens; identical to SEQ ID NO: 80765

SEQ ID NO: 211054 - RNA, 64 nt, Homo Sapiens; identical to SEQ ID NO: 80766

SEQ ID NO: 211055 - RNA, 64 nt, Homo Sapiens; identical to SEQ ID NO: 80767

SEQ ID NO: 211056 - RNA, 64 nt, Homo Sapiens; identical to SEQ ID NO: 80768

SEQ ID NO: 211057 - RNA, 64 nt, Homo Sapiens; identical to SEQ ID NO: 80769

SEQ ID NO: 211058 - RNA, 64 nt, Homo Sapiens; identical to SEQ ID NO: 80770

SEQ ID NO: 211059 - RNA, 64 nt, Homo Sapiens; identical to SEQ ID NO: 80771

SEQ ID NO: 211060 - RNA, 64 nt, Homo Sapiens; identical to SEQ ID NO: 80772

SEQ ID NO: 211061 - RNA, 64 nt, Homo Sapiens; identical to SEQ ID NO: 80773

SEQ ID NO: 211062 - RNA, 64 nt, Homo Sapiens; identical to SEQ ID NO: 80774

SEQ ID NO: 211063 - RNA, 59 nt, Homo Sapiens; identical to SEQ ID NO: 80775

SEQ ID NO: 211064 - RNA, 64 nt, Homo Sapiens; identical to SEQ ID NO: 80776

SEQ ID NO: 211065 - RNA, 64 nt, Homo Sapiens; identical to SEQ ID NO: 80777

SEQ ID NO: 211066 - RNA, 64 nt, Homo Sapiens; identical to SEQ ID NO: 80778

SEQ ID NO: 211067 - RNA, 64 nt, Homo Sapiens; identical to SEQ ID NO: 80779

SEQ ID NO: 211068 - RNA, 64 nt, Homo Sapiens; identical to SEQ ID NO: 80780

SEQ ID NO: 211069 - RNA, 64 nt, Homo Sapiens; identical to SEQ ID NO: 80781

SEQ ID NO: 211070 - RNA, 64 nt, Homo Sapiens; identical to SEQ ID NO: 80782

SEQ ID NO: 211071 - RNA, 64 nt, Homo Sapiens; identical to SEQ ID NO: 80783

SEQ ID NO: 211072 - RNA, 64 nt, Homo Sapiens; identical to SEQ ID NO: 80784

SEQ ID NO: 211073 - RNA, 64 nt, Homo Sapiens; identical to SEQ ID NO: 80785

SEQ ID NO: 211074 - RNA, 64 nt, Homo Sapiens; identical to SEQ ID NO: 80786

SEQ ID NO: 211075 - RNA, 64 nt, Homo Sapiens; identical to SEQ ID NO: 80787

SEQ ID NO: 211076 - RNA, 64 nt, Homo Sapiens; identical to SEQ ID NO: 80788

SEQ ID NO: 211077 - RNA, 64 nt, Homo Sapiens; identical to SEQ ID NO: 80789

SEQ ID NO: 211078 - RNA, 64 nt, Homo Sapiens; identical to SEQ ID NO: 80790

SEQ ID NO: 211079 - RNA, 64 nt, Homo Sapiens; identical to SEQ ID NO: 80791

SEQ ID NO: 211080 - RNA, 64 nt, Homo Sapiens; identical to SEQ ID NO: 80792

SEQ ID NO: 211081 - RNA, 64 nt, Homo Sapiens; identical to SEQ ID NO: 80793

SEQ ID NO: 211082 - RNA, 64 nt, Homo Sapiens; identical to SEQ ID NO: 80794

SEQ ID NO: 211083 - RNA, 64 nt, Homo Sapiens; identical to SEQ ID NO: 80795

SEQ ID NO: 211084 - RNA, 64 nt, Homo Sapiens; identical to SEQ ID NO: 80796

SEQ ID NO: 211085 - RNA, 64 nt, Homo Sapiens; identical to SEQ ID NO: 80797

SEQ ID NO: 211086 - RNA, 64 nt, Homo Sapiens; identical to SEQ ID NO: 80798

SEQ ID NO: 211087 - RNA, 64 nt, Homo Sapiens; identical to SEQ ID NO: 80799

SEQ ID NO: 211088 - RNA, 64 nt, Homo Sapiens; identical to SEQ ID NO: 80800

SEQ ID NO: 211089 - RNA, 64 nt, Homo Sapiens; identical to SEQ ID NO: 80801

SEQ ID NO: 211090 - RNA, 64 nt, Homo Sapiens; identical to SEQ ID NO: 80802

SEQ ID NO: 211091 - RNA, 64 nt, Homo Sapiens; identical to SEQ ID NO: 80803

SEQ ID NO: 211092 - RNA, 64 nt, Homo Sapiens; identical to SEQ ID NO: 80804

SEQ ID NO: 211093 - RNA, 64 nt, Homo Sapiens; identical to SEQ ID NO: 80805

SEQ ID NO: 211094 - RNA, 64 nt, Homo Sapiens; identical to SEQ ID NO: 80806

SEQ ID NO: 211095 - RNA, 64 nt, Homo Sapiens; identical to SEQ ID NO: 80807

SEQ ID NO: 211096 - RNA, 64 nt, Homo Sapiens; identical to SEQ ID NO: 80808

SEQ ID NO: 211097 - RNA, 64 nt, Homo Sapiens; identical to SEQ ID NO: 80809

SEQ ID NO: 211098 - RNA, 64 nt, Homo Sapiens; identical to SEQ ID NO: 80810

SEQ ID NO: 211099 - RNA, 64 nt, Homo Sapiens; identical to SEQ ID NO: 80811

SEQ ID NO: 211100 - RNA, 64 nt, Homo Sapiens; identical to SEQ ID NO: 80812

SEQ ID NO: 211101 - RNA, 64 nt, Homo Sapiens; identical to SEQ ID NO: 80813

SEQ ID NO: 211102 - RNA, 64 nt, Homo Sapiens; identical to SEQ ID NO: 80814

SEQ ID NO: 211103 - RNA, 64 nt, Homo Sapiens; identical to SEQ ID NO: 80815

SEQ ID NO: 211104 - RNA, 64 nt, Homo Sapiens; identical to SEQ ID NO: 80816

SEQ ID NO: 211105 - RNA, 64 nt, Homo Sapiens; identical to SEQ ID NO: 80817

SEQ ID NO: 211106 - RNA, 64 nt, Homo Sapiens; identical to SEQ ID NO: 80818

SEQ ID NO: 211107 - RNA, 64 nt, Homo Sapiens; identical to SEQ ID NO: 80819

SEQ ID NO: 211108 - RNA, 64 nt, Homo Sapiens; identical to SEQ ID NO: 80820

SEQ ID NO: 211109 - RNA, 64 nt, Homo Sapiens; identical to SEQ ID NO: 80821

SEQ ID NO: 211110 - RNA, 64 nt, Homo Sapiens; identical to SEQ ID NO: 80822

SEQ ID NO: 211111 - RNA, 64 nt, Homo Sapiens; identical to SEQ ID NO: 80823

SEQ ID NO: 211112 - RNA, 64 nt, Homo Sapiens; identical to SEQ ID NO: 80824

SEQ ID NO: 211113 - RNA, 64 nt, Homo Sapiens; identical to SEQ ID NO: 80825

SEQ ID NO: 211114 - RNA, 64 nt, Homo Sapiens; identical to SEQ ID NO: 80826

SEQ ID NO: 211115 - RNA, 64 nt, Homo Sapiens; identical to SEQ ID NO: 80827

SEQ ID NO: 211116 - RNA, 64 nt, Homo Sapiens; identical to SEQ ID NO: 80828

SEQ ID NO: 211117 - RNA, 64 nt, Homo Sapiens; identical to SEQ ID NO: 80829

SEQ ID NO: 211118 - RNA, 64 nt, Homo Sapiens; identical to SEQ ID NO: 80830

SEQ ID NO: 211119 - RNA, 64 nt, Homo Sapiens; identical to SEQ ID NO: 80831

SEQ ID NO: 211120 - RNA, 64 nt, Homo Sapiens; identical to SEQ ID NO: 80832

SEQ ID NO: 211121 - RNA, 64 nt, Homo Sapiens; identical to SEQ ID NO: 80833

SEQ ID NO: 211122 - RNA, 64 nt, Homo Sapiens; identical to SEQ ID NO: 80834

SEQ ID NO: 211123 - RNA, 64 nt, Homo Sapiens; identical to SEQ ID NO: 80835

SEQ ID NO: 211124 - RNA, 64 nt, Homo Sapiens; identical to SEQ ID NO: 80836

SEQ ID NO: 211125 - RNA, 64 nt, Homo Sapiens; identical to SEQ ID NO: 80837

SEQ ID NO: 211126 - RNA, 64 nt, Homo Sapiens; identical to SEQ ID NO: 80838

SEQ ID NO: 211127 - RNA, 64 nt, Homo Sapiens; identical to SEQ ID NO: 80839

SEQ ID NO: 211128 - RNA, 64 nt, Homo Sapiens; identical to SEQ ID NO: 80839

SEQ ID NO: 211129 - RNA, 64 nt, Homo Sapiens; identical to SEQ ID NO: 80841

SEQ ID NO: 211130 - RNA, 64 nt, Homo Sapiens; identical to SEQ ID NO: 80842

SEQ ID NO: 211131 - RNA, 64 nt, Homo Sapiens; identical to SEQ ID NO: 80843

SEQ ID NO: 211132 - RNA, 64 nt, Homo Sapiens; identical to SEQ ID NO: 80844

SEQ ID NO: 211133 - RNA, 64 nt, Homo Sapiens; identical to SEQ ID NO: 80845

SEQ ID NO: 211134 - RNA, 64 nt, Homo Sapiens; identical to SEQ ID NO: 80846

SEQ ID NO: 211135 - RNA, 64 nt, Homo Sapiens; identical to SEQ ID NO: 80847

SEQ ID NO: 211136 - RNA, 64 nt, Homo Sapiens; identical to SEQ ID NO: 80848

SEQ ID NO: 211137 - RNA, 64 nt, Homo Sapiens; identical to SEQ ID NO: 80849

SEQ ID NO: 211138 - RNA, 64 nt, Homo Sapiens; identical to SEQ ID NO: 80850

SEQ ID NO: 211139 - RNA, 64 nt, Homo Sapiens; identical to SEQ ID NO: 80851

SEQ ID NO: 211140 - RNA, 64 nt, Homo Sapiens; identical to SEQ ID NO: 80852

SEQ ID NO: 211141 - RNA, 64 nt, Homo Sapiens; identical to SEQ ID NO: 80853

SEQ ID NO: 211142 - RNA, 64 nt, Homo Sapiens; identical to SEQ ID NO: 80854

SEQ ID NO: 211143 - RNA, 64 nt, Homo Sapiens; identical to SEQ ID NO: 80855

SEQ ID NO: 211144 - RNA, 64 nt, Homo Sapiens; identical to SEQ ID NO: 80856

SEQ ID NO: 211145 - RNA, 64 nt, Homo Sapiens
caccagcccgcugagugugcacgaaauguucgcagugcaacaaaaagaaaaauccaucaggaac

SEQ ID NO: 211146 - RNA, 64 nt, Homo Sapiens
gcuguaugcuaguaauuguuuuuauuccuaaugugugcaacaucacaucuccccaagaagcaac

SEQ ID NO: 211147 - RNA, 64 nt, Homo Sapiens
augaaacaucaucucuacauuuugagaccagccugugcaacaucggaucacuugagcacaggag

SEQ ID NO: 211148 - RNA, 64 nt, Homo Sapiens
accauuaauaaaagaaaggaguaaauugcacauugugcaacagauuugucuagcuucuaaugug

SEQ ID NO: 211149 - RNA, 64 nt, Homo Sapiens
aucaauuuuuugcuaaacgagaauaauucuuccagugcaacaaauuuuuaaaagagauguagca

SEQ ID NO: 211150 - RNA, 64 nt, Homo Sapiens
agcaaaaugaugcuuuccgcugugugucuguugagugcaacaagguaaaaacaaaaagacagug

SEQ ID NO: 211151 - RNA, 64 nt, Homo Sapiens
ccugcggaggagguguggucaccaggaggcggcagugcaacaaccccagguaccgcagggaggg

SEQ ID NO: 211152 - RNA, 64 nt, Homo Sapiens
gugcauguguuggugcugaccuccaggccgagaugugcaacacucagguaggccugcuuccugg

SEQ ID NO: 211153 - RNA, 64 nt, Homo Sapiens; identical to SEQ ID NO: 128948

SEQ ID NO: 211154 - RNA, 64 nt, Homo Sapiens; identical to SEQ ID NO: 128949

SEQ ID NO: 211155 - RNA, 64 nt, Homo Sapiens; identical to SEQ ID NO: 128950

SEQ ID NO: 211156 - RNA, 64 nt, Homo Sapiens; identical to SEQ ID NO: 128951

SEQ ID NO: 211157 - RNA, 64 nt, Homo Sapiens; identical to SEQ ID NO: 128952

SEQ ID NO: 211158 - RNA, 64 nt, Homo Sapiens; identical to SEQ ID NO: 128953

SEQ ID NO: 211159 - RNA, 64 nt, Homo Sapiens; identical to SEQ ID NO: 128954

SEQ ID NO: 211160 - RNA, 64 nt, Homo Sapiens; identical to SEQ ID NO: 128955

SEQ ID NO: 211161 - RNA, 64 nt, Homo Sapiens; identical to SEQ ID NO: 128956

SEQ ID NO: 211162 - RNA, 64 nt, Homo Sapiens; identical to SEQ ID NO: 128957

SEQ ID NO: 211163 - RNA, 64 nt, Homo Sapiens; identical to SEQ ID NO: 128958

SEQ ID NO: 211164 - RNA, 64 nt, Homo Sapiens; identical to SEQ ID NO: 128959

SEQ ID NO: 211165 - RNA, 64 nt, Homo Sapiens; identical to SEQ ID NO: 128960

SEQ ID NO: 211166 - RNA, 64 nt, Homo Sapiens; identical to SEQ ID NO: 128961

SEQ ID NO: 211167 - RNA, 64 nt, Homo Sapiens; identical to SEQ ID NO: 128962

SEQ ID NO: 211168 - RNA, 64 nt, Homo Sapiens; identical to SEQ ID NO: 128963

SEQ ID NO: 211169 - RNA, 64 nt, Homo Sapiens; identical to SEQ ID NO: 128964

SEQ ID NO: 211170 - RNA, 64 nt, Homo Sapiens; identical to SEQ ID NO: 128965

SEQ ID NO: 211171 - RNA, 64 nt, Homo Sapiens; identical to SEQ ID NO: 128966

SEQ ID NO: 211172 - RNA, 64 nt, Homo Sapiens; identical to SEQ ID NO: 128967

SEQ ID NO: 211173 - RNA, 64 nt, Homo Sapiens; identical to SEQ ID NO: 128968

SEQ ID NO: 211174 - RNA, 64 nt, Homo Sapiens; identical to SEQ ID NO: 128969

SEQ ID NO: 211175 - RNA, 64 nt, Homo Sapiens; identical to SEQ ID NO: 128970

SEQ ID NO: 211176 - RNA, 64 nt, Homo Sapiens; identical to SEQ ID NO: 128971

SEQ ID NO: 211177 - RNA, 64 nt, Homo Sapiens; identical to SEQ ID NO: 128972

SEQ ID NO: 211178 - RNA, 64 nt, Homo Sapiens; identical to SEQ ID NO: 128973

SEQ ID NO: 211179 - RNA, 64 nt, Homo Sapiens; identical to SEQ ID NO: 128974

SEQ ID NO: 211180 - RNA, 64 nt, Homo Sapiens; identical to SEQ ID NO: 128975

SEQ ID NO: 211181 - RNA, 64 nt, Homo Sapiens; identical to SEQ ID NO: 128976

SEQ ID NO: 211182 - RNA, 64 nt, Homo Sapiens; identical to SEQ ID NO: 128977

SEQ ID NO: 211183 - RNA, 64 nt, Homo Sapiens; identical to SEQ ID NO: 128978

SEQ ID NO: 211184 - RNA, 64 nt, Homo Sapiens; identical to SEQ ID NO: 128979

SEQ ID NO: 211185 - RNA, 64 nt, Homo Sapiens; identical to SEQ ID NO: 128980

SEQ ID NO: 211186 - RNA, 64 nt, Homo Sapiens; identical to SEQ ID NO: 128981

SEQ ID NO: 211187 - RNA, 64 nt, Homo Sapiens; identical to SEQ ID NO: 128982

SEQ ID NO: 211188 - RNA, 64 nt, Homo Sapiens; identical to SEQ ID NO: 128983

SEQ ID NO: 211189 - RNA, 64 nt, Homo Sapiens; identical to SEQ ID NO: 128984

SEQ ID NO: 211190 - RNA, 64 nt, Homo Sapiens; identical to SEQ ID NO: 128985

SEQ ID NO: 211191 - RNA, 64 nt, Homo Sapiens; identical to SEQ ID NO: 128986

SEQ ID NO: 211192 - RNA, 64 nt, Homo Sapiens; identical to SEQ ID NO: 128987

SEQ ID NO: 211193 - RNA, 64 nt, Homo Sapiens; identical to SEQ ID NO: 128988

SEQ ID NO: 211194 - RNA, 64 nt, Homo Sapiens; identical to SEQ ID NO: 128989

SEQ ID NO: 211195 - RNA, 64 nt, Homo Sapiens; identical to SEQ ID NO: 128990

SEQ ID NO: 211196 - RNA, 64 nt, Homo Sapiens; identical to SEQ ID NO: 128991

SEQ ID NO: 211197 - RNA, 64 nt, Homo Sapiens; identical to SEQ ID NO: 128992

SEQ ID NO: 211198 - RNA, 64 nt, Homo Sapiens; identical to SEQ ID NO: 128993

SEQ ID NO: 211199 - RNA, 64 nt, Homo Sapiens; identical to SEQ ID NO: 128994

SEQ ID NO: 211200 - RNA, 56 nt, Homo Sapiens; identical to SEQ ID NO: 128995

SEQ ID NO: 211201 - RNA, 64 nt, Homo Sapiens
caauacaauuaaggaaugggcuuugcuaacccuucugagguaacuagacugcagcuaaccacca

SEQ ID NO: 211202 - RNA, 64 nt, Homo Sapiens
agggcugugauuuguaauuuaaacuaauuguauucugagguaaccacaaaauaaauucaaccaa

SEQ ID NO: 211203 - RNA, 64 nt, Homo Sapiens
gcagacaggucauguacuaauccuaguccuuuuccugagguagauuuuaaacaguauuuuuaaa

SEQ ID NO: 211204 - RNA, 64 nt, Homo Sapiens
guaugcuacaguuuuucacauggaauuccguuuucugagguacagcacauuuuagguaacagua

SEQ ID NO: 211205 - RNA, 64 nt, Homo Sapiens
uuucccuuuuuugccccauaagggcuagcauaagcugagguagaacuuaucuuuaagcugcagc

SEQ ID NO: 211206 - RNA, 64 nt, Homo Sapiens
gcucacacaugcuggcugaagcguaagcagacaacugagguacucuuuugaaggaugaaggugg

SEQ ID NO: 211207 - RNA, 64 nt, Homo Sapiens
aaagacagcagcaucaagaggaagaagcaggaaaagcaagaagagagcagagcaugcagugaug

SEQ ID NO: 211208 - RNA, 64 nt, Homo Sapiens
agaaaaggcgacaucaagaaagaacaucagaaaaagcaagaagagcacccagaacaugcugagc

SEQ ID NO: 211209 - RNA, 64 nt, Homo Sapiens
guuucuucucuccccuccuucuuuugcuuccagaagcaagaaaaauucucuaauuccaauaugu

SEQ ID NO: 211210 - RNA, 64 nt, Homo Sapiens
gagagugacuugauuugcuuaaaaaguauaaauuagcaagaaagaaaaaaaucauugccauaag

SEQ ID NO: 211211 - RNA, 64 nt, Homo Sapiens
ucuuguucuagauuuuuuguuauuacccauaacuagcaagaaguuucaccuuacucuguauuua

SEQ ID NO: 211212 - RNA, 64 nt, Homo Sapiens
uauauuuagauuagaaaugggugucauuuuaauaagcaagaagauguuuagaggcuuuguaugu

SEQ ID NO: 211213 - RNA, 64 nt, Homo Sapiens
agcaucgaaauuugagauacccaggacccuuucaagcaagaauggccaaaaagccuugugcugu

SEQ ID NO: 211214 - RNA, 64 nt, Homo Sapiens
acaccacaggaaacccacauuuuuagauggaaagagcaagaaaauugugucagugcucuuaguu

SEQ ID NO: 211215 - RNA, 64 nt, Homo Sapiens
uaaacauaagccagaaauuaaaaugacuauagacagcaagaauugagcuaauaauauguuuuaa

SEQ ID NO: 211216 - RNA, 64 nt, Homo Sapiens
auugagcuaauaauauguuuuaacucuuaacaccagcaagaagucagucauuuauugaaguuuu

SEQ ID NO: 211217 - RNA, 64 nt, Homo Sapiens
cuccuaaaauucuagccauuugucacacaaccacagcaagaaacguguucuauaucuagagugu

SEQ ID NO: 211218 - RNA, 64 nt, Homo Sapiens
cauuacuucacuauaauuacaaggacaaauuauuagcaagaaauaagaauaguauuagaagaau

SEQ ID NO: 211219 - RNA, 64 nt, Homo Sapiens
gcucugcaagaaaaauaucuugcauugcaccaugagcaagaacuauacuacauggacagaguac

SEQ ID NO: 211220 - RNA, 64 nt, Homo Sapiens
cuauuuggaucagaacuacaaucuuuuuaaagcuagcaagaacuccuguguauaaucucuugag

SEQ ID NO: 211221 - RNA, 64 nt, Homo Sapiens
agaccucccccucacuuacauaaagcucccuugaagcaagaaagagggucccagggcugcaaaa

SEQ ID NO: 211222 - RNA, 64 nt, Homo Sapiens
gaguuugggagaguggugaguggaagggaggagcagcaagaagcagccuguuuucacucagcuu

SEQ ID NO: 211223 - RNA, 64 nt, Homo Sapiens
uuaaaguucagcguguuaaccuaacauaaaacacagcaagaaucugguugucugaacuauuuua

SEQ ID NO: 211224 - RNA, 64 nt, Homo Sapiens
aaaacuuuguuuauugaaaaaaaaagaaaaagaaagcaagaaaaaaagauacuauggggucaag

SEQ ID NO: 211225 - RNA, 64 nt, Homo Sapiens
auauauaugggcuuaaucauuuaaaauuuguugcagcaagaacuuuccuaccuguaggcaauag

SEQ ID NO: 211226 - RNA, 64 nt, Homo Sapiens
ccucuugaugucucucagcugcagguggagcuggagcaagaauaccaagacaaauucaaaagac

SEQ ID NO: 211227 - RNA, 64 nt, Homo Sapiens
uugcacuuugaaagaaaggcguuaaucauaaagaagcaagaauggucaaaaucgaaugcugcau

SEQ ID NO: 211228 - RNA, 64 nt, Homo Sapiens
aagagccagggagggcagcccaggcccaagugacagcaagaacaagaaccacugccggcgugca

SEQ ID NO: 211229 - RNA, 64 nt, Homo Sapiens
ccccauccucgcugggcccgccgaccccgguguuagcaagaauccucuaaaucaguuuauggag

SEQ ID NO: 211230 - RNA, 64 nt, Homo Sapiens; identical to SEQ ID NO: 156330

SEQ ID NO: 211231 - RNA, 64 nt, Homo Sapiens; identical to SEQ ID NO: 156331

SEQ ID NO: 211232 - RNA, 64 nt, Homo Sapiens; identical to SEQ ID NO: 156332

SEQ ID NO: 211233 - RNA, 64 nt, Homo Sapiens; identical to SEQ ID NO: 156333

SEQ ID NO: 211234 - RNA, 64 nt, Homo Sapiens; identical to SEQ ID NO: 156334

SEQ ID NO: 211235 - RNA, 64 nt, Homo Sapiens; identical to SEQ ID NO: 156335

SEQ ID NO: 211236 - RNA, 64 nt, Homo Sapiens; identical to SEQ ID NO: 156336

SEQ ID NO: 211237 - RNA, 64 nt, Homo Sapiens; identical to SEQ ID NO: 156337

SEQ ID NO: 211238 - RNA, 64 nt, Homo Sapiens; identical to SEQ ID NO: 156338

SEQ ID NO: 211239 - RNA, 64 nt, Homo Sapiens; identical to SEQ ID NO: 156339

SEQ ID NO: 211240 - RNA, 64 nt, Homo Sapiens; identical to SEQ ID NO: 156340

SEQ ID NO: 211241 - RNA, 64 nt, Homo Sapiens; identical to SEQ ID NO: 156341

SEQ ID NO: 211242 - RNA, 63 nt, Homo Sapiens
uguuaggcucuccagggcuucuuuccaaacccccagcuccacaccccccagacccagcugguu

SEQ ID NO: 211243 - RNA, 63 nt, Homo Sapiens
cccggccaggcagcugggaccagaaugcaaccccagcuccacuccagccuggcguccagggcc

SEQ ID NO: 211244 - RNA, 63 nt, Homo Sapiens
cauauugcuacagaggacauugauaauggcuuccagcuccaucuuccuguguuaguuugcuua

SEQ ID NO: 211245 - RNA, 63 nt, Homo Sapiens
auuuuuaauuuuuuuaacuuaaugagaagagagcagcuccacaaugacuagcucuugccgauu

SEQ ID NO: 211246 - RNA, 63 nt, Homo Sapiens
ggucgugguggagaaucugagggcacucucugccagcuccacagggugggaugagccucuccu

SEQ ID NO: 211247 - RNA, 63 nt, Homo Sapiens
auucccacauaauacauuccaucacagccagcccagcuccacucagggcuggcccggggaguc

SEQ ID NO: 211248 - RNA, 63 nt, Homo Sapiens
gagcaucauacuggaaagcaaacaccuuuccuccagcuccagaauuccuugucucugaaugac

SEQ ID NO: 211249 - RNA, 63 nt, Homo Sapiens
agcucacaccgaguugugcuuggcuugcuugugcagcuccaggcacccggugggcacucuggu

SEQ ID NO: 211250 - RNA, 63 nt, Homo Sapiens
gacuuggccuaggguugucugagccggagccggcagcuccacuggagagcagugcaggcagag

SEQ ID NO: 211251 - RNA, 63 nt, Homo Sapiens
ggcgugugugugguggggcuuggcaugugauggcagcuccaggcaugccgcugcuuguauggc

SEQ ID NO: 211252 - RNA, 63 nt, Homo Sapiens
uugucccuuuugaucauuauuaacucaggguuucagcuccaaccucgcugaguuggugcagcu

SEQ ID NO: 211253 - RNA, 63 nt, Homo Sapiens
caggguuucagcuccaaccucgcugaguuggugcagcuccaggucauuccuggggugggaauc

SEQ ID NO: 211254 - RNA, 63 nt, Homo Sapiens
gcgcugucucgugaauggacagucccucucacgcagcuccacaacagcagcuccaccaaauga

SEQ ID NO: 211255 - RNA, 63 nt, Homo Sapiens
aaaugaagucccucucacgccaccuaagaacagcagcuccaccugagagcugggcggcgucca

SEQ ID NO: 211256 - RNA, 63 nt, Homo Sapiens
gcuccaccuggcuucacuccuucaaaggcuccacagcuccaccggccugggcccucaggaugu

SEQ ID NO: 211257 - RNA, 63 nt, Homo Sapiens
gaagccccagccccuuccaguggugccugagcgcagcuccaggagccaugagacccacagacu

SEQ ID NO: 211258 - RNA, 63 nt, Homo Sapiens
ggcaggcagugcccagcugguggaucucagguacagcuccaggguuauauacagauggcagcu

SEQ ID NO: 211259 - RNA, 63 nt, Homo Sapiens
uccacacaguggccggcccugguggucuggaggcagcuccacgucccgccagccuuguuuuca

SEQ ID NO: 211260 - RNA, 63 nt, Homo Sapiens
cuggcugcuugccuuccauuuguucccagcaaccagcuccaucgcuuuuccaccuccagcaag

SEQ ID NO: 211261 - RNA, 63 nt, Homo Sapiens
gagcagagugucgaggauggugugauguggacccagcuccagguggcugagcucugugaucgc

SEQ ID NO: 211262 - RNA, 63 nt, Homo Sapiens
uaccuuugugugucaccucauucacgggacuuccagcuccagcagccaccuuugcgugucacc

SEQ ID NO: 211263 - RNA, 63 nt, Homo Sapiens
caccuuugcgugucaccuucgcagguccaagugcagcuccagcccaaggugccugugcuccca

SEQ ID NO: 211264 - RNA, 63 nt, Homo Sapiens
ggugaugggggugauggacuaugggacgugucccagcuccagguuuuguauaaauaaaagaaa

SEQ ID NO: 211265 - RNA, 63 nt, Homo Sapiens
gugggggggcugucccaggggugacucccuugccagcuccagaucccgcagaccaaagagagu

SEQ ID NO: 211266 - RNA, 63 nt, Homo Sapiens
uuccaggcagccucgcccgccggacagcuccagcagcuccacgaaagaacuuuccaggucagc

SEQ ID NO: 211267 - RNA, 63 nt, Homo Sapiens
agcuccacguuccaggcagccaggucagccggacagcuccagccuagaggccaaagaacuuuc

SEQ ID NO: 211268 - RNA, 63 nt, Homo Sapiens
aaccaucaugguaagugguaaguucaucagagucagcuccaggucccauaccaaagcccugug

SEQ ID NO: 211269 - RNA, 63 nt, Homo Sapiens
cagugaaaauaguaaucagaucugaauuuggaucagcuccaaguugggucagaaccuucucuc

SEQ ID NO: 211270 - RNA, 63 nt, Homo Sapiens
gccgucaacuccuguucucccaccagggacuggcagcuccacugcaacacaacaaucagaugg

SEQ ID NO: 211271 - RNA, 63 nt, Homo Sapiens
aaaggcccugcuuccuggaaaggacacucagagcagcuccaagacagaggcucuguggcgggg

SEQ ID NO: 211272 - RNA, 63 nt, Homo Sapiens
cccuuggccagggccaugggagucccgcgcagucagcuccacauuggccucugcagcugggug

SEQ ID NO: 211273 - RNA, 63 nt, Homo Sapiens
uuauugugcucagugaacauccagugcugggugcagcuccaucacccucuuguguguuuacau

SEQ ID NO: 211274 - RNA, 63 nt, Homo Sapiens
aagugauagucuauaggaguguuuaauuucuugcagcuccaucugguugcugcauuugaagca

SEQ ID NO: 211275 - RNA, 63 nt, Homo Sapiens
gggaaucagaacucaaauggagggcccagagcccagcuccaagacaaggauagaugcuggccc

SEQ ID NO: 211276 - RNA, 63 nt, Homo Sapiens
cugcaaagaucuguccucagaggacuuccuguccagcuccaacuuugggccagacaugccaca

SEQ ID NO: 211277 - RNA, 63 nt, Homo Sapiens
guaaucuuacgggaucaucaaauaggaauuuuucagcuccauuccauggcuguguccccaggc

SEQ ID NO: 211278 - RNA, 63 nt, Homo Sapiens
gucucuccagaauaagacaucauuguugaacuucagcuccaguugccagguaauaagugugau

SEQ ID NO: 211279 - RNA, 63 nt, Homo Sapiens
uggcguccucccugccucucuucuuaagagucccagcuccagggugucuuugucauugucugg

SEQ ID NO: 211280 - RNA, 63 nt, Homo Sapiens
uccacuaccacuccaagccuagcccuggaauuccagcuccaccgucaaauggccugcccauga

SEQ ID NO: 211281 - RNA, 63 nt, Homo Sapiens
ggcacuaccacccugcuccaucaucacuacguccagcuccaacggcacuggugccccauucca

SEQ ID NO: 211282 - RNA, 63 nt, Homo Sapiens
gcaccagugccucgcuccauuggcaccaacgcccagcuccaccgguacuggcucccugcucca

SEQ ID NO: 211283 - RNA, 63 nt, Homo Sapiens
gguaguaccugagugugugcuaugauaaagguucagcuccagggacuagcacucagagggacu

SEQ ID NO: 211284 - RNA, 63 nt, Homo Sapiens
cucccaagugacaggccauucaggaagacccagcagcuccaccuuuugcaagacaguggucaa

SEQ ID NO: 211285 - RNA, 63 nt, Homo Sapiens
gccgcuccugcuuccccuccuccggcccagugccagcuccagucugauggaaugugccaccug

SEQ ID NO: 211286 - RNA, 63 nt, Homo Sapiens
cauuccagccaggcccaggccucucucacccaccagcuccacaggagggggaccuguccccca

SEQ ID NO: 211287 - RNA, 63 nt, Homo Sapiens
cccugguaccccucuucaugagucgugggagcccagcuccagggcacuccgucugaugggagg

SEQ ID NO: 211288 - RNA, 63 nt, Homo Sapiens
uccggaggcccagcacuccgguggcaaguggcacagcuccaugaggcaggcucucagauguag

SEQ ID NO: 211289 - RNA, 63 nt, Homo Sapiens
gacccccggccugcagaacaucuguccccaagccagcuccacugcccaggcccccaagagggc

SEQ ID NO: 211290 - RNA, 63 nt, Homo Sapiens
aagccagcuccacugcccaggcccccaagagggcagcuccagaagcugcccagggcuccggga

SEQ ID NO: 211291 - RNA, 63 nt, Homo Sapiens
aaacgccaccuuacacucugcaggcugcagcggcagcuccagauggccuccugagcuggacga

SEQ ID NO: 211292 - RNA, 63 nt, Homo Sapiens
cccagcgggaagggaggcugaugggccuuugcucagcuccaggcuagggcuccagagggguga

SEQ ID NO: 211293 - RNA, 63 nt, Homo Sapiens
ugcccucaccucucuagcagccacucccagccccagcuccagcguccauggggaucucaucac

SEQ ID NO: 211294 - RNA, 63 nt, Homo Sapiens
gccccaccuuuguccccuagcaaauucaggguacagcuccaccuagaaccaggcugcccucua

SEQ ID NO: 211295 - RNA, 63 nt, Homo Sapiens
cuuggccccugccugcgucugugcucaaagcagcagcuccaacccugccucuguccccuuccc

SEQ ID NO: 211296 - RNA, 63 nt, Homo Sapiens
agugccuccccgccccgccgcuggcgucaaguucagcuccacgugugccaucaguggauccga

SEQ ID NO: 211297 - RNA, 63 nt, Homo Sapiens
ucuuccuauuuugaguuugguucagaucuuaagcagcuccaugcaacuguauuuauuuuugau

SEQ ID NO: 211298 - RNA, 63 nt, Homo Sapiens
aaguccccgcaaugucucacgcugugguugcugcagcuccaggaaauugauuacaaguucucu

SEQ ID NO: 211299 - RNA, 63 nt, Homo Sapiens
cugacaccagcagaguccugcugcagauggaaucagcuccaggcugucagggugcuggccccu

SEQ ID NO: 211300 - RNA, 63 nt, Homo Sapiens
gggagggaggacagaccuccaccacacugacaucagcuccagcucccccagguugggggggag

SEQ ID NO: 211301 - RNA, 63 nt, Homo Sapiens
cacaucccccccaaccuacccccaccccaaaagcagcuccaacagaauggccagagggccuca

SEQ ID NO: 211302 - RNA, 64 nt, Homo Sapiens
gaagacuucaagccuuaaaaggaggcugccguggagcacggauacagaaacugagacacgugga

SEQ ID NO: 211303 - RNA, 64 nt, Homo Sapiens
cugucugccucagaacauagccgugaucaagaugagcacggaggcucgugucccagcaccuggc

SEQ ID NO: 211304 - RNA, 64 nt, Homo Sapiens
guuucuucucaaaauggauuucauauaauuucggagcacggaagcacacacaagcucuuuauga

SEQ ID NO: 211305 - RNA, 64 nt, Homo Sapiens
ggguagcugagucugcuuaggggacugcaugggaagcacggaauauaggguuagauguguguua

SEQ ID NO: 211306 - RNA, 64 nt, Homo Sapiens
gcucuggaggcugcugcugaccugggccaugaggagcacggaggagaaggacuggcagauccca

SEQ ID NO: 211307 - RNA, 64 nt, Homo Sapiens
ucccagccuccacuuucagagugaaauucaaggcagcacggacaugugcccaucaggcacagaa

SEQ ID NO: 211308 - RNA, 64 nt, Homo Sapiens
cugugacugccaccugcguccuuccuugcgugucagcacggaugugggauuaccgaagaguccc

SEQ ID NO: 211309 - RNA, 64 nt, Homo Sapiens
cugcuguguccugggugcucucucagauguguguagcacggagcguggugaggguucuagggga

SEQ ID NO: 211310 - RNA, 64 nt, Homo Sapiens
agcacauaaucuuucuuugcgucuuccggucugcagcacggaaaucauucaggaaaucaaauca

SEQ ID NO: 211311 - RNA, 64 nt, Homo Sapiens
cuagaaaauuuuauggcuaucgaagaaaugaagaagcacggaaguacucaugucggauucccag

SEQ ID NO: 211312 - RNA, 64 nt, Homo Sapiens
aguguugcccaaacuugguucaacaguucaaauaagcacggagaaacaaaucccauauguuggg

SEQ ID NO: 211313 - RNA, 64 nt, Homo Sapiens
cagccuuccacuuuucccagccccacccacaaagagcacggagcucguuucuuuuucaucuccc

SEQ ID NO: 211314 - RNA, 64 nt, Homo Sapiens
auuugaacucagaucugucugauaggaaugugaaagcacggacucuuacugcuaacuuuugugu

SEQ ID NO: 211315 - RNA, 64 nt, Homo Sapiens
caguuggaugaauagagaagggaaaaguugcuggagcacggagugaagaugggaggagcuguua

SEQ ID NO: 211316 - RNA, 64 nt, Homo Sapiens
cucuuggggcucuucuucagcgcucccuccuaacagcacggauuaucuugugaaccccuaaauc

SEQ ID NO: 211317 - RNA, 64 nt, Homo Sapiens
gucaguucucugggaagugguucaaacuuuugggagcacggacuuuuucacauuaggcuguugg

SEQ ID NO: 211318 - RNA, 64 nt, Homo Sapiens
ucuuacacaucugacuccgcagugccugcaggggagcacggagccgcgggacagccaagcaccu

SEQ ID NO: 211319 - RNA, 64 nt, Homo Sapiens
gauaaagaauugaacauuuuuacugauuauauagagcacggaaagauuauggucuuuagauuaa

SEQ ID NO: 211320 - RNA, 64 nt, Homo Sapiens
ugauguauugcuucuucacguuuuguuuuuauugagcacggaguagaauuccagggcugccuug

SEQ ID NO: 211321 - RNA, 64 nt, Homo Sapiens
gcagcauuguuuaugggaaugcugagcuuggagcagcacggacaccuuggggagggcuccuagu

SEQ ID NO: 211322 - RNA, 64 nt, Homo Sapiens
cuccccacggugcgugcccuggugcugcgggugcagcacggaaaccccggcuucuacuguacag

SEQ ID NO: 211323 - RNA, 64 nt, Homo Sapiens
uucucuccaacaaagguccagugaagguucaggaagcacggagacucccaaacaggaaacccug

SEQ ID NO: 211324 - RNA, 64 nt, Homo Sapiens
guuggggcugggggccagcucucccccugacuguagcacggagugggguucgcaccgugcuggg

SEQ ID NO: 211325 - RNA, 64 nt, Homo Sapiens
acuuucuuaaaacgcaaccucaaaacaggguaccagcacggaaguuaugcagaaaaaaauugaa

SEQ ID NO: 211326 - RNA, 57 nt, Homo Sapiens
accgggacacagaauuauagaugucugagcacggacucucccaggccugccugcaug

SEQ ID NO: 211327 - RNA, 64 nt, Homo Sapiens
auguagguuauagaucgucagcauguguggaggcagcacggaacgaaagggcaccccagcgggg

SEQ ID NO: 211328 - RNA, 64 nt, Homo Sapiens
gaucuccaaacauuccuagguauuccuguucaguagcacggaauugguuauuauuuauauuauu

SEQ ID NO: 211329 - RNA, 64 nt, Homo Sapiens
ucauguggaaagaggagcugggaccgcggcgagcagcacggagcggaagggagagcaggggaga

SEQ ID NO: 211330 - RNA, 64 nt, Homo Sapiens
uggucuguccugacagcacucugugccugggccuagcacggacauuggaugaggagugguuggg

SEQ ID NO: 211331 - RNA, 64 nt, Homo Sapiens
gggcugaggucaacucugauaugcuucuuucacaagcacggacucauugaacuugucuauggca

SEQ ID NO: 211332 - RNA, 64 nt, Homo Sapiens
aauggggccuucagcuggagcuaaggcaggggcgagcacggaacacauagcaagcugaacuguc

SEQ ID NO: 211333 - RNA, 64 nt, Homo Sapiens
cuccaccuucuggguggaggccagcgugguggucagcacggaagucagggacaagaccaguccc

SEQ ID NO: 211334 - RNA, 64 nt, Homo Sapiens
gggccugaggaggggucucuccaggcauuguuccagcacggaggugaugugucacgggcccuga

SEQ ID NO: 211335 - RNA, 64 nt, Homo Sapiens
uacucauaugggauucccagagaagaaaugaagaagcacggaagaaacuuucauucaagguuga

SEQ ID NO: 211336 - RNA, 64 nt, Homo Sapiens
uaacacuaugcauuaaaagcuuuagugauauggcagcacggauaaccugccuuggcaagccuau

SEQ ID NO: 211337 - RNA, 64 nt, Homo Sapiens
ucgaguucuuggggcgcagagaacuuaggagagaagcacggaggagcccccggcagagcacccg

SEQ ID NO: 211338 - RNA, 64 nt, Homo Sapiens
ucuagacaccaagggggaguaagcugagcugucuagcacggauuggagacucccucucccuggu

SEQ ID NO: 211339 - RNA, 64 nt, Homo Sapiens
ccggggcccacuccgauccgccugggcucagcuaagcacggaagccaagggggcugugccgugg

SEQ ID NO: 211340 - RNA, 64 nt, Homo Sapiens
aaacagaugcuccuguuugcugggggagggugugagcacggaguauuucugucccucgugaagu

SEQ ID NO: 211341 - RNA, 64 nt, Homo Sapiens
ucucgcuccacccagcucugagcaccucugcaccagcacggaccuagcccugaguccuaggagg

SEQ ID NO: 211342 - RNA, 64 nt, Homo Sapiens
augcccacgugccugagccacaggcgcccaguguagcacggaagaaccguuccugaaaggccac

SEQ ID NO: 211343 - RNA, 64 nt, Homo Sapiens
auccccuguuccuguuucacggggcucuucugggagcacggagcgcguaccucccucaccgucu

SEQ ID NO: 211344 - RNA, 64 nt, Homo Sapiens
ucuagagagagccgcguugcggcagaggcuggacagcacggacuaaggccuucccccaccacug

SEQ ID NO: 211345 - RNA, 64 nt, Homo Sapiens
agcccuauuuucacuccuuccaguggucgacaugagcacggacuccuaaaccuuuuccacgcca

SEQ ID NO: 211346 - RNA, 64 nt, Homo Sapiens
gcgccgacguccugcccaccacgcacucccggagagcacggaaccgcacgcacgucaggcaccg

SEQ ID NO: 211347 - RNA, 64 nt, Homo Sapiens
cccaugucccagccacuucugggucccagccagcagcacggauguuacuguccugcuccuuccc

SEQ ID NO: 211348 - RNA, 64 nt, Homo Sapiens
gcccugugguccugucccagugcagagggccuggagcacggauugugaauaaagccgcacaugc

SEQ ID NO: 211349 - RNA, 64 nt, Homo Sapiens
uccggaguaccggcgggaggagguguacauccgcagcacggacuuugaccgcacgcuggagagu

SEQ ID NO: 211350 - RNA, 64 nt, Homo Sapiens
cccuguaccucaacacccagaccccaaccacaggagcacggauuaucagugaauggaucccaac

SEQ ID NO: 211351 - RNA, 64 nt, Homo Sapiens
ggugucacaugcccacagcagccucggugacgagagcacggagcccaagagguggggugucgug

SEQ ID NO: 211352 - RNA, 64 nt, Homo Sapiens
auaaaccuccgccaaugcacgcgcccgccccugcagcacggacagccccaccggcgcgcucuuc

SEQ ID NO: 211353 - RNA, 64 nt, Homo Sapiens
ucaacucaaggguggucagcucaaugcuacacagagcacggacuuuuggauucuuugcaguacu

SEQ ID NO: 211354 - RNA, 64 nt, Homo Sapiens
caucaucaccgacauguccuucuuaucuggaaagagcacggaaaugcagcggccuccuugaaga

SEQ ID NO: 211355 - RNA, 64 nt, Homo Sapiens
agugcuggagagggugggcugagggacuggggccagcacggaccacccaaggccucugcuuccc

SEQ ID NO: 211356 - RNA, 64 nt, Homo Sapiens
uccggcuucccaaacccucacagcuggcaccugcagcacggagcuccaggagacauauuuccag

SEQ ID NO: 211357 - RNA, 64 nt, Homo Sapiens
auaagcucuggaagcuggcagcgucuguucugggagcacggaugcggcugggagcaugaccuug

SEQ ID NO: 211358 - RNA, 64 nt, Homo Sapiens
gcucccggccgggcgcgguggcucacgccuguaaucccagcacuuugggaggccgaggcgggca

SEQ ID NO: 211359 - RNA, 64 nt, Homo Sapiens
cuugccagccaggcgugguggaucacgccuguaaucccagcacucugggaggccaaagcgggca

SEQ ID NO: 211360 - RNA, 64 nt, Homo Sapiens
uaggcaggccaggugcaguggcucaugccuguaaucccagcauuuugguaggccgaggagggca

SEQ ID NO: 211361 - RNA, 64 nt, Homo Sapiens
acacauggccaggcgcgguggcucacacccguaaucccagcacuuugcggggccgaggcagggg

SEQ ID NO: 211362 - RNA, 64 nt, Homo Sapiens
uugggaggccgaggcggguggcucacgcuuguaaucccagcacuaagccaggccgagcguguug

SEQ ID NO: 211363 - RNA, 64 nt, Homo Sapiens
gggaggccgaggggggcggagcucacgccuguaaucccagcacugugauuggccaggcgcagug

SEQ ID NO: 211364 - RNA, 64 nt, Homo Sapiens
uugggaggccaaggugggcggcucacgccuguaaucccagcacuauggcaggcugggcgcggug

SEQ ID NO: 211365 - RNA, 64 nt, Homo Sapiens
acagcggagccuggacugacgguccagcagucguucccagcagauucuaacagaggaaacaaau

SEQ ID NO: 211366 - RNA, 64 nt, Homo Sapiens
agacacccacccucucacugugcucccacccuccucccagcagcacugggggcccagcagagcc

SEQ ID NO: 211367 - RNA, 64 nt, Homo Sapiens
uugagaggccgaggugagacgcucacaccuguaaucccagcacuuuuuuaggcugggcauggug

SEQ ID NO: 211368 - RNA, 64 nt, Homo Sapiens
uuggaaggcugaggcagaagccucaugccuauaaucccagcacuaacgaggcugggcgcagugg

SEQ ID NO: 211369 - RNA, 64 nt, Homo Sapiens
uugggaggccgagacgggugcucauugccuguaaucccagcacuacccaguaguuaaaaaucaa

SEQ ID NO: 211370 - RNA, 64 nt, Homo Sapiens
auuuauuaaauggggacuucuggcuagccaguaaucccagcacccaguuucaaucuucugcaua

SEQ ID NO: 211371 - RNA, 64 nt, Homo Sapiens
cugggaggccaaggcagaugccucaugccuguaaucccagcacugugaaaucugcccgggcaca

SEQ ID NO: 211372 - RNA, 64 nt, Homo Sapiens
uugggaggccgaggugggcagcucacaccuguaaucccagcacuuauuucauccgggcgcagug

SEQ ID NO: 211373 - RNA, 64 nt, Homo Sapiens
uugggaggccgagguggccagcucacgccuguaaucccagcacuuuuuuaaaauuagccuggug

SEQ ID NO: 211374 - RNA, 64 nt, Homo Sapiens
uugggaggcccaggugggcggcucacgccuguaaucccagcacuaaauuaggccgggcauggug

SEQ ID NO: 211375 - RNA, 64 nt, Homo Sapiens
uuaggaggccgaggcaggcggcucacaccuauaaucccagcacucucucgggccaggcgcugug

SEQ ID NO: 211376 - RNA, 50 nt, Homo Sapiens; identical to SEQ ID NO: 178066

SEQ ID NO: 211377 - RNA, 64 nt, Homo Sapiens
cccuuuacuacaaagggcuaucuggcucuugccuucccagcauggcaugcucuggggaggcggc

SEQ ID NO: 211378 - RNA, 64 nt, Homo Sapiens
cucuggggaggcggcucuggucuggugccccuccucccagcauggcaugcucuagagaggcggc

SEQ ID NO: 211379 - RNA, 64 nt, Homo Sapiens
cucuagagaggcggcucuggucuggugcccauccucccagcauggcacgcucuggggaggcggc

SEQ ID NO: 211380 - RNA, 64 nt, Homo Sapiens
cucuggggaggcggcucuggucuggugcccauccucccagcacggcaugcucuagagaggcggc

SEQ ID NO: 211381 - RNA, 64 nt, Homo Sapiens
cucuagagaggcggcucugguacugguguccgucucccagcaugaagugcaguccuuggagaug

SEQ ID NO: 211382 - RNA, 64 nt, Homo Sapiens
ugaaaggacaacacuaucugcugggccucaccgcucccagcaacgugggaggaaggggaaaggg

SEQ ID NO: 211383 - RNA, 64 nt, Homo Sapiens
uuuggagaccuccaggauuacaucgccauuccauucccagcagccugcccacuccugcgcuuuu

SEQ ID NO: 211384 - RNA, 64 nt, Homo Sapiens
uugggaggcugaggcagguggcucacaccuguaaucccagcacuguccugagccagccguggug

SEQ ID NO: 211385 - RNA, 64 nt, Homo Sapiens
uggggaggccaaggcaggcggcucaugccuguaaucccagcacuuuuuuuggccgggcauggug

SEQ ID NO: 211386 - RNA, 64 nt, Homo Sapiens
ucacacacuugucugugcuaugauguaugcaggaucccagcauugauacccaaugacaaacuau

SEQ ID NO: 211387 - RNA, 64 nt, Homo Sapiens
agcaaaccgugccuucuggcucugcgccccauauucccagcaucauagacauccaacagcacca

SEQ ID NO: 211388 - RNA, 64 nt, Homo Sapiens
uugaccuagccagcgcaguggcucaugccuguaaucccagcacuuugggaggcugaggcgggcg

SEQ ID NO: 211389 - RNA, 64 nt, Homo Sapiens
aacgugggcugggcaugguggcucaugccuguaaucccagcacucugggaggcugaggugggcg

SEQ ID NO: 211390 - RNA, 64 nt, Homo Sapiens
agucagcaggaggcugccggaacaacagcggcuuucccagcaaccccaaauucuggcugcgggu

SEQ ID NO: 211391 - RNA, 64 nt, Homo Sapiens
gcucaggugacuggagcccgagggccugacagguucccagcagcugggccggccagccuugcac

SEQ ID NO: 211392 - RNA, 64 nt, Homo Sapiens
uugggaggccauggcggguggcucacgccuguaaucccagcacuaacuuuggcugggcauggug

SEQ ID NO: 211393 - RNA, 64 nt, Homo Sapiens
uugggaggcugaggcaggcggcucacgcuuguaaucccagcacuuugacuggcugggugcggug

SEQ ID NO: 211394 - RNA, 64 nt, Homo Sapiens
gcugaaauggaagucagaagugagugaccuguuuucccagcaacucacccucuuccaucuccaa

SEQ ID NO: 211395 - RNA, 64 nt, Homo Sapiens
ugucguggccgggcgcaguggcucacgccuguaaucccagcacuuugggaggccgaggugggug

SEQ ID NO: 211396 - RNA, 64 nt, Homo Sapiens
cauaagggcugggggugguggcucaugccuguaaucccagcacuuugggaggccgaggcgggcg

SEQ ID NO: 211397 - RNA, 64 nt, Homo Sapiens
ugaauaggccaggcgcaguggcucacaccuguaaucccagcacguugggaggccaaggcgggca

SEQ ID NO: 211398 - RNA, 64 nt, Homo Sapiens
aaauaaggccagguguggugacucacacuuguaaucccagcaauuugggaggcugagacaggag

SEQ ID NO: 211399 - RNA, 64 nt, Homo Sapiens
uaaauaaauaaucgacucaaaaauaagucaugugucccagcauaaggcaucagguuguuagaug

SEQ ID NO: 211400 - RNA, 64 nt, Homo Sapiens
uugggaggccgagaugggugacucacgccuauaaucccagcacucaagagggccgggcgcggug

SEQ ID NO: 211401 - RNA, 64 nt, Homo Sapiens
augggaggcugaggcaagcagcucacaccuauaaucccagcacuaacuuuggccgggcacggug

SEQ ID NO: 211402 - RNA, 64 nt, Homo Sapiens
uugggaggccgaaguggguggcucacaccuguaaucccagcacuuaaaggggccggguguggug

SEQ ID NO: 211403 - RNA, 64 nt, Homo Sapiens
guaggcggccgagguggguggcucaugccuguaaucccagcacuaauucuaggccggugcggug

SEQ ID NO: 211404 - RNA, 64 nt, Homo Sapiens
augggaggccagggagggaggcucaugccuguaaucccagcacugcuuugggccaggugcggug

SEQ ID NO: 211405 - RNA, 64 nt, Homo Sapiens
uauugauuggauugacuuuuuugcauuaaauuuuucccagcaaaauaaaucauauggcgaguca

SEQ ID NO: 211406 - RNA, 64 nt, Homo Sapiens
aauccaggccaggugugguggcucaugccuguaaucccagcacuuugagaggccgaggugggca

SEQ ID NO: 211407 - RNA, 64 nt, Homo Sapiens
cuuguaggcugagcgcgguggcucacgccuguaaucccagcacuuugggaggccaaggugggug

SEQ ID NO: 211408 - RNA, 64 nt, Homo Sapiens
auagagggccaggugugguggcucacgccugugaucccagcacuuugggaggccaagacgggcg

SEQ ID NO: 211409 - RNA, 64 nt, Homo Sapiens
uuacauaugccggcgcaguggcucauguguguaaucccagcacucugggaggcugagacaggua

SEQ ID NO: 211410 - RNA, 64 nt, Homo Sapiens
aaaauuagccgggcgcgguggcucacaccuguaaucccagcacuuugggagguggaggcgggug

SEQ ID NO: 211411 - RNA, 64 nt, Homo Sapiens
agugcuucugggcccagcuaaggaagccaucuguucccagcagaggagagcugcugcgcugacc

SEQ ID NO: 211412 - RNA, 64 nt, Homo Sapiens
gagagcugcugcgcugaccugcagagguugguggucccagcacagagcugugcccaugggcuug

SEQ ID NO: 211413 - RNA, 64 nt, Homo Sapiens
ucugguggccgggcgcgguggcucaaaccuguaaucccagcacuuugggaggccgaggugggug

SEQ ID NO: 211414 - RNA, 64 nt, Homo Sapiens
gugauuggccaggugcaguggcucacaccuguaaucccagcacuuugggaggccaaagugggug

SEQ ID NO: 211415 - RNA, 64 nt, Homo Sapiens
uugggaggcugaggcuggaggugggcgccuguagucccagcagcaaaauuagcuuggcguggug

SEQ ID NO: 211416 - RNA, 64 nt, Homo Sapiens
uugggaggccgagguggguggcucacgccuguaaucccagcacuguuuuaguccaggcacagug

SEQ ID NO: 211417 - RNA, 64 nt, Homo Sapiens
aacaucucaggccacucauuaccuucgcucaugaucccagcagccauuuuucuuaacaccuucu

SEQ ID NO: 211418 - RNA, 64 nt, Homo Sapiens
ggaacuccugcacaaguuuuaacugaacaagaaaucccagcaaaaggcauuuuuuuuucuacuu

SEQ ID NO: 211419 - RNA, 64 nt, Homo Sapiens
uuggggggcugaggugggcggcucaugccuguaaucccagcacucgaagcggccgggcacggug

SEQ ID NO: 211420 - RNA, 64 nt, Homo Sapiens
gaggaauauuggcuggcaugcucaaacuuucccuucccagcacaugcuauggucuugauacauc

SEQ ID NO: 211421 - RNA, 64 nt, Homo Sapiens
aucuuauucugaauagcauuauauggaacugaguucccagcaucuaauuuuuauagaaucauuc

SEQ ID NO: 211422 - RNA, 64 nt, Homo Sapiens
ucuguaaccuucagcauuucagcgucugaucuaaucccagcacucauugugacuucucugauaa

SEQ ID NO: 211423 - RNA, 64 nt, Homo Sapiens
ggagagucaaagggcuugcuugccccagcagaguucccagcagacagccauggcucuucccagc

SEQ ID NO: 211424 - RNA, 64 nt, Homo Sapiens
cccagcagaguucccagcagacagccauggcucuucccagcagccugugcaaauucugaugaug

SEQ ID NO: 211425 - RNA, 64 nt, Homo Sapiens
guuccaugaagaccacauccacacacgcaggaacucccagcaacacaagcuggaagcacauguu

SEQ ID NO: 211426 - RNA, 64 nt, Homo Sapiens
aaguuuggccgggugcgguggcucacgccuguaaucccagcacuuugggaggccaagguggggg

SEQ ID NO: 211427 - RNA, 64 nt, Homo Sapiens
agauauggccgagcgugauggcucaccccuguaaucccagcacuuugugaggccaaggugggcg

SEQ ID NO: 211428 - RNA, 64 nt, Homo Sapiens
auacagggcugggcacgguggcucacgccuguaaucccagcacuuugggagguugcggguggau

SEQ ID NO: 211429 - RNA, 64 nt, Homo Sapiens
uugggggccaaggagggugggcucaugccuguaaucccagcacugaaguuagcuggguguggug

SEQ ID NO: 211430 - RNA, 64 nt, Homo Sapiens
uugggaggcugaggcgggcggcucaugccuguaaucccagcacuguuaauagccaggcauggug

SEQ ID NO: 211431 - RNA, 64 nt, Homo Sapiens
cugugcaaauucugaugaugacagccauggcucuucccagcagccccagcagaguucccagcag

SEQ ID NO: 211432 - RNA, 64 nt, Homo Sapiens
cagccauggcucuucccagcugccccagcagaguucccagcagaggagagucaaagggcuugcu

SEQ ID NO: 211433 - RNA, 64 nt, Homo Sapiens
uugggaggcaggggcgggugucucacacguuuaaucccagcacugaaagaggccagacauggug

SEQ ID NO: 211434 - RNA, 64 nt, Homo Sapiens
uugagaggcugaggugguaggcucacgccuguaaucccagcacuagggguggccgggcacagug

SEQ ID NO: 211435 - RNA, 64 nt, Homo Sapiens
uugggaggccgaggcaggcggcucacgccuguaaucccagcacugugccuggcugggcguggug

SEQ ID NO: 211436 - RNA, 64 nt, Homo Sapiens
uugggaugcuaaggcaggcggcucacacuuguaaucccagcacuguucuagcccaggagcggug

SEQ ID NO: 211437 - RNA, 64 nt, Homo Sapiens
uugggaggccaaggugggcggcucacacuuguaaucccagcacuguucuaggcggggcguggug

SEQ ID NO: 211438 - RNA, 64 nt, Homo Sapiens
cuaagcugggugggguggcucacacccgacguaaucccagcacguugggaggccgaggcaggug

SEQ ID NO: 211439 - RNA, 64 nt, Homo Sapiens
cauucaggccaggcacggugacucacgccuguaaucccagcacuuugggaggccgaggcgggug

SEQ ID NO: 211440 - RNA, 64 nt, Homo Sapiens
ccccgcccacauccuccuuccccaggaccugagcucccagcaucugcagacgacccccgcagcc

SEQ ID NO: 211441 - RNA, 64 nt, Homo Sapiens
gagaccaaaggccgcccccgccugcugggguuccucccagcaccccagcuugcuggcugcccuc

SEQ ID NO: 211442 - RNA, 64 nt, Homo Sapiens
uugguugcugcucuggccagggaggcagccccacucccagcaagcagaagugauccucgagggu

SEQ ID NO: 211443 - RNA, 64 nt, Homo Sapiens
gccugaaaacagaggggagggaggaaggaaggagucccagcaggagcacagcccugguuuccug

SEQ ID NO: 211444 - RNA, 64 nt, Homo Sapiens
cgagaccuucagcaguugaggcuggggcuaguggucccagcagcccagcccccacccuccuggc

SEQ ID NO: 211445 - RNA, 64 nt, Homo Sapiens
ugcuaccucccagggcaugcagucuggaagggggucccagcaguggagugccgggacccucaga

SEQ ID NO: 211446 - RNA, 64 nt, Homo Sapiens
ucaguccuuccuccaugcagcauucacugugcuaucccagcaucaacaaaaucauucauaguuc

SEQ ID NO: 211447 - RNA, 64 nt, Homo Sapiens
uugagaggcugaggcgggaagcucacaccgguaaucccagcacuacuuugggucggaugcaggg

SEQ ID NO: 211448 - RNA, 64 nt, Homo Sapiens
uugggaggcugaggcggguggcucacgccuguaaucccagcacuauguauggcuggacgcggug

SEQ ID NO: 211449 - RNA, 64 nt, Homo Sapiens
uugcaaggccgaggaggguggcucaugccuguaaucccagcacuccuucaggccagucguggug

SEQ ID NO: 211450 - RNA, 64 nt, Homo Sapiens
uuucacucuucaaacucccaaacacaugacuucuucccagcagcccuucccggccucuaaaguu

SEQ ID NO: 211451 - RNA, 64 nt, Homo Sapiens
uucccagcagcccuucccggccucuaaaguuuggucccagcagcccuucccagccucuaaaguu

SEQ ID NO: 211452 - RNA, 64 nt, Homo Sapiens
uagcacccagcaugugaccccacuccugaucaggucccagcaucuucccuucuuguucuguucc

SEQ ID NO: 211453 - RNA, 64 nt, Homo Sapiens
ccagcaucuucccuucuuguucuguuccuuaaggucccagcaccuuaccccaggacuuggucuu

SEQ ID NO: 211454 - RNA, 64 nt, Homo Sapiens
caucuguuaaaugagagaauagaguaugguugauucccagcauucagugguccugucaagcaac

SEQ ID NO: 211455 - RNA, 64 nt, Homo Sapiens
auccuuggccuggcgcgguggcucacaccuguaaucccagcacuuuuggaggccaaggugggug

SEQ ID NO: 211456 - RNA, 64 nt, Homo Sapiens
guccagggccggacacaguggcccaugccuguaaucccagcacuuuggggggccaaggcaggcu

SEQ ID NO: 211457 - RNA, 64 nt, Homo Sapiens
uagaaaucucagcaugagcugcuauagaauacccucccagcaacaaaaccuaaucaguaaggcc

SEQ ID NO: 211458 - RNA, 64 nt, Homo Sapiens
cuuaggugccgucucuagucugugagggaggaacucccagcauccccauugcccacaaauggaa

SEQ ID NO: 211459 - RNA, 64 nt, Homo Sapiens
cugugguggcauuggccgagggucuucgggugcuucccagcacaagcugcccuugcuguccugu

SEQ ID NO: 211460 - RNA, 64 nt, Homo Sapiens
gcccugggugggggacacucagagugggagcacaucccagcagugcccauguagcaggagcaca

SEQ ID NO: 211461 - RNA, 64 nt, Homo Sapiens
cuggcgaccugacuagcagcuucugccguccacaucccagcacacaccaccuccugcacugcac

SEQ ID NO: 211462 - RNA, 64 nt, Homo Sapiens
accauugaaaauaucucuguaagcuuuugcagcuucccagcacgacagucccuccacugugaac

SEQ ID NO: 211463 - RNA, 64 nt, Homo Sapiens
gaucauucucaaaagcgagcaguuaagggaggugucccagcacauugccaguagugccuucauc

SEQ ID NO: 211464 - RNA, 64 nt, Homo Sapiens
uggagagcuucaauugucagacgugcucgcgcccucccagcacggucuucucuucugccaacua

SEQ ID NO: 211465 - RNA, 64 nt, Homo Sapiens
caggcagugucuugcugguguggagggcauuguuucccagcacccccugagcucuccugcaggg

SEQ ID NO: 211466 - RNA, 64 nt, Homo Sapiens
aacuuuugacuuagaugggguccacauaguggcuucccagcaacggaggccaggaugugcaguc

SEQ ID NO: 211467 - RNA, 64 nt, Homo Sapiens
cauuaaggccgggugggguggcacaugccuguaaucccagcacuuugggaggccaaggcuggug

SEQ ID NO: 211468 - RNA, 64 nt, Homo Sapiens
ugugauggcugggugcaguggcucacgccuguaaucccagcacuuugggaggcuuaggcggcug

SEQ ID NO: 211469 - RNA, 64 nt, Homo Sapiens
agggcagaguagccaggguguggcccugccaucuucccagcagggccacucccggcacuccaug

SEQ ID NO: 211470 - RNA, 64 nt, Homo Sapiens
guuuccuuuuugguacuuauuacugcuaaguauuucccagcacaugaaaccuuauuuuuuccca

SEQ ID NO: 211471 - RNA, 64 nt, Homo Sapiens
uuucagaggccaaggcgggcgcucacgccuguaaucccagcacuaaauagggcugggcgcgguu

SEQ ID NO: 211472 - RNA, 64 nt, Homo Sapiens
uuuggaggcugaggcggguggcucacaucuguaaucccagcacuccuuuuggcauggugccaug

SEQ ID NO: 211473 - RNA, 64 nt, Homo Sapiens
gcaaacugcuuuccagccugcaucccgaggaaguucccagcagaaccacagaaggagacccaga

SEQ ID NO: 211474 - RNA, 64 nt, Homo Sapiens
ugugagcgucuguuggacuuggcaguccccagccucccagcauccugggugaggcucccaaccu

SEQ ID NO: 211475 - RNA, 64 nt, Homo Sapiens
aggcuccagcuggagggaugcccccuacuccauuucccagcaaaaaaccauaaugcagaguggg

SEQ ID NO: 211476 - RNA, 64 nt, Homo Sapiens
uggcugguggagagauuuuugguggccaccugggucccagcacuccuuaccugucaauaacaau

SEQ ID NO: 211477 - RNA, 64 nt, Homo Sapiens
uugauaggccgggcaugguggcucaugccuguaaucccagcacuuugggaggccaggaguucga

SEQ ID NO: 211478 - RNA, 64 nt, Homo Sapiens
aagucaggcugggcgcaguggcucacgccuguaaucccagcacuuugggagggauaggugggcg

SEQ ID NO: 211479 - RNA, 64 nt, Homo Sapiens
uguggggaggaaccauaaacccagcccucacagcucccagcacagggccucccugagccagugg

SEQ ID NO: 211480 - RNA, 64 nt, Homo Sapiens
caucugggccaggcaagauggcucacgccugugaucccagcauuuugggaggccgaggcgggug

SEQ ID NO: 211481 - RNA, 64 nt, Homo Sapiens
uuuugcuuauguuuuuccuuuuuaucuucucucaucccagcauacugaguuauuuauuaauuag

SEQ ID NO: 211482 - RNA, 64 nt, Homo Sapiens
cagccccucagucaugcugccuucugcugcucccucccagcaggauucacccucucauucccgg

SEQ ID NO: 211483 - RNA, 64 nt, Homo Sapiens
ucucucuucuaauuuucaguauaaccaaaaauuaucccagcaugagcacgggcacgugcccuuc

SEQ ID NO: 211484 - RNA, 64 nt, Homo Sapiens
aaauugggccaggcacgguggcucacgccuguaaucccagcacuuugggaggccaaggccagcg

SEQ ID NO: 211485 - RNA, 64 nt, Homo Sapiens
ggauaugguuauauauaugggaugguuugguuggucccagcaaaguauaugaaaauuaaaguuc

SEQ ID NO: 211486 - RNA, 64 nt, Homo Sapiens
uugggaggcugaggcaggcggcucaugccuguaaucccagcacuagcagcagucaggcacggug

SEQ ID NO: 211487 - RNA, 64 nt, Homo Sapiens
uugggaggccaaggcgggcggcucaugccuguaaucccagcauugguguuggccaggcauggug

SEQ ID NO: 211488 - RNA, 64 nt, Homo Sapiens
uugggaggccaaggugggcgcucacaccuuguaaucccagcacucauaaggccaggagcagugg

SEQ ID NO: 211489 - RNA, 64 nt, Homo Sapiens
auauauggccaggcgggauggcucacgccuguaaucccagcacuuugggaggcugaggcgggca

SEQ ID NO: 211490 - RNA, 64 nt, Homo Sapiens
aaaauuagccgggcgugguggcuuacgccuguaaucccagcacuuugggaggccaaggugggcg

SEQ ID NO: 211491 - RNA, 64 nt, Homo Sapiens
auaacuugccgggugcgguggcucaccccuguaaucccagcacuuugggaggccaaagcaggcg

SEQ ID NO: 211492 - RNA, 64 nt, Homo Sapiens
aaaauuagccagggguggugguaugcaccugcagucccagcaacaugggaggcugaacaggaga

SEQ ID NO: 211493 - RNA, 64 nt, Homo Sapiens
cuugagaacuuggcucagggcuccugaggaccuuucccagcauuaccuucccuucccuugaaag

SEQ ID NO: 211494 - RNA, 64 nt, Homo Sapiens
acuaaaggccaggugcaguggcccaugccuguaaucccagcacuuugggaggugggacaauugc

SEQ ID NO: 211495 - RNA, 64 nt, Homo Sapiens
uugagaggccugaggucggcgcucaugccuguaaucccagcacuaacacaggccgggucuggug

SEQ ID NO: 211496 - RNA, 64 nt, Homo Sapiens
ucuuaaaacuuuguagucuuagccucauuugcuaucccagcaucgcuugucaacacagaauuca

SEQ ID NO: 211497 - RNA, 64 nt, Homo Sapiens
uugggaggccaaggcaaguggcucacgccuguaaucccagcaguagggggggccaggugcagug

SEQ ID NO: 211498 - RNA, 64 nt, Homo Sapiens
uccauagcaguaggcuuagguuaugaagaucuucucccagcaggugccuuaucagaaaccaagc

SEQ ID NO: 211499 - RNA, 64 nt, Homo Sapiens
cauauuugggcuggguauggagguucacugguaaucccagcacuuugggaggcccaggcagaag

SEQ ID NO: 211500 - RNA, 64 nt, Homo Sapiens
aauuuuggcuaggcgugauggcucaggucuguaaucccagcacuuucgguggccggggugggug

SEQ ID NO: 211501 - RNA, 64 nt, Homo Sapiens
ucucugucgcccaggcuggggugcaguggcgcgaucccagcacugcagccucaaccuccugggc

SEQ ID NO: 211502 - RNA, 64 nt, Homo Sapiens
ccccucugcccugucccugcacaccuccacugccucccagcagaucuguggagacaaaacaagc

SEQ ID NO: 211503 - RNA, 64 nt, Homo Sapiens
ggcggggccggcagagaaggcaggcuguggcugcucccagcagaaaaucccagcaccccagcca

SEQ ID NO: 211504 - RNA, 64 nt, Homo Sapiens
ccagccacaggcuguggcugugaccaggaagaaaucccagcaccguuuguacguuucucuuuga

SEQ ID NO: 211505 - RNA, 64 nt, Homo Sapiens
acucuaggcugggugugguggcucacgccuauaaucccagcacuuugggaggcugaggugggug

SEQ ID NO: 211506 - RNA, 64 nt, Homo Sapiens
accacuggccaggcgagguggcucacaccuguaaucccagcacuuugggaggccaaggcgggug

SEQ ID NO: 211507 - RNA, 64 nt, Homo Sapiens
gggaaauagcaguucagagagaggaagcucucugucccagcaccgagacucacuccuaagucuu

SEQ ID NO: 211508 - RNA, 64 nt, Homo Sapiens
acaagauggaagccuaaagcccaagucgagcagcucccagcacugcugugcagaccuagagguc

SEQ ID NO: 211509 - RNA, 64 nt, Homo Sapiens
gaaaagaauuccccaggagaaaauggaaacacuaucccagcaaucugaauuccuuacuugggga

SEQ ID NO: 211510 - RNA, 64 nt, Homo Sapiens
gcauugggcugagugugguggcucaugccuguaaucccagcacuuugggaggcugagacaggcg

SEQ ID NO: 211511 - RNA, 64 nt, Homo Sapiens
aaaauuaaccaugcguggugguacacgucugucaucccagcagcucuuaaggcugaggcacaag

SEQ ID NO: 211512 - RNA, 64 nt, Homo Sapiens
uugggaggccgaggcaggcagcucaagccuguaaucccagcacuauaagaggccgggugcggug

SEQ ID NO: 211513 - RNA, 64 nt, Homo Sapiens
uugggaggcuaaggugggcggcucacgccuguaaucccagcacuuuugcuggccagguauggug

SEQ ID NO: 211514 - RNA, 64 nt, Homo Sapiens
uugggaggcugaggugggaggcucgugccuguacucccagcacuuuauuuggccaagccugaug

SEQ ID NO: 211515 - RNA, 64 nt, Homo Sapiens
uugggaggcugaggcaggcggcucacgccuguaaucccagcacuguccuuggccaggugcagug

SEQ ID NO: 211516 - RNA, 64 nt, Homo Sapiens
cccugggcugagaugagaugcuuuuccuggccucucccagcaugaaagcaaagaagagaaguga

SEQ ID NO: 211517 - RNA, 64 nt, Homo Sapiens
gagaggccgaucacuugagggcucacgccuguaaucccagcacucaagacgggccggcacggug

SEQ ID NO: 211518 - RNA, 64 nt, Homo Sapiens
uugggaggccaagguggguggcucacaccuguaaucccagcauuaagaugggccaggugcggug

SEQ ID NO: 211519 - RNA, 64 nt, Homo Sapiens
uuaggaggccgaggcuggcagcucacgccuguaaucccagcacuauuagcagccaggugcagug

SEQ ID NO: 211520 - RNA, 64 nt, Homo Sapiens
acaaaggacauaagaaaaguagaaaaaggcuaagucccagcaauaucagcuucaucaaaacaga

SEQ ID NO: 211521 - RNA, 64 nt, Homo Sapiens
cgaacagugccccuaacggaauugaccuguguguucccagcacagggcuuucuggcugcucuuc

SEQ ID NO: 211522 - RNA, 64 nt, Homo Sapiens
agugaguggagcugcucagguguggccaccugugucccagcagcgugggagagaaucaagcucc

SEQ ID NO: 211523 - RNA, 64 nt, Homo Sapiens
uucccagguccugcacccuuaaggggauugacucucccagcauggccuuagaaacagaauuccu

SEQ ID NO: 211524 - RNA, 64 nt, Homo Sapiens
ucgggaggccgaggcggguggcucacgccuguaaucccagcacuguuggcggccgggugcagug

SEQ ID NO: 211525 - RNA, 64 nt, Homo Sapiens
cggugaggccgggcgcaguggcucacgccuguaaucccagcacuuugggaggccgaggcgggug

SEQ ID NO: 211526 - RNA, 64 nt, Homo Sapiens
aauuuggccagacacaggugccucacgccuguaaucccagcacuuugggaggcugagcuggauc

SEQ ID NO: 211527 - RNA, 64 nt, Homo Sapiens
ggccuuggcugggcaugguggcucacgccuguaaucccagcacuuugggaggccgaggucagga

SEQ ID NO: 211528 - RNA, 64 nt, Homo Sapiens
ccuuagggccgagugcgguggcucacgccuauaaucccagcacuuugggaggccgaggcgggcg

SEQ ID NO: 211529 - RNA, 64 nt, Homo Sapiens
acuugucuggcaaacaggagaugcuggauuucaaucccagcagggccucacuaguugagguauu

SEQ ID NO: 211530 - RNA, 64 nt, Homo Sapiens
ggcucuggcugggugugguggcucacaccuguaaucccagcacuuugggaggcugaggcaggag

SEQ ID NO: 211531 - RNA, 64 nt, Homo Sapiens
aggagaggccaggccugguggcucacgccuguaaucccagcacuuuaagaggccaaggcggaug

SEQ ID NO: 211532 - RNA, 64 nt, Homo Sapiens
gagagauagugggugugguggcucacaccugcaaucccagcacuuuggaaggccgaggugggca

SEQ ID NO: 211533 - RNA, 64 nt, Homo Sapiens
auaaugggccaggugaaguggcucacaccuguaaucccagcacuguggaaagacaggaguucga

SEQ ID NO: 211534 - RNA, 64 nt, Homo Sapiens
aaugcgggccaggcacaguggcucacaccuguaaucccagcacuaugggaggcccaggugagca

SEQ ID NO: 211535 - RNA, 64 nt, Homo Sapiens
caugaauuguuuauuugcagugaugcuucauauuucccagcacuguucaugguaucuuauuucc

SEQ ID NO: 211536 - RNA, 64 nt, Homo Sapiens
uguauaggcugggugcgguggcucaugccuguaaucccagcacuuugggaggccaaggcaggug

SEQ ID NO: 211537 - RNA, 64 nt, Homo Sapiens
agauggagccgggugcaguugccaacacuuguaaucccagcaguuugcgaggccgaggcaggug

SEQ ID NO: 211538 - RNA, 64 nt, Homo Sapiens
acaggugagugggcaugguggcucaugccuguaaucccagcacuuuggaaggcugaggugggug

SEQ ID NO: 211539 - RNA, 64 nt, Homo Sapiens
gccaggggccgggcacggugccucacaccuguaaucccagcacuuagguaggccaaggugggug

SEQ ID NO: 211540 - RNA, 64 nt, Homo Sapiens
ucgggaggcugaggcaggaggugggcaccuguagucccagcaacaaaauuagccaggcguggug

SEQ ID NO: 211541 - RNA, 64 nt, Homo Sapiens
uugggaggcccaggugggcggcucacgccuguaaucccagcacugccuuuggccgggugcgggg

SEQ ID NO: 211542 - RNA, 64 nt, Homo Sapiens
uugggaggccauggcagguggcucaugccuguaaucccagcacuccaaguggccaggugcggug

SEQ ID NO: 211543 - RNA, 64 nt, Homo Sapiens
uugggaggacaaggugggugggucacaccuguaaucccagcacuugaauuuggccuggcacagg

SEQ ID NO: 211544 - RNA, 64 nt, Homo Sapiens
uugggaggucgggggggugggcucaugucuguaaucccagcacuaaaauuagccaggcgcauug

SEQ ID NO: 211545 - RNA, 64 nt, Homo Sapiens
augggaggccgagacgggcgguucaugccuguaaucccagcacuaggguuggccaggcacggug

SEQ ID NO: 211546 - RNA, 64 nt, Homo Sapiens
uugggaggccaaggugggcagcucaugccuguaaucccagcacuaaaauagaccaggugcucug

SEQ ID NO: 211547 - RNA, 64 nt, Homo Sapiens
uugggaggccgaggcaagaggcucacaccuguaaucccagcacuugcacaggacagguguggug

SEQ ID NO: 211548 - RNA, 64 nt, Homo Sapiens
uugagaggccaagacagguaucucacaccuguaaucccagcacuggauugggccaggcguggug

SEQ ID NO: 211549 - RNA, 64 nt, Homo Sapiens
cuucuuugcugggcauggugacucacgccuguaaucccagcacuuuggaagggugaggugggug

SEQ ID NO: 211550 - RNA, 64 nt, Homo Sapiens
auucucggcugggcgcgguggcgcaugccuguaaucccagcacuuugggaggccaaggugggug

SEQ ID NO: 211551 - RNA, 64 nt, Homo Sapiens
acaucagggcugggcacagcgguuccgccuguaaucccagcacuuugggagguccaggcaggug

SEQ ID NO: 211552 - RNA, 64 nt, Homo Sapiens
auuucuggccgggcgugguggcucaagccuguaaucccagcacuuugggaggccgaggugggcg

SEQ ID NO: 211553 - RNA, 64 nt, Homo Sapiens
uguuugggccaggcacagucgcucauacuuguaaucccagcacuuugggaggccgaggcgggug

SEQ ID NO: 211554 - RNA, 64 nt, Homo Sapiens
uaaucaggcuaggcacaguggcucacacauggaaucccagcacuuugggaggccgaggugggag

SEQ ID NO: 211555 - RNA, 64 nt, Homo Sapiens
cuuggccugaguaaacuuggcccuccuuugugugucccagcaccucuccccagcacugaguccc

SEQ ID NO: 211556 - RNA, 64 nt, Homo Sapiens
uugggaggcugagacaggcagcucacgccuguaaucccagcacucugagaggccgggcacggug

SEQ ID NO: 211557 - RNA, 64 nt, Homo Sapiens
uugggaggccgaggcagguggcucacgccuguaaucccagcacuuuaccuggccaggcauggug

SEQ ID NO: 211558 - RNA, 64 nt, Homo Sapiens
uugggaggcugagguggguggcuuguuccuauagucccagcacucaucugagcuggaugcagug

SEQ ID NO: 211559 - RNA, 64 nt, Homo Sapiens
caucuaggcuaggugcaguggcuuguuccuguagucccagcacucugggaaccuggguugggag

SEQ ID NO: 211560 - RNA, 64 nt, Homo Sapiens
agaguuuaccuggcagagugugucaugccugcaaucccagcacuuugggaggccaaggcaggca

SEQ ID NO: 211561 - RNA, 64 nt, Homo Sapiens
guccgacgccgcuuacucagagcccuggccucccucccccuaccucacacgcugcucaugaaag

SEQ ID NO: 211562 - RNA, 64 nt, Homo Sapiens
ggaaaugaaaugaaaucaaauuuaucaguuuuuuucccccuaauuacccaaaagaucuuuugca

SEQ ID NO: 211563 - RNA, 64 nt, Homo Sapiens
cccaccccuucccacggcgugucccacggccagacacaugcacacacaucacacccucaaacac

SEQ ID NO: 211564 - RNA, 64 nt, Homo Sapiens
auguguaugcguaugcauacacaccacacacacacacaugcacaagucaugugcgaacagcccu

SEQ ID NO: 211565 - RNA, 64 nt, Homo Sapiens
ucuacacguccacaccacucaccacacauacauacacaugcacacacacacacaugcaauucua

SEQ ID NO: 211566 - RNA, 64 nt, Homo Sapiens
acucaccacacauacauacacaugcacacacacacacaugcaauucuaccuuuuucuaacacca

SEQ ID NO: 211567 - RNA, 64 nt, Homo Sapiens
ccuagguucuuacacauaugcacacacgcauacacacaugcacgcacacacacauacacacaug

SEQ ID NO: 211568 - RNA, 64 nt, Homo Sapiens
cacgcauacacacaugcacgcacacacacauacacacaugcacgcacgcacgcaugcacaccaa

SEQ ID NO: 211569 - RNA, 64 nt, Homo Sapiens
gagaauucuuuacagcaaagccagagucuuagcucacaugcacuacaccucucuacugagugcu

SEQ ID NO: 211570 - RNA, 64 nt, Homo Sapiens
cauacaagcagucucaccucccucuggaagcuaccacaugcaaaaagauuaaaacugaagauuu

SEQ ID NO: 211571 - RNA, 64 nt, Homo Sapiens
acgugcucccugaaggcacacguacgcacacacgcacaugcacagauaugccgccugggcacac

SEQ ID NO: 211572 - RNA, 64 nt, Homo Sapiens
ugccuggacacacagauaaugcugccuugacacacacaugcacggauauugccuggacacacac

SEQ ID NO: 211573 - RNA, 64 nt, Homo Sapiens
acgugugcacagauaugcugucuggacacgcacacacaugcagauaugcugccuggacacacac

SEQ ID NO: 211574 - RNA, 64 nt, Homo Sapiens
gugcagauaugcuguccggauacacacgcacgcacacaugcagauaugcugccugggcacacac

SEQ ID NO: 211575 - RNA, 64 nt, Homo Sapiens
gcagauaugcugccugggcacacacuuccggacacacaugcacacacaggugcagauaugcugc

SEQ ID NO: 211576 - RNA, 64 nt, Homo Sapiens
cucgcuaagcggaaggaagucacgugcacguacacacaugcaugcacacaugcagacauguaca

SEQ ID NO: 211577 - RNA, 64 nt, Homo Sapiens
cauguacacacgugcacguacccccggauucccacacaugcagacgugaugcuccaccugccag

SEQ ID NO: 211578 - RNA, 64 nt, Homo Sapiens
auaggaaagcagccccuccucacacauacaugugcacaugcacacacaugcaugcacacacaug

SEQ ID NO: 211579 - RNA, 64 nt, Homo Sapiens
agccccuccucacacauacaugugcacaugcacacacaugcaugcacacacaugcacacauaca

SEQ ID NO: 211580 - RNA, 64 nt, Homo Sapiens
cauacaugugcacaugcacacacaugcaugcacacacaugcacacauacacgcacaugcacaca

SEQ ID NO: 211581 - RNA, 64 nt, Homo Sapiens
cacacaugcaugcacacacaugcacacauacacgcacaugcacacauacacaugcaugcacaca

SEQ ID NO: 211582 - RNA, 64 nt, Homo Sapiens
cacacaugcacacauacacgcacaugcacacauacacaugcaugcacacauacacaggcauaca

SEQ ID NO: 211583 - RNA, 64 nt, Homo Sapiens
ugcacacauacacaggcauacaugcaugcacacacacaugcacgcacacacacaugcacacaua

SEQ ID NO: 211584 - RNA, 64 nt, Homo Sapiens
cauacaugcaugcacacacacaugcacgcacacacacaugcacacauacacgugcacacauaca

SEQ ID NO: 211585 - RNA, 64 nt, Homo Sapiens
caugcacacauacacgugcacacauacacaggcacacaugcaugcacacauacacaugcacaca

SEQ ID NO: 211586 - RNA, 64 nt, Homo Sapiens
cacacauacacaggcacacaugcaugcacacauacacaugcacacacacaugcacacauauaug

SEQ ID NO: 211587 - RNA, 64 nt, Homo Sapiens
ggcacacaugcaugcacacauacacaugcacacacacaugcacacauauaugcacaggcacaca

SEQ ID NO: 211588 - RNA, 64 nt, Homo Sapiens
cauauaugcacaggcacacacauguacgcacacacacaugcacugcacacauauccaugcacac

SEQ ID NO: 211589 - RNA, 64 nt, Homo Sapiens
ugcacacauauccaugcacacaaacacauauauacacaugcacauacacagauuuuucugcugg

SEQ ID NO: 211590 - RNA, 64 nt, Homo Sapiens
uauuuacuaauccuaucugcugcguguguguauacacaugcauaauaauacacaugcauuuaug

SEQ ID NO: 211591 - RNA, 64 nt, Homo Sapiens
uaugugcguguguguauacaugugugugauaauacacaugcauucacaugccuccaugcauaua

SEQ ID NO: 211592 - RNA, 64 nt, Homo Sapiens
gaccucugccagccaccuaagcccugcguacauucacaugcacacauggaagaauguuuaucgg

SEQ ID NO: 211593 - RNA, 64 nt, Homo Sapiens
acaccuguaucacacaugugcuuacauuuccacucacaugcaccucugagccucccuugcuguc

SEQ ID NO: 211594 - RNA, 64 nt, Homo Sapiens
acauguacccaccacaaacgugcaagcuccugcacacaugcaugcacacaaacguguacacaag

SEQ ID NO: 211595 - RNA, 64 nt, Homo Sapiens
cagcguaaguuccuacacacggacgugugauacacacaugcauguacagguaagcacacaugua

SEQ ID NO: 211596 - RNA, 64 nt, Homo Sapiens
ugcacagcagagagacguaugagcuucuacugcacacaugcacacacacacgcacacguacauu

SEQ ID NO: 211597 - RNA, 64 nt, Homo Sapiens
auggacacaccccaaacacgcacaggcuccuacacacaugcacacacguguacaccacaaacga

SEQ ID NO: 211598 - RNA, 64 nt, Homo Sapiens
acacacgucucccacacgugagcucccacacguacacaugcacauguacgcaccacaaacacau

SEQ ID NO: 211599 - RNA, 64 nt, Homo Sapiens
aacacaugcgcaggcuccugcaggcgugaauacacacaugcacacacauauacacacaugugcc

SEQ ID NO: 211600 - RNA, 64 nt, Homo Sapiens
uuucaaaacaagaugugucaucggacuaacauuucacaugcacaaaaacuuccuuuacagaggu

SEQ ID NO: 211601 - RNA, 64 nt, Homo Sapiens
uagacauauucagcauauuuaacucuuaccaguccacaugcaauuggaacugcgauaacugaga

SEQ ID NO: 211602 - RNA, 64 nt, Homo Sapiens
uauggauacaacagcaaacauuuuauaaacuaugcacaugcauuacacacaugcacacacauau

SEQ ID NO: 211603 - RNA, 64 nt, Homo Sapiens
gcaaacauuuuauaaacuaugcacaugcauuacacacaugcacacacauaugcacacacaugug

SEQ ID NO: 211604 - RNA, 64 nt, Homo Sapiens
gaaggggagcaguugccaauauuugcaccaucuucacaugcacauguugcaacaagagcuucug

SEQ ID NO: 211605 - RNA, 64 nt, Homo Sapiens
ucuguguuuguuuugcacuuuaaaaaagagagaacacaugcaaaugaacuugcuuguguguauu

SEQ ID NO: 211606 - RNA, 64 nt, Homo Sapiens
ugaacuugcuuguguguauuuaaaaaagagagaacacaugcaaauccauguuuguuuugcacuu

SEQ ID NO: 211607 - RNA, 64 nt, Homo Sapiens
uguugcaacaagagcuucugauuugcaccaucuucacaugcacagaaggggagcaguugccaau

SEQ ID NO: 211608 - RNA, 64 nt, Homo Sapiens
ugaacuugcuuguguguauuuaaaaaagagagaacacaugcaaaucuguguuugucuugcacuu

SEQ ID NO: 211609 - RNA, 64 nt, Homo Sapiens
uguugcaacaagagcuucugauuugcaccaucuucacaugcaccgaaggggagcaguugccaau

SEQ ID NO: 211610 - RNA, 64 nt, Homo Sapiens
ggacuuagguucuggugaagggagacaaucagugcacaugcacacaccccacacgcauacacac

SEQ ID NO: 211611 - RNA, 64 nt, Homo Sapiens
acaugcacacaccccacacgcauacacacaugaacacaugcacaugugcacacacaaguaagau

SEQ ID NO: 211612 - RNA, 64 nt, Homo Sapiens
uauguccagggcaugggggucagaacucccaggucacaugcacgccccaacccccacacccaug

SEQ ID NO: 211613 - RNA, 64 nt, Homo Sapiens
cacacacgcgugcaugcacacagagcacacugcacacaugcacaacacagcacacacaagugca

SEQ ID NO: 211614 - RNA, 64 nt, Homo Sapiens
caggugcacagaccacacagcauaggccacacagcacaugcacaacacaugcacacacaaagug

SEQ ID NO: 211615 - RNA, 64 nt, Homo Sapiens
cacaaagugcauaggccacaacacacagcacuaacacaugcacacauacacaagugcacagacc

SEQ ID NO: 211616 - RNA, 64 nt, Homo Sapiens
cacguguagcucacacacaggugcacagaucacacacaugcacaaugcacgcuuacauguacac

SEQ ID NO: 211617 - RNA, 64 nt, Homo Sapiens
cuuacauguacacgugcacaugcauacaggcauacacaugcacgcauacgugcauacacaugcc

SEQ ID NO: 211618 - RNA, 64 nt, Homo Sapiens
cagaccacauagcacacaugcaugcacgcuugcacacaugcacauguccgcauacaggcguaca

SEQ ID NO: 211619 - RNA, 64 nt, Homo Sapiens
cuugcacacaugcacacagacgcauacaggcguacacaugcacgcacgugcucacauacauguc

SEQ ID NO: 211620 - RNA, 64 nt, Homo Sapiens
uacgauucucuuuccacaguaccugcuaucucuucaucaccaggugcccacagaugccaccaaa

SEQ ID NO: 211621 - RNA, 64 nt, Homo Sapiens
gccaaucugcucuagcugccgaacacugguacgucaucaccaaaauccuuuuucacggggacca

SEQ ID NO: 211622 - RNA, 64 nt, Homo Sapiens
cucccugaaagccuuuuugauuugucuucuuauccaucaccauguucuuaaguucggauccaag

SEQ ID NO: 211623 - RNA, 64 nt, Homo Sapiens
gccuacuucccaauauccacccugugugcugcagcaucaccacgccccuggccguccugucauc

SEQ ID NO: 211624 - RNA, 64 nt, Homo Sapiens
gccacgucaugagcgucaaaucugcuguuuacaacaucaccaguucauuuggcagccccuguuu

SEQ ID NO: 211625 - RNA, 64 nt, Homo Sapiens
ugguguguuccugugggaaagagaagaucauugccaucaccauugcucuccuccagcguggugu

SEQ ID NO: 211626 - RNA, 64 nt, Homo Sapiens
gguguuuccauauuuuuuccauuaucaauuuaaucaucaccaccuauggcaguguaucuaugua

SEQ ID NO: 211627 - RNA, 64 nt, Homo Sapiens
auuuuuugcucuuuuacauuuacuuuugcaacaccaucaccaaaauuuuuaaaucacaugucau

SEQ ID NO: 211628 - RNA, 64 nt, Homo Sapiens
gugcucagagaggauucuccucacagguucugugcaucaccacauuccauuuuagaauggggau

SEQ ID NO: 211629 - RNA, 64 nt, Homo Sapiens
gagcauucuuucagaaaaauguaaacaagcaauacaucaccaacugcaacuaggaacauauaca

SEQ ID NO: 211630 - RNA, 64 nt, Homo Sapiens
ccacgaugucugaaaccagauuaacacaaaagggcaucaccaucgcugaauccccuucacagug

SEQ ID NO: 211631 - RNA, 64 nt, Homo Sapiens
caugucugcagagccuggacggaggcaccaucaccaucaccaggcccuccaucugcccuggggu

SEQ ID NO: 211632 - RNA, 64 nt, Homo Sapiens
accaggcaugucugcagagcugggguggaggcaccaucaccaucagaagccccuccaucugccc

SEQ ID NO: 211633 - RNA, 64 nt, Homo Sapiens
aggggccauuccgucuguaccccggaauugucuucaucaccaaaccaacagccagugcuccaag

SEQ ID NO: 211634 - RNA, 64 nt, Homo Sapiens
gcccuagggaccaagacugacccuucuuccuccucaucaccaucagaucuccguggcugccauu

SEQ ID NO: 211635 - RNA, 64 nt, Homo Sapiens
cuuucauguagccccucaacagaaugcauugcaucaucaccaugguaacaguucccaucaccau

SEQ ID NO: 211636 - RNA, 64 nt, Homo Sapiens
gaaugcauugcaucaucaccaugguaacaguucccaucaccaucaccaccaccaccaccaucac

SEQ ID NO: 211637 - RNA, 64 nt, Homo Sapiens
auugcaucaucaccaugguaacaguucccaucaccaucaccaccaccaccaccaucaccaccac

SEQ ID NO: 211638 - RNA, 64 nt, Homo Sapiens
uaacaguucccaucaccaucaccaccaccaccaccaucaccaccaccauggacaacaagccuug

SEQ ID NO: 211639 - RNA, 64 nt, Homo Sapiens; identical to SEQ ID NO: 80540

SEQ ID NO: 211640 - RNA, 64 nt, Homo Sapiens; identical to SEQ ID NO: 80541

SEQ ID NO: 211641 - RNA, 64 nt, Homo Sapiens; identical to SEQ ID NO: 80542

SEQ ID NO: 211642 - RNA, 64 nt, Homo Sapiens; identical to SEQ ID NO: 80543

SEQ ID NO: 211643 - RNA, 64 nt, Homo Sapiens; identical to SEQ ID NO: 80544

SEQ ID NO: 211644 - RNA, 64 nt, Homo Sapiens; identical to SEQ ID NO: 80545

SEQ ID NO: 211645 - RNA, 64 nt, Homo Sapiens; identical to SEQ ID NO: 80546

SEQ ID NO: 211646 - RNA, 64 nt, Homo Sapiens; identical to SEQ ID NO: 80547

SEQ ID NO: 211647 - RNA, 64 nt, Homo Sapiens; identical to SEQ ID NO: 80548

SEQ ID NO: 211648 - RNA, 64 nt, Homo Sapiens; identical to SEQ ID NO: 80549

SEQ ID NO: 211649 - RNA, 64 nt, Homo Sapiens; identical to SEQ ID NO: 80550

SEQ ID NO: 211650 - RNA, 64 nt, Homo Sapiens; identical to SEQ ID NO: 80551

SEQ ID NO: 211651 - RNA, 64 nt, Homo Sapiens; identical to SEQ ID NO: 80552

SEQ ID NO: 211652 - RNA, 64 nt, Homo Sapiens; identical to SEQ ID NO: 80553

SEQ ID NO: 211653 - RNA, 64 nt, Homo Sapiens; identical to SEQ ID NO: 80554

SEQ ID NO: 211654 - RNA, 64 nt, Homo Sapiens; identical to SEQ ID NO: 80555

SEQ ID NO: 211655 - RNA, 64 nt, Homo Sapiens; identical to SEQ ID NO: 80556

SEQ ID NO: 211656 - RNA, 64 nt, Homo Sapiens; identical to SEQ ID NO: 80557

SEQ ID NO: 211657 - RNA, 64 nt, Homo Sapiens; identical to SEQ ID NO: 80558

SEQ ID NO: 211658 - RNA, 64 nt, Homo Sapiens; identical to SEQ ID NO: 80559

SEQ ID NO: 211659 - RNA, 64 nt, Homo Sapiens; identical to SEQ ID NO: 80560

SEQ ID NO: 211660 - RNA, 64 nt, Homo Sapiens; identical to SEQ ID NO: 80561

SEQ ID NO: 211661 - RNA, 64 nt, Homo Sapiens; identical to SEQ ID NO: 80562

SEQ ID NO: 211662 - RNA, 64 nt, Homo Sapiens; identical to SEQ ID NO: 80563

SEQ ID NO: 211663 - RNA, 64 nt, Homo Sapiens; identical to SEQ ID NO: 80564

SEQ ID NO: 211664 - RNA, 64 nt, Homo Sapiens; identical to SEQ ID NO: 80565

SEQ ID NO: 211665 - RNA, 64 nt, Homo Sapiens; identical to SEQ ID NO: 80566

SEQ ID NO: 211666 - RNA, 64 nt, Homo Sapiens; identical to SEQ ID NO: 80567

SEQ ID NO: 211667 - RNA, 64 nt, Homo Sapiens; identical to SEQ ID NO: 80568

SEQ ID NO: 211668 - RNA, 64 nt, Homo Sapiens; identical to SEQ ID NO: 80569

SEQ ID NO: 211669 - RNA, 64 nt, Homo Sapiens; identical to SEQ ID NO: 80570

SEQ ID NO: 211670 - RNA, 64 nt, Homo Sapiens; identical to SEQ ID NO: 80571

SEQ ID NO: 211671 - RNA, 64 nt, Homo Sapiens; identical to SEQ ID NO: 80572

SEQ ID NO: 211672 - RNA, 64 nt, Homo Sapiens; identical to SEQ ID NO: 80573

SEQ ID NO: 211673 - RNA, 64 nt, Homo Sapiens; identical to SEQ ID NO: 80574

SEQ ID NO: 211674 - RNA, 64 nt, Homo Sapiens; identical to SEQ ID NO: 80575

SEQ ID NO: 211675 - RNA, 64 nt, Homo Sapiens; identical to SEQ ID NO: 80576

SEQ ID NO: 211676 - RNA, 64 nt, Homo Sapiens; identical to SEQ ID NO: 80577

SEQ ID NO: 211677 - RNA, 64 nt, Homo Sapiens; identical to SEQ ID NO: 80578

SEQ ID NO: 211678 - RNA, 64 nt, Homo Sapiens; identical to SEQ ID NO: 80579

SEQ ID NO: 211679 - RNA, 64 nt, Homo Sapiens; identical to SEQ ID NO: 80580

SEQ ID NO: 211680 - RNA, 64 nt, Homo Sapiens; identical to SEQ ID NO: 80581

SEQ ID NO: 211681 - RNA, 64 nt, Homo Sapiens; identical to SEQ ID NO: 80582

SEQ ID NO: 211682 - RNA, 64 nt, Homo Sapiens; identical to SEQ ID NO: 80583

SEQ ID NO: 211683 - RNA, 64 nt, Homo Sapiens; identical to SEQ ID NO: 80584

SEQ ID NO: 211684 - RNA, 64 nt, Homo Sapiens; identical to SEQ ID NO: 80585

SEQ ID NO: 211685 - RNA, 64 nt, Homo Sapiens; identical to SEQ ID NO: 80586

SEQ ID NO: 211686 - RNA, 64 nt, Homo Sapiens; identical to SEQ ID NO: 80587

SEQ ID NO: 211687 - RNA, 64 nt, Homo Sapiens; identical to SEQ ID NO: 80588

SEQ ID NO: 211688 - RNA, 64 nt, Homo Sapiens; identical to SEQ ID NO: 80589

SEQ ID NO: 211689 - RNA, 64 nt, Homo Sapiens; identical to SEQ ID NO: 80590

SEQ ID NO: 211690 - RNA, 64 nt, Homo Sapiens; identical to SEQ ID NO: 80591

SEQ ID NO: 211691 - RNA, 64 nt, Homo Sapiens; identical to SEQ ID NO: 80592

SEQ ID NO: 211692 - RNA, 64 nt, Homo Sapiens; identical to SEQ ID NO: 80593

SEQ ID NO: 211693 - RNA, 64 nt, Homo Sapiens; identical to SEQ ID NO: 80594

SEQ ID NO: 211694 - RNA, 64 nt, Homo Sapiens; identical to SEQ ID NO: 80595

SEQ ID NO: 211695 - RNA, 64 nt, Homo Sapiens; identical to SEQ ID NO: 80596

SEQ ID NO: 211696 - RNA, 64 nt, Homo Sapiens; identical to SEQ ID NO: 80597

SEQ ID NO: 211697 - RNA, 64 nt, Homo Sapiens
uucaucuccagcuugguguuccauggccccuaggcgaggugaucagggaguggggccaaugggc

SEQ ID NO: 211698 - RNA, 64 nt, Homo Sapiens
ccuguucccugcuccgcuuccccauaccccagcccgaggugaagcccacaccuacacacccucu

SEQ ID NO: 211699 - RNA, 64 nt, Homo Sapiens
cuucuacagaauuuucgucuuuaccuaugugaagcgaggugacgugauacgucacuggcgccgu

SEQ ID NO: 211700 - RNA, 64 nt, Homo Sapiens
ucuugccccugaauuuugcagcugcacugcguuccgaggugaagggcucuccagccgcagcuca

SEQ ID NO: 211701 - RNA, 64 nt, Homo Sapiens
cgggaagauggcuugaacucgcacuuugagaggccgaggugagaggcucacaccuguaauccca

SEQ ID NO: 211702 - RNA, 64 nt, Homo Sapiens
gcaagaaaggugcaagaaagaauguggguguggccgaggugaugguucccaagccuauuggagg

SEQ ID NO: 211703 - RNA, 64 nt, Homo Sapiens
cagggccagggggaccccggcgaauuaacggugucgaggugagcgguuuccuaaaggagacgag

SEQ ID NO: 211704 - RNA, 64 nt, Homo Sapiens
aacagacagggggggucuagcccccgauccuggccgaggugaggacucugcaaaaugggggugu

SEQ ID NO: 211705 - RNA, 64 nt, Homo Sapiens
cacuguaaauccggcauugacagagaggaccuuucgaggugaugcaccaccgccacccagcagu

SEQ ID NO: 211706 - RNA, 64 nt, Homo Sapiens
uuacacuaaguaaguggagggaaugaaaguguuucgaggugaauguggauauaauuucccucuu

SEQ ID NO: 211707 - RNA, 64 nt, Homo Sapiens
ccacccuuugggcucagaggaggguggcuuuuuucgaggugagccauguuguagacacaugaua

SEQ ID NO: 211708 - RNA, 64 nt, Homo Sapiens
ucugaguauaaagauaggucaaaacuuuuugagacgaggugagaucauuggcgcauuaccccau

SEQ ID NO: 211709 - RNA, 64 nt, Homo Sapiens
agaguuggggacagaacuccggauguucuuuuuacgaggugacagaaaaugccaugaauuaccu

SEQ ID NO: 211710 - RNA, 64 nt, Homo Sapiens
uguccgucagugccagugccugugccagagguggcgaggugaguccuccagagcuuccuggccg

SEQ ID NO: 211711 - RNA, 64 nt, Homo Sapiens
ccuacucuguggaugaugugauuguccuggaaaucgaggugaaaggcucaguagaaccuuucca

SEQ ID NO: 211712 - RNA, 64 nt, Homo Sapiens
ggugcgggggcgcacccucucucuucgagaagugcgaggugaacgguucgagcccaacuucaug

SEQ ID NO: 211713 - RNA, 64 nt, Homo Sapiens
uacaccauaugcaugcacuagaauuauuaacuaacgaggugagguauugcaaauguucaaaaaa

SEQ ID NO: 211714 - RNA, 64 nt, Homo Sapiens
agucaauuuuacaauuuguaucagccccugaagacgaggugaaaugauuuagaaaagggacaga

SEQ ID NO: 211715 - RNA, 64 nt, Homo Sapiens
gagacgcagucaggcgcacgcccgcaagaggcggcgaggugacaaguuuggagugcgcccccuu

SEQ ID NO: 211716 - RNA, 64 nt, Homo Sapiens
cccugaaggggcugcugacugccccagaaucugccgaggugagaacagcauccugaggcacagc

SEQ ID NO: 211717 - RNA, 64 nt, Homo Sapiens
ggcucacgccuguaaucccagcacuuugggaggccgaggugagcggaucaccugaggucaggag

SEQ ID NO: 211718 - RNA, 64 nt, Homo Sapiens
acauccucuauugagaguuacagcaaguguuaaacgaggugaguucacauaacaggaauucugg

SEQ ID NO: 211719 - RNA, 64 nt, Homo Sapiens
gggaaauuuuuaaaaaacuauucucaauuauauacgaggugaugggacuucuuaacacacauuu

SEQ ID NO: 211720 - RNA, 64 nt, Homo Sapiens
aguuuaagaaguauucuaaacuguucuagaugaccgaggugaugaguucacauacacuggaagc

SEQ ID NO: 211721 - RNA, 64 nt, Homo Sapiens
gcagacccucccagggaggcccgggaccgugggccgaggugacugcugcuggagcccagucacc

SEQ ID NO: 211722 - RNA, 64 nt, Homo Sapiens
aucaggcagagaggcugggaugauggagaaagcucgaggugaaguuuuaaaaaaaaaguugugg

SEQ ID NO: 211723 - RNA, 64 nt, Homo Sapiens
ucguccugcagcguauuagagcuguaaagggaagcgaggugaagccaacucaggcacaugcuua

SEQ ID NO: 211724 - RNA, 52 nt, Homo Sapiens
cuggaugggggauccaguggcucgaggugaagcugcuggaguuaaggaguag

SEQ ID NO: 211725 - RNA, 64 nt, Homo Sapiens
ccugugguggagcauacacaggguacucuggggucgaggugagaggugaugugguauucagugc

SEQ ID NO: 211726 - RNA, 64 nt, Homo Sapiens
uggaccugcuuacagagcaagccacgccucuuuccgaggugaaggugggaccauuccuugggaa

SEQ ID NO: 211727 - RNA, 64 nt, Homo Sapiens
uccuuaugguaaauguaaacauguagacugcauucgaggugaccuaaaguagagaggucaugaa

SEQ ID NO: 211728 - RNA, 64 nt, Homo Sapiens
ugccaaagugucccuugggucacacagcuaaagccgaggugaccaguuguaccccgagugccag

SEQ ID NO: 211729 - RNA, 64 nt, Homo Sapiens
gcagaucaggggcucuggggaaacugcuggaacucgaggugaggaucagccuuuuccagcaucc

SEQ ID NO: 211730 - RNA, 64 nt, Homo Sapiens
uggacagagcucaaagaggcccucuuaccgcuagcgaggugauaggacaucuggcuugccacaa

SEQ ID NO: 211731 - RNA, 64 nt, Homo Sapiens
caagggcucugcuggucuuucugagucacagcugcgaggugaugggggcuggggccccaggcgu

SEQ ID NO: 211732 - RNA, 64 nt, Homo Sapiens
ccgcuucagaaccucaaaugaucccgcauggguucgaggugagggggaauugcacucuuggaag

SEQ ID NO: 211733 - RNA, 64 nt, Homo Sapiens
gauucuuggucaggugugcccacagaugcggaggcgaggugagugauuccaucauuucaguucu

SEQ ID NO: 211734 - RNA, 64 nt, Homo Sapiens
uagcagauacauggcaacguacugcccacaccaacgaggugaucgccuggcugcaggccugacu

SEQ ID NO: 211735 - RNA, 64 nt, Homo Sapiens
accgguggcuucucgcugcgcagccuccagggcccgaggugaucccgguggugggauccacgcu

SEQ ID NO: 211736 - RNA, 64 nt, Homo Sapiens
ugcucauuuucuggucugaccggcggaacccccacgaggugaagccagccuaugccaccaggua

SEQ ID NO: 211737 - RNA, 64 nt, Homo Sapiens
agaugucucaccacaaagaaggaggauaagggagcgaggugauggauauguuaauuagcuugau

SEQ ID NO: 211738 - RNA, 64 nt, Homo Sapiens
ggaucacuugagcccaggaagcacuuugggaggccgaggugaaacaggcacgccuguaauccca

SEQ ID NO: 211739 - RNA, 64 nt, Homo Sapiens
cugcagauaacccuauacauuaauacugguaucucgaggugacucuucugaccaagggugguua

SEQ ID NO: 211740 - RNA, 64 nt, Homo Sapiens
gguguguauauauaaaagguuguguacaacuccacgaggugaaaaauauucaguaacuuguuua

SEQ ID NO: 211741 - RNA, 64 nt, Homo Sapiens
ccccgccugcucuuuccuccgcucuuuccucccccgaggugaggcucccaguauggccccaccu

SEQ ID NO: 211742 - RNA, 64 nt, Homo Sapiens
caccuugcuccccgggaacccauggaaggagaagcgaggugaugcagcagcaggggcaagaccc

SEQ ID NO: 211743 - RNA, 64 nt, Homo Sapiens; identical to SEQ ID NO: 108616

SEQ ID NO: 211744 - RNA, 64 nt, Homo Sapiens; identical to SEQ ID NO: 108617

SEQ ID NO: 211745 - RNA, 64 nt, Homo Sapiens; identical to SEQ ID NO: 108618

SEQ ID NO: 211746 - RNA, 64 nt, Homo Sapiens; identical to SEQ ID NO: 108619

SEQ ID NO: 211747 - RNA, 64 nt, Homo Sapiens; identical to SEQ ID NO: 108620

SEQ ID NO: 211748 - RNA, 64 nt, Homo Sapiens; identical to SEQ ID NO: 108621

SEQ ID NO: 211749 - RNA, 64 nt, Homo Sapiens; identical to SEQ ID NO: 108622

SEQ ID NO: 211750 - RNA, 64 nt, Homo Sapiens; identical to SEQ ID NO: 108623

SEQ ID NO: 211751 - RNA, 61 nt, Homo Sapiens; identical to SEQ ID NO: 108624

SEQ ID NO: 211752 - RNA, 64 nt, Homo Sapiens; identical to SEQ ID NO: 108625

SEQ ID NO: 211753 - RNA, 64 nt, Homo Sapiens; identical to SEQ ID NO: 108626

SEQ ID NO: 211754 - RNA, 64 nt, Homo Sapiens; identical to SEQ ID NO: 108627

SEQ ID NO: 211755 - RNA, 64 nt, Homo Sapiens; identical to SEQ ID NO: 108628

SEQ ID NO: 211756 - RNA, 64 nt, Homo Sapiens; identical to SEQ ID NO: 108629

SEQ ID NO: 211757 - RNA, 64 nt, Homo Sapiens; identical to SEQ ID NO: 108630

SEQ ID NO: 211758 - RNA, 64 nt, Homo Sapiens; identical to SEQ ID NO: 108631

SEQ ID NO: 211759 - RNA, 64 nt, Homo Sapiens; identical to SEQ ID NO: 108632

SEQ ID NO: 211760 - RNA, 64 nt, Homo Sapiens; identical to SEQ ID NO: 108633

SEQ ID NO: 211761 - RNA, 64 nt, Homo Sapiens; identical to SEQ ID NO: 108634

SEQ ID NO: 211762 - RNA, 64 nt, Homo Sapiens; identical to SEQ ID NO: 108635

SEQ ID NO: 211763 - RNA, 64 nt, Homo Sapiens; identical to SEQ ID NO: 108636

SEQ ID NO: 211764 - RNA, 64 nt, Homo Sapiens; identical to SEQ ID NO: 108637

SEQ ID NO: 211765 - RNA, 64 nt, Homo Sapiens; identical to SEQ ID NO: 108638

SEQ ID NO: 211766 - RNA, 64 nt, Homo Sapiens; identical to SEQ ID NO: 108639

SEQ ID NO: 211767 - RNA, 64 nt, Homo Sapiens; identical to SEQ ID NO: 108640

SEQ ID NO: 211768 - RNA, 64 nt, Homo Sapiens; identical to SEQ ID NO: 108641

SEQ ID NO: 211769 - RNA, 64 nt, Homo Sapiens; identical to SEQ ID NO: 108642

SEQ ID NO: 211770 - RNA, 64 nt, Homo Sapiens; identical to SEQ ID NO: 108643

SEQ ID NO: 211771 - RNA, 64 nt, Homo Sapiens; identical to SEQ ID NO: 108644

SEQ ID NO: 211772 - RNA, 64 nt, Homo Sapiens; identical to SEQ ID NO: 108645

SEQ ID NO: 211773 - RNA, 64 nt, Homo Sapiens; identical to SEQ ID NO: 108646

SEQ ID NO: 211774 - RNA, 64 nt, Homo Sapiens; identical to SEQ ID NO: 108647

SEQ ID NO: 211775 - RNA, 64 nt, Homo Sapiens; identical to SEQ ID NO: 108648

SEQ ID NO: 211776 - RNA, 64 nt, Homo Sapiens; identical to SEQ ID NO: 108649

SEQ ID NO: 211777 - RNA, 64 nt, Homo Sapiens; identical to SEQ ID NO: 108650

SEQ ID NO: 211778 - RNA, 64 nt, Homo Sapiens; identical to SEQ ID NO: 108651

SEQ ID NO: 211779 - RNA, 64 nt, Homo Sapiens; identical to SEQ ID NO: 108652

SEQ ID NO: 211780 - RNA, 64 nt, Homo Sapiens; identical to SEQ ID NO: 108653

SEQ ID NO: 211781 - RNA, 64 nt, Homo Sapiens; identical to SEQ ID NO: 108654

SEQ ID NO: 211782 - RNA, 64 nt, Homo Sapiens; identical to SEQ ID NO: 108655

SEQ ID NO: 211783 - RNA, 64 nt, Homo Sapiens; identical to SEQ ID NO: 108656

SEQ ID NO: 211784 - RNA, 64 nt, Homo Sapiens; identical to SEQ ID NO: 108657

SEQ ID NO: 211785 - RNA, 64 nt, Homo Sapiens; identical to SEQ ID NO: 108658

SEQ ID NO: 211786 - RNA, 64 nt, Homo Sapiens; identical to SEQ ID NO: 108659

SEQ ID NO: 211787 - RNA, 64 nt, Homo Sapiens; identical to SEQ ID NO: 108660

SEQ ID NO: 211788 - RNA, 64 nt, Homo Sapiens; identical to SEQ ID NO: 108661

SEQ ID NO: 211789 - RNA, 64 nt, Homo Sapiens; identical to SEQ ID NO: 108662

SEQ ID NO: 211790 - RNA, 64 nt, Homo Sapiens; identical to SEQ ID NO: 108663

SEQ ID NO: 211791 - RNA, 64 nt, Homo Sapiens; identical to SEQ ID NO: 108664

SEQ ID NO: 211792 - RNA, 64 nt, Homo Sapiens; identical to SEQ ID NO: 108665

SEQ ID NO: 211793 - RNA, 64 nt, Homo Sapiens; identical to SEQ ID NO: 108666

SEQ ID NO: 211794 - RNA, 64 nt, Homo Sapiens; identical to SEQ ID NO: 108667

SEQ ID NO: 211795 - RNA, 64 nt, Homo Sapiens; identical to SEQ ID NO: 108668

SEQ ID NO: 211796 - RNA, 64 nt, Homo Sapiens; identical to SEQ ID NO: 108669

SEQ ID NO: 211797 - RNA, 64 nt, Homo Sapiens; identical to SEQ ID NO: 108670

SEQ ID NO: 211798 - RNA, 64 nt, Homo Sapiens; identical to SEQ ID NO: 108671

SEQ ID NO: 211799 - RNA, 64 nt, Homo Sapiens; identical to SEQ ID NO: 108672

SEQ ID NO: 211800 - RNA, 64 nt, Homo Sapiens; identical to SEQ ID NO: 108673

SEQ ID NO: 211801 - RNA, 64 nt, Homo Sapiens; identical to SEQ ID NO: 108674

SEQ ID NO: 211802 - RNA, 64 nt, Homo Sapiens; identical to SEQ ID NO: 108675

SEQ ID NO: 211803 - RNA, 64 nt, Homo Sapiens; identical to SEQ ID NO: 108676

SEQ ID NO: 211804 - RNA, 64 nt, Homo Sapiens; identical to SEQ ID NO: 108677

SEQ ID NO: 211805 - RNA, 64 nt, Homo Sapiens; identical to SEQ ID NO: 108678

SEQ ID NO: 211806 - RNA, 64 nt, Homo Sapiens; identical to SEQ ID NO: 108679

SEQ ID NO: 211807 - RNA, 64 nt, Homo Sapiens; identical to SEQ ID NO: 108680

SEQ ID NO: 211808 - RNA, 64 nt, Homo Sapiens; identical to SEQ ID NO: 108681

SEQ ID NO: 211809 - RNA, 64 nt, Homo Sapiens; identical to SEQ ID NO: 108682

SEQ ID NO: 211810 - RNA, 64 nt, Homo Sapiens; identical to SEQ ID NO: 108683

SEQ ID NO: 211811 - RNA, 64 nt, Homo Sapiens; identical to SEQ ID NO: 108684

SEQ ID NO: 211812 - RNA, 64 nt, Homo Sapiens; identical to SEQ ID NO: 108685

SEQ ID NO: 211813 - RNA, 64 nt, Homo Sapiens; identical to SEQ ID NO: 108686

SEQ ID NO: 211814 - RNA, 64 nt, Homo Sapiens; identical to SEQ ID NO: 108687

SEQ ID NO: 211815 - RNA, 64 nt, Homo Sapiens; identical to SEQ ID NO: 108688

SEQ ID NO: 211816 - RNA, 64 nt, Homo Sapiens; identical to SEQ ID NO: 108689

SEQ ID NO: 211817 - RNA, 64 nt, Homo Sapiens; identical to SEQ ID NO: 108690

SEQ ID NO: 211818 - RNA, 64 nt, Homo Sapiens; identical to SEQ ID NO: 108691

SEQ ID NO: 211819 - RNA, 64 nt, Homo Sapiens; identical to SEQ ID NO: 108692

SEQ ID NO: 211820 - RNA, 64 nt, Homo Sapiens; identical to SEQ ID NO: 108693

SEQ ID NO: 211821 - RNA, 64 nt, Homo Sapiens; identical to SEQ ID NO: 108694

SEQ ID NO: 211822 - RNA, 64 nt, Homo Sapiens; identical to SEQ ID NO: 108695

SEQ ID NO: 211823 - RNA, 64 nt, Homo Sapiens; identical to SEQ ID NO: 108696

SEQ ID NO: 211824 - RNA, 64 nt, Homo Sapiens; identical to SEQ ID NO: 108697

SEQ ID NO: 211825 - RNA, 64 nt, Homo Sapiens; identical to SEQ ID NO: 108698

SEQ ID NO: 211826 - RNA, 64 nt, Homo Sapiens; identical to SEQ ID NO: 108699

SEQ ID NO: 211827 - RNA, 64 nt, Homo Sapiens; identical to SEQ ID NO: 108700

SEQ ID NO: 211828 - RNA, 64 nt, Homo Sapiens; identical to SEQ ID NO: 108701

SEQ ID NO: 211829 - RNA, 64 nt, Homo Sapiens; identical to SEQ ID NO: 108702

SEQ ID NO: 211830 - RNA, 64 nt, Homo Sapiens; identical to SEQ ID NO: 108703

SEQ ID NO: 211831 - RNA, 64 nt, Homo Sapiens; identical to SEQ ID NO: 108704

SEQ ID NO: 211832 - RNA, 64 nt, Homo Sapiens; identical to SEQ ID NO: 108705

SEQ ID NO: 211833 - RNA, 64 nt, Homo Sapiens; identical to SEQ ID NO: 108706

SEQ ID NO: 211834 - RNA, 64 nt, Homo Sapiens; identical to SEQ ID NO: 108707

SEQ ID NO: 211835 - RNA, 64 nt, Homo Sapiens; identical to SEQ ID NO: 108708

SEQ ID NO: 211836 - RNA, 64 nt, Homo Sapiens; identical to SEQ ID NO: 108709

SEQ ID NO: 211837 - RNA, 64 nt, Homo Sapiens; identical to SEQ ID NO: 108710

SEQ ID NO: 211838 - RNA, 64 nt, Homo Sapiens; identical to SEQ ID NO: 108711

SEQ ID NO: 211839 - RNA, 64 nt, Homo Sapiens; identical to SEQ ID NO: 108712

SEQ ID NO: 211840 - RNA, 64 nt, Homo Sapiens; identical to SEQ ID NO: 108713

SEQ ID NO: 211841 - RNA, 64 nt, Homo Sapiens; identical to SEQ ID NO: 108714

SEQ ID NO: 211842 - RNA, 64 nt, Homo Sapiens; identical to SEQ ID NO: 108715

SEQ ID NO: 211843 - RNA, 64 nt, Homo Sapiens; identical to SEQ ID NO: 108716

SEQ ID NO: 211844 - RNA, 64 nt, Homo Sapiens; identical to SEQ ID NO: 108717

SEQ ID NO: 211845 - RNA, 64 nt, Homo Sapiens; identical to SEQ ID NO: 108718

SEQ ID NO: 211846 - RNA, 64 nt, Homo Sapiens; identical to SEQ ID NO: 108719

SEQ ID NO: 211847 - RNA, 64 nt, Homo Sapiens; identical to SEQ ID NO: 108720

SEQ ID NO: 211848 - RNA, 64 nt, Homo Sapiens; identical to SEQ ID NO: 108721

SEQ ID NO: 211849 - RNA, 64 nt, Homo Sapiens; identical to SEQ ID NO: 108722

SEQ ID NO: 211850 - RNA, 64 nt, Homo Sapiens; identical to SEQ ID NO: 108723

SEQ ID NO: 211851 - RNA, 64 nt, Homo Sapiens; identical to SEQ ID NO: 108724

SEQ ID NO: 211852 - RNA, 64 nt, Homo Sapiens; identical to SEQ ID NO: 108725

SEQ ID NO: 211853 - RNA, 64 nt, Homo Sapiens; identical to SEQ ID NO: 108726

SEQ ID NO: 211854 - RNA, 64 nt, Homo Sapiens; identical to SEQ ID NO: 108727

SEQ ID NO: 211855 - RNA, 64 nt, Homo Sapiens; identical to SEQ ID NO: 108728

SEQ ID NO: 211856 - RNA, 64 nt, Homo Sapiens; identical to SEQ ID NO: 108729

SEQ ID NO: 211857 - RNA, 64 nt, Homo Sapiens; identical to SEQ ID NO: 108730

SEQ ID NO: 211858 - RNA, 64 nt, Homo Sapiens; identical to SEQ ID NO: 108731

SEQ ID NO: 211859 - RNA, 64 nt, Homo Sapiens; identical to SEQ ID NO: 108732

SEQ ID NO: 211860 - RNA, 64 nt, Homo Sapiens; identical to SEQ ID NO: 108733

SEQ ID NO: 211861 - RNA, 64 nt, Homo Sapiens; identical to SEQ ID NO: 108734

SEQ ID NO: 211862 - RNA, 64 nt, Homo Sapiens; identical to SEQ ID NO: 108735

SEQ ID NO: 211863 - RNA, 64 nt, Homo Sapiens; identical to SEQ ID NO: 108736

SEQ ID NO: 211864 - RNA, 64 nt, Homo Sapiens; identical to SEQ ID NO: 108737

SEQ ID NO: 211865 - RNA, 64 nt, Homo Sapiens; identical to SEQ ID NO: 108738

SEQ ID NO: 211866 - RNA, 64 nt, Homo Sapiens; identical to SEQ ID NO: 108739

SEQ ID NO: 211867 - RNA, 64 nt, Homo Sapiens; identical to SEQ ID NO: 108740

SEQ ID NO: 211868 - RNA, 64 nt, Homo Sapiens; identical to SEQ ID NO: 108741

SEQ ID NO: 211869 - RNA, 64 nt, Homo Sapiens; identical to SEQ ID NO: 108742

SEQ ID NO: 211870 - RNA, 64 nt, Homo Sapiens; identical to SEQ ID NO: 108743

SEQ ID NO: 211871 - RNA, 64 nt, Homo Sapiens; identical to SEQ ID NO: 108744

SEQ ID NO: 211872 - RNA, 64 nt, Homo Sapiens; identical to SEQ ID NO: 108745

SEQ ID NO: 211873 - RNA, 64 nt, Homo Sapiens; identical to SEQ ID NO: 108746

SEQ ID NO: 211874 - RNA, 64 nt, Homo Sapiens; identical to SEQ ID NO: 108747

SEQ ID NO: 211875 - RNA, 64 nt, Homo Sapiens; identical to SEQ ID NO: 108748

SEQ ID NO: 211876 - RNA, 64 nt, Homo Sapiens; identical to SEQ ID NO: 108749

SEQ ID NO: 211877 - RNA, 64 nt, Homo Sapiens; identical to SEQ ID NO: 108750

SEQ ID NO: 211878 - RNA, 64 nt, Homo Sapiens; identical to SEQ ID NO: 108751

SEQ ID NO: 211879 - RNA, 64 nt, Homo Sapiens; identical to SEQ ID NO: 108752

SEQ ID NO: 211880 - RNA, 64 nt, Homo Sapiens; identical to SEQ ID NO: 108753

SEQ ID NO: 211881 - RNA, 64 nt, Homo Sapiens; identical to SEQ ID NO: 108754

SEQ ID NO: 211882 - RNA, 64 nt, Homo Sapiens; identical to SEQ ID NO: 108755

SEQ ID NO: 211883 - RNA, 64 nt, Homo Sapiens; identical to SEQ ID NO: 108756

SEQ ID NO: 211884 - RNA, 64 nt, Homo Sapiens; identical to SEQ ID NO: 108757

SEQ ID NO: 211885 - RNA, 64 nt, Homo Sapiens; identical to SEQ ID NO: 108758

SEQ ID NO: 211886 - RNA, 64 nt, Homo Sapiens; identical to SEQ ID NO: 108759

SEQ ID NO: 211887 - RNA, 64 nt, Homo Sapiens; identical to SEQ ID NO: 108760

SEQ ID NO: 211888 - RNA, 64 nt, Homo Sapiens; identical to SEQ ID NO: 108761

SEQ ID NO: 211889 - RNA, 64 nt, Homo Sapiens; identical to SEQ ID NO: 108762

SEQ ID NO: 211890 - RNA, 64 nt, Homo Sapiens; identical to SEQ ID NO: 108763

SEQ ID NO: 211891 - RNA, 64 nt, Homo Sapiens; identical to SEQ ID NO: 108764

SEQ ID NO: 211892 - RNA, 64 nt, Homo Sapiens; identical to SEQ ID NO: 108765

SEQ ID NO: 211893 - RNA, 64 nt, Homo Sapiens; identical to SEQ ID NO: 80433

SEQ ID NO: 211894 - RNA, 64 nt, Homo Sapiens; identical to SEQ ID NO: 80434

SEQ ID NO: 211895 - RNA, 64 nt, Homo Sapiens; identical to SEQ ID NO: 80435

SEQ ID NO: 211896 - RNA, 64 nt, Homo Sapiens; identical to SEQ ID NO: 80436

SEQ ID NO: 211897 - RNA, 64 nt, Homo Sapiens; identical to SEQ ID NO: 80437

SEQ ID NO: 211898 - RNA, 64 nt, Homo Sapiens; identical to SEQ ID NO: 80438

SEQ ID NO: 211899 - RNA, 64 nt, Homo Sapiens; identical to SEQ ID NO: 80439

SEQ ID NO: 211900 - RNA, 64 nt, Homo Sapiens; identical to SEQ ID NO: 80440

SEQ ID NO: 211901 - RNA, 64 nt, Homo Sapiens; identical to SEQ ID NO: 80441

SEQ ID NO: 211902 - RNA, 64 nt, Homo Sapiens; identical to SEQ ID NO: 80442

SEQ ID NO: 211903 - RNA, 64 nt, Homo Sapiens
cugcaaugaagcagccacuucugguuuuuaaacaagguccaaccucgguaaggaaaugucaaau

SEQ ID NO: 211904 - RNA, 64 nt, Homo Sapiens
augagccagggcugccuccacagccacaccaccgagguccaagucugcauggauaguccugggc

SEQ ID NO: 211905 - RNA, 64 nt, Homo Sapiens; identical to SEQ ID NO: 51723

SEQ ID NO: 211906 - RNA, 64 nt, Homo Sapiens; identical to SEQ ID NO: 51724

SEQ ID NO: 211907 - RNA, 64 nt, Homo Sapiens; identical to SEQ ID NO: 51725

SEQ ID NO: 211908 - RNA, 64 nt, Homo Sapiens; identical to SEQ ID NO: 51726

SEQ ID NO: 211909 - RNA, 64 nt, Homo Sapiens; identical to SEQ ID NO: 51727

SEQ ID NO: 211910 - RNA, 64 nt, Homo Sapiens; identical to SEQ ID NO: 51728

SEQ ID NO: 211911 - RNA, 64 nt, Homo Sapiens; identical to SEQ ID NO: 51729

SEQ ID NO: 211912 - RNA, 64 nt, Homo Sapiens; identical to SEQ ID NO: 51730

SEQ ID NO: 211913 - RNA, 64 nt, Homo Sapiens; identical to SEQ ID NO: 51731

SEQ ID NO: 211914 - RNA, 64 nt, Homo Sapiens; identical to SEQ ID NO: 51732

SEQ ID NO: 211915 - RNA, 64 nt, Homo Sapiens; identical to SEQ ID NO: 51733

SEQ ID NO: 211916 - RNA, 64 nt, Homo Sapiens; identical to SEQ ID NO: 51734

SEQ ID NO: 211917 - RNA, 64 nt, Homo Sapiens; identical to SEQ ID NO: 51735

SEQ ID NO: 211918 - RNA, 64 nt, Homo Sapiens; identical to SEQ ID NO: 51736

SEQ ID NO: 211919 - RNA, 64 nt, Homo Sapiens; identical to SEQ ID NO: 51737

SEQ ID NO: 211920 - RNA, 64 nt, Homo Sapiens; identical to SEQ ID NO: 51738

SEQ ID NO: 211921 - RNA, 64 nt, Homo Sapiens; identical to SEQ ID NO: 51739

SEQ ID NO: 211922 - RNA, 64 nt, Homo Sapiens; identical to SEQ ID NO: 51740

SEQ ID NO: 211923 - RNA, 64 nt, Homo Sapiens; identical to SEQ ID NO: 51741

SEQ ID NO: 211924 - RNA, 64 nt, Homo Sapiens; identical to SEQ ID NO: 51742

SEQ ID NO: 211925 - RNA, 64 nt, Homo Sapiens; identical to SEQ ID NO: 51743

SEQ ID NO: 211926 - RNA, 64 nt, Homo Sapiens; identical to SEQ ID NO: 51744

SEQ ID NO: 211927 - RNA, 64 nt, Homo Sapiens; identical to SEQ ID NO: 51745

SEQ ID NO: 211928 - RNA, 64 nt, Homo Sapiens; identical to SEQ ID NO: 51746

SEQ ID NO: 211929 - RNA, 64 nt, Homo Sapiens; identical to SEQ ID NO: 51747

SEQ ID NO: 211930 - RNA, 64 nt, Homo Sapiens; identical to SEQ ID NO: 51748

SEQ ID NO: 211931 - RNA, 64 nt, Homo Sapiens; identical to SEQ ID NO: 182949

SEQ ID NO: 211932 - RNA, 64 nt, Homo Sapiens; identical to SEQ ID NO: 182950

SEQ ID NO: 211933 - RNA, 64 nt, Homo Sapiens; identical to SEQ ID NO: 182951

SEQ ID NO: 211934 - RNA, 64 nt, Homo Sapiens; identical to SEQ ID NO: 182952

SEQ ID NO: 211935 - RNA, 64 nt, Homo Sapiens; identical to SEQ ID NO: 182953

SEQ ID NO: 211936 - RNA, 64 nt, Homo Sapiens; identical to SEQ ID NO: 182954

SEQ ID NO: 211937 - RNA, 64 nt, Homo Sapiens; identical to SEQ ID NO: 51723

SEQ ID NO: 211938 - RNA, 64 nt, Homo Sapiens; identical to SEQ ID NO: 51724

SEQ ID NO: 211939 - RNA, 64 nt, Homo Sapiens; identical to SEQ ID NO: 51725

SEQ ID NO: 211940 - RNA, 64 nt, Homo Sapiens; identical to SEQ ID NO: 51726

SEQ ID NO: 211941 - RNA, 64 nt, Homo Sapiens; identical to SEQ ID NO: 51727

SEQ ID NO: 211942 - RNA, 64 nt, Homo Sapiens; identical to SEQ ID NO: 51728

SEQ ID NO: 211943 - RNA, 64 nt, Homo Sapiens; identical to SEQ ID NO: 51729

SEQ ID NO: 211944 - RNA, 64 nt, Homo Sapiens; identical to SEQ ID NO: 51730

SEQ ID NO: 211945 - RNA, 64 nt, Homo Sapiens; identical to SEQ ID NO: 51731

SEQ ID NO: 211946 - RNA, 64 nt, Homo Sapiens; identical to SEQ ID NO: 51732

SEQ ID NO: 211947 - RNA, 64 nt, Homo Sapiens; identical to SEQ ID NO: 51733

SEQ ID NO: 211948 - RNA, 64 nt, Homo Sapiens; identical to SEQ ID NO: 51734

SEQ ID NO: 211949 - RNA, 64 nt, Homo Sapiens; identical to SEQ ID NO: 51735

SEQ ID NO: 211950 - RNA, 64 nt, Homo Sapiens; identical to SEQ ID NO: 51736

SEQ ID NO: 211951 - RNA, 64 nt, Homo Sapiens; identical to SEQ ID NO: 51737

SEQ ID NO: 211952 - RNA, 64 nt, Homo Sapiens; identical to SEQ ID NO: 51738

SEQ ID NO: 211953 - RNA, 64 nt, Homo Sapiens; identical to SEQ ID NO: 51739

SEQ ID NO: 211954 - RNA, 64 nt, Homo Sapiens; identical to SEQ ID NO: 51740

SEQ ID NO: 211955 - RNA, 64 nt, Homo Sapiens; identical to SEQ ID NO: 51741

SEQ ID NO: 211956 - RNA, 64 nt, Homo Sapiens; identical to SEQ ID NO: 51742

SEQ ID NO: 211957 - RNA, 64 nt, Homo Sapiens; identical to SEQ ID NO: 51743

SEQ ID NO: 211958 - RNA, 64 nt, Homo Sapiens; identical to SEQ ID NO: 51744

SEQ ID NO: 211959 - RNA, 64 nt, Homo Sapiens; identical to SEQ ID NO: 51745

SEQ ID NO: 211960 - RNA, 64 nt, Homo Sapiens; identical to SEQ ID NO: 51746

SEQ ID NO: 211961 - RNA, 64 nt, Homo Sapiens; identical to SEQ ID NO: 51747

SEQ ID NO: 211962 - RNA, 64 nt, Homo Sapiens; identical to SEQ ID NO: 51748

SEQ ID NO: 211963 - RNA, 64 nt, Homo Sapiens; identical to SEQ ID NO: 182949

SEQ ID NO: 211964 - RNA, 64 nt, Homo Sapiens; identical to SEQ ID NO: 182950

SEQ ID NO: 211965 - RNA, 64 nt, Homo Sapiens; identical to SEQ ID NO: 182951

SEQ ID NO: 211966 - RNA, 64 nt, Homo Sapiens; identical to SEQ ID NO: 182952

SEQ ID NO: 211967 - RNA, 64 nt, Homo Sapiens; identical to SEQ ID NO: 182953

SEQ ID NO: 211968 - RNA, 64 nt, Homo Sapiens; identical to SEQ ID NO: 182954

SEQ ID NO: 211969 - RNA, 64 nt, Homo Sapiens
ucguagcuguauuuauuggccaucuguuuuguuuuucaaacagguagcacaugccagagguuca

SEQ ID NO: 211970 - RNA, 64 nt, Homo Sapiens
cacaguucacauugcuaguaauuuaaauuuucuuuucaaacaggcuaaugcuuagugccugagu

SEQ ID NO: 211971 - RNA, 60 nt, Homo Sapiens
uuuuuuaacuuuuuuaaauuuauguacauauucaaacacaauucaaccacuucuguguga

SEQ ID NO: 211972 - RNA, 64 nt, Homo Sapiens
cacuaaucagcuccuggauuuuuuuuuuuuuuuuuucaaacaaugguuugaaacaacuacugga

SEQ ID NO: 211973 - RNA, 64 nt, Homo Sapiens
aaauauaacugacuguauacuauagugguaacuuuucaaacagcccuuagcacuuuuauacuaa

SEQ ID NO: 211974 - RNA, 64 nt, Homo Sapiens
ugugguguaaugaucuuuguguuuuuguauaguuuucaaacaucguugcauuaauuguauaagg

SEQ ID NO: 211975 - RNA, 64 nt, Homo Sapiens
guugcauuaauuguauaaggcugugugcuaauaauucaaacaauauucuguggauucuuuaaac

SEQ ID NO: 211976 - RNA, 64 nt, Homo Sapiens
accuacucugcaaaccuuggacccacagaagguguucaaacacaucaacuuggaaaugacacag

SEQ ID NO: 211977 - RNA, 64 nt, Homo Sapiens
ugucagagaagaaaaacgugguauuucacugaauuucaaacauucuucauccuugacuccuuug

SEQ ID NO: 211978 - RNA, 64 nt, Homo Sapiens
uaacuuuuauaugaaaaaaacuuccugcagacauuucaaacaugaaccugucugaugguggcau

SEQ ID NO: 211979 - RNA, 64 nt, Homo Sapiens
acaaaggaaaaauauagaaacuuacuuagcccaguucaaacagaaacagcagggucuaacugug

SEQ ID NO: 211980 - RNA, 64 nt, Homo Sapiens
uguccuggaugaugguccauuaacuggauauuucuucaaacagaucuaaccuuugaaaauauua

SEQ ID NO: 211981 - RNA, 64 nt, Homo Sapiens
uuaucuguauuuaaauguauaacaaacuggaauuuucaaacagacugcagauguuuuuucuuuu

SEQ ID NO: 211982 - RNA, 64 nt, Homo Sapiens
ccucuaaaaauguaaaaaccuuaguuuguuuuuuuucaaacaacuacauucuucuugcuguugu

SEQ ID NO: 211983 - RNA, 64 nt, Homo Sapiens
agugccucauuuuagaaauguggaaauguacauauucaaacagauaccagauguaauuauguuu

SEQ ID NO: 211984 - RNA, 64 nt, Homo Sapiens
aaggaguugaacaugcuuccuugugucaugccucuucaaacaccaaccacuaagggcucuaugu

SEQ ID NO: 211985 - RNA, 64 nt, Homo Sapiens
uaccgguuaaccaugacuacagacucugauaggauucaaacagaguuuaacacggccugauuca

SEQ ID NO: 211986 - RNA, 64 nt, Homo Sapiens
uguuuguguaccuuuugccauuucagucauucuuuucaaacaaguuguucuuugaaaguagacg

SEQ ID NO: 211987 - RNA, 64 nt, Homo Sapiens
agcaguacauguucuguuucaaauaagaguaagguucaaacacagaaaggggaaauuuuugguu

SEQ ID NO: 211988 - RNA, 64 nt, Homo Sapiens
uuuuccacuuuccauuuucucacauucuccaauguucaaacauaaagcaguuugguggccuuuu

SEQ ID NO: 211989 - RNA, 64 nt, Homo Sapiens
acuagauggggcucugaaaggaaaggucacauauuucaaacacauuuaagaccacaaguuagaa

SEQ ID NO: 211990 - RNA, 64 nt, Homo Sapiens
cgcgagccaccgcgcccggccccuaaguuaauauuucaaacaaucgaagguaaaacaacauauu

SEQ ID NO: 211991 - RNA, 64 nt, Homo Sapiens
aacaguaccuuuaucucaguaggaaauuaaauaauucaaacaucaaauaacuucaauuuaaggc

SEQ ID NO: 211992 - RNA, 64 nt, Homo Sapiens
uuugcacaaacuuuguaacuuuuguuacugugaauucaaacauuacucuuuggacaguuuggac

SEQ ID NO: 211993 - RNA, 64 nt, Homo Sapiens
aauuacuaacugcccucucccaagauucauuuaguucaaacaguauccguaaacuaggaauaau

SEQ ID NO: 211994 - RNA, 64 nt, Homo Sapiens
ucuccacucaccgcagcguacuuggcacuucaguuucaaacacguaguccuuuaaaacuugauc

SEQ ID NO: 211995 - RNA, 64 nt, Homo Sapiens
agcuguuuugcuaaauuauuuuuacuuggaauguuucaaacagauuucaggcugcaaacuuguu

SEQ ID NO: 211996 - RNA, 64 nt, Homo Sapiens
ucauccaguuuucucuccaucucuuuucuuuguacaaucccauuuccuauuaccauucucugca

SEQ ID NO: 211997 - RNA, 64 nt, Homo Sapiens
cacaugucugcaagaaggccuccaaauauagaaacaaucccauuagucagcaguggacccuguc

SEQ ID NO: 211998 - RNA, 64 nt, Homo Sapiens
ccuucuggauaaccagaugucgguuuuuuuaggccaaucccaucaaaacaauccagaaauugau

SEQ ID NO: 211999 - RNA, 64 nt, Homo Sapiens
gaaauugcuggcauucucaaccacauaccauucucaaucccacuaucacuccaagaaaagagau

SEQ ID NO: 212000 - RNA, 64 nt, Homo Sapiens
uagcccaggagagagcuacggcaugugacacccacaaucccaccgguagucucuucacagggaa

SEQ ID NO: 212001 - RNA, 64 nt, Homo Sapiens
accuuaggaggccgaggcagguggcucacaccugcaaucccagccugcaguauggccagacgug

SEQ ID NO: 212002 - RNA, 64 nt, Homo Sapiens
gcucugccauuccacugcuccuccauccacucgccaaucccaagagucuggccucccuccagcc

SEQ ID NO: 212003 - RNA, 64 nt, Homo Sapiens
uggccugcugcucuuguaguggacuuccugaguccaaucccaccuccugguguagaauuuacac

SEQ ID NO: 212004 - RNA, 64 nt, Homo Sapiens
cuuuuuuuaaugauuuauacaaugacuccaaaggcaaucccaaagaaaagauguaaagaauguu

SEQ ID NO: 212005 - RNA, 64 nt, Homo Sapiens
auuaggucuggccaggcgaagugacucacaccugcaaucccagcacuuugggaggccgaggcgg

SEQ ID NO: 212006 - RNA, 64 nt, Homo Sapiens
auucagagcgcguauggagugguguaagacaucacaaucccauuggccgcccaguuugagaauu

SEQ ID NO: 212007 - RNA, 64 nt, Homo Sapiens; identical to SEQ ID NO: 212006

SEQ ID NO: 212008 - RNA, 64 nt, Homo Sapiens
gauuggaccagacccugaauucuucuagcuccuccaaucccauuuuaucccauggaaccacuaa

SEQ ID NO: 212009 - RNA, 64 nt, Homo Sapiens
aggguaacuuaacagaguaucagaucuaucuugucaaucccaacguuuuacauaaaauaagaga

SEQ ID NO: 212010 - RNA, 64 nt, Homo Sapiens
gugucccuguugugugguggauuaaaugaaaaaacaaucccaugauuuuuauucauuuguauuu

SEQ ID NO: 212011 - RNA, 64 nt, Homo Sapiens
acuuugggagacugaggcggguggcucacgccugcaaucccagcaaauuuggaggcugggugcu

SEQ ID NO: 212012 - RNA, 64 nt, Homo Sapiens; identical to SEQ ID NO: 144448

SEQ ID NO: 212013 - RNA, 64 nt, Homo Sapiens; identical to SEQ ID NO: 144449

SEQ ID NO: 212014 - RNA, 64 nt, Homo Sapiens; identical to SEQ ID NO: 144450

SEQ ID NO: 212015 - RNA, 64 nt, Homo Sapiens; identical to SEQ ID NO: 144451

SEQ ID NO: 212016 - RNA, 64 nt, Homo Sapiens; identical to SEQ ID NO: 144452

SEQ ID NO: 212017 - RNA, 64 nt, Homo Sapiens; identical to SEQ ID NO: 144453

SEQ ID NO: 212018 - RNA, 64 nt, Homo Sapiens; identical to SEQ ID NO: 144454

SEQ ID NO: 212019 - RNA, 64 nt, Homo Sapiens; identical to SEQ ID NO: 144455

SEQ ID NO: 212020 - RNA, 64 nt, Homo Sapiens; identical to SEQ ID NO: 144456

SEQ ID NO: 212021 - RNA, 64 nt, Homo Sapiens; identical to SEQ ID NO: 144457

SEQ ID NO: 212022 - RNA, 64 nt, Homo Sapiens; identical to SEQ ID NO: 144458

SEQ ID NO: 212023 - RNA, 64 nt, Homo Sapiens; identical to SEQ ID NO: 144459

SEQ ID NO: 212024 - RNA, 64 nt, Homo Sapiens; identical to SEQ ID NO: 144460

SEQ ID NO: 212025 - RNA, 64 nt, Homo Sapiens; identical to SEQ ID NO: 144461

SEQ ID NO: 212026 - RNA, 64 nt, Homo Sapiens; identical to SEQ ID NO: 144462

SEQ ID NO: 212027 - RNA, 64 nt, Homo Sapiens; identical to SEQ ID NO: 144463

SEQ ID NO: 212028 - RNA, 64 nt, Homo Sapiens; identical to SEQ ID NO: 144464

SEQ ID NO: 212029 - RNA, 64 nt, Homo Sapiens; identical to SEQ ID NO: 144465

SEQ ID NO: 212030 - RNA, 64 nt, Homo Sapiens; identical to SEQ ID NO: 144466

SEQ ID NO: 212031 - RNA, 64 nt, Homo Sapiens; identical to SEQ ID NO: 144467

SEQ ID NO: 212032 - RNA, 64 nt, Homo Sapiens; identical to SEQ ID NO: 144468

SEQ ID NO: 212033 - RNA, 64 nt, Homo Sapiens; identical to SEQ ID NO: 144469

SEQ ID NO: 212034 - RNA, 64 nt, Homo Sapiens; identical to SEQ ID NO: 144470

SEQ ID NO: 212035 - RNA, 64 nt, Homo Sapiens; identical to SEQ ID NO: 144471

SEQ ID NO: 212036 - RNA, 64 nt, Homo Sapiens; identical to SEQ ID NO: 144472

SEQ ID NO: 212037 - RNA, 64 nt, Homo Sapiens; identical to SEQ ID NO: 144473

SEQ ID NO: 212038 - RNA, 64 nt, Homo Sapiens; identical to SEQ ID NO: 144474

SEQ ID NO: 212039 - RNA, 64 nt, Homo Sapiens; identical to SEQ ID NO: 144475

SEQ ID NO: 212040 - RNA, 64 nt, Homo Sapiens; identical to SEQ ID NO: 144476

SEQ ID NO: 212041 - RNA, 64 nt, Homo Sapiens; identical to SEQ ID NO: 144477

SEQ ID NO: 212042 - RNA, 64 nt, Homo Sapiens; identical to SEQ ID NO: 144478

SEQ ID NO: 212043 - RNA, 64 nt, Homo Sapiens; identical to SEQ ID NO: 144479

SEQ ID NO: 212044 - RNA, 64 nt, Homo Sapiens; identical to SEQ ID NO: 144480

SEQ ID NO: 212045 - RNA, 64 nt, Homo Sapiens; identical to SEQ ID NO: 144481

SEQ ID NO: 212046 - RNA, 64 nt, Homo Sapiens; identical to SEQ ID NO: 144482

SEQ ID NO: 212047 - RNA, 64 nt, Homo Sapiens; identical to SEQ ID NO: 144483

SEQ ID NO: 212048 - RNA, 64 nt, Homo Sapiens; identical to SEQ ID NO: 144484

SEQ ID NO: 212049 - RNA, 64 nt, Homo Sapiens; identical to SEQ ID NO: 144485

SEQ ID NO: 212050 - RNA, 64 nt, Homo Sapiens; identical to SEQ ID NO: 144486

SEQ ID NO: 212051 - RNA, 62 nt, Homo Sapiens; identical to SEQ ID NO: 144487

SEQ ID NO: 212052 - RNA, 64 nt, Homo Sapiens; identical to SEQ ID NO: 144488

SEQ ID NO: 212053 - RNA, 64 nt, Homo Sapiens; identical to SEQ ID NO: 144489

SEQ ID NO: 212054 - RNA, 64 nt, Homo Sapiens; identical to SEQ ID NO: 144490

SEQ ID NO: 212055 - RNA, 64 nt, Homo Sapiens; identical to SEQ ID NO: 144491

SEQ ID NO: 212056 - RNA, 64 nt, Homo Sapiens; identical to SEQ ID NO: 144492

SEQ ID NO: 212057 - RNA, 64 nt, Homo Sapiens; identical to SEQ ID NO: 144493

SEQ ID NO: 212058 - RNA, 64 nt, Homo Sapiens; identical to SEQ ID NO: 144494

SEQ ID NO: 212059 - RNA, 64 nt, Homo Sapiens; identical to SEQ ID NO: 144495

SEQ ID NO: 212060 - RNA, 64 nt, Homo Sapiens; identical to SEQ ID NO: 144496

SEQ ID NO: 212061 - RNA, 64 nt, Homo Sapiens; identical to SEQ ID NO: 144497

SEQ ID NO: 212062 - RNA, 64 nt, Homo Sapiens; identical to SEQ ID NO: 144498

SEQ ID NO: 212063 - RNA, 64 nt, Homo Sapiens; identical to SEQ ID NO: 144499

SEQ ID NO: 212064 - RNA, 64 nt, Homo Sapiens; identical to SEQ ID NO: 144500

SEQ ID NO: 212065 - RNA, 64 nt, Homo Sapiens; identical to SEQ ID NO: 144501

SEQ ID NO: 212066 - RNA, 64 nt, Homo Sapiens; identical to SEQ ID NO: 144502

SEQ ID NO: 212067 - RNA, 64 nt, Homo Sapiens; identical to SEQ ID NO: 144503

SEQ ID NO: 212068 - RNA, 64 nt, Homo Sapiens; identical to SEQ ID NO: 144504

SEQ ID NO: 212069 - RNA, 64 nt, Homo Sapiens
ccaacuacauuaccaugcugugccucaguuuacccauuuguaaaaugggauuaauaauacuuac

SEQ ID NO: 212070 - RNA, 64 nt, Homo Sapiens
aggauuuuuggguuuaagaugcacuuuuagcacacauuuguauuucccuuggcauaucagauug

SEQ ID NO: 212071 - RNA, 64 nt, Homo Sapiens
uuugcucccuuauguucuucggauaugguuauggcauuuguaggcuuggagguaaagaacugaa

SEQ ID NO: 212072 - RNA, 64 nt, Homo Sapiens
uauuggucuagaaacguuaaacuuaauuuuuuuccauuuguacagggguaacgcacuguauuaa

SEQ ID NO: 212073 - RNA, 64 nt, Homo Sapiens
acucagauuugugcccauucagugugcuacggugcauuuguaaccuguuuacaaauuugguuac

SEQ ID NO: 212074 - RNA, 64 nt, Homo Sapiens
cauuuggaaucuaaaccagcgauuaaagugacuucauuuguauaaaauuaagaaguauuuauag

SEQ ID NO: 212075 - RNA, 64 nt, Homo Sapiens
uuguggauguguucauucaaucaccuuuguaagacauuuguauauggcacuuguauuuaauucu

SEQ ID NO: 212076 - RNA, 64 nt, Homo Sapiens
gcuuauuuuauuaugagcuaaaauacagauaauucauuuguauuguaaauguuucuuuucccuu

SEQ ID NO: 212077 - RNA, 64 nt, Homo Sapiens
agguaauuguuuuuuaaagcuaugaaccuauuuucauuuguacauccauuuauuuaugaaaaaa

SEQ ID NO: 212078 - RNA, 64 nt, Homo Sapiens
uuaaaccaauuuuacuuuaugaauauauucaugacauuuguaauaaaugucuugagaaagaauu

SEQ ID NO: 212079 - RNA, 64 nt, Homo Sapiens
uucccucugcucccacccaccuaaacacagcagccauuuguaccuguuugcuucccaucccacu

SEQ ID NO: 212080 - RNA, 64 nt, Homo Sapiens
uuggggaaguaaaagaagauggaaauggauguuucauuuguaugaguuuggagcagugcugaag

SEQ ID NO: 212081 - RNA, 64 nt, Homo Sapiens
aaaguuugcuuagguuuauuacagcaguccuuggcauuuguaugguaauuuguacuuuacaaau

SEQ ID NO: 212082 - RNA, 64 nt, Homo Sapiens
ccuuugaaucuaaguauuuguuuccuaaaugaaacauuuguacaacauuugauguuuuuacuua

SEQ ID NO: 212083 - RNA, 64 nt, Homo Sapiens
ccuucaugcuguaaauggaaguuguacagguguacauuuguaaauaguagugaugcuuuccuug

SEQ ID NO: 212084 - RNA, 64 nt, Homo Sapiens
uuuuuuaagguucuuguguaugacuuuauucauccauuuguaaauuuaaagcaaaacuauuuau

SEQ ID NO: 212085 - RNA, 64 nt, Homo Sapiens
aagugaacugagcgucacacugagaaaugaccugcauuuguaugccauuucauagacauuuuac

SEQ ID NO: 212086 - RNA, 64 nt, Homo Sapiens
ucaguaauucagguacccaucauucauguguugucauuuguauacagaaucucacugcucuuuu

SEQ ID NO: 212087 - RNA, 64 nt, Homo Sapiens
uuauuuuuguauaaaauccacggcauuuaacuuacauuuguacuaaaggugaaaauguuuuauu

SEQ ID NO: 212088 - RNA, 64 nt, Homo Sapiens
aaugagacuuuuucaguggaaaguguaugaguugcauuuguaaagagaaaggguccaugaagga

SEQ ID NO: 212089 - RNA, 64 nt, Homo Sapiens
uaauguguguagacccuccuugcugauguguuuccauuuguauuccaggcuaaugacuugugug

SEQ ID NO: 212090 - RNA, 64 nt, Homo Sapiens
aauguaaugcgguucugaguaucccaacaaaucacauuuguagacagagacaucuuggcaccuc

SEQ ID NO: 212091 - RNA, 64 nt, Homo Sapiens
cagcacugccucucuguuugcauugucacagccucauuuguaaggcacugucauuuguaaaugc

SEQ ID NO: 212092 - RNA, 64 nt, Homo Sapiens
ugccauugucacagccucauguaacuggcacugucauuuguaaagugggaaagcauuuuguacg

SEQ ID NO: 212093 - RNA, 64 nt, Homo Sapiens
gauucacccacgaagguuacauuuaugcugaauacauuuguaaauacucaguuuuauacuguau

SEQ ID NO: 212094 - RNA, 64 nt, Homo Sapiens
aaaacugugcaauacgaauuaugcaaucacaauacauuuguagcucccgaguguccuaaaggga

SEQ ID NO: 212095 - RNA, 64 nt, Homo Sapiens
caugauacuuuaaucagaagcuccauuuauauuacauuuguaaccuuuuagccuuuuuuaaaaa

SEQ ID NO: 212096 - RNA, 64 nt, Homo Sapiens
ccagugcuuaacacauugccagcaccuuuagcugcauuuguaugccaccccacugccuuccuuc

SEQ ID NO: 212097 - RNA, 64 nt, Homo Sapiens
cagcuuauuuuuuucuacauaauugugaccaauacauuuguauuuugugaugaaucuacauuug

SEQ ID NO: 212098 - RNA, 64 nt, Homo Sapiens
uuuuguauuaacaaacacugcaauuuauagauuacauuuguaggaaguuaugcuuuuuucuggu

SEQ ID NO: 212099 - RNA, 64 nt, Homo Sapiens
caucacuagauaauaaagucuuuugugaacaaggcauuuguagccauuuuuaaaaguuuuuguc

SEQ ID NO: 212100 - RNA, 64 nt, Homo Sapiens
uuugcauuccucuuaugcuuuaccuguauuuuaucauuuguaagcagaacucuagcuauauggg

SEQ ID NO: 212101 - RNA, 64 nt, Homo Sapiens
auuccccaugaaaauugcucuacauaucagagaacauuuguacauugucuuucuagugaggaga

SEQ ID NO: 212102 - RNA, 64 nt, Homo Sapiens
cuauauuugaacgacauuccuauccuuuauauuucauuuguaaaucuuuguuuauccauucuuu

SEQ ID NO: 212103 - RNA, 64 nt, Homo Sapiens
auuggacuuacgacccaaaugaaccucgauacugcauuuguaaucagguaaaagucuguuauau

SEQ ID NO: 212104 - RNA, 64 nt, Homo Sapiens
gccuuggauuauuucaguggccaacauaugcagacauuuguacuccucaaccauuuucucaaag

SEQ ID NO: 212105 - RNA, 64 nt, Homo Sapiens
uguuauuuuuuauuuaaaaacuuuauauuaaagucauuuguaauguuauuguauaguuauugug

SEQ ID NO: 212106 - RNA, 64 nt, Homo Sapiens
uuagcagauacagucucuuagucacuaggcuuugcauuuguauguagcuguauguuuccgucca

SEQ ID NO: 212107 - RNA, 64 nt, Homo Sapiens
aggaaauauuuaaugaauuuucucccuaaauuaucauuuguaaacauuuuuauuuuaaaacuag

SEQ ID NO: 212108 - RNA, 64 nt, Homo Sapiens
uuuauugaaaaguggaauuuuuagugauaaaauacauuuguaaguguaaagcaauacagcauaa

SEQ ID NO: 212109 - RNA, 64 nt, Homo Sapiens
auaauuuguugcauaguguccuuauuuguauaaacauuuguaugcacguuauauuguaauagcu

SEQ ID NO: 212110 - RNA, 64 nt, Homo Sapiens
cauauauauauuuauaaugugucuuuuuauuaaccauuuguacaauaaaugucacuucccaugc

SEQ ID NO: 212111 - RNA, 64 nt, Homo Sapiens
cacaguuuccacaagcaccuauacaccacacaggcauuuguaagcccaggucuccucgaccucc

SEQ ID NO: 212112 - RNA, 64 nt, Homo Sapiens
aaggcaucuccuacucuccaaucuauuuauuucucauuuguaccuguucccuaggcugacuggu

SEQ ID NO: 212113 - RNA, 64 nt, Homo Sapiens
aauguauuuccauaauguguugaaaacaugcuaacauuuguaugauuuuuauacuucugccgaa

SEQ ID NO: 212114 - RNA, 64 nt, Homo Sapiens
uuuucccccuauucaguuuuaaucuuggaauaugcauuuguaaauugugaugucauugagacua

SEQ ID NO: 212115 - RNA, 64 nt, Homo Sapiens
gggucugccagauaggaagaggcuugagauaaugcauuuguaaaaccucaaagaauuguuguga

SEQ ID NO: 212116 - RNA, 64 nt, Homo Sapiens
uuaugaucuuggcuguauuuaguagaccuaaugacauuuguauugugaaugaaucucaagauuc

SEQ ID NO: 212117 - RNA, 64 nt, Homo Sapiens
uguaaaacuuuuaagguauagagugugaaauagacauuuguaaaucgauucuacuuuagaauga

SEQ ID NO: 212118 - RNA, 64 nt, Homo Sapiens
auagucuaauauacaggguaucagacucagacuccauuuguauuuuauuagauaugaguuguuu

SEQ ID NO: 212119 - RNA, 64 nt, Homo Sapiens
guuuuaaaggcuuuuugguguauagaaguuuguccauuuguaaaacuccggauugcguuccucc

SEQ ID NO: 212120 - RNA, 64 nt, Homo Sapiens
cuuccuucuguaaauacccguuaccauauuuauccauuuguaauuaaauuaugguauuaacuug

SEQ ID NO: 212121 - RNA, 64 nt, Homo Sapiens
cugcagcuuugaugugcauauuugaacuuuuuaacauuuguaacuuugguggcaaagagaauuu

SEQ ID NO: 212122 - RNA, 64 nt, Homo Sapiens
acacauaguuuuagcaaauuggaaauaauauauucauuuguauggcaagauaaaugcagucauc

SEQ ID NO: 212123 - RNA, 64 nt, Homo Sapiens
uugcagacagacccaaagugcuacagauguaacucauuuguauaaaaauagagucugccucgua

SEQ ID NO: 212124 - RNA, 64 nt, Homo Sapiens
uuaagcuggaauuauaaugaauggaaaauguucacauuuguagaaguaugguuugagacaacau

SEQ ID NO: 212125 - RNA, 64 nt, Homo Sapiens
auuaaaacuguaaggggccuccaucccucuuacucauuuguagucuaggaaauugagauuuuga

SEQ ID NO: 212126 - RNA, 64 nt, Homo Sapiens
uuuguuuuuuauuucuguugagauauagccuuuacauuuguacacaaaugugacuaugucuugg

SEQ ID NO: 212127 - RNA, 64 nt, Homo Sapiens
uauauuuuaaagucagaguuuuccuagcuuagagcauuuguaucacuacgguuguggaaaaccu

SEQ ID NO: 212128 - RNA, 64 nt, Homo Sapiens
uaguuaaaagagagugggucuuauaguuuaaguucauuuguaaaugauuauuuguguuucuaau

SEQ ID NO: 212129 - RNA, 64 nt, Homo Sapiens
cuauuggaucaucacuugaacaguuuauugaagacauuuguaaguuuuguucugccucaaagcu

SEQ ID NO: 212130 - RNA, 64 nt, Homo Sapiens
guaaagaucaguuauauauagucacugcuguggucauuuguaauaaaggcagaaaagcaacaca

SEQ ID NO: 212131 - RNA, 64 nt, Homo Sapiens
aaacucccuaauaaauuuagcuguaaagcccaaacauuuguaacuugaauccgugaaaucaugc

SEQ ID NO: 212132 - RNA, 64 nt, Homo Sapiens
auuguuguuguugaaaguccauacaguauguauacauuuguauaucuuggugugucucuaacag

SEQ ID NO: 212133 - RNA, 64 nt, Homo Sapiens
auaaaaacuuggugugggggucuuuuucuuguggcauuuguauuugaggaaacaguaccgaagu

SEQ ID NO: 212134 - RNA, 64 nt, Homo Sapiens
uaagucauuccaucuuucacuuuauaauauguugcauuuguacuacuuuuuuuguaagaaauug

SEQ ID NO: 212135 - RNA, 64 nt, Homo Sapiens
cacuaucaugauauuuucaacucaaaguugugugcauuuguaaagaaggauuuguaaagcuuug

SEQ ID NO: 212136 - RNA, 64 nt, Homo Sapiens
ugagcagaacuguuuuguuguugucuaauugacucauuuguaaauucagaaguugcugcuuugu

SEQ ID NO: 212137 - RNA, 64 nt, Homo Sapiens
acucaaaugaccacauaaagaccauuagagaaaccauuuguaaacacauaaaugauuuuggcau

SEQ ID NO: 212138 - RNA, 64 nt, Homo Sapiens
gcaaagaucaagauaagcuggaugaaguagugugcauuuguaauacuauugcaagacuccuccc

SEQ ID NO: 212139 - RNA, 64 nt, Homo Sapiens
aaaauguguuccauuuuaguguaaagauguguaucauuuguaauugugugugaccugacuguga

SEQ ID NO: 212140 - RNA, 64 nt, Homo Sapiens
acaagucucugucuuuuaauaaaagaacuuuacacauuuguaaaaaagagguucuugguaagau

SEQ ID NO: 212141 - RNA, 64 nt, Homo Sapiens
augugaauaucauauuuuugaaagguaaaaaguacauuuguauauuacauauauggacauaacu

SEQ ID NO: 212142 - RNA, 64 nt, Homo Sapiens
auacuggaaaagauuguugugcauaguuauuagucauuuguaaccuugcuuaaguauuucuuag

SEQ ID NO: 212143 - RNA, 64 nt, Homo Sapiens
cuguuuucuguucuguaagucuagaccuucaaaccauuuguaaacuaaccccugggaaauuuga

SEQ ID NO: 212144 - RNA, 64 nt, Homo Sapiens
aagaaacugguccauguaaauuuucauguuuuagcauuuguauacucuaucugguuuugggugu

SEQ ID NO: 212145 - RNA, 64 nt, Homo Sapiens
uauguggcuguaaugacaaaaugccuuuugaauacauuuguauuuagcaauaaaugcuuuucua

SEQ ID NO: 212146 - RNA, 64 nt, Homo Sapiens
uuaaggacugccacucucuucagacagaaucugauuauuccagcuugagagaagcacucuguuu

SEQ ID NO: 212147 - RNA, 64 nt, Homo Sapiens
gcaggaugcagggauuaauaaggacacauacacauuauuccaccaauugacuuugaaaagugga

SEQ ID NO: 212148 - RNA, 64 nt, Homo Sapiens
uucuuaaaggggaacaaaugaucuugacaacauauuauuccauaaaaccaguuuagggcacagg

SEQ ID NO: 212149 - RNA, 64 nt, Homo Sapiens
ucucucugugucugugccaagucagaacuauaauuuauuccauuuuucuacauugucccugagu

SEQ ID NO: 212150 - RNA, 64 nt, Homo Sapiens
cccagggauguaggagggggaaaggccacagccuuuauuccaggguuccaucuucccccuuccc

SEQ ID NO: 212151 - RNA, 64 nt, Homo Sapiens
aaaaaacagcagaccaacauaugccaagaaugcauuauuccacacauauugaaaccuuuuaagg

SEQ ID NO: 212152 - RNA, 64 nt, Homo Sapiens
aguuuuuugagucuugagcucaguccaguugggauuauuccaaaagcauuguuguccuucacug

SEQ ID NO: 212153 - RNA, 64 nt, Homo Sapiens
gaaugaccuggaacaggccuuagaaacaauugauuuauuccaauaguuaaccacuggcuggcuc

SEQ ID NO: 212154 - RNA, 64 nt, Homo Sapiens
uagagcuaggucaaaaaaacaacuguuucuuuucuuauuccacuauuaauaaauugaaagcuug

SEQ ID NO: 212155 - RNA, 64 nt, Homo Sapiens
uuuacacaauuaaaauugcaucuggguuggaggcuuauuccauguguuccagugaaaauggagu

SEQ ID NO: 212156 - RNA, 64 nt, Homo Sapiens
ggguuucucuccugugcagccuuuccagaauuauuuauuccauaguuucauuuguugcugaaug

SEQ ID NO: 212157 - RNA, 64 nt, Homo Sapiens
aaacuauuaaaaugauagauuguggagaaaguaauuauuccaacacccaucugccaugcgaugu

SEQ ID NO: 212158 - RNA, 64 nt, Homo Sapiens
uacuuuuuuauggcacauauuagcauauaagccuuuauuccaagagguauuuauuuuuucacuu

SEQ ID NO: 212159 - RNA, 64 nt, Homo Sapiens
caaaauuucuggugaauuacuuuuuuuuuucuaauuauuccaucgaguuacauguuuuaaccuc

SEQ ID NO: 212160 - RNA, 64 nt, Homo Sapiens
cagcaguuugacuuuguaaaauaaaacauacaguuuauuccacaauggaaugucccaguuuaau

SEQ ID NO: 212161 - RNA, 64 nt, Homo Sapiens
ucucaagauauauuauaaaaacauauuaaagccuuuauuccauccacuaaacacuccuuuuuug

SEQ ID NO: 212162 - RNA, 64 nt, Homo Sapiens
cuucuuuauuauugauaauuugacacgauagaucuuauuccauaaaaauauuuuuggauagcgu

SEQ ID NO: 212163 - RNA, 64 nt, Homo Sapiens
auuuaaauguuuauaacauaguuuaauuuuauauuuauuccagauaguauuuaauuuagugcuu

SEQ ID NO: 212164 - RNA, 64 nt, Homo Sapiens
caaacuucaaaaaguuaauuauugucauaaugcauuauuccauguguggugucaauacauuuua

SEQ ID NO: 212165 - RNA, 64 nt, Homo Sapiens
uaugguuaaguagugagaaauguuucuucaaagguuauuccaggugucuaaaguuugcuaguag

SEQ ID NO: 212166 - RNA, 64 nt, Homo Sapiens
uuucaaugauuuuucaaaauugagucucagaugauuauuccagucugcauguuugugaucacug

SEQ ID NO: 212167 - RNA, 64 nt, Homo Sapiens
uguccuauggggaaauuuacucaguaggacauuuuuauuccaucaacagauugagguuagagga

SEQ ID NO: 212168 - RNA, 64 nt, Homo Sapiens
uuccagagagaagagaaaacagggaaaagauucuuuauuccaauguguuuguuuugguucuugg

SEQ ID NO: 212169 - RNA, 64 nt, Homo Sapiens
uuuccagaccggaccaauguguccccaauuccaguuauuccaccaucuaccugugacccagaag

SEQ ID NO: 212170 - RNA, 64 nt, Homo Sapiens
caauauggcuuguaucucuuaucauuuagcaauauuauuccauucuacaucacauucaguuaua

SEQ ID NO: 212171 - RNA, 64 nt, Homo Sapiens
uuuucaguuuuaauacuuuuauguccacuuauucacuagguaaauggauagauucucaauuguu

SEQ ID NO: 212172 - RNA, 64 nt, Homo Sapiens
agaggaaggauuugagaaaucuggaacugaaggaacuagguagguuagcugugucccuguagcu

SEQ ID NO: 212173 - RNA, 64 nt, Homo Sapiens; identical to SEQ ID NO: 156143

SEQ ID NO: 212174 - RNA, 64 nt, Homo Sapiens; identical to SEQ ID NO: 156144

SEQ ID NO: 212175 - RNA, 64 nt, Homo Sapiens; identical to SEQ ID NO: 156145

SEQ ID NO: 212176 - RNA, 64 nt, Homo Sapiens; identical to SEQ ID NO: 156146

SEQ ID NO: 212177 - RNA, 64 nt, Homo Sapiens; identical to SEQ ID NO: 156147

SEQ ID NO: 212178 - RNA, 64 nt, Homo Sapiens; identical to SEQ ID NO: 156148

SEQ ID NO: 212179 - RNA, 64 nt, Homo Sapiens; identical to SEQ ID NO: 156149

SEQ ID NO: 212180 - RNA, 64 nt, Homo Sapiens; identical to SEQ ID NO: 156150

SEQ ID NO: 212181 - RNA, 64 nt, Homo Sapiens; identical to SEQ ID NO: 156151

SEQ ID NO: 212182 - RNA, 64 nt, Homo Sapiens; identical to SEQ ID NO: 156152

SEQ ID NO: 212183 - RNA, 64 nt, Homo Sapiens; identical to SEQ ID NO: 156153

SEQ ID NO: 212184 - RNA, 64 nt, Homo Sapiens; identical to SEQ ID NO: 156154

SEQ ID NO: 212185 - RNA, 64 nt, Homo Sapiens; identical to SEQ ID NO: 156155

SEQ ID NO: 212186 - RNA, 64 nt, Homo Sapiens; identical to SEQ ID NO: 156156

SEQ ID NO: 212187 - RNA, 64 nt, Homo Sapiens; identical to SEQ ID NO: 156157

SEQ ID NO: 212188 - RNA, 64 nt, Homo Sapiens; identical to SEQ ID NO: 156158

SEQ ID NO: 212189 - RNA, 64 nt, Homo Sapiens; identical to SEQ ID NO: 156159

SEQ ID NO: 212190 - RNA, 64 nt, Homo Sapiens; identical to SEQ ID NO: 156160

SEQ ID NO: 212191 - RNA, 64 nt, Homo Sapiens; identical to SEQ ID NO: 156161

SEQ ID NO: 212192 - RNA, 64 nt, Homo Sapiens; identical to SEQ ID NO: 156162

SEQ ID NO: 212193 - RNA, 64 nt, Homo Sapiens; identical to SEQ ID NO: 156163

SEQ ID NO: 212194 - RNA, 64 nt, Homo Sapiens; identical to SEQ ID NO: 156164

SEQ ID NO: 212195 - RNA, 64 nt, Homo Sapiens; identical to SEQ ID NO: 156165

SEQ ID NO: 212196 - RNA, 64 nt, Homo Sapiens; identical to SEQ ID NO: 156166

SEQ ID NO: 212197 - RNA, 64 nt, Homo Sapiens; identical to SEQ ID NO: 156167

SEQ ID NO: 212198 - RNA, 64 nt, Homo Sapiens; identical to SEQ ID NO: 156168

SEQ ID NO: 212199 - RNA, 64 nt, Homo Sapiens; identical to SEQ ID NO: 156169

SEQ ID NO: 212200 - RNA, 64 nt, Homo Sapiens; identical to SEQ ID NO: 156170

SEQ ID NO: 212201 - RNA, 64 nt, Homo Sapiens; identical to SEQ ID NO: 156171

SEQ ID NO: 212202 - RNA, 64 nt, Homo Sapiens; identical to SEQ ID NO: 156172

SEQ ID NO: 212203 - RNA, 64 nt, Homo Sapiens; identical to SEQ ID NO: 156173

SEQ ID NO: 212204 - RNA, 64 nt, Homo Sapiens; identical to SEQ ID NO: 156174

SEQ ID NO: 212205 - RNA, 64 nt, Homo Sapiens; identical to SEQ ID NO: 156175

SEQ ID NO: 212206 - RNA, 64 nt, Homo Sapiens; identical to SEQ ID NO: 156176

SEQ ID NO: 212207 - RNA, 64 nt, Homo Sapiens; identical to SEQ ID NO: 156177

SEQ ID NO: 212208 - RNA, 64 nt, Homo Sapiens; identical to SEQ ID NO: 156178

SEQ ID NO: 212209 - RNA, 64 nt, Homo Sapiens; identical to SEQ ID NO: 156179

SEQ ID NO: 212210 - RNA, 64 nt, Homo Sapiens; identical to SEQ ID NO: 156180

SEQ ID NO: 212211 - RNA, 64 nt, Homo Sapiens; identical to SEQ ID NO: 156181

SEQ ID NO: 212212 - RNA, 64 nt, Homo Sapiens; identical to SEQ ID NO: 156182

SEQ ID NO: 212213 - RNA, 64 nt, Homo Sapiens; identical to SEQ ID NO: 156183

SEQ ID NO: 212214 - RNA, 64 nt, Homo Sapiens; identical to SEQ ID NO: 156184

SEQ ID NO: 212215 - RNA, 64 nt, Homo Sapiens; identical to SEQ ID NO: 156185

SEQ ID NO: 212216 - RNA, 64 nt, Homo Sapiens; identical to SEQ ID NO: 156186

SEQ ID NO: 212217 - RNA, 64 nt, Homo Sapiens; identical to SEQ ID NO: 156187

SEQ ID NO: 212218 - RNA, 64 nt, Homo Sapiens; identical to SEQ ID NO: 156188

SEQ ID NO: 212219 - RNA, 64 nt, Homo Sapiens; identical to SEQ ID NO: 156189

SEQ ID NO: 212220 - RNA, 64 nt, Homo Sapiens; identical to SEQ ID NO: 156190

SEQ ID NO: 212221 - RNA, 64 nt, Homo Sapiens; identical to SEQ ID NO: 156191

SEQ ID NO: 212222 - RNA, 64 nt, Homo Sapiens; identical to SEQ ID NO: 156192

SEQ ID NO: 212223 - RNA, 64 nt, Homo Sapiens; identical to SEQ ID NO: 156193

SEQ ID NO: 212224 - RNA, 64 nt, Homo Sapiens; identical to SEQ ID NO: 156194

SEQ ID NO: 212225 - RNA, 64 nt, Homo Sapiens; identical to SEQ ID NO: 156195

SEQ ID NO: 212226 - RNA, 64 nt, Homo Sapiens; identical to SEQ ID NO: 156196

SEQ ID NO: 212227 - RNA, 64 nt, Homo Sapiens; identical to SEQ ID NO: 156197

SEQ ID NO: 212228 - RNA, 64 nt, Homo Sapiens; identical to SEQ ID NO: 156198

SEQ ID NO: 212229 - RNA, 64 nt, Homo Sapiens; identical to SEQ ID NO: 156199

SEQ ID NO: 212230 - RNA, 64 nt, Homo Sapiens; identical to SEQ ID NO: 156200

SEQ ID NO: 212231 - RNA, 64 nt, Homo Sapiens; identical to SEQ ID NO: 156201

SEQ ID NO: 212232 - RNA, 64 nt, Homo Sapiens; identical to SEQ ID NO: 156202

SEQ ID NO: 212233 - RNA, 64 nt, Homo Sapiens; identical to SEQ ID NO: 156203

SEQ ID NO: 212234 - RNA, 64 nt, Homo Sapiens; identical to SEQ ID NO: 156204

SEQ ID NO: 212235 - RNA, 64 nt, Homo Sapiens; identical to SEQ ID NO: 156205

SEQ ID NO: 212236 - RNA, 64 nt, Homo Sapiens; identical to SEQ ID NO: 156206

SEQ ID NO: 212237 - RNA, 64 nt, Homo Sapiens; identical to SEQ ID NO: 156207

SEQ ID NO: 212238 - RNA, 64 nt, Homo Sapiens; identical to SEQ ID NO: 156208

SEQ ID NO: 212239 - RNA, 64 nt, Homo Sapiens; identical to SEQ ID NO: 156209

SEQ ID NO: 212240 - RNA, 53 nt, Homo Sapiens; identical to SEQ ID NO: 156210

SEQ ID NO: 212241 - RNA, 64 nt, Homo Sapiens; identical to SEQ ID NO: 156211

SEQ ID NO: 212242 - RNA, 64 nt, Homo Sapiens; identical to SEQ ID NO: 156212

SEQ ID NO: 212243 - RNA, 64 nt, Homo Sapiens; identical to SEQ ID NO: 156213

SEQ ID NO: 212244 - RNA, 64 nt, Homo Sapiens; identical to SEQ ID NO: 156214

SEQ ID NO: 212245 - RNA, 64 nt, Homo Sapiens; identical to SEQ ID NO: 156215

SEQ ID NO: 212246 - RNA, 64 nt, Homo Sapiens; identical to SEQ ID NO: 156216

SEQ ID NO: 212247 - RNA, 64 nt, Homo Sapiens; identical to SEQ ID NO: 156217

SEQ ID NO: 212248 - RNA, 64 nt, Homo Sapiens; identical to SEQ ID NO: 156218

SEQ ID NO: 212249 - RNA, 64 nt, Homo Sapiens; identical to SEQ ID NO: 156219

SEQ ID NO: 212250 - RNA, 64 nt, Homo Sapiens; identical to SEQ ID NO: 156220

SEQ ID NO: 212251 - RNA, 64 nt, Homo Sapiens; identical to SEQ ID NO: 156221

SEQ ID NO: 212252 - RNA, 64 nt, Homo Sapiens; identical to SEQ ID NO: 156222

SEQ ID NO: 212253 - RNA, 64 nt, Homo Sapiens; identical to SEQ ID NO: 156223

SEQ ID NO: 212254 - RNA, 64 nt, Homo Sapiens; identical to SEQ ID NO: 156224

SEQ ID NO: 212255 - RNA, 64 nt, Homo Sapiens; identical to SEQ ID NO: 156225

SEQ ID NO: 212256 - RNA, 64 nt, Homo Sapiens; identical to SEQ ID NO: 156226

SEQ ID NO: 212257 - RNA, 64 nt, Homo Sapiens; identical to SEQ ID NO: 156227

SEQ ID NO: 212258 - RNA, 64 nt, Homo Sapiens; identical to SEQ ID NO: 156228

SEQ ID NO: 212259 - RNA, 64 nt, Homo Sapiens; identical to SEQ ID NO: 156229

SEQ ID NO: 212260 - RNA, 64 nt, Homo Sapiens; identical to SEQ ID NO: 156230

SEQ ID NO: 212261 - RNA, 64 nt, Homo Sapiens; identical to SEQ ID NO: 156231

SEQ ID NO: 212262 - RNA, 64 nt, Homo Sapiens; identical to SEQ ID NO: 156232

SEQ ID NO: 212263 - RNA, 64 nt, Homo Sapiens; identical to SEQ ID NO: 156233

SEQ ID NO: 212264 - RNA, 64 nt, Homo Sapiens; identical to SEQ ID NO: 156234

SEQ ID NO: 212265 - RNA, 64 nt, Homo Sapiens; identical to SEQ ID NO: 156235

SEQ ID NO: 212266 - RNA, 64 nt, Homo Sapiens; identical to SEQ ID NO: 156236

SEQ ID NO: 212267 - RNA, 64 nt, Homo Sapiens; identical to SEQ ID NO: 156237

SEQ ID NO: 212268 - RNA, 64 nt, Homo Sapiens; identical to SEQ ID NO: 156238

SEQ ID NO: 212269 - RNA, 64 nt, Homo Sapiens; identical to SEQ ID NO: 156239

SEQ ID NO: 212270 - RNA, 64 nt, Homo Sapiens; identical to SEQ ID NO: 156240

SEQ ID NO: 212271 - RNA, 64 nt, Homo Sapiens; identical to SEQ ID NO: 156241

SEQ ID NO: 212272 - RNA, 64 nt, Homo Sapiens; identical to SEQ ID NO: 156242

SEQ ID NO: 212273 - RNA, 64 nt, Homo Sapiens; identical to SEQ ID NO: 156243

SEQ ID NO: 212274 - RNA, 64 nt, Homo Sapiens; identical to SEQ ID NO: 156244

SEQ ID NO: 212275 - RNA, 64 nt, Homo Sapiens; identical to SEQ ID NO: 156245

SEQ ID NO: 212276 - RNA, 64 nt, Homo Sapiens; identical to SEQ ID NO: 156246

SEQ ID NO: 212277 - RNA, 64 nt, Homo Sapiens; identical to SEQ ID NO: 156247

SEQ ID NO: 212278 - RNA, 64 nt, Homo Sapiens; identical to SEQ ID NO: 156248

SEQ ID NO: 212279 - RNA, 64 nt, Homo Sapiens; identical to SEQ ID NO: 156249

SEQ ID NO: 212280 - RNA, 64 nt, Homo Sapiens; identical to SEQ ID NO: 156250

SEQ ID NO: 212281 - RNA, 64 nt, Homo Sapiens; identical to SEQ ID NO: 156251

SEQ ID NO: 212282 - RNA, 64 nt, Homo Sapiens; identical to SEQ ID NO: 156252

SEQ ID NO: 212283 - RNA, 64 nt, Homo Sapiens; identical to SEQ ID NO: 156253

SEQ ID NO: 212284 - RNA, 64 nt, Homo Sapiens; identical to SEQ ID NO: 156254

SEQ ID NO: 212285 - RNA, 64 nt, Homo Sapiens; identical to SEQ ID NO: 156255

SEQ ID NO: 212286 - RNA, 64 nt, Homo Sapiens; identical to SEQ ID NO: 156256

SEQ ID NO: 212287 - RNA, 64 nt, Homo Sapiens; identical to SEQ ID NO: 156257

SEQ ID NO: 212288 - RNA, 64 nt, Homo Sapiens; identical to SEQ ID NO: 156258

SEQ ID NO: 212289 - RNA, 64 nt, Homo Sapiens; identical to SEQ ID NO: 156259

SEQ ID NO: 212290 - RNA, 64 nt, Homo Sapiens; identical to SEQ ID NO: 156260

SEQ ID NO: 212291 - RNA, 64 nt, Homo Sapiens; identical to SEQ ID NO: 156261

SEQ ID NO: 212292 - RNA, 64 nt, Homo Sapiens; identical to SEQ ID NO: 156262

SEQ ID NO: 212293 - RNA, 64 nt, Homo Sapiens; identical to SEQ ID NO: 156263

SEQ ID NO: 212294 - RNA, 64 nt, Homo Sapiens; identical to SEQ ID NO: 156264

SEQ ID NO: 212295 - RNA, 64 nt, Homo Sapiens; identical to SEQ ID NO: 156265

SEQ ID NO: 212296 - RNA, 64 nt, Homo Sapiens; identical to SEQ ID NO: 156266

SEQ ID NO: 212297 - RNA, 64 nt, Homo Sapiens; identical to SEQ ID NO: 156267

SEQ ID NO: 212298 - RNA, 64 nt, Homo Sapiens; identical to SEQ ID NO: 156268

SEQ ID NO: 212299 - RNA, 64 nt, Homo Sapiens; identical to SEQ ID NO: 156269

SEQ ID NO: 212300 - RNA, 64 nt, Homo Sapiens; identical to SEQ ID NO: 156270

SEQ ID NO: 212301 - RNA, 64 nt, Homo Sapiens; identical to SEQ ID NO: 156271

SEQ ID NO: 212302 - RNA, 64 nt, Homo Sapiens; identical to SEQ ID NO: 156272

SEQ ID NO: 212303 - RNA, 64 nt, Homo Sapiens; identical to SEQ ID NO: 156273

SEQ ID NO: 212304 - RNA, 64 nt, Homo Sapiens; identical to SEQ ID NO: 156274

SEQ ID NO: 212305 - RNA, 64 nt, Homo Sapiens; identical to SEQ ID NO: 156275

SEQ ID NO: 212306 - RNA, 64 nt, Homo Sapiens; identical to SEQ ID NO: 156276

SEQ ID NO: 212307 - RNA, 64 nt, Homo Sapiens; identical to SEQ ID NO: 156277

SEQ ID NO: 212308 - RNA, 64 nt, Homo Sapiens; identical to SEQ ID NO: 156278

SEQ ID NO: 212309 - RNA, 64 nt, Homo Sapiens; identical to SEQ ID NO: 156279

SEQ ID NO: 212310 - RNA, 64 nt, Homo Sapiens; identical to SEQ ID NO: 156280

SEQ ID NO: 212311 - RNA, 64 nt, Homo Sapiens; identical to SEQ ID NO: 156281

SEQ ID NO: 212312 - RNA, 64 nt, Homo Sapiens; identical to SEQ ID NO: 156282

SEQ ID NO: 212313 - RNA, 64 nt, Homo Sapiens; identical to SEQ ID NO: 156283

SEQ ID NO: 212314 - RNA, 64 nt, Homo Sapiens; identical to SEQ ID NO: 156284

SEQ ID NO: 212315 - RNA, 64 nt, Homo Sapiens; identical to SEQ ID NO: 156285

SEQ ID NO: 212316 - RNA, 64 nt, Homo Sapiens; identical to SEQ ID NO: 156286

SEQ ID NO: 212317 - RNA, 64 nt, Homo Sapiens; identical to SEQ ID NO: 156287

SEQ ID NO: 212318 - RNA, 64 nt, Homo Sapiens; identical to SEQ ID NO: 95053

SEQ ID NO: 212319 - RNA, 64 nt, Homo Sapiens; identical to SEQ ID NO: 95054

SEQ ID NO: 212320 - RNA, 64 nt, Homo Sapiens; identical to SEQ ID NO: 95055

SEQ ID NO: 212321 - RNA, 64 nt, Homo Sapiens; identical to SEQ ID NO: 95056

SEQ ID NO: 212322 - RNA, 64 nt, Homo Sapiens; identical to SEQ ID NO: 95057

SEQ ID NO: 212323 - RNA, 64 nt, Homo Sapiens; identical to SEQ ID NO: 95058

SEQ ID NO: 212324 - RNA, 64 nt, Homo Sapiens; identical to SEQ ID NO: 95059

SEQ ID NO: 212325 - RNA, 64 nt, Homo Sapiens; identical to SEQ ID NO: 95060

SEQ ID NO: 212326 - RNA, 64 nt, Homo Sapiens; identical to SEQ ID NO: 95061

SEQ ID NO: 212327 - RNA, 64 nt, Homo Sapiens; identical to SEQ ID NO: 95062

SEQ ID NO: 212328 - RNA, 64 nt, Homo Sapiens; identical to SEQ ID NO: 95063

SEQ ID NO: 212329 - RNA, 64 nt, Homo Sapiens; identical to SEQ ID NO: 95064

SEQ ID NO: 212330 - RNA, 64 nt, Homo Sapiens; identical to SEQ ID NO: 95065

SEQ ID NO: 212331 - RNA, 64 nt, Homo Sapiens; identical to SEQ ID NO: 95066

SEQ ID NO: 212332 - RNA, 64 nt, Homo Sapiens; identical to SEQ ID NO: 95067

SEQ ID NO: 212333 - RNA, 64 nt, Homo Sapiens; identical to SEQ ID NO: 95068

SEQ ID NO: 212334 - RNA, 64 nt, Homo Sapiens; identical to SEQ ID NO: 95069

SEQ ID NO: 212335 - RNA, 64 nt, Homo Sapiens; identical to SEQ ID NO: 95070

SEQ ID NO: 212336 - RNA, 64 nt, Homo Sapiens; identical to SEQ ID NO: 95071

SEQ ID NO: 212337 - RNA, 64 nt, Homo Sapiens; identical to SEQ ID NO: 95072

SEQ ID NO: 212338 - RNA, 64 nt, Homo Sapiens; identical to SEQ ID NO: 95073

SEQ ID NO: 212339 - RNA, 64 nt, Homo Sapiens; identical to SEQ ID NO: 95074

SEQ ID NO: 212340 - RNA, 64 nt, Homo Sapiens; identical to SEQ ID NO: 95075

SEQ ID NO: 212341 - RNA, 64 nt, Homo Sapiens; identical to SEQ ID NO: 95076

SEQ ID NO: 212342 - RNA, 64 nt, Homo Sapiens; identical to SEQ ID NO: 95077

SEQ ID NO: 212343 - RNA, 64 nt, Homo Sapiens; identical to SEQ ID NO: 95078

SEQ ID NO: 212344 - RNA, 64 nt, Homo Sapiens; identical to SEQ ID NO: 95079

SEQ ID NO: 212345 - RNA, 64 nt, Homo Sapiens; identical to SEQ ID NO: 77572

SEQ ID NO: 212346 - RNA, 64 nt, Homo Sapiens; identical to SEQ ID NO: 77573

SEQ ID NO: 212347 - RNA, 64 nt, Homo Sapiens; identical to SEQ ID NO: 77574

SEQ ID NO: 212348 - RNA, 64 nt, Homo Sapiens; identical to SEQ ID NO: 77575

SEQ ID NO: 212349 - RNA, 64 nt, Homo Sapiens; identical to SEQ ID NO: 77576

SEQ ID NO: 212350 - RNA, 64 nt, Homo Sapiens; identical to SEQ ID NO: 77577

SEQ ID NO: 212351 - RNA, 64 nt, Homo Sapiens; identical to SEQ ID NO: 77578

SEQ ID NO: 212352 - RNA, 64 nt, Homo Sapiens; identical to SEQ ID NO: 77579

SEQ ID NO: 212353 - RNA, 64 nt, Homo Sapiens; identical to SEQ ID NO: 77580

SEQ ID NO: 212354 - RNA, 64 nt, Homo Sapiens; identical to SEQ ID NO: 77581

SEQ ID NO: 212355 - RNA, 64 nt, Homo Sapiens; identical to SEQ ID NO: 77582

SEQ ID NO: 212356 - RNA, 64 nt, Homo Sapiens; identical to SEQ ID NO: 77583

SEQ ID NO: 212357 - RNA, 64 nt, Homo Sapiens; identical to SEQ ID NO: 77584

SEQ ID NO: 212358 - RNA, 64 nt, Homo Sapiens; identical to SEQ ID NO: 77585

SEQ ID NO: 212359 - RNA, 64 nt, Homo Sapiens; identical to SEQ ID NO: 77586

SEQ ID NO: 212360 - RNA, 64 nt, Homo Sapiens; identical to SEQ ID NO: 77587

SEQ ID NO: 212361 - RNA, 64 nt, Homo Sapiens; identical to SEQ ID NO: 77588

SEQ ID NO: 212362 - RNA, 64 nt, Homo Sapiens; identical to SEQ ID NO: 77589

SEQ ID NO: 212363 - RNA, 56 nt, Homo Sapiens; identical to SEQ ID NO: 77590

SEQ ID NO: 212364 - RNA, 64 nt, Homo Sapiens; identical to SEQ ID NO: 77591

SEQ ID NO: 212365 - RNA, 64 nt, Homo Sapiens; identical to SEQ ID NO: 77592

SEQ ID NO: 212366 - RNA, 64 nt, Homo Sapiens; identical to SEQ ID NO: 77593

SEQ ID NO: 212367 - RNA, 64 nt, Homo Sapiens; identical to SEQ ID NO: 77594

SEQ ID NO: 212368 - RNA, 64 nt, Homo Sapiens; identical to SEQ ID NO: 77595

SEQ ID NO: 212369 - RNA, 64 nt, Homo Sapiens; identical to SEQ ID NO: 77596

SEQ ID NO: 212370 - RNA, 64 nt, Homo Sapiens; identical to SEQ ID NO: 77597

SEQ ID NO: 212371 - RNA, 64 nt, Homo Sapiens; identical to SEQ ID NO: 77598

SEQ ID NO: 212372 - RNA, 64 nt, Homo Sapiens; identical to SEQ ID NO: 77599

SEQ ID NO: 212373 - RNA, 64 nt, Homo Sapiens; identical to SEQ ID NO: 77600

SEQ ID NO: 212374 - RNA, 64 nt, Homo Sapiens; identical to SEQ ID NO: 77601

SEQ ID NO: 212375 - RNA, 64 nt, Homo Sapiens; identical to SEQ ID NO: 77602

SEQ ID NO: 212376 - RNA, 64 nt, Homo Sapiens; identical to SEQ ID NO: 77603

SEQ ID NO: 212377 - RNA, 64 nt, Homo Sapiens; identical to SEQ ID NO: 77604

SEQ ID NO: 212378 - RNA, 64 nt, Homo Sapiens; identical to SEQ ID NO: 77605

SEQ ID NO: 212379 - RNA, 64 nt, Homo Sapiens; identical to SEQ ID NO: 77606

SEQ ID NO: 212380 - RNA, 64 nt, Homo Sapiens; identical to SEQ ID NO: 77607

SEQ ID NO: 212381 - RNA, 64 nt, Homo Sapiens; identical to SEQ ID NO: 77608

SEQ ID NO: 212382 - RNA, 64 nt, Homo Sapiens; identical to SEQ ID NO: 77609

SEQ ID NO: 212383 - RNA, 64 nt, Homo Sapiens; identical to SEQ ID NO: 77610

SEQ ID NO: 212384 - RNA, 64 nt, Homo Sapiens; identical to SEQ ID NO: 77611

SEQ ID NO: 212385 - RNA, 64 nt, Homo Sapiens; identical to SEQ ID NO: 77612

SEQ ID NO: 212386 - RNA, 64 nt, Homo Sapiens; identical to SEQ ID NO: 77613

SEQ ID NO: 212387 - RNA, 64 nt, Homo Sapiens; identical to SEQ ID NO: 77614

SEQ ID NO: 212388 - RNA, 64 nt, Homo Sapiens; identical to SEQ ID NO: 77615

SEQ ID NO: 212389 - RNA, 64 nt, Homo Sapiens; identical to SEQ ID NO: 77616

SEQ ID NO: 212390 - RNA, 64 nt, Homo Sapiens; identical to SEQ ID NO: 77617

SEQ ID NO: 212391 - RNA, 64 nt, Homo Sapiens; identical to SEQ ID NO: 77618

SEQ ID NO: 212392 - RNA, 64 nt, Homo Sapiens; identical to SEQ ID NO: 77619

SEQ ID NO: 212393 - RNA, 64 nt, Homo Sapiens; identical to SEQ ID NO: 77620

SEQ ID NO: 212394 - RNA, 64 nt, Homo Sapiens; identical to SEQ ID NO: 77621

SEQ ID NO: 212395 - RNA, 64 nt, Homo Sapiens; identical to SEQ ID NO: 77622

SEQ ID NO: 212396 - RNA, 64 nt, Homo Sapiens; identical to SEQ ID NO: 77623

SEQ ID NO: 212397 - RNA, 64 nt, Homo Sapiens; identical to SEQ ID NO: 77624

SEQ ID NO: 212398 - RNA, 64 nt, Homo Sapiens; identical to SEQ ID NO: 77625

SEQ ID NO: 212399 - RNA, 64 nt, Homo Sapiens; identical to SEQ ID NO: 77626

SEQ ID NO: 212400 - RNA, 64 nt, Homo Sapiens; identical to SEQ ID NO: 77627

SEQ ID NO: 212401 - RNA, 64 nt, Homo Sapiens; identical to SEQ ID NO: 77628

SEQ ID NO: 212402 - RNA, 64 nt, Homo Sapiens; identical to SEQ ID NO: 77629

SEQ ID NO: 212403 - RNA, 64 nt, Homo Sapiens; identical to SEQ ID NO: 77630

SEQ ID NO: 212404 - RNA, 64 nt, Homo Sapiens; identical to SEQ ID NO: 77631

SEQ ID NO: 212405 - RNA, 64 nt, Homo Sapiens; identical to SEQ ID NO: 77632

SEQ ID NO: 212406 - RNA, 64 nt, Homo Sapiens; identical to SEQ ID NO: 77633

SEQ ID NO: 212407 - RNA, 64 nt, Homo Sapiens; identical to SEQ ID NO: 77634

SEQ ID NO: 212408 - RNA, 64 nt, Homo Sapiens; identical to SEQ ID NO: 77635

SEQ ID NO: 212409 - RNA, 64 nt, Homo Sapiens; identical to SEQ ID NO: 77636

SEQ ID NO: 212410 - RNA, 64 nt, Homo Sapiens; identical to SEQ ID NO: 77637

SEQ ID NO: 212411 - RNA, 64 nt, Homo Sapiens; identical to SEQ ID NO: 77638

SEQ ID NO: 212412 - RNA, 64 nt, Homo Sapiens; identical to SEQ ID NO: 77639

SEQ ID NO: 212413 - RNA, 64 nt, Homo Sapiens; identical to SEQ ID NO: 77640

SEQ ID NO: 212414 - RNA, 64 nt, Homo Sapiens; identical to SEQ ID NO: 77641

SEQ ID NO: 212415 - RNA, 64 nt, Homo Sapiens; identical to SEQ ID NO: 77642

SEQ ID NO: 212416 - RNA, 64 nt, Homo Sapiens; identical to SEQ ID NO: 77643

SEQ ID NO: 212417 - RNA, 64 nt, Homo Sapiens; identical to SEQ ID NO: 77644

SEQ ID NO: 212418 - RNA, 64 nt, Homo Sapiens; identical to SEQ ID NO: 77645

SEQ ID NO: 212419 - RNA, 64 nt, Homo Sapiens; identical to SEQ ID NO: 77646

SEQ ID NO: 212420 - RNA, 64 nt, Homo Sapiens; identical to SEQ ID NO: 77647

SEQ ID NO: 212421 - RNA, 64 nt, Homo Sapiens; identical to SEQ ID NO: 77648

SEQ ID NO: 212422 - RNA, 64 nt, Homo Sapiens; identical to SEQ ID NO: 77649

SEQ ID NO: 212423 - RNA, 64 nt, Homo Sapiens; identical to SEQ ID NO: 77650

SEQ ID NO: 212424 - RNA, 64 nt, Homo Sapiens; identical to SEQ ID NO: 77651

SEQ ID NO: 212425 - RNA, 64 nt, Homo Sapiens; identical to SEQ ID NO: 77652

SEQ ID NO: 212426 - RNA, 64 nt, Homo Sapiens; identical to SEQ ID NO: 77653

SEQ ID NO: 212427 - RNA, 64 nt, Homo Sapiens; identical to SEQ ID NO: 77654

SEQ ID NO: 212428 - RNA, 64 nt, Homo Sapiens; identical to SEQ ID NO: 77655

SEQ ID NO: 212429 - RNA, 64 nt, Homo Sapiens; identical to SEQ ID NO: 77656

SEQ ID NO: 212430 - RNA, 64 nt, Homo Sapiens; identical to SEQ ID NO: 77657

SEQ ID NO: 212431 - RNA, 64 nt, Homo Sapiens; identical to SEQ ID NO: 77658

SEQ ID NO: 212432 - RNA, 64 nt, Homo Sapiens; identical to SEQ ID NO: 77659

SEQ ID NO: 212433 - RNA, 64 nt, Homo Sapiens; identical to SEQ ID NO: 77660

SEQ ID NO: 212434 - RNA, 63 nt, Homo Sapiens; identical to SEQ ID NO: 77661

SEQ ID NO: 212435 - RNA, 64 nt, Homo Sapiens; identical to SEQ ID NO: 77662

SEQ ID NO: 212436 - RNA, 64 nt, Homo Sapiens; identical to SEQ ID NO: 77663

SEQ ID NO: 212437 - RNA, 64 nt, Homo Sapiens; identical to SEQ ID NO: 77664

SEQ ID NO: 212438 - RNA, 64 nt, Homo Sapiens; identical to SEQ ID NO: 77665

SEQ ID NO: 212439 - RNA, 64 nt, Homo Sapiens; identical to SEQ ID NO: 77666

SEQ ID NO: 212440 - RNA, 64 nt, Homo Sapiens; identical to SEQ ID NO: 77667

SEQ ID NO: 212441 - RNA, 64 nt, Homo Sapiens; identical to SEQ ID NO: 77668

SEQ ID NO: 212442 - RNA, 64 nt, Homo Sapiens; identical to SEQ ID NO: 77669

SEQ ID NO: 212443 - RNA, 64 nt, Homo Sapiens; identical to SEQ ID NO: 77670

SEQ ID NO: 212444 - RNA, 64 nt, Homo Sapiens; identical to SEQ ID NO: 77671

SEQ ID NO: 212445 - RNA, 64 nt, Homo Sapiens; identical to SEQ ID NO: 77672

SEQ ID NO: 212446 - RNA, 64 nt, Homo Sapiens; identical to SEQ ID NO: 77673

SEQ ID NO: 212447 - RNA, 64 nt, Homo Sapiens; identical to SEQ ID NO: 77674

SEQ ID NO: 212448 - RNA, 64 nt, Homo Sapiens; identical to SEQ ID NO: 77675

SEQ ID NO: 212449 - RNA, 64 nt, Homo Sapiens; identical to SEQ ID NO: 77676

SEQ ID NO: 212450 - RNA, 64 nt, Homo Sapiens; identical to SEQ ID NO: 77677

SEQ ID NO: 212451 - RNA, 64 nt, Homo Sapiens; identical to SEQ ID NO: 77678

SEQ ID NO: 212452 - RNA, 64 nt, Homo Sapiens; identical to SEQ ID NO: 77679

SEQ ID NO: 212453 - RNA, 64 nt, Homo Sapiens; identical to SEQ ID NO: 77680

SEQ ID NO: 212454 - RNA, 64 nt, Homo Sapiens; identical to SEQ ID NO: 77681

SEQ ID NO: 212455 - RNA, 64 nt, Homo Sapiens; identical to SEQ ID NO: 77682

SEQ ID NO: 212456 - RNA, 64 nt, Homo Sapiens; identical to SEQ ID NO: 77683

SEQ ID NO: 212457 - RNA, 57 nt, Homo Sapiens; identical to SEQ ID NO: 77684

SEQ ID NO: 212458 - RNA, 64 nt, Homo Sapiens; identical to SEQ ID NO: 77685

SEQ ID NO: 212459 - RNA, 64 nt, Homo Sapiens; identical to SEQ ID NO: 77686

SEQ ID NO: 212460 - RNA, 64 nt, Homo Sapiens; identical to SEQ ID NO: 77687

SEQ ID NO: 212461 - RNA, 64 nt, Homo Sapiens; identical to SEQ ID NO: 77688

SEQ ID NO: 212462 - RNA, 64 nt, Homo Sapiens; identical to SEQ ID NO: 77689

SEQ ID NO: 212463 - RNA, 64 nt, Homo Sapiens; identical to SEQ ID NO: 77690

SEQ ID NO: 212464 - RNA, 64 nt, Homo Sapiens; identical to SEQ ID NO: 77691

SEQ ID NO: 212465 - RNA, 64 nt, Homo Sapiens; identical to SEQ ID NO: 77692

SEQ ID NO: 212466 - RNA, 64 nt, Homo Sapiens; identical to SEQ ID NO: 77693

SEQ ID NO: 212467 - RNA, 64 nt, Homo Sapiens; identical to SEQ ID NO: 77694

SEQ ID NO: 212468 - RNA, 64 nt, Homo Sapiens; identical to SEQ ID NO: 77695

SEQ ID NO: 212469 - RNA, 64 nt, Homo Sapiens; identical to SEQ ID NO: 77696

SEQ ID NO: 212470 - RNA, 64 nt, Homo Sapiens; identical to SEQ ID NO: 77697

SEQ ID NO: 212471 - RNA, 64 nt, Homo Sapiens; identical to SEQ ID NO: 77698

SEQ ID NO: 212472 - RNA, 64 nt, Homo Sapiens; identical to SEQ ID NO: 77699

SEQ ID NO: 212473 - RNA, 64 nt, Homo Sapiens; identical to SEQ ID NO: 77700

SEQ ID NO: 212474 - RNA, 64 nt, Homo Sapiens; identical to SEQ ID NO: 77701

SEQ ID NO: 212475 - RNA, 64 nt, Homo Sapiens; identical to SEQ ID NO: 77702

SEQ ID NO: 212476 - RNA, 63 nt, Homo Sapiens; identical to SEQ ID NO: 77703

SEQ ID NO: 212477 - RNA, 64 nt, Homo Sapiens; identical to SEQ ID NO: 77704

SEQ ID NO: 212478 - RNA, 64 nt, Homo Sapiens; identical to SEQ ID NO: 77705

SEQ ID NO: 212479 - RNA, 64 nt, Homo Sapiens; identical to SEQ ID NO: 77706

SEQ ID NO: 212480 - RNA, 64 nt, Homo Sapiens; identical to SEQ ID NO: 77707

SEQ ID NO: 212481 - RNA, 64 nt, Homo Sapiens; identical to SEQ ID NO: 77708

SEQ ID NO: 212482 - RNA, 64 nt, Homo Sapiens; identical to SEQ ID NO: 77709

SEQ ID NO: 212483 - RNA, 64 nt, Homo Sapiens; identical to SEQ ID NO: 77710

SEQ ID NO: 212484 - RNA, 64 nt, Homo Sapiens; identical to SEQ ID NO: 77711

SEQ ID NO: 212485 - RNA, 64 nt, Homo Sapiens; identical to SEQ ID NO: 77712

SEQ ID NO: 212486 - RNA, 64 nt, Homo Sapiens; identical to SEQ ID NO: 77713

SEQ ID NO: 212487 - RNA, 64 nt, Homo Sapiens; identical to SEQ ID NO: 77714

SEQ ID NO: 212488 - RNA, 64 nt, Homo Sapiens; identical to SEQ ID NO: 77715

SEQ ID NO: 212489 - RNA, 64 nt, Homo Sapiens; identical to SEQ ID NO: 77716

SEQ ID NO: 212490 - RNA, 64 nt, Homo Sapiens; identical to SEQ ID NO: 77717

SEQ ID NO: 212491 - RNA, 64 nt, Homo Sapiens; identical to SEQ ID NO: 77718

SEQ ID NO: 212492 - RNA, 64 nt, Homo Sapiens; identical to SEQ ID NO: 77719

SEQ ID NO: 212493 - RNA, 64 nt, Homo Sapiens; identical to SEQ ID NO: 77720

SEQ ID NO: 212494 - RNA, 64 nt, Homo Sapiens; identical to SEQ ID NO: 77721

SEQ ID NO: 212495 - RNA, 64 nt, Homo Sapiens; identical to SEQ ID NO: 77722

SEQ ID NO: 212496 - RNA, 64 nt, Homo Sapiens; identical to SEQ ID NO: 77723

SEQ ID NO: 212497 - RNA, 64 nt, Homo Sapiens; identical to SEQ ID NO: 77724

SEQ ID NO: 212498 - RNA, 64 nt, Homo Sapiens; identical to SEQ ID NO: 77725

SEQ ID NO: 212499 - RNA, 64 nt, Homo Sapiens; identical to SEQ ID NO: 77726

SEQ ID NO: 212500 - RNA, 64 nt, Homo Sapiens; identical to SEQ ID NO: 77727

SEQ ID NO: 212501 - RNA, 64 nt, Homo Sapiens; identical to SEQ ID NO: 77728

SEQ ID NO: 212502 - RNA, 64 nt, Homo Sapiens; identical to SEQ ID NO: 77729

SEQ ID NO: 212503 - RNA, 64 nt, Homo Sapiens; identical to SEQ ID NO: 77730

SEQ ID NO: 212504 - RNA, 64 nt, Homo Sapiens; identical to SEQ ID NO: 77731

SEQ ID NO: 212505 - RNA, 64 nt, Homo Sapiens; identical to SEQ ID NO: 77732

SEQ ID NO: 212506 - RNA, 64 nt, Homo Sapiens; identical to SEQ ID NO: 77733

SEQ ID NO: 212507 - RNA, 64 nt, Homo Sapiens; identical to SEQ ID NO: 77734

SEQ ID NO: 212508 - RNA, 64 nt, Homo Sapiens; identical to SEQ ID NO: 77735

SEQ ID NO: 212509 - RNA, 50 nt, Homo Sapiens; identical to SEQ ID NO: 77736

SEQ ID NO: 212510 - RNA, 64 nt, Homo Sapiens; identical to SEQ ID NO: 77737

SEQ ID NO: 212511 - RNA, 64 nt, Homo Sapiens; identical to SEQ ID NO: 77738

SEQ ID NO: 212512 - RNA, 64 nt, Homo Sapiens; identical to SEQ ID NO: 77739

SEQ ID NO: 212513 - RNA, 64 nt, Homo Sapiens; identical to SEQ ID NO: 77740

SEQ ID NO: 212514 - RNA, 64 nt, Homo Sapiens; identical to SEQ ID NO: 77741

SEQ ID NO: 212515 - RNA, 64 nt, Homo Sapiens; identical to SEQ ID NO: 77742

SEQ ID NO: 212516 - RNA, 64 nt, Homo Sapiens; identical to SEQ ID NO: 77743

SEQ ID NO: 212517 - RNA, 64 nt, Homo Sapiens; identical to SEQ ID NO: 77744

SEQ ID NO: 212518 - RNA, 64 nt, Homo Sapiens; identical to SEQ ID NO: 52875

SEQ ID NO: 212519 - RNA, 64 nt, Homo Sapiens; identical to SEQ ID NO: 52876

SEQ ID NO: 212520 - RNA, 64 nt, Homo Sapiens; identical to SEQ ID NO: 52877

SEQ ID NO: 212521 - RNA, 64 nt, Homo Sapiens; identical to SEQ ID NO: 52878

SEQ ID NO: 212522 - RNA, 64 nt, Homo Sapiens; identical to SEQ ID NO: 52879

SEQ ID NO: 212523 - RNA, 64 nt, Homo Sapiens; identical to SEQ ID NO: 52880

SEQ ID NO: 212524 - RNA, 64 nt, Homo Sapiens; identical to SEQ ID NO: 52881

SEQ ID NO: 212525 - RNA, 64 nt, Homo Sapiens; identical to SEQ ID NO: 52882

SEQ ID NO: 212526 - RNA, 64 nt, Homo Sapiens; identical to SEQ ID NO: 52883

SEQ ID NO: 212527 - RNA, 64 nt, Homo Sapiens; identical to SEQ ID NO: 52884

SEQ ID NO: 212528 - RNA, 64 nt, Homo Sapiens; identical to SEQ ID NO: 52885

SEQ ID NO: 212529 - RNA, 64 nt, Homo Sapiens; identical to SEQ ID NO: 52886

SEQ ID NO: 212530 - RNA, 64 nt, Homo Sapiens; identical to SEQ ID NO: 52887

SEQ ID NO: 212531 - RNA, 64 nt, Homo Sapiens; identical to SEQ ID NO: 52888

SEQ ID NO: 212532 - RNA, 64 nt, Homo Sapiens; identical to SEQ ID NO: 52889

SEQ ID NO: 212533 - RNA, 64 nt, Homo Sapiens; identical to SEQ ID NO: 52890

SEQ ID NO: 212534 - RNA, 64 nt, Homo Sapiens; identical to SEQ ID NO: 52891

SEQ ID NO: 212535 - RNA, 64 nt, Homo Sapiens; identical to SEQ ID NO: 52892

SEQ ID NO: 212536 - RNA, 64 nt, Homo Sapiens; identical to SEQ ID NO: 52893

SEQ ID NO: 212537 - RNA, 64 nt, Homo Sapiens; identical to SEQ ID NO: 52894

SEQ ID NO: 212538 - RNA, 64 nt, Homo Sapiens; identical to SEQ ID NO: 52895

SEQ ID NO: 212539 - RNA, 64 nt, Homo Sapiens; identical to SEQ ID NO: 52896

SEQ ID NO: 212540 - RNA, 64 nt, Homo Sapiens; identical to SEQ ID NO: 52897

SEQ ID NO: 212541 - RNA, 64 nt, Homo Sapiens; identical to SEQ ID NO: 52898

SEQ ID NO: 212542 - RNA, 64 nt, Homo Sapiens; identical to SEQ ID NO: 52899

SEQ ID NO: 212543 - RNA, 64 nt, Homo Sapiens; identical to SEQ ID NO: 52900

SEQ ID NO: 212544 - RNA, 64 nt, Homo Sapiens; identical to SEQ ID NO: 52901

SEQ ID NO: 212545 - RNA, 64 nt, Homo Sapiens; identical to SEQ ID NO: 52902

SEQ ID NO: 212546 - RNA, 64 nt, Homo Sapiens; identical to SEQ ID NO: 52903

SEQ ID NO: 212547 - RNA, 64 nt, Homo Sapiens; identical to SEQ ID NO: 52904

SEQ ID NO: 212548 - RNA, 64 nt, Homo Sapiens; identical to SEQ ID NO: 52905

SEQ ID NO: 212549 - RNA, 64 nt, Homo Sapiens; identical to SEQ ID NO: 52906

SEQ ID NO: 212550 - RNA, 64 nt, Homo Sapiens; identical to SEQ ID NO: 52907

SEQ ID NO: 212551 - RNA, 64 nt, Homo Sapiens; identical to SEQ ID NO: 52908

SEQ ID NO: 212552 - RNA, 64 nt, Homo Sapiens; identical to SEQ ID NO: 52909

SEQ ID NO: 212553 - RNA, 64 nt, Homo Sapiens; identical to SEQ ID NO: 52910

SEQ ID NO: 212554 - RNA, 64 nt, Homo Sapiens; identical to SEQ ID NO: 52911

SEQ ID NO: 212555 - RNA, 64 nt, Homo Sapiens; identical to SEQ ID NO: 52912

SEQ ID NO: 212556 - RNA, 64 nt, Homo Sapiens; identical to SEQ ID NO: 52913

SEQ ID NO: 212557 - RNA, 64 nt, Homo Sapiens; identical to SEQ ID NO: 52914

SEQ ID NO: 212558 - RNA, 64 nt, Homo Sapiens
gaaagauagacagcagccaaacaggaaauguuuucuucuacauggacuuuuuuuaagcauccug

SEQ ID NO: 212559 - RNA, 64 nt, Homo Sapiens
aaugauguauguguugcugaaaaaccccuucagacuucuacauuuaagucaauguaaaaaguau

SEQ ID NO: 212560 - RNA, 64 nt, Homo Sapiens
caaauguuauguuaaagaauacaaauguacuguacuucuacauauguauacuguacuucuacau

SEQ ID NO: 212561 - RNA, 64 nt, Homo Sapiens
caaauguacuguacuucuaccucuguauacuguacuucuacauaaguauauuguaaauucuuau

SEQ ID NO: 212562 - RNA, 64 nt, Homo Sapiens
augguuuauuuauguuguagaauuaaaucagaggcuucuacaacuaugagccugguuugugcaa

SEQ ID NO: 212563 - RNA, 64 nt, Homo Sapiens
uuuaccaccauaggcguuuuaauggaaaaauaugcuucuacauauggaauaucgcuuuuaauaa

SEQ ID NO: 212564 - RNA, 64 nt, Homo Sapiens
aauaaggaacugggggcauuuguuuaggccaugacuucuacaagcagauuucuuuucuuuuagu

SEQ ID NO: 212565 - RNA, 64 nt, Homo Sapiens
aaguacaaagguacauuuucaauuaaaaagcacacuucuacaaaagauuugguuuuuaaauuau

SEQ ID NO: 212566 - RNA, 64 nt, Homo Sapiens
accacuacuccaaacaaaacacaauaugccuaggggcacggaugaacguccagggagcccgggc

SEQ ID NO: 212567 - RNA, 64 nt, Homo Sapiens
gggagcacgcaggacagacacagcaggggucuggggcacggagccuugcuggcaucagcaucag

SEQ ID NO: 212568 - RNA, 64 nt, Homo Sapiens
auuccaucauggucugaaagucaaacuucggcaaggcacggacgacugugcagacacagcagcg

SEQ ID NO: 212569 - RNA, 64 nt, Homo Sapiens
cuggcggguugcuucagccagcugggugggguggggcacggaggaauggacugaaugagugcgu

SEQ ID NO: 212570 - RNA, 64 nt, Homo Sapiens
ggacccuggauguggagucucccagacuguucugggcacggaagugcauccuguuuuccuaauu

SEQ ID NO: 212571 - RNA, 64 nt, Homo Sapiens
cacccagucucaaugcacgacacagaaacccguaggcacggacaaaagcacaaccccaaucaca

SEQ ID NO: 212572 - RNA, 64 nt, Homo Sapiens
cgccugacagugcaaggcaggggcacggugguggggcacggagggcagucccgggugggcuucu

SEQ ID NO: 212573 - RNA, 64 nt, Homo Sapiens
caauaaaagacuuuuacaaauuuucacuauguguggcacggauaucuuuuuuuaggaguguuau

SEQ ID NO: 212574 - RNA, 64 nt, Homo Sapiens
gcugugcuggccuggcuggggggacgguucagcgggcacggagcgggucaucagaggacugccu

SEQ ID NO: 212575 - RNA, 64 nt, Homo Sapiens
ggacaaagggagggagcaagcccuacucggauggggcacggacuguccaccuuuucugaugugu

SEQ ID NO: 212576 - RNA, 64 nt, Homo Sapiens
uuagacggccuuguaaauagaugugguagcuaaaggcacggaauaccacuuucccagcucuuag

SEQ ID NO: 212577 - RNA, 64 nt, Homo Sapiens
cuaggagugcugcuggaccccaaacuccugucauggcacggaaguauaugugaacuugacacuc

SEQ ID NO: 212578 - RNA, 64 nt, Homo Sapiens
ggcugugaccugguccccagaggccccuguggguggcacggagguuccuggaggcgaugcagcc

SEQ ID NO: 212579 - RNA, 64 nt, Homo Sapiens
ccaauuuaugcaguaaauagacuaaaguucacagggcacggaugaguuuaucaaacuucguuau

SEQ ID NO: 212580 - RNA, 64 nt, Homo Sapiens
acggcgugggcagccugggcggcacucugggacaggcacggaggcuaaugcccaacagcaucac

SEQ ID NO: 212581 - RNA, 64 nt, Homo Sapiens
gagagacccugggugagaccgguaggauuccucuggcacggagggauggaggcacucaggccug

SEQ ID NO: 212582 - RNA, 64 nt, Homo Sapiens
agagauucucugacauucacgugucagccacuuuggcacggaagccuuacaguguggggaacca

SEQ ID NO: 212583 - RNA, 64 nt, Homo Sapiens
acgguggggcguagacuugacaacaucccacaguggcacggagagaaggcccauaccuucuggu

SEQ ID NO: 212584 - RNA, 64 nt, Homo Sapiens
ggcucuggucugccauucgccagugcagggaucuggcacggaccagauguggcgaauggcagca

SEQ ID NO: 212585 - RNA, 64 nt, Homo Sapiens
acgcagggcagcaguacccccguuuggcacuugaggcacggagaagggaagggaaguccgccca

SEQ ID NO: 212586 - RNA, 64 nt, Homo Sapiens
uuucauuucccccaaugaaugucacaaggagaugggcacggagcugcuucgggugcaucacgcu

SEQ ID NO: 212587 - RNA, 64 nt, Homo Sapiens
uggcugcacuuucacaucccgugugugaucaaagggcacggaagugugugcucuuguguagucu

SEQ ID NO: 212588 - RNA, 64 nt, Homo Sapiens
aagcacauaguaaaaagggaaaacauuggcugggggcacggaauaagagaagggcugcucaggg

SEQ ID NO: 212589 - RNA, 64 nt, Homo Sapiens
gcacacguguggguguuuccauaggacauugucaggcacggauggcugguccgaagcacgugca

SEQ ID NO: 212590 - RNA, 64 nt, Homo Sapiens
uccugagcccuuucuguagugaaggcccacgggcggcacggaguagucagucggaguacuugaa

SEQ ID NO: 212591 - RNA, 64 nt, Homo Sapiens
aguggcccagcccugggugucccacuggaggucaggcacggaccccucacccuuggcuggcaga

SEQ ID NO: 212592 - RNA, 64 nt, Homo Sapiens
ucucgcagaaggucuggaagugcccagaaugggaggcacggaagccccucccggggaggacucc

SEQ ID NO: 212593 - RNA, 64 nt, Homo Sapiens
ccaggcuguccuuuuugaccaggccuaagggaugggcacggagccgaauguuguuacuggcaca

SEQ ID NO: 212594 - RNA, 64 nt, Homo Sapiens
gggugcacacgaauggcccgccuugaggggucauggcacggaauaugaaagccuccuccaccuc

SEQ ID NO: 212595 - RNA, 64 nt, Homo Sapiens
ucauucucaacucuagcccugcacacucaccuguggcacggaaugaaaacagagcuucccgugc

SEQ ID NO: 212596 - RNA, 64 nt, Homo Sapiens
gugucugcuggggcagcugugccccugaaucaugggcacggagggccgcccgccacgccccgcg

SEQ ID NO: 212597 - RNA, 64 nt, Homo Sapiens
ggagcuccagguguccuaucuuucucagugggguggcacggagcggggccgccucccucuucuc

SEQ ID NO: 212598 - RNA, 64 nt, Homo Sapiens
ucgugccucagccucccagguagcugguacuacaggcacggaccaccacgccuggcuaauuuuu

SEQ ID NO: 212599 - RNA, 64 nt, Homo Sapiens
cacuuccuguacagacccgaggggccaggcggggggcacggagcuccggaaaaaauaauaccug

SEQ ID NO: 212600 - RNA, 56 nt, Homo Sapiens
cccugccagcagcucccuccgccagcggcacggagaccuucgucugcuccuucuaa

SEQ ID NO: 212601 - RNA, 57 nt, Homo Sapiens
agaaaaggaaucagcaacugaggcugaggcacggagacuuguuguaauuucaacuaa

SEQ ID NO: 212602 - RNA, 64 nt, Homo Sapiens
cugagaaugaccuggcauagcauaugaagaguuuggcacggaggaugucuguccuagccaagau

SEQ ID NO: 212603 - RNA, 64 nt, Homo Sapiens
agacccacccacccccuggggcugcucagccucaggcacggacagggcacaugauaccaacugc

SEQ ID NO: 212604 - RNA, 64 nt, Homo Sapiens
uuucaaguuugugguggcaacagcagcaggacagggcacggagggagcgagggagagaggaccg

SEQ ID NO: 212605 - RNA, 64 nt, Homo Sapiens
ccccugucuccaggaggggccccagacccaccucggcacggacacacccucuggcucagcgggg

SEQ ID NO: 212606 - RNA, 64 nt, Homo Sapiens
uggcacauccauguuaaggggcugaggcgucccuggcacggaaugcagagcccugagcuagggc

SEQ ID NO: 212607 - RNA, 64 nt, Homo Sapiens
agaagugccaggauguccaucagccacucgccagggcacggagccgucaguccacuguuacggg

SEQ ID NO: 212608 - RNA, 64 nt, Homo Sapiens
gggacggggcucagcaaugcagacgcaccaugugggcacggaggaaggcaugagaaagaauuug

SEQ ID NO: 212609 - RNA, 64 nt, Homo Sapiens
cucgugcauguaauccuagcaaauggcucggccaggcacggaggaaaauccuugccuucaaacg

SEQ ID NO: 212610 - RNA, 64 nt, Homo Sapiens
uucacucugcagaggccgcccaggugcugggaauggcacggagcagagacucaggaacacuuga

SEQ ID NO: 212611 - RNA, 64 nt, Homo Sapiens
gccucccgccgaggggcccagcccccaacccacaggcacggaggggcaucccucccugccggcc

SEQ ID NO: 212612 - RNA, 64 nt, Homo Sapiens
guuuggaucugguaggacagggcucagagggcuaggcacggagggaaggucagaggagaaggca

SEQ ID NO: 212613 - RNA, 64 nt, Homo Sapiens
ccuccccuucuagugcacgucugccaagggcucaggcacggaccagaacgccagggaccgccug

SEQ ID NO: 212614 - RNA, 64 nt, Homo Sapiens
cguagcaccaggguuuggaggucccugggccugaggcacggacuccaugagcagacggccugug

SEQ ID NO: 212615 - RNA, 57 nt, Homo Sapiens
agggcccaccgagugguccccaggccuggcacggaggaccggaggguuguccucuga

SEQ ID NO: 212616 - RNA, 64 nt, Homo Sapiens
gggagaccgagccggaggcugaggaaaggaagagggcacggaguugccaggagcaaaccaaagu

SEQ ID NO: 212617 - RNA, 64 nt, Homo Sapiens
gagggggcacauguugggagacaccuaccaguguggcacggagagaacaaagcccauucaucca

SEQ ID NO: 212618 - RNA, 64 nt, Homo Sapiens
ucagccaugcacaccuugagcagcgccggcaggaggcacggaaggaacugugcuccguucuccu

SEQ ID NO: 212619 - RNA, 64 nt, Homo Sapiens
ggagggaacgucuugggaaauaaucuucuccacgggcacggaguauauugaaccguuucugcac

SEQ ID NO: 212620 - RNA, 64 nt, Homo Sapiens
gcucggcccucagcccugccgcguggggcgcgugggcacggagcuuccugccucucugcuccga

SEQ ID NO: 212621 - RNA, 64 nt, Homo Sapiens
ugggcagaggacgggguaaugugaggacgaagcgggcacggagccagauggccagucuccaggc

SEQ ID NO: 212622 - RNA, 64 nt, Homo Sapiens
agauaacugaggaggggagaggugggccguaacgggcacggaucacgauguaaauuauuaagca

SEQ ID NO: 212623 - RNA, 64 nt, Homo Sapiens
ggagcaggugcagccacaucgcguccuccucugcggcacggacggaggcuucugaaagaugacu

SEQ ID NO: 212624 - RNA, 64 nt, Homo Sapiens
gaaaggaauguuuagcacaaagaggggagacagaggcacggagagggagguugggaggggggac

SEQ ID NO: 212625 - RNA, 64 nt, Homo Sapiens
cucauguaaguaaucccagcgggagaucaggccaggcacggaggugauauaguacuuuauaaaa

SEQ ID NO: 212626 - RNA, 64 nt, Homo Sapiens
agccugagcucuccugcaagacagagccugauguggcacggagugggguugcgggggguggggg

SEQ ID NO: 212627 - RNA, 64 nt, Homo Sapiens
uuuucuuuuuccauuuuggguuccuuuuguuucaggcacggauaacagcaaauggaauucugua

SEQ ID NO: 212628 - RNA, 64 nt, Homo Sapiens
aaauuuggguuuuuaaguccucuaaacacacuugggcacggaaaugcaguacuguaaggaagag

SEQ ID NO: 212629 - RNA, 64 nt, Homo Sapiens
gugaaugugaagacacaagcaugcaaaugcuuaaggcacggaguuugcuuuccgaggugccaca

SEQ ID NO: 212630 - RNA, 64 nt, Homo Sapiens
cugacucuuacagcaauaaccagcccugcauccuggcacggacauuguccuggugcagugaggg

SEQ ID NO: 212631 - RNA, 60 nt, Homo Sapiens
uccgcaggauccagcagugaacaggggugcggcacggaggagcgcaugcgugcuuaucug

SEQ ID NO: 212632 - RNA, 64 nt, Homo Sapiens
ggggagguggugccccgcggaccccggggugccaggcacggaaggcgggacucugggagaagcg

SEQ ID NO: 212633 - RNA, 53 nt, Homo Sapiens
gauccagggcaucugugaacuugggcacggaggcggucaugacuuuuuuauga

SEQ ID NO: 212634 - RNA, 64 nt, Homo Sapiens
gggagggcccugcaaagcacaaagauccagcccaggcacggaaucucacucuuacuucuagaaa

SEQ ID NO: 212635 - RNA, 64 nt, Homo Sapiens
cccgcccacucccaauccccucccucgacucuggggcacggaacccggaccccaagcccacggc

SEQ ID NO: 212636 - RNA, 64 nt, Homo Sapiens
cgacggcgccacguagccucccaucccuguccccggcacggauccggguaagguggcccggggc

SEQ ID NO: 212637 - RNA, 64 nt, Homo Sapiens
ccuccaccgacuccuucuagugggacuuaccaaaggcacggaccggugcauuguccugcuuucu

SEQ ID NO: 212638 - RNA, 64 nt, Homo Sapiens
gcccgaggggacacaggauggaaaccccaggaugagaagggagcagggagaguuccagaaaggg

SEQ ID NO: 212639 - RNA, 64 nt, Homo Sapiens
guuucgcuuuucuguaaggauuaagcagauagggagaagggaaaaggggccucacuuuagaaug

SEQ ID NO: 212640 - RNA, 64 nt, Homo Sapiens
agccgaugaaucucuacaguagaaggggcagcuaagaagggagggcugccagaaacccuguucu

SEQ ID NO: 212641 - RNA, 64 nt, Homo Sapiens
gccggggaggauagggcaggggaagcacugggaaagaagggagaaaaaagucauuuggguccug

SEQ ID NO: 212642 - RNA, 64 nt, Homo Sapiens
aaagagaaaaacucaagucuuuaaauuauaagaaagaagggaaauuuagaguaaaaagccaaau

SEQ ID NO: 212643 - RNA, 64 nt, Homo Sapiens
ggguaggaggcacugggugccuaccagcugguauagaagggaaucccagaugugaaaugggagc

SEQ ID NO: 212644 - RNA, 64 nt, Homo Sapiens
gaaguguuuguguagaagagagaacgagaggaagagaagggaagacagagaagggaagagagga

SEQ ID NO: 212645 - RNA, 64 nt, Homo Sapiens
agaggaagaacgagaggaagaguuggaugaacagagaagggaagaugguuuucuuuuugaggca

SEQ ID NO: 212646 - RNA, 64 nt, Homo Sapiens
aaaaggaaugagaacuuugcaguuggaugaauagagaagggaaaaguugcuggagcacggagug

SEQ ID NO: 212647 - RNA, 64 nt, Homo Sapiens
agcuguuagcaaggcccacugcugcuccugggugagaagggagcucuggagcaggaccagcugg

SEQ ID NO: 212648 - RNA, 64 nt, Homo Sapiens
uagacacaguucaguuagagagacguauuuaaggagaagggaaggcaggauacccagaacuagc

SEQ ID NO: 212649 - RNA, 64 nt, Homo Sapiens
uucagcaacauuuccaucauagaauuucagcguuagaagggaucuuagagguagauuauccagg

SEQ ID NO: 212650 - RNA, 64 nt, Homo Sapiens
gcuuaggacuccaacagccacucugagggaggggagaagggagcagaggccacgcagaaugaac

SEQ ID NO: 212651 - RNA, 64 nt, Homo Sapiens
agugcauuugugcacuucuguuuguuugucucaaagaagggacuguaacaaucugaguaauuuc

SEQ ID NO: 212652 - RNA, 64 nt, Homo Sapiens
acggauucaaagacuuauuuugaaaguuggaaggagaagggagggaagagagcagaagggaaga

SEQ ID NO: 212653 - RNA, 64 nt, Homo Sapiens
uugaaaguuggaaggagaagggagggaagagagcagaagggaagaagguguaagucaagcucuu

SEQ ID NO: 212654 - RNA, 64 nt, Homo Sapiens
guggucgcuccuccgacugucgcgaugcucagacagaagggacugugggaguacugcaaccuga

SEQ ID NO: 212655 - RNA, 64 nt, Homo Sapiens
gcagucgugccucugacugucgaugcucagacacagaagggacugggaguacugcaaccugaca

SEQ ID NO: 212656 - RNA, 64 nt, Homo Sapiens
cgauacccgugacucagcccuggacacugguccgagaagggacaugugggacgugagccgggcu

SEQ ID NO: 212657 - RNA, 64 nt, Homo Sapiens
gccucuccaccagcccccuccucauuaaagggaaagaagggaauuugcaaguuuggugugguga

SEQ ID NO: 212658 - RNA, 64 nt, Homo Sapiens
gaaggaaagaucaaggaaccuccggaguaagguuagaagggaagucccuccccuucccacuccu

SEQ ID NO: 212659 - RNA, 64 nt, Homo Sapiens
agacgggcucuuaccucucuagcugccuugacccagaagggaugaggcucccauuaggaggaug

SEQ ID NO: 212660 - RNA, 64 nt, Homo Sapiens
agcguguagaacuguggccaagagugacagguagagaagggaagguaguggccgauuugacuuc

SEQ ID NO: 212661 - RNA, 64 nt, Homo Sapiens
uauauuugaaauauaaaauacacuguuuuuaucaagaagggaaaauagcugguuagaaaaaugc

SEQ ID NO: 212662 - RNA, 64 nt, Homo Sapiens
agaggcuggccucuacaucauaaacagaagcaacagaagggacauauuuccaugacuucccuug

SEQ ID NO: 212663 - RNA, 64 nt, Homo Sapiens
uccagucaagagucacuacaccugugauccagcaagaagggaguuucaaaaauauauucaugua

SEQ ID NO: 212664 - RNA, 64 nt, Homo Sapiens
ugaggccauucccuguaggauuuaauucuaaaagagaagggagcuaacucuuaguuuuuacuug

SEQ ID NO: 212665 - RNA, 64 nt, Homo Sapiens
acaggggucgccaacacuugcaguggacagagggagaagggagaugucuuuuaucauugcaggc

SEQ ID NO: 212666 - RNA, 64 nt, Homo Sapiens
gagcuaaacaguguuauuauaggggauuagccccagaagggacuguguuuccgguggguguaau

SEQ ID NO: 212667 - RNA, 62 nt, Homo Sapiens
uugucaccaagaaccaggauauaaccaugccaagaagggacaugggcccaaccucuccuuaa

SEQ ID NO: 212668 - RNA, 64 nt, Homo Sapiens
aaaaagggacauuaaaauuaaaagcaaaaccacaagaagggaaagaccgcaacucggacagccc

SEQ ID NO: 212669 - RNA, 64 nt, Homo Sapiens
ccagcacgcagccccuccagcuccacguggagacagaagggaucccggcacaucagugguaaca

SEQ ID NO: 212670 - RNA, 64 nt, Homo Sapiens
caaguguccagaugccagaaccuucuuuuccucuagaagggauggugcuugguaaccuuaccuu

SEQ ID NO: 212671 - RNA, 64 nt, Homo Sapiens
cuccccauggccccacugcagaauuaaagaaggaagaagggaaggcggaggagucuauaagaag

SEQ ID NO: 212672 - RNA, 64 nt, Homo Sapiens
acaugagccuucucccaugcgcucauguucccagagaagggacccaguggcaaaaccuaggaag

SEQ ID NO: 212673 - RNA, 64 nt, Homo Sapiens
aacugggccuggggcuggagcagcuccuggaaggagaagggaggggcucggcaggucugcagcu

SEQ ID NO: 212674 - RNA, 64 nt, Homo Sapiens
cacugugaaccucucgagugacugccacugccucagaagggagcaguguagcugcugugagccc

SEQ ID NO: 212675 - RNA, 64 nt, Homo Sapiens
uaagagcaggucuuucaagcaagcaggaggguaaagaagggaacuggagccucaucuccauguc

SEQ ID NO: 212676 - RNA, 64 nt, Homo Sapiens
aagcagagaaguagcaccauuauccccauuuaacagaagggaaacugaggcucggcaagcauag

SEQ ID NO: 212677 - RNA, 64 nt, Homo Sapiens
gaaagggggaaugccccucccaggaguuuaugggagaagggacugggccggcugccucccagcg

SEQ ID NO: 212678 - RNA, 64 nt, Homo Sapiens
aaaccccauuuugcagagaggaaaacugaggccuagaagggaggagugguccacccacgguccc

SEQ ID NO: 212679 - RNA, 64 nt, Homo Sapiens
accagggauuaggcuguaggggggugagaaggagagaagggaccaccccauucuucucaagcaa

SEQ ID NO: 212680 - RNA, 64 nt, Homo Sapiens
acacgggcagcugguugcucauaggguccuucucuagggagaaaccauuguuaauucaaauaag

SEQ ID NO: 212681 - RNA, 64 nt, Homo Sapiens
uucacuacagaaagaacuagguggugucuacugcuagggagauuauaugaaggccaaaauaaug

SEQ ID NO: 212682 - RNA, 64 nt, Homo Sapiens
guauuguguaacaaguacugcucccagcagcaauuagggagaaaacuagucuaaauuauuucaa

SEQ ID NO: 212683 - RNA, 64 nt, Homo Sapiens
agguuacaccacuccuucguccuuacaggagauguagggagaagaaucugcaggcugcuuguag

SEQ ID NO: 212684 - RNA, 64 nt, Homo Sapiens
agugacgggaaccuugaggaggaaacgccuguguuagggagagagugggugcgguguagaggau

SEQ ID NO: 212685 - RNA, 64 nt, Homo Sapiens
ccuccguaaacucaggaagugucaggugauuuccuagggagagguucccagucccagcaggcag

SEQ ID NO: 212686 - RNA, 64 nt, Homo Sapiens
uuagcccaggaguuaaagaccagccugggcaacauagggagacccugucuuuuuuuugggcagc

SEQ ID NO: 212687 - RNA, 64 nt, Homo Sapiens
guuguuaaaaguagggacucugccuuuuuguugguagggagaaaaaacgcuauugcuuugucuu

SEQ ID NO: 212688 - RNA, 64 nt, Homo Sapiens
cggagccgcacucuuuagccccggagcuccaggcccagcggaugcuggcacccaagcgcagcug

SEQ ID NO: 212689 - RNA, 64 nt, Homo Sapiens
gcuccugcagccggcccugcagcgcuacuuucugccagcggacgcggacccugacaccuacagc

SEQ ID NO: 212690 - RNA, 64 nt, Homo Sapiens
agguucacauguacagguaaguauauuguguauuucuguucauuuucuguucauagaguuguau

SEQ ID NO: 212691 - RNA, 64 nt, Homo Sapiens
uacagguaaguauauuguguauuucuguucauuuucuguucauagaguuguauaauaaaacaug

SEQ ID NO: 212692 - RNA, 64 nt, Homo Sapiens
cugucccacuuucuucauagcuuuguauuucugcucuguucauuggaugacucagagcgucugu

SEQ ID NO: 212693 - RNA, 64 nt, Homo Sapiens
ugucuggguauagucacuccgugaccacguucuaucuguucauugcguguguguguguguguac

SEQ ID NO: 212694 - RNA, 64 nt, Homo Sapiens
aaaucuuguaguuuauuguugggguccuaccauuucuguucaggaauucacuguaaaacauuca

SEQ ID NO: 212695 - RNA, 64 nt, Homo Sapiens
cgcgaaaggucuugcuuugucuuaaccguagaagucuguucaaauguuuuaaauuuaguuaaaa

SEQ ID NO: 212696 - RNA, 64 nt, Homo Sapiens
gugaguagcuuccaagguagcaaccuuugaccuuucuguucaagaaugaucaaaagugagcugg

SEQ ID NO: 212697 - RNA, 64 nt, Homo Sapiens
uugacaugaaauuggcugaucugaagaugcacucucuguucagucaguguuggcaaggaggacu

SEQ ID NO: 212698 - RNA, 64 nt, Homo Sapiens
uggaaacggaagauggaauacaucaaagugaauuucuguucaaguuuucccagauuaucauucu

SEQ ID NO: 212699 - RNA, 64 nt, Homo Sapiens
aucauuuguuucuuuugacucaaauuguauugcuucuguucagaugaucuuucauucaaugugu

SEQ ID NO: 212700 - RNA, 64 nt, Homo Sapiens
cccuggggaauugggaggaaccaagcccucuucaucuguucaugugcccagcauuuauuaagca

SEQ ID NO: 212701 - RNA, 64 nt, Homo Sapiens
ucagguguggucccugccugcuugaugaaguugcucuguucaagccuuuggugggaucaugugu

SEQ ID NO: 212702 - RNA, 64 nt, Homo Sapiens
uccauguagccuuuaauaugcuggguuaucaaauucuguucacugaguuaugaccagauaaaua

SEQ ID NO: 212703 - RNA, 64 nt, Homo Sapiens
ucaugauuaaggauuguugcuguuuuauaguuacucuguucaucacaguguaaauggugaugcg

SEQ ID NO: 212704 - RNA, 64 nt, Homo Sapiens; identical to SEQ ID NO: 111122

SEQ ID NO: 212705 - RNA, 64 nt, Homo Sapiens; identical to SEQ ID NO: 111123

SEQ ID NO: 212706 - RNA, 64 nt, Homo Sapiens; identical to SEQ ID NO: 111124

SEQ ID NO: 212707 - RNA, 64 nt, Homo Sapiens; identical to SEQ ID NO: 111125

SEQ ID NO: 212708 - RNA, 64 nt, Homo Sapiens; identical to SEQ ID NO: 111126

SEQ ID NO: 212709 - RNA, 64 nt, Homo Sapiens; identical to SEQ ID NO: 111127

SEQ ID NO: 212710 - RNA, 64 nt, Homo Sapiens; identical to SEQ ID NO: 111128

SEQ ID NO: 212711 - RNA, 64 nt, Homo Sapiens; identical to SEQ ID NO: 111129

SEQ ID NO: 212712 - RNA, 64 nt, Homo Sapiens; identical to SEQ ID NO: 111130

SEQ ID NO: 212713 - RNA, 64 nt, Homo Sapiens; identical to SEQ ID NO: 111131

SEQ ID NO: 212714 - RNA, 64 nt, Homo Sapiens; identical to SEQ ID NO: 111132

SEQ ID NO: 212715 - RNA, 64 nt, Homo Sapiens; identical to SEQ ID NO: 111133

SEQ ID NO: 212716 - RNA, 64 nt, Homo Sapiens; identical to SEQ ID NO: 111134

SEQ ID NO: 212717 - RNA, 64 nt, Homo Sapiens; identical to SEQ ID NO: 111135

SEQ ID NO: 212718 - RNA, 64 nt, Homo Sapiens; identical to SEQ ID NO: 111136

SEQ ID NO: 212719 - RNA, 64 nt, Homo Sapiens; identical to SEQ ID NO: 111137

SEQ ID NO: 212720 - RNA, 64 nt, Homo Sapiens; identical to SEQ ID NO: 111138

SEQ ID NO: 212721 - RNA, 64 nt, Homo Sapiens; identical to SEQ ID NO: 111139

SEQ ID NO: 212722 - RNA, 64 nt, Homo Sapiens; identical to SEQ ID NO: 111140

SEQ ID NO: 212723 - RNA, 64 nt, Homo Sapiens; identical to SEQ ID NO: 111141

SEQ ID NO: 212724 - RNA, 64 nt, Homo Sapiens; identical to SEQ ID NO: 111142

SEQ ID NO: 212725 - RNA, 64 nt, Homo Sapiens; identical to SEQ ID NO: 111143

SEQ ID NO: 212726 - RNA, 64 nt, Homo Sapiens; identical to SEQ ID NO: 111144

SEQ ID NO: 212727 - RNA, 64 nt, Homo Sapiens; identical to SEQ ID NO: 111145

SEQ ID NO: 212728 - RNA, 64 nt, Homo Sapiens; identical to SEQ ID NO: 111146

SEQ ID NO: 212729 - RNA, 64 nt, Homo Sapiens; identical to SEQ ID NO: 111147

SEQ ID NO: 212730 - RNA, 64 nt, Homo Sapiens; identical to SEQ ID NO: 111148

SEQ ID NO: 212731 - RNA, 64 nt, Homo Sapiens; identical to SEQ ID NO: 111149

SEQ ID NO: 212732 - RNA, 64 nt, Homo Sapiens; identical to SEQ ID NO: 111150

SEQ ID NO: 212733 - RNA, 64 nt, Homo Sapiens; identical to SEQ ID NO: 111151

SEQ ID NO: 212734 - RNA, 64 nt, Homo Sapiens; identical to SEQ ID NO: 111152

SEQ ID NO: 212735 - RNA, 64 nt, Homo Sapiens; identical to SEQ ID NO: 111153

SEQ ID NO: 212736 - RNA, 64 nt, Homo Sapiens; identical to SEQ ID NO: 111154

SEQ ID NO: 212737 - RNA, 64 nt, Homo Sapiens; identical to SEQ ID NO: 111155

SEQ ID NO: 212738 - RNA, 64 nt, Homo Sapiens; identical to SEQ ID NO: 111156

SEQ ID NO: 212739 - RNA, 64 nt, Homo Sapiens; identical to SEQ ID NO: 111157

SEQ ID NO: 212740 - RNA, 64 nt, Homo Sapiens; identical to SEQ ID NO: 111158

SEQ ID NO: 212741 - RNA, 64 nt, Homo Sapiens; identical to SEQ ID NO: 111159

SEQ ID NO: 212742 - RNA, 64 nt, Homo Sapiens; identical to SEQ ID NO: 111160

SEQ ID NO: 212743 - RNA, 64 nt, Homo Sapiens; identical to SEQ ID NO: 111161

SEQ ID NO: 212744 - RNA, 64 nt, Homo Sapiens; identical to SEQ ID NO: 111162

SEQ ID NO: 212745 - RNA, 64 nt, Homo Sapiens; identical to SEQ ID NO: 111163

SEQ ID NO: 212746 - RNA, 64 nt, Homo Sapiens; identical to SEQ ID NO: 111164

SEQ ID NO: 212747 - RNA, 64 nt, Homo Sapiens; identical to SEQ ID NO: 111165

SEQ ID NO: 212748 - RNA, 64 nt, Homo Sapiens; identical to SEQ ID NO: 111166

SEQ ID NO: 212749 - RNA, 64 nt, Homo Sapiens; identical to SEQ ID NO: 111167

SEQ ID NO: 212750 - RNA, 64 nt, Homo Sapiens; identical to SEQ ID NO: 111168

SEQ ID NO: 212751 - RNA, 64 nt, Homo Sapiens; identical to SEQ ID NO: 111169

SEQ ID NO: 212752 - RNA, 64 nt, Homo Sapiens; identical to SEQ ID NO: 111170

SEQ ID NO: 212753 - RNA, 64 nt, Homo Sapiens; identical to SEQ ID NO: 111171

SEQ ID NO: 212754 - RNA, 64 nt, Homo Sapiens; identical to SEQ ID NO: 111172

SEQ ID NO: 212755 - RNA, 64 nt, Homo Sapiens; identical to SEQ ID NO: 111173

SEQ ID NO: 212756 - RNA, 64 nt, Homo Sapiens; identical to SEQ ID NO: 111174

SEQ ID NO: 212757 - RNA, 64 nt, Homo Sapiens; identical to SEQ ID NO: 111175

SEQ ID NO: 212758 - RNA, 64 nt, Homo Sapiens; identical to SEQ ID NO: 111176

SEQ ID NO: 212759 - RNA, 64 nt, Homo Sapiens; identical to SEQ ID NO: 111177

SEQ ID NO: 212760 - RNA, 64 nt, Homo Sapiens; identical to SEQ ID NO: 111178

SEQ ID NO: 212761 - RNA, 64 nt, Homo Sapiens; identical to SEQ ID NO: 111179

SEQ ID NO: 212762 - RNA, 64 nt, Homo Sapiens; identical to SEQ ID NO: 111180

SEQ ID NO: 212763 - RNA, 64 nt, Homo Sapiens; identical to SEQ ID NO: 111181

SEQ ID NO: 212764 - RNA, 64 nt, Homo Sapiens; identical to SEQ ID NO: 111182

SEQ ID NO: 212765 - RNA, 64 nt, Homo Sapiens; identical to SEQ ID NO: 111183

SEQ ID NO: 212766 - RNA, 64 nt, Homo Sapiens; identical to SEQ ID NO: 111184

SEQ ID NO: 212767 - RNA, 64 nt, Homo Sapiens; identical to SEQ ID NO: 111185

SEQ ID NO: 212768 - RNA, 64 nt, Homo Sapiens; identical to SEQ ID NO: 111186

SEQ ID NO: 212769 - RNA, 64 nt, Homo Sapiens; identical to SEQ ID NO: 111187

SEQ ID NO: 212770 - RNA, 64 nt, Homo Sapiens; identical to SEQ ID NO: 111188

SEQ ID NO: 212771 - RNA, 64 nt, Homo Sapiens; identical to SEQ ID NO: 111189

SEQ ID NO: 212772 - RNA, 64 nt, Homo Sapiens; identical to SEQ ID NO: 111190

SEQ ID NO: 212773 - RNA, 64 nt, Homo Sapiens; identical to SEQ ID NO: 111191

SEQ ID NO: 212774 - RNA, 64 nt, Homo Sapiens; identical to SEQ ID NO: 111192

SEQ ID NO: 212775 - RNA, 64 nt, Homo Sapiens; identical to SEQ ID NO: 111193

SEQ ID NO: 212776 - RNA, 64 nt, Homo Sapiens; identical to SEQ ID NO: 111194

SEQ ID NO: 212777 - RNA, 64 nt, Homo Sapiens; identical to SEQ ID NO: 111195

SEQ ID NO: 212778 - RNA, 64 nt, Homo Sapiens; identical to SEQ ID NO: 111196

SEQ ID NO: 212779 - RNA, 64 nt, Homo Sapiens; identical to SEQ ID NO: 111197

SEQ ID NO: 212780 - RNA, 64 nt, Homo Sapiens; identical to SEQ ID NO: 111198

SEQ ID NO: 212781 - RNA, 64 nt, Homo Sapiens; identical to SEQ ID NO: 111199

SEQ ID NO: 212782 - RNA, 64 nt, Homo Sapiens; identical to SEQ ID NO: 111200

SEQ ID NO: 212783 - RNA, 64 nt, Homo Sapiens; identical to SEQ ID NO: 111201

SEQ ID NO: 212784 - RNA, 64 nt, Homo Sapiens; identical to SEQ ID NO: 111202

SEQ ID NO: 212785 - RNA, 64 nt, Homo Sapiens; identical to SEQ ID NO: 111203

SEQ ID NO: 212786 - RNA, 64 nt, Homo Sapiens; identical to SEQ ID NO: 111204

SEQ ID NO: 212787 - RNA, 64 nt, Homo Sapiens; identical to SEQ ID NO: 111205

SEQ ID NO: 212788 - RNA, 64 nt, Homo Sapiens; identical to SEQ ID NO: 111206

SEQ ID NO: 212789 - RNA, 64 nt, Homo Sapiens; identical to SEQ ID NO: 111207

SEQ ID NO: 212790 - RNA, 64 nt, Homo Sapiens; identical to SEQ ID NO: 111208

SEQ ID NO: 212791 - RNA, 64 nt, Homo Sapiens; identical to SEQ ID NO: 111209

SEQ ID NO: 212792 - RNA, 64 nt, Homo Sapiens; identical to SEQ ID NO: 111210

SEQ ID NO: 212793 - RNA, 64 nt, Homo Sapiens; identical to SEQ ID NO: 111211

SEQ ID NO: 212794 - RNA, 64 nt, Homo Sapiens; identical to SEQ ID NO: 111212

SEQ ID NO: 212795 - RNA, 64 nt, Homo Sapiens; identical to SEQ ID NO: 111213

SEQ ID NO: 212796 - RNA, 64 nt, Homo Sapiens; identical to SEQ ID NO: 111214

SEQ ID NO: 212797 - RNA, 64 nt, Homo Sapiens; identical to SEQ ID NO: 111215

SEQ ID NO: 212798 - RNA, 64 nt, Homo Sapiens; identical to SEQ ID NO: 111216

SEQ ID NO: 212799 - RNA, 64 nt, Homo Sapiens; identical to SEQ ID NO: 111217

SEQ ID NO: 212800 - RNA, 64 nt, Homo Sapiens; identical to SEQ ID NO: 111218

SEQ ID NO: 212801 - RNA, 64 nt, Homo Sapiens; identical to SEQ ID NO: 111219

SEQ ID NO: 212802 - RNA, 64 nt, Homo Sapiens; identical to SEQ ID NO: 111220

SEQ ID NO: 212803 - RNA, 64 nt, Homo Sapiens; identical to SEQ ID NO: 111221

SEQ ID NO: 212804 - RNA, 64 nt, Homo Sapiens; identical to SEQ ID NO: 111222

SEQ ID NO: 212805 - RNA, 64 nt, Homo Sapiens; identical to SEQ ID NO: 111223

SEQ ID NO: 212806 - RNA, 64 nt, Homo Sapiens; identical to SEQ ID NO: 111224

SEQ ID NO: 212807 - RNA, 64 nt, Homo Sapiens; identical to SEQ ID NO: 111225

SEQ ID NO: 212808 - RNA, 64 nt, Homo Sapiens; identical to SEQ ID NO: 111226

SEQ ID NO: 212809 - RNA, 64 nt, Homo Sapiens; identical to SEQ ID NO: 111227

SEQ ID NO: 212810 - RNA, 64 nt, Homo Sapiens; identical to SEQ ID NO: 111228

SEQ ID NO: 212811 - RNA, 64 nt, Homo Sapiens; identical to SEQ ID NO: 111229

SEQ ID NO: 212812 - RNA, 64 nt, Homo Sapiens; identical to SEQ ID NO: 111230

SEQ ID NO: 212813 - RNA, 64 nt, Homo Sapiens; identical to SEQ ID NO: 111231

SEQ ID NO: 212814 - RNA, 64 nt, Homo Sapiens; identical to SEQ ID NO: 111232

SEQ ID NO: 212815 - RNA, 64 nt, Homo Sapiens; identical to SEQ ID NO: 111233

SEQ ID NO: 212816 - RNA, 64 nt, Homo Sapiens; identical to SEQ ID NO: 111234

SEQ ID NO: 212817 - RNA, 64 nt, Homo Sapiens; identical to SEQ ID NO: 111235

SEQ ID NO: 212818 - RNA, 64 nt, Homo Sapiens; identical to SEQ ID NO: 111236

SEQ ID NO: 212819 - RNA, 64 nt, Homo Sapiens; identical to SEQ ID NO: 111237

SEQ ID NO: 212820 - RNA, 64 nt, Homo Sapiens; identical to SEQ ID NO: 111238

SEQ ID NO: 212821 - RNA, 64 nt, Homo Sapiens; identical to SEQ ID NO: 111239

SEQ ID NO: 212822 - RNA, 64 nt, Homo Sapiens; identical to SEQ ID NO: 111240

SEQ ID NO: 212823 - RNA, 64 nt, Homo Sapiens; identical to SEQ ID NO: 111241

SEQ ID NO: 212824 - RNA, 64 nt, Homo Sapiens; identical to SEQ ID NO: 111242

SEQ ID NO: 212825 - RNA, 64 nt, Homo Sapiens; identical to SEQ ID NO: 111243

SEQ ID NO: 212826 - RNA, 64 nt, Homo Sapiens; identical to SEQ ID NO: 111244

SEQ ID NO: 212827 - RNA, 64 nt, Homo Sapiens; identical to SEQ ID NO: 111245

SEQ ID NO: 212828 - RNA, 64 nt, Homo Sapiens; identical to SEQ ID NO: 111246

SEQ ID NO: 212829 - RNA, 64 nt, Homo Sapiens; identical to SEQ ID NO: 111247

SEQ ID NO: 212830 - RNA, 64 nt, Homo Sapiens; identical to SEQ ID NO: 111248

SEQ ID NO: 212831 - RNA, 64 nt, Homo Sapiens; identical to SEQ ID NO: 111249

SEQ ID NO: 212832 - RNA, 64 nt, Homo Sapiens; identical to SEQ ID NO: 111250

SEQ ID NO: 212833 - RNA, 64 nt, Homo Sapiens; identical to SEQ ID NO: 111251

SEQ ID NO: 212834 - RNA, 64 nt, Homo Sapiens; identical to SEQ ID NO: 111252

SEQ ID NO: 212835 - RNA, 64 nt, Homo Sapiens; identical to SEQ ID NO: 111253

SEQ ID NO: 212836 - RNA, 64 nt, Homo Sapiens; identical to SEQ ID NO: 111254

SEQ ID NO: 212837 - RNA, 64 nt, Homo Sapiens; identical to SEQ ID NO: 111255

SEQ ID NO: 212838 - RNA, 64 nt, Homo Sapiens; identical to SEQ ID NO: 111256

SEQ ID NO: 212839 - RNA, 64 nt, Homo Sapiens; identical to SEQ ID NO: 111257

SEQ ID NO: 212840 - RNA, 64 nt, Homo Sapiens; identical to SEQ ID NO: 111258

SEQ ID NO: 212841 - RNA, 64 nt, Homo Sapiens; identical to SEQ ID NO: 111259

SEQ ID NO: 212842 - RNA, 64 nt, Homo Sapiens; identical to SEQ ID NO: 111260

SEQ ID NO: 212843 - RNA, 64 nt, Homo Sapiens; identical to SEQ ID NO: 111261

SEQ ID NO: 212844 - RNA, 64 nt, Homo Sapiens; identical to SEQ ID NO: 111262

SEQ ID NO: 212845 - RNA, 64 nt, Homo Sapiens; identical to SEQ ID NO: 111263

SEQ ID NO: 212846 - RNA, 64 nt, Homo Sapiens; identical to SEQ ID NO: 111264

SEQ ID NO: 212847 - RNA, 64 nt, Homo Sapiens; identical to SEQ ID NO: 111265

SEQ ID NO: 212848 - RNA, 64 nt, Homo Sapiens; identical to SEQ ID NO: 111266

SEQ ID NO: 212849 - RNA, 64 nt, Homo Sapiens; identical to SEQ ID NO: 111267

SEQ ID NO: 212850 - RNA, 64 nt, Homo Sapiens; identical to SEQ ID NO: 111268

SEQ ID NO: 212851 - RNA, 64 nt, Homo Sapiens; identical to SEQ ID NO: 111269

SEQ ID NO: 212852 - RNA, 64 nt, Homo Sapiens; identical to SEQ ID NO: 111270

SEQ ID NO: 212853 - RNA, 64 nt, Homo Sapiens; identical to SEQ ID NO: 111271

SEQ ID NO: 212854 - RNA, 64 nt, Homo Sapiens; identical to SEQ ID NO: 111272

SEQ ID NO: 212855 - RNA, 64 nt, Homo Sapiens; identical to SEQ ID NO: 111273

SEQ ID NO: 212856 - RNA, 64 nt, Homo Sapiens; identical to SEQ ID NO: 111274

SEQ ID NO: 212857 - RNA, 64 nt, Homo Sapiens; identical to SEQ ID NO: 111275

SEQ ID NO: 212858 - RNA, 64 nt, Homo Sapiens; identical to SEQ ID NO: 111276

SEQ ID NO: 212859 - RNA, 64 nt, Homo Sapiens; identical to SEQ ID NO: 111277

SEQ ID NO: 212860 - RNA, 64 nt, Homo Sapiens; identical to SEQ ID NO: 111278

SEQ ID NO: 212861 - RNA, 64 nt, Homo Sapiens; identical to SEQ ID NO: 111279

SEQ ID NO: 212862 - RNA, 64 nt, Homo Sapiens; identical to SEQ ID NO: 111280

SEQ ID NO: 212863 - RNA, 64 nt, Homo Sapiens; identical to SEQ ID NO: 111281

SEQ ID NO: 212864 - RNA, 64 nt, Homo Sapiens; identical to SEQ ID NO: 111282

SEQ ID NO: 212865 - RNA, 64 nt, Homo Sapiens; identical to SEQ ID NO: 111283

SEQ ID NO: 212866 - RNA, 64 nt, Homo Sapiens; identical to SEQ ID NO: 111284

SEQ ID NO: 212867 - RNA, 64 nt, Homo Sapiens; identical to SEQ ID NO: 111285

SEQ ID NO: 212868 - RNA, 64 nt, Homo Sapiens; identical to SEQ ID NO: 111286

SEQ ID NO: 212869 - RNA, 64 nt, Homo Sapiens; identical to SEQ ID NO: 111287

SEQ ID NO: 212870 - RNA, 64 nt, Homo Sapiens; identical to SEQ ID NO: 111288

SEQ ID NO: 212871 - RNA, 64 nt, Homo Sapiens; identical to SEQ ID NO: 111289

SEQ ID NO: 212872 - RNA, 64 nt, Homo Sapiens; identical to SEQ ID NO: 111290

SEQ ID NO: 212873 - RNA, 64 nt, Homo Sapiens; identical to SEQ ID NO: 111291

SEQ ID NO: 212874 - RNA, 64 nt, Homo Sapiens; identical to SEQ ID NO: 111292

SEQ ID NO: 212875 - RNA, 64 nt, Homo Sapiens; identical to SEQ ID NO: 111293

SEQ ID NO: 212876 - RNA, 64 nt, Homo Sapiens; identical to SEQ ID NO: 111294

SEQ ID NO: 212877 - RNA, 64 nt, Homo Sapiens; identical to SEQ ID NO: 111295

SEQ ID NO: 212878 - RNA, 64 nt, Homo Sapiens; identical to SEQ ID NO: 111296

SEQ ID NO: 212879 - RNA, 64 nt, Homo Sapiens; identical to SEQ ID NO: 111297

SEQ ID NO: 212880 - RNA, 64 nt, Homo Sapiens; identical to SEQ ID NO: 111298

SEQ ID NO: 212881 - RNA, 64 nt, Homo Sapiens; identical to SEQ ID NO: 111299

SEQ ID NO: 212882 - RNA, 64 nt, Homo Sapiens; identical to SEQ ID NO: 111300

SEQ ID NO: 212883 - RNA, 64 nt, Homo Sapiens; identical to SEQ ID NO: 111301

SEQ ID NO: 212884 - RNA, 64 nt, Homo Sapiens; identical to SEQ ID NO: 111302

SEQ ID NO: 212885 - RNA, 64 nt, Homo Sapiens; identical to SEQ ID NO: 111303

SEQ ID NO: 212886 - RNA, 64 nt, Homo Sapiens; identical to SEQ ID NO: 111304

SEQ ID NO: 212887 - RNA, 64 nt, Homo Sapiens
cacggccccugccguggggcucacucugcagcuggagagacagcauaccugaaaccugcaagga

SEQ ID NO: 212888 - RNA, 64 nt, Homo Sapiens
uaaaacaacagaacagccaggaaaauggugcuaggagagacaguggagaggccagagaagcaaa

SEQ ID NO: 212889 - RNA, 64 nt, Homo Sapiens
ugaaauuucuaccaagcguuuucauggaugcuaugagagacaauccugaagcugcuguacauau

SEQ ID NO: 212890 - RNA, 64 nt, Homo Sapiens
aggcgaccuuggcuaucagacuugaaauauucacgagagacaauaaacgcugaaaggccagugc

SEQ ID NO: 212891 - RNA, 64 nt, Homo Sapiens
cauacuuauuaaguucgaacauguuucacuuaaggagagacaccuagcuuagucauggcaaguu

SEQ ID NO: 212892 - RNA, 64 nt, Homo Sapiens
aggaauauaaauauuugguaauucuguguaacaagagagacauggaaaaggaaaaaaauccacu

SEQ ID NO: 212893 - RNA, 64 nt, Homo Sapiens
agccaacgaaggaggucauuacgugauagauguugagagacagagguugagagacacagcugcu

SEQ ID NO: 212894 - RNA, 64 nt, Homo Sapiens
gcugcuacgugauagauguuugggugccuggguugagagacacaucucacugccuccagagagg

SEQ ID NO: 212895 - RNA, 64 nt, Homo Sapiens
ucucagucagcacuuccugugggugcaugucacagagagacagugaagguuuauggauuugaca

SEQ ID NO: 212896 - RNA, 64 nt, Homo Sapiens
ggcuccccucgagggagacugccaagcuguccgugagagacacguuuccaagaaugugaaucuu

SEQ ID NO: 212897 - RNA, 64 nt, Homo Sapiens
uccuugcugcaggccggguggccaauccaggugggagagacacucccagggacaagggaaggaa

SEQ ID NO: 212898 - RNA, 64 nt, Homo Sapiens
auuaccugccacuuccaggagcccagagggccaagagagacauugccuccaccucuccuuggaa

SEQ ID NO: 212899 - RNA, 64 nt, Homo Sapiens
aucucaaauaggcuugguggccuguggaaaagaagagagacagagagacagugucugaaacagg

SEQ ID NO: 212900 - RNA, 64 nt, Homo Sapiens
uaggcuugguggccuguggaaaagaagagagacagagagacagugucugaaacaggauggcaga

SEQ ID NO: 212901 - RNA, 64 nt, Homo Sapiens
guguguguguguguguguguaugagagagagagagagagacaacagagacagagagaggcagag

SEQ ID NO: 212902 - RNA, 64 nt, Homo Sapiens
agacaacagagacagagagaggcagagaggcauagagagacagagagagagacaagaaacagag

SEQ ID NO: 212903 - RNA, 64 nt, Homo Sapiens
cagagagaggcagagaggcauagagagacagagagagagacaagaaacagagauagacagaaaa

SEQ ID NO: 212904 - RNA, 64 nt, Homo Sapiens
acuccggagugagaagcuuugcccuccuaagagagagagacagagagacagagagagagaaaga

SEQ ID NO: 212905 - RNA, 64 nt, Homo Sapiens
gugagaagcuuugcccuccuaagagagagagacagagagacagagagagagaaagagagagugu

SEQ ID NO: 212906 - RNA, 64 nt, Homo Sapiens
gagggagagagggacagagagagggagagaggcagagagacagacagagagggagagaggcaga

SEQ ID NO: 212907 - RNA, 64 nt, Homo Sapiens
ggggaagagaggcagagagggagacagagggagagagagacagaaggagacagagagggagaga

SEQ ID NO: 212908 - RNA, 64 nt, Homo Sapiens
gggagagagagacagagggggacagagagggagagagagacagaagagggagagaaacagagga

SEQ ID NO: 212909 - RNA, 64 nt, Homo Sapiens
ggaggcagagagggagagaagagauaugaggagagagagacagaagagguggggagaggggaga

SEQ ID NO: 212910 - RNA, 64 nt, Homo Sapiens
ucuuguuccagugacaguuggaaggccucugcuggagagacaccagcucucagggcagagauug

SEQ ID NO: 212911 - RNA, 64 nt, Homo Sapiens
aauauguccucaggccagauacugauugcuaguagagagacacccggcacccaguccgaagccc

SEQ ID NO: 212912 - RNA, 64 nt, Homo Sapiens
guacucccaugauggcuuccgcuaguuacauacgcucugacauacaacggggaaagaccugaca

SEQ ID NO: 212913 - RNA, 64 nt, Homo Sapiens
ugguccuuugccuuaucuugcccuuucuuggugucucugacaaagaccauccaaauggaaauuc

SEQ ID NO: 212914 - RNA, 64 nt, Homo Sapiens
guggccaugagcagaugagauguuuagcaaauggcucugacaggguguguuggaucuacuaaca

SEQ ID NO: 212915 - RNA, 64 nt, Homo Sapiens
uggcucaccgcugucauuuggucuguguugcagccucugacacggcaaguagaauaguuucuga

SEQ ID NO: 212916 - RNA, 64 nt, Homo Sapiens
agugguaaaaaagcaaguagauuacaagcugucucucugacaccugcuggcaccaaauauuagg

SEQ ID NO: 212917 - RNA, 64 nt, Homo Sapiens
acaguauuuuuucugaccagcuaagaauuccucacucugacaugcuccccagcaccaccucaua

SEQ ID NO: 212918 - RNA, 64 nt, Homo Sapiens
uuuuaaagcuuuuggauuguugcuauaggguuugcucugacaauuuuaaggucuagauaggguu

SEQ ID NO: 212919 - RNA, 64 nt, Homo Sapiens
guuccaaauaugacucccuauaucucuacuguccagcauguauuauagcauguaacuucuccua

SEQ ID NO: 212920 - RNA, 64 nt, Homo Sapiens
uucuccuauaucucuacugucaaugagaagacauagcauguaacugcagauuuauggauauuau

SEQ ID NO: 212921 - RNA, 64 nt, Homo Sapiens
cuauuuuaugcaaauauuuuuuuguagaugaaaaagcauguacaguguucuguuuaauacucau

SEQ ID NO: 212922 - RNA, 64 nt, Homo Sapiens
augaaugugugugguuuuuuuucuaaaacuaaauagcauguauugugucuuuugcaugaugauc

SEQ ID NO: 212923 - RNA, 64 nt, Homo Sapiens
agagggaacauuuccuuagaggggguugggaggaagcauguaaguaagguguugaaagagugca

SEQ ID NO: 212924 - RNA, 64 nt, Homo Sapiens
ugggauauugggaugaggaagcuucuagggaguuagcauguagaccucagagguaggcaaguuu

SEQ ID NO: 212925 - RNA, 64 nt, Homo Sapiens
gagguuaacaucauccaugauaagcccuuuugauagcauguauccuugauagcaucacaucaua

SEQ ID NO: 212926 - RNA, 64 nt, Homo Sapiens
uuaaaugaauuagugaauguaagauacuuuagaaagcauguaaaguacuagaaacaaugaggug

SEQ ID NO: 212927 - RNA, 64 nt, Homo Sapiens
ucuuucaugagggagucaauauguaguggaaagaagcauguagcaaaaaagacaaccuugaucu

SEQ ID NO: 212928 - RNA, 64 nt, Homo Sapiens
caaaaaaagcagaacccacuggaguagaaaaggaagcauguagcauauacucaguagugaaauu

SEQ ID NO: 212929 - RNA, 64 nt, Homo Sapiens
ugacaagggguuacaugcugcaacccuuauuccacugccuuauugccugagugcuggccucugu

SEQ ID NO: 212930 - RNA, 64 nt, Homo Sapiens
uuccuuucacuccauucauuuggaaacuucuucccugccuuaccgcuuucuuuggaaaccagga

SEQ ID NO: 212931 - RNA, 64 nt, Homo Sapiens
agagccauuuauuuuuagaguuuuugauggcaugcugccuuaaaaaucccauuagagguacuuu

SEQ ID NO: 212932 - RNA, 64 nt, Homo Sapiens
ggggcgaaccuuuuaggauucaaccuaagauguucugccuuaucauaccauguauaauuuucua

SEQ ID NO: 212933 - RNA, 64 nt, Homo Sapiens
uucuauagugaagacaagcagguuauuuaaaaaucugccuuagacgacuccauccuuuuucagg

SEQ ID NO: 212934 - RNA, 64 nt, Homo Sapiens
gucaccucauguugcagaccgaggaaagagaacacugccuuacauucuucucauaggaaugcua

SEQ ID NO: 212935 - RNA, 64 nt, Homo Sapiens
ccugaaccacgccccagacuuccgccgggucuaccugccuuaugucaccaaccagaccuaucag

SEQ ID NO: 212936 - RNA, 64 nt, Homo Sapiens
ccauuggggccugagccaaggaacuuuccuucuacugccuuauagugcuuaaacauucuccgcc

SEQ ID NO: 212937 - RNA, 64 nt, Homo Sapiens
cauaaccuccgccucccagguucaagcaauucuccugccuuagccuccugaguagcugggauua

SEQ ID NO: 212938 - RNA, 64 nt, Homo Sapiens
uagaaggauuuaaauaaguaaaagcuacuauguacugccuuagugcugaugccuguguacugcc

SEQ ID NO: 212939 - RNA, 64 nt, Homo Sapiens
uacuauguacugccuuagugcugaugccuguguacugccuuaaauguaccuauggcaauuuagc

SEQ ID NO: 212940 - RNA, 64 nt, Homo Sapiens
guuuucaucaaugucuuuguaaagcacaaauuaucugccuuaaaggggcucugggucggggaau

SEQ ID NO: 212941 - RNA, 64 nt, Homo Sapiens
agggacccugccuacaccucauuuccagugugggcugccuuaguuaguuaugagaacagggaag

SEQ ID NO: 212942 - RNA, 64 nt, Homo Sapiens
aaugcacaaugauuuguacuuucgccuugauguucugccuuauaucuugaaauuccuaguuuaa

SEQ ID NO: 212943 - RNA, 64 nt, Homo Sapiens
uuugccaaagcaacggccacaagugaauuauuaccugccuuagcgcccuuagucuucauuuaug

SEQ ID NO: 212944 - RNA, 64 nt, Homo Sapiens
ugcagccucuaccucccagguucaagugauuauccugccuuagccuccugaguagcugggauua

SEQ ID NO: 212945 - RNA, 64 nt, Homo Sapiens
uaacaaagaaguaaccuuauaacugcucucuagucugccuuauuugugucauagaguaagauau

SEQ ID NO: 212946 - RNA, 64 nt, Homo Sapiens
guauauuauagaaacaguuuuguugauccccacacugccuuaaggaccauaucuccagggaugu

SEQ ID NO: 212947 - RNA, 64 nt, Homo Sapiens
cauuaacuaauucaauucauuuuugggaaauuaucugccuuauacuccuccagugagccccaua

SEQ ID NO: 212948 - RNA, 64 nt, Homo Sapiens
gcaaaagcuuuacaaauggaaaccaugcaauuaccugccuuaguucuuuugucauaaaaacaau

SEQ ID NO: 212949 - RNA, 64 nt, Homo Sapiens
guauuagacauacuguuuuuauaauguuuuacuucugccuuaagauuuagguuuuuuaaaugua

SEQ ID NO: 212950 - RNA, 64 nt, Homo Sapiens
uuuaacagaaacauuugaaauagaauuugcaugucugccuuaauuaacuuaaagacugauuuua

SEQ ID NO: 212951 - RNA, 64 nt, Homo Sapiens
uuuuuuuuuuuuacucccccucuaaacacugcugcugccuuaauuuuagaaagcagcuuacuag

SEQ ID NO: 212952 - RNA, 64 nt, Homo Sapiens
aaauaaagguaacuuuaccuuucuuaaauauuuccugccuuaaagagagcauuuccaugacuuu

SEQ ID NO: 212953 - RNA, 64 nt, Homo Sapiens
cgcuuugcaucuaucaguaaauaaaauucuucagcugccuuauuaggagugcuaugaggguaac

SEQ ID NO: 212954 - RNA, 64 nt, Homo Sapiens
cuuaauuccucaggcuuugcgauuuaaggaggagcugccuuaaaaaaaaauaaaggccuuauuu

SEQ ID NO: 212955 - RNA, 64 nt, Homo Sapiens
ucauuugcaguguuuucugccacagaccuuugggcugccuuauauugugugugugugugggugu

SEQ ID NO: 212956 - RNA, 64 nt, Homo Sapiens
ggcugcugcggccccgcagugugaacguuggcugcugccuuagcugcugaugacggcaggaggg

SEQ ID NO: 212957 - RNA, 64 nt, Homo Sapiens
gcacaggggaggcagguccuuggcgagguagccccugccuuaauccacggggcuccuuucccuc

SEQ ID NO: 212958 - RNA, 64 nt, Homo Sapiens
uuggauuuggcuuuccuguccuaaagauuuuggcagaaucaaugugacuacuuggugcuaacua

SEQ ID NO: 212959 - RNA, 64 nt, Homo Sapiens
acuuaaaggcaaaggagugaugaagcaaaaagcaagaaucaauuacuggcccacccacuugugu

SEQ ID NO: 212960 - RNA, 64 nt, Homo Sapiens
uagaaccuuuagauacuccacucaaauuuucuauagaaucaagaaagaggcaauucauuaaacu

SEQ ID NO: 212961 - RNA, 64 nt, Homo Sapiens
gggaaagggguuggguggggauaaaauacuggguagaaucaaauaacucagucuuccaacugca

SEQ ID NO: 212962 - RNA, 64 nt, Homo Sapiens
gcagauuugaaacuaacccaccaagaucacacacagaaucaauuuguuugguuauauggucaga

SEQ ID NO: 212963 - RNA, 64 nt, Homo Sapiens
aaugcuuucgagaaguucgcuggcuaagauucuuagaaucaauguuuuguuguuguucuuuuuu

SEQ ID NO: 212964 - RNA, 64 nt, Homo Sapiens
agcuuccucaacuacuguuuuucagaaggaagaaagaaucaaauggaagaagaaucaaguccau

SEQ ID NO: 212965 - RNA, 64 nt, Homo Sapiens
guuuuucagaaggaagaaagaaucaaauggaagaagaaucaaguccaugcccaagcccaaagcc

SEQ ID NO: 212966 - RNA, 64 nt, Homo Sapiens
cuguaucaucauugggaccaccugggcgcuuguuagaaucaaagacucucaggccucaccuaga

SEQ ID NO: 212967 - RNA, 64 nt, Homo Sapiens
gaaucaaagacucucaggccucaccuagacauccagaaucaaaaucugcauuuuaacaagaugc

SEQ ID NO: 212968 - RNA, 64 nt, Homo Sapiens
aacaaauacauuuuaauuaaaaacaaucuguaacagaaucaagaucaagaaacaaauuuuaauu

SEQ ID NO: 212969 - RNA, 64 nt, Homo Sapiens
aacaaauuuuaauuaaacaauccauguauauaacagaaucaagaaucccuuuucacaugguuuc

SEQ ID NO: 212970 - RNA, 61 nt, Homo Sapiens
gagagaaacauucagccuaauacuuuaggcuagaaucaaaaacaaguuaguguucuauggu

SEQ ID NO: 212971 - RNA, 64 nt, Homo Sapiens
aaagcccaaagguuccuaagccuggcugcaaagaagaaucaacagggacacuuuuuaaaaacac

SEQ ID NO: 212972 - RNA, 64 nt, Homo Sapiens
uugcucucugaaggagcuuuauaccgcacuucauagaaucaaagacacacacacacaugcacac

SEQ ID NO: 212973 - RNA, 64 nt, Homo Sapiens
gcagaaaacaaaaacaacaguuuucuuucccuuaagaaucaaaaucuugcugaauuugauaugu

SEQ ID NO: 212974 - RNA, 64 nt, Homo Sapiens
auugauuguccuggggcuaaaaacauugcaaaggagaaucaaagugggcauaaaaaagugauca

SEQ ID NO: 212975 - RNA, 64 nt, Homo Sapiens
aucaauuaauuauaaagccuaagauguagaaagaagaaucaagcguguccaauuucauuuuuaa

SEQ ID NO: 212976 - RNA, 64 nt, Homo Sapiens
agaccgcuagcaagacuaaugaagaaaagagagaagaaucaaauagaugcaauaaaaaaugaua

SEQ ID NO: 212977 - RNA, 64 nt, Homo Sapiens
gaaauggaagagcauuccaugcucauggguaggaagaaucaauaucaugaaaauggcccauacu

SEQ ID NO: 212978 - RNA, 64 nt, Homo Sapiens
aaacaaaagaaacauuuauaaacuaaagaaaaacuaaaagaaugacagaacaaucaucuuagca

SEQ ID NO: 212979 - RNA, 64 nt, Homo Sapiens
uuagcacccuuuccucacaauaauauaaaaauauuaaaagaacauaggcaggcuuuuuuuaaau

SEQ ID NO: 212980 - RNA, 64 nt, Homo Sapiens
ugugaaauauauauacauauauauauauauuuccuaaaagaagaaaagauaccuuucuguucaa

SEQ ID NO: 212981 - RNA, 64 nt, Homo Sapiens
gcugggggggagggaaaugacuaaugaagcuaauuaaaagaagcauucaaaucugcuuucuacc

SEQ ID NO: 212982 - RNA, 64 nt, Homo Sapiens
ugcucuaguaugguguauuuaaauaauaaaaacuuaaaagaaaaaauauuuaaugguguuuggg

SEQ ID NO: 212983 - RNA, 64 nt, Homo Sapiens
aggcagcuuucaucacacccuuuuaacauuuaucuaaaagaauuuaaauucuuuuucaaaaauu

SEQ ID NO: 212984 - RNA, 64 nt, Homo Sapiens
uuggauuuacgacugaagaaggacauuuucucuuuaaaagaaaguuagguuauaagaaacagag

SEQ ID NO: 212985 - RNA, 64 nt, Homo Sapiens
aaagaaacuagucccagauuguuggcauuucaguuaaaagaaaaugaaaaaacccugggcugaa

SEQ ID NO: 212986 - RNA, 64 nt, Homo Sapiens
cgcgacaucuuucuaagauucuucucucauucauuaaaagaaaagauucagggauacaaauggg

SEQ ID NO: 212987 - RNA, 64 nt, Homo Sapiens
auaaggcaaucauauauucaagaagauggggauauaaaagaaguucuaguuuucauaaucuauu

SEQ ID NO: 212988 - RNA, 64 nt, Homo Sapiens
uuuaucugcaaaugugcaaguauaauucuguucuuaaaagaaaaagcuguguuagggauuaaac

SEQ ID NO: 212989 - RNA, 64 nt, Homo Sapiens
auuuuaaugaaauguguuggaaagcaucaauaauuaaaagaauuguaaaauggacuucuuauuc

SEQ ID NO: 212990 - RNA, 64 nt, Homo Sapiens
acaucuucagaagagaagacagagaacauggcauuaaaagaaucaagucaggucaccagaggga

SEQ ID NO: 212991 - RNA, 64 nt, Homo Sapiens
uggguuuaugcacuaaacguaaaaugcuaaaucuuaaaagaaaccuaagauaagagacuaaaau

SEQ ID NO: 212992 - RNA, 64 nt, Homo Sapiens
aggaggcauuuucaucuuuauaaguauuauuuucuaaaagaaaucaaagaugcagcaagcuuau

SEQ ID NO: 212993 - RNA, 64 nt, Homo Sapiens
gaccccugucuauauauuuuuuuaauuuaaaaaauaaaagaauaaaauuguguagcucaguaua

SEQ ID NO: 212994 - RNA, 64 nt, Homo Sapiens
ccuacucacauuucuacacuuuauaaaaauguaauaaaagaaaauuaucuuucuaaaaagccua

SEQ ID NO: 212995 - RNA, 64 nt, Homo Sapiens
guccuugcuuauauggcaaccacugcuagaacccuaaaagaaccaaaaaucugccacagccugc

SEQ ID NO: 212996 - RNA, 64 nt, Homo Sapiens
aaaauaucaaauauaacucuuagagaaauguacauaaaagaaugcuucguaauuuuggaguagg

SEQ ID NO: 212997 - RNA, 64 nt, Homo Sapiens
gccacuacccuauaauuagugcagucuuauguuauaaaagaaagaaguuaacuauauuugggga

SEQ ID NO: 212998 - RNA, 64 nt, Homo Sapiens
uuugcccacaauuugcaaucuguggguuaauaguuaaaagaauguucccaaccaaaaaauucuu

SEQ ID NO: 212999 - RNA, 64 nt, Homo Sapiens
ugcucagcuauuuuaaagaggaaauuaaauauuauaaaagaaauaguaaagauaaguuauccuc

SEQ ID NO: 213000 - RNA, 64 nt, Homo Sapiens
aacaguaccuacuugaaaggaucauugugcggauuaaaagaaauaauauauguaaagcacuuua

SEQ ID NO: 213001 - RNA, 64 nt, Homo Sapiens
acuacuugauuuacaaaaauguacauuuagagguuaaaagaaacagugagaaauguaaacauuc

SEQ ID NO: 213002 - RNA, 64 nt, Homo Sapiens
gaacuuugauaauguugaagaugaagaaaaaguuuaaaagaaauucugacagaugacaucagaa

SEQ ID NO: 213003 - RNA, 64 nt, Homo Sapiens
aguuguacugccagaauuaucuacagcacugguguaaaagaagggucugcaaacuuuuucugua

SEQ ID NO: 213004 - RNA, 64 nt, Homo Sapiens
auuuuggaaacaguauuuguuuaccagaccuugguaaaagaacuuuugaccugguuguguuauu

SEQ ID NO: 213005 - RNA, 64 nt, Homo Sapiens
aauugcuagaaacauuugauuuaagucguguuuguaaaagaaguaccugcauaacuuuuugucu

SEQ ID NO: 213006 - RNA, 64 nt, Homo Sapiens
aaacuuuugcugaggucuugcacucuaacaaaaguaaaagaacaaccuuuuuuuuuuucuucuc

SEQ ID NO: 213007 - RNA, 64 nt, Homo Sapiens
aaagaaaaaaaaaggaaaaaaccuucauaugcaguaaaagaaagacccuacauuccagcaucuu

SEQ ID NO: 213008 - RNA, 64 nt, Homo Sapiens
gggcuguuuugcccaaaguuuccuggugagagcuuaaaagaaaucaguauaaaagcuacuuugc

SEQ ID NO: 213009 - RNA, 64 nt, Homo Sapiens
gaguuaguuuugagguaacuaacagaaccauuaauaaaagaaagugguaaauugcacauugugc

SEQ ID NO: 213010 - RNA, 64 nt, Homo Sapiens
aaauaaaacaaauaaaacuaaaugaaggguuuuuuaaaagaacuagagaaauaagaauaaaacu

SEQ ID NO: 213011 - RNA, 64 nt, Homo Sapiens
guacuuguacuucccaccacuggaaauguuagcauaaaagaacuuggagaggaaaaaaguauua

SEQ ID NO: 213012 - RNA, 64 nt, Homo Sapiens
uugauagauggggugugggaccaacaaaccaaauuaaaagaaauuguuuuucuuucaguacacu

SEQ ID NO: 213013 - RNA, 64 nt, Homo Sapiens
uguuuuguuuuuuuaagaacagaaacaacuauuuuaaaagaacucuuuuaagaaauuucauaaa

SEQ ID NO: 213014 - RNA, 64 nt, Homo Sapiens
gagcaguuacaagaaacccuaaaacccuuggauauaaaagaaaucuguuuauugauuuuuaaau

SEQ ID NO: 213015 - RNA, 64 nt, Homo Sapiens
aaccuguucagaguccugguuuaaucaaucaagcuaaaagaaucgaagacaucccuagugcaug

SEQ ID NO: 213016 - RNA, 64 nt, Homo Sapiens
uagagcugcaaaaaagggacacaccccacuucgguaaaagaaaauagggaaaggccauaaacaa

SEQ ID NO: 213017 - RNA, 64 nt, Homo Sapiens
guggauucagcagaaggcaagaugguuauaauucuaaaagaauagcuuguuuguuuguuuggga

SEQ ID NO: 213018 - RNA, 64 nt, Homo Sapiens
gggaagauaauuaaaggcagaaugacugcguuuguaaaagaaggaccaccaacuauacugacau

SEQ ID NO: 213019 - RNA, 64 nt, Homo Sapiens
uaauugauauuugugcugaggugauauuccugucuaaaagaacaacauugucuuucuuuucuag

SEQ ID NO: 213020 - RNA, 64 nt, Homo Sapiens
ugucagucauuguuaguucuugucuaguuuucauuaaaagaacaaagaucuuuuauauggauau

SEQ ID NO: 213021 - RNA, 64 nt, Homo Sapiens
ucaaaaaugcaaaaugugauaaugggcacuuguuuaaaagaauuaguguauccagccuucacuc

SEQ ID NO: 213022 - RNA, 64 nt, Homo Sapiens
uuuguauuuaauacaaaguucucagcguuuuucauaaaagaacucugcuaagcacuuugugggu

SEQ ID NO: 213023 - RNA, 64 nt, Homo Sapiens
auguaauuuguuuacaaaccacuuauuuauguccuaaaagaagagcuuaaauugcucuauuuua

SEQ ID NO: 213024 - RNA, 64 nt, Homo Sapiens
ugcuuuagcuucuggucagcugccaaucuuagccuaaaagaaauaaauugggucuaugauuuuu

SEQ ID NO: 213025 - RNA, 64 nt, Homo Sapiens
agccaaagugaaaaaaaguucaaaucuucauuuauaaaagaaaaguuaucuuugacuuuuacca

SEQ ID NO: 213026 - RNA, 64 nt, Homo Sapiens
cgguucuaauucaugugcagugauauaguauagauaaaagaaugaguaaaagaaaauacaagaa

SEQ ID NO: 213027 - RNA, 64 nt, Homo Sapiens
augugcagugauauaguauagauaaaagaaugaguaaaagaaaauacaagaauucuaaagaaag

SEQ ID NO: 213028 - RNA, 64 nt, Homo Sapiens
auaauggcuuucaaugaguuccuauguggauuuuuaaaagaacagaacaguaaugaaauauuug

SEQ ID NO: 213029 - RNA, 64 nt, Homo Sapiens
auuuaaaucagugaauauguuaaaaaguuugguuuaaaagaacuauaucuauauguauauuuuc

SEQ ID NO: 213030 - RNA, 64 nt, Homo Sapiens
gaagaaguauauuuuagaaauuuguuaaugagaguaaaagaaaauaaauguguauagcucaguu

SEQ ID NO: 213031 - RNA, 64 nt, Homo Sapiens
auagguuaaacaugguuagaaacaacugaaagcauaaaagaaaaaucuaggccgggugcagugg

SEQ ID NO: 213032 - RNA, 64 nt, Homo Sapiens
uuuccauaucauuucuaauuauaguuuauauccuuaaaagaaggaugccacaguaguauguaaa

SEQ ID NO: 213033 - RNA, 64 nt, Homo Sapiens
uagaaagaaaagcacaucuuccugaucacaguuauaaaagaaacccugaggccgggcgcggugg

SEQ ID NO: 213034 - RNA, 64 nt, Homo Sapiens
agaagccaaagcugcucuuggaaagcaucugagauaaaagaagcacgugcaaggaaaugaagcg

SEQ ID NO: 213035 - RNA, 64 nt, Homo Sapiens
aaaaagguaaauauuuuaagcuuagauguccuuguaaaagaauaacugcaaccagaagguaaaa

SEQ ID NO: 213036 - RNA, 64 nt, Homo Sapiens
uuuaaaagaaaaaaaaucagugugcucauaugaauaaaagaaaucuucucuaauuacuauacau

SEQ ID NO: 213037 - RNA, 64 nt, Homo Sapiens
uaagccauuuaacauuuuuuaaacauaagagucuuaaaagaaauuaauacccauuuaaugugaa

SEQ ID NO: 213038 - RNA, 64 nt, Homo Sapiens
uaagcauaaaaaucgaguaaauaugguugaaauguaaaagaaaggucucauggaaaaauuaauu

SEQ ID NO: 213039 - RNA, 64 nt, Homo Sapiens
ucugcauuugucacgaagacuuugagccaaguaauaaaagaaauugaaaaggaucaacaguuaa

SEQ ID NO: 213040 - RNA, 64 nt, Homo Sapiens
aguaugugaauaugaauugaguagccuugccuuuuaaaagaaaagcguccauguugcuuuauau

SEQ ID NO: 213041 - RNA, 64 nt, Homo Sapiens
ugugacauuuuaaaaaacaaagauauauauuuacuaaaagaauuaauuuguuuuauauucucua

SEQ ID NO: 213042 - RNA, 64 nt, Homo Sapiens
uggcuauuuuggggagaaaaauugaaucaucaaauaaaagaaugacuauuugaaucaaaaaugu

SEQ ID NO: 213043 - RNA, 64 nt, Homo Sapiens
ucaguaaaauauuuugcuugguacucuggcaauuuaaaagaaaaucuuaaccaguucacuuauu

SEQ ID NO: 213044 - RNA, 64 nt, Homo Sapiens
auucauuguuuugcaaaaguguaugguaggggcuuaaaagaaacuauaaaguuuuauuugaaug

SEQ ID NO: 213045 - RNA, 64 nt, Homo Sapiens
ccauuuguguuucagcucacaguucuuugcuggguaaaagaaauacuuucugacagucaccuga

SEQ ID NO: 213046 - RNA, 64 nt, Homo Sapiens
aaacuucuguuuguuuuuagucuaugguuuccuuuaaaagaaaagaaauuuuuuucaggacugc

SEQ ID NO: 213047 - RNA, 57 nt, Homo Sapiens
agauugaaugaagaauuuuugagauuguaaaagaagcucgccaauuuuagcaaauaa

SEQ ID NO: 213048 - RNA, 64 nt, Homo Sapiens
caacggcucuuuucagggccacccacgucuucucuaaaagaacuuaacauuuauuccaugugaa

SEQ ID NO: 213049 - RNA, 64 nt, Homo Sapiens
cuuuuugaaaacaguguagcgaacaccgcagauuuaaaagaaaaacuagagggaagguggucca

SEQ ID NO: 213050 - RNA, 64 nt, Homo Sapiens
aucagcagacuggaagcugaggaagaucuagaaguaaaagaaaaaauuagaugcguuaaaauga

SEQ ID NO: 213051 - RNA, 64 nt, Homo Sapiens
uauuuuuuuuucugugacuauguuuucacuuacauaaaagaaauugugauagaccuuuuucaua

SEQ ID NO: 213052 - RNA, 64 nt, Homo Sapiens
uuacugaagaaugagguuuuucauaccugaagaguaaaagaaaaacuaagagaucaaacugaga

SEQ ID NO: 213053 - RNA, 64 nt, Homo Sapiens
guuauauguaaugugauaaauuagcuaugaaugguaaaagaacaaaacugaucagaguaaauuc

SEQ ID NO: 213054 - RNA, 64 nt, Homo Sapiens
uucuaucauauaagauguauuuuuuuauuguccuuaaaagaagcucuagcaugaaauuaaagga

SEQ ID NO: 213055 - RNA, 64 nt, Homo Sapiens
uaauaagcaaauuauuggcuucuuucuucuagacuaaaagaaauuaaagagaugaaacaaucaa

SEQ ID NO: 213056 - RNA, 64 nt, Homo Sapiens
agaagaaagagagaaagaaagaaacagaaaaaccuaaaagaaagcgaaugaauuugacaccugu

SEQ ID NO: 213057 - RNA, 64 nt, Homo Sapiens
gaaaaaaauaguuggaaaauuucucugcuaaagguaaaagaaaagccucuaaaaugaugcuguu

SEQ ID NO: 213058 - RNA, 64 nt, Homo Sapiens
caaacccagauagauauguagagguuaccuuuaauaaaagaagaggucuguucuugcucucaag

SEQ ID NO: 213059 - RNA, 64 nt, Homo Sapiens
uuuuguaauuaaaugccuuuauugcuuuuuuauuuaaaagaaaaauuuuguggugauucgugcc

SEQ ID NO: 213060 - RNA, 64 nt, Homo Sapiens
ggcaggacucauauuauucagucaagaguguaaauaaaagaaauucugucauaauucuugcuga

SEQ ID NO: 213061 - RNA, 64 nt, Homo Sapiens
agucuuucagucagagcucaagucuuagucgacauaaaagaauacacacuagagaaaaaccuua

SEQ ID NO: 213062 - RNA, 64 nt, Homo Sapiens
cacauuuuuguauuuuaauagucuacaggcuauauaaaagaacauggcuuuuugacugauaaaa

SEQ ID NO: 213063 - RNA, 64 nt, Homo Sapiens
auaaauaaauaaauaaacaaaccagucuuuauuuuaaaagaaacuuuaggaaacaaacccacau

SEQ ID NO: 213064 - RNA, 64 nt, Homo Sapiens
uggacacccuaaacugugugugccuuuaaccaguuaaaagaacagugccuucagcauacuuuuu

SEQ ID NO: 213065 - RNA, 64 nt, Homo Sapiens
gacauuaagaguuccugaaaagguagaguuucuguaaaagaagaaccuaauuacaucaggauag

SEQ ID NO: 213066 - RNA, 64 nt, Homo Sapiens
auuucccauugcauacagguauugacuugguacuuaaaagaaaguacauuguacaguuaaagaa

SEQ ID NO: 213067 - RNA, 64 nt, Homo Sapiens
uuugucucagaucccagauucuaugaucccugcuuaaaagaaaauguucacugcauguagguug

SEQ ID NO: 213068 - RNA, 64 nt, Homo Sapiens
uaaaaauauaauuaccuguaagguuaucugguuuuaaaagaaaaaaaaaaagccuacaaacuca

SEQ ID NO: 213069 - RNA, 64 nt, Homo Sapiens
uaccaggaguaauauuuggaauauuuaaaucuaguaaaagaagaaaguuguacuuccuggcugg

SEQ ID NO: 213070 - RNA, 64 nt, Homo Sapiens
aauucagaaaauucaccugaaacguauuuugaccuaaaagaaacauauuuuuguaucaguauug

SEQ ID NO: 213071 - RNA, 64 nt, Homo Sapiens
ucuuuguaugucucaagguaagaaaauagcucuuuaaaagaauguuaaccuuugugcaauacca

SEQ ID NO: 213072 - RNA, 64 nt, Homo Sapiens
auucugcauagaaacauggcuuguguuuaaggcauaaaagaagacaaggcagcaacaagcucuu

SEQ ID NO: 213073 - RNA, 64 nt, Homo Sapiens
acuuugaagucuauaaaaaauguuccagugucuauaaaagaaaccaugcuuaccagauucacac

SEQ ID NO: 213074 - RNA, 64 nt, Homo Sapiens
uaaaauauaucaucaaguucagccugaguaaaguuaaaagaaugugauauauaaauauauuuau

SEQ ID NO: 213075 - RNA, 64 nt, Homo Sapiens
ggaaaauauacaaucaagauaucucauggcauauuaaaagaaaaaucuuaauagcaguguuggc

SEQ ID NO: 213076 - RNA, 64 nt, Homo Sapiens
uuaucugcuucuuaaagaaucagccgagacaccauaaaagaaauaggcuuuuugugccuuuugc

SEQ ID NO: 213077 - RNA, 64 nt, Homo Sapiens
agcaaagugagucaucagauuaugaguuacuguuuaaaagaaaaaugcuguuuauucaugcuga

SEQ ID NO: 213078 - RNA, 64 nt, Homo Sapiens
agccuuuuaaaauauucuacagaccuacggggcuuaaaagaaccccaguaccgacuaagcaaau

SEQ ID NO: 213079 - RNA, 64 nt, Homo Sapiens
aaaguaugucugucauccagcuccaucucaaaaauaaaagaauacagccugggugacagugaaa

SEQ ID NO: 213080 - RNA, 64 nt, Homo Sapiens
uuuuuugagacaaagucucguuuuuuuuuuuaauuaaaagaauuacaggaaguaguaaagcuuu

SEQ ID NO: 213081 - RNA, 64 nt, Homo Sapiens
aagcucugaguuuucagcaccaguagauuuguauuaaaagaaaaaaaaauggggccuuagcuuc

SEQ ID NO: 213082 - RNA, 64 nt, Homo Sapiens
aaacaaauagccaucugcuaucagcaucauuauguaaaagaaaauauauuuuagccccuaaaau

SEQ ID NO: 213083 - RNA, 64 nt, Homo Sapiens
ccauaugcuauauacagcuuaacucacagaacuguaaaagaaaauuauaaaauaauucaacaug

SEQ ID NO: 213084 - RNA, 64 nt, Homo Sapiens
aaauaauucaacauguccaucuuuuuagugauaauaaaagaaagcaugguauuaaacuaucaua

SEQ ID NO: 213085 - RNA, 64 nt, Homo Sapiens
uauacuuacuuccugcauuuagagggaguuuauuuaaaagaaauaaaugacaaucaaaccaaau

SEQ ID NO: 213086 - RNA, 64 nt, Homo Sapiens
aauuauuuguaaaucauguggcaucuauguauaauaaaagaaagagacaacuauauuacucaau

SEQ ID NO: 213087 - RNA, 64 nt, Homo Sapiens
cuaguguuguugggaacuaauugaacagcuacaguaaaagaaguuccuaucucauugccuuugu

SEQ ID NO: 213088 - RNA, 64 nt, Homo Sapiens
cucauugccuuuguggaaaggcuucccuaugugguaaaagaaaggcauuccuccguaaccuagg

SEQ ID NO: 213089 - RNA, 64 nt, Homo Sapiens
uaggggaugguccaggaucuaaugaaagugacuuuaaaagaaaaauauggcuucaaguuguaaa

SEQ ID NO: 213090 - RNA, 64 nt, Homo Sapiens
uuaccauucaguuaauucaaucuguauagaaaucuaaaagaauuaaucagaacuaaccaguacc

SEQ ID NO: 213091 - RNA, 64 nt, Homo Sapiens
uagaauggcugaagagaucaggccugauaccacauaaaagaaugauuuaaaccuugguuaucuu

SEQ ID NO: 213092 - RNA, 64 nt, Homo Sapiens
uccaacugacuuuuaaacuucuuggucuuuuaauuaaaagaaauacaaaggagcuucuuguccc

SEQ ID NO: 213093 - RNA, 64 nt, Homo Sapiens
cuugcuucacuguucaccugaaucucaaagccaguaaaagaaaugcauguaaaagauguauuac

SEQ ID NO: 213094 - RNA, 64 nt, Homo Sapiens
uuuguuuacuuacccauuagaaauaacuuguuuguaaaagaaaaaggaggaucccuaugacuca

SEQ ID NO: 213095 - RNA, 64 nt, Homo Sapiens
ugacuaugaauugaaacacaauauggucucuucuuaaaagaaguuuuauauaagaguuuuguca

SEQ ID NO: 213096 - RNA, 64 nt, Homo Sapiens
guaaacauugguaagaaugauuucaagauauuuguaaaagaacaauaauucuugaaugaggcaa

SEQ ID NO: 213097 - RNA, 64 nt, Homo Sapiens
uauacaucauuuuugcccucacuauggacagauguaaaagaaacugcuuagcaauguucuaauc

SEQ ID NO: 213098 - RNA, 64 nt, Homo Sapiens
auuuaucuuauaucguagaucugauaacccuaucuaaaagaaagucacacgcuaaauguauucu

SEQ ID NO: 213099 - RNA, 64 nt, Homo Sapiens
uucaguucacucacccaauguacaaccaaugaaauaaaagaagcauuuaaaaggauuguauagu

SEQ ID NO: 213100 - RNA, 64 nt, Homo Sapiens
aaauguucuuucaguuuuuagaaccuccauuuuauaaaagaauuauccuaucaauggauucuuu

SEQ ID NO: 213101 - RNA, 64 nt, Homo Sapiens
aacccagcuugcagguaagagcuuucaccuuugguaaaagaacagcuggggagguucaaggggu

SEQ ID NO: 213102 - RNA, 64 nt, Homo Sapiens
uuacaaaugcuuuccaagugcaagggaagaaauguaaaagaauuacaugcuaaaaggcaaauuu

SEQ ID NO: 213103 - RNA, 64 nt, Homo Sapiens
accauugacauuaccagacacuauauagcuaagcuaaaagaauaugaauuagacgacaaagcau

SEQ ID NO: 213104 - RNA, 64 nt, Homo Sapiens
ugaggaaaaggaagugcuucggaaaggaagaaauuaaaagaaaggauccaauaaguaaauucau

SEQ ID NO: 213105 - RNA, 64 nt, Homo Sapiens
auuauuggauuaaaagaugaagugcccuucguuuuaaaagaaagaagacgaugugacugcauga

SEQ ID NO: 213106 - RNA, 64 nt, Homo Sapiens
uuagauuaauaauccaacuuuaauaguauacauuuaaaagaaaaaaaacaaaagcccuggaagu

SEQ ID NO: 213107 - RNA, 64 nt, Homo Sapiens
ucagguauaaaaacaagagaucauaauaaaaaccuaaaagaaccuaugaucacggucuucccuu

SEQ ID NO: 213108 - RNA, 64 nt, Homo Sapiens
auucaccaaauggagcuuggcacuaaaauuuauguaaaagaaaaaucacaaaccuugaaaaauu

SEQ ID NO: 213109 - RNA, 64 nt, Homo Sapiens
ggaauauauauuagauguaaagaauuuucugcaauaaaagaaacuagacuuguuaaucccugcc

SEQ ID NO: 213110 - RNA, 64 nt, Homo Sapiens
aaguuuugguuauauuuuuauuauggcaaauguauaaaagaaacgaacuuuucugguauuacgu

SEQ ID NO: 213111 - RNA, 64 nt, Homo Sapiens
cgcuugucucugugagcacagcgcaguggagaaguaaaagaagcuuauuuacaacugaauuccu

SEQ ID NO: 213112 - RNA, 64 nt, Homo Sapiens
uugugaaaggugauggguuuuauucguugggcuuuaaaagaaaagguuuggcagaacuaaaaac

SEQ ID NO: 213113 - RNA, 64 nt, Homo Sapiens
ccuacacaugugccccugaaccuaaaaaaaaaguuaaaagaaaaacguuuggauuauuuucccu

SEQ ID NO: 213114 - RNA, 64 nt, Homo Sapiens
acugaaaagaaaugaaaucucaguuccacuaugauaaaagaaacgaaucaccagugucugucag

SEQ ID NO: 213115 - RNA, 64 nt, Homo Sapiens
gguugauugacuguuaauugauucaggguacccuuaaaagaaaagaaguuuucccauugugaac

SEQ ID NO: 213116 - RNA, 64 nt, Homo Sapiens
augucauuucuuaagcaguuaugcucuuaaugcuuaaaagaaggcuagcauuguuugcacaaaa

SEQ ID NO: 213117 - RNA, 64 nt, Homo Sapiens
ugaaugguacaguagauguaaaaaaaauucaguuuaaaagaacauuuguuuuuacauuaaaugu

SEQ ID NO: 213118 - RNA, 64 nt, Homo Sapiens
acccuuuauaaagagauuuucaaguggauauauauaaaagaaacaguugcuuguaaaauauacu

SEQ ID NO: 213119 - RNA, 64 nt, Homo Sapiens
agccacaucauguuaaacauuaacugguuuggauuaaaagaacauuaauauuauaauacacaua

SEQ ID NO: 213120 - RNA, 64 nt, Homo Sapiens
ucugacugaaagaaaaaugccauuaaaagucauguaaaagaacaaugguggaguaccgcgcaga

SEQ ID NO: 213121 - RNA, 64 nt, Homo Sapiens
cugaauggauaaaaccaugaacacaggaaauucauaaaagaaauaaccaucugcgaaaggacac

SEQ ID NO: 213122 - RNA, 64 nt, Homo Sapiens
acucugcuagucuuggcaaaucauacagaauguuuaaaagaaaagucccccagucugacauauu

SEQ ID NO: 213123 - RNA, 64 nt, Homo Sapiens
acaaugaauuagaagagaucuugugcacaauguuuaaaagaaaacuuucuaugugaauauaagc

SEQ ID NO: 213124 - RNA, 64 nt, Homo Sapiens
augcaaaucaaagauauuugguagucaaaauaaguaaaagaaauauaggaauauuccagucaau

SEQ ID NO: 213125 - RNA, 64 nt, Homo Sapiens
ucuuuuauaaagagacucaaagcuaaugauagcuuaaaagaaaaguuaaugccuucucauugga

SEQ ID NO: 213126 - RNA, 64 nt, Homo Sapiens
uacuuugcuuuuaaagaaacuuuaguauugcuauuaaaagaaguugcaauguuuuaaacagagu

SEQ ID NO: 213127 - RNA, 64 nt, Homo Sapiens
agaucaaguugucauuuuagaaauuuugaauguauaaaagaaaauaaaauaauagaagaaauag

SEQ ID NO: 213128 - RNA, 60 nt, Homo Sapiens
ugcaucgauguaaucagaauaaauuaaacauaaaagaaauuuagaggacacacugguuaa

SEQ ID NO: 213129 - RNA, 64 nt, Homo Sapiens
cauaugaaugagaaauccuagacuuuucugaauauaaaagaaauaugcuuuuggcaacaccuca

SEQ ID NO: 213130 - RNA, 64 nt, Homo Sapiens
cauacuggaggaaaagcccucaccuuacuacucauaaaagaauuaagacuucaacuguuccuca

SEQ ID NO: 213131 - RNA, 64 nt, Homo Sapiens
caauuacuacugcuaaauguguuuaaagaaugaguaaaagaaaggcccgacucucacuucauau

SEQ ID NO: 213132 - RNA, 64 nt, Homo Sapiens
gauacuuaacaauaauugggguugaacaaacauguaaaagaagagguuuuuacuuagaucauga

SEQ ID NO: 213133 - RNA, 64 nt, Homo Sapiens
auaucaugcuuuaaaguguaauaauaugauuuuuuaaaagaaauuuauuacuuguugcaaaggu

SEQ ID NO: 213134 - RNA, 64 nt, Homo Sapiens
uauuuauugaagaaacagauaccauacucauuucuaaaagaauauucagagaauaucaagauga

SEQ ID NO: 213135 - RNA, 64 nt, Homo Sapiens
auuuucacaugucugcuuauuuauuuuauauuuuuaaaagaagacaguauucaccuauguauuu

SEQ ID NO: 213136 - RNA, 64 nt, Homo Sapiens
uuuuuuacauaucuaucaauaucagagauuuggguaaaagaauggguaauguuuaaacaugugg

SEQ ID NO: 213137 - RNA, 64 nt, Homo Sapiens
augcugaugacuugguggguuccaguacaauaaauaaaagaaagcuuguguaauuuccugcucc

SEQ ID NO: 213138 - RNA, 64 nt, Homo Sapiens
uaaauaaucauacacagaaaaaagaguagaacuuuaaaagaaggauaguauacacaucauaaac

SEQ ID NO: 213139 - RNA, 64 nt, Homo Sapiens
uuaacagcuugaaacaucuacagauaguuccuacuaaaagaaguggccugcagaaguuuaauaa

SEQ ID NO: 213140 - RNA, 64 nt, Homo Sapiens
aaagccauaaugguagaagauggcauacugauuauaaaagaagcagaaaaacauugauuuuuuu

SEQ ID NO: 213141 - RNA, 64 nt, Homo Sapiens
cguaagccucugcaauuuuaaugcauauuugaaauaaaagaaagcuuauuccugguuaaucacu

SEQ ID NO: 213142 - RNA, 64 nt, Homo Sapiens
uaaaaaguaauuuuuggaaauggaaaugaaacauuaaaagaacuaauacccaauauauauuuuu

SEQ ID NO: 213143 - RNA, 64 nt, Homo Sapiens
cauucaaaauuugaugugcuugcgcacauagcuuuaaaagaagauaugugugugcgugcgugug

SEQ ID NO: 213144 - RNA, 64 nt, Homo Sapiens
gaaauggcaggauucuaaagagagccugguuuguuaaaagaaaacacugucaugcugucaguuc

SEQ ID NO: 213145 - RNA, 64 nt, Homo Sapiens
ggaucauuuuaacccugacuuccccuuauucccauaaaagaaguuuuccaguggaauggagauu

SEQ ID NO: 213146 - RNA, 64 nt, Homo Sapiens
guaaauggguugccaacauaagcuggcugagaaauaaaagaaaacaagacaguuguucauaaag

SEQ ID NO: 213147 - RNA, 64 nt, Homo Sapiens
guaacugaauugaaucaaccaguuugcauuuaaauaaaagaacaggcucaguggucuuccugua

SEQ ID NO: 213148 - RNA, 64 nt, Homo Sapiens
cccuguuaauuauagaauggaccaaauacauuuuuaaaagaaaacugagaccaaucagauggaa

SEQ ID NO: 213149 - RNA, 64 nt, Homo Sapiens
uugagcauugcuuacuuaugguuaaagugcuucuuaaaagaaccauaguccauuuacaauuuug

SEQ ID NO: 213150 - RNA, 64 nt, Homo Sapiens
ugucagcccugaucaguuuggugugggauacaugguggucaaguugguggugguggggguggug

SEQ ID NO: 213151 - RNA, 64 nt, Homo Sapiens
guauagauagcguguuaaagagagguucgagaauguggucaauuuacuuuuuucccccuuguaa

SEQ ID NO: 213152 - RNA, 64 nt, Homo Sapiens
gcaucggggaauuugcuccauacacaagguaaacguggucaaggcauuggccaggugugauuuu

SEQ ID NO: 213153 - RNA, 64 nt, Homo Sapiens
guuugggggaauuugugaccgcuugaaucuguucguggucaaaguccaaugcccugguuuuccu

SEQ ID NO: 213154 - RNA, 64 nt, Homo Sapiens
ugcuucaagauuaccaggacucaaccaucuggagguggucaaacccuggaugaugcugugcagu

SEQ ID NO: 213155 - RNA, 64 nt, Homo Sapiens
uguuauuugcugccuauaguuucggaacaagacuguggucaaccacggcgugaaggggcagaaa

SEQ ID NO: 213156 - RNA, 64 nt, Homo Sapiens
aauguaaauagaacgaauuauuuucuuguuuugaauugucaauauauuaaauguugacucuuug

SEQ ID NO: 213157 - RNA, 64 nt, Homo Sapiens
gaguuguuggcaaguuucaauggugagaaacauuauugucaacuugaaauguguucuguaaugg

SEQ ID NO: 213158 - RNA, 64 nt, Homo Sapiens
ucacaauuaaaucagacuucucauucaguaacugauugucaaaaucuaggcaauguggacuacc

SEQ ID NO: 213159 - RNA, 64 nt, Homo Sapiens
uucacagaacuauuaaacauacuaaaaguaauauauugucaauguuucucaagaacuguguacc

SEQ ID NO: 213160 - RNA, 64 nt, Homo Sapiens
uuauauuuuuguuuuauauaggucccaaauuauaauugucaaauauauauuuuaaauuaauaaa

SEQ ID NO: 213161 - RNA, 64 nt, Homo Sapiens
gaaccaaggggaaauguugugagauaacauuuacauugucaaccuuuauugacuuuguuuuuac

SEQ ID NO: 213162 - RNA, 64 nt, Homo Sapiens
uuuccagauuacugguaaaaagcaaucauuuuaaauugucaaaauuugaugcagacauaaaaau

SEQ ID NO: 213163 - RNA, 64 nt, Homo Sapiens
aaaaguaaaaucguucucuuggauaaugcuguuuauugucaagauacauuauuccuaauaauag

SEQ ID NO: 213164 - RNA, 64 nt, Homo Sapiens
acaaggguuaccugaaaagaaaaaaaaagucaacauugucaagcuguuuguuuacucuuucuuu

SEQ ID NO: 213165 - RNA, 64 nt, Homo Sapiens
ccucaccuuaaaggagacuaccccuuugccccauauugucaaccuaauuuucucucguacucuc

SEQ ID NO: 213166 - RNA, 64 nt, Homo Sapiens
uuaugaagguuccaaucagaaaauacaauucuacauugucaagcgugguuacacacuuuuuaag

SEQ ID NO: 213167 - RNA, 64 nt, Homo Sapiens
ugaugaauauggaauauccauaugaaagguuuacauugucaaaguuuuaagcaaaauauuauuu

SEQ ID NO: 213168 - RNA, 64 nt, Homo Sapiens
aucccacagauucaaucuucaggugagaauuuucauugucaaaacccacugguuagauguugua

SEQ ID NO: 213169 - RNA, 64 nt, Homo Sapiens
ugauagaaacagcaggugaugacucugcacucucauugucaagguuagauauauccccaguugc

SEQ ID NO: 213170 - RNA, 63 nt, Homo Sapiens
auucccuacuaaccuccaccauuuugccuuuuaaacaacuaggauuuaauuagucaggcaucc

SEQ ID NO: 213171 - RNA, 63 nt, Homo Sapiens
ucuauauuuaugggcaauauugauugagacugcaacaacuacauucaggauauaugaguuggc

SEQ ID NO: 213172 - RNA, 63 nt, Homo Sapiens
uuucaaaaguaaauguaauacaacuaaccuucuaacaacuaucuucuuuuuuuuccugaaaaa

SEQ ID NO: 213173 - RNA, 63 nt, Homo Sapiens
cuucuaacaacuaucuuucauuuuuuccugaaaaacaacuaacauuuuuacaucagauuucuu

SEQ ID NO: 213174 - RNA, 63 nt, Homo Sapiens
guugauguaguuuuaaaccaccaacuaguaauaaacaacuacuauuugugugcccuggaauuu

SEQ ID NO: 213175 - RNA, 63 nt, Homo Sapiens
ggaguaccaugaggguugcuauuuguuguuuuuaacaacuaaucaagagugagugaacaacua

SEQ ID NO: 213176 - RNA, 63 nt, Homo Sapiens
uuguuguuuuuaacaacuaaucaagagugagugaacaacuauuuauaaacuagaucuccuauu

SEQ ID NO: 213177 - RNA, 63 nt, Homo Sapiens
cugaagcaugcacaugccacugucaccaaaacaaacaacuaccacuuuccaaauuucauucag

SEQ ID NO: 213178 - RNA, 63 nt, Homo Sapiens
uguuauuuauguuauuuauauuagcuaacaggaaacaacuacuguguuucaacauaauaaaua

SEQ ID NO: 213179 - RNA, 64 nt, Homo Sapiens
ggauauaugaacauuuuucuuuuauuguuuuaucuucacagaaaauaaaagguguuaauuugcu

SEQ ID NO: 213180 - RNA, 64 nt, Homo Sapiens
acauacggagauauuugaagacccaagucugccuuucacagagcccuccauuccaaguuuaguu

SEQ ID NO: 213181 - RNA, 64 nt, Homo Sapiens
uacagucaacguugguacauagaaccaccaucaauucacagaauuaguguccaauuguauucac

SEQ ID NO: 213182 - RNA, 64 nt, Homo Sapiens
caccaucaauucacagaauuaguguccaauuguauucacagaaccauucaguuuacccauugcu

SEQ ID NO: 213183 - RNA, 64 nt, Homo Sapiens
ucaaaaaauaugucuaauguaauuaaaacacaaguucacagauuuacagugaacuugaucuaca

SEQ ID NO: 213184 - RNA, 64 nt, Homo Sapiens
aguucacagauuuacagugaacuugaucuacaaguucacagauccauugugugguuuaauagac

SEQ ID NO: 213185 - RNA, 64 nt, Homo Sapiens
uacccuguuuuccuuguauacuuacgcuuauacauucacagaacagcagcauuguuaaauaguu

SEQ ID NO: 213186 - RNA, 64 nt, Homo Sapiens
auaacuguucugcucauggauaaagcacuacguuuucacagacaacagguaaaaaugcaccuuu

SEQ ID NO: 213187 - RNA, 64 nt, Homo Sapiens
agccacuaaauacguuauugcuugaugaagaccuuucacagaauccuauggauugcagcauuuc

SEQ ID NO: 213188 - RNA, 64 nt, Homo Sapiens
ccaacugagaauuuauuuuuguuucauugguuguuucacagaauuagaacacacacgacuuuuu

SEQ ID NO: 213189 - RNA, 64 nt, Homo Sapiens
aucuuugggccuuuucauuauugugagaauauuuuucacagauuaaugagaucuaccgacucac

SEQ ID NO: 213190 - RNA, 64 nt, Homo Sapiens
cacaauuuugcccuuugcgauuaaguaaagucaauucacagaagaagcucaucacagccuagag

SEQ ID NO: 213191 - RNA, 64 nt, Homo Sapiens
uggccagauagggccuuccugagaaggggcaaguuucacagaaaccaacaguuacggagugcuu

SEQ ID NO: 213192 - RNA, 64 nt, Homo Sapiens
cccaacucagaggaaaaggguuggagccaugcccuucacagaguacaccagauaccucagcuua

SEQ ID NO: 213193 - RNA, 64 nt, Homo Sapiens
cauuuacuuucagaauccucaaguuaaauguagauucacagauacaauuuucauucucauuagg

SEQ ID NO: 213194 - RNA, 64 nt, Homo Sapiens
aaugggaagugacucuagucgcccccaccccugcuucacagaauuucacagugggggauggagg

SEQ ID NO: 213195 - RNA, 64 nt, Homo Sapiens
cuuaccagcauauauaguauuggucauuuagaguuucacagacucuauuguaggcucacuggau

SEQ ID NO: 213196 - RNA, 64 nt, Homo Sapiens
cuguguaacagaacacagccggucaucugauaauuucacagaugcagggauuugcucaccccaa

SEQ ID NO: 213197 - RNA, 64 nt, Homo Sapiens
gcaucuccccaccgaggccccggcagcagucuuguucacagaccuuaggcaccagacuggaggc

SEQ ID NO: 213198 - RNA, 64 nt, Homo Sapiens
gcaggccaggacugcuuuuuuuuaaugcucccauuucacagaggauaccaccgagacucggagg

SEQ ID NO: 213199 - RNA, 64 nt, Homo Sapiens
cuuaauaggacaguaaaucuguguggggcuagaacaaaauuaagacauguuuggcaauauuuca

SEQ ID NO: 213200 - RNA, 64 nt, Homo Sapiens
uuuucauuguuuuaaguuuuucuucugaguaaaacaaaauuauagaaaacaaaugcaacaaugu

SEQ ID NO: 213201 - RNA, 64 nt, Homo Sapiens
auuuagcaaaagagccagucauuuuaugaaaaaucaaaauuauaagugauuuuaaaaaccagaa

SEQ ID NO: 213202 - RNA, 64 nt, Homo Sapiens
uaaauuugcucauacagcuugaacguuguauuugcaaaauuaagccuucgauuuuuauaaaugu

SEQ ID NO: 213203 - RNA, 64 nt, Homo Sapiens
uguuuaagugaaguuuugugugaaaacuguaugccaaaauuaguuguuucuaauauuguccagu

SEQ ID NO: 213204 - RNA, 64 nt, Homo Sapiens
ccgggcaugguggcucacgcacuggcaagauuaacaaaauuagguuuugugucaauggcuugaa

SEQ ID NO: 213205 - RNA, 64 nt, Homo Sapiens
gaucauugucuuggaccuccugcaucagccuauucaaaauuaucucucucucuagcuuuccaca

SEQ ID NO: 213206 - RNA, 64 nt, Homo Sapiens
gcaggagacaugugauuaugaucaggaaacugcacaaaauuauuguuuucagcccccguguuau

SEQ ID NO: 213207 - RNA, 64 nt, Homo Sapiens
aaagaauaugucaggaaauaaggucacuuuaugucaaaauuauuugaguacuaugggaccuggc

SEQ ID NO: 213208 - RNA, 64 nt, Homo Sapiens
caacaacaacaacaacaacaacaacaacaaaccacaaaauuauuugaguacugugaaggauuau

SEQ ID NO: 213209 - RNA, 64 nt, Homo Sapiens
auuucauuuuaggcuauuggauuaugugaacaagcaaaauuaaaaaggggaaaaaaaacccaaa

SEQ ID NO: 213210 - RNA, 64 nt, Homo Sapiens
ugaacaagcaaaauuaaaauggggaaaaaaaacccaaaauuaugagagaagucagaacagagaa

SEQ ID NO: 213211 - RNA, 64 nt, Homo Sapiens
cuuuugucacuaaacgguuuuguguuagaaccaccaaaauuauagcuuuuaagagcuuccuuug

SEQ ID NO: 213212 - RNA, 64 nt, Homo Sapiens
acauuguuauuucuguaggagcaacuucucugaucaaaauuacuuuucuggguaugugcugauu

SEQ ID NO: 213213 - RNA, 64 nt, Homo Sapiens
uuaauuacuuuuaucuuuugucuucauuuguggccaaaauuauguuuacuagaggaaauuuggg

SEQ ID NO: 213214 - RNA, 64 nt, Homo Sapiens
uaaaguaggacagcuaagaaauuaauauuaauaucaaaauuauugauaaucuuaaauuauugau

SEQ ID NO: 213215 - RNA, 64 nt, Homo Sapiens
caggcgugauggugggcgccucuacuaaaaauaccaaaauuagccaacauggugaaaccccguc

SEQ ID NO: 213216 - RNA, 64 nt, Homo Sapiens
aacaugauuucucuaauuuugaucugaaauaacacaaaauuaaauuacaaguguuugaauuugu

SEQ ID NO: 213217 - RNA, 64 nt, Homo Sapiens
uaacaaugguaaaacaagcauucaagcacuuuuacaaaauuaccaaauucuuaaaaugaagcca

SEQ ID NO: 213218 - RNA, 64 nt, Homo Sapiens
cuaacacggugaaaccccaucucuacuaaaaauacaaaauuagcugggcgugguggccggcgcc

SEQ ID NO: 213219 - RNA, 64 nt, Homo Sapiens
cucacuuaaauuaauuuuugucgaauuccauggacaaaauuaggggguaauauuuuauuuaucu

SEQ ID NO: 213220 - RNA, 64 nt, Homo Sapiens
uauaaagaauugggaaggaugcuaacauagaccccaaaauuagaaugcuuucaauguuuuuaau

SEQ ID NO: 213221 - RNA, 64 nt, Homo Sapiens
aagggccccaugauuucauuuugugcugagcccucaaaauuaugucuguuucguggugggaaau

SEQ ID NO: 213222 - RNA, 64 nt, Homo Sapiens
ccaaaacagugaaaccccgucucuacuaaaaauacaaaauuagccagaugugguggcgcacacc

SEQ ID NO: 213223 - RNA, 64 nt, Homo Sapiens
aaaugaaauguguagguaaccuauaguuuugggacaaaauuauagucaugaaaaugaaacagau

SEQ ID NO: 213224 - RNA, 64 nt, Homo Sapiens
aaaauaaacauugucuuggauuuagaaauuugcacaaaauuaaauugccuuaaaugguagaaua

SEQ ID NO: 213225 - RNA, 64 nt, Homo Sapiens
ucacuguagacuguuuuaaauugccaagacugcacaaaauuacagugcuaauguauaugguugc

SEQ ID NO: 213226 - RNA, 64 nt, Homo Sapiens
ugaaaguauuauuaguuaaagauguaaaccuagccaaaauuaccaguuuauuaauaauuaggau

SEQ ID NO: 213227 - RNA, 64 nt, Homo Sapiens
ggugacuucuguuguaaaauaauccagaacacuucaaaauuauuccuaaaucauuaagauuuuc

SEQ ID NO: 213228 - RNA, 64 nt, Homo Sapiens
auuuucaaucuuaaaauauaauacaacaaucuugcaaaauuauggugucaguuacacaagcucu

SEQ ID NO: 213229 - RNA, 64 nt, Homo Sapiens
uuuauugaugcuugcugcagggcauaauuauaaucaaaauuaguaugucaucaaagaucaccag

SEQ ID NO: 213230 - RNA, 64 nt, Homo Sapiens
caguuuucaaaaaaucaagaauauagaaguuauucaaaauuauauaacaauuacagauccugau

SEQ ID NO: 213231 - RNA, 64 nt, Homo Sapiens
uuugcuuuuagaaaagggaguuuaaaaaugguaucaaaauuacauauacuacagucaagauaga

SEQ ID NO: 213232 - RNA, 64 nt, Homo Sapiens
ugaauugaauggugcauuguauagauauaaugaacaaaauuauuuguaagauauuugcaguuuu

SEQ ID NO: 213233 - RNA, 64 nt, Homo Sapiens
augaagcaaaaguauggagcaagaccuguagugacaaaauuacacaguagugguuaguccacug

SEQ ID NO: 213234 - RNA, 64 nt, Homo Sapiens
aaucaacauacugauaaaaugacuuuguacuccacaaaauuaugacugaaagguuuauuaaaau

SEQ ID NO: 213235 - RNA, 64 nt, Homo Sapiens
ucuauaugacacaaaguaugacacauacuguuuccaaaauuauuguggacaauuuacacaccca

SEQ ID NO: 213236 - RNA, 64 nt, Homo Sapiens
uucaaaucaagauguuuaaaagaacuaucaaauccaaaauuauuuuacgauguuggaauuuagc

SEQ ID NO: 213237 - RNA, 64 nt, Homo Sapiens
aaucuaaaguaauuuccauacacgccuuccaacucaaaauuagcuacaaaauuauucaaauucu

SEQ ID NO: 213238 - RNA, 64 nt, Homo Sapiens
caaauucucacgccuuccaauccaauacuauuuacaaaauuauuaucucaguuaucuuaaauau

SEQ ID NO: 213239 - RNA, 64 nt, Homo Sapiens
aagcuguauuuggacaacuagaauaccaaaacaacaaaauuauauaacuaaucuuuuugccuca

SEQ ID NO: 213240 - RNA, 64 nt, Homo Sapiens
uaaucuuuuugccucagaauggcauacagauucacaaaauuaacuccagguacuaaggacccaa

SEQ ID NO: 213241 - RNA, 64 nt, Homo Sapiens
ccuuggaacucaauguggaacuuuaaacauuuugcaaaauuacauuuagagaaacccaauuuuu

SEQ ID NO: 213242 - RNA, 64 nt, Homo Sapiens
auuuuucaaaguuuaagaaauauacaaaguaugacaaaauuaucuucauaagaacaugcugcau

SEQ ID NO: 213243 - RNA, 64 nt, Homo Sapiens
gaacaacuuuugucauagauuugauuuauuaaaccaaaauuauacauauuaaaauuauaucaca

SEQ ID NO: 213244 - RNA, 64 nt, Homo Sapiens
ccuucaguccauuccgcaaacucuugugaucuuccaaaauuagcucugauuagcuuucacuucc

SEQ ID NO: 213245 - RNA, 64 nt, Homo Sapiens
cucugcuugguacuuagucuguguccaugugauccaaaauuaccuuccuauugcauuuccuacu

SEQ ID NO: 213246 - RNA, 64 nt, Homo Sapiens
uaaauauuucucuuaccuuaagcucguucuugugcaaaauuaaagguugaauuuguucaguaua

SEQ ID NO: 213247 - RNA, 64 nt, Homo Sapiens
ccucaagucugccucuacuggaaaauuacuggggcaaaauuagagcuugacaaaaucacaaaag

SEQ ID NO: 213248 - RNA, 64 nt, Homo Sapiens
gaacaguauagaucucagcccaccaaugccaagacaaaauuauuuuucuuauacuuauuuuuua

SEQ ID NO: 213249 - RNA, 64 nt, Homo Sapiens
uuuuuacuugcauaucuguucaaaacacuuuuaacaaaauuaauucauuaaaguccaguuguug

SEQ ID NO: 213250 - RNA, 64 nt, Homo Sapiens
cuuccaaaugcaauuugauugacugcccauucaccaaaauuauccugaacucuucugcaaaaau

SEQ ID NO: 213251 - RNA, 64 nt, Homo Sapiens
uuuuuuuuucauagagauuugucuaauugcaucucaaaauuauucugcccuccuuaauuuggga

SEQ ID NO: 213252 - RNA, 64 nt, Homo Sapiens
cacuggcauguucaaagccacauuauuucuaguccaaaauuacaaguaaucaagggucauuaug

SEQ ID NO: 213253 - RNA, 64 nt, Homo Sapiens
cuaaccuuuuuguuuggggcaccaaaucugaagacaaaauuaauuugcaccaguaaacuucaag

SEQ ID NO: 213254 - RNA, 64 nt, Homo Sapiens
auuuaauaguauacuugccauuugagccucacugcaaaauuagugcagaggagaaaacaauuuu

SEQ ID NO: 213255 - RNA, 64 nt, Homo Sapiens
uaauagcuuuaaaauaauuuuuuaguaauuauuacaaaauuaaggaaaaucucuauuaccguua

SEQ ID NO: 213256 - RNA, 64 nt, Homo Sapiens
cauuuugguaaagcaaauuucacaggaaaauagacaaaauuauaagagauuccuggagacaaca

SEQ ID NO: 213257 - RNA, 64 nt, Homo Sapiens
uuguuuaauuuuauguaugauucaauacacuguucaaaauuaaauuuuuaagaauuugauguau

SEQ ID NO: 213258 - RNA, 64 nt, Homo Sapiens
uuuucauauccaugaucuugagucuuuaguacuucaaaauuaccgacuuugucuguuuuacucu

SEQ ID NO: 213259 - RNA, 64 nt, Homo Sapiens
uuggguaacuuuugauaacugcugcauucaacgucaaaauuaccccauuuuuuuauuguuuaaa

SEQ ID NO: 213260 - RNA, 64 nt, Homo Sapiens
guugccaacuuaauuuugugaucacacuacaucucaaaauuaauagaccaaaaguuugcucagc

SEQ ID NO: 213261 - RNA, 64 nt, Homo Sapiens
caggcaugguggugcaugcccucuauuaaagauacaaaauuagcccaacacugagaaaccccau

SEQ ID NO: 213262 - RNA, 64 nt, Homo Sapiens
gacuauguagaaaugaaugauuuaaaaucaaaaccaaaauuauagaaauuucaauaauaaaaug

SEQ ID NO: 213263 - RNA, 64 nt, Homo Sapiens
uguuguugaagcagucauaaaaaacuagaaucaucaaaauuauuuugcuacauauaugaauugu

SEQ ID NO: 213264 - RNA, 64 nt, Homo Sapiens
auuuuugugauguuuugcuauugaaauuaagagacaaaauuaucgauaugagauguaugaggau

SEQ ID NO: 213265 - RNA, 64 nt, Homo Sapiens
ggauuuuuuuuucuucuuuuaccuguauaaaaaccaaaauuauauuuuuucuuuuuuaguaaaa

SEQ ID NO: 213266 - RNA, 64 nt, Homo Sapiens
ggauuuuuuucuuuuuuaguaccuauaugaaaaccaaaauuauauuuuuucuuuuuuaguaaaa

SEQ ID NO: 213267 - RNA, 64 nt, Homo Sapiens
ggauuuuuucuuuuuuaguaaccuauauaaaaaccaaaauuauauuuuuucuuuuuuaguaaaa

SEQ ID NO: 213268 - RNA, 64 nt, Homo Sapiens
ggauuuuuuucuuuuuuaguaccgguaucaaaaccaaaauuauauuuuuucuuuuuuaguaaaa

SEQ ID NO: 213269 - RNA, 64 nt, Homo Sapiens
ggauuuuuucuuuuuuaguaaccuauauaaaaaccaaaauuauaagagccacuggugaguaaaa

SEQ ID NO: 213270 - RNA, 64 nt, Homo Sapiens
uucuacuccccaaagcagagauagauugauuuaucaaaauuauuaucuggccaacagugugacu

SEQ ID NO: 213271 - RNA, 64 nt, Homo Sapiens
aaaauauacaacuuucaccauauauauaagccugcaaaauuagaguagugaaagucaugcuagu

SEQ ID NO: 213272 - RNA, 64 nt, Homo Sapiens
aaacuaugacccauuuaauuucuauuguguuucacaaaauuaaguguuguucauuauacucucu

SEQ ID NO: 213273 - RNA, 64 nt, Homo Sapiens
uuucuuaaccuaggcuucagggagcauaugaaaccaaaauuauauggaacauuuucugugugua

SEQ ID NO: 213274 - RNA, 64 nt, Homo Sapiens
ugaauuguguuguuuucuuguuugucggggcaaacaaaauuaugaaaauuaacugcuuaaaugu

SEQ ID NO: 213275 - RNA, 64 nt, Homo Sapiens
ugcuuaaauguuuugucgggaaaacaaaacaaaacaaaauuaacauuguucuucaaaaacaaac

SEQ ID NO: 213276 - RNA, 64 nt, Homo Sapiens
cauauuugaacuugucgaaccagaucuucucauguacuaggaaguuuguagccauuuuucugac

SEQ ID NO: 213277 - RNA, 64 nt, Homo Sapiens
uuuaguuuuucauuaauuuugaucaauuguaucuuacuaggagaucacccauuuacuguaggua

SEQ ID NO: 213278 - RNA, 64 nt, Homo Sapiens
cugaaccuccuuuugucuuucauaaaauaaaagcuacuaggaugaguuguuuuaaggauuucag

SEQ ID NO: 213279 - RNA, 64 nt, Homo Sapiens
aaacucaaaucagaaugaaauaucacuucaaaccuacuaggaugguuauaauaaaaaagacaga

SEQ ID NO: 213280 - RNA, 64 nt, Homo Sapiens
gcuuuguaaacugguuuugugaagcacaagugcauacuaggaagcugauguaugaguccucuca

SEQ ID NO: 213281 - RNA, 64 nt, Homo Sapiens
auuuucuuuuacaggagggacuagcuuuacgcauuacuaggaauacuuauuuuugccugaguuc

SEQ ID NO: 213282 - RNA, 64 nt, Homo Sapiens
cugguguuuuguucaaucuggaagaaugacuguaucagucaauggggauuuuaacagacugccu

SEQ ID NO: 213283 - RNA, 64 nt, Homo Sapiens
cuucuuucuguagggaugagaauuccucuuuuaaucagucaagggagaugcuucaaagcuggag

SEQ ID NO: 213284 - RNA, 64 nt, Homo Sapiens
uugagccagccucuggaucgcccuccguuuccccucagucaaacugugugcuaggaacagccuu

SEQ ID NO: 213285 - RNA, 64 nt, Homo Sapiens
auuuaugaggaaaugagaucaaaauaauuuuauuucagucaaacguccuaaacauucuucagug

SEQ ID NO: 213286 - RNA, 64 nt, Homo Sapiens
aaagcacaugaauguaaugaauguggaaaagcuuucagucaaaccucaugccuuauucagcauc

SEQ ID NO: 213287 - RNA, 64 nt, Homo Sapiens
aaauuccauugcugcaaugaaugugaaaaagccaucagucaaagaaacuaccuuguuuaguauc

SEQ ID NO: 213288 - RNA, 64 nt, Homo Sapiens
cccguagccuagagcagugucauuucucugcuccucagucaaccaaguguucccuaaggaacag

SEQ ID NO: 213289 - RNA, 64 nt, Homo Sapiens
aaccacagucuguuaaucaucauauuuuguggacucagucaagcucacugugguaggcauuugg

SEQ ID NO: 213290 - RNA, 64 nt, Homo Sapiens
accaaacccuaaauugaaagacaaaacuaugguuucagucaacauauucaugaauuagggagcu

SEQ ID NO: 213291 - RNA, 64 nt, Homo Sapiens
caccaggggaugcucuacaucaagggaugcaccuucagucaaacugucaaaaagcccagaauuc

SEQ ID NO: 213292 - RNA, 64 nt, Homo Sapiens
uguacaccagcguuuauaacaaagcagggacuugaacagauauucuauagauccaaaagaauug

SEQ ID NO: 213293 - RNA, 64 nt, Homo Sapiens
aaagcuguuaauacuuaaacuuugucacaagaagaacagauaacaucuacaaaucccuuaccaa

SEQ ID NO: 213294 - RNA, 64 nt, Homo Sapiens
auagugacaauaaauguaauucuaugcuuuaaggaacagauacuuacaugaauuaugcuuuccu

SEQ ID NO: 213295 - RNA, 64 nt, Homo Sapiens
uuauuuuagacaaaaccuuuagccccuuuagaacaacagauacucaaccauucucuuaucaugu

SEQ ID NO: 213296 - RNA, 64 nt, Homo Sapiens
gcuuuuagugugugcauaauuuauuuuuguacuuuaucaugaauccuucuuauuuaaucuuuuc

SEQ ID NO: 213297 - RNA, 64 nt, Homo Sapiens
uuuaaaguaugcauuauuaagggguuccaugaguuaucaugaauguugaauuagugaguauagu

SEQ ID NO: 213298 - RNA, 64 nt, Homo Sapiens
ugcuaguucuuuuaaguuuguuagaaauaaaauuuaucaugaaaaacagaacuguaugaccccu

SEQ ID NO: 213299 - RNA, 64 nt, Homo Sapiens
aauuauugugaacaauuuagaaauaagcauguuuuaucaugaaauguaagcauguguauauaau

SEQ ID NO: 213300 - RNA, 64 nt, Homo Sapiens
aaagaugccuugacaaagggcucucucucucaacuaucaugauccacacacacacacucucgcg

SEQ ID NO: 213301 - RNA, 64 nt, Homo Sapiens
ucagaacccuuuaauguaauauuaucaaaguccauaucaugaauuucugccuggguuaguagau

SEQ ID NO: 213302 - RNA, 64 nt, Homo Sapiens
ugggaaagccuuuguuuccuucacuuccuuucgauaucaugaaaggacucacacuggagagaac

SEQ ID NO: 213303 - RNA, 64 nt, Homo Sapiens
uggcaaagcuuucacuucuuccaguucuuuucaauaucaugaaagaacacacuagggagaaacc

SEQ ID NO: 213304 - RNA, 64 nt, Homo Sapiens
ugcaaaagccuuuauuucuuccacuucuuuucaauaucaugaaaggacucacaugggagagaaa

SEQ ID NO: 213305 - RNA, 64 nt, Homo Sapiens
ugggaaagccuucauuucuucuaguucccuucaauaucaugaaaggacucacacuggagagaag

SEQ ID NO: 213306 - RNA, 64 nt, Homo Sapiens
auagcaugggaaagaccugcugagacucguucacuaucaugagauauaaaaccaucggaucucu

SEQ ID NO: 213307 - RNA, 64 nt, Homo Sapiens
caauuguauuacuccuuguacuuuuuagaaaaucuaucaugacuuggaaguuucuaaucaaauc

SEQ ID NO: 213308 - RNA, 64 nt, Homo Sapiens
ccauugugcagaacuggagucuuuacugacccgcuuuccacaucagcccaaggucuuuuuaaug

SEQ ID NO: 213309 - RNA, 64 nt, Homo Sapiens
cauuguagaagcggucacuauuagcaggcauacuuuuccacacaucuuuggacuuuucuuaaaa

SEQ ID NO: 213310 - RNA, 64 nt, Homo Sapiens
gacuuagaaccauccuugacccuuaggcccaaccuuuccacagagaaaucaccucucuuccuuu

SEQ ID NO: 213311 - RNA, 64 nt, Homo Sapiens
auuugucagaaauguauuuggcuuuuuaaacuccuuuccacaaaaguuuaagucuaaugaccuu

SEQ ID NO: 213312 - RNA, 64 nt, Homo Sapiens
gucucauucauuuugacaguuaucaaagauguacuuuccacaguuaaauuuacauuaauggcaa

SEQ ID NO: 213313 - RNA, 64 nt, Homo Sapiens
uuucccgucccauuugcagagcucuacuacuucauuuccacaguaagcauauauauaaugauca

SEQ ID NO: 213314 - RNA, 64 nt, Homo Sapiens
uuccuccuaauugugugguaauuugcuuuuacuguuuccacaguauuucaggucuuugcucauu

SEQ ID NO: 213315 - RNA, 64 nt, Homo Sapiens
uauuucugagauacaauauuaacuucauuaaauguuuccacaaggcugaaucuuguaaaauuau

SEQ ID NO: 213316 - RNA, 64 nt, Homo Sapiens
uauuuugcauuuuuaggagguucuuagauccuuauuuccacaaacaccauguagccugaaguuu

SEQ ID NO: 213317 - RNA, 64 nt, Homo Sapiens
cuuucagaugcugauguagauuucauggacacaauuuccacaaccaagaguucuacuuagaacu

SEQ ID NO: 213318 - RNA, 64 nt, Homo Sapiens
auugguggcaccuggaggacgggucuccaaggcauuuccacacucaagagaugucaucccccca

SEQ ID NO: 213319 - RNA, 64 nt, Homo Sapiens
ugucuccuuugcucuugccaaaaaauagcacacuuuuccacauuccagugaugugugagcuaug

SEQ ID NO: 213320 - RNA, 64 nt, Homo Sapiens
ccuuguaagcuaucugugcaggauauuugcacuauuuccacauggaaucaaucuuuaacaaccu

SEQ ID NO: 213321 - RNA, 64 nt, Homo Sapiens
cggugugugcauacaguuucuccacaagagggcuuuuccacacuauguacacaaauaacugacu

SEQ ID NO: 213322 - RNA, 64 nt, Homo Sapiens
uuuacauucaugugguuuucucuagcugaaaacuuuuccacagugugugcagugcgcucuggcu

SEQ ID NO: 213323 - RNA, 64 nt, Homo Sapiens
uggaaugggaaggcaucuccauucuguaguuaaauuuccacauuuugaaaauggaucuuguuug

SEQ ID NO: 213324 - RNA, 64 nt, Homo Sapiens
aaggagaggcaaggaaaagcaaaugagugugucauuuccacauggcacugggcuuuaaagagcg

SEQ ID NO: 213325 - RNA, 64 nt, Homo Sapiens
cagcuuuccccuagcauggagaaaaaugcacauuuuuccacacuuuuucuuuacagcauagaua

SEQ ID NO: 213326 - RNA, 64 nt, Homo Sapiens
auucaagaaucuuguauaaaaagccaugcccaauuuuccacaagagggacauuguucagauguc

SEQ ID NO: 213327 - RNA, 64 nt, Homo Sapiens
uuaguuuucauuuuuugagugaaaacuuuaagaguuuccacauaacauuuaaauagauuagugg

SEQ ID NO: 213328 - RNA, 64 nt, Homo Sapiens
gugaaaaauccucugucaugagauaggcuuuauauuuccacagacucucugcccaugggaaaag

SEQ ID NO: 213329 - RNA, 64 nt, Homo Sapiens
agcccauccgcugccuccgucaaaggcagcuacauuuccacagacuggguagcucacagccagc

SEQ ID NO: 213330 - RNA, 64 nt, Homo Sapiens
gcugcuaauaucccagcuccuggcacuacccagauuuccacagugucaccaaacaggagggucc

SEQ ID NO: 213331 - RNA, 64 nt, Homo Sapiens
gaacaauauuuuaaaaaauaaugaugacuuuuuuuuuccacaagauuaggaggaagauacaacc

SEQ ID NO: 213332 - RNA, 64 nt, Homo Sapiens
cuaguuuugauugacuucauuucuaaucugguucuuuccacagcuggugacuucacugcccugc

SEQ ID NO: 213333 - RNA, 64 nt, Homo Sapiens
cauucaccaaccauaccagagaaacauuuccaguuuuccacaaauacuugauacaagauuuaau

SEQ ID NO: 213334 - RNA, 64 nt, Homo Sapiens
cuuauugugaagagcgacacaacugccugcugccuuuccacagcuauaauggacaucagguuga

SEQ ID NO: 213335 - RNA, 64 nt, Homo Sapiens
aagauguagugcuauugccgauaacaaguaagauuuuccacacuacagcuggguguuucucuuu

SEQ ID NO: 213336 - RNA, 64 nt, Homo Sapiens
ugauaggacaucuuuucguggugugcaccagugcuuuccacacuugacagugguuggcuuugau

SEQ ID NO: 213337 - RNA, 64 nt, Homo Sapiens
ucacaugcaguguacuccaauguaugcuguagaguuuccacauuucuggagagaagcuguggug

SEQ ID NO: 213338 - RNA, 64 nt, Homo Sapiens
cguauuugaugaaagaaacuaucuaauuugguaguuuccacaauuugcaguauucauuaucugc

SEQ ID NO: 213339 - RNA, 64 nt, Homo Sapiens
ucaaauuauuaugccuuucacuccaaucaguucagauguguaacaaggagauaugauucuguaa

SEQ ID NO: 213340 - RNA, 64 nt, Homo Sapiens
auacugugugcuccagcaaauuguauauuuuugugauguguacccacaucuguaaagcaaucaa

SEQ ID NO: 213341 - RNA, 64 nt, Homo Sapiens
aauggaauaaaaaaaaaaaaauggcaaacagguggauguguaaaugauaaaauguugugacuuc

SEQ ID NO: 213342 - RNA, 64 nt, Homo Sapiens
uggcuggggggccagcccuguauuccuaucuguggauguguaaaaucacuaacccguuuuauuc

SEQ ID NO: 213343 - RNA, 64 nt, Homo Sapiens
gauguaguguuguaauaaacuguuuaauggggcugauguguaaagcuguucaaguuauuugaug

SEQ ID NO: 213344 - RNA, 64 nt, Homo Sapiens
guuuuaacacauaaguaaaaacccguacauauuugauguguaaugcagguuaauuacaacacag

SEQ ID NO: 213345 - RNA, 64 nt, Homo Sapiens
uggucauuccauuucuuuuguuugaagcuaaagagauguguagcucacaggggcuaccuuacca

SEQ ID NO: 213346 - RNA, 64 nt, Homo Sapiens
aacaugaauagauaccuuguaaacuuguauuguggauguguaaauaauauguacuuuggguuuu

SEQ ID NO: 213347 - RNA, 64 nt, Homo Sapiens
uuuguaaauuuacauuuuuuuuaaagaagagacugauguguagauagaaaacccuuuuuuugcu

SEQ ID NO: 213348 - RNA, 64 nt, Homo Sapiens
ucauuccccaccucuaccuuucuaauggcggcaugauguguaaacucugugcaggggugggggc

SEQ ID NO: 213349 - RNA, 64 nt, Homo Sapiens
cuuuacgcaucuuuccuuuuuucaucuuuguguggauguguauaaggaauucauucuuagcuuc

SEQ ID NO: 213350 - RNA, 64 nt, Homo Sapiens
gccuuaacaagcaauccucuauuuaaccaaagaagauguguaguagugauuuaaauaguuaauc

SEQ ID NO: 213351 - RNA, 64 nt, Homo Sapiens; identical to SEQ ID NO: 107033

SEQ ID NO: 213352 - RNA, 64 nt, Homo Sapiens; identical to SEQ ID NO: 107034

SEQ ID NO: 213353 - RNA, 64 nt, Homo Sapiens; identical to SEQ ID NO: 107035

SEQ ID NO: 213354 - RNA, 64 nt, Homo Sapiens; identical to SEQ ID NO: 107036

SEQ ID NO: 213355 - RNA, 64 nt, Homo Sapiens; identical to SEQ ID NO: 107037

SEQ ID NO: 213356 - RNA, 64 nt, Homo Sapiens; identical to SEQ ID NO: 107038

SEQ ID NO: 213357 - RNA, 64 nt, Homo Sapiens; identical to SEQ ID NO: 107039

SEQ ID NO: 213358 - RNA, 64 nt, Homo Sapiens; identical to SEQ ID NO: 107040

SEQ ID NO: 213359 - RNA, 64 nt, Homo Sapiens; identical to SEQ ID NO: 107041

SEQ ID NO: 213360 - RNA, 64 nt, Homo Sapiens; identical to SEQ ID NO: 107042

SEQ ID NO: 213361 - RNA, 64 nt, Homo Sapiens; identical to SEQ ID NO: 107043

SEQ ID NO: 213362 - RNA, 64 nt, Homo Sapiens; identical to SEQ ID NO: 107044

SEQ ID NO: 213363 - RNA, 64 nt, Homo Sapiens; identical to SEQ ID NO: 107045

SEQ ID NO: 213364 - RNA, 64 nt, Homo Sapiens; identical to SEQ ID NO: 107046

SEQ ID NO: 213365 - RNA, 64 nt, Homo Sapiens; identical to SEQ ID NO: 107047

SEQ ID NO: 213366 - RNA, 64 nt, Homo Sapiens; identical to SEQ ID NO: 107048

SEQ ID NO: 213367 - RNA, 64 nt, Homo Sapiens; identical to SEQ ID NO: 107049

SEQ ID NO: 213368 - RNA, 64 nt, Homo Sapiens; identical to SEQ ID NO: 107050

SEQ ID NO: 213369 - RNA, 64 nt, Homo Sapiens; identical to SEQ ID NO: 107051

SEQ ID NO: 213370 - RNA, 64 nt, Homo Sapiens; identical to SEQ ID NO: 107052

SEQ ID NO: 213371 - RNA, 64 nt, Homo Sapiens; identical to SEQ ID NO: 107053

SEQ ID NO: 213372 - RNA, 64 nt, Homo Sapiens; identical to SEQ ID NO: 107054

SEQ ID NO: 213373 - RNA, 64 nt, Homo Sapiens; identical to SEQ ID NO: 107055

SEQ ID NO: 213374 - RNA, 64 nt, Homo Sapiens; identical to SEQ ID NO: 107056

SEQ ID NO: 213375 - RNA, 64 nt, Homo Sapiens; identical to SEQ ID NO: 107057

SEQ ID NO: 213376 - RNA, 64 nt, Homo Sapiens; identical to SEQ ID NO: 107058

SEQ ID NO: 213377 - RNA, 64 nt, Homo Sapiens; identical to SEQ ID NO: 107059

SEQ ID NO: 213378 - RNA, 64 nt, Homo Sapiens; identical to SEQ ID NO: 107060

SEQ ID NO: 213379 - RNA, 64 nt, Homo Sapiens; identical to SEQ ID NO: 107061

SEQ ID NO: 213380 - RNA, 64 nt, Homo Sapiens; identical to SEQ ID NO: 107062

SEQ ID NO: 213381 - RNA, 64 nt, Homo Sapiens; identical to SEQ ID NO: 107063

SEQ ID NO: 213382 - RNA, 64 nt, Homo Sapiens; identical to SEQ ID NO: 107064

SEQ ID NO: 213383 - RNA, 64 nt, Homo Sapiens; identical to SEQ ID NO: 107065

SEQ ID NO: 213384 - RNA, 64 nt, Homo Sapiens; identical to SEQ ID NO: 107066

SEQ ID NO: 213385 - RNA, 64 nt, Homo Sapiens; identical to SEQ ID NO: 107067

SEQ ID NO: 213386 - RNA, 64 nt, Homo Sapiens; identical to SEQ ID NO: 107068

SEQ ID NO: 213387 - RNA, 64 nt, Homo Sapiens; identical to SEQ ID NO: 107069

SEQ ID NO: 213388 - RNA, 64 nt, Homo Sapiens; identical to SEQ ID NO: 107070

SEQ ID NO: 213389 - RNA, 64 nt, Homo Sapiens; identical to SEQ ID NO: 107071

SEQ ID NO: 213390 - RNA, 64 nt, Homo Sapiens; identical to SEQ ID NO: 107072

SEQ ID NO: 213391 - RNA, 64 nt, Homo Sapiens; identical to SEQ ID NO: 107073

SEQ ID NO: 213392 - RNA, 62 nt, Homo Sapiens; identical to SEQ ID NO: 107074

SEQ ID NO: 213393 - RNA, 64 nt, Homo Sapiens; identical to SEQ ID NO: 107075

SEQ ID NO: 213394 - RNA, 64 nt, Homo Sapiens; identical to SEQ ID NO: 107076

SEQ ID NO: 213395 - RNA, 64 nt, Homo Sapiens; identical to SEQ ID NO: 107077

SEQ ID NO: 213396 - RNA, 64 nt, Homo Sapiens; identical to SEQ ID NO: 107078

SEQ ID NO: 213397 - RNA, 64 nt, Homo Sapiens; identical to SEQ ID NO: 107079

SEQ ID NO: 213398 - RNA, 64 nt, Homo Sapiens; identical to SEQ ID NO: 107080

SEQ ID NO: 213399 - RNA, 64 nt, Homo Sapiens; identical to SEQ ID NO: 107081

SEQ ID NO: 213400 - RNA, 64 nt, Homo Sapiens; identical to SEQ ID NO: 107082

SEQ ID NO: 213401 - RNA, 64 nt, Homo Sapiens; identical to SEQ ID NO: 107083

SEQ ID NO: 213402 - RNA, 64 nt, Homo Sapiens; identical to SEQ ID NO: 107084

SEQ ID NO: 213403 - RNA, 64 nt, Homo Sapiens; identical to SEQ ID NO: 107085

SEQ ID NO: 213404 - RNA, 64 nt, Homo Sapiens; identical to SEQ ID NO: 107086

SEQ ID NO: 213405 - RNA, 64 nt, Homo Sapiens; identical to SEQ ID NO: 107087

SEQ ID NO: 213406 - RNA, 64 nt, Homo Sapiens; identical to SEQ ID NO: 107088

SEQ ID NO: 213407 - RNA, 64 nt, Homo Sapiens; identical to SEQ ID NO: 107089

SEQ ID NO: 213408 - RNA, 64 nt, Homo Sapiens; identical to SEQ ID NO: 107090

SEQ ID NO: 213409 - RNA, 64 nt, Homo Sapiens; identical to SEQ ID NO: 107091

SEQ ID NO: 213410 - RNA, 64 nt, Homo Sapiens; identical to SEQ ID NO: 107092

SEQ ID NO: 213411 - RNA, 64 nt, Homo Sapiens; identical to SEQ ID NO: 107093

SEQ ID NO: 213412 - RNA, 64 nt, Homo Sapiens; identical to SEQ ID NO: 107094

SEQ ID NO: 213413 - RNA, 64 nt, Homo Sapiens; identical to SEQ ID NO: 107095

SEQ ID NO: 213414 - RNA, 64 nt, Homo Sapiens; identical to SEQ ID NO: 107096

SEQ ID NO: 213415 - RNA, 64 nt, Homo Sapiens; identical to SEQ ID NO: 107097

SEQ ID NO: 213416 - RNA, 64 nt, Homo Sapiens; identical to SEQ ID NO: 107098

SEQ ID NO: 213417 - RNA, 64 nt, Homo Sapiens; identical to SEQ ID NO: 107099

SEQ ID NO: 213418 - RNA, 64 nt, Homo Sapiens; identical to SEQ ID NO: 107100

SEQ ID NO: 213419 - RNA, 64 nt, Homo Sapiens; identical to SEQ ID NO: 107101

SEQ ID NO: 213420 - RNA, 64 nt, Homo Sapiens; identical to SEQ ID NO: 107102

SEQ ID NO: 213421 - RNA, 64 nt, Homo Sapiens; identical to SEQ ID NO: 107103

SEQ ID NO: 213422 - RNA, 64 nt, Homo Sapiens; identical to SEQ ID NO: 107104

SEQ ID NO: 213423 - RNA, 64 nt, Homo Sapiens; identical to SEQ ID NO: 107105

SEQ ID NO: 213424 - RNA, 64 nt, Homo Sapiens; identical to SEQ ID NO: 107106

SEQ ID NO: 213425 - RNA, 64 nt, Homo Sapiens; identical to SEQ ID NO: 107107

SEQ ID NO: 213426 - RNA, 64 nt, Homo Sapiens; identical to SEQ ID NO: 107108

SEQ ID NO: 213427 - RNA, 64 nt, Homo Sapiens; identical to SEQ ID NO: 107109

SEQ ID NO: 213428 - RNA, 64 nt, Homo Sapiens; identical to SEQ ID NO: 107110

SEQ ID NO: 213429 - RNA, 64 nt, Homo Sapiens; identical to SEQ ID NO: 107111

SEQ ID NO: 213430 - RNA, 64 nt, Homo Sapiens; identical to SEQ ID NO: 107112

SEQ ID NO: 213431 - RNA, 64 nt, Homo Sapiens; identical to SEQ ID NO: 107113

SEQ ID NO: 213432 - RNA, 64 nt, Homo Sapiens; identical to SEQ ID NO: 107114

SEQ ID NO: 213433 - RNA, 64 nt, Homo Sapiens; identical to SEQ ID NO: 107115

SEQ ID NO: 213434 - RNA, 64 nt, Homo Sapiens; identical to SEQ ID NO: 107116

SEQ ID NO: 213435 - RNA, 64 nt, Homo Sapiens; identical to SEQ ID NO: 107117

SEQ ID NO: 213436 - RNA, 64 nt, Homo Sapiens; identical to SEQ ID NO: 107118

SEQ ID NO: 213437 - RNA, 64 nt, Homo Sapiens; identical to SEQ ID NO: 107119

SEQ ID NO: 213438 - RNA, 64 nt, Homo Sapiens; identical to SEQ ID NO: 107120

SEQ ID NO: 213439 - RNA, 64 nt, Homo Sapiens; identical to SEQ ID NO: 107121

SEQ ID NO: 213440 - RNA, 64 nt, Homo Sapiens; identical to SEQ ID NO: 107122

SEQ ID NO: 213441 - RNA, 64 nt, Homo Sapiens; identical to SEQ ID NO: 107123

SEQ ID NO: 213442 - RNA, 64 nt, Homo Sapiens; identical to SEQ ID NO: 107124

SEQ ID NO: 213443 - RNA, 64 nt, Homo Sapiens; identical to SEQ ID NO: 107125

SEQ ID NO: 213444 - RNA, 64 nt, Homo Sapiens; identical to SEQ ID NO: 107126

SEQ ID NO: 213445 - RNA, 64 nt, Homo Sapiens; identical to SEQ ID NO: 107127

SEQ ID NO: 213446 - RNA, 64 nt, Homo Sapiens; identical to SEQ ID NO: 107128

SEQ ID NO: 213447 - RNA, 64 nt, Homo Sapiens; identical to SEQ ID NO: 107129

SEQ ID NO: 213448 - RNA, 64 nt, Homo Sapiens; identical to SEQ ID NO: 107130

SEQ ID NO: 213449 - RNA, 64 nt, Homo Sapiens; identical to SEQ ID NO: 107131

SEQ ID NO: 213450 - RNA, 64 nt, Homo Sapiens; identical to SEQ ID NO: 107132

SEQ ID NO: 213451 - RNA, 64 nt, Homo Sapiens; identical to SEQ ID NO: 107133

SEQ ID NO: 213452 - RNA, 64 nt, Homo Sapiens; identical to SEQ ID NO: 107134

SEQ ID NO: 213453 - RNA, 64 nt, Homo Sapiens; identical to SEQ ID NO: 107135

SEQ ID NO: 213454 - RNA, 64 nt, Homo Sapiens; identical to SEQ ID NO: 107136

SEQ ID NO: 213455 - RNA, 64 nt, Homo Sapiens; identical to SEQ ID NO: 107137

SEQ ID NO: 213456 - RNA, 64 nt, Homo Sapiens; identical to SEQ ID NO: 107138

SEQ ID NO: 213457 - RNA, 64 nt, Homo Sapiens; identical to SEQ ID NO: 107139

SEQ ID NO: 213458 - RNA, 64 nt, Homo Sapiens; identical to SEQ ID NO: 107140

SEQ ID NO: 213459 - RNA, 64 nt, Homo Sapiens; identical to SEQ ID NO: 107141

SEQ ID NO: 213460 - RNA, 64 nt, Homo Sapiens; identical to SEQ ID NO: 107142

SEQ ID NO: 213461 - RNA, 64 nt, Homo Sapiens; identical to SEQ ID NO: 107143

SEQ ID NO: 213462 - RNA, 64 nt, Homo Sapiens; identical to SEQ ID NO: 107144

SEQ ID NO: 213463 - RNA, 64 nt, Homo Sapiens; identical to SEQ ID NO: 107145

SEQ ID NO: 213464 - RNA, 64 nt, Homo Sapiens; identical to SEQ ID NO: 107146

SEQ ID NO: 213465 - RNA, 64 nt, Homo Sapiens; identical to SEQ ID NO: 107147

SEQ ID NO: 213466 - RNA, 64 nt, Homo Sapiens; identical to SEQ ID NO: 107148

SEQ ID NO: 213467 - RNA, 64 nt, Homo Sapiens; identical to SEQ ID NO: 107149

SEQ ID NO: 213468 - RNA, 64 nt, Homo Sapiens; identical to SEQ ID NO: 107150

SEQ ID NO: 213469 - RNA, 64 nt, Homo Sapiens; identical to SEQ ID NO: 107151

SEQ ID NO: 213470 - RNA, 64 nt, Homo Sapiens; identical to SEQ ID NO: 107152

SEQ ID NO: 213471 - RNA, 64 nt, Homo Sapiens; identical to SEQ ID NO: 107153

SEQ ID NO: 213472 - RNA, 64 nt, Homo Sapiens; identical to SEQ ID NO: 107154

SEQ ID NO: 213473 - RNA, 64 nt, Homo Sapiens; identical to SEQ ID NO: 107155

SEQ ID NO: 213474 - RNA, 64 nt, Homo Sapiens; identical to SEQ ID NO: 107156

SEQ ID NO: 213475 - RNA, 64 nt, Homo Sapiens; identical to SEQ ID NO: 107157

SEQ ID NO: 213476 - RNA, 64 nt, Homo Sapiens; identical to SEQ ID NO: 107158

SEQ ID NO: 213477 - RNA, 64 nt, Homo Sapiens; identical to SEQ ID NO: 107159

SEQ ID NO: 213478 - RNA, 64 nt, Homo Sapiens; identical to SEQ ID NO: 107160

SEQ ID NO: 213479 - RNA, 64 nt, Homo Sapiens; identical to SEQ ID NO: 107161

SEQ ID NO: 213480 - RNA, 64 nt, Homo Sapiens; identical to SEQ ID NO: 107162

SEQ ID NO: 213481 - RNA, 64 nt, Homo Sapiens; identical to SEQ ID NO: 107163

SEQ ID NO: 213482 - RNA, 64 nt, Homo Sapiens; identical to SEQ ID NO: 107164

SEQ ID NO: 213483 - RNA, 64 nt, Homo Sapiens; identical to SEQ ID NO: 107165

SEQ ID NO: 213484 - RNA, 64 nt, Homo Sapiens; identical to SEQ ID NO: 107166

SEQ ID NO: 213485 - RNA, 64 nt, Homo Sapiens; identical to SEQ ID NO: 107167

SEQ ID NO: 213486 - RNA, 64 nt, Homo Sapiens; identical to SEQ ID NO: 107168

SEQ ID NO: 213487 - RNA, 64 nt, Homo Sapiens; identical to SEQ ID NO: 107169

SEQ ID NO: 213488 - RNA, 64 nt, Homo Sapiens; identical to SEQ ID NO: 107170

SEQ ID NO: 213489 - RNA, 64 nt, Homo Sapiens; identical to SEQ ID NO: 107171

SEQ ID NO: 213490 - RNA, 64 nt, Homo Sapiens; identical to SEQ ID NO: 107172

SEQ ID NO: 213491 - RNA, 64 nt, Homo Sapiens; identical to SEQ ID NO: 107173

SEQ ID NO: 213492 - RNA, 64 nt, Homo Sapiens; identical to SEQ ID NO: 107174

SEQ ID NO: 213493 - RNA, 64 nt, Homo Sapiens; identical to SEQ ID NO: 107175

SEQ ID NO: 213494 - RNA, 64 nt, Homo Sapiens; identical to SEQ ID NO: 107176

SEQ ID NO: 213495 - RNA, 64 nt, Homo Sapiens; identical to SEQ ID NO: 107177

SEQ ID NO: 213496 - RNA, 64 nt, Homo Sapiens; identical to SEQ ID NO: 107178

SEQ ID NO: 213497 - RNA, 64 nt, Homo Sapiens; identical to SEQ ID NO: 107179

SEQ ID NO: 213498 - RNA, 64 nt, Homo Sapiens; identical to SEQ ID NO: 107180

SEQ ID NO: 213499 - RNA, 64 nt, Homo Sapiens; identical to SEQ ID NO: 107181

SEQ ID NO: 213500 - RNA, 64 nt, Homo Sapiens; identical to SEQ ID NO: 107182

SEQ ID NO: 213501 - RNA, 64 nt, Homo Sapiens; identical to SEQ ID NO: 107183

SEQ ID NO: 213502 - RNA, 64 nt, Homo Sapiens; identical to SEQ ID NO: 107184

SEQ ID NO: 213503 - RNA, 64 nt, Homo Sapiens; identical to SEQ ID NO: 107185

SEQ ID NO: 213504 - RNA, 64 nt, Homo Sapiens; identical to SEQ ID NO: 107186

SEQ ID NO: 213505 - RNA, 64 nt, Homo Sapiens; identical to SEQ ID NO: 107187

SEQ ID NO: 213506 - RNA, 64 nt, Homo Sapiens; identical to SEQ ID NO: 107188

SEQ ID NO: 213507 - RNA, 64 nt, Homo Sapiens; identical to SEQ ID NO: 107189

SEQ ID NO: 213508 - RNA, 64 nt, Homo Sapiens; identical to SEQ ID NO: 107190

SEQ ID NO: 213509 - RNA, 64 nt, Homo Sapiens; identical to SEQ ID NO: 107191

SEQ ID NO: 213510 - RNA, 64 nt, Homo Sapiens; identical to SEQ ID NO: 107192

SEQ ID NO: 213511 - RNA, 64 nt, Homo Sapiens; identical to SEQ ID NO: 107193

SEQ ID NO: 213512 - RNA, 64 nt, Homo Sapiens; identical to SEQ ID NO: 107194

SEQ ID NO: 213513 - RNA, 64 nt, Homo Sapiens; identical to SEQ ID NO: 107195

SEQ ID NO: 213514 - RNA, 64 nt, Homo Sapiens; identical to SEQ ID NO: 107196

SEQ ID NO: 213515 - RNA, 64 nt, Homo Sapiens; identical to SEQ ID NO: 107197

SEQ ID NO: 213516 - RNA, 64 nt, Homo Sapiens; identical to SEQ ID NO: 107198

SEQ ID NO: 213517 - RNA, 64 nt, Homo Sapiens; identical to SEQ ID NO: 107199

SEQ ID NO: 213518 - RNA, 64 nt, Homo Sapiens; identical to SEQ ID NO: 107200

SEQ ID NO: 213519 - RNA, 64 nt, Homo Sapiens; identical to SEQ ID NO: 107201

SEQ ID NO: 213520 - RNA, 64 nt, Homo Sapiens; identical to SEQ ID NO: 107202

SEQ ID NO: 213521 - RNA, 64 nt, Homo Sapiens; identical to SEQ ID NO: 107203

SEQ ID NO: 213522 - RNA, 64 nt, Homo Sapiens; identical to SEQ ID NO: 107204

SEQ ID NO: 213523 - RNA, 64 nt, Homo Sapiens; identical to SEQ ID NO: 107205

SEQ ID NO: 213524 - RNA, 64 nt, Homo Sapiens; identical to SEQ ID NO: 107206

SEQ ID NO: 213525 - RNA, 64 nt, Homo Sapiens; identical to SEQ ID NO: 107207

SEQ ID NO: 213526 - RNA, 64 nt, Homo Sapiens; identical to SEQ ID NO: 107208

SEQ ID NO: 213527 - RNA, 64 nt, Homo Sapiens; identical to SEQ ID NO: 107209

SEQ ID NO: 213528 - RNA, 64 nt, Homo Sapiens; identical to SEQ ID NO: 107210

SEQ ID NO: 213529 - RNA, 64 nt, Homo Sapiens; identical to SEQ ID NO: 107211

SEQ ID NO: 213530 - RNA, 64 nt, Homo Sapiens; identical to SEQ ID NO: 107212

SEQ ID NO: 213531 - RNA, 64 nt, Homo Sapiens; identical to SEQ ID NO: 107213

SEQ ID NO: 213532 - RNA, 64 nt, Homo Sapiens; identical to SEQ ID NO: 107214

SEQ ID NO: 213533 - RNA, 64 nt, Homo Sapiens; identical to SEQ ID NO: 107215

SEQ ID NO: 213534 - RNA, 64 nt, Homo Sapiens; identical to SEQ ID NO: 107216

SEQ ID NO: 213535 - RNA, 64 nt, Homo Sapiens; identical to SEQ ID NO: 107217

SEQ ID NO: 213536 - RNA, 64 nt, Homo Sapiens; identical to SEQ ID NO: 107218

SEQ ID NO: 213537 - RNA, 64 nt, Homo Sapiens; identical to SEQ ID NO: 107219

SEQ ID NO: 213538 - RNA, 64 nt, Homo Sapiens; identical to SEQ ID NO: 107220

SEQ ID NO: 213539 - RNA, 64 nt, Homo Sapiens; identical to SEQ ID NO: 107221

SEQ ID NO: 213540 - RNA, 64 nt, Homo Sapiens; identical to SEQ ID NO: 107222

SEQ ID NO: 213541 - RNA, 64 nt, Homo Sapiens; identical to SEQ ID NO: 107223

SEQ ID NO: 213542 - RNA, 64 nt, Homo Sapiens; identical to SEQ ID NO: 107224

SEQ ID NO: 213543 - RNA, 64 nt, Homo Sapiens; identical to SEQ ID NO: 107225

SEQ ID NO: 213544 - RNA, 64 nt, Homo Sapiens; identical to SEQ ID NO: 107226

SEQ ID NO: 213545 - RNA, 64 nt, Homo Sapiens; identical to SEQ ID NO: 107227

SEQ ID NO: 213546 - RNA, 64 nt, Homo Sapiens; identical to SEQ ID NO: 107228

SEQ ID NO: 213547 - RNA, 64 nt, Homo Sapiens; identical to SEQ ID NO: 107229

SEQ ID NO: 213548 - RNA, 64 nt, Homo Sapiens; identical to SEQ ID NO: 107230

SEQ ID NO: 213549 - RNA, 64 nt, Homo Sapiens; identical to SEQ ID NO: 107231

SEQ ID NO: 213550 - RNA, 64 nt, Homo Sapiens; identical to SEQ ID NO: 107232

SEQ ID NO: 213551 - RNA, 64 nt, Homo Sapiens; identical to SEQ ID NO: 107233

SEQ ID NO: 213552 - RNA, 64 nt, Homo Sapiens; identical to SEQ ID NO: 107234

SEQ ID NO: 213553 - RNA, 64 nt, Homo Sapiens; identical to SEQ ID NO: 107235

SEQ ID NO: 213554 - RNA, 64 nt, Homo Sapiens; identical to SEQ ID NO: 107236

SEQ ID NO: 213555 - RNA, 64 nt, Homo Sapiens; identical to SEQ ID NO: 107237

SEQ ID NO: 213556 - RNA, 64 nt, Homo Sapiens; identical to SEQ ID NO: 107238

SEQ ID NO: 213557 - RNA, 64 nt, Homo Sapiens; identical to SEQ ID NO: 107239

SEQ ID NO: 213558 - RNA, 64 nt, Homo Sapiens; identical to SEQ ID NO: 107240

SEQ ID NO: 213559 - RNA, 64 nt, Homo Sapiens; identical to SEQ ID NO: 107241

SEQ ID NO: 213560 - RNA, 64 nt, Homo Sapiens; identical to SEQ ID NO: 107242

SEQ ID NO: 213561 - RNA, 64 nt, Homo Sapiens; identical to SEQ ID NO: 107243

SEQ ID NO: 213562 - RNA, 64 nt, Homo Sapiens; identical to SEQ ID NO: 107244

SEQ ID NO: 213563 - RNA, 64 nt, Homo Sapiens; identical to SEQ ID NO: 107245

SEQ ID NO: 213564 - RNA, 64 nt, Homo Sapiens; identical to SEQ ID NO: 107246

SEQ ID NO: 213565 - RNA, 64 nt, Homo Sapiens; identical to SEQ ID NO: 107247

SEQ ID NO: 213566 - RNA, 64 nt, Homo Sapiens; identical to SEQ ID NO: 107248

SEQ ID NO: 213567 - RNA, 64 nt, Homo Sapiens; identical to SEQ ID NO: 107249

SEQ ID NO: 213568 - RNA, 64 nt, Homo Sapiens; identical to SEQ ID NO: 107250

SEQ ID NO: 213569 - RNA, 64 nt, Homo Sapiens; identical to SEQ ID NO: 107251

SEQ ID NO: 213570 - RNA, 64 nt, Homo Sapiens; identical to SEQ ID NO: 107252

SEQ ID NO: 213571 - RNA, 64 nt, Homo Sapiens; identical to SEQ ID NO: 107253

SEQ ID NO: 213572 - RNA, 64 nt, Homo Sapiens; identical to SEQ ID NO: 107254

SEQ ID NO: 213573 - RNA, 64 nt, Homo Sapiens; identical to SEQ ID NO: 107255

SEQ ID NO: 213574 - RNA, 64 nt, Homo Sapiens; identical to SEQ ID NO: 107256

SEQ ID NO: 213575 - RNA, 64 nt, Homo Sapiens; identical to SEQ ID NO: 107257

SEQ ID NO: 213576 - RNA, 64 nt, Homo Sapiens; identical to SEQ ID NO: 107258

SEQ ID NO: 213577 - RNA, 64 nt, Homo Sapiens; identical to SEQ ID NO: 107259

SEQ ID NO: 213578 - RNA, 64 nt, Homo Sapiens; identical to SEQ ID NO: 107260

SEQ ID NO: 213579 - RNA, 64 nt, Homo Sapiens; identical to SEQ ID NO: 107261

SEQ ID NO: 213580 - RNA, 64 nt, Homo Sapiens; identical to SEQ ID NO: 107262

SEQ ID NO: 213581 - RNA, 64 nt, Homo Sapiens; identical to SEQ ID NO: 107263

SEQ ID NO: 213582 - RNA, 64 nt, Homo Sapiens; identical to SEQ ID NO: 107264

SEQ ID NO: 213583 - RNA, 64 nt, Homo Sapiens; identical to SEQ ID NO: 107265

SEQ ID NO: 213584 - RNA, 64 nt, Homo Sapiens; identical to SEQ ID NO: 107266

SEQ ID NO: 213585 - RNA, 64 nt, Homo Sapiens; identical to SEQ ID NO: 107267

SEQ ID NO: 213586 - RNA, 64 nt, Homo Sapiens; identical to SEQ ID NO: 107268

SEQ ID NO: 213587 - RNA, 64 nt, Homo Sapiens; identical to SEQ ID NO: 107269

SEQ ID NO: 213588 - RNA, 64 nt, Homo Sapiens; identical to SEQ ID NO: 107270

SEQ ID NO: 213589 - RNA, 64 nt, Homo Sapiens; identical to SEQ ID NO: 107271

SEQ ID NO: 213590 - RNA, 64 nt, Homo Sapiens; identical to SEQ ID NO: 107272

SEQ ID NO: 213591 - RNA, 64 nt, Homo Sapiens; identical to SEQ ID NO: 107273

SEQ ID NO: 213592 - RNA, 64 nt, Homo Sapiens; identical to SEQ ID NO: 107274

SEQ ID NO: 213593 - RNA, 64 nt, Homo Sapiens; identical to SEQ ID NO: 107275

SEQ ID NO: 213594 - RNA, 64 nt, Homo Sapiens; identical to SEQ ID NO: 107276

SEQ ID NO: 213595 - RNA, 64 nt, Homo Sapiens; identical to SEQ ID NO: 107277

SEQ ID NO: 213596 - RNA, 64 nt, Homo Sapiens; identical to SEQ ID NO: 107278

SEQ ID NO: 213597 - RNA, 64 nt, Homo Sapiens; identical to SEQ ID NO: 107279

SEQ ID NO: 213598 - RNA, 64 nt, Homo Sapiens; identical to SEQ ID NO: 107280

SEQ ID NO: 213599 - RNA, 64 nt, Homo Sapiens; identical to SEQ ID NO: 107281

SEQ ID NO: 213600 - RNA, 64 nt, Homo Sapiens; identical to SEQ ID NO: 107282

SEQ ID NO: 213601 - RNA, 64 nt, Homo Sapiens; identical to SEQ ID NO: 107283

SEQ ID NO: 213602 - RNA, 64 nt, Homo Sapiens; identical to SEQ ID NO: 107284

SEQ ID NO: 213603 - RNA, 64 nt, Homo Sapiens; identical to SEQ ID NO: 107285

SEQ ID NO: 213604 - RNA, 64 nt, Homo Sapiens; identical to SEQ ID NO: 107286

SEQ ID NO: 213605 - RNA, 64 nt, Homo Sapiens; identical to SEQ ID NO: 107287

SEQ ID NO: 213606 - RNA, 64 nt, Homo Sapiens; identical to SEQ ID NO: 107288

SEQ ID NO: 213607 - RNA, 64 nt, Homo Sapiens; identical to SEQ ID NO: 107289

SEQ ID NO: 213608 - RNA, 64 nt, Homo Sapiens; identical to SEQ ID NO: 107290

SEQ ID NO: 213609 - RNA, 64 nt, Homo Sapiens; identical to SEQ ID NO: 107291

SEQ ID NO: 213610 - RNA, 64 nt, Homo Sapiens; identical to SEQ ID NO: 107292

SEQ ID NO: 213611 - RNA, 64 nt, Homo Sapiens; identical to SEQ ID NO: 107293

SEQ ID NO: 213612 - RNA, 64 nt, Homo Sapiens; identical to SEQ ID NO: 107294

SEQ ID NO: 213613 - RNA, 64 nt, Homo Sapiens; identical to SEQ ID NO: 107295

SEQ ID NO: 213614 - RNA, 64 nt, Homo Sapiens; identical to SEQ ID NO: 107296

SEQ ID NO: 213615 - RNA, 64 nt, Homo Sapiens; identical to SEQ ID NO: 107297

SEQ ID NO: 213616 - RNA, 64 nt, Homo Sapiens; identical to SEQ ID NO: 107298

SEQ ID NO: 213617 - RNA, 64 nt, Homo Sapiens; identical to SEQ ID NO: 107299

SEQ ID NO: 213618 - RNA, 64 nt, Homo Sapiens; identical to SEQ ID NO: 107300

SEQ ID NO: 213619 - RNA, 64 nt, Homo Sapiens; identical to SEQ ID NO: 107301

SEQ ID NO: 213620 - RNA, 64 nt, Homo Sapiens; identical to SEQ ID NO: 107302

SEQ ID NO: 213621 - RNA, 64 nt, Homo Sapiens; identical to SEQ ID NO: 107303

SEQ ID NO: 213622 - RNA, 64 nt, Homo Sapiens; identical to SEQ ID NO: 107304

SEQ ID NO: 213623 - RNA, 64 nt, Homo Sapiens; identical to SEQ ID NO: 107305

SEQ ID NO: 213624 - RNA, 64 nt, Homo Sapiens; identical to SEQ ID NO: 107306

SEQ ID NO: 213625 - RNA, 64 nt, Homo Sapiens; identical to SEQ ID NO: 107307

SEQ ID NO: 213626 - RNA, 64 nt, Homo Sapiens; identical to SEQ ID NO: 107308

SEQ ID NO: 213627 - RNA, 64 nt, Homo Sapiens; identical to SEQ ID NO: 107309

SEQ ID NO: 213628 - RNA, 64 nt, Homo Sapiens; identical to SEQ ID NO: 107310

SEQ ID NO: 213629 - RNA, 64 nt, Homo Sapiens; identical to SEQ ID NO: 107311

SEQ ID NO: 213630 - RNA, 64 nt, Homo Sapiens; identical to SEQ ID NO: 107312

SEQ ID NO: 213631 - RNA, 64 nt, Homo Sapiens; identical to SEQ ID NO: 107313

SEQ ID NO: 213632 - RNA, 64 nt, Homo Sapiens; identical to SEQ ID NO: 107314

SEQ ID NO: 213633 - RNA, 64 nt, Homo Sapiens; identical to SEQ ID NO: 107315

SEQ ID NO: 213634 - RNA, 64 nt, Homo Sapiens; identical to SEQ ID NO: 107316

SEQ ID NO: 213635 - RNA, 64 nt, Homo Sapiens; identical to SEQ ID NO: 107317

SEQ ID NO: 213636 - RNA, 64 nt, Homo Sapiens; identical to SEQ ID NO: 107318

SEQ ID NO: 213637 - RNA, 64 nt, Homo Sapiens; identical to SEQ ID NO: 107319

SEQ ID NO: 213638 - RNA, 64 nt, Homo Sapiens; identical to SEQ ID NO: 107320

SEQ ID NO: 213639 - RNA, 64 nt, Homo Sapiens; identical to SEQ ID NO: 107321

SEQ ID NO: 213640 - RNA, 64 nt, Homo Sapiens; identical to SEQ ID NO: 107322

SEQ ID NO: 213641 - RNA, 64 nt, Homo Sapiens; identical to SEQ ID NO: 107323

SEQ ID NO: 213642 - RNA, 64 nt, Homo Sapiens; identical to SEQ ID NO: 107324

SEQ ID NO: 213643 - RNA, 64 nt, Homo Sapiens; identical to SEQ ID NO: 107325

SEQ ID NO: 213644 - RNA, 64 nt, Homo Sapiens; identical to SEQ ID NO: 107326

SEQ ID NO: 213645 - RNA, 64 nt, Homo Sapiens; identical to SEQ ID NO: 107327

SEQ ID NO: 213646 - RNA, 64 nt, Homo Sapiens; identical to SEQ ID NO: 107328

SEQ ID NO: 213647 - RNA, 64 nt, Homo Sapiens; identical to SEQ ID NO: 107329

SEQ ID NO: 213648 - RNA, 64 nt, Homo Sapiens; identical to SEQ ID NO: 107330

SEQ ID NO: 213649 - RNA, 64 nt, Homo Sapiens; identical to SEQ ID NO: 107331

SEQ ID NO: 213650 - RNA, 64 nt, Homo Sapiens; identical to SEQ ID NO: 107332

SEQ ID NO: 213651 - RNA, 64 nt, Homo Sapiens; identical to SEQ ID NO: 107333

SEQ ID NO: 213652 - RNA, 64 nt, Homo Sapiens; identical to SEQ ID NO: 107334

SEQ ID NO: 213653 - RNA, 64 nt, Homo Sapiens; identical to SEQ ID NO: 107335

SEQ ID NO: 213654 - RNA, 64 nt, Homo Sapiens; identical to SEQ ID NO: 107336

SEQ ID NO: 213655 - RNA, 64 nt, Homo Sapiens; identical to SEQ ID NO: 107337

SEQ ID NO: 213656 - RNA, 64 nt, Homo Sapiens; identical to SEQ ID NO: 107338

SEQ ID NO: 213657 - RNA, 64 nt, Homo Sapiens; identical to SEQ ID NO: 107339

SEQ ID NO: 213658 - RNA, 64 nt, Homo Sapiens; identical to SEQ ID NO: 107340

SEQ ID NO: 213659 - RNA, 64 nt, Homo Sapiens; identical to SEQ ID NO: 107341

SEQ ID NO: 213660 - RNA, 64 nt, Homo Sapiens; identical to SEQ ID NO: 107342

SEQ ID NO: 213661 - RNA, 64 nt, Homo Sapiens; identical to SEQ ID NO: 107343

SEQ ID NO: 213662 - RNA, 64 nt, Homo Sapiens; identical to SEQ ID NO: 107344

SEQ ID NO: 213663 - RNA, 64 nt, Homo Sapiens; identical to SEQ ID NO: 107345

SEQ ID NO: 213664 - RNA, 64 nt, Homo Sapiens; identical to SEQ ID NO: 107346

SEQ ID NO: 213665 - RNA, 64 nt, Homo Sapiens; identical to SEQ ID NO: 107347

SEQ ID NO: 213666 - RNA, 64 nt, Homo Sapiens; identical to SEQ ID NO: 107348

SEQ ID NO: 213667 - RNA, 64 nt, Homo Sapiens; identical to SEQ ID NO: 107349

SEQ ID NO: 213668 - RNA, 64 nt, Homo Sapiens; identical to SEQ ID NO: 107350

SEQ ID NO: 213669 - RNA, 64 nt, Homo Sapiens; identical to SEQ ID NO: 107351

SEQ ID NO: 213670 - RNA, 64 nt, Homo Sapiens; identical to SEQ ID NO: 107352

SEQ ID NO: 213671 - RNA, 64 nt, Homo Sapiens; identical to SEQ ID NO: 107353

SEQ ID NO: 213672 - RNA, 64 nt, Homo Sapiens; identical to SEQ ID NO: 107354

SEQ ID NO: 213673 - RNA, 64 nt, Homo Sapiens; identical to SEQ ID NO: 107355

SEQ ID NO: 213674 - RNA, 64 nt, Homo Sapiens; identical to SEQ ID NO: 107356

SEQ ID NO: 213675 - RNA, 64 nt, Homo Sapiens; identical to SEQ ID NO: 107357

SEQ ID NO: 213676 - RNA, 64 nt, Homo Sapiens; identical to SEQ ID NO: 107358

SEQ ID NO: 213677 - RNA, 64 nt, Homo Sapiens; identical to SEQ ID NO: 107359

SEQ ID NO: 213678 - RNA, 64 nt, Homo Sapiens; identical to SEQ ID NO: 107360

SEQ ID NO: 213679 - RNA, 64 nt, Homo Sapiens; identical to SEQ ID NO: 107361

SEQ ID NO: 213680 - RNA, 64 nt, Homo Sapiens; identical to SEQ ID NO: 107362

SEQ ID NO: 213681 - RNA, 64 nt, Homo Sapiens; identical to SEQ ID NO: 107363

SEQ ID NO: 213682 - RNA, 64 nt, Homo Sapiens; identical to SEQ ID NO: 107364

SEQ ID NO: 213683 - RNA, 64 nt, Homo Sapiens; identical to SEQ ID NO: 107365

SEQ ID NO: 213684 - RNA, 64 nt, Homo Sapiens; identical to SEQ ID NO: 107366

SEQ ID NO: 213685 - RNA, 64 nt, Homo Sapiens; identical to SEQ ID NO: 107367

SEQ ID NO: 213686 - RNA, 64 nt, Homo Sapiens; identical to SEQ ID NO: 107368

SEQ ID NO: 213687 - RNA, 64 nt, Homo Sapiens; identical to SEQ ID NO: 107369

SEQ ID NO: 213688 - RNA, 64 nt, Homo Sapiens; identical to SEQ ID NO: 107370

SEQ ID NO: 213689 - RNA, 64 nt, Homo Sapiens; identical to SEQ ID NO: 107371

SEQ ID NO: 213690 - RNA, 64 nt, Homo Sapiens; identical to SEQ ID NO: 107372

SEQ ID NO: 213691 - RNA, 64 nt, Homo Sapiens; identical to SEQ ID NO: 107373

SEQ ID NO: 213692 - RNA, 64 nt, Homo Sapiens; identical to SEQ ID NO: 107374

SEQ ID NO: 213693 - RNA, 64 nt, Homo Sapiens; identical to SEQ ID NO: 107375

SEQ ID NO: 213694 - RNA, 64 nt, Homo Sapiens; identical to SEQ ID NO: 107376

SEQ ID NO: 213695 - RNA, 64 nt, Homo Sapiens; identical to SEQ ID NO: 107377

SEQ ID NO: 213696 - RNA, 64 nt, Homo Sapiens; identical to SEQ ID NO: 107378

SEQ ID NO: 213697 - RNA, 64 nt, Homo Sapiens; identical to SEQ ID NO: 107379

SEQ ID NO: 213698 - RNA, 64 nt, Homo Sapiens; identical to SEQ ID NO: 107380

SEQ ID NO: 213699 - RNA, 64 nt, Homo Sapiens; identical to SEQ ID NO: 107381

SEQ ID NO: 213700 - RNA, 64 nt, Homo Sapiens; identical to SEQ ID NO: 107382

SEQ ID NO: 213701 - RNA, 64 nt, Homo Sapiens; identical to SEQ ID NO: 107383

SEQ ID NO: 213702 - RNA, 64 nt, Homo Sapiens; identical to SEQ ID NO: 107384

SEQ ID NO: 213703 - RNA, 64 nt, Homo Sapiens; identical to SEQ ID NO: 107385

SEQ ID NO: 213704 - RNA, 64 nt, Homo Sapiens; identical to SEQ ID NO: 107386

SEQ ID NO: 213705 - RNA, 64 nt, Homo Sapiens; identical to SEQ ID NO: 107387

SEQ ID NO: 213706 - RNA, 64 nt, Homo Sapiens; identical to SEQ ID NO: 107388

SEQ ID NO: 213707 - RNA, 64 nt, Homo Sapiens; identical to SEQ ID NO: 107389

SEQ ID NO: 213708 - RNA, 64 nt, Homo Sapiens; identical to SEQ ID NO: 107390

SEQ ID NO: 213709 - RNA, 64 nt, Homo Sapiens; identical to SEQ ID NO: 107391

SEQ ID NO: 213710 - RNA, 64 nt, Homo Sapiens; identical to SEQ ID NO: 107392

SEQ ID NO: 213711 - RNA, 64 nt, Homo Sapiens; identical to SEQ ID NO: 107393

SEQ ID NO: 213712 - RNA, 64 nt, Homo Sapiens; identical to SEQ ID NO: 107394

SEQ ID NO: 213713 - RNA, 64 nt, Homo Sapiens; identical to SEQ ID NO: 107395

SEQ ID NO: 213714 - RNA, 64 nt, Homo Sapiens; identical to SEQ ID NO: 107396

SEQ ID NO: 213715 - RNA, 64 nt, Homo Sapiens; identical to SEQ ID NO: 107397

SEQ ID NO: 213716 - RNA, 64 nt, Homo Sapiens; identical to SEQ ID NO: 107398

SEQ ID NO: 213717 - RNA, 64 nt, Homo Sapiens; identical to SEQ ID NO: 107399

SEQ ID NO: 213718 - RNA, 64 nt, Homo Sapiens; identical to SEQ ID NO: 107400

SEQ ID NO: 213719 - RNA, 64 nt, Homo Sapiens; identical to SEQ ID NO: 107401

SEQ ID NO: 213720 - RNA, 64 nt, Homo Sapiens; identical to SEQ ID NO: 107402

SEQ ID NO: 213721 - RNA, 64 nt, Homo Sapiens; identical to SEQ ID NO: 107403

SEQ ID NO: 213722 - RNA, 64 nt, Homo Sapiens; identical to SEQ ID NO: 107404

SEQ ID NO: 213723 - RNA, 64 nt, Homo Sapiens; identical to SEQ ID NO: 107405

SEQ ID NO: 213724 - RNA, 64 nt, Homo Sapiens; identical to SEQ ID NO: 107406

SEQ ID NO: 213725 - RNA, 64 nt, Homo Sapiens; identical to SEQ ID NO: 107407

SEQ ID NO: 213726 - RNA, 64 nt, Homo Sapiens; identical to SEQ ID NO: 107408

SEQ ID NO: 213727 - RNA, 64 nt, Homo Sapiens; identical to SEQ ID NO: 107409

SEQ ID NO: 213728 - RNA, 64 nt, Homo Sapiens; identical to SEQ ID NO: 107410

SEQ ID NO: 213729 - RNA, 64 nt, Homo Sapiens; identical to SEQ ID NO: 107411

SEQ ID NO: 213730 - RNA, 64 nt, Homo Sapiens; identical to SEQ ID NO: 107412

SEQ ID NO: 213731 - RNA, 64 nt, Homo Sapiens; identical to SEQ ID NO: 107413

SEQ ID NO: 213732 - RNA, 64 nt, Homo Sapiens; identical to SEQ ID NO: 107414

SEQ ID NO: 213733 - RNA, 64 nt, Homo Sapiens; identical to SEQ ID NO: 107415

SEQ ID NO: 213734 - RNA, 64 nt, Homo Sapiens; identical to SEQ ID NO: 107416

SEQ ID NO: 213735 - RNA, 64 nt, Homo Sapiens; identical to SEQ ID NO: 107417

SEQ ID NO: 213736 - RNA, 64 nt, Homo Sapiens; identical to SEQ ID NO: 107418

SEQ ID NO: 213737 - RNA, 64 nt, Homo Sapiens; identical to SEQ ID NO: 107419

SEQ ID NO: 213738 - RNA, 64 nt, Homo Sapiens; identical to SEQ ID NO: 107420

SEQ ID NO: 213739 - RNA, 64 nt, Homo Sapiens; identical to SEQ ID NO: 107421

SEQ ID NO: 213740 - RNA, 64 nt, Homo Sapiens; identical to SEQ ID NO: 107422

SEQ ID NO: 213741 - RNA, 64 nt, Homo Sapiens; identical to SEQ ID NO: 107423

SEQ ID NO: 213742 - RNA, 64 nt, Homo Sapiens; identical to SEQ ID NO: 107424

SEQ ID NO: 213743 - RNA, 64 nt, Homo Sapiens; identical to SEQ ID NO: 107425

SEQ ID NO: 213744 - RNA, 64 nt, Homo Sapiens; identical to SEQ ID NO: 107426

SEQ ID NO: 213745 - RNA, 64 nt, Homo Sapiens; identical to SEQ ID NO: 107427

SEQ ID NO: 213746 - RNA, 64 nt, Homo Sapiens; identical to SEQ ID NO: 107428

SEQ ID NO: 213747 - RNA, 64 nt, Homo Sapiens; identical to SEQ ID NO: 107429

SEQ ID NO: 213748 - RNA, 64 nt, Homo Sapiens; identical to SEQ ID NO: 107430

SEQ ID NO: 213749 - RNA, 64 nt, Homo Sapiens; identical to SEQ ID NO: 107431

SEQ ID NO: 213750 - RNA, 64 nt, Homo Sapiens; identical to SEQ ID NO: 107432

SEQ ID NO: 213751 - RNA, 64 nt, Homo Sapiens; identical to SEQ ID NO: 107433

SEQ ID NO: 213752 - RNA, 64 nt, Homo Sapiens; identical to SEQ ID NO: 107434

SEQ ID NO: 213753 - RNA, 64 nt, Homo Sapiens; identical to SEQ ID NO: 107435

SEQ ID NO: 213754 - RNA, 64 nt, Homo Sapiens; identical to SEQ ID NO: 107436

SEQ ID NO: 213755 - RNA, 64 nt, Homo Sapiens; identical to SEQ ID NO: 107437

SEQ ID NO: 213756 - RNA, 64 nt, Homo Sapiens; identical to SEQ ID NO: 107438

SEQ ID NO: 213757 - RNA, 64 nt, Homo Sapiens; identical to SEQ ID NO: 107439

SEQ ID NO: 213758 - RNA, 64 nt, Homo Sapiens; identical to SEQ ID NO: 107440

SEQ ID NO: 213759 - RNA, 64 nt, Homo Sapiens; identical to SEQ ID NO: 107441

SEQ ID NO: 213760 - RNA, 64 nt, Homo Sapiens; identical to SEQ ID NO: 107442

SEQ ID NO: 213761 - RNA, 64 nt, Homo Sapiens; identical to SEQ ID NO: 107443

SEQ ID NO: 213762 - RNA, 64 nt, Homo Sapiens; identical to SEQ ID NO: 107444

SEQ ID NO: 213763 - RNA, 64 nt, Homo Sapiens; identical to SEQ ID NO: 107445

SEQ ID NO: 213764 - RNA, 64 nt, Homo Sapiens; identical to SEQ ID NO: 107446

SEQ ID NO: 213765 - RNA, 64 nt, Homo Sapiens; identical to SEQ ID NO: 107447

SEQ ID NO: 213766 - RNA, 64 nt, Homo Sapiens; identical to SEQ ID NO: 107448

SEQ ID NO: 213767 - RNA, 64 nt, Homo Sapiens; identical to SEQ ID NO: 107449

SEQ ID NO: 213768 - RNA, 64 nt, Homo Sapiens; identical to SEQ ID NO: 107450

SEQ ID NO: 213769 - RNA, 64 nt, Homo Sapiens; identical to SEQ ID NO: 107451

SEQ ID NO: 213770 - RNA, 64 nt, Homo Sapiens; identical to SEQ ID NO: 107452

SEQ ID NO: 213771 - RNA, 64 nt, Homo Sapiens; identical to SEQ ID NO: 107453

SEQ ID NO: 213772 - RNA, 64 nt, Homo Sapiens; identical to SEQ ID NO: 107454

SEQ ID NO: 213773 - RNA, 64 nt, Homo Sapiens; identical to SEQ ID NO: 107455

SEQ ID NO: 213774 - RNA, 64 nt, Homo Sapiens; identical to SEQ ID NO: 107456

SEQ ID NO: 213775 - RNA, 64 nt, Homo Sapiens; identical to SEQ ID NO: 107457

SEQ ID NO: 213776 - RNA, 64 nt, Homo Sapiens; identical to SEQ ID NO: 107458

SEQ ID NO: 213777 - RNA, 64 nt, Homo Sapiens; identical to SEQ ID NO: 107459

SEQ ID NO: 213778 - RNA, 64 nt, Homo Sapiens; identical to SEQ ID NO: 107460

SEQ ID NO: 213779 - RNA, 64 nt, Homo Sapiens; identical to SEQ ID NO: 107461

SEQ ID NO: 213780 - RNA, 64 nt, Homo Sapiens; identical to SEQ ID NO: 107462

SEQ ID NO: 213781 - RNA, 64 nt, Homo Sapiens; identical to SEQ ID NO: 107463

SEQ ID NO: 213782 - RNA, 64 nt, Homo Sapiens; identical to SEQ ID NO: 107464

SEQ ID NO: 213783 - RNA, 64 nt, Homo Sapiens; identical to SEQ ID NO: 107465

SEQ ID NO: 213784 - RNA, 64 nt, Homo Sapiens; identical to SEQ ID NO: 107466

SEQ ID NO: 213785 - RNA, 64 nt, Homo Sapiens; identical to SEQ ID NO: 107467

SEQ ID NO: 213786 - RNA, 64 nt, Homo Sapiens; identical to SEQ ID NO: 107468

SEQ ID NO: 213787 - RNA, 64 nt, Homo Sapiens; identical to SEQ ID NO: 107469

SEQ ID NO: 213788 - RNA, 64 nt, Homo Sapiens; identical to SEQ ID NO: 107470

SEQ ID NO: 213789 - RNA, 64 nt, Homo Sapiens; identical to SEQ ID NO: 107471

SEQ ID NO: 213790 - RNA, 64 nt, Homo Sapiens; identical to SEQ ID NO: 107472

SEQ ID NO: 213791 - RNA, 64 nt, Homo Sapiens; identical to SEQ ID NO: 107473

SEQ ID NO: 213792 - RNA, 64 nt, Homo Sapiens; identical to SEQ ID NO: 107474

SEQ ID NO: 213793 - RNA, 64 nt, Homo Sapiens; identical to SEQ ID NO: 107475

SEQ ID NO: 213794 - RNA, 64 nt, Homo Sapiens; identical to SEQ ID NO: 107476

SEQ ID NO: 213795 - RNA, 64 nt, Homo Sapiens; identical to SEQ ID NO: 107477

SEQ ID NO: 213796 - RNA, 64 nt, Homo Sapiens; identical to SEQ ID NO: 107478

SEQ ID NO: 213797 - RNA, 64 nt, Homo Sapiens; identical to SEQ ID NO: 107479

SEQ ID NO: 213798 - RNA, 64 nt, Homo Sapiens; identical to SEQ ID NO: 107480

SEQ ID NO: 213799 - RNA, 64 nt, Homo Sapiens; identical to SEQ ID NO: 107481

SEQ ID NO: 213800 - RNA, 64 nt, Homo Sapiens; identical to SEQ ID NO: 107482

SEQ ID NO: 213801 - RNA, 64 nt, Homo Sapiens; identical to SEQ ID NO: 107483

SEQ ID NO: 213802 - RNA, 64 nt, Homo Sapiens; identical to SEQ ID NO: 107484

SEQ ID NO: 213803 - RNA, 64 nt, Homo Sapiens; identical to SEQ ID NO: 107485

SEQ ID NO: 213804 - RNA, 64 nt, Homo Sapiens; identical to SEQ ID NO: 107486

SEQ ID NO: 213805 - RNA, 64 nt, Homo Sapiens; identical to SEQ ID NO: 107487

SEQ ID NO: 213806 - RNA, 64 nt, Homo Sapiens; identical to SEQ ID NO: 107488

SEQ ID NO: 213807 - RNA, 64 nt, Homo Sapiens; identical to SEQ ID NO: 107489

SEQ ID NO: 213808 - RNA, 64 nt, Homo Sapiens; identical to SEQ ID NO: 107490

SEQ ID NO: 213809 - RNA, 64 nt, Homo Sapiens; identical to SEQ ID NO: 107491

SEQ ID NO: 213810 - RNA, 64 nt, Homo Sapiens; identical to SEQ ID NO: 107492

SEQ ID NO: 213811 - RNA, 64 nt, Homo Sapiens; identical to SEQ ID NO: 107493

SEQ ID NO: 213812 - RNA, 64 nt, Homo Sapiens; identical to SEQ ID NO: 107494

SEQ ID NO: 213813 - RNA, 64 nt, Homo Sapiens; identical to SEQ ID NO: 107495

SEQ ID NO: 213814 - RNA, 64 nt, Homo Sapiens; identical to SEQ ID NO: 107496

SEQ ID NO: 213815 - RNA, 64 nt, Homo Sapiens; identical to SEQ ID NO: 107497

SEQ ID NO: 213816 - RNA, 64 nt, Homo Sapiens; identical to SEQ ID NO: 107498

SEQ ID NO: 213817 - RNA, 64 nt, Homo Sapiens; identical to SEQ ID NO: 107499

SEQ ID NO: 213818 - RNA, 64 nt, Homo Sapiens; identical to SEQ ID NO: 107500

SEQ ID NO: 213819 - RNA, 64 nt, Homo Sapiens; identical to SEQ ID NO: 107501

SEQ ID NO: 213820 - RNA, 64 nt, Homo Sapiens; identical to SEQ ID NO: 107502

SEQ ID NO: 213821 - RNA, 64 nt, Homo Sapiens; identical to SEQ ID NO: 107503

SEQ ID NO: 213822 - RNA, 64 nt, Homo Sapiens; identical to SEQ ID NO: 107504

SEQ ID NO: 213823 - RNA, 64 nt, Homo Sapiens; identical to SEQ ID NO: 107505

SEQ ID NO: 213824 - RNA, 64 nt, Homo Sapiens; identical to SEQ ID NO: 107506

SEQ ID NO: 213825 - RNA, 64 nt, Homo Sapiens; identical to SEQ ID NO: 107507

SEQ ID NO: 213826 - RNA, 64 nt, Homo Sapiens; identical to SEQ ID NO: 107508

SEQ ID NO: 213827 - RNA, 64 nt, Homo Sapiens; identical to SEQ ID NO: 107509

SEQ ID NO: 213828 - RNA, 64 nt, Homo Sapiens; identical to SEQ ID NO: 107510

SEQ ID NO: 213829 - RNA, 64 nt, Homo Sapiens; identical to SEQ ID NO: 107511

SEQ ID NO: 213830 - RNA, 64 nt, Homo Sapiens; identical to SEQ ID NO: 107512

SEQ ID NO: 213831 - RNA, 64 nt, Homo Sapiens; identical to SEQ ID NO: 107513

SEQ ID NO: 213832 - RNA, 64 nt, Homo Sapiens; identical to SEQ ID NO: 107514

SEQ ID NO: 213833 - RNA, 64 nt, Homo Sapiens; identical to SEQ ID NO: 107515

SEQ ID NO: 213834 - RNA, 64 nt, Homo Sapiens; identical to SEQ ID NO: 107516

SEQ ID NO: 213835 - RNA, 64 nt, Homo Sapiens; identical to SEQ ID NO: 107517

SEQ ID NO: 213836 - RNA, 64 nt, Homo Sapiens; identical to SEQ ID NO: 107518

SEQ ID NO: 213837 - RNA, 64 nt, Homo Sapiens; identical to SEQ ID NO: 107519

SEQ ID NO: 213838 - RNA, 64 nt, Homo Sapiens; identical to SEQ ID NO: 107520

SEQ ID NO: 213839 - RNA, 64 nt, Homo Sapiens; identical to SEQ ID NO: 107521

SEQ ID NO: 213840 - RNA, 64 nt, Homo Sapiens; identical to SEQ ID NO: 107522

SEQ ID NO: 213841 - RNA, 64 nt, Homo Sapiens; identical to SEQ ID NO: 107523

SEQ ID NO: 213842 - RNA, 64 nt, Homo Sapiens; identical to SEQ ID NO: 107524

SEQ ID NO: 213843 - RNA, 64 nt, Homo Sapiens; identical to SEQ ID NO: 107525

SEQ ID NO: 213844 - RNA, 64 nt, Homo Sapiens; identical to SEQ ID NO: 107526

SEQ ID NO: 213845 - RNA, 64 nt, Homo Sapiens; identical to SEQ ID NO: 107527

SEQ ID NO: 213846 - RNA, 64 nt, Homo Sapiens; identical to SEQ ID NO: 107528

SEQ ID NO: 213847 - RNA, 64 nt, Homo Sapiens; identical to SEQ ID NO: 107529

SEQ ID NO: 213848 - RNA, 64 nt, Homo Sapiens; identical to SEQ ID NO: 107530

SEQ ID NO: 213849 - RNA, 64 nt, Homo Sapiens; identical to SEQ ID NO: 107531

SEQ ID NO: 213850 - RNA, 64 nt, Homo Sapiens; identical to SEQ ID NO: 107532

SEQ ID NO: 213851 - RNA, 64 nt, Homo Sapiens; identical to SEQ ID NO: 107533

SEQ ID NO: 213852 - RNA, 64 nt, Homo Sapiens; identical to SEQ ID NO: 107534

SEQ ID NO: 213853 - RNA, 64 nt, Homo Sapiens; identical to SEQ ID NO: 107535

SEQ ID NO: 213854 - RNA, 64 nt, Homo Sapiens; identical to SEQ ID NO: 107536

SEQ ID NO: 213855 - RNA, 64 nt, Homo Sapiens; identical to SEQ ID NO: 107537

SEQ ID NO: 213856 - RNA, 64 nt, Homo Sapiens; identical to SEQ ID NO: 107538

SEQ ID NO: 213857 - RNA, 64 nt, Homo Sapiens; identical to SEQ ID NO: 107539

SEQ ID NO: 213858 - RNA, 64 nt, Homo Sapiens; identical to SEQ ID NO: 107540

SEQ ID NO: 213859 - RNA, 64 nt, Homo Sapiens; identical to SEQ ID NO: 107541

SEQ ID NO: 213860 - RNA, 64 nt, Homo Sapiens; identical to SEQ ID NO: 107542

SEQ ID NO: 213861 - RNA, 64 nt, Homo Sapiens; identical to SEQ ID NO: 107543

SEQ ID NO: 213862 - RNA, 64 nt, Homo Sapiens; identical to SEQ ID NO: 107544

SEQ ID NO: 213863 - RNA, 64 nt, Homo Sapiens; identical to SEQ ID NO: 107545

SEQ ID NO: 213864 - RNA, 64 nt, Homo Sapiens; identical to SEQ ID NO: 107546

SEQ ID NO: 213865 - RNA, 64 nt, Homo Sapiens; identical to SEQ ID NO: 107547

SEQ ID NO: 213866 - RNA, 64 nt, Homo Sapiens; identical to SEQ ID NO: 107548

SEQ ID NO: 213867 - RNA, 64 nt, Homo Sapiens; identical to SEQ ID NO: 107549

SEQ ID NO: 213868 - RNA, 64 nt, Homo Sapiens; identical to SEQ ID NO: 107550

SEQ ID NO: 213869 - RNA, 64 nt, Homo Sapiens; identical to SEQ ID NO: 107551

SEQ ID NO: 213870 - RNA, 64 nt, Homo Sapiens; identical to SEQ ID NO: 107552

SEQ ID NO: 213871 - RNA, 64 nt, Homo Sapiens; identical to SEQ ID NO: 107553

SEQ ID NO: 213872 - RNA, 64 nt, Homo Sapiens; identical to SEQ ID NO: 107554

SEQ ID NO: 213873 - RNA, 64 nt, Homo Sapiens; identical to SEQ ID NO: 107555

SEQ ID NO: 213874 - RNA, 64 nt, Homo Sapiens; identical to SEQ ID NO: 107556

SEQ ID NO: 213875 - RNA, 64 nt, Homo Sapiens; identical to SEQ ID NO: 107557

SEQ ID NO: 213876 - RNA, 64 nt, Homo Sapiens; identical to SEQ ID NO: 107558

SEQ ID NO: 213877 - RNA, 64 nt, Homo Sapiens; identical to SEQ ID NO: 107559

SEQ ID NO: 213878 - RNA, 64 nt, Homo Sapiens; identical to SEQ ID NO: 107560

SEQ ID NO: 213879 - RNA, 64 nt, Homo Sapiens; identical to SEQ ID NO: 107561

SEQ ID NO: 213880 - RNA, 64 nt, Homo Sapiens; identical to SEQ ID NO: 107562

SEQ ID NO: 213881 - RNA, 64 nt, Homo Sapiens; identical to SEQ ID NO: 107563

SEQ ID NO: 213882 - RNA, 64 nt, Homo Sapiens; identical to SEQ ID NO: 107564

SEQ ID NO: 213883 - RNA, 64 nt, Homo Sapiens; identical to SEQ ID NO: 107565

SEQ ID NO: 213884 - RNA, 64 nt, Homo Sapiens; identical to SEQ ID NO: 107566

SEQ ID NO: 213885 - RNA, 64 nt, Homo Sapiens; identical to SEQ ID NO: 107567

SEQ ID NO: 213886 - RNA, 64 nt, Homo Sapiens; identical to SEQ ID NO: 107568

SEQ ID NO: 213887 - RNA, 64 nt, Homo Sapiens; identical to SEQ ID NO: 107569

SEQ ID NO: 213888 - RNA, 64 nt, Homo Sapiens; identical to SEQ ID NO: 107570

SEQ ID NO: 213889 - RNA, 64 nt, Homo Sapiens; identical to SEQ ID NO: 107571

SEQ ID NO: 213890 - RNA, 64 nt, Homo Sapiens; identical to SEQ ID NO: 107572

SEQ ID NO: 213891 - RNA, 64 nt, Homo Sapiens; identical to SEQ ID NO: 107573

SEQ ID NO: 213892 - RNA, 64 nt, Homo Sapiens; identical to SEQ ID NO: 107574

SEQ ID NO: 213893 - RNA, 64 nt, Homo Sapiens; identical to SEQ ID NO: 107575

SEQ ID NO: 213894 - RNA, 64 nt, Homo Sapiens; identical to SEQ ID NO: 107576

SEQ ID NO: 213895 - RNA, 64 nt, Homo Sapiens; identical to SEQ ID NO: 107577

SEQ ID NO: 213896 - RNA, 64 nt, Homo Sapiens; identical to SEQ ID NO: 107578

SEQ ID NO: 213897 - RNA, 64 nt, Homo Sapiens; identical to SEQ ID NO: 107579

SEQ ID NO: 213898 - RNA, 64 nt, Homo Sapiens; identical to SEQ ID NO: 107580

SEQ ID NO: 213899 - RNA, 64 nt, Homo Sapiens; identical to SEQ ID NO: 107581

SEQ ID NO: 213900 - RNA, 64 nt, Homo Sapiens; identical to SEQ ID NO: 107582

SEQ ID NO: 213901 - RNA, 64 nt, Homo Sapiens; identical to SEQ ID NO: 107583

SEQ ID NO: 213902 - RNA, 64 nt, Homo Sapiens; identical to SEQ ID NO: 107584

SEQ ID NO: 213903 - RNA, 64 nt, Homo Sapiens; identical to SEQ ID NO: 107585

SEQ ID NO: 213904 - RNA, 64 nt, Homo Sapiens; identical to SEQ ID NO: 107586

SEQ ID NO: 213905 - RNA, 64 nt, Homo Sapiens; identical to SEQ ID NO: 107587

SEQ ID NO: 213906 - RNA, 64 nt, Homo Sapiens; identical to SEQ ID NO: 107588

SEQ ID NO: 213907 - RNA, 64 nt, Homo Sapiens; identical to SEQ ID NO: 107589

SEQ ID NO: 213908 - RNA, 64 nt, Homo Sapiens; identical to SEQ ID NO: 107590

SEQ ID NO: 213909 - RNA, 64 nt, Homo Sapiens; identical to SEQ ID NO: 107591

SEQ ID NO: 213910 - RNA, 64 nt, Homo Sapiens; identical to SEQ ID NO: 107592

SEQ ID NO: 213911 - RNA, 64 nt, Homo Sapiens; identical to SEQ ID NO: 107593

SEQ ID NO: 213912 - RNA, 64 nt, Homo Sapiens; identical to SEQ ID NO: 107594

SEQ ID NO: 213913 - RNA, 64 nt, Homo Sapiens; identical to SEQ ID NO: 107595

SEQ ID NO: 213914 - RNA, 64 nt, Homo Sapiens; identical to SEQ ID NO: 107596

SEQ ID NO: 213915 - RNA, 64 nt, Homo Sapiens; identical to SEQ ID NO: 107597

SEQ ID NO: 213916 - RNA, 64 nt, Homo Sapiens; identical to SEQ ID NO: 107598

SEQ ID NO: 213917 - RNA, 64 nt, Homo Sapiens; identical to SEQ ID NO: 107599

SEQ ID NO: 213918 - RNA, 64 nt, Homo Sapiens; identical to SEQ ID NO: 107600

SEQ ID NO: 213919 - RNA, 64 nt, Homo Sapiens; identical to SEQ ID NO: 107601

SEQ ID NO: 213920 - RNA, 64 nt, Homo Sapiens; identical to SEQ ID NO: 107602

SEQ ID NO: 213921 - RNA, 64 nt, Homo Sapiens; identical to SEQ ID NO: 107603

SEQ ID NO: 213922 - RNA, 64 nt, Homo Sapiens; identical to SEQ ID NO: 107604

SEQ ID NO: 213923 - RNA, 64 nt, Homo Sapiens; identical to SEQ ID NO: 107605

SEQ ID NO: 213924 - RNA, 64 nt, Homo Sapiens; identical to SEQ ID NO: 107606

SEQ ID NO: 213925 - RNA, 64 nt, Homo Sapiens; identical to SEQ ID NO: 107607

SEQ ID NO: 213926 - RNA, 64 nt, Homo Sapiens; identical to SEQ ID NO: 107608

SEQ ID NO: 213927 - RNA, 64 nt, Homo Sapiens; identical to SEQ ID NO: 107609

SEQ ID NO: 213928 - RNA, 64 nt, Homo Sapiens; identical to SEQ ID NO: 107610

SEQ ID NO: 213929 - RNA, 64 nt, Homo Sapiens; identical to SEQ ID NO: 107611

SEQ ID NO: 213930 - RNA, 64 nt, Homo Sapiens; identical to SEQ ID NO: 107612

SEQ ID NO: 213931 - RNA, 64 nt, Homo Sapiens; identical to SEQ ID NO: 107613

SEQ ID NO: 213932 - RNA, 64 nt, Homo Sapiens; identical to SEQ ID NO: 107614

SEQ ID NO: 213933 - RNA, 64 nt, Homo Sapiens; identical to SEQ ID NO: 107615

SEQ ID NO: 213934 - RNA, 64 nt, Homo Sapiens; identical to SEQ ID NO: 107616

SEQ ID NO: 213935 - RNA, 64 nt, Homo Sapiens; identical to SEQ ID NO: 107617

SEQ ID NO: 213936 - RNA, 64 nt, Homo Sapiens; identical to SEQ ID NO: 107618

SEQ ID NO: 213937 - RNA, 64 nt, Homo Sapiens; identical to SEQ ID NO: 107619

SEQ ID NO: 213938 - RNA, 64 nt, Homo Sapiens; identical to SEQ ID NO: 107620

SEQ ID NO: 213939 - RNA, 64 nt, Homo Sapiens; identical to SEQ ID NO: 107621

SEQ ID NO: 213940 - RNA, 64 nt, Homo Sapiens; identical to SEQ ID NO: 107622

SEQ ID NO: 213941 - RNA, 64 nt, Homo Sapiens; identical to SEQ ID NO: 107623

SEQ ID NO: 213942 - RNA, 64 nt, Homo Sapiens; identical to SEQ ID NO: 107624

SEQ ID NO: 213943 - RNA, 64 nt, Homo Sapiens; identical to SEQ ID NO: 107625

SEQ ID NO: 213944 - RNA, 64 nt, Homo Sapiens; identical to SEQ ID NO: 107626

SEQ ID NO: 213945 - RNA, 64 nt, Homo Sapiens; identical to SEQ ID NO: 107627

SEQ ID NO: 213946 - RNA, 64 nt, Homo Sapiens; identical to SEQ ID NO: 107628

SEQ ID NO: 213947 - RNA, 64 nt, Homo Sapiens; identical to SEQ ID NO: 107629

SEQ ID NO: 213948 - RNA, 64 nt, Homo Sapiens; identical to SEQ ID NO: 107630

SEQ ID NO: 213949 - RNA, 64 nt, Homo Sapiens; identical to SEQ ID NO: 107631

SEQ ID NO: 213950 - RNA, 64 nt, Homo Sapiens; identical to SEQ ID NO: 107632

SEQ ID NO: 213951 - RNA, 64 nt, Homo Sapiens; identical to SEQ ID NO: 107633

SEQ ID NO: 213952 - RNA, 64 nt, Homo Sapiens; identical to SEQ ID NO: 107634

SEQ ID NO: 213953 - RNA, 64 nt, Homo Sapiens; identical to SEQ ID NO: 107635

SEQ ID NO: 213954 - RNA, 64 nt, Homo Sapiens; identical to SEQ ID NO: 107636

SEQ ID NO: 213955 - RNA, 64 nt, Homo Sapiens; identical to SEQ ID NO: 107637

SEQ ID NO: 213956 - RNA, 64 nt, Homo Sapiens; identical to SEQ ID NO: 107638

SEQ ID NO: 213957 - RNA, 64 nt, Homo Sapiens; identical to SEQ ID NO: 107639

SEQ ID NO: 213958 - RNA, 64 nt, Homo Sapiens; identical to SEQ ID NO: 107640

SEQ ID NO: 213959 - RNA, 64 nt, Homo Sapiens; identical to SEQ ID NO: 107641

SEQ ID NO: 213960 - RNA, 64 nt, Homo Sapiens; identical to SEQ ID NO: 107642

SEQ ID NO: 213961 - RNA, 64 nt, Homo Sapiens; identical to SEQ ID NO: 107643

SEQ ID NO: 213962 - RNA, 64 nt, Homo Sapiens; identical to SEQ ID NO: 107644

SEQ ID NO: 213963 - RNA, 64 nt, Homo Sapiens; identical to SEQ ID NO: 107645

SEQ ID NO: 213964 - RNA, 64 nt, Homo Sapiens; identical to SEQ ID NO: 107646

SEQ ID NO: 213965 - RNA, 64 nt, Homo Sapiens; identical to SEQ ID NO: 107647

SEQ ID NO: 213966 - RNA, 64 nt, Homo Sapiens; identical to SEQ ID NO: 107648

SEQ ID NO: 213967 - RNA, 64 nt, Homo Sapiens; identical to SEQ ID NO: 107649

SEQ ID NO: 213968 - RNA, 64 nt, Homo Sapiens; identical to SEQ ID NO: 107650

SEQ ID NO: 213969 - RNA, 64 nt, Homo Sapiens; identical to SEQ ID NO: 107651

SEQ ID NO: 213970 - RNA, 64 nt, Homo Sapiens; identical to SEQ ID NO: 107652

SEQ ID NO: 213971 - RNA, 64 nt, Homo Sapiens; identical to SEQ ID NO: 107653

SEQ ID NO: 213972 - RNA, 64 nt, Homo Sapiens; identical to SEQ ID NO: 107654

SEQ ID NO: 213973 - RNA, 64 nt, Homo Sapiens; identical to SEQ ID NO: 107655

SEQ ID NO: 213974 - RNA, 64 nt, Homo Sapiens; identical to SEQ ID NO: 107656

SEQ ID NO: 213975 - RNA, 64 nt, Homo Sapiens; identical to SEQ ID NO: 107657

SEQ ID NO: 213976 - RNA, 64 nt, Homo Sapiens; identical to SEQ ID NO: 107658

SEQ ID NO: 213977 - RNA, 64 nt, Homo Sapiens; identical to SEQ ID NO: 107659

SEQ ID NO: 213978 - RNA, 64 nt, Homo Sapiens; identical to SEQ ID NO: 107660

SEQ ID NO: 213979 - RNA, 64 nt, Homo Sapiens; identical to SEQ ID NO: 107661

SEQ ID NO: 213980 - RNA, 64 nt, Homo Sapiens; identical to SEQ ID NO: 107662

SEQ ID NO: 213981 - RNA, 64 nt, Homo Sapiens; identical to SEQ ID NO: 107663

SEQ ID NO: 213982 - RNA, 64 nt, Homo Sapiens; identical to SEQ ID NO: 107664

SEQ ID NO: 213983 - RNA, 64 nt, Homo Sapiens; identical to SEQ ID NO: 107665

SEQ ID NO: 213984 - RNA, 64 nt, Homo Sapiens; identical to SEQ ID NO: 107666

SEQ ID NO: 213985 - RNA, 64 nt, Homo Sapiens; identical to SEQ ID NO: 107667

SEQ ID NO: 213986 - RNA, 64 nt, Homo Sapiens; identical to SEQ ID NO: 107668

SEQ ID NO: 213987 - RNA, 64 nt, Homo Sapiens; identical to SEQ ID NO: 107669

SEQ ID NO: 213988 - RNA, 64 nt, Homo Sapiens; identical to SEQ ID NO: 107670

SEQ ID NO: 213989 - RNA, 64 nt, Homo Sapiens; identical to SEQ ID NO: 107671

SEQ ID NO: 213990 - RNA, 64 nt, Homo Sapiens; identical to SEQ ID NO: 107672

SEQ ID NO: 213991 - RNA, 64 nt, Homo Sapiens; identical to SEQ ID NO: 107673

SEQ ID NO: 213992 - RNA, 64 nt, Homo Sapiens; identical to SEQ ID NO: 107674

SEQ ID NO: 213993 - RNA, 64 nt, Homo Sapiens; identical to SEQ ID NO: 107675

SEQ ID NO: 213994 - RNA, 64 nt, Homo Sapiens; identical to SEQ ID NO: 107676

SEQ ID NO: 213995 - RNA, 64 nt, Homo Sapiens; identical to SEQ ID NO: 107677

SEQ ID NO: 213996 - RNA, 64 nt, Homo Sapiens; identical to SEQ ID NO: 107678

SEQ ID NO: 213997 - RNA, 64 nt, Homo Sapiens; identical to SEQ ID NO: 107679

SEQ ID NO: 213998 - RNA, 64 nt, Homo Sapiens; identical to SEQ ID NO: 107680

SEQ ID NO: 213999 - RNA, 64 nt, Homo Sapiens; identical to SEQ ID NO: 107681

SEQ ID NO: 214000 - RNA, 64 nt, Homo Sapiens; identical to SEQ ID NO: 107682

SEQ ID NO: 214001 - RNA, 64 nt, Homo Sapiens; identical to SEQ ID NO: 107683

SEQ ID NO: 214002 - RNA, 64 nt, Homo Sapiens; identical to SEQ ID NO: 107684

SEQ ID NO: 214003 - RNA, 64 nt, Homo Sapiens; identical to SEQ ID NO: 107685

SEQ ID NO: 214004 - RNA, 64 nt, Homo Sapiens; identical to SEQ ID NO: 107686

SEQ ID NO: 214005 - RNA, 64 nt, Homo Sapiens; identical to SEQ ID NO: 107687

SEQ ID NO: 214006 - RNA, 64 nt, Homo Sapiens; identical to SEQ ID NO: 107688

SEQ ID NO: 214007 - RNA, 64 nt, Homo Sapiens; identical to SEQ ID NO: 107689

SEQ ID NO: 214008 - RNA, 64 nt, Homo Sapiens; identical to SEQ ID NO: 107690

SEQ ID NO: 214009 - RNA, 64 nt, Homo Sapiens; identical to SEQ ID NO: 107691

SEQ ID NO: 214010 - RNA, 64 nt, Homo Sapiens; identical to SEQ ID NO: 107692

SEQ ID NO: 214011 - RNA, 64 nt, Homo Sapiens; identical to SEQ ID NO: 107693

SEQ ID NO: 214012 - RNA, 64 nt, Homo Sapiens; identical to SEQ ID NO: 107694

SEQ ID NO: 214013 - RNA, 64 nt, Homo Sapiens; identical to SEQ ID NO: 107695

SEQ ID NO: 214014 - RNA, 64 nt, Homo Sapiens
aggcugcucaucugaccacugggcaccuuagugccaaccugaaccaaagagaccuccuuguuuc

SEQ ID NO: 214015 - RNA, 64 nt, Homo Sapiens
gugggcggaucgccugaggucaggaguucaagaccaaccugacuaacauggugaaaccccaucu

SEQ ID NO: 214016 - RNA, 64 nt, Homo Sapiens
guggcgucuuuagagacaggcccacaggugacaucaaccugaggucuguagguggacccggucu

SEQ ID NO: 214017 - RNA, 64 nt, Homo Sapiens
ccuguuccccaucgcuaccaaccuuccacaugcccaaccugagauuaauccaagguacuggaaa

SEQ ID NO: 214018 - RNA, 64 nt, Homo Sapiens
cgaugcucagacagaagggaaggugggaguacugcaaccugacguuaccacagaccccagcguc

SEQ ID NO: 214019 - RNA, 64 nt, Homo Sapiens
caaugcucagaaacagaaucaggugggaguacugcaaccugacaacacaacugauccgugugug

SEQ ID NO: 214020 - RNA, 64 nt, Homo Sapiens
cgaugcucagacacagaaggagaugggaguacugcaaccugacaacacgauggaucccaaaguc

SEQ ID NO: 214021 - RNA, 64 nt, Homo Sapiens
ggaugcucagacaagaauagaggugggaguacugcaaccugacaauacaacggaucccaaaguc

SEQ ID NO: 214022 - RNA, 64 nt, Homo Sapiens
acaacauuguaugugagagaaauauaaauauuuacaaccugauauucguuguuguuuuauuguu

SEQ ID NO: 214023 - RNA, 64 nt, Homo Sapiens
gaucacaggcuauauucaugaaguuacuuuugaccaaccugaaaacugauaggauuuuguuugu

SEQ ID NO: 214024 - RNA, 64 nt, Homo Sapiens
cccaggaaagcagucuccaucaaaaaugacugugcaaccugaaauucauggcagugcaagauug

SEQ ID NO: 214025 - RNA, 64 nt, Homo Sapiens
aauuucacacugccaacaguaguguaauaacucccaaccugacccagugcuugccaauuucucu

SEQ ID NO: 214026 - RNA, 64 nt, Homo Sapiens; identical to SEQ ID NO: 98311

SEQ ID NO: 214027 - RNA, 64 nt, Homo Sapiens; identical to SEQ ID NO: 98312

SEQ ID NO: 214028 - RNA, 64 nt, Homo Sapiens; identical to SEQ ID NO: 98313

SEQ ID NO: 214029 - RNA, 64 nt, Homo Sapiens; identical to SEQ ID NO: 98314

SEQ ID NO: 214030 - RNA, 64 nt, Homo Sapiens; identical to SEQ ID NO: 98315

SEQ ID NO: 214031 - RNA, 64 nt, Homo Sapiens; identical to SEQ ID NO: 98316

SEQ ID NO: 214032 - RNA, 64 nt, Homo Sapiens; identical to SEQ ID NO: 98317

SEQ ID NO: 214033 - RNA, 64 nt, Homo Sapiens; identical to SEQ ID NO: 98318

SEQ ID NO: 214034 - RNA, 64 nt, Homo Sapiens; identical to SEQ ID NO: 98319

SEQ ID NO: 214035 - RNA, 64 nt, Homo Sapiens; identical to SEQ ID NO: 98320

SEQ ID NO: 214036 - RNA, 64 nt, Homo Sapiens; identical to SEQ ID NO: 98321

SEQ ID NO: 214037 - RNA, 64 nt, Homo Sapiens; identical to SEQ ID NO: 98322

SEQ ID NO: 214038 - RNA, 64 nt, Homo Sapiens; identical to SEQ ID NO: 98323

SEQ ID NO: 214039 - RNA, 64 nt, Homo Sapiens; identical to SEQ ID NO: 98324

SEQ ID NO: 214040 - RNA, 64 nt, Homo Sapiens; identical to SEQ ID NO: 98325

SEQ ID NO: 214041 - RNA, 64 nt, Homo Sapiens; identical to SEQ ID NO: 98326

SEQ ID NO: 214042 - RNA, 64 nt, Homo Sapiens; identical to SEQ ID NO: 98327

SEQ ID NO: 214043 - RNA, 64 nt, Homo Sapiens; identical to SEQ ID NO: 98328

SEQ ID NO: 214044 - RNA, 64 nt, Homo Sapiens; identical to SEQ ID NO: 98329

SEQ ID NO: 214045 - RNA, 64 nt, Homo Sapiens; identical to SEQ ID NO: 98330

SEQ ID NO: 214046 - RNA, 64 nt, Homo Sapiens; identical to SEQ ID NO: 98331

SEQ ID NO: 214047 - RNA, 64 nt, Homo Sapiens; identical to SEQ ID NO: 98332

SEQ ID NO: 214048 - RNA, 64 nt, Homo Sapiens; identical to SEQ ID NO: 98333

SEQ ID NO: 214049 - RNA, 64 nt, Homo Sapiens; identical to SEQ ID NO: 98334

SEQ ID NO: 214050 - RNA, 64 nt, Homo Sapiens; identical to SEQ ID NO: 98335

SEQ ID NO: 214051 - RNA, 64 nt, Homo Sapiens; identical to SEQ ID NO: 98336

SEQ ID NO: 214052 - RNA, 64 nt, Homo Sapiens; identical to SEQ ID NO: 98337

SEQ ID NO: 214053 - RNA, 64 nt, Homo Sapiens; identical to SEQ ID NO: 98338

SEQ ID NO: 214054 - RNA, 64 nt, Homo Sapiens; identical to SEQ ID NO: 98339

SEQ ID NO: 214055 - RNA, 64 nt, Homo Sapiens; identical to SEQ ID NO: 98340

SEQ ID NO: 214056 - RNA, 64 nt, Homo Sapiens; identical to SEQ ID NO: 98341

SEQ ID NO: 214057 - RNA, 64 nt, Homo Sapiens; identical to SEQ ID NO: 98342

SEQ ID NO: 214058 - RNA, 64 nt, Homo Sapiens; identical to SEQ ID NO: 98343

SEQ ID NO: 214059 - RNA, 64 nt, Homo Sapiens; identical to SEQ ID NO: 98344

SEQ ID NO: 214060 - RNA, 64 nt, Homo Sapiens; identical to SEQ ID NO: 98345

SEQ ID NO: 214061 - RNA, 64 nt, Homo Sapiens; identical to SEQ ID NO: 98346

SEQ ID NO: 214062 - RNA, 64 nt, Homo Sapiens; identical to SEQ ID NO: 98347

SEQ ID NO: 214063 - RNA, 64 nt, Homo Sapiens; identical to SEQ ID NO: 98348

SEQ ID NO: 214064 - RNA, 64 nt, Homo Sapiens; identical to SEQ ID NO: 98349

SEQ ID NO: 214065 - RNA, 64 nt, Homo Sapiens; identical to SEQ ID NO: 98350

SEQ ID NO: 214066 - RNA, 64 nt, Homo Sapiens; identical to SEQ ID NO: 98351

SEQ ID NO: 214067 - RNA, 64 nt, Homo Sapiens; identical to SEQ ID NO: 98352

SEQ ID NO: 214068 - RNA, 64 nt, Homo Sapiens; identical to SEQ ID NO: 98353

SEQ ID NO: 214069 - RNA, 64 nt, Homo Sapiens; identical to SEQ ID NO: 98354

SEQ ID NO: 214070 - RNA, 64 nt, Homo Sapiens; identical to SEQ ID NO: 98355

SEQ ID NO: 214071 - RNA, 64 nt, Homo Sapiens; identical to SEQ ID NO: 98356

SEQ ID NO: 214072 - RNA, 64 nt, Homo Sapiens; identical to SEQ ID NO: 98357

SEQ ID NO: 214073 - RNA, 64 nt, Homo Sapiens; identical to SEQ ID NO: 98358

SEQ ID NO: 214074 - RNA, 64 nt, Homo Sapiens; identical to SEQ ID NO: 98359

SEQ ID NO: 214075 - RNA, 64 nt, Homo Sapiens; identical to SEQ ID NO: 98360

SEQ ID NO: 214076 - RNA, 64 nt, Homo Sapiens; identical to SEQ ID NO: 98361

SEQ ID NO: 214077 - RNA, 64 nt, Homo Sapiens; identical to SEQ ID NO: 98362

SEQ ID NO: 214078 - RNA, 64 nt, Homo Sapiens; identical to SEQ ID NO: 98363

SEQ ID NO: 214079 - RNA, 64 nt, Homo Sapiens; identical to SEQ ID NO: 98364

SEQ ID NO: 214080 - RNA, 64 nt, Homo Sapiens; identical to SEQ ID NO: 98365

SEQ ID NO: 214081 - RNA, 64 nt, Homo Sapiens; identical to SEQ ID NO: 98366

SEQ ID NO: 214082 - RNA, 64 nt, Homo Sapiens; identical to SEQ ID NO: 98367

SEQ ID NO: 214083 - RNA, 64 nt, Homo Sapiens; identical to SEQ ID NO: 98368

SEQ ID NO: 214084 - RNA, 64 nt, Homo Sapiens; identical to SEQ ID NO: 98369

SEQ ID NO: 214085 - RNA, 64 nt, Homo Sapiens; identical to SEQ ID NO: 98370

SEQ ID NO: 214086 - RNA, 64 nt, Homo Sapiens; identical to SEQ ID NO: 98371

SEQ ID NO: 214087 - RNA, 64 nt, Homo Sapiens; identical to SEQ ID NO: 98372

SEQ ID NO: 214088 - RNA, 64 nt, Homo Sapiens; identical to SEQ ID NO: 98373

SEQ ID NO: 214089 - RNA, 64 nt, Homo Sapiens; identical to SEQ ID NO: 98374

SEQ ID NO: 214090 - RNA, 64 nt, Homo Sapiens; identical to SEQ ID NO: 98375

SEQ ID NO: 214091 - RNA, 64 nt, Homo Sapiens; identical to SEQ ID NO: 98376

SEQ ID NO: 214092 - RNA, 64 nt, Homo Sapiens; identical to SEQ ID NO: 98377

SEQ ID NO: 214093 - RNA, 64 nt, Homo Sapiens; identical to SEQ ID NO: 98378

SEQ ID NO: 214094 - RNA, 64 nt, Homo Sapiens; identical to SEQ ID NO: 98379

SEQ ID NO: 214095 - RNA, 64 nt, Homo Sapiens; identical to SEQ ID NO: 98380

SEQ ID NO: 214096 - RNA, 64 nt, Homo Sapiens; identical to SEQ ID NO: 98381

SEQ ID NO: 214097 - RNA, 64 nt, Homo Sapiens; identical to SEQ ID NO: 98382

SEQ ID NO: 214098 - RNA, 64 nt, Homo Sapiens; identical to SEQ ID NO: 98383

SEQ ID NO: 214099 - RNA, 64 nt, Homo Sapiens; identical to SEQ ID NO: 98384

SEQ ID NO: 214100 - RNA, 64 nt, Homo Sapiens; identical to SEQ ID NO: 98385

SEQ ID NO: 214101 - RNA, 64 nt, Homo Sapiens; identical to SEQ ID NO: 98386

SEQ ID NO: 214102 - RNA, 64 nt, Homo Sapiens; identical to SEQ ID NO: 98387

SEQ ID NO: 214103 - RNA, 64 nt, Homo Sapiens; identical to SEQ ID NO: 98388

SEQ ID NO: 214104 - RNA, 64 nt, Homo Sapiens; identical to SEQ ID NO: 98389

SEQ ID NO: 214105 - RNA, 64 nt, Homo Sapiens; identical to SEQ ID NO: 98390

SEQ ID NO: 214106 - RNA, 64 nt, Homo Sapiens; identical to SEQ ID NO: 98391

SEQ ID NO: 214107 - RNA, 64 nt, Homo Sapiens; identical to SEQ ID NO: 98392

SEQ ID NO: 214108 - RNA, 64 nt, Homo Sapiens; identical to SEQ ID NO: 98393

SEQ ID NO: 214109 - RNA, 64 nt, Homo Sapiens; identical to SEQ ID NO: 98394

SEQ ID NO: 214110 - RNA, 64 nt, Homo Sapiens; identical to SEQ ID NO: 98395

SEQ ID NO: 214111 - RNA, 64 nt, Homo Sapiens; identical to SEQ ID NO: 98396

SEQ ID NO: 214112 - RNA, 64 nt, Homo Sapiens; identical to SEQ ID NO: 98397

SEQ ID NO: 214113 - RNA, 64 nt, Homo Sapiens; identical to SEQ ID NO: 98398

SEQ ID NO: 214114 - RNA, 64 nt, Homo Sapiens; identical to SEQ ID NO: 98399

SEQ ID NO: 214115 - RNA, 64 nt, Homo Sapiens; identical to SEQ ID NO: 98400

SEQ ID NO: 214116 - RNA, 64 nt, Homo Sapiens; identical to SEQ ID NO: 98401

SEQ ID NO: 214117 - RNA, 64 nt, Homo Sapiens; identical to SEQ ID NO: 98402

SEQ ID NO: 214118 - RNA, 64 nt, Homo Sapiens; identical to SEQ ID NO: 98403

SEQ ID NO: 214119 - RNA, 64 nt, Homo Sapiens; identical to SEQ ID NO: 98404

SEQ ID NO: 214120 - RNA, 64 nt, Homo Sapiens; identical to SEQ ID NO: 98405

SEQ ID NO: 214121 - RNA, 64 nt, Homo Sapiens; identical to SEQ ID NO: 98406

SEQ ID NO: 214122 - RNA, 64 nt, Homo Sapiens; identical to SEQ ID NO: 98407

SEQ ID NO: 214123 - RNA, 64 nt, Homo Sapiens; identical to SEQ ID NO: 98408

SEQ ID NO: 214124 - RNA, 64 nt, Homo Sapiens; identical to SEQ ID NO: 98409

SEQ ID NO: 214125 - RNA, 64 nt, Homo Sapiens; identical to SEQ ID NO: 98410

SEQ ID NO: 214126 - RNA, 64 nt, Homo Sapiens; identical to SEQ ID NO: 98411

SEQ ID NO: 214127 - RNA, 64 nt, Homo Sapiens; identical to SEQ ID NO: 98412

SEQ ID NO: 214128 - RNA, 64 nt, Homo Sapiens; identical to SEQ ID NO: 98413

SEQ ID NO: 214129 - RNA, 64 nt, Homo Sapiens; identical to SEQ ID NO: 98414

SEQ ID NO: 214130 - RNA, 64 nt, Homo Sapiens; identical to SEQ ID NO: 98415

SEQ ID NO: 214131 - RNA, 64 nt, Homo Sapiens; identical to SEQ ID NO: 98416

SEQ ID NO: 214132 - RNA, 64 nt, Homo Sapiens; identical to SEQ ID NO: 98417

SEQ ID NO: 214133 - RNA, 64 nt, Homo Sapiens; identical to SEQ ID NO: 98418

SEQ ID NO: 214134 - RNA, 64 nt, Homo Sapiens; identical to SEQ ID NO: 98419

SEQ ID NO: 214135 - RNA, 64 nt, Homo Sapiens; identical to SEQ ID NO: 98420

SEQ ID NO: 214136 - RNA, 64 nt, Homo Sapiens; identical to SEQ ID NO: 98421

SEQ ID NO: 214137 - RNA, 64 nt, Homo Sapiens; identical to SEQ ID NO: 98422

SEQ ID NO: 214138 - RNA, 64 nt, Homo Sapiens; identical to SEQ ID NO: 98423

SEQ ID NO: 214139 - RNA, 64 nt, Homo Sapiens; identical to SEQ ID NO: 98424

SEQ ID NO: 214140 - RNA, 64 nt, Homo Sapiens; identical to SEQ ID NO: 98425

SEQ ID NO: 214141 - RNA, 64 nt, Homo Sapiens; identical to SEQ ID NO: 98426

SEQ ID NO: 214142 - RNA, 64 nt, Homo Sapiens; identical to SEQ ID NO: 98427

SEQ ID NO: 214143 - RNA, 64 nt, Homo Sapiens; identical to SEQ ID NO: 98428

SEQ ID NO: 214144 - RNA, 64 nt, Homo Sapiens; identical to SEQ ID NO: 98429

SEQ ID NO: 214145 - RNA, 64 nt, Homo Sapiens; identical to SEQ ID NO: 98430

SEQ ID NO: 214146 - RNA, 64 nt, Homo Sapiens; identical to SEQ ID NO: 98431

SEQ ID NO: 214147 - RNA, 64 nt, Homo Sapiens; identical to SEQ ID NO: 98432

SEQ ID NO: 214148 - RNA, 64 nt, Homo Sapiens; identical to SEQ ID NO: 98433

SEQ ID NO: 214149 - RNA, 64 nt, Homo Sapiens; identical to SEQ ID NO: 98434

SEQ ID NO: 214150 - RNA, 64 nt, Homo Sapiens; identical to SEQ ID NO: 98435

SEQ ID NO: 214151 - RNA, 64 nt, Homo Sapiens; identical to SEQ ID NO: 98436

SEQ ID NO: 214152 - RNA, 64 nt, Homo Sapiens; identical to SEQ ID NO: 98437

SEQ ID NO: 214153 - RNA, 64 nt, Homo Sapiens; identical to SEQ ID NO: 98438

SEQ ID NO: 214154 - RNA, 64 nt, Homo Sapiens; identical to SEQ ID NO: 98439

SEQ ID NO: 214155 - RNA, 64 nt, Homo Sapiens; identical to SEQ ID NO: 98440

SEQ ID NO: 214156 - RNA, 64 nt, Homo Sapiens; identical to SEQ ID NO: 98441

SEQ ID NO: 214157 - RNA, 64 nt, Homo Sapiens; identical to SEQ ID NO: 98442

SEQ ID NO: 214158 - RNA, 64 nt, Homo Sapiens; identical to SEQ ID NO: 98443

SEQ ID NO: 214159 - RNA, 64 nt, Homo Sapiens; identical to SEQ ID NO: 98444

SEQ ID NO: 214160 - RNA, 64 nt, Homo Sapiens; identical to SEQ ID NO: 98445

SEQ ID NO: 214161 - RNA, 64 nt, Homo Sapiens; identical to SEQ ID NO: 98446

SEQ ID NO: 214162 - RNA, 64 nt, Homo Sapiens; identical to SEQ ID NO: 98447

SEQ ID NO: 214163 - RNA, 64 nt, Homo Sapiens; identical to SEQ ID NO: 98448

SEQ ID NO: 214164 - RNA, 64 nt, Homo Sapiens; identical to SEQ ID NO: 98449

SEQ ID NO: 214165 - RNA, 64 nt, Homo Sapiens; identical to SEQ ID NO: 98450

SEQ ID NO: 214166 - RNA, 64 nt, Homo Sapiens; identical to SEQ ID NO: 98451

SEQ ID NO: 214167 - RNA, 64 nt, Homo Sapiens; identical to SEQ ID NO: 98452

SEQ ID NO: 214168 - RNA, 64 nt, Homo Sapiens; identical to SEQ ID NO: 98453

SEQ ID NO: 214169 - RNA, 64 nt, Homo Sapiens; identical to SEQ ID NO: 98454

SEQ ID NO: 214170 - RNA, 64 nt, Homo Sapiens; identical to SEQ ID NO: 98455

SEQ ID NO: 214171 - RNA, 64 nt, Homo Sapiens; identical to SEQ ID NO: 98456

SEQ ID NO: 214172 - RNA, 64 nt, Homo Sapiens; identical to SEQ ID NO: 98457

SEQ ID NO: 214173 - RNA, 64 nt, Homo Sapiens; identical to SEQ ID NO: 98458

SEQ ID NO: 214174 - RNA, 64 nt, Homo Sapiens; identical to SEQ ID NO: 98459

SEQ ID NO: 214175 - RNA, 64 nt, Homo Sapiens; identical to SEQ ID NO: 98460

SEQ ID NO: 214176 - RNA, 64 nt, Homo Sapiens; identical to SEQ ID NO: 98461

SEQ ID NO: 214177 - RNA, 64 nt, Homo Sapiens; identical to SEQ ID NO: 98462

SEQ ID NO: 214178 - RNA, 64 nt, Homo Sapiens; identical to SEQ ID NO: 98463

SEQ ID NO: 214179 - RNA, 64 nt, Homo Sapiens; identical to SEQ ID NO: 98464

SEQ ID NO: 214180 - RNA, 64 nt, Homo Sapiens; identical to SEQ ID NO: 98465

SEQ ID NO: 214181 - RNA, 64 nt, Homo Sapiens; identical to SEQ ID NO: 98466

SEQ ID NO: 214182 - RNA, 64 nt, Homo Sapiens; identical to SEQ ID NO: 98467

SEQ ID NO: 214183 - RNA, 64 nt, Homo Sapiens; identical to SEQ ID NO: 98468

SEQ ID NO: 214184 - RNA, 64 nt, Homo Sapiens; identical to SEQ ID NO: 98469

SEQ ID NO: 214185 - RNA, 64 nt, Homo Sapiens; identical to SEQ ID NO: 98470

SEQ ID NO: 214186 - RNA, 64 nt, Homo Sapiens; identical to SEQ ID NO: 98471

SEQ ID NO: 214187 - RNA, 64 nt, Homo Sapiens; identical to SEQ ID NO: 98472

SEQ ID NO: 214188 - RNA, 64 nt, Homo Sapiens; identical to SEQ ID NO: 98473

SEQ ID NO: 214189 - RNA, 64 nt, Homo Sapiens; identical to SEQ ID NO: 98474

SEQ ID NO: 214190 - RNA, 64 nt, Homo Sapiens; identical to SEQ ID NO: 98475

SEQ ID NO: 214191 - RNA, 64 nt, Homo Sapiens; identical to SEQ ID NO: 98476

SEQ ID NO: 214192 - RNA, 64 nt, Homo Sapiens; identical to SEQ ID NO: 98477

SEQ ID NO: 214193 - RNA, 64 nt, Homo Sapiens; identical to SEQ ID NO: 98478

SEQ ID NO: 214194 - RNA, 64 nt, Homo Sapiens; identical to SEQ ID NO: 98479

SEQ ID NO: 214195 - RNA, 64 nt, Homo Sapiens; identical to SEQ ID NO: 98480

SEQ ID NO: 214196 - RNA, 64 nt, Homo Sapiens; identical to SEQ ID NO: 98481

SEQ ID NO: 214197 - RNA, 64 nt, Homo Sapiens; identical to SEQ ID NO: 98482

SEQ ID NO: 214198 - RNA, 64 nt, Homo Sapiens; identical to SEQ ID NO: 98483

SEQ ID NO: 214199 - RNA, 64 nt, Homo Sapiens; identical to SEQ ID NO: 98484

SEQ ID NO: 214200 - RNA, 64 nt, Homo Sapiens; identical to SEQ ID NO: 98485

SEQ ID NO: 214201 - RNA, 64 nt, Homo Sapiens; identical to SEQ ID NO: 98486

SEQ ID NO: 214202 - RNA, 64 nt, Homo Sapiens; identical to SEQ ID NO: 98487

SEQ ID NO: 214203 - RNA, 64 nt, Homo Sapiens; identical to SEQ ID NO: 98488

SEQ ID NO: 214204 - RNA, 64 nt, Homo Sapiens; identical to SEQ ID NO: 98489

SEQ ID NO: 214205 - RNA, 64 nt, Homo Sapiens; identical to SEQ ID NO: 98490

SEQ ID NO: 214206 - RNA, 64 nt, Homo Sapiens; identical to SEQ ID NO: 98491

SEQ ID NO: 214207 - RNA, 64 nt, Homo Sapiens; identical to SEQ ID NO: 98492

SEQ ID NO: 214208 - RNA, 64 nt, Homo Sapiens; identical to SEQ ID NO: 98493

SEQ ID NO: 214209 - RNA, 64 nt, Homo Sapiens; identical to SEQ ID NO: 98494

SEQ ID NO: 214210 - RNA, 64 nt, Homo Sapiens; identical to SEQ ID NO: 98495

SEQ ID NO: 214211 - RNA, 64 nt, Homo Sapiens; identical to SEQ ID NO: 98496

SEQ ID NO: 214212 - RNA, 64 nt, Homo Sapiens; identical to SEQ ID NO: 98497

SEQ ID NO: 214213 - RNA, 64 nt, Homo Sapiens; identical to SEQ ID NO: 98498

SEQ ID NO: 214214 - RNA, 64 nt, Homo Sapiens; identical to SEQ ID NO: 98499

SEQ ID NO: 214215 - RNA, 64 nt, Homo Sapiens; identical to SEQ ID NO: 98500

SEQ ID NO: 214216 - RNA, 64 nt, Homo Sapiens; identical to SEQ ID NO: 98501

SEQ ID NO: 214217 - RNA, 64 nt, Homo Sapiens; identical to SEQ ID NO: 98502

SEQ ID NO: 214218 - RNA, 64 nt, Homo Sapiens; identical to SEQ ID NO: 98503

SEQ ID NO: 214219 - RNA, 64 nt, Homo Sapiens; identical to SEQ ID NO: 98504

SEQ ID NO: 214220 - RNA, 63 nt, Homo Sapiens
uauccccagcccuuggcaacacuggagugcacacgccgccacgguugcccagaaaaagugccc

SEQ ID NO: 214221 - RNA, 63 nt, Homo Sapiens
ggaaggugcagcuuuuccauaucagcucaaccacgccgccaguccauucuuaaggaacugccg

SEQ ID NO: 214222 - RNA, 63 nt, Homo Sapiens
aggcauugccaagccccccgagugaggacgcaccgccgccaccagcccgcaacucuccagccg

SEQ ID NO: 214223 - RNA, 63 nt, Homo Sapiens
agcccaggcagcaccagcgcggccacgugcacgcgccgccacuacgagagguacggcggggcg

SEQ ID NO: 214224 - RNA, 63 nt, Homo Sapiens
ucagccugccgagugccugcgauuacaggcgcgcgccgccacaccugacugguuuucguauuu

SEQ ID NO: 214225 - RNA, 54 nt, Homo Sapiens
ccaaacugacgcaucuguagcggccgccgccagcccgaacucgcggcaaaauua

SEQ ID NO: 214226 - RNA, 63 nt, Homo Sapiens
cugcccaggccuuuguuaggaaaacccaugggccgccgccacacucagugccauggggaagcg

SEQ ID NO: 214227 - RNA, 59 nt, Homo Sapiens
ccugggcucuggggcccuggagacaaagccgccgccaauagauacagguggacgauuga

SEQ ID NO: 214228 - RNA, 63 nt, Homo Sapiens
cugguccucucgcaggaaugcugcugcugccuccgccgccacugcugcugccaccucuuauau

SEQ ID NO: 214229 - RNA, 63 nt, Homo Sapiens
gugccccccgucccuccaccacguuccuucccccgccgccacugcaggcucaccugggacuca

SEQ ID NO: 214230 - RNA, 63 nt, Homo Sapiens
cugaccucacacccucugggcagccgacgacgccgccgccagccgcgacgccggccccggucg

SEQ ID NO: 214231 - RNA, 63 nt, Homo Sapiens
cacuccggagcuguccgcuugccgugccgccgccgccgccaggccgcgggcgggggcugcagg

SEQ ID NO: 214232 - RNA, 63 nt, Homo Sapiens
gcuucauucgagagcugcugccaaaacgccuggcgccgccaccgucgggggcuggcuucgagg

SEQ ID NO: 214233 - RNA, 63 nt, Homo Sapiens
gcugccccggguggugagcgggcaggaaccuggcgccgccaccgagacugagccuccugcaga

SEQ ID NO: 214234 - RNA, 59 nt, Homo Sapiens
augcacuguacauuccacaaugaggcgugcgccgccaauagcaagcaggcgaaucguaa

SEQ ID NO: 214235 - RNA, 63 nt, Homo Sapiens
ucagccucccaaguagcugugacuaaaggugcacgccgccaugcccagcuaauuuuuuguauu

SEQ ID NO: 214236 - RNA, 63 nt, Homo Sapiens
ugcuggacgugucccggagacccaccgggagggcgccgccaugccuuguacccccaccgugca

SEQ ID NO: 214237 - RNA, 63 nt, Homo Sapiens
cuaacaugagcacaggugcuagcaguaguggggcgccgccaaucauuaaucccaggaaccacu

SEQ ID NO: 214238 - RNA, 63 nt, Homo Sapiens
gccuugguuacucagagcacgccucugucaccccgccgccacugcccagugacagaaagaaca

SEQ ID NO: 214239 - RNA, 63 nt, Homo Sapiens
cuguuuucuggaaaggcugcaguucuggagaggcgccgccauccaggaguagggaggaaaagg

SEQ ID NO: 214240 - RNA, 63 nt, Homo Sapiens
cccagcucauuuuuguauuauauacaggcacaucgccgccacaucagccugcugaguagcugg

SEQ ID NO: 214241 - RNA, 63 nt, Homo Sapiens
gggaacucuccccauuggcaaaccggacccggccgccgccaggacuguguuuccaaagguucc

SEQ ID NO: 214242 - RNA, 63 nt, Homo Sapiens
acccuuguauuuuaucacgucuuugagggaucccgccgccaccaccccgugccucucgugguc

SEQ ID NO: 214243 - RNA, 63 nt, Homo Sapiens
gcaagugcuggagucuccugaggacacgcgcgucgccgccaccgcgggugugggaaagcgcgg

SEQ ID NO: 214244 - RNA, 63 nt, Homo Sapiens
caggcucaggcggccccacucacccacagcauccgccgccaccccuucgggugugagcgcuca

SEQ ID NO: 214245 - RNA, 63 nt, Homo Sapiens
ggagugcccuguauggaagucuccagugcagcccgccgccacuuuuuacaaaggggaaugguu

SEQ ID NO: 214246 - RNA, 63 nt, Homo Sapiens
gccgcuccagaagggugcccagucaggccgcaccgccgccagccuccuccggcccuggaggga

SEQ ID NO: 214247 - RNA, 63 nt, Homo Sapiens
cgaggcugaggacuccgaucagcgacccgccgccgccgccaagcuuucacugcggucccgcuu

SEQ ID NO: 214248 - RNA, 63 nt, Homo Sapiens
agccgcggguugacgacgguguccucgcagugucgccgccaccccagcguaguccaagucaga

SEQ ID NO: 214249 - RNA, 63 nt, Homo Sapiens
cccaagagaaagacugaaggccgccgccgccgccgccgccaugccacacccggugcccacauc

SEQ ID NO: 214250 - RNA, 63 nt, Homo Sapiens
gcccgcagacacccuggcaugcccuucccgcaccgccgccagcuggcccaguccugggccucg

SEQ ID NO: 214251 - RNA, 63 nt, Homo Sapiens
gauaggguuuuuggagggcucccacagacucagcgccgccagagguggugcugggggaggcac

SEQ ID NO: 214252 - RNA, 63 nt, Homo Sapiens
gaaguauguagggugggcagaagccacagucgccgccgccaggggcuugcuccuggcucuguc

SEQ ID NO: 214253 - RNA, 63 nt, Homo Sapiens
gcauaccugcugguguguaaguguggacuaacccgccgccaccacccucuguuccagcaggcu

SEQ ID NO: 214254 - RNA, 63 nt, Homo Sapiens
gcucucacucagcucccacgggacucagaagugcgccgccaugcugccuaggguacugucccc

SEQ ID NO: 214255 - RNA, 63 nt, Homo Sapiens
acucgcucgcccucccgcuuccacagccacagccgccgccaucgcacgccgcccuccgccacg

SEQ ID NO: 214256 - RNA, 63 nt, Homo Sapiens
cugccccuaaguuauuaccugguuagccugcaccgccgccaccaggcugcuggcuucagggag

SEQ ID NO: 214257 - RNA, 63 nt, Homo Sapiens
ucagccugccgagugccugcaauugcaggcgagcgccgccacgccugacugccucggccuccc

SEQ ID NO: 214258 - RNA, 63 nt, Homo Sapiens
gcaccccguacauacacacaggaauuugaggaccgccgccaggguucugucugccaccugaag

SEQ ID NO: 214259 - RNA, 63 nt, Homo Sapiens
gucugcagaaugugagaugaucgagcacugccccgccgccaaaccagcccacccagccagugg

SEQ ID NO: 214260 - RNA, 63 nt, Homo Sapiens
gggaggaagccugacuguccccugcccagcccacgccgccaccgccuccuccgggaagccuuc

SEQ ID NO: 214261 - RNA, 55 nt, Homo Sapiens
gcgcccuggcccuggccugagcccacgccgccaggaggcagggagggcuccgccg

SEQ ID NO: 214262 - RNA, 60 nt, Homo Sapiens
aggccacaagaggaagcugaaugaagaggacgccgccagcgaguccagcagggaguccag

SEQ ID NO: 214263 - RNA, 63 nt, Homo Sapiens
caucuguccccuccucccccgcagcccggccgccgccgccaaggacccggcucugagcgcccc

SEQ ID NO: 214264 - RNA, 63 nt, Homo Sapiens
gcacccacccagcugggguguuuuugggggagucgccgccaagcccaggcugcuggagccagg

SEQ ID NO: 214265 - RNA, 57 nt, Homo Sapiens
ugccugugcccgucauguaaucucacccgccgccacuagguguccccaacguccccu

SEQ ID NO: 214266 - RNA, 63 nt, Homo Sapiens
cugaagugccagcaccaccagcaccagauccuccgccgccacaccgcacugaggacacgccgg

SEQ ID NO: 214267 - RNA, 63 nt, Homo Sapiens
ucagccuccugaguagcugggauuacaggugugcgccgccacacccagcuaauuuuguauuuu

SEQ ID NO: 214268 - RNA, 63 nt, Homo Sapiens
gggccccgggacccccacggaugcugcuucaggcgccgccacuagcagguccgcauccaggag

SEQ ID NO: 214269 - RNA, 63 nt, Homo Sapiens
ccugcagcgggccggccagacuggcggggucuccgccgccagccgcggcacccggagccacag

SEQ ID NO: 214270 - RNA, 63 nt, Homo Sapiens
ccccagacuauggucacagggcuucugcguccccgccgccaggagaaucuggcucucagggug

SEQ ID NO: 214271 - RNA, 63 nt, Homo Sapiens
ucccccagacccccuccaccuccgcggcggggccgccgccagcucaacaucugguaccagcac

SEQ ID NO: 214272 - RNA, 63 nt, Homo Sapiens
uccccugggaccccgcccccgcuccucuagggccgccgccaccccuccacccccuccaacucu

SEQ ID NO: 214273 - RNA, 63 nt, Homo Sapiens
acagagaagggacggggugggcggcuagggccucgccgccagggccuugguccccagaagaug

SEQ ID NO: 214274 - RNA, 63 nt, Homo Sapiens
uccugacucucgggugaucuuuccagggccccucgccgccacgcagcuuugguaucuggagau

SEQ ID NO: 214275 - RNA, 63 nt, Homo Sapiens
ggagcccugucccuguugcuguggccccucucacgccgccaucucucugccccgccccgcccc

SEQ ID NO: 214276 - RNA, 63 nt, Homo Sapiens
uuucugcucagugugauccugagauggcuuccccgccgccacccagagugugguccuuggccg

SEQ ID NO: 214277 - RNA, 63 nt, Homo Sapiens
cugcccacagagggccgagggucacccgucggccgccgccaccccaggcgaggccggaggaag

SEQ ID NO: 214278 - RNA, 63 nt, Homo Sapiens
cguugcagcccagagccacuggucccuacagggcgccgccacaccagcaggaaggaggauggc

SEQ ID NO: 214279 - RNA, 63 nt, Homo Sapiens
caauccggagaaggggcucuguccacagucccccgccgccagguggcccacaugggaccagca

SEQ ID NO: 214280 - RNA, 63 nt, Homo Sapiens
gcugcccagggcuggaggggacgcuguuccucccgccgccacugcccaaccuuuccugauaau

SEQ ID NO: 214281 - RNA, 63 nt, Homo Sapiens
ggccagcacggaccacccaaggccucugcuucccgccgccacccuccucgcugccauucucug

SEQ ID NO: 214282 - RNA, 63 nt, Homo Sapiens
uccucggaggccagacccagcacacggugcgcccgccgccagcgccaucccugcaggccaggg

SEQ ID NO: 214283 - RNA, 63 nt, Homo Sapiens
ccagccgggcggccgacccggggucucucuccacgccgccaaggccagguguguguacauacg

SEQ ID NO: 214284 - RNA, 59 nt, Homo Sapiens
agcaagcaggcgaaucguaaugaggcgugcgccgccaauaugcacuguacauuccacaa

SEQ ID NO: 214285 - RNA, 63 nt, Homo Sapiens
ggaguacaagagccagaggcccgcccccacccccgccgccagacucaccagaggaugccaccu

SEQ ID NO: 214286 - RNA, 63 nt, Homo Sapiens
cccuccccgcagcccucaccggagggcccugcacgccgccacccgacccucgggccucggggg

SEQ ID NO: 214287 - RNA, 64 nt, Homo Sapiens
ucucccuaacaccaaagcuucaagagccaagauuuuaaccuagagugcgagcuacugcucccag

SEQ ID NO: 214288 - RNA, 64 nt, Homo Sapiens
gaaaaagccuuggaagagaaaaaaaaacauuuuguuaaccuaugauuuuuguuagccuaugaaa

SEQ ID NO: 214289 - RNA, 64 nt, Homo Sapiens
uuuaacuugagccccagucucuuauccuaaacccuuaaccuaaauucugggcuaucuuagcuaa

SEQ ID NO: 214290 - RNA, 64 nt, Homo Sapiens
uaauuagaaucccauuagagauaugaggaaaaguuuaaccuaaaggauuccaugugaaaauaaa

SEQ ID NO: 214291 - RNA, 64 nt, Homo Sapiens
uaaauggagcacuuagaaauuuguuguucugcacuuaaccuagagagagaaaaaaugcuuuucu

SEQ ID NO: 214292 - RNA, 64 nt, Homo Sapiens
uuucugccaaaacaauaaucaaagaacucuugcuuuaaccuauuccuguacaaagacuguuuuu

SEQ ID NO: 214293 - RNA, 64 nt, Homo Sapiens
uguauguucggagaguguuuaaaaaaucuaaauuuuaaccuacuaauuuaccuuuuaauaaauu

SEQ ID NO: 214294 - RNA, 64 nt, Homo Sapiens
cuauuguauuauaaugaugauguuuaauauuaacuuaaccuauuuaguugaauucaucuacguu

SEQ ID NO: 214295 - RNA, 64 nt, Homo Sapiens
augcacuguacacauuuccucaauaaagaaaaauuuaaccuaucaaaggaccugcguuggacaa

SEQ ID NO: 214296 - RNA, 64 nt, Homo Sapiens
gaguuaccuggucagcacugaugguuaccuugacuuaaccuauuccuaauccuauuaucuuuca

SEQ ID NO: 214297 - RNA, 64 nt, Homo Sapiens
gauuacaucacugauugguaaugguuagaaaccauuaaccuaaaacuuacuauuuaaccuagug

SEQ ID NO: 214298 - RNA, 64 nt, Homo Sapiens
aaugguuagaaaccauuaaccuaaaacuuacuauuuaaccuaguguuuuuguugaugagguuua

SEQ ID NO: 214299 - RNA, 64 nt, Homo Sapiens
auugccccugaucuuuuccauuuuuguuuccaccuuaaccuauagcagcuccuccaaaugagga

SEQ ID NO: 214300 - RNA, 64 nt, Homo Sapiens
acaagauguuacuauuauaucuaauaggaauucauuaaccuaaacugucccaaagugcugcuuc

SEQ ID NO: 214301 - RNA, 64 nt, Homo Sapiens
auucagaugauccuggaauucuaauaaucauuccuuaaccuagaguaguuguuuccagguuugg

SEQ ID NO: 214302 - RNA, 64 nt, Homo Sapiens
cuagcagcuacuaaaauagagaagaaauugagggcaaaguaauaugucuccaaaacugaacuga

SEQ ID NO: 214303 - RNA, 64 nt, Homo Sapiens
ucugaugccuacccuagguugggaaccacucuuucaaaguaaacagugaugacacagcauuugc

SEQ ID NO: 214304 - RNA, 60 nt, Homo Sapiens
acauggauaauagugaaugaaagcagaaagcaaaguaauaaaaucacaaauguuuggaaa

SEQ ID NO: 214305 - RNA, 64 nt, Homo Sapiens
cugagaauuuuuaguacuaaagagcacagcugcucaaaguaaagccugagcaguguucucagua

SEQ ID NO: 214306 - RNA, 64 nt, Homo Sapiens
gugacuggcauuaacaagacuggaaaucgggggucaaaguaaaauaucuuuguuuugcuuucau

SEQ ID NO: 214307 - RNA, 64 nt, Homo Sapiens
ucaaaguaaaauaucuuuguuuugcuuucauucacaaaguaaugaagccagcugccaauuacau

SEQ ID NO: 214308 - RNA, 64 nt, Homo Sapiens
uggauuguuuuucccuaaucuuccgucaaguacacaaaguaacuuugcgggauauuuaggguac

SEQ ID NO: 214309 - RNA, 64 nt, Homo Sapiens
ugucuuuccuuaucauuggugggaggcuugguagcaaaguaacauuuuuuggaaaagaggacag

SEQ ID NO: 214310 - RNA, 64 nt, Homo Sapiens
auauuuuagagcugaaucagcuaagaagccuugacaaaguaaguugaccuuauuucaacacauu

SEQ ID NO: 214311 - RNA, 64 nt, Homo Sapiens
uuaaugaauuuuuagcuuguuuugagaaaugaaucaaaguaauuaugaugaagaaaguuccuga

SEQ ID NO: 214312 - RNA, 64 nt, Homo Sapiens
aagagcugcuguccuuuuaggaauauguucaaugcaaaguaaaaaaauaugaauuguccccaau

SEQ ID NO: 214313 - RNA, 64 nt, Homo Sapiens
cucccaauaacuaaugcuaagaaaugcugaaaaucaaaguaaaaaauuaaagcccauaaggcca

SEQ ID NO: 214314 - RNA, 64 nt, Homo Sapiens
caguaacuauccacaaacucaccuuauguuacuccaaaguaauaguaggggauaaacccauaga

SEQ ID NO: 214315 - RNA, 64 nt, Homo Sapiens
uuaggaaacuagaaaaagaagagcaaauuaaauccaaaguaaccugaaaaaacauuagaguaaa

SEQ ID NO: 214316 - RNA, 64 nt, Homo Sapiens
uggaaaaaaauuagaguaaagagcaaauuaaauccaaaguaaccuuggaaaacuagaaaaagaa

SEQ ID NO: 214317 - RNA, 64 nt, Homo Sapiens
guaggggauaaacccauagagccuuauguuacuccaaaguaacacaauaacuauccacaaacuc

SEQ ID NO: 214318 - RNA, 64 nt, Homo Sapiens
ccaaugaaagugcucguguuauaugcacuuccaccaaaguaaugcccuucccaaaacagaguuc

SEQ ID NO: 214319 - RNA, 64 nt, Homo Sapiens
acaacccaaggcaacuggggugggguaaagacaacaaaguaaauacaguugauccucaucuguc

SEQ ID NO: 214320 - RNA, 64 nt, Homo Sapiens
guacaguuacccaucuacucgucaagcuaucuaucaaaguaaugggcugauuuauuuagguuuu

SEQ ID NO: 214321 - RNA, 64 nt, Homo Sapiens
uuaaaacaggcacauagagugacauguuaauaaacaaaguaacaauuuauguaauauuuagaac

SEQ ID NO: 214322 - RNA, 64 nt, Homo Sapiens
aguuuaacguauauuaaaccacuucaagauaaaucaaaguaauauugcguugaugacuuuuuua

SEQ ID NO: 214323 - RNA, 64 nt, Homo Sapiens
cuucacauauggcccuuucugaaucaaagugcggcaaaguaaauauugucuaagcuuuaaucca

SEQ ID NO: 214324 - RNA, 64 nt, Homo Sapiens
ugagucucuaaaucucucuguaagaaaaaaauuucaaaguaaagauuuuacucuugcaauuucu

SEQ ID NO: 214325 - RNA, 64 nt, Homo Sapiens
aagaucaaugguuuacauagauaaacuuauuuaccaaaguaaaaagaacucaugguacuucuaa

SEQ ID NO: 214326 - RNA, 64 nt, Homo Sapiens
uugucuguuuuccacuuggaguuauuuuaaaauucaaaguaaaucacucuauucuuauuuugaa

SEQ ID NO: 214327 - RNA, 64 nt, Homo Sapiens
ugcaaaaugaaaaaaauuagaaguaacacacacacaaaguaaaucacagggagugagauuauua

SEQ ID NO: 214328 - RNA, 64 nt, Homo Sapiens
ugaagcuauuccagguugagcuguuuucucuugccaaaguaagagaagaggagcaaaaauaccu

SEQ ID NO: 214329 - RNA, 64 nt, Homo Sapiens
guauauauuaugugauaaauuuucaagugacaagcaaaguaaauauuuuguguuuucuuaggca

SEQ ID NO: 214330 - RNA, 64 nt, Homo Sapiens
gaugguuuuauaaaauugaggcauugcuuuauuacaaaguaaagauuauggaaaaugucucuca

SEQ ID NO: 214331 - RNA, 64 nt, Homo Sapiens
cuuuuuuuuuucauuaaaagagacuuuugaagaacaaaguaaaauaaauagacuaguuaguaga

SEQ ID NO: 214332 - RNA, 64 nt, Homo Sapiens
gaugacauguggaauaaagucagguuuguuuuuccaaaguaacaagacaguaagguguuacucc

SEQ ID NO: 214333 - RNA, 64 nt, Homo Sapiens
uacagugcuuuuuauuacugcuaacuucuucccagggcauuaugugaaguauuggaguucaugu

SEQ ID NO: 214334 - RNA, 64 nt, Homo Sapiens
cugcuaaaagcugguuagauccuuugggugggcagggcauuaaagggcagaagaggacgaaaug

SEQ ID NO: 214335 - RNA, 64 nt, Homo Sapiens; identical to SEQ ID NO: 172152

SEQ ID NO: 214336 - RNA, 64 nt, Homo Sapiens; identical to SEQ ID NO: 172153

SEQ ID NO: 214337 - RNA, 64 nt, Homo Sapiens; identical to SEQ ID NO: 172154

SEQ ID NO: 214338 - RNA, 64 nt, Homo Sapiens; identical to SEQ ID NO: 172155

SEQ ID NO: 214339 - RNA, 64 nt, Homo Sapiens; identical to SEQ ID NO: 172156

SEQ ID NO: 214340 - RNA, 64 nt, Homo Sapiens; identical to SEQ ID NO: 172157

SEQ ID NO: 214341 - RNA, 64 nt, Homo Sapiens; identical to SEQ ID NO: 172158

SEQ ID NO: 214342 - RNA, 64 nt, Homo Sapiens; identical to SEQ ID NO: 172159

SEQ ID NO: 214343 - RNA, 64 nt, Homo Sapiens; identical to SEQ ID NO: 172160

SEQ ID NO: 214344 - RNA, 64 nt, Homo Sapiens; identical to SEQ ID NO: 172161

SEQ ID NO: 214345 - RNA, 64 nt, Homo Sapiens; identical to SEQ ID NO: 172162

SEQ ID NO: 214346 - RNA, 64 nt, Homo Sapiens; identical to SEQ ID NO: 172163

SEQ ID NO: 214347 - RNA, 64 nt, Homo Sapiens; identical to SEQ ID NO: 172164

SEQ ID NO: 214348 - RNA, 64 nt, Homo Sapiens; identical to SEQ ID NO: 172165

SEQ ID NO: 214349 - RNA, 64 nt, Homo Sapiens
cauuacauugccagcgcauaucauuuagcaaguuggcauuaacauuuaugcuuuaauuaaaugc

SEQ ID NO: 214350 - RNA, 64 nt, Homo Sapiens
ugauguaaauaguuaaccuucaguagucuauuaaggcauuaauacuucucuggacaugcgcguu

SEQ ID NO: 214351 - RNA, 64 nt, Homo Sapiens
cagccaccgccggggggagggugaggcggccgggggcauuaacugaccucugaguacagcaaua

SEQ ID NO: 214352 - RNA, 64 nt, Homo Sapiens
gccauuauguugaaauccuaauccccaaggugauggcauuaagaagugggccuuugggaaguga

SEQ ID NO: 214353 - RNA, 64 nt, Homo Sapiens
aaccauaagagauauuacuuuauugaauaugguuggcauuaaauuuagcauuucauuaucuaac

SEQ ID NO: 214354 - RNA, 64 nt, Homo Sapiens
uuuguguaugucuguguauguaaguuugucuuguggcauuaagacuauuuugcucuucuggaau

SEQ ID NO: 214355 - RNA, 64 nt, Homo Sapiens
caaagguggauuuaagaauuguuugacauguuagggcauuaaagaugaccagaggggaagagga

SEQ ID NO: 214356 - RNA, 64 nt, Homo Sapiens
auuaaacugcagcucugggcuauugagauaauugggcauuaaacgcaccauguaagccuccuug

SEQ ID NO: 214357 - RNA, 64 nt, Homo Sapiens
gaaauuuauaggaagaagguuucuuggccuuaauggcauuaaauaggaaguugguuaugccacc

SEQ ID NO: 214358 - RNA, 64 nt, Homo Sapiens
aaaaaagagauaaaauauuguguauuuuuguacuggcauuaacacauuuugucaagucaucaac

SEQ ID NO: 214359 - RNA, 50 nt, Homo Sapiens
agaaaugcacucaccaugagggcauuaagauuaaagccauuuuaaacuga

SEQ ID NO: 214360 - RNA, 64 nt, Homo Sapiens
aucuaauuaaaucgugaaauagucuuuuacuugaggcauuaaauuuugcuugcuuccauugauc

SEQ ID NO: 214361 - RNA, 64 nt, Homo Sapiens
aucauguacuucauaguuuguuuacucaaauuagggcauuaaauaccaagaaccgcugacuaaa

SEQ ID NO: 214362 - RNA, 64 nt, Homo Sapiens
auuugagagcuaacuauauuuaacugacuuaaguggcauuaaacaugcuuuacaaucugcacuu

SEQ ID NO: 214363 - RNA, 64 nt, Homo Sapiens
ggacagagucagcucacacgcugggcucagccugggcauuaaagagcagauacucaaggaggca

SEQ ID NO: 214364 - RNA, 64 nt, Homo Sapiens
cuccucaaugaggaagaaucagccagcuuacacaggcauuaacuugccccacaaacagaucacc

SEQ ID NO: 214365 - RNA, 64 nt, Homo Sapiens
gaaucacaucuucagaagagagggaagagaacauggcauuaaaaaaucuaagucaggucaccag

SEQ ID NO: 214366 - RNA, 64 nt, Homo Sapiens
uauacaaacugaaaaugugucaaacauaggucugggcauuaaauauuguuaugaauaagaaagg

SEQ ID NO: 214367 - RNA, 64 nt, Homo Sapiens
auauuaaaagugcagacuuuaaagcccaucagugggcauuaaaaauuuuaaaaaguauugacac

SEQ ID NO: 214368 - RNA, 64 nt, Homo Sapiens
cuugcuuugguuaaagccuuaaaagacaccuuguggcauuaaguaauuaauuacucuuggggaa

SEQ ID NO: 214369 - RNA, 64 nt, Homo Sapiens
cucagaagcuacuuacugcuuuauguacucuuugggcauuaaugccuucucuguaauuauaucu

SEQ ID NO: 214370 - RNA, 64 nt, Homo Sapiens
cuuggucuuagcccuugggagcugacagcccaugggcauuaaggcaaaguaguuccagugauuu

SEQ ID NO: 214371 - RNA, 64 nt, Homo Sapiens
augcugguauuugauuuccuguguguguugcccuggcauuaagggcauuuuacccuugcaguuu

SEQ ID NO: 214372 - RNA, 64 nt, Homo Sapiens
ugcauguuuacuuuauuagaguaggaaggcuacuggcauuaauuauuaauaccaaauauuuuag

SEQ ID NO: 214373 - RNA, 64 nt, Homo Sapiens
auaaaacauuuuucaaaauugaaauauuuuccugggcauuaaaaaccuuuacuauuggcuacaa

SEQ ID NO: 214374 - RNA, 64 nt, Homo Sapiens
aaaauccaaggcuuuacugcugauagugcuaauuggcauuaaccacaaaaugagaauuauauuu

SEQ ID NO: 214375 - RNA, 64 nt, Homo Sapiens
aagucaagggagaacagcagguggacaauugcugggcauuaaugacaguacaggugcauggccu

SEQ ID NO: 214376 - RNA, 64 nt, Homo Sapiens
acuccucguaaguguugcauucggccuuuuuagaggcauuaacuguauagguugacuuggcaau

SEQ ID NO: 214377 - RNA, 64 nt, Homo Sapiens
caguggcuuugcauagcuuucuaaaagagaucugggcauuaaguuggaggaacacagagaaauc

SEQ ID NO: 214378 - RNA, 64 nt, Homo Sapiens
agaagaaucccugcuguuuacccugaauggggcaggcauuaaauuuauaugugaauauaagugu

SEQ ID NO: 214379 - RNA, 64 nt, Homo Sapiens
cugugguuggggaaaugugacaguacaaccugauggcauuaauuuucaucaaugccuacacauu

SEQ ID NO: 214380 - RNA, 64 nt, Homo Sapiens
ccuagacucauauguauggauguacuguguaaucggcauuaauaagggaccucccucuguacug

SEQ ID NO: 214381 - RNA, 64 nt, Homo Sapiens
uuggucuucagccagcauucuggugggagugacuggcauuaacaagacuggaaaucggggguca

SEQ ID NO: 214382 - RNA, 64 nt, Homo Sapiens
agauaauggaacugaacuuucacucaauuaauugggcauuaacaaccuucuuuuauguuuguuc

SEQ ID NO: 214383 - RNA, 64 nt, Homo Sapiens
uuacuggaaaaagaacuugaauuaugcauuuauuggcauuaauguaaacaguaaguccuaagcu

SEQ ID NO: 214384 - RNA, 64 nt, Homo Sapiens
aacagaaccuagcacagugcuugggcagccaauaggcauuaaucaguaucuauugaguguuaug

SEQ ID NO: 214385 - RNA, 64 nt, Homo Sapiens
cugcuaagcacaggcuccucacucuucuccaucaggcauuaaaugaauggucucuuggccaccc

SEQ ID NO: 214386 - RNA, 64 nt, Homo Sapiens
gaggucagucuuaguggccuugagaguugcuuuuggcauuaauauucuaagagaauuaacugua

SEQ ID NO: 214387 - RNA, 64 nt, Homo Sapiens
uccauggucacugcuaagcaguagccagccaucgggcauuaauugauuuccuacuauauuccca

SEQ ID NO: 214388 - RNA, 64 nt, Homo Sapiens
uguaauggcaaaaccaauaucagguuuuaaaccuggcauuaaaauauaaagcugcagcuuucaa

SEQ ID NO: 214389 - RNA, 64 nt, Homo Sapiens
cugcuguuuuaaaaggcuccugcugauucuggggggcauuaaagccaagccugugaugacaugg

SEQ ID NO: 214390 - RNA, 64 nt, Homo Sapiens
auucccgcaaacuauaaagagaguuucuguuuagggcauuaaaaagcaagccaugaggcuguug

SEQ ID NO: 214391 - RNA, 64 nt, Homo Sapiens
uguuugaaugcaaauucgaucagaccuacuugguggcauuaaacgcugaguuuauacauuaguu

SEQ ID NO: 214392 - RNA, 64 nt, Homo Sapiens
agaugucuucacccugaauuaaauuuaauugaagggcauuaauuuccauuucuuauuuuccacc

SEQ ID NO: 214393 - RNA, 64 nt, Homo Sapiens
uuuagaauuugggcuggugaugauuguuacuaguggcauuaacuagguuuguuuuuccugcugu

SEQ ID NO: 214394 - RNA, 64 nt, Homo Sapiens
uauguuaguuggcaccuuaacagcguuauugaugggcauuaaucaaacagcaguugauaccuag

SEQ ID NO: 214395 - RNA, 64 nt, Homo Sapiens
aaaauagcaaauauuaaaaauucuccagaacuaaggcauuaaagauaugaugagauuuuagccu

SEQ ID NO: 214396 - RNA, 64 nt, Homo Sapiens
uggggcuucugcaugugaaaaacgguuuuccauaggcauuaaagugcugaaugcucagucugau

SEQ ID NO: 214397 - RNA, 64 nt, Homo Sapiens
uuugcuaaaacacuuauuacccuucugcagcaaaggcauuaaaagcgcuaagcauauauuaaua

SEQ ID NO: 214398 - RNA, 64 nt, Homo Sapiens
uaaacuaaaaaaguacucauaccaaaaacuuaaaggcauuaaaaauuuuccaaauguaaaaguc

SEQ ID NO: 214399 - RNA, 64 nt, Homo Sapiens
cuuuaauuuaaagaaaaguuauaaaaggauuaucggcauuaauaaaguucaaauauacuuguua

SEQ ID NO: 214400 - RNA, 64 nt, Homo Sapiens
uucuuuuguuauuaaaaaaauauagucaauauggggcauuaauacuugguuugcacauaaaacg

SEQ ID NO: 214401 - RNA, 64 nt, Homo Sapiens
ucaccaguguucucacccuccaagccacagcuauggcauuaaugcugccucucaaucccugucc

SEQ ID NO: 214402 - RNA, 64 nt, Homo Sapiens
aaaauguuucuaacacgcuugcaacuucccuuauggcauuaaucuuguugagggagagagacag

SEQ ID NO: 214403 - RNA, 64 nt, Homo Sapiens
uaagggauuuuccuuuuagcuuuucaucuccaguggcauuaaacauaaaaagacccuggcauuu

SEQ ID NO: 214404 - RNA, 64 nt, Homo Sapiens
ugagaaaguuuaucaucaugauagcuguaagucaggcauuaaaaucaaauggaaauacaccuaa

SEQ ID NO: 214405 - RNA, 64 nt, Homo Sapiens
uuguugcgaaggccaguggaauauaaaaaucaauggcauuaaugaggagcacauucuuugcuga

SEQ ID NO: 214406 - RNA, 64 nt, Homo Sapiens
auuuagaaguuugauuaauuauauuaucuauuuaggcauuaauauaaaagagguaggagucugu

SEQ ID NO: 214407 - RNA, 64 nt, Homo Sapiens
ucaaguacacacuacugagagaugaauuaucaucggcauuaacgagugaauauucuguagauca

SEQ ID NO: 214408 - RNA, 64 nt, Homo Sapiens
aaccaaauuucaacuuaagugaccacacaaggugggcauuaacauuccuucaaaacuguguuuu

SEQ ID NO: 214409 - RNA, 64 nt, Homo Sapiens
aagcaaauagugcccucagcgaugcuaauuauaaggcauuaagucuuagaucuacuguaaggca

SEQ ID NO: 214410 - RNA, 64 nt, Homo Sapiens
ggauaccauauacagcucagaaguuucuucuuuaggcauuaaauuuuagcaaagauaucucauc

SEQ ID NO: 214411 - RNA, 64 nt, Homo Sapiens
ugugucagagaauaggaaaagcagcuuuguuuggggcauuaaugcuuggaguggggucagcuaa

SEQ ID NO: 214412 - RNA, 64 nt, Homo Sapiens
uuuuuuuuuuuuuuuuuuuuuugggaguaagccaggcauuaaaagcaaccguuugaauccuauu

SEQ ID NO: 214413 - RNA, 64 nt, Homo Sapiens
gaaguguacauugauuuccaauuaaaaauuugcuggcauuaaaaauaagcacacuuacauaagc

SEQ ID NO: 214414 - RNA, 64 nt, Homo Sapiens
aaaauauggcuaacuaguguuuaaacucugaauaggcauuaaaacuuuuguuacugggacacuu

SEQ ID NO: 214415 - RNA, 64 nt, Homo Sapiens
guuccuugcuuuuauaguuguuaaaaucuugcauggcauuaauuauuucuaugccauuuuuagu

SEQ ID NO: 214416 - RNA, 64 nt, Homo Sapiens
auucuugcuaucauuuaccaaaaauccaggcaauggcauuaaacguagcaaauuuuccuuuuaa

SEQ ID NO: 214417 - RNA, 64 nt, Homo Sapiens
gcuagagaugucaaauggaaugucuuccgaaaaaggcauuaagggcauauucagcauaacagcu

SEQ ID NO: 214418 - RNA, 64 nt, Homo Sapiens
acuccaguaaaagcuggggccuggagucaucaaaggcauuaaaacaaggaacagaguugagugu

SEQ ID NO: 214419 - RNA, 64 nt, Homo Sapiens
agacugaugcuuugacugaaucaucacuagcuauggcauuaaaaggccucucuucucaucuggu

SEQ ID NO: 214420 - RNA, 64 nt, Homo Sapiens
guguguaacgacacaaucagcacaacuggagagaggcauuaaagaaccagggaagguaguuuga

SEQ ID NO: 214421 - RNA, 64 nt, Homo Sapiens
cccacauuugaguggugcuaacuugaugugaguaggcauuaauuaugggugcggcuacuaagau

SEQ ID NO: 214422 - RNA, 64 nt, Homo Sapiens
ccaggaaccacuagcaguagacuagcgcugcucuggcauuaaucgcugugcagaagagcagaua

SEQ ID NO: 214423 - RNA, 64 nt, Homo Sapiens
gacaauaaaaauuccaaaugccuauaaagcauaaggcauuaaauugcuucagaaugaauuugua

SEQ ID NO: 214424 - RNA, 64 nt, Homo Sapiens
auauguuguguaugaaguaugcagaaguuuucagggcauuaaaucuaaauaacucaguuuuuaa

SEQ ID NO: 214425 - RNA, 64 nt, Homo Sapiens
uuucaguguaguuuguuguuccaagaauuuuaucggcauuaauuuguauuucuuaauauuauga

SEQ ID NO: 214426 - RNA, 64 nt, Homo Sapiens
gacuuacuuucuuugcuguaguuaugaaccuuggggcauuaaaaucccauggcaaggagcauaa

SEQ ID NO: 214427 - RNA, 64 nt, Homo Sapiens
cguggaugcagcguaaacaucuuccuucagacgaggcauuaaccccaugguuaauggacugguc

SEQ ID NO: 214428 - RNA, 64 nt, Homo Sapiens
uuuguuucccagguauagcaggcuuauguuugguggcauuaaauugguuucuuuaaaaugcuuu

SEQ ID NO: 214429 - RNA, 64 nt, Homo Sapiens
aaaaacaaacaccaaauaauuggaauauauugcaggcauuaagcucauuaaaaacaaacuggcu

SEQ ID NO: 214430 - RNA, 62 nt, Homo Sapiens
guuugcguaauaaaacauuuguauuuaaugaguuggcauuaauucuuugagcacaucucucu

SEQ ID NO: 214431 - RNA, 64 nt, Homo Sapiens
ccaagucaccacuccugacccaaaaaucaggcauggcauuaaaacguugcaaauuccuuuacug

SEQ ID NO: 214432 - RNA, 64 nt, Homo Sapiens
cuugggcaccagcuucuuucagcccuuguggcgaggcauuaaaagagcucagccugccugggag

SEQ ID NO: 214433 - RNA, 64 nt, Homo Sapiens
cauuuucagaacauuucuguucagauuucuugguggcauuaaaggcggcagcuuccugcaccuu

SEQ ID NO: 214434 - RNA, 64 nt, Homo Sapiens
cacaucauggaccaaauguguugggaucugucuuggcauuaaaccuauguguuucuguaacaaa

SEQ ID NO: 214435 - RNA, 64 nt, Homo Sapiens
uuauauauguuaauaaggaaaaguguguuccaaaggcauuaaaaaaaaauuacauuuauuaaaa

SEQ ID NO: 214436 - RNA, 64 nt, Homo Sapiens
cagcaacauaauacucacuugggaaacauuuuuuggcauuaaugauauuaggcuggauugccau

SEQ ID NO: 214437 - RNA, 53 nt, Homo Sapiens
cuucuuuagaucugaaguugacaggcauuaacggcuuuuccgcugaagcuuaa

SEQ ID NO: 214438 - RNA, 64 nt, Homo Sapiens
ggguacuaugaacgugagugggguauuuuguucuggcauuaaaagaaaaacaagcaagcaaaca

SEQ ID NO: 214439 - RNA, 64 nt, Homo Sapiens
ucagaaacauuguuuugaauccucuguaaaccaaggcauuaaucuuaauaaaccaggauccauu

SEQ ID NO: 214440 - RNA, 64 nt, Homo Sapiens
gcuuagcacagcucuaguuacauucuuaugauauggcauuaaauuauuuccauauauuauauaa

SEQ ID NO: 214441 - RNA, 64 nt, Homo Sapiens
gaaaaacaagcaagcaaacaggguauuuuguucuggcauuaaaaggguacuaugaacgugagug

SEQ ID NO: 214442 - RNA, 64 nt, Homo Sapiens
uuuguaauugaaauguugcuuagguaguuuaacaggcauuaaaaggacuucucagcuucuccca

SEQ ID NO: 214443 - RNA, 64 nt, Homo Sapiens
uuugacuugaguugguucuuuucacaauaacaauggcauuaaggaaauuacuacuuaauccuaa

SEQ ID NO: 214444 - RNA, 64 nt, Homo Sapiens
cuacuuuacuaucuauacuggaaauugcuuucuaggcauuaauaaaaacccauccaguucuuca

SEQ ID NO: 214445 - RNA, 64 nt, Homo Sapiens
augcauaccaugcuuucagaagacaggcagcagaggcauuaaaaaugugguaagcggaaacaga

SEQ ID NO: 214446 - RNA, 64 nt, Homo Sapiens
auuuuacaaaaacauaauuuccacauuuucuuauggcauuaaaaucuuuuucauugcaaaauug

SEQ ID NO: 214447 - RNA, 64 nt, Homo Sapiens
aagucauaaucuaucaaaaguuuauuuauuggauggcauuaaaacauuuuugaggcaguugucu

SEQ ID NO: 214448 - RNA, 64 nt, Homo Sapiens
auaguuuuaaauacauaaagaaauguuucaguuaggcauuaaccuugauagaaucacucaguuu

SEQ ID NO: 214449 - RNA, 64 nt, Homo Sapiens
gauaauugccuauguucuagguaacaggaaaacaggcauuaaguuuauuuuagucuucccauuu

SEQ ID NO: 214450 - RNA, 64 nt, Homo Sapiens
uuuuuccauuuuuaugugccucacaggcuguuugggcauuaauuuugcuuuuugagccuuaagu

SEQ ID NO: 214451 - RNA, 64 nt, Homo Sapiens
aguccacuaacugugaguaaaaaugauauauauaggcauuaaccacacacuuuaauggguauaa

SEQ ID NO: 214452 - RNA, 64 nt, Homo Sapiens
uugacuauauuuuuggagucccauuguuucagugggcauuaacagaaugcuuuaaaaacuucua

SEQ ID NO: 214453 - RNA, 64 nt, Homo Sapiens
ucaucaucucaacccagaguugggugucggcugcggcauuaaauaaggagccaaagugugaaug

SEQ ID NO: 214454 - RNA, 64 nt, Homo Sapiens
uaccaucuuaaccauuguuaaguguaugguuuguggcauuaaauacauucacauuguugugcaa

SEQ ID NO: 214455 - RNA, 64 nt, Homo Sapiens
cuucuugcuaagagaaagaaaaacaaaaucagagggcauuaaauguuuuguaugugacaugauu

SEQ ID NO: 214456 - RNA, 64 nt, Homo Sapiens
cauuccugggagcugggcaaggagauccucccguggcauuaaaagagagucaaaggguugcgag

SEQ ID NO: 214457 - RNA, 64 nt, Homo Sapiens
uccccucuuugccaccuaggccaguuuugacccuggcauuaacuggccuuagaagaaacuggau

SEQ ID NO: 214458 - RNA, 64 nt, Homo Sapiens
auauuaauguacuuguuucucuguuguaagaauaggcauuaacacaaaggaggcgucucgggag

SEQ ID NO: 214459 - RNA, 64 nt, Homo Sapiens
ucauaauuaguuuauaaacaccuagaauaauacuggcauuaaagaauccuuguuggaugguaga

SEQ ID NO: 214460 - RNA, 64 nt, Homo Sapiens
acuucugacauaacuaacccacaccugagauaacggcauuaauccauucaugaggucucugcuc

SEQ ID NO: 214461 - RNA, 63 nt, Homo Sapiens
uugaaagguaaguuggcucagaguugcacaguagggcauuaaauguuuaagcaaagcaucugc

SEQ ID NO: 214462 - RNA, 64 nt, Homo Sapiens
gacagccaccaguaggcuugcauaagcugcacauggcauuaaaggcugcuuaucuccaaagcag

SEQ ID NO: 214463 - RNA, 64 nt, Homo Sapiens
uaauaauucuuguuuuucacuuucaauuguugguggcauuaauuuccacuugcuauuuauuuuu

SEQ ID NO: 214464 - RNA, 64 nt, Homo Sapiens
auauuuuauugauauuuuuguacaagaaauuguaggcauuaaaaaaaguuuugcaauuuaugua

SEQ ID NO: 214465 - RNA, 64 nt, Homo Sapiens
cuuaaccgcaucagaagccuuauugaaaaaaauuggcauuaaaaguauauuuauauaauuaugu

SEQ ID NO: 214466 - RNA, 64 nt, Homo Sapiens
gugucauacaguuguugccaagauuuuguuuccaggcauuaaguggcuguuuuucacuuuguuc

SEQ ID NO: 214467 - RNA, 64 nt, Homo Sapiens
gcugaaguagucugggauuuuuuuaugaauaaaaggcauuaaaguucagucuagcuuucacagu

SEQ ID NO: 214468 - RNA, 64 nt, Homo Sapiens
aaucaguauauauuuuaacuuauacuauuaguugggcauuaaaaagaaauccagucuuuaugaa

SEQ ID NO: 214469 - RNA, 64 nt, Homo Sapiens
auauucauuuaaaaauacaauugugaguuguguuggcauuaaaacuguauuuuaaaaaaagaca

SEQ ID NO: 214470 - RNA, 64 nt, Homo Sapiens
uugcagcuccaucugguugcugcauuugaagcauggcauuaauuuguauuugcccuguucuuug

SEQ ID NO: 214471 - RNA, 64 nt, Homo Sapiens
aaaaguuuccguuugcacaagaaaauaacgcuugggcauuaaaugaaugccuuuauagauaguc

SEQ ID NO: 214472 - RNA, 64 nt, Homo Sapiens
uauaauacuugcucaacaguauagugguaccaauggcauuaagaugguguuuuuguucuacaua

SEQ ID NO: 214473 - RNA, 64 nt, Homo Sapiens
uuugauauauucaaguauauaugaaaaucuguuuggcauuaagugaauuuuaauguuuuuguuu

SEQ ID NO: 214474 - RNA, 64 nt, Homo Sapiens
aaaaacaaaacaaugugaaacauuaaaauuaaaaggcauuaauaauauccacgugugccuucuu

SEQ ID NO: 214475 - RNA, 64 nt, Homo Sapiens
gugccugagacugucagaaguugaccuuugcacuggcauuaaagagucauagaaaaagaaucau

SEQ ID NO: 214476 - RNA, 64 nt, Homo Sapiens
uagcuuuggaaaaagggacuauuuguggaguaauggcauuaaucaacauagaacaucuuauuug

SEQ ID NO: 214477 - RNA, 64 nt, Homo Sapiens
caaaauccccauaaauauccaucccuuccuagauggcauuaacuuucauuuuagauuuuaggug

SEQ ID NO: 214478 - RNA, 64 nt, Homo Sapiens
uuuguggcauauccguguaauggaagauuaugcaggcauuaaaauauguacacaaaaaguuugg

SEQ ID NO: 214479 - RNA, 64 nt, Homo Sapiens
ugcuaaaagcugguuagaugcuuugggugggcagggcauuaaacggcagaagaggacgaaaugc

SEQ ID NO: 214480 - RNA, 64 nt, Homo Sapiens
caccaaugcauuuggacaacuuguaagcguuagcggcauuaauuauagauauauguauaaaaau

SEQ ID NO: 214481 - RNA, 64 nt, Homo Sapiens
uguuuguggaagaauauagcauuacauagacuuaggcauuaacaguuuuuuuaaaaaaagcuaa

SEQ ID NO: 214482 - RNA, 64 nt, Homo Sapiens
aagccuucgauaauauuaaauuuguguuuuuuaaggcauuaauauaaauguguguucagaacuu

SEQ ID NO: 214483 - RNA, 64 nt, Homo Sapiens
cugucugacacagccagccaaggggcuggggcauggcauuaacauugcccagcuugccaaggug

SEQ ID NO: 214484 - RNA, 64 nt, Homo Sapiens
gaggcggaggagcagccuuacugucuaaagaccuggcauuaaugucucaguaggaaugcuggug

SEQ ID NO: 214485 - RNA, 64 nt, Homo Sapiens
auaguaagccucccuccucgguacuggggcugagggcauuaaaauggucuccucugauuaucag

SEQ ID NO: 214486 - RNA, 64 nt, Homo Sapiens
cccgccuugaagggcgagcuugccugggaguuuuggcauuaagcuaaucaacagcucagccagc

SEQ ID NO: 214487 - RNA, 64 nt, Homo Sapiens
uugagcuaauguuaaaaaucugcugagaguugggggcauuaaccgcgggcacccgucaugcuuu

SEQ ID NO: 214488 - RNA, 64 nt, Homo Sapiens
aaaauuacaaguaaucaagggucauuauggguuaggcauuaauguuucuaucugauuuugugca

SEQ ID NO: 214489 - RNA, 64 nt, Homo Sapiens
aaaucauugguagccccccaaguguuuaauaacuggcauuaagcuuagagggugaaaaaaaaaa

SEQ ID NO: 214490 - RNA, 64 nt, Homo Sapiens
auauugcuacagcaucuagucugcuuuuucugugggcauuaacuuccuuucuuucucugaauua

SEQ ID NO: 214491 - RNA, 64 nt, Homo Sapiens
agaagugcaauuccuuuuuaagugugaaagagaaggcauuaaaauaccucauaagugcauauau

SEQ ID NO: 214492 - RNA, 64 nt, Homo Sapiens
caaaccucaaaaacgugagcauacaauaaaaacuggcauuaauaucucagagagcauuugucua

SEQ ID NO: 214493 - RNA, 64 nt, Homo Sapiens
gcuuuuuuuauccuuaaaauucaccugucagggaggcauuaaaaauuuggaaauguaugccagc

SEQ ID NO: 214494 - RNA, 64 nt, Homo Sapiens
aggugccaaugacuaacuuuuugaauucuauguuggcauuaacaauaaagcauuuugcaaacac

SEQ ID NO: 214495 - RNA, 64 nt, Homo Sapiens
agguccuuuuuuauaaaggauaugauguuuuuuaggcauuaauaacacaagcuuuccuagagaa

SEQ ID NO: 214496 - RNA, 64 nt, Homo Sapiens
acuuacaaagcacuauauugguaauucuuacaauggcauuaauagcuuacucuauaaauacaga

SEQ ID NO: 214497 - RNA, 64 nt, Homo Sapiens
caaauaugaauuuuaugauguacacuuugugcuuggcauuaaaagaaaaaaacacacauccugg

SEQ ID NO: 214498 - RNA, 64 nt, Homo Sapiens
uacagcccguguccgucugcucgugggccuggagggcauuaauauuacacucacaggugagggg

SEQ ID NO: 214499 - RNA, 64 nt, Homo Sapiens
ccauacaaugggcagugucugcuauagggcuucaggcauuaaauaaaaccgaggguuguugauu

SEQ ID NO: 214500 - RNA, 64 nt, Homo Sapiens
uuuagaagcucuggccaguaguuguuaagauguuggcauuaauggcauuuucauagauccuugg

SEQ ID NO: 214501 - RNA, 64 nt, Homo Sapiens
uucaagaaggauuuggcauugccuaaauagaccuggcauuaaauuucucgugguaguucauucg

SEQ ID NO: 214502 - RNA, 64 nt, Homo Sapiens
cuucacauuaucauaaccucuccucuaaaggggaggcauuaaaauucacugugcccagcacaug

SEQ ID NO: 214503 - RNA, 64 nt, Homo Sapiens
ggcucccaacuccucccuauccuaaaggcccacuggcauuaaagugcuguauccaagagcugcg

SEQ ID NO: 214504 - RNA, 64 nt, Homo Sapiens
uuagcaccaugcugcuucugucugucuuaaugcuggcauuaagaucaugagcccuuuuucucca

SEQ ID NO: 214505 - RNA, 64 nt, Homo Sapiens
uauuuucuauauccaguuuaggcaguuguaaucuggcauuaacuaauugcaaguugcccugcua

SEQ ID NO: 214506 - RNA, 64 nt, Homo Sapiens
aguuuaaaauuguucucaaugccagcuguugguaggcauuaaugaguauuuucagucaucagaa

SEQ ID NO: 214507 - RNA, 64 nt, Homo Sapiens
cuaagagagaggagccuggauacucaguuuccugggcauuaaguagauuugcugcugaugaaaa

SEQ ID NO: 214508 - RNA, 64 nt, Homo Sapiens
auugcugucuuuuuuuuaaaucuuuucuguucuuggcauuaauugccgggcaacacgucaacau

SEQ ID NO: 214509 - RNA, 64 nt, Homo Sapiens
aagauacacacuggacccucucuugcugaaugugggcauuaauuuuuugacugcagcucugcuu

SEQ ID NO: 214510 - RNA, 64 nt, Homo Sapiens
ugguuaaucaagagccuucuggguuugguuugguggcauuaaauggcaauuugugacugagaca

SEQ ID NO: 214511 - RNA, 64 nt, Homo Sapiens
gccugguggggaucagacagagauuggagagaagggcauuaaccugucugggggccagcggcag

SEQ ID NO: 214512 - RNA, 64 nt, Homo Sapiens
caaaggggacuuuagaggacuucauacaaagcugggcauuaagaaaaccacaaugcauggccgg

SEQ ID NO: 214513 - RNA, 64 nt, Homo Sapiens
gcccccgugggcucccaucucauccucugaacuaggcauuaacagucucuccaacugccuuucc

SEQ ID NO: 214514 - RNA, 64 nt, Homo Sapiens
uaauuuuaauguacugauaagcacagagcucuuuggcauuaaucucugaacucuuugacaaauu

SEQ ID NO: 214515 - RNA, 64 nt, Homo Sapiens
uggaaggaaacugacaagucgucuucuugacagcggcauuaauugggugagaguuaauuaugca

SEQ ID NO: 214516 - RNA, 64 nt, Homo Sapiens
guauagaagauauaggaaguauaaaaaucaaauuggcauuaaaacuguuaaauaucacaucaca

SEQ ID NO: 214517 - RNA, 64 nt, Homo Sapiens
acaagucggguggcuagaggaacuggauuuuauaggcauuaaaguaaauauuuuuccuccucug

SEQ ID NO: 214518 - RNA, 64 nt, Homo Sapiens
ccuuagagggaauaauaaagaccauucauucccuggcauuaauccaggggugggggguaugggg

SEQ ID NO: 214519 - RNA, 64 nt, Homo Sapiens
cuucagaaaucucugcguuuacucacuaacuauuggcauuaaagggagacagccaucuaaacag

SEQ ID NO: 214520 - RNA, 64 nt, Homo Sapiens
aaaaaugucacuuaggucagagauuacuguauuuggcauuaaaaauaagccauuaaaagcuugg

SEQ ID NO: 214521 - RNA, 64 nt, Homo Sapiens
agaaaucaaacaacuuggaaaucgaucacaaccaggcauuaaguucacaguaagaucauuuuau

SEQ ID NO: 214522 - RNA, 64 nt, Homo Sapiens
uggcucuaccuaaaaguugguuaaaaaugcaauuggcauuaacaaggaaaaauacugaauuagu

SEQ ID NO: 214523 - RNA, 64 nt, Homo Sapiens
aaaaaaucaaugguggggaaucuguacauccuggggcauuaaaagguguggaauauggggguua

SEQ ID NO: 214524 - RNA, 64 nt, Homo Sapiens
cuaccuccucgaguugucaugaggaugaaagaauggcauuaaagcauuugguauacaguaggug

SEQ ID NO: 214525 - RNA, 64 nt, Homo Sapiens
ucuacguauuugauggaacccucacagcuuugcaggcauuaaaagacagaggcuuuauucaggc

SEQ ID NO: 214526 - RNA, 64 nt, Homo Sapiens
ccaccgcugggacugcuccuagauggaucucagcggcauuaagcugugccugagcgaguuugua

SEQ ID NO: 214527 - RNA, 64 nt, Homo Sapiens
cugggaaggaaugggugcuuugugauggauaaaaggcauuaaauaaaaccacguuuacauuuug

SEQ ID NO: 214528 - RNA, 64 nt, Homo Sapiens
cguuucuuuugaucucuugauugaaggaggauagggcauuaaagugcuuuugacaugaggaauu

SEQ ID NO: 214529 - RNA, 64 nt, Homo Sapiens
ccagggguucacuuucaggcgggaagcccagugaggcauuaagcugcccugcuugugccuuagu

SEQ ID NO: 214530 - RNA, 64 nt, Homo Sapiens
cugaggcgagaccgggcacgggauucugaccaacggcauuaaaacuuuggagcccagaggugcg

SEQ ID NO: 214531 - RNA, 64 nt, Homo Sapiens
caccaagaguagcaccuucagaauauauugaauaggcauuaaaugcaaaaauauauauguagcc

SEQ ID NO: 214532 - RNA, 64 nt, Homo Sapiens
gaugaagggugauuauguaugaaggagaggaaggggcauuaagaccaucugugucuccugugca

SEQ ID NO: 214533 - RNA, 64 nt, Homo Sapiens
uguuuaaaaaaaaaaagucagcaguaaaauguauggcauuaagaaauagagaaagaguguaaga

SEQ ID NO: 214534 - RNA, 64 nt, Homo Sapiens
ccagucacugauuuuuacaaaucuuacaguccaaggcauuaaccucaaggcccucccagcaccc

SEQ ID NO: 214535 - RNA, 64 nt, Homo Sapiens
ccaugcugggcauccuaggccacuuugcuuagagggcauuaaaggugccaugaaagguagacuc

SEQ ID NO: 214536 - RNA, 64 nt, Homo Sapiens
uacucuuauguuccacaugcacauaugacaagguggcauuaauuagauucaauauuauuucuag

SEQ ID NO: 214537 - RNA, 64 nt, Homo Sapiens
cucuaccacauagcaggcacugucacagaguaauggcauuaauccccauaauaauccugugaag

SEQ ID NO: 214538 - RNA, 64 nt, Homo Sapiens
auuuuaaguauuuggagcucuuucacuaaaaucuggcauuaaaauuggaccugcuauaauaaua

SEQ ID NO: 214539 - RNA, 64 nt, Homo Sapiens
ugccuuuuucuaauaaaaucuguuuccagcaguuggcauuaaaggcaaauguauuuacuaugcg

SEQ ID NO: 214540 - RNA, 64 nt, Homo Sapiens
aaagucuuauaaggagaaaugcuguuucauuucuggcauuaauauucaaauucauuuuguuuuu

SEQ ID NO: 214541 - RNA, 62 nt, Homo Sapiens
ccucaagucuggucuccuggcagagagcacaugggcauuagauaccaucaacauccugcugu

SEQ ID NO: 214542 - RNA, 62 nt, Homo Sapiens
agccaccgccggggggagggugaggcggccgggggcauuaacugaccucugaguacagcaau

SEQ ID NO: 214543 - RNA, 62 nt, Homo Sapiens
gcaaagguggauuuaagaauuuugacauguuagggcauuaaaugaccagaggggaagaggag

SEQ ID NO: 214544 - RNA, 62 nt, Homo Sapiens
cauuaaacugcagcucugggauugagauaauugggcauuaaacaccauguaagccuccuugu

SEQ ID NO: 214545 - RNA, 62 nt, Homo Sapiens
uggccaggugagcuguccccggccggacauuggggcauuacacccagaggaccgaggacagg

SEQ ID NO: 214546 - RNA, 62 nt, Homo Sapiens
aacagaccucucauucucucucaggcuagugggggcauuagguugaggguuuugcuggguuc

SEQ ID NO: 214547 - RNA, 62 nt, Homo Sapiens
agugaacuacucugagauuucuguagagccuugggcauuaucuaauacaaaucacucacuaa

SEQ ID NO: 214548 - RNA, 62 nt, Homo Sapiens
ggccugagguucucuaggaccggccgggaugggggcauuagauggagaggccgagcagcagc

SEQ ID NO: 214549 - RNA, 62 nt, Homo Sapiens
gaagaauauauuaaaauguguuucuucuuagugggcauuauguucaucauuuaucccauuua

SEQ ID NO: 214550 - RNA, 62 nt, Homo Sapiens
gcaauauaacagcgauaauaugggcuacuacugggcauuagugaaugauaaagaauagacca

SEQ ID NO: 214551 - RNA, 62 nt, Homo Sapiens
uaucauguacuucauaguuuuuacucaaauuagggcauuaaaccaagaaccgcugacuaaau

SEQ ID NO: 214552 - RNA, 62 nt, Homo Sapiens
uucuccagcagagcucuggccugguccaucuugggcauuaggccucagguuguuuggccucu

SEQ ID NO: 214553 - RNA, 62 nt, Homo Sapiens
gggacagagucagcucacacugggcucagccugggcauuaaagcagauacucaaggaggcac

SEQ ID NO: 214554 - RNA, 62 nt, Homo Sapiens
uuuccaguauaccucuucugucagagauccuggggcauuagcccucaggccugauauguucu

SEQ ID NO: 214555 - RNA, 62 nt, Homo Sapiens
uuauacaaacugaaaaugugaaacauaggucugggcauuaaauuguuaugaauaagaaaggc

SEQ ID NO: 214556 - RNA, 62 nt, Homo Sapiens
aauauuaaaagugcagacuuaagcccaucagugggcauuaaauuuuaaaaaguauugacaca

SEQ ID NO: 214557 - RNA, 62 nt, Homo Sapiens
gaguaaugaauuuuaaguauuugugugguaaagggcauuauuaguuugcaugguaaaggaca

SEQ ID NO: 214558 - RNA, 62 nt, Homo Sapiens
ucagaagcuacuuacugcuuuauguacucuuugggcauuaaugccuucucuguaauuauauc

SEQ ID NO: 214559 - RNA, 62 nt, Homo Sapiens
uuggucuuagcccuugggagcugacagcccaugggcauuaaggcaaaguaguuccagugauu

SEQ ID NO: 214560 - RNA, 62 nt, Homo Sapiens
aaaaccacacuggcuccaacuuccuccucauggggcauuacacuucaaaacaguggggagca

SEQ ID NO: 214561 - RNA, 62 nt, Homo Sapiens
uaaaacauuuuucaaaauugaaauauuuuccugggcauuaaaaaccuuuacuauuggcuaca

SEQ ID NO: 214562 - RNA, 54 nt, Homo Sapiens
aggagaaugggaagcugugacucugggcauuaucgacacguucacccaucuuau

SEQ ID NO: 214563 - RNA, 62 nt, Homo Sapiens
ccaggugaacuggaaugccuuggggcguggaagggcauuaggaguguuucauuugauaugug

SEQ ID NO: 214564 - RNA, 62 nt, Homo Sapiens
cagguugcauuuauuggauggggagcuccaaggggcauuagugguuugggcugggccuuuug

SEQ ID NO: 214565 - RNA, 62 nt, Homo Sapiens
gaagucaagggagaacagcauggacaauugcugggcauuaaucaguacaggugcauggccug

SEQ ID NO: 214566 - RNA, 62 nt, Homo Sapiens
aaaucuagagaucuaaaggguuggccuuauucgggcauuaggcuuaauuaauuauucuguau

SEQ ID NO: 214567 - RNA, 62 nt, Homo Sapiens
uggguuuaaucucggagccuuuccccggcuccgggcauuauuagggccuaggguugaaagcc

SEQ ID NO: 214568 - RNA, 62 nt, Homo Sapiens
ucaguggcuuugcauagcuuuaaaagagaucugggcauuaagggaggaacacagagaaaucc

SEQ ID NO: 214569 - RNA, 62 nt, Homo Sapiens
gucaccugacuugaggagcuuuugcaagagaggggcauuacuacuaaugacaguuuguucuc

SEQ ID NO: 214570 - RNA, 62 nt, Homo Sapiens
gauaauggaacugaacuuucacucaauuaauugggcauuaacaaccuucuuuuauguuuguu

SEQ ID NO: 214571 - RNA, 62 nt, Homo Sapiens
ucuaugcuauauuuugcuauucaaaauuuagugggcauuacuuaacauuguuucuaauuauu

SEQ ID NO: 214572 - RNA, 62 nt, Homo Sapiens
ggccuugcuuuuaaguggugcuguuucccauagggcauuaguucucagauuuuggaauguga

SEQ ID NO: 214573 - RNA, 62 nt, Homo Sapiens
ccauggucacugcuaagcaguagccagccaucgggcauuaauugauuuccuacuauauuccc

SEQ ID NO: 214574 - RNA, 62 nt, Homo Sapiens
guugcuaaaagaagaaaguucucuagcugccugggcauuacuagcaaugaauauuaaggacu

SEQ ID NO: 214575 - RNA, 62 nt, Homo Sapiens
agaagggagugggugcuggcgcuggaagcccugggcauuaggacccaagggugaggagaggg

SEQ ID NO: 214576 - RNA, 62 nt, Homo Sapiens
gcugcuguuuuaaaaggcucgcugauucuggggggcauuaaacaagccugugaugacauggu

SEQ ID NO: 214577 - RNA, 62 nt, Homo Sapiens
aauucccgcaaacuauaaagaguuucuguuuagggcauuaaagcaagccaugaggcuguugg

SEQ ID NO: 214578 - RNA, 62 nt, Homo Sapiens
uguucguuauagacauggacacuuuguggagagggcauuacuuccaaccuccauuucuguuc

SEQ ID NO: 214579 - RNA, 62 nt, Homo Sapiens
uagaugucuucacccugaauaauuuaauugaagggcauuaauccauuucuuauuuuccacca

SEQ ID NO: 214580 - RNA, 62 nt, Homo Sapiens
cuauguuaguuggcaccuuaagcguuauugaugggcauuaauaacagcaguugauaccuagc

SEQ ID NO: 214581 - RNA, 62 nt, Homo Sapiens
gacagucaccuuggugggaaugccagaggcaugggcauuagguccccccggccagccuccgu

SEQ ID NO: 214582 - RNA, 62 nt, Homo Sapiens
auuggauguuuccccacauuaaguaaaauaaugggcauuaucacugguguaauuuaaguaua

SEQ ID NO: 214583 - RNA, 62 nt, Homo Sapiens
auucuuuuguuauuaaaaaaauagucaauauggggcauuaauuugguuugcacauaaaacgu

SEQ ID NO: 214584 - RNA, 62 nt, Homo Sapiens
cugucaaugagguuaugagaaaaaaacagcaggggcauuaguuucaggcaaggcagcuccca

SEQ ID NO: 214585 - RNA, 62 nt, Homo Sapiens
gcuauaugcaucuuuuugguuugucaaaacgagggcauuacaaaaauuuagcuacuuucaaa

SEQ ID NO: 214586 - RNA, 62 nt, Homo Sapiens
uccaaacugggacacucuugagaguaaauggagggcauuauuaauaauuaucuuguaaugaa

SEQ ID NO: 214587 - RNA, 62 nt, Homo Sapiens
ccacugccacugggugacacagacugucguuugggcauuauuucauggcagaugggccaguc

SEQ ID NO: 214588 - RNA, 62 nt, Homo Sapiens
gggaacauuuccccaucagcaacggggcucuagggcauuauuaaguaggggugaaauaugau

SEQ ID NO: 214589 - RNA, 62 nt, Homo Sapiens
aggcuauuucugaugcuucaagaauaggggcagggcauuauuaaaauuuaaaauggaaggga

SEQ ID NO: 214590 - RNA, 62 nt, Homo Sapiens
uauuaauugcaugggucuaaaguggagaaaaggggcauuaggaauuagaugccauauuaguu

SEQ ID NO: 214591 - RNA, 62 nt, Homo Sapiens
aaaccaaauuucaacuuaagaccacacaaggugggcauuaacuccuucaaaacuguguuuug

SEQ ID NO: 214592 - RNA, 62 nt, Homo Sapiens
gugucagagaauaggaaaagcagcuuuguuuggggcauuaaugcuuggaguggggucagcua

SEQ ID NO: 214593 - RNA, 62 nt, Homo Sapiens
ucuguaagugcccaccgcgggaugccgggaaggggcauuauuugugcacugagaacaccgcg

SEQ ID NO: 214594 - RNA, 62 nt, Homo Sapiens
caaaggcauauuauaaaauagugucaucuugugggcauuauaaacaacugcuauuguaauaa

SEQ ID NO: 214595 - RNA, 62 nt, Homo Sapiens
uauguuuuuuuuuuugcauucaccuguaaaaugggcauuauuuuuuucauuguuuaaaaugu

SEQ ID NO: 214596 - RNA, 62 nt, Homo Sapiens
ucaaagauaugagauuuuuuuuuuuauuaggugggcauuauuuaugaccuuuucuguggaag

SEQ ID NO: 214597 - RNA, 62 nt, Homo Sapiens
aucagagauaugagagauucuuuuuuauaggugggcauuauuuaugccccuuucuguggaag

SEQ ID NO: 214598 - RNA, 62 nt, Homo Sapiens
gacaucuuccuauacaccgagcugccuaugaggggcauuaucugugagugauaaauuauagg

SEQ ID NO: 214599 - RNA, 62 nt, Homo Sapiens
gcugauagcuguguguguuaaaguugaggggggggcauuaguuuuucuauaagaaaaaggaa

SEQ ID NO: 214600 - RNA, 62 nt, Homo Sapiens
cuuagugauauuuguuuccucuuuauauguaugggcauuacuaacguggcucaacuagauau

SEQ ID NO: 214601 - RNA, 62 nt, Homo Sapiens
uauauguuguguaugaaguacagaaguuuucagggcauuaaauaaauaacucaguuuuuaag

SEQ ID NO: 214602 - RNA, 62 nt, Homo Sapiens
auaaaaacuagggauacaauagggauaucagugggcauuagaaugugggaaaauguaaaagc

SEQ ID NO: 214603 - RNA, 62 nt, Homo Sapiens
acuuacuuucuuugcuguaguuaugaaccuuggggcauuaaaaucccauggcaaggagcaua

SEQ ID NO: 214604 - RNA, 62 nt, Homo Sapiens
ugucuuuagcauuuucccucuucccuucuaaugggcauuauaauuguuucaucuacucugug

SEQ ID NO: 214605 - RNA, 62 nt, Homo Sapiens
uauguuuccuguuuuuacagcucaacaugaaagggcauuagcagcuuggaccuuuguagcac

SEQ ID NO: 214606 - RNA, 62 nt, Homo Sapiens
ugguuguuaugggggugcaccagaucauaggagggcauuauuuggaggaaaccgcuauaaug

SEQ ID NO: 214607 - RNA, 62 nt, Homo Sapiens
agggaguuaagagggccaaccuuagggcacgugggcauuauuaaaggucuuaaaagcauuga

SEQ ID NO: 214608 - RNA, 62 nt, Homo Sapiens
gugaguuguugacauuggacaggugaacaguagggcauuacauuugugugaauuaaauguga

SEQ ID NO: 214609 - RNA, 62 nt, Homo Sapiens
gcugugcagucccugcagcucucuuuccucuggggcauuauccaucuuucacuaucuguaau

SEQ ID NO: 214610 - RNA, 62 nt, Homo Sapiens
uuuuccauuuuuaugugccucacaggcuguuugggcauuaauuuugcuuuuugagccuuaag

SEQ ID NO: 214611 - RNA, 62 nt, Homo Sapiens
ugacuauauuuuuggagucccauuguuucagugggcauuaacagaaugcuuuaaaaacuucu

SEQ ID NO: 214612 - RNA, 62 nt, Homo Sapiens
agcuaaaagcugugguauguuaaggcaucuaugggcauuaugaguuuugaauggcauuucau

SEQ ID NO: 214613 - RNA, 62 nt, Homo Sapiens
gacgguuccuacacaggacagggguuccuucugggcauuacaucgcauagaaaucaauaauu

SEQ ID NO: 214614 - RNA, 62 nt, Homo Sapiens
uucuugcuaagagaaagaaaaacaaaaucagagggcauuaaauguuuuguaugugacaugau

SEQ ID NO: 214615 - RNA, 62 nt, Homo Sapiens
cccccuucgcuccuccucucaucauuugcauugggcauuaguguccccccuugaagcaauaa

SEQ ID NO: 214616 - RNA, 62 nt, Homo Sapiens
uauugagucuguccagauaaguuauuuauaaugggcauuacugaauuuuuaaaaugccgauu

SEQ ID NO: 214617 - RNA, 62 nt, Homo Sapiens
gccaagacaguaucagacacagccccagaagggggcauuaugggcccugccuccccauaggc

SEQ ID NO: 214618 - RNA, 62 nt, Homo Sapiens
ugaaagguaaguuggcucagaguugcacaguagggcauuaaauguuuaagcaaagcaucugc

SEQ ID NO: 214619 - RNA, 62 nt, Homo Sapiens
aauuuauaaaaauccaugcuuggcagaggucugggcauuauucugccugacgccacagucau

SEQ ID NO: 214620 - RNA, 62 nt, Homo Sapiens
uguggguacccggggagcacgcccugcccagggggcauuaggcacccuccagccaaggagca

SEQ ID NO: 214621 - RNA, 62 nt, Homo Sapiens
acugaaauuccugaguucuuggcacaccaccugggcauuaggguaugugugcccucccugug

SEQ ID NO: 214622 - RNA, 62 nt, Homo Sapiens
ccucagguccuaagaaauaaagcuguaugcaugggcauuacccauagaugacuuggaauaaa

SEQ ID NO: 214623 - RNA, 62 nt, Homo Sapiens
aaaucaguauauauuuuaacauacuauuaguugggcauuaaagaaauccagucuuuaugaau

SEQ ID NO: 214624 - RNA, 62 nt, Homo Sapiens
aaaguuuccguuugcacaagaaaauaacgcuugggcauuaaaugaaugccuuuauagauagu

SEQ ID NO: 214625 - RNA, 62 nt, Homo Sapiens
uguugugugugaauauguguuacaccuaggaugggcauuaugcaaaagcacaaagauuauau

SEQ ID NO: 214626 - RNA, 62 nt, Homo Sapiens
uacagugcuuuuuauuacugaacuucuucccagggcauuaugaaguauuggaguucaugucu

SEQ ID NO: 214627 - RNA, 62 nt, Homo Sapiens
cugcuaaaagcugguuagauuuugggugggcagggcauuaaagcagaagaggacgaaaugcc

SEQ ID NO: 214628 - RNA, 62 nt, Homo Sapiens
caagccggacugccccagucaagaaggugggagggcauuagucguguuggugagauuaaggg

SEQ ID NO: 214629 - RNA, 62 nt, Homo Sapiens
uauccaggacccauccucuugauaugaguccugggcauuauuguuauaaccuauggggucag

SEQ ID NO: 214630 - RNA, 62 nt, Homo Sapiens
aauaguaagccucccuccucuacuggggcugagggcauuaaaggucuccucugauuaucagg

SEQ ID NO: 214631 - RNA, 62 nt, Homo Sapiens
auccugacuuuuugagagcuuagaacuuugaagggcauuaugaucacacuguauaagcuacu

SEQ ID NO: 214632 - RNA, 62 nt, Homo Sapiens
aucuuuugguuguuuuguguaaguauuaguacgggcauuacauauuucaaagccaguuuaga

SEQ ID NO: 214633 - RNA, 62 nt, Homo Sapiens
cuugagcuaauguuaaaaaugcugagaguugggggcauuaaccgggcacccgucaugcuuuu

SEQ ID NO: 214634 - RNA, 62 nt, Homo Sapiens
ggcaauaauucuuauccagauauugcacguuggggcauuaggaaucacugauucacacagac

SEQ ID NO: 214635 - RNA, 62 nt, Homo Sapiens
uauauugcuacagcaucuagugcuuuuucugugggcauuaacccuuucuuucucugaauuac

SEQ ID NO: 214636 - RNA, 62 nt, Homo Sapiens
uagcaaagguuauuccuggacacaggaaagacgggcauuacagggaccaaagcucugaaagg

SEQ ID NO: 214637 - RNA, 62 nt, Homo Sapiens
uggccaggcugcugccaaggucaagcccucaagggcauuaccccgccuccucuucaucacug

SEQ ID NO: 214638 - RNA, 62 nt, Homo Sapiens
gguucuucccccacuucccccaugcagccuuggggcauuaugacauuucuggauugugguuc

SEQ ID NO: 214639 - RNA, 62 nt, Homo Sapiens
gucaacacaaaccugccuuugguguauaaacagggcauuacagaaugguacacccuauauau

SEQ ID NO: 214640 - RNA, 62 nt, Homo Sapiens
auagaguuaaagggaagugauguacauuucgggggcauuaggguagggagaugaaucaaaaa

SEQ ID NO: 214641 - RNA, 62 nt, Homo Sapiens
acagcccguguccgucugcucgugggccuggagggcauuaauauuacacucacaggugaggg

SEQ ID NO: 214642 - RNA, 62 nt, Homo Sapiens
aaguucauuccaguguuucauuuuaauaaugugggcauuauuaaauuuuuguggaagcuaau

SEQ ID NO: 214643 - RNA, 62 nt, Homo Sapiens
caaccccagcaauuuuuccaaaagccagucaagggcauuacauuuguuccugggacuggcag

SEQ ID NO: 214644 - RNA, 62 nt, Homo Sapiens
gcagauugguuggaucacagaaugugugucuggggcauuaucugaaacguggugucaucuga

SEQ ID NO: 214645 - RNA, 62 nt, Homo Sapiens
ucuaagagagaggagccuggacucaguuuccugggcauuaaggauuugcugcugaugaaaau

SEQ ID NO: 214646 - RNA, 62 nt, Homo Sapiens
agauacacacuggacccucucuugcugaaugugggcauuaauuuuuugacugcagcucugcu

SEQ ID NO: 214647 - RNA, 62 nt, Homo Sapiens
ccugguggggaucagacagagauuggagagaagggcauuaaccugucugggggccagcggca

SEQ ID NO: 214648 - RNA, 62 nt, Homo Sapiens
ugauuuuuuuucucucucucuuuguuacauaagggcauuauguaacacuagccgaaugguag

SEQ ID NO: 214649 - RNA, 62 nt, Homo Sapiens
aaaggggacuuuagaggacuucauacaaagcugggcauuaagaaaaccacaaugcauggccg

SEQ ID NO: 214650 - RNA, 62 nt, Homo Sapiens
uguccaugccagggaugccagaugccuuugcugggcauuauguaaaguaauggaacuuugau

SEQ ID NO: 214651 - RNA, 62 nt, Homo Sapiens
uugucugugauuccggguugucaggacccacggggcauuaucccgucaugcccgcuugaggg

SEQ ID NO: 214652 - RNA, 62 nt, Homo Sapiens
uuaauagacuuaauugccuaucaguauuuugggggcauuagggugccccaucauauuaacug

SEQ ID NO: 214653 - RNA, 62 nt, Homo Sapiens
gaagacuugugauagaucagugauucugcacugggcauuauguuuuguucuccagacuccag

SEQ ID NO: 214654 - RNA, 62 nt, Homo Sapiens
gggaagacaauggccauugugguuggggcaaggggcauuacucugggagcuacagggggcgu

SEQ ID NO: 214655 - RNA, 62 nt, Homo Sapiens
aucaccucuuaccacagcacauuggaugauuugggcauuacgacuucacuuuaugauagugu

SEQ ID NO: 214656 - RNA, 62 nt, Homo Sapiens
caacaaauaaucuaggauuuguguaagcucuugggcauuauagguuaaaaugccauuuuauu

SEQ ID NO: 214657 - RNA, 62 nt, Homo Sapiens
aaaaaaaucaaugguggggacuguacauccuggggcauuaaaguguggaauauggggguuau

SEQ ID NO: 214658 - RNA, 62 nt, Homo Sapiens
cccgggaggaguuaacuuugcgccggccgucagggcauuaccgcuaacgucugcaggagcuu

SEQ ID NO: 214659 - RNA, 62 nt, Homo Sapiens
ccuacuaugugcccagcccuguucuaggcacugggcauuaccauagagaacaaaauagacaa

SEQ ID NO: 214660 - RNA, 62 nt, Homo Sapiens
uaugaccuuuucuuuggaaguuuuuuuuaggugggcauuauuucaaagauaggagaguuucu

SEQ ID NO: 214661 - RNA, 62 nt, Homo Sapiens
guuucuuuugaucucuugauugaaggaggauagggcauuaaagugcuuuugacaugaggaau

SEQ ID NO: 214662 - RNA, 62 nt, Homo Sapiens
caccauuguagccaccugugauccucccaacugggcauuaccaagaccccgucuaacacugc

SEQ ID NO: 214663 - RNA, 62 nt, Homo Sapiens
ugggcuauuggggaaaugugcaguugaggggagggcauuaccuguuuagggaacagagaugc

SEQ ID NO: 214664 - RNA, 62 nt, Homo Sapiens
uuguuagaggaccuuaaaauagugauucacuggggcauuauugucaaacaacuuauaagacu

SEQ ID NO: 214665 - RNA, 62 nt, Homo Sapiens
auuauuauuucuuuuguuacuaauaaagccccgggcauuauucucugagcagugauauagca

SEQ ID NO: 214666 - RNA, 62 nt, Homo Sapiens
auuucauuaugugcaauaaggcuaagagaauugggcauuagucuugcuuuuggcaggauaga

SEQ ID NO: 214667 - RNA, 62 nt, Homo Sapiens
gucagugaguggugaaugaaugugaaggccuagggcauuacuguauacuacuguaggcuuua

SEQ ID NO: 214668 - RNA, 62 nt, Homo Sapiens
agaugaagggugauuauguaaaggagaggaaggggcauuaagcaucugugucuccugugcag

SEQ ID NO: 214669 - RNA, 62 nt, Homo Sapiens
ccuucuaaauucccaaauccuagacugcuccugggcauuagcaaggcagagccuuuuuaccu

SEQ ID NO: 214670 - RNA, 62 nt, Homo Sapiens
caugcugggcauccuaggccacuuugcuuagagggcauuaaaggugccaugaaagguagacu

SEQ ID NO: 214671 - RNA, 62 nt, Homo Sapiens
acuuugugcucauaaauuggagugccaauugagggcauuaguuuuagagauaauugcuugcc

SEQ ID NO: 214672 - RNA, 61 nt, Homo Sapiens
gcaaaggcuucugaagaagaggaagggcgaguaggggcaccuggacgcugaugguggccag

SEQ ID NO: 214673 - RNA, 61 nt, Homo Sapiens
gaccacuacuccaaacaaaacacaauaugccuaggggcacggaugaacguccagggagccc

SEQ ID NO: 214674 - RNA, 61 nt, Homo Sapiens
ggugggguggggugagcuggcuuuggaauucuaggggcaugaggguauuuuuuagguucua

SEQ ID NO: 214675 - RNA, 61 nt, Homo Sapiens
aaccugagagugggggagcuaagccaugagguaggggcaggcaagagagaggauucagacg

SEQ ID NO: 214676 - RNA, 61 nt, Homo Sapiens
auugugguguacuauauuugugagccuaggguaggggcacugcugcaacuucugcuuucau

SEQ ID NO: 214677 - RNA, 61 nt, Homo Sapiens
augguuuauuucccaguuuaacaguucagaauaggggcauuuauuuuaucauauuuuaggg

SEQ ID NO: 214678 - RNA, 61 nt, Homo Sapiens
uauauaguugacacuugaaaaaugcaggugguaggggcacugacccaccccuacgccccgc

SEQ ID NO: 214679 - RNA, 61 nt, Homo Sapiens
caucagcgcaauacuugaaccuucucccagguaggggcaggaggagccacaugagagaggg

SEQ ID NO: 214680 - RNA, 61 nt, Homo Sapiens
aggcaugauugguggggagggaauguguauuuaggggcauaauaaaaagguggcucgaagc

SEQ ID NO: 214681 - RNA, 61 nt, Homo Sapiens
aacaaaacaaagaaaaagagcuuugagucuguaggggcagcaauuugggggaagcaaauau

SEQ ID NO: 214682 - RNA, 61 nt, Homo Sapiens
ggaaagccuuuacaaauuacucucaguucuuuaggggcagaaggcuuguuucaagagguuu

SEQ ID NO: 214683 - RNA, 61 nt, Homo Sapiens
ucugcauggugaccccacauguauuuuacccuaggggcaggacagguguugggggcagccu

SEQ ID NO: 214684 - RNA, 61 nt, Homo Sapiens
cacagaugauucauggauggugauguggaaauaggggcacacccaccugaagcccugggga

SEQ ID NO: 214685 - RNA, 55 nt, Homo Sapiens
ugggugaucucuaagcugcacuagguaggggcagggcgcugagcagaaugaguag

SEQ ID NO: 214686 - RNA, 61 nt, Homo Sapiens
gcuggugaggaggucugggcggggcucucccuaggggcauaauggggccgguuggagggca

SEQ ID NO: 214687 - RNA, 61 nt, Homo Sapiens
ucuaaagaccagcuguuaaggaaaaaauagauaggggcagcccuaguggucguggggcaca

SEQ ID NO: 214688 - RNA, 61 nt, Homo Sapiens
gaggcaguggcgccuuauggaaccaaaguuguaggggcauggacuuggggccuccauucau

SEQ ID NO: 214689 - RNA, 61 nt, Homo Sapiens
uggcauggucagguaacacuugcaguugggguaggggcagcccaugugcccugcuccugug

SEQ ID NO: 214690 - RNA, 61 nt, Homo Sapiens
acgacaaaaguaccuuugaaugauagaagaauaggggcaagauuuuuaaaaggacuauuga

SEQ ID NO: 214691 - RNA, 61 nt, Homo Sapiens
aguuuugaaugcacuuaaccacuaggaguguuaggggcagacagcugccaaguaggacaug

SEQ ID NO: 214692 - RNA, 61 nt, Homo Sapiens
ucugugucugagugugccuggacuggagcucuaggggcaucgugugugugcaaaucugugu

SEQ ID NO: 214693 - RNA, 61 nt, Homo Sapiens
uggccccucacaucacaagcguagaugccucuaggggcacaaagucaggagcaaaacccaa

SEQ ID NO: 214694 - RNA, 61 nt, Homo Sapiens
acaguuccauucuagagggaauacagguagcuaggggcaacgaacaacuacauuuucucau

SEQ ID NO: 214695 - RNA, 61 nt, Homo Sapiens
cuaucucccccaacccaccucuggcccuguguaggggcagggauggggguggcugggacuc

SEQ ID NO: 214696 - RNA, 61 nt, Homo Sapiens
ggccaauugacauauaauuuguucuuaaaaauaggggcaugaaauaugugaucuggaaaag

SEQ ID NO: 214697 - RNA, 61 nt, Homo Sapiens
ccagagcccuguggcuccccacacccugccauaggggcaguccugccuuacacauagaagc

SEQ ID NO: 214698 - RNA, 61 nt, Homo Sapiens
aaaauagaucaaugaauauaauucagucuuuuaggggcaccaaguaaagcauaaggucaua

SEQ ID NO: 214699 - RNA, 61 nt, Homo Sapiens
gcgucucccccaccagccccaccaggcgguguaggggcagcaggcugcacugaggaccgug

SEQ ID NO: 214700 - RNA, 61 nt, Homo Sapiens
uuuuuauggaccauaaagguuuaaaagaaaauaggggcacaggcuguugagguuuuuaugu

SEQ ID NO: 214701 - RNA, 61 nt, Homo Sapiens
aggcugcagggugaggccaggcaggccuggguaggggcagcuucuggagccuugggacaga

SEQ ID NO: 214702 - RNA, 61 nt, Homo Sapiens
cugaaugccucccucaaaggaaggugucuccuaggggcagcguucucaggaccuguucaag

SEQ ID NO: 214703 - RNA, 61 nt, Homo Sapiens
ccauguaagcugaggauuggggugguaggcauaggggcaaguggauggaagagcuauaaga

SEQ ID NO: 214704 - RNA, 61 nt, Homo Sapiens
aaugcugaaggacacagcaaauuugaccuuuuaggggcagcuccacuucagucuuaggcag

SEQ ID NO: 214705 - RNA, 61 nt, Homo Sapiens
gaggagcuuccucauucuggaguaguuccuauaggggcauugguuugcauuaacuuuucaa

SEQ ID NO: 214706 - RNA, 61 nt, Homo Sapiens
guuaacugacuucacuaggcauugugauguuuaggggcaaacaucacaaaauguaauuuaa

SEQ ID NO: 214707 - RNA, 61 nt, Homo Sapiens
ccuagccaaguuuaagaggcaaguaaaaauauaggggcaaugucagaugaagucuuguuca

SEQ ID NO: 214708 - RNA, 61 nt, Homo Sapiens
aucuugaacagcccaaaguaucauucucagauaggggcacccaagcuaaggguauuagcca

SEQ ID NO: 214709 - RNA, 61 nt, Homo Sapiens
aaggaaaugaaugugcauuuuauuaauuccuuaggggcacaaggaggacaauaauagcuga

SEQ ID NO: 214710 - RNA, 61 nt, Homo Sapiens
ccugcugcuguuaccagccaugugggccccauaggggcacugcgccugcugcccuuuccug

SEQ ID NO: 214711 - RNA, 61 nt, Homo Sapiens
acagcuguguuacugcuuggagaagcauauguaggggcauacccugugguguugugcugug

SEQ ID NO: 214712 - RNA, 61 nt, Homo Sapiens
auuuuuguuaaagagcacuugguggagguaguaggggcagggaaaggucagcauaggagag

SEQ ID NO: 214713 - RNA, 61 nt, Homo Sapiens
ucucauaaugugaaauaugaugagauucacuuaggggcagcauguuaguuuugggaggcaa

SEQ ID NO: 214714 - RNA, 61 nt, Homo Sapiens
uuuuugguugucauauuuacugagaaauguguaggggcacuccugucauuccagaggaugc

SEQ ID NO: 214715 - RNA, 61 nt, Homo Sapiens
guccauucuguuaggauuauuucacuguaacuaggggcauaacuccuaauuaauucccaca

SEQ ID NO: 214716 - RNA, 61 nt, Homo Sapiens
aguagaauggacaauuuccauuuuaaucaauuaggggcaauauccaguuuuuuguuguuau

SEQ ID NO: 214717 - RNA, 61 nt, Homo Sapiens
ucuugaauucuggccaagaaguaggauuaguuaggggcagacuguaaggguacugggagaa

SEQ ID NO: 214718 - RNA, 61 nt, Homo Sapiens
ggugggcuggcaggaggccuaggccuugcccuaggggcaguccugcuuccucauuuuauag

SEQ ID NO: 214719 - RNA, 61 nt, Homo Sapiens
ugguuuuuuuuauugggcugaguucacgaauuaggggcaggagcuggaagucgcccuagga

SEQ ID NO: 214720 - RNA, 61 nt, Homo Sapiens
aaguuaaaauuagauaugagaauguuuugcguaggggcaacacagucugcugcuauauagu

SEQ ID NO: 214721 - RNA, 61 nt, Homo Sapiens
gcacugaaaaccccucuggucucagagacaguaggggcagugccacuuucuacaaccugcc

SEQ ID NO: 214722 - RNA, 61 nt, Homo Sapiens
augaggaauauaacauugcagaaauuucucauaggggcaugccagugagcaauuacuuuau

SEQ ID NO: 214723 - RNA, 61 nt, Homo Sapiens
agagaauggcauggaagagacucacacauuauaggggcaucauagggacuauuguaauacc

SEQ ID NO: 214724 - RNA, 61 nt, Homo Sapiens
ccuguguugaguauuuguguauacaagggaguaggggcagaaaauaaacacauuucuaaca

SEQ ID NO: 214725 - RNA, 61 nt, Homo Sapiens
caaaguucugguuaucuaugagaagaaugauuaggggcaccuuucccucuuagaaaaucuc

SEQ ID NO: 214726 - RNA, 61 nt, Homo Sapiens
gccaguucugacaguguuuuggaggugaucauaggggcauaacauuaaauaccagccagca

SEQ ID NO: 214727 - RNA, 61 nt, Homo Sapiens
gaucaacaaaauaauucuaaauacucuuccauaggggcaucuauucaaaaugcuugcauga

SEQ ID NO: 214728 - RNA, 61 nt, Homo Sapiens
accuuaugcaaacauuucugugccugcuggguaggggcacgucugaggggcccugcuccaa

SEQ ID NO: 214729 - RNA, 61 nt, Homo Sapiens
gcauuauuaggcuauuucuggaagggaagaauaggggcagguuuuuuaaaaauuuaaaaug

SEQ ID NO: 214730 - RNA, 61 nt, Homo Sapiens
uacaacuauucuuaaugcuugaacauguauuuaggggcaaguuucucaugaugaugaaaaa

SEQ ID NO: 214731 - RNA, 61 nt, Homo Sapiens
ugacuucaugaguuacacagaugcuaauucguaggggcacuuggaaucacaugguuguuuu

SEQ ID NO: 214732 - RNA, 61 nt, Homo Sapiens
gagugccuguguagcuggggauggggauuccuaggggcagaugaaggacaagccccacugg

SEQ ID NO: 214733 - RNA, 61 nt, Homo Sapiens
gcagcucccagugugaccugacaaaaacacguaggggcagggacgguccccacccccaggg

SEQ ID NO: 214734 - RNA, 61 nt, Homo Sapiens
cauacauugcugaggaccugacaggacaaccuaggggcagggcugggguggggaccgcagg

SEQ ID NO: 214735 - RNA, 61 nt, Homo Sapiens
acauaguuuguggggaaaacaaacguucagcuaggggcaaaaagcaugacugcuuuuuccu

SEQ ID NO: 214736 - RNA, 61 nt, Homo Sapiens
gugaaggcuucagcucacugggccagagugcuaggggcaggcugcuggcagggccaggcaa

SEQ ID NO: 214737 - RNA, 61 nt, Homo Sapiens
agaaaagcacauaauggaugaccaugaucccuaggggcaugaaauauauacuugaccaagc

SEQ ID NO: 214738 - RNA, 61 nt, Homo Sapiens
acaaagagagaaagaaaacccaguguuuccauaggggcacuuuuagccuucccacaacagu

SEQ ID NO: 214739 - RNA, 61 nt, Homo Sapiens
auguguuucucuggagaagggcacauuuaucuaggggcauuucagguuuccaaagaaagga

SEQ ID NO: 214740 - RNA, 61 nt, Homo Sapiens
uauucuugcaguuuuaaguggaugcuaauuuuaggggcauaagccuuuuauggcccucuug

SEQ ID NO: 214741 - RNA, 61 nt, Homo Sapiens
cguaagagaugggguugcugcaguguuggaguaggggcagagggagggagccaaggucacu

SEQ ID NO: 214742 - RNA, 61 nt, Homo Sapiens
cuagcaaaaucaggcagcucugccccaucgguaggggcaccgauuagucuacuaacagcca

SEQ ID NO: 214743 - RNA, 61 nt, Homo Sapiens
guccaucggguccugggccuccuccccugccuaggggcaaagcugccauggcuccaggcuc

SEQ ID NO: 214744 - RNA, 61 nt, Homo Sapiens
gagacuggcuuuucaaacugugagucugauguaggggcaaacucguccucuuccauaaggc

SEQ ID NO: 214745 - RNA, 61 nt, Homo Sapiens
uccguuuucucacuguuggacuccaggaccuuaggggcagacugaccaccgauugagacgu

SEQ ID NO: 214746 - RNA, 61 nt, Homo Sapiens
agugagagaaugagccaaccgguuucaaauuuaggggcagauugggcaaugaggaaggaaa

SEQ ID NO: 214747 - RNA, 61 nt, Homo Sapiens
aggugcuuuguaaucuggaauggagaagagguaggggcauuuggggauuccuguuuacuug

SEQ ID NO: 214748 - RNA, 61 nt, Homo Sapiens
cucugaaguuauaaugcuuuggucucuacauuaggggcaagauccagucugagagaagucu

SEQ ID NO: 214749 - RNA, 61 nt, Homo Sapiens
ucucuccugcucacccgccucuugccccuucuaggggcaggugaaaggaauaggaaauuga

SEQ ID NO: 214750 - RNA, 61 nt, Homo Sapiens
aucuuuguuuaaauaagguuaguacauucacuaggggcaaauggguuuuucuaaauaaaug

SEQ ID NO: 214751 - RNA, 61 nt, Homo Sapiens
ugcaaaugggaaaaaaguuuacauuucaguuuaggggcauaucuaagcuaugcuauucccu

SEQ ID NO: 214752 - RNA, 61 nt, Homo Sapiens
gggcuugacaccugacucugagcuggaacaguaggggcagggagaagacaggucucaagaa

SEQ ID NO: 214753 - RNA, 61 nt, Homo Sapiens
caucacccggcuugccuguggcuggcuuugguaggggcacccaggugccguggagcagcag

SEQ ID NO: 214754 - RNA, 61 nt, Homo Sapiens
guauaaggaaauaucauaauaauucugucaguaggggcaugucuguugguuaguagacacu

SEQ ID NO: 214755 - RNA, 61 nt, Homo Sapiens
agucucaggggguguaaacuaaaugcugucauaggggcagcauuugacuaucuugggggua

SEQ ID NO: 214756 - RNA, 61 nt, Homo Sapiens
uuccucuugcaguguccacaaaucugaauauuaggggcaugaaauuaggcuuaccaucuga

SEQ ID NO: 214757 - RNA, 61 nt, Homo Sapiens
cucuggaagggcugguucaacagugggccacuaggggcaguucuucacagccugcacugcc

SEQ ID NO: 214758 - RNA, 61 nt, Homo Sapiens
ggcugauggccucuaccuuucuuuccucuucuaggggcaaaaaugaguacagauaauuuca

SEQ ID NO: 214759 - RNA, 61 nt, Homo Sapiens
cugggcagcaggaaggaagggccggacccgguaggggcaguuuacuuagaccucagccggc

SEQ ID NO: 214760 - RNA, 61 nt, Homo Sapiens
uccugacuacacuaagucaguacaagugauuuaggggcagauuguuguuuguuuguuuucc

SEQ ID NO: 214761 - RNA, 61 nt, Homo Sapiens
ugagauaagaagaagaauaauuugggagaaauaggggcacguuuacucuccuugucacuua

SEQ ID NO: 214762 - RNA, 61 nt, Homo Sapiens
uuguauggcagaugcaccuggcgaucagggauaggggcaggcagucuggggucagggauca

SEQ ID NO: 214763 - RNA, 61 nt, Homo Sapiens
uccgagagccccuuuuugugggagccuaggcuaggggcaccgggcuggggccugggccuca

SEQ ID NO: 214764 - RNA, 61 nt, Homo Sapiens
gcuuauugguaugaaauagaagguggcuuuguaggggcaagcaggcaaagaguacuaucca

SEQ ID NO: 214765 - RNA, 61 nt, Homo Sapiens
ggagucagauggcaauggguacuccagcagguaggggcacagugaauguguguauguauga

SEQ ID NO: 214766 - RNA, 61 nt, Homo Sapiens
cugugugugugucugaguugugugauuuuauuaggggcaucugccaauucucucacugugg

SEQ ID NO: 214767 - RNA, 61 nt, Homo Sapiens
ucuaccugcccucaaggguguguauauuguauaggggcaacuguaugaaaaauuggggagg

SEQ ID NO: 214768 - RNA, 61 nt, Homo Sapiens
gcuuugguucuucagaugcucuugggguucauaggggcagguccuagucgggcagggcccc

SEQ ID NO: 214769 - RNA, 61 nt, Homo Sapiens
ugaguugagucuccucucugagacugcuaaguaggggcagugaugguugccaggacgaauu

SEQ ID NO: 214770 - RNA, 61 nt, Homo Sapiens
uaaacgauggggauggaugaucccgccucuguaggggcauggcugcuauuaucuggaaauu

SEQ ID NO: 214771 - RNA, 61 nt, Homo Sapiens
cagagggccuuugcuacacugaguugggcguuaggggcaggccaugacugaggcaggcaug

SEQ ID NO: 214772 - RNA, 61 nt, Homo Sapiens
caggcgcugugcuaucaugaaaaggaacauuuaggggcaagacugacaugauuagcagaag

SEQ ID NO: 214773 - RNA, 61 nt, Homo Sapiens
uuuuucacaccucccugucucaucacuacauuaggggcaauuggugcuuuuuaaaaaacac

SEQ ID NO: 214774 - RNA, 61 nt, Homo Sapiens
agcccugaacgguugagagccccugccuucuuaggggcaucucacccuggaaaauacagug

SEQ ID NO: 214775 - RNA, 61 nt, Homo Sapiens
ggauugcacagagcuggagggaggggugagauaggggcagauaggagcugcaggggugccu

SEQ ID NO: 214776 - RNA, 61 nt, Homo Sapiens
uggaauuauaauucagaaucaucuugguagauaggggcacugugcuuaaacaaaaugccau

SEQ ID NO: 214777 - RNA, 61 nt, Homo Sapiens
cucguacugagaggaggugauaugccuggcuuaggggcaacggggagggagaaaauggggc

SEQ ID NO: 214778 - RNA, 61 nt, Homo Sapiens
gaaaggacugggccagggcaauagggugggguaggggcagguuuacaugauuugaugugca

SEQ ID NO: 214779 - RNA, 61 nt, Homo Sapiens
guagguccuggggcagccccacugaaggggguaggggcaguucuggcagcacugaagagcc

SEQ ID NO: 214780 - RNA, 61 nt, Homo Sapiens
agcccccagcuccacgccugcgccuacacaguaggggcaguggagacuauggggagcccac

SEQ ID NO: 214781 - RNA, 61 nt, Homo Sapiens
cagucuguagcaguugaagcugugaaugugcuaggggcaagcauuugucuuuguauguggu

SEQ ID NO: 214782 - RNA, 61 nt, Homo Sapiens
aagucugucuagggugggauugucagaggucuaggggcacugugggccuagugaagccuac

SEQ ID NO: 214783 - RNA, 61 nt, Homo Sapiens
aauucuuauccagacaugggcguuggggcauuaggggcaaugauucacacagacuauugca

SEQ ID NO: 214784 - RNA, 58 nt, Homo Sapiens
agcugggccuucgaggcgcacacagggcuaggggcagccuggcugugaaggcagcuga

SEQ ID NO: 214785 - RNA, 61 nt, Homo Sapiens
cacagaggggaggggaauguuuuggcaaguuuaggggcacaggagauguagucguuccagg

SEQ ID NO: 214786 - RNA, 61 nt, Homo Sapiens
agaaaacauucccucuugcaauggcaagaacuaggggcaguucucugucccuccucccaac

SEQ ID NO: 214787 - RNA, 61 nt, Homo Sapiens
cccagaggguagagugccuccuguggaaguuuaggggcaaauuuguucccugaccuggaga

SEQ ID NO: 214788 - RNA, 61 nt, Homo Sapiens
gcaagccucuccuccaccuucaccccaagacuaggggcaggaaugauaagaaggcugggug

SEQ ID NO: 214789 - RNA, 61 nt, Homo Sapiens
gggacccugggggcgggcauggaaguggaaguaggggcaagcucuugccccacucccuggc

SEQ ID NO: 214790 - RNA, 61 nt, Homo Sapiens
cuacagagcagcuccccagguugccccaagauaggggcacagagucagaugagcaaggaca

SEQ ID NO: 214791 - RNA, 61 nt, Homo Sapiens
cauccccaagcaccuccucaaaggccacucauaggggcaucaccucugaguuugcccacuc

SEQ ID NO: 214792 - RNA, 61 nt, Homo Sapiens
guaauuuuuaccaaaacugagauugagaauuuaggggcauggcucauauuuuuauaauucu

SEQ ID NO: 214793 - RNA, 61 nt, Homo Sapiens
cuuauuuugggacuucaguucucgugguccauaggggcagagaugucaaagugaagguugc

SEQ ID NO: 214794 - RNA, 61 nt, Homo Sapiens
cccagccucucccccacauugucccugacucuaggggcacauccagucuccaucgugcugc

SEQ ID NO: 214795 - RNA, 61 nt, Homo Sapiens
acacuucggcagggucaccaggaggcacagcuaggggcaugcucacauggguaggucaguu

SEQ ID NO: 214796 - RNA, 61 nt, Homo Sapiens
gcagagguauucaguuccuggcacaggggacuaggggcauguagaguauaugaggaggcag

SEQ ID NO: 214797 - RNA, 61 nt, Homo Sapiens
guucauucuccugcuuuaaaccuaagaagcuuaggggcaaguguggcuggccucagauaca

SEQ ID NO: 214798 - RNA, 61 nt, Homo Sapiens
uaauaauggaaugcuacuaacaucauguauuuaggggcaaguuaucugugcagggggcugg

SEQ ID NO: 214799 - RNA, 61 nt, Homo Sapiens
gaaauuuacucccaccaccauacauuuuaaauaggggcauuaaucuguuuaauguuaucag

SEQ ID NO: 214800 - RNA, 61 nt, Homo Sapiens
cucaugggacagcuagccaggcaugguuggauaggggcagggcacucauuaaagugcauca

SEQ ID NO: 214801 - RNA, 61 nt, Homo Sapiens
ugcugcgcccugccucggccuugcgccuguguaggggcagcucggccucuggucgccuugg

SEQ ID NO: 214802 - RNA, 61 nt, Homo Sapiens
gugggaauucccgcggccuccaccugcuugcuaggggcaggaucucauucaggcugcccug

SEQ ID NO: 214803 - RNA, 61 nt, Homo Sapiens
accuuccccuacucugccucggagaaucucauaggggcaggugucaucuugcaugcaauca

SEQ ID NO: 214804 - RNA, 61 nt, Homo Sapiens
gaaacucgaauaaaggauggcggggcuaggguaggggcaaguagcuggccaacgucagggu

SEQ ID NO: 214805 - RNA, 61 nt, Homo Sapiens
agcagacaucucugguagcagccuuuaucguuaggggcaaaacaccacugaugccacagaa

SEQ ID NO: 214806 - RNA, 61 nt, Homo Sapiens
gaaaugucucugcuccuacauccagcuccucuaggggcagccuccgucauccaugcccucc

SEQ ID NO: 214807 - RNA, 61 nt, Homo Sapiens
gucuagauuuuuucagaaaaacguggagugcuaggggcagccuggaaaagauggggaaccu

SEQ ID NO: 214808 - RNA, 61 nt, Homo Sapiens
accaugaggaaauaaucagacaaauccacauuaggggcauucugcuaaacaucugacccag

SEQ ID NO: 214809 - RNA, 61 nt, Homo Sapiens
ucgauugcugugagcagaggccacucggaguuaggggcaugggcaauagcaagcuggcggc

SEQ ID NO: 214810 - RNA, 61 nt, Homo Sapiens
accgcugauguuugccuugucaauaucagaauaggggcaucagugucccgugaaauacauu

SEQ ID NO: 214811 - RNA, 61 nt, Homo Sapiens
gucugggccgaagcacguccgagcaugccuuuaggggcaguuagugggacccgugggguug

SEQ ID NO: 214812 - RNA, 61 nt, Homo Sapiens
guuaauuuugaaaaggugugcccaguuggacuaggggcaguggcuggagccuucuccccuc

SEQ ID NO: 214813 - RNA, 61 nt, Homo Sapiens
auggagggcugagcccugugcucagcccagguaggggcaggggcuggcaggggccaguggg

SEQ ID NO: 214814 - RNA, 61 nt, Homo Sapiens
uucuuuaacuuccagaauagcuuugccuuccuaggggcauugagccauacucuggcugccu

SEQ ID NO: 214815 - RNA, 61 nt, Homo Sapiens
aaaugaaugaaagcuuuagcucuacuauuuuuaggggcaugauaaaauacauuuuuugcau

SEQ ID NO: 214816 - RNA, 61 nt, Homo Sapiens
aaacaacucugaaagugguagggaacaguuguaggggcagagagaacuuguaaugguguua

SEQ ID NO: 214817 - RNA, 61 nt, Homo Sapiens
ccuccaaucccaccggacccaggcccugggcuaggggcagagcaggccccgccccagggca

SEQ ID NO: 214818 - RNA, 61 nt, Homo Sapiens
uauuuauuccccuuuagguuugcagaggggguaggggcagagucaggggcuggccagaggg

SEQ ID NO: 214819 - RNA, 61 nt, Homo Sapiens
cgugcagcugaccugcccuccagcccaggacuaggggcaggacucuugccugaacccccag

SEQ ID NO: 214820 - RNA, 61 nt, Homo Sapiens
ggggcuaucccuacaaagaagaauccagaaauaggggcacauugaggaaugauacugagcc

SEQ ID NO: 214821 - RNA, 61 nt, Homo Sapiens
aauccagcccuuaaaucccccccaacauuuguaggggcacucuaaccaugaucuugaggga

SEQ ID NO: 214822 - RNA, 61 nt, Homo Sapiens
auagccccaggccacccuagucccucaacucuaggggcagcgccagccuccccagcccccu

SEQ ID NO: 214823 - RNA, 61 nt, Homo Sapiens
ucccuucaucuguccugggaagaaacaaccauaggggcagaacugagacucugauucagcg

SEQ ID NO: 214824 - RNA, 61 nt, Homo Sapiens
agccaccgcacccagcuugcaguguuaggauuaggggcaugcgcccgccucagccucccaa

SEQ ID NO: 214825 - RNA, 61 nt, Homo Sapiens
cuuggggccgugguggcccuaucugugugcauaggggcacugaagaauuacaaagugauuu

SEQ ID NO: 214826 - RNA, 58 nt, Homo Sapiens
ucuauggcaaagcuauagguagggcauuuaggggcauuuauucaccucugcucucuga

SEQ ID NO: 214827 - RNA, 61 nt, Homo Sapiens
uccuguguucucucccucucagucaguggccuaggggcagguuguggguuuuauccugcuc

SEQ ID NO: 214828 - RNA, 61 nt, Homo Sapiens
ucagaagggcugcguguagcugaacccagguuaggggcagauccuuacaucuaggcccagc

SEQ ID NO: 214829 - RNA, 61 nt, Homo Sapiens
caugggccccagccaggacagcuguugggguuaggggcagcucccagggagccagaccugu

SEQ ID NO: 214830 - RNA, 61 nt, Homo Sapiens
gccucaacauggagccuugccuggccugggcuaggggcacugucugaacuccugacuguca

SEQ ID NO: 214831 - RNA, 61 nt, Homo Sapiens
uucuguacugucuugguuagcucuauauaaguaggggcagcuuagcccugaggcccagaga

SEQ ID NO: 214832 - RNA, 61 nt, Homo Sapiens
agugcgagcuggcugacaaucaaggcuagucuaggggcaaggcucugaagcugccuucaga

SEQ ID NO: 214833 - RNA, 61 nt, Homo Sapiens
agacagacacguaacaggaacaggaaagauuuaggggcaggcuggggaaagggaugggagc

SEQ ID NO: 214834 - RNA, 61 nt, Homo Sapiens
gaggcaacacugcuguccacggagacugugguaggggcagguuggaguggccaaauaggag

SEQ ID NO: 214835 - RNA, 61 nt, Homo Sapiens
ucuugccuugaggcucugcaguggcaaaugguaggggcaauagcgcucccuuuucaccuga

SEQ ID NO: 214836 - RNA, 61 nt, Homo Sapiens
cuuacugaagaacauucccagugccccuggcuaggggcagagggcacugccaggcuguguu

SEQ ID NO: 214837 - RNA, 61 nt, Homo Sapiens
ucagaggcagaaccuagucuuguuguucauauaggggcaaaaauuugacauugucagaaug

SEQ ID NO: 214838 - RNA, 61 nt, Homo Sapiens
gccaagaccuuucaaagccauuuuaggcuguuaggggcaguggagguagaaugacuccuug

SEQ ID NO: 214839 - RNA, 61 nt, Homo Sapiens
uauccagaagccuaggagaucccagugcaguuaggggcagacacaggugugugcaguugcu

SEQ ID NO: 214840 - RNA, 64 nt, Homo Sapiens
guaaaggagaacagcuauauuguccuuucuauaagcuugucacugcaaaaaguugccuuuugcu

SEQ ID NO: 214841 - RNA, 64 nt, Homo Sapiens
ucuauaagcuugucacugcaaaaaguugccuuuugcuugucagguuuggauagaauauaauuga

SEQ ID NO: 214842 - RNA, 64 nt, Homo Sapiens
cuugguuaauuaaguaaccuaaaguaugcauuaggauugugaaaugucucgugaguaugccaau

SEQ ID NO: 214843 - RNA, 64 nt, Homo Sapiens
uuuaaauuacaacucuuguuauaacuuuuuaaaagauugugaaaauaucaaaauauaaaugaau

SEQ ID NO: 214844 - RNA, 64 nt, Homo Sapiens
cugcccuccagccugggugacugcagugugcugugauugugacauugagcccaggaggucgagg

SEQ ID NO: 214845 - RNA, 64 nt, Homo Sapiens
agagcauuuauauuggacuagaaaaagauaaagggauugugaaaaaaaaaaaaaaaaaagaaaa

SEQ ID NO: 214846 - RNA, 64 nt, Homo Sapiens
aggaaaaaagagaacaucaccuuguaaaacugaagauugugaccagucagaauaaugucaaagu

SEQ ID NO: 214847 - RNA, 64 nt, Homo Sapiens
auugcacuugucccggccuguugaguuugguggggauugugaccagaagauuuugaaaauuaaa

SEQ ID NO: 214848 - RNA, 64 nt, Homo Sapiens
ugcuaccauaguaauuaauguuuccaguuaucaagauugugauuagacacauuuaccuuucuuc

SEQ ID NO: 214849 - RNA, 64 nt, Homo Sapiens
ggggauugcgaugauugaucugggaacauggcuggauugugauuuaaccaagaaugcugauguu

SEQ ID NO: 214850 - RNA, 64 nt, Homo Sapiens
ggccucauccuccacugaagaguauggauugaaggauugugaacuauguuuagugugauuguga

SEQ ID NO: 214851 - RNA, 64 nt, Homo Sapiens
uauggauugaaggauugugaacuauguuuagugugauugugaacuuggugccuaauguuccaug

SEQ ID NO: 214852 - RNA, 64 nt, Homo Sapiens
agugcaauuuuaagucuaauucaugcagaugauugauugugauuauuguaagaaauuucuuaca

SEQ ID NO: 214853 - RNA, 64 nt, Homo Sapiens
uuuuagcaucuuuuuuuuuuuuuacaaucauucagauugugaauucaggcucagaauuuaccca

SEQ ID NO: 214854 - RNA, 64 nt, Homo Sapiens
uacucacuuagugauuuguaaaauuugcacaugugauugugaagaaauuuguacuaccuaaaag

SEQ ID NO: 214855 - RNA, 64 nt, Homo Sapiens
gcauagaaagaauauaaauauccuguacacggcagauugugaacaaacuauauuccuuuaaguu

SEQ ID NO: 214856 - RNA, 64 nt, Homo Sapiens
cagaauuugugagguuugguuccaagagcacuaggauugugauagaagaacuagugguaaaaca

SEQ ID NO: 214857 - RNA, 64 nt, Homo Sapiens
caauuauuaaaucaaaauuauuuuuuuuaguuuagauugugaggaaauuguuucagaguuuguu

SEQ ID NO: 214858 - RNA, 64 nt, Homo Sapiens; identical to SEQ ID NO: 167761

SEQ ID NO: 214859 - RNA, 64 nt, Homo Sapiens; identical to SEQ ID NO: 167762

SEQ ID NO: 214860 - RNA, 64 nt, Homo Sapiens; identical to SEQ ID NO: 167763

SEQ ID NO: 214861 - RNA, 64 nt, Homo Sapiens; identical to SEQ ID NO: 167764

SEQ ID NO: 214862 - RNA, 64 nt, Homo Sapiens; identical to SEQ ID NO: 167765

SEQ ID NO: 214863 - RNA, 64 nt, Homo Sapiens; identical to SEQ ID NO: 167766

SEQ ID NO: 214864 - RNA, 64 nt, Homo Sapiens
ucauuccaaacucaccaagguggcuuauagaacagaagcagauggauaugaagaggagagggga

SEQ ID NO: 214865 - RNA, 64 nt, Homo Sapiens
ggaagaaaagagggcaaagggaacaaugugaaaagaagcagaaaaucauaaaagaccauguguu

SEQ ID NO: 214866 - RNA, 64 nt, Homo Sapiens
ugaucacaucaccccgucauuuguuguggagaaggaagcagaugccugcccgccagcccugcuc

SEQ ID NO: 214867 - RNA, 64 nt, Homo Sapiens
ucgcucgcacuggucagucguagaagacccaagagaagcagaagcuccagcugucuucuaccac

SEQ ID NO: 214868 - RNA, 64 nt, Homo Sapiens
gcagagcacacacuggcucaauggcggggcuagggaagcagagaggauguaagggaugagaagg

SEQ ID NO: 214869 - RNA, 64 nt, Homo Sapiens
gcagagcaugcagugauggagugguggaaccagggaagcagagaagaggugaggaaacuuuuag

SEQ ID NO: 214870 - RNA, 64 nt, Homo Sapiens
augugacgaaaguggaaauggagaugguccugcagaagcagaagugcaauccagcccaugccga

SEQ ID NO: 214871 - RNA, 64 nt, Homo Sapiens
ccaaggugaagagauacagccuuccguauccaucgaagcagaugcucugaacccugagcaggca

SEQ ID NO: 214872 - RNA, 64 nt, Homo Sapiens
aacccugcuccuaccaaucuuuuuuaaagcaguugaagcagaauguauaggugucagagaagaa

SEQ ID NO: 214873 - RNA, 64 nt, Homo Sapiens
accaacuugccagccauguaagggagccaucuuggaagcagauccuccagccuccagucaaguc

SEQ ID NO: 214874 - RNA, 64 nt, Homo Sapiens
ucugagcccauguuuucugcucaguagcagcuuggaagcagauuuggaaugguuuacuauuuug

SEQ ID NO: 214875 - RNA, 64 nt, Homo Sapiens
gguuuacuauuuuggcugcucuuggggacugcgagaagcagagagaaugagagaccaguggcaa

SEQ ID NO: 214876 - RNA, 64 nt, Homo Sapiens
cugaagccggagagcugcggcccgcucagccucagaagcagacucggagagaaagaggagcccu

SEQ ID NO: 214877 - RNA, 64 nt, Homo Sapiens
gaggagaagagaagagccaaagacagaagagugagaagcagaugccaccaugaggugcaaaacg

SEQ ID NO: 214878 - RNA, 64 nt, Homo Sapiens
aggagcugaguuuggcaacaacccaagugagccugaagcagauucgccccagagccuccaggcg

SEQ ID NO: 214879 - RNA, 64 nt, Homo Sapiens
cucuaacucuauacuguagagaugagucugguccgaagcagauuaguaauuuagagauaagcca

SEQ ID NO: 214880 - RNA, 64 nt, Homo Sapiens
ccccagaugggccaaagaaagagccuaugaaggagaagcagaagcagacggcuggccuggcuca

SEQ ID NO: 214881 - RNA, 64 nt, Homo Sapiens
augggccaaagaaagagccuaugaaggagaagcagaagcagacggcuggccuggcucaccuucc

SEQ ID NO: 214882 - RNA, 64 nt, Homo Sapiens
cacacacacacacacacacauugauuagaaaaaugaagcagacaagcuuacaucaguuguuugu

SEQ ID NO: 214883 - RNA, 64 nt, Homo Sapiens
ugcacuggaaccauugcuuuacauuugucuucaugaagcagauuuugaauuucauauuugagag

SEQ ID NO: 214884 - RNA, 64 nt, Homo Sapiens
cagcuuaucaacgaccgcuguguggacaugcagagaagcagagaagaagaaaggagcugaggag

SEQ ID NO: 214885 - RNA, 64 nt, Homo Sapiens
ggaagcguuugaaggccaagaaccugauguaccugaagcagauccuguauuugcuggagaaauu

SEQ ID NO: 214886 - RNA, 64 nt, Homo Sapiens
uuucucuaggauaagcuugugugguucugccagugaagcagagaaccaccugugcuguugugga

SEQ ID NO: 214887 - RNA, 64 nt, Homo Sapiens
caguuagccagacuguuuuuaaagcaccuggcgggaagcagaagguuggauccaagcccuuguu

SEQ ID NO: 214888 - RNA, 64 nt, Homo Sapiens
gugaccaggcucuggagaagccuucugccaacuggaagcagaugugcuccccugugcuguuacu

SEQ ID NO: 214889 - RNA, 64 nt, Homo Sapiens
ucggcgccgcugcucccgccccgaagccgaagccgaagcagagcccgccugcaccgccgcgaag

SEQ ID NO: 214890 - RNA, 64 nt, Homo Sapiens
ucuaggaaguugugcuugcuuuuuaggcgaaauggaagcagaaauucauauacaaagccuguaa

SEQ ID NO: 214891 - RNA, 64 nt, Homo Sapiens
uagucauuuaugauuugaaaagggugggaagggagaagcagacaggagggaggaaaggguagga

SEQ ID NO: 214892 - RNA, 64 nt, Homo Sapiens
ugaaaugcgcccgccuggcggacagcucccuucugaagcagagaagccuccauggucacgaagc

SEQ ID NO: 214893 - RNA, 64 nt, Homo Sapiens
gaaagucugaguugggagugacaguggcuggagagaagcagaucugugcaacgugcagggcaag

SEQ ID NO: 214894 - RNA, 64 nt, Homo Sapiens
gcacccugggacugcggccuuucccagcuuuauugaagcagaaugguggaacuugugccggagg

SEQ ID NO: 214895 - RNA, 64 nt, Homo Sapiens
gcgugcgccuguagucccagcuacucgggaggcugaagcagaagaaucgcuugaacccgggagg

SEQ ID NO: 214896 - RNA, 64 nt, Homo Sapiens
agaucacacaacauuuauucuucuuacagguaaagaagcagauuuuagaugaaaagaucuacug

SEQ ID NO: 214897 - RNA, 64 nt, Homo Sapiens
ccucgcagauggagcggcagcgccucgcucgagagaagcagaugagggaggaggcugaacgcac

SEQ ID NO: 214898 - RNA, 64 nt, Homo Sapiens
aaaaagacuuuaaaaaaugguaaugaaaauggaaugcagcuacugcagcuaauaaaaaauuuua

SEQ ID NO: 214899 - RNA, 64 nt, Homo Sapiens
uuaaaaaaugguaaugaaaauggaaugcagcuacugcagcuaauaaaaaauuuuagauagcaau

SEQ ID NO: 214900 - RNA, 64 nt, Homo Sapiens
gccagggcagugcugcugcagagcuagaaggcccugcagcuacagcugcuucauucccugcauu

SEQ ID NO: 214901 - RNA, 64 nt, Homo Sapiens
cauacacugagcgggcuacagagcuagaaggcccugcagcuacagcugcuucauucccugcauu

SEQ ID NO: 214902 - RNA, 64 nt, Homo Sapiens
aucaugucucagcacuccaguaaucauagcucacugcagcuauggcagcuaucaucugcagcua

SEQ ID NO: 214903 - RNA, 64 nt, Homo Sapiens
aucauagcucacugcagcuacugcagcuaucaucugcagcuauauugagucuaggaguucgggg

SEQ ID NO: 214904 - RNA, 64 nt, Homo Sapiens
aucugcagcuauaaucauaguaggaguucggggcugcagcuaucaauguaggaucacuugaguc

SEQ ID NO: 214905 - RNA, 64 nt, Homo Sapiens
aggggaaagccagaagguugcuugugucugugacugcagcuauggccuuguuugcuuaguuuau

SEQ ID NO: 214906 - RNA, 64 nt, Homo Sapiens
cgcuuugguugucaugagaaagagacauucuccuugcagcuaccuccaugugagugaauuccug

SEQ ID NO: 214907 - RNA, 62 nt, Homo Sapiens
gggcugggaggaccccagugcccuccucagaagaagcacaugggcuccugcagcccuguccu

SEQ ID NO: 214908 - RNA, 62 nt, Homo Sapiens
cuuggugcuuuagugcaagaagccuaggcucagaagcacagcagcgccaucuuuccguuuca

SEQ ID NO: 214909 - RNA, 62 nt, Homo Sapiens
auguugaaaauccuggguguauguuucuuacagaagcacaauugcaggguaguaacccagug

SEQ ID NO: 214910 - RNA, 62 nt, Homo Sapiens
gccauguuggagagcaaaacccucugggagcugaagcacacggugcuuuguggcuuuggggu

SEQ ID NO: 214911 - RNA, 62 nt, Homo Sapiens
uuugcccuuugcgagacauuagucaauucacagaagcacaaucacagccuagaguuaaguaa

SEQ ID NO: 214912 - RNA, 59 nt, Homo Sapiens
uuuaguuuggguguuccucaccaaccuaagaagcacaaaugcaucgggauucagaauga

SEQ ID NO: 214913 - RNA, 62 nt, Homo Sapiens
cugggaaggccgcaagaggcauagagggagaggaagcacacugcagggcugcuguggcccag

SEQ ID NO: 214914 - RNA, 62 nt, Homo Sapiens
agacggagaccccgguggcaguggaaaaaucagaagcacaaaggaaaacucuuggccucugc

SEQ ID NO: 214915 - RNA, 62 nt, Homo Sapiens
ugugccuuaaaaaucaagacacuaguucagaggaagcacauaauguccagaucuauggcgaa

SEQ ID NO: 214916 - RNA, 62 nt, Homo Sapiens
cggcagaccucuuagagucccugugucaaggugaagcacauaaggcugcagcgcccggugcu

SEQ ID NO: 214917 - RNA, 62 nt, Homo Sapiens
accgggggagagggacacucggagaauugacugaagcacagcgguuugagagcccgcgugcu

SEQ ID NO: 214918 - RNA, 62 nt, Homo Sapiens
cgcagaccugcagcgggcaaagagcucccgaggaagcacagcuugggucagguucuugccuu

SEQ ID NO: 214919 - RNA, 62 nt, Homo Sapiens
gcaagaaagagggucccagggcugcaaaacuggaagcacagccucggggauggggagggaaa

SEQ ID NO: 214920 - RNA, 62 nt, Homo Sapiens
aaccagaagagugcgcugcaggugcacaugaagaagcacacgggggagcggcccuacaagug

SEQ ID NO: 214921 - RNA, 62 nt, Homo Sapiens
ucuguguucagguccaggguuacauaauugcagaagcacaagccauacaucgcagguaggaa

SEQ ID NO: 214922 - RNA, 62 nt, Homo Sapiens
ggcugaacucugggagugugucccagcugagggaagcacaaguagcaaagcucauuggucug

SEQ ID NO: 214923 - RNA, 62 nt, Homo Sapiens
ggucauuagcuuugggaauagaaggcuacacagaagcacacuguuuuugaacuugacaacag

SEQ ID NO: 214924 - RNA, 56 nt, Homo Sapiens; identical to SEQ ID NO: 55920

SEQ ID NO: 214925 - RNA, 64 nt, Homo Sapiens; identical to SEQ ID NO: 55921

SEQ ID NO: 214926 - RNA, 64 nt, Homo Sapiens; identical to SEQ ID NO: 55922

SEQ ID NO: 214927 - RNA, 64 nt, Homo Sapiens; identical to SEQ ID NO: 55923

SEQ ID NO: 214928 - RNA, 64 nt, Homo Sapiens
aagcccuuccaugucgccucugcauucaggaucaaaccccgaccaccugcccaaccugcucucc

SEQ ID NO: 214929 - RNA, 64 nt, Homo Sapiens
aauaucuuaugaauuaaggcauuccucuuucccuaaccccgauggcuccauucccaaguacccc

SEQ ID NO: 214930 - RNA, 64 nt, Homo Sapiens
aaucucugcaaucucuguugcaucaucuguacccaaccccgacgccaccugagaagguagccaa

SEQ ID NO: 214931 - RNA, 64 nt, Homo Sapiens
aggaauggugcuuggcaggaagcuccaggcaggaaaccccgagaagggccccugaagugacccc

SEQ ID NO: 214932 - RNA, 64 nt, Homo Sapiens
cgagggggaggaggccaccugaccaaaugccgccaaccccgagggccaguuucuugucgaauug

SEQ ID NO: 214933 - RNA, 64 nt, Homo Sapiens
ccccaguugaggaguugagaaacuguugccccccaaccccgaaccugaucccccuacugcaacu

SEQ ID NO: 214934 - RNA, 64 nt, Homo Sapiens
augaagauuggaaaaaggaauaucggggcgggccaaccccgagaaaacgaggacauggagugac

SEQ ID NO: 214935 - RNA, 64 nt, Homo Sapiens
cagccccaacuugcauuuccagcacagauggcacaaccccgaggggcgcugaccuuccagguag

SEQ ID NO: 214936 - RNA, 64 nt, Homo Sapiens
cuuugcagccguucggcccucaguugcaacucccaaccccgaauuagcgcaucggaaccccaca

SEQ ID NO: 214937 - RNA, 64 nt, Homo Sapiens
ccccagcccugggacuauucauguccagcacccuaaccccgacuuuccugggcaguaguaugug

SEQ ID NO: 214938 - RNA, 54 nt, Homo Sapiens
agcuaugcauaucaagaaaauaccaaccccgaaauuuacgaaagccaugucuaa

SEQ ID NO: 214939 - RNA, 64 nt, Homo Sapiens
auccuuuuccaauacuuaugcaaaagcaaaagaaaaccccgacaccucaccuuucgcuguuugu

SEQ ID NO: 214940 - RNA, 64 nt, Homo Sapiens
ucuucccagccagugagccaccccugcaguuagaaaccccgaagaggagauuggcaucccccag

SEQ ID NO: 214941 - RNA, 64 nt, Homo Sapiens
caggagagugacuguggccaccugcuacagacacaaccccgaggaccccugcugcccaagagag

SEQ ID NO: 214942 - RNA, 64 nt, Homo Sapiens
ccuccacuucagcuugcccugaccuccgcucgcaaaccccgagcuuccaagccuuuugcuccag

SEQ ID NO: 214943 - RNA, 64 nt, Homo Sapiens
gcagcugggccacaauugccccuuuccguuuucuaaccccgacucagauuucaccacccacacu

SEQ ID NO: 214944 - RNA, 64 nt, Homo Sapiens
cagacagaauccaaaugcaugugcuuguucuacgaaccccgaaugcguugucuuuguggaaaug

SEQ ID NO: 214945 - RNA, 64 nt, Homo Sapiens
auguguuaaguugaagaaagguaacucguguaugaaccccgagccauuucccuguuguccugag

SEQ ID NO: 214946 - RNA, 64 nt, Homo Sapiens
uugcucgcccacagggcugccucagauuuuguacaaccccgaagcguccucugcgugugcgugc

SEQ ID NO: 214947 - RNA, 64 nt, Homo Sapiens
ggugcugcagcagcagggcggugccccagggacaaaccccgaugguaagaacuggggcugagug

SEQ ID NO: 214948 - RNA, 64 nt, Homo Sapiens
agagcuuaucccuguggcggcaaagugggcaggcaaccccgacgaugagaaaagcagagaaccc

SEQ ID NO: 214949 - RNA, 64 nt, Homo Sapiens
aggaguucgaggccagccuggccaagauggcaaaaaccccgacucuacuaaaaauacaaaauua

SEQ ID NO: 214950 - RNA, 64 nt, Homo Sapiens
uggcuuuucucccaguggcucacuccucucccuaaaccccgagaccaauuucuguccuuuggau

SEQ ID NO: 214951 - RNA, 64 nt, Homo Sapiens
cagcagcucuccugucuccacagccgcguuuuuuaaccccgaccucucagcgucugaaugaaca

SEQ ID NO: 214952 - RNA, 64 nt, Homo Sapiens
caucgcucucgccaugugcggaaccaaccaaaccaaccccgaauaguguucagugggccacagu

SEQ ID NO: 214953 - RNA, 64 nt, Homo Sapiens
aaugucuguacgucaccuuucgacuugaguuuugaaccccgauuaacaacuaaccacguuuaca

SEQ ID NO: 214954 - RNA, 64 nt, Homo Sapiens
acauacuuuucuucuguuuuuugcuuuaagaacuaaccccgaucaagaguauuuucuuuagcua

SEQ ID NO: 214955 - RNA, 64 nt, Homo Sapiens
ucuaaaaaccauguugaaugaauccacguucuggaaccccgaggcgggagaaguagggagcugu

SEQ ID NO: 214956 - RNA, 64 nt, Homo Sapiens
cgccucccucucaaccuuguaaauuccccuucccaaccccgaggggcuugcagggacaaggcga

SEQ ID NO: 214957 - RNA, 64 nt, Homo Sapiens
acuuguguuaggauuccgaugcaacaccaugcaaaaccccgaaacagcugcuuugccguccguc

SEQ ID NO: 214958 - RNA, 64 nt, Homo Sapiens
cuuaucgcuagcggauucacccccaagaaccuccaaccccgaggugcuuuaucucccacgggcu

SEQ ID NO: 214959 - RNA, 64 nt, Homo Sapiens
acuucuaguuggcaggagcugaggagggugaacaaaccccgagggaggcccggcccuugcuccc

SEQ ID NO: 214960 - RNA, 64 nt, Homo Sapiens
ggcugggccaagccagggauggggccacagccagaaccccgagcccuacuuccagguucugguu

SEQ ID NO: 214961 - RNA, 64 nt, Homo Sapiens
gaauguucggaugacuuuggggugccucucaagaaaccccgaacgucccagcccagcguccagu

SEQ ID NO: 214962 - RNA, 64 nt, Homo Sapiens
gggacccgccccacagacuccaacuuccccuccaaaccccgaagugaaacccgccaccggguua

SEQ ID NO: 214963 - RNA, 64 nt, Homo Sapiens
ggcccaaccaaaucccuuguuuuguauuuucuugaaccccgaccacuaccccagguuucuaacu

SEQ ID NO: 214964 - RNA, 64 nt, Homo Sapiens
caggaguucgagaccagccuggccaacacggugaaaccccgacucuacuaaaaauacaaaaaau

SEQ ID NO: 214965 - RNA, 64 nt, Homo Sapiens
ccuggcgggagagagagagagaugggccccguggaaccccgaagccgacgccuggccugccagg

SEQ ID NO: 214966 - RNA, 64 nt, Homo Sapiens
cucaggaagagugaaaugcuggcugaccagauugaaccccgaaagacugauccccagaagcgau

SEQ ID NO: 214967 - RNA, 64 nt, Homo Sapiens
ucaaucuacguucuagucacaucucaaauccuggaaccccgauuggccccaaggcccugagggg

SEQ ID NO: 214968 - RNA, 64 nt, Homo Sapiens
uugggaccucacagugggugcugaggaaaggauaaaccccgauagagagcugaacaggcuggga

SEQ ID NO: 214969 - RNA, 64 nt, Homo Sapiens
cacuguacacuguuccuuuuuggggucaaagagaaaccccgagagaauuucugugacuuuuuuc

SEQ ID NO: 214970 - RNA, 64 nt, Homo Sapiens
caugagcaaccuggugccccccguggagcuggccaaccccgagaaccaguucagaguggacuac

SEQ ID NO: 214971 - RNA, 64 nt, Homo Sapiens
gcccuagcgugcagucagcgaacccuguccacccaaccccgagagggagcccaucucucggaga

SEQ ID NO: 214972 - RNA, 64 nt, Homo Sapiens
accggccucucaccaagcaguccuccaugugagcaaccccgagacaaaaaugcuaagugggauc

SEQ ID NO: 214973 - RNA, 64 nt, Homo Sapiens
uuaacuguuuucucaugaugccuuuuuauauuuaaaccccgagauagugcuggaacacugcuga

SEQ ID NO: 214974 - RNA, 64 nt, Homo Sapiens
gacaguggcacuccuggucccuucucccucaggcaaccccgacauacaccuccaccuccuuccc

SEQ ID NO: 214975 - RNA, 64 nt, Homo Sapiens
ugggggguuggcagcccacuaggcagccuuggggaaccccgagcuccagcccauccaaacacug

SEQ ID NO: 214976 - RNA, 64 nt, Homo Sapiens
gauuccuuuggaaaaccaaacuaguaucagaacaaaccccgaaacaguaagaaauuggagugag

SEQ ID NO: 214977 - RNA, 64 nt, Homo Sapiens
guuccauguugacugacuuauggcaugacucuucaaccccgaggucccuguugucagaucuauu

SEQ ID NO: 214978 - RNA, 64 nt, Homo Sapiens
cccugcccgagacgcuggucuccugucgaccgacaaccccgauggcgcuggcagaucugggagc

SEQ ID NO: 214979 - RNA, 64 nt, Homo Sapiens; identical to SEQ ID NO: 82791

SEQ ID NO: 214980 - RNA, 64 nt, Homo Sapiens; identical to SEQ ID NO: 82792

SEQ ID NO: 214981 - RNA, 64 nt, Homo Sapiens; identical to SEQ ID NO: 82793

SEQ ID NO: 214982 - RNA, 64 nt, Homo Sapiens; identical to SEQ ID NO: 82794

SEQ ID NO: 214983 - RNA, 64 nt, Homo Sapiens; identical to SEQ ID NO: 82795

SEQ ID NO: 214984 - RNA, 64 nt, Homo Sapiens; identical to SEQ ID NO: 82796

SEQ ID NO: 214985 - RNA, 64 nt, Homo Sapiens; identical to SEQ ID NO: 82797

SEQ ID NO: 214986 - RNA, 64 nt, Homo Sapiens; identical to SEQ ID NO: 82798

SEQ ID NO: 214987 - RNA, 64 nt, Homo Sapiens; identical to SEQ ID NO: 82799

SEQ ID NO: 214988 - RNA, 64 nt, Homo Sapiens; identical to SEQ ID NO: 82800

SEQ ID NO: 214989 - RNA, 64 nt, Homo Sapiens; identical to SEQ ID NO: 82801

SEQ ID NO: 214990 - RNA, 64 nt, Homo Sapiens; identical to SEQ ID NO: 82802

SEQ ID NO: 214991 - RNA, 64 nt, Homo Sapiens; identical to SEQ ID NO: 82803

SEQ ID NO: 214992 - RNA, 64 nt, Homo Sapiens; identical to SEQ ID NO: 82804

SEQ ID NO: 214993 - RNA, 64 nt, Homo Sapiens; identical to SEQ ID NO: 82805

SEQ ID NO: 214994 - RNA, 64 nt, Homo Sapiens; identical to SEQ ID NO: 82806

SEQ ID NO: 214995 - RNA, 64 nt, Homo Sapiens; identical to SEQ ID NO: 82807

SEQ ID NO: 214996 - RNA, 64 nt, Homo Sapiens; identical to SEQ ID NO: 82808

SEQ ID NO: 214997 - RNA, 64 nt, Homo Sapiens; identical to SEQ ID NO: 82809

SEQ ID NO: 214998 - RNA, 64 nt, Homo Sapiens; identical to SEQ ID NO: 82810

SEQ ID NO: 214999 - RNA, 61 nt, Homo Sapiens; identical to SEQ ID NO: 82811

SEQ ID NO: 215000 - RNA, 64 nt, Homo Sapiens; identical to SEQ ID NO: 82812

SEQ ID NO: 215001 - RNA, 64 nt, Homo Sapiens; identical to SEQ ID NO: 82813

SEQ ID NO: 215002 - RNA, 64 nt, Homo Sapiens; identical to SEQ ID NO: 82814

SEQ ID NO: 215003 - RNA, 64 nt, Homo Sapiens; identical to SEQ ID NO: 82815

SEQ ID NO: 215004 - RNA, 64 nt, Homo Sapiens; identical to SEQ ID NO: 82816

SEQ ID NO: 215005 - RNA, 64 nt, Homo Sapiens; identical to SEQ ID NO: 82817

SEQ ID NO: 215006 - RNA, 64 nt, Homo Sapiens; identical to SEQ ID NO: 82818

SEQ ID NO: 215007 - RNA, 64 nt, Homo Sapiens; identical to SEQ ID NO: 82819

SEQ ID NO: 215008 - RNA, 64 nt, Homo Sapiens; identical to SEQ ID NO: 82820

SEQ ID NO: 215009 - RNA, 64 nt, Homo Sapiens; identical to SEQ ID NO: 82821

SEQ ID NO: 215010 - RNA, 64 nt, Homo Sapiens; identical to SEQ ID NO: 82822

SEQ ID NO: 215011 - RNA, 64 nt, Homo Sapiens; identical to SEQ ID NO: 82823

SEQ ID NO: 215012 - RNA, 64 nt, Homo Sapiens; identical to SEQ ID NO: 82824

SEQ ID NO: 215013 - RNA, 64 nt, Homo Sapiens; identical to SEQ ID NO: 82825

SEQ ID NO: 215014 - RNA, 64 nt, Homo Sapiens; identical to SEQ ID NO: 82826

SEQ ID NO: 215015 - RNA, 64 nt, Homo Sapiens; identical to SEQ ID NO: 82827

SEQ ID NO: 215016 - RNA, 64 nt, Homo Sapiens; identical to SEQ ID NO: 82828

SEQ ID NO: 215017 - RNA, 64 nt, Homo Sapiens; identical to SEQ ID NO: 82829

SEQ ID NO: 215018 - RNA, 64 nt, Homo Sapiens; identical to SEQ ID NO: 82830

SEQ ID NO: 215019 - RNA, 64 nt, Homo Sapiens; identical to SEQ ID NO: 82831

SEQ ID NO: 215020 - RNA, 64 nt, Homo Sapiens; identical to SEQ ID NO: 82832

SEQ ID NO: 215021 - RNA, 64 nt, Homo Sapiens; identical to SEQ ID NO: 82833

SEQ ID NO: 215022 - RNA, 64 nt, Homo Sapiens; identical to SEQ ID NO: 82834

SEQ ID NO: 215023 - RNA, 64 nt, Homo Sapiens; identical to SEQ ID NO: 82835

SEQ ID NO: 215024 - RNA, 64 nt, Homo Sapiens; identical to SEQ ID NO: 82836

SEQ ID NO: 215025 - RNA, 64 nt, Homo Sapiens; identical to SEQ ID NO: 82837

SEQ ID NO: 215026 - RNA, 64 nt, Homo Sapiens; identical to SEQ ID NO: 82838

SEQ ID NO: 215027 - RNA, 64 nt, Homo Sapiens; identical to SEQ ID NO: 82839

SEQ ID NO: 215028 - RNA, 64 nt, Homo Sapiens; identical to SEQ ID NO: 82840

SEQ ID NO: 215029 - RNA, 61 nt, Homo Sapiens
aacaaaacaaaacaaaacuauacuugaacaaaagggucagaggaccuguauuuaagcaaau

SEQ ID NO: 215030 - RNA, 61 nt, Homo Sapiens
caaaaugaaugaggucugggcuagguagaaaaagggucaaugcuauuuuuguuuuuagaau

SEQ ID NO: 215031 - RNA, 61 nt, Homo Sapiens
ucagggcuaggaaaaaccaugaagggucaccaagggucagcggucuuugacuucauuuccu

SEQ ID NO: 215032 - RNA, 61 nt, Homo Sapiens
aagggucagcucagggcuaguucauuuccugaagggucaccuugcccccaaggucuuugac

SEQ ID NO: 215033 - RNA, 61 nt, Homo Sapiens
ggaaagguggucaggaaaacucuggcuggacaagggucagucuucggggucagcagcgaga

SEQ ID NO: 215034 - RNA, 61 nt, Homo Sapiens
caucugcggagccaaaacccagccaucggggaagggucagggcuucuguggaacuuggaac

SEQ ID NO: 215035 - RNA, 64 nt, Homo Sapiens
gcuuagauugcaguuuguuuugcauuugcuauaauuuucaaaauuauuuuugaagcaagacaaa

SEQ ID NO: 215036 - RNA, 64 nt, Homo Sapiens
ucgauuuuaugaagagaaagugaaguuugaaaacuuuucaaacuuuucuaguuacaauccaauu

SEQ ID NO: 215037 - RNA, 64 nt, Homo Sapiens
cauuuggaauggguauuuucuguuucaugauguauuuucaaauagaguucaggaucugcaauuc

SEQ ID NO: 215038 - RNA, 64 nt, Homo Sapiens
uauaaauagaugauuucaauagcuuuguaguuuuuuuucaaaaucuuaauguaaacuaggauug

SEQ ID NO: 215039 - RNA, 64 nt, Homo Sapiens
ugguaaaacuuuaguuguauugccauccacuccuuuuucaaaugaguuuaaugccauaaagcug

SEQ ID NO: 215040 - RNA, 64 nt, Homo Sapiens
uugaguucuauugaguauuauaagauagcuuacauuuucaaaauggaaauugucggucauauuu

SEQ ID NO: 215041 - RNA, 64 nt, Homo Sapiens
uuaccaguuuaguaugcugugguauuuuaauaaguuuucaaagauaauugggaaaacaugagac

SEQ ID NO: 215042 - RNA, 64 nt, Homo Sapiens
uaccuugcaaacuuaugaaccaaaccauauuggguuuucaaagugccuuuguauccaaaaaugu

SEQ ID NO: 215043 - RNA, 64 nt, Homo Sapiens
aauuaucacauuuuaaauuacuuuguggacuguguuuucaaaacuuugcaaauucaucuguuac

SEQ ID NO: 215044 - RNA, 64 nt, Homo Sapiens
aaaauuuaaaaauucaauuggcuguguauuguauuuuucaaauaaggggaggaaauaauucucu

SEQ ID NO: 215045 - RNA, 64 nt, Homo Sapiens
uaaaacuauauaauaauuauuuaagaaugaacacuuuucaaauaguauuuuaaauguuuauguu

SEQ ID NO: 215046 - RNA, 64 nt, Homo Sapiens
ggucguagcuguauuuauugcacaucuguuuuguuuuucaaacagcuagcacaugccagagguu

SEQ ID NO: 215047 - RNA, 64 nt, Homo Sapiens
ggcacaguucacauugcuagguauuuaaauuuucuuuucaaacaggcuaaugcuuagugccuga

SEQ ID NO: 215048 - RNA, 64 nt, Homo Sapiens
aaauauuuuuuccuuuuguaacauguagcaaagauuuucaaacauuacaguggcaaaaauaaug

SEQ ID NO: 215049 - RNA, 64 nt, Homo Sapiens
guccuaaggaguuaaaucuugucuuucuguguacuuuucaaagauuguccccgauuuuaccuuu

SEQ ID NO: 215050 - RNA, 64 nt, Homo Sapiens
aaaaauuaagcaaaauaguucuuuuaaauacauuuuuucaaauauauauuaaaaaguuguugga

SEQ ID NO: 215051 - RNA, 64 nt, Homo Sapiens
uccauguauuuucugccauuuuuuuuuuuuuuuuuuuucaaauugacugagguucuuuuuuuuu

SEQ ID NO: 215052 - RNA, 64 nt, Homo Sapiens
acauuauucauuauaauuuuguuauuauuuggacuuuucaaauucuccauuuucccucaucacu

SEQ ID NO: 215053 - RNA, 64 nt, Homo Sapiens
ucccuuucaaguuauguuuuuaauauuaugacauuuuucaaaaaguagacaaagaggaugugga

SEQ ID NO: 215054 - RNA, 64 nt, Homo Sapiens
caaagcgacagcucuacuucggccauucauuugauuuucaaaauuguggguggaaguuuguaaa

SEQ ID NO: 215055 - RNA, 64 nt, Homo Sapiens
auuguggguggaaguuuguagaguuacucaucccuuuucaaagagggagguaagaguaggguca

SEQ ID NO: 215056 - RNA, 64 nt, Homo Sapiens
aaacuuuuacuuugaacuauaaugacuguuacauuuuucaaauauuuuuaaacugcugaaauaa

SEQ ID NO: 215057 - RNA, 64 nt, Homo Sapiens
aaugaggccaagcugaagcuauguaaacauuuuauuuucaaaugcuggacacaggcgcggccuc

SEQ ID NO: 215058 - RNA, 64 nt, Homo Sapiens
uucaucauucacccuugauuuaauuacagauaacuuuucaaaaaaauaguaaaauccaaaguau

SEQ ID NO: 215059 - RNA, 64 nt, Homo Sapiens
uuuaaauaaugucuauccaucuuacuggugaacuuuuucaaauguggacuuugacccuaaugga

SEQ ID NO: 215060 - RNA, 64 nt, Homo Sapiens
uuuaaugucauuauugaaauacuuuuaauucuaauuuucaaaagaaagcuaaaugcugauugug

SEQ ID NO: 215061 - RNA, 64 nt, Homo Sapiens
acauccuaugaauuugaaaguuuccuaaguguuguuuucaaagaacugguuuauuuuauaguca

SEQ ID NO: 215062 - RNA, 64 nt, Homo Sapiens
ugaacuauggggaaucaugguucuuuuaaagcaauuuucaaaauaaguaccaauuaaagcuuua

SEQ ID NO: 215063 - RNA, 64 nt, Homo Sapiens
uuggauauguuuguaacacauaaacacaaagcacuuuucaaacaugaugcacuuuuaucuuugu

SEQ ID NO: 215064 - RNA, 64 nt, Homo Sapiens
aucacuaaucagcuccuggauuuuuuuuuuuuuuuuuucaaacaaugguuugaaacaacuacug

SEQ ID NO: 215065 - RNA, 64 nt, Homo Sapiens
ucaaauauaacugacuguauacuauagugguaacuuuucaaacagcccuuagcacuuuuauacu

SEQ ID NO: 215066 - RNA, 64 nt, Homo Sapiens
auuugguaccugucucucuccuacuguauugucauuuucaaaauguguuuguuuucuggcgcgu

SEQ ID NO: 215067 - RNA, 64 nt, Homo Sapiens
auguaacaaaauauuuuguagauuacauauugauuuuucaaaaauuaaaaauguauuucaaacu

SEQ ID NO: 215068 - RNA, 64 nt, Homo Sapiens
aagacaccaaauuccaaacuucuaaauguuggaauuuucaaaaauuguguuuagauuuuaugaa

SEQ ID NO: 215069 - RNA, 64 nt, Homo Sapiens
cggaucaauagacuguacuuauuuuccaauaaaauuuucaaacuuuguacuguuauccugagaa

SEQ ID NO: 215070 - RNA, 64 nt, Homo Sapiens
ugcaguguguuuucccccucaccuucaauaagguuuuucaaaaaggaaauggaaacuuuuuaac

SEQ ID NO: 215071 - RNA, 64 nt, Homo Sapiens
caucguuaaacaacuuuuaaaagaaauaacuaaauuuucaaaugaguaagcagugccaccaacu

SEQ ID NO: 215072 - RNA, 64 nt, Homo Sapiens
uacacuacaaugcuucuuugguuuccaggaauuuuuuucaaauggggcuguuucuggaaaaaug

SEQ ID NO: 215073 - RNA, 64 nt, Homo Sapiens
ucauuuccauuuaccugaguucgcuuuaaagagcuuuucaaagagagcuuuauagacacccaca

SEQ ID NO: 215074 - RNA, 64 nt, Homo Sapiens
guauauagaauaauauuuauguuuacaauguaacuuuucaaaauuuacaaaucaggauuauaua

SEQ ID NO: 215075 - RNA, 64 nt, Homo Sapiens
aacauuucagaagagcacaauaugcauaaaacauuuuucaaaauugaaauauuuuccugggcau

SEQ ID NO: 215076 - RNA, 64 nt, Homo Sapiens
ccuuuuuugagcaaacugagacuaaacuucucucuuuucaaaauuguguuaucuuccuuaaucc

SEQ ID NO: 215077 - RNA, 64 nt, Homo Sapiens
cuuaaauaucuuucacaugcauuuuaggauauucuuuucaaauauuuguaggacaacuuugaau

SEQ ID NO: 215078 - RNA, 64 nt, Homo Sapiens
acauaauugaauucgucucuaacuaaguaaauacuuuucaaaauauuugcaauuaauuuauuua

SEQ ID NO: 215079 - RNA, 64 nt, Homo Sapiens
aauguaauugauuuugaagucugcuguuaccccuuuuucaaagauaguugugauguaucaguaa

SEQ ID NO: 215080 - RNA, 64 nt, Homo Sapiens
caccacaaguauagacaguuuccuucccacccuuuuuucaaagggaaaaguuucuucucucccc

SEQ ID NO: 215081 - RNA, 64 nt, Homo Sapiens
aagaaaauaagugcucugucgagucgcuuuugccuuuucaaaucccuaauuaaguacaaaaaca

SEQ ID NO: 215082 - RNA, 64 nt, Homo Sapiens
cagcuacuuaaguuaaugguaaacaguauuuauuuuuucaaaaaauacuguuauaucuaaauuu

SEQ ID NO: 215083 - RNA, 64 nt, Homo Sapiens
agagaauagcccccuucgauacacaucagcuggauuuucaaaagcuucaaagucuuggucugug

SEQ ID NO: 215084 - RNA, 64 nt, Homo Sapiens
uuuucccgauguguccagccagcuccgcagcagcuuuucaaaaugcacuaugccugauugcuga

SEQ ID NO: 215085 - RNA, 64 nt, Homo Sapiens
cuguuuucccaccucuaaggauuucauguacaucuuuucaaagcuagaaauaagcacugucuaa

SEQ ID NO: 215086 - RNA, 64 nt, Homo Sapiens
auuuuuuuugucuguugacaaaaacaaaaaucuuuuuucaaauguagugcuggugaaaagguag

SEQ ID NO: 215087 - RNA, 64 nt, Homo Sapiens
aaaaucauaauucauaucauuggagaaguauuuauuuucaaauaucaaauugaagaaaaacuca

SEQ ID NO: 215088 - RNA, 64 nt, Homo Sapiens
ggcuuaccgcuuaccuuagaguuuuguuuuuuuuuuuucaaacccaucaaaaucuacuuauuua

SEQ ID NO: 215089 - RNA, 64 nt, Homo Sapiens
uauagacuuguuuuauuagauuuuaccaaugaauuuuucaaaauacaaaaaaaaguaguuuuuc

SEQ ID NO: 215090 - RNA, 64 nt, Homo Sapiens
uaaggugaaaucauggaucagauauuccuuacauuuuucaaaacuacugcauguuuaaaacuuc

SEQ ID NO: 215091 - RNA, 64 nt, Homo Sapiens
uguuuccuuuuugaacuuacuuugaaauuuguuuuuuucaaauauuugguuaugcuuauuuuug

SEQ ID NO: 215092 - RNA, 64 nt, Homo Sapiens
ugguaguaguuauuuuuaaauuucgccagggaucuuuucaaaacuaaguugauuuugggguuuc

SEQ ID NO: 215093 - RNA, 64 nt, Homo Sapiens
aauugcuuaaaucuagaaccucccauuccuaauuuuuucaaacuuuucaacaggacuuucuuau

SEQ ID NO: 215094 - RNA, 64 nt, Homo Sapiens
uucaacaugaaucagaauagccuuuuuccuuugguuuucaaaugcuuuaaauauuuuuaguuga

SEQ ID NO: 215095 - RNA, 64 nt, Homo Sapiens
uguacacggaaaucuggacaacaaguuauugugcuuuucaaaaauuguguuaagugcaauuaau

SEQ ID NO: 215096 - RNA, 64 nt, Homo Sapiens
gauaauuuacaauggaaggagcuugcuuucugcauuuucaaaaucuuccccagcagggcugcua

SEQ ID NO: 215097 - RNA, 64 nt, Homo Sapiens
caaguauucaacagucccuguguguccuucugaguuuucaaagguuauaaaucuggauuugccu

SEQ ID NO: 215098 - RNA, 64 nt, Homo Sapiens
uuuuccuuggcuguaauuuaguucucauagauaauuuucaaauagacauguucagcuaggcaga

SEQ ID NO: 215099 - RNA, 64 nt, Homo Sapiens
ucucccauuuuucucuccacuuuauaaagagguuuuuucaaauuuauuagagaaguuuuuuagc

SEQ ID NO: 215100 - RNA, 64 nt, Homo Sapiens
cgauaugugaaggacuacaguuuaaaagcagauuuuuucaaaauuuuguuauuccuuaaaaaca

SEQ ID NO: 215101 - RNA, 64 nt, Homo Sapiens
agaaaauuguguacucuagaauaagaaauaauuuuuuucaaauaauucuguuuaacaauaagaa

SEQ ID NO: 215102 - RNA, 64 nt, Homo Sapiens
auuguuaguaaagaacaaaauauuaaauuaccaauuuucaaauuauauuuucauauucacaaga

SEQ ID NO: 215103 - RNA, 64 nt, Homo Sapiens
auaguuuaucuucuguauaauuguauacuuuugcuuuucaaauuuguaaggccuguagcucugg

SEQ ID NO: 215104 - RNA, 64 nt, Homo Sapiens
aauauucaauuaugaaacaaaaaaauuaugauguuuuucaaaaugcaagugagguuugauuuuu

SEQ ID NO: 215105 - RNA, 64 nt, Homo Sapiens
aggagaucuaacaaaaacacuugaauauuuuuuauuuucaaaacuaaacacauaaaaugcuuuu

SEQ ID NO: 215106 - RNA, 64 nt, Homo Sapiens
uacgguaguaagaaaccuuugagaucuuucugacuuuucaaaauuagagaaagcaaaugggaug

SEQ ID NO: 215107 - RNA, 64 nt, Homo Sapiens
cuaaaguaauuguauugaugugaagcauaucauuuuuucaaauaugaaagugaucacuuagcaa

SEQ ID NO: 215108 - RNA, 64 nt, Homo Sapiens
ggucucuuucauuuuucucuuccugggauucauuuuuucaaaacacaaugcuggaaaaaaaaga

SEQ ID NO: 215109 - RNA, 64 nt, Homo Sapiens
gaaagacuucuuauggugcuauuccauaaacuuuuuuucaaacaaguuuuugaccuuugagcca

SEQ ID NO: 215110 - RNA, 64 nt, Homo Sapiens
cagcacauuuuuggaaacuaugucugaagacuuauuuucaaagacagaucuuuuccgacacaca

SEQ ID NO: 215111 - RNA, 64 nt, Homo Sapiens
ggugagaacagucuuacauuaaagggauuaggucuuuucaaaagaaauuauacuuuugguuuag

SEQ ID NO: 215112 - RNA, 64 nt, Homo Sapiens
cuauugaccacauugcucuacuuuccaaauggaguuuucaaauauuaccaaacuuuaucaagga

SEQ ID NO: 215113 - RNA, 64 nt, Homo Sapiens
ucuauaccaguaccuauuuuauacaugcauaauauuuucaaaguaauguauaacgaaugaauaa

SEQ ID NO: 215114 - RNA, 64 nt, Homo Sapiens
ugauucaguucauuuccuguucaaauacagcuuuuuuucaaagcuagacuucuuucucaagaaa

SEQ ID NO: 215115 - RNA, 64 nt, Homo Sapiens
aagugguauuuugaucaguuaagcaagcacuuuguuuucaaagccuuuccuuguauauaccauc

SEQ ID NO: 215116 - RNA, 64 nt, Homo Sapiens
aagcauaaacaauuuauuuguuaaaagugaccccuuuucaaacacauuuuucaauaaucucacc

SEQ ID NO: 215117 - RNA, 64 nt, Homo Sapiens
agaugagaauaugguacagaacuucagcaauugguuuucaaaauaccacuuugaugucaguaca

SEQ ID NO: 215118 - RNA, 64 nt, Homo Sapiens
aaaagugacaauuguagcauccuucugagcuuccuuuucaaaauaucucucuaagaguuuuuuu

SEQ ID NO: 215119 - RNA, 64 nt, Homo Sapiens
uagguuaggagcaaauuaucuuggaaucuuuccuuuuucaaaaguaccauuuuuucaagaaugu

SEQ ID NO: 215120 - RNA, 64 nt, Homo Sapiens
aauaaauuauguagacauuugcuuugaauuaauuuuuucaaaucuagccuucaauauacauucu

SEQ ID NO: 215121 - RNA, 64 nt, Homo Sapiens
acuucuuuauugacuugucccaaauguaauauuuuuuucaaauuugcucaacaagaaaaaaaug

SEQ ID NO: 215122 - RNA, 64 nt, Homo Sapiens
ugaagaaagcaaagcaaaaacuguauagagagauuuuucaaaagcaguaaucccucaauuuuaa

SEQ ID NO: 215123 - RNA, 64 nt, Homo Sapiens
ucugucuucacuguuuauaauacggauggauuuuuuuucaaaucaguguguguuuugaggucuu

SEQ ID NO: 215124 - RNA, 64 nt, Homo Sapiens
uguuacagugauugcaauaauaguauauuggaguuuuucaaagaaacuuaaaguaaugcccaau

SEQ ID NO: 215125 - RNA, 64 nt, Homo Sapiens
uguaauccaaaagauaagggugugguuuacaugcuuuucaaaaauuuuuguuaagaaguagcaa

SEQ ID NO: 215126 - RNA, 64 nt, Homo Sapiens
uuggagaugggaagagcaucuccaggcaaugaguuuuucaaagaaugccuacuuaguaguaaga

SEQ ID NO: 215127 - RNA, 64 nt, Homo Sapiens
aucuucugaggcuuuagaaauguggacaagcuaguuuucaaauuuugugugcgucuguaaguuc

SEQ ID NO: 215128 - RNA, 64 nt, Homo Sapiens
uuuuccauuuaugaagcaguaugaauuagauguauuuucaaaacaggucccuaagacaauucuu

SEQ ID NO: 215129 - RNA, 64 nt, Homo Sapiens
auaaaaacuaguauguuuucacgguguauauuuuuuuucaaaaauucuguaacaaauauauuua

SEQ ID NO: 215130 - RNA, 64 nt, Homo Sapiens
aaacaaaauaagcaguggauacuaaugacucaaauuuucaaaugaaaaaaaaaaaaauccuuga

SEQ ID NO: 215131 - RNA, 64 nt, Homo Sapiens
augaucuuauccuaguaucuuagguggcuucuguuuuucaaaaggaaacguauggguaggaguu

SEQ ID NO: 215132 - RNA, 64 nt, Homo Sapiens
aagacauugauaauauuaaacaguacaauucuucuuuucaaaugaacacacacagauauggaca

SEQ ID NO: 215133 - RNA, 64 nt, Homo Sapiens
uuuaauucuaaauuccagaucugccaauuugggauuuucaaauagaaaaagacugcaagcuuuc

SEQ ID NO: 215134 - RNA, 64 nt, Homo Sapiens
uagucuuuguaacauagaauaccaguaacuuuguuuuucaaaauguuaggaauaaaaaaaaaag

SEQ ID NO: 215135 - RNA, 64 nt, Homo Sapiens
auauuuucacccugacaguguaucuuuaaaaagcuuuucaaaauguuaaagcauaauaauaaca

SEQ ID NO: 215136 - RNA, 64 nt, Homo Sapiens
guaccacaacauagaacuguccaauuuuuucaguuuuucaaauucauuauuauuuuuuaauuuc

SEQ ID NO: 215137 - RNA, 64 nt, Homo Sapiens
acauuauuauuuuuuaauuuauaaaaagugcaauuuuucaaaacaccugcugaaggauuuauuu

SEQ ID NO: 215138 - RNA, 64 nt, Homo Sapiens
agagaugauuaauuucaagauuaauagaguauuguuuucaaaacuuagugcagaaauaacauua

SEQ ID NO: 215139 - RNA, 64 nt, Homo Sapiens
cauacuuuauuuucauuugauaaauauuuuuuaauuuucaaacuauuaaugugaaaguugucuc

SEQ ID NO: 215140 - RNA, 64 nt, Homo Sapiens
aaaugugcauuccucuuuuagaguagcuguaugcuuuucaaaugcuaucugccgugaauuuuuu

SEQ ID NO: 215141 - RNA, 64 nt, Homo Sapiens
uuauuccuaacaaaaauaaguacucaggacuuuuuuuucaaaaugaaauauuuauguacuguuu

SEQ ID NO: 215142 - RNA, 64 nt, Homo Sapiens
agugaggcaggccuagcaguucccuuaccugaaguuuucaaauccauacugcaguucccucucg

SEQ ID NO: 215143 - RNA, 64 nt, Homo Sapiens
caaacacagcacauaucuauuaucacuauauuaauuuucaaagguuuuucuuugacguuuaaaa

SEQ ID NO: 215144 - RNA, 64 nt, Homo Sapiens
uaauaauuuuaguacaaaauuucauaaaccguguuuuucaaaauaaguuuaugucaaauccagc

SEQ ID NO: 215145 - RNA, 64 nt, Homo Sapiens
aaauaggcaauaagaacuucauuuuacaauuuaguuuucaaaaaaaaaaugcaggaaacuguuu

SEQ ID NO: 215146 - RNA, 64 nt, Homo Sapiens
cuugaauuugucauaaagcuaaauauuuuauauguuuucaaagauuauuuuuucauauuaauag

SEQ ID NO: 215147 - RNA, 64 nt, Homo Sapiens
ucuguuggaucuuguaaacaugaaaagggcuuuauuuucaaaaauuaacuucaaaauaagugua

SEQ ID NO: 215148 - RNA, 64 nt, Homo Sapiens
uacucuuacauaauaaaauuccuuuuaaguaauuuuuucaaagaaucacagaauucuaguacau

SEQ ID NO: 215149 - RNA, 64 nt, Homo Sapiens
aacugcuauuauaauucucaaucauagaaggugcuuuucaaaacaaaaucaguggaaauaaaug

SEQ ID NO: 215150 - RNA, 64 nt, Homo Sapiens
ugaccaucuuaaacacaugauguuuggaaaacucuuuucaaaacggcauagcaugacuuauucu

SEQ ID NO: 215151 - RNA, 64 nt, Homo Sapiens
gaaauaaaacauuucuguaauuucuacaagguaauuuucaaaaauauuugauagaaaagucaca

SEQ ID NO: 215152 - RNA, 64 nt, Homo Sapiens
gaagaauacuuuaaacagccacggggcccauuucuuuucaaacucaccaaauucacacauuugu

SEQ ID NO: 215153 - RNA, 64 nt, Homo Sapiens
ugaauuaucuuuugugucuauucagguagauaauuuuucaaauguccucuuaagaguucuauuc

SEQ ID NO: 215154 - RNA, 64 nt, Homo Sapiens
ucaccaauaaaaguuuuggcuuuaaaaaaauuguuuuucaaaugauacuguucauuaauaguau

SEQ ID NO: 215155 - RNA, 64 nt, Homo Sapiens
agaauguaagcauuuuacuuuuaccugauuuuuguuuucaaauaacuugcacccaccauuuuuu

SEQ ID NO: 215156 - RNA, 64 nt, Homo Sapiens
gauauuuacauagucuguaauuucuggaaguguguuuucaaaaaauaauagaauauuacauuua

SEQ ID NO: 215157 - RNA, 64 nt, Homo Sapiens
agcacacuuguacaauuauucucuugguucauuauuuucaaacaucagguggguguacucuggc

SEQ ID NO: 215158 - RNA, 64 nt, Homo Sapiens
uugcaauuuggcuugauuaauacauauaauaaacuuuucaaaucuuuuccguaaacauauaucu

SEQ ID NO: 215159 - RNA, 64 nt, Homo Sapiens
aagaaaauaaccuuuauaugcaaaucugggagaauuuucaaaauuggaaagguuuggauuucuc

SEQ ID NO: 215160 - RNA, 64 nt, Homo Sapiens
caagaacauuagccuagaagaggcuuaaauuuauuuuucaaaguucccugggauuacuuagcca

SEQ ID NO: 215161 - RNA, 64 nt, Homo Sapiens
aagaauguacauauuccacuuggaaacauucuguuuuucaaaaguuaccaggaguaauugccca

SEQ ID NO: 215162 - RNA, 64 nt, Homo Sapiens
ccaacuacagccaaauugcacacucuucaaguuuuuuucaaagucacgcgcgcgcgcgcacaca

SEQ ID NO: 215163 - RNA, 64 nt, Homo Sapiens
cacacacacacgcgcgcgcgauuuucuaauucucuuuucaaacacauacccagugucuaccuuc

SEQ ID NO: 215164 - RNA, 64 nt, Homo Sapiens
uuacacaugagggaccgaaggauagaaaaguuauuuuucaaaggucuugcaguuaauaaauggc

SEQ ID NO: 215165 - RNA, 64 nt, Homo Sapiens
uauuuaaauaugaaucuauucaugcuaacauuauuuuucaaaacauacauggaaauuuagccca

SEQ ID NO: 215166 - RNA, 64 nt, Homo Sapiens
caucaacaaaagauugguccuuggugaaauaaacuuuucaaaaaugaauguucuuuucaaaaaa

SEQ ID NO: 215167 - RNA, 64 nt, Homo Sapiens
cuuggugaaauaaacuuuucaaaaaugaauguucuuuucaaaaaauaaaguagaaaaaugcacu

SEQ ID NO: 215168 - RNA, 64 nt, Homo Sapiens
agcaaccacauuuagaaauguuuauugacaggucuuuucaaauaaugcuuuucuaauuaauagc

SEQ ID NO: 215169 - RNA, 64 nt, Homo Sapiens
uacgcuaauaagugacaaauaagauuaauaagauuuuucaaaaucgccaggacuggugaauaua

SEQ ID NO: 215170 - RNA, 64 nt, Homo Sapiens
augaauuuuuauugagauuuuccauuaacuauuuuuuucaaagacucaaauuuuguaccaagua

SEQ ID NO: 215171 - RNA, 64 nt, Homo Sapiens
ugauuguaagucauauuuuauagagagcuaauuuuuuucaaagguuuguuuuucugugaacagu

SEQ ID NO: 215172 - RNA, 64 nt, Homo Sapiens
uugagcagcugaaaagcaaacuuuaguggacugguuuucaaaacaguuagacaaccaaagacga

SEQ ID NO: 215173 - RNA, 64 nt, Homo Sapiens
auguacaauucuuguauagacuguaacuuuuucauuuucaaaccuugcagcuauuaguugauug

SEQ ID NO: 215174 - RNA, 64 nt, Homo Sapiens
uaaaagcaguuuuacauuggaaguugacaaaaaauuuucaaagaccguuacuaaaauaguuuca

SEQ ID NO: 215175 - RNA, 64 nt, Homo Sapiens
auaaugaguaaguuuuggucaaaaauaaaaugacuuuucaaauuuggaugcauuuuuauuauga

SEQ ID NO: 215176 - RNA, 64 nt, Homo Sapiens
aaaauuuguccauguaaagcugcaaaaaaucauuuuuucaaagauauguuuauuaaugggccaa

SEQ ID NO: 215177 - RNA, 64 nt, Homo Sapiens
uugguauuuaaucaaagagaaaaugguaauaaacuuuucaaaaucuuuguuaaaccaaacauuc

SEQ ID NO: 215178 - RNA, 64 nt, Homo Sapiens
auaugaagucagguuuguuuuuuuuuuuuuuuuuuuuucaaagcacaguacuguuagcuguuuu

SEQ ID NO: 215179 - RNA, 64 nt, Homo Sapiens
auaacuuuaucaauucaugugaauuuuagcucaauuuucaaaguucacuaauauucucaauauu

SEQ ID NO: 215180 - RNA, 64 nt, Homo Sapiens
gaaucucuauccacguaucagguuauagacugguuuuucaaaagugaacaauccugugauaagu

SEQ ID NO: 215181 - RNA, 64 nt, Homo Sapiens
aauuaucgaauuaaaacuuaauguaugucaauuauuuucaaaugucuaaauuccuuuggaaaua

SEQ ID NO: 215182 - RNA, 64 nt, Homo Sapiens
caacuuagugucucuauuuaugagaucacugaacuuuucaaaauaaagcuuuugcauagaauaa

SEQ ID NO: 215183 - RNA, 64 nt, Homo Sapiens
aaauucagauaaugguaauuuaguguauaugugauuuucaaauauguaaacuuuaacuuccacu

SEQ ID NO: 215184 - RNA, 64 nt, Homo Sapiens
gcuccuagcuuuugauuaggguacauuuuuaaauuuuucaaacuuuauauauguuaauaaggaa

SEQ ID NO: 215185 - RNA, 64 nt, Homo Sapiens
acuuuuagaucuuaaaauuuuuuuacaaaucccauuuucaaauuagccauuauuaguaguaaac

SEQ ID NO: 215186 - RNA, 64 nt, Homo Sapiens
gaagauacacauuacagccacuuuauuuuauuuuuuuucaaaauuuauuuucaaaggaaaacac

SEQ ID NO: 215187 - RNA, 64 nt, Homo Sapiens
aaaacaccuuuauuuuauuuauugaaguuuauuauuuucaaagggaauguucauauagccaggg

SEQ ID NO: 215188 - RNA, 64 nt, Homo Sapiens
ucccauuucucaagaaauguggugggagggaauguuuucaaauuuuagagucuuauuugauuau

SEQ ID NO: 215189 - RNA, 64 nt, Homo Sapiens
gaagggcagcugcuuagagucuggauagaaauuguuuucaaagaugagcaaggccuacuuggcc

SEQ ID NO: 215190 - RNA, 64 nt, Homo Sapiens
aauuaguuguuuucuuauuucagaauuuguuuuuuuuucaaauaucaagccaagccugcaugua

SEQ ID NO: 215191 - RNA, 64 nt, Homo Sapiens
ucuggccauuuagcaaaguuacuguguuuucauuuuuucaaaugcuuacauacuuuguuuuaca

SEQ ID NO: 215192 - RNA, 64 nt, Homo Sapiens
uaccuuuccagguuuguuuuccacaaauuuuguuuuuucaaacuuuauauguuauaguuucuug

SEQ ID NO: 215193 - RNA, 64 nt, Homo Sapiens
aaguauagcuuuauguaacugaccuuuauuauuauuuucaaauuauuuuuuaaguuuacugaga

SEQ ID NO: 215194 - RNA, 64 nt, Homo Sapiens
acauuacuaauauagcuuuuguaaaacucguuuguuuucaaaggucuggacuaagcaaaacaac

SEQ ID NO: 215195 - RNA, 64 nt, Homo Sapiens
cacgaauauacuuuuuguuuguuuuccuuuuccauuuucaaaaugccaagaucugggagccucu

SEQ ID NO: 215196 - RNA, 64 nt, Homo Sapiens
caagcauauguuagcauuaaaguucuaggcauacuuuucaaagcugggaagacccuuucagaau

SEQ ID NO: 215197 - RNA, 64 nt, Homo Sapiens
guguaguuauaaaccaaugaaauuuugauuaaccuuuucaaauuaauguuccaguuugaagacc

SEQ ID NO: 215198 - RNA, 64 nt, Homo Sapiens
auuaaagaacaaauuauaaaaguuugaacaaaucuuuucaaauuaaguauauaaaaguaaacuu

SEQ ID NO: 215199 - RNA, 64 nt, Homo Sapiens
gcuaagcucuuuguacuacugcaaacuuaaaaguuuuucaaaugugggaaacgugugggaaggc

SEQ ID NO: 215200 - RNA, 64 nt, Homo Sapiens
aaauugaaaucauauguugggaaugguaaaaagguuuucaaaugguuuauuuuuccucuuuuau

SEQ ID NO: 215201 - RNA, 64 nt, Homo Sapiens
guuuucucucaguccuuuugcuacauucacuuucuuuucaaagaaauguuaauuauuacaaaaa

SEQ ID NO: 215202 - RNA, 64 nt, Homo Sapiens
guuaaguuaaacuggagaaaguuugucauccucauuuucaaacugaaaacuaaucaaauauagu

SEQ ID NO: 215203 - RNA, 64 nt, Homo Sapiens
cauaugcuucuaaccacuaacaaacacagucugauuuucaaaccaaugguagagauuuuuuuuu

SEQ ID NO: 215204 - RNA, 64 nt, Homo Sapiens
cagucugauuuucaaacccaugguagagauuuuuuuuucaaacaaugauuacucagcuaaaaaa

SEQ ID NO: 215205 - RNA, 64 nt, Homo Sapiens
uguugcaucccccuuagaauuauugcucuaauucuuuucaaaauauaauguaauacuguagaaa

SEQ ID NO: 215206 - RNA, 64 nt, Homo Sapiens
caaaguuaugguuuccucauuccucauuuaauauuuuucaaaauagaauuuauagaauaauuuc

SEQ ID NO: 215207 - RNA, 64 nt, Homo Sapiens
auuuuaagaacuuuauaaugacugaaggaauguguuuucaaaauauuauuugguaaagcaacag

SEQ ID NO: 215208 - RNA, 64 nt, Homo Sapiens
guauaaauucagcuaauuauuucuauauuauuauuuuucaaaugucauuuaucaggcauagcuc

SEQ ID NO: 215209 - RNA, 64 nt, Homo Sapiens
uuuuuguuaauuaaaauuaaauuuuuaagagauauuuucaaaacccuauuuauuuucuuguuca

SEQ ID NO: 215210 - RNA, 64 nt, Homo Sapiens
cuuuuauaaaauucaaugacgacuacuagaauucuuuucaaaaguuaacuuaucuccaaagugg

SEQ ID NO: 215211 - RNA, 64 nt, Homo Sapiens
auccucuuaccucucucacugcucguguucugccuuuucaaaaggaccacuaugaacagaucag

SEQ ID NO: 215212 - RNA, 64 nt, Homo Sapiens
acauuuugcaaaauuacauuuagagaaacccaauuuuucaaaguuuaagaaauauacaaaguau

SEQ ID NO: 215213 - RNA, 64 nt, Homo Sapiens
augaaaacuccagaaacgcacuuaugagucauuuuuuucaaaagaucuaacaauaugaagggcu

SEQ ID NO: 215214 - RNA, 64 nt, Homo Sapiens
gccugggagagucaaauggcgaagaugcaccgucuuuucaaaugacacaaaaaaaaugguaugu

SEQ ID NO: 215215 - RNA, 64 nt, Homo Sapiens
aauguguuuuuuacuugcuagcuuagaaguauuuuuuucaaagauuuauauguuaagagccuga

SEQ ID NO: 215216 - RNA, 64 nt, Homo Sapiens
acuuagaauagugucugagauaaaugaguuaacauuuucaaagccuuaggauugcuuugagguc

SEQ ID NO: 215217 - RNA, 64 nt, Homo Sapiens
ucagucaaguuuugcauuagauguuuuuguaaaauuuucaaauguccuucaaaaauaaguuaaa

SEQ ID NO: 215218 - RNA, 64 nt, Homo Sapiens
uuggcagauuuuuuuuuuuguguauucuagacaguuuucaaaaguguuaugcacuacuacuuuu

SEQ ID NO: 215219 - RNA, 64 nt, Homo Sapiens
ggaaaaacaaaauaguuuuucaagcuauaguuuguuuucaaaaauaguugcaauuacuggcucu

SEQ ID NO: 215220 - RNA, 64 nt, Homo Sapiens
acaguuuguguuucacaaacauggcuuaucaauuuuuucaaagaauucuuuuuucccaaaaaga

SEQ ID NO: 215221 - RNA, 64 nt, Homo Sapiens
guaaaaagaaauuauaauaaaagggauacuuugcuuuucaaaucuuuguuuucucuuauucuag

SEQ ID NO: 215222 - RNA, 64 nt, Homo Sapiens
cacauauuaucauacagacagaaaauccagaaucuuuucaaagcccacauaugguagcacaggc

SEQ ID NO: 215223 - RNA, 64 nt, Homo Sapiens
cuggccugugcaucggcaauucucauaucuguuuuuuucaaagaauaauaaaaucaaauaaaga

SEQ ID NO: 215224 - RNA, 64 nt, Homo Sapiens
uaauugauguuuuaaaaauguguuaaauuguaaauuuucaaaauuguuauugauaggaucaugu

SEQ ID NO: 215225 - RNA, 64 nt, Homo Sapiens
aaaagucaaucagcauuguucaguuuucaaugauuuuucaaaauugagucucagaugauuauuc

SEQ ID NO: 215226 - RNA, 64 nt, Homo Sapiens
cagauuuugucauaaaguugguuuuuacaggccuuuuucaaauggagggcaauucuguccuacu

SEQ ID NO: 215227 - RNA, 64 nt, Homo Sapiens
uacuuuaauguacaaguguaauauaugacuuuccuuuucaaaaaugauacauuauuuuaaucau

SEQ ID NO: 215228 - RNA, 64 nt, Homo Sapiens
uuaucaauacccuuucaaaauugaucaaaucugcuuuucaaagucaaaaccaagcaaaaugaag

SEQ ID NO: 215229 - RNA, 64 nt, Homo Sapiens
gcaucaucagcauuaccugucucuagaguggagguuuucaaagucaccucagagcuguccucuu

SEQ ID NO: 215230 - RNA, 64 nt, Homo Sapiens
cucauguaucucccagacccuugcagcuacuuccuuuucaaagccacuauauuugccuagcaac

SEQ ID NO: 215231 - RNA, 64 nt, Homo Sapiens
gaugucucuuuacacuuuuuuuguuuuauaugaauuuucaaaaagaucuaauaacauggaaggu

SEQ ID NO: 215232 - RNA, 64 nt, Homo Sapiens
aaaugcagcuuccacaaaaggcaaaauggguggauuuucaaauacaauauuaaaauguauguua

SEQ ID NO: 215233 - RNA, 64 nt, Homo Sapiens
aacauuuagaauucuauagaaaccgcuuguaugauuuucaaaagcaccuaacuuuaagaaaaag

SEQ ID NO: 215234 - RNA, 64 nt, Homo Sapiens
aaacccaaaauaauagcuuucaagaaaaagaaaauuuucaaauaggucuagaaacaaaauacuc

SEQ ID NO: 215235 - RNA, 64 nt, Homo Sapiens
uguucugagccuauaguguugugaauaucauguuuuuucaaaucuuaggguuauuguaaucaau

SEQ ID NO: 215236 - RNA, 64 nt, Homo Sapiens
ccauuuuauaaaaauccuaggugccucuacuaucuuuucaaaagggauaguauauggcuucuuu

SEQ ID NO: 215237 - RNA, 64 nt, Homo Sapiens
uuugugaccuaaggacgauggugaaaagaucacguuuucaaaacaaucuggugaucagaauguu

SEQ ID NO: 215238 - RNA, 64 nt, Homo Sapiens
ucccaccccaccccacccuucacaccuggcugauuuuucaaaaaguuuuuuuguagaaacaggg

SEQ ID NO: 215239 - RNA, 64 nt, Homo Sapiens
ccuuuaauaucuguugggaaggaaauguccagacuuuucaaaucucuuauuauauguuuccuuu

SEQ ID NO: 215240 - RNA, 64 nt, Homo Sapiens
guguacagugggggucuacaacaagaaguguauauuuucaaacaauuuuuuaaugauuuaacaa

SEQ ID NO: 215241 - RNA, 64 nt, Homo Sapiens
auaaguuaaugccaaacguuauguuaaaguuauuuuuucaaauacaggauuuggggagagaagc

SEQ ID NO: 215242 - RNA, 64 nt, Homo Sapiens
auuuuucauauuuuaguuugauuuuagacaauuauuuucaaaaagaaaccugacuuuuuuucac

SEQ ID NO: 215243 - RNA, 64 nt, Homo Sapiens
uuucuuccauucauaaggaguuagaauuuuaaaauuuucaaagagcaaaauugaaaaaaagauu

SEQ ID NO: 215244 - RNA, 64 nt, Homo Sapiens
ggaaauaaauuccaacucuccugcuagaauuugcuuuucaaaaucuggcucacgaaaaucugcc

SEQ ID NO: 215245 - RNA, 64 nt, Homo Sapiens
gcaguaaucaaaaugugaucaaauaaggaauacauuuucaaaauagaucucuuauuuaaaauuu

SEQ ID NO: 215246 - RNA, 64 nt, Homo Sapiens
gcucaccuacuggaagugugccagagaguacacuuuuucaaaauauaggccaaaauuauugugu

SEQ ID NO: 215247 - RNA, 64 nt, Homo Sapiens
acuaugaugugauuuuugauuauaauaaaugaacuuuucaaaugacagaaaguguauauuggua

SEQ ID NO: 215248 - RNA, 64 nt, Homo Sapiens
auaguaagaucacuuguguaaguucacuaccuuuuuuucaaaucucacagccuaaaacuucugg

SEQ ID NO: 215249 - RNA, 64 nt, Homo Sapiens
gaaugauacauucugaagguacugggcuacagaauuuucaaaaaacaugauagacagggcuaaa

SEQ ID NO: 215250 - RNA, 64 nt, Homo Sapiens
auaacugauuucaggcuaaccugugcuauuuuccuuuucaaaguucugccguuuaacuguccag

SEQ ID NO: 215251 - RNA, 64 nt, Homo Sapiens
ccucucccgauuuuaugacaucuuguguugaucuuuuucaaaaacucauuuucuuuuuuuuccu

SEQ ID NO: 215252 - RNA, 64 nt, Homo Sapiens
uuccggggaaggagauccagaacuuuuuaccagauuuucaaagacaucugugacucccaaaagu

SEQ ID NO: 215253 - RNA, 64 nt, Homo Sapiens
aauuuuaagaauuuagucuucaaacugcagguuuuuuucaaacuaguaugacuuuuaauguaaa

SEQ ID NO: 215254 - RNA, 64 nt, Homo Sapiens
gaaauuccauauaugugcaaauggugauuuaaaauuuucaaaauauaugucuuuuagauucuga

SEQ ID NO: 215255 - RNA, 64 nt, Homo Sapiens
ucucugacuugcucaggacaaacuaggccagugguuuucaaacugcuuggcagagcccugaagu

SEQ ID NO: 215256 - RNA, 64 nt, Homo Sapiens
uuuaaaaaauaagggaaauaaauguaauugccauuuuucaaagauuaaguaggaggagaggggu

SEQ ID NO: 215257 - RNA, 64 nt, Homo Sapiens
aaucaauuuagagauagaguguucuuacagaaauuuuucaaagggcauuucugaugaaucuaug

SEQ ID NO: 215258 - RNA, 64 nt, Homo Sapiens
uuuacucacauaauuaucucugaugugcuauagauuuucaaaucaaacucaacaucaaaugcuc

SEQ ID NO: 215259 - RNA, 64 nt, Homo Sapiens
cacaacugaggugugcgggccagcuuuguaccuguuuucaaaagcagucacagcucccaugccu

SEQ ID NO: 215260 - RNA, 64 nt, Homo Sapiens
cagcuuuuuucuauauauaagguauaaaucuggguuuucaaaacuacagaaaaaaaauguuuug

SEQ ID NO: 215261 - RNA, 64 nt, Homo Sapiens
acaaccugaaucuuuuuuuuauauaaauauauauuuuucaaauagauuuuugauucagcucauu

SEQ ID NO: 215262 - RNA, 64 nt, Homo Sapiens
cuaggauuuuuuuaaauagaugcugcuugcuauguuuucaaaccuuuuugagccauaggaucca

SEQ ID NO: 215263 - RNA, 64 nt, Homo Sapiens
gacuguaaauggcuugugauacucuugauacuuguuuucaaauauguuuacuaacuguaguguu

SEQ ID NO: 215264 - RNA, 64 nt, Homo Sapiens
guuaaaaaaaaagacauauauuuuuaaauaaaaauuuucaaaaaaaagucuguguuuuuguguu

SEQ ID NO: 215265 - RNA, 64 nt, Homo Sapiens
uauaauauguuuacagaugugacugauauuguaauuuucaaaugccuguaaacuguaucacuuu

SEQ ID NO: 215266 - RNA, 64 nt, Homo Sapiens
uccauucuguuaaaguaaccaaaaaaaaaaaauguuuucaaagugacuccgucucaaaaaaaaa

SEQ ID NO: 215267 - RNA, 64 nt, Homo Sapiens
ucuccauccuggcuaacacguuuucucuguaaaguuuucaaagucuaaaauauuuucaauacua

SEQ ID NO: 215268 - RNA, 64 nt, Homo Sapiens
auguuugaaucuacauucacuuuuagaacuccaguuuucaaaucaugguuuuuauguaaaacau

SEQ ID NO: 215269 - RNA, 64 nt, Homo Sapiens
gaauauaaacaggaucucaagacaugggccagguuuuucaaaaguauaugcuuucuuuugcaug

SEQ ID NO: 215270 - RNA, 64 nt, Homo Sapiens
cauuuuucauugcuaggauuuagaaaaugucaauuuuucaaacuuuuuucaaaauguagaauug

SEQ ID NO: 215271 - RNA, 64 nt, Homo Sapiens
guagaauuguagaaaaugucuauuagucaauuauuuuucaaaauaauuguguucuguaaaaaag

SEQ ID NO: 215272 - RNA, 64 nt, Homo Sapiens
gaucauaaaaccuuuaggaauugugagcucugauuuuucaaauucaugagaauucaacauaaaa

SEQ ID NO: 215273 - RNA, 64 nt, Homo Sapiens
cauguuacaagauagacauacuguaauuuaugauuuuucaaaauauaaucauguauucaaugga

SEQ ID NO: 215274 - RNA, 64 nt, Homo Sapiens
aauaaucugaggauguguuuaugcuauuuuaauauuuucaaauaucauuaaaaaauaauaaacg

SEQ ID NO: 215275 - RNA, 64 nt, Homo Sapiens
aauuguuaaacaucauucuuggguuuauuuuauauuuucaaaaauuuuuuacuaaaaugauaua

SEQ ID NO: 215276 - RNA, 64 nt, Homo Sapiens
uucuuuuuaaggaagugcuguuuuuuuuugaggguuuucaaaacauuuugaaaagcauuuacuu

SEQ ID NO: 215277 - RNA, 64 nt, Homo Sapiens
aaaagcauuuacuuuuuugaccacgagccaugaguuuucaaaaaaaucggggguuguguggguu

SEQ ID NO: 215278 - RNA, 64 nt, Homo Sapiens
caaaugugaaaaauguggcaaagcuuuuaaccaauuuucaaaccuuacuaaacauaagauaacu

SEQ ID NO: 215279 - RNA, 64 nt, Homo Sapiens
ugucuugcaaauguaauaaauuugggaaaacaaauuuucaaaaacuacagcuuagaaaacacca

SEQ ID NO: 215280 - RNA, 64 nt, Homo Sapiens
gcuuagaaaacaccagaguuuauacgaaaauauauuuucaaagguguaguaaaaauaaaaaaaa

SEQ ID NO: 215281 - RNA, 64 nt, Homo Sapiens
guaaaugccacuucagcaagguuuguuggugguuuuuucaaacucuuaugcacucaugaaacac

SEQ ID NO: 215282 - RNA, 64 nt, Homo Sapiens
uugauuuuguuuaugaaaagcaaggauagcuuaauuuucaaaaacucaaucaauguaauucagu

SEQ ID NO: 215283 - RNA, 64 nt, Homo Sapiens
cuacagcuuagaaaacaccaguuggaaaaauacuuuuucaaaaaaacugugcgaauguaauaaa

SEQ ID NO: 215284 - RNA, 64 nt, Homo Sapiens
auaaaucauaguguugagaaaaaacaccucaaacuuuucaaaacaaagaugugacagugcuuug

SEQ ID NO: 215285 - RNA, 64 nt, Homo Sapiens
auuauuuccagacccaccaccagaguggaucuuauuuucaaagcaguauagacaauuaugaguu

SEQ ID NO: 215286 - RNA, 64 nt, Homo Sapiens
gucuaccucuccucacaccccagcaccccccauuuuuucaaaccuugguaucuguugggugaac

SEQ ID NO: 215287 - RNA, 64 nt, Homo Sapiens
uugaagcauaucuugauuuuuaagcuuaucuugauuuucaaacaugcauagcuauuuuuaucac

SEQ ID NO: 215288 - RNA, 64 nt, Homo Sapiens
uacuaucuagacucgaaugcuuucauacaagugauuuucaaaaauuagucaauaaaaauugaug

SEQ ID NO: 215289 - RNA, 64 nt, Homo Sapiens
gcauguauggugaaaauaugcaaauaaaauccuguuuucaaaauauauuauuuugauuguuaaa

SEQ ID NO: 215290 - RNA, 64 nt, Homo Sapiens
gagccacuaaacagaaagucucccucccuuucacuuuucaaaguuugggaaaggaguacgugau

SEQ ID NO: 215291 - RNA, 64 nt, Homo Sapiens
gggguauuuguaccaggucaggguuuuuguguuguuuucaaauaaguuugacuaaaauaaguuu

SEQ ID NO: 215292 - RNA, 64 nt, Homo Sapiens
auauaguccaguuuuccaagauaagcucaguccuuuuucaaauguccccuuuuuaccaauacuu

SEQ ID NO: 215293 - RNA, 64 nt, Homo Sapiens
ugcacugacacagcauucaugauguuaccuucacuuuucaaaauauuguagaaggauuuuucuc

SEQ ID NO: 215294 - RNA, 64 nt, Homo Sapiens
aacuuaacauuaugagccuuuucugcucaaaaaauuuucaaagauuaaaacuauuauacauaua

SEQ ID NO: 215295 - RNA, 64 nt, Homo Sapiens
uuucacuuaaaauuauuaugcaaaaaugaauguuuuuucaaaaaaugugaaauguauuuuauuu

SEQ ID NO: 215296 - RNA, 64 nt, Homo Sapiens
aucuacaaauuacagguuuauccauuugcaaauauuuucaaaauggaaaucacuguuuauauug

SEQ ID NO: 215297 - RNA, 64 nt, Homo Sapiens
cuuaauaugccauuggguuuuuguguguaugugauuuucaaaauucaugacuugaagugcaagg

SEQ ID NO: 215298 - RNA, 64 nt, Homo Sapiens
uuauguauauuuuguuccuguuauauuggcuuuauuuucaaaauuguaguuuguaguauuaguu

SEQ ID NO: 215299 - RNA, 64 nt, Homo Sapiens
ggcugcuuacuauaggguuagggugcaucagugcuuuucaaaggaaaugauccauauaacuguu

SEQ ID NO: 215300 - RNA, 64 nt, Homo Sapiens
aaacuugccuuuuacauuauuugaguuuaagccauuuucaaaagauguucagcaagagaacugc

SEQ ID NO: 215301 - RNA, 64 nt, Homo Sapiens
guaaaaagguccucacagguccuuggcuugccauuuuucaaaaauuaguuggcaguuguuaagu

SEQ ID NO: 215302 - RNA, 64 nt, Homo Sapiens
cauuuagucuaacaacugccuugauuggaagggcuuuucaaaauuuuacaauccauauaagccc

SEQ ID NO: 215303 - RNA, 64 nt, Homo Sapiens
uugauuugguguggauugcacgaauggaggaauguuuucaaagauuucuacuguauguaugaac

SEQ ID NO: 215304 - RNA, 64 nt, Homo Sapiens
agggucuagugagcuaaguuuaguguguugaggcuuuucaaagaaccuacauauuacaugggug

SEQ ID NO: 215305 - RNA, 64 nt, Homo Sapiens
cauuuuguuuuugcuguuucacaaucacacugauuuuucaaauuuucauaccaucucugcaccc

SEQ ID NO: 215306 - RNA, 64 nt, Homo Sapiens
agcagguucuggugacauuaagaagccguuuugauuuucaaagagaagucauuuugauuuucaa

SEQ ID NO: 215307 - RNA, 64 nt, Homo Sapiens
agccguuuugauuuucaaagagaagucauuuugauuuucaaagauucuuuuuucagaccauaca

SEQ ID NO: 215308 - RNA, 64 nt, Homo Sapiens
ggccaggacauuuguccacuuaaacucucaacaacagugugaucauugguuggacacugugguu

SEQ ID NO: 215309 - RNA, 64 nt, Homo Sapiens
ugugucgagggaugggagcgaugcuuaucucucacagugugaguggucugugugaggcuguucc

SEQ ID NO: 215310 - RNA, 64 nt, Homo Sapiens
uuucuggcauagaguccuggugaggauuucuccccagugugaagcauuucuacacugauugcac

SEQ ID NO: 215311 - RNA, 64 nt, Homo Sapiens
ucuuuggugugcagugcgcuucucaugucucucccagugugaauuuuuccugcauuugcuguuu

SEQ ID NO: 215312 - RNA, 64 nt, Homo Sapiens
cgagacuucugcagagguggcugaccucaagaagcagugugaugugcugguggaagaguuugag

SEQ ID NO: 215313 - RNA, 64 nt, Homo Sapiens
ggcaggccuugugguuucaggacugcaaggacuccagugugaacucaggaggggcaggugucag

SEQ ID NO: 215314 - RNA, 64 nt, Homo Sapiens
uccuaaauagaggguaaagugugccucaguguugcagugugaaucaaagacuggggagagcugu

SEQ ID NO: 215315 - RNA, 64 nt, Homo Sapiens
aaauggcaucuaggaagguagggagguggagggacagugugaaucauggggaauguggggauca

SEQ ID NO: 215316 - RNA, 64 nt, Homo Sapiens
acuccacgggugccccuagcuggcccagagccggcagugugagcccaaguccgggcuggagccg

SEQ ID NO: 215317 - RNA, 64 nt, Homo Sapiens
cccccccggccugggcaucugaccucccccaccccagugugauuuaacauccaggaacugaggc

SEQ ID NO: 215318 - RNA, 64 nt, Homo Sapiens
caugguccucacuggccucagucucccugaccggcagugugaggggauguagcuauaguggagc

SEQ ID NO: 215319 - RNA, 64 nt, Homo Sapiens
cguuuagccaggauguggcucuccagcuuggcuucagugugaucacuugucagugcgcuuucuc

SEQ ID NO: 215320 - RNA, 64 nt, Homo Sapiens
cuugggugaugcuggaguugucauggccgcaguucagugugagauuuuuuaccagguauugcgc

SEQ ID NO: 215321 - RNA, 64 nt, Homo Sapiens
ucaucucaccagaugagaagcaacauccccugagcagugugagcccucacaccucgcuguuccc

SEQ ID NO: 215322 - RNA, 64 nt, Homo Sapiens
gcaugugugcaugcaugugugcugggacgggugacagugugagugcauguguguggcacagaug

SEQ ID NO: 215323 - RNA, 64 nt, Homo Sapiens
uuuuuccagucccauagcucagaaaaauuggccucagugugaaaaccuuuuuaacuuuauaguu

SEQ ID NO: 215324 - RNA, 64 nt, Homo Sapiens
ggggagggauggguaggugccauaaguaaaugagcagugugagaauguuuagucugagauggau

SEQ ID NO: 215325 - RNA, 58 nt, Homo Sapiens
ugaggugaccuacaggaacaaacaggagcagugugacacgguaccaguggaggaauag

SEQ ID NO: 215326 - RNA, 64 nt, Homo Sapiens
ucugaggccagggacgucacccaaggcugguggucagugugaagggcuccgugccaacugguca

SEQ ID NO: 215327 - RNA, 64 nt, Homo Sapiens
gagccgagaguucgccccaacccuuccccaggcccagugugaaaaacagacucacaaggggcuu

SEQ ID NO: 215328 - RNA, 64 nt, Homo Sapiens
auccaaagcuacccagucccuugacccagcacaguuggccgacccgugucacucccuggcuguc

SEQ ID NO: 215329 - RNA, 64 nt, Homo Sapiens
gcggacccucacaugggcagaaaaaugguggucauuggccgacaucacaguuuuccuguuuccc

SEQ ID NO: 215330 - RNA, 64 nt, Homo Sapiens
ccugugugauucccggucugccaggugccuguguuuggccgaggagaugcuggcaugccuuacu

SEQ ID NO: 215331 - RNA, 64 nt, Homo Sapiens
ucugauugggaccaggaggguggacagguaaggcuuggccgaugaacccccacaccucuuaccu

SEQ ID NO: 215332 - RNA, 64 nt, Homo Sapiens
uaaagcgugaaauuagagcuggacuuaagacucauuggccgaccauccuguguccuggccuggc

SEQ ID NO: 215333 - RNA, 64 nt, Homo Sapiens
cacuugccgaucugcguguguccagaaguggcccuuggccgagcgccgaacucgcucgcccucu

SEQ ID NO: 215334 - RNA, 64 nt, Homo Sapiens
agcuaaccacaaaugucuccuccaggcuaugaaauuggccgauuucaagaacacaucuccuuuu

SEQ ID NO: 215335 - RNA, 64 nt, Homo Sapiens
agcgaccacugcagccugcggacgaggccgggacuuggccgagcggauccuaauaaggggaaaa

SEQ ID NO: 215336 - RNA, 64 nt, Homo Sapiens
cuccuugccaggggagagacagccacgguccucuuuggccgaugcuguauucucauuuuggccc

SEQ ID NO: 215337 - RNA, 64 nt, Homo Sapiens
gcacuugcuauggaauaagaaauauaaccgaaaguuggccgacuaggugguagaacauagcaaa

SEQ ID NO: 215338 - RNA, 64 nt, Homo Sapiens
gucugcucacccagagaccucuccaggcuggccuuuggccgacucaggggucuggucucuuuga

SEQ ID NO: 215339 - RNA, 64 nt, Homo Sapiens
uuugccccacuuugcaucuccaaaauuacaacgguuggccgaucccauuugaggacaaugcuua

SEQ ID NO: 215340 - RNA, 64 nt, Homo Sapiens
cucuaaaauguaccuauuaaagcucugcugacccuuggccgaaacuuaucuacgagguuccuag

SEQ ID NO: 215341 - RNA, 64 nt, Homo Sapiens
uaugaaacagguccagaaaggggagguggccugcuuggccgacgucauggagccagcugggagc

SEQ ID NO: 215342 - RNA, 64 nt, Homo Sapiens
ccugcauguccggcugaagggccugagugaguguuuggccgaggcgcaccgcugggagucugag

SEQ ID NO: 215343 - RNA, 64 nt, Homo Sapiens
cgugaugaagacagaaggcuccggggugacgaauuuggccgauggcagauguuuugggggaacg

SEQ ID NO: 215344 - RNA, 64 nt, Homo Sapiens
uuauacagaaaccggacccacuaauccucugggauuggccgacugugagcugcagauaaggcua

SEQ ID NO: 215345 - RNA, 64 nt, Homo Sapiens
gcaaauccaaagacugaguuauguuuaaugacuuuuggccgaaucacuggaaauaucuguggug

SEQ ID NO: 215346 - RNA, 64 nt, Homo Sapiens
cagggaccuaagccacguuauccucugggaggucuuggccgacuugguggcagcugggcagguc

SEQ ID NO: 215347 - RNA, 64 nt, Homo Sapiens
ugggccccgcuggucacucaacagaguauuucccuuggccgagauggaaguuuugucccaauag

SEQ ID NO: 215348 - RNA, 52 nt, Homo Sapiens
caccuuggccugguggaugaauuuggccgaaucuucaugcaaggaaauaaca

SEQ ID NO: 215349 - RNA, 64 nt, Homo Sapiens
acgugggucugcguggaauuuaagaagggguucuuuggccgaagauucugaauaauauccgugu

SEQ ID NO: 215350 - RNA, 64 nt, Homo Sapiens
uggaaguuuugucccaauagacagaguauuucccuuggccgagaugggccccgcuggucacuca

SEQ ID NO: 215351 - RNA, 64 nt, Homo Sapiens
augguggcucaccccuguaauuaaaauauuacuuuuggccgagcuuuuuuccgugaaagauuuc

SEQ ID NO: 215352 - RNA, 64 nt, Homo Sapiens
uccacaaccaggggcuggcacuggagccagcagcuuggccgagucacaggugacccguggcccu

SEQ ID NO: 215353 - RNA, 64 nt, Homo Sapiens
cagcacguaguuugcauuccuaaauucauaucauuuggccgagucuugaauucuuuuccucucu

SEQ ID NO: 215354 - RNA, 64 nt, Homo Sapiens
agggccugauuugagccuccucucugaagaugauuuggccgagcggaagguguggaccaccgga

SEQ ID NO: 215355 - RNA, 64 nt, Homo Sapiens
uggcagacggucuuagccaagggcugugguggcauuggccgagggucuucgggugcuucccagc

SEQ ID NO: 215356 - RNA, 64 nt, Homo Sapiens
agcggggccaccgcgacguugucugcccguggacuuggccgaggcgugcgcgaugccugggguc

SEQ ID NO: 215357 - RNA, 64 nt, Homo Sapiens
uccggagagggugggguggagcagcgggggagccuuggccgaagagaaccaugcuuggcaccgu

SEQ ID NO: 215358 - RNA, 64 nt, Homo Sapiens
aaagucuaccggcccuuucuuugugaacgucacauuggccgagccguguucaguucccaggugg

SEQ ID NO: 215359 - RNA, 64 nt, Homo Sapiens
ugaugcaaacuucuccuuucagugguuggagaaauuggccgaguucaaccauucacugcaaugc

SEQ ID NO: 215360 - RNA, 64 nt, Homo Sapiens
cuaauguguggcccacagcuuaagggaugaaaacuuggccgagaucuucuguccauguugggca

SEQ ID NO: 215361 - RNA, 64 nt, Homo Sapiens
acugcacuugccucaguguuucagcuggguaguuuuggccgagacgugggcugaauuuugcuga

SEQ ID NO: 215362 - RNA, 64 nt, Homo Sapiens
gugcccgcuucuuaccacugugugucagcugggauuggccgacagcgugguggugacuucuagg

SEQ ID NO: 215363 - RNA, 64 nt, Homo Sapiens
uccuggggagcuccugggaccauggaccagcccauuggccgagcgccucuggccccucacccac

SEQ ID NO: 215364 - RNA, 64 nt, Homo Sapiens
caucuagcggccgcucgagggaagcacccgccgguuggccgaaguccacgaagccgcccucugc

SEQ ID NO: 215365 - RNA, 57 nt, Homo Sapiens
gacgggagucagagaucugagccaaccuuggccgacaugcagcauccacccccggcu

SEQ ID NO: 215366 - RNA, 64 nt, Homo Sapiens
cccuugucugcugcucccagccacguuggugguauuggccgaugagcugguuugacucauuaau

SEQ ID NO: 215367 - RNA, 64 nt, Homo Sapiens
cucagucagugucaugaauguugcaugacaacaguuggccgauuagaaggcagacuuucuacau

SEQ ID NO: 215368 - RNA, 64 nt, Homo Sapiens
ucccagugggaaaacguguggggauccaaaaugguuggccgagcccugacauucuuucccuuca

SEQ ID NO: 215369 - RNA, 64 nt, Homo Sapiens
ccgggacguggggucacuuccuucauguaagacuuuggccgaaauuucuacaccugugucuagu

SEQ ID NO: 215370 - RNA, 64 nt, Homo Sapiens
uguuuacagggucuuggaugucggguucgaccacuuggccgaugggaauggucugucacagucu

SEQ ID NO: 215371 - RNA, 64 nt, Homo Sapiens
auacuuccugucaucugccccuuuccagaaaaacuuggccgacccuuggucuacagcacggguu

SEQ ID NO: 215372 - RNA, 64 nt, Homo Sapiens
agagagacuuugucucuauuaaaaauaaaaaugauuggccgagcaugguggugcacaccaguau

SEQ ID NO: 215373 - RNA, 64 nt, Homo Sapiens
aggaagaacgcaacagaagaguccuggucugaacuuggccgaguaggggugggggugggauggc

SEQ ID NO: 215374 - RNA, 56 nt, Homo Sapiens
acuacugugggcugaaggauauucuauuggccgaucaaucaaugcuaaaccccuag

SEQ ID NO: 215375 - RNA, 64 nt, Homo Sapiens
cauagauuguaaccccuccacuccacucccgcccuuggccgaagaucauccuguccccacgcuc

SEQ ID NO: 215376 - RNA, 64 nt, Homo Sapiens
ccugagccaagcucaucuucauugaaugucucauuuggccgaggaacaacugaacuuugugguu

SEQ ID NO: 215377 - RNA, 64 nt, Homo Sapiens
gauaggcgcaguggagcggguugcuuggggggcguuggccgacuucuuagagaaggcccuccau

SEQ ID NO: 215378 - RNA, 64 nt, Homo Sapiens
gucgcgugggaugaugaguccguuguugucugccuuggccgaaagaugaaaaaaagccugaacc

SEQ ID NO: 215379 - RNA, 64 nt, Homo Sapiens
aucaggauuucccuauaaguauauugaauuuccuuuggccgauacuagaauuugcuaacuugua

SEQ ID NO: 215380 - RNA, 64 nt, Homo Sapiens
uauggagcgcuccgaccagacgacucccuccccauuggccgaguccugacaggcgcuuagcggg

SEQ ID NO: 215381 - RNA, 64 nt, Homo Sapiens
gggacuuuucaacauuggauaucgacuaaugcaguuggccgacuccucuuuagggaggcccaug

SEQ ID NO: 215382 - RNA, 64 nt, Homo Sapiens
uccccaaaugaaaaaaaaaaguaaucucagaauguuggccgagcaugguggcucacaccuguaa

SEQ ID NO: 215383 - RNA, 64 nt, Homo Sapiens
aaguaccugcucagcuuagcagcugcgggaggguuuggccgaugacggcucuguguucccuagc

SEQ ID NO: 215384 - RNA, 60 nt, Homo Sapiens
gcucugcucagcugcgcccccuucuuugcagcugcccagccccuccucccugcccucggg

SEQ ID NO: 215385 - RNA, 60 nt, Homo Sapiens
aaagguaggaagagagguccagccccccaggcugcccagagcugcuggucucauuugggg

SEQ ID NO: 215386 - RNA, 60 nt, Homo Sapiens
gcggcaccugaagggggaggaugacaagccgcugcccaccuccaagcccaggaaacagua

SEQ ID NO: 215387 - RNA, 60 nt, Homo Sapiens
ggcagcaagcgcagccuggaggaagagggugcugcccacagugggaagagacugcgggcc

SEQ ID NO: 215388 - RNA, 60 nt, Homo Sapiens
cgucugggaagugaggagcgucucugccuggcugcccauugucugggacgugagcagccc

SEQ ID NO: 215389 - RNA, 60 nt, Homo Sapiens
ugucugggacgugagcagccccucugccuggcugcccagucuggaaagugaggagcgucu

SEQ ID NO: 215390 - RNA, 60 nt, Homo Sapiens
cccaugcucacacccacagagaaucuaagugcugcccacuuccggacuauccauggcucc

SEQ ID NO: 215391 - RNA, 60 nt, Homo Sapiens
uucagccugcaaugagggacuaugugcuccgcugcccaccugcuuuggaagggacaagac

SEQ ID NO: 215392 - RNA, 60 nt, Homo Sapiens
cuguccccaggaaccaggcuuugcugaggugcugcccaaccugacaguccaggagaugga

SEQ ID NO: 215393 - RNA, 60 nt, Homo Sapiens
ucugugacccgguggugugcccaccgcccagcugcccacacccggugcaggcucccgacc

SEQ ID NO: 215394 - RNA, 60 nt, Homo Sapiens
gacgaccugcugccacuucugggaguacaagcugcccaugggugucgaggguauugggcc

SEQ ID NO: 215395 - RNA, 60 nt, Homo Sapiens
uucuacucagagcucuucacugccccucaugcugcccagcccaggugcauggauuggugc

SEQ ID NO: 215396 - RNA, 60 nt, Homo Sapiens
gcgugucccagacaucacagagugacggcugcugcccagauagggcuggcauugcuguag

SEQ ID NO: 215397 - RNA, 60 nt, Homo Sapiens
gggcuuccuacggaaguuucugccgcccaagcugcccaugacacaccugucccccaguga

SEQ ID NO: 215398 - RNA, 60 nt, Homo Sapiens
cccaggggcaggcucuuggccagagaccuugcugcccaggucacuggccucuguccuugg

SEQ ID NO: 215399 - RNA, 60 nt, Homo Sapiens
ccuccugguuuccaagcuggcaggagagaugcugcccagggcaacgccaggucugcaggc

SEQ ID NO: 215400 - RNA, 60 nt, Homo Sapiens
cccaggugagacaggcaacgcucaaguccugcugcccagggcugucugcuggguucuuuu

SEQ ID NO: 215401 - RNA, 60 nt, Homo Sapiens
uugugugugucacaugcugcuugucucagagcugcccacucaguggucacuugaccacca

SEQ ID NO: 215402 - RNA, 60 nt, Homo Sapiens
uucccuggcauuuuaaacagaauccacucugcugcccacccccagguuccuucuugcaca

SEQ ID NO: 215403 - RNA, 60 nt, Homo Sapiens
ucaggggaagaucaaacacaggugcacucagcugcccagggccucugggacacuugccuu

SEQ ID NO: 215404 - RNA, 60 nt, Homo Sapiens
ggacuccaccuccuggcugguuuaccugcugcugcccauuuucucuggguacugcuggcc

SEQ ID NO: 215405 - RNA, 60 nt, Homo Sapiens
ugcuucucaacuaaagaauagugccucagcgcugcccacaccaccgcccuccucgcugug

SEQ ID NO: 215406 - RNA, 60 nt, Homo Sapiens
uccagugcuuggcugccccacaggccacacgcugcccaggcucugcugacuucugagcag

SEQ ID NO: 215407 - RNA, 60 nt, Homo Sapiens
ggcacagccaacccuguugcccccagugccgcugcccagcuucggccauccagguggugg

SEQ ID NO: 215408 - RNA, 60 nt, Homo Sapiens
gccgggaggucacacauguacauccuggaagcugcccaagguguggccacuuguagggca

SEQ ID NO: 215409 - RNA, 60 nt, Homo Sapiens
ccucucggugcuccaucucccagcgauggugcugcccaggccccccaacugugguagcuc

SEQ ID NO: 215410 - RNA, 60 nt, Homo Sapiens
agcaagccuagguacgaagagcuggccagugcugcccaugccucccuaguuagcauccag

SEQ ID NO: 215411 - RNA, 60 nt, Homo Sapiens
gagacccgggaugugugugcuguaccccaagcugcccacugucuugcccgggcugagguc

SEQ ID NO: 215412 - RNA, 60 nt, Homo Sapiens
ugugcacauccugcaggugcuacugagacugcugcccaacaugagcagugaucuccaagg

SEQ ID NO: 215413 - RNA, 60 nt, Homo Sapiens
cugagcaaacaccagugagguugggcauaggcugcccaaugccuguuuagccaaguagcu

SEQ ID NO: 215414 - RNA, 60 nt, Homo Sapiens
gauagguaugaccuaugucuagcucagcucgcugcccaggagcacaacucagucuguggg

SEQ ID NO: 215415 - RNA, 60 nt, Homo Sapiens
caccuccuccaccugcuucaaccugcucaagcugcccaacuacagcaagaagagcguccu

SEQ ID NO: 215416 - RNA, 60 nt, Homo Sapiens
gcgccucuucccagacagccaggcccaucugcugcccagggaagcgcaggcgccugcuag

SEQ ID NO: 215417 - RNA, 60 nt, Homo Sapiens
gucugcaaaaucccaggaaacuugggucuugcugcccauccuuccucagcacagggaacc

SEQ ID NO: 215418 - RNA, 60 nt, Homo Sapiens
uuuuugcaaggcauuuuaaucagucaggaagcugcccauugaaggguuccaaccccaagu

SEQ ID NO: 215419 - RNA, 60 nt, Homo Sapiens
ccagauaucuguaaggcaucguauagauuugcugcccacauacacucauguugauggaua

SEQ ID NO: 215420 - RNA, 60 nt, Homo Sapiens
ggccucaaccacugggugcgggcccugguggcugcccagagcuaccuguacagcggcucc

SEQ ID NO: 215421 - RNA, 60 nt, Homo Sapiens
gcgagccucccucuacucggcacuguccuugcugcccagccccucucugggugccaggua

SEQ ID NO: 215422 - RNA, 60 nt, Homo Sapiens
gguccugugggcugagcggcuggggcuggggcugcccacguguggccuccgcuggcucug

SEQ ID NO: 215423 - RNA, 60 nt, Homo Sapiens
uuuuuuuuuuugagauggaguuucacucuugcugcccaggcuggagugcaguggcucaau

SEQ ID NO: 215424 - RNA, 60 nt, Homo Sapiens
cacaugggcuugugacauucaagccggacagcugcccagagcuaccacagacuugcacug

SEQ ID NO: 215425 - RNA, 60 nt, Homo Sapiens
ccagucccucgccgucccucccacagcucagcugcccaucccacuccgguuccccgcaac

SEQ ID NO: 215426 - RNA, 60 nt, Homo Sapiens
gccuggguguggcuggaaugucggaggguggcugcccacgcugcccccggcccagguguc

SEQ ID NO: 215427 - RNA, 60 nt, Homo Sapiens
gcgcuucugcugagacccugucggaugguggcugcccacgucaggaaaccaccaagugcc

SEQ ID NO: 215428 - RNA, 60 nt, Homo Sapiens
gagucagucucaguagccaucagccuggcagcugcccaucccauaaccaaagagcucaau

SEQ ID NO: 215429 - RNA, 60 nt, Homo Sapiens
ugcggauagugccucaccauugcccacccugcugcccaacuccugugagagaaaaaccaa

SEQ ID NO: 215430 - RNA, 60 nt, Homo Sapiens
ggugggagaggccagcuugagccagacagcgcugcccagggguggccgccuaguacacac

SEQ ID NO: 215431 - RNA, 60 nt, Homo Sapiens
gcuggagggcccugaacccugcacugcguggcugcccagccagcugccuccuguccuggg

SEQ ID NO: 215432 - RNA, 60 nt, Homo Sapiens
ccuguccugaaaacagcacgauguccagacgcugcccagucccaaaacccgcagguccuc

SEQ ID NO: 215433 - RNA, 60 nt, Homo Sapiens
uucggacagcgggaacuccucugcauucuggcugcccagcgguggggcccggggccaagc

SEQ ID NO: 215434 - RNA, 60 nt, Homo Sapiens
gcuccggaggugcagcuaaacagaggugaagcugcccaggcgugcaucuuccgaaggcac

SEQ ID NO: 215435 - RNA, 60 nt, Homo Sapiens
gucugugaaaugaaaguccccagaggugcagcugcccaaacgugcccgaugugcaccucc

SEQ ID NO: 215436 - RNA, 60 nt, Homo Sapiens
gugucagagaugaaacuccccagagguagagcugcccaaaugugccggaggugcggcuuc

SEQ ID NO: 215437 - RNA, 60 nt, Homo Sapiens
aucaagaugcccucccuugggcaagcugaagcugcccaccugcuccugaaguuguagaga

SEQ ID NO: 215438 - RNA, 60 nt, Homo Sapiens
uggagggguuuccuggguauaacccauugggcugcccaaggccagccagccugagcucuc

SEQ ID NO: 215439 - RNA, 60 nt, Homo Sapiens
guacaguuugacacugaucugguccaugaggcugcccagagaaagcacugcuucuguaug

SEQ ID NO: 215440 - RNA, 60 nt, Homo Sapiens
cuguucacaugcuggggaccgacaccgacagcugcccagcgacuuuugcccacagcacau

SEQ ID NO: 215441 - RNA, 60 nt, Homo Sapiens
cucaagacucaucugccuaggaaugagaaagcugcccauuaggucaccuuccugaaagau

SEQ ID NO: 215442 - RNA, 60 nt, Homo Sapiens
caaccuggucuucacaccaggcagccugcagcugcccacccuccaaagcaacgggcuggg

SEQ ID NO: 215443 - RNA, 60 nt, Homo Sapiens
ucccgggcacugucaugcccccacauggccgcugcccacggucaugcccagcuuggagug

SEQ ID NO: 215444 - RNA, 60 nt, Homo Sapiens
ucccgggcacugucaugcccccacguggccgcugcccacggucaugcccagcuuggagug

SEQ ID NO: 215445 - RNA, 60 nt, Homo Sapiens
ggcucuuccuggacagugagccaggcucaggcugcccagccccugcaaggugcaccugcc

SEQ ID NO: 215446 - RNA, 64 nt, Homo Sapiens
cugccucagccuccaacuagcugggauuacaggcacaagccaccaugccuggcuaaaauucuuu

SEQ ID NO: 215447 - RNA, 64 nt, Homo Sapiens
ucuguggguaccucccugcccagguuauucacucacaagccaccgggccuucaggacaucucaa

SEQ ID NO: 215448 - RNA, 64 nt, Homo Sapiens
cuggaaauaggccauagggccccuacuacugccaacaagccauggccuaccuugacacuuguuu

SEQ ID NO: 215449 - RNA, 64 nt, Homo Sapiens
uuagguaacugguacuuacuuccaaagacugaauacaagccacacuccaucauaucccuuaaac

SEQ ID NO: 215450 - RNA, 64 nt, Homo Sapiens
cacagagacugccucuuaacaugaagaucauuggacaagccacacggguaucccaucccgaucu

SEQ ID NO: 215451 - RNA, 64 nt, Homo Sapiens
auucagcagugucccggcacuacuaaccccugcaacaagccagaugaggaacauaaggaagaau

SEQ ID NO: 215452 - RNA, 64 nt, Homo Sapiens
gacccuuccauuaccaauggccugucccucaccaacaagccaacugccacagaugacccacuuc

SEQ ID NO: 215453 - RNA, 64 nt, Homo Sapiens
cacuucagccucccaaagugcagggauuacaggcacaagccaccgugcccagccaagaauuuuu

SEQ ID NO: 215454 - RNA, 64 nt, Homo Sapiens
cugccagccaugccuacauccccaugggcacagaacaagccaaagccuucguuguauguugacg

SEQ ID NO: 215455 - RNA, 64 nt, Homo Sapiens
ucacugggaauguguuuugaaaaugaauuugaagacaagccaacaaacccugcacuccaaaaaa

SEQ ID NO: 215456 - RNA, 64 nt, Homo Sapiens
acauucgaaggacaucagcgucccuuuuggaaauacaagccauaaaaucugggcugagccaaag

SEQ ID NO: 215457 - RNA, 64 nt, Homo Sapiens
caugcugagaagcggcgcucagcgaaugcucaagacaagccaggugauuaaucugcauucauuc

SEQ ID NO: 215458 - RNA, 64 nt, Homo Sapiens
cauggggagggcccuucagaaacccugagcuucacacuuaaacuggggggccgugcacacccca

SEQ ID NO: 215459 - RNA, 64 nt, Homo Sapiens
cauauuuauuuggcuuuuuaugggggacaggaaucacuuaaaauaaacuugugugugcaacuuu

SEQ ID NO: 215460 - RNA, 64 nt, Homo Sapiens
ucucuuguucgcacaaucuacacugccuuaccuucacuuaaaccacacacacaaggugcucaga

SEQ ID NO: 215461 - RNA, 64 nt, Homo Sapiens
gucacuuucucucuuauaaauucuguuagcugcucacuuaaacaauguccucuuugagaaaaug

SEQ ID NO: 215462 - RNA, 64 nt, Homo Sapiens
ugaauuuucaggaauuuaaaaauuagcuuuuuuccacuuaaaggagaaaaauauuugggacuag

SEQ ID NO: 215463 - RNA, 64 nt, Homo Sapiens
uucuaaaccaccuaugaguauuucuuuuagggcucacuuaaauacauguuuguauauacuguau

SEQ ID NO: 215464 - RNA, 64 nt, Homo Sapiens
cugugguaguacuccugcaauuauaaaucaaugucacuuaaaggugcagugaauugugaccaag

SEQ ID NO: 215465 - RNA, 64 nt, Homo Sapiens
auguccaugauggaauauucuuaaagugaauaaccacuuaaaaauagauaaccuguacuucaag

SEQ ID NO: 215466 - RNA, 64 nt, Homo Sapiens
aaagaagcaccacgagauggccaggacauuuguccacuuaaacucucaacaacagugugaucau

SEQ ID NO: 215467 - RNA, 64 nt, Homo Sapiens
uuaucucugauauacaaagggauauaaauauauacacuuaaauagagaaaaagagguugauuga

SEQ ID NO: 215468 - RNA, 64 nt, Homo Sapiens
aacaaccaacuaguaacagcucuuaggguuauuacacuuaaagcgugauuuuuauugggaauuu

SEQ ID NO: 215469 - RNA, 64 nt, Homo Sapiens
uugguagaucuggguuuauaguggacuugccuggcacuuaaaccucuccgcgguggagcaaacu

SEQ ID NO: 215470 - RNA, 64 nt, Homo Sapiens
caauuuuugucacaaaguaguccauuccugaucucacuuaaaauaaaucacaaguaaauuugaa

SEQ ID NO: 215471 - RNA, 64 nt, Homo Sapiens
auuacagccaaauauuaucuuaauuaauuucuuacacuuaaaaguguccaucaacaguguguca

SEQ ID NO: 215472 - RNA, 64 nt, Homo Sapiens
auuuuuucaacuucaagguauuaacagcuguuaacacuuaaaaaguacugccacauauguagcc

SEQ ID NO: 215473 - RNA, 64 nt, Homo Sapiens
gaguuauaugugaucuuucuauaaccaugccauucacuuaaauaauucaugaagggaaugguuu

SEQ ID NO: 215474 - RNA, 64 nt, Homo Sapiens
aggcgcuuuauagcuucucuaaccuucacccuuucacuuaaaggauacuuuuauuucucuugag

SEQ ID NO: 215475 - RNA, 64 nt, Homo Sapiens
gaaggucauuuggagaugugagggaagggaauuucacuuaaaagugaggauuugcuaugcagac

SEQ ID NO: 215476 - RNA, 64 nt, Homo Sapiens
aaagauaaugcauauuuuugcacaguggagcuuacacuuaaaagaaaacaaagccccaugggcu

SEQ ID NO: 215477 - RNA, 64 nt, Homo Sapiens
acaaaagaggcucccccuaaacacacagugcugccacuuaaaaagacuugagaaauuugaaagg

SEQ ID NO: 215478 - RNA, 64 nt, Homo Sapiens
uaaaaauggauaauuuauagcaguuaaauuuauagacaguuaagauuaauggauaauuuauaga

SEQ ID NO: 215479 - RNA, 64 nt, Homo Sapiens
uuuauagacaguuaaguaaaauggauaauuuauagacaguuaaacagccaacauuuuaaaauua

SEQ ID NO: 215480 - RNA, 64 nt, Homo Sapiens
ggaagaggcauagucaugaucaaaaggauauauugacaguuaucuauagccaggguaguuguua

SEQ ID NO: 215481 - RNA, 64 nt, Homo Sapiens
acauccuucucugauuucuucagcagggucaaaagacaguuacuagcaauggggaaugcuuguc

SEQ ID NO: 215482 - RNA, 64 nt, Homo Sapiens
ugcuaauuauauacaucugucuaaaguauuuguggacaguuaaaaaacacuaugauaggauuuc

SEQ ID NO: 215483 - RNA, 64 nt, Homo Sapiens
ugcuaauuaauauacaucugcaaaaguauuuguggacaguuaaaacugucuaugauaggauuuc

SEQ ID NO: 215484 - RNA, 64 nt, Homo Sapiens
agggacagacagcucuuccuugugacagagagaggacaguuaggggaacagugacauggacacc

SEQ ID NO: 215485 - RNA, 64 nt, Homo Sapiens
cuaacuccaaaaggcugucuuagaaaugaggaaggacaguuacgugccauucgcuauugagaac

SEQ ID NO: 215486 - RNA, 64 nt, Homo Sapiens; identical to SEQ ID NO: 84086

SEQ ID NO: 215487 - RNA, 64 nt, Homo Sapiens; identical to SEQ ID NO: 84087

SEQ ID NO: 215488 - RNA, 64 nt, Homo Sapiens; identical to SEQ ID NO: 84088

SEQ ID NO: 215489 - RNA, 64 nt, Homo Sapiens; identical to SEQ ID NO: 84089

SEQ ID NO: 215490 - RNA, 64 nt, Homo Sapiens; identical to SEQ ID NO: 84090

SEQ ID NO: 215491 - RNA, 64 nt, Homo Sapiens; identical to SEQ ID NO: 84091

SEQ ID NO: 215492 - RNA, 64 nt, Homo Sapiens; identical to SEQ ID NO: 84092

SEQ ID NO: 215493 - RNA, 64 nt, Homo Sapiens; identical to SEQ ID NO: 84093

SEQ ID NO: 215494 - RNA, 64 nt, Homo Sapiens; identical to SEQ ID NO: 84094

SEQ ID NO: 215495 - RNA, 64 nt, Homo Sapiens; identical to SEQ ID NO: 84095

SEQ ID NO: 215496 - RNA, 64 nt, Homo Sapiens; identical to SEQ ID NO: 84096

SEQ ID NO: 215497 - RNA, 64 nt, Homo Sapiens; identical to SEQ ID NO: 84097

SEQ ID NO: 215498 - RNA, 64 nt, Homo Sapiens; identical to SEQ ID NO: 84098

SEQ ID NO: 215499 - RNA, 64 nt, Homo Sapiens; identical to SEQ ID NO: 84099

SEQ ID NO: 215500 - RNA, 64 nt, Homo Sapiens; identical to SEQ ID NO: 84100

SEQ ID NO: 215501 - RNA, 64 nt, Homo Sapiens; identical to SEQ ID NO: 84101

SEQ ID NO: 215502 - RNA, 64 nt, Homo Sapiens; identical to SEQ ID NO: 84102

SEQ ID NO: 215503 - RNA, 64 nt, Homo Sapiens; identical to SEQ ID NO: 84103

SEQ ID NO: 215504 - RNA, 64 nt, Homo Sapiens; identical to SEQ ID NO: 84104

SEQ ID NO: 215505 - RNA, 64 nt, Homo Sapiens; identical to SEQ ID NO: 84105

SEQ ID NO: 215506 - RNA, 64 nt, Homo Sapiens; identical to SEQ ID NO: 84106

SEQ ID NO: 215507 - RNA, 64 nt, Homo Sapiens; identical to SEQ ID NO: 84107

SEQ ID NO: 215508 - RNA, 64 nt, Homo Sapiens; identical to SEQ ID NO: 84108

SEQ ID NO: 215509 - RNA, 64 nt, Homo Sapiens; identical to SEQ ID NO: 84109

SEQ ID NO: 215510 - RNA, 64 nt, Homo Sapiens; identical to SEQ ID NO: 84110

SEQ ID NO: 215511 - RNA, 64 nt, Homo Sapiens; identical to SEQ ID NO: 84111

SEQ ID NO: 215512 - RNA, 64 nt, Homo Sapiens; identical to SEQ ID NO: 84112

SEQ ID NO: 215513 - RNA, 64 nt, Homo Sapiens; identical to SEQ ID NO: 84113

SEQ ID NO: 215514 - RNA, 64 nt, Homo Sapiens; identical to SEQ ID NO: 84114

SEQ ID NO: 215515 - RNA, 64 nt, Homo Sapiens; identical to SEQ ID NO: 84115

SEQ ID NO: 215516 - RNA, 64 nt, Homo Sapiens; identical to SEQ ID NO: 84116

SEQ ID NO: 215517 - RNA, 64 nt, Homo Sapiens; identical to SEQ ID NO: 84117

SEQ ID NO: 215518 - RNA, 64 nt, Homo Sapiens; identical to SEQ ID NO: 84118

SEQ ID NO: 215519 - RNA, 64 nt, Homo Sapiens; identical to SEQ ID NO: 84119

SEQ ID NO: 215520 - RNA, 64 nt, Homo Sapiens; identical to SEQ ID NO: 84120

SEQ ID NO: 215521 - RNA, 64 nt, Homo Sapiens; identical to SEQ ID NO: 84121

SEQ ID NO: 215522 - RNA, 64 nt, Homo Sapiens; identical to SEQ ID NO: 84122

SEQ ID NO: 215523 - RNA, 64 nt, Homo Sapiens; identical to SEQ ID NO: 84123

SEQ ID NO: 215524 - RNA, 64 nt, Homo Sapiens; identical to SEQ ID NO: 84124

SEQ ID NO: 215525 - RNA, 64 nt, Homo Sapiens; identical to SEQ ID NO: 84125

SEQ ID NO: 215526 - RNA, 64 nt, Homo Sapiens; identical to SEQ ID NO: 84126

SEQ ID NO: 215527 - RNA, 64 nt, Homo Sapiens; identical to SEQ ID NO: 84127

SEQ ID NO: 215528 - RNA, 64 nt, Homo Sapiens; identical to SEQ ID NO: 84128

SEQ ID NO: 215529 - RNA, 64 nt, Homo Sapiens; identical to SEQ ID NO: 84129

SEQ ID NO: 215530 - RNA, 64 nt, Homo Sapiens; identical to SEQ ID NO: 84130

SEQ ID NO: 215531 - RNA, 64 nt, Homo Sapiens; identical to SEQ ID NO: 84131

SEQ ID NO: 215532 - RNA, 64 nt, Homo Sapiens
uuguccuccacagaucucauugcucugaaccaguguucuccacccaucccaccuugaaaaucac

SEQ ID NO: 215533 - RNA, 64 nt, Homo Sapiens
ugucggcaugucucuaccucaugcguuucuuacuguucuccaugccucaauuguccucuuuggc

SEQ ID NO: 215534 - RNA, 64 nt, Homo Sapiens
gaagagcccguuacuaucaggaggcaacuucaugguucuccaaagagccaagucugaagaauca

SEQ ID NO: 215535 - RNA, 64 nt, Homo Sapiens
cccauuuauuacuggcuugaggaaaauaugcgaaguucuccaaaccagcucggagucaauccca

SEQ ID NO: 215536 - RNA, 64 nt, Homo Sapiens
caaagggcagcgucgaagcuaguuuggugcuugugcacgggacuuucauugucauuauggccac

SEQ ID NO: 215537 - RNA, 64 nt, Homo Sapiens
uuacaguuaggauucauguugcuagcuguguggugcacgggacucccagacauacuuucagagc

SEQ ID NO: 215538 - RNA, 64 nt, Homo Sapiens
cggguggagcgugaagcaggcuggaggugccccugcacgggagguggcguuugcuaaccaaucg

SEQ ID NO: 215539 - RNA, 64 nt, Homo Sapiens
gcccccuccuugcccaccugccugcccccgggcagcacgggagggagagcagggugagcacgcu

SEQ ID NO: 215540 - RNA, 64 nt, Homo Sapiens
cugauaaggaucuaggagaagggucucaugcggacccucacaugggcagaaaaaugguggucau

SEQ ID NO: 215541 - RNA, 64 nt, Homo Sapiens
aaacuggaauccuuucacccgcuccuacagcuaacccucacaagcaugaagugcuguggcuguu

SEQ ID NO: 215542 - RNA, 64 nt, Homo Sapiens
guugagaacaagagccaguucaggguugaugccucccucacaggcagucucaucuguacaccga

SEQ ID NO: 215543 - RNA, 64 nt, Homo Sapiens
cucauuugagccucccugagcacgggggugaggacccucacacucaucugccuauagcaauagg

SEQ ID NO: 215544 - RNA, 64 nt, Homo Sapiens
ccuuucccaccgguagagaaacuuccagaccagccccucacaccacagccaagagaagccuuuc

SEQ ID NO: 215545 - RNA, 64 nt, Homo Sapiens
ccuuuaccaccuggagagaagcuuccagaccagccccucacaccacagccaggagaggccuuuc

SEQ ID NO: 215546 - RNA, 64 nt, Homo Sapiens
ccuuucucaccuggagagaaacuuccagaccagccccucacaccaccgccaggagaggccuuuc

SEQ ID NO: 215547 - RNA, 64 nt, Homo Sapiens
ccuuucccaccgggagagaaacuuccagaccagccccucacaccacagccaggagaggccuuuc

SEQ ID NO: 215548 - RNA, 64 nt, Homo Sapiens
ccuuucccaccgggagaggaacuuccagaccagccccucacaccacagccaggagaggccuuuc

SEQ ID NO: 215549 - RNA, 64 nt, Homo Sapiens
guggccaccugcaccagcgucaccucgugccucccccucacaggacacacccaagugccccuca

SEQ ID NO: 215550 - RNA, 64 nt, Homo Sapiens
ucgugccucccccucacaggacacacccaagugccccucacacccuguguuuccagaaggcccc

SEQ ID NO: 215551 - RNA, 64 nt, Homo Sapiens
aggagguagauagcucugaaucuccagccuuucucccucacaucucacagagcuuccuguggcu

SEQ ID NO: 215552 - RNA, 64 nt, Homo Sapiens
aagagagcucugagcaggugcugcccuuaccugacccucacagauuuuguucucucucugguca

SEQ ID NO: 215553 - RNA, 64 nt, Homo Sapiens
aaccuguuccucucucaggacucuccaucuaccucccucacaugucaauauguccaaaguggaa

SEQ ID NO: 215554 - RNA, 64 nt, Homo Sapiens
guaggggugcaguuuguccauuuucugaacuugacccucacauucuuucguuuuggaguguuca

SEQ ID NO: 215555 - RNA, 64 nt, Homo Sapiens
gaaaugaggauuuugcuuaagaauaguuuucuuacccucacauucaaaggauacaccugaacca

SEQ ID NO: 215556 - RNA, 64 nt, Homo Sapiens
agccaccaccagccaccucucagcugccuuuccucccucacagggggcugggggagggggcacc

SEQ ID NO: 215557 - RNA, 64 nt, Homo Sapiens
ggacugacaucgcaguuccucuccucucuucauucccucacagcagauuggccggcaccaaucu

SEQ ID NO: 215558 - RNA, 64 nt, Homo Sapiens
uuuccaucucaggcauguaucccaccaagugccucccucacagccaugcccagaagccucacac

SEQ ID NO: 215559 - RNA, 64 nt, Homo Sapiens
gugguuaaggguagcaaaucucuaaagcacgaagcccucacaaaucuuugccauuucccaaaca

SEQ ID NO: 215560 - RNA, 64 nt, Homo Sapiens
cauggauaugacaagcagggcagccuggacacugcccucacaggacagcgccaauaacaauaca

SEQ ID NO: 215561 - RNA, 64 nt, Homo Sapiens
ggccugugggccucaccugccccucuguucucuccccucacauccuccugcccagcuccucaca

SEQ ID NO: 215562 - RNA, 64 nt, Homo Sapiens
aaaaugacuuuauugcuuaauuucugccuuuccccccucacacaugcacuuuugggccuuuuuu

SEQ ID NO: 215563 - RNA, 64 nt, Homo Sapiens
uucagaugggccugugcauccuggccaagcgucacccucacacuggaggaggaugucugcucug

SEQ ID NO: 215564 - RNA, 64 nt, Homo Sapiens
agaugccacgucuucgugcauucgccaacacgugcccucacagggccagcguccuccuucccug

SEQ ID NO: 215565 - RNA, 64 nt, Homo Sapiens
gccccaccccgagaacccuccacacuggcccagccccucacacugcccguuggacuuugccccu

SEQ ID NO: 215566 - RNA, 64 nt, Homo Sapiens
ggcccagccccucacacugcccguuggacuuugccccucacacuaggccgcaggagugggaugc

SEQ ID NO: 215567 - RNA, 64 nt, Homo Sapiens
uuuucuguguuucuggacugcacuguuguccuugcccucacauagacacucagacacccucaca

SEQ ID NO: 215568 - RNA, 64 nt, Homo Sapiens
cuguuguccuugcccucacauagacacucagacacccucacaaacacaguagucuauaguuagg

SEQ ID NO: 215569 - RNA, 64 nt, Homo Sapiens
uuuggggaauggggugggggugggagaggagguagauggggaagaaauaccccagacccaacaa

SEQ ID NO: 215570 - RNA, 64 nt, Homo Sapiens
ugacuguucauuuuuuuccugccccacugcuugggauggggaguugcaacuucaguguggaauu

SEQ ID NO: 215571 - RNA, 64 nt, Homo Sapiens
cuucagaaauccuacuucagaaguguaauaaauggauggggaaaucguuugauggggaaaaguc

SEQ ID NO: 215572 - RNA, 64 nt, Homo Sapiens
ucagaaguguaauaaauggauggggaaaucguuugauggggaaaagucucuuguaaguaaaagu

SEQ ID NO: 215573 - RNA, 64 nt, Homo Sapiens
uggaggggcccgaggagccagguugcauuuauuggauggggagcuccaaggggcauuagugguu

SEQ ID NO: 215574 - RNA, 64 nt, Homo Sapiens
guaguagcccaggucggcuugucacucgcugugagauggggagauuuugucuuuugauuuaucc

SEQ ID NO: 215575 - RNA, 64 nt, Homo Sapiens
cggggggggggggggguguuaguugauccucugugauggggaggagggaagcuggaccaccugg

SEQ ID NO: 215576 - RNA, 64 nt, Homo Sapiens
gaggcugggcaucagggaucuaggaguagggugggauggggagguuuucuuuucucucugucuu

SEQ ID NO: 215577 - RNA, 64 nt, Homo Sapiens
aggaaggcuguggacccccaggaagucccaggaggauggggaccccugggcgaaucuccuccaa

SEQ ID NO: 215578 - RNA, 64 nt, Homo Sapiens
gaguggcccaggccugccccuggggcccagggaggauggggaggaagcucuggaaacuuguggg

SEQ ID NO: 215579 - RNA, 64 nt, Homo Sapiens
uggagaacaacccaagcuccuuaggggagacucggauggggacauucauuccagcaggaggcac

SEQ ID NO: 215580 - RNA, 64 nt, Homo Sapiens
caugcacaaaaucuuuucauaaaauggauuuggggauggggaaauuuacaguagaacucaucua

SEQ ID NO: 215581 - RNA, 64 nt, Homo Sapiens
aggcagugaggaaggagacaagcuuggggugggagauggggaacaagagccaaguguuacauug

SEQ ID NO: 215582 - RNA, 64 nt, Homo Sapiens
aagggacaggccaggagccaugggccucagggaggauggggauccccaucaggagggaagaugg

SEQ ID NO: 215583 - RNA, 64 nt, Homo Sapiens
uggaauguuaaggugaaccccaccccuucuuacagauggggacccagagccugcucuugggaac

SEQ ID NO: 215584 - RNA, 64 nt, Homo Sapiens
gaagcuuucagagucuucacuggcaguagggggagauggggagaggaaugaucucugcccagcc

SEQ ID NO: 215585 - RNA, 64 nt, Homo Sapiens
cccagagccaagguggcugggaucuggccccacagauggggaaagauggggaaggguguggagu

SEQ ID NO: 215586 - RNA, 64 nt, Homo Sapiens
agguggcugggaucuggccccacagauggggaaagauggggaaggguguggaguggggaggagc

SEQ ID NO: 215587 - RNA, 64 nt, Homo Sapiens
gugggacacgguguggugggagcagacaggggaggauggggaaugaauuggacuugagaugggg

SEQ ID NO: 215588 - RNA, 64 nt, Homo Sapiens
agacaggggaggauggggaaggaauuggacuugagauggggagcgcugccagggcucuggccuu

SEQ ID NO: 215589 - RNA, 64 nt, Homo Sapiens
aggcccgucgggaguucugcguuccccacucugggauggggaagcuugucugugacggcguguu

SEQ ID NO: 215590 - RNA, 64 nt, Homo Sapiens
caagcgcccacgugcucagcuauggaacucugcugauggggacccaggaaaacaccaaacacac

SEQ ID NO: 215591 - RNA, 64 nt, Homo Sapiens
agagugggauccacuucuugguuccugggauggcgauggggacucugccgcuguguagggacca

SEQ ID NO: 215592 - RNA, 64 nt, Homo Sapiens
cccagggcugcaaaacuggaagcacagccucggggauggggagggaaagacggugcuauaucca

SEQ ID NO: 215593 - RNA, 64 nt, Homo Sapiens
auguggccaagggcuccagggccagggugugagggauggggagcagcugggcacugggccggca

SEQ ID NO: 215594 - RNA, 64 nt, Homo Sapiens
caucacugcugucccuccugaggucuggauuggggauggggacaaagaaauagcaagagaugag

SEQ ID NO: 215595 - RNA, 64 nt, Homo Sapiens
agauauggagugagucaccugaccguccaggggagauggggaggcuucucuugaaaaguucagg

SEQ ID NO: 215596 - RNA, 64 nt, Homo Sapiens
ccuauuccugcuggccccuugugucuuugguggggauggggaggcccuggccugccuucuucuu

SEQ ID NO: 215597 - RNA, 64 nt, Homo Sapiens
agaagugaggccagggacagaugggugaagucuagauggggaggacccauuacaccagaagacc

SEQ ID NO: 215598 - RNA, 64 nt, Homo Sapiens
ggcaaaggugagagaucaccaaggcggucugggggauggggaggaggagggugcugggaacggc

SEQ ID NO: 215599 - RNA, 64 nt, Homo Sapiens
acuucccuaagaucccauggaauugaggcuuauggauggggaugggccagugcacacaggaaga

SEQ ID NO: 215600 - RNA, 58 nt, Homo Sapiens
cugccggaguccagaggcugcucaaugggauggggaacaauauuuaagcuccuuuuag

SEQ ID NO: 215601 - RNA, 64 nt, Homo Sapiens
accuauggauuucauguguuguucuguuacccucauucuauacauucaaacagauaacauaaaa

SEQ ID NO: 215602 - RNA, 64 nt, Homo Sapiens
ccuccuuccuagguguuaccucuacagagaaaacauucuauagcuuaaguggcuuuccuuggca

SEQ ID NO: 215603 - RNA, 64 nt, Homo Sapiens
uucaacacuuauuuucugaagcuugaauguccccauucuauaaauuaaugaucguucuggguca

SEQ ID NO: 215604 - RNA, 64 nt, Homo Sapiens
ucauauugagaucagcauucuguguauucuguggauucuauauuuguuauaucaucaauacuuu

SEQ ID NO: 215605 - RNA, 64 nt, Homo Sapiens
uagauggcuuaauaaaauagguauaaaaacaacaauucuauagacauagacauauuuuuuuaaa

SEQ ID NO: 215606 - RNA, 64 nt, Homo Sapiens
uuacauucuuggaaagucuaauuauuucaugcaaauucuauauuguuaaaaguacccaggcuug

SEQ ID NO: 215607 - RNA, 64 nt, Homo Sapiens
uaacccauucauagcauagccugagaugcaaggaauucuauaaaacaucagggcgcuugaguug

SEQ ID NO: 215608 - RNA, 64 nt, Homo Sapiens
uuagaagaaaagaucaguucucuauccuguaauuauucuauacuucuguauuauuucucucuga

SEQ ID NO: 215609 - RNA, 64 nt, Homo Sapiens
ccuuauaaacuugcucuggggaaaggccauuacuauucuauaaaaaauaucaagugaaaauuua

SEQ ID NO: 215610 - RNA, 64 nt, Homo Sapiens
uauuauuuuuaaauauaugaguuucuguacugcuauucuauauuucaugcuguuuaugcuauua

SEQ ID NO: 215611 - RNA, 64 nt, Homo Sapiens
gaaucauuagaaauuaugaguauaaaaauauaugauucuauaaaacaucacagacagaaaccuu

SEQ ID NO: 215612 - RNA, 62 nt, Homo Sapiens
ucagcauaguggaggggagauacugcagaaugaacugcaagugcagccuggcuacugcuuuu

SEQ ID NO: 215613 - RNA, 62 nt, Homo Sapiens
ccaacuuccugggccuuucucccugagcugguaacugcaaugcugcugcucucuuuccuucu

SEQ ID NO: 215614 - RNA, 62 nt, Homo Sapiens
cuaucaccucuagaagguuccagagacagugaaacugcaagaugcucucaacaggauuaugu

SEQ ID NO: 215615 - RNA, 62 nt, Homo Sapiens
uuguuucggcaaagcauuuugauggaauagggaacugcaaauguaugaugauuuugaaaagg

SEQ ID NO: 215616 - RNA, 62 nt, Homo Sapiens
augaaacagccaucuuaaaaaaaaaaaaaguaaacugcaaaaguacaaaaucauuuuucaau

SEQ ID NO: 215617 - RNA, 62 nt, Homo Sapiens
ucccagugaugccuuauuugaaacugggcuuaaacugcaaaaagaaugaaguuggauuuagg

SEQ ID NO: 215618 - RNA, 62 nt, Homo Sapiens
acacugaacauauaaccaucagcucagcaugaaacugcaaaagauaacuccaaguuuaaucc

SEQ ID NO: 215619 - RNA, 62 nt, Homo Sapiens
augaucugguacaggcaugcaaaugcccaaccaacugcaaccuucuugaaacagcaacaguc

SEQ ID NO: 215620 - RNA, 62 nt, Homo Sapiens
aauuguuguauaucacuaaaagcaugaauuggaacugcaaugaaagucaaauuuacuuuaaa

SEQ ID NO: 215621 - RNA, 62 nt, Homo Sapiens
aagauuccagagcucuuugaucgcuuuuaauaaacugcaaguucauuuuaaaugaagggcca

SEQ ID NO: 215622 - RNA, 62 nt, Homo Sapiens
auuaaaucuucuaucugagaacugacauggcuaacugcaagauuucugauuacucaugauaa

SEQ ID NO: 215623 - RNA, 62 nt, Homo Sapiens
uauuuuccuuuuauacuacacaaauacgagauaacugcaaaauucucuauggcaaagucuuu

SEQ ID NO: 215624 - RNA, 62 nt, Homo Sapiens
uuauuucaugucuuuacuggaccugaaauuuaaacugcaaugccaguccugcaggagugcug

SEQ ID NO: 215625 - RNA, 62 nt, Homo Sapiens
aaaucacaaccucuuugagccucugucaccugaacugcaaaaugaguggguuagacaaaauc

SEQ ID NO: 215626 - RNA, 62 nt, Homo Sapiens
uuuuuacuugcuagagaaucagcguauguuuaaacugcaagauuguaucuaaaguggauaca

SEQ ID NO: 215627 - RNA, 62 nt, Homo Sapiens
gucuaaaauacccauuggugcaaacaaaaaaaaacugcaaaaaaaaacagcaaaacaaaaag

SEQ ID NO: 215628 - RNA, 62 nt, Homo Sapiens
ucuacuuaccauagauaccuuucauaacugguaacugcaaagccuuuugugcuggacccagg

SEQ ID NO: 215629 - RNA, 62 nt, Homo Sapiens
guuugucauauaaccagguuuauccuuagucuaacugcaagggauggaaccugccccagguc

SEQ ID NO: 215630 - RNA, 64 nt, Homo Sapiens; identical to SEQ ID NO: 101831

SEQ ID NO: 215631 - RNA, 64 nt, Homo Sapiens; identical to SEQ ID NO: 101832

SEQ ID NO: 215632 - RNA, 64 nt, Homo Sapiens; identical to SEQ ID NO: 101833

SEQ ID NO: 215633 - RNA, 64 nt, Homo Sapiens; identical to SEQ ID NO: 101834

SEQ ID NO: 215634 - RNA, 61 nt, Homo Sapiens; identical to SEQ ID NO: 101835

SEQ ID NO: 215635 - RNA, 64 nt, Homo Sapiens; identical to SEQ ID NO: 101836

SEQ ID NO: 215636 - RNA, 64 nt, Homo Sapiens; identical to SEQ ID NO: 101837

SEQ ID NO: 215637 - RNA, 64 nt, Homo Sapiens; identical to SEQ ID NO: 101838

SEQ ID NO: 215638 - RNA, 64 nt, Homo Sapiens; identical to SEQ ID NO: 101839

SEQ ID NO: 215639 - RNA, 64 nt, Homo Sapiens; identical to SEQ ID NO: 101840

SEQ ID NO: 215640 - RNA, 64 nt, Homo Sapiens; identical to SEQ ID NO: 101841

SEQ ID NO: 215641 - RNA, 64 nt, Homo Sapiens; identical to SEQ ID NO: 101842

SEQ ID NO: 215642 - RNA, 64 nt, Homo Sapiens; identical to SEQ ID NO: 101843

SEQ ID NO: 215643 - RNA, 64 nt, Homo Sapiens; identical to SEQ ID NO: 101844

SEQ ID NO: 215644 - RNA, 64 nt, Homo Sapiens; identical to SEQ ID NO: 101845

SEQ ID NO: 215645 - RNA, 64 nt, Homo Sapiens; identical to SEQ ID NO: 101846

SEQ ID NO: 215646 - RNA, 64 nt, Homo Sapiens; identical to SEQ ID NO: 101847

SEQ ID NO: 215647 - RNA, 64 nt, Homo Sapiens; identical to SEQ ID NO: 101848

SEQ ID NO: 215648 - RNA, 64 nt, Homo Sapiens; identical to SEQ ID NO: 101849

SEQ ID NO: 215649 - RNA, 64 nt, Homo Sapiens; identical to SEQ ID NO: 101850

SEQ ID NO: 215650 - RNA, 64 nt, Homo Sapiens; identical to SEQ ID NO: 101851

SEQ ID NO: 215651 - RNA, 64 nt, Homo Sapiens; identical to SEQ ID NO: 101852

SEQ ID NO: 215652 - RNA, 64 nt, Homo Sapiens; identical to SEQ ID NO: 101853

SEQ ID NO: 215653 - RNA, 64 nt, Homo Sapiens; identical to SEQ ID NO: 101854

SEQ ID NO: 215654 - RNA, 64 nt, Homo Sapiens
aaacuaaugugauaugaaaaaagcauaaugaaaauagaugcaaaccuaaauuugaaauagugau

SEQ ID NO: 215655 - RNA, 64 nt, Homo Sapiens
uaagcaggcagcaggaacuucugcucuagauuaguagaugcauccagauggaucuuccuuacaa

SEQ ID NO: 215656 - RNA, 64 nt, Homo Sapiens
aaacucagauuuauauuuguuugcuagacacugguagaugcaacugugccuuugcuuuccaccc

SEQ ID NO: 215657 - RNA, 64 nt, Homo Sapiens
caggcuggucccugcugugaaaaugacauggaaauagaugcaggcacgugcagugcacacaaag

SEQ ID NO: 215658 - RNA, 64 nt, Homo Sapiens
ccuaaggagcuuuuaauugccccuuuuuaguuaauagaugcauuaggcacauuggugagaugca

SEQ ID NO: 215659 - RNA, 64 nt, Homo Sapiens
uuuuguguuuucuaaagcauuuuuaguucacuucuagaugcauaaucugugaucaucaugauuc

SEQ ID NO: 215660 - RNA, 64 nt, Homo Sapiens
uagagucuuacauauuugugcaccaaacuugaagaugaaccagaaaacagacuuaaacaaaaua

SEQ ID NO: 215661 - RNA, 64 nt, Homo Sapiens
uauauuuuguacaaaaacuaauucuuuugguaaaaugaaccauuuacaguucgguuuuggacuc

SEQ ID NO: 215662 - RNA, 64 nt, Homo Sapiens
agcuugugauaaagagaggagaauaugggacuccaugaaccaguguugauauguuugauuaaga

SEQ ID NO: 215663 - RNA, 64 nt, Homo Sapiens
aaaaaauuguaacccucuagaaaauaucaaagaaaugaaccagacgugguuuaaauaguugauu

SEQ ID NO: 215664 - RNA, 64 nt, Homo Sapiens
gaauaaaaaguccccaaacccaaacaaaugguuuaugaaccagaguauauguggaagauucuuu

SEQ ID NO: 215665 - RNA, 64 nt, Homo Sapiens
agccaauaaguuuuaucuuuuauaaucugucaggaugaaccacuccuuagcuuuuauccaauau

SEQ ID NO: 215666 - RNA, 64 nt, Homo Sapiens
uguuuuuaaggaaacaaaacaccacgccuggcccaugaaccaagugggauuacaggugugagcc

SEQ ID NO: 215667 - RNA, 64 nt, Homo Sapiens
uguuuuuuuuuguuuuuuuucuauuaaaugguaaaugaaccaagggauagcaaauaucuaucug

SEQ ID NO: 215668 - RNA, 64 nt, Homo Sapiens
ucauugcaugcugaagcgacgugaccacuuuagaaugaaccagugccucuugucaucaacagcc

SEQ ID NO: 215669 - RNA, 64 nt, Homo Sapiens
uaucgaccuaauggaaaugguguacaguauugccaugaaccauacuguaaugaaauuuuaaacu

SEQ ID NO: 215670 - RNA, 64 nt, Homo Sapiens
caccuuggccucccaaugcucugggauuacagacaugaaccacagugccuguuguagaaauuuu

SEQ ID NO: 215671 - RNA, 64 nt, Homo Sapiens
ccauuggaaaguggcagcuaaacauuaaauucgcaugaaccacagaugcuggagaucaccagac

SEQ ID NO: 215672 - RNA, 64 nt, Homo Sapiens
cuuuugcagauauucuucgguuugaauaauuaaaaugaaccagauaucagggugguuaauuaaa

SEQ ID NO: 215673 - RNA, 64 nt, Homo Sapiens
uaaaaugaaccagauaucagggugguuaauuaaaaugaaccagauaucagggugguuuauaaag

SEQ ID NO: 215674 - RNA, 64 nt, Homo Sapiens
ugugugugguaagagacuuguuccuaguggaucaaugaaccaucucuucugggcaguuuuguug

SEQ ID NO: 215675 - RNA, 64 nt, Homo Sapiens
uuguauugucaacaugggucauuuaaaguccuguaugaaccauaaccugcugugguaccuuugu

SEQ ID NO: 215676 - RNA, 64 nt, Homo Sapiens
cugggcuugacccgccaggggaguucuccaggccuagggccaggagagaggcccuggcacccug

SEQ ID NO: 215677 - RNA, 64 nt, Homo Sapiens
aaccauuuugcauuucccccuccuccagccucuguagggccauggcuguauguacugucgcugu

SEQ ID NO: 215678 - RNA, 64 nt, Homo Sapiens
ucgggcuguuuugcauuuaggcgaacgaguuccauagggccacaguuggguugaguuggacugu

SEQ ID NO: 215679 - RNA, 64 nt, Homo Sapiens
cugaauugaguuccauugagcuguuugagucucauagggccaugaguucaguugggucaugcca

SEQ ID NO: 215680 - RNA, 64 nt, Homo Sapiens
uugggucaaguuagauggucuuugguggguccccuagggccaugcauuguguaggauucugugg

SEQ ID NO: 215681 - RNA, 64 nt, Homo Sapiens
ugauuuuacucuugccugugaaccucaugcaugaaagcagcacauuaaauuguaaaaauacaaa

SEQ ID NO: 215682 - RNA, 64 nt, Homo Sapiens
aucucuacucucaaguaugaggggaauagaaacaaagcagcaguuuuagccaggguucaaugau

SEQ ID NO: 215683 - RNA, 64 nt, Homo Sapiens
uuugugucuuuggggucacacccuggacccagauaagcagcaacuuugaguuuaauuguacuga

SEQ ID NO: 215684 - RNA, 64 nt, Homo Sapiens
aaggagucgccagaugaucauuggguguugggagaagcagcagggggaugcagagcuuucuguu

SEQ ID NO: 215685 - RNA, 64 nt, Homo Sapiens
ggaacaccaaugcagagguaacucucaggcagcuaagcagcaccucaagaaaacauguuaaauu

SEQ ID NO: 215686 - RNA, 64 nt, Homo Sapiens
guuuaaaaagaagaagaagaaaaaaaacaagaacaagcagcaacagcuguuuuguuggggcuau

SEQ ID NO: 215687 - RNA, 64 nt, Homo Sapiens
accuucuaccuuguaauaugcaaauuugaggaguaagcagcauagcugugaucgacuuagaauc

SEQ ID NO: 215688 - RNA, 64 nt, Homo Sapiens
cucugcagggcugacaggaucagaaagaagaagcaagcagcaacuccugagaggaaguuaggau

SEQ ID NO: 215689 - RNA, 64 nt, Homo Sapiens
agcuggaauuccaaggccaaaggggcuuccuaaaaagcagcagcgcagcagauugaagaccagc

SEQ ID NO: 215690 - RNA, 64 nt, Homo Sapiens
uugaagaccagcaggggcuuucauccugggucugaagcagcagaugccaucaaccccaacagcu

SEQ ID NO: 215691 - RNA, 64 nt, Homo Sapiens
uuugauagacuggcaaagaucaugaccugaccugaagcagcagaucuuucccuuuucuuuuguu

SEQ ID NO: 215692 - RNA, 64 nt, Homo Sapiens
cgaaagucaguguguucuuggugacauguuugaaaagcagcaauccucccaacugaaaacaaca

SEQ ID NO: 215693 - RNA, 64 nt, Homo Sapiens
ccucuuuacacccacagaggugcugcgccaccggaagcagcacgugugagcugggccaggagcc

SEQ ID NO: 215694 - RNA, 64 nt, Homo Sapiens
acacuguuguuaggccugcaccugcccauccagaaagcagcagcugccuuguuaguccucccca

SEQ ID NO: 215695 - RNA, 64 nt, Homo Sapiens
ggaacuuuuugcuuucugccaaauuuaaaaauuaaagcagcaaaacaccuaaauuuuuguaaga

SEQ ID NO: 215696 - RNA, 64 nt, Homo Sapiens
gugggggucaggcuacaggucaaggaagcuuuggaagcagcaagccacaaggcccagcccuggg

SEQ ID NO: 215697 - RNA, 64 nt, Homo Sapiens
ucuucacccuuucagaugugaccucuuuuggacuaagcagcaaucuguucucuugcucaaauaa

SEQ ID NO: 215698 - RNA, 64 nt, Homo Sapiens
gucacaucuacucaacucugcuguugacaugcaaaagcagcaauagacaauaugcguguaaaug

SEQ ID NO: 215699 - RNA, 64 nt, Homo Sapiens
aaaagguagagaggaaccagcugggguggggggaaagcagcaagauacugaagcaugaagauuc

SEQ ID NO: 215700 - RNA, 64 nt, Homo Sapiens
ucccugcuugcacccccacagggcuuauaaugagaagcagcaguaaaaauaaaauaguacagaa

SEQ ID NO: 215701 - RNA, 64 nt, Homo Sapiens
uagcaaacuucaggagagcucacucaaauaguagaagcagcaaguagucauaaggagaaaaaaa

SEQ ID NO: 215702 - RNA, 64 nt, Homo Sapiens
aaaugugcauguggguagagggaauaccuuugggaagcagcaggacugucagugacaccaucuu

SEQ ID NO: 215703 - RNA, 64 nt, Homo Sapiens
ugguucauuccgacuuuuccaauggaaacucagaucccaaaagucccuaaagcagucguagagu

SEQ ID NO: 215704 - RNA, 64 nt, Homo Sapiens
cuuguauuguuuggaagaaaaaaugaugauagagucccaaaaagaagagaaaaaaaaugcccaa

SEQ ID NO: 215705 - RNA, 64 nt, Homo Sapiens
cugcuggucacugcuuagaaccgucaugccagggucccaaaagugugggugccugacuuccucu

SEQ ID NO: 215706 - RNA, 64 nt, Homo Sapiens
acugaacaguucccucaggacucacguacugaucucccaaaagaagagagggucucccuggggu

SEQ ID NO: 215707 - RNA, 64 nt, Homo Sapiens
ucagaagugcugaggcugagcaaagaauuaccccucccaaaaugauacacaaggaaagcagccu

SEQ ID NO: 215708 - RNA, 64 nt, Homo Sapiens
aaaggaauggagaaauaaucacuugagggggacgucccaaaauuaaacaguuuuguuuuguuuu

SEQ ID NO: 215709 - RNA, 64 nt, Homo Sapiens
cugggauuacaggugugagccacccgccucggccucccaaaauggaucuccugacgucgugauc

SEQ ID NO: 215710 - RNA, 64 nt, Homo Sapiens
ggcacuagaaguggcugggcaugucccuucacugucccaaaacuagcuguucauggcacugaag

SEQ ID NO: 215711 - RNA, 62 nt, Homo Sapiens
uacccacuaugucuguauguaauaaauuuuaaugucccaaaagaugucucaaauuuccagua

SEQ ID NO: 215712 - RNA, 64 nt, Homo Sapiens
ggagaaaugcaauggcuugauaaaaugugcugacucccaaaagaagcuaaauaacuuuccuaug

SEQ ID NO: 215713 - RNA, 64 nt, Homo Sapiens
ggcuuuaggcggcagaugauauacauaucugacuucccaaaagcuccaggauuugugugcuguu

SEQ ID NO: 215714 - RNA, 64 nt, Homo Sapiens
aauacaaauucuuugccuuguggauaucaagaaaucccaaaauauuuucuuaccacuguaaauu

SEQ ID NO: 215715 - RNA, 64 nt, Homo Sapiens
gggucagcucuuuuuaacuucuugcugcucuuuuucccaaaagguaaaaauauagauugaaaag

SEQ ID NO: 215716 - RNA, 64 nt, Homo Sapiens
ccuuuugugcauaugauacuaugaugaagcuuauucccaaaaugaucagaaaaaauguuaauug

SEQ ID NO: 215717 - RNA, 64 nt, Homo Sapiens
ccagagcuuucaacucucuguuacagguuuuugaucccaaaauuacugaauucuugugagugga

SEQ ID NO: 215718 - RNA, 64 nt, Homo Sapiens
uauaaaacugaaacccaugacacuaugucuucaaucccaaaaauugucaguuucuuaauguaga

SEQ ID NO: 215719 - RNA, 64 nt, Homo Sapiens
cuuuuggcagugaguaaauaaucuucuccaggauucccaaaaaguaaaacagauaaucaaauag

SEQ ID NO: 215720 - RNA, 64 nt, Homo Sapiens
uucuuuaugcauugucucaacacuuucccuuuuuucccaaaaugaguagagaauuaaagccacc

SEQ ID NO: 215721 - RNA, 64 nt, Homo Sapiens
cauuuuuucuuuucaccacccuguugagcaauuuucccaaaaaaagggcagcaauuauuaaauu

SEQ ID NO: 215722 - RNA, 64 nt, Homo Sapiens
aacauauuacuggggaaagucuaccaauuccuauucccaaaaugauacacaaaucuuuacuucu

SEQ ID NO: 215723 - RNA, 64 nt, Homo Sapiens
uugcugaaaaaguagauugauaucuugggauaguucccaaaagagaugcacuuaugcaguaaau

SEQ ID NO: 215724 - RNA, 64 nt, Homo Sapiens
uaaaaacaaauuggaagaaugagaaaggggaaucucccaaaauuguguaugcuuccagguggag

SEQ ID NO: 215725 - RNA, 64 nt, Homo Sapiens
uccagcccgggaacacuauagcuuagcauagaaaucccaaaacccagaucagcagucacccauc

SEQ ID NO: 215726 - RNA, 64 nt, Homo Sapiens
cagugucuagggacuaguuguucucuuacauccuucccaaaaaucccuaaaucugagucaguaa

SEQ ID NO: 215727 - RNA, 64 nt, Homo Sapiens
cagugucuagggacugguugucucuaaaaauccuucccaaaaauccuaaaucugagucaguaau

SEQ ID NO: 215728 - RNA, 64 nt, Homo Sapiens
ucuuuacaaagcccuaaagggcuauugaagaacuucccaaaacucgugauguccccaaacugcu

SEQ ID NO: 215729 - RNA, 64 nt, Homo Sapiens
ucagcacugacaugggaugcuccuuccagagccaucccaaaaagccuguguuuuggcaagguga

SEQ ID NO: 215730 - RNA, 64 nt, Homo Sapiens
gaacuccagaccucaugauucgccugccucggccucccaaaaugcugggauuacagauaugagc

SEQ ID NO: 215731 - RNA, 64 nt, Homo Sapiens
caacaguuaucucauguaccucugagugccuucuucccaaaagccagcaguaccauaccugcug

SEQ ID NO: 215732 - RNA, 64 nt, Homo Sapiens
uucguucucugccacagggacuugccucacugugucccaaaaacaaaucgcagccagcuuuucc

SEQ ID NO: 215733 - RNA, 64 nt, Homo Sapiens
aggcaaucccuguagccgcagagaauaaacgccuucccaaaauggcaacuucccacagccacau

SEQ ID NO: 215734 - RNA, 64 nt, Homo Sapiens
gaauucaguguaguuuauaccaggggcaaccugccagcaucacaauguuggggcugaagacgag

SEQ ID NO: 215735 - RNA, 64 nt, Homo Sapiens
ucugaggaguaaaacggcaccgcagagacuuuugcagcaucagaagcaagggggcugcugaaau

SEQ ID NO: 215736 - RNA, 64 nt, Homo Sapiens
cucagagugggggcuccuuaagccuccaggccagcagcaucagcaucaccugggagauuguuag

SEQ ID NO: 215737 - RNA, 64 nt, Homo Sapiens
gugggggcuccuuaagccuccaggccagcagcaucagcaucaccugggagauuguuaggaaugc

SEQ ID NO: 215738 - RNA, 64 nt, Homo Sapiens
aagcaaagauacuaauuuuuagaauacccacugccagcaucaaauaaauccacacacaacucug

SEQ ID NO: 215739 - RNA, 64 nt, Homo Sapiens
gcaacgcugcggaucuugguuggcuagaacggaacagcaucacaucugugcuuucuuuaccaac

SEQ ID NO: 215740 - RNA, 64 nt, Homo Sapiens
ccguguccagacuuugaacuugccugccagccuucagcaucaggaaaggccaaguccugggugu

SEQ ID NO: 215741 - RNA, 64 nt, Homo Sapiens
uuacauguuuucgaacacagaauagcucuuuucucagcaucauuauugcucuuucagcaucugu

SEQ ID NO: 215742 - RNA, 64 nt, Homo Sapiens
acggccuacuucccaauaucaucccugugugcugcagcaucaccuguccccuggccguccuguc

SEQ ID NO: 215743 - RNA, 64 nt, Homo Sapiens
ccccuggagggcugugguccgcacaagugagaggcagcaucagguugaaaguccgcuuguaaaa

SEQ ID NO: 215744 - RNA, 64 nt, Homo Sapiens
uggaaaagacuucagauugaauucacaucuuauucagcaucaaagaauucacacaggagagaaa

SEQ ID NO: 215745 - RNA, 64 nt, Homo Sapiens
uggaaaagcuuucagucaaaccucaugccuuauucagcaucacaaaaugcauaggaaagagaaa

SEQ ID NO: 215746 - RNA, 64 nt, Homo Sapiens
ugguaaagccuucagucauagcucagccauugcucagcaucagauaauucacaccagagagaaa

SEQ ID NO: 215747 - RNA, 64 nt, Homo Sapiens
aaaaaaccauacacacacacacacacacacaaaucagcaucauaagggaauguagccuuccaac

SEQ ID NO: 215748 - RNA, 64 nt, Homo Sapiens
augaacacacuugugaccuuaguacuuggucauccagcaucauacaggcaucuccaaguuagac

SEQ ID NO: 215749 - RNA, 64 nt, Homo Sapiens
gcaucauacaggcaucuccaaguuagacucuaugcagcaucaucuuuugcagcauuccucugcu

SEQ ID NO: 215750 - RNA, 64 nt, Homo Sapiens
gugauuaguaauuugucugucauugugcaugugacagcaucaauggcuggccugcagucagcau

SEQ ID NO: 215751 - RNA, 64 nt, Homo Sapiens
gugcaugugacagcaucaauggcuggccugcagucagcaucauuuuagcccugagauggugaca

SEQ ID NO: 215752 - RNA, 64 nt, Homo Sapiens
ccccggugccuaugggguccguggccauuuccgccagcaucacuacagaguccccagaacucau

SEQ ID NO: 215753 - RNA, 64 nt, Homo Sapiens
gccuuaaucguggccucccuaaggagccccaccucagcaucacuagcacaaggggccucccaaa

SEQ ID NO: 215754 - RNA, 64 nt, Homo Sapiens
gggccucauggaauggaaugucuccacuucacuccagcaucaacaaguggggaauucugaugga

SEQ ID NO: 215755 - RNA, 64 nt, Homo Sapiens
uucaguuuauaccuugccuguaguccagucucuccagcaucaauuccaucagcacaaagacaua

SEQ ID NO: 215756 - RNA, 64 nt, Homo Sapiens
cccauccaggggcuacagggcagggagcccacagcagcaucagacagugaguuacccagggcuc

SEQ ID NO: 215757 - RNA, 64 nt, Homo Sapiens
ucccucaagcuuaaugauccuguccaaagaaccucagcaucagcuuucccacuguuaaggacuc

SEQ ID NO: 215758 - RNA, 64 nt, Homo Sapiens
cacccuugguggcugcuggaaggggagagguucucagcaucaggccaccuccaccccaaugcca

SEQ ID NO: 215759 - RNA, 64 nt, Homo Sapiens
aauggauaaugggaggaaaaguugcugcuuccuucagcaucaaagccuuuccuugggaaucugc

SEQ ID NO: 215760 - RNA, 64 nt, Homo Sapiens
guccugguuccaucucugcugaggcaggcuuuuccagcaucacuacuuaugugaugacuugauc

SEQ ID NO: 215761 - RNA, 64 nt, Homo Sapiens
agauaaccaaacucguccucguuuuggaauccagcagcaucauaccgccuuagaauucggaagu

SEQ ID NO: 215762 - RNA, 64 nt, Homo Sapiens
gaccaucccaacuuuggugcuaagcuaggauguugcucagaaguaaaacggaagaaguuacccu

SEQ ID NO: 215763 - RNA, 64 nt, Homo Sapiens
uuuucagucugauaacuauuagaagagguauaaagcucagaagugcaugggggagccuuuggcc

SEQ ID NO: 215764 - RNA, 64 nt, Homo Sapiens
uuacgacgugaucuaaaccaguccuuagcaaggggcucagaacaccccgcucuggcaguaggug

SEQ ID NO: 215765 - RNA, 64 nt, Homo Sapiens
ugccgggccugggccuccugggaaggagggagcugcucagaaugccgcaugacaacugaaggca

SEQ ID NO: 215766 - RNA, 64 nt, Homo Sapiens
agugagaugaggugggcuugaaaguaccuuguccgcucagaaggaccauucaagguucacuguu

SEQ ID NO: 215767 - RNA, 64 nt, Homo Sapiens
cuccuggcuucuccuugucccuccugcagccucugcucagaacgcccuuccuccagacccugac

SEQ ID NO: 215768 - RNA, 64 nt, Homo Sapiens
agugggaaaauccacaccacacucuaaguggacagcucagaauaauuuagcauauuuccuuuca

SEQ ID NO: 215769 - RNA, 64 nt, Homo Sapiens
acagauucaccacaaauuuucaugggcguugagugcucagaauaaugcuugaacaccucaccuu

SEQ ID NO: 215770 - RNA, 64 nt, Homo Sapiens
ugcuccgcaaaguucuccgcgaccuugcugucucgcucagaacaggggcugggcguuugcucac

SEQ ID NO: 215771 - RNA, 64 nt, Homo Sapiens
acgggggucugugccggcagccugccgggguccagcucagaaccgccacccacgggggcuccuc

SEQ ID NO: 215772 - RNA, 64 nt, Homo Sapiens
uaccuuagcuucacucagcuaaucaucuuuguuggcucagaaaaccucgagccauagagccuga

SEQ ID NO: 215773 - RNA, 64 nt, Homo Sapiens
guugaggggcuccccagagggugaggaauuugaagcucagaaagguaggagucuuauaucccag

SEQ ID NO: 215774 - RNA, 64 nt, Homo Sapiens
caaagacagcaagagagcugcagccugggcccgagcucagaaacagcugucgccucagucugcg

SEQ ID NO: 215775 - RNA, 64 nt, Homo Sapiens
ugccugugccaggcaggccucaggugcaugccaugcucagaacccugcugcccuuucuaggcag

SEQ ID NO: 215776 - RNA, 64 nt, Homo Sapiens; identical to SEQ ID NO: 126013

SEQ ID NO: 215777 - RNA, 64 nt, Homo Sapiens; identical to SEQ ID NO: 126014

SEQ ID NO: 215778 - RNA, 64 nt, Homo Sapiens; identical to SEQ ID NO: 126015

SEQ ID NO: 215779 - RNA, 64 nt, Homo Sapiens; identical to SEQ ID NO: 126016

SEQ ID NO: 215780 - RNA, 64 nt, Homo Sapiens; identical to SEQ ID NO: 126017

SEQ ID NO: 215781 - RNA, 64 nt, Homo Sapiens; identical to SEQ ID NO: 126018

SEQ ID NO: 215782 - RNA, 64 nt, Homo Sapiens; identical to SEQ ID NO: 126019

SEQ ID NO: 215783 - RNA, 64 nt, Homo Sapiens; identical to SEQ ID NO: 126020

SEQ ID NO: 215784 - RNA, 64 nt, Homo Sapiens; identical to SEQ ID NO: 126021

SEQ ID NO: 215785 - RNA, 64 nt, Homo Sapiens; identical to SEQ ID NO: 126022

SEQ ID NO: 215786 - RNA, 64 nt, Homo Sapiens; identical to SEQ ID NO: 126023

SEQ ID NO: 215787 - RNA, 64 nt, Homo Sapiens; identical to SEQ ID NO: 126024

SEQ ID NO: 215788 - RNA, 64 nt, Homo Sapiens; identical to SEQ ID NO: 126025

SEQ ID NO: 215789 - RNA, 64 nt, Homo Sapiens; identical to SEQ ID NO: 126026

SEQ ID NO: 215790 - RNA, 64 nt, Homo Sapiens; identical to SEQ ID NO: 126027

SEQ ID NO: 215791 - RNA, 64 nt, Homo Sapiens; identical to SEQ ID NO: 126028

SEQ ID NO: 215792 - RNA, 64 nt, Homo Sapiens; identical to SEQ ID NO: 126029

SEQ ID NO: 215793 - RNA, 64 nt, Homo Sapiens; identical to SEQ ID NO: 126030

SEQ ID NO: 215794 - RNA, 61 nt, Homo Sapiens; identical to SEQ ID NO: 126031

SEQ ID NO: 215795 - RNA, 64 nt, Homo Sapiens; identical to SEQ ID NO: 126032

SEQ ID NO: 215796 - RNA, 64 nt, Homo Sapiens; identical to SEQ ID NO: 126033

SEQ ID NO: 215797 - RNA, 64 nt, Homo Sapiens; identical to SEQ ID NO: 126034

SEQ ID NO: 215798 - RNA, 64 nt, Homo Sapiens; identical to SEQ ID NO: 126035

SEQ ID NO: 215799 - RNA, 64 nt, Homo Sapiens; identical to SEQ ID NO: 126036

SEQ ID NO: 215800 - RNA, 64 nt, Homo Sapiens; identical to SEQ ID NO: 126037

SEQ ID NO: 215801 - RNA, 64 nt, Homo Sapiens; identical to SEQ ID NO: 126038

SEQ ID NO: 215802 - RNA, 64 nt, Homo Sapiens
cauaucuauugaaauuguacauuaauaauauuauccuauccauccuuaaguuggaaaaacuauu

SEQ ID NO: 215803 - RNA, 64 nt, Homo Sapiens
aauuauuuuuauuuucuccccccaccaaaaugcuccuauccaacagaugcaagucugugcaaaa

SEQ ID NO: 215804 - RNA, 64 nt, Homo Sapiens; identical to SEQ ID NO: 152097

SEQ ID NO: 215805 - RNA, 64 nt, Homo Sapiens; identical to SEQ ID NO: 152098

SEQ ID NO: 215806 - RNA, 64 nt, Homo Sapiens; identical to SEQ ID NO: 152099

SEQ ID NO: 215807 - RNA, 64 nt, Homo Sapiens; identical to SEQ ID NO: 152100

SEQ ID NO: 215808 - RNA, 64 nt, Homo Sapiens; identical to SEQ ID NO: 152101

SEQ ID NO: 215809 - RNA, 64 nt, Homo Sapiens; identical to SEQ ID NO: 152102

SEQ ID NO: 215810 - RNA, 64 nt, Homo Sapiens; identical to SEQ ID NO: 152103

SEQ ID NO: 215811 - RNA, 64 nt, Homo Sapiens; identical to SEQ ID NO: 152104

SEQ ID NO: 215812 - RNA, 64 nt, Homo Sapiens; identical to SEQ ID NO: 152105

SEQ ID NO: 215813 - RNA, 64 nt, Homo Sapiens; identical to SEQ ID NO: 152106

SEQ ID NO: 215814 - RNA, 64 nt, Homo Sapiens; identical to SEQ ID NO: 152107

SEQ ID NO: 215815 - RNA, 64 nt, Homo Sapiens; identical to SEQ ID NO: 152108

SEQ ID NO: 215816 - RNA, 64 nt, Homo Sapiens; identical to SEQ ID NO: 152109

SEQ ID NO: 215817 - RNA, 64 nt, Homo Sapiens; identical to SEQ ID NO: 152110

SEQ ID NO: 215818 - RNA, 64 nt, Homo Sapiens; identical to SEQ ID NO: 152111

SEQ ID NO: 215819 - RNA, 64 nt, Homo Sapiens; identical to SEQ ID NO: 152112

SEQ ID NO: 215820 - RNA, 64 nt, Homo Sapiens; identical to SEQ ID NO: 152113

SEQ ID NO: 215821 - RNA, 64 nt, Homo Sapiens; identical to SEQ ID NO: 152114

SEQ ID NO: 215822 - RNA, 64 nt, Homo Sapiens; identical to SEQ ID NO: 152115

SEQ ID NO: 215823 - RNA, 64 nt, Homo Sapiens; identical to SEQ ID NO: 152116

SEQ ID NO: 215824 - RNA, 64 nt, Homo Sapiens; identical to SEQ ID NO: 152117

SEQ ID NO: 215825 - RNA, 64 nt, Homo Sapiens; identical to SEQ ID NO: 152118

SEQ ID NO: 215826 - RNA, 64 nt, Homo Sapiens; identical to SEQ ID NO: 152119

SEQ ID NO: 215827 - RNA, 64 nt, Homo Sapiens; identical to SEQ ID NO: 152120

SEQ ID NO: 215828 - RNA, 64 nt, Homo Sapiens; identical to SEQ ID NO: 152121

SEQ ID NO: 215829 - RNA, 64 nt, Homo Sapiens; identical to SEQ ID NO: 152122

SEQ ID NO: 215830 - RNA, 64 nt, Homo Sapiens; identical to SEQ ID NO: 152123

SEQ ID NO: 215831 - RNA, 63 nt, Homo Sapiens; identical to SEQ ID NO: 152124

SEQ ID NO: 215832 - RNA, 64 nt, Homo Sapiens; identical to SEQ ID NO: 152125

SEQ ID NO: 215833 - RNA, 64 nt, Homo Sapiens; identical to SEQ ID NO: 152126

SEQ ID NO: 215834 - RNA, 64 nt, Homo Sapiens; identical to SEQ ID NO: 152127

SEQ ID NO: 215835 - RNA, 64 nt, Homo Sapiens; identical to SEQ ID NO: 152128

SEQ ID NO: 215836 - RNA, 64 nt, Homo Sapiens; identical to SEQ ID NO: 152129

SEQ ID NO: 215837 - RNA, 64 nt, Homo Sapiens; identical to SEQ ID NO: 152130

SEQ ID NO: 215838 - RNA, 64 nt, Homo Sapiens; identical to SEQ ID NO: 152131

SEQ ID NO: 215839 - RNA, 64 nt, Homo Sapiens; identical to SEQ ID NO: 152132

SEQ ID NO: 215840 - RNA, 64 nt, Homo Sapiens; identical to SEQ ID NO: 152133

SEQ ID NO: 215841 - RNA, 64 nt, Homo Sapiens; identical to SEQ ID NO: 152134

SEQ ID NO: 215842 - RNA, 64 nt, Homo Sapiens; identical to SEQ ID NO: 152135

SEQ ID NO: 215843 - RNA, 64 nt, Homo Sapiens; identical to SEQ ID NO: 152136

SEQ ID NO: 215844 - RNA, 64 nt, Homo Sapiens; identical to SEQ ID NO: 152137

SEQ ID NO: 215845 - RNA, 64 nt, Homo Sapiens; identical to SEQ ID NO: 152138

SEQ ID NO: 215846 - RNA, 64 nt, Homo Sapiens; identical to SEQ ID NO: 152139

SEQ ID NO: 215847 - RNA, 64 nt, Homo Sapiens; identical to SEQ ID NO: 152140

SEQ ID NO: 215848 - RNA, 64 nt, Homo Sapiens; identical to SEQ ID NO: 152141

SEQ ID NO: 215849 - RNA, 64 nt, Homo Sapiens; identical to SEQ ID NO: 152142

SEQ ID NO: 215850 - RNA, 64 nt, Homo Sapiens; identical to SEQ ID NO: 152143

SEQ ID NO: 215851 - RNA, 64 nt, Homo Sapiens; identical to SEQ ID NO: 152144

SEQ ID NO: 215852 - RNA, 64 nt, Homo Sapiens; identical to SEQ ID NO: 152145

SEQ ID NO: 215853 - RNA, 64 nt, Homo Sapiens; identical to SEQ ID NO: 152146

SEQ ID NO: 215854 - RNA, 64 nt, Homo Sapiens; identical to SEQ ID NO: 152147

SEQ ID NO: 215855 - RNA, 64 nt, Homo Sapiens; identical to SEQ ID NO: 152148

SEQ ID NO: 215856 - RNA, 64 nt, Homo Sapiens; identical to SEQ ID NO: 152149

SEQ ID NO: 215857 - RNA, 61 nt, Homo Sapiens; identical to SEQ ID NO: 152150

SEQ ID NO: 215858 - RNA, 64 nt, Homo Sapiens; identical to SEQ ID NO: 152151

SEQ ID NO: 215859 - RNA, 64 nt, Homo Sapiens; identical to SEQ ID NO: 152152

SEQ ID NO: 215860 - RNA, 64 nt, Homo Sapiens; identical to SEQ ID NO: 152153

SEQ ID NO: 215861 - RNA, 64 nt, Homo Sapiens; identical to SEQ ID NO: 152154

SEQ ID NO: 215862 - RNA, 64 nt, Homo Sapiens; identical to SEQ ID NO: 152155

SEQ ID NO: 215863 - RNA, 64 nt, Homo Sapiens; identical to SEQ ID NO: 152156

SEQ ID NO: 215864 - RNA, 64 nt, Homo Sapiens; identical to SEQ ID NO: 152157

SEQ ID NO: 215865 - RNA, 64 nt, Homo Sapiens; identical to SEQ ID NO: 152158

SEQ ID NO: 215866 - RNA, 64 nt, Homo Sapiens; identical to SEQ ID NO: 152159

SEQ ID NO: 215867 - RNA, 64 nt, Homo Sapiens; identical to SEQ ID NO: 152160

SEQ ID NO: 215868 - RNA, 64 nt, Homo Sapiens; identical to SEQ ID NO: 152161

SEQ ID NO: 215869 - RNA, 64 nt, Homo Sapiens; identical to SEQ ID NO: 152162

SEQ ID NO: 215870 - RNA, 64 nt, Homo Sapiens; identical to SEQ ID NO: 152163

SEQ ID NO: 215871 - RNA, 64 nt, Homo Sapiens; identical to SEQ ID NO: 152164

SEQ ID NO: 215872 - RNA, 64 nt, Homo Sapiens; identical to SEQ ID NO: 152165

SEQ ID NO: 215873 - RNA, 64 nt, Homo Sapiens; identical to SEQ ID NO: 210199

SEQ ID NO: 215874 - RNA, 64 nt, Homo Sapiens; identical to SEQ ID NO: 210200

SEQ ID NO: 215875 - RNA, 64 nt, Homo Sapiens; identical to SEQ ID NO: 210201

SEQ ID NO: 215876 - RNA, 64 nt, Homo Sapiens; identical to SEQ ID NO: 210202

SEQ ID NO: 215877 - RNA, 64 nt, Homo Sapiens; identical to SEQ ID NO: 210203

SEQ ID NO: 215878 - RNA, 64 nt, Homo Sapiens; identical to SEQ ID NO: 210204

SEQ ID NO: 215879 - RNA, 64 nt, Homo Sapiens; identical to SEQ ID NO: 210205

SEQ ID NO: 215880 - RNA, 64 nt, Homo Sapiens; identical to SEQ ID NO: 210206

SEQ ID NO: 215881 - RNA, 64 nt, Homo Sapiens; identical to SEQ ID NO: 210207

SEQ ID NO: 215882 - RNA, 64 nt, Homo Sapiens; identical to SEQ ID NO: 210208

SEQ ID NO: 215883 - RNA, 64 nt, Homo Sapiens; identical to SEQ ID NO: 210209

SEQ ID NO: 215884 - RNA, 64 nt, Homo Sapiens; identical to SEQ ID NO: 210210

SEQ ID NO: 215885 - RNA, 64 nt, Homo Sapiens; identical to SEQ ID NO: 210211

SEQ ID NO: 215886 - RNA, 60 nt, Homo Sapiens; identical to SEQ ID NO: 44968

SEQ ID NO: 215887 - RNA, 64 nt, Homo Sapiens; identical to SEQ ID NO: 210213

SEQ ID NO: 215888 - RNA, 64 nt, Homo Sapiens; identical to SEQ ID NO: 210214

SEQ ID NO: 215889 - RNA, 64 nt, Homo Sapiens; identical to SEQ ID NO: 210215

SEQ ID NO: 215890 - RNA, 64 nt, Homo Sapiens; identical to SEQ ID NO: 210216

SEQ ID NO: 215891 - RNA, 64 nt, Homo Sapiens
ccugaggcaggcagccgaccugaggccugggggcaccguggaccccuaugcccgggucagcguc

SEQ ID NO: 215892 - RNA, 64 nt, Homo Sapiens
ugagccccugggugagcuccgucugccacugggcaccguggaucugcagcauguucuggagcac

SEQ ID NO: 215893 - RNA, 64 nt, Homo Sapiens; identical to SEQ ID NO: 155629

SEQ ID NO: 215894 - RNA, 64 nt, Homo Sapiens; identical to SEQ ID NO: 155630

SEQ ID NO: 215895 - RNA, 64 nt, Homo Sapiens; identical to SEQ ID NO: 155631

SEQ ID NO: 215896 - RNA, 64 nt, Homo Sapiens; identical to SEQ ID NO: 155632

SEQ ID NO: 215897 - RNA, 64 nt, Homo Sapiens; identical to SEQ ID NO: 155633

SEQ ID NO: 215898 - RNA, 64 nt, Homo Sapiens; identical to SEQ ID NO: 155634

SEQ ID NO: 215899 - RNA, 64 nt, Homo Sapiens; identical to SEQ ID NO: 155635

SEQ ID NO: 215900 - RNA, 64 nt, Homo Sapiens; identical to SEQ ID NO: 155636

SEQ ID NO: 215901 - RNA, 64 nt, Homo Sapiens; identical to SEQ ID NO: 155637

SEQ ID NO: 215902 - RNA, 64 nt, Homo Sapiens; identical to SEQ ID NO: 155638

SEQ ID NO: 215903 - RNA, 64 nt, Homo Sapiens; identical to SEQ ID NO: 155639

SEQ ID NO: 215904 - RNA, 64 nt, Homo Sapiens; identical to SEQ ID NO: 155640

SEQ ID NO: 215905 - RNA, 64 nt, Homo Sapiens; identical to SEQ ID NO: 155641

SEQ ID NO: 215906 - RNA, 64 nt, Homo Sapiens; identical to SEQ ID NO: 155642

SEQ ID NO: 215907 - RNA, 64 nt, Homo Sapiens; identical to SEQ ID NO: 155643

SEQ ID NO: 215908 - RNA, 64 nt, Homo Sapiens; identical to SEQ ID NO: 155644

SEQ ID NO: 215909 - RNA, 64 nt, Homo Sapiens; identical to SEQ ID NO: 155645

SEQ ID NO: 215910 - RNA, 64 nt, Homo Sapiens; identical to SEQ ID NO: 155646

SEQ ID NO: 215911 - RNA, 64 nt, Homo Sapiens; identical to SEQ ID NO: 155647

SEQ ID NO: 215912 - RNA, 64 nt, Homo Sapiens; identical to SEQ ID NO: 155648

SEQ ID NO: 215913 - RNA, 64 nt, Homo Sapiens; identical to SEQ ID NO: 155649

SEQ ID NO: 215914 - RNA, 64 nt, Homo Sapiens; identical to SEQ ID NO: 155650

SEQ ID NO: 215915 - RNA, 64 nt, Homo Sapiens; identical to SEQ ID NO: 155651

SEQ ID NO: 215916 - RNA, 64 nt, Homo Sapiens; identical to SEQ ID NO: 155652

SEQ ID NO: 215917 - RNA, 64 nt, Homo Sapiens; identical to SEQ ID NO: 155653

SEQ ID NO: 215918 - RNA, 64 nt, Homo Sapiens; identical to SEQ ID NO: 155654

SEQ ID NO: 215919 - RNA, 64 nt, Homo Sapiens; identical to SEQ ID NO: 155655

SEQ ID NO: 215920 - RNA, 64 nt, Homo Sapiens; identical to SEQ ID NO: 155656

SEQ ID NO: 215921 - RNA, 64 nt, Homo Sapiens; identical to SEQ ID NO: 155657

SEQ ID NO: 215922 - RNA, 64 nt, Homo Sapiens; identical to SEQ ID NO: 155658

SEQ ID NO: 215923 - RNA, 64 nt, Homo Sapiens; identical to SEQ ID NO: 155659

SEQ ID NO: 215924 - RNA, 64 nt, Homo Sapiens; identical to SEQ ID NO: 155660

SEQ ID NO: 215925 - RNA, 64 nt, Homo Sapiens; identical to SEQ ID NO: 155661

SEQ ID NO: 215926 - RNA, 64 nt, Homo Sapiens; identical to SEQ ID NO: 155662

SEQ ID NO: 215927 - RNA, 64 nt, Homo Sapiens; identical to SEQ ID NO: 155663

SEQ ID NO: 215928 - RNA, 64 nt, Homo Sapiens; identical to SEQ ID NO: 155664

SEQ ID NO: 215929 - RNA, 64 nt, Homo Sapiens; identical to SEQ ID NO: 155665

SEQ ID NO: 215930 - RNA, 64 nt, Homo Sapiens; identical to SEQ ID NO: 155666

SEQ ID NO: 215931 - RNA, 64 nt, Homo Sapiens; identical to SEQ ID NO: 155667

SEQ ID NO: 215932 - RNA, 64 nt, Homo Sapiens; identical to SEQ ID NO: 155668

SEQ ID NO: 215933 - RNA, 64 nt, Homo Sapiens; identical to SEQ ID NO: 155669

SEQ ID NO: 215934 - RNA, 64 nt, Homo Sapiens; identical to SEQ ID NO: 155670

SEQ ID NO: 215935 - RNA, 64 nt, Homo Sapiens; identical to SEQ ID NO: 155671

SEQ ID NO: 215936 - RNA, 64 nt, Homo Sapiens; identical to SEQ ID NO: 155672

SEQ ID NO: 215937 - RNA, 64 nt, Homo Sapiens; identical to SEQ ID NO: 155673

SEQ ID NO: 215938 - RNA, 64 nt, Homo Sapiens; identical to SEQ ID NO: 155674

SEQ ID NO: 215939 - RNA, 64 nt, Homo Sapiens; identical to SEQ ID NO: 155675

SEQ ID NO: 215940 - RNA, 64 nt, Homo Sapiens; identical to SEQ ID NO: 155676

SEQ ID NO: 215941 - RNA, 64 nt, Homo Sapiens; identical to SEQ ID NO: 155677

SEQ ID NO: 215942 - RNA, 64 nt, Homo Sapiens; identical to SEQ ID NO: 155678

SEQ ID NO: 215943 - RNA, 64 nt, Homo Sapiens; identical to SEQ ID NO: 155679

SEQ ID NO: 215944 - RNA, 64 nt, Homo Sapiens; identical to SEQ ID NO: 155680

SEQ ID NO: 215945 - RNA, 64 nt, Homo Sapiens; identical to SEQ ID NO: 155681

SEQ ID NO: 215946 - RNA, 64 nt, Homo Sapiens; identical to SEQ ID NO: 155682

SEQ ID NO: 215947 - RNA, 64 nt, Homo Sapiens; identical to SEQ ID NO: 155683

SEQ ID NO: 215948 - RNA, 64 nt, Homo Sapiens; identical to SEQ ID NO: 155684

SEQ ID NO: 215949 - RNA, 64 nt, Homo Sapiens; identical to SEQ ID NO: 155685

SEQ ID NO: 215950 - RNA, 64 nt, Homo Sapiens; identical to SEQ ID NO: 155686

SEQ ID NO: 215951 - RNA, 64 nt, Homo Sapiens; identical to SEQ ID NO: 155687

SEQ ID NO: 215952 - RNA, 64 nt, Homo Sapiens; identical to SEQ ID NO: 155688

SEQ ID NO: 215953 - RNA, 64 nt, Homo Sapiens; identical to SEQ ID NO: 155689

SEQ ID NO: 215954 - RNA, 64 nt, Homo Sapiens; identical to SEQ ID NO: 155690

SEQ ID NO: 215955 - RNA, 64 nt, Homo Sapiens; identical to SEQ ID NO: 155691

SEQ ID NO: 215956 - RNA, 64 nt, Homo Sapiens; identical to SEQ ID NO: 155692

SEQ ID NO: 215957 - RNA, 64 nt, Homo Sapiens; identical to SEQ ID NO: 155693

SEQ ID NO: 215958 - RNA, 64 nt, Homo Sapiens; identical to SEQ ID NO: 155694

SEQ ID NO: 215959 - RNA, 64 nt, Homo Sapiens; identical to SEQ ID NO: 155695

SEQ ID NO: 215960 - RNA, 64 nt, Homo Sapiens; identical to SEQ ID NO: 155696

SEQ ID NO: 215961 - RNA, 64 nt, Homo Sapiens; identical to SEQ ID NO: 155697

SEQ ID NO: 215962 - RNA, 64 nt, Homo Sapiens; identical to SEQ ID NO: 155698

SEQ ID NO: 215963 - RNA, 64 nt, Homo Sapiens; identical to SEQ ID NO: 155699

SEQ ID NO: 215964 - RNA, 64 nt, Homo Sapiens; identical to SEQ ID NO: 155700

SEQ ID NO: 215965 - RNA, 64 nt, Homo Sapiens; identical to SEQ ID NO: 155701

SEQ ID NO: 215966 - RNA, 64 nt, Homo Sapiens; identical to SEQ ID NO: 155702

SEQ ID NO: 215967 - RNA, 64 nt, Homo Sapiens; identical to SEQ ID NO: 155703

SEQ ID NO: 215968 - RNA, 64 nt, Homo Sapiens; identical to SEQ ID NO: 155704

SEQ ID NO: 215969 - RNA, 64 nt, Homo Sapiens; identical to SEQ ID NO: 155705

SEQ ID NO: 215970 - RNA, 64 nt, Homo Sapiens; identical to SEQ ID NO: 155706

SEQ ID NO: 215971 - RNA, 64 nt, Homo Sapiens; identical to SEQ ID NO: 155707

SEQ ID NO: 215972 - RNA, 64 nt, Homo Sapiens; identical to SEQ ID NO: 155708

SEQ ID NO: 215973 - RNA, 64 nt, Homo Sapiens; identical to SEQ ID NO: 155709

SEQ ID NO: 215974 - RNA, 64 nt, Homo Sapiens; identical to SEQ ID NO: 155710

SEQ ID NO: 215975 - RNA, 64 nt, Homo Sapiens; identical to SEQ ID NO: 155711

SEQ ID NO: 215976 - RNA, 64 nt, Homo Sapiens; identical to SEQ ID NO: 155712

SEQ ID NO: 215977 - RNA, 64 nt, Homo Sapiens; identical to SEQ ID NO: 155713

SEQ ID NO: 215978 - RNA, 64 nt, Homo Sapiens; identical to SEQ ID NO: 155714

SEQ ID NO: 215979 - RNA, 64 nt, Homo Sapiens; identical to SEQ ID NO: 155715

SEQ ID NO: 215980 - RNA, 64 nt, Homo Sapiens; identical to SEQ ID NO: 155716

SEQ ID NO: 215981 - RNA, 64 nt, Homo Sapiens; identical to SEQ ID NO: 155717

SEQ ID NO: 215982 - RNA, 64 nt, Homo Sapiens; identical to SEQ ID NO: 155718

SEQ ID NO: 215983 - RNA, 64 nt, Homo Sapiens; identical to SEQ ID NO: 155719

SEQ ID NO: 215984 - RNA, 64 nt, Homo Sapiens; identical to SEQ ID NO: 155720

SEQ ID NO: 215985 - RNA, 64 nt, Homo Sapiens; identical to SEQ ID NO: 155721

SEQ ID NO: 215986 - RNA, 64 nt, Homo Sapiens; identical to SEQ ID NO: 155722

SEQ ID NO: 215987 - RNA, 64 nt, Homo Sapiens; identical to SEQ ID NO: 155723

SEQ ID NO: 215988 - RNA, 64 nt, Homo Sapiens; identical to SEQ ID NO: 155724

SEQ ID NO: 215989 - RNA, 64 nt, Homo Sapiens; identical to SEQ ID NO: 155725

SEQ ID NO: 215990 - RNA, 64 nt, Homo Sapiens; identical to SEQ ID NO: 155726

SEQ ID NO: 215991 - RNA, 64 nt, Homo Sapiens; identical to SEQ ID NO: 155727

SEQ ID NO: 215992 - RNA, 64 nt, Homo Sapiens; identical to SEQ ID NO: 155728

SEQ ID NO: 215993 - RNA, 64 nt, Homo Sapiens; identical to SEQ ID NO: 155729

SEQ ID NO: 215994 - RNA, 58 nt, Homo Sapiens; identical to SEQ ID NO: 155730

SEQ ID NO: 215995 - RNA, 64 nt, Homo Sapiens; identical to SEQ ID NO: 155731

SEQ ID NO: 215996 - RNA, 64 nt, Homo Sapiens; identical to SEQ ID NO: 155732

SEQ ID NO: 215997 - RNA, 64 nt, Homo Sapiens; identical to SEQ ID NO: 155733

SEQ ID NO: 215998 - RNA, 64 nt, Homo Sapiens; identical to SEQ ID NO: 155734

SEQ ID NO: 215999 - RNA, 64 nt, Homo Sapiens; identical to SEQ ID NO: 155735

SEQ ID NO: 216000 - RNA, 64 nt, Homo Sapiens; identical to SEQ ID NO: 155736

SEQ ID NO: 216001 - RNA, 64 nt, Homo Sapiens; identical to SEQ ID NO: 155737

SEQ ID NO: 216002 - RNA, 64 nt, Homo Sapiens; identical to SEQ ID NO: 155738

SEQ ID NO: 216003 - RNA, 64 nt, Homo Sapiens; identical to SEQ ID NO: 155739

SEQ ID NO: 216004 - RNA, 64 nt, Homo Sapiens; identical to SEQ ID NO: 155740

SEQ ID NO: 216005 - RNA, 64 nt, Homo Sapiens; identical to SEQ ID NO: 155741

SEQ ID NO: 216006 - RNA, 64 nt, Homo Sapiens; identical to SEQ ID NO: 155742

SEQ ID NO: 216007 - RNA, 64 nt, Homo Sapiens; identical to SEQ ID NO: 155743

SEQ ID NO: 216008 - RNA, 64 nt, Homo Sapiens; identical to SEQ ID NO: 155744

SEQ ID NO: 216009 - RNA, 64 nt, Homo Sapiens; identical to SEQ ID NO: 155745

SEQ ID NO: 216010 - RNA, 64 nt, Homo Sapiens; identical to SEQ ID NO: 155746

SEQ ID NO: 216011 - RNA, 64 nt, Homo Sapiens; identical to SEQ ID NO: 155747

SEQ ID NO: 216012 - RNA, 64 nt, Homo Sapiens; identical to SEQ ID NO: 155748

SEQ ID NO: 216013 - RNA, 64 nt, Homo Sapiens; identical to SEQ ID NO: 155749

SEQ ID NO: 216014 - RNA, 64 nt, Homo Sapiens; identical to SEQ ID NO: 155750

SEQ ID NO: 216015 - RNA, 64 nt, Homo Sapiens; identical to SEQ ID NO: 155751

SEQ ID NO: 216016 - RNA, 64 nt, Homo Sapiens; identical to SEQ ID NO: 155752

SEQ ID NO: 216017 - RNA, 64 nt, Homo Sapiens; identical to SEQ ID NO: 155753

SEQ ID NO: 216018 - RNA, 63 nt, Homo Sapiens; identical to SEQ ID NO: 155754

SEQ ID NO: 216019 - RNA, 64 nt, Homo Sapiens; identical to SEQ ID NO: 155755

SEQ ID NO: 216020 - RNA, 64 nt, Homo Sapiens; identical to SEQ ID NO: 155756

SEQ ID NO: 216021 - RNA, 64 nt, Homo Sapiens; identical to SEQ ID NO: 155757

SEQ ID NO: 216022 - RNA, 64 nt, Homo Sapiens; identical to SEQ ID NO: 155758

SEQ ID NO: 216023 - RNA, 64 nt, Homo Sapiens; identical to SEQ ID NO: 155759

SEQ ID NO: 216024 - RNA, 64 nt, Homo Sapiens; identical to SEQ ID NO: 155760

SEQ ID NO: 216025 - RNA, 64 nt, Homo Sapiens; identical to SEQ ID NO: 155761

SEQ ID NO: 216026 - RNA, 64 nt, Homo Sapiens; identical to SEQ ID NO: 155762

SEQ ID NO: 216027 - RNA, 64 nt, Homo Sapiens; identical to SEQ ID NO: 155763

SEQ ID NO: 216028 - RNA, 64 nt, Homo Sapiens; identical to SEQ ID NO: 155764

SEQ ID NO: 216029 - RNA, 64 nt, Homo Sapiens; identical to SEQ ID NO: 155765

SEQ ID NO: 216030 - RNA, 64 nt, Homo Sapiens; identical to SEQ ID NO: 155766

SEQ ID NO: 216031 - RNA, 64 nt, Homo Sapiens; identical to SEQ ID NO: 155767

SEQ ID NO: 216032 - RNA, 64 nt, Homo Sapiens; identical to SEQ ID NO: 155768

SEQ ID NO: 216033 - RNA, 64 nt, Homo Sapiens; identical to SEQ ID NO: 155769

SEQ ID NO: 216034 - RNA, 64 nt, Homo Sapiens; identical to SEQ ID NO: 155770

SEQ ID NO: 216035 - RNA, 64 nt, Homo Sapiens; identical to SEQ ID NO: 155771

SEQ ID NO: 216036 - RNA, 64 nt, Homo Sapiens; identical to SEQ ID NO: 155772

SEQ ID NO: 216037 - RNA, 64 nt, Homo Sapiens; identical to SEQ ID NO: 155773

SEQ ID NO: 216038 - RNA, 64 nt, Homo Sapiens; identical to SEQ ID NO: 155774

SEQ ID NO: 216039 - RNA, 64 nt, Homo Sapiens; identical to SEQ ID NO: 155775

SEQ ID NO: 216040 - RNA, 64 nt, Homo Sapiens; identical to SEQ ID NO: 155776

SEQ ID NO: 216041 - RNA, 64 nt, Homo Sapiens; identical to SEQ ID NO: 155777

SEQ ID NO: 216042 - RNA, 64 nt, Homo Sapiens; identical to SEQ ID NO: 155778

SEQ ID NO: 216043 - RNA, 64 nt, Homo Sapiens; identical to SEQ ID NO: 155779

SEQ ID NO: 216044 - RNA, 64 nt, Homo Sapiens; identical to SEQ ID NO: 155780

SEQ ID NO: 216045 - RNA, 64 nt, Homo Sapiens; identical to SEQ ID NO: 155781

SEQ ID NO: 216046 - RNA, 64 nt, Homo Sapiens; identical to SEQ ID NO: 155782

SEQ ID NO: 216047 - RNA, 64 nt, Homo Sapiens; identical to SEQ ID NO: 155783

SEQ ID NO: 216048 - RNA, 64 nt, Homo Sapiens; identical to SEQ ID NO: 155784

SEQ ID NO: 216049 - RNA, 64 nt, Homo Sapiens; identical to SEQ ID NO: 155785

SEQ ID NO: 216050 - RNA, 64 nt, Homo Sapiens; identical to SEQ ID NO: 155786

SEQ ID NO: 216051 - RNA, 53 nt, Homo Sapiens; identical to SEQ ID NO: 155787

SEQ ID NO: 216052 - RNA, 64 nt, Homo Sapiens; identical to SEQ ID NO: 155788

SEQ ID NO: 216053 - RNA, 64 nt, Homo Sapiens; identical to SEQ ID NO: 155789

SEQ ID NO: 216054 - RNA, 64 nt, Homo Sapiens; identical to SEQ ID NO: 155790

SEQ ID NO: 216055 - RNA, 64 nt, Homo Sapiens; identical to SEQ ID NO: 155791

SEQ ID NO: 216056 - RNA, 64 nt, Homo Sapiens; identical to SEQ ID NO: 155792

SEQ ID NO: 216057 - RNA, 64 nt, Homo Sapiens; identical to SEQ ID NO: 155793

SEQ ID NO: 216058 - RNA, 64 nt, Homo Sapiens; identical to SEQ ID NO: 155794

SEQ ID NO: 216059 - RNA, 64 nt, Homo Sapiens; identical to SEQ ID NO: 155795

SEQ ID NO: 216060 - RNA, 64 nt, Homo Sapiens; identical to SEQ ID NO: 155796

SEQ ID NO: 216061 - RNA, 64 nt, Homo Sapiens; identical to SEQ ID NO: 155797

SEQ ID NO: 216062 - RNA, 64 nt, Homo Sapiens; identical to SEQ ID NO: 155798

SEQ ID NO: 216063 - RNA, 64 nt, Homo Sapiens; identical to SEQ ID NO: 155799

SEQ ID NO: 216064 - RNA, 64 nt, Homo Sapiens; identical to SEQ ID NO: 155800

SEQ ID NO: 216065 - RNA, 64 nt, Homo Sapiens; identical to SEQ ID NO: 155801

SEQ ID NO: 216066 - RNA, 64 nt, Homo Sapiens; identical to SEQ ID NO: 155802

SEQ ID NO: 216067 - RNA, 64 nt, Homo Sapiens; identical to SEQ ID NO: 155803

SEQ ID NO: 216068 - RNA, 64 nt, Homo Sapiens; identical to SEQ ID NO: 155804

SEQ ID NO: 216069 - RNA, 64 nt, Homo Sapiens; identical to SEQ ID NO: 155805

SEQ ID NO: 216070 - RNA, 64 nt, Homo Sapiens; identical to SEQ ID NO: 155806

SEQ ID NO: 216071 - RNA, 64 nt, Homo Sapiens; identical to SEQ ID NO: 155807

SEQ ID NO: 216072 - RNA, 64 nt, Homo Sapiens; identical to SEQ ID NO: 155808

SEQ ID NO: 216073 - RNA, 64 nt, Homo Sapiens
uaagcuugggcgugugcaggaguuugacaguggccugcugcacuggcggauuggugggggggac

SEQ ID NO: 216074 - RNA, 64 nt, Homo Sapiens
cccagggcugcugcucauccugggcaagcugauccugcugcaccacaagcacccagaacggaag

SEQ ID NO: 216075 - RNA, 64 nt, Homo Sapiens
gaaaaaugucucuuuuuccugugccauuugccuucugcugcaacgaaaauauuuccugauucaa

SEQ ID NO: 216076 - RNA, 64 nt, Homo Sapiens
uuugguaccucuaguagauaguguguucauuucccugcugcaaauuuugaaguauuugggcagg

SEQ ID NO: 216077 - RNA, 64 nt, Homo Sapiens
uggcacaggcauugcacacggggcccagucagcccugcugcacaccugccaaggcugaaucccu

SEQ ID NO: 216078 - RNA, 64 nt, Homo Sapiens
gggugcaggcauugcacacgaggcccugccagcccugcugcacaccugcaagggcugaguuccc

SEQ ID NO: 216079 - RNA, 64 nt, Homo Sapiens
ugaaaacuuucuuucuaauacaccuuaacucuggcugcugcaauaagcaaaauugguuaaucua

SEQ ID NO: 216080 - RNA, 64 nt, Homo Sapiens
aauaagaaccauuaugugggauaucacugauauacugcugcaugaccuuuccuuaucaaauaga

SEQ ID NO: 216081 - RNA, 64 nt, Homo Sapiens
aaagcuauuacaaauauaacuauuuuuuuaauuccugcugcacuuuacguaugcagacuagucu

SEQ ID NO: 216082 - RNA, 64 nt, Homo Sapiens
auugcuuugccaucuucugcaguuguuccacuuucugcugcagucuaaaguauugcuuuagaau

SEQ ID NO: 216083 - RNA, 64 nt, Homo Sapiens
gguccuaugccagccucaccagguguuuacugugcugcugcacuccugguggggcugaugucac

SEQ ID NO: 216084 - RNA, 64 nt, Homo Sapiens
ugcggugucccuuuguucuucaaggagcucuucgcugcugcaucggcuuggugguuauugucuu

SEQ ID NO: 216085 - RNA, 64 nt, Homo Sapiens
gacauaaagaacuaaaggccgaaagaaucucuugcugcugcaaagaacagauuuuauauuucuu

SEQ ID NO: 216086 - RNA, 64 nt, Homo Sapiens
gaguccaaucccaccuccugguguagaauuuacacugcugcaccugaggucgauguuucaaagu

SEQ ID NO: 216087 - RNA, 64 nt, Homo Sapiens
cugcccugggcugggugcccgaggggcucauaugcugcugcagaaugagcucuuccugaacgug

SEQ ID NO: 216088 - RNA, 64 nt, Homo Sapiens
ccugugcccagccugugcgugucaaccccaccgacugcugcaaacaguguccaggugagagagg

SEQ ID NO: 216089 - RNA, 64 nt, Homo Sapiens
cgagacugagccuccugcagacgggcgaagccgccugcugcagcccaggaagccagcccucugc

SEQ ID NO: 216090 - RNA, 64 nt, Homo Sapiens
gaagccagcccucugcucggccucgccggccucccugcugcaggccucccucucuucaccgccu

SEQ ID NO: 216091 - RNA, 64 nt, Homo Sapiens
ucagcaacugugucgugagccacccacagccgaucugcugcagggagggccugacuguccugcu

SEQ ID NO: 216092 - RNA, 64 nt, Homo Sapiens
ugguauuucccugacagagaccauggccccggcucugcugcacucuggaguccaccagccugcc

SEQ ID NO: 216093 - RNA, 64 nt, Homo Sapiens
gucccgugcaugcuccuuuucccagaacuccucucugcugcacccacagcaucuguucccgagg

SEQ ID NO: 216094 - RNA, 64 nt, Homo Sapiens
ugucuguauuaaacauggcguuauuuaaguaguccugcugcaagaaaggcacuucagugaauau

SEQ ID NO: 216095 - RNA, 64 nt, Homo Sapiens
gcaccaaaaggcaaaugguacuguccacagugcacugcugcaaugaagagaagaggcagcagac

SEQ ID NO: 216096 - RNA, 64 nt, Homo Sapiens
uuaaggaaaguauuuuauauucaacagguauauucugcugcauguacuguacuccagagcuguu

SEQ ID NO: 216097 - RNA, 64 nt, Homo Sapiens
ggagagaaaucauaacagacagaagaacggcuuucugcugcaauucaucaccugcugucugcuu

SEQ ID NO: 216098 - RNA, 64 nt, Homo Sapiens
ucacaaacaccucugcauaucaaaugauacacuacugcugcagcagacaauuguucaaaagaug

SEQ ID NO: 216099 - RNA, 64 nt, Homo Sapiens
accaccuuccgcaggaugcaagccccacucacagcugcugcacccaucuugccagcccaccagc

SEQ ID NO: 216100 - RNA, 64 nt, Homo Sapiens
accaguaccucguaggucccagggggugccuccccugcugcacaagcacccccaaacuuaccuc

SEQ ID NO: 216101 - RNA, 64 nt, Homo Sapiens
acaaugcagggcuccucauugcucccaucugccucugcugcacacacaggcaccagcagggaug

SEQ ID NO: 216102 - RNA, 64 nt, Homo Sapiens
acucucucuugcucgggaccugccugagggcucccugcugcaguucgccguacuuccaucugcu

SEQ ID NO: 216103 - RNA, 64 nt, Homo Sapiens
uggacaucagccaaauuugacccaccguucuucucugcugcauugcaacacugugucccuucgc

SEQ ID NO: 216104 - RNA, 64 nt, Homo Sapiens
uuuuucucucaguguucuggucuccagcaggccucugcugcagcccagcagaucugaccacugu

SEQ ID NO: 216105 - RNA, 64 nt, Homo Sapiens
aggcuaaagaaucccgaaggcaucgaggccauuucugcugcaacaagguuuccugucucuucac

SEQ ID NO: 216106 - RNA, 64 nt, Homo Sapiens
gcccccuucugagaugcagccagaagcucugugccugcugcaaagauucagguggacccuccuc

SEQ ID NO: 216107 - RNA, 64 nt, Homo Sapiens
agguguauauaaacguccucugugcuggguguuucugcugcagguggcagguggccccaggccu

SEQ ID NO: 216108 - RNA, 64 nt, Homo Sapiens
gaucaccaggugcaggcccccacccucggagaugcugcugcagugagugguuccacugccugga

SEQ ID NO: 216109 - RNA, 64 nt, Homo Sapiens
agcucccccgggaggggcccgcuugccucggcuccugcugcaccaacccagccgcugcccggcg

SEQ ID NO: 216110 - RNA, 64 nt, Homo Sapiens
ggauccgacuugaauuuucccacugcacccccuccugcugcagaggggcaggcccugcacuguc

SEQ ID NO: 216111 - RNA, 64 nt, Homo Sapiens
uccugucuuccuuccuaggugaaacugaacuguacugcugcauugagcacauggguuauaauga

SEQ ID NO: 216112 - RNA, 64 nt, Homo Sapiens
cacagcuccuccagaaaggguaagucacagggaucugcugcagcggcccugugagggcugggac

SEQ ID NO: 216113 - RNA, 64 nt, Homo Sapiens
ccccucccagcugguggugcugcccuaucagaugcugcugcaugcggccacucggcaggccgcg

SEQ ID NO: 216114 - RNA, 64 nt, Homo Sapiens
guucuuuccccagcucugccaggcccauucccagcugcugcaguacguggagcgauacggguga

SEQ ID NO: 216115 - RNA, 64 nt, Homo Sapiens
ugcaugaagccccugcuuuuuggugggagugucccugcugcaucgaccaaagcccaggauggcu

SEQ ID NO: 216116 - RNA, 64 nt, Homo Sapiens
caaaagaucacauuucugggccuucuccagccagcugcugcagaggcacacaccuuucugaaau

SEQ ID NO: 216117 - RNA, 64 nt, Homo Sapiens
agcuuacuggucccuugcucauaucucaccugcacugcugcaaccacugcagaguugaggccuc

SEQ ID NO: 216118 - RNA, 64 nt, Homo Sapiens
cucucucucaauuacugggauagagcugcucuuccugcugcauugauacucauccuguuccccc

SEQ ID NO: 216119 - RNA, 64 nt, Homo Sapiens
gcugaagccaccccugcugaugaugagcaagugccugcugcagguccaaacacagcauccaggg

SEQ ID NO: 216120 - RNA, 64 nt, Homo Sapiens
aauccacugcuuuucaggcaaggagggagaaauccugcugcacacuggcuuugucccggagucg

SEQ ID NO: 216121 - RNA, 64 nt, Homo Sapiens
cugccacagaccgucucagacacgcacagugggccugcugcaugauucacacccagucccugcc

SEQ ID NO: 216122 - RNA, 64 nt, Homo Sapiens; identical to SEQ ID NO: 216121

SEQ ID NO: 216123 - RNA, 64 nt, Homo Sapiens
cugccacagaccgucucagacacgcacagugggccugcugcaugcguguuaccuggcuuuuggc

SEQ ID NO: 216124 - RNA, 64 nt, Homo Sapiens
aguggacgucagaagaaucuuuagaacaccugagcugcugcaugggaggagagguccacuuccc

SEQ ID NO: 216125 - RNA, 64 nt, Homo Sapiens
gcuggccaccauggcacccuggcacauaccaaagcugcugcacauaugaagaaaacagcugcau

SEQ ID NO: 216126 - RNA, 64 nt, Homo Sapiens
ccuagauggcacuuggugacacacacuccccucucugcugcagcggauuucggccuggcccggg

SEQ ID NO: 216127 - RNA, 64 nt, Homo Sapiens
caaguucccauggcugucggaggccgggcugcgccugcugcacuuccuguucauguacgacccu

SEQ ID NO: 216128 - RNA, 64 nt, Homo Sapiens
agggguccuggggagagagaauuuauccagaggccugcugcagauggggaagagcuggaaacca

SEQ ID NO: 216129 - RNA, 64 nt, Homo Sapiens
cagaggaccccuacuccaugcaggacagggucuccugcugcaagucccaacuuugaauaaaaca

SEQ ID NO: 216130 - RNA, 64 nt, Homo Sapiens
uggacaggugucugagaugggcccguacccagcccugcugcagcgcaacggcuccuuugccaac

SEQ ID NO: 216131 - RNA, 64 nt, Homo Sapiens
uggcauccaggcugcccguguguugcaccaggcacugcugcacaacaagauacgcucgccacag

SEQ ID NO: 216132 - RNA, 64 nt, Homo Sapiens
uccaguugcugccgccccaaugcugcaggcucuccugcugcaucccuccugcuguggcuucagc

SEQ ID NO: 216133 - RNA, 64 nt, Homo Sapiens
cucuccugcugcaucuccagugcuguggcuucagcugcugcaggcuagcagcaguagcuccucc

SEQ ID NO: 216134 - RNA, 64 nt, Homo Sapiens
ugcuccaggcccaccuugguuacagacaggggcgcugcugcagaccgugcgcuccucaccccuc

SEQ ID NO: 216135 - RNA, 64 nt, Homo Sapiens
aggcguggccaccaccagaucuccccccaccccucugcugcaggccccgugguguccccuggcc

SEQ ID NO: 216136 - RNA, 64 nt, Homo Sapiens
cccagugccuagaacagggcaucaaugucauucacugcugcaucccaggagaacagggauuucu

SEQ ID NO: 216137 - RNA, 64 nt, Homo Sapiens
ugcucacggugagccccccugcgccaaugaggaucugcugcaccagggcagcauccacccugca

SEQ ID NO: 216138 - RNA, 64 nt, Homo Sapiens
uuuccaggacaucuccaucaagaggcugcagcggcugcugcaggcccucgaggccccggagggc

SEQ ID NO: 216139 - RNA, 64 nt, Homo Sapiens
ccugggggcgcaggacggggcgcugcuggugcggcugcugcaggcgcugcgcguggccaggaug

SEQ ID NO: 216140 - RNA, 64 nt, Homo Sapiens
uuagagacugugccuucagcaggacucuuaauaucugcugcaacuuggagaaccucccugcccu

SEQ ID NO: 216141 - RNA, 64 nt, Homo Sapiens
uaauagaguggccucuuucgcucuucgauuaugacugcugcaguuuuaccccagcagucagcug

SEQ ID NO: 216142 - RNA, 64 nt, Homo Sapiens
aaaagugcaugggggacccuuaaguugugauuaccugcugcauguauagaauaaaccuuuuauu

SEQ ID NO: 216143 - RNA, 64 nt, Homo Sapiens
uuacagaagaguaaacugguuaccuguuuauucucugcugcaucaucaguaagguagcauucau

SEQ ID NO: 216144 - RNA, 64 nt, Homo Sapiens; identical to SEQ ID NO: 107841

SEQ ID NO: 216145 - RNA, 64 nt, Homo Sapiens; identical to SEQ ID NO: 107842

SEQ ID NO: 216146 - RNA, 64 nt, Homo Sapiens; identical to SEQ ID NO: 107843

SEQ ID NO: 216147 - RNA, 64 nt, Homo Sapiens; identical to SEQ ID NO: 107844

SEQ ID NO: 216148 - RNA, 64 nt, Homo Sapiens; identical to SEQ ID NO: 107845

SEQ ID NO: 216149 - RNA, 64 nt, Homo Sapiens; identical to SEQ ID NO: 107846

SEQ ID NO: 216150 - RNA, 64 nt, Homo Sapiens; identical to SEQ ID NO: 107847

SEQ ID NO: 216151 - RNA, 64 nt, Homo Sapiens; identical to SEQ ID NO: 107848

SEQ ID NO: 216152 - RNA, 64 nt, Homo Sapiens
uuaauagacuggaucuuugcugguucacagcuguaguauggagaugggcugggccucuuuccug

SEQ ID NO: 216153 - RNA, 64 nt, Homo Sapiens
aaucuucaguuguaucucuucuacaagugugguaaguauggaaaacuuguacuggagagaaauc

SEQ ID NO: 216154 - RNA, 64 nt, Homo Sapiens
gacauauuguguuaugaaugcuggcuuucucaagaguauggauuacaauauuuguuucuaauca

SEQ ID NO: 216155 - RNA, 64 nt, Homo Sapiens
aguggaauuguacauuuuuuuuuuauaaaggaauaguauggauaaagcuuaccugaaaucugcc

SEQ ID NO: 216156 - RNA, 64 nt, Homo Sapiens
agccuggguguguauggaggaucuagccugggugaguauggagggucuagccugggugaguaug

SEQ ID NO: 216157 - RNA, 64 nt, Homo Sapiens
agccugggugaguauggagggucuagccugggugaguauggagggucuagccuggguguguaug

SEQ ID NO: 216158 - RNA, 64 nt, Homo Sapiens
agccuggguguguauggagggucuagccugggugaguauggagggucuagccuggguguguaug

SEQ ID NO: 216159 - RNA, 64 nt, Homo Sapiens
agccuggguguguauggagggucuagccugggugaguauggagggucuagccuggguguguacg

SEQ ID NO: 216160 - RNA, 64 nt, Homo Sapiens
gauguaaaaacccugucuuuuugcacgauacagccaaaaguauuggcugauuucuugcugagug

SEQ ID NO: 216161 - RNA, 64 nt, Homo Sapiens
gcuaaugaagugaggggagggagggaugucaccccaaaaguaggcccucccauuggcuuuggcc

SEQ ID NO: 216162 - RNA, 64 nt, Homo Sapiens
cuucagccugagcaacacgagcaaaacuccgucucaaaaguaaauaaaaauaaucaccuggagu

SEQ ID NO: 216163 - RNA, 64 nt, Homo Sapiens
cugguagaacagaacaagcaaaagauuaagaguucaaaaguaaaugcaaccaauuuaacaugua

SEQ ID NO: 216164 - RNA, 64 nt, Homo Sapiens
aauuaauuuuaggagcaucuauuuaugcaguguucaaaaguacugaauuagaaaccaggaaguu

SEQ ID NO: 216165 - RNA, 64 nt, Homo Sapiens
caauuuauacaacgcugucauauuuuuaaaaaaacaaaaguaagccauccucaaauaaggaacc

SEQ ID NO: 216166 - RNA, 64 nt, Homo Sapiens
aaugaguauuuccuuucuccagcacaaaaguagacaaaaguauugcgaucucuaccgagaagca

SEQ ID NO: 216167 - RNA, 64 nt, Homo Sapiens
caaaaguauuaaugaguauuccgagaagcaagcacaaaaguagaucagguauaugcgaucucua

SEQ ID NO: 216168 - RNA, 64 nt, Homo Sapiens
ugcuacuguaacauucaauuucaucacaagaggucaaaaguauuaauuaaguucuaguucugac

SEQ ID NO: 216169 - RNA, 64 nt, Homo Sapiens
uguaauaaaaaugcacaacauaacaacuaucuuucaaaaguaaacugaaaaacaacuaaccuuc

SEQ ID NO: 216170 - RNA, 64 nt, Homo Sapiens
uuauauuaaaauuuugaccuaagcuauguguuggcaaaaguaauaaaaggagcaaagaaugcau

SEQ ID NO: 216171 - RNA, 64 nt, Homo Sapiens
aguguggcuauaagccugaguugaagauuaccuacaaaaguaacuggauuuuaaaccauaaaac

SEQ ID NO: 216172 - RNA, 64 nt, Homo Sapiens
uguacuugaaauauuuucaucuuaguggucuuuccaaaaguacaccuagaacauggauagaucu

SEQ ID NO: 216173 - RNA, 64 nt, Homo Sapiens
aauagcucuucuacccuugaguaaaacaaaaucucaaaaguauuuucucuauaauauucuuaga

SEQ ID NO: 216174 - RNA, 64 nt, Homo Sapiens
uuuccucuguaucccagcauaacuacccauauuccaaaaguagaaaagcuugcuaauaauagaa

SEQ ID NO: 216175 - RNA, 64 nt, Homo Sapiens
cgaucuaaaacaugacuaucccacugauguucaucaaaaguaugcaaaacuuuugcuauucaua

SEQ ID NO: 216176 - RNA, 64 nt, Homo Sapiens
uucauuuuuucccucuaauuauuuaagauuggaacaaaaguauaaauauuauuuauuugaggua

SEQ ID NO: 216177 - RNA, 64 nt, Homo Sapiens
aaauaguguugauguacugaaauaugaacuguaucaaaaguauugguaauuguauauggggugu

SEQ ID NO: 216178 - RNA, 64 nt, Homo Sapiens
caagcauaaaaggcuaacuuguggauaguguuuacaaaaguacaaaaguacuacuuccaaggaa

SEQ ID NO: 216179 - RNA, 64 nt, Homo Sapiens
aaaggcuaacuuguggauaguguuuacaaaaguacaaaaguacuacuuccaaggaaaaugcucu

SEQ ID NO: 216180 - RNA, 64 nt, Homo Sapiens
aaauguuucaaaauagacaacaggcucaaguuuuuauaguuauuugugaaaaacuaaugugucu

SEQ ID NO: 216181 - RNA, 64 nt, Homo Sapiens
acugauuacauccguaggacuugcuaaaagcauguauaguuagaaaaugugcaauuuguaaaua

SEQ ID NO: 216182 - RNA, 64 nt, Homo Sapiens
aaaauaaaaacuauaaaaacuauaguagcugcccuauaguuacacaguguuguuaagcuauugu

SEQ ID NO: 216183 - RNA, 64 nt, Homo Sapiens
aaccauucauauuuuaagugucucuuuaccucaguauaguuaaauauguaauuaaguggcaacu

SEQ ID NO: 216184 - RNA, 64 nt, Homo Sapiens
guaaaaaaugauauuuaugauuagaaugaccaaauauaguuauugguguuaaaaagugugcugc

SEQ ID NO: 216185 - RNA, 64 nt, Homo Sapiens
aaaaaugguugaagggagggcagauauuacauucuauaguuaccuauauuuaguuuugcuuuuc

SEQ ID NO: 216186 - RNA, 64 nt, Homo Sapiens
ugagaaaauuauuuuuuuuaauuuaaguccuaaauauaguuaaaauaaauaauguuuuaguaaa

SEQ ID NO: 216187 - RNA, 64 nt, Homo Sapiens
cucuauccaacauuuaauuguuugaaagccuccauauaguuagauugugcuuuguaauuuuguu

SEQ ID NO: 216188 - RNA, 64 nt, Homo Sapiens
auacguacauuaaaaaaaaaguuguagcagugaauauaguuaaaauauaguuguuacugguccu

SEQ ID NO: 216189 - RNA, 64 nt, Homo Sapiens
uuuaaagagauuuaguauuaauugucuuuuaugauauaguuaaucuuaguuuagugacaaaguc

SEQ ID NO: 216190 - RNA, 64 nt, Homo Sapiens
uauuuuuaaaacuucauagugauaaaugagacuauauaguuauauuguuaauauaguuaacaca

SEQ ID NO: 216191 - RNA, 64 nt, Homo Sapiens
agugauaaaugagacuauauaguuauauuguuaauauaguuaacacauuacaugauuuggugag

SEQ ID NO: 216192 - RNA, 64 nt, Homo Sapiens
gaaggcuugcuuuuucuccaugucucccaguuuguauaguuaaauuguccaguuguauaguuaa

SEQ ID NO: 216193 - RNA, 64 nt, Homo Sapiens
gucucccaguuuguauaguuaaauuguccaguuguauaguuaaauauuugaucuuauuaaaaac

SEQ ID NO: 216194 - RNA, 64 nt, Homo Sapiens
guguaaagaaaucagucaauuacaagaguaauuguauaguuauugagaccuauaguguguggcu

SEQ ID NO: 216195 - RNA, 64 nt, Homo Sapiens
aaguauauggcuaucaugacuaagugcuagaauuuauaguuacaggcgguguccuuuuaaaugu

SEQ ID NO: 216196 - RNA, 64 nt, Homo Sapiens
aaggaaagcugaacacuauacacuauuaguacaguauaguuagaauaaggcuugcuaugauuug

SEQ ID NO: 216197 - RNA, 64 nt, Homo Sapiens
guaauauaauucauauuuuuuuucuacugaacucuauaguuaguaaguuacagauaagaauuua

SEQ ID NO: 216198 - RNA, 64 nt, Homo Sapiens
cauaauucaacuagagauuugaagaauuggcuuguauaguuauaacaaccacaguagaaacauu

SEQ ID NO: 216199 - RNA, 64 nt, Homo Sapiens
uccuuucuuuggucugauacuucauguauuugaauauaguuaaaucguauuauuuuuuucuuaa

SEQ ID NO: 216200 - RNA, 64 nt, Homo Sapiens
uaauaaaaagcuuuugucuauguuuauccuuucauauaguuagcaaucacaugaauuauuacag

SEQ ID NO: 216201 - RNA, 64 nt, Homo Sapiens
acacuaccgaaugugucuuuagugucuuuuuuuguauaguuaacgauuuguuuuuaaacuguac

SEQ ID NO: 216202 - RNA, 64 nt, Homo Sapiens
gauuuuuuauuauguaagcauugccuaaaguggcuauaguuacuuaucugggaggauuuuuugg

SEQ ID NO: 216203 - RNA, 64 nt, Homo Sapiens
auacuauuuuucaaaaucaucauauguauaaugcuauaguuaaagugguuaaaaugguuucuag

SEQ ID NO: 216204 - RNA, 64 nt, Homo Sapiens
uguauugauuuaagucucacauaauaaagauaauuauaguuacaaauuuaaaaaauuuugcugc

SEQ ID NO: 216205 - RNA, 64 nt, Homo Sapiens
ggaauuggcuuaauuugauguauuccuacuuggauauaguuaauuuucaaagcauuucugaagu

SEQ ID NO: 216206 - RNA, 64 nt, Homo Sapiens
uauauuauaaaguaugcauucuuaucaccuaguauauaguuaguuuguagagugauuucccccc

SEQ ID NO: 216207 - RNA, 64 nt, Homo Sapiens
gauuuuuuauuaaacaaauaguaaacccuucaauuauaguuagucuuggugaaguaagauguuu

SEQ ID NO: 216208 - RNA, 64 nt, Homo Sapiens
gaacugauucugagaaaucuucaucuuuuuaaaguauaguuacuuaucacuguagaugagcaac

SEQ ID NO: 216209 - RNA, 64 nt, Homo Sapiens
augaauugcauaugaagaagucaguauuagaaauuauaguuacaauggcuucauuguuucuuuc

SEQ ID NO: 216210 - RNA, 64 nt, Homo Sapiens
acuugauuguagaagggacuagacuuuauuaugguauaguuaggaacuaauuaggaguugauug

SEQ ID NO: 216211 - RNA, 64 nt, Homo Sapiens
guggugacaugcaugagguggaggacuugcaggcuauaguuauggauccacaucagguggccac

SEQ ID NO: 216212 - RNA, 64 nt, Homo Sapiens
ugauuuauauuugaaaugugguccucugaauauuuauaguuaaacauacgcuugucuccugaau

SEQ ID NO: 216213 - RNA, 64 nt, Homo Sapiens
accugucuaucagacguauugauuauagcaguacuauaguuauucugcugucauuauuaaagau

SEQ ID NO: 216214 - RNA, 64 nt, Homo Sapiens
cacugccuuaaacagauauuucuauagcugucaguauaguuauguugcucccaagccuaguuau

SEQ ID NO: 216215 - RNA, 64 nt, Homo Sapiens; identical to SEQ ID NO: 97841

SEQ ID NO: 216216 - RNA, 64 nt, Homo Sapiens; identical to SEQ ID NO: 97842

SEQ ID NO: 216217 - RNA, 64 nt, Homo Sapiens; identical to SEQ ID NO: 97843

SEQ ID NO: 216218 - RNA, 64 nt, Homo Sapiens; identical to SEQ ID NO: 97844

SEQ ID NO: 216219 - RNA, 64 nt, Homo Sapiens; identical to SEQ ID NO: 97845

SEQ ID NO: 216220 - RNA, 64 nt, Homo Sapiens; identical to SEQ ID NO: 97846

SEQ ID NO: 216221 - RNA, 64 nt, Homo Sapiens; identical to SEQ ID NO: 97847

SEQ ID NO: 216222 - RNA, 64 nt, Homo Sapiens; identical to SEQ ID NO: 97848

SEQ ID NO: 216223 - RNA, 64 nt, Homo Sapiens
ugacaggggggcaguugugaggccacagagugccuugacacaaagauuacauuuuucagacccc

SEQ ID NO: 216224 - RNA, 64 nt, Homo Sapiens
uguaauugacaggauggcugcugcagaaugcugguugacacagggauuauuauacugcuauuuu

SEQ ID NO: 216225 - RNA, 64 nt, Homo Sapiens
ucauaccagcuugcuacaauuccaaauuuaauauuugacacaguuuuuugacuaugaacauuag

SEQ ID NO: 216226 - RNA, 64 nt, Homo Sapiens
cauucacauauaaauuguuaaacgugaaauauauuugacacacaauauauguguauauguuaua

SEQ ID NO: 216227 - RNA, 64 nt, Homo Sapiens
aacuaaaugcccaguuuuaauuauuaugcuuaauuugacacauuucagauaguccaaauuuagg

SEQ ID NO: 216228 - RNA, 64 nt, Homo Sapiens
uuaguuauuuuaauaacagagggaaaagaagacuuugacacauuagauauuagccuugaauugg

SEQ ID NO: 216229 - RNA, 64 nt, Homo Sapiens
aaaauaaaggaaauaaggaacuuuaaguguuuuuuugacacauuauauguauuuacaagaauau

SEQ ID NO: 216230 - RNA, 64 nt, Homo Sapiens
gcuuauauguauuuacaagacauaguacugaauguugacacacaucauauugaaaaaugauuug

SEQ ID NO: 216231 - RNA, 64 nt, Homo Sapiens
uggccaccuuggcacaaaaggggauuuccugacuuugacacacaccucuuggcucccaggagga

SEQ ID NO: 216232 - RNA, 64 nt, Homo Sapiens
acaaaucacugaugugguugcuucacacugcuguuugacacaucacugaaugugacugucauca

SEQ ID NO: 216233 - RNA, 64 nt, Homo Sapiens
aguaggaaucagugcagccuguaaguucuccacauugacacacacacacacacacacacacaca

SEQ ID NO: 216234 - RNA, 64 nt, Homo Sapiens
ugaugguuuugcuacuaauuccuaucccauacauuugacacaaaagaaguguugguaauggaua

SEQ ID NO: 216235 - RNA, 62 nt, Homo Sapiens
ccaagaucaagauccuguucugagucagaugaugaugacagcagugaaacuccuccucacug

SEQ ID NO: 216236 - RNA, 62 nt, Homo Sapiens
cuagaauuuggugaagaggaggaggaggagauugaugacaagcaaguuacucaggaaucaaa

SEQ ID NO: 216237 - RNA, 62 nt, Homo Sapiens
cuuccccuggaaaaaaaucguguuaagcuagaugaugacagugaugaugaugaagaaagcaa

SEQ ID NO: 216238 - RNA, 62 nt, Homo Sapiens
uggacccuugguggcuuuuguaaauuaauuuuugaugacauuuugaguuuuaagauuucuga

SEQ ID NO: 216239 - RNA, 62 nt, Homo Sapiens
uuccaauagcuuauaugcccaaauaguuuaagugaugacaagcugauuuucaucuuuauagg

SEQ ID NO: 216240 - RNA, 62 nt, Homo Sapiens
cuuuuuuuuuuuuguauguuucaaggcauacaugaugacaguagcuucucagcugaggacac

SEQ ID NO: 216241 - RNA, 64 nt, Homo Sapiens
caagucucaggugugucugccuguggcugcacaggcucucuaaccgaaaccucacuuucagaga

SEQ ID NO: 216242 - RNA, 64 nt, Homo Sapiens
acugggagaggaaucuaagaaccagauggcuucagcucucuagaggagcugagccuauucacag

SEQ ID NO: 216243 - RNA, 64 nt, Homo Sapiens
uuuuaagcaaagagcauggacugucucuuccacugcucucuaugacucuucuggcauaucucuc

SEQ ID NO: 216244 - RNA, 64 nt, Homo Sapiens
gggccacauacucuucuggccucaucauguuccagcucucuacaucucuucucucuccucuguc

SEQ ID NO: 216245 - RNA, 64 nt, Homo Sapiens; identical to SEQ ID NO: 93254

SEQ ID NO: 216246 - RNA, 64 nt, Homo Sapiens; identical to SEQ ID NO: 93255

SEQ ID NO: 216247 - RNA, 64 nt, Homo Sapiens; identical to SEQ ID NO: 93256

SEQ ID NO: 216248 - RNA, 64 nt, Homo Sapiens; identical to SEQ ID NO: 93257

SEQ ID NO: 216249 - RNA, 64 nt, Homo Sapiens; identical to SEQ ID NO: 93258

SEQ ID NO: 216250 - RNA, 64 nt, Homo Sapiens; identical to SEQ ID NO: 93259

SEQ ID NO: 216251 - RNA, 64 nt, Homo Sapiens; identical to SEQ ID NO: 93260

SEQ ID NO: 216252 - RNA, 64 nt, Homo Sapiens; identical to SEQ ID NO: 93261

SEQ ID NO: 216253 - RNA, 64 nt, Homo Sapiens; identical to SEQ ID NO: 93262

SEQ ID NO: 216254 - RNA, 64 nt, Homo Sapiens; identical to SEQ ID NO: 93263

SEQ ID NO: 216255 - RNA, 64 nt, Homo Sapiens; identical to SEQ ID NO: 93264

SEQ ID NO: 216256 - RNA, 64 nt, Homo Sapiens; identical to SEQ ID NO: 93265

SEQ ID NO: 216257 - RNA, 64 nt, Homo Sapiens; identical to SEQ ID NO: 93266

SEQ ID NO: 216258 - RNA, 64 nt, Homo Sapiens; identical to SEQ ID NO: 93267

SEQ ID NO: 216259 - RNA, 64 nt, Homo Sapiens; identical to SEQ ID NO: 93268

SEQ ID NO: 216260 - RNA, 64 nt, Homo Sapiens; identical to SEQ ID NO: 93269

SEQ ID NO: 216261 - RNA, 64 nt, Homo Sapiens; identical to SEQ ID NO: 93270

SEQ ID NO: 216262 - RNA, 64 nt, Homo Sapiens; identical to SEQ ID NO: 93271

SEQ ID NO: 216263 - RNA, 64 nt, Homo Sapiens; identical to SEQ ID NO: 93272

SEQ ID NO: 216264 - RNA, 64 nt, Homo Sapiens; identical to SEQ ID NO: 93273

SEQ ID NO: 216265 - RNA, 64 nt, Homo Sapiens; identical to SEQ ID NO: 93274

SEQ ID NO: 216266 - RNA, 64 nt, Homo Sapiens; identical to SEQ ID NO: 93275

SEQ ID NO: 216267 - RNA, 64 nt, Homo Sapiens; identical to SEQ ID NO: 93276

SEQ ID NO: 216268 - RNA, 64 nt, Homo Sapiens; identical to SEQ ID NO: 93277

SEQ ID NO: 216269 - RNA, 64 nt, Homo Sapiens; identical to SEQ ID NO: 93278

SEQ ID NO: 216270 - RNA, 64 nt, Homo Sapiens; identical to SEQ ID NO: 93279

SEQ ID NO: 216271 - RNA, 64 nt, Homo Sapiens; identical to SEQ ID NO: 93280

SEQ ID NO: 216272 - RNA, 64 nt, Homo Sapiens; identical to SEQ ID NO: 93281

SEQ ID NO: 216273 - RNA, 64 nt, Homo Sapiens; identical to SEQ ID NO: 93282

SEQ ID NO: 216274 - RNA, 64 nt, Homo Sapiens; identical to SEQ ID NO: 93283

SEQ ID NO: 216275 - RNA, 64 nt, Homo Sapiens; identical to SEQ ID NO: 93284

SEQ ID NO: 216276 - RNA, 64 nt, Homo Sapiens; identical to SEQ ID NO: 93285

SEQ ID NO: 216277 - RNA, 64 nt, Homo Sapiens; identical to SEQ ID NO: 93286

SEQ ID NO: 216278 - RNA, 64 nt, Homo Sapiens; identical to SEQ ID NO: 93287

SEQ ID NO: 216279 - RNA, 64 nt, Homo Sapiens; identical to SEQ ID NO: 93288

SEQ ID NO: 216280 - RNA, 64 nt, Homo Sapiens; identical to SEQ ID NO: 93289

SEQ ID NO: 216281 - RNA, 64 nt, Homo Sapiens; identical to SEQ ID NO: 93290

SEQ ID NO: 216282 - RNA, 64 nt, Homo Sapiens; identical to SEQ ID NO: 93291

SEQ ID NO: 216283 - RNA, 64 nt, Homo Sapiens; identical to SEQ ID NO: 93292

SEQ ID NO: 216284 - RNA, 64 nt, Homo Sapiens; identical to SEQ ID NO: 93293

SEQ ID NO: 216285 - RNA, 64 nt, Homo Sapiens; identical to SEQ ID NO: 93294

SEQ ID NO: 216286 - RNA, 64 nt, Homo Sapiens; identical to SEQ ID NO: 93295

SEQ ID NO: 216287 - RNA, 64 nt, Homo Sapiens; identical to SEQ ID NO: 93296

SEQ ID NO: 216288 - RNA, 64 nt, Homo Sapiens; identical to SEQ ID NO: 93297

SEQ ID NO: 216289 - RNA, 64 nt, Homo Sapiens; identical to SEQ ID NO: 93298

SEQ ID NO: 216290 - RNA, 64 nt, Homo Sapiens; identical to SEQ ID NO: 93299

SEQ ID NO: 216291 - RNA, 64 nt, Homo Sapiens; identical to SEQ ID NO: 93300

SEQ ID NO: 216292 - RNA, 64 nt, Homo Sapiens; identical to SEQ ID NO: 93301

SEQ ID NO: 216293 - RNA, 64 nt, Homo Sapiens; identical to SEQ ID NO: 93302

SEQ ID NO: 216294 - RNA, 64 nt, Homo Sapiens; identical to SEQ ID NO: 93303

SEQ ID NO: 216295 - RNA, 64 nt, Homo Sapiens; identical to SEQ ID NO: 93304

SEQ ID NO: 216296 - RNA, 64 nt, Homo Sapiens; identical to SEQ ID NO: 93305

SEQ ID NO: 216297 - RNA, 64 nt, Homo Sapiens; identical to SEQ ID NO: 93306

SEQ ID NO: 216298 - RNA, 64 nt, Homo Sapiens; identical to SEQ ID NO: 93307

SEQ ID NO: 216299 - RNA, 64 nt, Homo Sapiens; identical to SEQ ID NO: 93308

SEQ ID NO: 216300 - RNA, 64 nt, Homo Sapiens; identical to SEQ ID NO: 93309

SEQ ID NO: 216301 - RNA, 64 nt, Homo Sapiens; identical to SEQ ID NO: 93310

SEQ ID NO: 216302 - RNA, 64 nt, Homo Sapiens; identical to SEQ ID NO: 93311

SEQ ID NO: 216303 - RNA, 64 nt, Homo Sapiens; identical to SEQ ID NO: 93312

SEQ ID NO: 216304 - RNA, 64 nt, Homo Sapiens; identical to SEQ ID NO: 93313

SEQ ID NO: 216305 - RNA, 64 nt, Homo Sapiens; identical to SEQ ID NO: 93313

SEQ ID NO: 216306 - RNA, 64 nt, Homo Sapiens; identical to SEQ ID NO: 93315

SEQ ID NO: 216307 - RNA, 64 nt, Homo Sapiens; identical to SEQ ID NO: 93316

SEQ ID NO: 216308 - RNA, 64 nt, Homo Sapiens; identical to SEQ ID NO: 93317

SEQ ID NO: 216309 - RNA, 64 nt, Homo Sapiens; identical to SEQ ID NO: 93318

SEQ ID NO: 216310 - RNA, 64 nt, Homo Sapiens; identical to SEQ ID NO: 93319

SEQ ID NO: 216311 - RNA, 64 nt, Homo Sapiens; identical to SEQ ID NO: 93320

SEQ ID NO: 216312 - RNA, 64 nt, Homo Sapiens; identical to SEQ ID NO: 93321

SEQ ID NO: 216313 - RNA, 64 nt, Homo Sapiens; identical to SEQ ID NO: 93322

SEQ ID NO: 216314 - RNA, 64 nt, Homo Sapiens; identical to SEQ ID NO: 93323

SEQ ID NO: 216315 - RNA, 64 nt, Homo Sapiens; identical to SEQ ID NO: 93324

SEQ ID NO: 216316 - RNA, 64 nt, Homo Sapiens; identical to SEQ ID NO: 93325

SEQ ID NO: 216317 - RNA, 64 nt, Homo Sapiens; identical to SEQ ID NO: 93326

SEQ ID NO: 216318 - RNA, 64 nt, Homo Sapiens; identical to SEQ ID NO: 93327

SEQ ID NO: 216319 - RNA, 64 nt, Homo Sapiens; identical to SEQ ID NO: 93328

SEQ ID NO: 216320 - RNA, 64 nt, Homo Sapiens; identical to SEQ ID NO: 93329

SEQ ID NO: 216321 - RNA, 64 nt, Homo Sapiens; identical to SEQ ID NO: 93330

SEQ ID NO: 216322 - RNA, 64 nt, Homo Sapiens; identical to SEQ ID NO: 44425

SEQ ID NO: 216323 - RNA, 64 nt, Homo Sapiens; identical to SEQ ID NO: 44426

SEQ ID NO: 216324 - RNA, 64 nt, Homo Sapiens; identical to SEQ ID NO: 44427

SEQ ID NO: 216325 - RNA, 64 nt, Homo Sapiens; identical to SEQ ID NO: 44428

SEQ ID NO: 216326 - RNA, 64 nt, Homo Sapiens; identical to SEQ ID NO: 44429

SEQ ID NO: 216327 - RNA, 64 nt, Homo Sapiens; identical to SEQ ID NO: 44430

SEQ ID NO: 216328 - RNA, 64 nt, Homo Sapiens; identical to SEQ ID NO: 44431

SEQ ID NO: 216329 - RNA, 64 nt, Homo Sapiens; identical to SEQ ID NO: 44432

SEQ ID NO: 216330 - RNA, 64 nt, Homo Sapiens; identical to SEQ ID NO: 44433

SEQ ID NO: 216331 - RNA, 64 nt, Homo Sapiens; identical to SEQ ID NO: 44434

SEQ ID NO: 216332 - RNA, 64 nt, Homo Sapiens; identical to SEQ ID NO: 44435

SEQ ID NO: 216333 - RNA, 64 nt, Homo Sapiens; identical to SEQ ID NO: 44436

SEQ ID NO: 216334 - RNA, 64 nt, Homo Sapiens; identical to SEQ ID NO: 199324

SEQ ID NO: 216335 - RNA, 64 nt, Homo Sapiens; identical to SEQ ID NO: 199325

SEQ ID NO: 216336 - RNA, 64 nt, Homo Sapiens; identical to SEQ ID NO: 199326

SEQ ID NO: 216337 - RNA, 64 nt, Homo Sapiens; identical to SEQ ID NO: 199327

SEQ ID NO: 216338 - RNA, 64 nt, Homo Sapiens; identical to SEQ ID NO: 199328

SEQ ID NO: 216339 - RNA, 64 nt, Homo Sapiens; identical to SEQ ID NO: 199329

SEQ ID NO: 216340 - RNA, 64 nt, Homo Sapiens; identical to SEQ ID NO: 199330

SEQ ID NO: 216341 - RNA, 64 nt, Homo Sapiens; identical to SEQ ID NO: 199331

SEQ ID NO: 216342 - RNA, 64 nt, Homo Sapiens; identical to SEQ ID NO: 199332

SEQ ID NO: 216343 - RNA, 64 nt, Homo Sapiens; identical to SEQ ID NO: 199333

SEQ ID NO: 216344 - RNA, 64 nt, Homo Sapiens; identical to SEQ ID NO: 199334

SEQ ID NO: 216345 - RNA, 64 nt, Homo Sapiens; identical to SEQ ID NO: 199335

SEQ ID NO: 216346 - RNA, 64 nt, Homo Sapiens; identical to SEQ ID NO: 199336

SEQ ID NO: 216347 - RNA, 64 nt, Homo Sapiens; identical to SEQ ID NO: 199337

SEQ ID NO: 216348 - RNA, 64 nt, Homo Sapiens; identical to SEQ ID NO: 199338

SEQ ID NO: 216349 - RNA, 64 nt, Homo Sapiens; identical to SEQ ID NO: 199339

SEQ ID NO: 216350 - RNA, 64 nt, Homo Sapiens; identical to SEQ ID NO: 199340

SEQ ID NO: 216351 - RNA, 64 nt, Homo Sapiens; identical to SEQ ID NO: 199341

SEQ ID NO: 216352 - RNA, 64 nt, Homo Sapiens; identical to SEQ ID NO: 199342

SEQ ID NO: 216353 - RNA, 64 nt, Homo Sapiens; identical to SEQ ID NO: 199343

SEQ ID NO: 216354 - RNA, 64 nt, Homo Sapiens; identical to SEQ ID NO: 199344

SEQ ID NO: 216355 - RNA, 64 nt, Homo Sapiens; identical to SEQ ID NO: 199345

SEQ ID NO: 216356 - RNA, 64 nt, Homo Sapiens; identical to SEQ ID NO: 199346

SEQ ID NO: 216357 - RNA, 64 nt, Homo Sapiens; identical to SEQ ID NO: 199347

SEQ ID NO: 216358 - RNA, 64 nt, Homo Sapiens; identical to SEQ ID NO: 199348

SEQ ID NO: 216359 - RNA, 64 nt, Homo Sapiens; identical to SEQ ID NO: 199349

SEQ ID NO: 216360 - RNA, 64 nt, Homo Sapiens; identical to SEQ ID NO: 199350

SEQ ID NO: 216361 - RNA, 64 nt, Homo Sapiens; identical to SEQ ID NO: 199351

SEQ ID NO: 216362 - RNA, 64 nt, Homo Sapiens; identical to SEQ ID NO: 199352

SEQ ID NO: 216363 - RNA, 64 nt, Homo Sapiens; identical to SEQ ID NO: 199353

SEQ ID NO: 216364 - RNA, 64 nt, Homo Sapiens; identical to SEQ ID NO: 199354

SEQ ID NO: 216365 - RNA, 64 nt, Homo Sapiens; identical to SEQ ID NO: 199355

SEQ ID NO: 216366 - RNA, 64 nt, Homo Sapiens; identical to SEQ ID NO: 199356

SEQ ID NO: 216367 - RNA, 64 nt, Homo Sapiens; identical to SEQ ID NO: 199357

SEQ ID NO: 216368 - RNA, 64 nt, Homo Sapiens; identical to SEQ ID NO: 199358

SEQ ID NO: 216369 - RNA, 64 nt, Homo Sapiens; identical to SEQ ID NO: 199359

SEQ ID NO: 216370 - RNA, 64 nt, Homo Sapiens; identical to SEQ ID NO: 199360

SEQ ID NO: 216371 - RNA, 64 nt, Homo Sapiens; identical to SEQ ID NO: 199361

SEQ ID NO: 216372 - RNA, 64 nt, Homo Sapiens; identical to SEQ ID NO: 199362

SEQ ID NO: 216373 - RNA, 64 nt, Homo Sapiens; identical to SEQ ID NO: 199363

SEQ ID NO: 216374 - RNA, 64 nt, Homo Sapiens; identical to SEQ ID NO: 199364

SEQ ID NO: 216375 - RNA, 64 nt, Homo Sapiens; identical to SEQ ID NO: 199365

SEQ ID NO: 216376 - RNA, 64 nt, Homo Sapiens; identical to SEQ ID NO: 199366

SEQ ID NO: 216377 - RNA, 64 nt, Homo Sapiens; identical to SEQ ID NO: 199367

SEQ ID NO: 216378 - RNA, 64 nt, Homo Sapiens; identical to SEQ ID NO: 199368

SEQ ID NO: 216379 - RNA, 64 nt, Homo Sapiens; identical to SEQ ID NO: 199369

SEQ ID NO: 216380 - RNA, 64 nt, Homo Sapiens; identical to SEQ ID NO: 199370

SEQ ID NO: 216381 - RNA, 64 nt, Homo Sapiens; identical to SEQ ID NO: 199371

SEQ ID NO: 216382 - RNA, 64 nt, Homo Sapiens; identical to SEQ ID NO: 199372

SEQ ID NO: 216383 - RNA, 64 nt, Homo Sapiens; identical to SEQ ID NO: 199373

SEQ ID NO: 216384 - RNA, 64 nt, Homo Sapiens; identical to SEQ ID NO: 199374

SEQ ID NO: 216385 - RNA, 64 nt, Homo Sapiens; identical to SEQ ID NO: 199375

SEQ ID NO: 216386 - RNA, 64 nt, Homo Sapiens; identical to SEQ ID NO: 199376

SEQ ID NO: 216387 - RNA, 64 nt, Homo Sapiens; identical to SEQ ID NO: 199377

SEQ ID NO: 216388 - RNA, 64 nt, Homo Sapiens; identical to SEQ ID NO: 199378

SEQ ID NO: 216389 - RNA, 64 nt, Homo Sapiens; identical to SEQ ID NO: 199379

SEQ ID NO: 216390 - RNA, 64 nt, Homo Sapiens; identical to SEQ ID NO: 199380

SEQ ID NO: 216391 - RNA, 64 nt, Homo Sapiens; identical to SEQ ID NO: 199381

SEQ ID NO: 216392 - RNA, 64 nt, Homo Sapiens; identical to SEQ ID NO: 199382

SEQ ID NO: 216393 - RNA, 64 nt, Homo Sapiens; identical to SEQ ID NO: 199383

SEQ ID NO: 216394 - RNA, 64 nt, Homo Sapiens; identical to SEQ ID NO: 199384

SEQ ID NO: 216395 - RNA, 64 nt, Homo Sapiens; identical to SEQ ID NO: 199385

SEQ ID NO: 216396 - RNA, 64 nt, Homo Sapiens; identical to SEQ ID NO: 199386

SEQ ID NO: 216397 - RNA, 64 nt, Homo Sapiens; identical to SEQ ID NO: 199387

SEQ ID NO: 216398 - RNA, 62 nt, Homo Sapiens; identical to SEQ ID NO: 199388

SEQ ID NO: 216399 - RNA, 64 nt, Homo Sapiens; identical to SEQ ID NO: 199389

SEQ ID NO: 216400 - RNA, 64 nt, Homo Sapiens; identical to SEQ ID NO: 199390

SEQ ID NO: 216401 - RNA, 64 nt, Homo Sapiens; identical to SEQ ID NO: 199391

SEQ ID NO: 216402 - RNA, 64 nt, Homo Sapiens; identical to SEQ ID NO: 199392

SEQ ID NO: 216403 - RNA, 64 nt, Homo Sapiens; identical to SEQ ID NO: 199393

SEQ ID NO: 216404 - RNA, 64 nt, Homo Sapiens; identical to SEQ ID NO: 199394

SEQ ID NO: 216405 - RNA, 64 nt, Homo Sapiens; identical to SEQ ID NO: 199395

SEQ ID NO: 216406 - RNA, 64 nt, Homo Sapiens; identical to SEQ ID NO: 199396

SEQ ID NO: 216407 - RNA, 64 nt, Homo Sapiens; identical to SEQ ID NO: 199397

SEQ ID NO: 216408 - RNA, 64 nt, Homo Sapiens; identical to SEQ ID NO: 199398

SEQ ID NO: 216409 - RNA, 64 nt, Homo Sapiens; identical to SEQ ID NO: 199399

SEQ ID NO: 216410 - RNA, 64 nt, Homo Sapiens; identical to SEQ ID NO: 199400

SEQ ID NO: 216411 - RNA, 64 nt, Homo Sapiens; identical to SEQ ID NO: 199401

SEQ ID NO: 216412 - RNA, 64 nt, Homo Sapiens; identical to SEQ ID NO: 199402

SEQ ID NO: 216413 - RNA, 64 nt, Homo Sapiens
cuuuacaaauauaaagauagcuguuuaggauauuuuguuacauuuuuguaaauuuuugaaaugc

SEQ ID NO: 216414 - RNA, 64 nt, Homo Sapiens
aaacuugaguucuauuuaccuugcacauuuuuuguuguuacagugaaaaaaaugguccaagaaa

SEQ ID NO: 216415 - RNA, 64 nt, Homo Sapiens
gcuacugcagcuaauaaaaaauuuuagauagcaauuguuacaaccauaugccuuuauagcuaga

SEQ ID NO: 216416 - RNA, 64 nt, Homo Sapiens
uaguuucacuuuguauaaaaguuaggaccagcuguuguuacauguaauauuuuaguucagaacu

SEQ ID NO: 216417 - RNA, 64 nt, Homo Sapiens
aguuuuagaaauuucgugguaguaaguucggcauuuguuacauguauagagagaagacuaauaa

SEQ ID NO: 216418 - RNA, 64 nt, Homo Sapiens
uggcuguuuuuauaaguguaugaaaacagcuauuuuguuacagcuuuuuaugaguuuauggcua

SEQ ID NO: 216419 - RNA, 64 nt, Homo Sapiens
auuuuuuaaaaaaaggaaaauuuuuucauucucauuguuacaugaauaaaaguucacuguacuu

SEQ ID NO: 216420 - RNA, 64 nt, Homo Sapiens
guuagaacucuuacagccuuauuuauuuuuaaguuuguuacagccaaaggguuggagugugcca

SEQ ID NO: 216421 - RNA, 64 nt, Homo Sapiens
auccuuauuguucuuaauuguguuucucuacguauuguuacagaugagccauacguuucuuugu

SEQ ID NO: 216422 - RNA, 64 nt, Homo Sapiens
caagccagcugcuaagcuuguguuuaugugacucuuguuacagaucauggcggugcgucagccu

SEQ ID NO: 216423 - RNA, 64 nt, Homo Sapiens
cauuuuuucucagacaccuggccguaaaaucaguuuguuacagcauucuucucuaggcugcuaa

SEQ ID NO: 216424 - RNA, 64 nt, Homo Sapiens
uuauacacuauucuguuacuauuacaggaccagcuuguuacagaaauuggacuguaguuuagaa

SEQ ID NO: 216425 - RNA, 64 nt, Homo Sapiens
agcuguaauuuugcuaccaguuugcuuggagcuguuguuacaguuucaagcucugaauugauuu

SEQ ID NO: 216426 - RNA, 64 nt, Homo Sapiens
ugagauaacuucaucuguauauucauaagaaauauuguuacauuuaccuuccguuacaguguug

SEQ ID NO: 216427 - RNA, 64 nt, Homo Sapiens
uguucuuuuuuuauccgaucaccacgggggcuccuuguuacacaggagcccacuggaaacgccc

SEQ ID NO: 216428 - RNA, 64 nt, Homo Sapiens
ucuuguguuaacaaauuacgugcuauaugauuuuuuguuacauuguuacaaguguuaaugacau

SEQ ID NO: 216429 - RNA, 64 nt, Homo Sapiens
uaacaaauuacgugcuauaugauuuuuuguuacauuguuacaaguguuaaugacauuuucauua

SEQ ID NO: 216430 - RNA, 64 nt, Homo Sapiens
uauuuaauauaguaaaaucaaugcucccuuaauguuguuacaaagauaugguaacuguaauaug

SEQ ID NO: 216431 - RNA, 64 nt, Homo Sapiens
uucugcuguuuuaagguacccaguucaugguaauuuguuacagcaauccuaggaagcuaauacu

SEQ ID NO: 216432 - RNA, 64 nt, Homo Sapiens
aaggggaugugguuugcagagauaauaccuagucuuguuacauaauugccaaagugaaggugua

SEQ ID NO: 216433 - RNA, 64 nt, Homo Sapiens
aaugcagugacuuauacuaaugccuuucauuacuuuguuacagaaaguccgcuuggauuagcug

SEQ ID NO: 216434 - RNA, 64 nt, Homo Sapiens
aaagaaugagugacaaaucucugauuuuuuuuuguuguuacaugugaauugugagguaaacuac

SEQ ID NO: 216435 - RNA, 64 nt, Homo Sapiens
aaguaauagaaaaugguaauaacucccacuuuuuuuguuacaaacauuuuuuccuauuacaaaa

SEQ ID NO: 216436 - RNA, 64 nt, Homo Sapiens
aaagaaaaaaaaagaaaaaaaaaggugacucacauuguuacacaugcuuuaaaauauguauuca

SEQ ID NO: 216437 - RNA, 64 nt, Homo Sapiens
gagccuagcagacucaggccugugggaaugggauuuguuacaaaucuagguuuguuacuggcuu

SEQ ID NO: 216438 - RNA, 64 nt, Homo Sapiens
aaucccuguccacauuggaauaaaaaagacauuuuuguuacaaaguuugcaguauaauagaguu

SEQ ID NO: 216439 - RNA, 64 nt, Homo Sapiens
uguauauauuuaaaugaauaacuuuuuauacucuuuguuacauguuuguaucaguauuuagugg

SEQ ID NO: 216440 - RNA, 64 nt, Homo Sapiens
agagagauacguucacauaauuuuauuacauauauuguuacaauuguucuauuuuguuaguuac

SEQ ID NO: 216441 - RNA, 64 nt, Homo Sapiens
uucuuaguacacaaaacacagcaaacauaaaaaguuguuacacuucaucaaaaguacaaaguuc

SEQ ID NO: 216442 - RNA, 61 nt, Homo Sapiens
auugugaagaggaggaaaagugaaucacggagagagaaaggaaaggauagaaucacaggcu

SEQ ID NO: 216443 - RNA, 61 nt, Homo Sapiens
auccagcuauacuuacuugcacaguggauuggagagaaaggauucuccagugugcacacuc

SEQ ID NO: 216444 - RNA, 61 nt, Homo Sapiens
gcccgagugacacaugagagcuguaugaauugagagaaaaggcaacaaguagcauucuuca

SEQ ID NO: 216445 - RNA, 61 nt, Homo Sapiens
ugugcucuauuauacccugauagagaugggggagagaaaggaauguuuuugauggugguuu

SEQ ID NO: 216446 - RNA, 61 nt, Homo Sapiens
uguguguguguguguguguguguggcagagagagagaaagagagagagagagagaaauucu

SEQ ID NO: 216447 - RNA, 61 nt, Homo Sapiens
uguguggcagagagagagaaagagagagagagagagaaauucuguuaaaaucuauucugug

SEQ ID NO: 216448 - RNA, 61 nt, Homo Sapiens
cccgcagaccuccccagccccuagcccaggagagagaaagccaggcagguagccaggggga

SEQ ID NO: 216449 - RNA, 61 nt, Homo Sapiens
gugcuggaggugggagcaggagauugagaaggagagaaagugggugagaugcuggagaaga

SEQ ID NO: 216450 - RNA, 61 nt, Homo Sapiens
cgcccuccccuccccugcugcaggggcucuggagagaaacaauaaagagauucacacacaa

SEQ ID NO: 216451 - RNA, 61 nt, Homo Sapiens
gcagcgccacagaagccccuaacuuaagugagagagaaagggugucagcuuuucgucuagu

SEQ ID NO: 216452 - RNA, 61 nt, Homo Sapiens
acagggacuuugaaccuaggagagggaagaggagagaaaauuuaccggaguaggggguggg

SEQ ID NO: 216453 - RNA, 61 nt, Homo Sapiens
aaaaagugugacauuacagaaaaaaaaaaaagagagaaacaaauuauuuguaugcuucaaa

SEQ ID NO: 216454 - RNA, 61 nt, Homo Sapiens
gaccaugcugcauacauucuaaagagagagagagagaaaaaccaguuccguucugagagaa

SEQ ID NO: 216455 - RNA, 61 nt, Homo Sapiens
gagagagagagagaaaaagaaguuccguucugagagaaaaagcaaacauguugcuguuucc

SEQ ID NO: 216456 - RNA, 61 nt, Homo Sapiens
aaaacauagacuggaggagguaauccauggagagagaaaaagaagagggcucaggacaagg

SEQ ID NO: 216457 - RNA, 61 nt, Homo Sapiens
uugggguuuugccagggaaguaaaaggaguugagagaaagaugggucaguucagaagacau

SEQ ID NO: 216458 - RNA, 61 nt, Homo Sapiens
ugacuuuuugcacuucuguauauagucaaaagagagaaaccuguauaauaguaagaucuua

SEQ ID NO: 216459 - RNA, 61 nt, Homo Sapiens
cuacugcauguuuaaaacuucaacaaaaaaagagagaaagaacuauacuaagaacauauau

SEQ ID NO: 216460 - RNA, 61 nt, Homo Sapiens
uaauauuaacacaaaaaaauuaaaacgaggagagagaaaaaagcaagaaaagagaaaauau

SEQ ID NO: 216461 - RNA, 61 nt, Homo Sapiens
gaggaagggaacuuauuucuaagacaaacgggagagaaaaaugagcaaacaaaaaaaucga

SEQ ID NO: 216462 - RNA, 61 nt, Homo Sapiens
aaccuugauaaacauaagagaauucauaccggagagaaacuguacaaaugugaagaauaug

SEQ ID NO: 216463 - RNA, 61 nt, Homo Sapiens
ccucaaugcuuaauaaauauaauucaugcuggagagaaacuucacaugugaaccguguggc

SEQ ID NO: 216464 - RNA, 61 nt, Homo Sapiens
aacuuuguuaaacauaagagaauuuauaccagagagaaacccuacacauguaaagaaugug

SEQ ID NO: 216465 - RNA, 61 nt, Homo Sapiens
caccacagccaggaggggccuuucccaccuggagagaaacuuccagaccagccccucauac

SEQ ID NO: 216466 - RNA, 61 nt, Homo Sapiens
uaccacagccaagaggggccuuucucaccuggagagaaauuuccagaccauccccucucac

SEQ ID NO: 216467 - RNA, 61 nt, Homo Sapiens
caccacagccaagagaagccuuuccagccuggagagaaacuuccagaccagcccucucacu

SEQ ID NO: 216468 - RNA, 61 nt, Homo Sapiens
caccacagccaggagaggccuuucccaccuggagagaaacuuccagaccagccccucauac

SEQ ID NO: 216469 - RNA, 61 nt, Homo Sapiens
uaccacagccaagaggggccuuucucaccuggagagaaacuuccagaccagccccucacac

SEQ ID NO: 216470 - RNA, 61 nt, Homo Sapiens
caccaccgccaggagaggccuuucccaccgggagagaaacuuccagaccagccccucacac

SEQ ID NO: 216471 - RNA, 61 nt, Homo Sapiens
caccacagccaggagaggccuuucccaccgggagagaaacuuccagaccagcccucucacu

SEQ ID NO: 216472 - RNA, 61 nt, Homo Sapiens
caccacagccaggagagaccuuuucugccuggagagaaacuuucagaccagccccacacac

SEQ ID NO: 216473 - RNA, 61 nt, Homo Sapiens
caccacagccaggagaggccuuucccaccuggagagaaacuuccagaccagccccucucac

SEQ ID NO: 216474 - RNA, 61 nt, Homo Sapiens
uuuuuaaugaugaaaaguuacacauuuuuuggagagaaaagucuuagcugaagguaaauca

SEQ ID NO: 216475 - RNA, 61 nt, Homo Sapiens
gaaaaugcauaagguuaguacaagaucaguagagagaaagucaaagauuacagaagugcug

SEQ ID NO: 216476 - RNA, 61 nt, Homo Sapiens
accaacaaagaagauguucaauuaucaacaugagagaaaucauuuuaagccuucaaauuac

SEQ ID NO: 216477 - RNA, 61 nt, Homo Sapiens
aauuuauuuuacauugacauauggcaaagaggagagaaagaaaaaagcauacaucaugauu

SEQ ID NO: 216478 - RNA, 61 nt, Homo Sapiens
gugagagcacaaagauaacgcaggagagagagagagaaagaaugagaaagaaaaggaaugc

SEQ ID NO: 216479 - RNA, 61 nt, Homo Sapiens
guaaugacagagaguucuggugagauacccagagagaaaaagagagagcagggugggguaa

SEQ ID NO: 216480 - RNA, 61 nt, Homo Sapiens
aaacuccuugaaaccagcucuucuugcagcagagagaaauaaccaggaaauucuguuuaug

SEQ ID NO: 216481 - RNA, 61 nt, Homo Sapiens
agggcaacuucuacucuucaaucuaaguuucgagagaaagggacacgaacaaaccaaggaa

SEQ ID NO: 216482 - RNA, 61 nt, Homo Sapiens
cccuucuccaaacgauuagucuaaauuuucagagagaaauagauaaaacacgccacagccu

SEQ ID NO: 216483 - RNA, 61 nt, Homo Sapiens
caugcaucuagggcggagaggcugcacuugugagagaaaauacuauuucaagucauauucu

SEQ ID NO: 216484 - RNA, 61 nt, Homo Sapiens
aagcuuacuacacauaggaaaauucauacuggagagaaacuacaaaugugaagaauguguu

SEQ ID NO: 216485 - RNA, 61 nt, Homo Sapiens
cucauaccuuacuauacagaaauucauacuggagagaaagccuacaauugugaagaaugug

SEQ ID NO: 216486 - RNA, 61 nt, Homo Sapiens
accuugcuacauauaagacaguuuauacuuugagagaaacccugcaaaugugaauaaugug

SEQ ID NO: 216487 - RNA, 61 nt, Homo Sapiens
caacuuacugaacauaagaaaauuuacacuagagagaaagccuacaaaugugaagaaugug

SEQ ID NO: 216488 - RNA, 61 nt, Homo Sapiens
acccuuauuacacauaagauaauucauagcggagagaaaccccacaaaugugaagaaugug

SEQ ID NO: 216489 - RNA, 61 nt, Homo Sapiens
acucuuacugcacauaagaucauucauacuggagagaaaccuuacaaaugugaggaaugug

SEQ ID NO: 216490 - RNA, 61 nt, Homo Sapiens
aaccuuacuaaacacaagaagauucauacuagagagaaacccuacaaaugugaagaaugug

SEQ ID NO: 216491 - RNA, 61 nt, Homo Sapiens
aacuuuacuaugcauaagaaaauucaaacuggagagaaacucuacaaaugugaagaaugug

SEQ ID NO: 216492 - RNA, 61 nt, Homo Sapiens
ucaaaacuucuuacaccuaaaauucaugcaggagagaaacaccacaaaugugaaaaauuug

SEQ ID NO: 216493 - RNA, 61 nt, Homo Sapiens
acccuuucugcacauaauauaauucauacuggagagaaaccccacaaauaugaagaaugug

SEQ ID NO: 216494 - RNA, 61 nt, Homo Sapiens
caucuuauucagcaucaaagaauucacacaggagagaaagcacaugaauguaaugaaugug

SEQ ID NO: 216495 - RNA, 61 nt, Homo Sapiens
gccauugcucagcaucagauaauucacaccagagagaaacccucugaaugugacgaaugaa

SEQ ID NO: 216496 - RNA, 61 nt, Homo Sapiens
auuucaggcuuuacccaacaucgaaauaauggagagaaaauuguugauuauuuguuuauga

SEQ ID NO: 216497 - RNA, 61 nt, Homo Sapiens
uuacaagugugaagaaugugaauucauacuggagagaaaccaaacucauugaacacaagaa

SEQ ID NO: 216498 - RNA, 61 nt, Homo Sapiens
cuacaaaugugaagaaugugaauucauacuggagagaaaccacccuuauuggacauaagag

SEQ ID NO: 216499 - RNA, 61 nt, Homo Sapiens
augcucucuagcaacauugaucuuguagaaggagagaaaccauuuuccccauuuuucucuu

SEQ ID NO: 216500 - RNA, 61 nt, Homo Sapiens
aguuuccaaggauauguuucagacgaagggagagagaaagcgaagagggagggagagagaa

SEQ ID NO: 216501 - RNA, 61 nt, Homo Sapiens
cgaagggagagagaaagcagagagggagggagagagaaagacugaagagaaaugggaaaga

SEQ ID NO: 216502 - RNA, 61 nt, Homo Sapiens
auaaaaauauagcauauaauuagacuuugaggagagaaagcuaagugccauccuuuaauca

SEQ ID NO: 216503 - RNA, 61 nt, Homo Sapiens
uaaaauuaaaauaguauuuuacaucauggaggagagaaacuuuguaacagcguaauuaaac

SEQ ID NO: 216504 - RNA, 61 nt, Homo Sapiens
ggaaacacgaaagaaaagucaggaagguagagagagaaaaagggagggaaggagaaagaau

SEQ ID NO: 216505 - RNA, 61 nt, Homo Sapiens
cuggaggaaagucauuccugccuaauccaucgagagaaagaggcuuacgaaaaacuuugcc

SEQ ID NO: 216506 - RNA, 61 nt, Homo Sapiens
acacagagagaaggagaaagagggagggagagagagaaagagagagaaagagagagagaga

SEQ ID NO: 216507 - RNA, 61 nt, Homo Sapiens
aaggagaaagagggagggagagagagaaagagagagaaagagagagagagagagagagaga

SEQ ID NO: 216508 - RNA, 61 nt, Homo Sapiens
aaagagagagaaagagagagagagagagagagagagaaagcugaacgugcacucugacaag

SEQ ID NO: 216509 - RNA, 61 nt, Homo Sapiens
cccucuaucccuucuccuguccaggggcccagagagaaacacaccuaccccuggccuugcc

SEQ ID NO: 216510 - RNA, 61 nt, Homo Sapiens
ucuuuccguggcuggggguagacuuaauaaagagagaaauucaagaacugcuugcuuuauu

SEQ ID NO: 216511 - RNA, 61 nt, Homo Sapiens
uuuaacugccuaaaauguucuccuuagaugugagagaaagagaaaucagaaaaauuaauuc

SEQ ID NO: 216512 - RNA, 61 nt, Homo Sapiens
uguaaaauaagaaagcccuaaaauacuauuggagagaaaaaauuaacuagguugcuacuuu

SEQ ID NO: 216513 - RNA, 61 nt, Homo Sapiens
gagauggcccucugugacucgguuggaaggggagagaaacuauagagagguuggaaggggu

SEQ ID NO: 216514 - RNA, 61 nt, Homo Sapiens
gcucccaccugccagucccuccuggggagaggagagaaaggaugcucugggacgugugggc

SEQ ID NO: 216515 - RNA, 61 nt, Homo Sapiens
cuacaguugauccucaucugcguuucagagggagagaaaugguggguaccuaucccagcca

SEQ ID NO: 216516 - RNA, 61 nt, Homo Sapiens
cacaucugucucugcaaugcagcaagaacuugagagaaaaauauggcuggcuuuccuuagc

SEQ ID NO: 216517 - RNA, 61 nt, Homo Sapiens
cggggauauauuaagauauuuuuguacauaagagagaaagagagagaaaaauuuauagaag

SEQ ID NO: 216518 - RNA, 61 nt, Homo Sapiens
uuaagauauuuuuguacauaagagagaaagagagagaaaaauuuauagaaguuuuguacaa

SEQ ID NO: 216519 - RNA, 61 nt, Homo Sapiens
aagacuuagagaagaggaagagugauauacagagagaaaaaguaagaauaaaaacuaccaa

SEQ ID NO: 216520 - RNA, 61 nt, Homo Sapiens
cuauugaggcagugacuguugaugcaugugggagagaaaccuacuuucugacacuuuugag

SEQ ID NO: 216521 - RNA, 61 nt, Homo Sapiens
caaaauagcugcccuuaaagaguuguuagcagagagaaaaauaacagugaaugugcuccug

SEQ ID NO: 216522 - RNA, 61 nt, Homo Sapiens
uauacacucagcaauaauuagaaaaaaaggagagagaaaagugauuuaaacaggguggauu

SEQ ID NO: 216523 - RNA, 61 nt, Homo Sapiens
uaacuuauuguguguuugaucaacagcuauagagagaaagaaugugcuuuuuauuguaauu

SEQ ID NO: 216524 - RNA, 61 nt, Homo Sapiens
ggaacugaaggacgcgguuaugugagaaagcgagagaaagaaguguggcagagagugugca

SEQ ID NO: 216525 - RNA, 61 nt, Homo Sapiens
agaguaagugaaagggugccugcgcugacgugagagaaaggaaucuguaaacaguggaaac

SEQ ID NO: 216526 - RNA, 61 nt, Homo Sapiens
auuuaccuaggagcauguaagagaaagaagggagagaaaagguugcaucugcaggaugccu

SEQ ID NO: 216527 - RNA, 61 nt, Homo Sapiens
cuuagaacauacacagauccuuuuucuaaaggagagaaagaauagaaucagauuaucucuu

SEQ ID NO: 216528 - RNA, 61 nt, Homo Sapiens
cuuagaauguacacagauccuuucucuaaaugagagaaagaucuauagacuugagaauguu

SEQ ID NO: 216529 - RNA, 61 nt, Homo Sapiens
uuuaaggcaaugaaucacagggaaauucuaagagagaaaguacugguuuggcaugcgguau

SEQ ID NO: 216530 - RNA, 61 nt, Homo Sapiens
aggggauguaaccagcaaugcaggacuuacggagagaaauaauugccuuaagccaccuccc

SEQ ID NO: 216531 - RNA, 61 nt, Homo Sapiens
cgacaucaccccaaggacaacggcagaaguagagagaaacuaccuaccucacuucaaauua

SEQ ID NO: 216532 - RNA, 61 nt, Homo Sapiens
agcucggcuacuuuuguaaacuucagauuuggagagaaacacgaaagucugaauccugacc

SEQ ID NO: 216533 - RNA, 61 nt, Homo Sapiens
gagagagagaugcuguugaaagugagagagagagagaaagaagagugagagagagaaagag

SEQ ID NO: 216534 - RNA, 61 nt, Homo Sapiens
gagugagagagagagagaaaagagagugagagagagaaagauaaccaguuuccagagagcc

SEQ ID NO: 216535 - RNA, 61 nt, Homo Sapiens
gaggagacagagagggagagaggcagagagggagagaaacaugaggagagagagacagagg

SEQ ID NO: 216536 - RNA, 61 nt, Homo Sapiens
gagguggggagaggggagagagaggaggggagagagaaagaaggaggagggagagagaugg

SEQ ID NO: 216537 - RNA, 61 nt, Homo Sapiens
ucauuucaaauacaugaaaaaucuuacacuggagagaaacccuaugaguguaagcaaugug

SEQ ID NO: 216538 - RNA, 61 nt, Homo Sapiens
aaucuucgauuucauaaaaggacacacacuggagagaaacccugugaauguaagaaaugua

SEQ ID NO: 216539 - RNA, 61 nt, Homo Sapiens
auccuuugaauacaugcaagaacacacaauggagagaaacccuaugaauguaaagaaugca

SEQ ID NO: 216540 - RNA, 61 nt, Homo Sapiens
ucuuuucaauaucaugaaaggacucacaugggagagaaacccuaugaguguaugccaagug

SEQ ID NO: 216541 - RNA, 61 nt, Homo Sapiens
uuauuucaaacacaugaaaaaauucacacuggagagaaacccuauaaaugcaagcaaugug

SEQ ID NO: 216542 - RNA, 61 nt, Homo Sapiens
aaccuuucaauuuaugaaaggacacacacuggagagaaacccuaugaauguaagaaaugug

SEQ ID NO: 216543 - RNA, 61 nt, Homo Sapiens
gaucguuugaauacaugcaaaacacacacuggagagaaaccuaugaauguaaggaaugcaa

SEQ ID NO: 216544 - RNA, 61 nt, Homo Sapiens
ucauuucgaagacaugaaaaaacucacacuggagagaaacccuauaaaugcaugccaugug

SEQ ID NO: 216545 - RNA, 61 nt, Homo Sapiens
uccuuucaguaucaugaaaggacucacacuggagagaaacccuaugaguguaagcaaugug

SEQ ID NO: 216546 - RNA, 61 nt, Homo Sapiens
cacaccuucgaaggcaugguaggacucacuggagagaaacccuaugaguguaaggaaugug

SEQ ID NO: 216547 - RNA, 61 nt, Homo Sapiens
uccuuuugguaccaugaaaggacucacacuggagagaaacccuaugaguguaagcaaugug

SEQ ID NO: 216548 - RNA, 61 nt, Homo Sapiens
caccuucgaauccaugguagaacucacacuggagagaaacccuaugaguguaaggaaugug

SEQ ID NO: 216549 - RNA, 61 nt, Homo Sapiens
ucauuucaaauaccugaaaaaucuuacacuggagagaaacccuaugaguguaagcaaugug

SEQ ID NO: 216550 - RNA, 61 nt, Homo Sapiens
ucuuuucgauaacaugaaaggacucacacuggagagaaacccuaugaguguaagcaaugug

SEQ ID NO: 216551 - RNA, 61 nt, Homo Sapiens
ugaaaacacaaagcacaggucaggauccucugagagaaaaucaacauugcaccacguaggg

SEQ ID NO: 216552 - RNA, 61 nt, Homo Sapiens
gagggcaacaggagauguggggacguguuaggagagaaaaaaaaaaaaacaaaaauauaua

SEQ ID NO: 216553 - RNA, 61 nt, Homo Sapiens
caaccaacacaagaucaaaaaggaaaaggacgagagaaaaauuauuuuuaagauaauuaaa

SEQ ID NO: 216554 - RNA, 61 nt, Homo Sapiens
cccugaccgugcugaacagacccccccacacgagagaaaauaaaggagcaauaaagucacg

SEQ ID NO: 216555 - RNA, 61 nt, Homo Sapiens
acccuuaauacacauaagauaauuaaugcuggagagaaacccuacaaaugugaagaaugug

SEQ ID NO: 216556 - RNA, 61 nt, Homo Sapiens
uaccuuacuaaauauaagauaauucauauuggagagaaauucuacagaugugaagaaugug

SEQ ID NO: 216557 - RNA, 61 nt, Homo Sapiens
uccauuaguaaacauaagauaauucauacuggagagaaaaccuacaaaugugaggaaugug

SEQ ID NO: 216558 - RNA, 61 nt, Homo Sapiens
acccuuacuacacauuagauaauucaugcuggagagaaacccuacaaaugugaaaaaugug

SEQ ID NO: 216559 - RNA, 61 nt, Homo Sapiens
ccucaacuccuaguaaacauaauuaaugauggagagaaaccauacaacugugaagaaugug

SEQ ID NO: 216560 - RNA, 61 nt, Homo Sapiens
caaacuuuauugaacaaaauaauucauacaggagagaaacccuacaaaugugaagaaugug

SEQ ID NO: 216561 - RNA, 61 nt, Homo Sapiens
auuuuuacuaaacauaagaaaauucauacuggagagaaacccuaugauugugaaaaauaug

SEQ ID NO: 216562 - RNA, 61 nt, Homo Sapiens
ucccugcuucaacaucacaguauucauacuggagagaaaccuuacgaauguauuaaaugug

SEQ ID NO: 216563 - RNA, 61 nt, Homo Sapiens
aaucuuacugcccaucaaagaguacauaauggagagaaacccaauagugugguaagugugg

SEQ ID NO: 216564 - RNA, 61 nt, Homo Sapiens
aaucucauuacacaucagaaaauucacacuggagagaaaccuuaugaaugcagugaaugug

SEQ ID NO: 216565 - RNA, 61 nt, Homo Sapiens
aaccucacugaacaugagaaaauucauacuggagagaaaccuuaucauuguaaucaaugug

SEQ ID NO: 216566 - RNA, 61 nt, Homo Sapiens
aaucuucuugagcaugaaaaaauucauacuggagagaaaccauucaaauguaaugaaugug

SEQ ID NO: 216567 - RNA, 61 nt, Homo Sapiens
cgggacagagugagacccugucugaaagaaagagagaaagaaagaaagaaagagagagaaa

SEQ ID NO: 216568 - RNA, 61 nt, Homo Sapiens
ugaaagaaagagagaaagaaagaaagaaagagagagaaagaaagaaagaaagaaagggaaa

SEQ ID NO: 216569 - RNA, 61 nt, Homo Sapiens
aaggaaggaaaaagaaagagaaagagagagagagagaaagaaaaagaaagaaaaguaagaa

SEQ ID NO: 216570 - RNA, 61 nt, Homo Sapiens
agccuugcaugucaucauagacuucauacuggagagaaaccuuacaaaugugaagcaugug

SEQ ID NO: 216571 - RNA, 61 nt, Homo Sapiens
cgccuuaaaagacauaggagaauucauacuggagagaaaccuuacaaguguaaugagugug

SEQ ID NO: 216572 - RNA, 61 nt, Homo Sapiens
uaccuugcaguucaucagugaacucauacuggagagaaaccuuacaaaugucaugacugug

SEQ ID NO: 216573 - RNA, 61 nt, Homo Sapiens
uccuaugcaaaacauaggagaauucaugcaggagagaaaugucacaagugugaugaguguu

SEQ ID NO: 216574 - RNA, 61 nt, Homo Sapiens
caccucauuagacaucagagaaucccuacuggagagaaaucuuacaaaugucaucagugug

SEQ ID NO: 216575 - RNA, 61 nt, Homo Sapiens
ccuuggagcacugagcaccauuuggaagcuugagagaaaccaaaauuaaagagagaaagag

SEQ ID NO: 216576 - RNA, 61 nt, Homo Sapiens
auuuggaagcuugagagaaaccaaaauuaaagagagaaagagagagcgugcacgcuccugc

SEQ ID NO: 216577 - RNA, 61 nt, Homo Sapiens
caucugucguggcugagcgggagcuguucuggagagaaaacacaccccagugucacagggc

SEQ ID NO: 216578 - RNA, 61 nt, Homo Sapiens
ccacaaauuccaaugucacaauggggggagagagagaaaauagggucuggugauggcaggg

SEQ ID NO: 216579 - RNA, 61 nt, Homo Sapiens
aaaucacccaccacccccccagagacagagagagagaaaaaaacagaaacccgagaaagag

SEQ ID NO: 216580 - RNA, 61 nt, Homo Sapiens
cugcaauuuaaaugguauggaacucacauuggagagaaaccaaccuuaauguguguaugug

SEQ ID NO: 216581 - RNA, 61 nt, Homo Sapiens
guaugaauguagagaaucugaaaucucacuggagagaaacuagccuuaccaaacacaucag

SEQ ID NO: 216582 - RNA, 61 nt, Homo Sapiens
uuaaagcuggguguccggggagaguacaaaagagagaaauuaacuugagaaauaaagggac

SEQ ID NO: 216583 - RNA, 61 nt, Homo Sapiens
uuuuguauguaaagaauuugaacuccuaccagagagaaaccuauuccucaccccaccugug

SEQ ID NO: 216584 - RNA, 61 nt, Homo Sapiens
uuauaaauguaaggauugugaaugcacacuggagagaaaccggcuuucgagugcacaugag

SEQ ID NO: 216585 - RNA, 61 nt, Homo Sapiens
cuaugaauguaaagaaugugaauucauacuggagagaaaccuauauucauauacaugaacg

SEQ ID NO: 216586 - RNA, 61 nt, Homo Sapiens
uuaugaauguaaacagugugaacccacacuggagagaaaccgguuuccagauacaugaaag

SEQ ID NO: 216587 - RNA, 61 nt, Homo Sapiens
cuacaaauguaaggaauguggacucauacuggagagaaaccucagcucaaagacaugaaag

SEQ ID NO: 216588 - RNA, 61 nt, Homo Sapiens
cuacaaaugcaaggaauguggacucauacuggagagaaaccucugcucaaagacaugaaaa

SEQ ID NO: 216589 - RNA, 61 nt, Homo Sapiens
cuacaaauguaaggaaugugggcucauacuggagagaaaccucugcucaaaaacaugaaaa

SEQ ID NO: 216590 - RNA, 61 nt, Homo Sapiens
uuaugaagguaaacaaugugaauucacacucgagagaaaccugccuucuacaacaugaaag

SEQ ID NO: 216591 - RNA, 61 nt, Homo Sapiens
cuguacauguaaacaaugugaacucacacuggagagaaacuucuugucuaagacaugaaaa

SEQ ID NO: 216592 - RNA, 61 nt, Homo Sapiens
auaugaauguaagcaguguuaacucacucuggagagaaacuuuauuucguaugcaugaaag

SEQ ID NO: 216593 - RNA, 61 nt, Homo Sapiens
auaaagaaaauucuauauccaauauauacuggagagaaacuaucuuuuaaagacaccugag

SEQ ID NO: 216594 - RNA, 61 nt, Homo Sapiens
caaggaauguaaacgguguguacuuacgcuggagagaaauuuccuuuuggauguaugagag

SEQ ID NO: 216595 - RNA, 61 nt, Homo Sapiens
acaaagcuggaagacaucacaacuuaaacuggagagaaacuaaucuuacuaaacauaaaaa

SEQ ID NO: 216596 - RNA, 61 nt, Homo Sapiens
cuacaaauguaaagaaugugaauucauacuagagagaaaccauccuuaugaaacaaaagau

SEQ ID NO: 216597 - RNA, 61 nt, Homo Sapiens
cuacaaaugugauaaaugugaauucauacuggagagaaauccuuuuauuaaaacacaagau

SEQ ID NO: 216598 - RNA, 61 nt, Homo Sapiens
augcaugugugaagaaugugaacucauacuggagagaaaccaggcuuacuacauauaagac

SEQ ID NO: 216599 - RNA, 61 nt, Homo Sapiens
cuacaaaugcgaagaaugugaauucauacuggagagaaaccaaccuuguggaacauaagag

SEQ ID NO: 216600 - RNA, 61 nt, Homo Sapiens
cuacaaacgugaagaaugugaauucaugcuggagagaaacaaucuuuauuacacauaagaa

SEQ ID NO: 216601 - RNA, 61 nt, Homo Sapiens
cuacaaaggugaagaaugugaauucauacuggagagaaaaucagucuaguaaacauaagaa

SEQ ID NO: 216602 - RNA, 61 nt, Homo Sapiens
ucacaagugugaugauugugaauuuauacaggagagaaaccuccuaugcaaaacauaggag

SEQ ID NO: 216603 - RNA, 61 nt, Homo Sapiens
uuacaaaugucaugacugugaacucauacuggagagaaacccauauugcaggucaucggug

SEQ ID NO: 216604 - RNA, 61 nt, Homo Sapiens
uuacaaguguaaugagugugacuucacacuggagagaaacccaccuggaacaacauacugg

SEQ ID NO: 216605 - RNA, 61 nt, Homo Sapiens
uuacaaauguaagguuucugaauuuauacuggagagaaagcacaccuuaaagacauaggag

SEQ ID NO: 216606 - RNA, 61 nt, Homo Sapiens
ucacaugugugaugauugugaauucauacaggagagaaaccuccuaugcaaaacauaggag

SEQ ID NO: 216607 - RNA, 61 nt, Homo Sapiens
uuacaaaugucaugacugugcacucauacuggagagaaaccuacauugcaguucauugaca

SEQ ID NO: 216608 - RNA, 61 nt, Homo Sapiens
cacaagugugaugauugugggauucauacaggagagaaacuuccuaugcaaaacauaggag

SEQ ID NO: 216609 - RNA, 61 nt, Homo Sapiens
uuauaaaugucaugauugugaacucaugcuggagagaaaccuauauugcuauucaucaucg

SEQ ID NO: 216610 - RNA, 61 nt, Homo Sapiens
uuacaagugcaaugagugugaauucacacuggagagaaacccaccuggcacaccauacuag

SEQ ID NO: 216611 - RNA, 61 nt, Homo Sapiens
cuacaaguguaaugaaugugaauucguauuggagagaaaccuaccuuguaauucaaaaggc

SEQ ID NO: 216612 - RNA, 61 nt, Homo Sapiens
uuacaaaugugaugagugugaauucaaacuggagagaaaccuaccuggcaaaacauauuag

SEQ ID NO: 216613 - RNA, 61 nt, Homo Sapiens
uuacaaguguaaugaaugugcauucauacuggagagaaacuacccuuguaagucacaaagc

SEQ ID NO: 216614 - RNA, 61 nt, Homo Sapiens
uuaaaaguguaaugagugugacuucauaguggagagaaaccaaccuuguauaccaucauag

SEQ ID NO: 216615 - RNA, 61 nt, Homo Sapiens
ucacaagugugaugauuguggauucauacaggagagaaaccuccuaugcaaaacauaggag

SEQ ID NO: 216616 - RNA, 61 nt, Homo Sapiens
uuauaaaugucaugauugagaacucaugcuggagagaaaccugccuugcauuucacuggug

SEQ ID NO: 216617 - RNA, 61 nt, Homo Sapiens
uuacaagugcaaugagugugaauucacacuggagagaaacccacguggcaccccauacuag

SEQ ID NO: 216618 - RNA, 61 nt, Homo Sapiens
uuacaagcacaaugaaugugaauucauaguggagagaaaccggucaaaauucacaccuugu

SEQ ID NO: 216619 - RNA, 61 nt, Homo Sapiens
cauuauaaguguaaugagugaauucacacuggagagaaacuuaucuggcaaaacauacuag

SEQ ID NO: 216620 - RNA, 61 nt, Homo Sapiens
uuacaaaugggaggaaugugacuucauacuggagagaaaccaccuuugcacaucaccauag

SEQ ID NO: 216621 - RNA, 61 nt, Homo Sapiens
uuacaagcauaaugaaugugaauucauacuggagagaaaccaacccuguaagucauaaggc

SEQ ID NO: 216622 - RNA, 61 nt, Homo Sapiens
uguuuuuuaaacaaaugaugcugagaauaaggagagaaaugaauguagagagagguagaga

SEQ ID NO: 216623 - RNA, 61 nt, Homo Sapiens
aaggagagaaaugaauguagagagagguagagagagaaauaugaacucuaacaaaggacug

SEQ ID NO: 216624 - RNA, 61 nt, Homo Sapiens
cccaguuaguggugugcaaaaaaaaaagaaugagagaaaagagagaccugccagaagauua

SEQ ID NO: 216625 - RNA, 61 nt, Homo Sapiens
ugggguuuuguuuccccaccaaaaaugaucagagagaaaagccucuuagaaucucuuauga

SEQ ID NO: 216626 - RNA, 61 nt, Homo Sapiens
guaauuugauuauuucauucggugagaauuugagagaaauacucugagcgagucucuagag

SEQ ID NO: 216627 - RNA, 61 nt, Homo Sapiens
auuucuauuaaugguuuaauauuacauauuugagagaaaauacuuucuuuuacaaaagaau

SEQ ID NO: 216628 - RNA, 61 nt, Homo Sapiens
uaagagcugguucuaaaaucacauaugacacgagagaaaagugucaagugaggacuucauc

SEQ ID NO: 216629 - RNA, 61 nt, Homo Sapiens
gagccgcugugcugguggggggcaaagaauagagagaaaggcaauccagaggugccuucag

SEQ ID NO: 216630 - RNA, 61 nt, Homo Sapiens
augauuggcauuaguuaccacagccugcccagagagaaacuaucuucucccaacauuuacu

SEQ ID NO: 216631 - RNA, 61 nt, Homo Sapiens
auguuacaaccgcuguaaaaugacggagagagagagaaagaaucccagacauuaacgguau

SEQ ID NO: 216632 - RNA, 64 nt, Homo Sapiens
cuaacgguugcaccuccaagcaaccccugacugcuccucaaaaggggaagagagacugaaguca

SEQ ID NO: 216633 - RNA, 64 nt, Homo Sapiens
cugauucagaaacugacuugggaaucauuucuccuccucaaaaaugcugccuauaaaucuugga

SEQ ID NO: 216634 - RNA, 64 nt, Homo Sapiens
ggcaugggcuuucuucucuacaauuauguuacauuccucaaaguaccuuuguacccagacaaaa

SEQ ID NO: 216635 - RNA, 64 nt, Homo Sapiens
guuggacuauuugggaaaaggccucauauauuucuccucaaaacagugccguauaaaacaaccu

SEQ ID NO: 216636 - RNA, 64 nt, Homo Sapiens
aaagcuuugguauuaaaagagguaaacaucaguuuccucaaacauuuuauucauguugaaugcc

SEQ ID NO: 216637 - RNA, 64 nt, Homo Sapiens
uuuugugaaaauagaguuuugguaaucacuuucuuccucaaaauaaguccuucuguuaauuugu

SEQ ID NO: 216638 - RNA, 64 nt, Homo Sapiens
gaaauauucaguuagcaguguggccaggaucagauccucaaaaguuggaacucuagcugauccu

SEQ ID NO: 216639 - RNA, 64 nt, Homo Sapiens
auaucuauccucuaaaccagcuuuuccuuaguguuccucaaauugauuauuuacuuucucuuau

SEQ ID NO: 216640 - RNA, 64 nt, Homo Sapiens
aucucaauuucaggagguuuuuauagugcugagauccucaaauacuauccucaaauuauuuauu

SEQ ID NO: 216641 - RNA, 64 nt, Homo Sapiens
auuuauuuuauagugcugagcuguguccguacuauccucaaauugaugaauucagugugagguc

SEQ ID NO: 216642 - RNA, 64 nt, Homo Sapiens
aagcugugcaauuauguaaaauuuucaacugucuuccucaaaauaaagaaguaugguaaucuuu

SEQ ID NO: 216643 - RNA, 64 nt, Homo Sapiens
ugaacuuaauaacuguguacuguucggaagggguuccucaaauuuuuugacuuuuuuuguaugu

SEQ ID NO: 216644 - RNA, 52 nt, Homo Sapiens
cugacaacagugaccagugagguccucaaauggaaacaagccacuuagccag

SEQ ID NO: 216645 - RNA, 64 nt, Homo Sapiens
uaaagagaaauaugaauacaauuccccuaaacucuccucaaaagagaauucagucuacagccau

SEQ ID NO: 216646 - RNA, 64 nt, Homo Sapiens
gaugacacucauugucauaauaaaacaaauaauuuccucaaauaacaaagaaaaaugauaccua

SEQ ID NO: 216647 - RNA, 64 nt, Homo Sapiens
agaugggccauuaaggauucuucaaggaaaacauuccucaaaaugaucuuuagugccuuuauuc

SEQ ID NO: 216648 - RNA, 64 nt, Homo Sapiens
cacccuugacgucaagucuccuggcccgucauguuccucaaaagucaaaguuggggcaggcugg

SEQ ID NO: 216649 - RNA, 64 nt, Homo Sapiens
caaaugagaucccgccucuucaggaacacccgacuccucaaaagugacaacaugcgaccgugac

SEQ ID NO: 216650 - RNA, 64 nt, Homo Sapiens
auaaagaaaaaacuagaagaggagaaaaaggauuuccucaaauuuuaaauauguaacuucaggg

SEQ ID NO: 216651 - RNA, 64 nt, Homo Sapiens
auuacauuuugaguaguaaggucuacagcauuguuccucaaacuuggcuacguauuggaaucac

SEQ ID NO: 216652 - RNA, 64 nt, Homo Sapiens
agguuguggcuccuguugaacaguuguugguuguuccucaaaacuugaacuuccaguaggccca

SEQ ID NO: 216653 - RNA, 64 nt, Homo Sapiens
gcaugcccauugucuucaggaugguccuuuucacuccucaaaauuguuugccauggagcacuag

SEQ ID NO: 216654 - RNA, 64 nt, Homo Sapiens
aaucaggccagacucaauuuauuguaaaauuugcuccucaaaggguguguuagggugagggaug

SEQ ID NO: 216655 - RNA, 64 nt, Homo Sapiens
guggacguguguccccauggagggaaaagacaaauccucaaagcgucggcggcgcugggguugc

SEQ ID NO: 216656 - RNA, 64 nt, Homo Sapiens
gugaauaacugccuguuuuccuaaaucaaacccauccucaaaggaugaagacucaccaccaucc

SEQ ID NO: 216657 - RNA, 64 nt, Homo Sapiens
auucagaagaguucacugcagaugcugcagguaguccucaaaaauggguuccagaaauguuuug

SEQ ID NO: 216658 - RNA, 64 nt, Homo Sapiens
ugugcauauaugacaugaaaucccauucuuauucuccucaaaccuuucugagucgccugcauua

SEQ ID NO: 216659 - RNA, 64 nt, Homo Sapiens
auuugucauuucugagucgcgauguaggaaaaauuccucaaagucacuucauagcaccaacaga

SEQ ID NO: 216660 - RNA, 64 nt, Homo Sapiens
aaaagccuucaaaacacgagcuuccaccccaaacuccucaaaucgaaauucuguuggacacuca

SEQ ID NO: 216661 - RNA, 64 nt, Homo Sapiens
ugacuuugccaaagggauugauaaucuuuauggauccucaaagcucaauuggaauuuuuagagc

SEQ ID NO: 216662 - RNA, 64 nt, Homo Sapiens
gaauuauuuucuuuuuaaauaaaccugaguuuacuccucaaaucaugguaacugugugauuuag

SEQ ID NO: 216663 - RNA, 64 nt, Homo Sapiens; identical to SEQ ID NO: 76961

SEQ ID NO: 216664 - RNA, 64 nt, Homo Sapiens; identical to SEQ ID NO: 76962

SEQ ID NO: 216665 - RNA, 64 nt, Homo Sapiens; identical to SEQ ID NO: 76963

SEQ ID NO: 216666 - RNA, 64 nt, Homo Sapiens; identical to SEQ ID NO: 76964

SEQ ID NO: 216667 - RNA, 64 nt, Homo Sapiens; identical to SEQ ID NO: 76965

SEQ ID NO: 216668 - RNA, 64 nt, Homo Sapiens; identical to SEQ ID NO: 76966

SEQ ID NO: 216669 - RNA, 64 nt, Homo Sapiens; identical to SEQ ID NO: 76967

SEQ ID NO: 216670 - RNA, 64 nt, Homo Sapiens; identical to SEQ ID NO: 76968

SEQ ID NO: 216671 - RNA, 64 nt, Homo Sapiens; identical to SEQ ID NO: 76969

SEQ ID NO: 216672 - RNA, 64 nt, Homo Sapiens; identical to SEQ ID NO: 76970

SEQ ID NO: 216673 - RNA, 64 nt, Homo Sapiens; identical to SEQ ID NO: 76971

SEQ ID NO: 216674 - RNA, 64 nt, Homo Sapiens; identical to SEQ ID NO: 76972

SEQ ID NO: 216675 - RNA, 64 nt, Homo Sapiens; identical to SEQ ID NO: 76973

SEQ ID NO: 216676 - RNA, 64 nt, Homo Sapiens; identical to SEQ ID NO: 76974

SEQ ID NO: 216677 - RNA, 64 nt, Homo Sapiens; identical to SEQ ID NO: 76975

SEQ ID NO: 216678 - RNA, 64 nt, Homo Sapiens; identical to SEQ ID NO: 76976

SEQ ID NO: 216679 - RNA, 64 nt, Homo Sapiens; identical to SEQ ID NO: 76977

SEQ ID NO: 216680 - RNA, 64 nt, Homo Sapiens; identical to SEQ ID NO: 76978

SEQ ID NO: 216681 - RNA, 64 nt, Homo Sapiens; identical to SEQ ID NO: 76979

SEQ ID NO: 216682 - RNA, 64 nt, Homo Sapiens; identical to SEQ ID NO: 76980

SEQ ID NO: 216683 - RNA, 64 nt, Homo Sapiens; identical to SEQ ID NO: 76981

SEQ ID NO: 216684 - RNA, 64 nt, Homo Sapiens; identical to SEQ ID NO: 76982

SEQ ID NO: 216685 - RNA, 64 nt, Homo Sapiens; identical to SEQ ID NO: 76983

SEQ ID NO: 216686 - RNA, 64 nt, Homo Sapiens; identical to SEQ ID NO: 76984

SEQ ID NO: 216687 - RNA, 64 nt, Homo Sapiens; identical to SEQ ID NO: 76985

SEQ ID NO: 216688 - RNA, 64 nt, Homo Sapiens; identical to SEQ ID NO: 76986

SEQ ID NO: 216689 - RNA, 64 nt, Homo Sapiens; identical to SEQ ID NO: 76987

SEQ ID NO: 216690 - RNA, 64 nt, Homo Sapiens; identical to SEQ ID NO: 76988

SEQ ID NO: 216691 - RNA, 64 nt, Homo Sapiens; identical to SEQ ID NO: 76989

SEQ ID NO: 216692 - RNA, 64 nt, Homo Sapiens; identical to SEQ ID NO: 76990

SEQ ID NO: 216693 - RNA, 64 nt, Homo Sapiens; identical to SEQ ID NO: 76991

SEQ ID NO: 216694 - RNA, 64 nt, Homo Sapiens; identical to SEQ ID NO: 76992

SEQ ID NO: 216695 - RNA, 64 nt, Homo Sapiens; identical to SEQ ID NO: 76993

SEQ ID NO: 216696 - RNA, 64 nt, Homo Sapiens; identical to SEQ ID NO: 76994

SEQ ID NO: 216697 - RNA, 64 nt, Homo Sapiens; identical to SEQ ID NO: 76995

SEQ ID NO: 216698 - RNA, 64 nt, Homo Sapiens; identical to SEQ ID NO: 76996

SEQ ID NO: 216699 - RNA, 64 nt, Homo Sapiens; identical to SEQ ID NO: 76997

SEQ ID NO: 216700 - RNA, 64 nt, Homo Sapiens; identical to SEQ ID NO: 76998

SEQ ID NO: 216701 - RNA, 64 nt, Homo Sapiens; identical to SEQ ID NO: 76999

SEQ ID NO: 216702 - RNA, 64 nt, Homo Sapiens; identical to SEQ ID NO: 77000

SEQ ID NO: 216703 - RNA, 64 nt, Homo Sapiens; identical to SEQ ID NO: 77001

SEQ ID NO: 216704 - RNA, 64 nt, Homo Sapiens; identical to SEQ ID NO: 77002

SEQ ID NO: 216705 - RNA, 64 nt, Homo Sapiens; identical to SEQ ID NO: 77003

SEQ ID NO: 216706 - RNA, 64 nt, Homo Sapiens; identical to SEQ ID NO: 77004

SEQ ID NO: 216707 - RNA, 64 nt, Homo Sapiens; identical to SEQ ID NO: 77005

SEQ ID NO: 216708 - RNA, 64 nt, Homo Sapiens; identical to SEQ ID NO: 77006

SEQ ID NO: 216709 - RNA, 64 nt, Homo Sapiens; identical to SEQ ID NO: 77007

SEQ ID NO: 216710 - RNA, 64 nt, Homo Sapiens; identical to SEQ ID NO: 77008

SEQ ID NO: 216711 - RNA, 64 nt, Homo Sapiens; identical to SEQ ID NO: 77009

SEQ ID NO: 216712 - RNA, 64 nt, Homo Sapiens; identical to SEQ ID NO: 77010

SEQ ID NO: 216713 - RNA, 64 nt, Homo Sapiens; identical to SEQ ID NO: 77011

SEQ ID NO: 216714 - RNA, 64 nt, Homo Sapiens; identical to SEQ ID NO: 77012

SEQ ID NO: 216715 - RNA, 64 nt, Homo Sapiens; identical to SEQ ID NO: 77013

SEQ ID NO: 216716 - RNA, 64 nt, Homo Sapiens; identical to SEQ ID NO: 77014

SEQ ID NO: 216717 - RNA, 64 nt, Homo Sapiens; identical to SEQ ID NO: 77015

SEQ ID NO: 216718 - RNA, 64 nt, Homo Sapiens
ucauuuugaugaaaaauauuccaagacuaaguugagaaaagagauacuauuuuggauguguauc

SEQ ID NO: 216719 - RNA, 64 nt, Homo Sapiens
agcauauaagugaaaagucuuauaaguguaauagagaaaagauuugucaguguguuuuuuuaaa

SEQ ID NO: 216720 - RNA, 64 nt, Homo Sapiens
cacagaguauacuaaagugaauuauuuguuacaaagaaaagagaugccagccagguauuuuaag

SEQ ID NO: 216721 - RNA, 64 nt, Homo Sapiens
uuaugucaugccuugcacaaaagugaugaaaucuagaaaagauugugugucaccccuguuuauu

SEQ ID NO: 216722 - RNA, 64 nt, Homo Sapiens
gucuaggaccuaucauuucaucagagacaugaucagaaaagaaacugcuucugccccauuucuu

SEQ ID NO: 216723 - RNA, 64 nt, Homo Sapiens
cuguaaauaugaaagaacaaagguuauuuccuggagaaaagacaauuuauucaacaccaacgag

SEQ ID NO: 216724 - RNA, 64 nt, Homo Sapiens
cugagacuccagaaucugcuuaacuuaucuagaaagaaaagaccucugaaaagcaauugcccug

SEQ ID NO: 216725 - RNA, 64 nt, Homo Sapiens
agacccuggaauucagcaccugugugccuguggcagaaaagaggccaaaggggcugcuggggca

SEQ ID NO: 216726 - RNA, 64 nt, Homo Sapiens
gagaagaagcuggggucuccgugggaugggggaaagaaaagaaagcagagagagaaggaauggc

SEQ ID NO: 216727 - RNA, 64 nt, Homo Sapiens
augaaauuuaccagauaacacugagaagaaagggagaaaagaccaauuuucaaggggaaaaaac

SEQ ID NO: 216728 - RNA, 64 nt, Homo Sapiens
auuucuacuaauuucagaccgccaaaaagagaaaagaaaagaaagcuaaaacacuucuacuagg

SEQ ID NO: 216729 - RNA, 64 nt, Homo Sapiens
agaaaauuucuacuaauuuccuagggccaaaaagagaaaagaaauggaagcuaaaacacuucua

SEQ ID NO: 216730 - RNA, 64 nt, Homo Sapiens
gggaagaagaucaaaacccaaaagaagaaggggaagaaaagaaggggaagaagaucaaagaaga

SEQ ID NO: 216731 - RNA, 64 nt, Homo Sapiens
aaggggaagaaaagaaggggaagaagaucaaagaagaaaagaagaaggggaagaaaagaagggg

SEQ ID NO: 216732 - RNA, 64 nt, Homo Sapiens
gggaagaagaucaaagaagagaaggggaaggggaagaaaagaaguuuauugcagaaauugaaaa

SEQ ID NO: 216733 - RNA, 64 nt, Homo Sapiens
aauauuuaaggugacagauauauuuucaacauaaagaaaagacgaugaagaaaaguaauuagaa

SEQ ID NO: 216734 - RNA, 64 nt, Homo Sapiens
aaugaagaaaaguaauuagagaaagggagagagaagaaaagaaaaaaaagaagagagggaggaa

SEQ ID NO: 216735 - RNA, 64 nt, Homo Sapiens
cacaaauauaaaauuaaaaaauuugcaacauuagagaaaagagauaaugucauuagugacaaag

SEQ ID NO: 216736 - RNA, 64 nt, Homo Sapiens
gcuggagcugguggcuuaggaaaaaaaaaaagaaagaaaagaaacaagagcaaaacuccagcuc

SEQ ID NO: 216737 - RNA, 64 nt, Homo Sapiens
acuggaggcugggcgcagugaaccgcugcucuaaagaaaagaaauugaagccaaaaggauuuaa

SEQ ID NO: 216738 - RNA, 64 nt, Homo Sapiens
cuucucuguaaguaauugccugaacuagugauguagaaaagagacuaguuucuagugucacuga

SEQ ID NO: 216739 - RNA, 64 nt, Homo Sapiens
aaacaacuaaaaaaauuuuuccaggacucuuugaagaaaagaaauuccuuaugggaucauuuuu

SEQ ID NO: 216740 - RNA, 64 nt, Homo Sapiens
gugcuugaaagauuucaaauugcaaaggaugggcagaaaagaaauccuauauuuccauauugug

SEQ ID NO: 216741 - RNA, 64 nt, Homo Sapiens
cuuauguuuugcucaucuaaaguuauguugcuggagaaaagauaucauuuaaacuuugaugcuu

SEQ ID NO: 216742 - RNA, 64 nt, Homo Sapiens
gaaguuaacaaccuccacugaucugaauggaagaagaaaagagaugcuccucacagcuuuggga

SEQ ID NO: 216743 - RNA, 64 nt, Homo Sapiens
ccuggaacccaugugcauuugcccauugucacuuagaaaagacagacuacuguccaguaaggag

SEQ ID NO: 216744 - RNA, 64 nt, Homo Sapiens
cucuguuguggugggcauagguggcaccaucuaaagaaaagaggucuuguuuuuuguuuaaaaa

SEQ ID NO: 216745 - RNA, 64 nt, Homo Sapiens
ucccuucacugcuggaaaaauccacuggcucccaagaaaagaaaauggucugaagccucuguug

SEQ ID NO: 216746 - RNA, 64 nt, Homo Sapiens
gugaccuaguguacugggcagcugguggcggugcagaaaagagucucagguuauuuuuuguuuu

SEQ ID NO: 216747 - RNA, 64 nt, Homo Sapiens
agagaaaacugguaaagaacauuccaguaggaaaagaaaagaacaaucuuccauuucugggcuu

SEQ ID NO: 216748 - RNA, 64 nt, Homo Sapiens
caaaggcuuaaaggcagugaaaauggccagccagagaaaagaucucaagaaccagaaauaaaua

SEQ ID NO: 216749 - RNA, 64 nt, Homo Sapiens
agcuagacacaaugaaacaucagagccagcuaagagaaaagaaauauuuggaggauauugaaag

SEQ ID NO: 216750 - RNA, 64 nt, Homo Sapiens
ggugagaaaacuaaaacuacaugaguuucauguuagaaaagaauuuuuaaacaaucuucagaug

SEQ ID NO: 216751 - RNA, 64 nt, Homo Sapiens
caaauccccuugaugcuaccuuugaaauauaacuagaaaagaaugacuugccaccauauccacu

SEQ ID NO: 216752 - RNA, 64 nt, Homo Sapiens
uugcugcccaguuaaagggguguaauauuaaguuagaaaagaaguuuacuagaaaauaguucag

SEQ ID NO: 216753 - RNA, 64 nt, Homo Sapiens
uguuuauguauuaaaaaaacaaaugaguucuuaaagaaaagacuauccgaaagaauagacugug

SEQ ID NO: 216754 - RNA, 64 nt, Homo Sapiens
agagaggggacuaauuauuuaaaagacaugauagagaaaagaugagaaagaaaugucuuuauac

SEQ ID NO: 216755 - RNA, 64 nt, Homo Sapiens
gguuuaauauacuccuucaggaguguucagagggagaaaagaaaaguauaaaugaaugggccau

SEQ ID NO: 216756 - RNA, 64 nt, Homo Sapiens
ugguaaaaggagggagccugcugagccaggagggagaaaagaagauugaccagcuugcuagaaa

SEQ ID NO: 216757 - RNA, 64 nt, Homo Sapiens
gaggaacaaggauggggagguaggaaugagguauagaaaagagauagcaucuucuuuggcacaa

SEQ ID NO: 216758 - RNA, 64 nt, Homo Sapiens
uuuaguucacuauuauauaguggguuauauuaaaagaaaagaagaaaaauaucuaauuucucuu

SEQ ID NO: 216759 - RNA, 64 nt, Homo Sapiens
auggucauauuugaaauguauaaguccauaaaauagaaaagaacaagugaauuguugcuauuua

SEQ ID NO: 216760 - RNA, 64 nt, Homo Sapiens
caugguucaaauuauaucuauuucaaaaaagaaaagaaaagaaaggugacagagugagacucug

SEQ ID NO: 216761 - RNA, 64 nt, Homo Sapiens
agaaacaugguucaaauuaucucuguuucaaaaaagaaaagaaaagccuggugacagagugaga

SEQ ID NO: 216762 - RNA, 64 nt, Homo Sapiens
cuggccagaccugacuccacaggugcaagggcuuagaaaagaccaugugguuagaagccaucag

SEQ ID NO: 216763 - RNA, 64 nt, Homo Sapiens
ugucccaguucaucguccaggcaaagaaguauucagaaaagagacagugaacuagcaaagaaaa

SEQ ID NO: 216764 - RNA, 64 nt, Homo Sapiens
gaaugauucuuuguaggcgcgccuuuauuggugaagaaaagaaugcagaggaaagccaagaaca

SEQ ID NO: 216765 - RNA, 64 nt, Homo Sapiens
gcaguaaaugcauugaugucucuuucaaguuuacagaaaagaaaaaaaaguuuuuuuuaaucug

SEQ ID NO: 216766 - RNA, 64 nt, Homo Sapiens
gugccuugauguacauauauauuccuaaagcacaagaaaagaauaagcagaucacauguaaauc

SEQ ID NO: 216767 - RNA, 64 nt, Homo Sapiens
acaguuauuaaacacuguugguaaauugaccaugagaaaagaacauacuauuucuucaaggcaa

SEQ ID NO: 216768 - RNA, 64 nt, Homo Sapiens
ucaucuccugcuugucugacugcaaguuuuuuaaagaaaagaggaacuggagaaacgacuucca

SEQ ID NO: 216769 - RNA, 64 nt, Homo Sapiens
caagcgauucuucugccucagccucccaaaugucagaaaagaaagcauacaugcuuaugcauga

SEQ ID NO: 216770 - RNA, 64 nt, Homo Sapiens
ugcaugugguuuccugccaagccuaaaccugagaagaaaagauauuuccucuuuggaaugcugu

SEQ ID NO: 216771 - RNA, 64 nt, Homo Sapiens
ucuuaaucauccuuaugaaacuguagaccccaugagaaaagauguuuuuaagaaaugccagcug

SEQ ID NO: 216772 - RNA, 64 nt, Homo Sapiens
aaaaugaaagagacacagggaaacuggagccaauagaaaagacauuucuaacuuuauggacacu

SEQ ID NO: 216773 - RNA, 64 nt, Homo Sapiens
aagaaaaaaaucccuuguucgcaaaaagaaaaaaagaaaagaaauacucccugcccuucccccu

SEQ ID NO: 216774 - RNA, 55 nt, Homo Sapiens
aauuuguccaauuguguagaagagcagaaaagauguugauguggacaugaaguga

SEQ ID NO: 216775 - RNA, 64 nt, Homo Sapiens
augaucaucucagccaacaugcaucaguacugcaagaaaagaagucaaucagcagaggagagca

SEQ ID NO: 216776 - RNA, 64 nt, Homo Sapiens
guuucuggaauuccuuguuagggaacuuuaaagaagaaaagaaaaacuugaauuguguugaauu

SEQ ID NO: 216777 - RNA, 64 nt, Homo Sapiens
uuuagauagcagaauuauuugcaauuuguagcauagaaaagauuuuuaaauuuuuuuacaaaag

SEQ ID NO: 216778 - RNA, 64 nt, Homo Sapiens
acagggugagacccuuuuacacagaaugguggagagaaaagagaaugcugaaaaguggcucaga

SEQ ID NO: 216779 - RNA, 64 nt, Homo Sapiens
caaauggaggaaauagucggaggugauggcaaauagaaaagaaggucuggccccaucgggucac

SEQ ID NO: 216780 - RNA, 64 nt, Homo Sapiens
auuuaauaaauguaugugugauucauauuugagaagaaaagaacaggcucucacuagaguuacc

SEQ ID NO: 216781 - RNA, 64 nt, Homo Sapiens
aaaaaaacccuaaaaccaaauauuuugccuuaccagaaaagaaaacaaaugauaucuaaagauc

SEQ ID NO: 216782 - RNA, 64 nt, Homo Sapiens
uuuuuuuuuuuuuugagacauacaggaagcucuuagaaaagaaccuuuagggagcagccacaca

SEQ ID NO: 216783 - RNA, 64 nt, Homo Sapiens
aaaagggaaaaaagaaaagcuaagaaaagaaaaaagaaaagaaaucacgacuuaauguauguug

SEQ ID NO: 216784 - RNA, 64 nt, Homo Sapiens
aaagaaaagaaaaaaagggauaauguauguuguaagaaaagaaacuaacaucugauucacgacu

SEQ ID NO: 216785 - RNA, 64 nt, Homo Sapiens
guguuacauagguugcaucaaaagaacacggaugagaaaagaauuaaagguaauauuagcaguu

SEQ ID NO: 216786 - RNA, 64 nt, Homo Sapiens
gcagccauguaagaggcuaaaaagucaguguaucagaaaagaaaaaucuuggugccuucuguua

SEQ ID NO: 216787 - RNA, 64 nt, Homo Sapiens
agauaucccagaagucaaaaggaauugagccaggagaaaagagacuaaauggugcaauaggcua

SEQ ID NO: 216788 - RNA, 64 nt, Homo Sapiens
aaguacuacugccuaguugcaauaaaaacacagcagaaaagauuaugugaaaauauguuuugag

SEQ ID NO: 216789 - RNA, 64 nt, Homo Sapiens
augcucugugaugguaaauaaaauuggagcagacagaaaagauauagcaaaugaagaaauauuu

SEQ ID NO: 216790 - RNA, 64 nt, Homo Sapiens
guuagucuuaaagauuauuguuaaaaaauucagaagaaaagagagacaagugcucuucucucua

SEQ ID NO: 216791 - RNA, 64 nt, Homo Sapiens
gugggcacuaguauaucuaaguaggggauuuuugagaaaagaaguaccacuuucauguaagcug

SEQ ID NO: 216792 - RNA, 64 nt, Homo Sapiens
uuugauuuucaugaagguaaucugaauuuuugucagaaaagagaucaagacauucacccuaaau

SEQ ID NO: 216793 - RNA, 64 nt, Homo Sapiens
uaacaauauacauauguuccagacagggaaggauagaaaagacugaaggaaauaauaaagugau

SEQ ID NO: 216794 - RNA, 64 nt, Homo Sapiens
uugcuuuuauaaagcauuuaauuauaugguccuuagaaaagacuuuguguauauagagaccaua

SEQ ID NO: 216795 - RNA, 64 nt, Homo Sapiens
uguguuuuuuaaaugguggccagguagaggaacuagaaaagagauuuuguugccuguuuucuga

SEQ ID NO: 216796 - RNA, 64 nt, Homo Sapiens
ugcaccauguuaguaauaaacagaucugccuuaaagaaaagaaaauuuuagaaagaaauauugu

SEQ ID NO: 216797 - RNA, 58 nt, Homo Sapiens
uauggaagauuaagucaugacaauucaaagaaaagaagauguagccucuuuuccagaa

SEQ ID NO: 216798 - RNA, 64 nt, Homo Sapiens
uaauugcuaguuguaaaacuguauccaaauuuucagaaaagacagcuucagcuugcaaauucua

SEQ ID NO: 216799 - RNA, 64 nt, Homo Sapiens
cuucuagauuccagacagaaaaaaauuacacuucagaaaagacaucaaaggcaacauaugacaa

SEQ ID NO: 216800 - RNA, 64 nt, Homo Sapiens
aagagcgagacuccgucucaaaaacaaaaaaaaaagaaaagaaauauauuuuauucauucacau

SEQ ID NO: 216801 - RNA, 64 nt, Homo Sapiens
uccaauuaauuaaauaucacaaauuauucauaagagaaaagaauuuguacccuguugcucagag

SEQ ID NO: 216802 - RNA, 64 nt, Homo Sapiens
uugguuuuuccaaacuggacccuauuuggaacuuagaaaagauccucuugggugagcaacggca

SEQ ID NO: 216803 - RNA, 64 nt, Homo Sapiens
ucauagggccaaguucaaagaaaaagaaaagaaaagaaaagaaaaagagcaaaacuccgucuca

SEQ ID NO: 216804 - RNA, 64 nt, Homo Sapiens
agaaaucauagggccaaguuucucaaaaaagaaaagaaaagaaagcaacaagagcaaaacuccg

SEQ ID NO: 216805 - RNA, 64 nt, Homo Sapiens
agaaaagaaaucauagggcccuccgucucaaaaaagaaaagaaaccugggcaacaagagcaaaa

SEQ ID NO: 216806 - RNA, 64 nt, Homo Sapiens
guucaacaccuucgagucugcacccuuguaaggaagaaaagagaaaugcaguuaagaauucugg

SEQ ID NO: 216807 - RNA, 64 nt, Homo Sapiens
uguccaaaaagggcuucaaggcccacuucuucucagaaaagaggccagcucugcagcccccucg

SEQ ID NO: 216808 - RNA, 64 nt, Homo Sapiens
cggggacgcccccaccagcucaaauuccgagugcagaaaagaaaccggaccccccagugaggcc

SEQ ID NO: 216809 - RNA, 64 nt, Homo Sapiens
guuuaauugaacccauccacucugggcagguaagagaaaagaaaaagauaaggaaagaagagag

SEQ ID NO: 216810 - RNA, 64 nt, Homo Sapiens
agaaaaaaauagcucaagacacaguuaaucgagaagaaaagaaauauguacagaaccauaaaga

SEQ ID NO: 216811 - RNA, 64 nt, Homo Sapiens
ccauaaauaucgugucauauaaauggaccagaaaagaaaagaaaugaguacauuaaguaaaaua

SEQ ID NO: 216812 - RNA, 64 nt, Homo Sapiens
agaaaccauaaauaucguguaaauaaaauggaccagaaaagaaaacuagugaguacauuaagua

SEQ ID NO: 216813 - RNA, 64 nt, Homo Sapiens
uccauaaaggacgacaaaagaguggcugcaacagagaaaagacuuuccuuuugcaauuacugaa

SEQ ID NO: 216814 - RNA, 64 nt, Homo Sapiens
uaucaaaggcagaucaguaaacagguacaauagaagaaaagaucauauuuacagacuccuaacu

SEQ ID NO: 216815 - RNA, 64 nt, Homo Sapiens
cuauacaaaggcuugcuaagugugauaaaaaugaagaaaagaguaaaaggaauguagcucaacu

SEQ ID NO: 216816 - RNA, 64 nt, Homo Sapiens
aauucuaacuggucaguauuuagccuuucuugugagaaaagaauaagacaacuacagcccucau

SEQ ID NO: 216817 - RNA, 64 nt, Homo Sapiens
uuaccaagacauuaaaguagcauggcugcccaggagaaaagaagacauucuaauuccagucauu

SEQ ID NO: 216818 - RNA, 64 nt, Homo Sapiens
ggcaagaaggacagcaguaaaugaagaccauggaagaaaagaaggaaugccaaagaucgaggaa

SEQ ID NO: 216819 - RNA, 64 nt, Homo Sapiens
ccauacuguauaauuccauuuacaugaagcauccagaaaagauaaauguauagggacaaaaagu

SEQ ID NO: 216820 - RNA, 64 nt, Homo Sapiens
aauaaaagauagaggugagagaugauuuacuuugagaaaagacauugugucaccuaugaaauuu

SEQ ID NO: 216821 - RNA, 64 nt, Homo Sapiens
uaauauucaagugaucagacuuugagugacaucaagaaaagaugauaucagguucauuuuucaa

SEQ ID NO: 216822 - RNA, 64 nt, Homo Sapiens
aacccucuuauuuuauaacuaaauaaauaaucacagaaaagaaugaucugaacaagaacagcug

SEQ ID NO: 216823 - RNA, 64 nt, Homo Sapiens
uugugucaccuaugaaauuugaugauuuacuuugagaaaagacaaauaaaagauagaggugaga

SEQ ID NO: 216824 - RNA, 64 nt, Homo Sapiens
aauguauagggacaaaaaguuacaugaagcauccagaaaagauaccauacuguauaauuccauu

SEQ ID NO: 216825 - RNA, 64 nt, Homo Sapiens
aauaugagagaacuauuguuuuaacugucuugagagaaaagaaauguuucacuaauacuuacug

SEQ ID NO: 216826 - RNA, 64 nt, Homo Sapiens
cagaaguugaugugggaagagugaaguguuguggagaaaagagcuagacuuuccuuugcaccau

SEQ ID NO: 216827 - RNA, 64 nt, Homo Sapiens
uucuaguaauugaaccaugguguuuggccuucugagaaaagagcugucaucuaaauauuccgaa

SEQ ID NO: 216828 - RNA, 64 nt, Homo Sapiens
ucguguacauaggaacuggucuuuaaacuucuauagaaaagauaggcaccucugaacccaggca

SEQ ID NO: 216829 - RNA, 64 nt, Homo Sapiens
auuuauccucauucaacacaauguggcauuuuagagaaaagauaugggaauauagagaggguuc

SEQ ID NO: 216830 - RNA, 64 nt, Homo Sapiens
aaauaauuaccuuccauuccuuccccuaaacagaagaaaagaccaaaaugagugguucaguuca

SEQ ID NO: 216831 - RNA, 64 nt, Homo Sapiens
gaugcauuaaaagaaaauaaaaaaaagaaaaaagagaaaagaaaaaaaaagaaaaaaguuguag

SEQ ID NO: 216832 - RNA, 64 nt, Homo Sapiens
guuguuuguauguauaauucaaagcaccaaaauaagaaaagauguagauuuauuucaucauauu

SEQ ID NO: 216833 - RNA, 64 nt, Homo Sapiens
aaaaacaagaaugaaaaacagaaauaaaagaaguagaaaagacaaagaaagaaagcccaaaguc

SEQ ID NO: 216834 - RNA, 64 nt, Homo Sapiens
gaaaaugucaagcugauuuacuuuauucacauggagaaaagaauccacaaauuaaacugagucc

SEQ ID NO: 216835 - RNA, 64 nt, Homo Sapiens
cucacauuaagcgguuacucagacaguuaaucauagaaaagauuauuugcuucaucaguucaua

SEQ ID NO: 216836 - RNA, 64 nt, Homo Sapiens
aucauagaaaagauuauuugcuucaucaguucauagaaaagauuauuugcuucaucaguuaacu

SEQ ID NO: 216837 - RNA, 64 nt, Homo Sapiens
uccccccgcaaaaaaaaaaaagaaagaaagaaagagaaaagaaaagaaaagcaaccacagccag

SEQ ID NO: 216838 - RNA, 64 nt, Homo Sapiens
ccgcaaaaaaaaaaaagaaagaaagaaagagaaaagaaaagaaaagcaaccacagccagccuua

SEQ ID NO: 216839 - RNA, 64 nt, Homo Sapiens
gggcauuuuuuauguuacaaaaaaaaauuacgaaagaaaagaaaucucuaugcaaaaugacgaa

SEQ ID NO: 216840 - RNA, 64 nt, Homo Sapiens
cccugcgagcccuuuuuauuugagaaggaaaaagagaaaagagaaucguuuaagggaacccggc

SEQ ID NO: 216841 - RNA, 64 nt, Homo Sapiens
ugaagugcauaagucuccugcucacacuauaacaagaaaagaaacacagucacucacugccauu

SEQ ID NO: 216842 - RNA, 64 nt, Homo Sapiens
guaucauuucacccuugccauaucuugucaagauagaaaagauaugcuagacaccuucgcuugu

SEQ ID NO: 216843 - RNA, 64 nt, Homo Sapiens
accacccacauuuuaauuuauaugcaaaaagaaaagaaaagaaaauuaauggcaugauuuuuuu

SEQ ID NO: 216844 - RNA, 64 nt, Homo Sapiens
agaaaaccacccacauuuuauuuuuuaugcaaaaagaaaagaaacacacauuaauggcaugauu

SEQ ID NO: 216845 - RNA, 64 nt, Homo Sapiens
gaucuacuuuggugguuucuuaauggagcaggagagaaaagagauuuucauggagguuucauuu

SEQ ID NO: 216846 - RNA, 64 nt, Homo Sapiens
aagggagaaaaccucuuagcaauuguuucagagcagaaaagaaaccugcacaaagcaaccgcca

SEQ ID NO: 216847 - RNA, 64 nt, Homo Sapiens
uaugguaacuguaauauggguaaaaguuuauucaagaaaagaguacuugguagaagauucuuua

SEQ ID NO: 216848 - RNA, 64 nt, Homo Sapiens
ccaaaaaauucuuaucucuguaugugauuggaaaagaaaagaucacauuuguauauucaacaau

SEQ ID NO: 216849 - RNA, 64 nt, Homo Sapiens
cuccaucucaaaaauaaaauaaaaaaagaaagaaagaaaagaagaagaaaagagaagaaggaga

SEQ ID NO: 216850 - RNA, 64 nt, Homo Sapiens
aaauaaaauaaaaaaagaaagaaagaaaagaagaagaaaagagaagaaggagaaggagaugaag

SEQ ID NO: 216851 - RNA, 64 nt, Homo Sapiens
cagaauuaaaauuauauuguagaaggaaacaccaagaaaagaauuuccagggaaaauccucuuu

SEQ ID NO: 216852 - RNA, 64 nt, Homo Sapiens
aacgaucuugacugugcaacucagacauuccugcagaaaagacauauguugcuuuacaagaagg

SEQ ID NO: 216853 - RNA, 64 nt, Homo Sapiens
acaccugcuucaggggaacacaggcgcuugaaaaagaaaagagagaacagcccauaaugcuccc

SEQ ID NO: 216854 - RNA, 64 nt, Homo Sapiens
gaaaaauagacuuuauuuacaaguaauaacauuuagaaaagauccauccccggcccuuaaaaac

SEQ ID NO: 216855 - RNA, 64 nt, Homo Sapiens
ugcccuuucacacugaaucuucaaguucuaaggaagaaaagagucuccuuucgaaugugaagaa

SEQ ID NO: 216856 - RNA, 64 nt, Homo Sapiens
auggcaagagcccaacucuacuaaaaauacaaaaagaaaagaaaacagccaagcuuggugguau

SEQ ID NO: 216857 - RNA, 64 nt, Homo Sapiens
gcucuaaaaauuuaaagguuguaauugaaauacaagaaaagagccuucuuuuagaagaaagcaa

SEQ ID NO: 216858 - RNA, 64 nt, Homo Sapiens
aaccauauuuuaaaaguaccaauuuuguuuuuacagaaaagauaaaacucaaaagagaacagug

SEQ ID NO: 216859 - RNA, 64 nt, Homo Sapiens
aggaguccugggucuucccacucccagggauuagagaaaagagccuaccuuagcuggaccucgu

SEQ ID NO: 216860 - RNA, 64 nt, Homo Sapiens
gcucaggcccaaguggaguuccaaaggauaagaaagaaaagagaaaaaucagagccacgaugac

SEQ ID NO: 216861 - RNA, 64 nt, Homo Sapiens
acuggucuugggaacaucuuguagacguguagauagaaaagaggguucaagauggccaccacug

SEQ ID NO: 216862 - RNA, 64 nt, Homo Sapiens
ugcggcaggacucuuaucuuguucugggggagacagaaaagaggccuuagauguuacccagaug

SEQ ID NO: 216863 - RNA, 64 nt, Homo Sapiens
aaaaaccugccgauuaacaaaaacagaacaaaugagaaaagaaaaaucauaacuaaaacauuga

SEQ ID NO: 216864 - RNA, 64 nt, Homo Sapiens
aagacagauuuaaagugcccaucaccuaaaucccagaaaagagguaggacuuggcugugagaaa

SEQ ID NO: 216865 - RNA, 64 nt, Homo Sapiens
gcaagcugauauuuuaggugcucuaaagcaccuaagaaaagaacugcaaagucugagaaauagg

SEQ ID NO: 216866 - RNA, 64 nt, Homo Sapiens
uccaaaauucugaagucuggaaguuuuuccuucaagaaaagaaacugcauaaaaaauuuaaaac

SEQ ID NO: 216867 - RNA, 64 nt, Homo Sapiens
gagaacuaggugugcaagaaaguugucugaauugagaaaagaguugaaaauacauucuuaaacu

SEQ ID NO: 216868 - RNA, 64 nt, Homo Sapiens
uaccugaauaauuacuacaugcuuugagaccagaagaaaagacuaacugauacaucugaugcau

SEQ ID NO: 216869 - RNA, 64 nt, Homo Sapiens
caccaaaccaaaagaagguaggagugccauuuuuagaaaagacacaacuuuaauuccugucaag

SEQ ID NO: 216870 - RNA, 64 nt, Homo Sapiens
uuuaaguguugucuaaacaguugauuuuuacuuuagaaaagaucaucuucaacuguuuauugac

SEQ ID NO: 216871 - RNA, 64 nt, Homo Sapiens
cgaauaaguaugcuauacauauuaaaaaaagugaagaaaagaagguggccaaacaucagaaucg

SEQ ID NO: 216872 - RNA, 64 nt, Homo Sapiens
gucugagaaaucugaaaaaaugucaaaaaagaagagaaaagaucauggucaggacacaagccuc

SEQ ID NO: 216873 - RNA, 64 nt, Homo Sapiens
uguuccuuucaguaguugccaucuuggccaugcaagaaaagaaaagaaggcauuuacucuaugu

SEQ ID NO: 216874 - RNA, 64 nt, Homo Sapiens
cuuucaguaguugccaucuuggccaugcaagaaaagaaaagaaggcauuuacucuaugucgggg

SEQ ID NO: 216875 - RNA, 64 nt, Homo Sapiens
gugcaauggguaagggagggaaggggaauggaagagaaaagacagggugggagggaggagggag

SEQ ID NO: 216876 - RNA, 64 nt, Homo Sapiens
uggggagauaaaaagauuaagccccaacauguucagaaaagaagugaagucuuggguauuuuaa

SEQ ID NO: 216877 - RNA, 64 nt, Homo Sapiens
uugaauuucgaaagaaauaauuggcaagauaaugagaaaagaaaaaagucaugguaggugaggu

SEQ ID NO: 216878 - RNA, 64 nt, Homo Sapiens
uuguagccaagcagaguuguagagggggauaaaaagaaaagaaauuggauguauuuacagcugu

SEQ ID NO: 216879 - RNA, 64 nt, Homo Sapiens
aaagcucaucaguucccauaaaugcaguugucaaagaaaagauuugguugccauagucauaagc

SEQ ID NO: 216880 - RNA, 64 nt, Homo Sapiens
uguuuaauugcuacagagcuuuauagauauuuagagaaaagacuuaaucaauuaguaaauaaaa

SEQ ID NO: 216881 - RNA, 64 nt, Homo Sapiens
ucaagggggaaacugcauuuucaaauaagaggagagaaaagaacauguuaucaugggagggaag

SEQ ID NO: 216882 - RNA, 64 nt, Homo Sapiens
guuaaagcaaagaagagaaggacuuugaggccacagaaaagacacaccaagucuccccuuugaa

SEQ ID NO: 216883 - RNA, 64 nt, Homo Sapiens
gaaugaagcaguguugucuauggaaguggggaguagaaaagaagauccccauugacagugagga

SEQ ID NO: 216884 - RNA, 64 nt, Homo Sapiens
ccauugccgagaguccuguuauugagguagaaacagaaaagaaagacguucuugauuuugguga

SEQ ID NO: 216885 - RNA, 64 nt, Homo Sapiens
caacaaaggaauugaaacaggguuuucagaaaagagaaaagaaagaguaaaacuauuugcaacu

SEQ ID NO: 216886 - RNA, 64 nt, Homo Sapiens
aaagaaacaacaaaggaauuugcaacugguuuucagaaaagagaaaaaguugaguaaaacuauu

SEQ ID NO: 216887 - RNA, 64 nt, Homo Sapiens
aagaugcuacuugaaaagacauuuauugucccccagaaaagauugccaccuaagucuucauuua

SEQ ID NO: 216888 - RNA, 64 nt, Homo Sapiens
cuuaguucuaccuugauuacaugaagucaggaaaagaaaagaaaggugggucugaaauucauac

SEQ ID NO: 216889 - RNA, 64 nt, Homo Sapiens
cugacucuuucauuauggaauuaaauauuugcucagaaaagauguuccucucuaguguauaacu

SEQ ID NO: 216890 - RNA, 64 nt, Homo Sapiens
ggcaacaagagcaaaacuccgucucaaaauaaaaagaaaagaaaagaauggacaguguuugcag

SEQ ID NO: 216891 - RNA, 64 nt, Homo Sapiens
caagagcaaaacuccgucucaaaauaaaaagaaaagaaaagaauggacaguguuugcagagagu

SEQ ID NO: 216892 - RNA, 64 nt, Homo Sapiens
ucaaaaaaaaaaaaaaaaaaaaggaaagaaagaaagaaaagaaaagaaaauccuuuuugcuuua

SEQ ID NO: 216893 - RNA, 64 nt, Homo Sapiens
aaaaaaaaaaaaaaaaaggaaagaaagaaagaaaagaaaagaaaauccuuuuugcuuuaacuug

SEQ ID NO: 216894 - RNA, 64 nt, Homo Sapiens
gaagagagugggggccaauauucaacauucuuaaagaaaagaauuuucaacccagaauuucaua

SEQ ID NO: 216895 - RNA, 64 nt, Homo Sapiens
aacaaaauugauagaccgcuagcaagacuaaugaagaaaagagagaagaaucaaauagaugcaa

SEQ ID NO: 216896 - RNA, 64 nt, Homo Sapiens
agucuaaaauugcuucuuuaccaaggauauuuacagaaaagacucugaccagagaucgagacca

SEQ ID NO: 216897 - RNA, 64 nt, Homo Sapiens
cagucuggcaacagagcaagacuccaucucaaaaagaaaagaaaagaagacucugaccuguacu

SEQ ID NO: 216898 - RNA, 64 nt, Homo Sapiens
uggcaacagagcaagacuccaucucaaaaagaaaagaaaagaagacucugaccuguacucuuga

SEQ ID NO: 216899 - RNA, 64 nt, Homo Sapiens
aggaaaggaaagagacgggggucuaaaaauaaaaagaaaagagagggcaacacagcaagauccu

SEQ ID NO: 216900 - RNA, 64 nt, Homo Sapiens
ggcugggcaaggcauagugggcaggaagaggagcagaaaagaaguucugaaacuacgguagggg

SEQ ID NO: 216901 - RNA, 64 nt, Homo Sapiens
aagccagaaaaaguuggugcaaaaaaaaaagaaaagaaaagaaacagagcaacacucugucuca

SEQ ID NO: 216902 - RNA, 64 nt, Homo Sapiens
agaaaaagccagaaaaaguuucucaaaaaaaaaaagaaaagaaaggcagcagagcaacacucug

SEQ ID NO: 216903 - RNA, 64 nt, Homo Sapiens
ggaaaggacucauucaugucacgcuuccuugagcagaaaagagcacugagagcacuugggaccc

SEQ ID NO: 216904 - RNA, 64 nt, Homo Sapiens
cuuuuucacauuacuguuaaagaccagacguucuagaaaagaccccuccucucaugagcucccc

SEQ ID NO: 216905 - RNA, 64 nt, Homo Sapiens
gagagaugaguggguuagcuaauagaagcuauaaagaaaagagguuauuuuucucuuuaaaaaa

SEQ ID NO: 216906 - RNA, 64 nt, Homo Sapiens
uugaaagcucuauggauuauaagagggugaacaaagaaaagacaguccaggggagggaaaagcu

SEQ ID NO: 216907 - RNA, 64 nt, Homo Sapiens
aaguaauuuaccuguccaggaucaaaagaagccuagaaaagaagcaguaaucuaccucugccga

SEQ ID NO: 216908 - RNA, 64 nt, Homo Sapiens
cugaacaaaagcagguuuuuauauguaaacagugagaaaagaaaggcuaaacacuauguaaaug

SEQ ID NO: 216909 - RNA, 64 nt, Homo Sapiens
augcagcggccuccuugaagauccugauaaaugaagaaaagacacagagaaggaugugacaugc

SEQ ID NO: 216910 - RNA, 64 nt, Homo Sapiens
acagagugaacucugucucaaaaaaaaaaaaaaaagaaaagaaagaagaagccauucccaacgu

SEQ ID NO: 216911 - RNA, 64 nt, Homo Sapiens
uauuuagaaguaaaacacaaaacaaaaaagagagagaaaagaaaagaaaucacaauguauauaa

SEQ ID NO: 216912 - RNA, 64 nt, Homo Sapiens
agaaguaaaacacaaaacaaaaaagagagagaaaagaaaagaaaucacaauguauauaaaacag

SEQ ID NO: 216913 - RNA, 64 nt, Homo Sapiens
ccuuguaaagcuaaaauaguuacuucaaauuuucagaaaagauguauauagucaaaauuuaaga

SEQ ID NO: 216914 - RNA, 64 nt, Homo Sapiens
uugauguugaaaauuuuaaacuuggggaagauuaagaaaagaaccaauagugacaaaaaucagu

SEQ ID NO: 216915 - RNA, 64 nt, Homo Sapiens
gaagagacagugauuugggaaagaaaccuacucaagaaaagacaacacaagaacuuaagagaaa

SEQ ID NO: 216916 - RNA, 64 nt, Homo Sapiens
agaaucuguguuuuggaaugaggaaaccuguuacagaaaagacacaaggagaacauaagagaaa

SEQ ID NO: 216917 - RNA, 64 nt, Homo Sapiens
auaagaacucaaggagaacaaaacuuaaccucugagaaaagaacaagaaggaaaaaaaaagccc

SEQ ID NO: 216918 - RNA, 64 nt, Homo Sapiens
ucuguuucuaccaaacauuugacccaccgaaaaaagaaaagaaauggugaaaugucacuccauu

SEQ ID NO: 216919 - RNA, 64 nt, Homo Sapiens
agcugaaauuaugucaguggaccagauuggagauagaaaagaaugcccaagugucaagaaccac

SEQ ID NO: 216920 - RNA, 64 nt, Homo Sapiens
acugagaacuagaggagggaugaugccacuuugaagaaaagaacauaggccuggaagagacugu

SEQ ID NO: 216921 - RNA, 64 nt, Homo Sapiens
gaagcaguugccuuccggaguauacauugaaggaagaaaagaaguuuaggaaagaagaccuguu

SEQ ID NO: 216922 - RNA, 64 nt, Homo Sapiens; identical to SEQ ID NO: 216913

SEQ ID NO: 216923 - RNA, 64 nt, Homo Sapiens
uugauguugaaaauuguaaacuuggggaagauuaagaaaagaaccaauagugacaaaaaucagu

SEQ ID NO: 216924 - RNA, 64 nt, Homo Sapiens
aauugaaucuugagggaguauguuugcccaggacuccuaguaaguaacugccaggacacuuuug

SEQ ID NO: 216925 - RNA, 64 nt, Homo Sapiens
aguugaugucugcuagugguauuagauuuccuuuuccuaguaagaauucuuuuuuaaaauuuua

SEQ ID NO: 216926 - RNA, 64 nt, Homo Sapiens; identical to SEQ ID NO: 161670

SEQ ID NO: 216927 - RNA, 64 nt, Homo Sapiens; identical to SEQ ID NO: 161671

SEQ ID NO: 216928 - RNA, 64 nt, Homo Sapiens; identical to SEQ ID NO: 161672

SEQ ID NO: 216929 - RNA, 64 nt, Homo Sapiens; identical to SEQ ID NO: 161673

SEQ ID NO: 216930 - RNA, 64 nt, Homo Sapiens; identical to SEQ ID NO: 161674

SEQ ID NO: 216931 - RNA, 64 nt, Homo Sapiens; identical to SEQ ID NO: 161675

SEQ ID NO: 216932 - RNA, 64 nt, Homo Sapiens; identical to SEQ ID NO: 161676

SEQ ID NO: 216933 - RNA, 64 nt, Homo Sapiens; identical to SEQ ID NO: 161677

SEQ ID NO: 216934 - RNA, 64 nt, Homo Sapiens; identical to SEQ ID NO: 161678

SEQ ID NO: 216935 - RNA, 64 nt, Homo Sapiens; identical to SEQ ID NO: 161679

SEQ ID NO: 216936 - RNA, 64 nt, Homo Sapiens; identical to SEQ ID NO: 161680

SEQ ID NO: 216937 - RNA, 64 nt, Homo Sapiens; identical to SEQ ID NO: 161681

SEQ ID NO: 216938 - RNA, 64 nt, Homo Sapiens; identical to SEQ ID NO: 161682

SEQ ID NO: 216939 - RNA, 64 nt, Homo Sapiens; identical to SEQ ID NO: 161683

SEQ ID NO: 216940 - RNA, 64 nt, Homo Sapiens; identical to SEQ ID NO: 161684

SEQ ID NO: 216941 - RNA, 64 nt, Homo Sapiens; identical to SEQ ID NO: 161685

SEQ ID NO: 216942 - RNA, 64 nt, Homo Sapiens; identical to SEQ ID NO: 161686

SEQ ID NO: 216943 - RNA, 64 nt, Homo Sapiens; identical to SEQ ID NO: 161687

SEQ ID NO: 216944 - RNA, 64 nt, Homo Sapiens; identical to SEQ ID NO: 161688

SEQ ID NO: 216945 - RNA, 64 nt, Homo Sapiens; identical to SEQ ID NO: 161689

SEQ ID NO: 216946 - RNA, 64 nt, Homo Sapiens; identical to SEQ ID NO: 161690

SEQ ID NO: 216947 - RNA, 64 nt, Homo Sapiens; identical to SEQ ID NO: 161691

SEQ ID NO: 216948 - RNA, 64 nt, Homo Sapiens; identical to SEQ ID NO: 161692

SEQ ID NO: 216949 - RNA, 64 nt, Homo Sapiens; identical to SEQ ID NO: 161693

SEQ ID NO: 216950 - RNA, 64 nt, Homo Sapiens; identical to SEQ ID NO: 161694

SEQ ID NO: 216951 - RNA, 64 nt, Homo Sapiens; identical to SEQ ID NO: 161695

SEQ ID NO: 216952 - RNA, 64 nt, Homo Sapiens; identical to SEQ ID NO: 161696

SEQ ID NO: 216953 - RNA, 64 nt, Homo Sapiens; identical to SEQ ID NO: 161697

SEQ ID NO: 216954 - RNA, 64 nt, Homo Sapiens; identical to SEQ ID NO: 161698

SEQ ID NO: 216955 - RNA, 64 nt, Homo Sapiens; identical to SEQ ID NO: 161699

SEQ ID NO: 216956 - RNA, 64 nt, Homo Sapiens; identical to SEQ ID NO: 161700

SEQ ID NO: 216957 - RNA, 64 nt, Homo Sapiens; identical to SEQ ID NO: 161701

SEQ ID NO: 216958 - RNA, 64 nt, Homo Sapiens; identical to SEQ ID NO: 161702

SEQ ID NO: 216959 - RNA, 64 nt, Homo Sapiens; identical to SEQ ID NO: 161703

SEQ ID NO: 216960 - RNA, 64 nt, Homo Sapiens; identical to SEQ ID NO: 161704

SEQ ID NO: 216961 - RNA, 64 nt, Homo Sapiens; identical to SEQ ID NO: 161705

SEQ ID NO: 216962 - RNA, 64 nt, Homo Sapiens; identical to SEQ ID NO: 161706

SEQ ID NO: 216963 - RNA, 64 nt, Homo Sapiens; identical to SEQ ID NO: 161707

SEQ ID NO: 216964 - RNA, 64 nt, Homo Sapiens; identical to SEQ ID NO: 161708

SEQ ID NO: 216965 - RNA, 64 nt, Homo Sapiens; identical to SEQ ID NO: 161709

SEQ ID NO: 216966 - RNA, 64 nt, Homo Sapiens
ucccguccccccgguagacucuguccugcuggucccaccacacauggcugggacaucuguuccc

SEQ ID NO: 216967 - RNA, 64 nt, Homo Sapiens
caaccucccaaagugcugagauuacaggcgugagccaccacacccagcucagggaggcguaguu

SEQ ID NO: 216968 - RNA, 64 nt, Homo Sapiens
uggcuaauuuuuuuguauuuauuacaggcacccgccaccacacccagccucccaaguagcuggg

SEQ ID NO: 216969 - RNA, 64 nt, Homo Sapiens
gguacagcauuaaauggcagguguugcuuuaaagccaccacaaggccauugaacccacagagcu

SEQ ID NO: 216970 - RNA, 64 nt, Homo Sapiens
uggcaauucccugcuuuuuuuuacuagacguaagccaccacaccgaccucccaaagugcuggga

SEQ ID NO: 216971 - RNA, 64 nt, Homo Sapiens
uggcuaauuuuuguauuuuuacuacaggugcacgccaccacaacucagcucccaaguagcuggg

SEQ ID NO: 216972 - RNA, 64 nt, Homo Sapiens
cggccguggaaugguuuucuauuacaggcgugagccaccacacccggccucccaaagcgcuggg

SEQ ID NO: 216973 - RNA, 64 nt, Homo Sapiens
cagcuaauuuuuuguauuuuaucauaggcacgcgccaccacacccagccuccugaguagcuggg

SEQ ID NO: 216974 - RNA, 64 nt, Homo Sapiens
ccaccuccguccucacauacgcaagcagaccccaccaccacagcaaguggggcaaagccagcau

SEQ ID NO: 216975 - RNA, 64 nt, Homo Sapiens
cggccaaucaguccaccuuuauuacaggcaugagccaccacacccggccucccaaaguccucgg

SEQ ID NO: 216976 - RNA, 64 nt, Homo Sapiens
cagccuccugaguagcuaggacuacagaugcucgccaccacaccuggcuaauuuuuuuuuuuug

SEQ ID NO: 216977 - RNA, 64 nt, Homo Sapiens
uagccucccaaguagcugggacuacagguguacgccaccacacccagcuaauuuuuguauuuuu

SEQ ID NO: 216978 - RNA, 64 nt, Homo Sapiens
cagccuccugaguagcugggauuacaggcaugaaccaccacaccuggauaauuuuuguauuuuu

SEQ ID NO: 216979 - RNA, 64 nt, Homo Sapiens
cagccucccaaagugcugggauuacaggcgugagccaccacaccuggccuuucugcaacauuuu

SEQ ID NO: 216980 - RNA, 56 nt, Homo Sapiens
accuccagaacaccagguagccguggccaccacagccagacugaacguuugugaaa

SEQ ID NO: 216981 - RNA, 64 nt, Homo Sapiens
agccagacugaacguuugugaaagcugggacaucccaccacacgcugagccagaccugcagagu

SEQ ID NO: 216982 - RNA, 64 nt, Homo Sapiens
ccaccuauugucuauauuucauuacagggacgagccaccacaccuggccucccaaagugcuggg

SEQ ID NO: 216983 - RNA, 64 nt, Homo Sapiens
uggcuaauuuuuguguuuuuacuacagaugcacaccaccacacccagccuucugaguagcuggg

SEQ ID NO: 216984 - RNA, 64 nt, Homo Sapiens
cggccaagcacaggcuuuugaugauaggcgugagccaccacacccagccucccaaagugcuggg

SEQ ID NO: 216985 - RNA, 64 nt, Homo Sapiens
uuucuaauuuuugcauuuuuauuacaggugcauaccaccacaccggccuccuuuaguagguggg

SEQ ID NO: 216986 - RNA, 64 nt, Homo Sapiens
aggcccgagaaaugcuuuuuauuacaggcgugagccaccacacccagccucccaaagugcuggg

SEQ ID NO: 216987 - RNA, 64 nt, Homo Sapiens
cagugaauuuuuguauuuuuauuacaggcacaugccaccacacccagccuccggaguagcuggg

SEQ ID NO: 216988 - RNA, 64 nt, Homo Sapiens
uggccuaggaccuuaaauauauuacaggcaugagccaccacaucucggcccccaaagugcuggg

SEQ ID NO: 216989 - RNA, 64 nt, Homo Sapiens
cagcuaacuuuuuuuguauuauuacagacaccugccaccacauccagccucccaaguagcugga

SEQ ID NO: 216990 - RNA, 64 nt, Homo Sapiens
uaaugaaacuuggauuugcuguuuggcaaacucuccaccacacgaauggcuguggaguguggca

SEQ ID NO: 216991 - RNA, 64 nt, Homo Sapiens
gauccagcccugaguuccuacuccuccuagccacccaccacacuguggcaucagugucuuucca

SEQ ID NO: 216992 - RNA, 64 nt, Homo Sapiens
cucccucuacugggagccuaccuggagacuaaccccaccacaccauugggccccugccagaccc

SEQ ID NO: 216993 - RNA, 64 nt, Homo Sapiens
cagccucuugaguggcugggauuacaggcacaugccaccacacccggcuaauuuuuguauuuuu

SEQ ID NO: 216994 - RNA, 64 nt, Homo Sapiens
cggccucucaaauugcuggaauuacaguugugagccaccacaccuggcuugaauguagauuuua

SEQ ID NO: 216995 - RNA, 64 nt, Homo Sapiens
cagcuaauuuuuuuguauuuacuacaggugcccaccaccacaccuagucccaggaguagcuggg

SEQ ID NO: 216996 - RNA, 64 nt, Homo Sapiens
cagcuaauuuuuuuuuuuuugcuacaagcaugcaccaccacaccgccuccugaguagccgggga

SEQ ID NO: 216997 - RNA, 64 nt, Homo Sapiens
uccaccgaugcauuuguggcugcaaacuccagccccaccacacaaggcaaucuggaagcagaaa

SEQ ID NO: 216998 - RNA, 64 nt, Homo Sapiens
uaauuguaauuaagggaaaugagaaugauggucaccaccacaauuuucucucuuuuucuuugag

SEQ ID NO: 216999 - RNA, 64 nt, Homo Sapiens
cggcuaauuuuguauuuuuuauuacagucaggcaccaccacacccagccucccaaguagcuggg

SEQ ID NO: 217000 - RNA, 64 nt, Homo Sapiens
uggccccaagcuugaauuuuauuacagaugugagccaccacaccuggccucccaaagugcuggg

SEQ ID NO: 217001 - RNA, 64 nt, Homo Sapiens
uggcccccuucuguuuuaugauuacaggcaugagccaccacagccggccucccaaagugcuggg

SEQ ID NO: 217002 - RNA, 64 nt, Homo Sapiens
ugggugauuuuuguauuuuuauuacaggcaugugccaccacacccagccuccuaaguaucuggg

SEQ ID NO: 217003 - RNA, 64 nt, Homo Sapiens
aguuuaccgaccugaauguuuaccugugggauguccaccacaguaaaaggcuuauuaaagugga

SEQ ID NO: 217004 - RNA, 64 nt, Homo Sapiens
ucaaaagcaugauuuuuaauaguuguugaguauuccaccacaggaauguaucacaacuuaaccg

SEQ ID NO: 217005 - RNA, 64 nt, Homo Sapiens
agcaggacugagggaacugcuggcucgccuggcaccaccacacggccacagccagccaucugcu

SEQ ID NO: 217006 - RNA, 64 nt, Homo Sapiens
gcccacccuguguacccagguccagaggguccguccaccacagcagccccagguggagggcugg

SEQ ID NO: 217007 - RNA, 64 nt, Homo Sapiens
cagccucccaaguagcugggacuacaggcacacgccaccacacccaacuaauuuuuguauuuuu

SEQ ID NO: 217008 - RNA, 64 nt, Homo Sapiens
cagccucccaaagugcugggauuacaggcaugagccaccacacccagcgagacgggguuucauu

SEQ ID NO: 217009 - RNA, 64 nt, Homo Sapiens
cggccagugcacucuuaauaauuacaggcgugagccaccacaucagccuuccaaaagugcuggg

SEQ ID NO: 217010 - RNA, 64 nt, Homo Sapiens
uggcuaauuuuuguauuuuuacuacaggcuugcgccaccacacccagccuccugaguagcuggg

SEQ ID NO: 217011 - RNA, 64 nt, Homo Sapiens
accugaaaaggauuuuagaaaacccugggaaaacccaccacaccaccacaaaauggccuuuagu

SEQ ID NO: 217012 - RNA, 64 nt, Homo Sapiens
aggauuuuagaaaacccugggaaaacccaccacaccaccacaaaauggccuuuaguguaugaaa

SEQ ID NO: 217013 - RNA, 64 nt, Homo Sapiens
uagccuccuaaguagcugagacuacagacgugcgccaccacacccaguucauuuuuguauuuuu

SEQ ID NO: 217014 - RNA, 64 nt, Homo Sapiens
cucagccugaaagugcuaggauuacaggcgugagccaccacaccuggccagcucagcauauucu

SEQ ID NO: 217015 - RNA, 64 nt, Homo Sapiens
cagcuaaauuuuuuuguauuacuauaggcgcgugccaccacaaccagccuccugaguagcuggg

SEQ ID NO: 217016 - RNA, 64 nt, Homo Sapiens
cagaauaaucucaaaacugccagcccugcaccaaccaccacaguauccacucuccugcgguuac

SEQ ID NO: 217017 - RNA, 64 nt, Homo Sapiens
cggcccccaguucuuuuuuuauuacaggcgugagccaccacaccuggccucccaaagugcuggg

SEQ ID NO: 217018 - RNA, 64 nt, Homo Sapiens
ugccugguccuguugcaggagucccagugcucauccaccacagagugccgugccguguaauaaa

SEQ ID NO: 217019 - RNA, 64 nt, Homo Sapiens
ggacggcgcuggcuucggcaagugaacaagggcaccaccacaguggccagggcaucaagaaccc

SEQ ID NO: 217020 - RNA, 64 nt, Homo Sapiens
uggcuaauuuuuuguauuuuacuacaggugcacaccaccacacccagccucccgaguagcuggg

SEQ ID NO: 217021 - RNA, 64 nt, Homo Sapiens
gcagcugcguuuuaggaagagagcagaggcaaacccaccacagguuggagccucuuggccuuca

SEQ ID NO: 217022 - RNA, 64 nt, Homo Sapiens
cagcuaauuuucaaauuuuuacuacaggugagugccaccacacucagccuccugaguagcugag

SEQ ID NO: 217023 - RNA, 64 nt, Homo Sapiens
cagccucuguaguucuuuuuauuacaggugugagccaccacaccuggccucccaaagugcuggg

SEQ ID NO: 217024 - RNA, 64 nt, Homo Sapiens
ccucugccucccaaguaacugggacuauagcaugccaccacacccagcugauuaucauauuuuu

SEQ ID NO: 217025 - RNA, 64 nt, Homo Sapiens
cuucugccucccaaguaacugggacuauagcaugccaccacacccagcugauuaucauauuuuu

SEQ ID NO: 217026 - RNA, 64 nt, Homo Sapiens
cagcccuuuaaaccuuucccauuacugacaugagccaccacacucagucucccgaagugcuggg

SEQ ID NO: 217027 - RNA, 64 nt, Homo Sapiens
cagcugauuuuugcauuuuuauuauaggcaugugccaccacacccagccucgcgaguaguugga

SEQ ID NO: 217028 - RNA, 64 nt, Homo Sapiens
uggcuaauuuuuguguuuuuauuacaggcaugcaccaccacacccagccucccgaguagcuggg

SEQ ID NO: 217029 - RNA, 64 nt, Homo Sapiens
uggcuaauuuuuguauuuuuauuauaggcgugcaccaccacacccagccucccgaguagcugag

SEQ ID NO: 217030 - RNA, 64 nt, Homo Sapiens
uagucauauuccugagaaguggcaaacaucccagcuaaucaaaagagccuuuuuuuuuaagcuu

SEQ ID NO: 217031 - RNA, 64 nt, Homo Sapiens
uaaucccaccccaucaaaagagaaaugauuuuuacuaaucaaguauuuuaaauggauuuucagu

SEQ ID NO: 217032 - RNA, 64 nt, Homo Sapiens
uaagucuugcaucauaaauuuggaauuaggguuucuaaucaaaccucuuccucagcagaccucu

SEQ ID NO: 217033 - RNA, 64 nt, Homo Sapiens
ucuuauaugaauaauuuugaauguaguagcuaaacuaaucaaaauggaaauagucucaacgugc

SEQ ID NO: 217034 - RNA, 64 nt, Homo Sapiens
cuuucguuguuauuauucauuaaaugguucugugcuaaucaaaaacuaauuuggcuuucacauu

SEQ ID NO: 217035 - RNA, 52 nt, Homo Sapiens
cgugaucucuguuacaaaagcacuaaucaauacuggauaucagacucuguaa

SEQ ID NO: 217036 - RNA, 64 nt, Homo Sapiens
agaaugcuucaaguuuagugcaugcaucucuuuagauccaaaauaaauggacugaaguuaucau

SEQ ID NO: 217037 - RNA, 64 nt, Homo Sapiens
aagugauauuugauuuuguaaaaauaaccaguaggauccaaagaacuuuagcuauuuauguuca

SEQ ID NO: 217038 - RNA, 64 nt, Homo Sapiens
acacagggagacuugcuuacugccagauuggagagauccaaacagacacgguauuaggagggaa

SEQ ID NO: 217039 - RNA, 64 nt, Homo Sapiens
gcuggacacgguauuaggagaagugggauuuauugauccaaaguauauuauuuuagcuucugug

SEQ ID NO: 217040 - RNA, 64 nt, Homo Sapiens
cgaguguuuuucuuucuuuuugugucuguuguuggauccaaauacuugcugaccauucacucuc

SEQ ID NO: 217041 - RNA, 64 nt, Homo Sapiens
uuuuuuuguuuguuugagauugaggcccucuccugauccaaaucuuccagcuguuauugggcuc

SEQ ID NO: 217042 - RNA, 64 nt, Homo Sapiens
uaucccuugguucacuugagugugcaagucauuaaauccucaucauuuuaggguugccagugau

SEQ ID NO: 217043 - RNA, 64 nt, Homo Sapiens
acagguaccuacugcuggccucuucaguggccacaauccucaguccucaccugcugguuuggag

SEQ ID NO: 217044 - RNA, 64 nt, Homo Sapiens
gagguccggguuuaguauauaucuaaggaaaauuaauccucacagguuaagacguuggaaggaa

SEQ ID NO: 217045 - RNA, 64 nt, Homo Sapiens
ucagucuuccuuguggaauguggcaaaucacuucaauccucaaaaauaagcuuucucagaaugu

SEQ ID NO: 217046 - RNA, 64 nt, Homo Sapiens
ugaggaagcucucccuuguucagaaauuccaguaaauccucauugugcccaaaagggcacccac

SEQ ID NO: 217047 - RNA, 64 nt, Homo Sapiens
aacuccugugaaagaaagacuuuuuauuguguuuaauccucauccuuuaccuuuagacguauua

SEQ ID NO: 217048 - RNA, 64 nt, Homo Sapiens
uucuuucuacagaacaaagacuaaauaaugacauaauccucagcugacugacugaaaaugugac

SEQ ID NO: 217049 - RNA, 64 nt, Homo Sapiens
ucauguggccuuacgggaugcacuuuaauugauuaauccucaauaggcucaacauuuggaauug

SEQ ID NO: 217050 - RNA, 64 nt, Homo Sapiens
cugugacgcccucagguacuggccaugcccugugaauccucagggagacugagcugggugcacu

SEQ ID NO: 217051 - RNA, 64 nt, Homo Sapiens
uauaguugugaagaauguggcaaagcuuuuaaccaauccucauaccuuacuauacagaaauuca

SEQ ID NO: 217052 - RNA, 64 nt, Homo Sapiens
ugcaaaugugaauaauguggcaauacuuuaaaccaauccucaaaccucacuaaacauaagauaa

SEQ ID NO: 217053 - RNA, 64 nt, Homo Sapiens
uucaaacauggggaaacaggcccugaaccucagaaauccucagcguugcaaaacgagcuuguuu

SEQ ID NO: 217054 - RNA, 64 nt, Homo Sapiens
cuuuggacagaaaaaaaaaagagacuacguauguaauccucacuucucaucgucuugcaggucg

SEQ ID NO: 217055 - RNA, 64 nt, Homo Sapiens
uacaaaugugaagaauguggcaaagcuuuuaacaaauccucauccauuaguaaacauaagauaa

SEQ ID NO: 217056 - RNA, 64 nt, Homo Sapiens
uacaaaugugaaaaauguggcaaaccuuuuaaccaauccucaacccuuacuacacauuagauaa

SEQ ID NO: 217057 - RNA, 64 nt, Homo Sapiens
uugauacucuuuccacaauacugagcugccucagaauccucaaaaucaguuuuuauauucccca

SEQ ID NO: 217058 - RNA, 64 nt, Homo Sapiens
ucuuugucauacuacuauuccuuucgucucccagaauccucagggcacugaggguaggucugac

SEQ ID NO: 217059 - RNA, 64 nt, Homo Sapiens; identical to SEQ ID NO: 60066

SEQ ID NO: 217060 - RNA, 64 nt, Homo Sapiens; identical to SEQ ID NO: 60067

SEQ ID NO: 217061 - RNA, 64 nt, Homo Sapiens; identical to SEQ ID NO: 60068

SEQ ID NO: 217062 - RNA, 64 nt, Homo Sapiens; identical to SEQ ID NO: 60069

SEQ ID NO: 217063 - RNA, 64 nt, Homo Sapiens; identical to SEQ ID NO: 60070

SEQ ID NO: 217064 - RNA, 64 nt, Homo Sapiens; identical to SEQ ID NO: 60071

SEQ ID NO: 217065 - RNA, 64 nt, Homo Sapiens; identical to SEQ ID NO: 60072

SEQ ID NO: 217066 - RNA, 64 nt, Homo Sapiens; identical to SEQ ID NO: 60073

SEQ ID NO: 217067 - RNA, 64 nt, Homo Sapiens; identical to SEQ ID NO: 60074

SEQ ID NO: 217068 - RNA, 64 nt, Homo Sapiens; identical to SEQ ID NO: 60075

SEQ ID NO: 217069 - RNA, 64 nt, Homo Sapiens; identical to SEQ ID NO: 60076

SEQ ID NO: 217070 - RNA, 64 nt, Homo Sapiens
uuuugcuuuagagaaugccacuuuggcugaacuacaaguguaggccaccauuauaauuuauaaa

SEQ ID NO: 217071 - RNA, 64 nt, Homo Sapiens
ccuggugccuuaccaaguugugcuuuucuguuuucaaguguaaaugauguugagcagaauguug

SEQ ID NO: 217072 - RNA, 64 nt, Homo Sapiens
auccuaccauaaaaugcuaaauuuguguaaaugacaaguguaaaacuugaagcagaaccuugua

SEQ ID NO: 217073 - RNA, 64 nt, Homo Sapiens
aaagguggaugauucuguuaggauguaaaacaaacaaguguaucgauaggcuguaguguacaug

SEQ ID NO: 217074 - RNA, 64 nt, Homo Sapiens
aaacagugaaucuuaugguggaagagguucucagcaaguguacaguauuuaccuuccuuugucu

SEQ ID NO: 217075 - RNA, 64 nt, Homo Sapiens
aaauuuuccauuaauuucaacauaauuaugggaacaaguguacagaagaauuuuuuuuuuaaga

SEQ ID NO: 217076 - RNA, 64 nt, Homo Sapiens
gugucacuuguucaccucuuuacuucauucuuaacaaguguauaguucucuaggacaguugaug

SEQ ID NO: 217077 - RNA, 64 nt, Homo Sapiens
cgaauuugguauuuagguacauuguuuauauagccaaguguauaugcuuuacuaccuaacaauu

SEQ ID NO: 217078 - RNA, 64 nt, Homo Sapiens
uauaaggguauacacauacauauauggcauauaacaaguguacacauauacacauaacaagugu

SEQ ID NO: 217079 - RNA, 64 nt, Homo Sapiens
auggcauauaacaaguguacacauauacacauaacaaguguagaaguauauauuacauacauac

SEQ ID NO: 217080 - RNA, 64 nt, Homo Sapiens
aagcuugucuaugguacaaaaaucacaaggcauucaaguguacagugaaaagucucccuuucca

SEQ ID NO: 217081 - RNA, 64 nt, Homo Sapiens
ugagguuuccuucagacagauuccaggcgaugugcaaguguaugcacgugugcacacacaccac

SEQ ID NO: 217082 - RNA, 64 nt, Homo Sapiens
aggagacuggggcuuuuuucggcaccaaauuauccaaguguauugggucuaucgccuuguggau

SEQ ID NO: 217083 - RNA, 64 nt, Homo Sapiens
gauauuugagugaauuaaaagauaaucuuuacugcaaguguaaucacuucucgugacauuuguu

SEQ ID NO: 217084 - RNA, 64 nt, Homo Sapiens
aaauguggcaaauuuuucaggaagagagaucuuacaaguguaauaucauuggagaauccauaau

SEQ ID NO: 217085 - RNA, 64 nt, Homo Sapiens
gaguguggcaaagccuuuggggagagaaaccuuacaaguguaauaacauacuggacuucacacu

SEQ ID NO: 217086 - RNA, 64 nt, Homo Sapiens
aaaugugacagauuuuucagaaugagagaucuuacaaguguaaucaaaucauuggagaauccau

SEQ ID NO: 217087 - RNA, 64 nt, Homo Sapiens
gaauguggcauaguuuuuaaggagagaaacccuacaaguguaauuucaaaaggcaauucguauu

SEQ ID NO: 217088 - RNA, 64 nt, Homo Sapiens
gaauguggcaagguuuuuaaggagagaaacuuuacaaguguaaugucacaaagccauucauacu

SEQ ID NO: 217089 - RNA, 64 nt, Homo Sapiens
uagcuuuuggagaguggguugagugggcugacaucaaguguaauaaguguaauuagcuuuugga

SEQ ID NO: 217090 - RNA, 64 nt, Homo Sapiens
uagcuuuuggagagugggcuguuaccucugacaucaaguguaauaccuauaauuuugcaaaucu

SEQ ID NO: 217091 - RNA, 64 nt, Homo Sapiens
aaugggguguggggugccacuugccaugggaagcacugggaaguggaugggccacggauggagc

SEQ ID NO: 217092 - RNA, 64 nt, Homo Sapiens
guccuuugcuuuggggcccacuugucuagacuccacugggaagauuuugguucuuuuauaaaga

SEQ ID NO: 217093 - RNA, 64 nt, Homo Sapiens
gggaggugaggggcgccucugcccagcugccccuacugggaagugaggagccccucugccccgc

SEQ ID NO: 217094 - RNA, 64 nt, Homo Sapiens
gggaggcgaggggcgccucugcccggcugccccuacugggaagugaggagccccucugcccggc

SEQ ID NO: 217095 - RNA, 64 nt, Homo Sapiens
gggagguuaggggcgccucugcccggccgccccuacugggaagugaggagccccucugcccggc

SEQ ID NO: 217096 - RNA, 64 nt, Homo Sapiens
aaaagugguuuaauuggacuaagacauacccgagacugggaagaccguuuucacgcugcugaua

SEQ ID NO: 217097 - RNA, 64 nt, Homo Sapiens
aaaagagguuuacuuggacuaagacguacccgagacugggaagacuguauuaaugcugcugaua

SEQ ID NO: 217098 - RNA, 64 nt, Homo Sapiens
cccagaccuggauucugaguaaugggagcauaguacugggaaacaugggagcacaguacuggga

SEQ ID NO: 217099 - RNA, 64 nt, Homo Sapiens
gggagcauaguacugggaaaaaugggagcacaguacugggaaauaugggagcauaguacuggga

SEQ ID NO: 217100 - RNA, 64 nt, Homo Sapiens
gggagcacaguacugggaaaaaugggagcauaguacugggaaaugggaguucacaguacucgga

SEQ ID NO: 217101 - RNA, 64 nt, Homo Sapiens
gggaguucacaguacucggaugggagcccacaguacugggaaaggggagcacaguacugggaaa

SEQ ID NO: 217102 - RNA, 64 nt, Homo Sapiens
gggagcccacaguacugggaaaugggagcacaguacugggaaaugggagcacacaguacuggga

SEQ ID NO: 217103 - RNA, 64 nt, Homo Sapiens
gggagcacaguacugggaaaugggagcacacaguacugggaaaugggcauacaguacugagaaa

SEQ ID NO: 217104 - RNA, 64 nt, Homo Sapiens
gggcauacaguacugagaaaaaugggagcacaguacugggaaauaugggaguacacuacugaga

SEQ ID NO: 217105 - RNA, 64 nt, Homo Sapiens
gggagcacaguacugagaagaaugggagcacaguacugggaaguaugggagcacaguauuggga

SEQ ID NO: 217106 - RNA, 64 nt, Homo Sapiens
gggggcucacagcacugcaaaaugggagcacaguacugggaaauaugggagcacaguacuggga

SEQ ID NO: 217107 - RNA, 64 nt, Homo Sapiens
gggagcacaguacugggaaaaaugggagcacaguacugggaaauaugggagcacaguacuagga

SEQ ID NO: 217108 - RNA, 64 nt, Homo Sapiens
gggagcacaguacuaggaaaccugugagcacaguacugggaaaugccgggcauguuggcucaca

SEQ ID NO: 217109 - RNA, 59 nt, Homo Sapiens
gcccucagagugcucuguaggagcuguagacugggaagagaggccaggcgugguggcuc

SEQ ID NO: 217110 - RNA, 64 nt, Homo Sapiens
acagcuagacccugucucaaaaaaaaaaaaaaagacugggaagagagcuagagggacuaggaga

SEQ ID NO: 217111 - RNA, 64 nt, Homo Sapiens
aguuaagcccccuccucaccuuuccagggucuuuacugggaagcauccuccugcaagagugggc

SEQ ID NO: 217112 - RNA, 64 nt, Homo Sapiens
ccccauaacuacagagucugugcugcuuuggcugacugggaacauucauucccacugcacuugg

SEQ ID NO: 217113 - RNA, 64 nt, Homo Sapiens
ugugggaacaggaauaaaggagaaaccacuauugacugggaagacacacaaagaacuuugucaa

SEQ ID NO: 217114 - RNA, 64 nt, Homo Sapiens
ccaggcuuggucaugcaugccuguaauccuagcuacugggaaggcugaggaaggagaauugcuu

SEQ ID NO: 217115 - RNA, 64 nt, Homo Sapiens
uaucaaaaaguacaauaauaaauccucagguaguacugggaauggaaggcuuugccaugggccu

SEQ ID NO: 217116 - RNA, 64 nt, Homo Sapiens
aggcuuugccaugggccugcugcgucagaccaguacugggaaggaggacgguuguaagcaguug

SEQ ID NO: 217117 - RNA, 64 nt, Homo Sapiens
gugccagcauccagcaugagcagaugucggggagacugggaagucuccagcguuacugcucucc

SEQ ID NO: 217118 - RNA, 64 nt, Homo Sapiens
gugccagcauccagcgugagcagacgucggggagacugggaagucuccgauguuacugccugcc

SEQ ID NO: 217119 - RNA, 64 nt, Homo Sapiens
ucugagugaaaggauggccuuacaaucuugaguaacugggaaagaguuugacuucguuccugaa

SEQ ID NO: 217120 - RNA, 64 nt, Homo Sapiens
ugugaaaacuauuuaagauacguccugcucacaaacugggaaagucacacagcugagaagccgg

SEQ ID NO: 217121 - RNA, 64 nt, Homo Sapiens
acuaagugcuuauucaaagacuagguuauuuucaacugggaaaaaagcagugcuaacaggauau

SEQ ID NO: 217122 - RNA, 64 nt, Homo Sapiens
uagaaccgguaagauggugacauuguugaucaagacugggaauauaagagagaagcagguuugg

SEQ ID NO: 217123 - RNA, 64 nt, Homo Sapiens; identical to SEQ ID NO: 161557

SEQ ID NO: 217124 - RNA, 64 nt, Homo Sapiens; identical to SEQ ID NO: 161558

SEQ ID NO: 217125 - RNA, 64 nt, Homo Sapiens; identical to SEQ ID NO: 161559

SEQ ID NO: 217126 - RNA, 64 nt, Homo Sapiens; identical to SEQ ID NO: 161560

SEQ ID NO: 217127 - RNA, 64 nt, Homo Sapiens; identical to SEQ ID NO: 161561

SEQ ID NO: 217128 - RNA, 64 nt, Homo Sapiens; identical to SEQ ID NO: 161562

SEQ ID NO: 217129 - RNA, 64 nt, Homo Sapiens; identical to SEQ ID NO: 161563

SEQ ID NO: 217130 - RNA, 64 nt, Homo Sapiens; identical to SEQ ID NO: 161564

SEQ ID NO: 217131 - RNA, 64 nt, Homo Sapiens; identical to SEQ ID NO: 161565

SEQ ID NO: 217132 - RNA, 64 nt, Homo Sapiens; identical to SEQ ID NO: 161566

SEQ ID NO: 217133 - RNA, 64 nt, Homo Sapiens; identical to SEQ ID NO: 161567

SEQ ID NO: 217134 - RNA, 64 nt, Homo Sapiens; identical to SEQ ID NO: 161568

SEQ ID NO: 217135 - RNA, 64 nt, Homo Sapiens; identical to SEQ ID NO: 161569

SEQ ID NO: 217136 - RNA, 64 nt, Homo Sapiens; identical to SEQ ID NO: 161570

SEQ ID NO: 217137 - RNA, 64 nt, Homo Sapiens; identical to SEQ ID NO: 161571

SEQ ID NO: 217138 - RNA, 64 nt, Homo Sapiens; identical to SEQ ID NO: 161572

SEQ ID NO: 217139 - RNA, 64 nt, Homo Sapiens; identical to SEQ ID NO: 161573

SEQ ID NO: 217140 - RNA, 64 nt, Homo Sapiens; identical to SEQ ID NO: 161574

SEQ ID NO: 217141 - RNA, 64 nt, Homo Sapiens; identical to SEQ ID NO: 161575

SEQ ID NO: 217142 - RNA, 64 nt, Homo Sapiens; identical to SEQ ID NO: 161576

SEQ ID NO: 217143 - RNA, 64 nt, Homo Sapiens; identical to SEQ ID NO: 161577

SEQ ID NO: 217144 - RNA, 64 nt, Homo Sapiens; identical to SEQ ID NO: 161578

SEQ ID NO: 217145 - RNA, 64 nt, Homo Sapiens; identical to SEQ ID NO: 161579

SEQ ID NO: 217146 - RNA, 64 nt, Homo Sapiens; identical to SEQ ID NO: 161580

SEQ ID NO: 217147 - RNA, 64 nt, Homo Sapiens; identical to SEQ ID NO: 161581

SEQ ID NO: 217148 - RNA, 64 nt, Homo Sapiens; identical to SEQ ID NO: 161582

SEQ ID NO: 217149 - RNA, 64 nt, Homo Sapiens; identical to SEQ ID NO: 161583

SEQ ID NO: 217150 - RNA, 64 nt, Homo Sapiens; identical to SEQ ID NO: 161584

SEQ ID NO: 217151 - RNA, 64 nt, Homo Sapiens; identical to SEQ ID NO: 161585

SEQ ID NO: 217152 - RNA, 64 nt, Homo Sapiens; identical to SEQ ID NO: 161586

SEQ ID NO: 217153 - RNA, 64 nt, Homo Sapiens; identical to SEQ ID NO: 161587

SEQ ID NO: 217154 - RNA, 64 nt, Homo Sapiens; identical to SEQ ID NO: 161588

SEQ ID NO: 217155 - RNA, 64 nt, Homo Sapiens; identical to SEQ ID NO: 161589

SEQ ID NO: 217156 - RNA, 64 nt, Homo Sapiens; identical to SEQ ID NO: 161590

SEQ ID NO: 217157 - RNA, 64 nt, Homo Sapiens; identical to SEQ ID NO: 161591

SEQ ID NO: 217158 - RNA, 64 nt, Homo Sapiens; identical to SEQ ID NO: 161592

SEQ ID NO: 217159 - RNA, 64 nt, Homo Sapiens; identical to SEQ ID NO: 161593

SEQ ID NO: 217160 - RNA, 64 nt, Homo Sapiens; identical to SEQ ID NO: 161594

SEQ ID NO: 217161 - RNA, 64 nt, Homo Sapiens; identical to SEQ ID NO: 161595

SEQ ID NO: 217162 - RNA, 64 nt, Homo Sapiens; identical to SEQ ID NO: 161596

SEQ ID NO: 217163 - RNA, 64 nt, Homo Sapiens; identical to SEQ ID NO: 161597

SEQ ID NO: 217164 - RNA, 64 nt, Homo Sapiens; identical to SEQ ID NO: 161598

SEQ ID NO: 217165 - RNA, 64 nt, Homo Sapiens; identical to SEQ ID NO: 161599

SEQ ID NO: 217166 - RNA, 64 nt, Homo Sapiens; identical to SEQ ID NO: 161600

SEQ ID NO: 217167 - RNA, 64 nt, Homo Sapiens; identical to SEQ ID NO: 161601

SEQ ID NO: 217168 - RNA, 64 nt, Homo Sapiens; identical to SEQ ID NO: 161602

SEQ ID NO: 217169 - RNA, 64 nt, Homo Sapiens; identical to SEQ ID NO: 161603

SEQ ID NO: 217170 - RNA, 64 nt, Homo Sapiens; identical to SEQ ID NO: 161604

SEQ ID NO: 217171 - RNA, 64 nt, Homo Sapiens; identical to SEQ ID NO: 161605

SEQ ID NO: 217172 - RNA, 64 nt, Homo Sapiens; identical to SEQ ID NO: 161606

SEQ ID NO: 217173 - RNA, 64 nt, Homo Sapiens; identical to SEQ ID NO: 161607

SEQ ID NO: 217174 - RNA, 64 nt, Homo Sapiens; identical to SEQ ID NO: 161608

SEQ ID NO: 217175 - RNA, 64 nt, Homo Sapiens; identical to SEQ ID NO: 161609

SEQ ID NO: 217176 - RNA, 64 nt, Homo Sapiens; identical to SEQ ID NO: 161610

SEQ ID NO: 217177 - RNA, 64 nt, Homo Sapiens; identical to SEQ ID NO: 161611

SEQ ID NO: 217178 - RNA, 64 nt, Homo Sapiens; identical to SEQ ID NO: 161612

SEQ ID NO: 217179 - RNA, 64 nt, Homo Sapiens; identical to SEQ ID NO: 161613

SEQ ID NO: 217180 - RNA, 64 nt, Homo Sapiens; identical to SEQ ID NO: 161614

SEQ ID NO: 217181 - RNA, 64 nt, Homo Sapiens; identical to SEQ ID NO: 161615

SEQ ID NO: 217182 - RNA, 64 nt, Homo Sapiens; identical to SEQ ID NO: 161616

SEQ ID NO: 217183 - RNA, 64 nt, Homo Sapiens; identical to SEQ ID NO: 161617

SEQ ID NO: 217184 - RNA, 64 nt, Homo Sapiens; identical to SEQ ID NO: 161618

SEQ ID NO: 217185 - RNA, 64 nt, Homo Sapiens; identical to SEQ ID NO: 161619

SEQ ID NO: 217186 - RNA, 64 nt, Homo Sapiens; identical to SEQ ID NO: 161620

SEQ ID NO: 217187 - RNA, 64 nt, Homo Sapiens; identical to SEQ ID NO: 161621

SEQ ID NO: 217188 - RNA, 64 nt, Homo Sapiens; identical to SEQ ID NO: 161622

SEQ ID NO: 217189 - RNA, 64 nt, Homo Sapiens
cagaaacuauucaguuuuuguauugcucugaguaacugacaaaggaaaacaacuguuacaguuu

SEQ ID NO: 217190 - RNA, 64 nt, Homo Sapiens
uauuuuaaaaauauauaaaaacguacaucguaaaacugacaaaagggcuguggugaauggauga

SEQ ID NO: 217191 - RNA, 64 nt, Homo Sapiens
gaggcgucugcugucucaucgaugacaaaccauaacugacaagauaagaaggaaaagaagaaga

SEQ ID NO: 217192 - RNA, 64 nt, Homo Sapiens
ugugaagauggaacuaaacuggaaauuaaauuauacugacaauauuauggcauuuuuaagauca

SEQ ID NO: 217193 - RNA, 64 nt, Homo Sapiens
cgcaagaugcuugccccgcuaguggcagaugugaacugacaaggagugaagcgcccacccagcg

SEQ ID NO: 217194 - RNA, 64 nt, Homo Sapiens
uggcagccacccucuaggagacaaaacuacccccacugacaaggcuuuaggagacccuaaaguc

SEQ ID NO: 217195 - RNA, 64 nt, Homo Sapiens
gcuguuuuguucuaguaacaauuuuggaaugaauacugacaauauuccaugagggugugcaagc

SEQ ID NO: 217196 - RNA, 64 nt, Homo Sapiens
cauugaaacaguuuauuuuaugauuugaaaaauaacugacaaacuggaugacuguacauuuuag

SEQ ID NO: 217197 - RNA, 64 nt, Homo Sapiens
cagagaaaaauggaccuuuuaaggaaccuuuuauacugacaaacaacuuaaauauauauaaaua

SEQ ID NO: 217198 - RNA, 64 nt, Homo Sapiens; identical to SEQ ID NO: 161557

SEQ ID NO: 217199 - RNA, 64 nt, Homo Sapiens; identical to SEQ ID NO: 161558

SEQ ID NO: 217200 - RNA, 64 nt, Homo Sapiens; identical to SEQ ID NO: 161559

SEQ ID NO: 217201 - RNA, 64 nt, Homo Sapiens; identical to SEQ ID NO: 161560

SEQ ID NO: 217202 - RNA, 64 nt, Homo Sapiens; identical to SEQ ID NO: 161561

SEQ ID NO: 217203 - RNA, 64 nt, Homo Sapiens; identical to SEQ ID NO: 161562

SEQ ID NO: 217204 - RNA, 64 nt, Homo Sapiens; identical to SEQ ID NO: 161563

SEQ ID NO: 217205 - RNA, 64 nt, Homo Sapiens; identical to SEQ ID NO: 161564

SEQ ID NO: 217206 - RNA, 64 nt, Homo Sapiens; identical to SEQ ID NO: 161565

SEQ ID NO: 217207 - RNA, 64 nt, Homo Sapiens; identical to SEQ ID NO: 161566

SEQ ID NO: 217208 - RNA, 64 nt, Homo Sapiens; identical to SEQ ID NO: 161567

SEQ ID NO: 217209 - RNA, 64 nt, Homo Sapiens; identical to SEQ ID NO: 161568

SEQ ID NO: 217210 - RNA, 64 nt, Homo Sapiens; identical to SEQ ID NO: 161569

SEQ ID NO: 217211 - RNA, 64 nt, Homo Sapiens; identical to SEQ ID NO: 161570

SEQ ID NO: 217212 - RNA, 64 nt, Homo Sapiens; identical to SEQ ID NO: 161571

SEQ ID NO: 217213 - RNA, 64 nt, Homo Sapiens; identical to SEQ ID NO: 161572

SEQ ID NO: 217214 - RNA, 64 nt, Homo Sapiens; identical to SEQ ID NO: 161573

SEQ ID NO: 217215 - RNA, 64 nt, Homo Sapiens; identical to SEQ ID NO: 161574

SEQ ID NO: 217216 - RNA, 64 nt, Homo Sapiens; identical to SEQ ID NO: 161575

SEQ ID NO: 217217 - RNA, 64 nt, Homo Sapiens; identical to SEQ ID NO: 161576

SEQ ID NO: 217218 - RNA, 64 nt, Homo Sapiens; identical to SEQ ID NO: 161577

SEQ ID NO: 217219 - RNA, 64 nt, Homo Sapiens; identical to SEQ ID NO: 161578

SEQ ID NO: 217220 - RNA, 64 nt, Homo Sapiens; identical to SEQ ID NO: 161579

SEQ ID NO: 217221 - RNA, 64 nt, Homo Sapiens; identical to SEQ ID NO: 161580

SEQ ID NO: 217222 - RNA, 64 nt, Homo Sapiens; identical to SEQ ID NO: 161581

SEQ ID NO: 217223 - RNA, 64 nt, Homo Sapiens; identical to SEQ ID NO: 161582

SEQ ID NO: 217224 - RNA, 64 nt, Homo Sapiens; identical to SEQ ID NO: 161583

SEQ ID NO: 217225 - RNA, 64 nt, Homo Sapiens; identical to SEQ ID NO: 161584

SEQ ID NO: 217226 - RNA, 64 nt, Homo Sapiens; identical to SEQ ID NO: 161585

SEQ ID NO: 217227 - RNA, 64 nt, Homo Sapiens; identical to SEQ ID NO: 161586

SEQ ID NO: 217228 - RNA, 64 nt, Homo Sapiens; identical to SEQ ID NO: 161587

SEQ ID NO: 217229 - RNA, 64 nt, Homo Sapiens; identical to SEQ ID NO: 161588

SEQ ID NO: 217230 - RNA, 64 nt, Homo Sapiens; identical to SEQ ID NO: 161589

SEQ ID NO: 217231 - RNA, 64 nt, Homo Sapiens; identical to SEQ ID NO: 161590

SEQ ID NO: 217232 - RNA, 64 nt, Homo Sapiens; identical to SEQ ID NO: 161591

SEQ ID NO: 217233 - RNA, 64 nt, Homo Sapiens; identical to SEQ ID NO: 161592

SEQ ID NO: 217234 - RNA, 64 nt, Homo Sapiens; identical to SEQ ID NO: 161593

SEQ ID NO: 217235 - RNA, 64 nt, Homo Sapiens; identical to SEQ ID NO: 161594

SEQ ID NO: 217236 - RNA, 64 nt, Homo Sapiens; identical to SEQ ID NO: 161595

SEQ ID NO: 217237 - RNA, 64 nt, Homo Sapiens; identical to SEQ ID NO: 161596

SEQ ID NO: 217238 - RNA, 64 nt, Homo Sapiens; identical to SEQ ID NO: 161597

SEQ ID NO: 217239 - RNA, 64 nt, Homo Sapiens; identical to SEQ ID NO: 161598

SEQ ID NO: 217240 - RNA, 64 nt, Homo Sapiens; identical to SEQ ID NO: 161599

SEQ ID NO: 217241 - RNA, 64 nt, Homo Sapiens; identical to SEQ ID NO: 161600

SEQ ID NO: 217242 - RNA, 64 nt, Homo Sapiens; identical to SEQ ID NO: 161601

SEQ ID NO: 217243 - RNA, 64 nt, Homo Sapiens; identical to SEQ ID NO: 161602

SEQ ID NO: 217244 - RNA, 64 nt, Homo Sapiens; identical to SEQ ID NO: 161603

SEQ ID NO: 217245 - RNA, 64 nt, Homo Sapiens; identical to SEQ ID NO: 161604

SEQ ID NO: 217246 - RNA, 64 nt, Homo Sapiens; identical to SEQ ID NO: 161605

SEQ ID NO: 217247 - RNA, 64 nt, Homo Sapiens; identical to SEQ ID NO: 161606

SEQ ID NO: 217248 - RNA, 64 nt, Homo Sapiens; identical to SEQ ID NO: 161607

SEQ ID NO: 217249 - RNA, 64 nt, Homo Sapiens; identical to SEQ ID NO: 161608

SEQ ID NO: 217250 - RNA, 64 nt, Homo Sapiens; identical to SEQ ID NO: 161609

SEQ ID NO: 217251 - RNA, 64 nt, Homo Sapiens; identical to SEQ ID NO: 161610

SEQ ID NO: 217252 - RNA, 64 nt, Homo Sapiens; identical to SEQ ID NO: 161611

SEQ ID NO: 217253 - RNA, 64 nt, Homo Sapiens; identical to SEQ ID NO: 161612

SEQ ID NO: 217254 - RNA, 64 nt, Homo Sapiens; identical to SEQ ID NO: 161613

SEQ ID NO: 217255 - RNA, 64 nt, Homo Sapiens; identical to SEQ ID NO: 161614

SEQ ID NO: 217256 - RNA, 64 nt, Homo Sapiens; identical to SEQ ID NO: 161615

SEQ ID NO: 217257 - RNA, 64 nt, Homo Sapiens; identical to SEQ ID NO: 161616

SEQ ID NO: 217258 - RNA, 64 nt, Homo Sapiens; identical to SEQ ID NO: 161617

SEQ ID NO: 217259 - RNA, 64 nt, Homo Sapiens; identical to SEQ ID NO: 161618

SEQ ID NO: 217260 - RNA, 64 nt, Homo Sapiens; identical to SEQ ID NO: 161619

SEQ ID NO: 217261 - RNA, 64 nt, Homo Sapiens; identical to SEQ ID NO: 161620

SEQ ID NO: 217262 - RNA, 64 nt, Homo Sapiens; identical to SEQ ID NO: 161621

SEQ ID NO: 217263 - RNA, 64 nt, Homo Sapiens; identical to SEQ ID NO: 161622

SEQ ID NO: 217264 - RNA, 64 nt, Homo Sapiens; identical to SEQ ID NO: 217189

SEQ ID NO: 217265 - RNA, 64 nt, Homo Sapiens; identical to SEQ ID NO: 217190

SEQ ID NO: 217266 - RNA, 64 nt, Homo Sapiens; identical to SEQ ID NO: 217191

SEQ ID NO: 217267 - RNA, 64 nt, Homo Sapiens; identical to SEQ ID NO: 217192

SEQ ID NO: 217268 - RNA, 64 nt, Homo Sapiens; identical to SEQ ID NO: 217193

SEQ ID NO: 217269 - RNA, 64 nt, Homo Sapiens; identical to SEQ ID NO: 217194

SEQ ID NO: 217270 - RNA, 64 nt, Homo Sapiens; identical to SEQ ID NO: 217195

SEQ ID NO: 217271 - RNA, 64 nt, Homo Sapiens; identical to SEQ ID NO: 217196

SEQ ID NO: 217272 - RNA, 64 nt, Homo Sapiens; identical to SEQ ID NO: 217197

SEQ ID NO: 217273 - RNA, 64 nt, Homo Sapiens
ugcugagcccucaccucccuccuuaggauucuccucucucuaggcaauagaguugaaagagagg

SEQ ID NO: 217274 - RNA, 64 nt, Homo Sapiens
aauagggucuguuucacaggagguuuuuccucugucucucuaggagauugugccauaccagcug

SEQ ID NO: 217275 - RNA, 64 nt, Homo Sapiens
cagagcguuccuggccagagcagcugcagagggcucucucuaggcugaguccccgaucuagggc

SEQ ID NO: 217276 - RNA, 64 nt, Homo Sapiens
ccuaugaaccacaaagcaggagcccgcugucgggucucucuaggcauucucacucacacugggc

SEQ ID NO: 217277 - RNA, 64 nt, Homo Sapiens
agucuauuuccauucuuucagcucagugccuuccucucucuaccuacgcacauaccuucaugug

SEQ ID NO: 217278 - RNA, 64 nt, Homo Sapiens
agucuauuuccacugaacaaguucagugccuuccucucucuaccuacacacauaccuucaugug

SEQ ID NO: 217279 - RNA, 64 nt, Homo Sapiens
agucuauuuccacugaacaaauucacugccuuccucucucuaccuacacacguaccuucaugug

SEQ ID NO: 217280 - RNA, 64 nt, Homo Sapiens
ugcucuggaauggaugaguguuuucuucugugcuucucucuaucuuugucauauugccucuaga

SEQ ID NO: 217281 - RNA, 64 nt, Homo Sapiens
aaagcucuugcaccuuuaucuaugcuagaaacugucucucuagggccuacuguguuccaggaac

SEQ ID NO: 217282 - RNA, 64 nt, Homo Sapiens
uugcuauuugccaccauccuuccaagauuuaucaucucucuauuuuugaucauuugauuuugga

SEQ ID NO: 217283 - RNA, 64 nt, Homo Sapiens
uggaugaaucaaaauguaaugaaaucucucucucucucucuauuaaaguagugccaaaaaucuu

SEQ ID NO: 217284 - RNA, 64 nt, Homo Sapiens
acuuaaaacaaucuccucucucucucucucucucucucucuaucucucucucuaucuccucucu

SEQ ID NO: 217285 - RNA, 64 nt, Homo Sapiens
cuccucucucucucucucucucucucucuaucucucucucuaucuccucucucucucuccucuc

SEQ ID NO: 217286 - RNA, 64 nt, Homo Sapiens
uaccauuuuucugcgugcucucacucucucuuucucucucuagcuuuuuaauucaugaauauuu

SEQ ID NO: 217287 - RNA, 64 nt, Homo Sapiens
caucacaaaguaggucauuccaucaccacccuugucucucuacacauuuugccuuuggggaucu

SEQ ID NO: 217288 - RNA, 64 nt, Homo Sapiens
ccagcuuacugugggacauaucaggaauuugaguucucucuaacuuguucgguuuuguuuucca

SEQ ID NO: 217289 - RNA, 64 nt, Homo Sapiens
cuguucuacaagcaaacaaaaucuagcacuuacaucucucuauguugccaaagccauccuuggc

SEQ ID NO: 217290 - RNA, 64 nt, Homo Sapiens
caauucagggccugcuuuccccuccuccaccaagucucucuagaagggacaaggcgggccgugg

SEQ ID NO: 217291 - RNA, 64 nt, Homo Sapiens
ccucucccuuacuggcccacguaaacugguguccucucucuagccaagugaaagucaacccuau

SEQ ID NO: 217292 - RNA, 64 nt, Homo Sapiens
ccucauugucagagggaauuaacugcuaggcaccucucucuaacaucuggcuuugcugcuuucu

SEQ ID NO: 217293 - RNA, 64 nt, Homo Sapiens
ugggcaccagugaacaugcgacaguugccauuuuucucucuaacuguaggugacucccacauac

SEQ ID NO: 217294 - RNA, 64 nt, Homo Sapiens
ggccccaggacacccagccugugccccacaaggaucucucuaaaugggagggauugaggcuacu

SEQ ID NO: 217295 - RNA, 64 nt, Homo Sapiens
ucaguauucaucucuuuguuuuuugucacucuuuucucucuaauugugucauuuguacuguuug

SEQ ID NO: 217296 - RNA, 63 nt, Homo Sapiens
uuuuuuuuuuuuuuuuuuuuuuaacaauggauauucuguaaaauauccuguacaaaacaagac

SEQ ID NO: 217297 - RNA, 63 nt, Homo Sapiens
auuuugacuuaaaacaucugcugaauuccaaauuucuguaauagcuacuguaucugugauaaa

SEQ ID NO: 217298 - RNA, 63 nt, Homo Sapiens
uauuaugcugccucuccaguguaauauuugccuuucuguaaaugggauuaaauaugauuugua

SEQ ID NO: 217299 - RNA, 63 nt, Homo Sapiens
gcuaauccgccgaagaaaaggugaagaaaggaauucuguaaagaaaccaucagauuuguuaag

SEQ ID NO: 217300 - RNA, 63 nt, Homo Sapiens
auaaauaaaacuuuguuucuuaggagaaaaugauucuguaauuccagugucacuaauuuauau

SEQ ID NO: 217301 - RNA, 61 nt, Homo Sapiens
ggcuuacuucugaugcauaguauugaucuacuucuguaauugguaauugaucaauguuuuu

SEQ ID NO: 217302 - RNA, 63 nt, Homo Sapiens
cuuagucacaaaauauauuuuguuuacaaaaauuucuguaaaacagguuauaacaguguuuaa

SEQ ID NO: 217303 - RNA, 63 nt, Homo Sapiens
gguagggaaaagaacugcugggugggggccuguuucuguaacuuucucccccucuacugagaa

SEQ ID NO: 217304 - RNA, 63 nt, Homo Sapiens
uuaaauuuauuaaucuuaaaucauguacuuuuuuucuguaauagaacucggauucuuuugcau

SEQ ID NO: 217305 - RNA, 63 nt, Homo Sapiens
gaaaaccugaaacgaugauugaugugauggacguucuguaauagauuguaauuugguuuauug

SEQ ID NO: 217306 - RNA, 63 nt, Homo Sapiens
uuccccuggccuaaaugauuaacauggucaguauucuguaaaggguuccuaucucuucaggca

SEQ ID NO: 217307 - RNA, 63 nt, Homo Sapiens
ugugaccguuugacaucuguguuuuccuuugacuucuguaaaagagugcagaacugugguuuu

SEQ ID NO: 217308 - RNA, 63 nt, Homo Sapiens
acaaaggcaguccgcauucuuaaguugugaaauuucuguaauacuuucgggguugucauuaag

SEQ ID NO: 217309 - RNA, 63 nt, Homo Sapiens
aguuacuuuuaaauauuuauuuaaaaccucuguuucuguaacuguauguuaaacguauucuuc

SEQ ID NO: 217310 - RNA, 63 nt, Homo Sapiens
cucuguuucuguaacuguauguuaaacguauucuucuguaaugagaauagacuggaacaugug

SEQ ID NO: 217311 - RNA, 63 nt, Homo Sapiens
cugauauugucuauugguuacagaaucagccaguucuguaaaaaaccucaaagacagauguua

SEQ ID NO: 217312 - RNA, 63 nt, Homo Sapiens
gaggacuauccucagucugcuucguuuuguauuuucuguaacaguuuuaguuuuuuguuucgu

SEQ ID NO: 217313 - RNA, 63 nt, Homo Sapiens
aaaauuuguuugccucauguuugcaguggugguuucuguaauuuuucuccuuucuacaugaca

SEQ ID NO: 217314 - RNA, 63 nt, Homo Sapiens
ugaauuccauccauuuuccaugaaaauaugguauucuguaacuuguucuuacauaagcacuca

SEQ ID NO: 217315 - RNA, 63 nt, Homo Sapiens
auuggcugauauuuauauacuuaauagauugaguucuguaagggcaaaaacggauugaaauga

SEQ ID NO: 217316 - RNA, 63 nt, Homo Sapiens
uauuacaucauuuauaugugaaaaguuggacauuucuguaaguuuuuaaaauuauccauuugu

SEQ ID NO: 217317 - RNA, 63 nt, Homo Sapiens
ucauagcucaagaauuguuagcaaaugacagauuucuguaagccuauauauauagucaaaucg

SEQ ID NO: 217318 - RNA, 63 nt, Homo Sapiens
uucugccuauguaaaaugaauugaaaaacaauuuucuguaaucuuuuauuuaaguagugggca

SEQ ID NO: 217319 - RNA, 63 nt, Homo Sapiens
uguuugcuguuaauuuuuuauuuacaauaaaaauucuguaaauuaacuaguaaugagcuucug

SEQ ID NO: 217320 - RNA, 63 nt, Homo Sapiens
gaaaugcugacuucgccucuccagauaguauuuuucuguaaauucagcaacucauugucucca

SEQ ID NO: 217321 - RNA, 63 nt, Homo Sapiens
gguuauccuuucugacccacaaaguaugaaaaguucuguaaucuguaaacucaguucuguaau

SEQ ID NO: 217322 - RNA, 63 nt, Homo Sapiens
aaguaugaaaaguucuguaaucuguaaacucaguucuguaaucuguauuauugagaugauuaa

SEQ ID NO: 217323 - RNA, 63 nt, Homo Sapiens
uuuuuacaccuaauuuacuaggaaaauauuuuauucuguaauucauguuaagauuauguaugg

SEQ ID NO: 217324 - RNA, 63 nt, Homo Sapiens
uuuaaggggauuuauguuagguuaauuaguuguuucuguaaaucauuuguaauagcauagugc

SEQ ID NO: 217325 - RNA, 63 nt, Homo Sapiens
ccuagguguaaaauuuuaauaguuaaugcagaauucuguaaucauugaaucauuagugguuaa

SEQ ID NO: 217326 - RNA, 63 nt, Homo Sapiens
aaauacauuccuaaaaauguauuugaacauugguucuguaaaagauaauggacuaaaaaagua

SEQ ID NO: 217327 - RNA, 63 nt, Homo Sapiens
acauuccuauccccaacacaucaauuguauuuuuucuguaaaacucagauuuuccucaguauu

SEQ ID NO: 217328 - RNA, 63 nt, Homo Sapiens
auaauccagggaaacccaagagccuuacuggucuucuguaacuuccaagacugacagcuuuuu

SEQ ID NO: 217329 - RNA, 63 nt, Homo Sapiens
ucugugacauguuuauauucacccauguacauuuucuguaaauaccaaacgcuacugauuccc

SEQ ID NO: 217330 - RNA, 63 nt, Homo Sapiens
uguggaaaguuaacacuagcuuuguauuuuuuuuucuguaaaacugugaacugauauauuuuc

SEQ ID NO: 217331 - RNA, 63 nt, Homo Sapiens
aauauuauggaaggguuucuauccccaaaucuguucuguaaauaacccacuuggguaguuacu

SEQ ID NO: 217332 - RNA, 63 nt, Homo Sapiens
aguaauuuugaucaaaagacacugcacuaggauuucuguaaggaaacgcugaagagaguaaca

SEQ ID NO: 217333 - RNA, 63 nt, Homo Sapiens
uucagcauuucuuugaaggacuaaucccagcacuucuguaaccucucugauaaagcgucugau

SEQ ID NO: 217334 - RNA, 63 nt, Homo Sapiens
gccaaugaaggacugcaguauuugugugcccgauucuguaaacacacacacacagaguauaua

SEQ ID NO: 217335 - RNA, 63 nt, Homo Sapiens
aaaaucaguugacguugccuggugguuccuaccuucuguaaaacgaacagauuccuuaagauu

SEQ ID NO: 217336 - RNA, 63 nt, Homo Sapiens
ucuugguuaaacauugcacaguucuuaccucauuucuguaaauaaaguuuugugaaucuguuu

SEQ ID NO: 217337 - RNA, 63 nt, Homo Sapiens
guuuauuuuacuuauuuaacccacugguuguuauucuguaacaguuuguauaaaugguaaauu

SEQ ID NO: 217338 - RNA, 63 nt, Homo Sapiens
uccuauguagaaggcucagucaguguuauucauuucuguaaaugaaauggagaauaagcagca

SEQ ID NO: 217339 - RNA, 63 nt, Homo Sapiens
uaaauguuguuaauaagaauuaccucugggucauucuguaaugcuuuucugagguuuuucagc

SEQ ID NO: 217340 - RNA, 63 nt, Homo Sapiens
agugacucguggcuugccuuaccaagagugacuuucuguaaggucgugagcacaucuuuaggg

SEQ ID NO: 217341 - RNA, 63 nt, Homo Sapiens
aaggcugucagucugcuuaaaauuacaagugaauucuguaagucuagugcaguuuuugucaua

SEQ ID NO: 217342 - RNA, 63 nt, Homo Sapiens
ccccuucauuuccuaccuucaaaacccagccccuucuguaauccagacagcggggaccagggg

SEQ ID NO: 217343 - RNA, 63 nt, Homo Sapiens
ugauaucuuucauacuugacaagcuaguuucuguucuguaaagugucuuccagaaaaauacau

SEQ ID NO: 217344 - RNA, 63 nt, Homo Sapiens
aaaauauaaucaaaauucaaagauuuuuuuuguuucuguaacuggaacuaaaucaaaugauua

SEQ ID NO: 217345 - RNA, 63 nt, Homo Sapiens
gaaaagugaaaccuuaauuuuaucaaaagaaauuucuguaaaugguaugucuccuuagaauac

SEQ ID NO: 217346 - RNA, 63 nt, Homo Sapiens
auuguacaauuugaucuuuuuugauauaugauauucuguaaauuguuacacucugccuauuca

SEQ ID NO: 217347 - RNA, 63 nt, Homo Sapiens
cguguaauaaguugaguauccauuaaaauugguuucuguaaaaugugguggccuuuaugugug

SEQ ID NO: 217348 - RNA, 63 nt, Homo Sapiens
uucaguuuuuauuaaucuacuguaucaauaaaauucuguaauuugaaugaguuuuuaauaguc

SEQ ID NO: 217349 - RNA, 63 nt, Homo Sapiens
ugaaaaaaagugcugaaaaugggaugugcuguuuucuguaaauucauauuuagccauaguaua

SEQ ID NO: 217350 - RNA, 63 nt, Homo Sapiens
cauuauguaauuuaaaaaauuuuuccaaugcuuuucuguaauagcuuaucuuauccuguuuau

SEQ ID NO: 217351 - RNA, 63 nt, Homo Sapiens
aaugagugguauuugauguagaaugacauucaguucuguaagauuaauugcauuuccagcaag

SEQ ID NO: 217352 - RNA, 63 nt, Homo Sapiens
aaaugauuggugucauuuucuuauaaaaccauuuucuguaauccauaauuucaagaggaggau

SEQ ID NO: 217353 - RNA, 63 nt, Homo Sapiens
gcagacuucauuagcacacacuuggcuuugagauucuguaacuugccuuacagacuuuacagg

SEQ ID NO: 217354 - RNA, 63 nt, Homo Sapiens
uuauucuuggauguauaaagugaacuuuuuggcuucuguaaguaugcucuaugcaccucuaau

SEQ ID NO: 217355 - RNA, 63 nt, Homo Sapiens
auguauuuauauguuguacacaguacuggcugauucuguaaauggauguauuguacagagaac

SEQ ID NO: 217356 - RNA, 63 nt, Homo Sapiens
agguuuggcaaaaaaaaaaauauuaacaaaauauucuguaagaaucaauugucuauauggaau

SEQ ID NO: 217357 - RNA, 63 nt, Homo Sapiens
guaaaauuuauacacacaaaaauuaacaaaagauucuguaagaauuaauuggcuauauggaau

SEQ ID NO: 217358 - RNA, 63 nt, Homo Sapiens
uuuuauuuuuguuuuuuagccuguuauauuuccuucuguaaaauaaaauauguccagaagagg

SEQ ID NO: 217359 - RNA, 63 nt, Homo Sapiens
gacauacaucauucugugauuaaaucuccagauuucuguaaaugauaccuacauucuaaagag

SEQ ID NO: 217360 - RNA, 63 nt, Homo Sapiens; identical to SEQ ID NO: 217358

SEQ ID NO: 217361 - RNA, 63 nt, Homo Sapiens; identical to SEQ ID NO: 217359

SEQ ID NO: 217362 - RNA, 64 nt, Homo Sapiens
uaacugguaugucacugaguaacuugacucggugucagagcauuuuaacuagccacucagauga

SEQ ID NO: 217363 - RNA, 64 nt, Homo Sapiens
ugacuuuauuuuguaaugggaggaagaaauuuucucagagcaaacuuucuauuuuuuaccugug

SEQ ID NO: 217364 - RNA, 64 nt, Homo Sapiens
ugcaggcuuagguccucacuucugucuccugucuucagagcaaaagacuugagccauccaaaga

SEQ ID NO: 217365 - RNA, 64 nt, Homo Sapiens
cccuccccugcucccagguugaggugcgcucaccucagagcagggccaaagcacagcugggcau

SEQ ID NO: 217366 - RNA, 64 nt, Homo Sapiens
ccaggccugcaggggcaaggggcuggcuggagucucagagcacagagguaggagaacugggguu

SEQ ID NO: 217367 - RNA, 64 nt, Homo Sapiens
uguucucauuccguauaugagcacaaguaagguuucagagcaacacacaugagaaagagaguaa

SEQ ID NO: 217368 - RNA, 64 nt, Homo Sapiens
cauggaucaagccccuaaaaugugguaaguguugucagagcagggcaauaucucuacucucaag

SEQ ID NO: 217369 - RNA, 64 nt, Homo Sapiens
acucgcucggcaggauuaugcgaucacggaucagucagagcagggucaggagacggggcugacg

SEQ ID NO: 217370 - RNA, 64 nt, Homo Sapiens
cacauugaauccugcccgucagggcaccuuuuccucagagcaauccggccacacgaauagaagg

SEQ ID NO: 217371 - RNA, 64 nt, Homo Sapiens
gauaagccacacagcagggcccugucugucaagcucagagcaugccaccggcacuguccauuug

SEQ ID NO: 217372 - RNA, 64 nt, Homo Sapiens
ggagacuggagcccuguuugccucagccucauggucagagcaguuuauaaaugugcuuugccug

SEQ ID NO: 217373 - RNA, 64 nt, Homo Sapiens
gcuaucaacuuggagaaacaaauuacugaauauuucagagcaaacuaauuuuuucuuuugugug

SEQ ID NO: 217374 - RNA, 64 nt, Homo Sapiens
uuuaccucucucuuaaauguaacuacugagauauucagagcauuauuguuucaugaguucacuu

SEQ ID NO: 217375 - RNA, 64 nt, Homo Sapiens
uauuuuguaacauucucuuuucuauucaccuuuuucagagcagacaaccacaaacccuaucaga

SEQ ID NO: 217376 - RNA, 64 nt, Homo Sapiens
aagguuauauuuuuuaaaauuugcuguguuuucuucagagcaagucuguucccuucuaaguugu

SEQ ID NO: 217377 - RNA, 64 nt, Homo Sapiens
gagcugccaucugggcuauucuuaacuuccuuccucagagcacuuguuugugccaguacaugac

SEQ ID NO: 217378 - RNA, 64 nt, Homo Sapiens
guuaaugagacaaaaguuguaaagauguacacugucagagcauugcugccccuuuaggaucaag

SEQ ID NO: 217379 - RNA, 64 nt, Homo Sapiens
ucaauuagggaugcucaaacgaaauuuucugaucucagagcauuuggcaucacgucagugcuca

SEQ ID NO: 217380 - RNA, 64 nt, Homo Sapiens
uuucgauuuuuuuuggaagauuucagcucuugcuucagagcagaugggagucuaaccugcguca

SEQ ID NO: 217381 - RNA, 64 nt, Homo Sapiens
uguaaguagaucugccaucugcuagugaaagaccucagagcaguuaauauaggauuauaaauca

SEQ ID NO: 217382 - RNA, 64 nt, Homo Sapiens
aguuaacugugaaaaaaauggaucgguaggcaguucagagcauagccauuucgccauuauuugu

SEQ ID NO: 217383 - RNA, 64 nt, Homo Sapiens
accugcuguuugcuuucugaaagaauuucagaaaucagagcaaaugugucuuuaggcagauuca

SEQ ID NO: 217384 - RNA, 64 nt, Homo Sapiens
ugcuguuuucugaaggugagaagccauuuuuagcucagagcaacccuuaagagaacuuuuggca

SEQ ID NO: 217385 - RNA, 64 nt, Homo Sapiens
aaaggccugaagagugagcuguggccuucagggcucagagcagccuuuuucccugcccaacccu

SEQ ID NO: 217386 - RNA, 55 nt, Homo Sapiens
uugugguguagugggggcuggccguucagagcaccccucccaccucuuccucuga

SEQ ID NO: 217387 - RNA, 64 nt, Homo Sapiens
acugucacugcaaguccagcaagccuaguccuguucagagcagcgcugaccaccucuccaacag

SEQ ID NO: 217388 - RNA, 64 nt, Homo Sapiens
caagucauugguguucauuuacucccugcaagccucagagcagcccugggaugccuaacugucu

SEQ ID NO: 217389 - RNA, 64 nt, Homo Sapiens
cccaucugauggaggaacuuuaaacgcuguuuucucagagcaagcuaugcaccugggaguuccu

SEQ ID NO: 217390 - RNA, 64 nt, Homo Sapiens
uaggacucaguaucugugaaauguccgucauaucucagagcauauagagggaauuaaauaaaca

SEQ ID NO: 217391 - RNA, 64 nt, Homo Sapiens
ugccaaacuucgggcaucuacugcucgccucccuucagagcaucagcacuuggcccggggucuc

SEQ ID NO: 217392 - RNA, 64 nt, Homo Sapiens
gacagguggauaguaaaucaguuggcugcaggacucagagcaugauguuuuaguuaagaguccu

SEQ ID NO: 217393 - RNA, 64 nt, Homo Sapiens
agguguuacccaaggucacaggggaaacugaggcucagagcagcuagccucauuucuuacagac

SEQ ID NO: 217394 - RNA, 64 nt, Homo Sapiens
ggaguggcuucccaaggucugagaaaccugagucucagagcaggccucacucuguuuuccaggg

SEQ ID NO: 217395 - RNA, 64 nt, Homo Sapiens
gcuuauaagugcaucuuuauagacaguggugauaaccccacacuccuagaaugggagaguaagu

SEQ ID NO: 217396 - RNA, 64 nt, Homo Sapiens
ugacauggcuccuccauccccuuuucuccgugugaccccacaaugaaacauacugcugcacuga

SEQ ID NO: 217397 - RNA, 64 nt, Homo Sapiens
gugaauaggcugcuuuuugcuuucuucuuuccagaccccacaguagagcacuuuucacuuauuu

SEQ ID NO: 217398 - RNA, 64 nt, Homo Sapiens
cuuaaccguggacucuuccuuuauccccuccuuuaccccacauaugcaaugacuuuuaauuuuc

SEQ ID NO: 217399 - RNA, 64 nt, Homo Sapiens
ucacuuagaaugaaguaaccucaagguaccaaauaccccacauaaggaaaguacuacacuaaau

SEQ ID NO: 217400 - RNA, 64 nt, Homo Sapiens
cauauaguagagugaggugagggucguggcuaaaaccccacaauaacuuuacauuccuagcuuu

SEQ ID NO: 217401 - RNA, 64 nt, Homo Sapiens
uuauuacacauaagauaauucauagcggagagaaaccccacaaaugugaagaauguggcagagc

SEQ ID NO: 217402 - RNA, 64 nt, Homo Sapiens
uuaguacacauaagaaaauucauacuggggagaaaccccacaaauguggagaaugcggaaaagc

SEQ ID NO: 217403 - RNA, 64 nt, Homo Sapiens
uuucugcacauaauauaauucauacuggagagaaaccccacaaauaugaagaaugugguaaugc

SEQ ID NO: 217404 - RNA, 64 nt, Homo Sapiens
ggaugcagcccccagcugcacagaggaugaagccaccccacagaagcaggccccacagacccca

SEQ ID NO: 217405 - RNA, 64 nt, Homo Sapiens
ggaugaagccaccccacagaagcaggccccacagaccccacagaauggaaugcugaugacuugg

SEQ ID NO: 217406 - RNA, 64 nt, Homo Sapiens
cuguguccauaucaagccagaccuccuccccuccaccccacaccccuccuuggucgggcaccau

SEQ ID NO: 217407 - RNA, 64 nt, Homo Sapiens
caggggccaggcucucccggucccgggcagcuucaccccacaccagucuggcucagcagccccc

SEQ ID NO: 217408 - RNA, 64 nt, Homo Sapiens
gcgagacaggccaggcucguggcucggaagacaaaccccacacacacucaaggggucgaaaaca

SEQ ID NO: 217409 - RNA, 64 nt, Homo Sapiens
caaaccccacacacacucaaggggucgaaaacaaaccccacacgagggcucucaccuccuucuc

SEQ ID NO: 217410 - RNA, 64 nt, Homo Sapiens
gggcugcucaguucacaggaggcucccagcagccaccccacauccagccuacacagaacuucgu

SEQ ID NO: 217411 - RNA, 64 nt, Homo Sapiens
uucucaccugcaguuuuggugaagcaggagaugcaccccacagcucuagcucucaaauggcuuc

SEQ ID NO: 217412 - RNA, 64 nt, Homo Sapiens
accugggccagaccaacagcacuggccucaaaggaccccacagcuuucaaucuacguucuaguc

SEQ ID NO: 217413 - RNA, 64 nt, Homo Sapiens
ggaauucccaucccuggaaaacaggcaccaggaaaccccacacaagacaccucaagcccuauuc

SEQ ID NO: 217414 - RNA, 64 nt, Homo Sapiens
gcccacagcuccugugcuggcuuguaugaagcccaccccacaugccucaagaaacccccagugc

SEQ ID NO: 217415 - RNA, 64 nt, Homo Sapiens
guuuucuguaguuccuuuuucaaugcagcaauuaaccccacaucugggaaucagcauaacaggg

SEQ ID NO: 217416 - RNA, 64 nt, Homo Sapiens
uaagugaaugccaaagucuucaggguuuccaaucaccccacagguagacuuugcuacaggauuu

SEQ ID NO: 217417 - RNA, 64 nt, Homo Sapiens
auuuacuuggaaagauuuuaccugugaagugaaauucuuucauuggggguaaggguaugaggug

SEQ ID NO: 217418 - RNA, 64 nt, Homo Sapiens
gccaagcaaaaugauaguaaauucuuugucuuuguucuuucagucagagguauuuauuaaguac

SEQ ID NO: 217419 - RNA, 64 nt, Homo Sapiens
aacagugugacugagugaaugaagauaaguuggauucuuucagagcauucuuuuccucaaaacg

SEQ ID NO: 217420 - RNA, 64 nt, Homo Sapiens
ucuuaauaacaaaggucccuuuaugaguuauuccuucuuucaguucaucucacuggagcacagc

SEQ ID NO: 217421 - RNA, 64 nt, Homo Sapiens
cuuucccauugccuugaaggucuggcaaucccuguucuuucauuugacaaguacuuacugagua

SEQ ID NO: 217422 - RNA, 64 nt, Homo Sapiens
uggcuacuugagaaaaaggagaggggagaaccccuucuuucauuccaacugccuccgaccccaa

SEQ ID NO: 217423 - RNA, 64 nt, Homo Sapiens
uccccuccuccaaacacacacagaaugggcugguuucuuucaaguuuaaaaaaagcccccuucu

SEQ ID NO: 217424 - RNA, 64 nt, Homo Sapiens
ucugacagcugccuuugaaacccaaagccucggguucuuucaagcuacauguacuaaauugucg

SEQ ID NO: 217425 - RNA, 64 nt, Homo Sapiens
uuuguucaaagauuaaugccaacucuuaagauuauucuuucaccaacuauagaauguauuuuau

SEQ ID NO: 217426 - RNA, 64 nt, Homo Sapiens
cucagcccucuacugagucccuuagccaagcaguuucuuucaaagaagccagcaggcgaaaagc

SEQ ID NO: 217427 - RNA, 64 nt, Homo Sapiens
ccuaguucccauucuccuuuccuuauuucuuugcuucuuucauuuccuuuucuucuuucaccuc

SEQ ID NO: 217428 - RNA, 64 nt, Homo Sapiens
ucccuuauuucuuugcuucuuuuuucuccuuuucuucuuucaccacauuucucuuucucuuuau

SEQ ID NO: 217429 - RNA, 64 nt, Homo Sapiens
ucgcugauccauauuaccaaaggaacuuaaaauuuucuuucaugcugccuuuaauguguuuuug

SEQ ID NO: 217430 - RNA, 64 nt, Homo Sapiens
ugauugcauugaucuaugcaauuucguuugaauuuucuuucauaugauuuacuuauuuuuccaa

SEQ ID NO: 217431 - RNA, 64 nt, Homo Sapiens
aauauuaaauauauuuuagugacagagugccaacuucuuucaucaggaaaccuuauucaggagg

SEQ ID NO: 217432 - RNA, 64 nt, Homo Sapiens
uauuucuuaaggggguagggaaaauuaguucccauucuuucaacccccuuaacuguauagcucu

SEQ ID NO: 217433 - RNA, 64 nt, Homo Sapiens
agaccaagauauaauuuuuuaaaaauaaguuuauuucuuucaagguuuacaaauaacaaaggug

SEQ ID NO: 217434 - RNA, 64 nt, Homo Sapiens
uaugugauuguuuuuuaauugcuguaggauccuguucuuucagcaggugaaaaauaaaacgcag

SEQ ID NO: 217435 - RNA, 64 nt, Homo Sapiens
aaaguaguuguucacaaaagaauucgccauggaauucuuucaguuaccaagcucuccugguaau

SEQ ID NO: 217436 - RNA, 64 nt, Homo Sapiens
auuggcaugaaauggccaacuguggcuguuacaguucuuucauucaauuauaacuuguaaacca

SEQ ID NO: 217437 - RNA, 64 nt, Homo Sapiens
aucaaacauuucaacuagguaucagaaaaaggcuuucuuucauaagacuauuuuaaauagaaau

SEQ ID NO: 217438 - RNA, 64 nt, Homo Sapiens
cugacgcccucuccaugccccacaguaauguggcuucuuucauggguuuuuuuuucuucuuuuu

SEQ ID NO: 217439 - RNA, 64 nt, Homo Sapiens
aaggcagguucaaaauucuggcuuucuaauuuuuuucuuucacauucuguguggguauaauaua

SEQ ID NO: 217440 - RNA, 64 nt, Homo Sapiens
uuuguagauuacauuuaauauucucuuuauguuauucuuucacuauuaagaauuaccuuucauu

SEQ ID NO: 217441 - RNA, 64 nt, Homo Sapiens
ugugucugacauguuugugcccagucuauuuccauucuuucagcucagugccuuccucucucua

SEQ ID NO: 217442 - RNA, 64 nt, Homo Sapiens
ucuucaugcgugcccuuuucuuaccaaggaugaauucuuucaaugccacaagaccuagccuaau

SEQ ID NO: 217443 - RNA, 64 nt, Homo Sapiens
ugccaagauucaagcagucggagcagccagaacuuucuuucacgguuacuguuccugaaaagaa

SEQ ID NO: 217444 - RNA, 64 nt, Homo Sapiens
auuugagaguacaggugcauauuaauuuucuugguucuuucagcugaauuauauugguccagaa

SEQ ID NO: 217445 - RNA, 64 nt, Homo Sapiens
ucucagacagcauaaaugcuguuuuagcacuggauucuuucacugagcacaaagaguuguuggg

SEQ ID NO: 217446 - RNA, 64 nt, Homo Sapiens
aauuuuacuggaacuauugaauaaaucuuuuauuuucuuucagguuuacuugauaguggauaca

SEQ ID NO: 217447 - RNA, 64 nt, Homo Sapiens
aauguggugaugaaauugccagguugucugauauuucuuucagacuucgccagacagauugcug

SEQ ID NO: 217448 - RNA, 64 nt, Homo Sapiens
uuuagacaauugucuuuuuuucaagaugcuuuguuucuuucauaugaaaaaaaugcauuuuaua

SEQ ID NO: 217449 - RNA, 64 nt, Homo Sapiens
ugucaauauuaauaagaaaaggcuugcaucgcuauucuuucacccucuuacugaguaaaccaga

SEQ ID NO: 217450 - RNA, 64 nt, Homo Sapiens
cuguaaacuaauuccauuugaauuauaugcaacauucuuucauuuaaauucuguauuaaaaugg

SEQ ID NO: 217451 - RNA, 64 nt, Homo Sapiens
guuuuauuaccuuuuauugucuguucuucuuuucuucuuucauuucaguggcauuuggaagcaa

SEQ ID NO: 217452 - RNA, 64 nt, Homo Sapiens
gcauuuggaagcaaagagugcuaggcaccugcuguucuuucaggaaacagcuuggcugugguaa

SEQ ID NO: 217453 - RNA, 64 nt, Homo Sapiens
acuuuuuaaguuuuuuuuccuucauuuccucggauucuuucaccuuuaccugcacaugcuuucu

SEQ ID NO: 217454 - RNA, 64 nt, Homo Sapiens
uccucggauucuuucaccacuaccugcacaugcuuucuuucauuguccuugcccugccucaguu

SEQ ID NO: 217455 - RNA, 64 nt, Homo Sapiens
acuuuuucuuuguuugauuuuuucccuaucugguuucuuucaaucucaguagauaagguguauu

SEQ ID NO: 217456 - RNA, 64 nt, Homo Sapiens
gcaugucuacuggcaacuaaacuucuuuuaaugcuucuuucaagcuuuuccuucccuccagaga

SEQ ID NO: 217457 - RNA, 64 nt, Homo Sapiens
agucuaaaaguuagaaauauauggccucagacauuucuuucaucguauuucuuuuuugcauuua

SEQ ID NO: 217458 - RNA, 64 nt, Homo Sapiens
ugccgaauguuauuagaaucaaaacacuuggugauucuuucaagccagaaaaccgcuuuuuaaa

SEQ ID NO: 217459 - RNA, 64 nt, Homo Sapiens
uacaucuacuaagagcucgugacaacaaaacccauucuuucaguaaaauuucucaaacuuacuu

SEQ ID NO: 217460 - RNA, 51 nt, Homo Sapiens
guuugcuuuuuaaagcaaaguuucuuucaaaaauuaugugaagaaaauuaa

SEQ ID NO: 217461 - RNA, 64 nt, Homo Sapiens
aaagcuucauugacaccugcaugagaugcagccauucuuucagcacauacucucuucaaagagc

SEQ ID NO: 217462 - RNA, 64 nt, Homo Sapiens
agacugaucaggaccuccaaacugaggcauccacuucuuucagcaaucccguaacaccugauua

SEQ ID NO: 217463 - RNA, 64 nt, Homo Sapiens
cuccaagaugagaaaggagcaugggacagagagcuucuuucagcaccuccugccccagcauuuc

SEQ ID NO: 217464 - RNA, 64 nt, Homo Sapiens
uuuguucucuaaaaccacacuaaaguuuucugacuucuuucacacucuuuaugauaauccucug

SEQ ID NO: 217465 - RNA, 64 nt, Homo Sapiens
cugacuacagcauggaaaaaaauaguucuuuuaauucuuucaccuuaaagcauauuuuaugucu

SEQ ID NO: 217466 - RNA, 64 nt, Homo Sapiens
gguuuucaggauauaacagcacuucaccgaaauauucuuucagccauaccacugguaacauuuc

SEQ ID NO: 217467 - RNA, 64 nt, Homo Sapiens
ugcuuuggaaguuuuaaucuaaggugaacauugguucuuucauuugccaacuuuccccacguua

SEQ ID NO: 217468 - RNA, 64 nt, Homo Sapiens
uaaguuaguuccacugagacugccugucuuaauuuucuuucacuaaaacaaaggccuaauucua

SEQ ID NO: 217469 - RNA, 64 nt, Homo Sapiens
uagaggcaaaacugcuuuuuuugacauggugcuuuucuuucaucuagccaauagaaaaguuugc

SEQ ID NO: 217470 - RNA, 64 nt, Homo Sapiens
aucguagcuuaaacucuguuuuauuaaaaucuucuucuuucacuuaucuacaauuuuuucagga

SEQ ID NO: 217471 - RNA, 64 nt, Homo Sapiens
uuuacagaacuguauuauaacuuuuuccugacaguucuuucagccaaaaaaaguaacacccucc

SEQ ID NO: 217472 - RNA, 64 nt, Homo Sapiens
acuacacaugaaugaauccaauuguuugaguacauucuuucaacagguguuuaugucuuaauua

SEQ ID NO: 217473 - RNA, 64 nt, Homo Sapiens
cauaugagguccuaaugaaguacuacaguuuucauucuuucaaggguagacuaaaauauaguuu

SEQ ID NO: 217474 - RNA, 64 nt, Homo Sapiens
aauacuguacuucauuuaacagaaugauugauuuuucuuucaaucagcauguucaccaaaaaua

SEQ ID NO: 217475 - RNA, 64 nt, Homo Sapiens
cucuccucugcaauccuggaagcaucgugcauaguucuuucauuguaagccgcuauuuaaauuc

SEQ ID NO: 217476 - RNA, 64 nt, Homo Sapiens
cucauaauuagcccaaaacaugugauauaagguuuucuuucauaggcuuacaugaacgugaaac

SEQ ID NO: 217477 - RNA, 64 nt, Homo Sapiens
uuuuucugccucuuacuauaaagauuauuuaaaauucuuucauucuggcccuguagacacgugu

SEQ ID NO: 217478 - RNA, 64 nt, Homo Sapiens
uagucaacauuuuauauaauguuucaauaaauguuucuuucaauaaagauacuaugugcccuuc

SEQ ID NO: 217479 - RNA, 64 nt, Homo Sapiens
ccacauuguuuuaauugauuuuucuuaucuugauuucuuucauuagaaacuaucccuaaaugua

SEQ ID NO: 217480 - RNA, 64 nt, Homo Sapiens
guuauuagaaggaaauacaaagagaaaaauuucuuucuuucaugggcauuugauaauuucaguc

SEQ ID NO: 217481 - RNA, 64 nt, Homo Sapiens
agagugguguuuacuaugugugugcuugagcauuuucuuucaguuacauggguguaauuuaaaa

SEQ ID NO: 217482 - RNA, 64 nt, Homo Sapiens
guguuuuccaguuuaaagcaauaacuuucauaguuucuuucaaaguuuaauacauccaauaugu

SEQ ID NO: 217483 - RNA, 64 nt, Homo Sapiens
ugaaaaaacuccaaaauuccaauuuugccuuguauucuuucacuauuauggauauuauauauga

SEQ ID NO: 217484 - RNA, 64 nt, Homo Sapiens
uuuuuuuuaaaagccaacuauguguuacgagguauucuuucaaauaccaauuuagacucuaguu

SEQ ID NO: 217485 - RNA, 64 nt, Homo Sapiens
ugaaauuuauuauuuuauuaauuuugcucgcuuguucuuucaggcuuugugaauuuccuugucu

SEQ ID NO: 217486 - RNA, 64 nt, Homo Sapiens
agcuuucucuguuuuucuauauuaauauagugaguucuuucagggugccugcaaccaaaugaaa

SEQ ID NO: 217487 - RNA, 64 nt, Homo Sapiens
uagaaaucuacauguauauauggagcugaaucuuuucuuucaugagggucagcccuuuucuauu

SEQ ID NO: 217488 - RNA, 64 nt, Homo Sapiens
aaaaugaucauccaucuuuuuuuucagggugcacuucuuucaucauauucuaaacuggcaaaaa

SEQ ID NO: 217489 - RNA, 61 nt, Homo Sapiens
auuaggcacgacccaucugugguuccugguugguggcuaaugaagugaggggagggaggga

SEQ ID NO: 217490 - RNA, 61 nt, Homo Sapiens
cuuucugacuaagcuaaaaaugaaugaaaaugguggcuaaagaaaauagggacucugaaga

SEQ ID NO: 217491 - RNA, 61 nt, Homo Sapiens
uuugaaagguuauuaugcacuaaccuuuuuugguggcuaauuaggguuuaaauacagaaac

SEQ ID NO: 217492 - RNA, 61 nt, Homo Sapiens
cagacuugucacugacuuuccuucuggagcagguggcuagaaaaagaggcugugggcagga

SEQ ID NO: 217493 - RNA, 61 nt, Homo Sapiens
uuucacccaugggcauggucagguagccucugguggcuaugcauuuauuacucaaaaguug

SEQ ID NO: 217494 - RNA, 61 nt, Homo Sapiens
agcugugggcaggcaagcccuucagucaccugguggcuaauuagaccccuccccuuguguc

SEQ ID NO: 217495 - RNA, 61 nt, Homo Sapiens
gccacccguucugcuggccucuaucccaggagguggcuaugaacuaugaacuacaaagcuu

SEQ ID NO: 217496 - RNA, 61 nt, Homo Sapiens
acagagaggaaugucuucgaucauagcugcagguggcuauaagcagagaugaauggcaaac

SEQ ID NO: 217497 - RNA, 61 nt, Homo Sapiens
ugggaggcagcaagaugugaauacuccuguugguggcuauuguucagauaucggggcuuuc

SEQ ID NO: 217498 - RNA, 61 nt, Homo Sapiens
cugaccaauaaaguuauuuuaaagcaugagugguggcuaacaaaggauccuuauuacagga

SEQ ID NO: 217499 - RNA, 61 nt, Homo Sapiens
gggcucuaccugagaaggacggcaaggcugagguggcuaagggggaccauggggagguggc

SEQ ID NO: 217500 - RNA, 61 nt, Homo Sapiens
gcacaggggaugauuacccuccuaggaccgcgguggcuaagucauugcaggaacggggcug

SEQ ID NO: 217501 - RNA, 61 nt, Homo Sapiens
ccagggagggacccaccagagcacaagagaagguggcuaccugggggugucccagggacuc

SEQ ID NO: 217502 - RNA, 61 nt, Homo Sapiens
caacagguuugaggccccacuggucaucugagguggcuacuggaacucuggagguggguuc

SEQ ID NO: 217503 - RNA, 61 nt, Homo Sapiens
gccgcugcacuauccuuuucagaggaugcacgguggcuagaaggcccuucagagccagggc

SEQ ID NO: 217504 - RNA, 61 nt, Homo Sapiens
aaauguuacauucuuuguuaccuaauuacuugguggcuaaucaauauaauugaugcuaucu

SEQ ID NO: 217505 - RNA, 61 nt, Homo Sapiens
ggauuagacagcacgagucucacauguggcugguggcuacuauuuuuaagugcucaguagc

SEQ ID NO: 217506 - RNA, 61 nt, Homo Sapiens
gggcucucuggucucaggccagcuggcgauggguggcuagagugaugaacucaagcccugu

SEQ ID NO: 217507 - RNA, 61 nt, Homo Sapiens
aucucaguacccaguguuuuagccaugcucggguggcuaaauuacauccaggaauggugcc

SEQ ID NO: 217508 - RNA, 61 nt, Homo Sapiens
uccacuggacugugaagacucuagacccauggguggcuaaaggcuucugccacccugagcc

SEQ ID NO: 217509 - RNA, 61 nt, Homo Sapiens
acaaagcaguacugcaguaugcuuugcaccugguggcuauuuuucccucugguucuuccug

SEQ ID NO: 217510 - RNA, 61 nt, Homo Sapiens
cgccaggccuuccaccuuugaaggcaugauggguggcuaucagccaagaaagcagaauaug

SEQ ID NO: 217511 - RNA, 61 nt, Homo Sapiens
cagugcggggaggcccugccugcaucauccugguggcuagccacaucuggggugcaacguc

SEQ ID NO: 217512 - RNA, 61 nt, Homo Sapiens
gaugguagaacuaaacaauaacuaagaauuagguggcuacauccugcuccagaaucgcuag

SEQ ID NO: 217513 - RNA, 61 nt, Homo Sapiens
cuuuguguugguguguaauuuuuguacucuugguggcuaguuuuugucaaaucuuuuuugg

SEQ ID NO: 217514 - RNA, 61 nt, Homo Sapiens
caagcugccccugacagcacagggccugggggguggcuaacgagagaggccuuacagugcc

SEQ ID NO: 217515 - RNA, 61 nt, Homo Sapiens
ucaugaaauagaaacguguuuggcacuuguggguggcuauuuugauuuggcaugacuacuu

SEQ ID NO: 217516 - RNA, 61 nt, Homo Sapiens
uucagccuccucgucuccacuccagagaggagguggcuaugucuucuuaagccucuggccc

SEQ ID NO: 217517 - RNA, 61 nt, Homo Sapiens
gcacuguugcuuuaagaacaaggccuuuggagguggcuaaacuugcacgcacgugugugaa

SEQ ID NO: 217518 - RNA, 61 nt, Homo Sapiens
aaaacuaaggaacaagaaugagucucuuuuugguggcuaaguagaaucuuccuaaaaccau

SEQ ID NO: 217519 - RNA, 61 nt, Homo Sapiens
uaagugaaaaaagccugcuagcuguguguaagguggcuagcuuggcacaccugacuugugg

SEQ ID NO: 217520 - RNA, 61 nt, Homo Sapiens
ggucagacugaagucaccagggaacuaugcagguggcuagugagaugccaagaagggcuau

SEQ ID NO: 217521 - RNA, 61 nt, Homo Sapiens
ucccucuggccuaagguaggauccugaguuugguggcuacuccuccccucugaccagggac

SEQ ID NO: 217522 - RNA, 61 nt, Homo Sapiens
aaauuagaaacaccauucauaacuugacccagguggcuagcauaaauacacuuccugcuua

SEQ ID NO: 217523 - RNA, 61 nt, Homo Sapiens
guaacuaaccucagcaggcccagugaaaagggguggcuagacuggugcucagcuuccccau

SEQ ID NO: 217524 - RNA, 61 nt, Homo Sapiens
ccagagagcugggagggaccaagguuguaaggguggcuaagucccaccauaacagcuaagg

SEQ ID NO: 217525 - RNA, 61 nt, Homo Sapiens
ccgugucugucagacugucugccuguccugggguggcuaggagcugggucugaccguugua

SEQ ID NO: 217526 - RNA, 61 nt, Homo Sapiens
uugucuugguaauugcaauuuaacuaggugcgguggcuacuaaaguucgaaggcacgauau

SEQ ID NO: 217527 - RNA, 61 nt, Homo Sapiens
caagcuccuccucccugcaugucugcauuucgguggcuaguuaaggggcccggccagccau

SEQ ID NO: 217528 - RNA, 61 nt, Homo Sapiens
ugugcauuguaggauaauuagcaguaucccugguggcuacccaauagacgccaguagcacc

SEQ ID NO: 217529 - RNA, 61 nt, Homo Sapiens
ggcauggggugggggaaacuuggaguuggaagguggcuaaucuuugauucuauguuuuuga

SEQ ID NO: 217530 - RNA, 61 nt, Homo Sapiens
ccugaccccgaggacuuggucuggucucucugguggcuacaaccccagaguuuuaaggacu

SEQ ID NO: 217531 - RNA, 52 nt, Homo Sapiens
aaaaggaauggcucauuugagggguggcuacuuggcuaugggauagggagga

SEQ ID NO: 217532 - RNA, 61 nt, Homo Sapiens
aagcucacggcugaagauucguccccaucaugguggcuaugagggccccaugccagucagu

SEQ ID NO: 217533 - RNA, 61 nt, Homo Sapiens
ccagcuauuccaucucaaaagguuuggaacugguggcuaugacugggcguggcugauugag

SEQ ID NO: 217534 - RNA, 61 nt, Homo Sapiens
guggauggaucgcuugagccccaccugcucagguggcuagggucuuuaugugccuggaauc

SEQ ID NO: 217535 - RNA, 61 nt, Homo Sapiens
cugucuuguggguauuaaugcaaucuucagugguggcuacuguucucuagcuguucuacaa

SEQ ID NO: 217536 - RNA, 61 nt, Homo Sapiens
caauaaaucugccaucuuugaacucaucuuugguggcuagacugcuacggcagcuucucug

SEQ ID NO: 217537 - RNA, 61 nt, Homo Sapiens
caaacugacccucuugggacauagcucugaugguggcuacaacuuggucccacguccuccu

SEQ ID NO: 217538 - RNA, 61 nt, Homo Sapiens
uuuaucuugggugauggagguaacaaaaaaggguggcuagaguugaaagaaaaggcacagu

SEQ ID NO: 217539 - RNA, 61 nt, Homo Sapiens
aaucuuccgauggaugaaucugacuggaccugguggcuacggaaagugcauaugaaauccu

SEQ ID NO: 217540 - RNA, 61 nt, Homo Sapiens
cuggaucaucgcaggcaccaacuacuccaaagguggcuaugccaggggacagcagcaggag

SEQ ID NO: 217541 - RNA, 61 nt, Homo Sapiens
aggaacacuuuuugugugauugaagcuaaaugguggcuaaaauuuuccagucuucguugug

SEQ ID NO: 217542 - RNA, 61 nt, Homo Sapiens
ccugaggagucaccauaaggggauuuaagaugguggcuauccccagcugggccccauuccu

SEQ ID NO: 217543 - RNA, 61 nt, Homo Sapiens
accuauaauucccagcacuugggcugggcgcgguggcuaacuuaucuaaaagccugcuuca

SEQ ID NO: 217544 - RNA, 61 nt, Homo Sapiens
ggccauaugcagggaaugguucccaccccaggguggcuagucugucugucuagacaggcug

SEQ ID NO: 217545 - RNA, 61 nt, Homo Sapiens
agcuuagacauccaaaacuaaucaaugcugagguggcuaaauaccuagccuuuuacaugua

SEQ ID NO: 217546 - RNA, 61 nt, Homo Sapiens
gaguauuuugagaugagcccacaccaaaggagguggcuaaagugauuaacaaugucuccaa

SEQ ID NO: 217547 - RNA, 61 nt, Homo Sapiens
aauacaaaaaguuagccgggagaccaggcgcgguggcuaaacaguaauuaauaaccuucca

SEQ ID NO: 217548 - RNA, 61 nt, Homo Sapiens
aaugcaacuuguauaaaacagccaaugaugugguggcuagacuauucuucuggaauaagau

SEQ ID NO: 217549 - RNA, 61 nt, Homo Sapiens
aauaaaacuccuuaggaaaauggguuuccaugguggcuaucuauucuuccauaagaccaug

SEQ ID NO: 217550 - RNA, 61 nt, Homo Sapiens
ccuucugcuuagagaaagaaggggagaaaaugguggcuaucugcccaccacgcagcaguca

SEQ ID NO: 217551 - RNA, 61 nt, Homo Sapiens
cucaaaaaggacacaaccaguuuggggaagggguggcuaaggaagaugguauaggugaagg

SEQ ID NO: 217552 - RNA, 61 nt, Homo Sapiens
gccuggcuugcuguggcuaugggaaucagcugguggcuagguuucuagcgcauuugauuuc

SEQ ID NO: 217553 - RNA, 61 nt, Homo Sapiens
cugauagccuuuggugaugucacugcugggagguggcuauccuguggaccaccuggccucc

SEQ ID NO: 217554 - RNA, 61 nt, Homo Sapiens
ucuuucacuuccagcuugcccuguucuaggugguggcuaaaucugggccuaaucugggugg

SEQ ID NO: 217555 - RNA, 61 nt, Homo Sapiens
aauuaaugaaaaaauuuucaucauuaauuuagguggcuagguggaugcugagcauucuuac

SEQ ID NO: 217556 - RNA, 61 nt, Homo Sapiens
uugccucauuuugcauccuuugggccaguuggguggcuaggucauuuccccccuugaccac

SEQ ID NO: 217557 - RNA, 53 nt, Homo Sapiens
gccaguguuguagcaacugaggggguggcuagcagcaaacaaguauggagcua

SEQ ID NO: 217558 - RNA, 61 nt, Homo Sapiens
acugacuugacacguuuguaaaugguagaacgguggcuacugugaguggggagcagaaccg

SEQ ID NO: 217559 - RNA, 61 nt, Homo Sapiens
agaaaugucauguggcuaccuguaacuugaagguggcuacaaagaugacuguggacguggg

SEQ ID NO: 217560 - RNA, 61 nt, Homo Sapiens
caauuucccuuucguugggagugggcagugggguggcuaauugucuucggccaaccagggg

SEQ ID NO: 217561 - RNA, 61 nt, Homo Sapiens
ccccaucaccuacucacacaggcauuuccuggguggcuacucugugccagagccuggggcu

SEQ ID NO: 217562 - RNA, 61 nt, Homo Sapiens
gggcuucaguuauccuuugauguccugcagggguggcuaaugugcugggguuuuucugugu

SEQ ID NO: 217563 - RNA, 61 nt, Homo Sapiens
uuuuacuaaggaaaauaacuagucauacuuugguggcuaaguauagguuugugacacaaga

SEQ ID NO: 217564 - RNA, 61 nt, Homo Sapiens
gccuguaauccugacacuuuaggccagguacgguggcuaacaucuuguaaaaacugggagc

SEQ ID NO: 217565 - RNA, 61 nt, Homo Sapiens
cagagagaguguuugggggugggcagucucggguggcuagugagugugggaagggagagcg

SEQ ID NO: 217566 - RNA, 61 nt, Homo Sapiens
auccuagcacuuugggaggcagacgaggugcgguggcuauaacauuuaaaaggcuauuuca

SEQ ID NO: 217567 - RNA, 61 nt, Homo Sapiens
uuagugggagcaguucaccuugugacugaaugguggcuagagaggaaacgaggacguaggg

SEQ ID NO: 217568 - RNA, 61 nt, Homo Sapiens
gguacuucguggccgcacauuuugcagccuggguggcuaugauuuauccaccuccaucuuc

SEQ ID NO: 217569 - RNA, 61 nt, Homo Sapiens
caaaguuuagaauuuuuguccuuuuaacauagguggcuagccauaugcagugccuuuuuuc

SEQ ID NO: 217570 - RNA, 61 nt, Homo Sapiens
uguuauuuucacugucuuuuucagagggaaggguggcuaugugcugugcuucccacccuug

SEQ ID NO: 217571 - RNA, 61 nt, Homo Sapiens
agcccugcccccuuucccuccuuccuggagugguggcuacagaagcuuggggccaacccug

SEQ ID NO: 217572 - RNA, 61 nt, Homo Sapiens
uggggccuggggcagaggaggugggcacagggguggcuaguugaaggcacagggccugcua

SEQ ID NO: 217573 - RNA, 61 nt, Homo Sapiens
aggucuuccuguguugcccaggcuggagugcgguggcuauucacagaugcuaucauagcac

SEQ ID NO: 217574 - RNA, 61 nt, Homo Sapiens
cugaaauugcuuugguccucauagagccugugguggcuacuuuuggucugaaacccacuug

SEQ ID NO: 217575 - RNA, 61 nt, Homo Sapiens
gguaucaguucucugauccacgaggaaaggagguggcuaguuauuuagcaaaugcauacaa

SEQ ID NO: 217576 - RNA, 61 nt, Homo Sapiens
gugucaauggaggaucugggaugacgaaaaggguggcuacaaguccacgcugacauacaga

SEQ ID NO: 217577 - RNA, 61 nt, Homo Sapiens
gcccuccuuaggaagcccagcaacaucgcuggguggcuacgaccugguggauggaguugac

SEQ ID NO: 217578 - RNA, 61 nt, Homo Sapiens
gagaauacuuguugauuucugaugugcaggggguggcuacagaaaagccccuuucuuccuc

SEQ ID NO: 217579 - RNA, 61 nt, Homo Sapiens
agagggucacuuuacauaggauuaaguucgagguggcuaccgauuucagcacaugcacuac

SEQ ID NO: 217580 - RNA, 61 nt, Homo Sapiens
uagagaugccucccugacccugcagagaugcgguggcuaaaggucccaaggcaaggggugc

SEQ ID NO: 217581 - RNA, 61 nt, Homo Sapiens
cccuggggauggggcggcgguagcagcuguggguggcuaauuaagauagaucgcguuagcc

SEQ ID NO: 217582 - RNA, 61 nt, Homo Sapiens
ucuaaagccgcagacccuggugcaaugcucugguggcuagggauguacucaugcucauaug

SEQ ID NO: 217583 - RNA, 61 nt, Homo Sapiens
gucuggaaaggguuacuugccuauggguucugguggcuagagagaaaaguagaaaaccaga

SEQ ID NO: 217584 - RNA, 61 nt, Homo Sapiens
gagcaaagagccagcacccugaugucccugggguggcuaggcaggaguggcguggggccaa

SEQ ID NO: 217585 - RNA, 61 nt, Homo Sapiens
agugugugugugggggucaucuugugagagggguggcuaccggguuggccacaauugaucu

SEQ ID NO: 217586 - RNA, 61 nt, Homo Sapiens
aacagucagauuagggucucucugaguucuugguggcuaaucuucuugaguucuuugcucu

SEQ ID NO: 217587 - RNA, 61 nt, Homo Sapiens
gggcuccuugagacauaccuaagacaagucggguggcuagaacuggauuuuauaggcauua

SEQ ID NO: 217588 - RNA, 61 nt, Homo Sapiens
gggagaaaaaggaaaugucuauguggcgggggguggcuagacugagacccaugaucagggg

SEQ ID NO: 217589 - RNA, 61 nt, Homo Sapiens
agagccaauaaaaggacuggugggggccggggguggcuauugugggaagucauaacccaca

SEQ ID NO: 217590 - RNA, 61 nt, Homo Sapiens
uugagaacuccagcuggugcaggguggcccagguggcuauucucugcuccagcaagcaaac

SEQ ID NO: 217591 - RNA, 61 nt, Homo Sapiens
gcagaggcugagggggcuggucggggccaaagguggcuaagccuuaccuaaguuuggacuc

SEQ ID NO: 217592 - RNA, 61 nt, Homo Sapiens
gggaagagaagaaacagaagggaaggggcgugguggcuagaugggggcaggauggcggaaa

SEQ ID NO: 217593 - RNA, 61 nt, Homo Sapiens
gggaagagaagaaacagaagggaaggggcgugguggcuagauggggggaagaugcgggaaa

SEQ ID NO: 217594 - RNA, 61 nt, Homo Sapiens
cuacuugccaugacuucacuccucugacauggguggcuauguucucccccacagguucgaa

SEQ ID NO: 217595 - RNA, 61 nt, Homo Sapiens
gguuaccuuacugaccagcccaacagccacugguggcuauucuagccauauuucaagugcu

SEQ ID NO: 217596 - RNA, 61 nt, Homo Sapiens
aauauuggauggcgaggacagcaggaacugggguggcuaucuaugugugccaggcuggcug

SEQ ID NO: 217597 - RNA, 61 nt, Homo Sapiens
aaugcaaaguuauuugcagguugaauuucuugguggcuauuagcagaagugcagaguaggg

SEQ ID NO: 217598 - RNA, 61 nt, Homo Sapiens
gucugugcucaggaagagggaaggggauggggguggcuaguaggcuccuggccucuuuggu

SEQ ID NO: 217599 - RNA, 61 nt, Homo Sapiens
cuaagagcauagaacucaaaugcuggggguagguggcuaaucucaggacugggaagauuac

SEQ ID NO: 217600 - RNA, 61 nt, Homo Sapiens
ucaugggggguggagggaggugaggugcccagguggcuauuugcccugcagagcugggagu

SEQ ID NO: 217601 - RNA, 61 nt, Homo Sapiens
ugguuggaauuucauuguaucgcauuauccagguggcuaguggcauuugauaauauagaga

SEQ ID NO: 217602 - RNA, 61 nt, Homo Sapiens
ggagaaucuuuccuugccacguccaccuuuugguggcuauuggcauuuuuuggcuuauggc

SEQ ID NO: 217603 - RNA, 61 nt, Homo Sapiens
gaacagacuggccugaggagcagcaguugcugguggcuaaugguguaaccugagauggccc

SEQ ID NO: 217604 - RNA, 61 nt, Homo Sapiens
gcuuucauugccauagucuguaaaagacuuugguggcuagaccacuuuauaccuucgcagu

SEQ ID NO: 217605 - RNA, 61 nt, Homo Sapiens
uugccaaggcugcuugugcuaccaguuugcugguggcuaacggcuugugcuugaaagucuu

SEQ ID NO: 217606 - RNA, 61 nt, Homo Sapiens
ucuuagacaugaggauauuggaacucagagagguggcuauugcauugcgcagaacgcuaca

SEQ ID NO: 217607 - RNA, 61 nt, Homo Sapiens
ccuagaagccccucacccccacuggcccacugguggcuaggucuccccuuauccuucuggu

SEQ ID NO: 217608 - RNA, 61 nt, Homo Sapiens
caucgacguuuucaaugugcgacuguuaacagguggcuauaugaauuuauacgaauacugg

SEQ ID NO: 217609 - RNA, 61 nt, Homo Sapiens
gaggauuuuggcaugcgugggcugggccggagguggcuaugggccccacccucuggcuggu

SEQ ID NO: 217610 - RNA, 64 nt, Homo Sapiens; identical to SEQ ID NO: 181517

SEQ ID NO: 217611 - RNA, 64 nt, Homo Sapiens; identical to SEQ ID NO: 181518

SEQ ID NO: 217612 - RNA, 64 nt, Homo Sapiens; identical to SEQ ID NO: 181519

SEQ ID NO: 217613 - RNA, 64 nt, Homo Sapiens; identical to SEQ ID NO: 181520

SEQ ID NO: 217614 - RNA, 64 nt, Homo Sapiens; identical to SEQ ID NO: 181521

SEQ ID NO: 217615 - RNA, 64 nt, Homo Sapiens; identical to SEQ ID NO: 181522

SEQ ID NO: 217616 - RNA, 64 nt, Homo Sapiens; identical to SEQ ID NO: 181523

SEQ ID NO: 217617 - RNA, 64 nt, Homo Sapiens; identical to SEQ ID NO: 181524

SEQ ID NO: 217618 - RNA, 64 nt, Homo Sapiens; identical to SEQ ID NO: 181525

SEQ ID NO: 217619 - RNA, 64 nt, Homo Sapiens; identical to SEQ ID NO: 181526

SEQ ID NO: 217620 - RNA, 64 nt, Homo Sapiens; identical to SEQ ID NO: 181527

SEQ ID NO: 217621 - RNA, 64 nt, Homo Sapiens; identical to SEQ ID NO: 181528

SEQ ID NO: 217622 - RNA, 64 nt, Homo Sapiens; identical to SEQ ID NO: 181529

SEQ ID NO: 217623 - RNA, 64 nt, Homo Sapiens; identical to SEQ ID NO: 181530

SEQ ID NO: 217624 - RNA, 64 nt, Homo Sapiens; identical to SEQ ID NO: 181531

SEQ ID NO: 217625 - RNA, 64 nt, Homo Sapiens; identical to SEQ ID NO: 181532

SEQ ID NO: 217626 - RNA, 64 nt, Homo Sapiens; identical to SEQ ID NO: 181533

SEQ ID NO: 217627 - RNA, 64 nt, Homo Sapiens; identical to SEQ ID NO: 181534

SEQ ID NO: 217628 - RNA, 64 nt, Homo Sapiens; identical to SEQ ID NO: 181535

SEQ ID NO: 217629 - RNA, 64 nt, Homo Sapiens; identical to SEQ ID NO: 181536

SEQ ID NO: 217630 - RNA, 64 nt, Homo Sapiens; identical to SEQ ID NO: 181537

SEQ ID NO: 217631 - RNA, 64 nt, Homo Sapiens; identical to SEQ ID NO: 181538

SEQ ID NO: 217632 - RNA, 64 nt, Homo Sapiens; identical to SEQ ID NO: 181539

SEQ ID NO: 217633 - RNA, 64 nt, Homo Sapiens; identical to SEQ ID NO: 181540

SEQ ID NO: 217634 - RNA, 64 nt, Homo Sapiens; identical to SEQ ID NO: 181541

SEQ ID NO: 217635 - RNA, 64 nt, Homo Sapiens; identical to SEQ ID NO: 181542

SEQ ID NO: 217636 - RNA, 64 nt, Homo Sapiens; identical to SEQ ID NO: 181543

SEQ ID NO: 217637 - RNA, 64 nt, Homo Sapiens; identical to SEQ ID NO: 181544

SEQ ID NO: 217638 - RNA, 64 nt, Homo Sapiens; identical to SEQ ID NO: 181545

SEQ ID NO: 217639 - RNA, 64 nt, Homo Sapiens; identical to SEQ ID NO: 181546

SEQ ID NO: 217640 - RNA, 64 nt, Homo Sapiens; identical to SEQ ID NO: 181547

SEQ ID NO: 217641 - RNA, 64 nt, Homo Sapiens; identical to SEQ ID NO: 181548

SEQ ID NO: 217642 - RNA, 53 nt, Homo Sapiens; identical to SEQ ID NO: 181549

SEQ ID NO: 217643 - RNA, 59 nt, Homo Sapiens; identical to SEQ ID NO: 181550

SEQ ID NO: 217644 - RNA, 64 nt, Homo Sapiens; identical to SEQ ID NO: 181551

SEQ ID NO: 217645 - RNA, 64 nt, Homo Sapiens; identical to SEQ ID NO: 181552

SEQ ID NO: 217646 - RNA, 64 nt, Homo Sapiens; identical to SEQ ID NO: 181553

SEQ ID NO: 217647 - RNA, 64 nt, Homo Sapiens; identical to SEQ ID NO: 181554

SEQ ID NO: 217648 - RNA, 64 nt, Homo Sapiens; identical to SEQ ID NO: 181555

SEQ ID NO: 217649 - RNA, 64 nt, Homo Sapiens; identical to SEQ ID NO: 181556

SEQ ID NO: 217650 - RNA, 64 nt, Homo Sapiens; identical to SEQ ID NO: 181557

SEQ ID NO: 217651 - RNA, 64 nt, Homo Sapiens; identical to SEQ ID NO: 181558

SEQ ID NO: 217652 - RNA, 64 nt, Homo Sapiens; identical to SEQ ID NO: 181559

SEQ ID NO: 217653 - RNA, 64 nt, Homo Sapiens; identical to SEQ ID NO: 181560

SEQ ID NO: 217654 - RNA, 64 nt, Homo Sapiens; identical to SEQ ID NO: 181561

SEQ ID NO: 217655 - RNA, 64 nt, Homo Sapiens; identical to SEQ ID NO: 181562

SEQ ID NO: 217656 - RNA, 64 nt, Homo Sapiens; identical to SEQ ID NO: 181563

SEQ ID NO: 217657 - RNA, 64 nt, Homo Sapiens; identical to SEQ ID NO: 181564

SEQ ID NO: 217658 - RNA, 64 nt, Homo Sapiens; identical to SEQ ID NO: 181565

SEQ ID NO: 217659 - RNA, 64 nt, Homo Sapiens; identical to SEQ ID NO: 181566

SEQ ID NO: 217660 - RNA, 64 nt, Homo Sapiens; identical to SEQ ID NO: 181567

SEQ ID NO: 217661 - RNA, 64 nt, Homo Sapiens; identical to SEQ ID NO: 181568

SEQ ID NO: 217662 - RNA, 64 nt, Homo Sapiens
aaggaacuugaaauguggggagugauaauaguccagugauuaaacuacaguccagugauuacca

SEQ ID NO: 217663 - RNA, 64 nt, Homo Sapiens
gagugauaauaguccagugauuaaacuacaguccagugauuaccaccaacuuucugacuaagcu

SEQ ID NO: 217664 - RNA, 64 nt, Homo Sapiens
gaugaugagugauuuuuauaguaugcauuucuguagugauuaguauucugacuggugugagaug

SEQ ID NO: 217665 - RNA, 64 nt, Homo Sapiens
aaagaauaucagggccugacguuuaaaauuaaaaagugauuaucagcaguuucauucaagaaaa

SEQ ID NO: 217666 - RNA, 64 nt, Homo Sapiens
ccucugguauagcuuuccuauuuaaucauuguauagugauuauguauaaauuguaaagguaaug

SEQ ID NO: 217667 - RNA, 64 nt, Homo Sapiens
aauuguaaagguaauguuuauauucuguaauuucagugauuauaaaaagaaaugugcauauauu

SEQ ID NO: 217668 - RNA, 64 nt, Homo Sapiens
aguacuuuccuuauuggcaacuuauggacucgcuagugauuaaacgaggcaaugacugugagcg

SEQ ID NO: 217669 - RNA, 64 nt, Homo Sapiens
gcauuggccuuaauauaccuaaaucuccaaaaacagugauuaaagcaagagaauuauuacaagg

SEQ ID NO: 217670 - RNA, 64 nt, Homo Sapiens
accuuuacaauggagacaucuaccagaucauccaagugauuaaauuuaacaucaucaaugaugg

SEQ ID NO: 217671 - RNA, 64 nt, Homo Sapiens
uggguggcggggagaaggauacaccaaaaaacuaagugauuaucuuuggaugggaaaauguuug

SEQ ID NO: 217672 - RNA, 64 nt, Homo Sapiens
cagcagggaagauauuagugggagggaagauauuagugauuagaaagacauuagugauuagaca

SEQ ID NO: 217673 - RNA, 64 nt, Homo Sapiens
caggagggaagauauuagugggaaggaagacauuagugauuagacuuaacucagugauuagaca

SEQ ID NO: 217674 - RNA, 64 nt, Homo Sapiens
caggaaggaagacauuaguguuuucccuuaacucagugauuagauccuguaaguaaaugacuau

SEQ ID NO: 217675 - RNA, 64 nt, Homo Sapiens
aauuuuaccuauuuuuauaauuauuauuucuuaaagugauuaaaugagaacauggaugagugga

SEQ ID NO: 217676 - RNA, 64 nt, Homo Sapiens
cuaaauaagauuuuaaacuaauucauauguaaaaagugauuaggaagaacuugaaguaucauuu

SEQ ID NO: 217677 - RNA, 64 nt, Homo Sapiens
cauuucuugccacuuccccaacuagaccacuccuagugauuacugacuuuagugccuaaaccuu

SEQ ID NO: 217678 - RNA, 64 nt, Homo Sapiens
cauucaggccagagacacagagaccacauagcccagugauuaaaccccgguuucacucuggccc

SEQ ID NO: 217679 - RNA, 64 nt, Homo Sapiens
gcugggggcuuccccuucauguggcaccuuugugccaggccaccaggcagacucuucccaccuu

SEQ ID NO: 217680 - RNA, 64 nt, Homo Sapiens
ucaccccaaaaguaggcccucccauuggcuuuggccaggccagacacuucacaucguuuacaug

SEQ ID NO: 217681 - RNA, 64 nt, Homo Sapiens
cgcagaagcccugccugguccaguccgggggcggccaggccaacugcaagauucuggacuguuu

SEQ ID NO: 217682 - RNA, 64 nt, Homo Sapiens
cuguuaacaccccuuugcuuuuucuaugggaccuccaggccaccauauuuagaacuaguuaccu

SEQ ID NO: 217683 - RNA, 64 nt, Homo Sapiens
guaccaccccaccugcccagggaguggaggaggcccaggccacaugcgcuuugccggacuggau

SEQ ID NO: 217684 - RNA, 64 nt, Homo Sapiens
ggccaggccuugugccguggggggccuacacguuccaggccaguaugaguuucacagugcugua

SEQ ID NO: 217685 - RNA, 64 nt, Homo Sapiens
cucccauggaauagguaggccccccuugacacauccaggccaacucuuuacuagagcugaaagg

SEQ ID NO: 217686 - RNA, 64 nt, Homo Sapiens
gugcguccagucuccuguccccccgcugccuuccccaggccacagggagcagcccagggccaag

SEQ ID NO: 217687 - RNA, 64 nt, Homo Sapiens
acccaggggagccagcgcugcacagccggaacagccaggccaugaccuagcaggagugccaggc

SEQ ID NO: 217688 - RNA, 64 nt, Homo Sapiens
gccggaacagccaggccaugaccuagcaggagugccaggccacagucgcucccacccuccgugc

SEQ ID NO: 217689 - RNA, 64 nt, Homo Sapiens
uccuauuauaaccaacucucugccauuuaaaaauccaggccagacaaccacuuuuugaauggug

SEQ ID NO: 217690 - RNA, 64 nt, Homo Sapiens
uugucguguuuguuuuaacuagcccagcacaggcccaggccacuuaucagaaggucuccuuuuu

SEQ ID NO: 217691 - RNA, 64 nt, Homo Sapiens
uuagaaugggguuuggaaguccuuucccugggagccaggccaccugcccugcccugagcugagu

SEQ ID NO: 217692 - RNA, 64 nt, Homo Sapiens
cagcccaaaauuauuucauccacggaagucuauuccaggccaacucuccugaccccauugggaa

SEQ ID NO: 217693 - RNA, 64 nt, Homo Sapiens
cggguaaggggcugggcagggccagggcugccagccaggccacuacaucgugaugggccccuca

SEQ ID NO: 217694 - RNA, 64 nt, Homo Sapiens
ugccucaccugcuguccugcgcugcugcugcaaaccaggccacucgacgaggaggacagaggcu

SEQ ID NO: 217695 - RNA, 64 nt, Homo Sapiens
aggggccgaguccaggagccccagccagcccuucccaggccagcgaggcgaggcugccucuggg

SEQ ID NO: 217696 - RNA, 64 nt, Homo Sapiens
cccugcuacuccacugaccuggaagagcuggguaccaggccacccacuguggggcaagccugag

SEQ ID NO: 217697 - RNA, 64 nt, Homo Sapiens
accccccucuucaggcugcugcaggaggccaggcccaggccagagaccccaggcagccugagcu

SEQ ID NO: 217698 - RNA, 64 nt, Homo Sapiens
ggcaggacucucuggccuucuguggccugcaaugccaggccaugugccccucugcccucuaguu

SEQ ID NO: 217699 - RNA, 64 nt, Homo Sapiens
agccacagcugggcccaccgaggugcuauccugcccaggccagcacuuggcugaguuggguugg

SEQ ID NO: 217700 - RNA, 64 nt, Homo Sapiens
uaaggagagcucugauugcagcacagagcaguggccaggccacccaaaggagcuccgccuggac

SEQ ID NO: 217701 - RNA, 64 nt, Homo Sapiens
agcuggacuacggcggcaguauggaauuccagugccaggccagugaccucauucccgagcagcc

SEQ ID NO: 217702 - RNA, 64 nt, Homo Sapiens
uggaauugaguggccaaguauggggucauggauuccaggccacaaauuccaggccuaguucagu

SEQ ID NO: 217703 - RNA, 64 nt, Homo Sapiens
cuaguucagucugggggcagggucaguccuucucccaggccagcccuugacauuaaaaaaaaug

SEQ ID NO: 217704 - RNA, 64 nt, Homo Sapiens
uaaauguggcucaguggagggagacccagcauagccaggccaguauggagcaccucacgcacag

SEQ ID NO: 217705 - RNA, 64 nt, Homo Sapiens
cugagucacuggcccaucucuuugcucuugugccccaggccagaauaaagaauagaguguagag

SEQ ID NO: 217706 - RNA, 64 nt, Homo Sapiens
agccugccuaaccaggcccagccaguugguggggccaggccaggaccacacaguccccagacuc

SEQ ID NO: 217707 - RNA, 64 nt, Homo Sapiens
agaugggugggggcuccugguggccuucugcugcccaggccacagccgccuuuggguuccaucu

SEQ ID NO: 217708 - RNA, 64 nt, Homo Sapiens
cacugggccuaggugauggcaguccauguggcugccaggccaaggcagucacaggggcccugac

SEQ ID NO: 217709 - RNA, 64 nt, Homo Sapiens
cugccaggccaaggcagucacaggggcccugaccccaggccacacagacggacaugggcccaca

SEQ ID NO: 217710 - RNA, 64 nt, Homo Sapiens
gauuugcagcugaagugggccagccuugcaccagccaggccagaccaccauggugaaggcuucu

SEQ ID NO: 217711 - RNA, 64 nt, Homo Sapiens
ugggaucucagugugccccuaccuguucuccccuccaggccaccugucucuguaaaggaugucu

SEQ ID NO: 217712 - RNA, 64 nt, Homo Sapiens
gggguggccuuucauuuggggugcccuuucacucccaggccaagcccuggagcaaucuucuuca

SEQ ID NO: 217713 - RNA, 64 nt, Homo Sapiens
agacauagauguugaauuguuuguggggggugugccaggccacgucucguguguccguaugcag

SEQ ID NO: 217714 - RNA, 58 nt, Homo Sapiens
gcaagaaggagaagaaguaacauggaggccaggccaagagccacagggcggccucucc

SEQ ID NO: 217715 - RNA, 64 nt, Homo Sapiens
ggucagcggagccccagcaggaagggugggccagccaggccauucuuagucccuggguugggga

SEQ ID NO: 217716 - RNA, 64 nt, Homo Sapiens
uagaaguuuuaaauaaugccuaagacuauacucaccaggccauuaaaaaguaaggaagcuaaac

SEQ ID NO: 217717 - RNA, 64 nt, Homo Sapiens
ucuaccuucuaaccauucucaugagccacuacguccaggccaccaaagugcugggacuacaggc

SEQ ID NO: 217718 - RNA, 64 nt, Homo Sapiens
uauggggcccuggcuguguucucccaacuucuccccaggccaagcccccaaccacugcuuaggc

SEQ ID NO: 217719 - RNA, 64 nt, Homo Sapiens
ugagucccuccauccguggagcuccacacugcggccaggccagcugcuugccucauaccucugu

SEQ ID NO: 217720 - RNA, 64 nt, Homo Sapiens
cgcacaugcuggugcccgucuuccuccuaaggggccaggccacauccaagugggccucugucgg

SEQ ID NO: 217721 - RNA, 64 nt, Homo Sapiens
aaaccagucugaauugggucugucuuugagaugcccaggccagcagaaagcagcucagaaguau

SEQ ID NO: 217722 - RNA, 64 nt, Homo Sapiens
ggaagagagggaaggacaccaagcaaaaaauguuccaggccaggauucggauucuugaauuacu

SEQ ID NO: 217723 - RNA, 64 nt, Homo Sapiens
agccagacagagcaggugcggggaagggaagggcccaggccagacccaucccaaacggaugaug

SEQ ID NO: 217724 - RNA, 64 nt, Homo Sapiens
cugcaguccacuuacuguaccaucacccucagcaccaggccaccgacagguguacgucugcacc

SEQ ID NO: 217725 - RNA, 64 nt, Homo Sapiens
aggcaguuggggaagguggggaccuauccaguagccaggccaguccccauuauguacagaauag

SEQ ID NO: 217726 - RNA, 64 nt, Homo Sapiens
gacaccccacccagguacugggguuuacuacaggccaggccaugugaacacaguggaaggcaga

SEQ ID NO: 217727 - RNA, 64 nt, Homo Sapiens
aguauuacuccacuagaucaguuuuauuuuucucccaggccagaagaaaggugugauuugacug

SEQ ID NO: 217728 - RNA, 64 nt, Homo Sapiens
uccagcaccuuccccugguuaugacagggagcucccaggccaggccacaugaccccacagguag

SEQ ID NO: 217729 - RNA, 64 nt, Homo Sapiens
caccuuccccugguuaugacagggagcucccaggccaggccacaugaccccacagguaggcuga

SEQ ID NO: 217730 - RNA, 64 nt, Homo Sapiens
cugacaagcacugcuaggcgagugccaggacuccccaggccaggccaccaggauggcccuuccc

SEQ ID NO: 217731 - RNA, 64 nt, Homo Sapiens
aagcacugcuaggcgagugccaggacuccccaggccaggccaccaggauggcccuucccacugg

SEQ ID NO: 217732 - RNA, 64 nt, Homo Sapiens
ccgcugcgguacacuggaugugagaaauccuuucccaggccaggcggucucuggaaagucaggc

SEQ ID NO: 217733 - RNA, 64 nt, Homo Sapiens
aacggcaguccuucugccuuuccccucgcaucccccaggccaccgcugcgaugugaacugcccc

SEQ ID NO: 217734 - RNA, 64 nt, Homo Sapiens
ugcccaggaaaggacggcugggggaguaaacggcccaggccaggauccaucacagacggauacu

SEQ ID NO: 217735 - RNA, 64 nt, Homo Sapiens
ugcggccaggccugcgggccccugacgcucagccccaggccagcgcccugugggagccgcagag

SEQ ID NO: 217736 - RNA, 64 nt, Homo Sapiens
caaaaucacugccaugguucaauguucccaggccccaggccauccacuugccggcccccaccag

SEQ ID NO: 217737 - RNA, 64 nt, Homo Sapiens
uugucaggggccaggacuggccccacugcagugcccaggccagucuugagcagcagggagggcu

SEQ ID NO: 217738 - RNA, 64 nt, Homo Sapiens
uagcaugugacacaggacaggcuuugcuauauccccaggccaaauuguuguuuaguuacauuag

SEQ ID NO: 217739 - RNA, 64 nt, Homo Sapiens
cuauucuuuuaaaguaagcugcgugagccaccagccaggccaagcgaaagugcugggauuacag

SEQ ID NO: 217740 - RNA, 64 nt, Homo Sapiens
cgucgggcuaggaggggccaagccgaagagccacccaggccacaguuccugugccugccuuccc

SEQ ID NO: 217741 - RNA, 64 nt, Homo Sapiens
uuggagcugcuccuugcaggggcgggucaguuucccaggccaugccgggguggccaucuauggu

SEQ ID NO: 217742 - RNA, 64 nt, Homo Sapiens
ugucccugugcuccaagcugcccccggcugcagcccaggccauggacaugugcaccaguaugua

SEQ ID NO: 217743 - RNA, 64 nt, Homo Sapiens
ucuggagacaagcucuuccggagugcucugggagccaggccagggugugagggaggugcagagg

SEQ ID NO: 217744 - RNA, 64 nt, Homo Sapiens
ggacuuugggggcagugagaccucacuauucucaccaggccaugggcuguguugccccucuccu

SEQ ID NO: 217745 - RNA, 64 nt, Homo Sapiens
agggagugcagagcaugucucacuagugcgccagccaggccaggcugcacugagccaguucagu

SEQ ID NO: 217746 - RNA, 64 nt, Homo Sapiens
gucacuguuaguugaagaaaagccugcuucugggccaggccauugggggugucuucugagcuca

SEQ ID NO: 217747 - RNA, 64 nt, Homo Sapiens
ggucuccagaguuuuccuguccucuagaggcaagccaggccagggagcugggagcgagcaagcu

SEQ ID NO: 217748 - RNA, 64 nt, Homo Sapiens
uugguuuuguggggagaggggaaggaucagggggccaggccagcagcucgggggccacaaggag

SEQ ID NO: 217749 - RNA, 64 nt, Homo Sapiens
uucauggcugagugcugggaagggcugagcucacccaggccagcaggugggguaucaucugcuc

SEQ ID NO: 217750 - RNA, 64 nt, Homo Sapiens
guuccuugguccauaacuggugagcuauggagacccaggccaacaaauuauccccagugauaug

SEQ ID NO: 217751 - RNA, 64 nt, Homo Sapiens
cuccuguccucucccaguucauuccuggaaccagccaggccaggcaaccaguggcccccaaagg

SEQ ID NO: 217752 - RNA, 64 nt, Homo Sapiens
gaccuccugugacaccacgccagaucacagggcaccaggccagagauagucuucuuuuuguccu

SEQ ID NO: 217753 - RNA, 64 nt, Homo Sapiens
ugccacacccccgacacuccacagcuccagggacccaggccagccugagucccugagggcagac

SEQ ID NO: 217754 - RNA, 64 nt, Homo Sapiens
ggaaaguuacuguguggauaugcaguggccaacuccaggccagugggagcgugcagccagcaug

SEQ ID NO: 217755 - RNA, 64 nt, Homo Sapiens
cccaucuggaaggagucccuaaucgcuguagcugccaggccagcgauguucugggggaggaggc

SEQ ID NO: 217756 - RNA, 64 nt, Homo Sapiens
gugugaagcuggggcagaguaugcuacgaagggaccaggccaggccacagggcucuccucccag

SEQ ID NO: 217757 - RNA, 64 nt, Homo Sapiens
aagcuggggcagaguaugcuacgaagggaccaggccaggccacagggcucuccucccagucuuu

SEQ ID NO: 217758 - RNA, 64 nt, Homo Sapiens
guccuuacauagaccuuaaaaagagcucacccuuccaggccaaugcugaagacacagcuccgcu

SEQ ID NO: 217759 - RNA, 64 nt, Homo Sapiens
cagcuccgcuugggagccugagaacccaggcuucccaggccagaguguggcuucuuaaacggca

SEQ ID NO: 217760 - RNA, 64 nt, Homo Sapiens
uucaauggugcaaucuggcuucacacucugucacccaggccaaguuuuuugagacagaaucuca

SEQ ID NO: 217761 - RNA, 64 nt, Homo Sapiens
guguagaacagcugguccaaugaaaauaacuucgccaggccaguauggcuggcuugagaugagu

SEQ ID NO: 217762 - RNA, 64 nt, Homo Sapiens
cagauguggucaccucaguccagcucuggggccuccaggccauguggcuguucccacggcccag

SEQ ID NO: 217763 - RNA, 64 nt, Homo Sapiens
gccuccuaaaggccacacccuccccacgcacuucccaggccagaauccaaacaucgggaacccu

SEQ ID NO: 217764 - RNA, 64 nt, Homo Sapiens
uuucugcauggauggucaguaggcagcgagcagcccaggccagcugaggugggaaagccacggc

SEQ ID NO: 217765 - RNA, 64 nt, Homo Sapiens
uuugacagcugccuuucugaggaggggagcaggcccaggccaagagcucuucagccagggcauu

SEQ ID NO: 217766 - RNA, 64 nt, Homo Sapiens
cuagaccagccagcuccagcucaggggucccaaaccaggccaucgagaccaugagaaggagagu

SEQ ID NO: 217767 - RNA, 64 nt, Homo Sapiens
cugcuggacaagcagagaccgcccgggagaaagcccaggccagcugcuucggaccuccgccucu

SEQ ID NO: 217768 - RNA, 64 nt, Homo Sapiens
acccaucugggugacccggggcaggccacagaggccaggccagggcuggaaggacaggccugcc

SEQ ID NO: 217769 - RNA, 64 nt, Homo Sapiens
uugaugucuugacagauugaccaucugucuccagccaggccaccccuuuccaaaauucccucuu

SEQ ID NO: 217770 - RNA, 64 nt, Homo Sapiens
uggcccaggccccuggcaguaaaaggcaaggcuuccaggccagugccucugcgccuccacaggg

SEQ ID NO: 217771 - RNA, 64 nt, Homo Sapiens
agaacccugaugaccuugaauguuguacccaucuccaggccaccgaggaaccugaguaugagaa

SEQ ID NO: 217772 - RNA, 64 nt, Homo Sapiens
acagcccucccagccaugaaucucuccaagugugccaggccaggcaccuccauagggaaaggcu

SEQ ID NO: 217773 - RNA, 64 nt, Homo Sapiens
cugggaccuaaguuuaagaaggauggcaaacuccccaggccauugcuggccguaugaucugugu

SEQ ID NO: 217774 - RNA, 64 nt, Homo Sapiens
gggccuaagugguaaaugugucucacucaucagaccaggccauugugaucgauuucacuagaug

SEQ ID NO: 217775 - RNA, 64 nt, Homo Sapiens
uccuuggucaccuccccagcgccccccggaggguccaggccacgugggugggguuucuuaguga

SEQ ID NO: 217776 - RNA, 64 nt, Homo Sapiens
aggcgggcuccuuuguacaggaacaggucccacgccaggccagcuuccugccugguccaguggg

SEQ ID NO: 217777 - RNA, 64 nt, Homo Sapiens
ucaggaauucccuggaaaagugcagcuucacccaccaggccagccacccccuuugacucugggg

SEQ ID NO: 217778 - RNA, 64 nt, Homo Sapiens
ccucccagccucugcccagggaccccugccuuccccaggccaucugcucugccgucgacacucg

SEQ ID NO: 217779 - RNA, 64 nt, Homo Sapiens
gguggcaucugccacgaaggaagcgccagccucgccaggccagcaggggcgucguuuuguugcc

SEQ ID NO: 217780 - RNA, 64 nt, Homo Sapiens
ggccaggcccuguggagacaagccggggagguggccaggccaguuguggcugcuggaucagggc

SEQ ID NO: 217781 - RNA, 64 nt, Homo Sapiens
aucugcugcuggggccccccggauagccgcagccccaggccaucacaccgcccucccuccgugg

SEQ ID NO: 217782 - RNA, 64 nt, Homo Sapiens
cauccaucuccaaguuaacagcaacgcuaggccuccaggccacgccggccaccguguccgaggc

SEQ ID NO: 217783 - RNA, 64 nt, Homo Sapiens
cacagauagcucagcugcgaccccagggguaaccccaggccaagccucaccccucucccacccu

SEQ ID NO: 217784 - RNA, 64 nt, Homo Sapiens
cuagcccagccccugcauugggggcagcauagccccaggccaccgcccccuucccucaacucua

SEQ ID NO: 217785 - RNA, 64 nt, Homo Sapiens
gagggaacccugggcagggccaggggcugguggcccaggccaggucugagggcaccucauggac

SEQ ID NO: 217786 - RNA, 64 nt, Homo Sapiens
uagaacacccaacaccaaacccaacucuuggacaccaggccaacggaacccuuuuucgacugcc

SEQ ID NO: 217787 - RNA, 64 nt, Homo Sapiens
caggcacaauccccccacccgcccucccccaaccccaggccaguaccaaauuaugguguagaca

SEQ ID NO: 217788 - RNA, 64 nt, Homo Sapiens
gcucaggaggguugggucccugggaggccggcagccaggccacagaauccacacguggaccauu

SEQ ID NO: 217789 - RNA, 64 nt, Homo Sapiens
cguggaccauugugggucccugggaggccggcagccaggccacggaauccacacguggaccauu

SEQ ID NO: 217790 - RNA, 64 nt, Homo Sapiens
auggcuuggaugcccucaggggugcugaccccugccaggccacgaauaucaggcuagagaccca

SEQ ID NO: 217791 - RNA, 64 nt, Homo Sapiens
uggcugacaauccuggaaaucuguucuccagaauccaggccaaaaaguucacagucaaaugggg

SEQ ID NO: 217792 - RNA, 64 nt, Homo Sapiens
cugaggcuucugugcuccuggcuucuuacgccguccaggccaagguaggcucaaagaagaaaaa

SEQ ID NO: 217793 - RNA, 64 nt, Homo Sapiens
aagccgauucuuuggaaguucagcagaugaaagcccaggccagggaggagaaggcuagaaagca

SEQ ID NO: 217794 - RNA, 64 nt, Homo Sapiens
uggcaugcagcgaagcagcccagcccggcggaucccaggccagcacgccugccggcuucucauc

SEQ ID NO: 217795 - RNA, 64 nt, Homo Sapiens
ccaaagacccugagggucugagcagcuagaaguccuagacaaagaacuuguggaugacuuuugu

SEQ ID NO: 217796 - RNA, 64 nt, Homo Sapiens
aggcaaagggacaauuaucacugcaugucaucuccuagacaaucagucaaauagagcugguggc

SEQ ID NO: 217797 - RNA, 64 nt, Homo Sapiens
aacucauauaucagucucucacauggccacaauucuagacaaaaaccaaagacccagaggccag

SEQ ID NO: 217798 - RNA, 64 nt, Homo Sapiens
cuguuacacauaguuuuugacuugaauuaaaauacuagacaaagcagaaauguacaauuucugg

SEQ ID NO: 217799 - RNA, 64 nt, Homo Sapiens
aguauucaauccacuuuuggcugaauuccauuuguggacugaaauugaugauuaagugggguca

SEQ ID NO: 217800 - RNA, 64 nt, Homo Sapiens
cagucuuaccugagacuggacucccuugcauuucuggacugaacuaaggauucaggagaagcau

SEQ ID NO: 217801 - RNA, 64 nt, Homo Sapiens
acauugaugugauucuugaaucauauuggacugauggacugaaaaagaaauagaguugcuccau

SEQ ID NO: 217802 - RNA, 64 nt, Homo Sapiens
gacugaaaacauugaugugaugcuccauucauauuggacugaugagaagaaaaagaaauagagu

SEQ ID NO: 217803 - RNA, 64 nt, Homo Sapiens
aaagacugcagaacccccagcuaagauagaaagcuggacugaccacugcggaagccaaaggcag

SEQ ID NO: 217804 - RNA, 64 nt, Homo Sapiens
acaccaaccaggccuucaucgcagaagcauugccuggacugacccugggcuucauuccggacug

SEQ ID NO: 217805 - RNA, 64 nt, Homo Sapiens
ggggcacauccagucuccaucgugcugcagcagcuggacugagggcagagccuguaggugcaga

SEQ ID NO: 217806 - RNA, 64 nt, Homo Sapiens
uucccuccugugucaaguagcuaacugcagcagcuggacugagggcagagucugugggugcaga

SEQ ID NO: 217807 - RNA, 64 nt, Homo Sapiens
uuaacccgcugcacaacaccuuuucuugcuuuacuggacugauugaugaagcucucucuaaaua

SEQ ID NO: 217808 - RNA, 64 nt, Homo Sapiens
aaugacccccaaaauucguacauauuaaguacuuuggacugaacauguggaaagagaaaagaau

SEQ ID NO: 217809 - RNA, 64 nt, Homo Sapiens
guguuuuaaagguagaguuaacagaauauacugguggacugaauguagguugagagaggaagcg

SEQ ID NO: 217810 - RNA, 64 nt, Homo Sapiens
ugcucaccucagcaaaaguuaagacagcuguaaauggacugaucuacaaaaagguaaaaauucc

SEQ ID NO: 217811 - RNA, 64 nt, Homo Sapiens
aggccagagaagguggcaugggccugaacccaccuggacugacuucugcacugaagccacagau

SEQ ID NO: 217812 - RNA, 64 nt, Homo Sapiens
ccagcuguuucuaguuaccaccuaccccuggccguggacugaucagaccagcauucaaaauaaa

SEQ ID NO: 217813 - RNA, 64 nt, Homo Sapiens
cccaagugcauacucggguucucugccugaagacaggaaacaggcucuuagcuuuaguuuaucu

SEQ ID NO: 217814 - RNA, 64 nt, Homo Sapiens
aauacuuauauauacacagaacagaaacaaguuaaggaaacaaacuccuaguugugugugggca

SEQ ID NO: 217815 - RNA, 64 nt, Homo Sapiens
accugcugaggcacagacuuccaccaugugcaucaggaaacaccucacucauacugucauauaa

SEQ ID NO: 217816 - RNA, 64 nt, Homo Sapiens
uuuuuaaguacaaaaaaguuuaagauugcaaggaaggaaacaauggucacaaggucuuuacuua

SEQ ID NO: 217817 - RNA, 64 nt, Homo Sapiens
cacuuugagggaaacccuggugcagccagcccugaggaaacauggccugagugcccucacuggu

SEQ ID NO: 217818 - RNA, 64 nt, Homo Sapiens
aaacuuggugaauagucccagugcuaggucauauaggaaacagaaagcaugacaguggccuuuu

SEQ ID NO: 217819 - RNA, 64 nt, Homo Sapiens
acucucacuaacauugcuuccuuuuuugaccagcaggaaacagcaggucuggccagauucucac

SEQ ID NO: 217820 - RNA, 64 nt, Homo Sapiens
gccaguguuuugaucugggcucugagcacaagucaggaaacaccaacauauucacacucuccca

SEQ ID NO: 217821 - RNA, 64 nt, Homo Sapiens
agagacugaauuaauaauucuuauguuucuuccaaggaaacaggaguaaguucuucucauuuca

SEQ ID NO: 217822 - RNA, 64 nt, Homo Sapiens
gcucuuccucaccugucacauucacuucauccacaggaaacacuagcuucagcaccucaguaac

SEQ ID NO: 217823 - RNA, 64 nt, Homo Sapiens
cuguugauagaccuggaauuucugccccauguugaggaaacaauuguaagaagcagaggccauu

SEQ ID NO: 217824 - RNA, 64 nt, Homo Sapiens
uauuaugguaauacaaagaacucuuuguuuuuaaaggaaacaucauuauugccucauaaacucu

SEQ ID NO: 217825 - RNA, 64 nt, Homo Sapiens
guauagaaguagauuaagagccauauaaguuugaaggaaacaguuaauaccauuuuuuaaggaa

SEQ ID NO: 217826 - RNA, 64 nt, Homo Sapiens
uaaguuugaaggaaacaguuaauaccauuuuuuaaggaaacaauauaaccacaaagcacaguuu

SEQ ID NO: 217827 - RNA, 64 nt, Homo Sapiens
ccugucucaacuaauggaaagaccaguguagugcaggaaacagcuugcagaaagguggucagau

SEQ ID NO: 217828 - RNA, 64 nt, Homo Sapiens
gugggagaauaggaguccaguguggaccuucuuuaggaaacaguuaggcuaguaaccaaaauaa

SEQ ID NO: 217829 - RNA, 64 nt, Homo Sapiens
ggacucagaauuguagggauaauaugaaugcaggaggaaacauucugucaggcgguaugacugg

SEQ ID NO: 217830 - RNA, 64 nt, Homo Sapiens
acuugaccaagcaaaggggcugaaaaacugaauaaggaaacaacuuuauaagagaaacaguggu

SEQ ID NO: 217831 - RNA, 64 nt, Homo Sapiens
agucuguaguauuauaaaacauuccuagauauggaggaaacauagagggaggguggauauuuuu

SEQ ID NO: 217832 - RNA, 64 nt, Homo Sapiens
gucuguaaaugagcgacuuuaaaaguaaagaugcaggaaacacagaucagucuauggucccagu

SEQ ID NO: 217833 - RNA, 64 nt, Homo Sapiens
gugggacauagucuuccauugcuggcugucccugaggaaacagacaugagucuuggagguucug

SEQ ID NO: 217834 - RNA, 64 nt, Homo Sapiens
cguuucucuuucuccuucucuuucccuugagguuaggaaacagguuaaaacucagagaacucca

SEQ ID NO: 217835 - RNA, 64 nt, Homo Sapiens
caguauccaauucaauauaucuuagaaaaagcacaggaaacagaccuuaaaauuguaaccuacc

SEQ ID NO: 217836 - RNA, 64 nt, Homo Sapiens
uuggcuuagaguagagguuuuuuuuaaguuauggaggaaacauuuuuguaaaaguuuaaugacc

SEQ ID NO: 217837 - RNA, 64 nt, Homo Sapiens
acaacauucaauuugauagagucucacccaccauaggaaacaaguucaaacacuggcaccuugg

SEQ ID NO: 217838 - RNA, 64 nt, Homo Sapiens
aaagggugaaggaaauccuugcuggguuuuaaugaggaaacaggauucucaagucaucuuucuu

SEQ ID NO: 217839 - RNA, 64 nt, Homo Sapiens
gcuggaagagcugccaagggcauggauugugaugaggaaacaagucugaguucugaauggagag

SEQ ID NO: 217840 - RNA, 64 nt, Homo Sapiens
acagggucugaguucugaaucauccgagcuggcgaggaaacaguugcggggucaggggcuccag

SEQ ID NO: 217841 - RNA, 64 nt, Homo Sapiens
cauucaauacuguuauaucagaggaguaggagagaggaaacauuugacuuaucuggaaaagcaa

SEQ ID NO: 217842 - RNA, 63 nt, Homo Sapiens
ggaaaauauuaaaaggcuaacauuaaaagacuaaaggaaacagacucagaagucucuaauuua

SEQ ID NO: 217843 - RNA, 64 nt, Homo Sapiens
ugccagcucagcccguuaggaugagggugcugagaggaaacaggaaacaagacugcgaauggcg

SEQ ID NO: 217844 - RNA, 64 nt, Homo Sapiens
ucagcccguuaggaugagggugcugagaggaaacaggaaacaagacugcgaauggcgcucaggc

SEQ ID NO: 217845 - RNA, 64 nt, Homo Sapiens
uguuuuuugggcccuagagugauugaauacaugcaggaaacaaaggaaauaucaaguuccagaa

SEQ ID NO: 217846 - RNA, 64 nt, Homo Sapiens
cucagaggaauaaguggcauacauuccacaggugaggaaacaggugcuauauuguauagcauuc

SEQ ID NO: 217847 - RNA, 64 nt, Homo Sapiens
uguaccucuaagcuccuuuccuugacugaacagaaggaaacagcugcacuuuaugaaacuggca

SEQ ID NO: 217848 - RNA, 64 nt, Homo Sapiens
gaauugguucauuucuucuccagucucucuugggaggaaacaaugcuuuuuaaaacuaguguca

SEQ ID NO: 217849 - RNA, 64 nt, Homo Sapiens
augauaggauuuccuaaaguccaguuuuauauagaggaaacacuacuuaauucuuguuuuuuuc

SEQ ID NO: 217850 - RNA, 64 nt, Homo Sapiens
gucuaugauaggauuuccaaccaguuuuauauagaggaaacacugacuuacuucuuguuuuuuc

SEQ ID NO: 217851 - RNA, 64 nt, Homo Sapiens
ugcuuacuucuagagggagaagacugugcggcacaggaaacagcaaacaguggggugaucugca

SEQ ID NO: 217852 - RNA, 64 nt, Homo Sapiens
ucccuuuauaaagagugcuacaugguuuagauaaaggaaacauauaacuauugaguuacagggg

SEQ ID NO: 217853 - RNA, 64 nt, Homo Sapiens
gguaugaaacaaacuacugugucacuguccagguaggaaacaauucuuucaacuggguuuucag

SEQ ID NO: 217854 - RNA, 64 nt, Homo Sapiens
cccccaaccagagauguuaaagugagccugucccaggaaacaucuccacccaagacgucuuugg

SEQ ID NO: 217855 - RNA, 64 nt, Homo Sapiens
ccugcaaccccaacacccacaaguuuguuucucuaggaaacacauucacugucucagcuggcug

SEQ ID NO: 217856 - RNA, 64 nt, Homo Sapiens
cagcagggucuccugugagcacuaaacugcaccaaggaaacaccgggucaggugccagaccugg

SEQ ID NO: 217857 - RNA, 64 nt, Homo Sapiens
acaggcugaacgggggaggacggucaggcugcugaggaaacaccggagagaaugggggaggagg

SEQ ID NO: 217858 - RNA, 64 nt, Homo Sapiens
auguucugcuagcuuguuuuacaucaccuuagugaggaaacaaauuggcaaaggcaucucagga

SEQ ID NO: 217859 - RNA, 64 nt, Homo Sapiens
uaaugauaggcggacucccaaugggcuggaaguaaggaaacauggcaaggagccaacauaacag

SEQ ID NO: 217860 - RNA, 64 nt, Homo Sapiens
cauaggccuuacuauucaugugucugugcauccuaggaaacaaacugaacguaggaaaccuguc

SEQ ID NO: 217861 - RNA, 64 nt, Homo Sapiens
aagagauguuggaaagcccuugaacuuggucguuaggaaacauccacacugaagaggaaccuga

SEQ ID NO: 217862 - RNA, 64 nt, Homo Sapiens
gcacauacuuuaauuuuaaaaugguguuaugucuaggaaacaagguagucuaauaaaguguaaa

SEQ ID NO: 217863 - RNA, 64 nt, Homo Sapiens
uagaaaguacagccauaccuaaguaggcugacucaggaaacacuaugaccaaaaaauggagaaa

SEQ ID NO: 217864 - RNA, 64 nt, Homo Sapiens
aggugagcaguggagagaaggggggcccugcacaaggaaacagggaagagccaucgaaguuuca

SEQ ID NO: 217865 - RNA, 64 nt, Homo Sapiens
agacuuuaggaucacgugugugacuaauacagaaaggaaacauggcgucggggagagggauaaa

SEQ ID NO: 217866 - RNA, 64 nt, Homo Sapiens; identical to SEQ ID NO: 94836

SEQ ID NO: 217867 - RNA, 64 nt, Homo Sapiens; identical to SEQ ID NO: 94837

SEQ ID NO: 217868 - RNA, 64 nt, Homo Sapiens; identical to SEQ ID NO: 94838

SEQ ID NO: 217869 - RNA, 64 nt, Homo Sapiens; identical to SEQ ID NO: 94839

SEQ ID NO: 217870 - RNA, 64 nt, Homo Sapiens; identical to SEQ ID NO: 94840

SEQ ID NO: 217871 - RNA, 64 nt, Homo Sapiens; identical to SEQ ID NO: 94841

SEQ ID NO: 217872 - RNA, 64 nt, Homo Sapiens; identical to SEQ ID NO: 94842

SEQ ID NO: 217873 - RNA, 52 nt, Homo Sapiens; identical to SEQ ID NO: 94843

SEQ ID NO: 217874 - RNA, 64 nt, Homo Sapiens; identical to SEQ ID NO: 94844

SEQ ID NO: 217875 - RNA, 64 nt, Homo Sapiens; identical to SEQ ID NO: 94845

SEQ ID NO: 217876 - RNA, 64 nt, Homo Sapiens; identical to SEQ ID NO: 94846

SEQ ID NO: 217877 - RNA, 64 nt, Homo Sapiens; identical to SEQ ID NO: 94847

SEQ ID NO: 217878 - RNA, 64 nt, Homo Sapiens; identical to SEQ ID NO: 94848

SEQ ID NO: 217879 - RNA, 64 nt, Homo Sapiens; identical to SEQ ID NO: 94849

SEQ ID NO: 217880 - RNA, 64 nt, Homo Sapiens
uugcaggaaacaccauauuaauagacauccucaccaucuccauccgcucucacgccuccugcag

SEQ ID NO: 217881 - RNA, 64 nt, Homo Sapiens
aaaaauacacagcacuccccaccuuucuuucguucaucuccagggccccaccucagaucaaagc

SEQ ID NO: 217882 - RNA, 64 nt, Homo Sapiens
gucucauuugaaagugagcguuugaaugccuuuucaucuccaugguugacauagcacugggcug

SEQ ID NO: 217883 - RNA, 64 nt, Homo Sapiens
gcccccaaagaccuccguuggaaaaucccucugacaucuccacugagggcagaggaggagauca

SEQ ID NO: 217884 - RNA, 64 nt, Homo Sapiens
auuuccugcucuaauguauauucucuuuuuguuccaucuccauucaagugauucaauggacaag

SEQ ID NO: 217885 - RNA, 64 nt, Homo Sapiens
gaauguugcuaauccaaaguguuaauaguuaaaucaucuccaagauugcuaacugacaaauaaa

SEQ ID NO: 217886 - RNA, 64 nt, Homo Sapiens
guauggaaaacugauauuacuagguuuuacguugcaucuccaguauugaucuuuggaaacugau

SEQ ID NO: 217887 - RNA, 64 nt, Homo Sapiens
uauucucucauggacuucucauccuuucuuuuuucaucuccaacaguuaaaugguaaggagagc

SEQ ID NO: 217888 - RNA, 64 nt, Homo Sapiens
caacaugaauguuucugugagcucuggugucacucaucuccaugaucaucucagccaacaugca

SEQ ID NO: 217889 - RNA, 64 nt, Homo Sapiens
aucccuugggcuuuggauuuggagaugggaagagcaucuccaggcaaugaguuuuucaaagaau

SEQ ID NO: 217890 - RNA, 64 nt, Homo Sapiens
gcucaaagcagcaggacugugggaaagagccuaacaucuccauggggaggccucaccccaggga

SEQ ID NO: 217891 - RNA, 64 nt, Homo Sapiens
ucaccucuaacccccuccccucgcugcugggccccaucuccacaggagagacugguucagcucu

SEQ ID NO: 217892 - RNA, 64 nt, Homo Sapiens
ucagggagugcguggucuuggaugccauccugcucaucuccagcauuuccucucaccuccgugu

SEQ ID NO: 217893 - RNA, 64 nt, Homo Sapiens
ucggggagugcguggugucagaucccauccugcucaucuccagcauuuccucucaccucugugu

SEQ ID NO: 217894 - RNA, 64 nt, Homo Sapiens
gugaaaauuuaccuaaaaccuugguuaucaaauacaucuccaguacauuccguucuuuuuuuuu

SEQ ID NO: 217895 - RNA, 64 nt, Homo Sapiens
ugaugaaggcaucugaugccuucaucuguucagucaucuccaaaaacaguaaaaauaaccacuu

SEQ ID NO: 217896 - RNA, 64 nt, Homo Sapiens
cggggucaccuacgucaucucaucccccacaguccaucuccauuagguacagcaaggagagcuc

SEQ ID NO: 217897 - RNA, 64 nt, Homo Sapiens
auuucuauaguauaccaaccuucaaccagugugccaucuccaauauuuuaguuuuuuuuuuucu

SEQ ID NO: 217898 - RNA, 64 nt, Homo Sapiens
uagagaugguuuuacuucuuuagacagaucaugccaucuccaaaggauuucuuagaauuuucug

SEQ ID NO: 217899 - RNA, 64 nt, Homo Sapiens
uccaucccccagaccuccccagaggagacccuagcaucuccaugagaacagcuggacggagcug

SEQ ID NO: 217900 - RNA, 64 nt, Homo Sapiens
ucauccucaugcugcucaauuccuucuucaacgccaucuccacucuuguggucaucauggccag

SEQ ID NO: 217901 - RNA, 64 nt, Homo Sapiens
uggaugccaaccagagaagcugcuaccccuacaucaucuccaaccggucagaagccgccucccu

SEQ ID NO: 217902 - RNA, 64 nt, Homo Sapiens
ggagggggaauggcagcagggguuggggaaacagcaucuccaagcagcuuagaguuggccauau

SEQ ID NO: 217903 - RNA, 64 nt, Homo Sapiens
aaaaaaaaaaaaaaagccagugcccagggaugggcaucuccagggagcuggggauuagugccag

SEQ ID NO: 217904 - RNA, 64 nt, Homo Sapiens
cagacaaccuuugucuuuacgcugaacucuucuccaucuccaaguuggccccaaagcgagcuau

SEQ ID NO: 217905 - RNA, 64 nt, Homo Sapiens
cauaggauggauuuugaagcaaucccagccccagcaucuccaagagccagaaugugguuuguag

SEQ ID NO: 217906 - RNA, 64 nt, Homo Sapiens
ucccagaaaagaagauccuacaucccagaagaggcaucuccauaacuguuaucuugguaucccu

SEQ ID NO: 217907 - RNA, 64 nt, Homo Sapiens
cugucaaguuuagauaauccccccucugcagcaacaucuccaaaacaccaguaagugcuaccca

SEQ ID NO: 217908 - RNA, 64 nt, Homo Sapiens
augggccagcauggacccugggcuagagcaagcacaucuccaucucuuccaccucaggcagugu

SEQ ID NO: 217909 - RNA, 64 nt, Homo Sapiens
gaugcggagucaugaagcagaguccucgggaaggcaucuccacagccccggguccucugucuaa

SEQ ID NO: 217910 - RNA, 64 nt, Homo Sapiens
cuccuucuccagaacccccuccaugggaaggagccaucuccacuccaagaucacaugcaggaua

SEQ ID NO: 217911 - RNA, 64 nt, Homo Sapiens
gugccaauuaccagcaagugagaacccagccggccaucuccaugcgcugcccagagccaugucc

SEQ ID NO: 217912 - RNA, 64 nt, Homo Sapiens
uucagcacacgaauuaugcugcguugcucacauucaaaccaaaccaacgacuauguuuaaugaa

SEQ ID NO: 217913 - RNA, 64 nt, Homo Sapiens
cacacgaauuaugcugcguugcucacauucaaaccaaaccaacgacuauguuuaaugaacucag

SEQ ID NO: 217914 - RNA, 64 nt, Homo Sapiens
uuucuuuacccagugcaauagguuuguuugugugcaaaccaaacuugagccuugcuggacaagu

SEQ ID NO: 217915 - RNA, 64 nt, Homo Sapiens
gcuuuggcuucugguguggugaagcguuguuuggcaaaccaacacguuucacauuaaauggugu

SEQ ID NO: 217916 - RNA, 64 nt, Homo Sapiens
accauugucuuaccucccaaccccccucuccucccaaaccaaaaauaaucucuuggaucugccg

SEQ ID NO: 217917 - RNA, 64 nt, Homo Sapiens
gucugucaguguacagcagcuaguguuugggauucaaaccaacaccaguucagggacagaauua

SEQ ID NO: 217918 - RNA, 64 nt, Homo Sapiens
cucacugaaugccagugauuaagagcaacacuuucaaaccaaauccuugcauucuaagugauag

SEQ ID NO: 217919 - RNA, 64 nt, Homo Sapiens
uaaaguaacuguguguugaauaagagacucaagacaaaccaagagucaggcucaaaagaagaau

SEQ ID NO: 217920 - RNA, 64 nt, Homo Sapiens
aaucaaccaaacaaagaaaaaaacaggaacccaccaaaccaaccccuagcguuuuggaagagga

SEQ ID NO: 217921 - RNA, 64 nt, Homo Sapiens
accaucugaggaaugagaagagccagaucgggagcaaaccaaaggaaugagaccaaacgcagcc

SEQ ID NO: 217922 - RNA, 64 nt, Homo Sapiens
agcucuuggaugugaagauaccaaagaaacaaaccaaaccaaccauugcuucuuuuauugguuu

SEQ ID NO: 217923 - RNA, 64 nt, Homo Sapiens
caaccagcucuuggaugugagguuuccaaagaaacaaaccaaacaaaaaauugcuucuuuuauu

SEQ ID NO: 217924 - RNA, 64 nt, Homo Sapiens
auuagaaugacuugagaacgggcaaauaacaaagcaaaccaauauaauuauauggucauucuga

SEQ ID NO: 217925 - RNA, 64 nt, Homo Sapiens
auugauugaauacaguuuuuacuaauuaguuuaucaaaccaaauacugugaacguaccaggugu

SEQ ID NO: 217926 - RNA, 64 nt, Homo Sapiens
aaacuguaagugcugaaagcaaguuuagccaugacaaaccaaagagugcccaggucagccaaga

SEQ ID NO: 217927 - RNA, 64 nt, Homo Sapiens
gaagugucagcccucaauguuggguacuuagacccaaaccaauaaauggugaguuuugaacaag

SEQ ID NO: 217928 - RNA, 64 nt, Homo Sapiens
uuuuuccugcgaaguuuaauuacaaagacaaccccaaaccaauuaaauucauuguguauauuac

SEQ ID NO: 217929 - RNA, 64 nt, Homo Sapiens
cgucaacagcauaauaaaaucaaacaaaaccacacaaaccaaacaagagagaaaaaaucaacag

SEQ ID NO: 217930 - RNA, 64 nt, Homo Sapiens
cagaggaagacugccucaaacaaacaaaaaacaacaaaccaaaccaaaccaaaccaaaaaaauc

SEQ ID NO: 217931 - RNA, 64 nt, Homo Sapiens
gaagacugccucaaacaaacaaaaaacaacaaaccaaaccaaaccaaaccaaaaaaaucucaaa

SEQ ID NO: 217932 - RNA, 64 nt, Homo Sapiens
cugccucaaacaaacaaaaaacaacaaaccaaaccaaaccaaaccaaaaaaaucucaaagcgau

SEQ ID NO: 217933 - RNA, 64 nt, Homo Sapiens
ucaaacaaacaaaaaacaacaaaccaaaccaaaccaaaccaaaaaaaucucaaagcgauuggac

SEQ ID NO: 217934 - RNA, 64 nt, Homo Sapiens
agaaagcaguggagguggggucccaaacucaaaccaaaccaaacaaaaaagagcuagcccaaaa

SEQ ID NO: 217935 - RNA, 64 nt, Homo Sapiens
caaacagaaagcaguggaggcaaaaucccaaacucaaaccaaaccaaagaaaaaagagcuagcc

SEQ ID NO: 217936 - RNA, 64 nt, Homo Sapiens
uguuuaaaugugacacuugugagaaggcauuugccaaaccaagccagcuggagcgccacagccg

SEQ ID NO: 217937 - RNA, 64 nt, Homo Sapiens
uaguaucgucaauggugccacauaaaacaugucccaaaccaaaucccacccgugcugggcagag

SEQ ID NO: 217938 - RNA, 64 nt, Homo Sapiens
ccuagggacaccaaaaaagaaaaaaaaaaaaacccaaaccaaaaacgcaaaccaaagcaggcag

SEQ ID NO: 217939 - RNA, 64 nt, Homo Sapiens
aaaaagaaaaaaaaaaaaacccaaaccaaaaacgcaaaccaaagcaggcaggcagacagcugcu

SEQ ID NO: 217940 - RNA, 64 nt, Homo Sapiens
auccagacucaggguuccagaaaucccccguucccaaaccaaaccaaucauggaucuucccuuu

SEQ ID NO: 217941 - RNA, 64 nt, Homo Sapiens
gacucaggguuccagaaaucccccguucccaaaccaaaccaaucauggaucuucccuuuaaggg

SEQ ID NO: 217942 - RNA, 64 nt, Homo Sapiens
cccgucucauuuguaucuucugauauucuuuauacaaaccaaaaguccccuucaacauuuuuua

SEQ ID NO: 217943 - RNA, 64 nt, Homo Sapiens
ugcuucagaugaaaacaaaucacacaccguuucccaaaccaacagucuucacauuucuaucccu

SEQ ID NO: 217944 - RNA, 64 nt, Homo Sapiens
aacacagaccgcuuuaaccuuuacaaccuuucauuuaaccgaaauaucagcgguaaaaaugcau

SEQ ID NO: 217945 - RNA, 64 nt, Homo Sapiens
ucugguaacauaucuggaauauuguuguuguuuuuuaaccgaguuuucccaucagugccaaaac

SEQ ID NO: 217946 - RNA, 64 nt, Homo Sapiens
caguuaagaggauauuagguauauaauucucuucuuaaccgaaugucagauggucuuacgccac

SEQ ID NO: 217947 - RNA, 64 nt, Homo Sapiens
cuccauaaauaaaaauaagauuaaaauguguuuauuaaccgauuaaauacauaauauauugaau

SEQ ID NO: 217948 - RNA, 64 nt, Homo Sapiens
auaaguacuugcuguguauuaaaaagcauaaucuuuaaccgagucauguuuugguugcuaaaga

SEQ ID NO: 217949 - RNA, 64 nt, Homo Sapiens
guucauucauauucauuuauucaaguaagucauuuuaaccgaaugauauauuuguguuuuuauu

SEQ ID NO: 217950 - RNA, 64 nt, Homo Sapiens
uuccagucuccaaagcggaaucccugaaacucaguuaaccgaauaauguugaggguauuagaca

SEQ ID NO: 217951 - RNA, 63 nt, Homo Sapiens
gugaaacccugucucuacuaaaaauacaaaaaaauuaaccgagcaugguggcacgugccugua

SEQ ID NO: 217952 - RNA, 64 nt, Homo Sapiens
uuuaaaucaacuuuuuaaaaaaauaaaguguaaauuaaccgacuagaguacuuggaaaauguga

SEQ ID NO: 217953 - RNA, 64 nt, Homo Sapiens
ccuuuggaauugugcuccaaaugucuacugaagcuuaaccgaagaacuaauaaauggacuacag

SEQ ID NO: 217954 - RNA, 64 nt, Homo Sapiens
cuuuaccaaacagcaaaccaacuagaugaccucauuaaccgaugucaaguagcugggauuuuaa

SEQ ID NO: 217955 - RNA, 64 nt, Homo Sapiens
gaaggauaugguauguuguauagguuagaaaccuuuaaccgauaaagaaaggagagaagguuuu

SEQ ID NO: 217956 - RNA, 64 nt, Homo Sapiens
uuaaggcagcacagacugccaaguacuguuuuuuuuaaccgacugaaaucacuuugggauauuu

SEQ ID NO: 217957 - RNA, 64 nt, Homo Sapiens
aaugacccaagacuuaguucauuguuaacguguauuaaccgaaaacauguacaaaauacauaua

SEQ ID NO: 217958 - RNA, 64 nt, Homo Sapiens
cacuuuauauggcccugcacaacaaacaaaaaaauuaaccgagaucugaaguacaaacaugaaa

SEQ ID NO: 217959 - RNA, 64 nt, Homo Sapiens
ugcuucuaguuggugagcagugucucacaugugcuuaaccgaggacaucuuuccuaugcaagag

SEQ ID NO: 217960 - RNA, 64 nt, Homo Sapiens
ugagaguuuuccuuuaaccuaaaauucaacugcauuaaccgaucguugcucacauucucaagca

SEQ ID NO: 217961 - RNA, 64 nt, Homo Sapiens
uaaaucacauacuuuguuuagagaggcgagggguuuaaccgagucacccagcuggucucauaca

SEQ ID NO: 217962 - RNA, 64 nt, Homo Sapiens
gugaaaauaauaacauuauuaugagaaaguggacuuaaccgaaauggaaccaacugacauucua

SEQ ID NO: 217963 - RNA, 64 nt, Homo Sapiens
cacuucucauugcuaaaaauaaauaaaccaaaguuuaaccgaaucaguuagggaaagugauuua

SEQ ID NO: 217964 - RNA, 64 nt, Homo Sapiens
gacaguugaguaugucuaugcgacacagcucaguuuaaccgaauaaucccgugugcacgcugaa

SEQ ID NO: 217965 - RNA, 64 nt, Homo Sapiens
ucccauugguggcagaugugagcgacaucaggcgcuuccucagugcauuucacgagccacaggu

SEQ ID NO: 217966 - RNA, 64 nt, Homo Sapiens
ugcaaccuccgccucucagguucaagugguucuccuuccucagccucccaaguagcugggauua

SEQ ID NO: 217967 - RNA, 64 nt, Homo Sapiens
uuuuuaguuuuuaaaauauuccguggucaaaauucuuccucacuauaauugguauuuacuuuua

SEQ ID NO: 217968 - RNA, 64 nt, Homo Sapiens
cauaggagggaacagaccauggaaauuuaaacgacuuccucacggucacagaacuaguuuuuua

SEQ ID NO: 217969 - RNA, 64 nt, Homo Sapiens
gcucaggcaacgagugggccacaucucacuucugcuuccucaucucagcccacucugaaaaugu

SEQ ID NO: 217970 - RNA, 64 nt, Homo Sapiens
ugcuccucccccagcuccagggcuccuggauguccuuccucaacucccuccaccccuagacaau

SEQ ID NO: 217971 - RNA, 64 nt, Homo Sapiens
ucuccgucucuuuuuuuucaccucauccuucugucuuccucaauuccucccuucccuccuccuu

SEQ ID NO: 217972 - RNA, 64 nt, Homo Sapiens
cuucugucuuccucaauucuucccuucccuccuccuuccucaucaguguuaaccuuccaccucc

SEQ ID NO: 217973 - RNA, 64 nt, Homo Sapiens
gaagaagugccucgggguugggucacaaaguguucuuccucaugugcuugagcugccaaagaag

SEQ ID NO: 217974 - RNA, 64 nt, Homo Sapiens
caaacugguccauuagauucacuugacuucaagccuuccucaacuauuggugcaucucagaugc

SEQ ID NO: 217975 - RNA, 64 nt, Homo Sapiens
ucuggaauuuggccaggcagccagucacucgccccuuccucaucggucuccagccaccccuacc

SEQ ID NO: 217976 - RNA, 64 nt, Homo Sapiens
uucccuucccuccaccucucuucccuaaacgacccuuccucacaauugcucaaccaguauuuau

SEQ ID NO: 217977 - RNA, 64 nt, Homo Sapiens
cccuauuuccguguucuuaccuagccuccccccacuuccucaaaacaaacaagagauggcaaag

SEQ ID NO: 217978 - RNA, 64 nt, Homo Sapiens
auaaagaugaaaagacaacaaaaguaucuucauacuuccucauccccucauugcaacaaaaccu

SEQ ID NO: 217979 - RNA, 64 nt, Homo Sapiens
auguagacuugaaaugucuccacauuuuggaggacuuccucagcccuuuucauugagggaaaau

SEQ ID NO: 217980 - RNA, 64 nt, Homo Sapiens
auuuuugugaaaauagaguuuugguaaucacuuucuuccucaaaauaaguccuucuguuaauuu

SEQ ID NO: 217981 - RNA, 64 nt, Homo Sapiens
gguuuguguugcuaagcaaaaacuuauuuuguagcuuccucacuccuguuugcuauuuuuguuu

SEQ ID NO: 217982 - RNA, 64 nt, Homo Sapiens
ugucuguaaauaacucugguuugaaaacuaggaucuuccucagaggaauauuuuccugacagac

SEQ ID NO: 217983 - RNA, 64 nt, Homo Sapiens
caauggguggccuugugacuccauucuccaaugacuuccucaacgcagccagauuccgaaacuc

SEQ ID NO: 217984 - RNA, 64 nt, Homo Sapiens
cugggaaaacugagaaaaccggggcauugaggagcuuccucauuuuuucaaaguaguuccuaua

SEQ ID NO: 217985 - RNA, 64 nt, Homo Sapiens
guuucccaccucaccugagagccauugaauuugccuuccucaugaauuaaaaccucccccaagc

SEQ ID NO: 217986 - RNA, 64 nt, Homo Sapiens
cuuccucaugaauuaaaaccucccccaagcagagcuuccucagagaaagugguucuaugaugac

SEQ ID NO: 217987 - RNA, 64 nt, Homo Sapiens
gggcaccugaaagaaauuagugacaugaugcagucuuccucaugucuccccaagugaguggaag

SEQ ID NO: 217988 - RNA, 56 nt, Homo Sapiens
gagaggggcagaagcaagaagcaagccuuccucaaaauaucacaucucugaguuaa

SEQ ID NO: 217989 - RNA, 64 nt, Homo Sapiens
cuucccuacagauuugcaggcugggaaggcuagacuuccucagcccgagggcugcccuuccaaa

SEQ ID NO: 217990 - RNA, 64 nt, Homo Sapiens
gcugaggucugagcagggccuggccuuuccuccucuuccucacccucauccuuugggaggcuga

SEQ ID NO: 217991 - RNA, 64 nt, Homo Sapiens
aggaaagagaggaaccaauaccuucaaggcucuucuuccucaccgagcaugcuucccuaggauc

SEQ ID NO: 217992 - RNA, 64 nt, Homo Sapiens
gugagugacaaagccucugaaagaugcaucaucucuuccucacacccauuuagugggggauggg

SEQ ID NO: 217993 - RNA, 64 nt, Homo Sapiens
acugacuauuuuaucaaauuaaacacacuauauacuuccucaccuaugaauauauuaaauccac

SEQ ID NO: 217994 - RNA, 64 nt, Homo Sapiens
uggaaggcagcuuuucagaaugaaaaauuagucacuuccucacaacgcccuuuauagugugaaa

SEQ ID NO: 217995 - RNA, 64 nt, Homo Sapiens
aucacaugguucaggacagacaaagaugaagugacuuccucaaaaaaagauaaucugaagcuca

SEQ ID NO: 217996 - RNA, 64 nt, Homo Sapiens
gucuguagccaucugauauccaucugccuaauuccuuccucacaggggaagaucuguccugcac

SEQ ID NO: 217997 - RNA, 64 nt, Homo Sapiens
gcuagaacagucucguagcugcaguucagcugugcuuccucagccuacuaucauaggcuuccuc

SEQ ID NO: 217998 - RNA, 64 nt, Homo Sapiens
guucagcugugcuuccucagccuacuaucauaggcuuccucagcccucugucauauggcuguuu

SEQ ID NO: 217999 - RNA, 64 nt, Homo Sapiens
aaaaaggguagcaaaggccaaugucuucuagcugcuuccucaaccccuguccccuggagaccag

SEQ ID NO: 218000 - RNA, 64 nt, Homo Sapiens
acacuuuaauggguauaauuuccuggcugccucccuuccucagcccauuagguuaaacaccaaa

SEQ ID NO: 218001 - RNA, 64 nt, Homo Sapiens
cccucauuggaacaaaaccuaaaauaucuucauacuuccucaucauaaagaugaaaagacaaca

SEQ ID NO: 218002 - RNA, 64 nt, Homo Sapiens
acaaacaagagauggcaaagcuagccucccccgacuuccucaaacccuauuacccuauucuuac

SEQ ID NO: 218003 - RNA, 64 nt, Homo Sapiens
caccgccacugggccugucacccuuuuguauucucuuccucaucgaagagauuuuaaagacguu

SEQ ID NO: 218004 - RNA, 64 nt, Homo Sapiens
uuucagcagugcagccggggcacuggagccaucucuuccucauacuggccuggccagcacccca

SEQ ID NO: 218005 - RNA, 64 nt, Homo Sapiens
cgacgacgacugcaaaguguaugcacaccgcaugcuuccucauccacauagugccagcagcagu

SEQ ID NO: 218006 - RNA, 64 nt, Homo Sapiens
cuuguuucuuagcuuggggagaugauggacuuagcuuccucaagauaaauuucuaguuuauuaa

SEQ ID NO: 218007 - RNA, 64 nt, Homo Sapiens
uguucauuauaaucuguauugacuuaaaaaguuucuuccucaugaugcuaauaguuuuuuguau

SEQ ID NO: 218008 - RNA, 64 nt, Homo Sapiens
uucaaggucagugaagucuaucaaucauucuccccuuccucaucagcaaugguagauagaaaug

SEQ ID NO: 218009 - RNA, 64 nt, Homo Sapiens
gggucuguccccgucauuucugaccgugaacauccuuccucaucaguagugggaagugugaagg

SEQ ID NO: 218010 - RNA, 64 nt, Homo Sapiens
gggaccccuucaucuguuggcccgcccuccccugcuuccucagcacgccaccguuguguccgag

SEQ ID NO: 218011 - RNA, 64 nt, Homo Sapiens
ccuccucugacccacccaugccuggcccgcucaccuuccucacccgccuccaccccugcagccu

SEQ ID NO: 218012 - RNA, 64 nt, Homo Sapiens
gcccgucggguuguggcauccuuagauaaucgugcuuccucagcuuguucaacaguggcuuuuu

SEQ ID NO: 218013 - RNA, 64 nt, Homo Sapiens
ugucacuguguuuccucugcacuguucccuuccacuuccucauccucuuugugacauggaaguu

SEQ ID NO: 218014 - RNA, 64 nt, Homo Sapiens
auguagauauaaaaaugauugugcccuaaccaaacuuccucagauugugcacuguuuguuuaaa

SEQ ID NO: 218015 - RNA, 64 nt, Homo Sapiens
gcacucugcuucuuccguucacccagcccucucucuuccucaauucacaggggugagccaccgc

SEQ ID NO: 218016 - RNA, 64 nt, Homo Sapiens
cucgagccucagucucccgucggacggcagaugccuuccucaguguccucaggagcuccaaccc

SEQ ID NO: 218017 - RNA, 64 nt, Homo Sapiens
aggacugaccaucucucacuguccuccccaccuucuuccucacucacacauuuuuuguacaucu

SEQ ID NO: 218018 - RNA, 64 nt, Homo Sapiens
cucuagccggggcagacacccagcuggcuggguccuuccucagccuugccuccuccugucccca

SEQ ID NO: 218019 - RNA, 64 nt, Homo Sapiens
auuuaaaauucuuauuuaaccuuccucccuucaucuuccucacccuuuuuacaguggaagaaag

SEQ ID NO: 218020 - RNA, 64 nt, Homo Sapiens
ccucuuuuccaauccuaguugucuaccuucuuuucuuccucauuuccuucuuuuauuccucccc

SEQ ID NO: 218021 - RNA, 64 nt, Homo Sapiens
acucuuaaaauacgguaccuggcaauguuuauuucauaaagaauugugaacuucuugaaucuag

SEQ ID NO: 218022 - RNA, 64 nt, Homo Sapiens
uauguucaguaggaacuguacauguguugggaggcauaaagacuaauuagcaaccauaauaugg

SEQ ID NO: 218023 - RNA, 64 nt, Homo Sapiens
guguuauauaaaaauccgacuggagucuagcucacauaaagagaucugugaagugugaggacuc

SEQ ID NO: 218024 - RNA, 64 nt, Homo Sapiens
caaucucuuaauuauauuuugagcggccauaagccauaaagaguugagaaauacgagucuguca

SEQ ID NO: 218025 - RNA, 64 nt, Homo Sapiens
ccccugcuccaucccccauugcaugggggaagggcauaaagaaucauuuauaugcacguggaga

SEQ ID NO: 218026 - RNA, 64 nt, Homo Sapiens
gguuggaugccguugcagagaaaaucagcaaugacauaaagagauuucuagaauaguugauggu

SEQ ID NO: 218027 - RNA, 64 nt, Homo Sapiens
gaugaguuuaugcccuuugugaauacuaugcagccauaaagaaguguggcacauauacaccaug

SEQ ID NO: 218028 - RNA, 64 nt, Homo Sapiens
gccacccaucugauuccucaccuauuauuuccuucauaaagaauaucccuucugagaaauguac

SEQ ID NO: 218029 - RNA, 64 nt, Homo Sapiens
cuugugaaaguguaaugugcgauggcuauguagacauaaagaagaaacuuguaaauaucuuuuu

SEQ ID NO: 218030 - RNA, 64 nt, Homo Sapiens
ucagcaguacaaaggcauguuuuaaaaucuauaacauaaagaauaaggaauagcuuuguauuuu

SEQ ID NO: 218031 - RNA, 64 nt, Homo Sapiens
cauuucucucccacccucaacucuaacaggagaacauaaagauucuggaaggaaaaaagcuauu

SEQ ID NO: 218032 - RNA, 64 nt, Homo Sapiens
guuuaugcauucaucugaaauuucaugucauacccauaaagauagguaacauucuacaguuacu

SEQ ID NO: 218033 - RNA, 64 nt, Homo Sapiens; identical to SEQ ID NO: 70892

SEQ ID NO: 218034 - RNA, 64 nt, Homo Sapiens; identical to SEQ ID NO: 70893

SEQ ID NO: 218035 - RNA, 64 nt, Homo Sapiens; identical to SEQ ID NO: 70894

SEQ ID NO: 218036 - RNA, 64 nt, Homo Sapiens; identical to SEQ ID NO: 70895

SEQ ID NO: 218037 - RNA, 64 nt, Homo Sapiens; identical to SEQ ID NO: 70896

SEQ ID NO: 218038 - RNA, 64 nt, Homo Sapiens; identical to SEQ ID NO: 70897

SEQ ID NO: 218039 - RNA, 64 nt, Homo Sapiens; identical to SEQ ID NO: 70898

SEQ ID NO: 218040 - RNA, 64 nt, Homo Sapiens; identical to SEQ ID NO: 70899

SEQ ID NO: 218041 - RNA, 64 nt, Homo Sapiens; identical to SEQ ID NO: 70900

SEQ ID NO: 218042 - RNA, 64 nt, Homo Sapiens; identical to SEQ ID NO: 70901

SEQ ID NO: 218043 - RNA, 64 nt, Homo Sapiens; identical to SEQ ID NO: 70902

SEQ ID NO: 218044 - RNA, 64 nt, Homo Sapiens; identical to SEQ ID NO: 70903

SEQ ID NO: 218045 - RNA, 64 nt, Homo Sapiens; identical to SEQ ID NO: 70904

SEQ ID NO: 218046 - RNA, 64 nt, Homo Sapiens; identical to SEQ ID NO: 70905

SEQ ID NO: 218047 - RNA, 64 nt, Homo Sapiens; identical to SEQ ID NO: 70906

SEQ ID NO: 218048 - RNA, 64 nt, Homo Sapiens; identical to SEQ ID NO: 70907

SEQ ID NO: 218049 - RNA, 63 nt, Homo Sapiens
gcaggucugcccuuucauugggguguauacauaucaggggacccugagguggcaccguacuca

SEQ ID NO: 218050 - RNA, 63 nt, Homo Sapiens
gaggccaggguucgggaaguacacugccaucggucaggggacagcugccucccaccuugccug

SEQ ID NO: 218051 - RNA, 63 nt, Homo Sapiens
cugaaauuuacccacagugaggcuguggauggaucaggggaccuguauaaaauguuugagccu

SEQ ID NO: 218052 - RNA, 63 nt, Homo Sapiens
uguauccucaaucauacuauacagcaguuuuugucaggggaacauaaaaauauccaagagagg

SEQ ID NO: 218053 - RNA, 63 nt, Homo Sapiens
cugcuaggggaaggacuggcaccacugggccccucaggggaagcgaacugugcucccacgggg

SEQ ID NO: 218054 - RNA, 63 nt, Homo Sapiens
aaccagggguaccaggcacaaggcccugcuuuaucaggggacaagcugaggccucccuugagu

SEQ ID NO: 218055 - RNA, 63 nt, Homo Sapiens
gcuaacuggagcauaauccuuacaguuuugcacucaggggauuaaguuugaaacauagugucu

SEQ ID NO: 218056 - RNA, 63 nt, Homo Sapiens
guauuugauucacaagaggauucucccugagugucaggggaggcugugggacuucaccacgug

SEQ ID NO: 218057 - RNA, 63 nt, Homo Sapiens
agagccuuuuuuguuucugcucuuugucagcuuucaggggagaaggaggccacuggaaaauua

SEQ ID NO: 218058 - RNA, 63 nt, Homo Sapiens
cauggcuuuauuuaugaaccugguuuucgggagucaggggaggagaugacuuugcuucugugc

SEQ ID NO: 218059 - RNA, 63 nt, Homo Sapiens
ugcuccaccugagaggaccaugugccccuaucaucaggggaacguucuugcagacaccccacc

SEQ ID NO: 218060 - RNA, 63 nt, Homo Sapiens
aagggacuugcccaagucccaggaaacugaggcucaggggauauuaucuaugugugacaaaug

SEQ ID NO: 218061 - RNA, 63 nt, Homo Sapiens
gccuucgugaaaagccaauagcacucucagauaucaggggauuuuaguuccaagcagggaccc

SEQ ID NO: 218062 - RNA, 63 nt, Homo Sapiens
ggcagugacucgguggcuucccaagcaggagugucaggggaaccaugagagagagucuaggag

SEQ ID NO: 218063 - RNA, 63 nt, Homo Sapiens
caggaagaaaggaaggaaggaaaauguagcuucucaggggagggcucuucuccagagauuaca

SEQ ID NO: 218064 - RNA, 63 nt, Homo Sapiens
cccugaaaaauuaccugcagaacuuuucauaacucaggggauuuucuuuuuuuuuuuaacucg

SEQ ID NO: 218065 - RNA, 64 nt, Homo Sapiens; identical to SEQ ID NO: 180322

SEQ ID NO: 218066 - RNA, 64 nt, Homo Sapiens; identical to SEQ ID NO: 180323

SEQ ID NO: 218067 - RNA, 64 nt, Homo Sapiens; identical to SEQ ID NO: 180324

SEQ ID NO: 218068 - RNA, 64 nt, Homo Sapiens; identical to SEQ ID NO: 180325

SEQ ID NO: 218069 - RNA, 64 nt, Homo Sapiens; identical to SEQ ID NO: 180326

SEQ ID NO: 218070 - RNA, 64 nt, Homo Sapiens; identical to SEQ ID NO: 180327

SEQ ID NO: 218071 - RNA, 64 nt, Homo Sapiens; identical to SEQ ID NO: 180328

SEQ ID NO: 218072 - RNA, 64 nt, Homo Sapiens; identical to SEQ ID NO: 180329

SEQ ID NO: 218073 - RNA, 64 nt, Homo Sapiens; identical to SEQ ID NO: 180330

SEQ ID NO: 218074 - RNA, 64 nt, Homo Sapiens; identical to SEQ ID NO: 180331

SEQ ID NO: 218075 - RNA, 64 nt, Homo Sapiens; identical to SEQ ID NO: 180332

SEQ ID NO: 218076 - RNA, 64 nt, Homo Sapiens; identical to SEQ ID NO: 180333

SEQ ID NO: 218077 - RNA, 64 nt, Homo Sapiens; identical to SEQ ID NO: 180334

SEQ ID NO: 218078 - RNA, 64 nt, Homo Sapiens; identical to SEQ ID NO: 180335

SEQ ID NO: 218079 - RNA, 64 nt, Homo Sapiens; identical to SEQ ID NO: 180336

SEQ ID NO: 218080 - RNA, 64 nt, Homo Sapiens; identical to SEQ ID NO: 180337

SEQ ID NO: 218081 - RNA, 64 nt, Homo Sapiens; identical to SEQ ID NO: 180338

SEQ ID NO: 218082 - RNA, 64 nt, Homo Sapiens; identical to SEQ ID NO: 180339

SEQ ID NO: 218083 - RNA, 63 nt, Homo Sapiens
cugucccuggaguucccagguucccagcucccccccugcaagccuugaagccuccagcaacgu

SEQ ID NO: 218084 - RNA, 63 nt, Homo Sapiens
ggucugaaaaucagccagugccaacauugcuugcccugcaaggugcaacugagcccacauagc

SEQ ID NO: 218085 - RNA, 63 nt, Homo Sapiens
gcugaaucuagccuaauucgagugagguuccuucccugcaaauuggugaaaagcuuuucacua

SEQ ID NO: 218086 - RNA, 63 nt, Homo Sapiens
gagacagguccuccaguaccagggaccaccucacccugcaaaaccccuccaucaagaucuuug

SEQ ID NO: 218087 - RNA, 63 nt, Homo Sapiens
uucccuagcccccucaauagcuggacccucaaccccugcaaccguggaguggggagguugggc

SEQ ID NO: 218088 - RNA, 63 nt, Homo Sapiens
ccccagagggcugcccacgaccuuuacaccuaccccugcaagugcccagccccaguacugcca

SEQ ID NO: 218089 - RNA, 63 nt, Homo Sapiens
acccaguaaaugguaagguauuaaauaauauugcccugcaagucauuuuaauuuggcaaucuc

SEQ ID NO: 218090 - RNA, 63 nt, Homo Sapiens
uuucugcucccucucuugcuuacgcugucuauacccugcaaccuauuuccagccuaugacucc

SEQ ID NO: 218091 - RNA, 63 nt, Homo Sapiens
gaaaccaaacguccaccuggacccucccugaaccccugcaaaugcccucccugaaccccugca

SEQ ID NO: 218092 - RNA, 63 nt, Homo Sapiens
cucccugaaccccugcaaaugcccucccugaaccccugcaaccuccccgguugugggacaaga

SEQ ID NO: 218093 - RNA, 63 nt, Homo Sapiens
caacaggugcauggugaguggccgcaccucugucccugcaaacacagggugagaagagucagg

SEQ ID NO: 218094 - RNA, 63 nt, Homo Sapiens
ggugaccuaagcguggugcaauggacuuccggucccugcaacgcucaggguugcggcagagcc

SEQ ID NO: 218095 - RNA, 63 nt, Homo Sapiens
aagcagccacuucagcccagaaacaagguccaacccugcaaugaaaugucaaaucugguuuuu

SEQ ID NO: 218096 - RNA, 63 nt, Homo Sapiens
ccuggcagcuuuggcccuggagggcugccuccacccugcaacuccgagguccaaguaugagcc

SEQ ID NO: 218097 - RNA, 63 nt, Homo Sapiens
uaucccuucucacagcacauugccuucugacggcccugcaaugcuuggccuagcccacccugc

SEQ ID NO: 218098 - RNA, 63 nt, Homo Sapiens
cccacaggaggcaagcaagcuggacaguucacacccugcaagggagcaggcgguggggagaga

SEQ ID NO: 218099 - RNA, 63 nt, Homo Sapiens
cugucccugcccuccucaccgcccugcaagggccccugcaaucccagagguauuagcugcuga

SEQ ID NO: 218100 - RNA, 58 nt, Homo Sapiens
gccccugcaauccugucccucugcugagcccugcaaggcguccagccagagguauuag

SEQ ID NO: 218101 - RNA, 63 nt, Homo Sapiens
uggucacucugccaucuuggacugauucacacucccugcaaaacuugucacugccgucugugc

SEQ ID NO: 218102 - RNA, 63 nt, Homo Sapiens
uccaaccgccaacugcagugugcugaauccaugcccugcaauggacauccaugcaggcagcag

SEQ ID NO: 218103 - RNA, 63 nt, Homo Sapiens
acacguggaggaaugcucccccauccuccccuucccugcaaacaugggguuggcugggcccag

SEQ ID NO: 218104 - RNA, 63 nt, Homo Sapiens
ugaccuguggggauuucucccagcucuagacaacccugcaaaggacuguuuuuuccugagcuu

SEQ ID NO: 218105 - RNA, 63 nt, Homo Sapiens
aagagccucccaccagagccgggaggaaaaggccccugcaauguggugacaccucccccuuuc

SEQ ID NO: 218106 - RNA, 63 nt, Homo Sapiens
acuaccagccagccucagaaggccccagagagacccugcaagaccacggagggagcgacacuu

SEQ ID NO: 218107 - RNA, 64 nt, Homo Sapiens
auaccuggggugagaagauggggcgaaacaacugaugggggaagaaggggagauuucagaagac

SEQ ID NO: 218108 - RNA, 64 nt, Homo Sapiens
gagugggauuaggcugaaguucccuuaagccaggaugggggaaaucugccccaauacacauacc

SEQ ID NO: 218109 - RNA, 64 nt, Homo Sapiens
gguucaaguuaccgagagauagguguguuccuuuaugggggauggggggguguguuggggauuc

SEQ ID NO: 218110 - RNA, 64 nt, Homo Sapiens
caguucuucugugcucuauuauacccugauagagaugggggagagaaaggaauguuuuugaugg

SEQ ID NO: 218111 - RNA, 64 nt, Homo Sapiens
ggaccagacaaagagguaagaagacugaguauugaugggggagucuaauugauauauguguugg

SEQ ID NO: 218112 - RNA, 64 nt, Homo Sapiens
aaaguaaaauugagagacccgaaacaaagguuaaaugggggauuuuucaguugauuuuuugaaa

SEQ ID NO: 218113 - RNA, 64 nt, Homo Sapiens
aaagauuagguugcuccugaacucuaguuuaauaaugggggaaauuacaaguuguguaaaaugg

SEQ ID NO: 218114 - RNA, 64 nt, Homo Sapiens
gggagguugagaaaggaaguuuguggggauggcuaugggggaagauauuccuugaugggacagc

SEQ ID NO: 218115 - RNA, 64 nt, Homo Sapiens
uuccacauucaaaaguuuuguaggguggugggaaaugggggaucuucaauguuuauuuuaaaau

SEQ ID NO: 218116 - RNA, 64 nt, Homo Sapiens
acacagugaccucugaaucaguuucagagaagggaugggggagaaaaugccuucuagguuuuga

SEQ ID NO: 218117 - RNA, 64 nt, Homo Sapiens
ugacuaaaagucuucggucggcuaaucaaauccaaugggggaaaaagcacucgggaaaccuggg

SEQ ID NO: 218118 - RNA, 64 nt, Homo Sapiens
ggggaaggaguuuuauguuaaguuuuaccagaugaugggggaggggugcgucuccccggaguuc

SEQ ID NO: 218119 - RNA, 64 nt, Homo Sapiens
gaaaucuccaugguuccugcaaauugugagguggaugggggagugugagguggaugggggagug

SEQ ID NO: 218120 - RNA, 64 nt, Homo Sapiens
gaaauugugagguggaugggucauugugagguggaugggggaguuaagaugugcuagauuaauu

SEQ ID NO: 218121 - RNA, 64 nt, Homo Sapiens
cagcaagcuuuugggaucgggggaauaagaggguaugggggaaagguucauagacuuaggugug

SEQ ID NO: 218122 - RNA, 64 nt, Homo Sapiens
ugugagaaugaggugggaggugucugguaaggucaugggggaagggagaugagagaggagauag

SEQ ID NO: 218123 - RNA, 64 nt, Homo Sapiens
ggucccaugaugaugggccagggcucguguagaaaugggggaauugguuccccauggcccagga

SEQ ID NO: 218124 - RNA, 64 nt, Homo Sapiens
gaaaccgagcagaccuggcccauguggagcuggcaugggggacacagcccagagacagagaagc

SEQ ID NO: 218125 - RNA, 64 nt, Homo Sapiens
gcugaugaggccccagcuggguaggggggggggaaugggggagggacgacccuugucucccugg

SEQ ID NO: 218126 - RNA, 64 nt, Homo Sapiens
gaacuagaaccaccugcacccucucugccaggaaaugggggaagcccuuccuuucacagccggu

SEQ ID NO: 218127 - RNA, 61 nt, Homo Sapiens
aacccugccccaaugcaccucugaaccuggcccaacagaaaacaacaaagugcaauacagg

SEQ ID NO: 218128 - RNA, 61 nt, Homo Sapiens
gagcaggcagagggugggggcacccccagagccaacagaggaggguggggaggugcagugg

SEQ ID NO: 218129 - RNA, 61 nt, Homo Sapiens
uucaagucucuuccagagugaaaguaccugaccaacagaacggcagggacuguguucaggg

SEQ ID NO: 218130 - RNA, 61 nt, Homo Sapiens
uaaaaacgaaaaacaaaaaauugcuugggcaccaacagaaucucuuuguagaugauguauu

SEQ ID NO: 218131 - RNA, 61 nt, Homo Sapiens
ggucgggguagguucgugcaagguuucaguuccaacagaaaggcuucucauuuacaccaac

SEQ ID NO: 218132 - RNA, 61 nt, Homo Sapiens
ucuuguccugccuucuagauuugcccuuuggccaacagauuuuccacagagguggcagguc

SEQ ID NO: 218133 - RNA, 64 nt, Homo Sapiens
cugauuucuuaaaaccuacauauguauaguguuuauacaugauggaauuuuaaguauagcaaaa

SEQ ID NO: 218134 - RNA, 64 nt, Homo Sapiens
guugugucauuauuagagauauacauuugcuaucauacaugacaaagucugaaugaauuauuau

SEQ ID NO: 218135 - RNA, 64 nt, Homo Sapiens
agcucaaaguaaacguguauauagcuuuaaaauuauacaugagccucgagugagccaugcaaaa

SEQ ID NO: 218136 - RNA, 64 nt, Homo Sapiens
cauugcaauauggaauuuugacaaacuaaaguuaauacaugaaguucacaugaauaguaaugug

SEQ ID NO: 218137 - RNA, 64 nt, Homo Sapiens
uuuaaugaauaguagaggugucaagggacuauguauacaugauuaggguaagauagaauguauu

SEQ ID NO: 218138 - RNA, 64 nt, Homo Sapiens
auggggaggcagagagucacuugaccauccagaaauacaugacuacaaguccuuuaugacuguu

SEQ ID NO: 218139 - RNA, 64 nt, Homo Sapiens
aaauuaauuuuguguugcuaucagcacaucuuuuauacaugaagacugaugaggcaugcagcuu

SEQ ID NO: 218140 - RNA, 64 nt, Homo Sapiens
aaauggaaaguuacuucuaguauaacauaucaaaauacaugaacgguuuaauucggguggggaa

SEQ ID NO: 218141 - RNA, 64 nt, Homo Sapiens
uugcauuuugaccuguucaguagguugaugaaagauacaugaguaaaagugaagcaacaagauu

SEQ ID NO: 218142 - RNA, 64 nt, Homo Sapiens
acauuuugauagggcuuauucaguugguacagaaauacaugaacaugacagucucaguauagau

SEQ ID NO: 218143 - RNA, 64 nt, Homo Sapiens
guugauaguagauuaugucucuagguagagacagauacaugagaagagccuccaaaacuggaag

SEQ ID NO: 218144 - RNA, 64 nt, Homo Sapiens
agaaaccaugcaauuuaacacuucaguuaaagaaauacaugagaacugcuugucaugaccagac

SEQ ID NO: 218145 - RNA, 64 nt, Homo Sapiens
acaugggaaauuacguaaguuacaucuuuaaagaauacaugacauaaugcccaguuauuaaaau

SEQ ID NO: 218146 - RNA, 64 nt, Homo Sapiens
guauuauacacacacacuuuagauauguauuacuauacaugaauuagugggagaaaaacauuuu

SEQ ID NO: 218147 - RNA, 64 nt, Homo Sapiens
uuuguuuacagaauccaaaaauacaauagagaagauacaugagggcuuaaacaagaaauaguaa

SEQ ID NO: 218148 - RNA, 64 nt, Homo Sapiens
augcaaaaguguaauacauaaauugucacaaauuauacaugaaauugauuacaaauacauuuga

SEQ ID NO: 218149 - RNA, 64 nt, Homo Sapiens
caugugggccuguuagucuuggaguugaagucuaauacaugauaaaaaaaugcacucucacagu

SEQ ID NO: 218150 - RNA, 64 nt, Homo Sapiens
gauuugguuauaacucaaucgcuuagcuuuauucauacaugaguccuauauaaaagcuauugag

SEQ ID NO: 218151 - RNA, 64 nt, Homo Sapiens
gcauuucuuuuuucucaaaaagaaacuguaggaaauacaugacagagaaaguuacacucaggga

SEQ ID NO: 218152 - RNA, 64 nt, Homo Sapiens
gcuucuuagucuuuguuguaggaugcauaauaaaauacaugaaugaguuuuaaaugguuagcuu

SEQ ID NO: 218153 - RNA, 64 nt, Homo Sapiens
auauaauguaauauuauguaccuaccacuaagaaauacaugaaccgugccaugaggacaguaag

SEQ ID NO: 218154 - RNA, 64 nt, Homo Sapiens
aaucuuagacauuaccuguugacucccuguugucauacaugaggcuuuagcucucuuuugucag

SEQ ID NO: 218155 - RNA, 64 nt, Homo Sapiens
aauucagcugucauucaguugaggcagucaauaaauacaugagagcacagaacuuugaaccuag

SEQ ID NO: 218156 - RNA, 64 nt, Homo Sapiens
augcuuaaaagugauaggaaauauauugagauuaauacaugaaaaccauauguaugcuauuaaa

SEQ ID NO: 218157 - RNA, 64 nt, Homo Sapiens
ugaagauuucgacuuccacuguuaaauguacaagauacaugaaauauuaaagaaaauguguaac

SEQ ID NO: 218158 - RNA, 64 nt, Homo Sapiens
aauuuguuucuauuaagcaaguaccaguuuaccaauacaugaguaacugaaguguaacuguuaa

SEQ ID NO: 218159 - RNA, 64 nt, Homo Sapiens
gguuguauacuuacauuuuuucuuuccuuaauuuauacaugauccuuuuuccuuaauuuauaca

SEQ ID NO: 218160 - RNA, 64 nt, Homo Sapiens
ccuuaauuuauacaugauccuuuuuccuuaauuuauacaugauccaggcacauuugaaauuugg

SEQ ID NO: 218161 - RNA, 64 nt, Homo Sapiens
ugggaggggcuuuuauucugccaagucauuucaaauacaugaaaaaucuuacacuggagagaaa

SEQ ID NO: 218162 - RNA, 64 nt, Homo Sapiens
uagaaaagcauuccauaauuucucuucuuugcaaauacaugaaaggaugcacagaggagagaag

SEQ ID NO: 218163 - RNA, 64 nt, Homo Sapiens
uggaaaagcguuccauaauuucucuucuuuucaaauacaugaaaguugcacagaggagaggcgc

SEQ ID NO: 218164 - RNA, 64 nt, Homo Sapiens
caaacaagcauucaauuauuuuucuuccuugcauauacaugaaaggacucauacgagagagaau

SEQ ID NO: 218165 - RNA, 64 nt, Homo Sapiens
gggaaagcaugaaauucugucagugccuuuuuuaauacaugaaagaauucuagagagaagccau

SEQ ID NO: 218166 - RNA, 64 nt, Homo Sapiens
ugggaaagcuuucaaucauuuuaguuccuuucaaauacaugaaagaacucaucauggagaaaac

SEQ ID NO: 218167 - RNA, 64 nt, Homo Sapiens
gaauucauacuggagagaaaccaguuauauucauauacaugaacugguaaagccuucaguaguu

SEQ ID NO: 218168 - RNA, 64 nt, Homo Sapiens
gaacccacacuggagagaaauugcagguuuccagauacaugaaaugggaaaacauacauuacuc

SEQ ID NO: 218169 - RNA, 64 nt, Homo Sapiens; identical to SEQ ID NO: 99128

SEQ ID NO: 218170 - RNA, 64 nt, Homo Sapiens; identical to SEQ ID NO: 99129

SEQ ID NO: 218171 - RNA, 64 nt, Homo Sapiens; identical to SEQ ID NO: 99130

SEQ ID NO: 218172 - RNA, 64 nt, Homo Sapiens; identical to SEQ ID NO: 99131

SEQ ID NO: 218173 - RNA, 64 nt, Homo Sapiens; identical to SEQ ID NO: 99132

SEQ ID NO: 218174 - RNA, 64 nt, Homo Sapiens; identical to SEQ ID NO: 99133

SEQ ID NO: 218175 - RNA, 64 nt, Homo Sapiens; identical to SEQ ID NO: 99134

SEQ ID NO: 218176 - RNA, 64 nt, Homo Sapiens; identical to SEQ ID NO: 99135

SEQ ID NO: 218177 - RNA, 64 nt, Homo Sapiens; identical to SEQ ID NO: 99136

SEQ ID NO: 218178 - RNA, 64 nt, Homo Sapiens; identical to SEQ ID NO: 99137

SEQ ID NO: 218179 - RNA, 64 nt, Homo Sapiens; identical to SEQ ID NO: 99138

SEQ ID NO: 218180 - RNA, 64 nt, Homo Sapiens; identical to SEQ ID NO: 99139

SEQ ID NO: 218181 - RNA, 64 nt, Homo Sapiens; identical to SEQ ID NO: 99140

SEQ ID NO: 218182 - RNA, 64 nt, Homo Sapiens; identical to SEQ ID NO: 99141

SEQ ID NO: 218183 - RNA, 64 nt, Homo Sapiens; identical to SEQ ID NO: 99142

SEQ ID NO: 218184 - RNA, 64 nt, Homo Sapiens; identical to SEQ ID NO: 99143

SEQ ID NO: 218185 - RNA, 64 nt, Homo Sapiens; identical to SEQ ID NO: 99144

SEQ ID NO: 218186 - RNA, 64 nt, Homo Sapiens; identical to SEQ ID NO: 99145

SEQ ID NO: 218187 - RNA, 64 nt, Homo Sapiens; identical to SEQ ID NO: 99146

SEQ ID NO: 218188 - RNA, 64 nt, Homo Sapiens; identical to SEQ ID NO: 99147

SEQ ID NO: 218189 - RNA, 64 nt, Homo Sapiens; identical to SEQ ID NO: 99148

SEQ ID NO: 218190 - RNA, 64 nt, Homo Sapiens; identical to SEQ ID NO: 99149

SEQ ID NO: 218191 - RNA, 64 nt, Homo Sapiens
ccaaggaagagagauuguucugaaguuacccucugaaaaauauuuugucucucugacuugauuu

SEQ ID NO: 218192 - RNA, 64 nt, Homo Sapiens
uauuuuacauaauuaaauauguacauauugauuagaaaaauauaacaagcaauuuuuccugcua

SEQ ID NO: 218193 - RNA, 64 nt, Homo Sapiens
guaaugcauuguucucaguuucccugccaacauugaaaaauaaaaacagcagcuuuucuccuuu

SEQ ID NO: 218194 - RNA, 64 nt, Homo Sapiens
aaacuuuauauaaugugugguuucaauucagcuugaaaaauaaucucacuacauguagcaguac

SEQ ID NO: 218195 - RNA, 64 nt, Homo Sapiens
cgagggguggggggaggggggagauuuuucuuuugaaaaauaaugacucuuaggacauuuguuu

SEQ ID NO: 218196 - RNA, 64 nt, Homo Sapiens
ugguacaaaaccacucgccagagcuguggugucagaaaaauaaaauauauuguuucuuacaaaa

SEQ ID NO: 218197 - RNA, 64 nt, Homo Sapiens
agugcugccaacccugauauaggggaguuguauggaaaaauaguagaauuacacagcaugaaaa

SEQ ID NO: 218198 - RNA, 64 nt, Homo Sapiens
ugcaauaacauuuaggauaaucuuugacauuuuggaaaaauaagaauugaggaaaaaaagugua

SEQ ID NO: 218199 - RNA, 64 nt, Homo Sapiens
ucaaaagcuaaauauggcacacuuguucuuuacagaaaaauaaagauauuuuaaacaaaauacu

SEQ ID NO: 218200 - RNA, 64 nt, Homo Sapiens
aauauuuguagaaggguuauauuuuacuacuguggaaaaauauuuaagauaguuuugccagaac

SEQ ID NO: 218201 - RNA, 64 nt, Homo Sapiens
auauagcuauuuuuauggaauuuuucauugauaugaaaaauaugauauugcauaugcauaguuc

SEQ ID NO: 218202 - RNA, 64 nt, Homo Sapiens
aaacaagcugagcuuugguccacuaaaacaagaugaaaaauacaagagugacucuauaacucug

SEQ ID NO: 218203 - RNA, 64 nt, Homo Sapiens
gcauggaucaaguaagcauaguuuuauccagggagaaaaauaaaaggaagccauagaauugcuc

SEQ ID NO: 218204 - RNA, 64 nt, Homo Sapiens
uuggccuaaaccucaguuauuuuucauuccuaaagaaaaauaucucacauucuuggcuuaauca

SEQ ID NO: 218205 - RNA, 64 nt, Homo Sapiens
aaucucuuuuccacuccauuaaacugccaauauagaaaaauaaaaaaaccggucacugauggga

SEQ ID NO: 218206 - RNA, 64 nt, Homo Sapiens
auguuucauuaugcacuuuuaaauucaagagcuagaaaaauaaacuauggcuuauuucuaugac

SEQ ID NO: 218207 - RNA, 64 nt, Homo Sapiens
auguugauaauauauauuaacauuauucaagaaugaaaaauauagcucaaaguaugcaaugcuu

SEQ ID NO: 218208 - RNA, 64 nt, Homo Sapiens
guaaccaaaagggaagagcuauucacuguauguggaaaaauaauaacgaccccuuguuaccuug

SEQ ID NO: 218209 - RNA, 64 nt, Homo Sapiens
auuaaucauuuugcuguuaaauuucauuuauauugaaaaauaauuuucuuuaaaaaauguaagg

SEQ ID NO: 218210 - RNA, 64 nt, Homo Sapiens
auuuucacuuuaucaacugaugccaagcgaaagugaaaaauaucagggcuaaaguugugucuua

SEQ ID NO: 218211 - RNA, 64 nt, Homo Sapiens
uugguuacugggaaaaggucuuacuuuauucaaagaaaaauauaaggaaugucaaaaauacauu

SEQ ID NO: 218212 - RNA, 64 nt, Homo Sapiens
uguuacaaauuuauaauuucaaggcauguauuuugaaaaauaucuuuugcauuuaaguuguuug

SEQ ID NO: 218213 - RNA, 64 nt, Homo Sapiens
uauuuuuuuccaaaguguguauaucaaguuauuugaaaaauacccuaugaaauacauaaaccau

SEQ ID NO: 218214 - RNA, 64 nt, Homo Sapiens
uaagacaggguacuaauuuuuauacugguuuuuagaaaaauauuuauauuguuggugcucaaau

SEQ ID NO: 218215 - RNA, 64 nt, Homo Sapiens
aucggaccugguugaguaaggaccucuuaaaagggaaaaauaaauuuugccgucagcuucuuca

SEQ ID NO: 218216 - RNA, 64 nt, Homo Sapiens
ugugaugaagacaaauauguauaccuggcauagagaaaaauauauaccugguacauuggagaaa

SEQ ID NO: 218217 - RNA, 64 nt, Homo Sapiens
ggcauagagaaaaauauauaccugguacauuggagaaaaauaauuacacuuucaaagagaauuc

SEQ ID NO: 218218 - RNA, 64 nt, Homo Sapiens
uuaaaugcugcuggcuauuccuuuguauauaaaugaaaaauaccauucauuaaaauuaaguacu

SEQ ID NO: 218219 - RNA, 64 nt, Homo Sapiens
uuugauauucauagaguugugccuaccuuuaauggaaaaauacaugucagauacuuagauguuu

SEQ ID NO: 218220 - RNA, 64 nt, Homo Sapiens
aaaagcugauauuuccuaccuaagcaucucccgagaaaaauaucucauuaaaaagcccauaaau

SEQ ID NO: 218221 - RNA, 64 nt, Homo Sapiens
uauuaacuauccugaauauuuuauaauuuuguaggaaaaauaugcaucuauuuuuucuugacuu

SEQ ID NO: 218222 - RNA, 64 nt, Homo Sapiens
agccugagcaguguucucaguaauguauuugaaggaaaaauacccugauuugaaaccaacagca

SEQ ID NO: 218223 - RNA, 64 nt, Homo Sapiens
aagcgugacguguuucuaaugccccuugagaggugaaaaauaccacauaaugaucaguaugcug

SEQ ID NO: 218224 - RNA, 64 nt, Homo Sapiens
guuagcuacuaugaauggugccagugaagacacugaaaaauaagugauuucaguaaccuucugg

SEQ ID NO: 218225 - RNA, 64 nt, Homo Sapiens
ugcauuaauaaaagcagccaaauagggccaaagagaaaaauaacaggacucuguacuggaccua

SEQ ID NO: 218226 - RNA, 64 nt, Homo Sapiens
cuacaauauucacaaaauucuuauguucucuuaugaaaaauauacacuuuucauuuugucuucu

SEQ ID NO: 218227 - RNA, 64 nt, Homo Sapiens
cauacaccaaauauaggucuguuuuaaaggagaggaaaaauaguucaaggaguuuuugccucuu

SEQ ID NO: 218228 - RNA, 64 nt, Homo Sapiens
uauuuuuauuaccaauaaauuuaaaauuuuuuaagaaaaauauuuuuauccuagggccaagugu

SEQ ID NO: 218229 - RNA, 64 nt, Homo Sapiens
uauauagguauuuauuucagaauugauauuuugagaaaaauacaugugagucauuuuuucuguu

SEQ ID NO: 218230 - RNA, 64 nt, Homo Sapiens
agucacugagucugggugacacuuuuagggaaaugaaaaauaaaauuuaauucauauuugggaa

SEQ ID NO: 218231 - RNA, 64 nt, Homo Sapiens
cgugucaaucuggaugauaggcacugaagagguggaaaaauaauuguauguugcguaucccaag

SEQ ID NO: 218232 - RNA, 64 nt, Homo Sapiens
cuguuuggucaaguuaaggacaagauuuucagaggaaaaauacacaauggaauacaaccuuuga

SEQ ID NO: 218233 - RNA, 64 nt, Homo Sapiens
auauuuuuaugagaguggacauuauauuucuuuugaaaaauauacaaucagugauuuucaaugu

SEQ ID NO: 218234 - RNA, 64 nt, Homo Sapiens
augggaacauggacaccauuauggucugauccaggaaaaauaaauuuuaagauuuguucauaaa

SEQ ID NO: 218235 - RNA, 64 nt, Homo Sapiens
ugauugccacauuccuuuaaacagaauugagguugaaaaauauucaaagaauugaaugaauaca

SEQ ID NO: 218236 - RNA, 64 nt, Homo Sapiens
uauaaagaaaugagguugacaugcauugaugccugaaaaauaugauuuuuuaagggaugugccu

SEQ ID NO: 218237 - RNA, 64 nt, Homo Sapiens
ugccagugacucuugagguucucccaauaucacagaaaaauacaguccuggauuaauacuuugu

SEQ ID NO: 218238 - RNA, 64 nt, Homo Sapiens
cucucugcuuaaucuuuucuaaaaucgccuguaugaaaaauaccucgcuggauggaaaaguaga

SEQ ID NO: 218239 - RNA, 64 nt, Homo Sapiens
aagaaguaaagaagaggucacuagauguugcagugaaaaauaguaggccacuuggcucacacag

SEQ ID NO: 218240 - RNA, 64 nt, Homo Sapiens
uuaauugcuguaggauccuguucuuucagcaggugaaaaauaaaacgcaguucaaauuucaugg

SEQ ID NO: 218241 - RNA, 64 nt, Homo Sapiens
uuauuauuacugcaguaguugacuuugcuguauggaaaaauaaagugaaauugcccuaauaaaa

SEQ ID NO: 218242 - RNA, 64 nt, Homo Sapiens
ucaauuuaaaaaaugggcuacacaacaauaaggagaaaaauaaauauauaaauaacucuuauaa

SEQ ID NO: 218243 - RNA, 64 nt, Homo Sapiens
uaaauuggacuuaaucaagaacaagcaaccaauggaaaaauagguuagauaugauaccaaagac

SEQ ID NO: 218244 - RNA, 64 nt, Homo Sapiens
uucccgccccccuccccuguacgcaggccaaguggaaaaauacuagccccagaucugagccuug

SEQ ID NO: 218245 - RNA, 64 nt, Homo Sapiens
aauacagugguguggaauacuuacaugugguugggaaaaauaaaagccccaucguagcacagua

SEQ ID NO: 218246 - RNA, 64 nt, Homo Sapiens
gcuggaaaauuuccaauuucagugcuuauuuaaagaaaaauacuagaagagcugcagcuuugac

SEQ ID NO: 218247 - RNA, 64 nt, Homo Sapiens
auuaaccucauuguuuauggaugaacuuuggcaagaaaaauaacaugcaacugauuuauacaaa

SEQ ID NO: 218248 - RNA, 64 nt, Homo Sapiens
gaagacauuguauuaccacugaaaaauaacuuuagaaaaauauuuguugucuuauuauuauaua

SEQ ID NO: 218249 - RNA, 64 nt, Homo Sapiens
uuuagaaaaauauugaagaccuuauuauuauauagaaaaauaacccuauaugcuaugcuguugu

SEQ ID NO: 218250 - RNA, 64 nt, Homo Sapiens
gaguuuuagaaaugagaucuaguuuuagaaaugagaaaaauacaucaguuugauuggauacuua

SEQ ID NO: 218251 - RNA, 64 nt, Homo Sapiens
aaggaaaacuugaaucaauaaaacuuaucauaaggaaaaauagaguuguauaagcuacuguaag

SEQ ID NO: 218252 - RNA, 64 nt, Homo Sapiens
cauuauaaaagcagaacauaaaaaacagaagagagaaaaauauaauuuagaaguuuuggauaug

SEQ ID NO: 218253 - RNA, 64 nt, Homo Sapiens
ugucauauauuaaaaaagagcuugcuuacuacaagaaaaauauugaaauauugaaaauauugaa

SEQ ID NO: 218254 - RNA, 64 nt, Homo Sapiens
aauauuugguuaguaccuucacugagcaauaguggaaaaauaaaaaaauaaguaaacagaaaaa

SEQ ID NO: 218255 - RNA, 64 nt, Homo Sapiens
accaccacaaccaaguuccagcuggcaagaagaggaaaaauaacacagaggaguuaugaccagu

SEQ ID NO: 218256 - RNA, 64 nt, Homo Sapiens
auaugucaacugaagaucugacuguacuaaauaugaaaaauaaagcagcacauacuuucucuac

SEQ ID NO: 218257 - RNA, 64 nt, Homo Sapiens
caguaguaaaauauguaaccauugucccaguaaagaaaaauaacaaaaguuguaaaauguauau

SEQ ID NO: 218258 - RNA, 64 nt, Homo Sapiens
auguuuaaauguccauuuuuauucauuaugcuuugaaaaauaauuauggggaaauacauguuug

SEQ ID NO: 218259 - RNA, 64 nt, Homo Sapiens
aacuucaaaauauauauauauauauaauuuaaaggaaaaauaggugccuccuuuauaaacagua

SEQ ID NO: 218260 - RNA, 64 nt, Homo Sapiens
agagucucauuagacaaugauuuuuaaagcauuggaaaaauauuuugccuguaaaaguuaguaa

SEQ ID NO: 218261 - RNA, 64 nt, Homo Sapiens
aucagucuagaauugauauuauguugguagcugagaaaaauaucuuuugggauaacuuauuugu

SEQ ID NO: 218262 - RNA, 64 nt, Homo Sapiens
uugcuaagauuguguuggucagauuauuacaaaagaaaaauaugucauuggaagaaaucaccaa

SEQ ID NO: 218263 - RNA, 64 nt, Homo Sapiens
uaaucuaaucaauuucuuugaauucugucucuuagaaaaauacacaaucacuuuuacuuuuugu

SEQ ID NO: 218264 - RNA, 64 nt, Homo Sapiens
caaauguauaccuagcaauccaaagaaaaauguugaaaaauaaguacaaaauguuuuugucuac

SEQ ID NO: 218265 - RNA, 64 nt, Homo Sapiens
aagcauaaaacacaauuucuugcaucuucauuaggaaaaauaaaaggugccaucuuaaauuaau

SEQ ID NO: 218266 - RNA, 64 nt, Homo Sapiens
aaaaaauuaaugacuguauuugccacagcuuggggaaaaauagaucauuguguuuuuuguuggu

SEQ ID NO: 218267 - RNA, 64 nt, Homo Sapiens
acaugaaaugcuuccaagcaugacaacuuuuaaagaaaaauaugauacucucagauuuuaaggg

SEQ ID NO: 218268 - RNA, 64 nt, Homo Sapiens
agggagcuauuuucauuuagugcuaaacaaguaagaaaaauaagcucgagugaauuucuaaaug

SEQ ID NO: 218269 - RNA, 64 nt, Homo Sapiens
ccuuagaaaucauuguagaaacacaguuuugaaagaaaaauaccaugucucuaagccaacuuua

SEQ ID NO: 218270 - RNA, 64 nt, Homo Sapiens
ugacuuuuucugagcuuuucauggaaguggcagugaaaaauauguugaguguucauuuuaguga

SEQ ID NO: 218271 - RNA, 64 nt, Homo Sapiens
ucuuaaggcaucauaucuagaagcaaagaaaaaagaaaaauaacaauuuaaguuguguaaauug

SEQ ID NO: 218272 - RNA, 64 nt, Homo Sapiens
cugucucagaaaaaaaaaaaaagaaaaggaaaaagaaaaauauauauucuauauuuuuuuaacu

SEQ ID NO: 218273 - RNA, 64 nt, Homo Sapiens
cuuauuguauauuuuaugccugaaaacaauaauugaaaaauagcucauaaugcauuuuccaacu

SEQ ID NO: 218274 - RNA, 64 nt, Homo Sapiens
aauucuggacaaauaagucauuuauugggauacagaaaaauauaaauacacauggcuuaauuau

SEQ ID NO: 218275 - RNA, 64 nt, Homo Sapiens
aaaaaccuucuuuuagaucuuccuugggccuuuggaaaaauaugugacaagugaauguaagucu

SEQ ID NO: 218276 - RNA, 64 nt, Homo Sapiens
aaaaucaaugauuuuaaugcauagcaguauguuugaaaaauagaccauucuaaaaagcccauga

SEQ ID NO: 218277 - RNA, 64 nt, Homo Sapiens
uaccagaaagccaaauuuuauaaugcgggugaaagaaaaauauagauuaaaauugcugggcacu

SEQ ID NO: 218278 - RNA, 64 nt, Homo Sapiens
auuauauuuuuauuuuauuauuuuagugucuugagaaaaauaccaagagauauaauguuucuuu

SEQ ID NO: 218279 - RNA, 64 nt, Homo Sapiens
gugucacuaccguauuucuuccaugugcuugaaggaaaaauaaauuuaguacuuuugucuucuc

SEQ ID NO: 218280 - RNA, 64 nt, Homo Sapiens
acucuguugucuuacuugauaauaaccucaaaaagaaaaauacguuauagcuaugucuugugaa

SEQ ID NO: 218281 - RNA, 64 nt, Homo Sapiens
agcgugagacccugucucaaagaagaaaaaaagagaaaaauaacucuuuugaacaaacagacaa

SEQ ID NO: 218282 - RNA, 64 nt, Homo Sapiens
ucauugugguguauuauaauuaguuuugugaauagaaaaauaaagcacuuauguuuaaauuugu

SEQ ID NO: 218283 - RNA, 64 nt, Homo Sapiens
agauauauugcaaagucuguauuccagcucuuaagaaaaauauaagcauguuaaauaccauauu

SEQ ID NO: 218284 - RNA, 64 nt, Homo Sapiens
gugaaaauuaagucuaaugucagaauaacuuacagaaaaauagaaaaugcacagcuuuaaaaug

SEQ ID NO: 218285 - RNA, 64 nt, Homo Sapiens
aguuuuuaaaaauaaauuauaaacuuggagauuagaaaaauaaagcaguugcuguagaauaggc

SEQ ID NO: 218286 - RNA, 64 nt, Homo Sapiens
ugcuuuagaguuaaauauuccuaucuuaaguuuagaaaaauacaaaaaaccauuccaaggauga

SEQ ID NO: 218287 - RNA, 64 nt, Homo Sapiens
uugguaugcgauacagacagcuaacuuuucuuaugaaaaauacauauuugcauguaaacaauga

SEQ ID NO: 218288 - RNA, 64 nt, Homo Sapiens
auauuugcauguaaacaaugauuucaaaauacuugaaaaauaaaauuuuaacccaaaugaauaa

SEQ ID NO: 218289 - RNA, 64 nt, Homo Sapiens
aagaugagaguacacgguugcaguuuccacaucugaaaaauaagugcuuagcuucucuagacau

SEQ ID NO: 218290 - RNA, 64 nt, Homo Sapiens
gcuguuugacuugucaggugcuuuuguaauguuugaaaaauaaagcagucaaaaaaaaaaauac

SEQ ID NO: 218291 - RNA, 64 nt, Homo Sapiens
ucauuuaaaucugcauucagugaauguauugggagaaaaauaggucuugcagguuuccuuuuga

SEQ ID NO: 218292 - RNA, 64 nt, Homo Sapiens
ugaaugcagucuuucaugcuaaugaguuagucuggaaaaauaaagucuuauuuucuauguuuua

SEQ ID NO: 218293 - RNA, 64 nt, Homo Sapiens
agagaacuauuguuuggggagucuugagagaaaagaaaaauaugacuaauacuuacuguuaacu

SEQ ID NO: 218294 - RNA, 64 nt, Homo Sapiens
aaaacaacaaauacuuccaucaaucacuagucaagaaaaauauaucucaaauuuuucaucucuu

SEQ ID NO: 218295 - RNA, 64 nt, Homo Sapiens
ugucccuguggucugaauuugaacugcucugcaagaaaaauauccugcauugcaccaugagcaa

SEQ ID NO: 218296 - RNA, 64 nt, Homo Sapiens
uuaaaggaacaaaaaauccaaggaauaaauagcagaaaaauacccaggauuauaaagucaagug

SEQ ID NO: 218297 - RNA, 64 nt, Homo Sapiens
ugacauuauauauaaccaauguuauauucugaaagaaaaauaacaauagguuacuacaaaaaag

SEQ ID NO: 218298 - RNA, 64 nt, Homo Sapiens
uuuaaaaauuugaauggaagaccuaccuuguauagaaaaauaauuaacuuuguauagcccaugu

SEQ ID NO: 218299 - RNA, 64 nt, Homo Sapiens
guuaggguuuaaaaccauauugaucaacuagaaagaaaaauaugaaaagagaaaaauauuuuaa

SEQ ID NO: 218300 - RNA, 64 nt, Homo Sapiens
auauugaucaacuagaaagaaaaauaugaaaagagaaaaauauuuuaauuuaaaaauuguaaua

SEQ ID NO: 218301 - RNA, 64 nt, Homo Sapiens
gucauucauuggcaaagaugaaaucuugaccauagaaaaauacaauaauguaucccagaauuuu

SEQ ID NO: 218302 - RNA, 64 nt, Homo Sapiens
aguaauuuggcauauugaccgaagaugauggauugaaaaauauaaauuuaagugacaaauguua

SEQ ID NO: 218303 - RNA, 64 nt, Homo Sapiens
uauugcuuuugaacaaaacuccucuuaucuucaugaaaaauaaaucuauagcgaauguaauaug

SEQ ID NO: 218304 - RNA, 64 nt, Homo Sapiens
guuuccagagaaaaggccaagauuauuaaaaaaggaaaaauaugcuuacauauacaucuuaguu

SEQ ID NO: 218305 - RNA, 64 nt, Homo Sapiens
agaccagccugacauggugaaaccccaucucuacgaaaaauacaaaaauuagcugggcauagug

SEQ ID NO: 218306 - RNA, 64 nt, Homo Sapiens
auuuggaauagagaaaccaguauauuuuaaaaaagaaaaauauucuuuguagcaacuguaaauu

SEQ ID NO: 218307 - RNA, 64 nt, Homo Sapiens
uaaaaguuuuuuuccccuaucuguuugugcuuuggaaaaauauaugauggagaggcauaguaau

SEQ ID NO: 218308 - RNA, 64 nt, Homo Sapiens
uggcuccuuuaauuccucugaugcauuaucaaaggaaaaauauuauucaguguugcgguagcag

SEQ ID NO: 218309 - RNA, 64 nt, Homo Sapiens
uggcauauauccaaucacaauuagaaagaagccagaaaaauaaaaauucagcaggaauuacaca

SEQ ID NO: 218310 - RNA, 64 nt, Homo Sapiens
gcauuauugagguauuuaagaagauuauuuuagagaaaaauauuucucauuugauauaauuuuu

SEQ ID NO: 218311 - RNA, 64 nt, Homo Sapiens
ugaagaguuuggauguguaacuugugaugccuuagaaaaauauccuaagcacaaaauaaaccuu

SEQ ID NO: 218312 - RNA, 64 nt, Homo Sapiens
uuucguaaauauuugcaucuucuauguaaagugagaaaaauauguacaaaugaaaugauaggca

SEQ ID NO: 218313 - RNA, 64 nt, Homo Sapiens
gugagaaugguuuaauuccgagcaaacaguccuggaaaaauauguauguaaaaacaagccaguu

SEQ ID NO: 218314 - RNA, 64 nt, Homo Sapiens
aggcaucacaguuuugcaaccucugcuccaaagagaaaaauagaaugaguuuucuuucuuuuuu

SEQ ID NO: 218315 - RNA, 64 nt, Homo Sapiens
uuaggaaaaaggaaagucauuuugaccucagguagaaaaauagauugcuuugaguuuuauguag

SEQ ID NO: 218316 - RNA, 64 nt, Homo Sapiens
aguaucaugaaaaaaccuauuauuuuuaaaaaaggaaaaauaaaguacuuguacccccuaaauu

SEQ ID NO: 218317 - RNA, 64 nt, Homo Sapiens
aguauauuugcgugaugguuuagaacuguaauuagaaaaauacauugugguggcaaauguuugg

SEQ ID NO: 218318 - RNA, 64 nt, Homo Sapiens
uugguuuuuuaucaagaacaaaaaauuguaaauagaaaaauaauuuuuacauuaaaccuuuucu

SEQ ID NO: 218319 - RNA, 64 nt, Homo Sapiens
uuuacauuaaaccuuuucuaaaauauauaaagaagaaaaauauuuuaacauuaucauggcaggg

SEQ ID NO: 218320 - RNA, 64 nt, Homo Sapiens
ggauuugauuccacaguucuuucuuguucuucuugaaaaauauagcuauaauccucacuguauu

SEQ ID NO: 218321 - RNA, 64 nt, Homo Sapiens
uucacucccacuuauguguuacagagagauuaaagaaaaauaugagagagagagagaggagaag

SEQ ID NO: 218322 - RNA, 64 nt, Homo Sapiens
gauuuuuaaaaagcaaagaaaacaaaauauaagggaaaaauaugagaaaaauaaaaauaaaaag

SEQ ID NO: 218323 - RNA, 64 nt, Homo Sapiens
agcaaagaaaacaaaauauaagggaaaaauaugagaaaaauaaaaauaaaaagagaauaauagg

SEQ ID NO: 218324 - RNA, 64 nt, Homo Sapiens
cagccugcccaacguggugaaaccccaucucuaugaaaaauacaaaaaucagacgggcacagug

SEQ ID NO: 218325 - RNA, 64 nt, Homo Sapiens
uuucuacuaagggguuuagccauaacugugcauagaaaaauaauuaucuguaaaaaaugaaggg

SEQ ID NO: 218326 - RNA, 64 nt, Homo Sapiens
ucuugcucaucagaaccucagcuaaucuaccuaggaaaaauaguaucaaaggaaaugagaaagu

SEQ ID NO: 218327 - RNA, 64 nt, Homo Sapiens
ggaacccuaaaaaguuggcccgaugacuuaaagggaaaaauaauucauucccagagaugaguca

SEQ ID NO: 218328 - RNA, 64 nt, Homo Sapiens
ucgugguuuaaaauuacuaacaaguugugggaaagaaaaauaauauuugauuuugaaucuuaaa

SEQ ID NO: 218329 - RNA, 64 nt, Homo Sapiens
ggagaaaaagaaaacucuggcguuagaggauauagaaaaauauaaguacaauuguuacaaauaa

SEQ ID NO: 218330 - RNA, 64 nt, Homo Sapiens
ugaacgcccccagaaaauugugccaaagaguuuagaaaaauaaauauacaauaaaaguaaacac

SEQ ID NO: 218331 - RNA, 64 nt, Homo Sapiens
uaguucuaguguggucguuauaaaccaauauugugaaaaauagcaacuauucauuuguucacaa

SEQ ID NO: 218332 - RNA, 64 nt, Homo Sapiens
acacaaugauuuuccagacaaaugguaugguguugaaaaauaacuguuacuucuuaaagcagca

SEQ ID NO: 218333 - RNA, 64 nt, Homo Sapiens
uuaaaaaugcagaacugcuuuauccaagaaugcugaaaaauacuguucuauccagguuuccuaa

SEQ ID NO: 218334 - RNA, 64 nt, Homo Sapiens
uucaguguauguuuaauaauauacauuuaaugaugaaaaauauuuucagcaaagcuuuaaaacc

SEQ ID NO: 218335 - RNA, 64 nt, Homo Sapiens
aagggaaacuucugcuucacggaaucaaaccacagaaaaauacagguacaggcaacaggagaaa

SEQ ID NO: 218336 - RNA, 64 nt, Homo Sapiens
ucauuaccuaaaaucauuuuaguuacuuugauaggaaaaauacugauacuaguugucugaauug

SEQ ID NO: 218337 - RNA, 64 nt, Homo Sapiens
gcauccuuguacuuauaaucccaaugacuaugaagaaaaauaauuuagccaaauaguuccuaga

SEQ ID NO: 218338 - RNA, 64 nt, Homo Sapiens
gaaaaauaauuuagccaaauaguuccuagaacaggaaaaauaaggaauuauauuuugagauaag

SEQ ID NO: 218339 - RNA, 64 nt, Homo Sapiens
gauuuucaagcuuucaaauccucccuacuuccaagaaaaauaauuaaaaaaaaaacuucauucu

SEQ ID NO: 218340 - RNA, 64 nt, Homo Sapiens
gccuuggcucguucucuucucucuucaaucucuggaaaaauaaguacauauaguugauaacccc

SEQ ID NO: 218341 - RNA, 64 nt, Homo Sapiens
uauuuuguauuguucuaauggugauuuccuuaaugaaaaauacauuuuaaaggugauguaaaua

SEQ ID NO: 218342 - RNA, 64 nt, Homo Sapiens
ugcuuacauuuuucacuuuuucaaaaauaaauuagaaaaauauauucacagcuuauuauccaau

SEQ ID NO: 218343 - RNA, 64 nt, Homo Sapiens
uuuccuucuuguaccauuuccauuuuuguucugugaaaaauaaagguaccugagucaaaauugu

SEQ ID NO: 218344 - RNA, 64 nt, Homo Sapiens
ucuugguuuucauuugcuuauaaauaaaagagcagaaaaauaugacuuugagguuucaucaaua

SEQ ID NO: 218345 - RNA, 64 nt, Homo Sapiens
uagguaguauauugaagacaggugagaaguugcauaaacagaauaccauaaaaaacaauuaccu

SEQ ID NO: 218346 - RNA, 64 nt, Homo Sapiens
uauccauuuuguaguuauaguaaugaagauaacuuaaacagaaaagaaaacuugccucuauuua

SEQ ID NO: 218347 - RNA, 64 nt, Homo Sapiens
gauuauuggcuaaggcaggcuuuucaaauuuaccuaaacagaaagugguaguaaugauguauau

SEQ ID NO: 218348 - RNA, 64 nt, Homo Sapiens
ggaauaaauauaaaugagauuaguuaccaaaucauaaacagaguuaauauaaugccuuucaaau

SEQ ID NO: 218349 - RNA, 64 nt, Homo Sapiens
gaauuuuucagaacucauccaguccuuguaaucuuaaacagaugcaaauccuaccccugcccuu

SEQ ID NO: 218350 - RNA, 64 nt, Homo Sapiens
ugccucucacuuugaaagaaagacuccguaaucuuaaacagaugcaaauccaauuaggcggcca

SEQ ID NO: 218351 - RNA, 64 nt, Homo Sapiens
ugaagaaagaguauuauaccuacuuuuauucuguuaaacagaaugcauugcuuuaaccuuuggu

SEQ ID NO: 218352 - RNA, 64 nt, Homo Sapiens
aaaaacuguaauccuggggugaacauccuaguuuuaaacagaagauagaaaccccauuucuacu

SEQ ID NO: 218353 - RNA, 64 nt, Homo Sapiens
auacuggagaguauuuaacccuucccugccuuaguaaacagaguuuucuaaaauguauuacgca

SEQ ID NO: 218354 - RNA, 64 nt, Homo Sapiens
uuaucauugaacccaaaguagauauuauuuggaauaaacagaaucuugugaacuccuuggauau

SEQ ID NO: 218355 - RNA, 64 nt, Homo Sapiens
ccgggagaaugcuggcaaagauggcagagcagucuaaacagaguucacacucuccauguuagua

SEQ ID NO: 218356 - RNA, 64 nt, Homo Sapiens
ccuguuucagaaaucuggaguagaaaguucuguguaaacagaagggcaguucugauaagcuucc

SEQ ID NO: 218357 - RNA, 64 nt, Homo Sapiens
gcugagguaacaguaaucugcccauuuaguucaguaaacagacuguagagugucugacuauacu

SEQ ID NO: 218358 - RNA, 64 nt, Homo Sapiens
agauuguuuuagugggcccugauggucauuuuucuaaacagaggcccugcuuuguaauaugugg

SEQ ID NO: 218359 - RNA, 64 nt, Homo Sapiens
gggguaggaauggaagaugguaucuuuuauaugcuaaacagauuagaaaauuaacauaggauac

SEQ ID NO: 218360 - RNA, 64 nt, Homo Sapiens
ucuugaagaagcuuguuugccuuuagaagaaucguaaacagagucuaaacuaaaggcuuuuugg

SEQ ID NO: 218361 - RNA, 64 nt, Homo Sapiens
gauguauuuaucacuuggacaucuguuuauaauauaaacagacaugugacugggaacaucuugc

SEQ ID NO: 218362 - RNA, 64 nt, Homo Sapiens
aaacuacaguccuuauaaaccauuggcaugguaauaaacagaucuuaaguauaaaaauuuugua

SEQ ID NO: 218363 - RNA, 64 nt, Homo Sapiens; identical to SEQ ID NO: 108409

SEQ ID NO: 218364 - RNA, 64 nt, Homo Sapiens; identical to SEQ ID NO: 108410

SEQ ID NO: 218365 - RNA, 64 nt, Homo Sapiens; identical to SEQ ID NO: 108411

SEQ ID NO: 218366 - RNA, 64 nt, Homo Sapiens; identical to SEQ ID NO: 108412

SEQ ID NO: 218367 - RNA, 55 nt, Homo Sapiens; identical to SEQ ID NO: 113265

SEQ ID NO: 218368 - RNA, 64 nt, Homo Sapiens; identical to SEQ ID NO: 113266

SEQ ID NO: 218369 - RNA, 64 nt, Homo Sapiens; identical to SEQ ID NO: 113267

SEQ ID NO: 218370 - RNA, 64 nt, Homo Sapiens; identical to SEQ ID NO: 113268

SEQ ID NO: 218371 - RNA, 64 nt, Homo Sapiens; identical to SEQ ID NO: 113269

SEQ ID NO: 218372 - RNA, 64 nt, Homo Sapiens; identical to SEQ ID NO: 113270

SEQ ID NO: 218373 - RNA, 64 nt, Homo Sapiens; identical to SEQ ID NO: 113271

SEQ ID NO: 218374 - RNA, 64 nt, Homo Sapiens; identical to SEQ ID NO: 113272

SEQ ID NO: 218375 - RNA, 64 nt, Homo Sapiens; identical to SEQ ID NO: 113273

SEQ ID NO: 218376 - RNA, 64 nt, Homo Sapiens; identical to SEQ ID NO: 113274

SEQ ID NO: 218377 - RNA, 64 nt, Homo Sapiens; identical to SEQ ID NO: 113275

SEQ ID NO: 218378 - RNA, 64 nt, Homo Sapiens; identical to SEQ ID NO: 113276

SEQ ID NO: 218379 - RNA, 64 nt, Homo Sapiens; identical to SEQ ID NO: 113277

SEQ ID NO: 218380 - RNA, 64 nt, Homo Sapiens; identical to SEQ ID NO: 113278

SEQ ID NO: 218381 - RNA, 64 nt, Homo Sapiens
acccuccgcacucaccugccgggacccucccuauuccauccaagggaagcagaacugccaaaga

SEQ ID NO: 218382 - RNA, 64 nt, Homo Sapiens
cuggaagacaagguguuucugccaaacggggaccuccauccagagaaaaggaagaaggugcagg

SEQ ID NO: 218383 - RNA, 64 nt, Homo Sapiens
ucagcugggucacauccaucccuccauucauccuuccauccaucuuuccauccauuaccuccau

SEQ ID NO: 218384 - RNA, 64 nt, Homo Sapiens
cauccaucccuccauucauccuuccauccaucuuuccauccauuaccuccauccauccuuccaa

SEQ ID NO: 218385 - RNA, 64 nt, Homo Sapiens
auucauccuuccauccaucuuuccauccauuaccuccauccauccuuccaacauauauuuauug

SEQ ID NO: 218386 - RNA, 64 nt, Homo Sapiens
caccagccaccucauccccaacccccuguaagguuccauccaccccugcgucgagcugggaagg

SEQ ID NO: 218387 - RNA, 64 nt, Homo Sapiens
ccuccucccugcccucgggucuccccaccugcacuccauccagcuacaggagagauagaagccu

SEQ ID NO: 218388 - RNA, 64 nt, Homo Sapiens
guauauauugcuacucauucuuuuaaauuauugauccauccauaugucaccuccauccagauuc

SEQ ID NO: 218389 - RNA, 64 nt, Homo Sapiens
uucuuuuaaauuauugaucccaacuacugucaccuccauccagaguuuggggguuuuauaaaag

SEQ ID NO: 218390 - RNA, 64 nt, Homo Sapiens
cauuugggucuuaacuuauuggaacuguagagcauccauccauccauccauccagcaaugugac

SEQ ID NO: 218391 - RNA, 64 nt, Homo Sapiens
ugggucuuaacuuauuggaacuguagagcauccauccauccauccauccagcaaugugacuuuu

SEQ ID NO: 218392 - RNA, 64 nt, Homo Sapiens
ucuuaacuuauuggaacuguagagcauccauccauccauccauccagcaaugugacuuuuucau

SEQ ID NO: 218393 - RNA, 64 nt, Homo Sapiens
aacuuauuggaacuguagagcauccauccauccauccauccagcaaugugacuuuuucaugucu

SEQ ID NO: 218394 - RNA, 64 nt, Homo Sapiens
auggaacuguuuucugguccacaugaacacaggcuccauccaggcccagcuccuacccaccgcc

SEQ ID NO: 218395 - RNA, 64 nt, Homo Sapiens
gguaaccuugucugcucugccauuccacugcuccuccauccacucgccaaucccaagagucugg

SEQ ID NO: 218396 - RNA, 64 nt, Homo Sapiens
aagcuagucccuuguuucucaacuguauuuuugguccauccagguaggauugaaacagucuaua

SEQ ID NO: 218397 - RNA, 64 nt, Homo Sapiens
uuccagaccucuacucauguucuguaacuugaauuccauccauucacucaugaaaauaugguau

SEQ ID NO: 218398 - RNA, 64 nt, Homo Sapiens
cuucccaggucuaugcccaagagaauugaaaacauccauccacacaauaccugugcucccgcgu

SEQ ID NO: 218399 - RNA, 64 nt, Homo Sapiens
acucaaaagucaaacgguagcaacaacccaaauguccauccacagaugaauuaagacaugaagu

SEQ ID NO: 218400 - RNA, 64 nt, Homo Sapiens
ccuaaaguucauugacuaauaaacacuucguugauccauccagcaaggaagcuggggcagugaa

SEQ ID NO: 218401 - RNA, 64 nt, Homo Sapiens
ugauuuuacaguuuuauuuucuagcugggcuaacuccauccaaauugcuaggacaccaaaagac

SEQ ID NO: 218402 - RNA, 64 nt, Homo Sapiens
uuugugucugggucuugucaacaucuaauuuuuuuccauccauucuguuacacuuuguauuuuc

SEQ ID NO: 218403 - RNA, 64 nt, Homo Sapiens
agcaaaaaauaggguacauaaagcaggguggcuguccauccacugauucuggggugagaagcga

SEQ ID NO: 218404 - RNA, 64 nt, Homo Sapiens
ggcagagaaccaaaggggccccagcauaaauccauccauccaaaccggcucccuccagacaaug

SEQ ID NO: 218405 - RNA, 64 nt, Homo Sapiens
caaaggcagagaaccaaaggaaugccagcauaaauccauccaucacacccggcucccuccagac

SEQ ID NO: 218406 - RNA, 64 nt, Homo Sapiens
ggcugguuacagcuucagucccuuugucugucuguccauccauuccuccauccacccaucuguc

SEQ ID NO: 218407 - RNA, 64 nt, Homo Sapiens
cuucagucccuuugucugucuguccauccauuccuccauccacccaucuguccauccgcccauc

SEQ ID NO: 218408 - RNA, 64 nt, Homo Sapiens
cauccacccaucuguccauccgcccaucugcccguccauccauccauccacucuuccacccucu

SEQ ID NO: 218409 - RNA, 64 nt, Homo Sapiens
cacccaucuguccauccgcccaucugcccguccauccauccauccacucuuccacccucuaccc

SEQ ID NO: 218410 - RNA, 64 nt, Homo Sapiens
caucuguccauccgcccaucugcccguccauccauccauccacucuuccacccucuaccccuua

SEQ ID NO: 218411 - RNA, 64 nt, Homo Sapiens
auacucacugggcaccagccuugcccucuuagccuccauccauccagacagcccuucccaccuc

SEQ ID NO: 218412 - RNA, 64 nt, Homo Sapiens
ucacugggcaccagccuugcccucuuagccuccauccauccagacagcccuucccaccuccugg

SEQ ID NO: 218413 - RNA, 64 nt, Homo Sapiens
agcacuuuuagaaaucuucucugaccuagaagaauccauccaaaucccugccuuccucucugaa

SEQ ID NO: 218414 - RNA, 64 nt, Homo Sapiens
aguucccuucucugacaggggccauccucuaucuuccauccagcggcucuucuuuuuaggaagg

SEQ ID NO: 218415 - RNA, 64 nt, Homo Sapiens
cccugugucuuuccauagucugggcgccagacccuccauccaagccugcuccauccaucccucc

SEQ ID NO: 218416 - RNA, 64 nt, Homo Sapiens
ccuccugggcgccagacccuauccuggggccugcuccauccaucgagucugacuggagucucgc

SEQ ID NO: 218417 - RNA, 64 nt, Homo Sapiens
uaugcagugggaggauucgaauugcaacuguagggaacaccauucaccaaggagcaaugcuggg

SEQ ID NO: 218418 - RNA, 64 nt, Homo Sapiens
agcccgauuucaaauggcugucuugcucccaugagaacaccaagcauacagaucacugguccuu

SEQ ID NO: 218419 - RNA, 64 nt, Homo Sapiens
cagcccccagaucccacaguuuagcuauaaaccacucaaagauuuguuagauguauccuagcuu

SEQ ID NO: 218420 - RNA, 64 nt, Homo Sapiens
acuucaaaccauuuaacugggggugaguucucuccucaaagaagauuuucugcuccugaaggca

SEQ ID NO: 218421 - RNA, 64 nt, Homo Sapiens
cuacggaauuuagcauuuugugaaagucacuggucucaaagaauauggaaauggauugaaagag

SEQ ID NO: 218422 - RNA, 64 nt, Homo Sapiens
agcuguggaaagaagucacaaauguuugaacaaacucaaagaaccacacauuugacuuggaagc

SEQ ID NO: 218423 - RNA, 64 nt, Homo Sapiens
cauuuguaccuuauugaucuuugcccauggaagucucaaagaucuuucguugguuguuucucug

SEQ ID NO: 218424 - RNA, 64 nt, Homo Sapiens
gucuagaauccugcuuuacaggaucauguaaaugcucaaagauguaauguaguucuuuguuccu

SEQ ID NO: 218425 - RNA, 64 nt, Homo Sapiens
uagaguuaaugaguuguugucuguucuccaaaaccucaaagagaaauaacuucacauaaacuuc

SEQ ID NO: 218426 - RNA, 64 nt, Homo Sapiens
aagagugaggcuaaacugcgccgagugugugugacucaaagaucagcuucuaaagacauuguca

SEQ ID NO: 218427 - RNA, 64 nt, Homo Sapiens
cauuaccaccaaccccacagaaauacgaaaaacccucaaagauuacuauaaacaccuguaugca

SEQ ID NO: 218428 - RNA, 64 nt, Homo Sapiens
aauucagccauuguggaaagcacugcagcgauuucucaaagacauaaaagaacauagcauucaa

SEQ ID NO: 218429 - RNA, 64 nt, Homo Sapiens
uauaagugggagcuaaacauugauuacacauggacucaaagaagggaacaguagacacgggcuu

SEQ ID NO: 218430 - RNA, 64 nt, Homo Sapiens
ugaaaggacucauacuggagauacuacuacucagcucaaagacaaaauguggaaaagcauuuag

SEQ ID NO: 218431 - RNA, 64 nt, Homo Sapiens
ugaaaagacucauacuggagauaucacaacucugcucaaagacaaaaugugggaaaguguucgu

SEQ ID NO: 218432 - RNA, 64 nt, Homo Sapiens
ugcucacauuucucuaauguacugcacuugaugccaguaggaaagaagcuuaagugucuucagu

SEQ ID NO: 218433 - RNA, 64 nt, Homo Sapiens
gguaaauguguuuccacuauacuugggaaaaggucaguaggaugugcauccuagggaagauaaa

SEQ ID NO: 218434 - RNA, 64 nt, Homo Sapiens
aaaaaaaaaaaaaaaaaaaauuugucaguucaugcaguaggauaauauguaugaaugccagaaa

SEQ ID NO: 218435 - RNA, 64 nt, Homo Sapiens
ugcuccccugaaggacgggguuggaaguguugugcaguaggaccccugaggccucggcuugcuc

SEQ ID NO: 218436 - RNA, 64 nt, Homo Sapiens
uugauuucuccagguuugcugugucucacagaggcaguaggaacccagcucucagggcugucuu

SEQ ID NO: 218437 - RNA, 64 nt, Homo Sapiens
gcaucagaguugauaaauuagauugaaaccauuccaguaggaaaucaggcaguucccuguugaa

SEQ ID NO: 218438 - RNA, 64 nt, Homo Sapiens
aaaaauccauccaucugagauuguuuuuuggcuccaguaggaaauguuguacauagaguucagc

SEQ ID NO: 218439 - RNA, 64 nt, Homo Sapiens
cucccccgcaggagcuggcgcaggguggggcgcgcaguaggaacuaaagccugacauucuugca

SEQ ID NO: 218440 - RNA, 64 nt, Homo Sapiens
gcauuacuugcuuccuugcaugauugucuuuaugcauccccaaucuuaauugagaccauacuug

SEQ ID NO: 218441 - RNA, 64 nt, Homo Sapiens
uguggaauugcacaucuaccuuacaauuacugaccauccccaguagacuccccagucccauaau

SEQ ID NO: 218442 - RNA, 57 nt, Homo Sapiens; identical to SEQ ID NO: 54899

SEQ ID NO: 218443 - RNA, 64 nt, Homo Sapiens
agugucuauaguguuggacagcacauucuuagagcauccccaaucaauaguuucagaaguuaua

SEQ ID NO: 218444 - RNA, 64 nt, Homo Sapiens
gguaagagcuucgaucucugugaugacuugugcacauccccaaggucgcccagcagugcugcuc

SEQ ID NO: 218445 - RNA, 64 nt, Homo Sapiens
cuaccuccuuccuucuaccccauucagcuugucucauccccagugagugacugagagcacuuaa

SEQ ID NO: 218446 - RNA, 64 nt, Homo Sapiens
ucuaacuucagccagaccugccagccuaggaaaacauccccauucccuaacagguugggcuggc

SEQ ID NO: 218447 - RNA, 64 nt, Homo Sapiens
gcugcccaaaccaccacugccgcccccccuccaucauccccaagucuaggccuugguaacuaug

SEQ ID NO: 218448 - RNA, 64 nt, Homo Sapiens
gugguggggaggggaggcagguguggguagcgcacauccccacagaucaaucucugcagaugac

SEQ ID NO: 218449 - RNA, 64 nt, Homo Sapiens
cuuaggaugagagucagagccuuuggaaaggcugcauccccagggcuagagcucagaugaccuu

SEQ ID NO: 218450 - RNA, 64 nt, Homo Sapiens
ccccacucgaugacugccucaucuuccucaguuucauccccauccccaggucuuccuagacgcu

SEQ ID NO: 218451 - RNA, 64 nt, Homo Sapiens
ucgaugacugccucaucuuccucaguuucauccccauccccaggucuuccuagacgcucagcac

SEQ ID NO: 218452 - RNA, 64 nt, Homo Sapiens
cccugcccuggccuggguggaggaacugugccuccauccccagaagaaacagcccccucugcug

SEQ ID NO: 218453 - RNA, 64 nt, Homo Sapiens
cagagccccucccgccgccucagaccccugugcacauccccagggccucagccgucucauuggu

SEQ ID NO: 218454 - RNA, 64 nt, Homo Sapiens
aaggucuguggcuccucccgaaacccaaguuaugcauccccauccccaugcccucaucccgacc

SEQ ID NO: 218455 - RNA, 64 nt, Homo Sapiens
uguggcuccucccgaaacccaaguuaugcauccccauccccaugcccucaucccgaccucuuag

SEQ ID NO: 218456 - RNA, 64 nt, Homo Sapiens
ccugggagagggugagguucagcacaucacacaccauccccacugucauucagggccugggucu

SEQ ID NO: 218457 - RNA, 64 nt, Homo Sapiens
cuccauggagccacuaggccuggccuccucuacacauccccagggcuaucugguuaauuccauc

SEQ ID NO: 218458 - RNA, 64 nt, Homo Sapiens
cuuuuuuuuuuuucuucugucccauuuuccaauccauccccagcuuaucccaguaacuccucuu

SEQ ID NO: 218459 - RNA, 64 nt, Homo Sapiens
augguuaauuccaacucucagucucuuuaggggacauccccaacgaacacuuuggggcugauuu

SEQ ID NO: 218460 - RNA, 64 nt, Homo Sapiens
cugguccugguauugauacaugcuuaagcccucucauccccacggcagauuucaggcugauccc

SEQ ID NO: 218461 - RNA, 64 nt, Homo Sapiens
gcaguuucaggugccggcugggccaggagaggcccauccccagggaggcguuuggccccggccu

SEQ ID NO: 218462 - RNA, 64 nt, Homo Sapiens
gaugcaacugguuuuacuagugugcaaguguguucauccccaaguucucuuuuguccucacaug

SEQ ID NO: 218463 - RNA, 64 nt, Homo Sapiens
cuaugagcccagcauggaugugucucaggcaccucauccccaccccaccucaccccaacaaacu

SEQ ID NO: 218464 - RNA, 64 nt, Homo Sapiens
gaggcagagaggcuccauggccgugcugcugggccauccccaacucccuaucccauccccagcc

SEQ ID NO: 218465 - RNA, 64 nt, Homo Sapiens
gccgugcugcugggccauccccaacucccuaucccauccccagccuccacccccauccagaugg

SEQ ID NO: 218466 - RNA, 64 nt, Homo Sapiens
ccgugugucacaacaggcuauagggcggcguguucauccccacaccacgccgugugucacgggc

SEQ ID NO: 218467 - RNA, 64 nt, Homo Sapiens
ccgugugucacgggcuaggguuauguggcguguucauccccacgaaaacagggucaccagugca

SEQ ID NO: 218468 - RNA, 64 nt, Homo Sapiens
ccgccgggcucugcguccccacguccccucgucccauccccacguccccucaucccgucaccuc

SEQ ID NO: 218469 - RNA, 64 nt, Homo Sapiens
ccugucaccucguccccacguccccucgucuccucauccccacguccucucguccccuuguccc

SEQ ID NO: 218470 - RNA, 64 nt, Homo Sapiens
gugccagguacgacgcuugccccggcccacccuccauccccacccuccauccccacccuagaug

SEQ ID NO: 218471 - RNA, 64 nt, Homo Sapiens
cgcuugccccggcccacccuccauccccacccuccauccccacccuagauggagcgagggccuu

SEQ ID NO: 218472 - RNA, 64 nt, Homo Sapiens
cuuuacccagcucuuggggugucucuguuuuuuccauccccacuuccugccuucucguggcccu

SEQ ID NO: 218473 - RNA, 64 nt, Homo Sapiens
aucucagccaccuuccucaggcucacuccaccuacauccccagucugccacaccccaucccuuu

SEQ ID NO: 218474 - RNA, 64 nt, Homo Sapiens
cauagggcuggcucacaucccgguagggcggugccauccccaccugcagcuucaacucucucgg

SEQ ID NO: 218475 - RNA, 64 nt, Homo Sapiens
ucuaaaaccaguaaaucagccagcacugggugcccauccccaucaccuucucuggucuucaguc

SEQ ID NO: 218476 - RNA, 64 nt, Homo Sapiens
gauuagugccaggcagcccugccagccaugccuacauccccaugggcacagaacaagccaaagc

SEQ ID NO: 218477 - RNA, 64 nt, Homo Sapiens
uugguggcugcacacucuuccuggcccgcacccccauccccagucccuguuccccaagaggaua

SEQ ID NO: 218478 - RNA, 64 nt, Homo Sapiens
ccugcuaucugcaaugaccaccauagcuuaaccccauccccacccucaaccccaagcucaaccc

SEQ ID NO: 218479 - RNA, 64 nt, Homo Sapiens
uauccuccaccccacaucccaccacauccaccuccauccccaacccauccucauccccaacuac

SEQ ID NO: 218480 - RNA, 64 nt, Homo Sapiens
cccaccacauccaccuccauccccaacccauccucauccccaacuacagccccaaacccagccc

SEQ ID NO: 218481 - RNA, 64 nt, Homo Sapiens
cagccccaaacccagccccagacuaauccacagccauccccaacucauccucauccccaacugc

SEQ ID NO: 218482 - RNA, 64 nt, Homo Sapiens
ccagacuaauccacagccauccccaacucauccucauccccaacugcagccccaaacccaaccc

SEQ ID NO: 218483 - RNA, 64 nt, Homo Sapiens
auccccaacugcagccccaaacccaacccagggccauccccaaacccauccccaagccaaacuc

SEQ ID NO: 218484 - RNA, 64 nt, Homo Sapiens
agccccaaacccaacccagggccauccccaaacccauccccaagccaaacucaacaccaucccc

SEQ ID NO: 218485 - RNA, 64 nt, Homo Sapiens
ucccuaaucaccucuccugccccuagcucagccucauccccaacuccaugccugucuccaaucc

SEQ ID NO: 218486 - RNA, 64 nt, Homo Sapiens
cauccucaacuaagcuccucuccagcccuggccacauccccauccucccccaaccuccagcccc

SEQ ID NO: 218487 - RNA, 64 nt, Homo Sapiens
uccaccgucccgaagccaacuucacccauguccccauccccaaucuuguccccauuccugacuc

SEQ ID NO: 218488 - RNA, 64 nt, Homo Sapiens
acugccgggaagugucggccccccacugcccugccauccccaguuuccccuugcauccugggag

SEQ ID NO: 218489 - RNA, 64 nt, Homo Sapiens
cucucaaccgucucccucgggaacuugacaucuccauccccaggcugagccacgcccagugugu

SEQ ID NO: 218490 - RNA, 64 nt, Homo Sapiens
uugggaccaggugggcuguguccgccacaucacccauccccauccccugacucuuucaccggca

SEQ ID NO: 218491 - RNA, 64 nt, Homo Sapiens
gcagcugggccccucuuccagcagcggccguauccauccccaggggcugugcuccgggccaaug

SEQ ID NO: 218492 - RNA, 64 nt, Homo Sapiens
aaccuaacagauuauuuuguacaacauaauguugacaaaucaggaaaccaucgggagcuaagaa

SEQ ID NO: 218493 - RNA, 64 nt, Homo Sapiens
uuuuauucaagcuuucuaaauuuugucugauuuuacaaaucagacaccuuuagacaaaggugac

SEQ ID NO: 218494 - RNA, 64 nt, Homo Sapiens
acuccaauaaauuuaaugacuaaaugccaaguuaacaaaucaacuuccauuuggauuguaggug

SEQ ID NO: 218495 - RNA, 64 nt, Homo Sapiens
agcuaucuaacaacuaauuacuaauuuuuaaagaacaaaucacacauuuaaaaaaucuguagaa

SEQ ID NO: 218496 - RNA, 64 nt, Homo Sapiens
cacuauaauaaacugcaucauuagcaaaccauguacaaaucaauagccuacaacauagaugcau

SEQ ID NO: 218497 - RNA, 64 nt, Homo Sapiens
uuagccaaaaagccuacaaccugagaggguuuuaacaaaucauagucacuguaacagcacuuug

SEQ ID NO: 218498 - RNA, 64 nt, Homo Sapiens
gcaaagaaaaaucccaaaguguacauagauuguuacaaaucaaaucaggguuaccaaagaaggc

SEQ ID NO: 218499 - RNA, 64 nt, Homo Sapiens
cugcuuucuuuauccucucugauuggaacgcgccacaaaucaucucugacuucuuauuaccucc

SEQ ID NO: 218500 - RNA, 64 nt, Homo Sapiens
uuuaguguugggcugcaagguugguucaguauacacaaaucaauaaaugugauuuaucacauac

SEQ ID NO: 218501 - RNA, 64 nt, Homo Sapiens
caaagaucuaauccagaaucuauaaagaacucaaacaaaucaacaaugagaaaaacaaccccau

SEQ ID NO: 218502 - RNA, 64 nt, Homo Sapiens
ccgcuucucucaguuuauuuucugugaaaacauuacaaaucaaaugggugagguauaucccacu

SEQ ID NO: 218503 - RNA, 64 nt, Homo Sapiens
ucuaugcagcgaucuugggaacaugauccucaugacaaaucauuucccuauauccugaagaaga

SEQ ID NO: 218504 - RNA, 64 nt, Homo Sapiens
ccucuucccuuucuguguguuuuuauuuuagcagauaguucaaagcaauaaaagauuucuuuuu

SEQ ID NO: 218505 - RNA, 64 nt, Homo Sapiens
auuucucucugcguccuauuucauuagugaagacauaguucaccuaaaauggcauccugcucug

SEQ ID NO: 218506 - RNA, 64 nt, Homo Sapiens
auggguaugagauauuuauuuuuggggugauaaaauaguucaccaaaauacggaucauuuguau

SEQ ID NO: 218507 - RNA, 64 nt, Homo Sapiens
uuaggggaagcauuuuuccaaaugcuaucuaaccauaguucauguggugaauuuccugacagac

SEQ ID NO: 218508 - RNA, 64 nt, Homo Sapiens
cagcaugcuggguugucauggguuugcugcauacauaguucacccuaauuuauacuuacucauc

SEQ ID NO: 218509 - RNA, 64 nt, Homo Sapiens
cuucucaugaacuauuucucguacaaaucauuaaauaguucauuggaugaggcugggugacauu

SEQ ID NO: 218510 - RNA, 64 nt, Homo Sapiens
uccucugggaggaaugucuucugucuuugguauuauaguucaucuucccauucuuuuacuuagu

SEQ ID NO: 218511 - RNA, 64 nt, Homo Sapiens
gaacuuuguucuguuuucugccacaaaaaugugaauaguucagagugaaaaccuuuugugaugg

SEQ ID NO: 218512 - RNA, 64 nt, Homo Sapiens
caaaaaauuagcugggcaugguggcauauaccuguaaccccaacuacuuggguggcugaggcag

SEQ ID NO: 218513 - RNA, 64 nt, Homo Sapiens
ucagaaguaguaaacuaucuuugaggaaauacuguaaccccagaauauuuccucuugacuucuu

SEQ ID NO: 218514 - RNA, 64 nt, Homo Sapiens
ccaucauuuucuguguaaaugguuuauuguucuauaaccccagccaggucuaaauguaaugguu

SEQ ID NO: 218515 - RNA, 64 nt, Homo Sapiens
cuaagaugcacaaugucuccucuuuguaauuauauaaccccaaaugaaaacuugcacaggguca

SEQ ID NO: 218516 - RNA, 64 nt, Homo Sapiens
gaugugaagaucgcuugugagucagacuuguagauaaccccaaagggauuugggaugagauaug

SEQ ID NO: 218517 - RNA, 64 nt, Homo Sapiens
uucugcuuacccuugauuuucugcucacaggauguaaccccaccgggaugugcugugugugcac

SEQ ID NO: 218518 - RNA, 64 nt, Homo Sapiens
gcaccaggcugcugggugugguggcucauaccuguaaccccagcacuuugggaggcugagguag

SEQ ID NO: 218519 - RNA, 64 nt, Homo Sapiens
augauaugcaaaggcaccuguucuccucaugaccuaaccccaauucuuacuccacggguucaug

SEQ ID NO: 218520 - RNA, 64 nt, Homo Sapiens
ggaguggcgagcccagcugcccagcccugcccccccuccccauagccagcacagcuaucccgcg

SEQ ID NO: 218521 - RNA, 64 nt, Homo Sapiens
gucagaacacgaucugggggggggauccugucuuccuccccaccccaccccacucuuacccaau

SEQ ID NO: 218522 - RNA, 64 nt, Homo Sapiens
caauucugaauagccaguggggcacacugacuguccuccccaggggaacugcagcgcccuccuc

SEQ ID NO: 218523 - RNA, 64 nt, Homo Sapiens
cugacuguccuccccaggggaacugcagcgcccuccuccccacugcccccugcagccccugaga

SEQ ID NO: 218524 - RNA, 64 nt, Homo Sapiens
ccccugcagccccugagauauuuugcucacuaucccuccccacuugcuucccugauaugugcuc

SEQ ID NO: 218525 - RNA, 64 nt, Homo Sapiens
ggcaucuucccugaagcccccaaucuggccccccccuccccagacuuccuccccaaaacacccc

SEQ ID NO: 218526 - RNA, 64 nt, Homo Sapiens
aagcccccaaucuggccccccccuccccagacuuccuccccaaaacaccccagcuuucuggcuu

SEQ ID NO: 218527 - RNA, 64 nt, Homo Sapiens
auuagggcuuagccaucucccuguccccagcaccccuccccagcccacagugguggccucugcc

SEQ ID NO: 218528 - RNA, 64 nt, Homo Sapiens
aguccugacaguguuugaaaagggccgccugcccccuccccacugugcuuuugaugccuuugga

SEQ ID NO: 218529 - RNA, 64 nt, Homo Sapiens
ggcagugguuuuggcaaacgcuaaagagcccuugccuccccauuucccaucugcaccccuucuc

SEQ ID NO: 218530 - RNA, 64 nt, Homo Sapiens
uugccuccccauuucccaucugcaccccuucucuccuccccaaaucaauacacuaguuguuucu

SEQ ID NO: 218531 - RNA, 64 nt, Homo Sapiens
gccaucguccugggacucggagacuauggccucgccuccccacccuccucuuggaauuacaagc

SEQ ID NO: 218532 - RNA, 64 nt, Homo Sapiens
uguacauagagaucuauuuuuucuaaaacauuccccuccccacuccucucccacagagugcugg

SEQ ID NO: 218533 - RNA, 64 nt, Homo Sapiens
aaaaaaauccuucaagggagcugcuuggaaguggccuccccaggugccuuuggagagaacuguu

SEQ ID NO: 218534 - RNA, 64 nt, Homo Sapiens
aaucuucaccccacuuccucuacccccagguucuccuccccacagccaguccccuuuccuggau

SEQ ID NO: 218535 - RNA, 64 nt, Homo Sapiens
gccacggcuguuucuucuuugugcuucccgugugccuccccaguagcccucaccugcauaccaa

SEQ ID NO: 218536 - RNA, 64 nt, Homo Sapiens
ccaggcugaccucagcucccgaaggcucgcacagccuccccauccuuccuucccagcccuugug

SEQ ID NO: 218537 - RNA, 64 nt, Homo Sapiens
cugcccugcccaccucaggcccccacccuccacuccuccccacgguacugugaacgucguguga

SEQ ID NO: 218538 - RNA, 64 nt, Homo Sapiens
ggcuuuccacccacacugcagcuggagccauuggccuccccaggccccgcuuuggagaggcuga

SEQ ID NO: 218539 - RNA, 61 nt, Homo Sapiens
gacgccaggcaggccaggccgaccgccggcgccuccccacgcgcugggcuccgcguccuag

SEQ ID NO: 218540 - RNA, 64 nt, Homo Sapiens
gcacccccugccaucaggggguucucuccucucuccuccccagaggaauuuuccaaaacagccu

SEQ ID NO: 218541 - RNA, 64 nt, Homo Sapiens
ccccagagggagaggcccaccccgccggguccucccuccccagaagcucugagcacgggcucuu

SEQ ID NO: 218542 - RNA, 64 nt, Homo Sapiens
gcccacccaucugggcuguccccugccuccccacccuccccaugacaccagcccgugggcugcc

SEQ ID NO: 218543 - RNA, 64 nt, Homo Sapiens
cuccccauggcccacccaucugggcugcccccugccuccccaccugaagaccaacaccagcccg

SEQ ID NO: 218544 - RNA, 64 nt, Homo Sapiens
ccauuuggcagaacugcuggccccaccagagcugccuccccaaucgccucccgggaagcauccu

SEQ ID NO: 218545 - RNA, 64 nt, Homo Sapiens
agagcugccuccccaauccacucccgggaagcauccuccccacccacagcuccuccccugccgc

SEQ ID NO: 218546 - RNA, 64 nt, Homo Sapiens
ggcugcauugaggagacuccuuugauggaaccacccuccccagaagauucucccaccuccuccc

SEQ ID NO: 218547 - RNA, 64 nt, Homo Sapiens
gggugcacagugcagaggggccaggcguguggucccuccccauucgucuuacagucgccauccu

SEQ ID NO: 218548 - RNA, 64 nt, Homo Sapiens
uugaccuuggggaauuauucaaagaagguaauuuccuccccaaauccacuauuccaccucucua

SEQ ID NO: 218549 - RNA, 64 nt, Homo Sapiens
ccaccgugccgaaggagcucccugucucuucaagccuccccacuuuagcauuuguucuucaucu

SEQ ID NO: 218550 - RNA, 64 nt, Homo Sapiens
uuccucacuucuccaucacccucuacuaccacgaccuccccauaccacauccacucaaugugaa

SEQ ID NO: 218551 - RNA, 64 nt, Homo Sapiens
cagggagccugggaugggcagguuaguggaggccccuccccaaguaaaaacauaaaacacugga

SEQ ID NO: 218552 - RNA, 64 nt, Homo Sapiens
cugguuuccaccccgggcugcacugaugggucucccuccccaucgagugcaggaguggacucuc

SEQ ID NO: 218553 - RNA, 64 nt, Homo Sapiens
auggauuaacagcugcgugguggcuaaguucucuccuccccagauuagucagaaugugagcaga

SEQ ID NO: 218554 - RNA, 63 nt, Homo Sapiens
ccacucugcuggcucuguaacccagugcaccucccuccccagcuccggaggggguccuccucg

SEQ ID NO: 218555 - RNA, 64 nt, Homo Sapiens
ggccuggaccuuccccagaugcugccaggcagccccuccccaagccucaaagaagcauuugcug

SEQ ID NO: 218556 - RNA, 64 nt, Homo Sapiens
gggauacugcagggccaggacugagccccgcagaccuccccagccccuagcccaggagagagaa

SEQ ID NO: 218557 - RNA, 64 nt, Homo Sapiens
gagagcggucucaggcuggugggaggggcgcccaccuccccacgcccuccccuccccugcugca

SEQ ID NO: 218558 - RNA, 64 nt, Homo Sapiens
ccaggccugccggcccggacccgucccagccuccccuccccaccccaugcagcccccaggggga

SEQ ID NO: 218559 - RNA, 64 nt, Homo Sapiens
cagggggauagcccaugggccccuguggacccucccuccccaaguggacacauggcugugcagg

SEQ ID NO: 218560 - RNA, 64 nt, Homo Sapiens
cugggugcaggacacuggucgagagccaaaggucccuccccagacaucuggacacugggcauag

SEQ ID NO: 218561 - RNA, 64 nt, Homo Sapiens
gggcauagauuucucaagaaggaagacuccccugccuccccagggccucugcucuccugggaga

SEQ ID NO: 218562 - RNA, 64 nt, Homo Sapiens
gcaggaggcccucagcacccgaacacaucuuccuccuccccacccgagccuggagcacucuaac

SEQ ID NO: 218563 - RNA, 64 nt, Homo Sapiens
ggcaucuuuccuggagccccgagccagcccugucccuccccagugcagcauggcacucaggaga

SEQ ID NO: 218564 - RNA, 64 nt, Homo Sapiens
cucucccagcacaaguggggugaccuccccaugcccuccccagccccaagccccacuuccuccc

SEQ ID NO: 218565 - RNA, 64 nt, Homo Sapiens
cccuccccagccucucccagcacuuccucccugaccuccccaugucuuuaucaaccccaagccc

SEQ ID NO: 218566 - RNA, 64 nt, Homo Sapiens
uccuccacaggucccuccacucauauggccucucccuccccagcuaguggaggggaagcagucu

SEQ ID NO: 218567 - RNA, 64 nt, Homo Sapiens
aaaaauaucuauuuaagccucucucucuuucucuccuccccaacuuuuuucugaaagccuugau

SEQ ID NO: 218568 - RNA, 64 nt, Homo Sapiens
cacugucuauccauccgguggacugggcagcauuccuccccagggcucuucccuugggggccuc

SEQ ID NO: 218569 - RNA, 64 nt, Homo Sapiens
gaaacuggauagauacacucauaaaacccccaccccuccccaccccaccccugcucccauugug

SEQ ID NO: 218570 - RNA, 64 nt, Homo Sapiens
cacagugacgguggccuggccagcccucgggaccccuccccaccuaacugcacugaaaccauuu

SEQ ID NO: 218571 - RNA, 64 nt, Homo Sapiens
uuguuuuucagacaguauggguuaaguucucugcccuccccaggggucugaggaggcucugggu

SEQ ID NO: 218572 - RNA, 64 nt, Homo Sapiens
aggcccaagcugggacuucuccaggccuguguucccuccccaggaagugcgccccaaaccucuu

SEQ ID NO: 218573 - RNA, 64 nt, Homo Sapiens
uauugaagauggauuaggagagggggugaugaccccuccccaagccccucagggcccagaccuu

SEQ ID NO: 218574 - RNA, 64 nt, Homo Sapiens
caucucccggguucaagcgauuuuccugccucagccuccccaguagcugggacuacagacgugu

SEQ ID NO: 218575 - RNA, 64 nt, Homo Sapiens
ucgaacuccugaccucaucguccaccugccucggccuccccaaagugcugagauuaggcguuag

SEQ ID NO: 218576 - RNA, 64 nt, Homo Sapiens
ugcggagcugagccccgcccugccaugagguuuuccuccccaggcaggcaggaggccgcgggga

SEQ ID NO: 218577 - RNA, 64 nt, Homo Sapiens
cguggaaaguuggcugcugccuggggaagcuucuccuccccaaggcggccauggggcagccugc

SEQ ID NO: 218578 - RNA, 64 nt, Homo Sapiens
gccugcacagaggacccugaggaaccugggacccccuccccacugcccugccucccucugucag

SEQ ID NO: 218579 - RNA, 64 nt, Homo Sapiens
ggcuggcaggggccugcuugguccccaguguugcccuccccagucacggaggggcugugaccug

SEQ ID NO: 218580 - RNA, 64 nt, Homo Sapiens
cucuacccaucucccccaucccccacugccacacccuccccauucagacacuucauggaccaag

SEQ ID NO: 218581 - RNA, 64 nt, Homo Sapiens
ucaaagaagucauggcccaaauccagugugcaccccuccccauucacagagccuuuuucacaau

SEQ ID NO: 218582 - RNA, 64 nt, Homo Sapiens
acuccuucuccuucuaccacucuuaaauuuacucccuccccacccagaacccagauggggugga

SEQ ID NO: 218583 - RNA, 64 nt, Homo Sapiens
ugcccuuuccccaccucaggcccuaccccuggacccuccccaaccuuccuucucucuucuuugg

SEQ ID NO: 218584 - RNA, 64 nt, Homo Sapiens
uuccuggcccccuccccccccgccccucugcuucccuccccacccaccaccucaaggguaggga

SEQ ID NO: 218585 - RNA, 64 nt, Homo Sapiens
cuuccuaccuguuuuauuuuguuuucucguucucccuccccaccccacucccagccuuaucuau

SEQ ID NO: 218586 - RNA, 64 nt, Homo Sapiens
guugggugggccggcuucaugccagcuacuuccuccuccccacuuguccgcugggugguacccu

SEQ ID NO: 218587 - RNA, 64 nt, Homo Sapiens
aaaucguccagcgaccuuccucauccaccccaucccuccccaguucauugcacuuugauuagca

SEQ ID NO: 218588 - RNA, 64 nt, Homo Sapiens
cacacacacacacacacacauacauccugcuuucccuccccaaacccaucagacagguaaaugg

SEQ ID NO: 218589 - RNA, 64 nt, Homo Sapiens
gucagucucucucucccuuuuaaauggugggaacccuccccaaaaccuuuccccagacacauuc

SEQ ID NO: 218590 - RNA, 64 nt, Homo Sapiens
agaggacacggaggguucagaccccuccucagacccuccccacaucugaaacugccucccccca

SEQ ID NO: 218591 - RNA, 64 nt, Homo Sapiens
aaccaaaacuuuuuguuggcuuuuuccuuugucgccuccccagcaccugcccucccagucuccc

SEQ ID NO: 218592 - RNA, 64 nt, Homo Sapiens
ccaccccuccugagaggcagggggcccuccgcccccuccccauguauuccccaccuguguuccg

SEQ ID NO: 218593 - RNA, 64 nt, Homo Sapiens
agagccgucauggguagcccacgccguccuuuccccuccccaaguguuucucuccugacccagg

SEQ ID NO: 218594 - RNA, 64 nt, Homo Sapiens
cccccuccggagaccaaacucaccaucccucaguccuccccaacaggguacuaggacugcagcc

SEQ ID NO: 218595 - RNA, 64 nt, Homo Sapiens
gaugcagggucugcucaccccaacacaugccuucccuccccagccacaccgugcacgaaggggg

SEQ ID NO: 218596 - RNA, 64 nt, Homo Sapiens
aagaauguuuacaugccaaacagaauguaacaccccuccccaagcccuucccagucacugcaug

SEQ ID NO: 218597 - RNA, 64 nt, Homo Sapiens
aaacgcuaauaauuuauuagaucuaaagccccuuccuccccagccccugcuuucauuaagguau

SEQ ID NO: 218598 - RNA, 64 nt, Homo Sapiens
cagagggaguucccccagaucaguaccccccaccccuccccagcuaguagcaugaccaggagag

SEQ ID NO: 218599 - RNA, 64 nt, Homo Sapiens
uucaaucugagcccagcaggcaugagaauaaauaccuccccaaauggccauggugggaaauggg

SEQ ID NO: 218600 - RNA, 64 nt, Homo Sapiens
ccccaaaaaauaaaagggggaaauucccucuucaccuccccaccgugggagaaaagcuugugug

SEQ ID NO: 218601 - RNA, 64 nt, Homo Sapiens
acagaccgacaggcagcccaagggccuggacaccccuccccaggcaggugcugccccaggagga

SEQ ID NO: 218602 - RNA, 64 nt, Homo Sapiens
gggcuuuggacugaggucccuguggccucggucuccuccccaugaagugggagcgaggcucccc

SEQ ID NO: 218603 - RNA, 64 nt, Homo Sapiens
auguccuuggggaggggucagcucuggccacaauccuccccaccagucucacccacuaggauag

SEQ ID NO: 218604 - RNA, 64 nt, Homo Sapiens
guccuguuaacccuccaccuccucucuuggacucccuccccaccccaaccacucuuucuuucuc

SEQ ID NO: 218605 - RNA, 64 nt, Homo Sapiens
aacaugucacuuuucuguuaagaaaacugagcccccuccccacagguuaaaaaacuuuaguaac

SEQ ID NO: 218606 - RNA, 64 nt, Homo Sapiens
cgccuccuggguucacgccauucuccugccucagccuccccagcagcugggacuacaggcacac

SEQ ID NO: 218607 - RNA, 64 nt, Homo Sapiens
auguccaaucucauccaaauaacauuguucccauccuccccacccaccacaucaaaacauaaca

SEQ ID NO: 218608 - RNA, 64 nt, Homo Sapiens
acauaacacaucacagcacucaguagagguccugccuccccauuucucaagggaagccaguagg

SEQ ID NO: 218609 - RNA, 64 nt, Homo Sapiens
cguguggccgcccggguguggcucagccauguccccuccccagguccuucauucaccccucccc

SEQ ID NO: 218610 - RNA, 64 nt, Homo Sapiens
auguccccuccccagguccuucauucaccccuccccuccccacaguggaauuguugaagugugg

SEQ ID NO: 218611 - RNA, 64 nt, Homo Sapiens
uuucaucucagaguccacuguggcacuggccaccccuccccaguacaggggugcugcagguggc

SEQ ID NO: 218612 - RNA, 64 nt, Homo Sapiens
ucauguggcccaacucuccuggccuggccaucucccuccccagaaacagugugcauggguuauu

SEQ ID NO: 218613 - RNA, 62 nt, Homo Sapiens
ucaaagucaaggucccuugaaucccaaaagugccuccccagccucagcccccaccuccagcc

SEQ ID NO: 218614 - RNA, 64 nt, Homo Sapiens
aaacaccugccuugggggugaagugaaggcccagccuccccaccccaccgcgccccagggguug

SEQ ID NO: 218615 - RNA, 64 nt, Homo Sapiens
ugccccccucaccuugauggccaacaucucccagccuccccaggaccagaggaaaaggaagugc

SEQ ID NO: 218616 - RNA, 64 nt, Homo Sapiens
uuccggggcagaguggggacccccagggacaccgccuccccauuugaccugcaggaacucccca

SEQ ID NO: 218617 - RNA, 64 nt, Homo Sapiens
uguaaauaguauuuauuagcccuccccagcuucuccuccccagucccacacauccauaguucug

SEQ ID NO: 218618 - RNA, 64 nt, Homo Sapiens
uucuccuccccaguuguaaacauccauaguucugccuccccagcccacaaccugguuccccaca

SEQ ID NO: 218619 - RNA, 64 nt, Homo Sapiens
gcuggcgcucagcagcccuacuguuucaagcccuccuccccagauauuuuaacaacauauaaaa

SEQ ID NO: 218620 - RNA, 64 nt, Homo Sapiens
gaaggcgggcugaggagacaacagggcuguuuugccuccccacggcccugccccacccaacucc

SEQ ID NO: 218621 - RNA, 64 nt, Homo Sapiens
uccagcucucccagaccuacgugccuuccugggcccuccccagccacucaaacaucuccucuug

SEQ ID NO: 218622 - RNA, 64 nt, Homo Sapiens
uguccuccaagacuccacucgaguccucaccagcccuccccauugagagcaugagcacuucccu

SEQ ID NO: 218623 - RNA, 64 nt, Homo Sapiens
cuggagacccccccccaacuaagggcuggcucccccuccccaggugccccacggagacagagga

SEQ ID NO: 218624 - RNA, 64 nt, Homo Sapiens
aucaagcuuuugcuugaucccuggaauguuuuucccuccccagacacguuggccggcggcuacu

SEQ ID NO: 218625 - RNA, 64 nt, Homo Sapiens
uguccagcuggggccagagggcacccucagggagccuccccauccagaggguguggcuuuccag

SEQ ID NO: 218626 - RNA, 64 nt, Homo Sapiens
gugugcccagaacaucccuguucugggggcccugccuccccauugagaugggggugggggaugc

SEQ ID NO: 218627 - RNA, 64 nt, Homo Sapiens
ggagggcaagcccccccaccuaaccagugccuuuccuccccacucuuaaccuaaaccauaauug

SEQ ID NO: 218628 - RNA, 64 nt, Homo Sapiens
auaauuaguaacugguuguuuucugugaaaauaaccuccccaaaauuuggaaauuguugcugug

SEQ ID NO: 218629 - RNA, 64 nt, Homo Sapiens
uuuccaggaacccuacuggcagacacacaccuacccuccccagcaggcccccuaccagugcaug

SEQ ID NO: 218630 - RNA, 64 nt, Homo Sapiens
ggcuacugggcuguggucucugacccccuggaggccuccccacgccucacagaacacagugcag

SEQ ID NO: 218631 - RNA, 64 nt, Homo Sapiens
gggaggcccagcccugcaggugggacuggcucucccuccccagccacgaguaugccacaggggg

SEQ ID NO: 218632 - RNA, 64 nt, Homo Sapiens
cccucucucucccucucucucccucucucuuuacccuccccagggcuccaucuccgccucaggg

SEQ ID NO: 218633 - RNA, 64 nt, Homo Sapiens
accaccgcccgccucaguuccuuugcgucuguugccuccccagcccugcacgcccuggcuggca

SEQ ID NO: 218634 - RNA, 64 nt, Homo Sapiens
ggccagcguccuccuccacagccugucacugcccccuccccagccuguguccacagugcuguga

SEQ ID NO: 218635 - RNA, 64 nt, Homo Sapiens
ucguggcaagaacuagcgugagcccagccaggcgccuccccaccgggcucucaggacacccugc

SEQ ID NO: 218636 - RNA, 64 nt, Homo Sapiens
cccgacuccccguucagaccagagugccccggccccuccccagccugagucuucuccuugcucu

SEQ ID NO: 218637 - RNA, 64 nt, Homo Sapiens
cagagggagccucuguucugaccagcccuuugcaccuccccagguaacagcagucagguuguuu

SEQ ID NO: 218638 - RNA, 64 nt, Homo Sapiens
ugggcagggcggagggagccuccacuuccccaacccuccccagggcaccuacugugcagaacuc

SEQ ID NO: 218639 - RNA, 64 nt, Homo Sapiens
guauuaacgcuccaagaguacccaagugccugccccuccccagagccuucaugcccuagggccc

SEQ ID NO: 218640 - RNA, 64 nt, Homo Sapiens
cccaagugccuucaugcccuuacauccccuguccccuccccaacggccccgcccagucccgcag

SEQ ID NO: 218641 - RNA, 64 nt, Homo Sapiens
ccccuggggaccccaaggccuuauuauuuauuucccuccccaugcuccuuaucccccauggugu

SEQ ID NO: 218642 - RNA, 64 nt, Homo Sapiens
cacacccccauuccuccuggauaagcaucgagcaccuccccauucaagaccuuuagugccacaa

SEQ ID NO: 218643 - RNA, 64 nt, Homo Sapiens
acuuuccugucccugagaacgagcccacgccuguccuccccauccuguguccaccggccaugag

SEQ ID NO: 218644 - RNA, 64 nt, Homo Sapiens
ccgcgcaggccacugagacguccucaucgcucccccuccccaccacccccauggcucgggucag

SEQ ID NO: 218645 - RNA, 64 nt, Homo Sapiens
uugacgugcagaaucucaguggcaucuggguucaccuccccacucugaugaucuccagccucca

SEQ ID NO: 218646 - RNA, 64 nt, Homo Sapiens
ggcucacccucccuuuccuuuuccccucuucuacccuccccaagaaaaagggccuucaaggcag

SEQ ID NO: 218647 - RNA, 64 nt, Homo Sapiens
guuucucgaaggugcuuggcggucuugccuucccccuccccacaggcucuccuugugggguccc

SEQ ID NO: 218648 - RNA, 64 nt, Homo Sapiens
gggccgagucccgccuggugggcauuugccgccgccuccccaccaccagucacugccucgcaga

SEQ ID NO: 218649 - RNA, 64 nt, Homo Sapiens
cuaugaaaucccuggagaauacuguugccacucuccuccccagagccgccugaaugccgagcua

SEQ ID NO: 218650 - RNA, 64 nt, Homo Sapiens
ccuccgcucugcucccuggcucuagcgaugcuguccuccccacuaccaaggucgguuuccgccc

SEQ ID NO: 218651 - RNA, 64 nt, Homo Sapiens
uccccgcaagcuggucccaucugagucacagccaccuccccaccgggacaagcuguggagcugg

SEQ ID NO: 218652 - RNA, 64 nt, Homo Sapiens
caggccugguggcaggaaggaaccuugccugccaccuccccauugugugggugaccugcccuca

SEQ ID NO: 218653 - RNA, 64 nt, Homo Sapiens
uugcugagaugaccucuuuuaaaagcaaagccccccuccccauacaccccaagccugagcccug

SEQ ID NO: 218654 - RNA, 64 nt, Homo Sapiens
acggcguggcugugcuuccuggggaaaugaacccccuccccacagacaccacccuggguggauc

SEQ ID NO: 218655 - RNA, 64 nt, Homo Sapiens
gccaaggagcugcuucucucuucucccaguucuaccuccccagaagccuuccuccccagguggg

SEQ ID NO: 218656 - RNA, 64 nt, Homo Sapiens
ucucuucucccaguucuaccuccccagaagccuuccuccccagguggggcugauggagcaaggg

SEQ ID NO: 218657 - RNA, 64 nt, Homo Sapiens
cugacccugggcuuucacgggccccauuccaccgccuccccaacuugagccugugaccuuggga

SEQ ID NO: 218658 - RNA, 64 nt, Homo Sapiens
ggagggcacuggagcugggaggucucgucccagcccuccccaucucggggcugcuguguggacg

SEQ ID NO: 218659 - RNA, 64 nt, Homo Sapiens
ucccagccugggcucugggagugggggcuccagcccuccccacuaugcccaggagucuucccaa

SEQ ID NO: 218660 - RNA, 64 nt, Homo Sapiens
uggagaggccuggggcugugggaugccccaucccccuccccaucaccuuuggugggggcagggc

SEQ ID NO: 218661 - RNA, 64 nt, Homo Sapiens
cccuggccucaauuucccuuuguuccuugccaggccuccccaaccugccaccuaccaugcacca

SEQ ID NO: 218662 - RNA, 61 nt, Homo Sapiens
cucagucuucccaucugaaccccaagacacaccuccccaacccccgagcccagcuuccuaa

SEQ ID NO: 218663 - RNA, 64 nt, Homo Sapiens
gucuacugcugauuucuagaaccauccucucuuuccuccccaggagaguagggagaagaagggc

SEQ ID NO: 218664 - RNA, 64 nt, Homo Sapiens
gucauagagggggccaugaguucgccagcccuccccuccccaggugguguggugcuggugaggg

SEQ ID NO: 218665 - RNA, 64 nt, Homo Sapiens
ccucuggggcccacuggaaaccucaaacuccugcccuccccaggccuggagaaagaacagugug

SEQ ID NO: 218666 - RNA, 64 nt, Homo Sapiens
gcccaccucggcugcuaggccuguccacacacugccuccccacccuaagaaccccacggcccca

SEQ ID NO: 218667 - RNA, 64 nt, Homo Sapiens
gcuccccgcacugacggggcggugcuccagcgcaccuccccagauguccagcaccagccaagcu

SEQ ID NO: 218668 - RNA, 64 nt, Homo Sapiens
gcaaagaacugccccaucuccucccauggccuucccuccccacaguccucacagccucucccuu

SEQ ID NO: 218669 - RNA, 64 nt, Homo Sapiens
cagccucucccuuaaugagcaaggacaaccugccccuccccagcccuuugcaggcccagcagac

SEQ ID NO: 218670 - RNA, 64 nt, Homo Sapiens
agcugcaggagaagauggccuacuuggaucaaacccuccccagagcccccggccaggcaccccc

SEQ ID NO: 218671 - RNA, 64 nt, Homo Sapiens
cagaaggucaguccuaccuuuuucuuucugagagccuccccaccccgagaucacauuucucacu

SEQ ID NO: 218672 - RNA, 64 nt, Homo Sapiens
cagggacuucccgguuccuaguucuuugccagcuccuccccacucugugcgaccuuuccaagcc

SEQ ID NO: 218673 - RNA, 64 nt, Homo Sapiens
gagcccaggucuggguacugaguguccagagcugccuccccaggagguuaaggugggggcaaag

SEQ ID NO: 218674 - RNA, 64 nt, Homo Sapiens
gacuuacguaucuuuucuccuccucccuaguguuccuccccauuuuuucagaaaacacuucuga

SEQ ID NO: 218675 - RNA, 64 nt, Homo Sapiens
ugaauuuagucccuccauccuuaauccccccaucccuccccaucaugcaaccagugguuuaauc

SEQ ID NO: 218676 - RNA, 64 nt, Homo Sapiens
acggaauccagacucuuccuggacuggcuugccuccuccccaccuccccacccuggaaccccug

SEQ ID NO: 218677 - RNA, 64 nt, Homo Sapiens
cagacucuuccuggacuggcuugccuccuccccaccuccccacccuggaaccccugagggccaa

SEQ ID NO: 218678 - RNA, 64 nt, Homo Sapiens
ccugucuucucaucagccacgagcucuccucagaccuccccagauugggggcaggaucuggccc

SEQ ID NO: 218679 - RNA, 64 nt, Homo Sapiens
cuuccuacucccagcuuucauucccagccccaucccuccccaccgagacgaggugugcuguucc

SEQ ID NO: 218680 - RNA, 64 nt, Homo Sapiens
uccccagggaaggaaacuguuagcuuuggagacgccuccccaaugcuuucuuuccaauccuuua

SEQ ID NO: 218681 - RNA, 64 nt, Homo Sapiens
cccacccauaccagcuagaagauugugcaaauccccuccccaaaugacaugaacccauccaaug

SEQ ID NO: 218682 - RNA, 64 nt, Homo Sapiens
ucuuuauacucaggaaaaugucaccaagcacccuccuccccaguucacaaaaggaagaagauga

SEQ ID NO: 218683 - RNA, 64 nt, Homo Sapiens
aggaagaagaugaagauucugucucccuguucccccuccccaguuuuccaaagugucugagcau

SEQ ID NO: 218684 - RNA, 64 nt, Homo Sapiens
cccauagcuccagugcacgcagagacccgagcauccuccccacccccacgccucugcaaguggg

SEQ ID NO: 218685 - RNA, 64 nt, Homo Sapiens
agugcaacagaaaccaccuggggaggcaccccacccuccccaccagggacgcccccagaggacc

SEQ ID NO: 218686 - RNA, 59 nt, Homo Sapiens
auagaaauaugcauagguagaauguacccccuccccaagcaugaaaaucaucucacuga

SEQ ID NO: 218687 - RNA, 64 nt, Homo Sapiens
aauagccucaaucucccaccccauguaggcacuaccuccccaauuacccuuagaaaaugaucac

SEQ ID NO: 218688 - RNA, 64 nt, Homo Sapiens
gcgcagaggaaacaggccaguagccuccuccacuccuccccacagguguucuucaugagaguac

SEQ ID NO: 218689 - RNA, 64 nt, Homo Sapiens
ucccugcagccaccucccaggccccgcccuccauccuccccacaaggcgagaugagcuggcgca

SEQ ID NO: 218690 - RNA, 64 nt, Homo Sapiens
uuuugcuauguuaauauuuguaaaacaauuguguccuccccacaaggaaguagggauauuuuua

SEQ ID NO: 218691 - RNA, 64 nt, Homo Sapiens
ccaucucaccauauccaucucagcuuucuaacauccuccccacaugagaagugauaaacaccuc

SEQ ID NO: 218692 - RNA, 64 nt, Homo Sapiens
ggaccucgaaggcugcaacgggagcagcauuucuccuccccagaagcacaagcucacccacuuu

SEQ ID NO: 218693 - RNA, 64 nt, Homo Sapiens
ggcggaauugcuuucuucugcccucccuuccucuccuccccacaucaccguguguccuccccuc

SEQ ID NO: 218694 - RNA, 64 nt, Homo Sapiens
agggaugaagaaaacccuguugccccuuccacuuccuccccaaaucaaacaagaagcucagagc

SEQ ID NO: 218695 - RNA, 64 nt, Homo Sapiens
gaaugggcuguauguccugccccaggggccucauccuccccaugagagccgugccucacugacc

SEQ ID NO: 218696 - RNA, 64 nt, Homo Sapiens
ccucuucgugggaaggcccccggaggcccgagagccuccccaggcaucgaggagggagggcaga

SEQ ID NO: 218697 - RNA, 64 nt, Homo Sapiens
gggacuugggcugggcuaaaugggagggguugucccuccccaucauccauuccugugagguguc

SEQ ID NO: 218698 - RNA, 64 nt, Homo Sapiens
uagcuccacccuccccgugcugcuguguucugcuccuccccacgcuucccugcuauaguuccca

SEQ ID NO: 218699 - RNA, 64 nt, Homo Sapiens
cagcccacucauccuuuccccagcccucuucagcccuccccaguccuccccagccuucuucagc

SEQ ID NO: 218700 - RNA, 64 nt, Homo Sapiens
auccuuuccccagcccucuucagcccuccccaguccuccccagccuucuucagccuucuucagc

SEQ ID NO: 218701 - RNA, 64 nt, Homo Sapiens
ccccacccccagcugaccagggaggcagaggacaccuccccaucacucagcauucccagcucag

SEQ ID NO: 218702 - RNA, 64 nt, Homo Sapiens
gauuccuuagugaucugugccccuccccuaaugcccuccccaugucucccucuggaggaccaag

SEQ ID NO: 218703 - RNA, 64 nt, Homo Sapiens
acaccuaggcugucagucucggcucccaucuauaccuccccaugccaaaugcugugaccuguuu

SEQ ID NO: 218704 - RNA, 64 nt, Homo Sapiens
gucugcuugugggcacgcucggcugccucuucucccuccccaagcuggcugcgacuaggagcag

SEQ ID NO: 218705 - RNA, 64 nt, Homo Sapiens
agcugggauuacaggcacccuucuccugucucagccuccccaguugcuucccggguucaagcau

SEQ ID NO: 218706 - RNA, 64 nt, Homo Sapiens
ugcuuccgggaaucuuggucggaaacaagccgggccuccccagcugccugggcuugaccggcgg

SEQ ID NO: 218707 - RNA, 64 nt, Homo Sapiens
ccuggcagcccacauuuuuguugcuccccaaaucccuccccacguggggaugagaaccuuccug

SEQ ID NO: 218708 - RNA, 64 nt, Homo Sapiens
cuccguccucgcucaguugugauccagcagccccccuccccacugccuccccagcucucaguga

SEQ ID NO: 218709 - RNA, 64 nt, Homo Sapiens
cucaguugugauccagcagccccccuccccacugccuccccagcucucagugaccccgacuguc

SEQ ID NO: 218710 - RNA, 64 nt, Homo Sapiens
accccuaguggggaggggcauuucuccagccccuccuccccacagcugaguggucaggagccag

SEQ ID NO: 218711 - RNA, 64 nt, Homo Sapiens
uucccaaacuucugucugccacccccacuucaccccuccccagcccuuucuagccugccccccc

SEQ ID NO: 218712 - RNA, 64 nt, Homo Sapiens
gacauacagauugcccucccccaucaucacuacuccuccccagauuuucacaccgcaucagucc

SEQ ID NO: 218713 - RNA, 64 nt, Homo Sapiens
ccaagaggggucugagugggggggccgcccccaaccuccccacccuuuuguguuuuggccaccu

SEQ ID NO: 218714 - RNA, 64 nt, Homo Sapiens
gggccucgggaccucagguguccuccccacccgcccuccccacgucaggcaggccaaggccuuc

SEQ ID NO: 218715 - RNA, 64 nt, Homo Sapiens
cgcccuccccacggggccucggccaaggccuucuccuccccaccgaggccuccagcuucaggca

SEQ ID NO: 218716 - RNA, 64 nt, Homo Sapiens
uggacccauaagucuguucauccugcugaaguccccuccccauugcuccuucaagccaaaacua

SEQ ID NO: 218717 - RNA, 64 nt, Homo Sapiens
gucucugucccucucucuuugacucucccuuuguccuccccauagagcuggggugggguggauc

SEQ ID NO: 218718 - RNA, 64 nt, Homo Sapiens
cacuuccuguccagagagagaagugccccugcugccuccccaacccugccccugccccgucacc

SEQ ID NO: 218719 - RNA, 64 nt, Homo Sapiens
ggggagugggacagagucuggguguauuuauuuuccuccccagcagguggggaggggguuuggg

SEQ ID NO: 218720 - RNA, 64 nt, Homo Sapiens
aggggccaagacacugccuaggccuagccccaucccuccccaugccaagggagucugggcccua

SEQ ID NO: 218721 - RNA, 64 nt, Homo Sapiens
gcucaccccucaaccccaaggcugggagcugugaccuccccaacccaggaggcuccaguucugg

SEQ ID NO: 218722 - RNA, 64 nt, Homo Sapiens
uccccagcugccuggcugggcuccccaucagccuccuccccacaggaggacagcugccuguuuc

SEQ ID NO: 218723 - RNA, 64 nt, Homo Sapiens
agccuccuccccacauccccacagcugccuguuuccuccccauccucuuagcucuaccgggagg

SEQ ID NO: 218724 - RNA, 64 nt, Homo Sapiens
aaaggggguuugucagaagccgaguccccuuguuccuccccauuacgaccagguucucaagaca

SEQ ID NO: 218725 - RNA, 64 nt, Homo Sapiens
ccuccaggaacuccacucccugaaaacacgccccccuccccacauggcugagauuuuucuaaau

SEQ ID NO: 218726 - RNA, 64 nt, Homo Sapiens
cccacaacacugccaaaaaugcugggguuucucuccuccccagugccuuccuuguucuggugga

SEQ ID NO: 218727 - RNA, 64 nt, Homo Sapiens
gaauugaaacgucagcucagucccugccccgccaccuccccaaacugccucaucuuuccucccg

SEQ ID NO: 218728 - RNA, 64 nt, Homo Sapiens
cucagggcagagauuggcuuggggccagaaggacccuccccaacccuggagacacccugaaggu

SEQ ID NO: 218729 - RNA, 64 nt, Homo Sapiens
uacuaauacagaagcuugacaagcauguccucacccuccccaccacauaaacacauggacacac

SEQ ID NO: 218730 - RNA, 64 nt, Homo Sapiens
ccauccccugaucugugcggcuccagccucgcccccuccccacgugcaccauaccuggggaguu

SEQ ID NO: 218731 - RNA, 64 nt, Homo Sapiens
cugaccacaacuuuggacaccccaggcugccaccccuccccacccguucacccccaggaugcug

SEQ ID NO: 218732 - RNA, 64 nt, Homo Sapiens
ugcuguugcuguaggacgccugcugcccuggagcccuccccaggaugugagccaguccccucgc

SEQ ID NO: 218733 - RNA, 64 nt, Homo Sapiens
ucgcccggcugccacaagcucucugcggguccauccuccccaccgggguccguccucgcaggcc

SEQ ID NO: 218734 - RNA, 64 nt, Homo Sapiens
ugcucaccagcugcuucggccuucaggugaccucccuccccacggcauccugcucuccgggugg

SEQ ID NO: 218735 - RNA, 64 nt, Homo Sapiens
cucagccagaggugccuggccaugccugcacacuccuccccauuuuaauaaauggucgcaacuu

SEQ ID NO: 218736 - RNA, 64 nt, Homo Sapiens
agcaggggugacguauguagaaugcuuaggguguccuccccacagagcagauacuugaaccgac

SEQ ID NO: 218737 - RNA, 64 nt, Homo Sapiens
ccuguguaaagagcacuuuguccugcuucacggaccuccccaaagugugcagaguucuauauag

SEQ ID NO: 218738 - RNA, 64 nt, Homo Sapiens
caucucccgggccagacagcuguccccccguccuccuccccagcccagccugcucagagaagcu

SEQ ID NO: 218739 - RNA, 64 nt, Homo Sapiens
ccaucuagggcaaguccugaaaggcccaaggcccccuccccagucuggccuuggccuccagccu

SEQ ID NO: 218740 - RNA, 64 nt, Homo Sapiens
caccugccaucuuggucaugagcuacugucugucccuccccaggacccgcggugggugcugcau

SEQ ID NO: 218741 - RNA, 64 nt, Homo Sapiens
gggagggggcuggccugggggucuugggaaggccccuccccaggcccuaggccaccucgcggaa

SEQ ID NO: 218742 - RNA, 64 nt, Homo Sapiens
guuucuggcccucguccucccugccucucaucugccuccccaacccccaccuacccacugcucc

SEQ ID NO: 218743 - RNA, 64 nt, Homo Sapiens
ggcugcccacccuguccacgugaagugccaacgcccuccccacccugggccgagcccccacccc

SEQ ID NO: 218744 - RNA, 64 nt, Homo Sapiens
accugggccaccagaaggugacacccccagaaucccuccccagagacugcaccagcgcagccag

SEQ ID NO: 218745 - RNA, 64 nt, Homo Sapiens
aaccuuccccaucucccugccagccccuaacuacccuccccagccuccaggaacuauccaucca

SEQ ID NO: 218746 - RNA, 64 nt, Homo Sapiens
ucuuccaaggccugaugcauucauaaguugaagcccuccccagauccccuuggggagccucugc

SEQ ID NO: 218747 - RNA, 64 nt, Homo Sapiens
cuuuucuguucauuucaucuggcuccccccaccaccuccccaccccaccccccacccccugcuu

SEQ ID NO: 218748 - RNA, 64 nt, Homo Sapiens
cccacucccacagggagccccggccauuugcugcccuccccaccccugccccagccucaggacu

SEQ ID NO: 218749 - RNA, 64 nt, Homo Sapiens
gacugcaggagccauccgccccccucagccccuuccuccccagggagcaaagccauaaggggca

SEQ ID NO: 218750 - RNA, 64 nt, Homo Sapiens
cuggcuugggagccugggccgacugccugacuccccuccccagaguuacccccaggagauccug

SEQ ID NO: 218751 - RNA, 64 nt, Homo Sapiens
ccccccuaagcugcucucccacccuacacaacgcccuccccaggcagcuguggcccccagggcu

SEQ ID NO: 218752 - RNA, 64 nt, Homo Sapiens
gccaugggagggguguccucccuggaaccugcguccuccccaaacguguuucugcccugugacu

SEQ ID NO: 218753 - RNA, 64 nt, Homo Sapiens
ccggccacgcccccacccaccugggggcacagccccuccccacugugggagccacccccaggug

SEQ ID NO: 218754 - RNA, 64 nt, Homo Sapiens
agcugggacuacaggcacccuucuccugccucagccuccccagccgccucccagauucacgcca

SEQ ID NO: 218755 - RNA, 64 nt, Homo Sapiens
cucuuccauuuuucuacagacagccucuuuccucccuccccaauaggcacaaccuggacccagg

SEQ ID NO: 218756 - RNA, 64 nt, Homo Sapiens
aauaaaacucuguuuacaacgccucccccagcccccuccccauccucugcccucucuggaguuu

SEQ ID NO: 218757 - RNA, 64 nt, Homo Sapiens
ccaggccccuggcgugugugccccuggaaaggucccuccccaaccagaccuaagcccuccccca

SEQ ID NO: 218758 - RNA, 64 nt, Homo Sapiens
ccagccgcccagccacauguaguggcggcuguccccuccccagcacuuccacgcucugcugguc

SEQ ID NO: 218759 - RNA, 64 nt, Homo Sapiens
uugauguuuguguuuuguuuucccccccggccagccuccccaaccccaagcaugcaauugccug

SEQ ID NO: 218760 - RNA, 64 nt, Homo Sapiens
acagcuacguuuguacaucacccccuccccacccccuccccaauugacccgucccucccccauc

SEQ ID NO: 218761 - RNA, 64 nt, Homo Sapiens
cccuccccaauacagcuacgccucccccauccccccuccccaccugaaggaagacugacccguc

SEQ ID NO: 218762 - RNA, 64 nt, Homo Sapiens
cucaccuugccaugccaggucccccugccccccaccuccccaggcccagcucugcaaauccccu

SEQ ID NO: 218763 - RNA, 64 nt, Homo Sapiens
guuaagcacuggaugucucccuuuuggugcuaccccuccccagauccgucgcugcccuucacac

SEQ ID NO: 218764 - RNA, 64 nt, Homo Sapiens
ccuugaacccccaugcaaugccacccaagccucaccuccccaccgcucuuucuccccucccucc

SEQ ID NO: 218765 - RNA, 64 nt, Homo Sapiens
caagccucaccuccccaccccucuuucuccccucccuccccaccgguggcauacugcagucugg

SEQ ID NO: 218766 - RNA, 64 nt, Homo Sapiens
caccccccccccaccgaggcccagagagggggcaccuccccacaacccuggggggggccaggcu

SEQ ID NO: 218767 - RNA, 64 nt, Homo Sapiens
accuagguggggccuggggucccccuugcccaggccuccccagcccagggggugcccucccaga

SEQ ID NO: 218768 - RNA, 64 nt, Homo Sapiens
ucccacgccccagccccuccguccauucgggccuccuccccaccucucuuauccucaacuuucu

SEQ ID NO: 218769 - RNA, 64 nt, Homo Sapiens
ccccuucccucaacucuagggccugucaggccagccuccccagcucccggcccccuccucucca

SEQ ID NO: 218770 - RNA, 64 nt, Homo Sapiens
ggcccgggggagaccucuuccugucucccccuucccuccccaccccugccccaggaccagaggc

SEQ ID NO: 218771 - RNA, 64 nt, Homo Sapiens
ucuaaccagaccccauccccgauguccuaggcccccuccccaacaccuccccagacucugcacg

SEQ ID NO: 218772 - RNA, 64 nt, Homo Sapiens
cucugcacggauguccuaggcucucccaccccaaccuccccagaccaacaccaaacuguacaga

SEQ ID NO: 218773 - RNA, 64 nt, Homo Sapiens
guggcauuuccugccaggggcugagacuggagacccuccccaguggacaggcagccccgcgccc

SEQ ID NO: 218774 - RNA, 64 nt, Homo Sapiens
cugugcccugccauauacgucucucuguuacagcccuccccaugucccccuuuggaugggaggc

SEQ ID NO: 218775 - RNA, 64 nt, Homo Sapiens
gcccaacccccaccccuuccccgacacccaagccccuccccacgucgcccccuccugcacagcc

SEQ ID NO: 218776 - RNA, 64 nt, Homo Sapiens
gccgccaucucucugccccgccccgccccuccggccuccccacaccccccuugcccucacuacc

SEQ ID NO: 218777 - RNA, 64 nt, Homo Sapiens
acuuaugacaccucacuucccuagagaaggccugccuccccauagggaaucuggggguuucuuc

SEQ ID NO: 218778 - RNA, 64 nt, Homo Sapiens
ccagccuaaugagccccuuauuuucuuuuuuuucccuccccaggucuaguagcucuaacuaaaa

SEQ ID NO: 218779 - RNA, 64 nt, Homo Sapiens
ccucggaguguggccuggauccauccugcuagcaccuccccagacagggcuccagccugucggc

SEQ ID NO: 218780 - RNA, 64 nt, Homo Sapiens
gacuccaggcccccguugaagccgcucccgguucccuccccagcuccucgucuuugaacugccg

SEQ ID NO: 218781 - RNA, 64 nt, Homo Sapiens
ggcuuugugagagaggaccuccaugcccccgccaccuccccacuccagcagauaaggccgagcc

SEQ ID NO: 218782 - RNA, 64 nt, Homo Sapiens
gugaccuccugcagggagccuucugccaccagccccuccccagacucucagguggaggcaacag

SEQ ID NO: 218783 - RNA, 64 nt, Homo Sapiens
acaacaaaguuccacuuccaggucugccugguucccuccccaaggccacagggagcuccgucag

SEQ ID NO: 218784 - RNA, 64 nt, Homo Sapiens
cccuuucucuggcccugucccugccugcuuuccaccuccccagugcgggcuccugagccugcuu

SEQ ID NO: 218785 - RNA, 64 nt, Homo Sapiens
uggcccugggcucaggggacucagaauccucuuuccuccccauugccugcuuauugccucuuuc

SEQ ID NO: 218786 - RNA, 64 nt, Homo Sapiens
ccccgcccuacugucucuucacaagauucccgaaccuccccaaacuguguugagggcagaugcc

SEQ ID NO: 218787 - RNA, 64 nt, Homo Sapiens
ucuucccugccuucuagagauucucucuggucuuccuccccacugccacauggccuucagaacc

SEQ ID NO: 218788 - RNA, 64 nt, Homo Sapiens
ggauggcuguguccggagccuggcggggaggcggccuccccaguaugugagugcagggaucugc

SEQ ID NO: 218789 - RNA, 64 nt, Homo Sapiens
aauugucagccucuacgggcagaguccggcauccccuccccagacugccugcugucaaaccacg

SEQ ID NO: 218790 - RNA, 64 nt, Homo Sapiens
gccccacccacagggaccucccugggucgcacccccuccccacgaaucacaagccugggcaugg

SEQ ID NO: 218791 - RNA, 64 nt, Homo Sapiens
cagagagaggcuucccuccccggacagaggaccaccuccccauaacagccccucaccacggaca

SEQ ID NO: 218792 - RNA, 64 nt, Homo Sapiens
ccuucccuacucaacggucauagcacagauuccuccuccccagggcucccucagcagccacuca

SEQ ID NO: 218793 - RNA, 64 nt, Homo Sapiens
cccgcuggccccagacccgccauccuacccacugccuccccaucccagagcugccccccacggg

SEQ ID NO: 218794 - RNA, 64 nt, Homo Sapiens
ugccacggggaccaggaccccacagcgcacccccccuccccaccaacuucucugccccagggac

SEQ ID NO: 218795 - RNA, 64 nt, Homo Sapiens
ugcugccacagggggcuggugacacccagagcccccuccccagcccucaggcccucccugccaa

SEQ ID NO: 218796 - RNA, 64 nt, Homo Sapiens
ccaugccucagccacgccccuccggccucagcucccuccccaaagugccugagcgccgccucug

SEQ ID NO: 218797 - RNA, 64 nt, Homo Sapiens
ucucagucccucccccaacacuguccacacugccccuccccacuguuuauuuauugcacggauc

SEQ ID NO: 218798 - RNA, 64 nt, Homo Sapiens
ggcuacugagccacagugaccgccugcccccgccccuccccaucuguccccucucuccacaccc

SEQ ID NO: 218799 - RNA, 64 nt, Homo Sapiens
ccuccugcagcuggacccugcaggguggcucccuccuccccaucaagcacaagagagggcccag

SEQ ID NO: 218800 - RNA, 64 nt, Homo Sapiens
auagaaaccgcagugggccugcaagccgcccgagccuccccagcagccuccuacagagcaggaa

SEQ ID NO: 218801 - RNA, 64 nt, Homo Sapiens
ugucaguauccaggaccccccggauucuccacgcccuccccaucucccagucucccugcccccc

SEQ ID NO: 218802 - RNA, 64 nt, Homo Sapiens
aagauguacugcuuuaaaacacaacuccagagccccuccccaagcuccccuccccaagcuccug

SEQ ID NO: 218803 - RNA, 64 nt, Homo Sapiens
uaaaacacaacuccagagccccuccccaagcuccccuccccaagcuccugaagacccgguuucu

SEQ ID NO: 218804 - RNA, 64 nt, Homo Sapiens
cuuucucucagacagcuuauaauagaaauuuccaccuccccaacaggaagaaucacacccuugg

SEQ ID NO: 218805 - RNA, 64 nt, Homo Sapiens
uuuuuccccaagacaagacaggacaucucccccaccuccccacucuaaccuuuuagggugguua

SEQ ID NO: 218806 - RNA, 64 nt, Homo Sapiens
gaagaacaaauaugauucucguucaaagaaccccccuccccaaguucccaaacccuucgguauu

SEQ ID NO: 218807 - RNA, 64 nt, Homo Sapiens
gugcagugaagaaaauguuucagaaagggcagccccuccccauguggggcuuccauggugguuu

SEQ ID NO: 218808 - RNA, 64 nt, Homo Sapiens
aggaggcaggcauggaccacaccuccugcccuccccuccccagcccuccccaacugcucaauaa

SEQ ID NO: 218809 - RNA, 59 nt, Homo Sapiens
ugcucaauaaaccuccugccauucccaccccuccccaacccugcguccacgcccucuga

SEQ ID NO: 218810 - RNA, 64 nt, Homo Sapiens
uccucccugccuugggaccccauagcaauguccuccuccccauguuuucaaaaauauauauaca

SEQ ID NO: 218811 - RNA, 64 nt, Homo Sapiens
agcccccacccuugccccagccucucuucccccaccuccccagccuaccucccaccccagcagc

SEQ ID NO: 218812 - RNA, 64 nt, Homo Sapiens
gagcagagcacacacuggcuggauggcggggcuagggaagcagauuggauguaagggaugagaa

SEQ ID NO: 218813 - RNA, 64 nt, Homo Sapiens
gagcagagcaugcagugaugaggugguggaaccagggaagcagaauagaggugaggaaacuuuu

SEQ ID NO: 218814 - RNA, 64 nt, Homo Sapiens
gaaaaaguuaagcauuguuuacuugaagugggcagggaagcagcacugaguaaaguucaauuga

SEQ ID NO: 218815 - RNA, 64 nt, Homo Sapiens
gcagugguucccaacucuccgaucagaaucaucugggaagcauuuucaaacagcaaaguacuuu

SEQ ID NO: 218816 - RNA, 64 nt, Homo Sapiens
cggugcaggagguggcucaguuauugaaccuuuugggaagcagcaccugggaaugcugccucgu

SEQ ID NO: 218817 - RNA, 64 nt, Homo Sapiens
ugugccuuucuggcaggguuuuguggggucacaugggaagcaauguguuacgcaagcagucucc

SEQ ID NO: 218818 - RNA, 64 nt, Homo Sapiens
agccucagugcagcccccucaggcccaaaccagggggaagcaccagggugaccccucaucugaa

SEQ ID NO: 218819 - RNA, 64 nt, Homo Sapiens
gccuggggugggugugagcagcaagcuguacaaagggaagcagauugcagaccaggaaggaaga

SEQ ID NO: 218820 - RNA, 64 nt, Homo Sapiens
gggaggugggcugaggccucguggagguggcggggggaagcagagugcaggggagggggcaaug

SEQ ID NO: 218821 - RNA, 64 nt, Homo Sapiens
auuguccucugggcauguggggguagggggaugugggaagcagcaagguuagaaggcaaaagug

SEQ ID NO: 218822 - RNA, 64 nt, Homo Sapiens
auacccuggcgggccacccuucuccuugaggaaggggaagcaggccuggcugcgggauggaggc

SEQ ID NO: 218823 - RNA, 64 nt, Homo Sapiens
auguuuacaaaucuguuuugcugccaguugaaaagggaagcauuuguauugucuuuucaaagug

SEQ ID NO: 218824 - RNA, 64 nt, Homo Sapiens
cuguggccuaccagcaucuguugauuagagcaaugggaagcauauuagcuacacugcuucccac

SEQ ID NO: 218825 - RNA, 64 nt, Homo Sapiens
uucccuucuggaggaagcacaagccucagggaaggggaagcaggaugcggagggccaaagcccg

SEQ ID NO: 218826 - RNA, 64 nt, Homo Sapiens
uucaagggcuggcagccagggagaaugggcccaggggaagcaaagaccucuucccucugccguu

SEQ ID NO: 218827 - RNA, 64 nt, Homo Sapiens
ggucccuccucaauuuucagcaucacauauaacugggaagcaggccauuugaugaaaagucuua

SEQ ID NO: 218828 - RNA, 64 nt, Homo Sapiens
cagcaacccuuuaaagaaaaccaccuuuuuucaggggaagcauuguugcugauuuugaaaacag

SEQ ID NO: 218829 - RNA, 64 nt, Homo Sapiens
ucacugucaaggaugcagagagcuggugguaggugggaagcaugguguccaccugccugcugac

SEQ ID NO: 218830 - RNA, 64 nt, Homo Sapiens
uucaauccuccacucuaagugauuccuccagggugggaagcacggggagcaauggaaucagaug

SEQ ID NO: 218831 - RNA, 64 nt, Homo Sapiens
cccagguccucuuacauuugacagguuucucagugggaagcaggucgccauggucccugcauuc

SEQ ID NO: 218832 - RNA, 64 nt, Homo Sapiens
gugauguucaacagcaucgccuguuuggacucuggggaagcagucagcaguaaaggagugggca

SEQ ID NO: 218833 - RNA, 64 nt, Homo Sapiens
gagggagggagcaagugugaugaggaggaguggagggaagcaggccagccccucuggccaggac

SEQ ID NO: 218834 - RNA, 64 nt, Homo Sapiens
gguugcagugaacugagauaaaucgcuugagcccgggaagcagauugggaggcugaggcaggag

SEQ ID NO: 218835 - RNA, 64 nt, Homo Sapiens
gucaagcccacccgggaaacugagcccuggagaggggaagcagccagcccaggaugcuucaggg

SEQ ID NO: 218836 - RNA, 64 nt, Homo Sapiens
ugcuccuggcugacccugagcucucgcaguuggagggaagcagacagacuugacuuuuugcaag

SEQ ID NO: 218837 - RNA, 64 nt, Homo Sapiens
auacuccauugucuagaugaugcauuuauuuuuagcacugaauagucauuucauggcuuaauag

SEQ ID NO: 218838 - RNA, 64 nt, Homo Sapiens
aaucaggcaggaaaaaagccuccaaguuguaugugcacugaacuuucaaacccagauccucugg

SEQ ID NO: 218839 - RNA, 64 nt, Homo Sapiens
gauagcuuucaagggcccaauggaggcggcgguggcacugaagagccauggccugugccuugca

SEQ ID NO: 218840 - RNA, 64 nt, Homo Sapiens
ccaggggcacacgcgcgcagucacgcaggcaaaugcacugaaacccacaggugcgaucagugcc

SEQ ID NO: 218841 - RNA, 64 nt, Homo Sapiens
uggaggacucuguccaugccuucuguaccucaaggcacugaagcuuccuugacugucuuugugu

SEQ ID NO: 218842 - RNA, 64 nt, Homo Sapiens
uuaaauugcuaucaagaauaauuugcuuuugcuugcacugaaaaguguauuacagugggcaggu

SEQ ID NO: 218843 - RNA, 64 nt, Homo Sapiens
uuaaauugcuaucaagagcaguuugcuuuugcuugcacugaaaaauggcagugagcagguaugu

SEQ ID NO: 218844 - RNA, 64 nt, Homo Sapiens
ccuaguuugaccucacagugacccuucccaaucagcacugaaaauaccaucaggccuaaucuca

SEQ ID NO: 218845 - RNA, 64 nt, Homo Sapiens
ccuaaucucauaccucugaccaacaggcuguucugcacugaaaagguucuucaucccuuuccag

SEQ ID NO: 218846 - RNA, 64 nt, Homo Sapiens
ucugagaacuauuuaccuauuuuuggggggggaugcacugaaaaggugggugggaugaaacaug

SEQ ID NO: 218847 - RNA, 52 nt, Homo Sapiens
ggcuggggaaacccugcugauggcacugaaggagccagaugccgacgaguga

SEQ ID NO: 218848 - RNA, 64 nt, Homo Sapiens
acacaauugacuggacaggucucuuuaccaaagggcacugaaacgugugugugcuaaguacagu

SEQ ID NO: 218849 - RNA, 64 nt, Homo Sapiens
gcugaaaguugacuugagucccuuucugcaaagugcacugaauuacuuuaugcuuaauuuagau

SEQ ID NO: 218850 - RNA, 64 nt, Homo Sapiens
uuuacgacaaaaugucucuggcuggaggugagcugcacugaaacaucuaaaaagauuaccuuug

SEQ ID NO: 218851 - RNA, 64 nt, Homo Sapiens
aacuuuucagggcugugugaccaacugguaguuggcacugaaaaagcucauucacguuucauga

SEQ ID NO: 218852 - RNA, 64 nt, Homo Sapiens
gugaagguggcuuccggcacugcaaaagaucugugcacugaacaccgaugcuuugcacugaagu

SEQ ID NO: 218853 - RNA, 64 nt, Homo Sapiens
ugcaaaagaucugugcacugagcuccgaugcuuugcacugaaguaagacguuuuggucucgauu

SEQ ID NO: 218854 - RNA, 64 nt, Homo Sapiens
uugauuucauucuguuuaaugaauuuggaaauaugcacugaaagaaauguaaaacauuuagaau

SEQ ID NO: 218855 - RNA, 64 nt, Homo Sapiens
aacauuuagaauagcucguguuauggaaaaaagugcacugaauuuauuagacaaacuuacgaau

SEQ ID NO: 218856 - RNA, 64 nt, Homo Sapiens
aaaaccaaggcccccuucccccaccucuuccauggggugagacuugagcagaacaggggcuucc

SEQ ID NO: 218857 - RNA, 64 nt, Homo Sapiens
aggggcuuccccaaguugcccagaaagacugucugggugagaagccauggccagagcuucuccc

SEQ ID NO: 218858 - RNA, 64 nt, Homo Sapiens
acuucaggccagucauuuccucccgauggggaaagggugagauuuacauccccaaaugcuugag

SEQ ID NO: 218859 - RNA, 64 nt, Homo Sapiens
ggggaagagauuugaggaggaaagaaaggagauggggugagaggguuuuuaagucugaaacucu

SEQ ID NO: 218860 - RNA, 64 nt, Homo Sapiens
gagacaaaugaaccccccucgcaguuucaggauugggugagacaggcuuuuucuugguuacacu

SEQ ID NO: 218861 - RNA, 64 nt, Homo Sapiens
cacaccacauuacacaugugggcccugugguccagggugagagucaguaaaucacagacccagg

SEQ ID NO: 218862 - RNA, 64 nt, Homo Sapiens
acagccuuuugaaagcuauuuccaucuaguaucagggugagagcauccuugaucuggcugccug

SEQ ID NO: 218863 - RNA, 64 nt, Homo Sapiens
gauggguucaaagagaaagguuggagaugauagugggugagaagcaggcuggugagacugggcu

SEQ ID NO: 218864 - RNA, 64 nt, Homo Sapiens
ggcaugaagagaaauacgccccuacuuuuuacuggggugagaggaaucuguguauucuuuuucu

SEQ ID NO: 218865 - RNA, 64 nt, Homo Sapiens
cuaaaacccagcuugccuguauuuggagugucaagggugagagcccuuggccacucccagcaca

SEQ ID NO: 218866 - RNA, 64 nt, Homo Sapiens
gcucacuucugccccgggcaggacugaggcuccagggugagaaguucccucgggcccuuaugaa

SEQ ID NO: 218867 - RNA, 64 nt, Homo Sapiens
ccagcacugcugcugcccugugucacuauggccugggugagagguuuguuuuuggguccgcugg

SEQ ID NO: 218868 - RNA, 64 nt, Homo Sapiens
uaagacauacauacuuuagaguuaugguaggagagggugagauaaaagcaugauuaguuugcag

SEQ ID NO: 218869 - RNA, 64 nt, Homo Sapiens
agaaacucuuaagaaauccuuuguugucuauggagggugagagcgcuuacauuuggauucagag

SEQ ID NO: 218870 - RNA, 64 nt, Homo Sapiens
aacccuuccuccagcgucuuuggcaugguuucuagggugagaguucccaauuuggauagaacgg

SEQ ID NO: 218871 - RNA, 64 nt, Homo Sapiens
aggugaauauaaucaaugccaauguaaugccagcgggugagauggccgauggagguuucaaaga

SEQ ID NO: 218872 - RNA, 64 nt, Homo Sapiens
cuggguccaggccuggccaucugccugggagccagggugagaguauggcuccacaccuccaaug

SEQ ID NO: 218873 - RNA, 64 nt, Homo Sapiens
cugcacagaagacagcagcaacacaaauuugggagggugagacacugcuuuugccuacgugaca

SEQ ID NO: 218874 - RNA, 64 nt, Homo Sapiens
cucuguuucagacugggcugggggcacacgugcugggugagacagugggcccucguccccuccc

SEQ ID NO: 218875 - RNA, 64 nt, Homo Sapiens
cccuuucuugacugagacgcaugagugccuucuggggugagagcagccccaggguuuaaguugg

SEQ ID NO: 218876 - RNA, 64 nt, Homo Sapiens
cuuagccaucccugacccugccacagcgcuccuagggugagagggccugcgcuaauuguaggag

SEQ ID NO: 218877 - RNA, 64 nt, Homo Sapiens
ggaucgcaguuuggaaacucccccuuguuucuuugggugagaaguguugaucauggaucauacu

SEQ ID NO: 218878 - RNA, 64 nt, Homo Sapiens
cacugacccucugaccuccuuccugggccugcggcuggaggagaagaucacagagccauucuug

SEQ ID NO: 218879 - RNA, 64 nt, Homo Sapiens
aauacuugagcaauuucagaaaaccaucuaagugcuggaggaaccacgcuuccuaacugcugcu

SEQ ID NO: 218880 - RNA, 64 nt, Homo Sapiens
uucuaaguaaaggcaaugaauucuccauuuccuacuggaggauuuauuuaaauaaaauaugcuu

SEQ ID NO: 218881 - RNA, 64 nt, Homo Sapiens
ugaaggcuggcgcccguaaucccagcuacuaaggcuggaggaucacuucagcccaggaguuuaa

SEQ ID NO: 218882 - RNA, 64 nt, Homo Sapiens
acacucccaucagaacuugggcugggagauguuccuggaggaggcagggcucugcucgucgggg

SEQ ID NO: 218883 - RNA, 64 nt, Homo Sapiens
cucccaucagaaccuggcaggccugaagacauuccuggaggacacugggcucugcccgcugggg

SEQ ID NO: 218884 - RNA, 64 nt, Homo Sapiens
ccuccaaguagaggggagaccaucaucagggguccuggaggaaggacuguuuggacccaggccu

SEQ ID NO: 218885 - RNA, 64 nt, Homo Sapiens
ggugauacguacauacgcauucaugaugacuucgcuggaggaaaggauuucugcaagucgacua

SEQ ID NO: 218886 - RNA, 64 nt, Homo Sapiens
gucaccuccagacaacaucuccagcuccaucgcgcuggaggagaccagcuccuggaggagggac

SEQ ID NO: 218887 - RNA, 64 nt, Homo Sapiens
gacccagcuccaucgcgcugccccaauccagcuccuggaggaggacuccagacucauuuaauca

SEQ ID NO: 218888 - RNA, 64 nt, Homo Sapiens
ggaccccccccgccugccgacagugccuuuuguucuggaggagacucugggguggucaccucgu

SEQ ID NO: 218889 - RNA, 64 nt, Homo Sapiens
cacugcccaccccaccaccccaaggugugugugucuggaggaaccacagagggagacuauggac

SEQ ID NO: 218890 - RNA, 64 nt, Homo Sapiens
ucccugcuccaggguagaccugagaugaaccucccuggaggagacuuauuucaaugaguccacc

SEQ ID NO: 218891 - RNA, 64 nt, Homo Sapiens
uaugcaggagucacacggucauaggccaucaaagcuggaggagaccucagaaucauucauucac

SEQ ID NO: 218892 - RNA, 64 nt, Homo Sapiens
aaacagcgggagugugggggaggguuagacaagccuggaggacaugcccgugaggagggggaga

SEQ ID NO: 218893 - RNA, 64 nt, Homo Sapiens
agguaacauagaugccugggaacacuuuacaguucuggaggaggggagcaguugaccuuugcca

SEQ ID NO: 218894 - RNA, 64 nt, Homo Sapiens
ugcaccaaggcuugccagagacuauugguggcaccuggaggacaggucuccaaggcauuuccac

SEQ ID NO: 218895 - RNA, 64 nt, Homo Sapiens
ugggaauuucaucuuucugcggggaaugaugggacuggaggaccaggcaggcuggagcagggcu

SEQ ID NO: 218896 - RNA, 64 nt, Homo Sapiens
gcaggcuagaggcacagcgguguguccccugcaccuggaggagauggauggggccggcaggucc

SEQ ID NO: 218897 - RNA, 64 nt, Homo Sapiens
cuguccaugcccgugucaccucaaggcacugaagcuggaggacuugucuuuguguuucuguacc

SEQ ID NO: 218898 - RNA, 64 nt, Homo Sapiens
cugagguccugccuuucauucagaggaaacugagcuggaggagcuuggagcuugguuucccugc

SEQ ID NO: 218899 - RNA, 64 nt, Homo Sapiens
uuaggggaggaagagccacgagauacuguccccucuggaggauuggccguguuuugccagcaug

SEQ ID NO: 218900 - RNA, 64 nt, Homo Sapiens
cuacuccuagccacgucccuugggaccggugggacuggaggaggaacggucacccuccuccccc

SEQ ID NO: 218901 - RNA, 64 nt, Homo Sapiens
uccaggggucccccagacaugaaagaggggugagcuggaggaagucauggugucacugggguac

SEQ ID NO: 218902 - RNA, 64 nt, Homo Sapiens
ggcccaggcagggggacagggaacugaccacggccuggaggacuacagugaagacaguaacuug

SEQ ID NO: 218903 - RNA, 64 nt, Homo Sapiens
ggaaacagugacuaaaagcuagugaugucccauccuggaggagaggcucacgaaugccagaggc

SEQ ID NO: 218904 - RNA, 64 nt, Homo Sapiens
ugugcagugcuggacucaccucgaucuuaugaagcuggaggacuggugaagauuggggccagua

SEQ ID NO: 218905 - RNA, 64 nt, Homo Sapiens
aagcagaguuggucuagagaggaggagggcggggcuggaggaaugugggggauugaaacuagcu

SEQ ID NO: 218906 - RNA, 64 nt, Homo Sapiens
agagguuaaauccucaucaagagagaccaggcggcuggaggacaagcggcucuaacccuggggg

SEQ ID NO: 218907 - RNA, 64 nt, Homo Sapiens
cgguaaaggcugagaugaaguggacugaguagaacuggaggacaggagucgacgugaguuccug

SEQ ID NO: 218908 - RNA, 64 nt, Homo Sapiens
uuccugggagucuccagagauggggccuggaggccuggaggaaggggccaggccucacauucgu

SEQ ID NO: 218909 - RNA, 64 nt, Homo Sapiens
cccgcacuccaaccagcagcuggauuccugggaacuggaggaucagguagaggcucaggcagag

SEQ ID NO: 218910 - RNA, 64 nt, Homo Sapiens
caaggccggccugcgcacuugcugccaccagaaacuggaggacaugauccaggagcuucagguu

SEQ ID NO: 218911 - RNA, 64 nt, Homo Sapiens
cgggccugcucagcugcccggagagccgccgccgcuggaggagaccgacuggucgcacucgcag

SEQ ID NO: 218912 - RNA, 64 nt, Homo Sapiens
gagcaucuccccuaacaccaccuaccccucccuccuggaggauggucgugucgaguacagagug

SEQ ID NO: 218913 - RNA, 64 nt, Homo Sapiens
cagaguggcccucaccgaggaccggcugccccgccuggaggagauccgcaucuggggaccccuc

SEQ ID NO: 218914 - RNA, 60 nt, Homo Sapiens
aggacuuccugggcccauaggugaagccuucuggaggagaaggugacguggcccagcguc

SEQ ID NO: 218915 - RNA, 64 nt, Homo Sapiens
acagacucagcuccaggcugcuuggcagcccagccuggaggagaaggcuaaugacggaggggcc

SEQ ID NO: 218916 - RNA, 64 nt, Homo Sapiens
ugaggaugagauggaagaggaggaggaggaggagcuggaggaggaggucgacgagcugcagacg

SEQ ID NO: 218917 - RNA, 64 nt, Homo Sapiens
ccacccagcuguucuaacccugcuauccacagcccuggaggaacuggggcuccuggaaggagga

SEQ ID NO: 218918 - RNA, 64 nt, Homo Sapiens
ccucccaucucaacucccugagagccacaggugccuggaggagcugugcugccggaaaaagccg

SEQ ID NO: 218919 - RNA, 64 nt, Homo Sapiens
uggcugacuuugccaaccugcccagcugcugccgcuggaggauccggaaagaguuuccgaagag

SEQ ID NO: 218920 - RNA, 64 nt, Homo Sapiens
cccaggcaucauuaaacaaggaauuguguuguuccuggaggaagaggagagcugagauuggagg

SEQ ID NO: 218921 - RNA, 64 nt, Homo Sapiens
agagaguaaagcuucuaggcugaccgcaggaauccuggaggaacgggagacugguugcaaggug

SEQ ID NO: 218922 - RNA, 64 nt, Homo Sapiens
uagaaccuagagaagcuaaaaccugagcuagaagcuggaggacuagaaccuggagggcuggaau

SEQ ID NO: 218923 - RNA, 64 nt, Homo Sapiens
cccaccacccacucuccucugccucaguaaguaucuggaggaagaaaacaggugaaagaagaag

SEQ ID NO: 218924 - RNA, 64 nt, Homo Sapiens
uaggcagaaacaaaaugacuaucugccuuugaaucuggaggaaaaugaguuccgagaugaccca

SEQ ID NO: 218925 - RNA, 64 nt, Homo Sapiens
caugaguuccgagaugacccguuguugcuguguccuggaggagaaggcuguuccuugaaaaugu

SEQ ID NO: 218926 - RNA, 64 nt, Homo Sapiens
cuguccccaaauguccauuuuugaagugauuuuccuggaggauuaggguauuuagcaguugaag

SEQ ID NO: 218927 - RNA, 64 nt, Homo Sapiens
gagcuugucaaugugauuuuaaaaaauugacuaccuggaggaaugauuaggaaucuaaaugaag

SEQ ID NO: 218928 - RNA, 64 nt, Homo Sapiens
ccugucccaauucugcccgccugugcccgacugacuggaggaggccucagcugccuccugcgcc

SEQ ID NO: 218929 - RNA, 64 nt, Homo Sapiens
cgcuggacuucggcgaggugaccucaguccucgccuggaggagagaccgagcgugugccacugg

SEQ ID NO: 218930 - RNA, 64 nt, Homo Sapiens
gccccuggccauccacaaacagcagaggccuucccuggaggaggcuuugggaccaccccugggg

SEQ ID NO: 218931 - RNA, 64 nt, Homo Sapiens
ccgcagagcacagagcaggagaagggcuugggcccuggaggagaaagccauucuggacaccagg

SEQ ID NO: 218932 - RNA, 64 nt, Homo Sapiens
ugggguggagcacuggacuccggggccccacuggcuggaggaaguggggucuggccuguugaug

SEQ ID NO: 218933 - RNA, 64 nt, Homo Sapiens
cuggccuguugauguuuacauggcgcccugccuccuggaggaccagauugcucugccccaccuu

SEQ ID NO: 218934 - RNA, 64 nt, Homo Sapiens
cgaggaaggcggcugggcgggcggggagcugggccuggaggauccuggagucucauuaaaugcc

SEQ ID NO: 218935 - RNA, 64 nt, Homo Sapiens
ggccugugcauccuggccaagcgucacccucacacuggaggaggaugucugcucuggacuuauc

SEQ ID NO: 218936 - RNA, 64 nt, Homo Sapiens
ucucuuguccaaauaguggauugggcagacuggccuggaggaaaugcuagaacagagggaaagg

SEQ ID NO: 218937 - RNA, 64 nt, Homo Sapiens
gauccugccccuuccuucuugccuguagcuccugcuggaggaagaggauuccagccuguuggcc

SEQ ID NO: 218938 - RNA, 64 nt, Homo Sapiens
cugggccccaggccagcuccaaugagugaagauccuggaggaccuggucagaaccguuacugug

SEQ ID NO: 218939 - RNA, 64 nt, Homo Sapiens
ggucagaaccguuacugugacauccacgugcgaccuggaggacucucccuccccaccccugucg

SEQ ID NO: 218940 - RNA, 64 nt, Homo Sapiens
aaagcuguauccuggaguuguauguauuuuggcucuggaggagccaguggucucagccacaucc

SEQ ID NO: 218941 - RNA, 64 nt, Homo Sapiens
gcgcuguggagccccucccgaccauguugacccucuggaggagaagcugucugcagggaacgcc

SEQ ID NO: 218942 - RNA, 64 nt, Homo Sapiens
cacagucucaguccagaugcgcugcucauuccuucuggaggacaagaggugguagaaccacuug

SEQ ID NO: 218943 - RNA, 64 nt, Homo Sapiens
ccuccauccggcuccugucagagccaggcucugccuggaggaucuagcccucccuggcauguca

SEQ ID NO: 218944 - RNA, 64 nt, Homo Sapiens
ccuugggacucaggagcucagucaaggccacaggcuggaggagagacggggcugggcgcaaggu

SEQ ID NO: 218945 - RNA, 64 nt, Homo Sapiens
gaugaggguuccuaaaccuuaaaccucucugccucuggaggagggugggguauucuggcaggau

SEQ ID NO: 218946 - RNA, 59 nt, Homo Sapiens
uuggcaguuuggcagcuugacuucugcagcuggaggaggccccucaggccggggaucug

SEQ ID NO: 218947 - RNA, 64 nt, Homo Sapiens
uuugugagggugucgaguagccucaccggccugucuggaggagcagcuggcucugcucugagaa

SEQ ID NO: 218948 - RNA, 64 nt, Homo Sapiens
uuuaauuacagguccagggaugagcugaugguugcuggaggaggccaguguagagccagugaga

SEQ ID NO: 218949 - RNA, 64 nt, Homo Sapiens
augaaaaaucaggcagggaaucgaaacgacagugcuggaggagacucaggaagcagaggcgucc

SEQ ID NO: 218950 - RNA, 64 nt, Homo Sapiens
gcgaccccucagacagggguccaagaagccccugcuggaggacgacccucagggugccaggaag

SEQ ID NO: 218951 - RNA, 64 nt, Homo Sapiens
ugaacacagaacccucaagacaaggaugacagagcuggaggacacaucuagcugccauugcaac

SEQ ID NO: 218952 - RNA, 64 nt, Homo Sapiens
uucugcugcgcaucaacuucgcuaccagccccaccuggaggacugaccaagcuggugaaccgcg

SEQ ID NO: 218953 - RNA, 64 nt, Homo Sapiens
uccagcgugcgcacgcagagccaccgugggcgaccuggaggagacgaguucagggccagguugg

SEQ ID NO: 218954 - RNA, 64 nt, Homo Sapiens
cggaccauugaugcacuuggugucuuuuugccugcuggaggacaccuggccacacacuuccaug

SEQ ID NO: 218955 - RNA, 64 nt, Homo Sapiens
cccucaguuugcuccacaugacccagacggggggcuggaggacauugggccggccaggcagggc

SEQ ID NO: 218956 - RNA, 64 nt, Homo Sapiens
guauuuaaugcccugucagucccugacccugcuccuaucccacacccuguuuuguauaccccuc

SEQ ID NO: 218957 - RNA, 64 nt, Homo Sapiens
gucucuguugccaccaucagccccagccuccugucuaucccaggacauccgauuucuccuccug

SEQ ID NO: 218958 - RNA, 64 nt, Homo Sapiens
uuagggcuccagaaaagccagaggcucugauuuccuaucccaguuuugguacaguccacauuau

SEQ ID NO: 218959 - RNA, 62 nt, Homo Sapiens
aacauucaaaucaagcccauaccggauaaugccuaucccagaaagaaaugguuuacagauga

SEQ ID NO: 218960 - RNA, 64 nt, Homo Sapiens
ucucagcuagaaccauccacucugaauucagaaacuaucccagacaauguggcuggugaacacu

SEQ ID NO: 218961 - RNA, 64 nt, Homo Sapiens
ucacagauaugauuuaccacagaagcagugaugacuaucccauaauguguuaucuucagccaug

SEQ ID NO: 218962 - RNA, 64 nt, Homo Sapiens
aaggagucuugaccauagaguccucucucugccucuaucccauucuuuuuacauuuaacaaaac

SEQ ID NO: 218963 - RNA, 64 nt, Homo Sapiens
ccugcagccuuaacauucucuuccccugcuccuccuaucccauugcccucugcccagcugacag

SEQ ID NO: 218964 - RNA, 64 nt, Homo Sapiens
augagaccguuacucggauguugaaaguuggaaacuaucccauugcaaguuucucuccaaauaa

SEQ ID NO: 218965 - RNA, 64 nt, Homo Sapiens
uaaccucccaagcuucucacuuaaagaggacucccuaucccacaaacacaugcucccucuuccu

SEQ ID NO: 218966 - RNA, 64 nt, Homo Sapiens
caagaacaucaaaccagagugcccaaccccggccugugggcagccgcgccagcugccgggacac

SEQ ID NO: 218967 - RNA, 64 nt, Homo Sapiens
agagcuucgggggcacguggcugcccugcccuacugugggcauagcgcccgccaugacagugag

SEQ ID NO: 218968 - RNA, 64 nt, Homo Sapiens
cagaagcauagccuugaaggucagaaguaaagugugugggcaauacccguaaaauaugaaauac

SEQ ID NO: 218969 - RNA, 64 nt, Homo Sapiens
cugaaaauaucuuuaacuguuuacaugacucuaaugugggcaguuugagaaagaaugaugcaga

SEQ ID NO: 218970 - RNA, 64 nt, Homo Sapiens
ugcagacuuccucuuucaagggaggcagggccccugugggcacuagguguaaaaggugcuggcc

SEQ ID NO: 218971 - RNA, 64 nt, Homo Sapiens
caccucacagagucuggaggccuccaggaucaacugugggcaaagugccugccucugaccucau

SEQ ID NO: 218972 - RNA, 64 nt, Homo Sapiens
cccaggcacacgugggcaggaucagccucuguccugugggcagauacuuuacguaggauuuccc

SEQ ID NO: 218973 - RNA, 64 nt, Homo Sapiens
gccacgugguucuugccgauaccuugaagaagugugugggcacucugcugccuccaggaucagc

SEQ ID NO: 218974 - RNA, 64 nt, Homo Sapiens
uggccagccgggcccaggcaggagcagguggcccugugggcaccuggugccugcccccugccgg

SEQ ID NO: 218975 - RNA, 64 nt, Homo Sapiens
ccuccucugccaggguggguccugggaccucuaaugugggcaugucguccaccccaggacgagc

SEQ ID NO: 218976 - RNA, 64 nt, Homo Sapiens
acaugcagaauaauccuguuaaccuugcccuaguugugggcaacuuguacuugugaugagagau

SEQ ID NO: 218977 - RNA, 64 nt, Homo Sapiens
gugccaagauuuaaaauuaaaaagucacacggcuugugggcacuuuuauauuaucaaggggacu

SEQ ID NO: 218978 - RNA, 64 nt, Homo Sapiens
uuaggccacggcccuaaauaggaauucccuggauugugggcaagugggcggaaguuauucuggc

SEQ ID NO: 218979 - RNA, 64 nt, Homo Sapiens
gugucgugaucaagguucacugaagccuugacgcugugggcacugccucagccgcccaaguauc

SEQ ID NO: 218980 - RNA, 64 nt, Homo Sapiens
ggacuggcuggaaacgucugcaugcucgugcuggugugggcaugccacgaagggaauucuugca

SEQ ID NO: 218981 - RNA, 64 nt, Homo Sapiens
uggagagggguauuugcccuguggggacuaaaaaugugggcaugcccagcucuugaguacagug

SEQ ID NO: 218982 - RNA, 64 nt, Homo Sapiens
gaaauuggaagggcccuuuucaggcuggguucccugugggcauuugcuuaguaaaugccuguug

SEQ ID NO: 218983 - RNA, 64 nt, Homo Sapiens
ggaugacacucaagauacuugccagucucuccagugugggcaccagccggccagaacagaugcg

SEQ ID NO: 218984 - RNA, 64 nt, Homo Sapiens
agugugugugucucgaguggcuaccuguugggcuugugggcagugauuguacagagccugucca

SEQ ID NO: 218985 - RNA, 64 nt, Homo Sapiens
ggcugggggaggugggagggaucacgccuauaggugugggcacaugaaacgaccuggaacuugc

SEQ ID NO: 218986 - RNA, 64 nt, Homo Sapiens
aaauuggggcccuaacuaauuuuccuuuugagguugugggcauaagugcugaucuagaauacag

SEQ ID NO: 218987 - RNA, 64 nt, Homo Sapiens
ugggagcuugauucucagcaaucugugggcacgcugugggcaggagcugccauccagggaugcc

SEQ ID NO: 218988 - RNA, 64 nt, Homo Sapiens
cugugggcaggugggagcuuccagggaugccaucugugggcacgcaguccaccugagcugccau

SEQ ID NO: 218989 - RNA, 64 nt, Homo Sapiens
accugacacaucucgucuccccucuuuuccgcacugugggcacaaagacacuuuuucuuccgca

SEQ ID NO: 218990 - RNA, 64 nt, Homo Sapiens
uggagcaccucccuggggagucgggggauuggguugugggcaguccccauggccgccuggagaa

SEQ ID NO: 218991 - RNA, 64 nt, Homo Sapiens
cgaauccauccaccuguccaacacagaccacagaugugggcacacuggggcuacguccaugugg

SEQ ID NO: 218992 - RNA, 64 nt, Homo Sapiens
cccggcccagugcccccuggaccgugaggaggggugugggcaccaaaaauccccaaaaaagcga

SEQ ID NO: 218993 - RNA, 64 nt, Homo Sapiens
gguggaggaggagagacgggucgccgggggagguugugggcaacgacccugggaggaggugaca

SEQ ID NO: 218994 - RNA, 64 nt, Homo Sapiens
gcuacguguuuugggggcagagcaucccuucuggugugggcauccgggcccugcgguggcauga

SEQ ID NO: 218995 - RNA, 64 nt, Homo Sapiens
ggaaccagccaaccaucauguguagagccccuacugugggcaaaguccuccuuucauuacccua

SEQ ID NO: 218996 - RNA, 64 nt, Homo Sapiens
ccaaugcuugcauggagaaugggacgaggacauuugugggcaagcagaugacagagguuugaag

SEQ ID NO: 218997 - RNA, 62 nt, Homo Sapiens
acgucuagcggccccgcgggacuggggacugagcccaggagguuugcacaagccgggcgauu

SEQ ID NO: 218998 - RNA, 62 nt, Homo Sapiens
uggggaacagauggcugaggcugcagacucaggcccaggacacucaaccccaggaggggagc

SEQ ID NO: 218999 - RNA, 62 nt, Homo Sapiens
ggggagccgcucggcgaaugagcugggugggugcccaggagccggcccgcagcaccugcaca

SEQ ID NO: 219000 - RNA, 62 nt, Homo Sapiens
ucaaggcugcagugagccaaaggaucacuugagcccaggagggcuugggaggcugagguugc

SEQ ID NO: 219001 - RNA, 62 nt, Homo Sapiens
uugagguuguaguaagcuacaggaucacuugagcccaggaaucuuuggaaggcugaggcaga

SEQ ID NO: 219002 - RNA, 62 nt, Homo Sapiens
uugagaaugcagugagcuugaggaucacaagagcccaggaggaugcagaugucuaagacagg

SEQ ID NO: 219003 - RNA, 62 nt, Homo Sapiens
ucaagaccagccuggacaacggaucgucuugagcccaggaguuuugggaggcugaaguagga

SEQ ID NO: 219004 - RNA, 62 nt, Homo Sapiens
uggggaagaguagguucucguuccguucuggggcccaggaaguuccacaggccauccucuua

SEQ ID NO: 219005 - RNA, 61 nt, Homo Sapiens; identical to SEQ ID NO: 108624

SEQ ID NO: 219006 - RNA, 62 nt, Homo Sapiens
aucaacacuguucucucuguagccccuuuguggcccaggauaggaagugaacuacccagggc

SEQ ID NO: 219007 - RNA, 62 nt, Homo Sapiens
auggcacccuuagagugcagugggcagagguggcccaggaccacgugagaugaacacuggag

SEQ ID NO: 219008 - RNA, 62 nt, Homo Sapiens
acaaaguguggaggccucggcuuggaggcagggcccaggagacucugaguucugugcugucu

SEQ ID NO: 219009 - RNA, 62 nt, Homo Sapiens
ugggagaaggucacagagccaguccagcucaggcccaggaggcccuacuccaccuccuucca

SEQ ID NO: 219010 - RNA, 62 nt, Homo Sapiens
auugcuuuucugugaauucaaacacauucuuggcccaggagcgggggugcuggccaagagcc

SEQ ID NO: 219011 - RNA, 62 nt, Homo Sapiens
uuucugccuuggccucggcgggcuuuucuggggcccaggaagcccacacuaugcacagagcc

SEQ ID NO: 219012 - RNA, 62 nt, Homo Sapiens
ccaagucagacagaugucagcuucccagccaugcccaggacguccuaucucccccaacccac

SEQ ID NO: 219013 - RNA, 62 nt, Homo Sapiens
cagcacuuagggugccaauguggauuaccugagcccaggaguuugagaccagccuggguaac

SEQ ID NO: 219014 - RNA, 62 nt, Homo Sapiens
aaaaucuaggcagugaacaagucuucauccuggcccaggaaauagccuauuaaaaaaugcug

SEQ ID NO: 219015 - RNA, 62 nt, Homo Sapiens
ggggaggaugacaagccgcugcccaccuccaagcccaggaaacaguacaagauggcuaagga

SEQ ID NO: 219016 - RNA, 62 nt, Homo Sapiens
aaaacuggguuuaucucaaggcagcagccugagcccaggagcagaggacccaguuguuauaa

SEQ ID NO: 219017 - RNA, 62 nt, Homo Sapiens
gagcuacggcagggugugugcaaucccaccuagcccaggagaagggaagcaugugacaccca

SEQ ID NO: 219018 - RNA, 62 nt, Homo Sapiens
cagagguugcagugagccgaagaaucacugcagcccaggagggagaauuacuugaacgcagg

SEQ ID NO: 219019 - RNA, 62 nt, Homo Sapiens
aauaugaaauuuuuuuucaugcuuuaucaauagcccaggauauauuuuauuuuuagaauuuu

SEQ ID NO: 219020 - RNA, 62 nt, Homo Sapiens
agagacaauuucugcagguggcaggugagcaagcccaggagaaugcugcaaucuugggggug

SEQ ID NO: 219021 - RNA, 62 nt, Homo Sapiens
uugaggcuggagugagccauaggaucacuugagcccaggaggacucaggaggcugaggcagg

SEQ ID NO: 219022 - RNA, 62 nt, Homo Sapiens
ucgagaccagccugggcaacgcggauaguugagcccaggaguacuuugggaggcugaugugg

SEQ ID NO: 219023 - RNA, 62 nt, Homo Sapiens
ucgaggcugcagugugcuguaaaaucacuugagcccaggaggacucaggaggcugagguggg

SEQ ID NO: 219024 - RNA, 62 nt, Homo Sapiens
uugagaacaggauuuugagacagguuguuugagcccaggaaucuaugggaggcugaggcaag

SEQ ID NO: 219025 - RNA, 62 nt, Homo Sapiens
gugccugcacaugagaggagggucugcuuccugcccaggaagccgccacugcaguucugcua

SEQ ID NO: 219026 - RNA, 62 nt, Homo Sapiens
agccagcaagagcaaggcaucucuggcagcuggcccaggaaggcauccuggugccugcauac

SEQ ID NO: 219027 - RNA, 62 nt, Homo Sapiens
gacguggucuuccagcccaugaggagugaggagcccaggaacuucuuauaccacguuccacg

SEQ ID NO: 219028 - RNA, 62 nt, Homo Sapiens
guggucugccauugcaaugcaucugcacuccagcccaggacuagugccaagauuggcuuggc

SEQ ID NO: 219029 - RNA, 62 nt, Homo Sapiens
uggagccacagagcuggugcccuuggcaguuggcccaggaacaaggcuggcacgugcagcgu

SEQ ID NO: 219030 - RNA, 62 nt, Homo Sapiens
uuuugggaggccgaggagagaggaucacuuaagcccaggagucugagaccagccugggcaac

SEQ ID NO: 219031 - RNA, 62 nt, Homo Sapiens
acaugggaggcugaggugggaggaucacuugagcccaggaaguccagaacguagugagccuu

SEQ ID NO: 219032 - RNA, 62 nt, Homo Sapiens
ggaagggcccucgaaugccauucacaggaacagcccaggaacccagggacuucagaagggcu

SEQ ID NO: 219033 - RNA, 62 nt, Homo Sapiens
aucccagcucuggaagcugaaggauagcuugagcccaggaguucgaggcugcagugagcuau

SEQ ID NO: 219034 - RNA, 62 nt, Homo Sapiens
cagagguugcagugagccaaaggauugcuugagcccaggaggacugaggaggcugagguggg

SEQ ID NO: 219035 - RNA, 62 nt, Homo Sapiens
ucaagaccagccugggcaacuagauuacuugagcccaggaaucuuugggaggcugagguggg

SEQ ID NO: 219036 - RNA, 62 nt, Homo Sapiens
ucgaggcugcagugagccauaagaucacuugagcccaggaggucucaggaggcugggguggg

SEQ ID NO: 219037 - RNA, 62 nt, Homo Sapiens
uugagaccagcuaaggcaauaggauagcgugagcccaggagucuuugggaggcugagucggg

SEQ ID NO: 219038 - RNA, 62 nt, Homo Sapiens
ggguucguaccagcaaguagacuaggaacugagcccaggaaagggggauguuuuccuggugu

SEQ ID NO: 219039 - RNA, 62 nt, Homo Sapiens
cacugcccaagucauggcaacaggcuggagcagcccaggagaugggccuaaaauguucugga

SEQ ID NO: 219040 - RNA, 62 nt, Homo Sapiens
ccucccucgucccacccccacccaggcaggaagcccaggaggagugcgggcagggccugacc

SEQ ID NO: 219041 - RNA, 62 nt, Homo Sapiens
gaaggggucccccauuguuuugcuuccccagcgcccaggaugagcgguuuaccaucgagcuu

SEQ ID NO: 219042 - RNA, 62 nt, Homo Sapiens
gaugcucucauaagcaccuuugcucucauaaggcccaggaagagagaagggcccaggaagga

SEQ ID NO: 219043 - RNA, 62 nt, Homo Sapiens
gaugcucucauaaggcccagggcaagagaagggcccaggaagugccauccacggccuuuucu

SEQ ID NO: 219044 - RNA, 62 nt, Homo Sapiens
ucagguucauuuuguuacauacagcaggcugggcccaggaggacaaaacaaacagugauugu

SEQ ID NO: 219045 - RNA, 62 nt, Homo Sapiens
uuucuuuucuggguaucuugcuuuuccuggaggcccaggauaaggagaaggaauuggagcag

SEQ ID NO: 219046 - RNA, 62 nt, Homo Sapiens
uugaggcugcagugagcagaaggcucacuugagcccaggaggccagcugcucugauaagagg

SEQ ID NO: 219047 - RNA, 62 nt, Homo Sapiens
uggagguugcagugagcugauggaucgcuugagcccaggagggcucagguggcuagggugga

SEQ ID NO: 219048 - RNA, 62 nt, Homo Sapiens
ucuugggaggucgaggcaagcugaucgcuugagcccaggaguuuaagaccggccugaguagc

SEQ ID NO: 219049 - RNA, 62 nt, Homo Sapiens
acugggggugcugaggugggaggaucgcuugagcccaggagagugaggcugcagugagcuga

SEQ ID NO: 219050 - RNA, 62 nt, Homo Sapiens
auagcuaggaaucauguucaauauugaauucugcccaggagcaugaacugauccaugaaugc

SEQ ID NO: 219051 - RNA, 62 nt, Homo Sapiens
ggcugagguggaagaauggaagaaucacuugagcccaggaguuugaggcugcagugagcuau

SEQ ID NO: 219052 - RNA, 62 nt, Homo Sapiens
gcuccccaccugcccugcacucugcccucuuugcccaggauacugaggagggcuggagcucg

SEQ ID NO: 219053 - RNA, 62 nt, Homo Sapiens
cuugggccacugccugggacccagcagacacugcccaggacucuuuagugcacucacucuug

SEQ ID NO: 219054 - RNA, 62 nt, Homo Sapiens
cagauaaauaaccauacacugaccucauacuugcccaggacccauuaaaguugcgguauuua

SEQ ID NO: 219055 - RNA, 62 nt, Homo Sapiens
acuccuguugggacacaguuggucugcagucggcccaggacggucuacucagcacaacugac

SEQ ID NO: 219056 - RNA, 62 nt, Homo Sapiens
ucgaggcugcagucagucauaggauugcuugagcccaggaguacucaggaggcugaggcagg

SEQ ID NO: 219057 - RNA, 62 nt, Homo Sapiens
cauccguugugcuugccugcugcuaaauggucgcccaggagaagcccaagugaaaucaaagg

SEQ ID NO: 219058 - RNA, 62 nt, Homo Sapiens
uugaggcugcagugagccauaggaucacuugagcccaggagaggcuacucuggaggcccuug

SEQ ID NO: 219059 - RNA, 62 nt, Homo Sapiens
ucgacaccagccuggccaacgcaauggcuugagcccaggaguaucccagcacuuugaggugg

SEQ ID NO: 219060 - RNA, 62 nt, Homo Sapiens
ucacuguccuguaaugucucccggucagggcagcccaggacugcccagccuggugggcuggg

SEQ ID NO: 219061 - RNA, 62 nt, Homo Sapiens
aauccauagaaagacaaacggccaccuugggugcccaggauacuggugccuggccccacgua

SEQ ID NO: 219062 - RNA, 62 nt, Homo Sapiens
cuuuaggaggcugaggcaggaggacuguuugagcccaggaguuugagaccaaccugaguaag

SEQ ID NO: 219063 - RNA, 62 nt, Homo Sapiens
acuuggggugcugaggcgggaggauuacuugagcccaggaggauuacuucaaccugggaggu

SEQ ID NO: 219064 - RNA, 62 nt, Homo Sapiens
acuuuggaggccaaggcaggaggacugcuugagcccaggaguuugagaccagccugggcaau

SEQ ID NO: 219065 - RNA, 62 nt, Homo Sapiens
cuuugggaggccgaggcaggaagacugcuugagcccaggaguucaagaccagccugggcaac

SEQ ID NO: 219066 - RNA, 62 nt, Homo Sapiens
acucaggagguugaggugggaagauugcuugagcccaggaguuugagguugcagugagcuga

SEQ ID NO: 219067 - RNA, 62 nt, Homo Sapiens
cuuugggaggccauagcaggaggauugcuugagcccaggaguucgagaccagccagagcaac

SEQ ID NO: 219068 - RNA, 62 nt, Homo Sapiens
acuugggagguugaggugggaggauugcuugagcccaggauuucaaggcugcagugagccau

SEQ ID NO: 219069 - RNA, 62 nt, Homo Sapiens
uucauaucuuuaaaagcugccaaagggguaaggcccaggacagcagcugcuagcucagacac

SEQ ID NO: 219070 - RNA, 62 nt, Homo Sapiens
cugaggaaauacccagucagaggaucaaacaggcccaggagcccugaaccagagcuggagug

SEQ ID NO: 219071 - RNA, 62 nt, Homo Sapiens
auuugucugagacauuuccaagggagggccaagcccaggagggccccggcugugccagggug

SEQ ID NO: 219072 - RNA, 62 nt, Homo Sapiens
ccuuucucugccgccugcugcuccaaauuacagcccaggacacgggaucccagaacucuggu

SEQ ID NO: 219073 - RNA, 62 nt, Homo Sapiens
agcaaugucucuucacgggcugaucaacuggggcccaggaaaagucuuuuuuuccucugccc

SEQ ID NO: 219074 - RNA, 62 nt, Homo Sapiens
ccauguugggcccucguuucacaugugcccuggcccaggaggagggcugcaggcaaagcugg

SEQ ID NO: 219075 - RNA, 62 nt, Homo Sapiens
aaguacagccacuguaaauaacccucgucccugcccaggaacccagacuggacuucagucuc

SEQ ID NO: 219076 - RNA, 62 nt, Homo Sapiens
aagaaggucauuuccaaacccauccuggaagggcccaggauccaaaggucaucaguccugcu

SEQ ID NO: 219077 - RNA, 62 nt, Homo Sapiens
cgaugggaggccaagacaggcagaucacuugagcccaggaguuugaggccagccugggcaac

SEQ ID NO: 219078 - RNA, 62 nt, Homo Sapiens
acucaggaggcaaagaugggaggauuacuugagcccaggaggucaaggcuacagugagccau

SEQ ID NO: 219079 - RNA, 62 nt, Homo Sapiens
gcccagagugaccaagcagcaccagcaggccugcccaggaugcugaaagcagauuucuucuu

SEQ ID NO: 219080 - RNA, 62 nt, Homo Sapiens
aauaagaaaauaggggugauggagggggagaagcccaggacugggagaaucgcacaugcccc

SEQ ID NO: 219081 - RNA, 62 nt, Homo Sapiens
ugggcccugccacccaggcccuggguccugccgcccaggagcagcaggaggaagcccaggag

SEQ ID NO: 219082 - RNA, 62 nt, Homo Sapiens
uggguccugccgcccaggagcagcaggaggaagcccaggagccacuuccccaagggcggacc

SEQ ID NO: 219083 - RNA, 62 nt, Homo Sapiens
uugggugugcugacgagcagggagccccaguagcccaggagccugcugaugagcccacucua

SEQ ID NO: 219084 - RNA, 62 nt, Homo Sapiens
caggacugagguccugagaaggggauagcacugcccaggacgugugucccuagccuggaaug

SEQ ID NO: 219085 - RNA, 62 nt, Homo Sapiens
ccagcugcccucuacgaucaggugcaggggcugcccaggacaaagcgggggcaggggaaaga

SEQ ID NO: 219086 - RNA, 62 nt, Homo Sapiens
cuuugggaggcccaggcagaaggaucgcugcagcccaggaguucgagacuagccugggcaac

SEQ ID NO: 219087 - RNA, 62 nt, Homo Sapiens
acucaggaggccaaggcaggaggauugcuugagcccaggaguuugagaccagccugggcaac

SEQ ID NO: 219088 - RNA, 62 nt, Homo Sapiens
gaaucaacugcuauccuuccccucaccccucagcccaggagggaaagggcauuuucuuuuuc

SEQ ID NO: 219089 - RNA, 62 nt, Homo Sapiens
ucagugcugacucacgggcaugcuucauugaggcccaggaagaggcccugguuuggggcugu

SEQ ID NO: 219090 - RNA, 62 nt, Homo Sapiens
uugaggcugcagugaggugugaggauccuugagcccaggagguacucaggaggcugaggcua

SEQ ID NO: 219091 - RNA, 62 nt, Homo Sapiens
ucaagacuagccuaggcaacaggaucacuugagcccaggagucuuugggaggcugaggcagg

SEQ ID NO: 219092 - RNA, 62 nt, Homo Sapiens
gcucgggacagcugugugcuguggcugagagggcccaggagggccugagcuuagguugugga

SEQ ID NO: 219093 - RNA, 62 nt, Homo Sapiens
uuaagugacuuggcuaaaguauaaggaaacaggcccaggagaccauuccucucuugcuacaa

SEQ ID NO: 219094 - RNA, 62 nt, Homo Sapiens
uucccugccccuuacucacccucgggcucugagcccaggacacagggacaccccugcagggu

SEQ ID NO: 219095 - RNA, 62 nt, Homo Sapiens
ucggacugcugguccuggaguacugcgcggcggcccaggagcagggggccacuggcuacccc

SEQ ID NO: 219096 - RNA, 62 nt, Homo Sapiens
gaccacucccaccucaggaagcuaguauucaugcccaggaucggugaguucaggggauccau

SEQ ID NO: 219097 - RNA, 62 nt, Homo Sapiens
ccacucacaccccagggggaugagcucuccaagcccaggauucuggcaagagaggugaagaa

SEQ ID NO: 219098 - RNA, 62 nt, Homo Sapiens
aagcaggugucggacugcucagaguccgcauggcccaggagcagguggucggaggccccugg

SEQ ID NO: 219099 - RNA, 62 nt, Homo Sapiens
ccagguggcgaaaggggcccagucguucuugggcccaggauggggccucuagacuugcaagg

SEQ ID NO: 219100 - RNA, 62 nt, Homo Sapiens
gccugggcagagacccuguagcucccggaggggcccaggaaguggcccaggccccuggcagu

SEQ ID NO: 219101 - RNA, 62 nt, Homo Sapiens
cagucucuggcuguggcuccaguucaaggagagcccaggagcggcugggggcuggcaccgag

SEQ ID NO: 219102 - RNA, 62 nt, Homo Sapiens
ugcgccauccuuuaggccgaaaauucuuuccugcccaggaccacaguuaugugauaaaggaa

SEQ ID NO: 219103 - RNA, 62 nt, Homo Sapiens
ggagggaggcaagccagucguggccucgcuaggcccaggagaugaccgaccauugccauuuc

SEQ ID NO: 219104 - RNA, 62 nt, Homo Sapiens
uccccgugguguccccuggccucccagagaaagcccaggaaggauguggccagagcaccggc

SEQ ID NO: 219105 - RNA, 62 nt, Homo Sapiens
cucaccgugucacagcuguggguuugccaucagcccaggauauggcucagccaucccggcug

SEQ ID NO: 219106 - RNA, 62 nt, Homo Sapiens
agaaucgcugccuccucucccugaaaacgagggcccaggaccucagauucaagcccaggagg

SEQ ID NO: 219107 - RNA, 62 nt, Homo Sapiens
cugaaaacgagggcccaggacaucagauucaagcccaggagguggccaccagccccagcugc

SEQ ID NO: 219108 - RNA, 62 nt, Homo Sapiens
cuuuaagaggccaaggcggauggaucacuugagcccaggaguucaacaccagccugagcaac

SEQ ID NO: 219109 - RNA, 62 nt, Homo Sapiens
agcugccuggcauguggcacuuugucagggcagcccaggaaucugaaacaggaucaaacucu

SEQ ID NO: 219110 - RNA, 62 nt, Homo Sapiens
cugcauucccuggagacucacugcaaguuccugcccaggaggcugagggcaccccauccuca

SEQ ID NO: 219111 - RNA, 62 nt, Homo Sapiens
ggcucaagacaccacccccuccagcuucuggggcccaggagccucucccugcuacagggggu

SEQ ID NO: 219112 - RNA, 62 nt, Homo Sapiens
aacugggaggcugaggcaggaggaucacuugagcccaggagauugaggcugcagugagcaug

SEQ ID NO: 219113 - RNA, 62 nt, Homo Sapiens
ccagcugcccacucaugggcccuucaccaccugcccaggaucucacccaguacugacagcuc

SEQ ID NO: 219114 - RNA, 62 nt, Homo Sapiens
gaugagggggucgacagguugaacgucuucaggcccaggaccccaagcuccucagccuggcc

SEQ ID NO: 219115 - RNA, 62 nt, Homo Sapiens
ggggccgacccuccucgggaccccuccacucugcccaggagacacacacuccacgagagcag

SEQ ID NO: 219116 - RNA, 62 nt, Homo Sapiens
ugaggagcuggaguggaagccuuccaagaugugcccaggaugauggcugugggaauccccca

SEQ ID NO: 219117 - RNA, 62 nt, Homo Sapiens
ccccgggccucgggcccggccaccgggcgcucgcccaggacucgacacgcguccucgggcgc

SEQ ID NO: 219118 - RNA, 62 nt, Homo Sapiens
gagaggcgggucccaggccccagcggccgcucgcccaggaugccgcccacggggggccacag

SEQ ID NO: 219119 - RNA, 62 nt, Homo Sapiens
cgacaagcuggacccccugcccccccgagggugcccaggacugcggcccccggggauucccc

SEQ ID NO: 219120 - RNA, 62 nt, Homo Sapiens
ucagagagggcgcggccccccuccccgagugugcccaggaacugcggcccuggggacccccc

SEQ ID NO: 219121 - RNA, 62 nt, Homo Sapiens
agaagccaccgggaaagcagccagcacaaagggcccaggaagccagcccccgagagcugagc

SEQ ID NO: 219122 - RNA, 62 nt, Homo Sapiens
gacuuggcagcauggagccaaggucuguccccgcccaggagggugccuuccucggggguagg

SEQ ID NO: 219123 - RNA, 62 nt, Homo Sapiens
cguccagaccucacccuguggcuccagcauuugcccaggacccccacuccauggggacagaa

SEQ ID NO: 219124 - RNA, 62 nt, Homo Sapiens
acgggagcuucugaagagcuucuccauaaaaggcccaggaacgccaugccuauccaaugacg

SEQ ID NO: 219125 - RNA, 62 nt, Homo Sapiens
ggagccauggcauaugacaaugaggggcaucugcccaggacauuacugaggccaugagaacc

SEQ ID NO: 219126 - RNA, 62 nt, Homo Sapiens
cccauccuugcuucaucucacccuugccuggagcccaggaaccccugcugcagagagcacag

SEQ ID NO: 219127 - RNA, 62 nt, Homo Sapiens
uuucuccaccuguguuuaugaaguaaugagaagcccaggaaauguuuggggaagaugcaagg

SEQ ID NO: 219128 - RNA, 62 nt, Homo Sapiens
uugaacauuuuccuuuacccuggggcaccagugcccaggaauguggcaaggcuuggaugaga

SEQ ID NO: 219129 - RNA, 62 nt, Homo Sapiens
ggcugccugcagaggacagggagcaacagcuggcccaggaaagaucagcuggauccccacgu

SEQ ID NO: 219130 - RNA, 62 nt, Homo Sapiens
aacacuuacauucuggugccaagggauuuugggcccaggagagaaacgacgguacccaggag

SEQ ID NO: 219131 - RNA, 62 nt, Homo Sapiens
aaaucgauuucacaauccaaaaauggcccacagcccaggaagcuacccugaacaugccaguu

SEQ ID NO: 219132 - RNA, 62 nt, Homo Sapiens
uuccacugcaaaaguggcugcuuuggaugccagcccaggaugaguaguuccuguucucaggg

SEQ ID NO: 219133 - RNA, 62 nt, Homo Sapiens
auuugggaggcagaggugagagaaucgcuugagcccaggaauucgagaccagccugggccac

SEQ ID NO: 219134 - RNA, 62 nt, Homo Sapiens
gggucauucauguccuacgcagcuaaaacagagcccaggagccagggaggaaaagcagucag

SEQ ID NO: 219135 - RNA, 62 nt, Homo Sapiens
uuccccaucaggcugggcucuggcagggaccugcccaggauggagaugagagagggugagag

SEQ ID NO: 219136 - RNA, 62 nt, Homo Sapiens
ggcucccuccuccccaucaagcacaagagagggcccaggaaaaaagguuucacauaagugua

SEQ ID NO: 219137 - RNA, 62 nt, Homo Sapiens
auucacucccaggcaggggugaggguggccuggcccaggaggccaggaaggagggcccuguc

SEQ ID NO: 219138 - RNA, 62 nt, Homo Sapiens
cucagucugugaguaaaacugggggcucaaaugcccaggaugaggggaucagugacugucua

SEQ ID NO: 219139 - RNA, 62 nt, Homo Sapiens
cuuugggaggccgaggugggaggaucacuugagcccaggaguucgagaccagccuaggcaac

SEQ ID NO: 219140 - RNA, 62 nt, Homo Sapiens
gggcagaaacccagaacucagcauucaaggaugcccaggagagcugucccuguuuuaaagag

SEQ ID NO: 219141 - RNA, 62 nt, Homo Sapiens
acccaugcacagcagcuguguaaugccagguggcccaggaguuggucucaucuccauugccu

SEQ ID NO: 219142 - RNA, 62 nt, Homo Sapiens
uuacaacacagcaaguagcaagagggguuccugcccaggauccuugucuaucuugauggaga

SEQ ID NO: 219143 - RNA, 62 nt, Homo Sapiens
gaccuguguguaagucccaauguccugucgcugcccaggauugaagcacagaucucuagagc

SEQ ID NO: 219144 - RNA, 62 nt, Homo Sapiens
gagugcaguggcucaaucucucucgcucuaucgcccaggauguuuuuuuuuuugagauggag

SEQ ID NO: 219145 - RNA, 62 nt, Homo Sapiens
cuuccacugguagaaggccuuuaaugaucugggcccaggaugauuuccugcccuuuuaucau

SEQ ID NO: 219146 - RNA, 62 nt, Homo Sapiens
gccucaucuuccuuccugcuguaccacagauggcccaggagaggcacuugucuuuuauuaua

SEQ ID NO: 219147 - RNA, 64 nt, Homo Sapiens
uauuaauuaggcuuauacagcgggggauuugagcuuacaggauuccuccaugguaaagcugaac

SEQ ID NO: 219148 - RNA, 64 nt, Homo Sapiens
uaaccuggcauuuacuuagcaacugccuuaucaauuacaggauuugccgguaaaagcagacuca

SEQ ID NO: 219149 - RNA, 64 nt, Homo Sapiens
aaugaacgucaucggcuacagaaacagccuaaguuuacaggacuuuuuagagucuuacauauuu

SEQ ID NO: 219150 - RNA, 64 nt, Homo Sapiens
cauuucuaauuuauugcuuauuacuuucuuaauuuuacaggauaauuauaagcaaguggaacua

SEQ ID NO: 219151 - RNA, 64 nt, Homo Sapiens
cugcacugggucucagugaaugagaccgccccauuuacaggaaugggccaucaccuguggccuc

SEQ ID NO: 219152 - RNA, 64 nt, Homo Sapiens
ccacaugacaguguccugccuaccucgagagaauuuacaggaguuuguuggaagagugcuuacu

SEQ ID NO: 219153 - RNA, 64 nt, Homo Sapiens
uuaagauugagcuaaauuaucuaccauugccuauuuacaggauaaguacauucaggacaauuua

SEQ ID NO: 219154 - RNA, 64 nt, Homo Sapiens
ugagaauucacuucuucuuguaaaaauaaguaauuuacaggaaaggcaaaaugcuaauacuaac

SEQ ID NO: 219155 - RNA, 62 nt, Homo Sapiens
ggaacuugaaauguggggagugauaauaguccagugauuaaacuacaguccagugauuacca

SEQ ID NO: 219156 - RNA, 62 nt, Homo Sapiens
gugauaauaguccagugauuaaacuacaguccagugauuaccaccaacuuucugacuaagcu

SEQ ID NO: 219157 - RNA, 62 nt, Homo Sapiens
gaugaugagugauuuuuauaaugcauuucuguagugauuaguucugacuggugugagauggu

SEQ ID NO: 219158 - RNA, 62 nt, Homo Sapiens
aaagaauaucagggccugacuuaaaauuaaaaagugauuauccaguuucauucaagaaaagu

SEQ ID NO: 219159 - RNA, 62 nt, Homo Sapiens
ccucugguauagcuuuccuauaaucauuguauagugauuauguaaauuguaaagguaauguu

SEQ ID NO: 219160 - RNA, 62 nt, Homo Sapiens
aauuguaaagguaauguuuauucuguaauuucagugauuauaaagaaaugugcauauauuua

SEQ ID NO: 219161 - RNA, 62 nt, Homo Sapiens
uacuuuccuuauuggcaacuuauggacucgcuagugauuaaacgaggcaaugacugugagcg

SEQ ID NO: 219162 - RNA, 62 nt, Homo Sapiens
auuggccuuaauauaccuaaaucuccaaaaacagugauuaaagcaagagaauuauuacaagg

SEQ ID NO: 219163 - RNA, 62 nt, Homo Sapiens
cuuuacaauggagacaucuaccagaucauccaagugauuaaauuuaacaucaucaaugaugg

SEQ ID NO: 219164 - RNA, 62 nt, Homo Sapiens
gguggcggggagaaggauacaccaaaaaacuaagugauuaucuuuggaugggaaaauguuug

SEQ ID NO: 219165 - RNA, 62 nt, Homo Sapiens
cagcagggaagauauuagugagggaagauauuagugauuagagacauuagugauuagacagg

SEQ ID NO: 219166 - RNA, 62 nt, Homo Sapiens
caggagggaagauauuagugaaggaagacauuagugauuagauaacucagugauuagacagg

SEQ ID NO: 219167 - RNA, 62 nt, Homo Sapiens
caggaaggaagacauuaguguucccuuaacucagugauuagacuguaaguaaaugacuauuu

SEQ ID NO: 219168 - RNA, 62 nt, Homo Sapiens
uuuuaccuauuuuuauaauuauuauuucuuaaagugauuaaaugagaacauggaugagugga

SEQ ID NO: 219169 - RNA, 62 nt, Homo Sapiens
aaauaagauuuuaaacuaauucauauguaaaaagugauuaggaagaacuugaaguaucauuu

SEQ ID NO: 219170 - RNA, 62 nt, Homo Sapiens
uuucuugccacuuccccaacuagaccacuccuagugauuacugacuuuagugccuaaaccuu

SEQ ID NO: 219171 - RNA, 62 nt, Homo Sapiens
uucaggccagagacacagagaccacauagcccagugauuaaaccccgguuucacucuggccc

SEQ ID NO: 219172 - RNA, 64 nt, Homo Sapiens
caggugaucagggcagagcugggacuccagcucauggcccuagcagccaguacagugcccuguc

SEQ ID NO: 219173 - RNA, 64 nt, Homo Sapiens
cagauguccguguggaggggacauagacacugcauggcccuauguggcucugcauucuagucag

SEQ ID NO: 219174 - RNA, 64 nt, Homo Sapiens
cauccucauccuacugacauagacauccugcaccugccacuaggcccacacacgacaaagucac

SEQ ID NO: 219175 - RNA, 64 nt, Homo Sapiens
uccaccagggagaguccuucugaccacauauuuaugccacuaccgucugagaaggcaggauaag

SEQ ID NO: 219176 - RNA, 64 nt, Homo Sapiens
aacauaaagagagcaacugauuucagccagguuuugccacuacccuauaauuagugcagucuua

SEQ ID NO: 219177 - RNA, 64 nt, Homo Sapiens
aaagagaaaaugcaaugagcccaguuacugcacuugccacuaccaugcuguccauggaaggaau

SEQ ID NO: 219178 - RNA, 64 nt, Homo Sapiens
uuguacccauaaaaaugguuauuuugaauguuaaugccacuaaaagcgaugaugguugcucaac

SEQ ID NO: 219179 - RNA, 64 nt, Homo Sapiens
uauacaccaaguucauagcaacaaauguauaaaaugccacuauuauacaugaggauggauuugu

SEQ ID NO: 219180 - RNA, 64 nt, Homo Sapiens
ucauucacacuaagguguaacucaggaaagaaacugccacuaauuuguucuuucaaauccuguu

SEQ ID NO: 219181 - RNA, 64 nt, Homo Sapiens
agcagcaaccaggacgucugugaagcagcaauucugccacuaccggcaaggcuucucuucagac

SEQ ID NO: 219182 - RNA, 64 nt, Homo Sapiens
uuugccuagcaacuugcagcuccauugcaacugaugccacuauacucguuuaaggacuuuccac

SEQ ID NO: 219183 - RNA, 64 nt, Homo Sapiens
uauugaucacucguuuaagguuggucuagagucuugccacuaaaacaucaggcaauuuccaggg

SEQ ID NO: 219184 - RNA, 64 nt, Homo Sapiens
aaaucagccugagugaccaaauuuuggucuggugggaacagaugggaaccagcucaauugggug

SEQ ID NO: 219185 - RNA, 64 nt, Homo Sapiens
aauucuagaaucaggcaacagacucauugaaucaggaacagauucacuccauaaaauacagaga

SEQ ID NO: 219186 - RNA, 64 nt, Homo Sapiens
accugaagacaaugauuauuucuggaggagcaagggaacagaaacuacauuguaaccuguuugu

SEQ ID NO: 219187 - RNA, 64 nt, Homo Sapiens
cagggaaguuuuuaaaaaugucauuacuuucaaaggaacagaaguaguuaaccaaacuaacaag

SEQ ID NO: 219188 - RNA, 64 nt, Homo Sapiens
cucucuuccccaggcaauuacuggccucaaaagaggaacagaggugcugcgaggugcucaccuc

SEQ ID NO: 219189 - RNA, 64 nt, Homo Sapiens
cauuuaccaauuaaauaacugagaccuaagucugggaacagagccacgaaucugccuuugagau

SEQ ID NO: 219190 - RNA, 64 nt, Homo Sapiens
cugcucuuuauuucauuccuuggauuugauacuaggaacagaaucucuuuuaagaaucaaaaua

SEQ ID NO: 219191 - RNA, 64 nt, Homo Sapiens
ccgucuuugaauucuccaacauaauuuguuugcuggaacagaagcacgugacuacaauggauaa

SEQ ID NO: 219192 - RNA, 64 nt, Homo Sapiens
cucuggaagccccccaccuugugcggcaggagcaggaacagagagccccagggcccuaacgggg

SEQ ID NO: 219193 - RNA, 64 nt, Homo Sapiens
gggccucuucccucaguuuuugccauaccgcuggggaacagagcuugucaggacccaggccgcc

SEQ ID NO: 219194 - RNA, 64 nt, Homo Sapiens
ugcugaucaaagaugaucaagcuuucuguguauuggaacagaaaguaacaaagaggaaugagcc

SEQ ID NO: 219195 - RNA, 64 nt, Homo Sapiens
uacucgucaaagaguuuucagaggcaaugaaaggggaacagauuuuucauuguaauaguggaag

SEQ ID NO: 219196 - RNA, 64 nt, Homo Sapiens
gaugaaugaggucccaggcaaugaggcaaugucaggaacagaagaaaacggggcagccaaaccc

SEQ ID NO: 219197 - RNA, 64 nt, Homo Sapiens
acagaagucaugaagcccaauugguaagaagccgggaacagacaaccaaaagaacaagaauuuc

SEQ ID NO: 219198 - RNA, 64 nt, Homo Sapiens
ccagggccaggcagacugggcucauugccaauauggaacagagcaagucucccugccgugggcu

SEQ ID NO: 219199 - RNA, 64 nt, Homo Sapiens
gcguaagagccaggugggaucuaacuucucacuuggaacagacuucuuuguuuacaggacucug

SEQ ID NO: 219200 - RNA, 64 nt, Homo Sapiens
guguuuugaggauaguauuucuaaauagcauucaggaacagaguauuauugcacagaucugaag

SEQ ID NO: 219201 - RNA, 64 nt, Homo Sapiens
uuaaggaggaaagcaacagaggaaacagugaaggggaacagaaggggguagcaaaguguuacag

SEQ ID NO: 219202 - RNA, 64 nt, Homo Sapiens
uguucuaguuuuggcugaaaacaaaacaacaaaaggaacagauccuugaccgcauggcggcagc

SEQ ID NO: 219203 - RNA, 64 nt, Homo Sapiens
uugaagcaaugccucucugcauuuuuuccccaguggaacagacucugcaguacauuaaucaggu

SEQ ID NO: 219204 - RNA, 64 nt, Homo Sapiens
gaucagaccuuugaaugauuccggcgggccucagggaacagaauugguaugaagccagaccucc

SEQ ID NO: 219205 - RNA, 64 nt, Homo Sapiens
cccugggcccuuccuaucagcacuguagagggaaggaacagaggacccuucuuaagacauguau

SEQ ID NO: 219206 - RNA, 64 nt, Homo Sapiens
uggugaaaguuuaggcacauuuucacuaaaagugggaacagaaaauggaggccuguuuuuuauu

SEQ ID NO: 219207 - RNA, 64 nt, Homo Sapiens
guaacaagaaaaauuaaguuguaaauauuggaaaggaacagacaaaaauagaugacauggucau

SEQ ID NO: 219208 - RNA, 64 nt, Homo Sapiens
gccauaauuucugagccucgguuuccccaucuaaggaacagauguggucguuccgcccucucag

SEQ ID NO: 219209 - RNA, 64 nt, Homo Sapiens
cagcuggaugagacuguccuggaggauccaccccggaacagacagaauggugucucucaggaug

SEQ ID NO: 219210 - RNA, 64 nt, Homo Sapiens
agcuauaguaaucaagauagaugguauuggcagaggaacagacacauacgucaauggaacagau

SEQ ID NO: 219211 - RNA, 64 nt, Homo Sapiens
ugguauuggcagaggaacagacacauacgucaauggaacagaugagagaacccagaaauaaacc

SEQ ID NO: 219212 - RNA, 64 nt, Homo Sapiens
aggguagugggugggcuaggaagcugggagauagggaacagaagaaagugggggauggcuaaga

SEQ ID NO: 219213 - RNA, 64 nt, Homo Sapiens
gaaggaaagaaagaugggaggaaaagaaagcaaaggaacagaaggggcagaaggaaggagggaa

SEQ ID NO: 219214 - RNA, 64 nt, Homo Sapiens
gaccauacuuuaguugugcccuucccaggcaucauccuccuaccaccaaccuggggccccaucu

SEQ ID NO: 219215 - RNA, 64 nt, Homo Sapiens
ucucuggaccagaucugucccaguccuggaugccuccuccuacuggugccuucuuuucuuccag

SEQ ID NO: 219216 - RNA, 64 nt, Homo Sapiens
uccugacucagcaccauguagagauuuaagaaucuccuccuaccccccagcccagaacucuuca

SEQ ID NO: 219217 - RNA, 64 nt, Homo Sapiens
gaaacuguuccuauaaacuuuacuccuuuccuuuuccuccuauuaagauguacauaguacucca

SEQ ID NO: 219218 - RNA, 64 nt, Homo Sapiens
ggacugggcuggaugagagagcacagcugugacuuccuccuaacugucaggguggggagcuggu

SEQ ID NO: 219219 - RNA, 64 nt, Homo Sapiens
agaagaaucugcaguuuacugagggcauuucaguuccuccuaccaccucaacaggacuuugucc

SEQ ID NO: 219220 - RNA, 64 nt, Homo Sapiens
accgagcuggcuaacaggcuugucugccugguuuuccuccuacacguggacauuauucuccuga

SEQ ID NO: 219221 - RNA, 64 nt, Homo Sapiens
guuuuccuccuacacguggacauuauucuccugauccuccuaccugguccaccccagggcuacc

SEQ ID NO: 219222 - RNA, 64 nt, Homo Sapiens
caaaagcagaaacaugccgccaguucucaaguuuuccuccuaacuccauuugaauguaagggca

SEQ ID NO: 219223 - RNA, 64 nt, Homo Sapiens
cucccguguggccagagacauccuagcaaauccuuccuccuauuauaucugacacuaauuucuu

SEQ ID NO: 219224 - RNA, 64 nt, Homo Sapiens
uggggcagcuggggcugccaccagcucccggccguccuccuaccaggcccaacccaucccccac

SEQ ID NO: 219225 - RNA, 64 nt, Homo Sapiens
agaucguggggaacgucaggcagcaccccuggaguccuccuagcgacagagagcagggggcaga

SEQ ID NO: 219226 - RNA, 64 nt, Homo Sapiens
ccccgcgguucauacgcaucccaucucucccacuuccuccuaccuggggacuccucaaaccacu

SEQ ID NO: 219227 - RNA, 64 nt, Homo Sapiens
cucuucuuccccuuuguccugcguuuucuccggguccuccuaagucccuuccuauucuccugcc

SEQ ID NO: 219228 - RNA, 64 nt, Homo Sapiens; identical to SEQ ID NO: 69094

SEQ ID NO: 219229 - RNA, 64 nt, Homo Sapiens; identical to SEQ ID NO: 69095

SEQ ID NO: 219230 - RNA, 64 nt, Homo Sapiens; identical to SEQ ID NO: 69096

SEQ ID NO: 219231 - RNA, 64 nt, Homo Sapiens; identical to SEQ ID NO: 69097

SEQ ID NO: 219232 - RNA, 64 nt, Homo Sapiens; identical to SEQ ID NO: 69098

SEQ ID NO: 219233 - RNA, 64 nt, Homo Sapiens; identical to SEQ ID NO: 69099

SEQ ID NO: 219234 - RNA, 63 nt, Homo Sapiens
caggggcacaagcccagguccugcugccucucuuucacacaaugcccaacuuacugucuucuu

SEQ ID NO: 219235 - RNA, 63 nt, Homo Sapiens
aaagcauuucuuuucucuuuaaucuccuauuccuucacacaguucaacauaaagagcaauaaa

SEQ ID NO: 219236 - RNA, 63 nt, Homo Sapiens
uagaaauugacgcaagugaacugaaaacuuauguucacacaaaaacucgcacaugacuguuua

SEQ ID NO: 219237 - RNA, 63 nt, Homo Sapiens
auccauacucaacaguaaaaaaugaacucuugguucacacaauaauauagacauaucuuaaau

SEQ ID NO: 219238 - RNA, 63 nt, Homo Sapiens
aauuugguuuacugcuuuguuuggauauuuauguucacacaggauacgcaauauuauauuaua

SEQ ID NO: 219239 - RNA, 63 nt, Homo Sapiens
ccacaagggguauaucuuguagauaaauuuauuuucacacagugcuacuguucaaauacauaa

SEQ ID NO: 219240 - RNA, 63 nt, Homo Sapiens
cacacacacacacacacacauacauucacuauuuucacacacagaaauacucacauucccaca

SEQ ID NO: 219241 - RNA, 63 nt, Homo Sapiens
auuucaaaacaaaaacaagauauaaggcacguuuucacacaaauuauuuucaaaaaugugaaa

SEQ ID NO: 219242 - RNA, 63 nt, Homo Sapiens
uauacuuauuauucaaguugacagaaugcacauuucacacacauacacacauuacacacacac

SEQ ID NO: 219243 - RNA, 63 nt, Homo Sapiens
guuucugcaaccuaacguuucagaggcaaaaguuucacacaaauccgagggaugagauuaagg

SEQ ID NO: 219244 - RNA, 63 nt, Homo Sapiens
gaaguuuaugguuauuugugugauagggcuuauuucacacaaaagaaauacaugaacacauuu

SEQ ID NO: 219245 - RNA, 63 nt, Homo Sapiens
uguguugguuugugguccaaauugguggcuguuuucacacagagaggggcuggggggacucaa

SEQ ID NO: 219246 - RNA, 63 nt, Homo Sapiens
auauccaggugcuaaauaggcagcagaucucaauucacacaugacuaccuuugagcuaaugac

SEQ ID NO: 219247 - RNA, 63 nt, Homo Sapiens
uuugcaccacuacuccaagauaguauuuuucuuuucacacaaucucuuuacagcagaauccag

SEQ ID NO: 219248 - RNA, 63 nt, Homo Sapiens
uuuuguuuucuguauguuguugggggaucaacuuucacacauagcaagcacauggccucccug

SEQ ID NO: 219249 - RNA, 63 nt, Homo Sapiens
acuaaaaauuuguuccuuuuucacuaugggcaguucacacaaggcaaaaacuauugaacaguu

SEQ ID NO: 219250 - RNA, 63 nt, Homo Sapiens
ccauuuuuacacagacccuugccccucuucugauucacacauccugccuggcucugugccagg

SEQ ID NO: 219251 - RNA, 63 nt, Homo Sapiens
cuccuuguagaugggagccacggccagcaccauuucacacacacuugccugggucggggccug

SEQ ID NO: 219252 - RNA, 63 nt, Homo Sapiens
auauggauucuauuuauaaacaauaauaauuaauucacacaccauguggccagaaagaaagag

SEQ ID NO: 219253 - RNA, 63 nt, Homo Sapiens
acuuaggcuuaaaaaugagcaacuuccaggauauucacacaacacuucaacauagcucuuaac

SEQ ID NO: 219254 - RNA, 63 nt, Homo Sapiens
cccuggcccuuggcuucucacuugauggacagcuucacacacccuuaagcgguggacuccagc

SEQ ID NO: 219255 - RNA, 63 nt, Homo Sapiens
gguccuucugaacugaccuugaccucugaucucuucacacaucuccccuuagcaucuccacuu

SEQ ID NO: 219256 - RNA, 63 nt, Homo Sapiens
guuuugaucucagcauccuggaaauuugugugcuucacacaaagugaaauuaguauuuugagc

SEQ ID NO: 219257 - RNA, 63 nt, Homo Sapiens
guuucuaguaacaguauuuccauacgugcccauuucacacaacuguggauaaauuuuggaaga

SEQ ID NO: 219258 - RNA, 64 nt, Homo Sapiens; identical to SEQ ID NO: 107011

SEQ ID NO: 219259 - RNA, 64 nt, Homo Sapiens; identical to SEQ ID NO: 107012

SEQ ID NO: 219260 - RNA, 64 nt, Homo Sapiens; identical to SEQ ID NO: 107013

SEQ ID NO: 219261 - RNA, 64 nt, Homo Sapiens; identical to SEQ ID NO: 107014

SEQ ID NO: 219262 - RNA, 64 nt, Homo Sapiens; identical to SEQ ID NO: 107015

SEQ ID NO: 219263 - RNA, 64 nt, Homo Sapiens; identical to SEQ ID NO: 107016

SEQ ID NO: 219264 - RNA, 64 nt, Homo Sapiens; identical to SEQ ID NO: 107017

SEQ ID NO: 219265 - RNA, 64 nt, Homo Sapiens; identical to SEQ ID NO: 107018

SEQ ID NO: 219266 - RNA, 64 nt, Homo Sapiens; identical to SEQ ID NO: 107019

SEQ ID NO: 219267 - RNA, 64 nt, Homo Sapiens; identical to SEQ ID NO: 107020

SEQ ID NO: 219268 - RNA, 64 nt, Homo Sapiens; identical to SEQ ID NO: 107021

SEQ ID NO: 219269 - RNA, 64 nt, Homo Sapiens; identical to SEQ ID NO: 107022

SEQ ID NO: 219270 - RNA, 64 nt, Homo Sapiens; identical to SEQ ID NO: 107023

SEQ ID NO: 219271 - RNA, 64 nt, Homo Sapiens; identical to SEQ ID NO: 107024

SEQ ID NO: 219272 - RNA, 64 nt, Homo Sapiens; identical to SEQ ID NO: 107025

SEQ ID NO: 219273 - RNA, 64 nt, Homo Sapiens; identical to SEQ ID NO: 107026

SEQ ID NO: 219274 - RNA, 64 nt, Homo Sapiens; identical to SEQ ID NO: 107027

SEQ ID NO: 219275 - RNA, 64 nt, Homo Sapiens; identical to SEQ ID NO: 107028

SEQ ID NO: 219276 - RNA, 64 nt, Homo Sapiens; identical to SEQ ID NO: 107029

SEQ ID NO: 219277 - RNA, 64 nt, Homo Sapiens; identical to SEQ ID NO: 107030

SEQ ID NO: 219278 - RNA, 64 nt, Homo Sapiens; identical to SEQ ID NO: 107031

SEQ ID NO: 219279 - RNA, 64 nt, Homo Sapiens; identical to SEQ ID NO: 107032

SEQ ID NO: 219280 - RNA, 64 nt, Homo Sapiens
uuaaucagaaauagcaacgaugaucauuuuguuaaaggucuacuuagaaaugaagguuucauaa

SEQ ID NO: 219281 - RNA, 64 nt, Homo Sapiens
ccauucuccauauccuggguuaggauaagaaauuaaggucuauuuuuggucuucagcuaaaaaa

SEQ ID NO: 219282 - RNA, 64 nt, Homo Sapiens
caucuacucuuuuaauucuuauuggaugguaacuaaggucuauaaaaggucuagagugauuugu

SEQ ID NO: 219283 - RNA, 64 nt, Homo Sapiens
gugauuuguauuggaugguaguuaaguggaauuaaaggucuagacuguaaggacaguuucggua

SEQ ID NO: 219284 - RNA, 64 nt, Homo Sapiens
uucuauucaccauccuuuacggauggggauaagaauaggucauucaggaauccuagaagcaaau

SEQ ID NO: 219285 - RNA, 64 nt, Homo Sapiens
uaugucuguaucuacuuagcgaguuugguguuuuauaggucacauguauacuucauuagcaagu

SEQ ID NO: 219286 - RNA, 64 nt, Homo Sapiens
ucuuggccucccaaaccccuaguccuucuacagaauaggucagacaacuguuacuuuccuaagg

SEQ ID NO: 219287 - RNA, 64 nt, Homo Sapiens
caugaaugucuagugagacacuugcagacgagcuauaggucauaggagaaaaugaggauauauu

SEQ ID NO: 219288 - RNA, 64 nt, Homo Sapiens
cugccuaaggcugaacuuguuuucugggaacaccauaggucaccuuuauucuggcagaggaggg

SEQ ID NO: 219289 - RNA, 64 nt, Homo Sapiens
aaacauuaugaugugugaaaacugguuaauauuuauaggucacuuuguuuuacugucuuaaguu

SEQ ID NO: 219290 - RNA, 64 nt, Homo Sapiens
cuucgcuccuuaucacugcauugugaagaggaggaaaagugaaucacggagagagaaaggaaag

SEQ ID NO: 219291 - RNA, 64 nt, Homo Sapiens
gaaaggauagaaucacaggcugcgucugcaccugaaaagugacccgcggaaacucuauggcgga

SEQ ID NO: 219292 - RNA, 64 nt, Homo Sapiens
uacuuauugucuauuauaaagcucauuauaauauaaaagugaaguacaaaaguuguaaguuucc

SEQ ID NO: 219293 - RNA, 64 nt, Homo Sapiens
uuauaagugguauauuuguuuuuugucauugauuaaaagugauuuuagcccuaggcccgaaaug

SEQ ID NO: 219294 - RNA, 64 nt, Homo Sapiens
ugacauguccaauuucauuuaucguuuuggggacaaaagugacuuucuaguauuucucugaaag

SEQ ID NO: 219295 - RNA, 64 nt, Homo Sapiens
uaguagccacaguacaacacagauagaaugauacaaaagugaagagaaauguagcuugcuaaua

SEQ ID NO: 219296 - RNA, 64 nt, Homo Sapiens
uuaguuuccuaucugaauuaaucucugauuccacaaaagugaguguucuuuccaacucagaauc

SEQ ID NO: 219297 - RNA, 64 nt, Homo Sapiens
guuuauaggacuaaaaaacuaucaugugcccuauaaaagugaguaaagagaagucacacagaca

SEQ ID NO: 219298 - RNA, 64 nt, Homo Sapiens
augggucaguuucucagacucuuggcuauuuagaaaaagugauagcuuucagaaacuuugagaa

SEQ ID NO: 219299 - RNA, 64 nt, Homo Sapiens
caaauacuucuaauuuuuuucccuaaacauuuuuaaaagugaaauaugggaagagcuuuacaga

SEQ ID NO: 219300 - RNA, 64 nt, Homo Sapiens
accuagaguuuuaauuaccuuuauaauguuucuuaaaagugaaacuuagauacaauugugauug

SEQ ID NO: 219301 - RNA, 64 nt, Homo Sapiens
ucaauaccaagcuucugauuccuccucacauaugaaaagugaaaguugugaguuguuuuccucu

SEQ ID NO: 219302 - RNA, 64 nt, Homo Sapiens
auuuuucagaagcgacauuucauauauaggugccaaaagugaaucggggugcggagagugggaa

SEQ ID NO: 219303 - RNA, 64 nt, Homo Sapiens
guucuauuuauguauauauauguauguuucuccaaaaagugauaaaaccaaaauaucacugacu

SEQ ID NO: 219304 - RNA, 64 nt, Homo Sapiens
uaagaaaaaaaucaaaucgaagucagccugcuggaaaagugaucacauggcaguugcaguaacu

SEQ ID NO: 219305 - RNA, 64 nt, Homo Sapiens
agcauggauuaacucauccuacuuggcuguacugaaaagugaacgcuucaagucugugcaguug

SEQ ID NO: 219306 - RNA, 64 nt, Homo Sapiens
ccaguaaagugggggaagaguugucccacaaggaaaaagugaugacugcagaaaucaguugaca

SEQ ID NO: 219307 - RNA, 64 nt, Homo Sapiens
gcaucuuuuuucaaaguuuaaugugaacuuuuagaaaagugauuaauguugcccuaauacuuua

SEQ ID NO: 219308 - RNA, 64 nt, Homo Sapiens
uuuucuaaauauuucaaacuugaaaacagaguaaaaaagugauagaaaaguugccaguuugggg

SEQ ID NO: 219309 - RNA, 64 nt, Homo Sapiens
uugcuuaaugaagacauuuacagaaaaugggcucaaaagugagugaacuuugaggacuguuggu

SEQ ID NO: 219310 - RNA, 64 nt, Homo Sapiens
gugaguggugccauugugugcccuuggggaaaguaaaagugacuguuacuuaauguugaucuau

SEQ ID NO: 219311 - RNA, 64 nt, Homo Sapiens
ccuuuucaaacaaagcauaaaauaaucucaccuuaaaagugaccacuuugaaaggucauuuuuc

SEQ ID NO: 219312 - RNA, 64 nt, Homo Sapiens
uauguuuuuuuucagaaaaauaauuccugagugaaaaagugaaccaguuauugggagaguuaau

SEQ ID NO: 219313 - RNA, 64 nt, Homo Sapiens
ggaugaaaggucaauacugcuggacuuguuacagaaaagugauacuucucuucuccauaguaca

SEQ ID NO: 219314 - RNA, 64 nt, Homo Sapiens
gugagaucacccagggaagcgcuaaagauaggauaaaagugaguaauaguucauauaaaaauau

SEQ ID NO: 219315 - RNA, 64 nt, Homo Sapiens
gaacagcaaggaagaguguucuuuuaggaaaaagaaaagugaguucccucugucaaccccacgc

SEQ ID NO: 219316 - RNA, 64 nt, Homo Sapiens
ucauaguaacauauguuuuaauaugauguaggcuaaaagugaaaauguaaaaggggaaauuagu

SEQ ID NO: 219317 - RNA, 64 nt, Homo Sapiens
aucucaaaaaaaaaaaaaagaaagaaagaaacugaaaagugagguguggaacuccaggcaacga

SEQ ID NO: 219318 - RNA, 64 nt, Homo Sapiens
ucuugauauguaaagcacuuaauauuaaaggcauaaaagugaaacugcuaaauauguauagaga

SEQ ID NO: 219319 - RNA, 64 nt, Homo Sapiens
uuuucaucugcacaaugaggcuguugaaaggaaaaaaagugagccucuaggaauuauucaaaaa

SEQ ID NO: 219320 - RNA, 64 nt, Homo Sapiens
aacuguguagccagcagggaccuaaacuuuggcaaaaagugaacacaauucaaauacgaaugaa

SEQ ID NO: 219321 - RNA, 64 nt, Homo Sapiens
augccaccauaauuacuuaagaaaaaauaauguuaaaagugaauaauugcauaguugagucuag

SEQ ID NO: 219322 - RNA, 64 nt, Homo Sapiens
ucugccuuuccuuugaucgaaaagucucacauggaaaagugaguauucaaggucaggucuacuc

SEQ ID NO: 219323 - RNA, 64 nt, Homo Sapiens
aggcacugugauauacuugggacccuuuaaauuaaaaagugaagauagucaccagggccagaaa

SEQ ID NO: 219324 - RNA, 64 nt, Homo Sapiens
gcuugaauaaguagaccccaagcauccuuuucuaaaaagugacuuaaaauaagccaacagacuc

SEQ ID NO: 219325 - RNA, 64 nt, Homo Sapiens
uggguuaacuccucagauuuggaguggcaaggauaaaagugagggcagaaguagcugugggaaa

SEQ ID NO: 219326 - RNA, 64 nt, Homo Sapiens
gugugguggaggagguagaauugcagaucagauaaaaagugagcuuacacuugaacuuaguuau

SEQ ID NO: 219327 - RNA, 64 nt, Homo Sapiens
agaccccacacuuuacacuccaaaacgugggugcaaaagugaugaguguggagaaaccaacagg

SEQ ID NO: 219328 - RNA, 64 nt, Homo Sapiens
ccuaaauccacuccguuuggugguuuuuccuugaaaaagugaaauauguggaaaauuucuuuga

SEQ ID NO: 219329 - RNA, 64 nt, Homo Sapiens
aagcauaagaaauuugggacggguuagauaaaggaaaagugaaaacaggaaauuagaaguguua

SEQ ID NO: 219330 - RNA, 64 nt, Homo Sapiens
gugacuaaggcacguuggagaaaacaccuuaaauaaaagugauuauaucaucuugaaccauuau

SEQ ID NO: 219331 - RNA, 64 nt, Homo Sapiens
aaugaaugauaauuuagaucacuguaaaacacagaaaagugauuugacuuuuuaauauguuauc

SEQ ID NO: 219332 - RNA, 64 nt, Homo Sapiens
acuucaugccuuucucagcaauggcaacuuuaagaaaagugacuuggccacuuucuagauaaga

SEQ ID NO: 219333 - RNA, 64 nt, Homo Sapiens
acuauaguuaaaauggcuguaagaauaguuuuauaaaagugaauacacagaucuauuguauuug

SEQ ID NO: 219334 - RNA, 64 nt, Homo Sapiens
cccucuaaguguuauuuugguuguucuaacuuacaaaagugauuuugaauaagaaauauuuggu

SEQ ID NO: 219335 - RNA, 64 nt, Homo Sapiens
agaaugcuuggaaacuugagucucccuagaggugaaaagugagcagaggcccguagaaacccuc

SEQ ID NO: 219336 - RNA, 64 nt, Homo Sapiens
uaccaaaaauccuuuuauggaaaccauuuuuuuaaaaagugaauguacacaaauccacagagga

SEQ ID NO: 219337 - RNA, 64 nt, Homo Sapiens
uuauaguuuuuuuuacuuuuuugcucucaauagcaaaagugaugugcaaauacuacacgucccu

SEQ ID NO: 219338 - RNA, 64 nt, Homo Sapiens
uuccuauggcagaguccagggugcaaaacccuauaaaagugauaggaacagaaaacaaacaucu

SEQ ID NO: 219339 - RNA, 64 nt, Homo Sapiens
ugacagggagugaagacacugaaaguguugggaaaaaagugaugcagagcaaaauauggauaau

SEQ ID NO: 219340 - RNA, 64 nt, Homo Sapiens
ggaauuauugagaaacuuauacaugaaaaugcuuaaaagugauauaaaauauauugagauuaau

SEQ ID NO: 219341 - RNA, 64 nt, Homo Sapiens
gcugaaaagagaaaugauaauaacugaaaagauuaaaagugagacuaaguuuuacuaaggaaaa

SEQ ID NO: 219342 - RNA, 64 nt, Homo Sapiens
auaauuugaggcacagaagauauauguauauuuaaaaagugaauuuugaauauacauauauaua

SEQ ID NO: 219343 - RNA, 64 nt, Homo Sapiens
aggaaacaacuagcaaaaagaaguagaaaaagaaaaaagugaaaaaagaaagagaaaaaagaua

SEQ ID NO: 219344 - RNA, 64 nt, Homo Sapiens
ugcaucuuuccuacaugagaagcuucucugccacaaaagugacuucaaagacggauggguugag

SEQ ID NO: 219345 - RNA, 64 nt, Homo Sapiens
auaaauuaccuuagcuuuuauguagaauggguucaaaagugaguguuucuauuugagaaggaca

SEQ ID NO: 219346 - RNA, 64 nt, Homo Sapiens
gaagcauguccacugacaaagacccaccagcuggaaaagugaagggcagggcccaauccuucca

SEQ ID NO: 219347 - RNA, 64 nt, Homo Sapiens
aaaagaagcgaauaaguaugcagaaucgauuaaaaaaagugaaguggagcaaguggccaaacau

SEQ ID NO: 219348 - RNA, 64 nt, Homo Sapiens
ucaucauaggcaaacauauauccguuccaaggcuaaaagugaccuuaacuguauuuauucucaa

SEQ ID NO: 219349 - RNA, 64 nt, Homo Sapiens
uucuguauucauuauagauguagcccuuauuuaaaaaagugaauuccauacuaaaacuaggaau

SEQ ID NO: 219350 - RNA, 64 nt, Homo Sapiens
uggcaaccuuugaccuuucugugaagaaaugaucaaaagugagcacaaagcaaaaugaaaucca

SEQ ID NO: 219351 - RNA, 64 nt, Homo Sapiens
augauuuugcugacuuccacacacuccuucaggaaaaagugauguguugaagaccugaaagaua

SEQ ID NO: 219352 - RNA, 64 nt, Homo Sapiens
cuagugagauuucuguaauaauuuuaauucuuuaaaaagugaaagcuuguuguaaagauauuuu

SEQ ID NO: 219353 - RNA, 64 nt, Homo Sapiens
uuuguuuaaaauuuuguauaucaccaaauuuuuaaaaagugauagucacagugcuaaguuaucu

SEQ ID NO: 219354 - RNA, 64 nt, Homo Sapiens
uuucguuaugauuaaagaugucucauguacuuggaaaagugagcauuuuuuuuuuuuuuguauu

SEQ ID NO: 219355 - RNA, 64 nt, Homo Sapiens
uacugccugaguugugccucuugugugcuagauuaaaagugagacagagacuugacuugauccu

SEQ ID NO: 219356 - RNA, 64 nt, Homo Sapiens
guugaaagugguggcauagguauaauauaccacuaaaagugacaaugauuaugugaaaguugaa

SEQ ID NO: 219357 - RNA, 64 nt, Homo Sapiens
uaugggauggauucuagaaaauuuuuguuaacuaaaaagugaaacugcagugauuaaccaagac

SEQ ID NO: 219358 - RNA, 64 nt, Homo Sapiens
uaaguguugacuuuuuaaaauauaaguuuauuguaaaagugacaugaaaauuacaacagauauu

SEQ ID NO: 219359 - RNA, 64 nt, Homo Sapiens
cauuugcguauguaaacauucauauuugcaauaaaaaagugagcuuuuauauucuaaauuuuua

SEQ ID NO: 219360 - RNA, 64 nt, Homo Sapiens
uuuggagccucgggauaaaaugacagugagguugaaaagugaaaacccuagaacuugaauaggu

SEQ ID NO: 219361 - RNA, 64 nt, Homo Sapiens
uauuuauuuguaucaucucuuugucuaggaauguaaaagugauucuaaacuaagauguguaaua

SEQ ID NO: 219362 - RNA, 64 nt, Homo Sapiens
aaauagcuauuuugcuuaaauuucuacaguauguaaaagugaaaaaaugaugaagacgggugca

SEQ ID NO: 219363 - RNA, 64 nt, Homo Sapiens
caggacugguuuuguuuuuauauauauaaaaaaaaaaagugaaaacaccaaugugugaaaugcc

SEQ ID NO: 219364 - RNA, 64 nt, Homo Sapiens
uauuguuaaauauuugaacaauaaaaaagguacaaaaagugaaguacaaauuacccaaaucucu

SEQ ID NO: 219365 - RNA, 64 nt, Homo Sapiens
auaccuauguacccagauagauauaugcauagauaaaagugaugaaauauaagugcuguucuau

SEQ ID NO: 219366 - RNA, 64 nt, Homo Sapiens
uaauuucaaauaggaaucaugucacuuguugugcaaaagugaauccgcuggaauuggcuugugg

SEQ ID NO: 219367 - RNA, 64 nt, Homo Sapiens
aaaaaaagcucuggacaccucauuuaaaaaagcaaaaagugaaaccauuguuuguggaggauua

SEQ ID NO: 219368 - RNA, 64 nt, Homo Sapiens
cuuggauuagggggugugggguaguuaauugggaaaaagugauaagugccucccagaacauuuu

SEQ ID NO: 219369 - RNA, 64 nt, Homo Sapiens
ugaugguaguacugguuucuauuuucgguucaggaaaagugagaugucuguagcuaccagaaac

SEQ ID NO: 219370 - RNA, 64 nt, Homo Sapiens
uucucccagaguuuucuuuggagaacagaaagaagaaaggaaagaaaggaaccagaggcagaga

SEQ ID NO: 219371 - RNA, 64 nt, Homo Sapiens
aguuuucuuuggagaacagaaagaagaaaggaaagaaaggaaccagaggcagagagacgaggau

SEQ ID NO: 219372 - RNA, 64 nt, Homo Sapiens
acaauggcgauguggugagaaacuccugaaugaagaaaggaaccuugucuuucagggcauaagg

SEQ ID NO: 219373 - RNA, 64 nt, Homo Sapiens
uuaaaguacuucuuccccuuauccccucaauaaagaaaggaaauccaaauuugaagcaucacuc

SEQ ID NO: 219374 - RNA, 64 nt, Homo Sapiens
aaacaaaauugacgcauguuaaucuaugcaaagagaaaggaaaggaugaggugauguauugacu

SEQ ID NO: 219375 - RNA, 64 nt, Homo Sapiens
agauauuaaaguaauucaaaucuuccccaaaggggaaaggaagagagugauacugaccuuuuua

SEQ ID NO: 219376 - RNA, 64 nt, Homo Sapiens
gcuuuauguuucucuguuguggugagguuggggagaaaggaagaagccagccaugguaagggcu

SEQ ID NO: 219377 - RNA, 64 nt, Homo Sapiens
agauuuuuuccaaaacccagugauguaggaaacugaaaggaaauuucugcaggaugcuuuuaac

SEQ ID NO: 219378 - RNA, 64 nt, Homo Sapiens
agagaugccucaggcuucagaagagagggaggaggaaaggaaggaaagaaggcaaggagguagg

SEQ ID NO: 219379 - RNA, 64 nt, Homo Sapiens
aaaggaagagagaggaagggaaaagggaaaagcagaaaggaaaaagaaugaggagaaaaaggag

SEQ ID NO: 219380 - RNA, 64 nt, Homo Sapiens
ugaucucugggacgucagcuaggagucccucccagaaaggaaaccuucugcaccccccucaaug

SEQ ID NO: 219381 - RNA, 64 nt, Homo Sapiens
augcagaugagaagcacccaaagcuacagcaucugaaaggaauggaggcagaaagaggaggaag

SEQ ID NO: 219382 - RNA, 64 nt, Homo Sapiens
guuagagugaaaaaguguguuuuaugucaauugugaaaggaaaauguuaggaguaugguuuuua

SEQ ID NO: 219383 - RNA, 64 nt, Homo Sapiens
guuuugcaugcucaauuucuagguccuuugucuagaaaggaaauuugccucaguugaauuagug

SEQ ID NO: 219384 - RNA, 64 nt, Homo Sapiens
guggagcccucugacaauuugcaaggcccucugagaaaggaagcugcuuagagccaggggguua

SEQ ID NO: 219385 - RNA, 64 nt, Homo Sapiens
gcugccugcaaagccagcuggaggugaagugcaggaaaggaaaggucaccccauucuacuccau

SEQ ID NO: 219386 - RNA, 64 nt, Homo Sapiens
uaaaggcaaagaaugcaauaggugaugguugguugaaaggaauuguuauugcuguuuuuauuuu

SEQ ID NO: 219387 - RNA, 64 nt, Homo Sapiens
aaacccuugcuuuuaggggagggaagcggggaaggaaaggaaugagggaggaaauauuccuuuc

SEQ ID NO: 219388 - RNA, 64 nt, Homo Sapiens
ggcugacaauaagguuugacuuguauaccauauugaaaggaagaaaaugauaaacuuuaagacc

SEQ ID NO: 219389 - RNA, 64 nt, Homo Sapiens
aaaaaggccuugaauugacaaaauguaucaauuggaaaggaagaaugucugucucuaaaggguu

SEQ ID NO: 219390 - RNA, 64 nt, Homo Sapiens
uagaauaugaucaauuccuuuuuuaugaauuccugaaaggaaaacaaaggugcuauccuaggga

SEQ ID NO: 219391 - RNA, 64 nt, Homo Sapiens
ggggucacgcacaucauguagugacacacguaaggaaaggaaaguaaaaugucuuaauggcugu

SEQ ID NO: 219392 - RNA, 60 nt, Homo Sapiens
acccacaacaaccagcauaagcaaaugaaagaaaggaauuguauuuaccuuuuauaauua

SEQ ID NO: 219393 - RNA, 64 nt, Homo Sapiens
cacaugauuucuuuucuugauggaugaaaaauaugaaaggaaacuuuuauaucuguugccuagu

SEQ ID NO: 219394 - RNA, 64 nt, Homo Sapiens
uagugaagacaugcaucauggaaugagaaaaugagaaaggaaugaguugucuaacaucacagug

SEQ ID NO: 219395 - RNA, 64 nt, Homo Sapiens
uuauaauuaggcuuuauuaucuuccuaaaucaaggaaaggaaaucauccccagaccauuuaugc

SEQ ID NO: 219396 - RNA, 64 nt, Homo Sapiens
uucuuacugugcuaugcauuuuauugagaguacagaaaggaagaggaaccuuuuuuuaaucacu

SEQ ID NO: 219397 - RNA, 64 nt, Homo Sapiens
aaaaucuaacguugaguaaaugugauagugaugagaaaggaauuuuguguacuguaaccuugca

SEQ ID NO: 219398 - RNA, 64 nt, Homo Sapiens
gaucuucuuugaagaaaaguaaaagaagaaaaaagaaaggaaaaaaacuuuggguaccaaacca

SEQ ID NO: 219399 - RNA, 64 nt, Homo Sapiens
ugcauguucugaccauuuuaacugaacugccuuugaaaggaaaucacccuccuugagccaaugc

SEQ ID NO: 219400 - RNA, 64 nt, Homo Sapiens
ccucugucuugugaaguaggaaauggaagguuuggaaaggaaugcucauguuagagcgacauuc

SEQ ID NO: 219401 - RNA, 64 nt, Homo Sapiens
guucaccgccacaaaucauaaaaaaaauaaaaaggaaaggaagcuuggcaguaauugucuguuu

SEQ ID NO: 219402 - RNA, 64 nt, Homo Sapiens
guggaaaagguaucuugguuuauuuacauauucagaaaggaauagcaugaacuaaguaguuaaa

SEQ ID NO: 219403 - RNA, 64 nt, Homo Sapiens
cauaaguguugugauuaguacugaagacuguccugaaaggaagaguucuuucccuucugguuau

SEQ ID NO: 219404 - RNA, 64 nt, Homo Sapiens
gagguaucaaguaaauacuggacaaaguaagagggaaaggaaaacguuuauccugacugaaaua

SEQ ID NO: 219405 - RNA, 64 nt, Homo Sapiens
gaagagugcuccaagacuugaguaggacccaagggaaaggaaggaaauccagaagcaaagagau

SEQ ID NO: 219406 - RNA, 64 nt, Homo Sapiens
cugagccuugguuaaaccagggagaaggggagcagaaaggaaacguuguuacugaugaguacca

SEQ ID NO: 219407 - RNA, 64 nt, Homo Sapiens
auuuucuaaauauuuugauaucaauuuggguaaagaaaggaauacuuuuguuagaaugagaauu

SEQ ID NO: 219408 - RNA, 64 nt, Homo Sapiens
agacaaaccaaagguaaccagcuagcccaccacugaaaggaaagaucugagacaugggauuccc

SEQ ID NO: 219409 - RNA, 64 nt, Homo Sapiens
guugggcauuucuuuuccagauuggccugugauggaaaggaaggcuucuaauuagaaaacacag

SEQ ID NO: 219410 - RNA, 64 nt, Homo Sapiens
agcuuuuccaacaaaucuuugaaaagcaaucuuggaaaggaauucauuaacuaaaugggguaaa

SEQ ID NO: 219411 - RNA, 64 nt, Homo Sapiens
uuuauacugcacuuuuuaaagcuuuuauguugaggaaaggaaaagggcauuugucuaaacaugg

SEQ ID NO: 219412 - RNA, 64 nt, Homo Sapiens
uacaaagaaaugcauucauaucaaaauuggaauagaaaggaaaaccuauuuuuaagauaucaac

SEQ ID NO: 219413 - RNA, 64 nt, Homo Sapiens
uggucugucauaaauuauuuccccgguaauuuuugaaaggaaaaauguauaacaaguacuauuu

SEQ ID NO: 219414 - RNA, 64 nt, Homo Sapiens
ugugguguuuguuuccauccccaaggcaaacaaggaaaggaaaggaaagaagaaaaggugccuu

SEQ ID NO: 219415 - RNA, 64 nt, Homo Sapiens
uguuuguuuccauccccaaggcaaacaaggaaaggaaaggaaagaagaaaaggugccuuagucc

SEQ ID NO: 219416 - RNA, 64 nt, Homo Sapiens
gggcuucacagugccugccugcauccccggggaagaaaggaacgaggagcggucagggcuccag

SEQ ID NO: 219417 - RNA, 63 nt, Homo Sapiens
guggcucucccuuaucauuuaggcagcgugggggaaaggaaacggucuaauguaggcaaguag

SEQ ID NO: 219418 - RNA, 64 nt, Homo Sapiens
aacacuaguguucuuucagucuuuuuucacaacggaaaggaaaguuucaauuccucagaaacaa

SEQ ID NO: 219419 - RNA, 64 nt, Homo Sapiens
aaugugauucaagauauuuauugagauuucagaagaaaggaaacagugcugugagaauucuccu

SEQ ID NO: 219420 - RNA, 64 nt, Homo Sapiens
acacucuuucauugcugaauugcauuggaagagagaaaggaaacuuaagggguuguuguguagu

SEQ ID NO: 219421 - RNA, 64 nt, Homo Sapiens
uuuguaugaccacuguucuaaaugccaaauuugggaaaggaaauguuaaggacaaagauguaaa

SEQ ID NO: 219422 - RNA, 64 nt, Homo Sapiens
gggaagucagcugaaacuugucuuguuuugccaggaaaggaaguaguugccuuuggucauccau

SEQ ID NO: 219423 - RNA, 64 nt, Homo Sapiens
uuaugagugauugcucuacauuauuucuucaaaggaaaggaaaggaauugaagacuuugcuacu

SEQ ID NO: 219424 - RNA, 64 nt, Homo Sapiens
agugauugcucuacauuauuucuucaaaggaaaggaaaggaauugaagacuuugcuacucucug

SEQ ID NO: 219425 - RNA, 64 nt, Homo Sapiens
agcccauuucuguuaaccucuuaucacuaagaaagaaaggaaagaaggagaugaauagaagaaa

SEQ ID NO: 219426 - RNA, 64 nt, Homo Sapiens
uuuuaaaccacagucuggagugauagcuacuguagaaaggaaauagacuuuguaugaacucuuu

SEQ ID NO: 219427 - RNA, 64 nt, Homo Sapiens
gaucucaaauuuucaucugcacaaugaggcuguugaaaggaaaaaaagugagccucuaggaauu

SEQ ID NO: 219428 - RNA, 64 nt, Homo Sapiens
gaaauggcugcagauagaucccgcagucccuucugaaaggaacuguguagccagcagggaccua

SEQ ID NO: 219429 - RNA, 64 nt, Homo Sapiens
aaaagacuuaaaacuggaguggugggagacauaagaaaggaaagucuuuuaaaacuugaauaua

SEQ ID NO: 219430 - RNA, 64 nt, Homo Sapiens
guuugcagaggagaguguagcagagcacugaaaagaaaggaaggaggcuuuucuauauacuucu

SEQ ID NO: 219431 - RNA, 64 nt, Homo Sapiens
acagcacaauggugaccacugggcugaguuaagugaaaggaaaaagcuuccuucucuggcucaa

SEQ ID NO: 219432 - RNA, 64 nt, Homo Sapiens
caaaacacuagaaaaagcauuccgccagggcugggaaaggaacuagacaacacccuuacaagga

SEQ ID NO: 219433 - RNA, 64 nt, Homo Sapiens
cucagcaauccugcugcuggguauauacccgaaagaaaggaaaaggaagccaguauauugaaga

SEQ ID NO: 219434 - RNA, 64 nt, Homo Sapiens
acauagagaguagaagguugguuaccagaagcuggaaaggaaagugggguugggaggaaggugg

SEQ ID NO: 219435 - RNA, 64 nt, Homo Sapiens
gucauauuuauuccugcacccaucccauuuuggggaaaggaaaaauacucugcuuuucugucaa

SEQ ID NO: 219436 - RNA, 64 nt, Homo Sapiens
gaaauuaccacugggaaaauaggaaguaaaaacagaaaggaaaaagucuaacaacacugauaau

SEQ ID NO: 219437 - RNA, 64 nt, Homo Sapiens
cuuuugccaauuccacuaauuguuugggugaagagaaaggaaguacagaaaacaugcagaaagc

SEQ ID NO: 219438 - RNA, 64 nt, Homo Sapiens
agaaaggaaguacagaaaacaugcagaaagcacagaaaggaaaaccaagguucucaugaaucuc

SEQ ID NO: 219439 - RNA, 64 nt, Homo Sapiens
uaauuccaagagucuaggaacguucuccuacacggaaaggaaucagcuggaggcugggcgccug

SEQ ID NO: 219440 - RNA, 64 nt, Homo Sapiens
aggggacugaaaucucccaauauccuuuuguugugaaaggaagguuauuacguaauuagagggu

SEQ ID NO: 219441 - RNA, 64 nt, Homo Sapiens
gcaaacuguaaauguauaaaugcucaaaaaagaugaaaggaaaugggacaugcagaauugaauu

SEQ ID NO: 219442 - RNA, 64 nt, Homo Sapiens
aauggaaggaaagugauucugcauguagggacaggaaaggaaacuuugaaugaagcaagggaag

SEQ ID NO: 219443 - RNA, 64 nt, Homo Sapiens
acacaaauugcccccagauuuccaccuuugcaaagaaaggaaaaggacaggagcugucuggagc

SEQ ID NO: 219444 - RNA, 64 nt, Homo Sapiens
cuucccuuaacucuuucugcgaaggaacaggaaugaaaggaaacaacuguucaaaagcaaaaga

SEQ ID NO: 219445 - RNA, 64 nt, Homo Sapiens
ggauugcaaacacauggcuccaucuucugcacacgaaaggaaagucccucuccuuuucuacagu

SEQ ID NO: 219446 - RNA, 64 nt, Homo Sapiens
gcugaucccagggugaggagaagauugggacauagaaaggaaacugcaucagaaacaugaacag

SEQ ID NO: 219447 - RNA, 64 nt, Homo Sapiens
uaguuuucauaaaacucaugcuaacaaaugaugugaaaggaaaggaucauggguguggcauucu

SEQ ID NO: 219448 - RNA, 64 nt, Homo Sapiens
aaaagguugucucuugauuuuccuuugcuacuuugaaaggaaaagucagccaaucuuuuauugu

SEQ ID NO: 219449 - RNA, 64 nt, Homo Sapiens
uuuuucuaaaaaggaaaggacagaaaaaaaugaagaaaggaaaggaagacaaauguaaagaaau

SEQ ID NO: 219450 - RNA, 64 nt, Homo Sapiens
cuaaaaaggaaaggacagaaaaaaaugaagaaaggaaaggaagacaaauguaaagaaauaagga

SEQ ID NO: 219451 - RNA, 64 nt, Homo Sapiens
guggccuccuuggauucuucugacuuuggcuucugaaaggaaggccuagauccagcccuggugg

SEQ ID NO: 219452 - RNA, 64 nt, Homo Sapiens
aagcucgaggugaaguuuuaaaaaaaaaguuguggaaaggaaaguuccaaagaggugguuucug

SEQ ID NO: 219453 - RNA, 64 nt, Homo Sapiens
aggcucuggcuaaauucaugagcacacugcuugugaaaggaaaggcaucuaugugagaccauuu

SEQ ID NO: 219454 - RNA, 64 nt, Homo Sapiens
gcugcaugcgggcuuccuccgaggguagagcggagaaaggaaggcaugggcccucucagcaggg

SEQ ID NO: 219455 - RNA, 64 nt, Homo Sapiens
agguaauagaauacuaguaggauagaaacaacuagaaaggaaagugugacacaguuuuuaaauu

SEQ ID NO: 219456 - RNA, 64 nt, Homo Sapiens
uagauguagaaaauaaugaauuaaugagauuggugaaaggaaaucaugcaaaacauuugaaugc

SEQ ID NO: 219457 - RNA, 64 nt, Homo Sapiens
ggcuuggagggaagggagaaacggguauuguugggaaaggaacacuucauuccggggaacaaag

SEQ ID NO: 219458 - RNA, 64 nt, Homo Sapiens
aagaaaaaagcaauuagguagaaacagaaaguuggaaaggaaaaagcucacugcugcugccucu

SEQ ID NO: 219459 - RNA, 64 nt, Homo Sapiens
acagcuguccuugaacaaguaucaauguguuuaugaaaggaagaucuaaaucagacaggaguug

SEQ ID NO: 219460 - RNA, 64 nt, Homo Sapiens
uggaauggaacccuugcuauaguagugacaaagugaaaggaaauuuaggaggcauaggccauuu

SEQ ID NO: 219461 - RNA, 64 nt, Homo Sapiens
aguaccuucaauacuuaaaacaauaugaauucaagaaaggaaauaaauccacaccguacaucug

SEQ ID NO: 219462 - RNA, 64 nt, Homo Sapiens
gcuaauaaaucucuucuuuguacacagauaccuugaaaggaagacuuuuguuguuuauauacag

SEQ ID NO: 219463 - RNA, 64 nt, Homo Sapiens
ccuuucuggcuccugauaggguggagcaaaaguggaaaggaaaggaaagaggccuuuucucaca

SEQ ID NO: 219464 - RNA, 64 nt, Homo Sapiens
cuggcuccugauaggguggagcaaaaguggaaaggaaaggaaagaggccuuuucucacagccau

SEQ ID NO: 219465 - RNA, 64 nt, Homo Sapiens
gaggcccagaaagaggcaguggagggaauuugaagaaaggaacuaucuuguaauguuagaauuu

SEQ ID NO: 219466 - RNA, 64 nt, Homo Sapiens
ccaaacacuguuucuaacucagaaaagggcuugcgaaaggaaaggcagccuccugccugcucca

SEQ ID NO: 219467 - RNA, 64 nt, Homo Sapiens
gugaaccccagggaacagcgggacacaaccucaagaaaggaagccugcaggguguggggaagga

SEQ ID NO: 219468 - RNA, 64 nt, Homo Sapiens
aagcuggguguguucugucuggccuaugugaaaagaaaggaacuuaccacccauccaaccuuug

SEQ ID NO: 219469 - RNA, 64 nt, Homo Sapiens
cagauccuccccucugcuuuauaagaaaggaaaggaaaggaaaauggucaaauugauacccuua

SEQ ID NO: 219470 - RNA, 64 nt, Homo Sapiens
gaaaacagauccuccccucuccuuaauaagaaaggaaaggaaagucuuauggucaaauugauac

SEQ ID NO: 219471 - RNA, 64 nt, Homo Sapiens
gaaaggaaaacagauccuccgauacccuuaauaagaaaggaaagccuugucuuauggucaaauu

SEQ ID NO: 219472 - RNA, 64 nt, Homo Sapiens
cggaugcugguauuuuaacagauggagagacaaggaaaggaaaggaaaggccuggcaugggcau

SEQ ID NO: 219473 - RNA, 64 nt, Homo Sapiens
gcugguauuuuaacagauggagagacaaggaaaggaaaggaaaggccuggcaugggcauuguga

SEQ ID NO: 219474 - RNA, 64 nt, Homo Sapiens
acccauuuuuaagcugguuuucuccugauaagaagaaaggaagaaagccccagacgcuugguuu

SEQ ID NO: 219475 - RNA, 64 nt, Homo Sapiens
uaaaccgagcuuuaaaggauaaaguguuaauaaagaaaggaagcugggcacaugucaaaaaggg

SEQ ID NO: 219476 - RNA, 64 nt, Homo Sapiens
acguacagcaaugcggagugaguggauuuuuauugaaaggaaccuguucuuaucacugagacac

SEQ ID NO: 219477 - RNA, 64 nt, Homo Sapiens
caaucgacacaguuauuagcaugaugugacuauggaaaggaaggggucugguguucaaguaaaa

SEQ ID NO: 219478 - RNA, 64 nt, Homo Sapiens
cuuccagacuucuaucaguuuagaaagcuagauuacuaguaaggaggggaugauccuaaugucu

SEQ ID NO: 219479 - RNA, 64 nt, Homo Sapiens
gacauaguugaagcuuaaauaugccaaaucacaaacuaguaagagccaagacaggguaaauaac

SEQ ID NO: 219480 - RNA, 64 nt, Homo Sapiens
cuugauuugguuucuguuguguuuuugccuaaauacuaguaacauaucagugaaaaacccuaau

SEQ ID NO: 219481 - RNA, 64 nt, Homo Sapiens
gugaaaaacccuaauuuuuuuucucuucaaugucacuaguaagagaggugguaauuuuucaccu

SEQ ID NO: 219482 - RNA, 64 nt, Homo Sapiens; identical to SEQ ID NO: 93499

SEQ ID NO: 219483 - RNA, 64 nt, Homo Sapiens; identical to SEQ ID NO: 93500

SEQ ID NO: 219484 - RNA, 64 nt, Homo Sapiens; identical to SEQ ID NO: 93501

SEQ ID NO: 219485 - RNA, 64 nt, Homo Sapiens; identical to SEQ ID NO: 93502

SEQ ID NO: 219486 - RNA, 64 nt, Homo Sapiens; identical to SEQ ID NO: 93503

SEQ ID NO: 219487 - RNA, 64 nt, Homo Sapiens; identical to SEQ ID NO: 93504

SEQ ID NO: 219488 - RNA, 64 nt, Homo Sapiens; identical to SEQ ID NO: 93505

SEQ ID NO: 219489 - RNA, 64 nt, Homo Sapiens; identical to SEQ ID NO: 93506

SEQ ID NO: 219490 - RNA, 64 nt, Homo Sapiens; identical to SEQ ID NO: 93507

SEQ ID NO: 219491 - RNA, 64 nt, Homo Sapiens; identical to SEQ ID NO: 93508

SEQ ID NO: 219492 - RNA, 64 nt, Homo Sapiens; identical to SEQ ID NO: 93509

SEQ ID NO: 219493 - RNA, 64 nt, Homo Sapiens; identical to SEQ ID NO: 93510

SEQ ID NO: 219494 - RNA, 64 nt, Homo Sapiens; identical to SEQ ID NO: 93511

SEQ ID NO: 219495 - RNA, 64 nt, Homo Sapiens; identical to SEQ ID NO: 93512

SEQ ID NO: 219496 - RNA, 64 nt, Homo Sapiens; identical to SEQ ID NO: 93513

SEQ ID NO: 219497 - RNA, 64 nt, Homo Sapiens; identical to SEQ ID NO: 93514

SEQ ID NO: 219498 - RNA, 64 nt, Homo Sapiens; identical to SEQ ID NO: 93515

SEQ ID NO: 219499 - RNA, 64 nt, Homo Sapiens; identical to SEQ ID NO: 93516

SEQ ID NO: 219500 - RNA, 64 nt, Homo Sapiens; identical to SEQ ID NO: 93517

SEQ ID NO: 219501 - RNA, 64 nt, Homo Sapiens; identical to SEQ ID NO: 93518

SEQ ID NO: 219502 - RNA, 64 nt, Homo Sapiens; identical to SEQ ID NO: 93519

SEQ ID NO: 219503 - RNA, 64 nt, Homo Sapiens; identical to SEQ ID NO: 93520

SEQ ID NO: 219504 - RNA, 64 nt, Homo Sapiens; identical to SEQ ID NO: 93521

SEQ ID NO: 219505 - RNA, 64 nt, Homo Sapiens; identical to SEQ ID NO: 93522

SEQ ID NO: 219506 - RNA, 64 nt, Homo Sapiens; identical to SEQ ID NO: 93523

SEQ ID NO: 219507 - RNA, 64 nt, Homo Sapiens; identical to SEQ ID NO: 93524

SEQ ID NO: 219508 - RNA, 64 nt, Homo Sapiens; identical to SEQ ID NO: 93525

SEQ ID NO: 219509 - RNA, 64 nt, Homo Sapiens; identical to SEQ ID NO: 93526

SEQ ID NO: 219510 - RNA, 64 nt, Homo Sapiens; identical to SEQ ID NO: 93527

SEQ ID NO: 219511 - RNA, 64 nt, Homo Sapiens; identical to SEQ ID NO: 93528

SEQ ID NO: 219512 - RNA, 64 nt, Homo Sapiens; identical to SEQ ID NO: 93529

SEQ ID NO: 219513 - RNA, 64 nt, Homo Sapiens; identical to SEQ ID NO: 93530

SEQ ID NO: 219514 - RNA, 64 nt, Homo Sapiens; identical to SEQ ID NO: 93531

SEQ ID NO: 219515 - RNA, 64 nt, Homo Sapiens; identical to SEQ ID NO: 93532

SEQ ID NO: 219516 - RNA, 64 nt, Homo Sapiens; identical to SEQ ID NO: 93533

SEQ ID NO: 219517 - RNA, 64 nt, Homo Sapiens; identical to SEQ ID NO: 93534

SEQ ID NO: 219518 - RNA, 64 nt, Homo Sapiens; identical to SEQ ID NO: 93535

SEQ ID NO: 219519 - RNA, 64 nt, Homo Sapiens; identical to SEQ ID NO: 93536

SEQ ID NO: 219520 - RNA, 64 nt, Homo Sapiens; identical to SEQ ID NO: 93537

SEQ ID NO: 219521 - RNA, 64 nt, Homo Sapiens; identical to SEQ ID NO: 93538

SEQ ID NO: 219522 - RNA, 64 nt, Homo Sapiens; identical to SEQ ID NO: 93539

SEQ ID NO: 219523 - RNA, 64 nt, Homo Sapiens; identical to SEQ ID NO: 93540

SEQ ID NO: 219524 - RNA, 64 nt, Homo Sapiens; identical to SEQ ID NO: 93541

SEQ ID NO: 219525 - RNA, 64 nt, Homo Sapiens; identical to SEQ ID NO: 93542

SEQ ID NO: 219526 - RNA, 64 nt, Homo Sapiens; identical to SEQ ID NO: 93543

SEQ ID NO: 219527 - RNA, 64 nt, Homo Sapiens; identical to SEQ ID NO: 93544

SEQ ID NO: 219528 - RNA, 64 nt, Homo Sapiens; identical to SEQ ID NO: 93545

SEQ ID NO: 219529 - RNA, 64 nt, Homo Sapiens; identical to SEQ ID NO: 93546

SEQ ID NO: 219530 - RNA, 64 nt, Homo Sapiens; identical to SEQ ID NO: 93547

SEQ ID NO: 219531 - RNA, 64 nt, Homo Sapiens; identical to SEQ ID NO: 93548

SEQ ID NO: 219532 - RNA, 64 nt, Homo Sapiens; identical to SEQ ID NO: 93549

SEQ ID NO: 219533 - RNA, 64 nt, Homo Sapiens; identical to SEQ ID NO: 93550

SEQ ID NO: 219534 - RNA, 64 nt, Homo Sapiens; identical to SEQ ID NO: 93551

SEQ ID NO: 219535 - RNA, 64 nt, Homo Sapiens; identical to SEQ ID NO: 93552

SEQ ID NO: 219536 - RNA, 64 nt, Homo Sapiens; identical to SEQ ID NO: 93553

SEQ ID NO: 219537 - RNA, 64 nt, Homo Sapiens; identical to SEQ ID NO: 93554

SEQ ID NO: 219538 - RNA, 64 nt, Homo Sapiens; identical to SEQ ID NO: 93555

SEQ ID NO: 219539 - RNA, 64 nt, Homo Sapiens; identical to SEQ ID NO: 93556

SEQ ID NO: 219540 - RNA, 64 nt, Homo Sapiens; identical to SEQ ID NO: 93557

SEQ ID NO: 219541 - RNA, 64 nt, Homo Sapiens; identical to SEQ ID NO: 93558

SEQ ID NO: 219542 - RNA, 64 nt, Homo Sapiens; identical to SEQ ID NO: 93559

SEQ ID NO: 219543 - RNA, 64 nt, Homo Sapiens; identical to SEQ ID NO: 93560

SEQ ID NO: 219544 - RNA, 64 nt, Homo Sapiens; identical to SEQ ID NO: 93561

SEQ ID NO: 219545 - RNA, 64 nt, Homo Sapiens; identical to SEQ ID NO: 93562

SEQ ID NO: 219546 - RNA, 64 nt, Homo Sapiens; identical to SEQ ID NO: 93563

SEQ ID NO: 219547 - RNA, 64 nt, Homo Sapiens; identical to SEQ ID NO: 93564

SEQ ID NO: 219548 - RNA, 64 nt, Homo Sapiens; identical to SEQ ID NO: 93565

SEQ ID NO: 219549 - RNA, 64 nt, Homo Sapiens; identical to SEQ ID NO: 93566

SEQ ID NO: 219550 - RNA, 64 nt, Homo Sapiens; identical to SEQ ID NO: 93567

SEQ ID NO: 219551 - RNA, 64 nt, Homo Sapiens; identical to SEQ ID NO: 93568

SEQ ID NO: 219552 - RNA, 64 nt, Homo Sapiens; identical to SEQ ID NO: 93569

SEQ ID NO: 219553 - RNA, 64 nt, Homo Sapiens; identical to SEQ ID NO: 93570

SEQ ID NO: 219554 - RNA, 64 nt, Homo Sapiens; identical to SEQ ID NO: 93571

SEQ ID NO: 219555 - RNA, 64 nt, Homo Sapiens; identical to SEQ ID NO: 93572

SEQ ID NO: 219556 - RNA, 64 nt, Homo Sapiens; identical to SEQ ID NO: 93573

SEQ ID NO: 219557 - RNA, 64 nt, Homo Sapiens; identical to SEQ ID NO: 93574

SEQ ID NO: 219558 - RNA, 64 nt, Homo Sapiens; identical to SEQ ID NO: 93575

SEQ ID NO: 219559 - RNA, 64 nt, Homo Sapiens; identical to SEQ ID NO: 93576

SEQ ID NO: 219560 - RNA, 64 nt, Homo Sapiens; identical to SEQ ID NO: 93577

SEQ ID NO: 219561 - RNA, 64 nt, Homo Sapiens; identical to SEQ ID NO: 93578

SEQ ID NO: 219562 - RNA, 64 nt, Homo Sapiens; identical to SEQ ID NO: 93579

SEQ ID NO: 219563 - RNA, 64 nt, Homo Sapiens; identical to SEQ ID NO: 93580

SEQ ID NO: 219564 - RNA, 64 nt, Homo Sapiens; identical to SEQ ID NO: 93581

SEQ ID NO: 219565 - RNA, 64 nt, Homo Sapiens; identical to SEQ ID NO: 93582

SEQ ID NO: 219566 - RNA, 62 nt, Homo Sapiens
guccacuucugcacucucugacacauaaacucgcuucugagccagcagauagaggaaaagac

SEQ ID NO: 219567 - RNA, 62 nt, Homo Sapiens
auucaguuuuggagcaaguccccuaucaugcugcuucugaaaucagaguugaauaucucuuu

SEQ ID NO: 219568 - RNA, 62 nt, Homo Sapiens
aauggaaauguagguucacuccuuccauguuugcuucugauaauacuucaucauguauguaa

SEQ ID NO: 219569 - RNA, 62 nt, Homo Sapiens
cuggaacucuggaggaagacggcggaaucgcagcuucugagaguaacuggagcgucaccacc

SEQ ID NO: 219570 - RNA, 62 nt, Homo Sapiens
uacaaaacaaaugugcuaugaaauaaggguuggcuucugaaccucuuguacacauuuuaaua

SEQ ID NO: 219571 - RNA, 62 nt, Homo Sapiens
ucagggacaaaacucagugaggcugugccagggcuucugacuugauuuggccugugaacuug

SEQ ID NO: 219572 - RNA, 62 nt, Homo Sapiens
cuugaaaggccaauaccagaacacaggcugaugcuucugagaaagucuuuuccuaguauuua

SEQ ID NO: 219573 - RNA, 62 nt, Homo Sapiens
cagcucauuuccauuccacuauuucccauaaugcuucugagagccacuaacuugauugauaa

SEQ ID NO: 219574 - RNA, 62 nt, Homo Sapiens
gugugugucuugugcuuccucagaccuuucucgcuucugagcuugguggccuguucccucca

SEQ ID NO: 219575 - RNA, 62 nt, Homo Sapiens
cuuauccuucugguccagcgcaaggaggggcugcuucugaggucgguggcugucuuuccauu

SEQ ID NO: 219576 - RNA, 64 nt, Homo Sapiens; identical to SEQ ID NO: 54328

SEQ ID NO: 219577 - RNA, 64 nt, Homo Sapiens; identical to SEQ ID NO: 54329

SEQ ID NO: 219578 - RNA, 64 nt, Homo Sapiens; identical to SEQ ID NO: 54330

SEQ ID NO: 219579 - RNA, 64 nt, Homo Sapiens; identical to SEQ ID NO: 54331

SEQ ID NO: 219580 - RNA, 64 nt, Homo Sapiens; identical to SEQ ID NO: 54332

SEQ ID NO: 219581 - RNA, 64 nt, Homo Sapiens; identical to SEQ ID NO: 54333

SEQ ID NO: 219582 - RNA, 64 nt, Homo Sapiens; identical to SEQ ID NO: 54334

SEQ ID NO: 219583 - RNA, 64 nt, Homo Sapiens; identical to SEQ ID NO: 54335

SEQ ID NO: 219584 - RNA, 64 nt, Homo Sapiens; identical to SEQ ID NO: 54336

SEQ ID NO: 219585 - RNA, 64 nt, Homo Sapiens; identical to SEQ ID NO: 54337

SEQ ID NO: 219586 - RNA, 64 nt, Homo Sapiens; identical to SEQ ID NO: 54338

SEQ ID NO: 219587 - RNA, 64 nt, Homo Sapiens; identical to SEQ ID NO: 54339

SEQ ID NO: 219588 - RNA, 64 nt, Homo Sapiens; identical to SEQ ID NO: 54340

SEQ ID NO: 219589 - RNA, 64 nt, Homo Sapiens; identical to SEQ ID NO: 54341

SEQ ID NO: 219590 - RNA, 64 nt, Homo Sapiens; identical to SEQ ID NO: 54342

SEQ ID NO: 219591 - RNA, 64 nt, Homo Sapiens; identical to SEQ ID NO: 54343

SEQ ID NO: 219592 - RNA, 64 nt, Homo Sapiens; identical to SEQ ID NO: 54344

SEQ ID NO: 219593 - RNA, 64 nt, Homo Sapiens; identical to SEQ ID NO: 54345

SEQ ID NO: 219594 - RNA, 64 nt, Homo Sapiens; identical to SEQ ID NO: 54346

SEQ ID NO: 219595 - RNA, 64 nt, Homo Sapiens; identical to SEQ ID NO: 54347

SEQ ID NO: 219596 - RNA, 64 nt, Homo Sapiens; identical to SEQ ID NO: 54348

SEQ ID NO: 219597 - RNA, 64 nt, Homo Sapiens; identical to SEQ ID NO: 54349

SEQ ID NO: 219598 - RNA, 64 nt, Homo Sapiens; identical to SEQ ID NO: 54350

SEQ ID NO: 219599 - RNA, 64 nt, Homo Sapiens; identical to SEQ ID NO: 54351

SEQ ID NO: 219600 - RNA, 64 nt, Homo Sapiens; identical to SEQ ID NO: 54352

SEQ ID NO: 219601 - RNA, 64 nt, Homo Sapiens; identical to SEQ ID NO: 54353

SEQ ID NO: 219602 - RNA, 64 nt, Homo Sapiens; identical to SEQ ID NO: 54354

SEQ ID NO: 219603 - RNA, 64 nt, Homo Sapiens; identical to SEQ ID NO: 54355

SEQ ID NO: 219604 - RNA, 64 nt, Homo Sapiens; identical to SEQ ID NO: 54356

SEQ ID NO: 219605 - RNA, 64 nt, Homo Sapiens; identical to SEQ ID NO: 54357

SEQ ID NO: 219606 - RNA, 64 nt, Homo Sapiens; identical to SEQ ID NO: 54358

SEQ ID NO: 219607 - RNA, 64 nt, Homo Sapiens; identical to SEQ ID NO: 54359

SEQ ID NO: 219608 - RNA, 64 nt, Homo Sapiens; identical to SEQ ID NO: 54360

SEQ ID NO: 219609 - RNA, 64 nt, Homo Sapiens; identical to SEQ ID NO: 54361

SEQ ID NO: 219610 - RNA, 64 nt, Homo Sapiens; identical to SEQ ID NO: 54362

SEQ ID NO: 219611 - RNA, 64 nt, Homo Sapiens; identical to SEQ ID NO: 54363

SEQ ID NO: 219612 - RNA, 64 nt, Homo Sapiens; identical to SEQ ID NO: 54364

SEQ ID NO: 219613 - RNA, 64 nt, Homo Sapiens; identical to SEQ ID NO: 54365

SEQ ID NO: 219614 - RNA, 64 nt, Homo Sapiens; identical to SEQ ID NO: 54366

SEQ ID NO: 219615 - RNA, 64 nt, Homo Sapiens; identical to SEQ ID NO: 54367

SEQ ID NO: 219616 - RNA, 64 nt, Homo Sapiens; identical to SEQ ID NO: 54368

SEQ ID NO: 219617 - RNA, 64 nt, Homo Sapiens; identical to SEQ ID NO: 54369

SEQ ID NO: 219618 - RNA, 64 nt, Homo Sapiens; identical to SEQ ID NO: 54370

SEQ ID NO: 219619 - RNA, 64 nt, Homo Sapiens; identical to SEQ ID NO: 54371

SEQ ID NO: 219620 - RNA, 64 nt, Homo Sapiens; identical to SEQ ID NO: 54372

SEQ ID NO: 219621 - RNA, 64 nt, Homo Sapiens; identical to SEQ ID NO: 54373

SEQ ID NO: 219622 - RNA, 64 nt, Homo Sapiens; identical to SEQ ID NO: 54374

SEQ ID NO: 219623 - RNA, 64 nt, Homo Sapiens; identical to SEQ ID NO: 54375

SEQ ID NO: 219624 - RNA, 64 nt, Homo Sapiens; identical to SEQ ID NO: 54376

SEQ ID NO: 219625 - RNA, 64 nt, Homo Sapiens; identical to SEQ ID NO: 54377

SEQ ID NO: 219626 - RNA, 64 nt, Homo Sapiens; identical to SEQ ID NO: 54378

SEQ ID NO: 219627 - RNA, 64 nt, Homo Sapiens; identical to SEQ ID NO: 54379

SEQ ID NO: 219628 - RNA, 64 nt, Homo Sapiens; identical to SEQ ID NO: 54380

SEQ ID NO: 219629 - RNA, 64 nt, Homo Sapiens; identical to SEQ ID NO: 54381

SEQ ID NO: 219630 - RNA, 64 nt, Homo Sapiens; identical to SEQ ID NO: 54382

SEQ ID NO: 219631 - RNA, 64 nt, Homo Sapiens; identical to SEQ ID NO: 54383

SEQ ID NO: 219632 - RNA, 64 nt, Homo Sapiens; identical to SEQ ID NO: 54384

SEQ ID NO: 219633 - RNA, 64 nt, Homo Sapiens; identical to SEQ ID NO: 54385

SEQ ID NO: 219634 - RNA, 64 nt, Homo Sapiens; identical to SEQ ID NO: 54386

SEQ ID NO: 219635 - RNA, 64 nt, Homo Sapiens; identical to SEQ ID NO: 54387

SEQ ID NO: 219636 - RNA, 64 nt, Homo Sapiens; identical to SEQ ID NO: 54388

SEQ ID NO: 219637 - RNA, 64 nt, Homo Sapiens; identical to SEQ ID NO: 54389

SEQ ID NO: 219638 - RNA, 64 nt, Homo Sapiens; identical to SEQ ID NO: 54390

SEQ ID NO: 219639 - RNA, 64 nt, Homo Sapiens; identical to SEQ ID NO: 54391

SEQ ID NO: 219640 - RNA, 64 nt, Homo Sapiens; identical to SEQ ID NO: 54392

SEQ ID NO: 219641 - RNA, 64 nt, Homo Sapiens; identical to SEQ ID NO: 54393

SEQ ID NO: 219642 - RNA, 64 nt, Homo Sapiens; identical to SEQ ID NO: 54394

SEQ ID NO: 219643 - RNA, 64 nt, Homo Sapiens; identical to SEQ ID NO: 54395

SEQ ID NO: 219644 - RNA, 64 nt, Homo Sapiens; identical to SEQ ID NO: 54396

SEQ ID NO: 219645 - RNA, 64 nt, Homo Sapiens; identical to SEQ ID NO: 54397

SEQ ID NO: 219646 - RNA, 64 nt, Homo Sapiens; identical to SEQ ID NO: 54398

SEQ ID NO: 219647 - RNA, 64 nt, Homo Sapiens; identical to SEQ ID NO: 54399

SEQ ID NO: 219648 - RNA, 64 nt, Homo Sapiens; identical to SEQ ID NO: 54400

SEQ ID NO: 219649 - RNA, 64 nt, Homo Sapiens; identical to SEQ ID NO: 54401

SEQ ID NO: 219650 - RNA, 64 nt, Homo Sapiens; identical to SEQ ID NO: 54402

SEQ ID NO: 219651 - RNA, 64 nt, Homo Sapiens; identical to SEQ ID NO: 54403

SEQ ID NO: 219652 - RNA, 64 nt, Homo Sapiens; identical to SEQ ID NO: 54404

SEQ ID NO: 219653 - RNA, 64 nt, Homo Sapiens; identical to SEQ ID NO: 54405

SEQ ID NO: 219654 - RNA, 64 nt, Homo Sapiens; identical to SEQ ID NO: 54406

SEQ ID NO: 219655 - RNA, 64 nt, Homo Sapiens; identical to SEQ ID NO: 54407

SEQ ID NO: 219656 - RNA, 64 nt, Homo Sapiens; identical to SEQ ID NO: 54408

SEQ ID NO: 219657 - RNA, 64 nt, Homo Sapiens; identical to SEQ ID NO: 54409

SEQ ID NO: 219658 - RNA, 64 nt, Homo Sapiens; identical to SEQ ID NO: 54410

SEQ ID NO: 219659 - RNA, 64 nt, Homo Sapiens; identical to SEQ ID NO: 54411

SEQ ID NO: 219660 - RNA, 64 nt, Homo Sapiens; identical to SEQ ID NO: 54412

SEQ ID NO: 219661 - RNA, 64 nt, Homo Sapiens; identical to SEQ ID NO: 54413

SEQ ID NO: 219662 - RNA, 64 nt, Homo Sapiens; identical to SEQ ID NO: 54414

SEQ ID NO: 219663 - RNA, 64 nt, Homo Sapiens; identical to SEQ ID NO: 54415

SEQ ID NO: 219664 - RNA, 64 nt, Homo Sapiens; identical to SEQ ID NO: 54416

SEQ ID NO: 219665 - RNA, 64 nt, Homo Sapiens; identical to SEQ ID NO: 54417

SEQ ID NO: 219666 - RNA, 64 nt, Homo Sapiens; identical to SEQ ID NO: 54418

SEQ ID NO: 219667 - RNA, 64 nt, Homo Sapiens; identical to SEQ ID NO: 54419

SEQ ID NO: 219668 - RNA, 64 nt, Homo Sapiens; identical to SEQ ID NO: 54420

SEQ ID NO: 219669 - RNA, 64 nt, Homo Sapiens; identical to SEQ ID NO: 54421

SEQ ID NO: 219670 - RNA, 64 nt, Homo Sapiens; identical to SEQ ID NO: 54422

SEQ ID NO: 219671 - RNA, 64 nt, Homo Sapiens; identical to SEQ ID NO: 54423

SEQ ID NO: 219672 - RNA, 64 nt, Homo Sapiens; identical to SEQ ID NO: 54424

SEQ ID NO: 219673 - RNA, 64 nt, Homo Sapiens; identical to SEQ ID NO: 54425

SEQ ID NO: 219674 - RNA, 64 nt, Homo Sapiens; identical to SEQ ID NO: 54426

SEQ ID NO: 219675 - RNA, 64 nt, Homo Sapiens; identical to SEQ ID NO: 54427

SEQ ID NO: 219676 - RNA, 64 nt, Homo Sapiens; identical to SEQ ID NO: 54428

SEQ ID NO: 219677 - RNA, 64 nt, Homo Sapiens; identical to SEQ ID NO: 54429

SEQ ID NO: 219678 - RNA, 64 nt, Homo Sapiens; identical to SEQ ID NO: 54430

SEQ ID NO: 219679 - RNA, 64 nt, Homo Sapiens; identical to SEQ ID NO: 54431

SEQ ID NO: 219680 - RNA, 64 nt, Homo Sapiens; identical to SEQ ID NO: 54432

SEQ ID NO: 219681 - RNA, 64 nt, Homo Sapiens; identical to SEQ ID NO: 54433

SEQ ID NO: 219682 - RNA, 64 nt, Homo Sapiens; identical to SEQ ID NO: 54434

SEQ ID NO: 219683 - RNA, 64 nt, Homo Sapiens; identical to SEQ ID NO: 54435

SEQ ID NO: 219684 - RNA, 64 nt, Homo Sapiens; identical to SEQ ID NO: 54436

SEQ ID NO: 219685 - RNA, 64 nt, Homo Sapiens; identical to SEQ ID NO: 54437

SEQ ID NO: 219686 - RNA, 64 nt, Homo Sapiens; identical to SEQ ID NO: 54438

SEQ ID NO: 219687 - RNA, 64 nt, Homo Sapiens; identical to SEQ ID NO: 54439

SEQ ID NO: 219688 - RNA, 64 nt, Homo Sapiens; identical to SEQ ID NO: 54440

SEQ ID NO: 219689 - RNA, 64 nt, Homo Sapiens; identical to SEQ ID NO: 54441

SEQ ID NO: 219690 - RNA, 64 nt, Homo Sapiens; identical to SEQ ID NO: 54442

SEQ ID NO: 219691 - RNA, 64 nt, Homo Sapiens; identical to SEQ ID NO: 54443

SEQ ID NO: 219692 - RNA, 64 nt, Homo Sapiens; identical to SEQ ID NO: 54444

SEQ ID NO: 219693 - RNA, 64 nt, Homo Sapiens; identical to SEQ ID NO: 54445

SEQ ID NO: 219694 - RNA, 64 nt, Homo Sapiens; identical to SEQ ID NO: 54446

SEQ ID NO: 219695 - RNA, 64 nt, Homo Sapiens; identical to SEQ ID NO: 54447

SEQ ID NO: 219696 - RNA, 64 nt, Homo Sapiens; identical to SEQ ID NO: 54448

SEQ ID NO: 219697 - RNA, 64 nt, Homo Sapiens; identical to SEQ ID NO: 54449

SEQ ID NO: 219698 - RNA, 64 nt, Homo Sapiens; identical to SEQ ID NO: 54450

SEQ ID NO: 219699 - RNA, 64 nt, Homo Sapiens; identical to SEQ ID NO: 54451

SEQ ID NO: 219700 - RNA, 64 nt, Homo Sapiens; identical to SEQ ID NO: 54452

SEQ ID NO: 219701 - RNA, 58 nt, Homo Sapiens; identical to SEQ ID NO: 54453

SEQ ID NO: 219702 - RNA, 64 nt, Homo Sapiens; identical to SEQ ID NO: 54454

SEQ ID NO: 219703 - RNA, 64 nt, Homo Sapiens; identical to SEQ ID NO: 54455

SEQ ID NO: 219704 - RNA, 64 nt, Homo Sapiens; identical to SEQ ID NO: 54456

SEQ ID NO: 219705 - RNA, 64 nt, Homo Sapiens; identical to SEQ ID NO: 54457

SEQ ID NO: 219706 - RNA, 64 nt, Homo Sapiens; identical to SEQ ID NO: 54458

SEQ ID NO: 219707 - RNA, 64 nt, Homo Sapiens; identical to SEQ ID NO: 54459

SEQ ID NO: 219708 - RNA, 64 nt, Homo Sapiens; identical to SEQ ID NO: 54460

SEQ ID NO: 219709 - RNA, 64 nt, Homo Sapiens; identical to SEQ ID NO: 54461

SEQ ID NO: 219710 - RNA, 64 nt, Homo Sapiens; identical to SEQ ID NO: 54462

SEQ ID NO: 219711 - RNA, 64 nt, Homo Sapiens; identical to SEQ ID NO: 54463

SEQ ID NO: 219712 - RNA, 64 nt, Homo Sapiens; identical to SEQ ID NO: 54464

SEQ ID NO: 219713 - RNA, 53 nt, Homo Sapiens; identical to SEQ ID NO: 54465

SEQ ID NO: 219714 - RNA, 64 nt, Homo Sapiens; identical to SEQ ID NO: 54466

SEQ ID NO: 219715 - RNA, 64 nt, Homo Sapiens; identical to SEQ ID NO: 54467

SEQ ID NO: 219716 - RNA, 64 nt, Homo Sapiens; identical to SEQ ID NO: 54468

SEQ ID NO: 219717 - RNA, 64 nt, Homo Sapiens; identical to SEQ ID NO: 54469

SEQ ID NO: 219718 - RNA, 64 nt, Homo Sapiens; identical to SEQ ID NO: 54470

SEQ ID NO: 219719 - RNA, 64 nt, Homo Sapiens; identical to SEQ ID NO: 54471

SEQ ID NO: 219720 - RNA, 64 nt, Homo Sapiens; identical to SEQ ID NO: 54472

SEQ ID NO: 219721 - RNA, 64 nt, Homo Sapiens; identical to SEQ ID NO: 54473

SEQ ID NO: 219722 - RNA, 64 nt, Homo Sapiens; identical to SEQ ID NO: 54474

SEQ ID NO: 219723 - RNA, 64 nt, Homo Sapiens; identical to SEQ ID NO: 54475

SEQ ID NO: 219724 - RNA, 64 nt, Homo Sapiens; identical to SEQ ID NO: 54476

SEQ ID NO: 219725 - RNA, 64 nt, Homo Sapiens; identical to SEQ ID NO: 54477

SEQ ID NO: 219726 - RNA, 64 nt, Homo Sapiens; identical to SEQ ID NO: 54478

SEQ ID NO: 219727 - RNA, 64 nt, Homo Sapiens; identical to SEQ ID NO: 54479

SEQ ID NO: 219728 - RNA, 64 nt, Homo Sapiens; identical to SEQ ID NO: 54480

SEQ ID NO: 219729 - RNA, 64 nt, Homo Sapiens; identical to SEQ ID NO: 54481

SEQ ID NO: 219730 - RNA, 64 nt, Homo Sapiens; identical to SEQ ID NO: 54482

SEQ ID NO: 219731 - RNA, 64 nt, Homo Sapiens; identical to SEQ ID NO: 54483

SEQ ID NO: 219732 - RNA, 64 nt, Homo Sapiens; identical to SEQ ID NO: 54484

SEQ ID NO: 219733 - RNA, 64 nt, Homo Sapiens; identical to SEQ ID NO: 54485

SEQ ID NO: 219734 - RNA, 64 nt, Homo Sapiens; identical to SEQ ID NO: 54486

SEQ ID NO: 219735 - RNA, 64 nt, Homo Sapiens; identical to SEQ ID NO: 54487

SEQ ID NO: 219736 - RNA, 64 nt, Homo Sapiens; identical to SEQ ID NO: 54488

SEQ ID NO: 219737 - RNA, 64 nt, Homo Sapiens; identical to SEQ ID NO: 54489

SEQ ID NO: 219738 - RNA, 64 nt, Homo Sapiens; identical to SEQ ID NO: 54490

SEQ ID NO: 219739 - RNA, 64 nt, Homo Sapiens; identical to SEQ ID NO: 54491

SEQ ID NO: 219740 - RNA, 64 nt, Homo Sapiens; identical to SEQ ID NO: 54492

SEQ ID NO: 219741 - RNA, 64 nt, Homo Sapiens; identical to SEQ ID NO: 54493

SEQ ID NO: 219742 - RNA, 64 nt, Homo Sapiens; identical to SEQ ID NO: 54494

SEQ ID NO: 219743 - RNA, 64 nt, Homo Sapiens; identical to SEQ ID NO: 54495

SEQ ID NO: 219744 - RNA, 64 nt, Homo Sapiens; identical to SEQ ID NO: 54496

SEQ ID NO: 219745 - RNA, 64 nt, Homo Sapiens; identical to SEQ ID NO: 54497

SEQ ID NO: 219746 - RNA, 64 nt, Homo Sapiens; identical to SEQ ID NO: 54498

SEQ ID NO: 219747 - RNA, 64 nt, Homo Sapiens; identical to SEQ ID NO: 54499

SEQ ID NO: 219748 - RNA, 64 nt, Homo Sapiens; identical to SEQ ID NO: 54500

SEQ ID NO: 219749 - RNA, 64 nt, Homo Sapiens; identical to SEQ ID NO: 54501

SEQ ID NO: 219750 - RNA, 64 nt, Homo Sapiens; identical to SEQ ID NO: 54502

SEQ ID NO: 219751 - RNA, 64 nt, Homo Sapiens; identical to SEQ ID NO: 54503

SEQ ID NO: 219752 - RNA, 64 nt, Homo Sapiens; identical to SEQ ID NO: 54504

SEQ ID NO: 219753 - RNA, 64 nt, Homo Sapiens; identical to SEQ ID NO: 54505

SEQ ID NO: 219754 - RNA, 64 nt, Homo Sapiens; identical to SEQ ID NO: 54506

SEQ ID NO: 219755 - RNA, 64 nt, Homo Sapiens; identical to SEQ ID NO: 54507

SEQ ID NO: 219756 - RNA, 64 nt, Homo Sapiens; identical to SEQ ID NO: 54508

SEQ ID NO: 219757 - RNA, 64 nt, Homo Sapiens; identical to SEQ ID NO: 54509

SEQ ID NO: 219758 - RNA, 64 nt, Homo Sapiens; identical to SEQ ID NO: 54510

SEQ ID NO: 219759 - RNA, 64 nt, Homo Sapiens; identical to SEQ ID NO: 54511

SEQ ID NO: 219760 - RNA, 64 nt, Homo Sapiens; identical to SEQ ID NO: 54512

SEQ ID NO: 219761 - RNA, 64 nt, Homo Sapiens; identical to SEQ ID NO: 54513

SEQ ID NO: 219762 - RNA, 64 nt, Homo Sapiens; identical to SEQ ID NO: 54514

SEQ ID NO: 219763 - RNA, 64 nt, Homo Sapiens; identical to SEQ ID NO: 54515

SEQ ID NO: 219764 - RNA, 64 nt, Homo Sapiens; identical to SEQ ID NO: 54516

SEQ ID NO: 219765 - RNA, 64 nt, Homo Sapiens; identical to SEQ ID NO: 54517

SEQ ID NO: 219766 - RNA, 64 nt, Homo Sapiens; identical to SEQ ID NO: 54518

SEQ ID NO: 219767 - RNA, 64 nt, Homo Sapiens; identical to SEQ ID NO: 54519

SEQ ID NO: 219768 - RNA, 64 nt, Homo Sapiens; identical to SEQ ID NO: 54520

SEQ ID NO: 219769 - RNA, 64 nt, Homo Sapiens; identical to SEQ ID NO: 54521

SEQ ID NO: 219770 - RNA, 64 nt, Homo Sapiens; identical to SEQ ID NO: 54522

SEQ ID NO: 219771 - RNA, 64 nt, Homo Sapiens; identical to SEQ ID NO: 54523

SEQ ID NO: 219772 - RNA, 64 nt, Homo Sapiens; identical to SEQ ID NO: 54524

SEQ ID NO: 219773 - RNA, 64 nt, Homo Sapiens; identical to SEQ ID NO: 54525

SEQ ID NO: 219774 - RNA, 64 nt, Homo Sapiens; identical to SEQ ID NO: 54526

SEQ ID NO: 219775 - RNA, 64 nt, Homo Sapiens; identical to SEQ ID NO: 54527

SEQ ID NO: 219776 - RNA, 64 nt, Homo Sapiens; identical to SEQ ID NO: 54528

SEQ ID NO: 219777 - RNA, 64 nt, Homo Sapiens; identical to SEQ ID NO: 54529

SEQ ID NO: 219778 - RNA, 64 nt, Homo Sapiens; identical to SEQ ID NO: 54530

SEQ ID NO: 219779 - RNA, 64 nt, Homo Sapiens; identical to SEQ ID NO: 54531

SEQ ID NO: 219780 - RNA, 64 nt, Homo Sapiens; identical to SEQ ID NO: 54532

SEQ ID NO: 219781 - RNA, 64 nt, Homo Sapiens; identical to SEQ ID NO: 54533

SEQ ID NO: 219782 - RNA, 64 nt, Homo Sapiens; identical to SEQ ID NO: 54534

SEQ ID NO: 219783 - RNA, 64 nt, Homo Sapiens; identical to SEQ ID NO: 54535

SEQ ID NO: 219784 - RNA, 64 nt, Homo Sapiens; identical to SEQ ID NO: 54536

SEQ ID NO: 219785 - RNA, 64 nt, Homo Sapiens; identical to SEQ ID NO: 54537

SEQ ID NO: 219786 - RNA, 64 nt, Homo Sapiens; identical to SEQ ID NO: 54538

SEQ ID NO: 219787 - RNA, 64 nt, Homo Sapiens; identical to SEQ ID NO: 54539

SEQ ID NO: 219788 - RNA, 64 nt, Homo Sapiens; identical to SEQ ID NO: 54540

SEQ ID NO: 219789 - RNA, 64 nt, Homo Sapiens; identical to SEQ ID NO: 54541

SEQ ID NO: 219790 - RNA, 64 nt, Homo Sapiens; identical to SEQ ID NO: 54542

SEQ ID NO: 219791 - RNA, 64 nt, Homo Sapiens; identical to SEQ ID NO: 54543

SEQ ID NO: 219792 - RNA, 64 nt, Homo Sapiens; identical to SEQ ID NO: 54544

SEQ ID NO: 219793 - RNA, 64 nt, Homo Sapiens; identical to SEQ ID NO: 54545

SEQ ID NO: 219794 - RNA, 64 nt, Homo Sapiens; identical to SEQ ID NO: 54546

SEQ ID NO: 219795 - RNA, 64 nt, Homo Sapiens; identical to SEQ ID NO: 54547

SEQ ID NO: 219796 - RNA, 64 nt, Homo Sapiens; identical to SEQ ID NO: 54548

SEQ ID NO: 219797 - RNA, 64 nt, Homo Sapiens; identical to SEQ ID NO: 54549

SEQ ID NO: 219798 - RNA, 64 nt, Homo Sapiens; identical to SEQ ID NO: 54550

SEQ ID NO: 219799 - RNA, 64 nt, Homo Sapiens; identical to SEQ ID NO: 54551

SEQ ID NO: 219800 - RNA, 64 nt, Homo Sapiens; identical to SEQ ID NO: 54552

SEQ ID NO: 219801 - RNA, 64 nt, Homo Sapiens; identical to SEQ ID NO: 54553

SEQ ID NO: 219802 - RNA, 64 nt, Homo Sapiens; identical to SEQ ID NO: 54554

SEQ ID NO: 219803 - RNA, 64 nt, Homo Sapiens; identical to SEQ ID NO: 54555

SEQ ID NO: 219804 - RNA, 64 nt, Homo Sapiens; identical to SEQ ID NO: 54556

SEQ ID NO: 219805 - RNA, 64 nt, Homo Sapiens; identical to SEQ ID NO: 54557

SEQ ID NO: 219806 - RNA, 64 nt, Homo Sapiens; identical to SEQ ID NO: 54558

SEQ ID NO: 219807 - RNA, 64 nt, Homo Sapiens; identical to SEQ ID NO: 54559

SEQ ID NO: 219808 - RNA, 64 nt, Homo Sapiens; identical to SEQ ID NO: 54560

SEQ ID NO: 219809 - RNA, 64 nt, Homo Sapiens; identical to SEQ ID NO: 54561

SEQ ID NO: 219810 - RNA, 64 nt, Homo Sapiens; identical to SEQ ID NO: 54562

SEQ ID NO: 219811 - RNA, 64 nt, Homo Sapiens; identical to SEQ ID NO: 54563

SEQ ID NO: 219812 - RNA, 64 nt, Homo Sapiens; identical to SEQ ID NO: 54564

SEQ ID NO: 219813 - RNA, 64 nt, Homo Sapiens; identical to SEQ ID NO: 54565

SEQ ID NO: 219814 - RNA, 64 nt, Homo Sapiens; identical to SEQ ID NO: 54566

SEQ ID NO: 219815 - RNA, 64 nt, Homo Sapiens; identical to SEQ ID NO: 54567

SEQ ID NO: 219816 - RNA, 64 nt, Homo Sapiens; identical to SEQ ID NO: 54568

SEQ ID NO: 219817 - RNA, 64 nt, Homo Sapiens; identical to SEQ ID NO: 54569

SEQ ID NO: 219818 - RNA, 64 nt, Homo Sapiens; identical to SEQ ID NO: 54570

SEQ ID NO: 219819 - RNA, 64 nt, Homo Sapiens; identical to SEQ ID NO: 54571

SEQ ID NO: 219820 - RNA, 64 nt, Homo Sapiens; identical to SEQ ID NO: 54572

SEQ ID NO: 219821 - RNA, 64 nt, Homo Sapiens; identical to SEQ ID NO: 54573

SEQ ID NO: 219822 - RNA, 64 nt, Homo Sapiens; identical to SEQ ID NO: 54574

SEQ ID NO: 219823 - RNA, 64 nt, Homo Sapiens; identical to SEQ ID NO: 54575

SEQ ID NO: 219824 - RNA, 64 nt, Homo Sapiens; identical to SEQ ID NO: 54576

SEQ ID NO: 219825 - RNA, 64 nt, Homo Sapiens; identical to SEQ ID NO: 54577

SEQ ID NO: 219826 - RNA, 64 nt, Homo Sapiens; identical to SEQ ID NO: 54578

SEQ ID NO: 219827 - RNA, 64 nt, Homo Sapiens; identical to SEQ ID NO: 54579

SEQ ID NO: 219828 - RNA, 64 nt, Homo Sapiens; identical to SEQ ID NO: 54580

SEQ ID NO: 219829 - RNA, 64 nt, Homo Sapiens; identical to SEQ ID NO: 54581

SEQ ID NO: 219830 - RNA, 64 nt, Homo Sapiens; identical to SEQ ID NO: 54582

SEQ ID NO: 219831 - RNA, 64 nt, Homo Sapiens; identical to SEQ ID NO: 54583

SEQ ID NO: 219832 - RNA, 64 nt, Homo Sapiens
gggcagauggccagaugcaccuuaaguaaaguccaaaguccaagcugcccuuguugaguuuucu

SEQ ID NO: 219833 - RNA, 64 nt, Homo Sapiens
guccaaggggcagauggccaguuuucucuuaaguaaaguccaaagggcuuucugcccuuguuga

SEQ ID NO: 219834 - RNA, 64 nt, Homo Sapiens
agaaaugcaccccagaaccauggagcaggacaauaaaguccacugucccuuucuacuguggugu

SEQ ID NO: 219835 - RNA, 64 nt, Homo Sapiens
ucuccugggggccuggagagccuauccaugggucaaaguccaccugaaaaaacugguccuuugg

SEQ ID NO: 219836 - RNA, 64 nt, Homo Sapiens
gguuaguguacuaguccaucaaauugguaucaagaaaguccacuuguuuuauccauucaacuga

SEQ ID NO: 219837 - RNA, 64 nt, Homo Sapiens
gaugcaaauuggacuggcgagaacuucagacacaaaaguccacuccaguuaugccuuccaagag

SEQ ID NO: 219838 - RNA, 64 nt, Homo Sapiens
gagcaagcaucuuccugacagcauuuugucaucuaaaguccagugacaugguuccccguggugg

SEQ ID NO: 219839 - RNA, 64 nt, Homo Sapiens
ggaagaaugagacaauuuuguguaggcuuuuucuaaaguccaguacuuuguccagauuuuagau

SEQ ID NO: 219840 - RNA, 64 nt, Homo Sapiens
agccauggacaguaaaguuggcaucucucuucauuccuggaauggugugugugugucucuuuga

SEQ ID NO: 219841 - RNA, 64 nt, Homo Sapiens
ugugugugugugugucucuugcauuucucuucauuccuggaauggugugugugugugucuuuga

SEQ ID NO: 219842 - RNA, 64 nt, Homo Sapiens
cccuguucagagguguggccaauuuaucccgaucuccuggaaggcuguugugauuuccaucuaa

SEQ ID NO: 219843 - RNA, 64 nt, Homo Sapiens
gagaccccaaauuucucaccaauguuuugggagauccuggaaaagaucccuucaguuuggggug

SEQ ID NO: 219844 - RNA, 64 nt, Homo Sapiens
uauucaucuuccuauccccagaaccuugcacagauccuggaaugugguaggugcucaguaaaug

SEQ ID NO: 219845 - RNA, 64 nt, Homo Sapiens
aacaaggcacugucacugcccaccuccuugggccuccuggaacgccagggccucggcggcugcu

SEQ ID NO: 219846 - RNA, 64 nt, Homo Sapiens
acuccaaguccugcccugccacccucggccucuguccuggaagccccaccccuuuccuccugua

SEQ ID NO: 219847 - RNA, 64 nt, Homo Sapiens
cugccaccucauuucacaaggauugauuugcauuuccuggaacuaacaugucauuuugaaacug

SEQ ID NO: 219848 - RNA, 64 nt, Homo Sapiens
ugagcuugacguuuguaaacugucccccgcccguuccuggaaaccccgcaaccccuccucucug

SEQ ID NO: 219849 - RNA, 64 nt, Homo Sapiens
ugguugggggcuccuguuucucauccuagcuuuuuccuggaaagcccgcuagaagguuugggaa

SEQ ID NO: 219850 - RNA, 64 nt, Homo Sapiens
augcauggccucuaagagugcccgugucgguucuuccuggaaguugacuuuccuuagacccgcc

SEQ ID NO: 219851 - RNA, 64 nt, Homo Sapiens
ggucacaggaacgcacagauaagagguucugcacuccuggaaccuauucccuucugaucuugga

SEQ ID NO: 219852 - RNA, 64 nt, Homo Sapiens
ugucauuugacaacacaugugcggugucugcagcuccuggaaggccaucggggaaugacacacu

SEQ ID NO: 219853 - RNA, 64 nt, Homo Sapiens
cccuccuucccauuggcuuucucuccuuggccuuuccuggaagccaguuaguaaacuuccuauu

SEQ ID NO: 219854 - RNA, 64 nt, Homo Sapiens
auauuuaggaaaaccucaagcaguaauuaauaucuccuggaacacuauagagaaccaagugacc

SEQ ID NO: 219855 - RNA, 64 nt, Homo Sapiens
gcuuaccucuucuuugugaaaauacuaucucauuuccuggaaauaaaauguaaaaccugucagu

SEQ ID NO: 219856 - RNA, 64 nt, Homo Sapiens
uuuguauugugguccuaaucuaagaucaggagaauccuggaauuguuaucugucucuugcucug

SEQ ID NO: 219857 - RNA, 64 nt, Homo Sapiens
gauacaggaaacauauuaaguuuuuuuuuuggcauccuggaaauaaggcuagagaguugauuuu

SEQ ID NO: 219858 - RNA, 64 nt, Homo Sapiens
ccuuuaaagauuucagacuuaauuuaaaaaugcauccuggaaauuagucugaguucuggugggg

SEQ ID NO: 219859 - RNA, 64 nt, Homo Sapiens
cucaguuguaaaacaugaugucauccugcaugccuccuggaauucuccaauggggucgccaaac

SEQ ID NO: 219860 - RNA, 64 nt, Homo Sapiens
uggcagcuguggcugcagcugugcuccugcucccuccuggaaugugcgacaagcccaaauguuc

SEQ ID NO: 219861 - RNA, 64 nt, Homo Sapiens
cauaccccacaaggacaguguccuugaagacacauccuggaauuacuaauaggacacauguaaa

SEQ ID NO: 219862 - RNA, 64 nt, Homo Sapiens
ugcauuuaaauaauaguaaauauuggaaauauguuccuggaaaauguuuuugaugaucuaucug

SEQ ID NO: 219863 - RNA, 64 nt, Homo Sapiens
gaaagggaugggagccacagugcccuucacucucuccuggaaaccaacuguaagcuggugggcu

SEQ ID NO: 219864 - RNA, 64 nt, Homo Sapiens
acccugcuauccacagcccuggaggaacuggggcuccuggaaggaggaggaggcucuccacugu

SEQ ID NO: 219865 - RNA, 64 nt, Homo Sapiens
agaguuaucaaccaauguguccagccaggagaaguccuggaauauugcaccuuuccugaugcuu

SEQ ID NO: 219866 - RNA, 64 nt, Homo Sapiens
uuucagauacagcugagcccacacagugcccuguuccuggaaugccccagcugcagcuauccug

SEQ ID NO: 219867 - RNA, 64 nt, Homo Sapiens
cccuguaccccuccuccucauggcuuccuucuaauccuggaaaaagugcccaagcagcuaaacu

SEQ ID NO: 219868 - RNA, 64 nt, Homo Sapiens
caggaggguccccugcccugggcuucccuuuggcuccuggaaggcagaguggcgcuggggccuc

SEQ ID NO: 219869 - RNA, 64 nt, Homo Sapiens
aucaguuacucagcccugggcuucuucggggaacuccuggaaauagcucucccucuggcccugc

SEQ ID NO: 219870 - RNA, 64 nt, Homo Sapiens
uguguccuugcaccugcaucgugacugccccaacuccuggaagcauguuaaagucagugggaac

SEQ ID NO: 219871 - RNA, 64 nt, Homo Sapiens
uguucaucaccugcccaccggagccgcaugcucuuccuggaacugcccacgucugcacagaaca

SEQ ID NO: 219872 - RNA, 64 nt, Homo Sapiens
uucuuuggauuuguuuuguguuuuuguugacuaguccuggaaauguuugaggcuagacggggag

SEQ ID NO: 219873 - RNA, 64 nt, Homo Sapiens
ggccccgcagggcgggcugcaacuuuucuguugauccuggaauguagcuggugcagugagaggg

SEQ ID NO: 219874 - RNA, 64 nt, Homo Sapiens
ugagccuuuuccuggccaagguuccgccaccuucuccuggaaggccgcagguggugcugggugg

SEQ ID NO: 219875 - RNA, 64 nt, Homo Sapiens
agaagccuuucagguuucccggaccagaaugcuuuccuggaaaacgagagcagucugcauccug

SEQ ID NO: 219876 - RNA, 64 nt, Homo Sapiens
ccgauuucaaucuacguucugaggggaucucaaauccuggaaccauggaaggccccaaggcccu

SEQ ID NO: 219877 - RNA, 64 nt, Homo Sapiens
gcuaauuacaggaccccccaagacaccaaaacaguccuggaagucacugucaccccuaauuuac

SEQ ID NO: 219878 - RNA, 64 nt, Homo Sapiens
uuuuuccuuucuggcgcaugaauccauacaucauuccuggaagugaggcaagacucuugcaucu

SEQ ID NO: 219879 - RNA, 64 nt, Homo Sapiens
acaauuuuuugucccuaauguucuuccuuuuacauccuggaacaacaauaaaaacauuuuuuua

SEQ ID NO: 219880 - RNA, 64 nt, Homo Sapiens
gugugauggaggagggagaugccuggggaggggcuccuggaauccaggccagcccaacagcccu

SEQ ID NO: 219881 - RNA, 64 nt, Homo Sapiens
ccagggguggagggggaaaaccaggcaauuucguuccuggaaucaaccaaaucauguuuuccuc

SEQ ID NO: 219882 - RNA, 64 nt, Homo Sapiens
ucuggauuugguggaagaccgaagacguggauuuuccuggaagauggaagacauggauuuccug

SEQ ID NO: 219883 - RNA, 64 nt, Homo Sapiens
cguggauuuuccuggaagauggaagacauggauuuccuggaagauggaagaccuugaaauuauu

SEQ ID NO: 219884 - RNA, 64 nt, Homo Sapiens
uggaauuuugcacauuuuugguuaauacaugaagcauugcaauauaguaaugugacaaacuaaa

SEQ ID NO: 219885 - RNA, 64 nt, Homo Sapiens
agggaacgcacagccucacaaaagacugaaaauucauugcaauuuugaaucguuaacauuauuu

SEQ ID NO: 219886 - RNA, 64 nt, Homo Sapiens
uuuugaauucagauuuaaaaaccaacuuauaaagcauugcaacaagguuaccucuauuuugcca

SEQ ID NO: 219887 - RNA, 64 nt, Homo Sapiens
aaaaaaaaaaggaaacuuuuuuuguuugcucuugcauugcaaaaauuauaaaguaauuuauuau

SEQ ID NO: 219888 - RNA, 64 nt, Homo Sapiens
agcaucauuuaaguaguuuugcaacuuugagugccauugcaagccuucuuuuggggguugguca

SEQ ID NO: 219889 - RNA, 64 nt, Homo Sapiens
uuauuaggcauuuuagaaucaagccuucagucaucauugcaaccuaagggugaugaguuuggga

SEQ ID NO: 219890 - RNA, 64 nt, Homo Sapiens
uccaaauaaggauaccccucagggcucagcuagacauugcaauuuugcauagcuuuccaguucc

SEQ ID NO: 219891 - RNA, 64 nt, Homo Sapiens
cuaauccuuacuauccuauuaggauaccacuuuucauugcaaaguuugugucaauaaagucauu

SEQ ID NO: 219892 - RNA, 64 nt, Homo Sapiens
gaaaagcccaugcguggaguuccccuccuuucaacauugcaacaacaguaacaacaagacaacc

SEQ ID NO: 219893 - RNA, 64 nt, Homo Sapiens
cccucucgcccucagagagguccaccugguuugucauugcaaugcuuuucauuuuuuuuuuuug

SEQ ID NO: 219894 - RNA, 64 nt, Homo Sapiens
ggagguggagggacaggcucguuauugccccaaccauugcaaugcugagcuaggauuagggagg

SEQ ID NO: 219895 - RNA, 64 nt, Homo Sapiens
aaaauggggacuuccugggugucaggaccugggccauugcaaccgggaaguacagagugggaug

SEQ ID NO: 219896 - RNA, 64 nt, Homo Sapiens
guugauuacuacuuuaagugauauucauuuaaaacauugcaaauuuauuuuauuuauuuaauuu

SEQ ID NO: 219897 - RNA, 64 nt, Homo Sapiens
gauuacaggcuugagccaccacgcccggcuaaaacauugcaaauuuaaaugagaguuuuaaaaa

SEQ ID NO: 219898 - RNA, 64 nt, Homo Sapiens
uacgaugccagcagcucucaucugggacucagccucuuaggacccucuuugucuguaagcuugc

SEQ ID NO: 219899 - RNA, 64 nt, Homo Sapiens
acuuuucuagucacagauguacgaugguguuaauucuuaggacucuacaaugugguaggcugaa

SEQ ID NO: 219900 - RNA, 64 nt, Homo Sapiens
aggcaucuguaagaaguagagaacccagaugaucucuuaggaagccuuuuauucgugggaacuc

SEQ ID NO: 219901 - RNA, 64 nt, Homo Sapiens
uggcugugugacuuugaacacaucucuuagucccucuuaggaguacuuuccuuauuggcaacuu

SEQ ID NO: 219902 - RNA, 64 nt, Homo Sapiens
agcuucaccguuaguaaucccucacuuuaauaccucuuaggaaccaaagaaugccucuacaagc

SEQ ID NO: 219903 - RNA, 64 nt, Homo Sapiens
auccauauuguaccagaaugacuaugucuguguuucuuaggaauguugaagcuuuuugugaaaa

SEQ ID NO: 219904 - RNA, 64 nt, Homo Sapiens
uuuucaguucuucauugaguuugauuauggaaauccauucaaagucacuaugaaaauuuuacuc

SEQ ID NO: 219905 - RNA, 64 nt, Homo Sapiens
uuuggauacuuugaaagaugacagauuguuaaauccauucaaugguaaagaaacucaccaucug

SEQ ID NO: 219906 - RNA, 64 nt, Homo Sapiens
aauaauugguaaauaauauuguaccccaguaaaaccauucaaucggcugaaagguuugaaauac

SEQ ID NO: 219907 - RNA, 64 nt, Homo Sapiens
auuaaugcaugauagggccuuucauuaacuccugccauucaauggcguuguaacaggaaaaguu

SEQ ID NO: 219908 - RNA, 64 nt, Homo Sapiens
aggaaaguacuggacuacccguggguaaguccugccauucaagacuggagacaccugggaaaua

SEQ ID NO: 219909 - RNA, 64 nt, Homo Sapiens
aucuuugauccuuccauuucauuuauucauccauccauucaacaaguauuugcuaaacacuaac

SEQ ID NO: 219910 - RNA, 64 nt, Homo Sapiens
uuauuuuauuuauuuuugaauccacuaucucuuuccauucaaaauauuuccauucaaaaugugg

SEQ ID NO: 219911 - RNA, 64 nt, Homo Sapiens
uugaauccacuaucucuuuccauucaaaauauuuccauucaaaaugugguucacagacccgcca

SEQ ID NO: 219912 - RNA, 64 nt, Homo Sapiens
ucuuuguaaagaaaguggcuugaaaucuuuuuuguucaaagauuaaugccaacucuuaagauua

SEQ ID NO: 219913 - RNA, 64 nt, Homo Sapiens
gcccucuacugagucccuuagccaagcaguuucuuucaaagaagccagcaggcgaaaagcaggg

SEQ ID NO: 219914 - RNA, 64 nt, Homo Sapiens
uuuauuuuuauuaacuuuuuucaguuucuuuuuauucaaagaaacaaaauucaaucucugauaa

SEQ ID NO: 219915 - RNA, 64 nt, Homo Sapiens
uauccaagugacucuauugauguauguauguucauucaaagaaugggaaaaggauaugacauau

SEQ ID NO: 219916 - RNA, 64 nt, Homo Sapiens
aucaaccucugugguggucaggcaaccuugagaguucaaagaaagccauucuccuucacugguu

SEQ ID NO: 219917 - RNA, 64 nt, Homo Sapiens
ggauccucuuucaaaggcuauagcauucugucaauucaaagaagucuuggcagugcuuuuucuu

SEQ ID NO: 219918 - RNA, 64 nt, Homo Sapiens
gagauacaauuuuuuaguuugagauggagauauguucaaagaauagccaaccaacugaaaaccu

SEQ ID NO: 219919 - RNA, 64 nt, Homo Sapiens
guugucuuguucuuguggugaauuuuauguugcauucaaagacuauguuugcugugcuuuucug

SEQ ID NO: 219920 - RNA, 64 nt, Homo Sapiens
ugggcuuucucuugaucuuugugucauuucagaauucaaagacugugcuacgggaguucugaac

SEQ ID NO: 219921 - RNA, 64 nt, Homo Sapiens
uggauauguugaaggguauuuguuaauuuuacuuuucaaagauacuuuaaaacaguagagcuag

SEQ ID NO: 219922 - RNA, 64 nt, Homo Sapiens
gaauauuugaagcauguuuucugcauggugucuuuucaaagauaaucagaggaaagcuuauuuu

SEQ ID NO: 219923 - RNA, 64 nt, Homo Sapiens
ucagcagcaaaccaaaacagaauacauaauucucuucaaagacuaugggcaaagagcuacuuug

SEQ ID NO: 219924 - RNA, 64 nt, Homo Sapiens
agugagucuaauguagugaaagcagcugucacacuucaaagagccagucucucauagaguauaa

SEQ ID NO: 219925 - RNA, 64 nt, Homo Sapiens
gagagccaugagacuuucccauuacaauugcaacuucaaagacaaaggaagaagaggaccucaa

SEQ ID NO: 219926 - RNA, 64 nt, Homo Sapiens
auucagaagccuuguuauuuuaaaaaugaaauauuucaaagacugaauauuuucaaagaaaaug

SEQ ID NO: 219927 - RNA, 64 nt, Homo Sapiens
uuuuaaaaaugaaauauuucaaagacugaauauuuucaaagaaaaugaauaauucauugcccuu

SEQ ID NO: 219928 - RNA, 64 nt, Homo Sapiens
aggaaacuuaagaugugcaaggagauuuaaugauuucaaagaaaauaaugguucuuuguuuuua

SEQ ID NO: 219929 - RNA, 64 nt, Homo Sapiens
ccauuuggaaaaaugaaauuuaguaguuccaaguuucaaagaaaugucaacauuuuauuccauu

SEQ ID NO: 219930 - RNA, 64 nt, Homo Sapiens
ucuugugcugggacaggggauuacaccaucucuguucaaagagggggaaaugugccuaugccuu

SEQ ID NO: 219931 - RNA, 64 nt, Homo Sapiens
uagacaagccaaauggcuggcagaugauguggauuucaaagagcccagaaugaacucaucacug

SEQ ID NO: 219932 - RNA, 64 nt, Homo Sapiens
aaguuuaaguaaaaagugauacuccaccuuguguuucaaagaauuuaguuccaccucuucauac

SEQ ID NO: 219933 - RNA, 64 nt, Homo Sapiens
uaauacaucuuagauuccuuauaucuaauaagaguucaaagaguuaugaguugaagucuugaau

SEQ ID NO: 219934 - RNA, 53 nt, Homo Sapiens; identical to SEQ ID NO: 168469

SEQ ID NO: 219935 - RNA, 64 nt, Homo Sapiens
aauuguaaaauaucacauaauauagaaauggcaguucaaagagaauuguggcagauguugugug

SEQ ID NO: 219936 - RNA, 64 nt, Homo Sapiens
aauuccaauuucuauuuacuuuucuuucaaugcuuucaaagauauagucauugugcauguuaaa

SEQ ID NO: 219937 - RNA, 64 nt, Homo Sapiens
aacacuuuuguuaagaccccaauucuaagcacguuucaaagaugggguugcaaaucagaacuaa

SEQ ID NO: 219938 - RNA, 64 nt, Homo Sapiens
aauuuguccauguaaagcuucaaaaaaucauuuuuucaaagaaauguuuauuaaugggccaaug

SEQ ID NO: 219939 - RNA, 64 nt, Homo Sapiens
uuagagcauuuguuucaucuuuuauaacuugaccuucaaagagauugcuucaucauaagaauaa

SEQ ID NO: 219940 - RNA, 64 nt, Homo Sapiens
guuugagggaaauaugucccuagcaggaaaagaauucaaagagguucaaagaauaugucacuua

SEQ ID NO: 219941 - RNA, 64 nt, Homo Sapiens
aauaugucccuagcaggaaaagaauucaaagagguucaaagaauaugucacuuacuccuacuug

SEQ ID NO: 219942 - RNA, 64 nt, Homo Sapiens
uugaaaagauugaagagggcgcauugguuauaaauucaaagagcuuuucuuucuuaacuuaaag

SEQ ID NO: 219943 - RNA, 64 nt, Homo Sapiens
aaacauaaaaagugggaaggguuugguguaagccuucaaagaaauaguuaaauauuucaguguu

SEQ ID NO: 219944 - RNA, 64 nt, Homo Sapiens
cagacacaccuggguuuggaaggguuauguaauguucaaagauucucccaacccuguggugauc

SEQ ID NO: 219945 - RNA, 64 nt, Homo Sapiens
aaacuagaacuuuaaaaguuuuacuuuguuuugauucaaagaccauggcuuuuauaaacaucuu

SEQ ID NO: 219946 - RNA, 64 nt, Homo Sapiens
uaggggagaaccacgagagaagcauuaagugacuuucaaagacuuucagaguacagccacuugg

SEQ ID NO: 219947 - RNA, 64 nt, Homo Sapiens
aaaaugacguuuguggcucuuucccaaguuggccuucaaagagccugccugcuguugagccaga

SEQ ID NO: 219948 - RNA, 64 nt, Homo Sapiens
aaguggagaggaccuaacaugaaaugaugucaguuucaaagagauguguaauuuuacauuucau

SEQ ID NO: 219949 - RNA, 64 nt, Homo Sapiens
auuucuucuuuuagcuuuggggaauuccaugggcuucaaagaacagaagacuccaccugugcuu

SEQ ID NO: 219950 - RNA, 64 nt, Homo Sapiens
augacuagaagaaaaaggagacaauaccauguuguucaaagaaacauugaaggaaauugggaug

SEQ ID NO: 219951 - RNA, 64 nt, Homo Sapiens
aggcagaggggauucaaaugugugagaggcuagauucaaagacccucaguguucuauguuaucu

SEQ ID NO: 219952 - RNA, 64 nt, Homo Sapiens
uuagcaagcuucauuaaagaacaaaacagaauauuucaaagaaaaaaauauugaaugcuuucua

SEQ ID NO: 219953 - RNA, 64 nt, Homo Sapiens
cuuuugccaguuacaugcauguguauuuuuucuauucaaagaugccaccauuuucauuugugca

SEQ ID NO: 219954 - RNA, 64 nt, Homo Sapiens
cuccaccuugggaccuguuuagagaagccggcucuucaaagacaauggaaacuguaccauacac

SEQ ID NO: 219955 - RNA, 64 nt, Homo Sapiens
aguuuagaaauaauugaaaggaaauguuugaguuuucaaagaucccgugaaauugaugccagug

SEQ ID NO: 219956 - RNA, 64 nt, Homo Sapiens
aaggaaaaaagauuauuguagucauauucuuguauucaaagaaauuuccacugaaaacauuuuu

SEQ ID NO: 219957 - RNA, 64 nt, Homo Sapiens
ucugcauguugggcgaaaacccacccccauuuguuucaaagaggaagacagauuuaaagugccc

SEQ ID NO: 219958 - RNA, 64 nt, Homo Sapiens
gugaacagcuugcugucacuggucugagucuauguucaaagacuaaauagauuagguuugcggg

SEQ ID NO: 219959 - RNA, 64 nt, Homo Sapiens
auagauuagguuugcggggguuauuuccacuauuuucaaagaaagaauuuucaaggccuucagu

SEQ ID NO: 219960 - RNA, 64 nt, Homo Sapiens
ugaaaggacucacacuaggguuauuucauuggauuucaaagacaauaugugggaaagccuuugu

SEQ ID NO: 219961 - RNA, 64 nt, Homo Sapiens
ugaaaccacucacagugcagugcuuccacuucccuucaaagacgcaaugugggaaagccuucag

SEQ ID NO: 219962 - RNA, 64 nt, Homo Sapiens
cauggcagugcagcauggaguucuuugggaaaccuucaaagacagaauguaggaaguccuucaa

SEQ ID NO: 219963 - RNA, 64 nt, Homo Sapiens
cuuaacauuaugagccuuuucugcucaaaaaauuuucaaagauuaaaacuauuauacauauaca

SEQ ID NO: 219964 - RNA, 64 nt, Homo Sapiens
caagucuuuuuugcaaucuugaacuuucauuagcuucaaagagaagcuguauuuacaggagaaa

SEQ ID NO: 219965 - RNA, 64 nt, Homo Sapiens
cuuaaacuuaaauauccaaagaugccuuuugaauuucaaagauuaaaacacagcuagaguagua

SEQ ID NO: 219966 - RNA, 64 nt, Homo Sapiens
gauuugguguggauugcaauaauggaggaauguuuucaaagauuucuacuguauguaugaaccg

SEQ ID NO: 219967 - RNA, 64 nt, Homo Sapiens
ggucuagugagcuaaguuucguguguugaggcuuuucaaagaagcuacauauuacaugggugua

SEQ ID NO: 219968 - RNA, 64 nt, Homo Sapiens
acauaugauucuuuccaagauggcuaccaacccauucaaagagguggaaagccaguuaccucag

SEQ ID NO: 219969 - RNA, 64 nt, Homo Sapiens
acauaugacucuuuccaagaaagcaguuaccucauucaaagaagauauuucacaagcaauggaa

SEQ ID NO: 219970 - RNA, 64 nt, Homo Sapiens
cagguucuggugacauuauuaagccguuuugauuuucaaagaagagucauuuugauuuucaaag

SEQ ID NO: 219971 - RNA, 64 nt, Homo Sapiens
ccguuuugauuuucaaagaaaagucauuuugauuuucaaagaagcuuuuuucagaccauacaag

SEQ ID NO: 219972 - RNA, 64 nt, Homo Sapiens; identical to SEQ ID NO: 168534

SEQ ID NO: 219973 - RNA, 64 nt, Homo Sapiens; identical to SEQ ID NO: 168535

SEQ ID NO: 219974 - RNA, 64 nt, Homo Sapiens; identical to SEQ ID NO: 168536

SEQ ID NO: 219975 - RNA, 64 nt, Homo Sapiens; identical to SEQ ID NO: 168537

SEQ ID NO: 219976 - RNA, 64 nt, Homo Sapiens; identical to SEQ ID NO: 168538

SEQ ID NO: 219977 - RNA, 64 nt, Homo Sapiens; identical to SEQ ID NO: 168539

SEQ ID NO: 219978 - RNA, 64 nt, Homo Sapiens; identical to SEQ ID NO: 168540

SEQ ID NO: 219979 - RNA, 64 nt, Homo Sapiens; identical to SEQ ID NO: 168541

SEQ ID NO: 219980 - RNA, 64 nt, Homo Sapiens; identical to SEQ ID NO: 168542

SEQ ID NO: 219981 - RNA, 64 nt, Homo Sapiens; identical to SEQ ID NO: 168543

SEQ ID NO: 219982 - RNA, 64 nt, Homo Sapiens; identical to SEQ ID NO: 168544

SEQ ID NO: 219983 - RNA, 64 nt, Homo Sapiens; identical to SEQ ID NO: 168545

SEQ ID NO: 219984 - RNA, 64 nt, Homo Sapiens
cuucacucuccucugauuagaugaaacuguuaccuuacccuaaacacaguauuucuuuuuaacu

SEQ ID NO: 219985 - RNA, 64 nt, Homo Sapiens
uccuauucagcuccccaagaugauguguuuuugcuuacccuaagagagguuuucuucuuauuuu

SEQ ID NO: 219986 - RNA, 64 nt, Homo Sapiens
ccauuacauaaugauuuugcccuuguuauaaauguuacccuaggaauuguuuuaaccauuuccu

SEQ ID NO: 219987 - RNA, 64 nt, Homo Sapiens
aacagcucaaagcaccuucacaaguugccuugacuuacccuaggugggugugaaagagcacccg

SEQ ID NO: 219988 - RNA, 64 nt, Homo Sapiens
uacuaaggcacaaagacaugacacuaaggacauuucaaauuaagauuuacuuugguauauuuuu

SEQ ID NO: 219989 - RNA, 64 nt, Homo Sapiens
uuuauguuccuauauauuacgagcuagaaggagaucaaauuacauuaugauuuccagaguuuuu

SEQ ID NO: 219990 - RNA, 64 nt, Homo Sapiens
uaggaaggaaguggcauaguuuuaucaauaucugucaaauuaaacuucaaggcaaaacuuuuuu

SEQ ID NO: 219991 - RNA, 64 nt, Homo Sapiens
acauuuagcuagauugaccacccccucaaaagacucaaauuacuagaaucagaaacaaaaguca

SEQ ID NO: 219992 - RNA, 64 nt, Homo Sapiens
guuaguaaagaacaaaaugauaaauuaccaauuuucaaauuauuuuuucauauucacaagauau

SEQ ID NO: 219993 - RNA, 64 nt, Homo Sapiens
guuuaucuucuguauaacuguauacuuuugcuuuucaaauuauaaaggccuguagcucugguug

SEQ ID NO: 219994 - RNA, 64 nt, Homo Sapiens
cauuacaagguauggauuuuaaauggaugaaacuucaaauuaucuuauuuggauagaagucuau

SEQ ID NO: 219995 - RNA, 64 nt, Homo Sapiens
ucaaacaucauggccucccauccaaucaacaucaucaaauuacauguguaaucaaggcucugug

SEQ ID NO: 219996 - RNA, 64 nt, Homo Sapiens
gccucggaaauguagaauuucccacuucugaaguucaaauuaguuugccuuacauaucagcccu

SEQ ID NO: 219997 - RNA, 64 nt, Homo Sapiens
uauauuggcauugcuggauugcaaauaggggcuaucaaauuaccguauaauuguuaaucacuuu

SEQ ID NO: 219998 - RNA, 64 nt, Homo Sapiens
uuuaugacuucuacguucaguuacaaguaugcugucaaauuaucguggguugaaacuuguuaaa

SEQ ID NO: 219999 - RNA, 64 nt, Homo Sapiens
aauaguaacaagguauauuauacuuucauuacaaucaaauuauagaaauuacuuguguaaaagg

SEQ ID NO: 220000 - RNA, 64 nt, Homo Sapiens
uuugacuccuggaaguauugucuuccauuuucauucaaauuaacaaauuauugucaacuuguuc

SEQ ID NO: 220001 - RNA, 64 nt, Homo Sapiens
gucaacuuguucucuuccauaagcaugaauugcuucaaauuauuuaaacgucauucagcccuag

SEQ ID NO: 220002 - RNA, 64 nt, Homo Sapiens
gaacugagacauuggccuuauacuuaagaagucaucaaauuaguacuuuauucuguuuaaaaug

SEQ ID NO: 220003 - RNA, 64 nt, Homo Sapiens
uuuagaucuuaaaauuuucauacaaaucccauuuucaaauuacucauuauuaguaguaaacuuu

SEQ ID NO: 220004 - RNA, 64 nt, Homo Sapiens
uaaauggaaauguuuacaccugaagugaguauuuucaaauuaaaauuuaauuaagugauuuucu

SEQ ID NO: 220005 - RNA, 64 nt, Homo Sapiens
uguuauuauucauauuaacaaaucugaaaauaugucaaauuacguguuuuuaugaccauguaau

SEQ ID NO: 220006 - RNA, 64 nt, Homo Sapiens
uguuuuuaugaccauguaauaaucugaaaauaugucaaauuacguguuauuauucauauuaaca

SEQ ID NO: 220007 - RNA, 64 nt, Homo Sapiens
auuuaauuaagugauuuucuugaagugaguauuuucaaauuaaauaaauggaaauguuuacacc

SEQ ID NO: 220008 - RNA, 64 nt, Homo Sapiens
cccagagggcgcucagccaagcuuagagcagcuaucaaauuauaaguuaucaucaucuuauucu

SEQ ID NO: 220009 - RNA, 64 nt, Homo Sapiens
uuaaauguguguuauacugauaaaauuucaucuuucaaauuauagucuauuauuuuaaagggau

SEQ ID NO: 220010 - RNA, 64 nt, Homo Sapiens
aacauggaauuucuuuuaggugcagugguggucuucaaauuacauuaguuuuuuuuauauauau

SEQ ID NO: 220011 - RNA, 64 nt, Homo Sapiens
ggagacuaccuuuuuagauuuuuuuuauuauauaucaaauuauaguuguauauacuuaugagaa

SEQ ID NO: 220012 - RNA, 64 nt, Homo Sapiens
aauggcuaaacaguaucaagguccacuuaauuagucaaauuagcgggauucaaaaggugucaca

SEQ ID NO: 220013 - RNA, 64 nt, Homo Sapiens
uaccuggaaacauagcuauucagaaaauaaguaaucaaauuagggccuuacaacuuacaggcau

SEQ ID NO: 220014 - RNA, 64 nt, Homo Sapiens
agaagaaaaauuauuaaacaacucauuuuaagauucaaauuaacuaauuccugcauauaugaca

SEQ ID NO: 220015 - RNA, 64 nt, Homo Sapiens
ucuccaguugauucaagaaacucauuacuuugccucaaauuauauguaaaauauuuguuuuacu

SEQ ID NO: 220016 - RNA, 64 nt, Homo Sapiens
gcauuuccuuauucuuuaguguaauuguaauuuuucaaauuaaauguguauauaucucuacacu

SEQ ID NO: 220017 - RNA, 64 nt, Homo Sapiens
gaaaaagggaagaucauagcuaauuuauaauagcucaaauuacuaauuuaauaacugggucacc

SEQ ID NO: 220018 - RNA, 64 nt, Homo Sapiens
agcuauuuaaguuuauauucuuucuuugugggaaucaaauuacaauugcccagccugggaaucu

SEQ ID NO: 220019 - RNA, 64 nt, Homo Sapiens
gaccuggacaggguccaaguaucaucagcuaccuucaaauuauuacagagcccaccugaucaag

SEQ ID NO: 220020 - RNA, 64 nt, Homo Sapiens; identical to SEQ ID NO: 128804

SEQ ID NO: 220021 - RNA, 64 nt, Homo Sapiens; identical to SEQ ID NO: 128805

SEQ ID NO: 220022 - RNA, 64 nt, Homo Sapiens; identical to SEQ ID NO: 128806

SEQ ID NO: 220023 - RNA, 64 nt, Homo Sapiens; identical to SEQ ID NO: 128807

SEQ ID NO: 220024 - RNA, 64 nt, Homo Sapiens; identical to SEQ ID NO: 128808

SEQ ID NO: 220025 - RNA, 64 nt, Homo Sapiens; identical to SEQ ID NO: 128809

SEQ ID NO: 220026 - RNA, 64 nt, Homo Sapiens; identical to SEQ ID NO: 128810

SEQ ID NO: 220027 - RNA, 64 nt, Homo Sapiens; identical to SEQ ID NO: 128811

SEQ ID NO: 220028 - RNA, 64 nt, Homo Sapiens; identical to SEQ ID NO: 128812

SEQ ID NO: 220029 - RNA, 64 nt, Homo Sapiens; identical to SEQ ID NO: 128813

SEQ ID NO: 220030 - RNA, 64 nt, Homo Sapiens; identical to SEQ ID NO: 128814

SEQ ID NO: 220031 - RNA, 64 nt, Homo Sapiens; identical to SEQ ID NO: 128815

SEQ ID NO: 220032 - RNA, 64 nt, Homo Sapiens; identical to SEQ ID NO: 128816

SEQ ID NO: 220033 - RNA, 64 nt, Homo Sapiens; identical to SEQ ID NO: 128817

SEQ ID NO: 220034 - RNA, 64 nt, Homo Sapiens; identical to SEQ ID NO: 128818

SEQ ID NO: 220035 - RNA, 64 nt, Homo Sapiens; identical to SEQ ID NO: 128819

SEQ ID NO: 220036 - RNA, 64 nt, Homo Sapiens; identical to SEQ ID NO: 128820

SEQ ID NO: 220037 - RNA, 64 nt, Homo Sapiens; identical to SEQ ID NO: 128821

SEQ ID NO: 220038 - RNA, 64 nt, Homo Sapiens; identical to SEQ ID NO: 128822

SEQ ID NO: 220039 - RNA, 64 nt, Homo Sapiens; identical to SEQ ID NO: 128823

SEQ ID NO: 220040 - RNA, 64 nt, Homo Sapiens; identical to SEQ ID NO: 128824

SEQ ID NO: 220041 - RNA, 64 nt, Homo Sapiens; identical to SEQ ID NO: 128825

SEQ ID NO: 220042 - RNA, 64 nt, Homo Sapiens; identical to SEQ ID NO: 128826

SEQ ID NO: 220043 - RNA, 64 nt, Homo Sapiens; identical to SEQ ID NO: 128827

SEQ ID NO: 220044 - RNA, 62 nt, Homo Sapiens
cgcccuggcccuuggguuagccgccucccggccagcgccaucucccgcccuuggugcugccc

SEQ ID NO: 220045 - RNA, 64 nt, Homo Sapiens
uuggugcugcccccgggcgguaccugcucucucccagcgccacuuggccucuuccucuccuccu

SEQ ID NO: 220046 - RNA, 64 nt, Homo Sapiens
ugcuccaaguugggccuggcuaccugcuccgggccagcgccaucgcagagaggagcugacaggg

SEQ ID NO: 220047 - RNA, 64 nt, Homo Sapiens
gaggaucugcugcaccugcucagcauccacccugcagcgccaauagcugguggcccuccaaggg

SEQ ID NO: 220048 - RNA, 64 nt, Homo Sapiens
uauacugaaauuggauugacuuagagauuaugaagucauuaauuugguagaaaaaucaaauacc

SEQ ID NO: 220049 - RNA, 64 nt, Homo Sapiens
aacuuuacauaugugagauacacaugcaagugaagucauuaaaguuaagccugagccauauucu

SEQ ID NO: 220050 - RNA, 64 nt, Homo Sapiens
auacacccucuacuugggcuauguaagcaaaguagucauuaaaaagacauuugcacaaucuaaa

SEQ ID NO: 220051 - RNA, 64 nt, Homo Sapiens
ccagcucaaaggggguuuaaaacaaagcaacugggucauuaaaaaucuaaauaaauggcuuuca

SEQ ID NO: 220052 - RNA, 64 nt, Homo Sapiens
acacuucaacuggucaauauaaaaauuuacuucugucauuaauuuaauaacuaaccuuuaggua

SEQ ID NO: 220053 - RNA, 64 nt, Homo Sapiens
aucuuguacguauauaauucacguaacuugauuagucauuaaaauaauauuuguuggcugggcc

SEQ ID NO: 220054 - RNA, 64 nt, Homo Sapiens
accucacuucccacuugcuauugaauugugaauagucauuaaaaaccugugauaccaaaucuuc

SEQ ID NO: 220055 - RNA, 64 nt, Homo Sapiens
aaaaaaauggugucuuaagugcuuaguguuugaugucauuaacaguuucguaaaacucuacagu

SEQ ID NO: 220056 - RNA, 64 nt, Homo Sapiens; identical to SEQ ID NO: 189120

SEQ ID NO: 220057 - RNA, 64 nt, Homo Sapiens; identical to SEQ ID NO: 189121

SEQ ID NO: 220058 - RNA, 64 nt, Homo Sapiens; identical to SEQ ID NO: 189122

SEQ ID NO: 220059 - RNA, 64 nt, Homo Sapiens; identical to SEQ ID NO: 189123

SEQ ID NO: 220060 - RNA, 64 nt, Homo Sapiens; identical to SEQ ID NO: 189124

SEQ ID NO: 220061 - RNA, 64 nt, Homo Sapiens; identical to SEQ ID NO: 189125

SEQ ID NO: 220062 - RNA, 64 nt, Homo Sapiens; identical to SEQ ID NO: 189126

SEQ ID NO: 220063 - RNA, 64 nt, Homo Sapiens; identical to SEQ ID NO: 189127

SEQ ID NO: 220064 - RNA, 64 nt, Homo Sapiens; identical to SEQ ID NO: 189128

SEQ ID NO: 220065 - RNA, 64 nt, Homo Sapiens; identical to SEQ ID NO: 189129

SEQ ID NO: 220066 - RNA, 64 nt, Homo Sapiens; identical to SEQ ID NO: 189130

SEQ ID NO: 220067 - RNA, 64 nt, Homo Sapiens; identical to SEQ ID NO: 189131

SEQ ID NO: 220068 - RNA, 64 nt, Homo Sapiens; identical to SEQ ID NO: 189132

SEQ ID NO: 220069 - RNA, 64 nt, Homo Sapiens; identical to SEQ ID NO: 189133

SEQ ID NO: 220070 - RNA, 64 nt, Homo Sapiens; identical to SEQ ID NO: 189134

SEQ ID NO: 220071 - RNA, 64 nt, Homo Sapiens; identical to SEQ ID NO: 189135

SEQ ID NO: 220072 - RNA, 64 nt, Homo Sapiens; identical to SEQ ID NO: 189136

SEQ ID NO: 220073 - RNA, 64 nt, Homo Sapiens; identical to SEQ ID NO: 189137

SEQ ID NO: 220074 - RNA, 64 nt, Homo Sapiens; identical to SEQ ID NO: 189138

SEQ ID NO: 220075 - RNA, 64 nt, Homo Sapiens; identical to SEQ ID NO: 189139

SEQ ID NO: 220076 - RNA, 64 nt, Homo Sapiens; identical to SEQ ID NO: 189140

SEQ ID NO: 220077 - RNA, 64 nt, Homo Sapiens; identical to SEQ ID NO: 189141

SEQ ID NO: 220078 - RNA, 64 nt, Homo Sapiens; identical to SEQ ID NO: 189142

SEQ ID NO: 220079 - RNA, 64 nt, Homo Sapiens; identical to SEQ ID NO: 189143

SEQ ID NO: 220080 - RNA, 64 nt, Homo Sapiens; identical to SEQ ID NO: 189144

SEQ ID NO: 220081 - RNA, 64 nt, Homo Sapiens; identical to SEQ ID NO: 189145

SEQ ID NO: 220082 - RNA, 64 nt, Homo Sapiens; identical to SEQ ID NO: 189146

SEQ ID NO: 220083 - RNA, 64 nt, Homo Sapiens; identical to SEQ ID NO: 189147

SEQ ID NO: 220084 - RNA, 64 nt, Homo Sapiens; identical to SEQ ID NO: 189148

SEQ ID NO: 220085 - RNA, 64 nt, Homo Sapiens; identical to SEQ ID NO: 189149

SEQ ID NO: 220086 - RNA, 64 nt, Homo Sapiens; identical to SEQ ID NO: 189150

SEQ ID NO: 220087 - RNA, 64 nt, Homo Sapiens; identical to SEQ ID NO: 189151

SEQ ID NO: 220088 - RNA, 64 nt, Homo Sapiens; identical to SEQ ID NO: 189152

SEQ ID NO: 220089 - RNA, 64 nt, Homo Sapiens; identical to SEQ ID NO: 189153

SEQ ID NO: 220090 - RNA, 64 nt, Homo Sapiens; identical to SEQ ID NO: 189154

SEQ ID NO: 220091 - RNA, 64 nt, Homo Sapiens; identical to SEQ ID NO: 189155

SEQ ID NO: 220092 - RNA, 64 nt, Homo Sapiens; identical to SEQ ID NO: 189156

SEQ ID NO: 220093 - RNA, 64 nt, Homo Sapiens; identical to SEQ ID NO: 189157

SEQ ID NO: 220094 - RNA, 64 nt, Homo Sapiens; identical to SEQ ID NO: 189158

SEQ ID NO: 220095 - RNA, 64 nt, Homo Sapiens; identical to SEQ ID NO: 189159

SEQ ID NO: 220096 - RNA, 64 nt, Homo Sapiens; identical to SEQ ID NO: 189160

SEQ ID NO: 220097 - RNA, 64 nt, Homo Sapiens; identical to SEQ ID NO: 189161

SEQ ID NO: 220098 - RNA, 64 nt, Homo Sapiens; identical to SEQ ID NO: 189162

SEQ ID NO: 220099 - RNA, 64 nt, Homo Sapiens; identical to SEQ ID NO: 189163

SEQ ID NO: 220100 - RNA, 64 nt, Homo Sapiens; identical to SEQ ID NO: 189164

SEQ ID NO: 220101 - RNA, 64 nt, Homo Sapiens; identical to SEQ ID NO: 189165

SEQ ID NO: 220102 - RNA, 64 nt, Homo Sapiens; identical to SEQ ID NO: 189166

SEQ ID NO: 220103 - RNA, 64 nt, Homo Sapiens; identical to SEQ ID NO: 189167

SEQ ID NO: 220104 - RNA, 64 nt, Homo Sapiens; identical to SEQ ID NO: 189168

SEQ ID NO: 220105 - RNA, 64 nt, Homo Sapiens; identical to SEQ ID NO: 189169

SEQ ID NO: 220106 - RNA, 64 nt, Homo Sapiens; identical to SEQ ID NO: 189170

SEQ ID NO: 220107 - RNA, 64 nt, Homo Sapiens; identical to SEQ ID NO: 189171

SEQ ID NO: 220108 - RNA, 64 nt, Homo Sapiens; identical to SEQ ID NO: 189172

SEQ ID NO: 220109 - RNA, 64 nt, Homo Sapiens; identical to SEQ ID NO: 189173

SEQ ID NO: 220110 - RNA, 64 nt, Homo Sapiens; identical to SEQ ID NO: 189174

SEQ ID NO: 220111 - RNA, 64 nt, Homo Sapiens; identical to SEQ ID NO: 189175

SEQ ID NO: 220112 - RNA, 64 nt, Homo Sapiens; identical to SEQ ID NO: 189176

SEQ ID NO: 220113 - RNA, 64 nt, Homo Sapiens; identical to SEQ ID NO: 189177

SEQ ID NO: 220114 - RNA, 64 nt, Homo Sapiens; identical to SEQ ID NO: 189178

SEQ ID NO: 220115 - RNA, 64 nt, Homo Sapiens; identical to SEQ ID NO: 189179

SEQ ID NO: 220116 - RNA, 64 nt, Homo Sapiens; identical to SEQ ID NO: 189180

SEQ ID NO: 220117 - RNA, 64 nt, Homo Sapiens; identical to SEQ ID NO: 189181

SEQ ID NO: 220118 - RNA, 64 nt, Homo Sapiens; identical to SEQ ID NO: 189182

SEQ ID NO: 220119 - RNA, 64 nt, Homo Sapiens; identical to SEQ ID NO: 189183

SEQ ID NO: 220120 - RNA, 64 nt, Homo Sapiens; identical to SEQ ID NO: 189184

SEQ ID NO: 220121 - RNA, 64 nt, Homo Sapiens
cacacuuucucccugguuuucuuccuggugagcauugccccagcugguucuuucuaaucuuaaa

SEQ ID NO: 220122 - RNA, 64 nt, Homo Sapiens
cucucuguugagccugcuugugggaugauaaacauugccccaguucuuugucucugugguuggg

SEQ ID NO: 220123 - RNA, 64 nt, Homo Sapiens
acauuugccaagaaauuuucccuguuuggaaaguuugccccagcuuucccgggcacaccaccuu

SEQ ID NO: 220124 - RNA, 64 nt, Homo Sapiens
gccgcucaguuccaggcuuuugcccaggucacuguugccccauguucggagaaccuggcccacc

SEQ ID NO: 220125 - RNA, 64 nt, Homo Sapiens
gugauggcccuggaggcgggaugagcaaaagcuguugccccaaauagagauguuuuauaguuac

SEQ ID NO: 220126 - RNA, 64 nt, Homo Sapiens
accucugucuaaaggcccaaugggguauauucauuugccccaucuuuauuuuuaaaacuggauc

SEQ ID NO: 220127 - RNA, 64 nt, Homo Sapiens
ucaucuccacuccaccugaccacccacccgcugcuugccccaucuauuuaugucuccgcuuugu

SEQ ID NO: 220128 - RNA, 64 nt, Homo Sapiens
aacugcauuuccuggggccaggugggagcugccuuugccccacugccuccccuguucugcucuc

SEQ ID NO: 220129 - RNA, 64 nt, Homo Sapiens
uguguuccugaucccacauaagcaugucucauccuugccccacuggugagaggaggaccuugug

SEQ ID NO: 220130 - RNA, 64 nt, Homo Sapiens
cuuggggccaccucugccuccagcaggcuugagcuugccccaggccuugggcauaauuauuucc

SEQ ID NO: 220131 - RNA, 64 nt, Homo Sapiens
cagugcaauggcccuccugccacuucagcacaccuugccccaccugggaccaucacacgugaag

SEQ ID NO: 220132 - RNA, 64 nt, Homo Sapiens
agcccaggccuccaugaaggagaaccugguggcauugccccagagcucuccagagaugagccuc

SEQ ID NO: 220133 - RNA, 62 nt, Homo Sapiens
acgccuuuccaaaucugaaggacuucaucucccgcuuugagggcuuggagaagaucucugcc

SEQ ID NO: 220134 - RNA, 62 nt, Homo Sapiens
ccagugagccuccuugaacaugcuuauuccaacgcuuugaggggcuggaagccuugacacau

SEQ ID NO: 220135 - RNA, 62 nt, Homo Sapiens
aaggcaaagggcgguaccuggacgagaagaagcgcuuugaggguccacagcccgagaccgag

SEQ ID NO: 220136 - RNA, 62 nt, Homo Sapiens
uucugacaugucacuugcccugcauuaugagucgcuuugagccucuccaaagcaaauucaca

SEQ ID NO: 220137 - RNA, 62 nt, Homo Sapiens
uacccaccguccugucagcuugagcucagccucgcuuugaggcacccuucccuguggccuua

SEQ ID NO: 220138 - RNA, 62 nt, Homo Sapiens
gguguaacaacauuuaauugcauguccucuaacgcuuugaaaccuuuagagggaagauccuc

SEQ ID NO: 220139 - RNA, 62 nt, Homo Sapiens
gagccgaugcggugaggagaagcgucaggcggcgcuuugaugaucagaacuugcguucuguu

SEQ ID NO: 220140 - RNA, 62 nt, Homo Sapiens
gaagggguccagaugggaaugcacacaaccuccgcuuugaagggauggagaggcaguacgca

SEQ ID NO: 220141 - RNA, 62 nt, Homo Sapiens
agaggaugcauauuauucagugaaugugggaacgcuuugaucgagaaaccacgugaauguaa

SEQ ID NO: 220142 - RNA, 62 nt, Homo Sapiens
acauggaguucccgugcaccuacggaaggggacgcuuugaaggaaccaagugcauuuuuauc

SEQ ID NO: 220143 - RNA, 62 nt, Homo Sapiens
cuuccugcacagcucagcccuguuggccuggucgcuuugauuaggaagggguugcuguccag

SEQ ID NO: 220144 - RNA, 62 nt, Homo Sapiens
ccaguuuuauaaauggucuuuauuuugaaauacgcuuugaccccauguucauaaaacugaau

SEQ ID NO: 220145 - RNA, 62 nt, Homo Sapiens
acggggaccugaaggauggagaggcuggaccccgcuuugaagagggugcagccugggaaggg

SEQ ID NO: 220146 - RNA, 62 nt, Homo Sapiens
auuuacauucacugucaguaaagaccuggcuacgcuuugagaaaucaggaucuccuagguca

SEQ ID NO: 220147 - RNA, 62 nt, Homo Sapiens
uaaguuggauuagucacacuugaucucagagccgcuuugagcaguugacuugagagaagggc

SEQ ID NO: 220148 - RNA, 62 nt, Homo Sapiens
caggggcucucugugcaaggaaaaaucaaaggcgcuuugaaauucuuguaaagagugagaaa

SEQ ID NO: 220149 - RNA, 62 nt, Homo Sapiens
gaggagguauuguaagcuuuucguaggccugccgcuuugaugcaaacccuguucaggcuggc

SEQ ID NO: 220150 - RNA, 62 nt, Homo Sapiens
aggcggcgggugccgcgccgcugaagacaggccgcuuugaagagaagcaggaccccuacuug

SEQ ID NO: 220151 - RNA, 62 nt, Homo Sapiens
gugccagcagcccuuguuuaaacuauccccugcgcuuugaacggacuacauuuugcucugug

SEQ ID NO: 220152 - RNA, 62 nt, Homo Sapiens
ugugauacagccuacauaaagacuguuaugaucgcuuugauuuuaaaguucauuggaacuac

SEQ ID NO: 220153 - RNA, 62 nt, Homo Sapiens
ggcacaagacucgugacaucacacacuucauucgcuuugaggcccugcuuuaaccuuaaguu

SEQ ID NO: 220154 - RNA, 62 nt, Homo Sapiens
aaauguaacuguuaccgaguuaaauguuuuuccgcuuugagggauguaaccacauccacuca

SEQ ID NO: 220155 - RNA, 62 nt, Homo Sapiens
cagcaaauggagcagcugaccugcccagcgugcgcuuugauauauugugcauauggcagacc

SEQ ID NO: 220156 - RNA, 62 nt, Homo Sapiens
ucuccuugauuuuggguaccauguauauuuuccgcuuugacuuuaacgcuuucuaggauagg

SEQ ID NO: 220157 - RNA, 62 nt, Homo Sapiens
cuggaggccccuuccaaaccucaaguguccggcgcuuugauugccugaguuucugacacuuc

SEQ ID NO: 220158 - RNA, 62 nt, Homo Sapiens
cccccagagaugucaucagagaaaaugagggccgcuuugaguaaucaccugggaaaauacca

SEQ ID NO: 220159 - RNA, 62 nt, Homo Sapiens
cauaaacuuuugcaggaauguugcccucugcccgcuuugauauccuguaguguguaaaugug

SEQ ID NO: 220160 - RNA, 62 nt, Homo Sapiens
gggaaacauuagugaaaauucuguuggugccacgcuuugaugagcauuuguuugaccccagu

SEQ ID NO: 220161 - RNA, 62 nt, Homo Sapiens
aauucaaggucauuauuauuguacaaaauaagcgcuuugauuaacacagcuauauaguuuuu

SEQ ID NO: 220162 - RNA, 62 nt, Homo Sapiens
acuaaacuggaaaacaaagguuguucacaccacgcuuugauaccagugugacacuaagcauu

SEQ ID NO: 220163 - RNA, 62 nt, Homo Sapiens
uauuccuggagggccaagccauccgaaaaguucgcuuugauacuuguuuucaugagacaaua

SEQ ID NO: 220164 - RNA, 62 nt, Homo Sapiens
gaagcaagacacguggccucccugggagcuuccgcuuugaaaagagaagccagccacagacc

SEQ ID NO: 220165 - RNA, 62 nt, Homo Sapiens
aauuggaaaagaaccugcugcaccccaugcagcgcuuugagguucucuucugucucugcccc

SEQ ID NO: 220166 - RNA, 62 nt, Homo Sapiens
aacaaaagaacuaguccucuuagaauuucuugcgcuuugauuuuuuuagggcuugugcccug

SEQ ID NO: 220167 - RNA, 62 nt, Homo Sapiens
augaaugggcacauuuuacugcacacuucagacgcuuugacuuuuuuaaaaaaauuguuucu

SEQ ID NO: 220168 - RNA, 62 nt, Homo Sapiens
cuggagaacuaaucacccagucacugguggcucgcuuugauguuaccacggagauccucaag

SEQ ID NO: 220169 - RNA, 62 nt, Homo Sapiens
gacuuccuccaggcgcugugcccccaggagcucgcuuugaccccuuuggacccauugggacc

SEQ ID NO: 220170 - RNA, 62 nt, Homo Sapiens
ucuaaauuuaucaguaccuaaguaagauguagcgcuuugaauaugaaaucauaggugaagac

SEQ ID NO: 220171 - RNA, 62 nt, Homo Sapiens
ucgcucccaccgagggacuagcuuggccuuugcgcuuugauuccagauaguaagaugagugg

SEQ ID NO: 220172 - RNA, 62 nt, Homo Sapiens
ccccuuauuuuuaagacaucaggaagccagaccgcuuugaguugggagaauuuuguagcuca

SEQ ID NO: 220173 - RNA, 62 nt, Homo Sapiens
guagagacccgugggcacuuccagcccccacccgcuuugaaucccaucugccuuucuuuccc

SEQ ID NO: 220174 - RNA, 62 nt, Homo Sapiens
ccuuacaugaaauguucugguuuuaauaugaccgcuuugaauaacuuuauauugaagcugua

SEQ ID NO: 220175 - RNA, 62 nt, Homo Sapiens
ccuuguuccgaucuaauucuguggagcagagucgcuuugaagauugaauuuucugaauuugg

SEQ ID NO: 220176 - RNA, 62 nt, Homo Sapiens
cgcaugcacauuggggaagagcagaguaggaacgcuuugaugguuguagagcuggaacgagu

SEQ ID NO: 220177 - RNA, 62 nt, Homo Sapiens
uauaauauugaacuucaguaagaauggcaaaucgcuuugagacaucgugauaggaaggccua

SEQ ID NO: 220178 - RNA, 62 nt, Homo Sapiens
cauaguaacuucuuauggaauuuguguauuuacgcuuugauuauuuuggauuguauauugug

SEQ ID NO: 220179 - RNA, 64 nt, Homo Sapiens
gcucucguucucaguagcggagagcaauaaauuauccaugaaguacgcaucaaauuugauucuc

SEQ ID NO: 220180 - RNA, 64 nt, Homo Sapiens
gaucgucauugcaguuaaaguagcauucaggccuuccaugaacagugaccuaucaagacauuca

SEQ ID NO: 220181 - RNA, 64 nt, Homo Sapiens
uacugauucuucuguaucguccucagcaaaauaauccaugaauuagaggcuuuaaaauuuaaaa

SEQ ID NO: 220182 - RNA, 64 nt, Homo Sapiens
ggucuucuauuaauacuuugauagaauaagcaaauccaugaacuaugaguuuugucucagcagg

SEQ ID NO: 220183 - RNA, 64 nt, Homo Sapiens
ucuacaugguuuucuuuuucuuaguaugggaguguccaugaauaaauucaugggcauccucaua

SEQ ID NO: 220184 - RNA, 64 nt, Homo Sapiens
ccaugaauaaauucaugggcauccucauaacucuuccaugaauggcaagggguacuuauggaaa

SEQ ID NO: 220185 - RNA, 64 nt, Homo Sapiens
cacagggaucucugaaauauuguuugaaauuauguccaugaaauuagaagcaguuagagcaaug

SEQ ID NO: 220186 - RNA, 64 nt, Homo Sapiens
agauggagaaagcucauugucacuacuuggaguuuccaugaauagagaagccaacacuugauag

SEQ ID NO: 220187 - RNA, 64 nt, Homo Sapiens
ucaauauugaauucugcccaggagcaugaacugauccaugaaugccuuuuccagguuaaaauuu

SEQ ID NO: 220188 - RNA, 64 nt, Homo Sapiens
uccugccuuaaaaaaaaaaaaaaaaucccaauaguccaugaaggcuuugaucucuugggaaguu

SEQ ID NO: 220189 - RNA, 64 nt, Homo Sapiens
ccucuccuauccucuugccauaugaauagcguuuuccaugaaauaggaaaauauuacuugguau

SEQ ID NO: 220190 - RNA, 64 nt, Homo Sapiens
ggaguuguuuuaaaagacauaaucacuuugaacuuccaugaaaccugucuuccaccacaacaac

SEQ ID NO: 220191 - RNA, 64 nt, Homo Sapiens
cagccucauuuggacuaaaaaaagaaagcagaaauccaugaacacauugcuucucggccuuuug

SEQ ID NO: 220192 - RNA, 64 nt, Homo Sapiens
uucucggccuuuuggcuaagaucaaguguagaaauccaugaacacuaaaggacuucauugauuu

SEQ ID NO: 220193 - RNA, 64 nt, Homo Sapiens
cuucacaauccauguuuuucggaacuaauaaauguccaugaaacuuauaaaaguauuaauuugg

SEQ ID NO: 220194 - RNA, 64 nt, Homo Sapiens
cuuuacaauuuauguuuagaggaagugauaaguguccaugaaauaucacaaggguauugacugg

SEQ ID NO: 220195 - RNA, 64 nt, Homo Sapiens
ccacucaugaucucuuuaucgauggcugauauaguccaugaaucucucuucucacuucuguuaa

SEQ ID NO: 220196 - RNA, 64 nt, Homo Sapiens
ccauggaugauuaauuacucaaaacuacaagucccaagcaaagugaacuauuuguuccuggaag

SEQ ID NO: 220197 - RNA, 64 nt, Homo Sapiens
ugcuaugagcaucagcuuacuuugucacuuagagcaagcaaaacccagugcaagagucucguuc

SEQ ID NO: 220198 - RNA, 64 nt, Homo Sapiens
aguucugaaccuauaguaucuuuuacccuguucccaagcaaagacuggugacuuuaucugaaaa

SEQ ID NO: 220199 - RNA, 64 nt, Homo Sapiens
guacaucagacuuuuaaaaucuguaauauacaagcaagcaaaauuauuuuaaaugacuuaauug

SEQ ID NO: 220200 - RNA, 64 nt, Homo Sapiens
guccuuuagcucaauugauagggucagcgucucgcaagcaaaaaaucucaugaccucauauuug

SEQ ID NO: 220201 - RNA, 64 nt, Homo Sapiens
uaaagcauuccucagaacugucccauuugaagggcaagcaaaccugggguauuuauccacugac

SEQ ID NO: 220202 - RNA, 61 nt, Homo Sapiens
aacuggccaaugaaauuugaacaucacuaaacaagcaaauggaaugacuuuggaccauauc

SEQ ID NO: 220203 - RNA, 64 nt, Homo Sapiens
gcuugauguuguagaaacugggacauauagauaccaagcaaaauuauaagaaaccuauaaggug

SEQ ID NO: 220204 - RNA, 64 nt, Homo Sapiens
uuguagauugagcugaauaaccaugggaagugaccaagcaaagacacucgauuggagucaguug

SEQ ID NO: 220205 - RNA, 64 nt, Homo Sapiens
gagcaguugugaaaauugcuaauggugccaaggccaagcaaagaguuucagaaaaugacugaga

SEQ ID NO: 220206 - RNA, 64 nt, Homo Sapiens
ucaccuggagaaaaggaacguugcucuuggacagcaagcaaaccauuucucuccgucuguucug

SEQ ID NO: 220207 - RNA, 64 nt, Homo Sapiens
caccaucacaaucucacccaaacuccugcucacucaagcaaaagcagccucuggccuucccucc

SEQ ID NO: 220208 - RNA, 64 nt, Homo Sapiens
uuaugguuacuaugauuguuauuauuuguccaaucaagcaaagcaccauuauuucuaacauaua

SEQ ID NO: 220209 - RNA, 64 nt, Homo Sapiens
ugcuuauauauuuucauauucuaacuugucuuuucaagcaaauaacuaauauauaugugcaugc

SEQ ID NO: 220210 - RNA, 64 nt, Homo Sapiens
uuacacuacuagauuggguauuuugcuaaauuaccaagcaaagcagacaaucuuuuucuugaaa

SEQ ID NO: 220211 - RNA, 64 nt, Homo Sapiens
aaugcauuauguuuuacaaagauaucuaaggauccaagcaaacuacuuuaagcaaauauuugua

SEQ ID NO: 220212 - RNA, 64 nt, Homo Sapiens
agacucuguggaguuuguucagugguacgguguccaagcaaacagcagaaugcaacuuucuaaa

SEQ ID NO: 220213 - RNA, 64 nt, Homo Sapiens
agcaaacagcagaaugcaacuuucuaaacagccccaagcaaacagcagaauucaacuuuuuaaa

SEQ ID NO: 220214 - RNA, 64 nt, Homo Sapiens
gugaucacggauguuggcucccccucgcccuaugcaagcaaacacacucucaccuccucuccca

SEQ ID NO: 220215 - RNA, 64 nt, Homo Sapiens
caucccaagguucaauaaggccuuauuuaacaagcaagcaaaaugcaaaccaaaccauuauuca

SEQ ID NO: 220216 - RNA, 64 nt, Homo Sapiens
uuuucguaaucuucaucaagaaguuuuuaaaaggcaagcaaaaacagaagcaaaucauaucaaa

SEQ ID NO: 220217 - RNA, 64 nt, Homo Sapiens
aggcuccaucccuggcuuccccagccugcggccgcaagcaaaaccaagcgcgagaugcagcuag

SEQ ID NO: 220218 - RNA, 64 nt, Homo Sapiens
uuguauuuuuauguccaaacuuuuccauuuuagauuccuuuauagacacgucagccuaaaaauc

SEQ ID NO: 220219 - RNA, 64 nt, Homo Sapiens
auuccauuauuauauuuugcgcuuggcauauuuauuccuuuaugcuuuuaaucacuaacauauu

SEQ ID NO: 220220 - RNA, 64 nt, Homo Sapiens
cacauugaagggacuucguugugcuugaagcuguuuccuuuacuaucacuuguaaaaauuguca

SEQ ID NO: 220221 - RNA, 64 nt, Homo Sapiens
cauguugaagggacuuuguugugcuugaaacuguuuccuuuacugucacucguaaaaacuguca

SEQ ID NO: 220222 - RNA, 64 nt, Homo Sapiens
aauaaagagaucucagcagcggccacuguuagguuuccuuuagagagggugugauaguaaggaa

SEQ ID NO: 220223 - RNA, 64 nt, Homo Sapiens
aguugagggagcagaggcccguugauccaacacuuuccuuuaaagaaaaaaacuuuagaguuca

SEQ ID NO: 220224 - RNA, 64 nt, Homo Sapiens
ugucucauaaaaugagacuuagaggugguuuuaauuccuuuagaggaguuuaagauauagcugu

SEQ ID NO: 220225 - RNA, 64 nt, Homo Sapiens
uaggcuuccaacaccaaauauuugagaaguucuuuuccuuuauacaacugcacgggacauuguu

SEQ ID NO: 220226 - RNA, 64 nt, Homo Sapiens
aaaaauauauauguauauauugcauauucacuuuuuccuuuagguagagaugauuucaauccaa

SEQ ID NO: 220227 - RNA, 64 nt, Homo Sapiens
aucaacugagccaaaugucugugugcaauuguguuuccuuuaccuuguaaaauuuuguacagca

SEQ ID NO: 220228 - RNA, 64 nt, Homo Sapiens
gaaugaacauguaauaauuuguuuaggucaauuuuuccuuuacuuuuuuaauuuaaaaauuguu

SEQ ID NO: 220229 - RNA, 64 nt, Homo Sapiens
caauaacuuaccuaguagagauuuagugaguuguuuccuuuaaagaauuuuacacuacauauuu

SEQ ID NO: 220230 - RNA, 64 nt, Homo Sapiens
cacuacauauuuuaauaguaaacagggaucacuuuuccuuuagcauucagaaugacaccauauu

SEQ ID NO: 220231 - RNA, 64 nt, Homo Sapiens
uucauacuugaagacggauauaaaggaagaauauuuccuuuauguguuucuccagaauggugcc

SEQ ID NO: 220232 - RNA, 64 nt, Homo Sapiens
uugauaguuuaaguguguucuuaccgccuccuuuuuccuuuaaucuuauuuuugaugaacacau

SEQ ID NO: 220233 - RNA, 64 nt, Homo Sapiens
uuaauuuuauaaacaaaacuguuaaucaucauuuuuccuuuaguagaugacccauuauguccua

SEQ ID NO: 220234 - RNA, 64 nt, Homo Sapiens
uucucaccguuugaaugcauccuuuuuuuuuuuuuuccuuuaugucuuuuucuuuuuucuuuuu

SEQ ID NO: 220235 - RNA, 64 nt, Homo Sapiens
uugauuugagaagaaaucuggcugguuugaggguuuccuuuaguucacccucauacucucagga

SEQ ID NO: 220236 - RNA, 64 nt, Homo Sapiens
uuuucuuauuagcacauuugagaaaaauauuccuuuccuuuauuguaguaaaucuauuaaaggc

SEQ ID NO: 220237 - RNA, 64 nt, Homo Sapiens
uagagaauaaacagccacacacacauuuuuuuuuuuccuuuaaaacaguaacuuggaaauauga

SEQ ID NO: 220238 - RNA, 64 nt, Homo Sapiens
auuuuuuuucuugaauuucgcuguuuucuucugcuuccuuuagauaaaaagcagcucaagagac

SEQ ID NO: 220239 - RNA, 64 nt, Homo Sapiens
cuaaaaaggucuuauacucaagagugggguagucuuccuuuaauuuuguuaccaauacgcuuua

SEQ ID NO: 220240 - RNA, 64 nt, Homo Sapiens
gguaaggaauuuaagaacuggaugagguuauuucuuccuuuacucuucaaaauguauuuuugau

SEQ ID NO: 220241 - RNA, 64 nt, Homo Sapiens
gauacuuuguucucaccacucaaucgauauuuguuuccuuuaggucagugagcuaggaaagcac

SEQ ID NO: 220242 - RNA, 64 nt, Homo Sapiens
ucaaugauucucagaaggcccuuuuccguaauauuuccuuuauuacauuuuuggaaacuaaucu

SEQ ID NO: 220243 - RNA, 64 nt, Homo Sapiens
agccacuuaacuuccauacaucauagaucuuggcuuccuuuagacuguugagcugguuuuugag

SEQ ID NO: 220244 - RNA, 64 nt, Homo Sapiens
uugucccuggaagcauugcucuucuuacaaugcauuccuuuaacacuucuauggcuuccagggu

SEQ ID NO: 220245 - RNA, 64 nt, Homo Sapiens
gauagugaaacagcuuucuggguaauucaccaauuuccuuuaaaacauaagcuaccugaaugga

SEQ ID NO: 220246 - RNA, 64 nt, Homo Sapiens
agggaggaccuguuguguuccagccauucugguauuccuuuauguaucuaauuucauucaaacc

SEQ ID NO: 220247 - RNA, 64 nt, Homo Sapiens
uuuuuuuuaguuuuaaaccaccaaaccaauauuuuuccuuuaaauuuuaaucuuauaauauaga

SEQ ID NO: 220248 - RNA, 64 nt, Homo Sapiens
aaccaaacaaacccaggccugaugggaaaaaugauuccuuuauucuagcaacuuacuuucuguu

SEQ ID NO: 220249 - RNA, 64 nt, Homo Sapiens
acugaaagcuaggcguccucaccagggaaaucacuuccuuuaggggcaaaaucaccuucccuuu

SEQ ID NO: 220250 - RNA, 64 nt, Homo Sapiens
cuccagccuuggcaaaaucaaagacaguuccaucuuccuuuagaggucugcuggagacgccuga

SEQ ID NO: 220251 - RNA, 64 nt, Homo Sapiens
ggacaggaccaucuuuaugaguguuuuaaaagauuuccuuuaucaguuauuuuagcuuuugaaa

SEQ ID NO: 220252 - RNA, 64 nt, Homo Sapiens
auuucauguuaaucugguuuuauaaaaaagcuuuuuccuuuacacaaaaagccauaauaauaag

SEQ ID NO: 220253 - RNA, 64 nt, Homo Sapiens
uuugaacaaauaaauaaaagcuuucuguaguugcuuccuuuaucagaaaagaacauuugauacc

SEQ ID NO: 220254 - RNA, 64 nt, Homo Sapiens
uacuggugaacagugguuaauaaauaguuuuauauuccuuuaugcaauuauuagacuuuuuucu

SEQ ID NO: 220255 - RNA, 64 nt, Homo Sapiens
uucugggagaugucauuuuccaucucccgauuacuuccuuuacgucuagcaguaugugccgaga

SEQ ID NO: 220256 - RNA, 64 nt, Homo Sapiens
uguguagcacacacucaucauggauugcucagaguuccuuuagggcagagcugagggccuggga

SEQ ID NO: 220257 - RNA, 64 nt, Homo Sapiens
ggucaaaauauucagaugagacauuuggcaugucuuccuuuauucacugauauuuucuacccau

SEQ ID NO: 220258 - RNA, 64 nt, Homo Sapiens
aauaucagugaaauauuuugagaucuuugaauaauuccuuuagaggaauuauacaaaauuaaua

SEQ ID NO: 220259 - RNA, 64 nt, Homo Sapiens
agagaaauguuugccuuauguauauucccuuuauuuccuuuaccuuuuguuuuuccuuggaccu

SEQ ID NO: 220260 - RNA, 64 nt, Homo Sapiens
uaacaaagaggaaugagccaggagaacaaacuaauuccuuuaaauaaauaaaaaaaaaaaaugc

SEQ ID NO: 220261 - RNA, 64 nt, Homo Sapiens
gcacuggucauauuguauugcucagaaucuggccuuccuuuauaaugacaauccccuuugauuc

SEQ ID NO: 220262 - RNA, 64 nt, Homo Sapiens
aacuuagggcagauauaaaauaugaguaucuuuauuccuuuauuauucacuugaaacuugucca

SEQ ID NO: 220263 - RNA, 64 nt, Homo Sapiens
guuuaaaaaaaaaaucuaaacucuccuuccucccuuccuuuacauuuucccacuuuccuucugu

SEQ ID NO: 220264 - RNA, 64 nt, Homo Sapiens
acaaaucaguauuaaaacuuuccuaguugaugccuuccuuuauuucuaagcauucuuuuuuuuu

SEQ ID NO: 220265 - RNA, 64 nt, Homo Sapiens
ucacaugaccccagcaacuggucaauuggauauauuccuuuaccauagucauguugggcuaaca

SEQ ID NO: 220266 - RNA, 64 nt, Homo Sapiens
ugacaaggacacuccugaggcugucucuggucucuuccuuuagcugcccaugugucaggagugg

SEQ ID NO: 220267 - RNA, 64 nt, Homo Sapiens
uuuuguauuucgauggccagagagaauguugugcuuccuuuagcggugcaaggcagggaggcag

SEQ ID NO: 220268 - RNA, 64 nt, Homo Sapiens
ucugugucucuguguguauagcccagaugauacuuuccuuuaaagauaccauucaccgccuuca

SEQ ID NO: 220269 - RNA, 64 nt, Homo Sapiens
aguuaacucugcugccaucuuguuuuuuuuuuuuuuccuuuauuuugauaagugauuauuaugc

SEQ ID NO: 220270 - RNA, 64 nt, Homo Sapiens
auaguauugucugacuuuuuauuuucuacuaugguuccuuuagcagaaaaguaacuuuugugca

SEQ ID NO: 220271 - RNA, 64 nt, Homo Sapiens
gugccuagugcuacucauuauauucccccuaucauuccuuuacaauuccuuuauuuuuauaaau

SEQ ID NO: 220272 - RNA, 64 nt, Homo Sapiens
uuuauaaauuauucccccuacaggauccaugucauuccuuuauuaguuguaagcuccuugagag

SEQ ID NO: 220273 - RNA, 64 nt, Homo Sapiens
uggccuuucuuucuuucuguuccguaaugccuucuuccuuuauucaugcuuccagugauuuguc

SEQ ID NO: 220274 - RNA, 64 nt, Homo Sapiens
aucaaauacuucuucauaaucaccagaugauuucuuccuuuaccuuauuccauuuucuucuggu

SEQ ID NO: 220275 - RNA, 64 nt, Homo Sapiens
gagguucggacuaacauuucacauacgcaaaaacuuccuuuacaauguguauuaaugucuaacu

SEQ ID NO: 220276 - RNA, 64 nt, Homo Sapiens
aagauuuuuauaucuaacuuauccacccucauuuuuccuuuagcuuucacuuuuuucuucugcc

SEQ ID NO: 220277 - RNA, 64 nt, Homo Sapiens
aggaacuguuauaauuuauugguagcagccacacuuccuuuagaucaaaauaaguguaauccac

SEQ ID NO: 220278 - RNA, 64 nt, Homo Sapiens
acaacuuuaccaggguuuuggcauuuccuuuccuuuccuuuauaaaacaugcucagcaaacugc

SEQ ID NO: 220279 - RNA, 64 nt, Homo Sapiens
uacacagcaauaauuacaguaaauuaaauaaagauuccuuuaaggcagacaagggcuaagauuu

SEQ ID NO: 220280 - RNA, 64 nt, Homo Sapiens
uugugguuuacacgguugucgaaauauauucuacuuccuuuauugcacugcuuuauaauaaaau

SEQ ID NO: 220281 - RNA, 64 nt, Homo Sapiens
gcugaccacauuguacccauuguacauguauuaguuccuuuacuccaggcuuugugcugagugc

SEQ ID NO: 220282 - RNA, 64 nt, Homo Sapiens
aaaaguaugauugacagaaaacaggagagaggccuuccuuuaacaaagucuugucggagucugc

SEQ ID NO: 220283 - RNA, 64 nt, Homo Sapiens
acuagaagcuucaaagaaucaugauugugaaaaguuccuuuaaaccguugggaaguccaugcug

SEQ ID NO: 220284 - RNA, 64 nt, Homo Sapiens
aaugaaauuugccuugucuuauuccacuaguuuauuccuuuaacaacaauauuuuauguguguc

SEQ ID NO: 220285 - RNA, 64 nt, Homo Sapiens
auuuuugcagccugggaucucccuacuccauuuuuuccuuuaauuuaaguggccacauguauau

SEQ ID NO: 220286 - RNA, 64 nt, Homo Sapiens
ucaguauuuaccaaaguguaucugauuuuaaaaauuccuuuagucuguaaaacuccuagaggga

SEQ ID NO: 220287 - RNA, 64 nt, Homo Sapiens
ugcuuuucggcuccuagaauccuuagagucugaauuccuuuagcugggaacagcugucaugguc

SEQ ID NO: 220288 - RNA, 64 nt, Homo Sapiens
auaugaccaucuguugcucaacaauacuguuuuuuuccuuuaguaguuuaccauaagggaauuu

SEQ ID NO: 220289 - RNA, 64 nt, Homo Sapiens
guuuuuuuccuuuaguaguuuaccauaagggaauuuccuuuaagucaaccaugauuucuccuug

SEQ ID NO: 220290 - RNA, 64 nt, Homo Sapiens
aaaaaccacagggaccaagauuuuuguuguuuguuuccuuuaagauuuggagcagaguuguuug

SEQ ID NO: 220291 - RNA, 64 nt, Homo Sapiens
uccuguacaucauucucugccaauuauauucuaguuccuuuaugcaccauauaauagaaauacc

SEQ ID NO: 220292 - RNA, 64 nt, Homo Sapiens
caagcaauccaugaucuauacacauaagcauaauuuccuuuaguucuaguuagucaucagagaa

SEQ ID NO: 220293 - RNA, 64 nt, Homo Sapiens
cagauauaagacuuuccccaacaaugugauuggauuccuuuauggcaaaaucgagagaagcugc

SEQ ID NO: 220294 - RNA, 64 nt, Homo Sapiens
uaaaguaaacaagugaccagcagcccacagaugauuccuuuauauagauguauaaugauucaaa

SEQ ID NO: 220295 - RNA, 64 nt, Homo Sapiens
cucuguaccugcagcucugcucucgggauggugcuuccuuuaucuugaaggguggcacauguuu

SEQ ID NO: 220296 - RNA, 64 nt, Homo Sapiens
ugacgcuggaccuuuucuuuugucuugcauuuuuuuccuuuauguuacaugaagauuugguuuu

SEQ ID NO: 220297 - RNA, 64 nt, Homo Sapiens
auucuuucuuuuuccuucaugcguuauuuucuuuuuccuuuauaagcuucaccacuuguccauu

SEQ ID NO: 220298 - RNA, 64 nt, Homo Sapiens
ccuuuuacuuuucagugucuucugagaaaccaccaggcuugaagguaaugaaacugucauuuau

SEQ ID NO: 220299 - RNA, 64 nt, Homo Sapiens
ccuuuuacuuuucagugucuucugagaaaccaccaggcuugaagguaaugaaacugucguuuau

SEQ ID NO: 220300 - RNA, 64 nt, Homo Sapiens
uaaugcauuuguaaagggucaaagaauuguugugaggcuugagaucacuuucuaugucuaccuc

SEQ ID NO: 220301 - RNA, 64 nt, Homo Sapiens
uuuuccaaauggauccuguucugccacauucuaaaggcuugauagcguaguccgcuuucucuug

SEQ ID NO: 220302 - RNA, 64 nt, Homo Sapiens
ggugcuuggggccaggcuacgcaccgcugcccucaggcuugaggggugggcccucaguggugaa

SEQ ID NO: 220303 - RNA, 64 nt, Homo Sapiens
caccaggccugacuuugucucccccucucaacaaaggcuugaugguacauaaaccucagacucu

SEQ ID NO: 220304 - RNA, 64 nt, Homo Sapiens
aucguuuguuagaguuauagauuuaugauuucauaggcuugauucuaugugaaauaucuuuuua

SEQ ID NO: 220305 - RNA, 64 nt, Homo Sapiens
gaccuguuugcugaaguguucauaagauaacaauaggcuugaaucuccaauucaaaugaauguc

SEQ ID NO: 220306 - RNA, 64 nt, Homo Sapiens
caggguuauggauuuccuuguccugguucugaggaggcuugagacuucaggaucuuuaguauuu

SEQ ID NO: 220307 - RNA, 64 nt, Homo Sapiens
caggguuauggauuuccagagaaccaaugugaggaggcuugagaaguguuuuguuaggugguau

SEQ ID NO: 220308 - RNA, 64 nt, Homo Sapiens
ggugcagaagcauacaucuuuauaaaaaauauggaggcuugaguuaugaaacacuuuuauaagg

SEQ ID NO: 220309 - RNA, 64 nt, Homo Sapiens
gaugugugacuuucacaguugucaccauggacuuaggcuugauuaaaaugcuacacauuuagag

SEQ ID NO: 220310 - RNA, 64 nt, Homo Sapiens; identical to SEQ ID NO: 216223

SEQ ID NO: 220311 - RNA, 64 nt, Homo Sapiens; identical to SEQ ID NO: 216224

SEQ ID NO: 220312 - RNA, 64 nt, Homo Sapiens; identical to SEQ ID NO: 216225

SEQ ID NO: 220313 - RNA, 64 nt, Homo Sapiens; identical to SEQ ID NO: 216226

SEQ ID NO: 220314 - RNA, 64 nt, Homo Sapiens; identical to SEQ ID NO: 216227

SEQ ID NO: 220315 - RNA, 64 nt, Homo Sapiens; identical to SEQ ID NO: 216228

SEQ ID NO: 220316 - RNA, 64 nt, Homo Sapiens; identical to SEQ ID NO: 216229

SEQ ID NO: 220317 - RNA, 64 nt, Homo Sapiens; identical to SEQ ID NO: 216230

SEQ ID NO: 220318 - RNA, 64 nt, Homo Sapiens; identical to SEQ ID NO: 216231

SEQ ID NO: 220319 - RNA, 64 nt, Homo Sapiens; identical to SEQ ID NO: 216232

SEQ ID NO: 220320 - RNA, 64 nt, Homo Sapiens; identical to SEQ ID NO: 216233

SEQ ID NO: 220321 - RNA, 64 nt, Homo Sapiens; identical to SEQ ID NO: 216234

SEQ ID NO: 220322 - RNA, 64 nt, Homo Sapiens
uuuacaucaaaaagcuuuuagaaaaugguacgagguaaccaauucuugucauggugaaaucuga

SEQ ID NO: 220323 - RNA, 64 nt, Homo Sapiens
guaaccaauucuugucauggugaaaucugauugaguaaccaagcaguuuuacuauucuggugcu

SEQ ID NO: 220324 - RNA, 64 nt, Homo Sapiens
gguguuggaugucaaugaugauuuuucugaggaaguaaccaaacaagaagaccucaugagagag

SEQ ID NO: 220325 - RNA, 64 nt, Homo Sapiens
ccuucccacagguaaacaccuuuguaaagaaucuguaaccaauaccaugaaguucaggcuguga

SEQ ID NO: 220326 - RNA, 64 nt, Homo Sapiens
acgacuucuuccucgacaucuuccuccucuacugguaaccaaggcaaucaggccuaccagaauc

SEQ ID NO: 220327 - RNA, 64 nt, Homo Sapiens
guaccaaagcuguuuuuauagcacauagaugucuguaaccaauaauguagcaguucugcacuuu

SEQ ID NO: 220328 - RNA, 64 nt, Homo Sapiens
cagagaagagaugaagagggaugcuucaugcccuguuccccacaacuagaagugcgcaugaagg

SEQ ID NO: 220329 - RNA, 64 nt, Homo Sapiens
gggcaggaaguaggcucccccgccuccagcagccguuccccaggaccaccgccaccgagagccc

SEQ ID NO: 220330 - RNA, 64 nt, Homo Sapiens
caggaccuuuuuaaagcuccccaagugauucuacguuccccaaguuugaggaccacuuuucugu

SEQ ID NO: 220331 - RNA, 64 nt, Homo Sapiens
acccgcccugagauuugguaaagaacacugccuuguuccccaucaguaaacaagguuaccuacc

SEQ ID NO: 220332 - RNA, 64 nt, Homo Sapiens
agacuuuguccuguagccuccacuucugcccuaaguuccccagcauccugacuaccugucugca

SEQ ID NO: 220333 - RNA, 64 nt, Homo Sapiens
acauucucucucucucucucucucugucuaucuaguuccccagcuuggagagccuuuccccuug

SEQ ID NO: 220334 - RNA, 64 nt, Homo Sapiens
caccuguuggcacgugacagagggcggcgccuggguuccccaggcugaggccaacuuauggcag

SEQ ID NO: 220335 - RNA, 64 nt, Homo Sapiens
aguagagggcucugggugcccccacucuucccuuguuccccagauggugcagggccccuccacg

SEQ ID NO: 220336 - RNA, 64 nt, Homo Sapiens
gccccggggcggcauuuuacucucauuccuuucuguuccccaguuuggcuucugccuguugggg

SEQ ID NO: 220337 - RNA, 64 nt, Homo Sapiens
gccuguguucgcaggagccaggcagucacugccuguuccccacugaggaggaacggugggggug

SEQ ID NO: 220338 - RNA, 64 nt, Homo Sapiens
acgagagccuccugucugcaccuugcuugccacuguuccccauggcauccuguccuccagccac

SEQ ID NO: 220339 - RNA, 64 nt, Homo Sapiens
gcccugugccuuccggcccccccuccaaacacugguuccccacuucuguagauagcagaggaca

SEQ ID NO: 220340 - RNA, 64 nt, Homo Sapiens
gcuguuugaacuguugaguuucuuuaacugacauguuccccagugagcuggucagcguuucguc

SEQ ID NO: 220341 - RNA, 64 nt, Homo Sapiens
acagugguccaucaucgugcugaugccgcacuguguuccccaugcgaugccagucugugugccg

SEQ ID NO: 220342 - RNA, 64 nt, Homo Sapiens
ggcacuugggguuucugggaaugacaucaucucuguuccccauccccaguaguuuacauuccug

SEQ ID NO: 220343 - RNA, 64 nt, Homo Sapiens
gggucacagcaacaugcccuggccuuucugcucuguuccccaaccccacugaggccugcugcac

SEQ ID NO: 220344 - RNA, 64 nt, Homo Sapiens
agguuguggccuuugcgcuccuggcccagccuuuguuccccacuggagcagaaggggagaugga

SEQ ID NO: 220345 - RNA, 64 nt, Homo Sapiens
cucuuccuggcccgcacccccauccccagucccuguuccccaagaggauacagagcacggugcu

SEQ ID NO: 220346 - RNA, 64 nt, Homo Sapiens
gacagaguuagggaaagaguagugaggggagaagguuccccaggcgggagggaacuccagggga

SEQ ID NO: 220347 - RNA, 64 nt, Homo Sapiens
ccacaguaucagcaagauaaacacuggcucagcaguuccccagggccaaaggaaccugugcaag

SEQ ID NO: 220348 - RNA, 64 nt, Homo Sapiens
guauaagaauaacaaucugcuagucugucauuucuggagugauacuuuuuuuuuugagacggag

SEQ ID NO: 220349 - RNA, 64 nt, Homo Sapiens
ugggauuauaggcgugagccaccgcgcccagcccuggagugauacuuuuuauggaagacaaaag

SEQ ID NO: 220350 - RNA, 64 nt, Homo Sapiens
auucccugcaccucgaggccgcugcgggccaaucuggagugaaacacggggaccugaaggaugg

SEQ ID NO: 220351 - RNA, 64 nt, Homo Sapiens
gcuccgccucaucagcuaugugaagggguguguguggagugauccugccgcccccucccugggc

SEQ ID NO: 220352 - RNA, 64 nt, Homo Sapiens
gcccccagauguuccugggcuggguaaaagcagcuggagugaagcacucauuuuccauaaaggu

SEQ ID NO: 220353 - RNA, 64 nt, Homo Sapiens
gaguuggaagugauuucagcacauucuuuuuuaguggagugaaaguucugaagcccccuuuuaa

SEQ ID NO: 220354 - RNA, 64 nt, Homo Sapiens
agggugaagacugaggcuaggugccagaauggacuggagugaaggcgugucuagagugugggcu

SEQ ID NO: 220355 - RNA, 64 nt, Homo Sapiens
cucaggagguccaggccucuaaggcuucucucccuggagugaggguggaggugagggagagcug

SEQ ID NO: 220356 - RNA, 64 nt, Homo Sapiens
uuucuccuggaaacuccagguaaaaaccuucaaaggugauuauuuugacuaauuucacaugcuc

SEQ ID NO: 220357 - RNA, 64 nt, Homo Sapiens
cagagauaucuaugaaaacccuuagcacugcccuggugauuaccuugguucagggugauaacua

SEQ ID NO: 220358 - RNA, 64 nt, Homo Sapiens
uguuucauuaaauaauagggaaauauccauuuaaaacagguauaucaguggaaacacagaguua

SEQ ID NO: 220359 - RNA, 64 nt, Homo Sapiens
auucacuuuugacuuuauaugacaguugaucaagaacagguacuaccccuuuuuuucauuucaa

SEQ ID NO: 220360 - RNA, 64 nt, Homo Sapiens
acagacagagaugugcugauuuuguuuuagcuguaacagguaaugguuuuuggauagaugauug

SEQ ID NO: 220361 - RNA, 64 nt, Homo Sapiens
cugggcucaugacuuguaaauggaagcugaugugaacagguaauuaauauuaugacccacuucu

SEQ ID NO: 220362 - RNA, 64 nt, Homo Sapiens
gaugaggagccagggcuaagggggcagccuucucucuucccagugaugcacauccuucacauug

SEQ ID NO: 220363 - RNA, 64 nt, Homo Sapiens
cauucugucucagcaccauccagccuggcacuucucuucccauauauccauuggauuuuuuuuu

SEQ ID NO: 220364 - RNA, 64 nt, Homo Sapiens
cauuugacuucucuacucggugucucagacagugucuucccagaaaaccaccacccucuaccca

SEQ ID NO: 220365 - RNA, 64 nt, Homo Sapiens
cuucuuauaacuuuauccugcuauaacuuuauccucuucccagccucaucccuguuuuucuguu

SEQ ID NO: 220366 - RNA, 64 nt, Homo Sapiens
ucaaaagguaauguugccugggggagcacuuaauucuucccauuuuuugcuuuauaguuuggcu

SEQ ID NO: 220367 - RNA, 64 nt, Homo Sapiens
gaucugaggucauggaacuucacggcucuuaaguucuucccaauuguuccaaccccauaaaucu

SEQ ID NO: 220368 - RNA, 64 nt, Homo Sapiens
acgugugcuuuuucaagggagcugauaaagaacuucuucccaaaauggccgaagcuggacugua

SEQ ID NO: 220369 - RNA, 64 nt, Homo Sapiens
cggccgccaucccaucuaggaagugaggagcgccucuucccacccgccaucccaucuaggaagu

SEQ ID NO: 220370 - RNA, 64 nt, Homo Sapiens
auuauaaauuguguauuuaaacacugaaaugaaaucuucccagucaggaauaauguuuugggaa

SEQ ID NO: 220371 - RNA, 64 nt, Homo Sapiens
aauuauuacaauucuugaauuacagaaaccacagucuucccagcacugugaagccacccugggc

SEQ ID NO: 220372 - RNA, 64 nt, Homo Sapiens
uuuuuuuuccuauuuauuugaaaaaaauuuuagcucuucccacuacuuuuaauuuaaaaacaca

SEQ ID NO: 220373 - RNA, 64 nt, Homo Sapiens
aucaaaaguggagagucgaauagaagaacaaugaucuucccauauucaagggccuuccaaguug

SEQ ID NO: 220374 - RNA, 64 nt, Homo Sapiens
cacauccauuuuguggaagagcaucuuagguauuucuucccagucaacagggcauuggguacuu

SEQ ID NO: 220375 - RNA, 64 nt, Homo Sapiens
uucucuguucugguguuggauuucagagcaauuaucuucccaaaacacagggaggccaguucug

SEQ ID NO: 220376 - RNA, 64 nt, Homo Sapiens
ccugcagggccagaaguucaagacaaaagcgauuucuucccacuggaaggcucaguugucggaa

SEQ ID NO: 220377 - RNA, 64 nt, Homo Sapiens
auaugagugagaauauugguuuaggacacuagguucuucccagcaccaucucuacucuuuuugg

SEQ ID NO: 220378 - RNA, 64 nt, Homo Sapiens
aagugauauaaccuacuuggugaagagaacucucucuucccacucugagaaucugcaaagucuc

SEQ ID NO: 220379 - RNA, 64 nt, Homo Sapiens
uucauaggaaacagacuaugauuaauccauuuauucuucccacacacuuaccuuacuaagucuu

SEQ ID NO: 220380 - RNA, 64 nt, Homo Sapiens
ccucugccguaaauccuggggcaagggaucagccucuucccaggaaccaucgccuucuauaaac

SEQ ID NO: 220381 - RNA, 64 nt, Homo Sapiens
cagcucuaacagcccuuucacccaaggcacgccuucuucccaggugacggcaucuucccaguuc

SEQ ID NO: 220382 - RNA, 64 nt, Homo Sapiens
uccccaaggcacgccuucuuccacacugacggcaucuucccagucuggcuguccuccugcccac

SEQ ID NO: 220383 - RNA, 64 nt, Homo Sapiens
uggcugguuccagggcucgucccggcauuucaugucuucccacgggguugagucgggccauagg

SEQ ID NO: 220384 - RNA, 64 nt, Homo Sapiens
cugggacuugcggugucucggcauaccccucuccucuucccaccuccuccuggcuauguucugc

SEQ ID NO: 220385 - RNA, 64 nt, Homo Sapiens
cccggacccgcagggccugccugguuccuggaagucuucccagucuucccagccagcccgggcc

SEQ ID NO: 220386 - RNA, 64 nt, Homo Sapiens
gcagggccugccugguuccuggaagucuucccagucuucccagccagcccgggcccuggggagc

SEQ ID NO: 220387 - RNA, 64 nt, Homo Sapiens
uccaaaaauccagagacauuguuacuuggccauuucuucccaucgaguugggaaugaggaugcu

SEQ ID NO: 220388 - RNA, 64 nt, Homo Sapiens
acaguguucugggcagccagggugaugucagaauucuucccagcccaaucaagugcagcacaug

SEQ ID NO: 220389 - RNA, 64 nt, Homo Sapiens
gagguccuaggauuugcacauuuuuuccuggaguucuucccauuccugagaaagacuugucauu

SEQ ID NO: 220390 - RNA, 64 nt, Homo Sapiens
cucugugccaggugccagacagugaagacuccccucuucccaucccacaacugaaccagaagag

SEQ ID NO: 220391 - RNA, 64 nt, Homo Sapiens
ggucucuuaucuucagugagaaggugacccgccuucuucccaugguggcugccuaaagugcuuc

SEQ ID NO: 220392 - RNA, 64 nt, Homo Sapiens
uuugugugucaucguacuggaguagagggccgacucuucccaugaaggugagcacagcugugag

SEQ ID NO: 220393 - RNA, 64 nt, Homo Sapiens
uucuagagauuugccucuaucuuccuuuccucagucuucccagacugcuaucaagcuguguaaa

SEQ ID NO: 220394 - RNA, 64 nt, Homo Sapiens
aauuguucuuuauuuuacaggcaguuacugaggcucuucccagaucucaguaaacagccacuca

SEQ ID NO: 220395 - RNA, 64 nt, Homo Sapiens
ggccuccugccugccuucucuuuguuucuguuccucuucccaucuacuccccuacgccccuuca

SEQ ID NO: 220396 - RNA, 64 nt, Homo Sapiens
cacccagcuggucuccccaggcaagaagguauccucuucccaagguguacccacugaauguugu

SEQ ID NO: 220397 - RNA, 64 nt, Homo Sapiens
uagggaaacugaggcagagauguuguccagaaaaucuucccagaaaaaaaaauauaguauuuuc

SEQ ID NO: 220398 - RNA, 64 nt, Homo Sapiens
cucagcugccuguauucauguuauuugccuuccgucuucccaacgggccugucugcugugcuau

SEQ ID NO: 220399 - RNA, 64 nt, Homo Sapiens
uuccaauccauccccagccuaucccaguaacuccucuucccauuccacccuccagcuuucucuu

SEQ ID NO: 220400 - RNA, 64 nt, Homo Sapiens
uugcuugccugauaaaacagaccuucuuccuaccucuucccauaguuaguucucucucucuacc

SEQ ID NO: 220401 - RNA, 64 nt, Homo Sapiens
aaaauagacaguaaggauuuaucuguucaguuuuucuucccagugaauuaauuucagcuuauau

SEQ ID NO: 220402 - RNA, 64 nt, Homo Sapiens
cugucauagccucugcguuugaccuuaaaauagcucuucccaguaagauugugcaauuuuuauu

SEQ ID NO: 220403 - RNA, 64 nt, Homo Sapiens
uaagaagaacuaguuccucuuuugugcuuaggaaucuucccaggucagccccuaagaaaccuaa

SEQ ID NO: 220404 - RNA, 64 nt, Homo Sapiens
acagaggacagagugacaggaggacccuucugcaucuucccaugggagggcccagagcccagug

SEQ ID NO: 220405 - RNA, 64 nt, Homo Sapiens
aagcccuuaaaaaaauaaaaccucugaaccaaaaucuucccaggaauaguacuuaauagauuuu

SEQ ID NO: 220406 - RNA, 64 nt, Homo Sapiens
cuguccuuuacucuuugauaguaucccucuauuuucuucccaauucucuaaaugcuuuaucauu

SEQ ID NO: 220407 - RNA, 64 nt, Homo Sapiens
cacuuuuuuuuuucucacugauucaacaacagcuucuucccaguuauauuaacaagcaaagucg

SEQ ID NO: 220408 - RNA, 64 nt, Homo Sapiens
gaccaggucccuugacguucucagcaaacgcagcucuucccaagcacccucuuuaacccauccc

SEQ ID NO: 220409 - RNA, 64 nt, Homo Sapiens
accagaaacaucuuuucaggaacccuacuuuucuucuucccaucgcauauggcagcaacaagag

SEQ ID NO: 220410 - RNA, 64 nt, Homo Sapiens
caaaagcaacaucugguugaagaauaugacaccaucuucccaggggcacugaugacucugcaac

SEQ ID NO: 220411 - RNA, 64 nt, Homo Sapiens
guuccaauguccaccccacccccagguacccgccucuucccacagaagcaauuuuagaauuuug

SEQ ID NO: 220412 - RNA, 64 nt, Homo Sapiens
cuucgacuauucuucccuguccugccuugcuaauucuucccacuagcacuaaucucgacucuuu

SEQ ID NO: 220413 - RNA, 64 nt, Homo Sapiens
cccaauauucuguagagagggagucaggaugcugucuucccacgaauaguacucaguaacaaac

SEQ ID NO: 220414 - RNA, 64 nt, Homo Sapiens
auuuguguucagucugaauuaugggaaaguuagcucuucccagaccuaagcugccuucucuccc

SEQ ID NO: 220415 - RNA, 64 nt, Homo Sapiens
caccaagugcacaccuugcauucugugcaaggcuucuucccauucuguccuugacccacuggug

SEQ ID NO: 220416 - RNA, 64 nt, Homo Sapiens
uccccauccccccuucccuuaaaaugugauuccuucuucccaacaccccuagugggcaguuugc

SEQ ID NO: 220417 - RNA, 64 nt, Homo Sapiens
aacucucucugcccccaaaaggcccuuucaccccucuucccacccuugcauaagccucaggccu

SEQ ID NO: 220418 - RNA, 64 nt, Homo Sapiens
gcaagcaccugggugugcucuuacugguugguguucuucccaaacuggugcccacccuucgcag

SEQ ID NO: 220419 - RNA, 64 nt, Homo Sapiens
uuaauuaacugguaaccucaaaauucguggccugucuucccauucaccccgcuuuugacuauug

SEQ ID NO: 220420 - RNA, 64 nt, Homo Sapiens
acugggagcacgggcugacggcugcuggugccuuucuucccaccucgcuugccuguuuccgcuu

SEQ ID NO: 220421 - RNA, 64 nt, Homo Sapiens
cccucaauucugcucccugaacuucacacauaaaucuucccaaguggguuuuaggguguauaga

SEQ ID NO: 220422 - RNA, 64 nt, Homo Sapiens
uauugcauugcgcagaacgcuacagagcccaugcucuucccagagcagcacccacaaaagcaag

SEQ ID NO: 220423 - RNA, 64 nt, Homo Sapiens
ucccugaacauaguuuucacccaagagcuguccuggugaccaaaaaagauuacuaggguuuugc

SEQ ID NO: 220424 - RNA, 64 nt, Homo Sapiens
cauuaaaaucuugaaagcgaaauacuugaaaagaggugaccauaaagaucacaccaauuuagaa

SEQ ID NO: 220425 - RNA, 64 nt, Homo Sapiens; identical to SEQ ID NO: 44100

SEQ ID NO: 220426 - RNA, 64 nt, Homo Sapiens; identical to SEQ ID NO: 44101

SEQ ID NO: 220427 - RNA, 64 nt, Homo Sapiens; identical to SEQ ID NO: 44102

SEQ ID NO: 220428 - RNA, 64 nt, Homo Sapiens; identical to SEQ ID NO: 44103

SEQ ID NO: 220429 - RNA, 64 nt, Homo Sapiens; identical to SEQ ID NO: 44104

SEQ ID NO: 220430 - RNA, 64 nt, Homo Sapiens; identical to SEQ ID NO: 44105

SEQ ID NO: 220431 - RNA, 64 nt, Homo Sapiens; identical to SEQ ID NO: 44106

SEQ ID NO: 220432 - RNA, 64 nt, Homo Sapiens; identical to SEQ ID NO: 44107

SEQ ID NO: 220433 - RNA, 64 nt, Homo Sapiens; identical to SEQ ID NO: 44108

SEQ ID NO: 220434 - RNA, 64 nt, Homo Sapiens; identical to SEQ ID NO: 44109

SEQ ID NO: 220435 - RNA, 64 nt, Homo Sapiens; identical to SEQ ID NO: 44110

SEQ ID NO: 220436 - RNA, 64 nt, Homo Sapiens; identical to SEQ ID NO: 44111

SEQ ID NO: 220437 - RNA, 64 nt, Homo Sapiens; identical to SEQ ID NO: 44112

SEQ ID NO: 220438 - RNA, 64 nt, Homo Sapiens; identical to SEQ ID NO: 44113

SEQ ID NO: 220439 - RNA, 64 nt, Homo Sapiens; identical to SEQ ID NO: 44114

SEQ ID NO: 220440 - RNA, 64 nt, Homo Sapiens; identical to SEQ ID NO: 44115

SEQ ID NO: 220441 - RNA, 64 nt, Homo Sapiens; identical to SEQ ID NO: 44116

SEQ ID NO: 220442 - RNA, 64 nt, Homo Sapiens; identical to SEQ ID NO: 44117

SEQ ID NO: 220443 - RNA, 64 nt, Homo Sapiens; identical to SEQ ID NO: 44118

SEQ ID NO: 220444 - RNA, 64 nt, Homo Sapiens; identical to SEQ ID NO: 44119

SEQ ID NO: 220445 - RNA, 64 nt, Homo Sapiens; identical to SEQ ID NO: 44120

SEQ ID NO: 220446 - RNA, 64 nt, Homo Sapiens; identical to SEQ ID NO: 44121

SEQ ID NO: 220447 - RNA, 64 nt, Homo Sapiens; identical to SEQ ID NO: 44122

SEQ ID NO: 220448 - RNA, 64 nt, Homo Sapiens; identical to SEQ ID NO: 44123

SEQ ID NO: 220449 - RNA, 64 nt, Homo Sapiens; identical to SEQ ID NO: 44124

SEQ ID NO: 220450 - RNA, 64 nt, Homo Sapiens; identical to SEQ ID NO: 44125

SEQ ID NO: 220451 - RNA, 64 nt, Homo Sapiens; identical to SEQ ID NO: 44126

SEQ ID NO: 220452 - RNA, 64 nt, Homo Sapiens; identical to SEQ ID NO: 44127

SEQ ID NO: 220453 - RNA, 64 nt, Homo Sapiens; identical to SEQ ID NO: 44128

SEQ ID NO: 220454 - RNA, 64 nt, Homo Sapiens; identical to SEQ ID NO: 44129

SEQ ID NO: 220455 - RNA, 64 nt, Homo Sapiens; identical to SEQ ID NO: 44130

SEQ ID NO: 220456 - RNA, 64 nt, Homo Sapiens; identical to SEQ ID NO: 44131

SEQ ID NO: 220457 - RNA, 64 nt, Homo Sapiens; identical to SEQ ID NO: 44132

SEQ ID NO: 220458 - RNA, 64 nt, Homo Sapiens; identical to SEQ ID NO: 44133

SEQ ID NO: 220459 - RNA, 64 nt, Homo Sapiens; identical to SEQ ID NO: 44134

SEQ ID NO: 220460 - RNA, 64 nt, Homo Sapiens; identical to SEQ ID NO: 44135

SEQ ID NO: 220461 - RNA, 64 nt, Homo Sapiens; identical to SEQ ID NO: 44136

SEQ ID NO: 220462 - RNA, 64 nt, Homo Sapiens; identical to SEQ ID NO: 44137

SEQ ID NO: 220463 - RNA, 64 nt, Homo Sapiens; identical to SEQ ID NO: 44138

SEQ ID NO: 220464 - RNA, 64 nt, Homo Sapiens; identical to SEQ ID NO: 44139

SEQ ID NO: 220465 - RNA, 64 nt, Homo Sapiens; identical to SEQ ID NO: 44140

SEQ ID NO: 220466 - RNA, 64 nt, Homo Sapiens; identical to SEQ ID NO: 44141

SEQ ID NO: 220467 - RNA, 64 nt, Homo Sapiens; identical to SEQ ID NO: 44142

SEQ ID NO: 220468 - RNA, 64 nt, Homo Sapiens; identical to SEQ ID NO: 44143

SEQ ID NO: 220469 - RNA, 64 nt, Homo Sapiens; identical to SEQ ID NO: 44144

SEQ ID NO: 220470 - RNA, 64 nt, Homo Sapiens; identical to SEQ ID NO: 44145

SEQ ID NO: 220471 - RNA, 64 nt, Homo Sapiens; identical to SEQ ID NO: 44146

SEQ ID NO: 220472 - RNA, 64 nt, Homo Sapiens; identical to SEQ ID NO: 44147

SEQ ID NO: 220473 - RNA, 64 nt, Homo Sapiens; identical to SEQ ID NO: 44148

SEQ ID NO: 220474 - RNA, 64 nt, Homo Sapiens; identical to SEQ ID NO: 44149

SEQ ID NO: 220475 - RNA, 64 nt, Homo Sapiens; identical to SEQ ID NO: 44150

SEQ ID NO: 220476 - RNA, 64 nt, Homo Sapiens; identical to SEQ ID NO: 44151

SEQ ID NO: 220477 - RNA, 64 nt, Homo Sapiens; identical to SEQ ID NO: 44152

SEQ ID NO: 220478 - RNA, 64 nt, Homo Sapiens; identical to SEQ ID NO: 44153

SEQ ID NO: 220479 - RNA, 64 nt, Homo Sapiens; identical to SEQ ID NO: 44154

SEQ ID NO: 220480 - RNA, 64 nt, Homo Sapiens; identical to SEQ ID NO: 44155

SEQ ID NO: 220481 - RNA, 64 nt, Homo Sapiens; identical to SEQ ID NO: 44156

SEQ ID NO: 220482 - RNA, 64 nt, Homo Sapiens; identical to SEQ ID NO: 44157

SEQ ID NO: 220483 - RNA, 64 nt, Homo Sapiens; identical to SEQ ID NO: 44158

SEQ ID NO: 220484 - RNA, 64 nt, Homo Sapiens; identical to SEQ ID NO: 44159

SEQ ID NO: 220485 - RNA, 64 nt, Homo Sapiens; identical to SEQ ID NO: 44160

SEQ ID NO: 220486 - RNA, 64 nt, Homo Sapiens; identical to SEQ ID NO: 44161

SEQ ID NO: 220487 - RNA, 64 nt, Homo Sapiens; identical to SEQ ID NO: 44162

SEQ ID NO: 220488 - RNA, 64 nt, Homo Sapiens; identical to SEQ ID NO: 44163

SEQ ID NO: 220489 - RNA, 64 nt, Homo Sapiens; identical to SEQ ID NO: 44164

SEQ ID NO: 220490 - RNA, 64 nt, Homo Sapiens; identical to SEQ ID NO: 44165

SEQ ID NO: 220491 - RNA, 64 nt, Homo Sapiens; identical to SEQ ID NO: 44166

SEQ ID NO: 220492 - RNA, 64 nt, Homo Sapiens; identical to SEQ ID NO: 44167

SEQ ID NO: 220493 - RNA, 64 nt, Homo Sapiens; identical to SEQ ID NO: 44168

SEQ ID NO: 220494 - RNA, 64 nt, Homo Sapiens; identical to SEQ ID NO: 44169

SEQ ID NO: 220495 - RNA, 64 nt, Homo Sapiens; identical to SEQ ID NO: 44170

SEQ ID NO: 220496 - RNA, 64 nt, Homo Sapiens; identical to SEQ ID NO: 44171

SEQ ID NO: 220497 - RNA, 64 nt, Homo Sapiens; identical to SEQ ID NO: 44172

SEQ ID NO: 220498 - RNA, 64 nt, Homo Sapiens; identical to SEQ ID NO: 44173

SEQ ID NO: 220499 - RNA, 64 nt, Homo Sapiens; identical to SEQ ID NO: 44174

SEQ ID NO: 220500 - RNA, 64 nt, Homo Sapiens; identical to SEQ ID NO: 44175

SEQ ID NO: 220501 - RNA, 64 nt, Homo Sapiens; identical to SEQ ID NO: 44176

SEQ ID NO: 220502 - RNA, 64 nt, Homo Sapiens; identical to SEQ ID NO: 44177

SEQ ID NO: 220503 - RNA, 64 nt, Homo Sapiens; identical to SEQ ID NO: 44178

SEQ ID NO: 220504 - RNA, 64 nt, Homo Sapiens; identical to SEQ ID NO: 44179

SEQ ID NO: 220505 - RNA, 64 nt, Homo Sapiens; identical to SEQ ID NO: 44180

SEQ ID NO: 220506 - RNA, 64 nt, Homo Sapiens; identical to SEQ ID NO: 44181

SEQ ID NO: 220507 - RNA, 64 nt, Homo Sapiens; identical to SEQ ID NO: 44182

SEQ ID NO: 220508 - RNA, 64 nt, Homo Sapiens; identical to SEQ ID NO: 44183

SEQ ID NO: 220509 - RNA, 64 nt, Homo Sapiens; identical to SEQ ID NO: 44184

SEQ ID NO: 220510 - RNA, 64 nt, Homo Sapiens; identical to SEQ ID NO: 44185

SEQ ID NO: 220511 - RNA, 64 nt, Homo Sapiens; identical to SEQ ID NO: 44186

SEQ ID NO: 220512 - RNA, 64 nt, Homo Sapiens; identical to SEQ ID NO: 44187

SEQ ID NO: 220513 - RNA, 64 nt, Homo Sapiens; identical to SEQ ID NO: 44188

SEQ ID NO: 220514 - RNA, 64 nt, Homo Sapiens; identical to SEQ ID NO: 44189

SEQ ID NO: 220515 - RNA, 64 nt, Homo Sapiens; identical to SEQ ID NO: 44190

SEQ ID NO: 220516 - RNA, 64 nt, Homo Sapiens; identical to SEQ ID NO: 44191

SEQ ID NO: 220517 - RNA, 64 nt, Homo Sapiens; identical to SEQ ID NO: 44192

SEQ ID NO: 220518 - RNA, 64 nt, Homo Sapiens; identical to SEQ ID NO: 44193

SEQ ID NO: 220519 - RNA, 64 nt, Homo Sapiens; identical to SEQ ID NO: 44194

SEQ ID NO: 220520 - RNA, 64 nt, Homo Sapiens; identical to SEQ ID NO: 44195

SEQ ID NO: 220521 - RNA, 64 nt, Homo Sapiens; identical to SEQ ID NO: 44196

SEQ ID NO: 220522 - RNA, 64 nt, Homo Sapiens; identical to SEQ ID NO: 44197

SEQ ID NO: 220523 - RNA, 64 nt, Homo Sapiens; identical to SEQ ID NO: 44198

SEQ ID NO: 220524 - RNA, 64 nt, Homo Sapiens; identical to SEQ ID NO: 44199

SEQ ID NO: 220525 - RNA, 64 nt, Homo Sapiens; identical to SEQ ID NO: 44200

SEQ ID NO: 220526 - RNA, 64 nt, Homo Sapiens; identical to SEQ ID NO: 44201

SEQ ID NO: 220527 - RNA, 64 nt, Homo Sapiens; identical to SEQ ID NO: 44202

SEQ ID NO: 220528 - RNA, 64 nt, Homo Sapiens; identical to SEQ ID NO: 44203

SEQ ID NO: 220529 - RNA, 64 nt, Homo Sapiens; identical to SEQ ID NO: 44204

SEQ ID NO: 220530 - RNA, 64 nt, Homo Sapiens; identical to SEQ ID NO: 44205

SEQ ID NO: 220531 - RNA, 64 nt, Homo Sapiens; identical to SEQ ID NO: 44206

SEQ ID NO: 220532 - RNA, 64 nt, Homo Sapiens; identical to SEQ ID NO: 44207

SEQ ID NO: 220533 - RNA, 64 nt, Homo Sapiens; identical to SEQ ID NO: 44208

SEQ ID NO: 220534 - RNA, 64 nt, Homo Sapiens; identical to SEQ ID NO: 44209

SEQ ID NO: 220535 - RNA, 64 nt, Homo Sapiens; identical to SEQ ID NO: 44210

SEQ ID NO: 220536 - RNA, 64 nt, Homo Sapiens; identical to SEQ ID NO: 44211

SEQ ID NO: 220537 - RNA, 64 nt, Homo Sapiens; identical to SEQ ID NO: 44212

SEQ ID NO: 220538 - RNA, 64 nt, Homo Sapiens; identical to SEQ ID NO: 44213

SEQ ID NO: 220539 - RNA, 64 nt, Homo Sapiens; identical to SEQ ID NO: 44214

SEQ ID NO: 220540 - RNA, 64 nt, Homo Sapiens; identical to SEQ ID NO: 44215

SEQ ID NO: 220541 - RNA, 64 nt, Homo Sapiens; identical to SEQ ID NO: 44216

SEQ ID NO: 220542 - RNA, 64 nt, Homo Sapiens; identical to SEQ ID NO: 44217

SEQ ID NO: 220543 - RNA, 64 nt, Homo Sapiens; identical to SEQ ID NO: 44218

SEQ ID NO: 220544 - RNA, 64 nt, Homo Sapiens; identical to SEQ ID NO: 44219

SEQ ID NO: 220545 - RNA, 64 nt, Homo Sapiens; identical to SEQ ID NO: 44220

SEQ ID NO: 220546 - RNA, 64 nt, Homo Sapiens; identical to SEQ ID NO: 44221

SEQ ID NO: 220547 - RNA, 64 nt, Homo Sapiens; identical to SEQ ID NO: 44222

SEQ ID NO: 220548 - RNA, 64 nt, Homo Sapiens; identical to SEQ ID NO: 44223

SEQ ID NO: 220549 - RNA, 64 nt, Homo Sapiens; identical to SEQ ID NO: 44224

SEQ ID NO: 220550 - RNA, 64 nt, Homo Sapiens; identical to SEQ ID NO: 44225

SEQ ID NO: 220551 - RNA, 64 nt, Homo Sapiens; identical to SEQ ID NO: 44226

SEQ ID NO: 220552 - RNA, 64 nt, Homo Sapiens; identical to SEQ ID NO: 44227

SEQ ID NO: 220553 - RNA, 64 nt, Homo Sapiens; identical to SEQ ID NO: 44228

SEQ ID NO: 220554 - RNA, 64 nt, Homo Sapiens; identical to SEQ ID NO: 44229

SEQ ID NO: 220555 - RNA, 64 nt, Homo Sapiens; identical to SEQ ID NO: 44230

SEQ ID NO: 220556 - RNA, 64 nt, Homo Sapiens; identical to SEQ ID NO: 44231

SEQ ID NO: 220557 - RNA, 64 nt, Homo Sapiens; identical to SEQ ID NO: 44232

SEQ ID NO: 220558 - RNA, 64 nt, Homo Sapiens; identical to SEQ ID NO: 44233

SEQ ID NO: 220559 - RNA, 64 nt, Homo Sapiens; identical to SEQ ID NO: 44234

SEQ ID NO: 220560 - RNA, 64 nt, Homo Sapiens; identical to SEQ ID NO: 44235

SEQ ID NO: 220561 - RNA, 64 nt, Homo Sapiens; identical to SEQ ID NO: 44236

SEQ ID NO: 220562 - RNA, 64 nt, Homo Sapiens; identical to SEQ ID NO: 44237

SEQ ID NO: 220563 - RNA, 64 nt, Homo Sapiens; identical to SEQ ID NO: 44238

SEQ ID NO: 220564 - RNA, 64 nt, Homo Sapiens; identical to SEQ ID NO: 44239

SEQ ID NO: 220565 - RNA, 64 nt, Homo Sapiens; identical to SEQ ID NO: 44240

SEQ ID NO: 220566 - RNA, 64 nt, Homo Sapiens; identical to SEQ ID NO: 44241

SEQ ID NO: 220567 - RNA, 64 nt, Homo Sapiens; identical to SEQ ID NO: 44242

SEQ ID NO: 220568 - RNA, 64 nt, Homo Sapiens; identical to SEQ ID NO: 44243

SEQ ID NO: 220569 - RNA, 64 nt, Homo Sapiens; identical to SEQ ID NO: 44244

SEQ ID NO: 220570 - RNA, 64 nt, Homo Sapiens; identical to SEQ ID NO: 44245

SEQ ID NO: 220571 - RNA, 64 nt, Homo Sapiens; identical to SEQ ID NO: 44246

SEQ ID NO: 220572 - RNA, 64 nt, Homo Sapiens; identical to SEQ ID NO: 44247

SEQ ID NO: 220573 - RNA, 64 nt, Homo Sapiens; identical to SEQ ID NO: 44248

SEQ ID NO: 220574 - RNA, 64 nt, Homo Sapiens; identical to SEQ ID NO: 44249

SEQ ID NO: 220575 - RNA, 64 nt, Homo Sapiens; identical to SEQ ID NO: 44250

SEQ ID NO: 220576 - RNA, 64 nt, Homo Sapiens; identical to SEQ ID NO: 44251

SEQ ID NO: 220577 - RNA, 64 nt, Homo Sapiens; identical to SEQ ID NO: 44252

SEQ ID NO: 220578 - RNA, 64 nt, Homo Sapiens; identical to SEQ ID NO: 44253

SEQ ID NO: 220579 - RNA, 64 nt, Homo Sapiens
uaagagacaaguccuuacuauauugcccugucucucaagggaagacaucaagacuggacuugaa

SEQ ID NO: 220580 - RNA, 64 nt, Homo Sapiens
cuguguugcccagacuggucuugaacuccuggacucaagggauccuccugucuugggcucccaa

SEQ ID NO: 220581 - RNA, 64 nt, Homo Sapiens
uuuuauucggauugacgaaaaucaaccauaauuuucaagggaucuucauggguugugacuggaa

SEQ ID NO: 220582 - RNA, 64 nt, Homo Sapiens
aaaguaguguguggcuggugccaguagaggucagucaagggaucccugacgagaauaaagagcc

SEQ ID NO: 220583 - RNA, 64 nt, Homo Sapiens
cuuuuuuccuuagccuucagugccauggaacuaaucaagggaggaaaaggucaccagggagaac

SEQ ID NO: 220584 - RNA, 64 nt, Homo Sapiens
cagcaguuuuauuuccucuagaacucauccuguuucaagggaaguaccuaagaagauauagagu

SEQ ID NO: 220585 - RNA, 64 nt, Homo Sapiens
cuguccccaaauuggccucgcccugcucccuuucucaagggaacgcagcucccuaagagcgggg

SEQ ID NO: 220586 - RNA, 64 nt, Homo Sapiens
guucuccuggaccaaggcuuugucgucgucaaagucaagggaaaguuuaugcuggugggccacu

SEQ ID NO: 220587 - RNA, 64 nt, Homo Sapiens; identical to SEQ ID NO: 93597

SEQ ID NO: 220588 - RNA, 64 nt, Homo Sapiens; identical to SEQ ID NO: 93598

SEQ ID NO: 220589 - RNA, 64 nt, Homo Sapiens; identical to SEQ ID NO: 93599

SEQ ID NO: 220590 - RNA, 64 nt, Homo Sapiens; identical to SEQ ID NO: 93600

SEQ ID NO: 220591 - RNA, 64 nt, Homo Sapiens; identical to SEQ ID NO: 93601

SEQ ID NO: 220592 - RNA, 64 nt, Homo Sapiens; identical to SEQ ID NO: 93602

SEQ ID NO: 220593 - RNA, 64 nt, Homo Sapiens; identical to SEQ ID NO: 93603

SEQ ID NO: 220594 - RNA, 64 nt, Homo Sapiens; identical to SEQ ID NO: 93604

SEQ ID NO: 220595 - RNA, 64 nt, Homo Sapiens; identical to SEQ ID NO: 93605

SEQ ID NO: 220596 - RNA, 64 nt, Homo Sapiens; identical to SEQ ID NO: 93606

SEQ ID NO: 220597 - RNA, 64 nt, Homo Sapiens; identical to SEQ ID NO: 93607

SEQ ID NO: 220598 - RNA, 64 nt, Homo Sapiens; identical to SEQ ID NO: 93608

SEQ ID NO: 220599 - RNA, 64 nt, Homo Sapiens; identical to SEQ ID NO: 93609

SEQ ID NO: 220600 - RNA, 64 nt, Homo Sapiens; identical to SEQ ID NO: 93610

SEQ ID NO: 220601 - RNA, 64 nt, Homo Sapiens; identical to SEQ ID NO: 93611

SEQ ID NO: 220602 - RNA, 64 nt, Homo Sapiens; identical to SEQ ID NO: 93612

SEQ ID NO: 220603 - RNA, 64 nt, Homo Sapiens; identical to SEQ ID NO: 93613

SEQ ID NO: 220604 - RNA, 64 nt, Homo Sapiens; identical to SEQ ID NO: 93614

SEQ ID NO: 220605 - RNA, 64 nt, Homo Sapiens; identical to SEQ ID NO: 93615

SEQ ID NO: 220606 - RNA, 64 nt, Homo Sapiens; identical to SEQ ID NO: 93616

SEQ ID NO: 220607 - RNA, 64 nt, Homo Sapiens; identical to SEQ ID NO: 93617

SEQ ID NO: 220608 - RNA, 64 nt, Homo Sapiens; identical to SEQ ID NO: 93618

SEQ ID NO: 220609 - RNA, 64 nt, Homo Sapiens; identical to SEQ ID NO: 93619

SEQ ID NO: 220610 - RNA, 64 nt, Homo Sapiens; identical to SEQ ID NO: 93620

SEQ ID NO: 220611 - RNA, 64 nt, Homo Sapiens; identical to SEQ ID NO: 93621

SEQ ID NO: 220612 - RNA, 64 nt, Homo Sapiens; identical to SEQ ID NO: 93622

SEQ ID NO: 220613 - RNA, 64 nt, Homo Sapiens
aaaauaaacugaacuugcaaugguauauuguacacaaaccuacaauaaaaccccauaucuguuu

SEQ ID NO: 220614 - RNA, 64 nt, Homo Sapiens
cuuuuuaaaagauagaagauauucuaauguaucccaaaccuaaucucccugcccuuugagcuuu

SEQ ID NO: 220615 - RNA, 64 nt, Homo Sapiens
uuuuagaaaguaaucauaaaaguaaauugaauuucaaaccuauuuggcuucuguuuugugaacc

SEQ ID NO: 220616 - RNA, 64 nt, Homo Sapiens
cauaacugcugccaccaccaucagaauucauaaucaaaccuaaccuuuuuguuuggggcaccaa

SEQ ID NO: 220617 - RNA, 64 nt, Homo Sapiens
auaauaugcucaguuuggaccuuuuuuucaguuaaaugcuaaauauaugaaaauuacuauaccu

SEQ ID NO: 220618 - RNA, 64 nt, Homo Sapiens
ggaaccuucuuaaucucuucugugggauuuucaaaaugcuaaagacucacacugcagcaaucau

SEQ ID NO: 220619 - RNA, 64 nt, Homo Sapiens
acuucuuuaauagcuagaaaucaccauaaauaagaaugcuaaacagaauugaaaauuauaucaa

SEQ ID NO: 220620 - RNA, 64 nt, Homo Sapiens
uauaugaaaaugguguguuauuggaagauguuaaaaugcuaauuugagagaaguaggaguguau

SEQ ID NO: 220621 - RNA, 64 nt, Homo Sapiens
augccuugcuaaauguagacuaaagaacuuguugaaugcuaaggcugaaaucccaaccugagau

SEQ ID NO: 220622 - RNA, 64 nt, Homo Sapiens
uauuaugauuauaguaaacagacuaguggguaguaaugcuaaauuaccaucacaguuaugugcc

SEQ ID NO: 220623 - RNA, 64 nt, Homo Sapiens
gaaggauuuguuauguuuagugcauacacgaagaaaugcuaacguugaacaggaaguaggaaca

SEQ ID NO: 220624 - RNA, 64 nt, Homo Sapiens
gaaaguaauagagacuguccauuuuauuuuuuaaaaugcuaacuaaaauauaaaaucacaguag

SEQ ID NO: 220625 - RNA, 64 nt, Homo Sapiens
ugaaagaaaauugauaagaaaagaaaguuuauucaaugcuaauuaggaaaauaaaucaaaccca

SEQ ID NO: 220626 - RNA, 64 nt, Homo Sapiens
uuuauuauaggaaaauaaauaacauuuuacauaaaaugcuaaaaugacuauuaaccagaaaaga

SEQ ID NO: 220627 - RNA, 64 nt, Homo Sapiens
gaaaaaaagacuuggccaggaaugcuaauauaaaaaugcuaaguaaaggguggggaugauaaga

SEQ ID NO: 220628 - RNA, 64 nt, Homo Sapiens
uaaaaaugcuaagugaaaaauggggaugauaagaaaugcuaauaacaaacugucaaagaaaggg

SEQ ID NO: 220629 - RNA, 64 nt, Homo Sapiens
uaagcuacuuugucauagaucacaaaagaaucauaaugcuaacaaacucuauuucuuccuuauu

SEQ ID NO: 220630 - RNA, 64 nt, Homo Sapiens
ucuuguaaaaauaaguaauuuacaggaaaggcaaaaugcuaauacuaacauuuguagcacuuga

SEQ ID NO: 220631 - RNA, 64 nt, Homo Sapiens
auauacaucuguaguuauucuuuguggacaguuaaaugcuaauuugauaggauuuccuaaagua

SEQ ID NO: 220632 - RNA, 64 nt, Homo Sapiens
aauauacaucuguaguuauuuuuguggacaguuaaaugcuaauuugauaggauuuccaaaagua

SEQ ID NO: 220633 - RNA, 64 nt, Homo Sapiens
gcagggagggccagggagguugggggugggagugaaugcuaaaagcagaucguccagugcccuu

SEQ ID NO: 220634 - RNA, 64 nt, Homo Sapiens
aagcaguccuccaugugagcaaccccgagacaaaaaugcuaagugggaucaagagagcagcacu

SEQ ID NO: 220635 - RNA, 64 nt, Homo Sapiens
aauacacuuuuguguauuagcaaugguuuuuacuaaugcuaaaacuuuuaaaguuuauuuuuua

SEQ ID NO: 220636 - RNA, 64 nt, Homo Sapiens
acucuucugcuuccugauaagaaaagguauaugcaaugcuaaaacuguagaagcccaaucacca

SEQ ID NO: 220637 - RNA, 64 nt, Homo Sapiens
ccugccucugcagagcagaaagaucauagacaacauuuaugaaugugcccagugcugccaagaa

SEQ ID NO: 220638 - RNA, 64 nt, Homo Sapiens
gacauuauuaaaagaacaggggcagaaguggcucauuuaugacccauucacuagccccagggau

SEQ ID NO: 220639 - RNA, 64 nt, Homo Sapiens
auaugauguauuuguuacacauaguuuucucauuauuuaugaaacuuaaccauacagaaugaua

SEQ ID NO: 220640 - RNA, 64 nt, Homo Sapiens
uaaaagaaggcaggggaaacuuacguuggaugacauuuaugagggucagucccacauaccucuu

SEQ ID NO: 220641 - RNA, 64 nt, Homo Sapiens
gcuaauuuaaggaugacuuuuuauuucauggauuauuuaugagaagaggagccagaaguaaagu

SEQ ID NO: 220642 - RNA, 64 nt, Homo Sapiens
gugcauuucuugacuucacaaagcguagacauauauuuaugaauuggauguguuugauuuuuua

SEQ ID NO: 220643 - RNA, 64 nt, Homo Sapiens
uucagcauuuacagugaaaagugagaauuuuaaaauuuaugaaaucuauauuccagguauuguu

SEQ ID NO: 220644 - RNA, 64 nt, Homo Sapiens
auugaaaucuguucaaaaacagauuaagacaaacauuuaugauggucuguaucaaucagcagau

SEQ ID NO: 220645 - RNA, 64 nt, Homo Sapiens
guuaauaaaauuuaucuuguuccaaaauauuuaaauuuaugaguuaacugauaaaggucuagua

SEQ ID NO: 220646 - RNA, 64 nt, Homo Sapiens
auucaagaaagugaaaaaaauugucaaaaacuaaauuuaugauuauuucuauaaaagcaagauu

SEQ ID NO: 220647 - RNA, 64 nt, Homo Sapiens
aaacauucuuuguuuagaaggagauucuaaaguuauuuaugaugcuuagccauaguauucaggc

SEQ ID NO: 220648 - RNA, 64 nt, Homo Sapiens
uauuuaaguguuggacugcuaggagaacuuguacauuuaugauaaugcagaauuaggaaaacgg

SEQ ID NO: 220649 - RNA, 64 nt, Homo Sapiens
uccccuuccaaagacugucuuugccagauucaacauuuaugaccuaagacaagaaauuuaugau

SEQ ID NO: 220650 - RNA, 64 nt, Homo Sapiens
ugccagauucaacauuuauguguuaagacaagaaauuuaugauugaugauaguaaaugcggcaa

SEQ ID NO: 220651 - RNA, 64 nt, Homo Sapiens
aaaaucuccuuauacuuuugguauggcuugcagcauuuaugaguuuuccaaaauauagaaagca

SEQ ID NO: 220652 - RNA, 64 nt, Homo Sapiens
aacaacaacuaugaguuaucaaaauauugacuccauuuaugacuagacuacauuucugaaagau

SEQ ID NO: 220653 - RNA, 64 nt, Homo Sapiens
caaaaguuacaguaccuuuguggcuucauugaauauuuaugaagauaaugucagauguagacaa

SEQ ID NO: 220654 - RNA, 64 nt, Homo Sapiens
guauuguagagacuuuaugauuagaauugcauauauuuaugaaacuuaaagaugaauguuuuau

SEQ ID NO: 220655 - RNA, 64 nt, Homo Sapiens
aaccagguucuccaaaguuaggaauagggaacuaauuuaugaaacagccaucuuaaaaaaaaaa

SEQ ID NO: 220656 - RNA, 64 nt, Homo Sapiens
ucaaucuguucccaguuucuaaacaauuuuaaauauuuaugagaagcaaacccuauguguaggg

SEQ ID NO: 220657 - RNA, 64 nt, Homo Sapiens
ccuuuaugauuguauaugauccacagaagaccugauuuaugaaauuuuguacuaaaaucauuug

SEQ ID NO: 220658 - RNA, 64 nt, Homo Sapiens
uaaucauuccuuuuuuaagaagaaguaauuuuccauuuaugaagcaguaugaauuagauguauu

SEQ ID NO: 220659 - RNA, 64 nt, Homo Sapiens
guuaaguaagcuugacuuaugugcguuuuuuguaauuuaugauucuagaacaaaauuauucaua

SEQ ID NO: 220660 - RNA, 64 nt, Homo Sapiens
cugugauaauauuauucaauacaauuuuuaacacauuuaugauuggagguaauuuguugauauu

SEQ ID NO: 220661 - RNA, 64 nt, Homo Sapiens
uuuauucauuagaaauuuuccucauuucaaaauaauuuaugacucauggaauguugaucgccua

SEQ ID NO: 220662 - RNA, 64 nt, Homo Sapiens
uauguuagacuuuuuacauuguuuaucuaauauuauuuaugacaguaauuuuaaaauauauuau

SEQ ID NO: 220663 - RNA, 64 nt, Homo Sapiens
aauuaucauuccagcuuuuuauauacuauauuucauuuaugaagaaauugauuuucuuuuggga

SEQ ID NO: 220664 - RNA, 64 nt, Homo Sapiens
agggagcaugcuguuuugucaaucaauauaaaauauuuaugaggucucccccacccccaggagg

SEQ ID NO: 220665 - RNA, 64 nt, Homo Sapiens
ggcauuaaagagucauagaaaaagaaucauggauauuuaugaauuaagguaagagguguggcuu

SEQ ID NO: 220666 - RNA, 64 nt, Homo Sapiens
gccucaaaucauguaauuaauaauuugccuguuuauuuaugaccuaauugugauucuuuuauua

SEQ ID NO: 220667 - RNA, 64 nt, Homo Sapiens
ugcaaugauagaaaacuccucuuuuaaaaguuauauuuaugacuagguaaaagcugcuaguauu

SEQ ID NO: 220668 - RNA, 64 nt, Homo Sapiens
ugauguucucgugaaauguuaaacagaugguaguauuuaugaaccuccaggaggguggugauag

SEQ ID NO: 220669 - RNA, 64 nt, Homo Sapiens
auuuauuaguuuuuuuuuaauuuaauguauuuugauuuaugauuaugauguacuguaauuuuau

SEQ ID NO: 220670 - RNA, 64 nt, Homo Sapiens
cuuugaaaggaucgucuuguucaagaagacuuuuauuuaugaacaugcaggaaacgauuucgag

SEQ ID NO: 220671 - RNA, 64 nt, Homo Sapiens
aaaaugcauuauuuuuuuaauaucugcucuaaauauuuaugauagauacugauuuuaaugccag

SEQ ID NO: 220672 - RNA, 64 nt, Homo Sapiens
ugcuaaaguggugauuuaucaauaucuugaccuuauuuaugaucuuguauguuaacuuauuuuc

SEQ ID NO: 220673 - RNA, 64 nt, Homo Sapiens
uuaugucacauugaagaauuaucauacauuuauuauuuaugacuucccugcuaaaaaucuguuu

SEQ ID NO: 220674 - RNA, 64 nt, Homo Sapiens
uggaaagauauauauagugucagaaagaaucugaauuuaugaauuaaugacugcugucugcagc

SEQ ID NO: 220675 - RNA, 64 nt, Homo Sapiens
gcugcugcuuggaguggaugcccuggggcuucacauuuaugacccugagaacagacugaccccc

SEQ ID NO: 220676 - RNA, 64 nt, Homo Sapiens
agauucuccagcuauguaucgggaaccaugaucuauuuaugaggagaaggaaagccgauucuuu

SEQ ID NO: 220677 - RNA, 64 nt, Homo Sapiens
gacauagauuuuguaauguauaacuugauauuuaauuuaugauuaaacuguguguaaauuuugu

SEQ ID NO: 220678 - RNA, 64 nt, Homo Sapiens
guauuacugaagguguguauacucccuaauacacauuuaugaaaaucuacuuguuuaggcuuuu

SEQ ID NO: 220679 - RNA, 64 nt, Homo Sapiens
gacauagauuuuguaauguauaacuugauauuuaauuuaugauuaaacuguaauuuuguaacau

SEQ ID NO: 220680 - RNA, 64 nt, Homo Sapiens
guauuacugaagguguguauacucccuaauacacauuuaugaaaaucuacuuguuuagacuuuu

SEQ ID NO: 220681 - RNA, 64 nt, Homo Sapiens
uuccuaucagcuggauucuauccaagugacucuauugauguauguauguucauucaaagaaugg

SEQ ID NO: 220682 - RNA, 64 nt, Homo Sapiens
auacauauaacauaaacauaacaaaguugccuaguugauguaacaguggaaaguuaucuggaaa

SEQ ID NO: 220683 - RNA, 64 nt, Homo Sapiens
aauuaaaugaaugcugcacagguccagauguguguugauguagacuugaaaugucuccacauuu

SEQ ID NO: 220684 - RNA, 64 nt, Homo Sapiens
aguuucagaaccuuaacacuccccaacagcuuuguugauguagcuuguaucucugagaauuuau

SEQ ID NO: 220685 - RNA, 64 nt, Homo Sapiens
gguucaccaaacauauuuaguuuggagccaggcauugauguagagcauggaccccagagauagu

SEQ ID NO: 220686 - RNA, 64 nt, Homo Sapiens
cuuauauggugguuuuagucaauuguuggcaaacuugauguaacuuuggucauacuauuuacca

SEQ ID NO: 220687 - RNA, 64 nt, Homo Sapiens
acaaauguucuuauuuggcuuacauccuagccauuugauguaaucugaauaaggaguagcuugu

SEQ ID NO: 220688 - RNA, 64 nt, Homo Sapiens
uguaaauauugcaguuuuuauauauguuguaagauugauguaucuuucuuauuguuaaaguuuu

SEQ ID NO: 220689 - RNA, 64 nt, Homo Sapiens
ugcuuuguuugcaauagcacgccucuuccugcaguugauguaauuaguguauucaacauugucu

SEQ ID NO: 220690 - RNA, 64 nt, Homo Sapiens
acauagcuguaugggguuuuugaccuucauuuaguugauguaauuaaugcuguuaaacaggagu

SEQ ID NO: 220691 - RNA, 64 nt, Homo Sapiens
uacguuagcagauggagagguauauguuguuauuuugauguagaugagguuuucguuuugaaua

SEQ ID NO: 220692 - RNA, 64 nt, Homo Sapiens
aggugcacauuugccuaacauacuuaacaugaacuugauguaguaugagucugucugagcauga

SEQ ID NO: 220693 - RNA, 64 nt, Homo Sapiens
gaggggccugaagagccuccgggcuccugggacauugauguagaguuuuuagugaagugggcac

SEQ ID NO: 220694 - RNA, 64 nt, Homo Sapiens
cugucccguguagaugcaauucgguuuaauggcauugauguauagucacugugccuuucuuuuu

SEQ ID NO: 220695 - RNA, 64 nt, Homo Sapiens
aauuaaguuacucuuaaaacucuaguuaaaauacuugauguacauaaagugcuuagcaaaauga

SEQ ID NO: 220696 - RNA, 64 nt, Homo Sapiens
ugcuuaguaaauguuagauaaguauucuccagaauugauguaaauuauuuuuaaacagugcauu

SEQ ID NO: 220697 - RNA, 64 nt, Homo Sapiens
gugauagaaaauucaccccucucugacuuugcuauugauguaguacaagauggaaaauugauuc

SEQ ID NO: 220698 - RNA, 64 nt, Homo Sapiens
guuacaagauggaaaauugagugaauuugcuauuuugauguagugggggccuuuggaaggcacu

SEQ ID NO: 220699 - RNA, 64 nt, Homo Sapiens
cguaggcugacauaguaucacccaaucccugaagcaagaauacaaaggguauacucuguuggau

SEQ ID NO: 220700 - RNA, 64 nt, Homo Sapiens
gagaaacucauacauguacaccaggagauguguacaagaauauucauagcaacccuauucacaa

SEQ ID NO: 220701 - RNA, 64 nt, Homo Sapiens
ugaagucuggaggcuagacuuccugaaagcaagucaagaauauagagcaccuugcaggaguuca

SEQ ID NO: 220702 - RNA, 64 nt, Homo Sapiens
guucacagauauuuuauguuuuuuuaauuuucuccaagaauauuuauagaauuccaaagaauca

SEQ ID NO: 220703 - RNA, 64 nt, Homo Sapiens
agaucaauucuuaucccauauaaugcuuagcuuccaagaauauucuuuacuuucuucugucuuu

SEQ ID NO: 220704 - RNA, 64 nt, Homo Sapiens
uccaacauaaaaauuauaauuuuagauguccaaacaagaauacuaggugauaacuguccuaaua

SEQ ID NO: 220705 - RNA, 64 nt, Homo Sapiens
auuugaaagacuuuuccagcgagcuagauacaagcaagaauaguaaaauuuaaacuguauaaug

SEQ ID NO: 220706 - RNA, 64 nt, Homo Sapiens
agauaauuggagcugaguacuaucagcauccuuucaagaauauuggggggacacaaccaaacca

SEQ ID NO: 220707 - RNA, 64 nt, Homo Sapiens
augggaaagacuggcccccacuuauucacuaucacaagaauagcagccaucagaucuugugaaa

SEQ ID NO: 220708 - RNA, 64 nt, Homo Sapiens
ugaaaugauguuaaagcauagaugccgugugugccaagaauaaagauguauuuuuacuuuccaa

SEQ ID NO: 220709 - RNA, 64 nt, Homo Sapiens
gauauaagcauugcuagucugaaacaaaacaauccaagaauagguuguuagauagucagaguug

SEQ ID NO: 220710 - RNA, 64 nt, Homo Sapiens
agacaugcuuguguuuuggaauuucacacccuuacaagaauaccacauuuugaaacccagaaag

SEQ ID NO: 220711 - RNA, 64 nt, Homo Sapiens
caucuuuucaaagauacaacaaaagcagaaguuacaagaauauugcggagagguuggaaagcag

SEQ ID NO: 220712 - RNA, 64 nt, Homo Sapiens
gagacggaagcaggugcgauacuaagccucagcccaagaauaaaagagaguucaacuguuacuc

SEQ ID NO: 220713 - RNA, 64 nt, Homo Sapiens; identical to SEQ ID NO: 51693

SEQ ID NO: 220714 - RNA, 64 nt, Homo Sapiens; identical to SEQ ID NO: 51694

SEQ ID NO: 220715 - RNA, 64 nt, Homo Sapiens; identical to SEQ ID NO: 51695

SEQ ID NO: 220716 - RNA, 64 nt, Homo Sapiens; identical to SEQ ID NO: 51696

SEQ ID NO: 220717 - RNA, 64 nt, Homo Sapiens; identical to SEQ ID NO: 51697

SEQ ID NO: 220718 - RNA, 64 nt, Homo Sapiens; identical to SEQ ID NO: 51698

SEQ ID NO: 220719 - RNA, 64 nt, Homo Sapiens; identical to SEQ ID NO: 51699

SEQ ID NO: 220720 - RNA, 64 nt, Homo Sapiens; identical to SEQ ID NO: 51700

SEQ ID NO: 220721 - RNA, 64 nt, Homo Sapiens; identical to SEQ ID NO: 51701

SEQ ID NO: 220722 - RNA, 64 nt, Homo Sapiens; identical to SEQ ID NO: 51702

SEQ ID NO: 220723 - RNA, 64 nt, Homo Sapiens; identical to SEQ ID NO: 51703

SEQ ID NO: 220724 - RNA, 64 nt, Homo Sapiens; identical to SEQ ID NO: 51704

SEQ ID NO: 220725 - RNA, 64 nt, Homo Sapiens; identical to SEQ ID NO: 51705

SEQ ID NO: 220726 - RNA, 64 nt, Homo Sapiens
acaaggauggcuggcuggugaguguccaccaguuggaagcaauguaagugacuccggaugcauc

SEQ ID NO: 220727 - RNA, 64 nt, Homo Sapiens
uuaugaagaaugauggugggacaaucaggagauuggaagcaaauggaaaaagucuagacccaga

SEQ ID NO: 220728 - RNA, 64 nt, Homo Sapiens
gagaaguggggaauccagucauggucugucugaaggaagcaacaauucacuggcaaaugccuga

SEQ ID NO: 220729 - RNA, 64 nt, Homo Sapiens
uaguguggugggcagagccccagauagcaggcagggaagcaaugguuuuuagugaaguaucuuu

SEQ ID NO: 220730 - RNA, 64 nt, Homo Sapiens
aggacagauguccucuuaagaaaaugaugcaucaggaagcaacgugauggaggacuugggggaa

SEQ ID NO: 220731 - RNA, 64 nt, Homo Sapiens
gacuugggggaaaaggaucacauacucagucuauggaagcaacgucccuggaagaagaggcugc

SEQ ID NO: 220732 - RNA, 64 nt, Homo Sapiens
gcacacacaaaaugcccaaggcacucacuggggaggaagcaaggaagcaaacagucugagaaaa

SEQ ID NO: 220733 - RNA, 64 nt, Homo Sapiens
aaaaugcccaaggcacucacuggggaggaagcaaggaagcaaacagucugagaaaaugaugcaa

SEQ ID NO: 220734 - RNA, 64 nt, Homo Sapiens
cacauagugacaaguccuuacuuuuaggaauucaggaagcaaauguggcugcucugcugacuau

SEQ ID NO: 220735 - RNA, 64 nt, Homo Sapiens
aguuuucuuucuuaacaauuuggguauuuaaacuggaagcaaauauuucuccauuuguaauagc

SEQ ID NO: 220736 - RNA, 64 nt, Homo Sapiens
cccugcagaaucaaucugagggaggggauaaagaggaagcaauaaaaaaaaaacauccgacaga

SEQ ID NO: 220737 - RNA, 64 nt, Homo Sapiens
uaacuguaauauuugguugcucagcauaagugauggaagcaaacacuaauuucuaauaaaauug

SEQ ID NO: 220738 - RNA, 64 nt, Homo Sapiens
agugggugggagaauguauccaaaucuuuguccgggaagcaagaugcaucugcuaaugggagac

SEQ ID NO: 220739 - RNA, 64 nt, Homo Sapiens
guccugaucuuucaugcugcuuugaggcugguuaggaagcaagauuaggucccuguccucuguc

SEQ ID NO: 220740 - RNA, 64 nt, Homo Sapiens
caugagaccaacaacacugucugccucagaacauagccgugaucaagaugagcacggaggcucg

SEQ ID NO: 220741 - RNA, 64 nt, Homo Sapiens
ccaggcaggcaguccugucugcguguggaggagcagccgugacugcccguggcucugcugccgc

SEQ ID NO: 220742 - RNA, 64 nt, Homo Sapiens
gggggucacggccuggacaagaaaggcuugacugagccgugaacugaagaaugguauccaguca

SEQ ID NO: 220743 - RNA, 64 nt, Homo Sapiens
guuuuccagguuuaagcuguuacugucuucaguaagccgugauuuucauugcugggcuugucug

SEQ ID NO: 220744 - RNA, 64 nt, Homo Sapiens
guaaacuuccccucuaccagggccaagaggagacagccgugacgauugcccgagggcucagcaa

SEQ ID NO: 220745 - RNA, 64 nt, Homo Sapiens
auuuguucuuugaugugauugcuuaaacgucaaaagccgugacaugcccuacaaaauuuguuug

SEQ ID NO: 220746 - RNA, 64 nt, Homo Sapiens
acauuuucuauuuauuuccaaauuucuaggugugagccgugaucaagucugagcacuuuaugua

SEQ ID NO: 220747 - RNA, 64 nt, Homo Sapiens
gcgccacugcacuucagccuucaaggcugcagugagccgugauggcuugcuugagcccaggagg

SEQ ID NO: 220748 - RNA, 64 nt, Homo Sapiens
cucaggcuugaaaugcauuaacuaguuuugugccagccgugauguaguugguguucaaaaaaac

SEQ ID NO: 220749 - RNA, 64 nt, Homo Sapiens
cugccuguuucuaaggaaaugcaugugugcccugagccgugaugauccucccauccguguugug

SEQ ID NO: 220750 - RNA, 64 nt, Homo Sapiens
gauuguuugagccuaggagagggagguugcagugagccgugauugcaccacugcacuccagccu

SEQ ID NO: 220751 - RNA, 64 nt, Homo Sapiens
uucaucuuguccugucucgauuuaccccagaagaagccgugaacgugaugggcucuucaagguc

SEQ ID NO: 220752 - RNA, 64 nt, Homo Sapiens
gcccaguucagacuggggccgcaugaaacgcaugagccgugagcacuguggcuggugccgucuu

SEQ ID NO: 220753 - RNA, 64 nt, Homo Sapiens
agccuggacugcuaccuuucaaagcuuggagggaagccgugaauucaguugguucguucuguac

SEQ ID NO: 220754 - RNA, 64 nt, Homo Sapiens
gacgcuggcaccgugcugcuuguacagccugcagagccgugagccaaguaaaccucuuuaauua

SEQ ID NO: 220755 - RNA, 64 nt, Homo Sapiens
aacccugucucuacuaaaaauacaaaaaguagccagccgugaugacaggcaccuguaaucccag

SEQ ID NO: 220756 - RNA, 64 nt, Homo Sapiens
uccaggaagggaccccacugucugccuggccuugagccgugaccaggcagccugcagaccacac

SEQ ID NO: 220757 - RNA, 64 nt, Homo Sapiens
acuuuagaaugaaccaguuccucuugucaucaacagccgugaccgccauauaaaaauacaaagc

SEQ ID NO: 220758 - RNA, 64 nt, Homo Sapiens
ccaaagguugcgacuccugauugggcuuccucugagccgugaugcagcaggaggagcaccgggc

SEQ ID NO: 220759 - RNA, 64 nt, Homo Sapiens
gugccacugcauaccagccuucaaggcuauggugagccgugauugaucucuugagcccaggagg

SEQ ID NO: 220760 - RNA, 64 nt, Homo Sapiens
ucucugucgaaacuacucaacuuucaguuuggcgagccgugagggccagauacugaauccagua

SEQ ID NO: 220761 - RNA, 64 nt, Homo Sapiens
gugcgagccugagauggucuggaggauucucucuagccgugacuccgcugcucugaaggucaac

SEQ ID NO: 220762 - RNA, 64 nt, Homo Sapiens
gccagcgcccugggagacagcaccguggacagcaagccgugaggagggagcccgcucaggaugg

SEQ ID NO: 220763 - RNA, 64 nt, Homo Sapiens
aaagcagcguuacuucugaccagugugagagguuagccgugaugguugcugugaauacuucucu

SEQ ID NO: 220764 - RNA, 64 nt, Homo Sapiens
cuguggaaggugcgucgggcgcagcaggaggaggagccgugaccuagcgaguccauggagcuga

SEQ ID NO: 220765 - RNA, 64 nt, Homo Sapiens
gugaacauuaggaauauguaaaaauguguaacacagccgugaaauuacucauaacuucucuucc

SEQ ID NO: 220766 - RNA, 64 nt, Homo Sapiens
caucuuagaaaaugccucugaauguuuucauaggagccgugaccuuugguucuucaucucuacc

SEQ ID NO: 220767 - RNA, 64 nt, Homo Sapiens
gcuuggucccacaggccacggaccaauggccugcagccgugacaacacuccugucauauuggag

SEQ ID NO: 220768 - RNA, 64 nt, Homo Sapiens
accagugcacucuagccuggucaaggcuagagugagccgugaucaauugcuugggcccaggaau

SEQ ID NO: 220769 - RNA, 64 nt, Homo Sapiens
ucaagcuauuuuccugaaauaugaauaggucuagagccgugauuauguugaccuacguuaaaag

SEQ ID NO: 220770 - RNA, 64 nt, Homo Sapiens
uagucuucauccccacgugaacaaaaugggaaggagccgugaggagaggagugaggcaacaggc

SEQ ID NO: 220771 - RNA, 64 nt, Homo Sapiens
cccaccuuugccacccucagcccuccccugggucagccgugagggcucucccaagcuuccccgc

SEQ ID NO: 220772 - RNA, 64 nt, Homo Sapiens
uugccuucauugcuucaucccucugugcuuuagcagccgugaccgguuucacacuuuuuaaccc

SEQ ID NO: 220773 - RNA, 64 nt, Homo Sapiens
ugaauugggaauguuguuccaggauguggaaugcagccgugaucacacuuaccgagcuuacuuu

SEQ ID NO: 220774 - RNA, 64 nt, Homo Sapiens
ucaggggcccuccccucgguguggcuggugggugagccgugaagggacccugccuuucagggca

SEQ ID NO: 220775 - RNA, 64 nt, Homo Sapiens
aggcaggggauuguaguagccuucugaagacacgagccgugaguuaagggucucgaccccuugg

SEQ ID NO: 220776 - RNA, 64 nt, Homo Sapiens
aggugccccagaguugcuguucauuaacaaagccagccgugaaaaaagcgaucugacaugaaag

SEQ ID NO: 220777 - RNA, 64 nt, Homo Sapiens
auguuuggaaggggucuguaacccugagcugaccagccgugagcacuagacaagccagaacuug

SEQ ID NO: 220778 - RNA, 64 nt, Homo Sapiens
gcucugucugaugcccucuccauagcccagcuggagccgugaacacugggguccccuggcagag

SEQ ID NO: 220779 - RNA, 64 nt, Homo Sapiens
uaggcuggaagaacaguuauuggcaaguaugcagagccgugaacgucauggcauguccaaggaa

SEQ ID NO: 220780 - RNA, 64 nt, Homo Sapiens
gcucuugucccacgugucuuccacuuugcauaugagccgugaacugugcauagugcugggaugg

SEQ ID NO: 220781 - RNA, 64 nt, Homo Sapiens
ugauuucaaggcaugagcugaacagcguugacacagccgugacuuacaauuaaacccuuucaau

SEQ ID NO: 220782 - RNA, 64 nt, Homo Sapiens
ggcugacgacaaaguuguacauccugaaccccaaagccgugagugucauagaacucuacggcau

SEQ ID NO: 220783 - RNA, 63 nt, Homo Sapiens
agccuuucaucaguguccuguaccauggggggaagccgugacuaucacaugccaccacacuga

SEQ ID NO: 220784 - RNA, 64 nt, Homo Sapiens
uugauuuccgcucguguuuauaggauuuccacuuagccgugaucaguaguuaagcacaggaaaa

SEQ ID NO: 220785 - RNA, 64 nt, Homo Sapiens
gaucaccuaaggccaggaggucaaggcugcggugagccgugauugugccaauguacuccagccu

SEQ ID NO: 220786 - RNA, 64 nt, Homo Sapiens
agaaaacgcgaccuuggccgcaccuaaagcagccagccgugagugcagaccccuuggccagcgu

SEQ ID NO: 220787 - RNA, 64 nt, Homo Sapiens
aaucacuugagaccaggaaguugaggcugcaaugagccgugaucaugccacugcacuccagccu

SEQ ID NO: 220788 - RNA, 64 nt, Homo Sapiens
ugagacccucguggccuuccccagccucuucuagagccgugaugccucccuguugaagcucugg

SEQ ID NO: 220789 - RNA, 64 nt, Homo Sapiens
augcuuuugugagcaagcaaaagcagaaacgugaagccgugauacaaauuggugaacaaaaaau

SEQ ID NO: 220790 - RNA, 64 nt, Homo Sapiens
acaggugacgaccgcaccgcagggggcgccaggcagccgugaucagggcugagguggggccggc

SEQ ID NO: 220791 - RNA, 64 nt, Homo Sapiens
uaaugaucaagcccuauaauuagcuucucauuagagccgugauggugaugugugcugucuaaaa

SEQ ID NO: 220792 - RNA, 64 nt, Homo Sapiens
ucuccguguuuuccaguuaauuacauccucaugcagccgugaucaagggaauguaacugcugaa

SEQ ID NO: 220793 - RNA, 64 nt, Homo Sapiens
uagcucuuuuauugugcuuauuugcccuagaagaagccgugauuaaucuuuccccagauaauau

SEQ ID NO: 220794 - RNA, 64 nt, Homo Sapiens
cgcagcauuuuccugccguuuacaguaugaagggagccgugacacuggcccugccccuccucau

SEQ ID NO: 220795 - RNA, 64 nt, Homo Sapiens
cgaccagaaggccguccucuaaaaaaaaaagccaagccgugagcuuaguuuaaaaaaaagacaa

SEQ ID NO: 220796 - RNA, 56 nt, Homo Sapiens
uggaacuuaaagguuuuuaccauccuagccgugaguacgugcucugugaugguuag

SEQ ID NO: 220797 - RNA, 64 nt, Homo Sapiens
gggacagagaggggcagguugaccgggacuucaaagccgugaucgugaauaucgagaacugcca

SEQ ID NO: 220798 - RNA, 64 nt, Homo Sapiens
ccaccgggacaacuucagcccuuaccuguuugccagccgugaccaccugcugugaggcccgacc

SEQ ID NO: 220799 - RNA, 64 nt, Homo Sapiens
aucacuugagccugggagauagaggcuugcagugagccgugauggcaccauugcacuccaaccg

SEQ ID NO: 220800 - RNA, 64 nt, Homo Sapiens
ucuagcaguugacuucaccucuccaccucuuaaaagccgugauuaggccagaguucaaauguga

SEQ ID NO: 220801 - RNA, 64 nt, Homo Sapiens
guuuucaggggccgugcagggccuggagcuccugagccgugacagcgaggucccccaggccuca

SEQ ID NO: 220802 - RNA, 64 nt, Homo Sapiens
ucaccaccacuccagccugguugaggcugcagugagccgugauugauugccugagaccaggagg

SEQ ID NO: 220803 - RNA, 51 nt, Homo Sapiens
ucauuucuguauuucaggaacagccgugaugcuggccuuaauccauuauag

SEQ ID NO: 220804 - RNA, 51 nt, Homo Sapiens
ucauuuuuguauuucaggaacagccgugaugcuuucaauaauccaacguag

SEQ ID NO: 220805 - RNA, 51 nt, Homo Sapiens
ucauuucuguauuucaggaacagccgugaagcucuccuuaauccaauauag

SEQ ID NO: 220806 - RNA, 64 nt, Homo Sapiens
gaucaugugagccugggaggucaaggcugcagugagccgugauugcaccacugcacuccagccu

SEQ ID NO: 220807 - RNA, 64 nt, Homo Sapiens
acaguauuccuuugucugucgaggcugggaggguagccgugagcguggugggugggugguguga

SEQ ID NO: 220808 - RNA, 64 nt, Homo Sapiens
uuggcacaugugcugcucgugcaaccagcacaagagccgugagccacauguaauuaaauuccag

SEQ ID NO: 220809 - RNA, 64 nt, Homo Sapiens
ccugaggaggcacagcgccugaagggggcacaggagccgugaccgcuugucgggcuugggugag

SEQ ID NO: 220810 - RNA, 64 nt, Homo Sapiens
acccgccuucagccucccaacgugcugggauuacagccgugagccgccgcgccuggccuagacu

SEQ ID NO: 220811 - RNA, 64 nt, Homo Sapiens
gacagggcaccccaaacccccaacucccaauaaaagccgugacguucggacaaaccgcguacug

SEQ ID NO: 220812 - RNA, 64 nt, Homo Sapiens
cagccuggacaccggacauggauguuugacacccagccgugacuuuugauccuguuggccagag

SEQ ID NO: 220813 - RNA, 64 nt, Homo Sapiens
auauuaucgaaaaaagaaaagaauucuaaugaccagccgugaauguguaggguugcagcucuau

SEQ ID NO: 220814 - RNA, 64 nt, Homo Sapiens
gaucgcuggagccugggaaguugaggcugcagugagccgugaucaugccacugcauuccagccu

SEQ ID NO: 220815 - RNA, 64 nt, Homo Sapiens
cacacuacaugcccccgugagugauuuuguguucagccgugagugcuguagcacaggcuucaca

SEQ ID NO: 220816 - RNA, 64 nt, Homo Sapiens
gcccugagguucccaucaacauucaggcuuuuucaucuacgaagagccucugcucuguggcucc

SEQ ID NO: 220817 - RNA, 64 nt, Homo Sapiens
gguaaaaagagaugaucaguuuuaagaagaaaacaucuacgaaacuaaacauauaacuauaugu

SEQ ID NO: 220818 - RNA, 64 nt, Homo Sapiens
uuccuagagcucugcugaccuugaccaaaugcuuaucuacgagguuaaucugagcaggucugaa

SEQ ID NO: 220819 - RNA, 64 nt, Homo Sapiens
uucuucuacauucauugaugacuugaugugaaaaaucuacgauuuuugacaaagcucagcagaa

SEQ ID NO: 220820 - RNA, 64 nt, Homo Sapiens
accgcaaggguagacugguuuauccacccacaacaucuacgaaucguacuucuuuaauugaucu

SEQ ID NO: 220821 - RNA, 64 nt, Homo Sapiens
aagugaacuuaaaaggacauccauaucuuaaacuaucuacgacaaauuaaggacugagaaauga

SEQ ID NO: 220822 - RNA, 64 nt, Homo Sapiens
uuaaaacaaauuaaaaacacauuuuguggcuucaaucuacgaugagggucuuugugugcugugg

SEQ ID NO: 220823 - RNA, 64 nt, Homo Sapiens
uaauauuuuuuucuagaaaacaggugacauuuguaucuacgauaaaaauuuuuauacagaaccu

SEQ ID NO: 220824 - RNA, 64 nt, Homo Sapiens
aacuuggcuauggcugaucuauuuuuuuuucauaaucuacgaagaaccuagaccuaucagugcc

SEQ ID NO: 220825 - RNA, 64 nt, Homo Sapiens
uuuuuuuguuguuuguucauuuuguaucaguauaaucuacgauucuguuagaaguaucuucuca

SEQ ID NO: 220826 - RNA, 64 nt, Homo Sapiens
aaagccaucuuauacaaaauuauucacauuuuucaucuacgauucaacuaaucgaaggauuaaa

SEQ ID NO: 220827 - RNA, 64 nt, Homo Sapiens
guucauggaagccaaaaaauuugcagaauguucaaucuacgagugguacuauuauaauucuuac

SEQ ID NO: 220828 - RNA, 64 nt, Homo Sapiens
aguaucaaguucugaaguuuguaauaaguugaguaucuacgaagaauugguuucuguaaaacgu

SEQ ID NO: 220829 - RNA, 64 nt, Homo Sapiens
uuguccugggagauuguaugucaucgccuucaucaucuacgaguccagaugaccagcggcaacc

SEQ ID NO: 220830 - RNA, 64 nt, Homo Sapiens
auauuguucauacugaucaguuuauaugcaguagaucuacgaaauaaugcuuugaugaaaaggc

SEQ ID NO: 220831 - RNA, 64 nt, Homo Sapiens
uccaagguccaauugacugacgcccuugacagccaucuacgacuuuauuaacagguuacuguga

SEQ ID NO: 220832 - RNA, 64 nt, Homo Sapiens
ugccuugaacaacccaaucuggcugguaaaugacaucuacgaagccacaggccuggccucaacu

SEQ ID NO: 220833 - RNA, 64 nt, Homo Sapiens
gcuaggggccagucucuucaccauuggcuucgccaucuacgagguucccaaagagguauagcag

SEQ ID NO: 220834 - RNA, 64 nt, Homo Sapiens
gccuaaccggccucaugacugccuguccccggucaucuacgacaaacccucugugugcaggcca

SEQ ID NO: 220835 - RNA, 64 nt, Homo Sapiens
cacacauaggcucaaaauaaaaggauggaggaagaucuacgaagcaaauggaaaacaaacaaaa

SEQ ID NO: 220836 - RNA, 50 nt, Homo Sapiens
acaguggaccugggagagugaucuacgaaugaacacaugcuggagcguga

SEQ ID NO: 220837 - RNA, 64 nt, Homo Sapiens; identical to SEQ ID NO: 99154

SEQ ID NO: 220838 - RNA, 64 nt, Homo Sapiens; identical to SEQ ID NO: 99155

SEQ ID NO: 220839 - RNA, 64 nt, Homo Sapiens; identical to SEQ ID NO: 99156

SEQ ID NO: 220840 - RNA, 64 nt, Homo Sapiens; identical to SEQ ID NO: 99157

SEQ ID NO: 220841 - RNA, 64 nt, Homo Sapiens; identical to SEQ ID NO: 99158

SEQ ID NO: 220842 - RNA, 64 nt, Homo Sapiens; identical to SEQ ID NO: 99159

SEQ ID NO: 220843 - RNA, 64 nt, Homo Sapiens; identical to SEQ ID NO: 99160

SEQ ID NO: 220844 - RNA, 64 nt, Homo Sapiens; identical to SEQ ID NO: 99161

SEQ ID NO: 220845 - RNA, 64 nt, Homo Sapiens; identical to SEQ ID NO: 99162

SEQ ID NO: 220846 - RNA, 64 nt, Homo Sapiens; identical to SEQ ID NO: 99163

SEQ ID NO: 220847 - RNA, 64 nt, Homo Sapiens; identical to SEQ ID NO: 99164

SEQ ID NO: 220848 - RNA, 64 nt, Homo Sapiens; identical to SEQ ID NO: 99165

SEQ ID NO: 220849 - RNA, 64 nt, Homo Sapiens; identical to SEQ ID NO: 99166

SEQ ID NO: 220850 - RNA, 64 nt, Homo Sapiens; identical to SEQ ID NO: 99167

SEQ ID NO: 220851 - RNA, 64 nt, Homo Sapiens; identical to SEQ ID NO: 99168

SEQ ID NO: 220852 - RNA, 64 nt, Homo Sapiens; identical to SEQ ID NO: 99169

SEQ ID NO: 220853 - RNA, 64 nt, Homo Sapiens; identical to SEQ ID NO: 99170

SEQ ID NO: 220854 - RNA, 64 nt, Homo Sapiens; identical to SEQ ID NO: 99171

SEQ ID NO: 220855 - RNA, 64 nt, Homo Sapiens; identical to SEQ ID NO: 99172

SEQ ID NO: 220856 - RNA, 64 nt, Homo Sapiens; identical to SEQ ID NO: 99173

SEQ ID NO: 220857 - RNA, 64 nt, Homo Sapiens; identical to SEQ ID NO: 99174

SEQ ID NO: 220858 - RNA, 64 nt, Homo Sapiens; identical to SEQ ID NO: 99175

SEQ ID NO: 220859 - RNA, 64 nt, Homo Sapiens; identical to SEQ ID NO: 99176

SEQ ID NO: 220860 - RNA, 64 nt, Homo Sapiens; identical to SEQ ID NO: 99177

SEQ ID NO: 220861 - RNA, 64 nt, Homo Sapiens; identical to SEQ ID NO: 99178

SEQ ID NO: 220862 - RNA, 64 nt, Homo Sapiens; identical to SEQ ID NO: 99179

SEQ ID NO: 220863 - RNA, 64 nt, Homo Sapiens; identical to SEQ ID NO: 92519

SEQ ID NO: 220864 - RNA, 64 nt, Homo Sapiens; identical to SEQ ID NO: 92520

SEQ ID NO: 220865 - RNA, 64 nt, Homo Sapiens; identical to SEQ ID NO: 92521

SEQ ID NO: 220866 - RNA, 64 nt, Homo Sapiens; identical to SEQ ID NO: 92522

SEQ ID NO: 220867 - RNA, 64 nt, Homo Sapiens; identical to SEQ ID NO: 92523

SEQ ID NO: 220868 - RNA, 64 nt, Homo Sapiens; identical to SEQ ID NO: 92524

SEQ ID NO: 220869 - RNA, 64 nt, Homo Sapiens; identical to SEQ ID NO: 92525

SEQ ID NO: 220870 - RNA, 64 nt, Homo Sapiens; identical to SEQ ID NO: 92526

SEQ ID NO: 220871 - RNA, 64 nt, Homo Sapiens; identical to SEQ ID NO: 92527

SEQ ID NO: 220872 - RNA, 64 nt, Homo Sapiens; identical to SEQ ID NO: 92528

SEQ ID NO: 220873 - RNA, 64 nt, Homo Sapiens; identical to SEQ ID NO: 92529

SEQ ID NO: 220874 - RNA, 64 nt, Homo Sapiens; identical to SEQ ID NO: 92530

SEQ ID NO: 220875 - RNA, 64 nt, Homo Sapiens; identical to SEQ ID NO: 92531

SEQ ID NO: 220876 - RNA, 64 nt, Homo Sapiens; identical to SEQ ID NO: 92532

SEQ ID NO: 220877 - RNA, 64 nt, Homo Sapiens; identical to SEQ ID NO: 92533

SEQ ID NO: 220878 - RNA, 64 nt, Homo Sapiens; identical to SEQ ID NO: 92534

SEQ ID NO: 220879 - RNA, 64 nt, Homo Sapiens; identical to SEQ ID NO: 92535

SEQ ID NO: 220880 - RNA, 64 nt, Homo Sapiens; identical to SEQ ID NO: 92536

SEQ ID NO: 220881 - RNA, 64 nt, Homo Sapiens; identical to SEQ ID NO: 92537

SEQ ID NO: 220882 - RNA, 64 nt, Homo Sapiens; identical to SEQ ID NO: 92538

SEQ ID NO: 220883 - RNA, 64 nt, Homo Sapiens; identical to SEQ ID NO: 92539

SEQ ID NO: 220884 - RNA, 64 nt, Homo Sapiens; identical to SEQ ID NO: 92540

SEQ ID NO: 220885 - RNA, 64 nt, Homo Sapiens; identical to SEQ ID NO: 92541

SEQ ID NO: 220886 - RNA, 64 nt, Homo Sapiens; identical to SEQ ID NO: 92542

SEQ ID NO: 220887 - RNA, 64 nt, Homo Sapiens; identical to SEQ ID NO: 92543

SEQ ID NO: 220888 - RNA, 64 nt, Homo Sapiens; identical to SEQ ID NO: 92544

SEQ ID NO: 220889 - RNA, 64 nt, Homo Sapiens; identical to SEQ ID NO: 92545

SEQ ID NO: 220890 - RNA, 64 nt, Homo Sapiens; identical to SEQ ID NO: 92546

SEQ ID NO: 220891 - RNA, 64 nt, Homo Sapiens; identical to SEQ ID NO: 92547

SEQ ID NO: 220892 - RNA, 64 nt, Homo Sapiens; identical to SEQ ID NO: 92548

SEQ ID NO: 220893 - RNA, 64 nt, Homo Sapiens; identical to SEQ ID NO: 92549

SEQ ID NO: 220894 - RNA, 64 nt, Homo Sapiens; identical to SEQ ID NO: 92550

SEQ ID NO: 220895 - RNA, 64 nt, Homo Sapiens; identical to SEQ ID NO: 92551

SEQ ID NO: 220896 - RNA, 64 nt, Homo Sapiens; identical to SEQ ID NO: 92552

SEQ ID NO: 220897 - RNA, 64 nt, Homo Sapiens; identical to SEQ ID NO: 92553

SEQ ID NO: 220898 - RNA, 64 nt, Homo Sapiens; identical to SEQ ID NO: 92554

SEQ ID NO: 220899 - RNA, 64 nt, Homo Sapiens; identical to SEQ ID NO: 92555

SEQ ID NO: 220900 - RNA, 64 nt, Homo Sapiens; identical to SEQ ID NO: 92556

SEQ ID NO: 220901 - RNA, 64 nt, Homo Sapiens; identical to SEQ ID NO: 92557

SEQ ID NO: 220902 - RNA, 64 nt, Homo Sapiens; identical to SEQ ID NO: 92558

SEQ ID NO: 220903 - RNA, 64 nt, Homo Sapiens; identical to SEQ ID NO: 92559

SEQ ID NO: 220904 - RNA, 64 nt, Homo Sapiens; identical to SEQ ID NO: 92560

SEQ ID NO: 220905 - RNA, 64 nt, Homo Sapiens; identical to SEQ ID NO: 92561

SEQ ID NO: 220906 - RNA, 64 nt, Homo Sapiens; identical to SEQ ID NO: 92562

SEQ ID NO: 220907 - RNA, 64 nt, Homo Sapiens; identical to SEQ ID NO: 92563

SEQ ID NO: 220908 - RNA, 64 nt, Homo Sapiens; identical to SEQ ID NO: 92564

SEQ ID NO: 220909 - RNA, 64 nt, Homo Sapiens; identical to SEQ ID NO: 92565

SEQ ID NO: 220910 - RNA, 64 nt, Homo Sapiens; identical to SEQ ID NO: 92566

SEQ ID NO: 220911 - RNA, 64 nt, Homo Sapiens; identical to SEQ ID NO: 92567

SEQ ID NO: 220912 - RNA, 64 nt, Homo Sapiens; identical to SEQ ID NO: 92568

SEQ ID NO: 220913 - RNA, 64 nt, Homo Sapiens; identical to SEQ ID NO: 92569

SEQ ID NO: 220914 - RNA, 64 nt, Homo Sapiens; identical to SEQ ID NO: 92570

SEQ ID NO: 220915 - RNA, 64 nt, Homo Sapiens; identical to SEQ ID NO: 92571

SEQ ID NO: 220916 - RNA, 64 nt, Homo Sapiens; identical to SEQ ID NO: 92572

SEQ ID NO: 220917 - RNA, 64 nt, Homo Sapiens; identical to SEQ ID NO: 92573

SEQ ID NO: 220918 - RNA, 64 nt, Homo Sapiens; identical to SEQ ID NO: 92574

SEQ ID NO: 220919 - RNA, 64 nt, Homo Sapiens; identical to SEQ ID NO: 92575

SEQ ID NO: 220920 - RNA, 64 nt, Homo Sapiens; identical to SEQ ID NO: 92576

SEQ ID NO: 220921 - RNA, 64 nt, Homo Sapiens; identical to SEQ ID NO: 92577

SEQ ID NO: 220922 - RNA, 64 nt, Homo Sapiens; identical to SEQ ID NO: 92578

SEQ ID NO: 220923 - RNA, 64 nt, Homo Sapiens; identical to SEQ ID NO: 92579

SEQ ID NO: 220924 - RNA, 64 nt, Homo Sapiens; identical to SEQ ID NO: 92580

SEQ ID NO: 220925 - RNA, 64 nt, Homo Sapiens; identical to SEQ ID NO: 92581

SEQ ID NO: 220926 - RNA, 64 nt, Homo Sapiens; identical to SEQ ID NO: 92582

SEQ ID NO: 220927 - RNA, 64 nt, Homo Sapiens; identical to SEQ ID NO: 92583

SEQ ID NO: 220928 - RNA, 64 nt, Homo Sapiens; identical to SEQ ID NO: 92584

SEQ ID NO: 220929 - RNA, 64 nt, Homo Sapiens; identical to SEQ ID NO: 92585

SEQ ID NO: 220930 - RNA, 64 nt, Homo Sapiens; identical to SEQ ID NO: 92586

SEQ ID NO: 220931 - RNA, 64 nt, Homo Sapiens; identical to SEQ ID NO: 92587

SEQ ID NO: 220932 - RNA, 64 nt, Homo Sapiens; identical to SEQ ID NO: 92588

SEQ ID NO: 220933 - RNA, 64 nt, Homo Sapiens; identical to SEQ ID NO: 92589

SEQ ID NO: 220934 - RNA, 64 nt, Homo Sapiens; identical to SEQ ID NO: 92590

SEQ ID NO: 220935 - RNA, 64 nt, Homo Sapiens; identical to SEQ ID NO: 92591

SEQ ID NO: 220936 - RNA, 64 nt, Homo Sapiens; identical to SEQ ID NO: 92592

SEQ ID NO: 220937 - RNA, 64 nt, Homo Sapiens; identical to SEQ ID NO: 92593

SEQ ID NO: 220938 - RNA, 64 nt, Homo Sapiens; identical to SEQ ID NO: 92594

SEQ ID NO: 220939 - RNA, 64 nt, Homo Sapiens; identical to SEQ ID NO: 92595

SEQ ID NO: 220940 - RNA, 64 nt, Homo Sapiens; identical to SEQ ID NO: 92596

SEQ ID NO: 220941 - RNA, 64 nt, Homo Sapiens; identical to SEQ ID NO: 92597

SEQ ID NO: 220942 - RNA, 64 nt, Homo Sapiens; identical to SEQ ID NO: 92598

SEQ ID NO: 220943 - RNA, 64 nt, Homo Sapiens; identical to SEQ ID NO: 92599

SEQ ID NO: 220944 - RNA, 64 nt, Homo Sapiens; identical to SEQ ID NO: 92600

SEQ ID NO: 220945 - RNA, 64 nt, Homo Sapiens; identical to SEQ ID NO: 92601

SEQ ID NO: 220946 - RNA, 64 nt, Homo Sapiens; identical to SEQ ID NO: 92602

SEQ ID NO: 220947 - RNA, 64 nt, Homo Sapiens; identical to SEQ ID NO: 92603

SEQ ID NO: 220948 - RNA, 64 nt, Homo Sapiens; identical to SEQ ID NO: 92604

SEQ ID NO: 220949 - RNA, 64 nt, Homo Sapiens; identical to SEQ ID NO: 92605

SEQ ID NO: 220950 - RNA, 64 nt, Homo Sapiens; identical to SEQ ID NO: 92606

SEQ ID NO: 220951 - RNA, 64 nt, Homo Sapiens; identical to SEQ ID NO: 92607

SEQ ID NO: 220952 - RNA, 64 nt, Homo Sapiens; identical to SEQ ID NO: 92608

SEQ ID NO: 220953 - RNA, 64 nt, Homo Sapiens; identical to SEQ ID NO: 92609

SEQ ID NO: 220954 - RNA, 64 nt, Homo Sapiens; identical to SEQ ID NO: 92610

SEQ ID NO: 220955 - RNA, 64 nt, Homo Sapiens; identical to SEQ ID NO: 92611

SEQ ID NO: 220956 - RNA, 64 nt, Homo Sapiens; identical to SEQ ID NO: 92612

SEQ ID NO: 220957 - RNA, 64 nt, Homo Sapiens; identical to SEQ ID NO: 92613

SEQ ID NO: 220958 - RNA, 64 nt, Homo Sapiens
uugggccgggcagcagcagguaacaaagaaugcguccgaggacuucccucucugaccugcaggu

SEQ ID NO: 220959 - RNA, 64 nt, Homo Sapiens
cuacugccagcagagggaggucgaggacuggaauuccgaggaacggucuugucaccuuucaacu

SEQ ID NO: 220960 - RNA, 64 nt, Homo Sapiens
ccuccuguggggaaagggguaugugugguggccucagcugaauggaagugcgugaauguaugua

SEQ ID NO: 220961 - RNA, 64 nt, Homo Sapiens
uggugcgcccugucucuguggcuucaucaagguucagcugaagccaaggacgguucuuacacag

SEQ ID NO: 220962 - RNA, 64 nt, Homo Sapiens
agggcguuuuucagagcugcagggacagggugagcagcugaagggcuaggagggaagccggccc

SEQ ID NO: 220963 - RNA, 64 nt, Homo Sapiens
ggaagccggcccccgcucugcagaagcugcauuucagcugaaucuguguuucagccucaguugg

SEQ ID NO: 220964 - RNA, 64 nt, Homo Sapiens
aaccauucuuuaaaggugaguggaggcugauuugcagcugaagugggccagccuugcaccagcc

SEQ ID NO: 220965 - RNA, 64 nt, Homo Sapiens
gacagcuaucuaagcucuggacuaccccuuugugcagcugaaucacugcaggguugaccaugcc

SEQ ID NO: 220966 - RNA, 64 nt, Homo Sapiens
guacgucugacaugaaaacuucucaccgccucagcagcugaacuaaaaaccugaauagccauga

SEQ ID NO: 220967 - RNA, 64 nt, Homo Sapiens
caguauuuggcaauaaaagaaagaagaaauagaacagcugaagucucaaaucauugucuggaau

SEQ ID NO: 220968 - RNA, 64 nt, Homo Sapiens
agguugcucuuuuuuggcagauauaaaaauccgacagcugaacugcucacauaaagagaguguu

SEQ ID NO: 220969 - RNA, 64 nt, Homo Sapiens
gccuuugguuuuggcuucucuuuauuuuuauuagcagcugaaauaaugugcauagaguuuguau

SEQ ID NO: 220970 - RNA, 64 nt, Homo Sapiens
ugucuaugguguuacagaagugcuacacgggcuacagcugaagauuggaauacuaaaguaagug

SEQ ID NO: 220971 - RNA, 64 nt, Homo Sapiens
ucagcaaaagaacauggaaugccugaaaagaauccagcugaagggaauacaguauuuguuuaua

SEQ ID NO: 220972 - RNA, 64 nt, Homo Sapiens
aauggaaacauuuuucuggacucuuucuaugucccagcugaagcgaaaucuaacucccugaaac

SEQ ID NO: 220973 - RNA, 64 nt, Homo Sapiens
uacuugccucacuggacucuaggagaaagaagagcagcugaacuccauaggaagaaaaggaguu

SEQ ID NO: 220974 - RNA, 64 nt, Homo Sapiens
gugguuggggaugauucuuacuggcaaguguucucagcugaaaauucccauccagagacauucu

SEQ ID NO: 220975 - RNA, 64 nt, Homo Sapiens
cggguaguccaguggccuagcucugauuuccuggcagcugaacuaugcccaauauuugaggugg

SEQ ID NO: 220976 - RNA, 64 nt, Homo Sapiens
agcaaagggugcacugccagcacagcuacaugggcagcugaaggcagugccgaagaggagcagg

SEQ ID NO: 220977 - RNA, 64 nt, Homo Sapiens
ccuacucccggagcccccaggccgcuuccuuucucagcugaaccugcuagagcagaagcggaag

SEQ ID NO: 220978 - RNA, 64 nt, Homo Sapiens
ccuacccggagcccccagcagccgcuuccuuucucagcugaaccugcuagagcagaagcggaag

SEQ ID NO: 220979 - RNA, 64 nt, Homo Sapiens
ccaguccaagaggaggaggacgaaggccuagacucagcugaaggaucuucaaagcaggaugaag

SEQ ID NO: 220980 - RNA, 64 nt, Homo Sapiens
gaugaagaccuagacuuaccugaaggccuagacucagcugaaggaucuucaaagcaggaugaag

SEQ ID NO: 220981 - RNA, 64 nt, Homo Sapiens
ggacgggaaaagugaagcagaccgguacuuuuaagguuaggaugcagggaguggaauuucguca

SEQ ID NO: 220982 - RNA, 64 nt, Homo Sapiens
gcuggggguacaaguccccaagcucaugaaacuugguuaggauguagauagugcuaaauauuuu

SEQ ID NO: 220983 - RNA, 64 nt, Homo Sapiens
uacacagaaaauuuugacuuaaaacaucugcugaauuccaaauuucuguaauagcuacuguauc

SEQ ID NO: 220984 - RNA, 64 nt, Homo Sapiens
agagauuauuaauaugguagaacccuguuauguaauuccaaaacuuaagaaccauauuuacauu

SEQ ID NO: 220985 - RNA, 64 nt, Homo Sapiens
cucugcugucaagauagauuccauauaaaauauaauuccaaaguuaaaacauucugcuuaaaaa

SEQ ID NO: 220986 - RNA, 64 nt, Homo Sapiens
gaccaguagaauuuaaauugccccuuuuucuaugauuccaaaagcaaagaaaauauuaaggucu

SEQ ID NO: 220987 - RNA, 64 nt, Homo Sapiens
aaauauuaaggucuccccuuuuucccaccaagguauuccaaagaaaaugauauucuuaaaauuu

SEQ ID NO: 220988 - RNA, 64 nt, Homo Sapiens
uuuacaccuggcagcacggcagccacacaccgguauuccaaaccuuaacaaugaaggggguuag

SEQ ID NO: 220989 - RNA, 64 nt, Homo Sapiens
cuuuuuaauauucuggcaaucuuuagaaagggagauuccaaacucccauuugguaaaccaguug

SEQ ID NO: 220990 - RNA, 64 nt, Homo Sapiens
aaacucacuucaaugaacaaagggauucuccaggauuccaaaguuuugaagucaucuuagcuuu

SEQ ID NO: 220991 - RNA, 64 nt, Homo Sapiens
ccgagucuaggaaugcuuuuauucaagacaccaaauuccaaacuucuaaauguuggaauuuuca

SEQ ID NO: 220992 - RNA, 64 nt, Homo Sapiens
auuaugccccaccaaggcuguuuuggcacuugccauuccaaaauuugcccaguacauuuaaauu

SEQ ID NO: 220993 - RNA, 64 nt, Homo Sapiens
cauggcaugcuuaaauuuuaauuaauauauuaaaauuccaaauucuuguuuugaaaauaaccua

SEQ ID NO: 220994 - RNA, 64 nt, Homo Sapiens
gggacuuuuagauguacauuggcacuuggauuagauuccaaaagacaaaaguguugggugcuuc

SEQ ID NO: 220995 - RNA, 64 nt, Homo Sapiens
uguguaugugcuuugguuguaggaaaacuugaaaauuccaaaauccuuauuuuccuauuugaga

SEQ ID NO: 220996 - RNA, 64 nt, Homo Sapiens
cuuuuuuuuucuuuuccacuuguguguguguaacauuccaaauagaccuaauacauuuccucug

SEQ ID NO: 220997 - RNA, 64 nt, Homo Sapiens
acacugcagauguucaaacuaguugagccacuuuauuccaaaguagcaauucauuucugaaagc

SEQ ID NO: 220998 - RNA, 64 nt, Homo Sapiens
auuauacgauggagaggucagcuauguugggccaauuccaaaaucaaucacuguccgauuguaa

SEQ ID NO: 220999 - RNA, 64 nt, Homo Sapiens
ccauguuguuuucacucucuccuggauguacuugauuccaaauggaauucaggcaugacucaaa

SEQ ID NO: 221000 - RNA, 64 nt, Homo Sapiens
uguccuuugccaucucauccggaucgucuaucugauuccaaagccaaguguaggaaggcacgcu

SEQ ID NO: 221001 - RNA, 64 nt, Homo Sapiens
accuguuuccccuuccauuagguuccaccuuuccauuccaaaccggagcacauuuuguggaccu

SEQ ID NO: 221002 - RNA, 64 nt, Homo Sapiens
auuuuugugaauaucuaaguuucccaaggaauauauuccaaaacaauauaggagacccuucaca

SEQ ID NO: 221003 - RNA, 64 nt, Homo Sapiens
uuguucuuaagugcuugagaaguuaaccugaaagauuccaaaaacuuguugauauaaccuuuuu

SEQ ID NO: 221004 - RNA, 64 nt, Homo Sapiens
ucaguauuuaauguaauuaacuauuuuagcacucauuccaaaauuaaugaccaaaucacauuau

SEQ ID NO: 221005 - RNA, 64 nt, Homo Sapiens
aguauauugguuccaauuagaaguucuggggagcauuccaaagccacuuuaaaaaccgccuugu

SEQ ID NO: 221006 - RNA, 64 nt, Homo Sapiens
ucagcuaaaggaaaaaugauuaagugcuauuggcauuccaaaauauaaauaaauuuuuaaagag

SEQ ID NO: 221007 - RNA, 64 nt, Homo Sapiens
uauggcugaauauacuaaauagauugaagcacuaauuccaaaauuacauguaauaugaaaauug

SEQ ID NO: 221008 - RNA, 64 nt, Homo Sapiens
ugacauaguugaugcauccaauccuaaaacuuacauuccaaaggaauuauaucauuauguuccu

SEQ ID NO: 221009 - RNA, 64 nt, Homo Sapiens
guacaucuugaggccucucagcaggagacaaaggauuccaaaaagagauguggaggugcugagg

SEQ ID NO: 221010 - RNA, 64 nt, Homo Sapiens
uucauuaacaguacuaaguggaagggaucugcagauuccaaacuggaauaagcucuaucauauu

SEQ ID NO: 221011 - RNA, 64 nt, Homo Sapiens
uauauguaacucauuuuaaaauauauuaaauuguauuccaaaccuguucuucuguuucuguggc

SEQ ID NO: 221012 - RNA, 64 nt, Homo Sapiens
uuguuugagggacucguuaucaauauaucucgcaauuccaaacuucucaagaaucaagguaccc

SEQ ID NO: 221013 - RNA, 64 nt, Homo Sapiens
agucauagaagaugaagcacccaaagugauauguauuccaaaaacagggaauguaaguuuauua

SEQ ID NO: 221014 - RNA, 64 nt, Homo Sapiens
aacaguugaauuaaacauuuacuaugacuacuacauuccaaagaaacuguaacuuaaauuccaa

SEQ ID NO: 221015 - RNA, 64 nt, Homo Sapiens
augacuacuacauuccaaaggaacuguaacuuaaauuccaaacucauaaaaaccacauagaacu

SEQ ID NO: 221016 - RNA, 64 nt, Homo Sapiens
aagccaucccuauggggaaacugggggaaauaccauuccaaaggagccucagccagcguggguc

SEQ ID NO: 221017 - RNA, 64 nt, Homo Sapiens
aacuuucuuccuaggaugugggcgcauaggcugaauuccaaaagaauuuaauucugcucugucc

SEQ ID NO: 221018 - RNA, 64 nt, Homo Sapiens
uuaaaauauguacucuggcccaagagcuauccucauuccaaauucuaaagugcauguucuaaaa

SEQ ID NO: 221019 - RNA, 64 nt, Homo Sapiens
uaucugaguuguauacccauaccuuaaguuaguaauuccaaauccaacauuaaggagaaauugu

SEQ ID NO: 221020 - RNA, 64 nt, Homo Sapiens
cucuuguggcugaugccauuauugcacauuggccauuccaaaccuguggagaacuuuguuguca

SEQ ID NO: 221021 - RNA, 64 nt, Homo Sapiens
agaaggaggcuagcuucuagccuggguggccauuauuccaaaaggucauuguuucucacuagac

SEQ ID NO: 221022 - RNA, 64 nt, Homo Sapiens
cugucuaaagucaaucauccgagauggguuuuccauuccaaagaaaggcaauaugguuccuucc

SEQ ID NO: 221023 - RNA, 64 nt, Homo Sapiens
guguucaagggaaaugaucagucauugcauuguuauuccaaagagcagccaacaguggccuccc

SEQ ID NO: 221024 - RNA, 64 nt, Homo Sapiens
aaaaccagaacaguaugaauuuacuggacaaagaauuccaaagccugcguuaugaagagcuaau

SEQ ID NO: 221025 - RNA, 64 nt, Homo Sapiens
gcacauauuagugcagccaaugacacucuauaagauuccaaaaacauuccaaaguucaacuugg

SEQ ID NO: 221026 - RNA, 64 nt, Homo Sapiens
ucaacuuggugacacucuauggaugauucaagccauuccaaagugcccggcacagaugcuccag

SEQ ID NO: 221027 - RNA, 64 nt, Homo Sapiens
gcccucugccucagcaguaccaguauaagaugacauuccaaagacuggaggcaacucagccuga

SEQ ID NO: 221028 - RNA, 64 nt, Homo Sapiens
uuaucaguggcucuuggguucaaaguaauaaagaauuccaaaacugagauguuugcuuucucua

SEQ ID NO: 221029 - RNA, 64 nt, Homo Sapiens
agagcaguaaauucaaauggauaaugacaggaaaauuccaaacucauguauugguuuaaacucg

SEQ ID NO: 221030 - RNA, 64 nt, Homo Sapiens
gcacagaauacuguucucaguuaucagagaucugauuccaaagaaugaaauugagcuauaugau

SEQ ID NO: 221031 - RNA, 64 nt, Homo Sapiens
uaaaaaaagaaauauuuuuagaaaccuauugugaauuccaaaucuuuacaaaggaggaacggaa

SEQ ID NO: 221032 - RNA, 64 nt, Homo Sapiens; identical to SEQ ID NO: 91802

SEQ ID NO: 221033 - RNA, 64 nt, Homo Sapiens; identical to SEQ ID NO: 91803

SEQ ID NO: 221034 - RNA, 64 nt, Homo Sapiens; identical to SEQ ID NO: 91804

SEQ ID NO: 221035 - RNA, 64 nt, Homo Sapiens; identical to SEQ ID NO: 91805

SEQ ID NO: 221036 - RNA, 64 nt, Homo Sapiens; identical to SEQ ID NO: 91806

SEQ ID NO: 221037 - RNA, 64 nt, Homo Sapiens; identical to SEQ ID NO: 91807

SEQ ID NO: 221038 - RNA, 64 nt, Homo Sapiens; identical to SEQ ID NO: 91808

SEQ ID NO: 221039 - RNA, 64 nt, Homo Sapiens; identical to SEQ ID NO: 91809

SEQ ID NO: 221040 - RNA, 64 nt, Homo Sapiens; identical to SEQ ID NO: 91810

SEQ ID NO: 221041 - RNA, 64 nt, Homo Sapiens; identical to SEQ ID NO: 91811

SEQ ID NO: 221042 - RNA, 64 nt, Homo Sapiens; identical to SEQ ID NO: 91812

SEQ ID NO: 221043 - RNA, 64 nt, Homo Sapiens; identical to SEQ ID NO: 91813

SEQ ID NO: 221044 - RNA, 64 nt, Homo Sapiens; identical to SEQ ID NO: 91814

SEQ ID NO: 221045 - RNA, 64 nt, Homo Sapiens; identical to SEQ ID NO: 91815

SEQ ID NO: 221046 - RNA, 64 nt, Homo Sapiens; identical to SEQ ID NO: 91816

SEQ ID NO: 221047 - RNA, 64 nt, Homo Sapiens; identical to SEQ ID NO: 91817

SEQ ID NO: 221048 - RNA, 64 nt, Homo Sapiens; identical to SEQ ID NO: 91818

SEQ ID NO: 221049 - RNA, 64 nt, Homo Sapiens; identical to SEQ ID NO: 91819

SEQ ID NO: 221050 - RNA, 64 nt, Homo Sapiens; identical to SEQ ID NO: 91820

SEQ ID NO: 221051 - RNA, 64 nt, Homo Sapiens; identical to SEQ ID NO: 91821

SEQ ID NO: 221052 - RNA, 64 nt, Homo Sapiens; identical to SEQ ID NO: 91822

SEQ ID NO: 221053 - RNA, 64 nt, Homo Sapiens; identical to SEQ ID NO: 91823

SEQ ID NO: 221054 - RNA, 64 nt, Homo Sapiens; identical to SEQ ID NO: 91824

SEQ ID NO: 221055 - RNA, 64 nt, Homo Sapiens; identical to SEQ ID NO: 91825

SEQ ID NO: 221056 - RNA, 64 nt, Homo Sapiens; identical to SEQ ID NO: 91826

SEQ ID NO: 221057 - RNA, 64 nt, Homo Sapiens; identical to SEQ ID NO: 91827

SEQ ID NO: 221058 - RNA, 64 nt, Homo Sapiens; identical to SEQ ID NO: 91828

SEQ ID NO: 221059 - RNA, 64 nt, Homo Sapiens; identical to SEQ ID NO: 91829

SEQ ID NO: 221060 - RNA, 64 nt, Homo Sapiens; identical to SEQ ID NO: 91830

SEQ ID NO: 221061 - RNA, 64 nt, Homo Sapiens; identical to SEQ ID NO: 91831

SEQ ID NO: 221062 - RNA, 64 nt, Homo Sapiens; identical to SEQ ID NO: 91832

SEQ ID NO: 221063 - RNA, 64 nt, Homo Sapiens; identical to SEQ ID NO: 91833

SEQ ID NO: 221064 - RNA, 64 nt, Homo Sapiens; identical to SEQ ID NO: 91834

SEQ ID NO: 221065 - RNA, 64 nt, Homo Sapiens; identical to SEQ ID NO: 91835

SEQ ID NO: 221066 - RNA, 64 nt, Homo Sapiens; identical to SEQ ID NO: 91836

SEQ ID NO: 221067 - RNA, 64 nt, Homo Sapiens; identical to SEQ ID NO: 91837

SEQ ID NO: 221068 - RNA, 64 nt, Homo Sapiens; identical to SEQ ID NO: 91838

SEQ ID NO: 221069 - RNA, 64 nt, Homo Sapiens; identical to SEQ ID NO: 91839

SEQ ID NO: 221070 - RNA, 64 nt, Homo Sapiens; identical to SEQ ID NO: 91840

SEQ ID NO: 221071 - RNA, 64 nt, Homo Sapiens; identical to SEQ ID NO: 91841

SEQ ID NO: 221072 - RNA, 64 nt, Homo Sapiens; identical to SEQ ID NO: 91842

SEQ ID NO: 221073 - RNA, 64 nt, Homo Sapiens; identical to SEQ ID NO: 91843

SEQ ID NO: 221074 - RNA, 64 nt, Homo Sapiens; identical to SEQ ID NO: 91844

SEQ ID NO: 221075 - RNA, 64 nt, Homo Sapiens; identical to SEQ ID NO: 91845

SEQ ID NO: 221076 - RNA, 64 nt, Homo Sapiens; identical to SEQ ID NO: 91846

SEQ ID NO: 221077 - RNA, 64 nt, Homo Sapiens; identical to SEQ ID NO: 91847

SEQ ID NO: 221078 - RNA, 64 nt, Homo Sapiens; identical to SEQ ID NO: 91848

SEQ ID NO: 221079 - RNA, 64 nt, Homo Sapiens; identical to SEQ ID NO: 91849

SEQ ID NO: 221080 - RNA, 64 nt, Homo Sapiens; identical to SEQ ID NO: 91850

SEQ ID NO: 221081 - RNA, 64 nt, Homo Sapiens; identical to SEQ ID NO: 91851

SEQ ID NO: 221082 - RNA, 64 nt, Homo Sapiens; identical to SEQ ID NO: 91852

SEQ ID NO: 221083 - RNA, 64 nt, Homo Sapiens; identical to SEQ ID NO: 91853

SEQ ID NO: 221084 - RNA, 64 nt, Homo Sapiens; identical to SEQ ID NO: 91854

SEQ ID NO: 221085 - RNA, 64 nt, Homo Sapiens; identical to SEQ ID NO: 91855

SEQ ID NO: 221086 - RNA, 64 nt, Homo Sapiens; identical to SEQ ID NO: 91856

SEQ ID NO: 221087 - RNA, 64 nt, Homo Sapiens; identical to SEQ ID NO: 91857

SEQ ID NO: 221088 - RNA, 64 nt, Homo Sapiens; identical to SEQ ID NO: 91858

SEQ ID NO: 221089 - RNA, 64 nt, Homo Sapiens; identical to SEQ ID NO: 91859

SEQ ID NO: 221090 - RNA, 64 nt, Homo Sapiens; identical to SEQ ID NO: 91860

SEQ ID NO: 221091 - RNA, 64 nt, Homo Sapiens; identical to SEQ ID NO: 91861

SEQ ID NO: 221092 - RNA, 64 nt, Homo Sapiens; identical to SEQ ID NO: 91862

SEQ ID NO: 221093 - RNA, 64 nt, Homo Sapiens
agaaugugggaguaugucugccgguuucaacacacacagacaaacacagccacacgcgcacaca

SEQ ID NO: 221094 - RNA, 64 nt, Homo Sapiens
gcauacuuucuuuuuucuuuuccuuuuuucccuccacagacaauguccucuguucaauuccuaa

SEQ ID NO: 221095 - RNA, 64 nt, Homo Sapiens
acggcuuccucuccagaauguggcuuugccugagcacagacagagucagcauggaaugcucuug

SEQ ID NO: 221096 - RNA, 64 nt, Homo Sapiens
aggcggauugaggcugcugggucagccuugaucgcacagacagagcuugugccggauuuggccc

SEQ ID NO: 221097 - RNA, 64 nt, Homo Sapiens
ugugugcugugagccccccacucugccgugcucacacagacacacccagcugcacacaugaggc

SEQ ID NO: 221098 - RNA, 64 nt, Homo Sapiens
aagucaugugcgaacagcccuccaaagccuaugccacagacagcucuugccccagccagaauca

SEQ ID NO: 221099 - RNA, 64 nt, Homo Sapiens
ugcgaccagagacuggaggugucagccagcacugcacagacagccagacagcugcgaccaggac

SEQ ID NO: 221100 - RNA, 64 nt, Homo Sapiens
ugcgaccaggacgucagccaaucagccagcacugcacagacagcaggccgugguuagcguggac

SEQ ID NO: 221101 - RNA, 64 nt, Homo Sapiens
aaaauauacagacaaucaaauuauguaugacuugcacagacacaagcacaaggcuggcagagau

SEQ ID NO: 221102 - RNA, 64 nt, Homo Sapiens
uagaugcucaccagccuggccggucagucagcaucacagacacagcuauuagguaugucuugug

SEQ ID NO: 221103 - RNA, 64 nt, Homo Sapiens
aauggcuauuaaaaauguuuccuuuacauuccuccacagacagaguccgacaacaggccauuuc

SEQ ID NO: 221104 - RNA, 64 nt, Homo Sapiens
aucuguaugugguugugcaugauggggaaauguucacagacaucagaacggguaacuagugcag

SEQ ID NO: 221105 - RNA, 64 nt, Homo Sapiens
ucugcaguaccagugagccaagccugaugggcagcacagacacagacacacaccgcagggcccg

SEQ ID NO: 221106 - RNA, 64 nt, Homo Sapiens
guaccagugagccaagccugaugggcagcacagacacagacacacaccgcagggcccgacccuc

SEQ ID NO: 221107 - RNA, 64 nt, Homo Sapiens
uucuugugaguuuucagucuguaauguucuucaccacagacaccuauuaagauuuauaaccuuu

SEQ ID NO: 221108 - RNA, 64 nt, Homo Sapiens
ucccgaugcgcugcccccugcuuauguauccagccacagacagcaggcaaaagaauccucgaag

SEQ ID NO: 221109 - RNA, 64 nt, Homo Sapiens
uacacauacuugaaacuugggcaccaugugucaucacagacacuggugacagggcgcucacuga

SEQ ID NO: 221110 - RNA, 64 nt, Homo Sapiens
guggagccgcgcucuucuccgccaccgagcucaccacagacacacaucagcuugucccauucaa

SEQ ID NO: 221111 - RNA, 64 nt, Homo Sapiens
uugucaucagcuugucccauaccgggaugaggcccacagacaggagcaccaagagccagucuug

SEQ ID NO: 221112 - RNA, 64 nt, Homo Sapiens
ugaugugaaugccuacaaagugagauuuucaggacacagacauaaauaggaaggagaaauuaau

SEQ ID NO: 221113 - RNA, 64 nt, Homo Sapiens
gcugaccauaacccaggaauccagacacacauggcacagacacagagccccuguauucugcugg

SEQ ID NO: 221114 - RNA, 64 nt, Homo Sapiens
cacagaaagacacacacagacacaccauuacauacacagacacagccccuccccgccacagaga

SEQ ID NO: 221115 - RNA, 64 nt, Homo Sapiens
caaucacacgcagccccucccacagaaagacacacacagacacacacaccauuacacacacaua

SEQ ID NO: 221116 - RNA, 64 nt, Homo Sapiens
caaucgcagauacgcccuuccacaccauuacauacacagacacgcacccuccccgccacagaga

SEQ ID NO: 221117 - RNA, 64 nt, Homo Sapiens
aaaucacacacacacccucccacacacagaaagacacagacacagacaccauuacauacacaga

SEQ ID NO: 221118 - RNA, 64 nt, Homo Sapiens
cacagaaagacacagacacagacaccauuacauacacagacacacacacccuccccgccacaga

SEQ ID NO: 221119 - RNA, 64 nt, Homo Sapiens
aaaucacacacacacccucccacagaaagacacacacagacacaccauuacauacacagacaca

SEQ ID NO: 221120 - RNA, 64 nt, Homo Sapiens
cacagaaagacacacacagagacaccauuacauacacagacacacacccccuccccaccacaga

SEQ ID NO: 221121 - RNA, 64 nt, Homo Sapiens
cauacacccaugaugugagcccccugaacacacacacagacacaacaacacacacacauacaca

SEQ ID NO: 221122 - RNA, 64 nt, Homo Sapiens
caacacacacacauacacacacccugaaaacacacacagacacacuggcccucuccacaugcac

SEQ ID NO: 221123 - RNA, 64 nt, Homo Sapiens
ggagagcaugcccauauuggcuuacuuugucugccacagacacagacagagggaguugggacau

SEQ ID NO: 221124 - RNA, 64 nt, Homo Sapiens
caugcccauauuggcuuacuuugucugccacagacacagacagagggaguugggacaugcaugc

SEQ ID NO: 221125 - RNA, 64 nt, Homo Sapiens
aaauauuauacuaauauguugccauacuacauggcacagacacaaacugugaaaaacaaguugu

SEQ ID NO: 221126 - RNA, 64 nt, Homo Sapiens
ccuaggcaaaguuuuuguuuauaagcuaaagcaacacagacacucuuggugacccauguauugc

SEQ ID NO: 221127 - RNA, 64 nt, Homo Sapiens
uacacccaucuuggcacccucccuugcccaucuucacagacacaucagcuccuugcagauguag

SEQ ID NO: 221128 - RNA, 64 nt, Homo Sapiens
cacauugauccuccuccucacuccucccaauccccacagacacacacuuccagcagaguccugc

SEQ ID NO: 221129 - RNA, 64 nt, Homo Sapiens
cuuuuccuaaaguugaagcaacuacgaucacagacacagacauaaaacgaacucugguuggggu

SEQ ID NO: 221130 - RNA, 64 nt, Homo Sapiens
gacauacuuuuccuaaaguuugggguacuacgaucacagacacaaaaacaaaacgaacucuggu

SEQ ID NO: 221131 - RNA, 64 nt, Homo Sapiens
uucugacaggcgcaacuccuucuuccccgaaucacacagacagugcuacuaagauacuccauau

SEQ ID NO: 221132 - RNA, 64 nt, Homo Sapiens
gcacagaccuuagggaauggccuguccucuggaucacagacacuauuagggacacuuucacagu

SEQ ID NO: 221133 - RNA, 64 nt, Homo Sapiens
acaagaaaacgggacagcccaugauuaauuuguacacagacagggaaacuggcaagcugaaggg

SEQ ID NO: 221134 - RNA, 64 nt, Homo Sapiens
cuuuggcccuggcaagauggauuccaggggugagcacagacaggaucgcagggagaggccguau

SEQ ID NO: 221135 - RNA, 64 nt, Homo Sapiens
uccuccaguucuaucaauggaacccaacaggaaacacagacacaaugauguaagagaugagaaa

SEQ ID NO: 221136 - RNA, 64 nt, Homo Sapiens
ccucacacaaggaauauaaacaaauuccaaauaucacagacaccgcauugucuaaauccauucu

SEQ ID NO: 221137 - RNA, 64 nt, Homo Sapiens
aggaucccaguaaauaugggaccagcccaugccucacagacaguagaaaagacuuaaauggaga

SEQ ID NO: 221138 - RNA, 64 nt, Homo Sapiens
gugucaccucucccagcucugacucagugggccacacagacacaguggcccucagccaugcgug

SEQ ID NO: 221139 - RNA, 64 nt, Homo Sapiens
gccggcccccgagaccccggcccccaccccacaccacagacacccaccagcccggccccucccg

SEQ ID NO: 221140 - RNA, 64 nt, Homo Sapiens
cacucguccccagaggcacauucgugcacauucucacagacaccgucucacacguuggcuuugg

SEQ ID NO: 221141 - RNA, 64 nt, Homo Sapiens
agggaggggacuggggaagugcgcacacagcccacacagacaacacgcacccacacagacacag

SEQ ID NO: 221142 - RNA, 64 nt, Homo Sapiens
ugcgcacacagcccacacagacaacacgcacccacacagacacagagggaagggguugggaugg

SEQ ID NO: 221143 - RNA, 64 nt, Homo Sapiens
cucugccaugucuuagcuguacugcuaguggagucacagacacaacagucagaauaaucucaaa

SEQ ID NO: 221144 - RNA, 64 nt, Homo Sapiens
gucagcauugcauuauuccaugcacauccuaauucacagacauuccccaagugggaucugccua

SEQ ID NO: 221145 - RNA, 64 nt, Homo Sapiens
gugacaacacacaccaugacgugaugaugucacacacagacacagcgauggcaucacacagacg

SEQ ID NO: 221146 - RNA, 64 nt, Homo Sapiens
gggaacuuggcaugacgucaugcagcacgucgcacacagacauguagcgauggcgucgugcaga

SEQ ID NO: 221147 - RNA, 64 nt, Homo Sapiens
ccaccacacacacacacacacacacacacacacacacagacacacagacacauacgcacacacg

SEQ ID NO: 221148 - RNA, 64 nt, Homo Sapiens
cacacacacacacacacacacacacacacagacacacagacacauacgcacacacgugcacaca

SEQ ID NO: 221149 - RNA, 64 nt, Homo Sapiens
ccaaguaccaguauaagcaucagacacacacacacacagacacagacacacaaacacacacaca

SEQ ID NO: 221150 - RNA, 64 nt, Homo Sapiens
cacacacacagacacaccaacacaaacacacacacacagacacacugcauuuacacaccagaca

SEQ ID NO: 221151 - RNA, 64 nt, Homo Sapiens
acagauuuacuacauuaaagcacacgaaacacaacacagacacuuacacacacacagacacaca

SEQ ID NO: 221152 - RNA, 64 nt, Homo Sapiens
cacacacgaaacacaacacacacacauacacacacacagacacacacacacacaaacacauaca

SEQ ID NO: 221153 - RNA, 64 nt, Homo Sapiens
gagcaggaggacacguggaggacagaagaggagacacagacacaugacagguguccuuccaaga

SEQ ID NO: 221154 - RNA, 64 nt, Homo Sapiens
aagcaggaggccacauaaaggacggaagaggagacacagacacaaauccagugucccuaugaga

SEQ ID NO: 221155 - RNA, 64 nt, Homo Sapiens
acugcucuucuuuuguucugaggcaagcuaaaugucugaugaagagauugugcuugugauuuuc

SEQ ID NO: 221156 - RNA, 64 nt, Homo Sapiens
agugauguugagcauuuuuuauauuuuguauuccucugaugauugagaguaucucauugugguu

SEQ ID NO: 221157 - RNA, 64 nt, Homo Sapiens
cugauuuggagcacccuuuucuguaccuuaucauucugaugaaauugcagacauggcugcagua

SEQ ID NO: 221158 - RNA, 64 nt, Homo Sapiens
ccaauguguuggaaaguuuauuuuuuaaagcccuucugaugauuaugcccggcuggcaguugua

SEQ ID NO: 221159 - RNA, 64 nt, Homo Sapiens
cccaauaaucucucaauacccuacuuaagucugcucugaugaaacaaaucuaaaaucaaccagg

SEQ ID NO: 221160 - RNA, 64 nt, Homo Sapiens
cccagucucucaauaccuucuuacuuaaguccgcucugaugaaacaauucuaagaucaaccagg

SEQ ID NO: 221161 - RNA, 64 nt, Homo Sapiens
auuugcaauacaaacuggcauaagaauuacuuauucugaugaugcacuuuuauguauuuuucau

SEQ ID NO: 221162 - RNA, 64 nt, Homo Sapiens
ucugaaucuggacaaagucgacuuaacagauuuuucugaugagcauguuuuaugaauccuccau

SEQ ID NO: 221163 - RNA, 64 nt, Homo Sapiens
uaggcucccagcaggcuacuucugaugaacauccucugaugauccuaggaugaucuguuccccc

SEQ ID NO: 221164 - RNA, 64 nt, Homo Sapiens
auccucugaugaucuaggcuugaucuguucccccucugaugaacaacuccucugugaucuagga

SEQ ID NO: 221165 - RNA, 64 nt, Homo Sapiens
ucauuuggcaagggaagucuuuuuaacuaguuuaucugaugauuuucuuacaugagcuuuugaa

SEQ ID NO: 221166 - RNA, 64 nt, Homo Sapiens
ugccugcuaguuaugauggacaggauccagaauuucugaugauuuggguucuuuuccauagucc

SEQ ID NO: 221167 - RNA, 64 nt, Homo Sapiens
ggggacagaacaaaaaucaaaacaaagaaccugcucugaugacacuuagaggggagagaugaaa

SEQ ID NO: 221168 - RNA, 64 nt, Homo Sapiens
aauaaaguuuuaaauguaucuaugucucgacuuuucugaugaaguuauaccagaaaaguuaauu

SEQ ID NO: 221169 - RNA, 64 nt, Homo Sapiens
auuuucacauuuucucucugcaaaacuuuaguuuucugaugaucuacacacacacacacacaca

SEQ ID NO: 221170 - RNA, 64 nt, Homo Sapiens
ggccuuggaaaccuguuacuucuagggcuucagaucugaugauaucuuuuucaucacauuacaa

SEQ ID NO: 221171 - RNA, 64 nt, Homo Sapiens
auuuucacauuuucucucugcaaaccuuuaguuuucugaugaucuacacacacacauacacaca

SEQ ID NO: 221172 - RNA, 64 nt, Homo Sapiens
ggccuuggaaaucuguuacuucuacggcuucagaucugaugauaucuuuuucaucacauuacaa

SEQ ID NO: 221173 - RNA, 64 nt, Homo Sapiens; identical to SEQ ID NO: 198753

SEQ ID NO: 221174 - RNA, 64 nt, Homo Sapiens; identical to SEQ ID NO: 198754

SEQ ID NO: 221175 - RNA, 64 nt, Homo Sapiens; identical to SEQ ID NO: 198755

SEQ ID NO: 221176 - RNA, 64 nt, Homo Sapiens; identical to SEQ ID NO: 198756

SEQ ID NO: 221177 - RNA, 64 nt, Homo Sapiens; identical to SEQ ID NO: 198757

SEQ ID NO: 221178 - RNA, 64 nt, Homo Sapiens; identical to SEQ ID NO: 198758

SEQ ID NO: 221179 - RNA, 64 nt, Homo Sapiens; identical to SEQ ID NO: 198759

SEQ ID NO: 221180 - RNA, 64 nt, Homo Sapiens; identical to SEQ ID NO: 198760

SEQ ID NO: 221181 - RNA, 64 nt, Homo Sapiens; identical to SEQ ID NO: 198761

SEQ ID NO: 221182 - RNA, 64 nt, Homo Sapiens; identical to SEQ ID NO: 198762

SEQ ID NO: 221183 - RNA, 64 nt, Homo Sapiens; identical to SEQ ID NO: 198763

SEQ ID NO: 221184 - RNA, 64 nt, Homo Sapiens; identical to SEQ ID NO: 198764

SEQ ID NO: 221185 - RNA, 64 nt, Homo Sapiens; identical to SEQ ID NO: 198765

SEQ ID NO: 221186 - RNA, 64 nt, Homo Sapiens; identical to SEQ ID NO: 198766

SEQ ID NO: 221187 - RNA, 64 nt, Homo Sapiens; identical to SEQ ID NO: 198767

SEQ ID NO: 221188 - RNA, 64 nt, Homo Sapiens; identical to SEQ ID NO: 198768

SEQ ID NO: 221189 - RNA, 64 nt, Homo Sapiens; identical to SEQ ID NO: 198769

SEQ ID NO: 221190 - RNA, 64 nt, Homo Sapiens; identical to SEQ ID NO: 198770

SEQ ID NO: 221191 - RNA, 64 nt, Homo Sapiens; identical to SEQ ID NO: 198771

SEQ ID NO: 221192 - RNA, 64 nt, Homo Sapiens; identical to SEQ ID NO: 198772

SEQ ID NO: 221193 - RNA, 64 nt, Homo Sapiens; identical to SEQ ID NO: 198773

SEQ ID NO: 221194 - RNA, 64 nt, Homo Sapiens; identical to SEQ ID NO: 198774

SEQ ID NO: 221195 - RNA, 64 nt, Homo Sapiens; identical to SEQ ID NO: 198775

SEQ ID NO: 221196 - RNA, 64 nt, Homo Sapiens; identical to SEQ ID NO: 198776

SEQ ID NO: 221197 - RNA, 64 nt, Homo Sapiens; identical to SEQ ID NO: 198777

SEQ ID NO: 221198 - RNA, 64 nt, Homo Sapiens; identical to SEQ ID NO: 198778

SEQ ID NO: 221199 - RNA, 64 nt, Homo Sapiens; identical to SEQ ID NO: 198779

SEQ ID NO: 221200 - RNA, 64 nt, Homo Sapiens; identical to SEQ ID NO: 198780

SEQ ID NO: 221201 - RNA, 64 nt, Homo Sapiens; identical to SEQ ID NO: 198781

SEQ ID NO: 221202 - RNA, 64 nt, Homo Sapiens; identical to SEQ ID NO: 198782

SEQ ID NO: 221203 - RNA, 64 nt, Homo Sapiens; identical to SEQ ID NO: 198783

SEQ ID NO: 221204 - RNA, 64 nt, Homo Sapiens; identical to SEQ ID NO: 198784

SEQ ID NO: 221205 - RNA, 64 nt, Homo Sapiens; identical to SEQ ID NO: 198785

SEQ ID NO: 221206 - RNA, 64 nt, Homo Sapiens; identical to SEQ ID NO: 198786

SEQ ID NO: 221207 - RNA, 64 nt, Homo Sapiens; identical to SEQ ID NO: 198787

SEQ ID NO: 221208 - RNA, 64 nt, Homo Sapiens; identical to SEQ ID NO: 198788

SEQ ID NO: 221209 - RNA, 64 nt, Homo Sapiens; identical to SEQ ID NO: 198789

SEQ ID NO: 221210 - RNA, 64 nt, Homo Sapiens; identical to SEQ ID NO: 198790

SEQ ID NO: 221211 - RNA, 64 nt, Homo Sapiens; identical to SEQ ID NO: 198791

SEQ ID NO: 221212 - RNA, 64 nt, Homo Sapiens; identical to SEQ ID NO: 198792

SEQ ID NO: 221213 - RNA, 64 nt, Homo Sapiens; identical to SEQ ID NO: 198793

SEQ ID NO: 221214 - RNA, 64 nt, Homo Sapiens; identical to SEQ ID NO: 198794

SEQ ID NO: 221215 - RNA, 64 nt, Homo Sapiens; identical to SEQ ID NO: 198795

SEQ ID NO: 221216 - RNA, 64 nt, Homo Sapiens; identical to SEQ ID NO: 198796

SEQ ID NO: 221217 - RNA, 64 nt, Homo Sapiens; identical to SEQ ID NO: 198797

SEQ ID NO: 221218 - RNA, 64 nt, Homo Sapiens; identical to SEQ ID NO: 198798

SEQ ID NO: 221219 - RNA, 64 nt, Homo Sapiens; identical to SEQ ID NO: 198799

SEQ ID NO: 221220 - RNA, 64 nt, Homo Sapiens
ccauucugugggagaguguggaaaggcacucuuuuuucuccauauuaguuaacaagaggugucu

SEQ ID NO: 221221 - RNA, 64 nt, Homo Sapiens
cuggcuaauuucauauuuuuuaguagagacaggauuucuccauguuggucaggcuggucuugaa

SEQ ID NO: 221222 - RNA, 64 nt, Homo Sapiens
uucaaaucaaauauuuacauauugcuuaucacuuuuucuccauuuuaauaauggaaugaacuaa

SEQ ID NO: 221223 - RNA, 64 nt, Homo Sapiens
ugaguuguucacagauauuuuauguuuuuuuaauuuucuccaagaauauuuauagaauuccaaa

SEQ ID NO: 221224 - RNA, 64 nt, Homo Sapiens
gauugucccuguguugucccaucugcccucccuguuucuccacaacagccugggguuguccccg

SEQ ID NO: 221225 - RNA, 64 nt, Homo Sapiens
ccauuuuuguuuauuuuccuuaaauuuuuagccauuucuccaugggccaccgcccagcucaugu

SEQ ID NO: 221226 - RNA, 64 nt, Homo Sapiens
uguaaaacaaguggcugcagucucugggccucuauuucuccauucuuggacaaggcgcuucauc

SEQ ID NO: 221227 - RNA, 64 nt, Homo Sapiens
uugcuaucuacucagccuuaacauuuauucaguauuucuccaaguuacuguuuucaaacugcuc

SEQ ID NO: 221228 - RNA, 64 nt, Homo Sapiens
ccagaggccugggccucugauaacacuuuggcuuuuucuccauucacgcugauuuggcaaaagg

SEQ ID NO: 221229 - RNA, 64 nt, Homo Sapiens
ccaguauguucuucuuuuuuauguaagggacagcuuucuccacagaguccuuucugcuggugag

SEQ ID NO: 221230 - RNA, 64 nt, Homo Sapiens
cuccaugagugcacaaucccugaacucacugucuuuucuccacacuuguccuaagccaagguag

SEQ ID NO: 221231 - RNA, 64 nt, Homo Sapiens
ucccaacuuaggcucuuuauuaauugguuaagguuuucuccaaaaagggcauuucaacaauggg

SEQ ID NO: 221232 - RNA, 64 nt, Homo Sapiens
agguguguugugaaaguuuggaaggucagaccuuuuucuccaagaaggacaagccccuguguaa

SEQ ID NO: 221233 - RNA, 64 nt, Homo Sapiens
uuucuacauauuauucaugaagcauaauguugcauuucuccaaauuuuaugccugaaaggguag

SEQ ID NO: 221234 - RNA, 64 nt, Homo Sapiens
ucaucuuuuaauuccuguuauuaaggaauuauucuuucuccauauuauucuuucuccauaucuu

SEQ ID NO: 221235 - RNA, 64 nt, Homo Sapiens
ucuuuuaaggaauuauucuuuuacggaauuauucuuucuccauagacuuaccuguaaaguuauc

SEQ ID NO: 221236 - RNA, 64 nt, Homo Sapiens
ccccuguaccuuuugaggagccccagcuacccuuuuucuccagcugggcucugcaauuccccuc

SEQ ID NO: 221237 - RNA, 64 nt, Homo Sapiens
uuuucucucggcuccccauguguccugguucccguuucuccaccuagacuguaaaccucucgag

SEQ ID NO: 221238 - RNA, 64 nt, Homo Sapiens
aaacacuuugagauacuuaaauguaguaaaaagauuucuccagaauggaauaucaaguauaaug

SEQ ID NO: 221239 - RNA, 64 nt, Homo Sapiens
agccuucuggcugauuguucguuugugcuuccucuuucuccagagggguaguucuguucugugg

SEQ ID NO: 221240 - RNA, 64 nt, Homo Sapiens
cuuguuuagcaagcauauguuguuccucagcucuuuucuccagcuuuugcaguguccuggcauc

SEQ ID NO: 221241 - RNA, 64 nt, Homo Sapiens
ucaagugauaauuuuguguuuuucucauauaaguuuucuccagagcacccaccuucucuuccuu

SEQ ID NO: 221242 - RNA, 64 nt, Homo Sapiens
ccuccagcuaggaggaaaugcaagagcccuccccuuucuccaucccaugugggaauaggugggc

SEQ ID NO: 221243 - RNA, 64 nt, Homo Sapiens
acagcagacuauuguccgugagucagcacggcccuuucuccagccuugguccacuccagccauc

SEQ ID NO: 221244 - RNA, 64 nt, Homo Sapiens
aaucagcugguggcuagguuucuagcgcauuugauuucuccagguuugcugugucucacagagg

SEQ ID NO: 221245 - RNA, 64 nt, Homo Sapiens
aaauucuagaagcagaagguuguuuuuuuuuuuuuuucuccauucugaaaauagcaggacauuu

SEQ ID NO: 221246 - RNA, 64 nt, Homo Sapiens
uugucaaguuuucuaggguugaauuuuuuucuuuuuucuccaugguguuaaugauauuagagau

SEQ ID NO: 221247 - RNA, 64 nt, Homo Sapiens
auucaguuuuauuuauuuauuuuuaauuuguuuuuuucuccaaguccaccagucucugaaauua

SEQ ID NO: 221248 - RNA, 64 nt, Homo Sapiens
caaauggagaagaaacauccaaaagcacauuucauuucuccaaacuuuguguuuuaaauuauag

SEQ ID NO: 221249 - RNA, 64 nt, Homo Sapiens
auuguaagguaauuuuaaauugucccucguauuauuucuccacgucuguuuuaguuuaaugucu

SEQ ID NO: 221250 - RNA, 64 nt, Homo Sapiens
ugggacucaggauauuaguuauuuaugcaagguauuucuccagugaguaaaaaggugguaugua

SEQ ID NO: 221251 - RNA, 64 nt, Homo Sapiens
ucaaaacgagggcugauggacugaggagaggaguuuucuccauaagaagaaugaaaaugcaguc

SEQ ID NO: 221252 - RNA, 64 nt, Homo Sapiens
ugauuuucaguuuuaaaugugggcaaaaaggcauuuucuccaagauuuuaaaacuaauucuuau

SEQ ID NO: 221253 - RNA, 64 nt, Homo Sapiens
uuuuucaagagcuauuuuguaaacagaugauguauuucuccauugaaaacacaauaaaaaaaaa

SEQ ID NO: 221254 - RNA, 64 nt, Homo Sapiens
cucauguccauuuuggugugaucugcuguauucauuucuccaauuuuuuucuucuaucuguucc

SEQ ID NO: 221255 - RNA, 64 nt, Homo Sapiens
agacaaauggaaaaaaagaguagaaaaaguauuuuuucuccaccaaaaacuacauauuuuauua

SEQ ID NO: 221256 - RNA, 64 nt, Homo Sapiens
auuaccuucccuucccuugaaaguagagaugagguuucuccauguuggucaggcuggucucgaa

SEQ ID NO: 221257 - RNA, 64 nt, Homo Sapiens
uugcaacuggccugagcaacacagggagacucaguuucuccaaaaaaauaaaaaauuagccgau

SEQ ID NO: 221258 - RNA, 64 nt, Homo Sapiens
ugggauguugucucugcccgaaugauagugcaaguuucuccaguuuuaucucggcauccucuug

SEQ ID NO: 221259 - RNA, 64 nt, Homo Sapiens
uuuucucaaagaguuuacaucuccccgguccuuuuuucuccaaccuggaauauuaaaccaaacu

SEQ ID NO: 221260 - RNA, 64 nt, Homo Sapiens
uuggugauggaaaaagcgcuguuuccuugccugcuuucuccaagacagauuuucggaacacauu

SEQ ID NO: 221261 - RNA, 64 nt, Homo Sapiens
guguucugcugagacugagcaccuuacagauauuuuucuccagaagauggugcuggguaauaaa

SEQ ID NO: 221262 - RNA, 64 nt, Homo Sapiens
guguccugacaggucagcccgaaguuucuccagauuucuccaauauccacagcuucucacugcc

SEQ ID NO: 221263 - RNA, 64 nt, Homo Sapiens
uuucuccaauguguccugacucucacugccgaaguuucuccagauccuucccucauccacagcu

SEQ ID NO: 221264 - RNA, 64 nt, Homo Sapiens
uacagugcagagagcugucugaugccaucacucuuuucuccacagggcugcuaugguuugaaug

SEQ ID NO: 221265 - RNA, 64 nt, Homo Sapiens
gugcaccugaggcagaucauuaaaucaugagcguuuucuccacugguauuauaauaccaaauug

SEQ ID NO: 221266 - RNA, 64 nt, Homo Sapiens
aaaugcaugucauguauucuucagauuuaguugauuucuccaccgcuuacugaauggcuucauu

SEQ ID NO: 221267 - RNA, 54 nt, Homo Sapiens
agcguggaggaaagauuaugccauuuucuccagauccagcguugcacgccauaa

SEQ ID NO: 221268 - RNA, 64 nt, Homo Sapiens
aggauuagcuuggaguucucuaggccuaagaggcuuucuccagguugcuuaccugaucucaugu

SEQ ID NO: 221269 - RNA, 64 nt, Homo Sapiens
gccuugugugaacucaccaaaaugccuucuccuauuucuccaaaagagagaaaguaaaggcagu

SEQ ID NO: 221270 - RNA, 64 nt, Homo Sapiens
gcgcucuugcugggagguccacgccgcagguagguuucuccaguagcaggccgacuccacuccc

SEQ ID NO: 221271 - RNA, 64 nt, Homo Sapiens
aagaacucgacuugucugaaggaaggaacuagucuuucuccaaguggccucagcuccucccugg

SEQ ID NO: 221272 - RNA, 64 nt, Homo Sapiens
gcccugccucuacuuuccuucaguuugucuuucuuuucuccauauuuugucaucuuuguaucuc

SEQ ID NO: 221273 - RNA, 64 nt, Homo Sapiens
ugaggucuuggucugaagaaacuuuucaugcuucuuucuccaccaccuggguccuccaucggga

SEQ ID NO: 221274 - RNA, 64 nt, Homo Sapiens; identical to SEQ ID NO: 55178

SEQ ID NO: 221275 - RNA, 64 nt, Homo Sapiens; identical to SEQ ID NO: 55179

SEQ ID NO: 221276 - RNA, 64 nt, Homo Sapiens; identical to SEQ ID NO: 55180

SEQ ID NO: 221277 - RNA, 64 nt, Homo Sapiens; identical to SEQ ID NO: 55181

SEQ ID NO: 221278 - RNA, 64 nt, Homo Sapiens; identical to SEQ ID NO: 55182

SEQ ID NO: 221279 - RNA, 64 nt, Homo Sapiens; identical to SEQ ID NO: 55183

SEQ ID NO: 221280 - RNA, 64 nt, Homo Sapiens; identical to SEQ ID NO: 55184

SEQ ID NO: 221281 - RNA, 64 nt, Homo Sapiens; identical to SEQ ID NO: 55185

SEQ ID NO: 221282 - RNA, 64 nt, Homo Sapiens; identical to SEQ ID NO: 55186

SEQ ID NO: 221283 - RNA, 64 nt, Homo Sapiens; identical to SEQ ID NO: 55187

SEQ ID NO: 221284 - RNA, 64 nt, Homo Sapiens; identical to SEQ ID NO: 55188

SEQ ID NO: 221285 - RNA, 64 nt, Homo Sapiens; identical to SEQ ID NO: 55189

SEQ ID NO: 221286 - RNA, 64 nt, Homo Sapiens; identical to SEQ ID NO: 97683

SEQ ID NO: 221287 - RNA, 64 nt, Homo Sapiens; identical to SEQ ID NO: 97684

SEQ ID NO: 221288 - RNA, 64 nt, Homo Sapiens; identical to SEQ ID NO: 97685

SEQ ID NO: 221289 - RNA, 64 nt, Homo Sapiens; identical to SEQ ID NO: 97686

SEQ ID NO: 221290 - RNA, 64 nt, Homo Sapiens; identical to SEQ ID NO: 97687

SEQ ID NO: 221291 - RNA, 64 nt, Homo Sapiens; identical to SEQ ID NO: 97688

SEQ ID NO: 221292 - RNA, 64 nt, Homo Sapiens; identical to SEQ ID NO: 97689

SEQ ID NO: 221293 - RNA, 64 nt, Homo Sapiens; identical to SEQ ID NO: 97690

SEQ ID NO: 221294 - RNA, 64 nt, Homo Sapiens; identical to SEQ ID NO: 97691

SEQ ID NO: 221295 - RNA, 64 nt, Homo Sapiens; identical to SEQ ID NO: 97692

SEQ ID NO: 221296 - RNA, 56 nt, Homo Sapiens; identical to SEQ ID NO: 97693

SEQ ID NO: 221297 - RNA, 64 nt, Homo Sapiens; identical to SEQ ID NO: 97694

SEQ ID NO: 221298 - RNA, 64 nt, Homo Sapiens; identical to SEQ ID NO: 97695

SEQ ID NO: 221299 - RNA, 64 nt, Homo Sapiens; identical to SEQ ID NO: 97696

SEQ ID NO: 221300 - RNA, 64 nt, Homo Sapiens; identical to SEQ ID NO: 97697

SEQ ID NO: 221301 - RNA, 64 nt, Homo Sapiens; identical to SEQ ID NO: 97698

SEQ ID NO: 221302 - RNA, 64 nt, Homo Sapiens; identical to SEQ ID NO: 97699

SEQ ID NO: 221303 - RNA, 64 nt, Homo Sapiens; identical to SEQ ID NO: 97700

SEQ ID NO: 221304 - RNA, 64 nt, Homo Sapiens; identical to SEQ ID NO: 97701

SEQ ID NO: 221305 - RNA, 64 nt, Homo Sapiens; identical to SEQ ID NO: 97702

SEQ ID NO: 221306 - RNA, 64 nt, Homo Sapiens; identical to SEQ ID NO: 97703

SEQ ID NO: 221307 - RNA, 64 nt, Homo Sapiens; identical to SEQ ID NO: 97704

SEQ ID NO: 221308 - RNA, 64 nt, Homo Sapiens; identical to SEQ ID NO: 97705

SEQ ID NO: 221309 - RNA, 64 nt, Homo Sapiens; identical to SEQ ID NO: 97706

SEQ ID NO: 221310 - RNA, 64 nt, Homo Sapiens; identical to SEQ ID NO: 97707

SEQ ID NO: 221311 - RNA, 64 nt, Homo Sapiens; identical to SEQ ID NO: 97708

SEQ ID NO: 221312 - RNA, 64 nt, Homo Sapiens; identical to SEQ ID NO: 97709

SEQ ID NO: 221313 - RNA, 64 nt, Homo Sapiens; identical to SEQ ID NO: 97710

SEQ ID NO: 221314 - RNA, 64 nt, Homo Sapiens; identical to SEQ ID NO: 97711

SEQ ID NO: 221315 - RNA, 64 nt, Homo Sapiens; identical to SEQ ID NO: 97712

SEQ ID NO: 221316 - RNA, 64 nt, Homo Sapiens; identical to SEQ ID NO: 97713

SEQ ID NO: 221317 - RNA, 64 nt, Homo Sapiens; identical to SEQ ID NO: 97714

SEQ ID NO: 221318 - RNA, 64 nt, Homo Sapiens; identical to SEQ ID NO: 97715

SEQ ID NO: 221319 - RNA, 64 nt, Homo Sapiens; identical to SEQ ID NO: 97716

SEQ ID NO: 221320 - RNA, 64 nt, Homo Sapiens; identical to SEQ ID NO: 97717

SEQ ID NO: 221321 - RNA, 64 nt, Homo Sapiens; identical to SEQ ID NO: 97718

SEQ ID NO: 221322 - RNA, 64 nt, Homo Sapiens; identical to SEQ ID NO: 97719

SEQ ID NO: 221323 - RNA, 64 nt, Homo Sapiens; identical to SEQ ID NO: 97720

SEQ ID NO: 221324 - RNA, 64 nt, Homo Sapiens; identical to SEQ ID NO: 97721

SEQ ID NO: 221325 - RNA, 64 nt, Homo Sapiens; identical to SEQ ID NO: 97722

SEQ ID NO: 221326 - RNA, 64 nt, Homo Sapiens; identical to SEQ ID NO: 97723

SEQ ID NO: 221327 - RNA, 64 nt, Homo Sapiens; identical to SEQ ID NO: 97724

SEQ ID NO: 221328 - RNA, 64 nt, Homo Sapiens; identical to SEQ ID NO: 97725

SEQ ID NO: 221329 - RNA, 64 nt, Homo Sapiens; identical to SEQ ID NO: 97726

SEQ ID NO: 221330 - RNA, 64 nt, Homo Sapiens; identical to SEQ ID NO: 97727

SEQ ID NO: 221331 - RNA, 64 nt, Homo Sapiens; identical to SEQ ID NO: 97728

SEQ ID NO: 221332 - RNA, 64 nt, Homo Sapiens; identical to SEQ ID NO: 97729

SEQ ID NO: 221333 - RNA, 64 nt, Homo Sapiens; identical to SEQ ID NO: 97730

SEQ ID NO: 221334 - RNA, 64 nt, Homo Sapiens; identical to SEQ ID NO: 97731

SEQ ID NO: 221335 - RNA, 64 nt, Homo Sapiens; identical to SEQ ID NO: 97732

SEQ ID NO: 221336 - RNA, 64 nt, Homo Sapiens; identical to SEQ ID NO: 97733

SEQ ID NO: 221337 - RNA, 64 nt, Homo Sapiens; identical to SEQ ID NO: 97734

SEQ ID NO: 221338 - RNA, 64 nt, Homo Sapiens
gcuacagcccucugcauaaaccaaggacuuggcugccucgcaggcagccuccguuccucccgcu

SEQ ID NO: 221339 - RNA, 64 nt, Homo Sapiens
gaugcagagggcacgcccauagucccucugcagagccucgcacuggggccagggcaggcaccag

SEQ ID NO: 221340 - RNA, 64 nt, Homo Sapiens
gacugagaggcuuuucuagcguaugaggggucuacaccugcaaggggugagggccaugcaugca

SEQ ID NO: 221341 - RNA, 64 nt, Homo Sapiens
ggacgaguccccgggccuggugugagaaggucuacaccugcaagagugcaggcauugcacaugg

SEQ ID NO: 221342 - RNA, 64 nt, Homo Sapiens
ggcugaggcccugggcccaggugugaggaguguacaccugcaaguggcacaggcauugcacacg

SEQ ID NO: 221343 - RNA, 64 nt, Homo Sapiens
ggcugagucccugggcucagugugaaugggucuacaccugcauggguacaggcauugcacacag

SEQ ID NO: 221344 - RNA, 64 nt, Homo Sapiens
ggcugaguuccugggcucgagugugaagggucuacaccugcacagggugcaggcauugcacacg

SEQ ID NO: 221345 - RNA, 64 nt, Homo Sapiens
cccaggccucccucccccggagaauggaagccuccaccugcagcgcccccuccugaccccaccu

SEQ ID NO: 221346 - RNA, 64 nt, Homo Sapiens
gagcagcacgccaaccccaguagacucacggcugcaccugcaggggagcugaggggcagggccg

SEQ ID NO: 221347 - RNA, 64 nt, Homo Sapiens
caggugauuaaaaagcuuuauuuuggacucagcccaccugcacccaccacccuuugcugacucu

SEQ ID NO: 221348 - RNA, 64 nt, Homo Sapiens
cccagcaccuuaggaggccggacgugguggcucacaccugcaauaaagugcugcaguauggcca

SEQ ID NO: 221349 - RNA, 64 nt, Homo Sapiens
guuucugguugucacugcacggccacuggguguucaccugcaaacuggggacccugccagggaa

SEQ ID NO: 221350 - RNA, 64 nt, Homo Sapiens
caagguacccgaagaagcagacccugccccaaugcaccugcagggaaccuggcccaacagaaaa

SEQ ID NO: 221351 - RNA, 64 nt, Homo Sapiens
agggcacgccuggcuuuccuuggauacccacugucaccugcacuaugaagugcugcuggcuggg

SEQ ID NO: 221352 - RNA, 64 nt, Homo Sapiens
ugccccccuuuggcuuaauuaagugugcugucugcaccugcaagguauggccacccaaucuucu

SEQ ID NO: 221353 - RNA, 64 nt, Homo Sapiens
ccucagugcccccuuuuggagagaugagcuguaucaccugcagaugugggguaaguggggagca

SEQ ID NO: 221354 - RNA, 64 nt, Homo Sapiens
gcagagcucauuguggaaacagucuuggagaagccaccugcacaacaccugcaaggcugucaac

SEQ ID NO: 221355 - RNA, 64 nt, Homo Sapiens
gcugucaacagucuuggagagacgaugccaaguacaccugcaaguuagugauguuugcggggau

SEQ ID NO: 221356 - RNA, 64 nt, Homo Sapiens
acugccuugccaucgggcccaguucuccgggccccaccugcaccccuuucuucccccugggaua

SEQ ID NO: 221357 - RNA, 64 nt, Homo Sapiens
gccuuugccccagggugggugcaggugcgagugucaccugcagcugccucagucauucagaguu

SEQ ID NO: 221358 - RNA, 64 nt, Homo Sapiens
cccagcuacuugggaggccaagugugguaauguucaccugcaguucucuacuaaaaauuagcca

SEQ ID NO: 221359 - RNA, 64 nt, Homo Sapiens
agaagugcguaccagaaguauggcagugugcugucaccugcaacaaaaaugaugaaguugcaaa

SEQ ID NO: 221360 - RNA, 64 nt, Homo Sapiens
uacccgugcacaggcacacgugcuggucugcacacaccugcacacaccugcacacucgcuaugc

SEQ ID NO: 221361 - RNA, 64 nt, Homo Sapiens
caggcacacgugcuggucugcacacaccugcacacaccugcacacucgcuaugccaggccuccu

SEQ ID NO: 221362 - RNA, 64 nt, Homo Sapiens
agccgcaaucuggcuccuccuggaaaauuucccccaccugcagcgcugggccccaaggcuugcc

SEQ ID NO: 221363 - RNA, 64 nt, Homo Sapiens
gucccauacucccacuuugugccaaaugacuuugcaccugcaaauggugcuucaaugucguuuu

SEQ ID NO: 221364 - RNA, 64 nt, Homo Sapiens
aaaaauacaaaaaucagccagacaugguggcaugcaccugcaaucccagcuacucgggaggcug

SEQ ID NO: 221365 - RNA, 64 nt, Homo Sapiens
auguuaacaugacauuuaccagcaacuugaacuucaccugcaaagcucuguggccacauuuuca

SEQ ID NO: 221366 - RNA, 64 nt, Homo Sapiens
cguaguucccugaaaacccaaagcuguguccuugcaccugcaucgugacugccccaacuccugg

SEQ ID NO: 221367 - RNA, 64 nt, Homo Sapiens
uccccccacugcaggccccgcucagggacagagacaccugcacccaggagaaaugcauccauuc

SEQ ID NO: 221368 - RNA, 64 nt, Homo Sapiens
cccagcuacuugggaggcugggcaugauggcacgcaccugcaguaaaaguacaaaaauuagcug

SEQ ID NO: 221369 - RNA, 64 nt, Homo Sapiens
guccagugaaaugauauauuuugaucauccaaagcaccugcagacuacagccauguccuauucc

SEQ ID NO: 221370 - RNA, 64 nt, Homo Sapiens
cacguguguaugcacuccccuaugcagggcuaugcaccugcaggccacggugccaucucuugug

SEQ ID NO: 221371 - RNA, 64 nt, Homo Sapiens
gucacucuuuugaugcugggaucauuacugccuucaccugcauaacagccacauuuccauuugc

SEQ ID NO: 221372 - RNA, 64 nt, Homo Sapiens
ccaaagggucccaggcugucaggggcguuugcgccaccugcaagggcgugggucagagaguuuu

SEQ ID NO: 221373 - RNA, 64 nt, Homo Sapiens
ccugcugucccggcuccaucuugguucuagccgccaccugcaugaacacaguggcccggcuuaa

SEQ ID NO: 221374 - RNA, 64 nt, Homo Sapiens
aguguucuggucaaaacuaaaggaacucccuccccaccugcaggacuccgaagacagugcgacu

SEQ ID NO: 221375 - RNA, 64 nt, Homo Sapiens
cacugagucagacaagugggagcuguaggaacugcaccugcagccucuucuuacuccccauuga

SEQ ID NO: 221376 - RNA, 64 nt, Homo Sapiens
cuguuguuggugucagggaggcuuacuggagccacaccugcaggcgcuguguucaggcaccacc

SEQ ID NO: 221377 - RNA, 64 nt, Homo Sapiens
gggugucagcccagaugacuccucacccauccaccaccugcagcuugagauguuaacuauuaga

SEQ ID NO: 221378 - RNA, 64 nt, Homo Sapiens
aaagaagacgagagauagugggugugguggcucacaccugcaaucccagcacuuuggaaggccg

SEQ ID NO: 221379 - RNA, 64 nt, Homo Sapiens
ccugacugcuggggacccucgccuucccuccucucaccugcaggcugauccuucuuuucacuuu

SEQ ID NO: 221380 - RNA, 64 nt, Homo Sapiens
uauuacaccccgacccuccuccugucagcccccucaccugcagccuguugcccaauaaauuuaa

SEQ ID NO: 221381 - RNA, 64 nt, Homo Sapiens
caaugcugacccuaggauuuuccuucccugcccucaccugcaaaugaguuaaagaagaggcgug

SEQ ID NO: 221382 - RNA, 64 nt, Homo Sapiens
ccgucccucuccccggacaacacaccccugcacacaccugcacaucugcacgugcacacaccug

SEQ ID NO: 221383 - RNA, 64 nt, Homo Sapiens
ccccugcacacaccugcacaucugcacgugcacacaccugcacauccugcccuagcaguuugcc

SEQ ID NO: 221384 - RNA, 64 nt, Homo Sapiens
uagaacgcucaacuugguugcgguaccaucagcccaccugcauuuggcuuucgacuugcuuguu

SEQ ID NO: 221385 - RNA, 64 nt, Homo Sapiens
guguuuagauccaugccauucacugacucacuaacaccugcaaaaucuuuaaggaaaaaagcug

SEQ ID NO: 221386 - RNA, 64 nt, Homo Sapiens
uuggguggggcuccugggagcuggugcaggucuccaccugcacaggaacuugcccugagcacuc

SEQ ID NO: 221387 - RNA, 64 nt, Homo Sapiens
ggcugcccucuggggccacuagacagccagguggcaccugcagcaaggagagacauggaaaggg

SEQ ID NO: 221388 - RNA, 64 nt, Homo Sapiens
ucuggcagccaauaaaaucaucauaagcccuuuguaauaaaaagcuaguuuccugagugaacaa

SEQ ID NO: 221389 - RNA, 64 nt, Homo Sapiens
aacacaauuucuaacugccuguuuuuguauaauuuaauaaaaaccuuuuaaacauuacugcuuu

SEQ ID NO: 221390 - RNA, 64 nt, Homo Sapiens
guuaggaaggucaaaaaaaaggaaaaaagaaaaauaauaaaaaauaauaaaaauccuuaggaua

SEQ ID NO: 221391 - RNA, 64 nt, Homo Sapiens
ucaaaaaaaaggaaaaaagaaaaauaauaaaaaauaauaaaaauccuuaggauaacuugaggcc

SEQ ID NO: 221392 - RNA, 64 nt, Homo Sapiens
auagaaaguauauagcaaaguaauuuuacucugauaauaaaaauuguuugacauguauuuuguu

SEQ ID NO: 221393 - RNA, 64 nt, Homo Sapiens
auuuuaaaguguagaagaauacacugcuaauaaauaauaaaaguuuuauucaauuuacuuauuu

SEQ ID NO: 221394 - RNA, 64 nt, Homo Sapiens
aaagauuauuuguaagucauuguauuaauaauacuaauaaaauuuaucaagccuuuauagcaag

SEQ ID NO: 221395 - RNA, 64 nt, Homo Sapiens
gauauuuuaaacaaaauacuagggccaugguauguaauaaaauuugaaacaauaauuucaaaua

SEQ ID NO: 221396 - RNA, 64 nt, Homo Sapiens
ccuuaaucucuacagccuugcucuccggggugguuaauaaaaugcaacacuuggcauuuuuaug

SEQ ID NO: 221397 - RNA, 64 nt, Homo Sapiens
uuuuuauguuuuaagaaaaacaguauuuuauuuauaauaaaaucugaauauuuguaacccuuua

SEQ ID NO: 221398 - RNA, 64 nt, Homo Sapiens
cuucaccugggaaacugaucacuucacaugccauuaauaaaacccaagaucuuuuaaaucaaaa

SEQ ID NO: 221399 - RNA, 64 nt, Homo Sapiens
guauuuugaacuuuaagccaaguuuaaaacauuauaauaaaaggaauaccauuugugcauuuua

SEQ ID NO: 221400 - RNA, 64 nt, Homo Sapiens
uuauguacugcuguagcaacgagaaucagaauauuaauaaaacuugccauaaaagcuaugacac

SEQ ID NO: 221401 - RNA, 64 nt, Homo Sapiens
gcacagugcuguugguggcauggacuugaaugguuaauaaaacuccaaucuuaccagaugcuac

SEQ ID NO: 221402 - RNA, 64 nt, Homo Sapiens
uuuuuauaccugugucagaccuguacaaugcugauaauaaaaaccuucauaaaaucuaugaaua

SEQ ID NO: 221403 - RNA, 64 nt, Homo Sapiens
agccaucuggaggaaauaaauauuguaagucaauuaauaaaaagccagcaaacugaccugcccc

SEQ ID NO: 221404 - RNA, 64 nt, Homo Sapiens
cugaaauguuaaguagaagagauuuuuaaaggauuaauaaaauuuaacucaaaagaaauagggu

SEQ ID NO: 221405 - RNA, 64 nt, Homo Sapiens
uuauaagauuuuuaugaagcuuucugaacuugguuaauaaaaguggagaucaccccucuaauua

SEQ ID NO: 221406 - RNA, 64 nt, Homo Sapiens
aagaaaagauaagugcuuguuguguugggcuuaguaauaaaaaaaguuacugcaugccacgcac

SEQ ID NO: 221407 - RNA, 64 nt, Homo Sapiens
agaggaaaugcauacagggcuuucuuaauuugaauaauaaaaccaccaaaaaauuuuuaaguau

SEQ ID NO: 221408 - RNA, 64 nt, Homo Sapiens
auuucuaaugaugaaaacucugcuuuaaaauaaauaauaaaauuugcuaccaguuacauugaac

SEQ ID NO: 221409 - RNA, 64 nt, Homo Sapiens
uuuaaagaaaagauauucuaaucaacuuaaaggauaauaaaauuuucuuuucauaaugaagcag

SEQ ID NO: 221410 - RNA, 64 nt, Homo Sapiens
ggcggggauacugauucagaaauccuguagcguguaauaaaagaagaggaaauggcauggaauc

SEQ ID NO: 221411 - RNA, 64 nt, Homo Sapiens
auuuauuuaucuuucuggguauuuuuauagcccuuaauaaaaaauauuaaaauagccugugcua

SEQ ID NO: 221412 - RNA, 64 nt, Homo Sapiens
uauguguauaucauggaaaaagacaaggauauuuuaauaaaacauuacuuauuucauuucacuu

SEQ ID NO: 221413 - RNA, 64 nt, Homo Sapiens
uuguauaacugauuaauuuucugauauggcuuccuaauaaaauaugaauaaggaaggauauguu

SEQ ID NO: 221414 - RNA, 64 nt, Homo Sapiens
aaaauuagaugacugaauuucuauggcauauugauaauaaaauucauuccauuugcugauuguc

SEQ ID NO: 221415 - RNA, 64 nt, Homo Sapiens
ccauuugcugauugucugaaauuuucuagaauacuaauaaaauacauacuauagauucuuuauu

SEQ ID NO: 221416 - RNA, 64 nt, Homo Sapiens
cauggauaauagugaaugaaagcagaaagcaaaguaauaaaaucacaaauguuuggaaaacaca

SEQ ID NO: 221417 - RNA, 64 nt, Homo Sapiens
aauccauaugauuauacauaaaguucugaugcauuaauaaaagcagccaaauagggccaaagag

SEQ ID NO: 221418 - RNA, 64 nt, Homo Sapiens
aacauagggugacuuguguuuuuagguauuuaaauaauaaaauuucaagggauaguuuuuauuc

SEQ ID NO: 221419 - RNA, 64 nt, Homo Sapiens
aguucguuaguauaaauuacuuuucuaggauuauuaauaaaagccacauagguggcaaguugua

SEQ ID NO: 221420 - RNA, 64 nt, Homo Sapiens
aacacuuacauuuccauaaagaaaacucaaguauuaauaaaagagacuuuacuggcuuaagagg

SEQ ID NO: 221421 - RNA, 64 nt, Homo Sapiens
uuauuauuccaaaugauaaaauuuaagauuuuucuaauaaaagaguacagauaaugggacaguu

SEQ ID NO: 221422 - RNA, 64 nt, Homo Sapiens
cuaaugagaaguuacugaaaucuauuacuguccuuaauaaaaauugaguagaaaaaaguggaac

SEQ ID NO: 221423 - RNA, 64 nt, Homo Sapiens
cccagggccucugcucuccugggagacaaagcaauaauaaaaggaaguguuuguaaucccagca

SEQ ID NO: 221424 - RNA, 64 nt, Homo Sapiens
aaaaauaaacaaauaaauuuuaaaaauaaauaaauaauaaaaggaaguguuagacaauguaaug

SEQ ID NO: 221425 - RNA, 64 nt, Homo Sapiens
cugauuccaacaggacugagauaacaacuucauauaauaaaaugcaagaucguauacccauaau

SEQ ID NO: 221426 - RNA, 64 nt, Homo Sapiens
auagaacuaugaaaauaucaauugguaauugauguaauaaaaccauuugucuagcuuaauaaau

SEQ ID NO: 221427 - RNA, 64 nt, Homo Sapiens
agcguaaaaagugaguuuacaaacuaauaaaaacuaauaaaagauuauuucugauacuuuugaa

SEQ ID NO: 221428 - RNA, 64 nt, Homo Sapiens
uaauaaaagaagcguaaaaauacuuuugaaaaacuaauaaaaaccaacauucuguuauuucuga

SEQ ID NO: 221429 - RNA, 64 nt, Homo Sapiens
acaaaaauuagccgggcaugugaaaccccgucucuaauaaaaaugaccauccuggccaacaugg

SEQ ID NO: 221430 - RNA, 64 nt, Homo Sapiens
uccucagcuacagucuuucccauccauuuuuuuuuaauaaaagacucucucaucaccaaagucc

SEQ ID NO: 221431 - RNA, 64 nt, Homo Sapiens
caucuauacaaaagaaguccuauuuuauuguuuauaauaaaaauuguaguugagacauuacaua

SEQ ID NO: 221432 - RNA, 64 nt, Homo Sapiens
acucauguuagagacccuuuuuuuugcuucauaauaauaaaacaacugugagauucuuaaaacu

SEQ ID NO: 221433 - RNA, 64 nt, Homo Sapiens
cagaccaacuuuuaguuagccaagcagauggugauaauaaaaagaccaacauuguuuagaauuu

SEQ ID NO: 221434 - RNA, 64 nt, Homo Sapiens
gaagcaugguauucuuuucuaaaaccagaguuuguaauaaaaugauucuuauuugcuacucaua

SEQ ID NO: 221435 - RNA, 64 nt, Homo Sapiens
uaguuucucauuauagucuaaaaauagcaauuguuaauaaaauuagaguaaucuuucaggaacu

SEQ ID NO: 221436 - RNA, 64 nt, Homo Sapiens
cuucuuuaaacaucuuauuuaaguuguuugugcuuaauaaaagauuguauugauaauguauuaa

SEQ ID NO: 221437 - RNA, 64 nt, Homo Sapiens
gagacccgucuuuaguaaauaaaaauaaauuuauuaauaaaacuaaaaauuuaauaauaaaaag

SEQ ID NO: 221438 - RNA, 64 nt, Homo Sapiens
aaaaauaaauuuauuaauaaaacuaaaaauuuaauaauaaaaaguggacauuguuuuuuaaaau

SEQ ID NO: 221439 - RNA, 64 nt, Homo Sapiens
aaugguaaugaaaauggaaugcagcuacugcagcuaauaaaaaauuuuagauagcaauuguuac

SEQ ID NO: 221440 - RNA, 64 nt, Homo Sapiens
uuuuuccucccuuucucauguuuuuauaaauagguaauaaaaaauguuuugccugccaauugaa

SEQ ID NO: 221441 - RNA, 64 nt, Homo Sapiens
ucuccccacuucuguauuuguuugcaauuuuucauaauaaaaaaguuuuaaaaguccuccaguu

SEQ ID NO: 221442 - RNA, 64 nt, Homo Sapiens
cuuuuuuccguaugucacuuucuugaauguguucuaauaaaaugauucuaaagcaggcuguuga

SEQ ID NO: 221443 - RNA, 64 nt, Homo Sapiens
guaguaagggccuccagaauugacuuagcccuaguaauaaaagcacugccaaaacaucucagag

SEQ ID NO: 221444 - RNA, 64 nt, Homo Sapiens
guuuaauagcauaacauuaccaagguaaucaaacuaauaaaauuccauauaucuucccugcauc

SEQ ID NO: 221445 - RNA, 64 nt, Homo Sapiens
auuuuuuacuugugccacuuaauaucaggcauuuuaauaaaauauuguuacaaaaaauguacag

SEQ ID NO: 221446 - RNA, 64 nt, Homo Sapiens
aauguacaguacugacaccaccacaaaucaugguuaauaaaagagaguaguuuuaacuuuauuu

SEQ ID NO: 221447 - RNA, 64 nt, Homo Sapiens
uuuauauauaggcagcagcacaauacaagaaaauuaauaaaaaagagcguauucaagaucuucc

SEQ ID NO: 221448 - RNA, 64 nt, Homo Sapiens
guggugaauuuuaccaaaacacuacaugucaaaguaauaaaagaaugacggauaguuuaggaug

SEQ ID NO: 221449 - RNA, 64 nt, Homo Sapiens
uuuuaagcuauuuuguugggauauuauauauacuuaauaaaacauuuguaaauauuacccugua

SEQ ID NO: 221450 - RNA, 64 nt, Homo Sapiens
uaagcuguaaucaaccuucucuccuccaucucaguaauaaaaaucucaaaacacgauaaguuua

SEQ ID NO: 221451 - RNA, 64 nt, Homo Sapiens
auuaugaucuauguuguuugagcuguaauuuaguuaauaaaauaguuaaguuuuuauucaaagc

SEQ ID NO: 221452 - RNA, 64 nt, Homo Sapiens
aacuaaggacgaaaaaaccccauauccuguaauuuaauaaaaaaaauacuuaguaaucgaaaac

SEQ ID NO: 221453 - RNA, 64 nt, Homo Sapiens
guaaccagaacggcccacucguggaauacccuucuaauaaaaggaaaaccuccggcucucugug

SEQ ID NO: 221454 - RNA, 64 nt, Homo Sapiens
uuacuuuggagauuugugcaaguaaagguuuuuguaauaaaaacuuaauaaaacauugaauugu

SEQ ID NO: 221455 - RNA, 64 nt, Homo Sapiens
uugaauuguaguaaagguuuccugacuuuagucuuaauaaaacaacucaguaaguuggcaaggu

SEQ ID NO: 221456 - RNA, 64 nt, Homo Sapiens
ggaugccuacgucugaaauugcucuuacgaacuuuaauaaaauaguuagcuaauagaaaaacag

SEQ ID NO: 221457 - RNA, 64 nt, Homo Sapiens
uauauuuauagugacaaaugugguagacuaaagguaauaaaaaucauugucuuaagauuauguu

SEQ ID NO: 221458 - RNA, 64 nt, Homo Sapiens
aaacuagaauuuguaaugcaaauggagcucagucuaauaaaaaagagguuuugguauuaaaagu

SEQ ID NO: 221459 - RNA, 64 nt, Homo Sapiens
guuauuaauguguaauacugagcacuuuacuucuuaauaaaaacuugauauaguagcagaugug

SEQ ID NO: 221460 - RNA, 64 nt, Homo Sapiens
aacguguuucugaaaaacagauuuucauaaguaauaauaaaaauaauaauaaaaaaguuuuggu

SEQ ID NO: 221461 - RNA, 64 nt, Homo Sapiens
aaaaacagauuuucauaaguaauaauaaaaauaauaauaaaaaaguuuugguaugguaagccuu
